United States Patent 12,102,091 (CONTROL OF PLANT PESTS USING RNA MOLECULES) - sequence listing, part 3

SEQ ID NO: 5570 - RNA, 885 nt, Diabrotica virgifera
augccagcagcuacucuagguagcauaccacauccuaauaaugaagacuguggcauuagggauguuugggcccauaaccuggaggaugaauucagaaccaucagacaaauaguacaaaaauaucaguauguugcuauggacacagaauuuccugguguaguugcgaggccuauuggagaauuuagaaguucugcagauuaccaauaccaaaugcugaggugcaaugucgauuuauugaggauaauacagcuugggcucacauuucuugaugauaacggaaaaacuccagggggugccuauacuacauggcaauucaacuucaaauucaaccuucaggaagacauguaugcacaggauaguauagaccuccugcaaaauucuggcauucaguuuaagaaacaugaggaugaagguauugaaccucuugaauuugcggaauugcugaugucaucugguauuguccugguggaaaauauaaaauggcuguccuuccauucugguuaugauuuuggcuaccugauaaaacuguuaacggacaacaacuuaccucaagacgaaacagaauucuucgauuuguuaaaauuauauuuuccuaccauauaugauguaaaguaccuuaugaaaucaugcaaaaaucuuaaagggggauuacaagaaguggcagaacagcuagaacuugaaaggauuggaccacaacaucaagcagguucugauucucuucugacaggaauggcauuuuucaagaugaaagagauguucuucgaagacaccauagacgacuccaaauucucgggccaucucuacggucucggcaccucuuucgcagugaacggaacugccaacaacuacucgaacgacaacggagauaccacaaacucuucauga

SEQ ID NO: 5571 - RNA, 1209 nt, Diabrotica virgifera
auggcaguuccaaaaagaggugccucaguuuuugaggacuuaucaaauguagaguuugaaacuagugaagaugucgaaguuaucgagaaguuuaaaaacaugaaccuuaaagaagaacuucuucgugguaucuucgcauauggcuucgaaaaacccucagccauucaacagagagcaauaaagccuauuaugaaaggaagagauguaauagcucaggcacaaucugguacugguaaaacagcuaccuuuuccauuucgauuuuacaagcuuuagauuugacaaugcgagaaacgcaaguuuuaugcuugucuccuacuagagaauuggcuguacagauucaaaaaguuauucuagcuuuaggugacuucaugaauguucaaugucaugcuuguauuggaggcacaaaucuuggggaagauauuagaaaacuugauuauggacagcaugucguuaguggaacaccuggaagaguuuaugauaugaucagaagaagagcucuaagaacaagaucuguaaaaauguugguuuuagaugaggcugaugaaauguuaaauaaaggauucaaagaacaaauuuaugaugucuacagauuccuucccccaucaacacaaguuguacucauuucagcuacacugccucacgaaauuuuggaaauuacuuccaaauuuaugacagauccuauuaggauuuugguaaaacgugaugaauugacauuggaggguauaaaacaguucuuuguggcuguggaaagggaagaauggaaauuugacacccucugugaccucuacgauacauuaaccauuacacaggcuguuauuuucugcaacacaaagaggaagguagacuggcugacggagaaaaugagggaaaacaauuuuacaguuaguucaaugcacggagauaugccacaaaaggaacgugacaauauuaugaaagaguuuaggucaggacagaguaggguccuaaucacaacugauguuugggcuagagguaucgacguacaacaagucaguuugguuaucaauuaugacuugccgaacaaucgugaauuguacauccaucguaucgguagaucugguagguucggccgaaaggguguagccaucaauuucguaaaaucagacgauaucagaauucuaagagauaucgaacaauauuacucgacccaaauugacgaaaugccaaugaacguugcggacuuaauuuaa

SEQ ID NO: 5572 - RNA, 1605 nt, Diabrotica virgifera
augacugccccuacagccgguggugauacaaauagaggaagaaccguugcauauaaggacaaaaguaaacccgcugaugucaggaccaguaauauuaacgccgcaaaagcuguuugcgaugcuauccguacaagucuuggcccuagaggaauggauaaaaugauccaggcuggaaauggugaagugacaauuaccaaugauggagcuacaaucuugaaacaaauaaaccucauucacccugcugcuaaaauguugguagaauuaucaagggcccaagacauugaagcaggagacgguaccacaucuguuguuguaauugcaggagcuuuguuggaugcugcagaaaaguuauuacaaaggggaauucacccuacagcaauaucugaaucuuuccaaagagcagcccaguuggcaguugauauuuugucagacauuucuacuccaauugaaauuacuaauagagaauuguuaauuaaaagugcauccacuucccuaaacucaaaaguuguuucccaacacucaagcuuuuuggguccacuugcugucgaugcaguucuuaaaauuguugaaccugguagagaacaagcuuguaauuuaucugauaucaaaguuauuaagcaacuuggagguacaguagaagauaccgaauuaguagaaggaauuuguuucccucaaagaucugcaaaugucucuggaccaaaaaggauugagaaagcuaaaauugguuucauccaguucuguauuucaccuccaaaaacagauauggaccacaaugucauuguuucugauuacgcugcuauggauagaguauuaaaagaagagagagcauauauuuugaauauugucaagcagauaaagaaagcuggauguaauguacuuuugguucaaaaaucaauuuugagggaugcaguuucagaucuugccuuacacuuuuuggauaaaaucaaguguaugguuauuaaggauauugaaagagaagaugucgaauuuguauguaaaucuuuaggaugccgcccuauugcaucuuuggaucauuuuguugcugaaaacuugguuacugcugauuuaguugaagagguuggauuggcaggaaauagaauggucaaaauuacaggugcacaaaaugcaggcaggacaguaacucugcugguuagaggauccaacaaauuaguucuugaagaggcugauagaucucuucaugaugcucucuguguaauucguugucuuguucgcaagaaggcacuuauugccggaggaggagcgcccgagguugagguggcucuuaaacuagcggcuauggccaacaaacuggaaggcauugaugccauuugcacacgcgcauaugcgaaugccuuagagauuauaccauuuaccuugucugagaaugcaggauuaaaucccauacagaccguuacugaacuaagaaacagacacgccaaaggagagacaucugcuggaauaaacguucguaaaggagcuauuacagauauucucgaagaaaauguuguucaaccacuuuuaguuagcacuucagcauugaguuuagcuacagaaacugugagauccaucuugaaaaucgaugauauuguuaacacauucacauaa

SEQ ID NO: 5573 - RNA, 1230 nt, Diabrotica virgifera
auggaggcuauggauauuguuauaccagaaaaagaagaagguaguccuucggaaguaaaacaagugcugcaggauguggauacugaagauuuguacacuaaauauaaaaaacuucaacaacaguuggaguucuuggagguucaagaagaguacauuaaagaugagcaaaggaaucucaaaaaggaguauuuacaugcucaggaagaagugaagcguauccagucugucccgcuuguuauuggacaguuuuuagaagcuguagaucaaaacacuggcauuguuggcucaacuacagguucaaauuauuauguuagaaucuuaucaacaauugauagagaacucuuaaaaccuucugcuaguguugcucuucauaaacacagcaaugccuuaguagauguccuaccaccagaggcagauucuucaauaagcaugcuccaggcugaugaaaaaccagauguucaauacagugacauuggagguauggauaugcagaaacaagaaauuagggaagcuguagaguuaccuuugacucacuucgaauuguauaaacagauugguauugauccccccagagguguguugauguauggaccuccuggaugcgggaagacuauguuggccaaagcuguugcucaucauacuacagcugccuuuauucguguagucggaucagaauucguacagaaauaucuuggugaagguccucgaaugguuagagacguguuccgucuagcaaaagaaaauucuccagcaaucaucuuuauugaugaaauugaugcaaucgcuaccaaacguuuugaugcccagacaggugcugaucgugaaguccagagaauuuuauuggaacugcuuaaccagauggaugguuuugaucagacaacaaauguuaagguuaucauggcaacuaacagagcugauacauuagauccugcacuucugagaccuggucgucuggacagaaaaaucgaauuuccuuuaccagauagaagacaaaagcguuugauuuucagcacuaucacaucuaaaaugaauuugucagaggaggucgacuuggaggacuauguagcuagaccagacagaauaucaggagcagacauaaacgccaucugccaggaagccgguaugcaugccguccgagaaaaccguuacaucguuuuaccuaaagauuucgagaaggguuauaagaauaacauuaagaaggaugagagcgagcacgaguuuuacaaauag

SEQ ID NO: 5574 - RNA, 489 nt, Diabrotica virgifera
augccaaauauaaaauugcagucgucugauggcgagaccuucgaaauugauguugaaauugcuaaaugcuccgucacuaucaaaacuauguuagaagacuugggaauggacgaagaagaagaagaagugguuccuuuaccaaacguaaauuccgccauacucaggaaagucauccaaugggcgacuuaccacaaagaugauccaccaccaccagaagaugacgauaacaaagaaaaaagaacagaugauauuuccucaugggacgcagacuuccuuaaagucgaccaaggaacccucuucgaguugauuuuggcugcuaacuaucuggauaucaaggggcucuuagaugucacauguaagacuguugcuaauaugaucaaagguaaagcuccugaagaaaucagaaagacuuucaacaucaagaaugacuucacggcaucugaagaagaacaagugagaaaagagaaugaguggugcgaggaaaaguaa

SEQ ID NO: 5575 - RNA, 930 nt, Diabrotica virgifera
auggacgauaaggcgucguguaaggagcuggauggauggauagaacaguuaaaugaaugcaagcaauuaacggaaaaucaaguuaaaacacuaugugauaaggcuaaagaaauauugucaaaagaaucaaauguacaagaagugaaaugcccaguaacaguauguggagauguccauggacaguuccacgaucugauggaacuguuuaggauaggagguaggagcccagacacuaauuaccuguucaugggagauuauguagaucguggauacuauucuguugagacugucaccuuauugguagcacugaaagucagguacaaagagagaauuacaauuuugagaggcaaccacgaaucaagacaaaucacacaaguuuacggauuuuacgaugaaugucuaaggaaauacggaaacgcgaauguauggaaauucuucaccgaucuguucgauuauuugccccuaacagcgcucgucgauagucaaauuuucugucugcacggcggauugaguccuagcaucgacaccuuggaucacauuagggcgcuugaucguuuacaagagguaccucaugaaggccccaugugcgaccuucucuggucagacccugacgaccgcgggggcuggggcaucuccccccguggagccggcuacaccuucggacaggacauuucagaaacguucaaccauaccaacggucugucuuuaguaucuagggcgcaucaacucgucauggaggguuacaauuggugucacgaaagaaacguagugaccauuuucagcgcccccaauuauugcuaccgaugcgguaaccaggcggccauuauggaauuagaugaugcccugaaauauucauucuuacaguuugauccagcaccaagacguggcgaaccucauguuacgcguagaacuccagacuauuuccuuuaa

SEQ ID NO: 5576 - RNA, 2433 nt, Diabrotica virgifera
augcagaucuuugugaaaaccuugacugguaaaaccaucaccuuggaaguagagccuuccgacaccauugaaaaugugaaagccaagauccaagacaaggaagguaucccaccagaucaacagagauugaucuucgcugguaaacaacuugaagaugguagaacucuaucugacuacaacauccagaaggaaucuacccuucauuugguccuuagauugagaggaggcaugcagaucuuugucaaaaccuugacuggcaagaccaucaccuuggaaguagaaccuucugacaccauugaaaaugugaaagccaagauccaagacaaggaagguaucccaccagaucaacagagauugaucuucgcugguaaacaacuugaagaugguagaacucuaucugacuacaacauccagaaggaaucuacccuucauuugguccuuagauugagaggaggcaugcagaucuuugucaaaaccuugacaggcaagaccaucacccuggaaguugagccauccgauacuauugaaaaugguagaacucuaucugacuacaacauccagaaggaaucuacccuucauuugguccuuagauugagaggaggcaugcagaucuuugucaaaaccuugacaggcaagaccaucacccuggaaguugagccauccgauacuauugaaaauguuaaagcuaagauccaggauaaggaggguaucccaccagaucagcaaagauugaucuuugccgguaaacaauuggaagauggaagaacuuugucugauuauaacauccagaaagagucuacucuucauuugguacuuagauugagaggagguaugcagaucuucgucaagacacuaacuggaaagaccaucacuuuggaaguugaaccaucugauaccauugaaaacgugaaagcuaaaauccaagauaaagaagguaucccaccagaucagcaaagauugauuuuugcaggaaaacagcuagaagaugguagaaccuugucugacuauaacauccagaaagaguccacucuucacuugguacugagauugagaggagguaugcagaucuucgucaagacacuaacuggaaagaccaucacuuuggaaguagaaccaucugauaccauugagaaugugaaagccaagauccaagauaaggaagguaucccaccagaucagcaaagauugaucuuugcagguaaacagcuagaagaugguagaacuuugucugauuauaacauccagaaagaguccacucuucacuugguacuuagauugagaggagguaugcagauuuuugucaagacauugacugguaaaacuaucacauuagaaguugaaccaucugauacuauugagaaugugaaagcuaagauccaagauaaggaagguaucccaccagaccagcaaagauugaucuuugcaggaaaacagcuagaagaugguagaaccuugucugacuauaacauccagaaagaguccacucuucacuugguacugagauugagaggagguaugcagaucuucgucaagacacuaacuggaaagaccaucacuuuggaaguugaaccaucugauaccauugagaaugucaaagcuaaaauccaagauaaagaagguaucccaccagaccagcaaagauugaucuuugcaggaaaacagcuagaagaugguagaaccuugucugacuauaacauucagaaagaguccacucuucacuugguacugagguugagaggagguaugcagaucuucgucaagacacuaacuggaaagacaaucacuuuggaaguagaaccaucugauaccauugagaaugucaaagcuaaaauccaagauaaagaagguaucccaccagaccagcaaagauugauauuugcaggaaaacagcuugaagaugguagaaccuugucugacuauaacauccagaaagaguccacucuucacuugguacugagauugagaggagguaugcagaucuucgucaagacacuaacuggaaagaccaucacuuuggaaguagaaccaucugauaccauugagaaugugaaagcuaagauccaagauaaggaagguaucccaccagaccagcaaagauugaucuuugcaggaaaacagcuagaagaugguagaaccuugucugacuauaacauccagaaagaguccacucuucacuugguacuuagauugagaggagguaugcagauuuucgucaagacauugacugguaaaaccaucacauuagaaguugaaccaucugacacuauugagaauguaaaagcaaagauccaagacaaagaagguauccccccagaucaacaacguuuaauauuugcugguaaacaauuagaagauggaagaaccuugucagauuauaacauccaaaaggaaucuacucuccacuugguacuaagguugagaggaggcaauuaa

SEQ ID NO: 5577 - RNA, 1623 nt, Diabrotica virgifera
augaugcaaccacagauauuacucuuaaaagagggaacugacucaucccaaggaaaaccucaauuaaucucaaacauaaaugccugccagaaugugacggaugcuguaagaacaacauuggggcccagggguauggacaagcucauaguacagaggcaaggacaugcuacuauaucaaacgacggggcaacuauuuugaaauuauuggauaucguucacccugcugcgaaaacuuugguagauauugcuaagucacaagaugcagaggucggggacgguacgacaaguguaguauuacuagcaggagaguuuuuaaaacaaauaaagccuuacguugaugaggguguucacccgagaauaauaaucaaagcagucagaagaucguuccaaauuugccuugagaaaauaagugaaauagcuguuaaaaucaauaaaucaaaugcugacgaauucagaucucuauuggaaaagugugcugccacagcgaugagcucgaaauuaauuaaucaacaaagaucuuucuuuucuaaaaugguuguagaugcuguucuguuacuagacgauuuacuaccucucaauaugaucgguaucaaaaagguacaagguggagcccuagaagagucacuuuugguagccggaguagcauuuaagaaaacuuuuucuuaugccggauuugaaaugcaacccaagguauacaaagauuguaaaauagcucugcuaaacauugaauuggaacuuaaagcugagagggauaacgcagaaguaagaguagauaauguaaaagaauaucagaaaauuguugaugcagaauggacuaucuuguacaauaaacuucaaaaaauuuaugagucuggagcuaauguuguuuugucaaaauuacccauuggagauguugcuacccaauacuuugcugauagggauauguucugugcuggucguguucaagaagaugauaugaaacguacccugaaagcauguggaggugcuguaaugaccacuguuaaugacaucagcgauucuguacucgguaaaugugagcuguuugaagaaaaacaaauaggaggagaaagauuuaauuucuuuaaaggcugcccaaaugcaaaaacguguacuuuaauuuuacguggaggagcagaacaauuuuuagaagaaacugaaagaucacuucaugaugccaucaugauuguuagaaggacuauuaaaaaugacgcaguuguagcuggggguggugcuauagagauggaauuaucaaaaauuuuacgggaucauucucgcacaauugccggcaaagaacagcuucugauuggugcaauagcuaaggcauuagagaucauccccagacaauuaugcgauaacgcaggauuugacgccaccaacauccucaacaaacuucgacagaaacacgcgcagggucacugcugguacgguguggacauaaacaaagaagacaucagugauaacuucgaagccugcguaugggaaccggccaucgucaaaaucaacgcccugacugcagccacagaagcaacauguuugauucugucuguugaugaaacgauaaaaaaucaaaaaucugaggcgccaccucaaauggggggccgugguaugggaaggccuauguaa

SEQ ID NO: 5578 - RNA, 13950 nt, Diabrotica virgifera
augggggacucuuuagaauccacggaagccagccacgaaacgcaaaauguggcucuaguugauuuuacagcauuuucgaauuuuauuuuaaaagcgaccacuguucuuuugccggaggaugacggccaagccgaaccggcaaacuuaguggcagcuauagaugauaaagcaaaucaggaauguauaaggaaauucauaagugauccgcaaauugcaacuuuguacauacagaggaacucuuccaaagaugaugacagcguucaaccgccagagggcgaggaagaaaaagagccaguuacauauuaugucagcaaugaaguccauuauaccaacucaaaaaugucaaguuuaguaugcauuaagagaggcccagugaucgaagccgauaaaaguauuagagcccaaguccggcugaugaauuucagcgauggcucaccauaugaaauauuacacgauuaugucaguagaacaguugcaccguuuuuuaaauccuaugucaaagaaucuggcagagcugaucgugauggugacaaaauggcuccggcagucgaaaaaaccaucgcugaacuugaaaugggucuuuugcaucugcagcaaaauauugauauucccgaaauaacccuacaaguacacccguacguggcaagccuaaucaaacaaugugcagaugaaggcagaaaaccaaaaguagcugauuuuagugacaaaguagaugauuccaacuuuuugaaccaguugcaacaugguguaaacagguggaucaaggaaauccaaaagguuacaaaauuggauagagauccagccuccggaacagcuuuacaagaaaucagcuuuugguugaaucuagaaagagcucuucaccgcauucaggagaaacgugaaaguauggaaguugcacuaacuuuggacauccucaaacauggaaaaagauuccaugcaacuguuucguuugauacagacacuggucuuaaacaagcuauagcuaccgucaacgacuacaauccccuaaugaaagacuuucccaucaacgauuuauuagcugcuacagaacuggaaagaaucagagccgcaguccaacugauuuucgcccauuugagaaaagugagaucaacgaaguaucccauucagagauguuugaggcucguugaagcuauuucaagagacuugggugcccaauuacucaaaguuuugggcacgagaagacugaugcacauuccguucgacgaauucgagaaaguuaugacucaauguuuugagguguuuuccauaugggaagaugaauaugagaagcugcaagcucuauuaagagauaucaugaagaagaaacgugacgaacacaugaaaauggucuggcguaucucaccgcaacacaagaaacuccaaagcaggauggaucagaugcguaaguuccgaagacaacaugaacaauuaagaacugucaucguucgaguguuaaggcccagcaucaaaggaagcgcugugccgauugaaggaggcgacaucgaaccaccgaagccgacuuucucccuugaugcagccgaugcuaaugcuauagaggaagugaauuuggcauacgaaaaugugaaagaaguagauugucuagauaucucaaaggagggacaagaugcuugggaugccgcuguacaaagauaugaagaacgcauugacagagucgaaaccagaaucacagcucaucuucgugaucaacucgguacugcuaagaaugccaacgagauguucagaaucuucucucguuucaaugcucucuucguuagaccucacaucagaggagcuauuagggaauaccagacucaucuuauacaaaggguaaaagaugacaucgaagcucuucaugaaaaguuuaaggugcaauacccacagaguaauagcgcuaaaauaagcaaagugagagacauuccgccuguugcugguuccauaaugugggcgaaacaaauugaucaccaacucaccacauauuugagacgcguagaggaugucuuagguaaaggaugggaaaaccauauagaaggccaaaaacuuaaagccgauggagacagcuuccgucucaaacuuaacacccaagaaauauucgacgauugggcucgaaacguucaacaacgcaacuuaggagucuccggaagaauauuuaccaucgaagcaguccguucaagaagcgguagaggcaacguguugaaacugaaagugaauuuccuaccagaaaucauaacuuuggccaaagaaguuagaaaucugaaaugucuaggauucagagugccauuggccauugucaacaaggcgcaucaggcuaaccagcuguacccauuugcuauuucgcucaucgagaguguuaggacauacgagaugacgcuugagaagauugaagacaaagccagcauuauaccucuuguagcaggaaugcgaaaagagguucagcagguuauugcggagggcauacaacucgucugggagaguuacaagcuggauccuuauguccaacguuucucagaccucgucguaaguuuccaagagagaguagaagaauuggugcuaguaggugaacaguuagaagucgacguaagaucuuuggagaccuguccauauucugcuaacacauuugcugacauccugucgaagauucaacaugcugucgaugaucugucuuugaaacaguacucgaacuuacauaucugggucagcagauuggacgaagagguugaaaagaauuuggcaagacgucugcaagcuggaguggaagccuggaccgaugcacugagcggccacaagaaggaaaucgaucacagcauggacaccgacgcucccgcucagccgacacacaaaccaggaggagauccgcagauccaaaccaugguucaugaaguuagaauaacaaaccaaaccauguaucuguacccaagcaucgaagaagccagauuuuugaucaugcaacaguuguuugcauggcaagcuaucgucacaucccagcagagguugcaaaguagcagguaucaaguuggcgucgauaaaccuguuacagaaaccuacaggaacauauuaacgaaguugccggguggagcucaaccucuaaacucggcuuacagugcaauugcuuccaaaauuaaagagguucaaaacuacgugaacgaaugguugaccuaucaaucgcuuugggacuugcaagcugauaaucuguacggaaaacuaggagaagauauuggcaaauggauggaauguuuaaaugauaucaaaaaaacccguacgacauuugacacuucagacacccgucgugaauucggucccauuauuaucgacuucgccaaaguccaaagcaaagucucucuaaaauacgauucauggcacaaagacacuuuaggcaaauucgguggucuacuuaguaacgaaaugacaucuuuccacgccaauguauccaagucaagaucagacuuggaacuccaaagcaucgaggccgccagcaccucagacgccguuagcuucauuacuuacguucaacaguugaaacgaagcaugaaggcuugggagaaacaaguugauauuuacaaggagggucaaaggauuuuggaacgacagagauuccaguucccaacaaauugguuacacguggagaacuuggaaggagaauggggcgcuuucaacgaaaucaucaaacguaaagauucuagcauucaaacccaaguagccagucuccagcagaagaucguauccgaagacaaggcaguggagagucgcacuaaugacuucuuaaaugauugggaaaagagcaagccugucgaagggcaucucagaccagacgacgccuugucacaacugcaacuguuugaaagcaaauuuuccagacucaaagaggaaagggacaauguugccaaggcuaaagaagcucucgagcuucaagauccuggcgguauaagcaccagcgaagacagaaugcaagucgucuaugaagaacuccaagaccucagagguguuugguccgaauugucaagaauauggcaacaaauagaugaaacuagggaaaaaccauggcuuucaauucaaccaaggaagcucagacagcaguuggacgcucuaaguacacaauuaaaggaacuaccagcaagauugaggcaauaugcuucguaugaguacgucaagaaaacuuuacagacauauaccaaaguuaacaugcucauaguugagcuuaaaucugaugcucuaaaagaacgccauuggaagcaauugaugaaacaauuacgaguaaacuggaucuugucagauuuaacacuaggacagguuugggacguaaaccuacaaaagaacgaagccaucguaaaagauaucauucuaguggcacaaggagaaauggcuuuagaagaauucuugaaacaaguucgugaguccuggcagaacuacgaacuggaccucaucaacuaucaaaacaagugcaaacuaaucagaggaugggacgauuuguucaauaaagucaaagaacacaucaauucaguagcagcuaugaagcucucaccuuauuacaaaguuuuugaagaagaagcauugaccugggaagaaaaauugaaucguauuaaugcuuuguuugaugucuggaucgauguacagagaagauggguuuaccucgaaggaauuuucucagguagugccgauauuaaaacucuucuaccaguggaaaccucgagauuccaaagcaucaguucagaauuucugggauugaugaaaaagguuagcaaaagucccaugguaauggacguauuaaauauuccaggagugcaacgagcuuuagaaagauuagcugauuuauugggcaaaauacaaaaagcuuuaggagaauaucuagaaagagagcguacuucauucccuagauuuuauuucguuggugaugaggauuuauuggaaauuauaggaaacagcaagaacaucgcuagacuucagaaacacuuuaaaaaaauguuugcuggaguugcuucuauacuuuuaaaugaaaacaacaccauaauuacagguauagcuucaagggaaggugaagaaguucacuucaacaacccagucucgacuguagaucauccaaagauaaacgaauggcucacaaugguagagaaggagaugcguguaacuuuagcuucaaauuuaacccaagcuguacaagauaucaagcaauuuaaagacggcauugauucaaagaguuacaugcaaugggucgacaaauaccaggcgcagauagugguccucgcugcucaaaucuuguggagcgaagauguagaagcugcucuugucaagaugaacagcgaaccucaaaaagguccucuagaaaaaguacuucaacagguagaaaauacacucaauguacuugccgacucgguucuucaagagcaaccucaacucagaaggaagaagcuggagcaucucauaaacgaauucguacacaaaagaacugugacuagaagacugaucgcaaacggaguuuguagcaacaaagcauucgaaugguugugugaaaugagguucuauuuugauccaaggcagacugaaguuuugaaacaauuaacgauacauauggcaaaugcgagguucuacuauggauuugaguauuuaggaguucaagauaggcuaguucaaacaccguugacagauagauguuauuugaccaugacucaagcuuuggaagcucguuugggagguucgccuuucgguccggcugguaccgguaaaacugaaucagucaaagcucucggcaaucagcugggacguuucguuuugguauucaauugugacgaaaccuucgauuuccaggcuaugggaagaauauuugugggucucugucagguaggagcauggggauguuucgacgaguucaaucgauuggaagaaagaauguugucugccguuucacaacagauucagacuauucaggaagcuuugaagucgcagaaagaagcugcugcugaagguguuacuacaggcaguauuaguguagaauugguaggaaaacaagugaaagugucgccagauauggcuaucuucauaacgaugaauccagguuaugcaggaagaucgaauuuaccugauaauuuaaagaaauuguucagaucuuuggcuaugacaacgccagacagacaauuaauugccgagguuauguuguucucucaaggauucaggcaagcugaaaaauuggcuucgaagauuguuccuuucuucagguuaugcgacgaacaacuauccaaucaaucccacuacgacuucgguuugagagcccuaaaauccguacuuauaucugccgguaaugucaagagagaccgaauucagcggauuaaggaaggaaugacccaacguggcgaaaccaacaucgaugaagccagcaucgcugagaauuugccagagcaggaaaucuugauccaaucagugugcgaaaccaugguacccaaguugguggcugaagauauaccacuucucuucaguuuguugaaugauguauucccuaauguucaguacacaagagcagaaaugaaaggucuuaaggaugaaaucagaaaaguauguucugaagaguauuugguauguggagaaggagacgaacgaggaucagcuuggauggagaagguacuucaacuuuaccaaauaucaaauuugaaucacgguuugaugauggucggcccaagcgguuccgguaagaguucggcauggagaguucuucuuaaagcucuugaaagauucgaaggcguugaaggaguugcacaugucaucgauccaaaagcuauuagcaaggaagcacuguaugguguuuuggaucccaauaccagggaauggacggacggucucuucacucacauauuaaggaaaauuauugacaacgucaggggagaaauuaacaaacgucaauggaucaucuucgacggugacguagauccugaguggguagaaaacuugaauucaguacuugaugacaacaaauuguugacucugcccaacggugaacgucuuucccuaccuccaaacguuaggguuauguucgagguucaagacuugaaauaugcgacacuagccacgguuucucguugcgguauggucugguucucugaagaugucuugucaacugacaugauuuucgaaaacuauauucuucguuugaggaauaucccucuggaagaaagcgaagauagcggcuuuggcaagaaaaacgacaaagacgauaugcuuucucccacucuucaacuacaagucgacguugucaaucuacuacaaccauacuuaucacccgauggucuagucguacguugucuggaauaugcgauggaacaagaacauauuauggacuucacacgucuuagagcacucagcucguuauucucuauguuaaaucaagccguaagaaacguucuccaauauaaccacaugcaucccgacuuuccauuaaccaaugaugucuuagacaaauauauuccaaaauguuugauauauuccauccuuuggaguuucgcuggugacgccaaacugaagauucguucugaucugggagauuuuaucagaucuguaacaacgguaccgcuuccuccagacaacaacaugccuauaaucgacuacgaggucaccaucgagggagaauggucgcugugguccaauaaagugccacaaauugagauugagacgcacaagguugcuucaccugauguuguagugcccacuuuggauacaguaagacaugaauccuugcuuuauacuugguuagccgaacauaaaccauuaguauuaugcgguccaccuggaucugguaaaacgaugacucuauucuccgcuuuaagggcguuaccugauauggaagugguuggcuugaacuuuucaucugcuacaacuccugaauugcugcugaagacauucgaccacuacugugaauacagaaaaacgccuaaugguguaguuuuguccccaauacaguugggcaaaugguuaguucucuucugugacgaaauaaauuuaccagacauggacaacuacggcacacaacguguuauaauguucuugcgucaaaucguggaacagaaagguuuuuacagagccucggaccaauccugggucucacuagaacguauccaauuugucggugccuguaauccuccaacugaucccggcagaaagccucuaucccaccgauucuugcgacacguucccgucauuuauguagauuaucccggagagacaucuuugaaacagaucuacgguacuuucaccagggcuauguuaagauuggcgccuggucugaaagguuaugccgaaccauugacuaaugcuaugguggaauuuuauuuggcaucucaagauagauuuacucaagauaugcaaccacauuauguuuauucuccaagagaaaugaccagauggguaagaggaauuugugaagcaauaaggccucuugauaaucuugcuguggaggguuugguaaggcuuugggcucaugaagcucuccgucucuuccaagacagauuagucgaagacacagaaagacguuggacuaacgaaaacauugaugcuguagcuuuaaaacacuucccaucagcuaacugcgagaaagcuuuggaaagacccauucuuuacagcaauugguuauccaaggauuauguaccuguuggaagggaacaacuaagagaauauguaaaggccagacugaagguguucuaugaggaagaacuugauguuccuuugguguuguucgaugagguguuggaccauguuuuaaggauugacagaauauucagacaaccucaaggucacuuacuacugaucggaguuucuggugccggaaaaacaacucuguccagauuuguagccuggaugaaugguuuaucuauauuccaaauuaaaguacacaacaaauacacagcggaagauuucgaugaagaucuaagaucuguuuugagaaggaguggaugcaaacaugaaaagauugcuuucauuuuggacgaguccaauauguuagauuccaguuucuuggaaagaaugaacacucuacuagcuaauggugaaguuccuggacuuuuugaaggagaugaauauacuacucuuaugacucaguguaaggaaggagcucaaagggaagguuuaauguuggauucaaaugacgaauuauacaaaugguuuacacagcaaguaaugcguaaucugcauguugucuucaccaugaaucccucuaccgauggucugaaagauagggcugccacuucuccagcucuguucaacagaugcgucuuaaacugguucggugacuggucagauggagcucucuuccagguugguaaagaauucacgaaucguuuggaucuugaaaaacaaagcuggagauguccagacuucuucccggcugcuugccaucacaucucagcgucuccuacucauagagaagcugucaucaaugccuguguguauguacaucagacucuucauaaagcaaacaguagauugguuaagagaggaagccguaccauggcgaucacuccaagacauuacuuagauuuuauucaucaucucguuaaacuguacaaugagaaacggucagaucuggaggagcaacaguugcauuugaacguuggucugaauaagaucgccgaaacuguagaacagguugaagaaaugcagaagaguuuggccgucaaaucucaggagcuacaggccaaaaaugaagcugccaacgcuaaacucaggcagauggugaaagaucaacaagaagcugaaaagaagaagguacagagucaagagauucagcagcaguuggcugaacaaacgauucacauugaacagaaacggucagaaguaauggcugaucuagaacaggucgacccugccguuauugaagcccaauuagcuguaaaauccaucaaaaaacaacaguugguagaaauccguacuauggcuaacccaccagcucuugugaaguuggcuuuggaauccauuuguuuacugcucggugaaaaugcuagcgacuggaagucgauucgugcuguaauuaugagagauaacuucaucaacaccgugguuaacaacuucaacacugaagauauuagugaugauguaagggaaaaaaugaagaaccgcuaccuuagcaauccagauuacaacauugauaagaucuaccacgccaguaacgcuugcgguccacuugucaaaugggcuugugcgcaaguucaauacgcagacaugcucaaaaaggucgagccucuccgugaagagcucaaaucucuagaacaacaagcugaaaccaaccaaaagagaggcgaagauguuaaagcacucauuagccaauuggaacagaguaucgcugcuuauaaagaagaauaugcacaacuuauagcucaggcgcaggcuauaaagacugauuuggaaaauguacaagcuaaaguagacaggucaauagcucuucugaaaucucuggucaucgaaagggaaagaugggaagccagcagugagacuuucagaucccaaaugucuaccaucaucggugacguucuucuaucggcugcauuuauagcauacggcgguuacuuugaucagcauuaccgucaaaaucuguuuagcacuuggugucagcauuuaacucaggccagcauccaauaucgagcagauaucgcuagaacggaauaucuuucuaauccagaugaaagacuuagauggcaagcuaaugcuuuaccaacggaugauuuguguacugagaacgcaauuauguugaagagguucaacagauauccucuuauuaucgauccuucgggucaagcuacugaauuuauaaugaacgaauuuaaggauaagaagauuaccaagacuaguuucuuggaugacucuuucaggaagaauuuggaaucugcuuugcguuuugguaauccucuucuuguccaagacguugaaaauuaugaugcuauucuuaauccaguacucaacagagaauugaggagaacuggaggucgugucuugaucacuuuaggugaccaagauaucgauuugucaccaucguuuguuaucuucuuaucaacuagagauccuacuguagaauucccgccugauauaugcucuagaguuacguuuguuaauuucacaguuacuagaaguucccuccagagccagugcuugaaccaagugcuuaaagcugaaagaccagacauugaugcuaagcguucagauuuauuaaaacuacaaggagaauuccacuuaagauuaagacagcuagaaaagucucuguuacaagcuuugaacgaugcaaaggguaaaaucuuggacgaugacaguguuaucacaacucuagaaacccugaaacaagaagcagcagaaauuggucagaaagucgaagaaaccgauaagguuauuucugaaauugaaacgguaucucaacaauaucuaccguuaucacaggcuugcaguaauaccuacuucaccauggacagucuuaaccaaguucauuucuuguaucaauauucacucaagauguucuuggauguuuuugccacuguuuugcauaauaacucucagcuggauggaaucagcgauuaccaagcuagauugaaccucaucacaucaaauuuauucucuguuguauaugaaagaguggcaagagguaugcuccacaacgaucgacuuacauuugcaauacuacucuguagaauccacuugaaaggacagcuaaccgaaccgaauuuggaucaagaauucaacuucuuccuuagaggcaaagaagguguuuucaguaacaccggugcauucgcuaccgauggauugaacagcgaucaacaagaagcugucguuagauuaucgacaaaauuaccaacauuuaagaaauuagcgaaccaaauaaaggaaaugccugaauuuggagcuugguugcaacaaggaaguccugagcaagcaguuccacaauuguggauugaggaaaaacaacucagugcaguggguagagcaauguaccaacugcugguuauccaagccuucagaccugauagaguaauagcugcugcucauaacuucguaucggucguucugggagcggacuucauguacuuggcagaaaaagaacuugaauuugccgcaugcgucgaaaaagagauuagaucuaacguuccagcacuuuuaugcucgguucccgguuucgacgcuucuggucgugucgaugaucuugcagccgaacuuaacaagcaaauauccagcauugcuaucggaucagccgaaggauucaaccaggcugauagagcuauaaauauggccugcaagacuggaagaugggucaugcugaagaacguacacuuggcuccucaaugguuaguccagcuggagaagaagcuucauucacuucaaccucacgccaacuuuagacuauuccucaccauggaaauuaauccgaaacuaccaguuaaucuucuuagagcaggaagaauauuuguauucgaaccuccaccggguauuagagcuaaccucuugagaacauucagcacaguuccagccaguaggaugaugaaagcaccaaacgaaagagcaagacuuuacuucuuauuggcgugguuccacgcgauuguccaggagagguugagauauugcccucuagguugggcaaaacauuaugaauuuagugaaucagauuuaagaguugccugugauacuuuggauacuuggauugauacaacggcuaugggaaggacgaauuugccgccagagaaagucccaugggacgcccuagucacuuugcucucgcaauccaucuauggugguaaaaucgauaacgauuucgaucaacgacuguuacauuccuuccugaauaaacuuuuuacucccaagagcuuugagagcgacuuugcuuuaguggcgaacaucgacaacggaccugguggaaauagacacauuacaaugccagaugguacuagaagagaucacuucuugaaguggaucgagaguuuugcugauagacaaacuccagcuugguugggauuaccaaauaaugcugaaaagguccuauuaacaacuagagguaccgauuuaauagccaaacuauugaaaaugcaacagcuggaagacgacgacgaauuagcuuacucuauugaugacagcucgccuacagaucaugcugaaauugacgguagaccgucuuggaugaagacucuucauaacagcgcucauacuuggguuaacuuguuaccaacuucucuucagaccuuacgaagaacugucgaaaauauuaaagauccccuuuauagauauuucgagagggaagucaacucugcuuccaaacuucucauugauguauuacacgaucuuaaugauguacuuuugauuugucaaggggacaaaaagcaaacgaauuaucaccgacugauguuggcugagcuagugagagguauuauucccaagaauuggcacagauacaccauaccgaaaggauguaccgucaugcaauggauuaccgauuucagucagaggguuaagcaauugcaaaaggugucucaaguaguuucuucuucaggagcuaaagaguuacagagucucccuguaugguuggguggauuacuaaauccagaagccuacauaaccgccacaagacaaugcguugcccaggcgaacagcuggccauuggaagaacuccaucuagacguaacaaucacggauaguaccgacaaagauucuauuccucacgauuguuuugcugucauugguauuaaacuacaaggugcucaaugucgcaacagucaacuuuuacucaccuccagcaucaugauagaacuaccaaucacucuuuuccgauggguccgaauggcgacuggcgacgagaaacucaaagagggaaaacugucucuuccucuuuaucuaaacuccacaagaacggaauuguuguauacaguagaacugaauauagcagcuggacaggacccacacagcuucuaugaacguggcguagcuuuacuuacauccacuucuuugaacuaa

SEQ ID NO: 5579 - RNA, 2673 nt, Diabrotica virgifera
auggaucgaccaaguacaaguaagcgaaaugucuuugacuccgauucagauagugucgacagcacugaagaagcucgccgaagagaucugaaggaaagagaugaauucgcaaauaggcucaaaaaacgcgaugaagaacguacuagaaacguugccaguacuucugauaagcgcgcuuaugaagaggcugcuaaaagacuuaaauuggacaaugcagaaaaagagaaacuuauuccugcacucagaguugcuuccaggaggaaguauuuggagaagagaaaggaggacaaacuacaagaauuggaagcugauauugccgaugaugaguaccuuuuugaggaagauguuuugacugaaagagagaaaaaagaucguguacacaagaaagagcuguuaaaauuggcgcaggaacaugaaaaggccagggaacuugagcggguucaaagguaucacaugcccagagauuugggcaaggacuccacugcugauuacauugaaguugaugacuuggagaagguaccacaaucugaacagaagaaaugggaaaaagaucagauggccucggcaguguuuaaguuuggagcaaaagaugggauuaaaaaagaagaguaugaguuaguguuagaagaucaaauucaguuuauacaagcacuacaaaugccaggagugucugauaagaaagaacccgaacuaacggaaacagaaaagaaaaaacuuacuauagaagaaacaaagaaaagccuuccgauauacccuuuuaaagacgacuuaauacaggccauuagggaacaccaaguuuugauuaucgaaggugaaaccggcucuggcaaaaccacacaaauuccacaguauuuauacgaagcugguuucugugaagaugggaagaagauugguuguacucagccacgaagaguagcagccaugucaguagcugcuagaguagcacaagaaaugaguguuaaauuagguaacgaaguaggauaugccaucagauuugaggauugcaccucugaaaggacaguuauuaaauacaugacagaugguaccuuacacagagaguuccuaucagaaccagauuuagcgucuuauaguguuaugauuauugacgaagcucaugaaaggacuuuacacacugacauauuguuugguuuaguuaaagauauagcuagauuuagaccagacuuaaagcucuuaauauccagugcaacacuugacguaacaaaauuuucugauuuuuuugacgaugcuccuguuuaccaaauaccaggaagaagguuuccaguugacauuuauuacacgaaagcuccugaagccgacuacgucgaugcuuguguaguaucaguacuucagauucaugugacacaacccuugggcgacauacuaguauuuuugacuggacaagacgaaauagaaacgugccaagaacuuuuacaagauaaaguucguaggcuagggucaaaaguuaaagaauuacuuauauugccacuauaugcaaauuuacccagcgauaugcaagguaaaauuuuugaaccgacgccuccaggugcuagaaaaguuguuuuggccacaaauauagcugaaacgucuuuaacaauagacaauauuauauacguuauagauccuggguuugcgaaacaaaaucauuucaauucgagaacagggauggagaguuugaugguaguaccaauauccaaagcuucugcaaaccagagagcuggcagagcugguagaguagcagcuggaaaauguuuuaggcuauacacugcuuggucuuauaaacaugagcuagaggacaauacuauaccggaaauccagcggauaaauuuaggaaacgccguacucauguugaaggcgcuaggaauaaaugauuugguacauuuugauuuuuuggauccaccuccucaugagacuuugguguuagcauuagaacaauuauacgcuuugggggcuuuaaaucaucacggagaauugaccaaauugggcagaagaauggccgaguuaccgguggaucccaugauggccaagaugauauuagcuucggaaaaauacaaaugcucugaagaaauagucaccauaggagccauguuaucaguaaauggugccauauuuuaccgaccaaaggauaaaauaauucacgcugauacugcucgaaaaaauuucagucacuuagcaggagaucaucuaagucuucuaaauguuuauaaucaauggagggauucugauuacucccuacagugguguuacgaaaauuucauacaauacagaucaaugaagcgagcccgagacgucagggaacagcugguuaauuugaugacaagaguagaaauagaaaucguuuccaacguuucugaaaccguggacauccgcaaggcuaucaccuccgguuauuucuaccacauagcuagauuuuccaaagggggaaguuacaagacggugaagcacaaccaaagugucaccauccaccccaacagugcacuuuucgaaucauuaccuagguggguucucuaccacgaauuaguuuuuacuucaaaggaguucaugaggcaagugauagagaucgagaguaaaugguuauuggagguagcuccacauuauuauaagcaaaaggaauuagaagauccgacgaauaaaaagaugccgaaaacgguaggcaggaguaccagaacugauuag

SEQ ID NO: 5580 - RNA, 1371 nt, Diabrotica virgifera
augaagguagaggaggugaaaaguacuguaaagacacaaagaauaagugcucauagucauauuaaagguuuagguuuggaugaagcagguuuugcaauuccaucagcugccggcuugguuggacaagaacaggcaagggaggcugccggcauaguaguggacaugauaaaaaguaaaaaaauggcuggaagggcugugcuucuagcugguccaccagguacugguaaaacagcaauugcacuugcaauagcccaagaguugggaaauaaaguaccuuuuugcccgaugguaggaucugaagucuacaguucugaaauaaaaaagacugaaguucuuauggagaacuuucgaagagcaauugguuugaggauuagggaaaccaaagaaguuuaugagggggaagucagugaauugacaccaguagaaacggaaaacccugcuggagguuauggaaaaacuguaagucauguuaucauuggucuaagaacugcaaagggaaguaaacaacucaaacuggaucccgguauauaugaagcacuccagaaagagaaaguugaaguaggagacgucauuuauauugaagccacaaguggugcaguuaaaagacaaggaagaucugaugcuuaugccaccgaauuugacuuagaagcugaagaauaugugccauuaccaaaaggagauguacauaaaaagaaagaaguuauucaggacguuacauuacacgaucuagaugccgcuaaugcuaaaccucaagguggacaagacguuuugucaaugaugggccaacuucuaaaaccaaagaaaacagaaaucacagauaaacuuagaaaagaaaucaacaaaauaguagauaaauauauugaucaagguauugcagaauugguuccugguguacuauuuaucgaugaagugcacauguuagauauagaaacauucacuuaucuacacagagcuuuagaaagugccauagcucccauuguuauuuuugcaacgaauagaggucguugucuaauuagaggaacagacgauguuuaugcuccacaugguauuccuuuagaucuguuagauaggcuguugauuauucggacaauuccuuacgguagaagugacauggaacaaauacugaaacugagagcuaccacugaagguuuagaaauugaucaugaagcaaucgcaucguuaggcgaaguuggggcaaaagcaacuuuaagauaugcaguucaguuauuaacgccagcacaucuaacggcaaaaauuaacggaagaaacaauauacuucaaagugacauugaagaaguugguucccuauuuuuagaugcuaaagcuucagcgaaaguuuuaucugaaaauaaggagaaguuuaugacguaa

SEQ ID NO: 5581 - RNA, 2199 nt, Diabrotica virgifera
augacuucaauuauaaaacugcaagcuuugucaggagccaaagaugaaucucccccaugcuauauucuucaaauugacgaagugcgaauacuuuuagacuguggaugggacgaaaaauuugacauggaauuuauuaaggaaauaaaaaggcauguucauacuauagacgcaguguuacugucuuauccagacauauaucauuugggagcccuucccuauguaguuggaaaacuggguuuaaauugcccaauuuaugcaacuauaccuguauacaaaaugggacagauguuuauguaugauuuauaucaaucucaguacaauaugaaagaguuuugcauuuuuucacuggaugauguugauacuacauuugaaaaaauuauucaauuaaaauauaaucaaaauguaccauugaaagguaaagguuaugguuuaacaauuacacccuuaccagcuggucauaugauuggagguacaauauggaaaauaaugaaaauggaagaagauauaauauauuguaaugauuucaaucauaagaaagagcgacauuuaaaugguugugagcucgauagacugcaaaaaccuuccuuacuuauuacugaugcguuuaaugcuacuuaucaacaagccagaagaagggcuagagaugaaaaacuaaugaccaauauucuucaaacucuucggaacaaugguaacguacuuauagcaguagacacggcaggcaggguucuggaguuggcucacauguuggaucagcuauggcguaacaaagaaucuggccuauuggccuacucuuuagcguuuuuaaacaacgucaguuauaacguuauagaauuugccaaaucccagauagaauggaugagugauaaguuaaugagaaguuuugaaggcgccagaaauaaucccuuucaauuuaaacacuugcaguggugucacaguuuagcagaauuaaguaaaguuccuaguccaaagguuguucuugcaaguucacccgauuuggaaaguggguucuccagagaguuguuccugcagugguguucuaauuccaauaacaguauuauauuaacaacaagaacauccccugguacuuuagcuagagacuuaauugacaacggagcagaaagaaauauagauuuaacgguagaaaggcgaguaaaacucgaaggcguagagcuugaagaauaugaaaaacgacaacgagcgcgaggucaaaauguagaaaaggaagaugcagauucggacucugauucugacauagaaaugucuguuaucaccaaagguagacaugacauaguuauuaaacaagagggaaaaauaaaugccgguuucuuuaaggucacgaaaaaaauguaucccauguaucccuuccacgaagaaaaaauuaagagcgaugaauauggagaaauuauaaaaccugaaaauuacaaauuggcagauguggcuguagaaggagaggacaauaaagaaaauguauugauaaaaaaggaaguggaggaagaaaucacugaaauacaugaacagccaacaaaaugcauaguacuucagagaacuguacaaguuaauugucagguacauuauaucgauuuugaaggucgcucagauggagaaucccuuaugaaaauuuugucgcagcucaaaccuagaagaguaauagucguuagaggugacgaggaaaauacaucggucauagcaaaacauugcgaagguauaaaagccagaguuuuuacgccaucucgaggggaaauuguugaugcuacgagcgaaacacauauuuaccaaguuagauuaacagaugcacuaguaucacaguuaagcuuucaaaaagccaaagaagcagagguagcuuggauuacagcgaacguaguucuuaaagagagucaagcagacgcuaagcguguuuauguggaugaugaaccaauggaagucgaagauguggacacaaggauuuugacgcuggaaccuguacuagaaggagauugucaugauccaguuuuuauaaacgaauuaaaauuaucugaauuuaaacaaguuuuaggaaggcacaacauuacuucggaauuuucagguggugucuuaugguguuccaauggaacaauagcugugaggaggguggagucuggaaagauuaugcuagagggcuguauaucugaagauuauuauagaguuaaggauuuauuguaugagcaguaugcuauauuguaa

SEQ ID NO: 5582 - RNA, 2283 nt, Diabrotica virgifera
auggcuccuuuagagucaacuaauaacaacaacaaugaggaaccuggcccaauaaauccaauugugggaauuauuuauccaccaccagaggugagaaauauugucgacaaaacugcaaguuuuguugcuagaaaugguccagaauuugaagcucguauuagacaaaaugaguuaggaaacccuaaguuuaauuuuuuaaacaguggggauccuuaccauuccuacuaucaacauaaaguuaaagacuuuagggaaggaaaaggacaagauccuaccccuggauuaacucaagccgucucaaaacuuucugucacugcaucagcucaacagaaacagcaagaaauuuuaaagcaaguagaacagcccuuuauacccaaggaaacaccuucagaauuugaauuuauagcugaucccccaucaauuucagcucuagauuuagauauuguuaagcuuacagcucaguucguagcuagaaaugguagagcuuuucugacacaauugaugaauagagaacagagaaaucugcaguuugauuuuuugagaccucaacacucuuuauuucaauacuucaccaaauuacuggagcaauauacaaagguucuuauucccccaaaaaguaugcaugaaagccugcgaaacgaggcuaauaguccgaagaauguguuagagcaagucaaauaucgugcagaaugguugaaguaucaagagcaacaaaaagcuaaggaagaggagcuuuuagaacgagaaaggguugcguaugcacaaauugacuggcaugaguuuguagucgucgaaacuguugacuaccaacccuucgaaauuggaaauuuuccggcuccaacuaccccugaagaagucggagcccguauuuuaauucaagagaggauagaagaaggggaagauaucgaaaugcaauuagagagugaugaggaagaaccaccaguuauggaagcugguuuaagcagcaugcaggacaaaaccaaucggaagacacgcgacgauaccagaauucaagauauggaagaagaaagcuccgaugaagaaaaagaagaagaagaggaauuagcuuuaccuccaccaccaccaucuauucaaccaccguuaccuccuauuccugauaaaguugucgugaaaaaauaugaucccaaacaagcugucaauguuagucggccaacaauuggagaugacuuucucgucucacccauuacuggagagaaaauaccugcgaacaaaguccaggaacauaugcguauuggucuguuggauccgcguuggguagagcagcgcgacaaacaaauaacggacaaaaugaaccaagaaacaguauaugcugcugguagugccaucgaugcuucauugaaacugcucgccgagagacguacugauauuuuuggaguuggagaugaagaaacagcuauugguaagaagauuggugaagaagauguuagaaaagacgagaagguaacuugggaugggcauacgaguagcguugaagccgcuacaagagcugccagagccaauaucaccuuggaggaacaaauucaucaaauacacaagguaaaggguuugcuuccugaugaagaaaaggagaaaaucgguccaaagaauauugguucaaaaucugguaaaaucaacauucaaagcguaauuacuacgaagccgccuacuucacuucaacccaaaccgccagucucuuuaauucaaacccaagcaacugcgucgcuaauaucgguaccaccacaaccuauguuaccaccucaaccucccauuaugaugaugucagcuacaucuaugccucccauuagaccaccuccaauaaugaugacaggaccuccuccaauaccggguuuuccuguagcaccaauguccucaccuauggguccaccuaugaaucuguccccaaugaaacaucaggcugaagcaccucacgaagaugaaccgaguaacaaaaaaaugagaaacgaagauucgcuuauaccggaaaaacuauuuuuagcaagacaucaaagccaaguagcuaucaagauuucgauuccacauaugccagaaaaaucagaauggaaacugacggguaagaugauuucguggacuguaccacuugccgaaucuguagcgaauuugaaggcgaaacugcaagaagaaacuaacaugccuccagcuaaacagaagcucuuuuuugaugguauguucuuuaaggauuccaacaguuuagcauacuacaacgugacuacugguucaaucauucagcuacagauuaaagagagaggaggaaggaaaaaauaa

SEQ ID NO: 5583 - RNA, 969 nt, Diabrotica virgifera
augccgagucaagaauuaacaacuaauaaaguaauaguccacccuuugguucuucuaagugugguggaccauuuuaaucgcaugggcaaaaucggcaaucaaaagcguguuguugguguucuucuuggcuguuggcgugcuaaaggagucuuagauguuucuaacaguuuugcaguuccuuuugacgaagaugacaaggauaagucugugugguucuuggaccaugauuacuuagaaaacauguauggaauguucaaaaaaguuaaugccagggaacgaguaguagguugguaccacaccggccccaaacuucaucaaaaugauauugccauuaaugaguuaaucagaagguauuguccaaauuccguucuaguuaucauagacgcuaaaccaaaagauuuagguuuaccaacugaagcuuaucaagcuguagaagaaguacacgaugacgguucaccuacaucuaaaacauuugagcauguuccuagugaaaucggagcugaggaagcugaagaaguugguguugaacacuuauugagagauauuaaagacacaacuguugguacuuugucacagagaauaacgaaucagcuuuuaggguuaaaaggucuccauucacaguuacgugauauuagggacuauuugguacaagugugugguaaccagcuuccaaucaaucaccaaaucaucuaccaauuacaagacauauuuaaucuuuugcccgauauaaaucaggaugcauuuaauacaucguuuuacgugaaaaauaacgaucaaauguuagucguuuaucuagcagcuuuaguuagaucuauugucgcucuacacaaucuuauuaacaacaaacuaacaaauagagacgcggaagaaggaaaaaaggaggauaguaagaaagaaagcaaagauaaggacaaggauaaagagaaggaaaaggauaaagaugcuaagaaggacgagaagaaaaaguaa

SEQ ID NO: 5584 - RNA, 1656 nt, Diabrotica virgifera
auguuugguggaggacgugccccuauuuugguguuaagucaaaauaccaaacgagaauccggucgaaaaguucagcuggaaaacaucaaugccggaaagcaaaucgcggaugugauaaggacaugccuugguccucaagcuauguuaaaaaugcuuauggauccaaugggagguauugugaugacuaaugauggcaaugcuauuuuacgugaaauuacaguacagcauccagcugcaaaaaguaugauugaaauugcaagaacacaagacgaagaaguuggagaugguaccaccucaguaauugucuuagcaggagaaauguuaguggcagcugaacaguuuuuggaacaacauauucauccgacaaucauaauucgccaguacagacaagcacucgaagauaugauucaguuauuggaagguccauuaaguauaccagucgauagaaacgauaaaaaugcucuugcccaagucgugaaaggcugcauuggcacaaaauucauaaguaaauggucagauuuggcaguaaauauugcuuuagaugcaguaaauacaguauuauuagaagaaaauggcagaacugaaguugauaucaagagguaugccaaagucgagaagauuccuggaggauccauugaagaaucuaaaauuuuaagagguguuaugcuuaauaaagauguaacccaucccaaaaugaaaagauauauacagaauccgagaauaauacuuuuggauugugcauuagaauauaaaaaaggggaaucucaaacaaacguagaaauuucagcagaaacagacuucaccaaacuauuagaacuggaagaggagcaugucaagcgucaaugugaugagauuauugcacucaaaccugacgucgucuucacagaaaaaggaguaucagauuuggcccaacacuuuuuacugaaagcugguauuaccgcuaucaggcguguucgaaaaucugauaauaacagaauugccagagccuguggagccacgauuguuaaccgaacagaagaauuacaagaaagcgauguuggcuuaggagcuggacucuucgaaaucaagaaaauuggugaugaguauuucugcuuuguggucgaaugcaaaaauccaaaggccuguacaauuuuacucagaggugccaguaaagacauucucaacgaaacugaaaggaaucuacaagacgcccuacaagucgccagaaauauuguccuaucuccccguuuagugccuggagguggugccauagaaauggccguagcccagcgucugaugcagaaggcuacgcacggaccuuauagagcucuugcacacgcuuuagaaauuauuccaaaaacucuuacucagaacugcggagcaaacacaaucagaacauuaacugcuuugagggcgaaacacgccaaccacacggacguuaacaaaccaugccuuugggguauugauggcgaaacuggagagcucguagagauggacaagaaagaacugugggaaccucuagcugucaaacuccaaacauacaaaaccgcuauagaaacugccauucucuuacuucgcauugacgacauuguaucuggcuccaaaaagaagggaggcaacgaaccaccaacuccuagccaaaugcaacagcaagaagcuagaggagaagcugaauaa

SEQ ID NO: 5585 - RNA, 702 nt, Diabrotica virgifera
augaugcaaacagcuaauaaugcauauuaucccgauuauuccacugcuccaaugcaacgucaaauuaaccccuaugcagauaauggagggaguguaguagcaauagcaggugaagacuuuguaauaauuggugcagauacacguuugaguacuggauuuuccauuuauaccagagaacaaaacaaacuuuucccacuaucaggcacuacuguuuuggguugugcaggauguuggugugacacucuaacauuaaccagaauccuuaaaucucgcaugcagauguaccaacaagagcauaacaaaacaaugucuacaacugcaugugcccagauguugucaaccaugcucuacuacaagagauucuuuccuuauuauauaucaaacauucuaguagguuuagauaaugaaggaaagggcuguguuuacagcuaugauccuauuggacauugugaaaaagcuacguauagagcaggugguucagcuggagcucuucuucagccucuguuggacaaucaaauuggacagaagaacaugcuuaaaacaucuggggaaccucuuagucaggagaaagcuuugucuacccuuaaagauguauuuauuucugcugcugaaagagacaucuacacuggagauagcguacuuauaaauauuauuacuaaagauggaguaaaggaagaguccuuccaguugagacgggauuag

SEQ ID NO: 5586 - RNA, 897 nt, Diabrotica virgifera
auguuucaauuuggauucaacauguuuccugagguccccaggccuuuuaauaugacuuauaagugcuacucaguggcuauguuuccuggcaaugaacgagaagacguugaaagggguggaaaaauuauuaugcccccaucagcuuuggaacaauugacuagguuaaauauaaacuaucccauguuguuuaaacuugugaauaaaaagacacaucgcacaacucauuguggaguuuuagaauuuguugcugaugaaggaaaaguuuauuugccacuuuggaugaugaacaacuuaguacugacugaaggagauuugguucaaauggaaaguguuucccuuccaguuggcacauuuucaaaauuccaaccucuuaauccagacuucuuggacauuacuaauccuaaagcagucuuagaaaaugguuugagaucuuuugccugccuuacaacaggagaugucauugcaguaaaguacaaucaaaaggcuuaugaguuguguguucuagaaaccaaacccggagaugccauuaguaucauugaaugugacaugaauguggaauuugcugcuccuguuggauacaaagaacccgaacaagucaaaaaggaagaagaagaaauggcuauagauccugcagauuuaaugccagaaccuucuggauuuguagcauucagaggugcaggaaaucgacuugauggcaaaaagcguaaagauacuucaggaacugauaguucaguggccaaaccaacuuaugucagaggaauuccagauuaugauuaccaaauaggcaacuuaaaauuuaucaggagaaugaucaagcagaaaucuaacgauuaugcagaggacagcgaauucaaagcauuuaguggagcaggauuuaguuuaaaaucgagaacguaa

SEQ ID NO: 5587 - RNA, 1623 nt, Diabrotica virgifera
augagugcuauaccaggaaguauugcauuugaugaauauggacgacccuucauaauucuuagagaccaagauaagcaaaagagguugaccgggauagaugcacuuaagucacauauuuuggcagcgagacaaaucgcucaaacuauaagcacuucuuugggucccaaagguuuagacaagaugauggugucaccugacggugaaguaacagucacuaaugauggugcuacuauuuugaaaaugauggauguugaacaugaagucgcuaaauugcuaguacagcuaucacagucccaagaugaugaaauuggugaugguaccacagguguuguaguuuuggcuggugcccuguuagagcaagcaggaucuuuauuagacagagguauucaucccauaaggauugcugaugguuuugagcuagcuugucaaacagcuguagcucauuuggaaaaaauugcagaacuauuuccaguaucagcagaaaacacugaaccauuaauaaaaguugcaaugaccacucugggaucuaaaaucauuaacaagugucauaaacagauggcagaaauagcuguuaaugcagucuuagcuguugcagauuuagaacagaaagauguuaauuuugaacuuauuaaaguugaaggcaagguugguggaaaauuggaagacacaacauuaguuaaagguguaguuauugacaaaacaaugucccauccacaaaugcccaaagaacuaaaagauguaaaauuggcuauucucaccugcccguucgaaccaccaaaaccaaagaccaaacauaaguuggaugucagcaguguggaagauuauaaggaacuaagacaguaugaacaagaaaaguucaaagaaaucguugguuugguaaagaaagcuggagcuacauuagcaauuugucaauggggcuucgaugaugaagccaaucacuuauuguuacaacaagaauuaccagcuguaagauggguuggagguccagaaauugaacuuauagcaauagcuacuggggguaggauaguuccccguuuugaagagcuuacuccugaaaaacuuggucaugcugguuugguacgagaaauugcauuuggcaccacuaaggauagaauguugguuauugaagaauguucaaauucacgggcaguuacgauucuugucagaggagguaaucaaauguuaguagcugaagccaagagaagucuccaugaugcauuauguguugucaggaguuuaguucaagaaccaagaguaguguauggugguggagcagcagaaauugccugcuguuuggcagucgcggcucaagcagaucaacuagcuuccuuggaacaguacgccuaucgugcauuugcugaagccuuagaaaguauaccacuugcuuuggcugauaacagugggcuaucugcgauccauacgcuaggagaagucaaggcuaaacaagcagcuacaggagauccagcucucgguaucgauuguaugaauacuggaaaccucaacaugagagaacaacauguuaucgaaucacucagaucaaaaagacaacaauuuuuguuggccacccaguugguuaaaaugauauugaaaauugacgauguacgccaaccugcaucgggauaa

SEQ ID NO: 5588 - RNA, 342 nt, Diabrotica virgifera
auggcuucugcuauggacguugaugccgaagaaguagaauugcccacuuccaguagcucaaaaggagaaaagaaacguuuugaaguaaaaaaguggaaugcuguagcuuugugggccugggacauuguuguggauaacugugccauuugccgaaaucauauuauggaucuauguauugaaugccaggcaaaccaggcgucagccaccagugaagaauguacuguagcuugggguguuuguaaucaugccuuucacuuccacugcauaucuagaugguuaaaaacuagacaaguaugucccuuagauaauagagaaugggaguuccagaaguauggacauuag

SEQ ID NO: 5589 - RNA, 1605 nt, Diabrotica virgifera
augguaucccuaaaucccguaagaauucucaagcaagaagccgaggaagaaagggcagagauugcccgacucaguaguuuuguaggugcuauagcuauaggagauuugguuagaagcaccuugggaccaaaaggaauggauaaaauuuuaguauccagugguagaucugcaggaucaguugaaguuacuaacgacggagcaacuauccuaaaaucgguggguguugauaauccugcugcuaaaauuuugguggauaugucaaaaguccaggaugaugaaguaggagauggcaccacaucagugacaguauuagcaucugaacuacuuaaagaagcagaaaaacuuguagaacagaaaauucacccacaaacaaucauugccgguuggaggaaagcaguagauauugccagaaaagcucuucuagaaacugccaaagacaacagcucugauucagaaaaguucagagaagaucugaugaacauugccagaacuacacucagcucaaagauucuuucacaacauaaagaauauuuugccaaacuggcaguagaugcugugcugagauugaaagguacaggugauuuacaauccauccagcugauuaagaaaacuggugguacuuuggaagauuccuuuuuggaugaagguuuuuuauuggacaaaaaaccugguguacaucaaccaaagagaguagaaaaugcaaaaauccugauagccaacacuccuauggacacagauaaaaucaaaguauuugguucucacauuaagguagauucaauggcuaaaauugcagagcuggaaucugcagaaaaggaaaaaaugaaagauaaagugaacaaaauucuuaaacauaaugcuaauguauuuauuaauagacaguugauuuacaauuauccugaacaauuguuugcugaugcaggaguuauggcuauugaacaugcagauuuugauggaauugaaaggcuagcacuugucacaggaggagagauugucucaacauuugaccauccagaauugguaaaacuuggaacuuguaagcuuauugaacaaaucaugauuggagaagauauccugcuccguuucagugguguugcucuuggggaagcuugcacaauuguuaucagaggugcuacacaacagaucauugaugaagcugaccguucccuucaugaugcuuuguguguauuagcagccacagucaaagagagucgaauuguguauggaggagguugcagugaaacccuaauguccacagcgguaucaagagcugcugcuaacacuccaggaaaagaagcuguagcaauggaagcguuugccagagcuuuguugcaguugcccacaauuauugcagacaaugcagguuacgacucugcccaauuggucagugagcuuaaggcagcacauaacaguggccagagcaccaugggacuuaacauggaaaagggugaauugggggauaugaaaaccuugggaaucacagaaucuuuuguuguuaaaagacaaguauuagucucggcaucugaagcagcugaaaugaucuugcguguugauaauaucaucaaggcugcaccaaggaggagaacagaagacaggggaaugugcuag

SEQ ID NO: 5590 - RNA, 852 nt, Diabrotica virgifera
auguuucgaaaccaauacgauagugaugugacaguguggagcccccagggccgucugcaucagguagaauaugccauggaagcaguuaaccuagguucagccacagugggacugaaaaguaaaacucaugcuguacuuaucgcuuugaagagggcuucuucagaacugucugccuaccagaagaaaauuaucaacauagacgaucacauugguaucaccaucucgggacuuacagcugaugcuaggauccuuaguagauauaugcgaaacgaaugcuugaauuauaaguacucuuuggauacuuauaugccauugaauaggcuuaucaguauuuuagguaacaaaaugcagacauguacccaaagauacgaccgcagaccauucgguguaggucuucuaguagcugguuaugacgaaucugguucucauaucuaccaaacgugcccuucugcuaauuucuacgauugcaaagcuauguccauuggagcucgaucccagagugccaggacauacuuagaaaaacaucuggaugaauugccaucuaguucuuuagaagaacuuaucaaacauggauugagggcucuuagagauacucuaccuccagagguugaccucacaacuaaaaaugucuccauaggcuacacuggaaaaggccagaccuucaaaauccuugaagaagaagaaacuucccccuacuugucccuuauugagggugaagaacguagaggaggaggagcugcagcugcugcaauugaggaccuuccugcagauccauugagagaugaugcgggggacgagcccagggaugcagucccagcuguggaaacuucugccauggauaccacagaauag

SEQ ID NO: 5591 - RNA, 2547 nt, Diabrotica virgifera
augccgauaaagccuggggaugaaacggaaaauauggaaauaaccuuuagugaugaagaucucccauaugaagaagaaauuuuaagaaacccuuauucaguuaaacacuggcuaagauauauagaccacaaaaagacagcaccaaauaauggcgucaauauaaucuuugaaagagcccugaaggaauuaccaggauccuacaaauuaugguauaauuauuuaagaacuagaagaaaucaaauaaaaaguaaauguauaacagacccagguuaugaagaagugaauaaugcauuugaaagaucauuaguguuuaugcacaagaugccuagaauauggauggauuauugcacauuuuugacagaucagugcaaaaucacuaggucaagaaaaguauuugacagggcuuugagggcauugccaguuacccagcacaacagaauuuggccucuguauuuaaaauuuguucaaaaacaugauauaccagaaacugcaguaagaguuuuucgaagauauaugaaauuauguccagaaaaugcagaagaauuuauagauuaccucacagguauugaaaggcuagaugaagcagcucagcugauggcaaagauugugaaugaugaggguuuuguuucucaacaaggaaaaucaaaacaucaguuguggaaugaacugugugaauugaucucaaagaauccagaaaagguacauucucuuaauguggaugccauuauuaggggugguuugaggagauauacugaucaacuaggccaccuauggaauucucuagccaauuacuauguucgaagugguuuauuugaaagagcucgugacauauaugaagaagcuauucaaacagugaccacuguuagggacuucacccaagucuuugaugcuuaugcccaauuugaggaacugaguuuaagcaaaagaauggaagaaguugcuaauaagucuaguccuacugaagaugaugauacugaauuagaauugagacuuggaagguaugcauauuugauggagagaagauuguugcugcugaauucuguuuuguugaggcagaauccacauaaugugcaggaauggcacaaaagaguacagcuuuaugaaggaaaaccaguagauauaaucaacaccuacacagaagcuguucaaacuguagauccaaaacuggcuguaggaaaacuucauaccuuauggguggacuuugccaaauucuacgaaaccaauggucaaauagaagauucacgccucaucuuugaaaaagcaucccaaguuucuuacgucaaaguagacgauuuggcaacaguguggugugaaugggccgaaauggaaauaaggaacgagaauuaugaugaagcuuuaagacucaugcauaaagcaacuguuaugccuagucgaaaaguagcauaucaugaugacacugaaacaguucaaagucgacuauauaagucucucaaaguuugguccauguacgcagauuuagaagaaaguuucggcaccuuuaaauccuguaaagcuauuuacgacaaaauaauagauuugaaaauugcaacaccucaaauuauuauaaacuaugggauauuucuagaagaaaauaauuauuuugaagaggcauucagagcguaugaaaaaggaauaucucuauuuaaauggcccaauguauacgacauauggaacaccuauuugacgaaauuccugacucguuaugggggaucaaaacuagaacgugccagagaucuguucgaacaaugcuuggauggaugcccacaacaguuugccaaacaucuuuaccugcucuacgcgaaacuagaagaagaacauggaauggcuagacacgcuauggcuguauaugaaagaucaaccaaagcuguuccagagcaagaaauguucgacguuuuuaauauauauaucaaacgagccgccgaaaucuaugggauucccaaaacgaggcagaucuacgaaaaggcuaucgagguacuuccagaggacaaaacuagagaaaugugucuuagauuuucugauauggaaacaaaacugggugaaauugauagagccagagcuauauaugcucacuguagccaaauuugugauccgaggauaacggcagaguuuuggcagauauggaaagaguucgaaguucgucaugguaaugaagauaccaugagagaaauguuaagaauaaaacguagcguacaagcuguuuacaacacgcaggugaauaugaugucagcacagauguugaguucggcgggcagcaugagcgguacaguagcggauuuggcgccgggaguuaaagacgguaugagacucuuggaagccaaagccguugaaauggcuggaacuucacaagucgccaaaccuggagguauuauguuuguuaggggagaaacucaaggagcuaauaaagauaagguuguuaauccagacgaaauugacauagacagugaagaaucggaagcggaagaagaaguaccagucgaaaagcagaacguaccgucagaaguuuuuggaagucuuaagaaacaaggacagggagacgaugacgauuag

SEQ ID NO: 5592 - RNA, 1176 nt, Diabrotica virgifera
auggccaacggaccgauagcagaaagaaaucgagaugccacuauuuaugugggaggccuagaugauaaaguuucggaguccuuauugugggagcucuuuguacaagcagggccuuuagucaauguacauaugccaaaagaucgaguaacgaccaugcaccagggcuauggguuuguagaauuuaugggagaggaggaugcagauuaugcuauuaaaauuaugaauaugauaaaauuguaugggaagccuauaagaguaaacaaagcuucggcucaucagaaaaacuuagacguaggagcuaacauuuuuauuggaaauuuagacccagaaguagacgaaaaauuacucuaugauacuuuuuccgcauuuggaguaauauuacaaacaccuaagauuaugagagauccugauacuggcaacuccaaaggguucgcuuucaucaauuuugcaagcuucgaagcaucagaugccuccaucgaagccaugaauggccaauauuugugcaauagacccauaucagugucuuaugcuuucaagaaagacucaaaaggagagagacauggaucugcagcugaacgucuucuugcugcucagaauccauuaucacaggcugauaggccucaucaacuguuugcugaugcaccuccaauagguuugaugcccauguccauggccccaccuccuccaccagucauaaugacaggaaugaugcccccaccgccuccaacacuaucaaacuugccaccuccuccuccaccuguaccaccaccaggaaugggaaguuccuucccagcaggaauaccaccuccuccauuaccucccucccaaccacccuuaccaccuggugcaccaccaacgaugccaacugcggcaggagcccaagccagacccccuuuaccaccgccuccaguggcaccucauggacugauaccuccaccuccaacguggacaggugcagcuccugggagcuugcccauuccuccagguccaccgacuccugcaggaggugcuucauuugguggaauguucccgccucccccaccacccggaggaagaccaccaccgccuaacuggaggccuccuccaccaccaccaccagguuuugccggagguagaccagcuuucccuguaaggggaccuccaccacccccaccuacuuuugauacuaaaauuuga

SEQ ID NO: 5593 - RNA, 774 nt, Diabrotica virgifera
augggucguguaauucgugcacaacguaaaggugcgggaucuguauucaaaucccacacaaaaaagaggaaaggagcacccaaacuacguuauuuagauuucucagaaagacaugguuacauuaaggguguuguaaaagauaucauacaugacccuggccguggugcuccauuggcaguaguacauuucagagaucccuacaaguuccaaacuaggaaggaauuguuuauugcccccgaaggaauguacacuggacaauuuuuguacuguggaaagaaagcuaaccuucaaauuggaaauguauugccuguaggaacuaugccugaagguaccauuguaugcaacuuagaagaaaaaacuggugaccguggucggcuagcucgugcaucuggaaacuaugcuaccguaauugcccauaaucacgacacaaagaaaaccagaguuaaguuaccuucuggagccaagaaaguuauuccaucaaacaacagggccaugguggguaucguugcuggagguggucguauugacaaaccaaucuugaaagcaggucgugcuuaccacaaauacaaaguuaaacguaacugcuggccuaagguacgugguguugcuaugaacccuguugaacauccucacggaggugguaaccaucaacacauugguaaagcauccacaguuaagagaggaacaucugcuggucguaaagucggucuuaucgcugccaggagaacugguaggauuaggggaggcaaaguugaugccaagaaagaggauuag

SEQ ID NO: 5594 - RNA, 417 nt, Diabrotica virgifera
ggaauaauggcacguacaaagcaaacagcccgaaaauccacuggugguaaagcaccacgcaaacaguuggcaacuaaagcugcucgcaagagugcaccugcuacuggaggagucaaaaaaccucaucguuacaggccagguaccguagcccuucgugaaauuagacguuaccagaaaaguacugagcuacuuaucagaaaacuaccuuuccaacgucuuguccgugaaauagcucaagauuuuaagacagacuuacguuuucagaguucggcaguuauggcuuuacaggaagcgagugaagcauauuugguagguuuauucgaagauaccaacuuaugcgcuauucaugcuaagagagugacuauuaugccuaaagacauucaguuggccagaagaaucagaggagaaagggcauaa

SEQ ID NO: 5595 - RNA, 1593 nt, Diabrotica virgifera
auggcuaucaguuuguuaaauccaaaagcugaaguggcuagagcugcacaagcccuagccguuaauauaucagcggcaaaaggcauucaagauguaaugaagucaaaccuuggucccaaaggaacagugaaaauguugguaucuggugccggcgauauaaaaauaaccaaagauggaaacguucuauugcacgaaaugcaaauucaacaccccacggcuucccuuauugcucgagccucaacugcccaagaugauaugaccggcgacggcacuacaucgacuguguuagucauaggugaacuauuaaaacaagcagauauuuacauagcagaaggucuccacccuagauuguuaacagauggcuuugauaaggcuaggacaaaagcguuggaaguacuggagaaaaugaagauuucaauugaagcgaacaaagaaacuuuaacagauauuugcaggacgaguuuaagaacaaagcugcaucaaaaacuggcugauguuuugacagacguuuguguggaugccguucuagcuauaaagaaagaugacaaaccuguugaucuucauaugguugaauuaauggaaaugcagcacaaaacagaaacagauacucaguuaauuaaggguuuaguccuggaccauggcucccgucauccagauaugccuaaaagucucaacaacugcuacauuuuaacauguaaugucagcauggaauaugaaaaaagugaagucaauucaggauucuucuacaaaacugcagaagagagagaaaaauuagugacugcagagcgugaauucauugagcagagaguuaagaaagucauugaacugaaaaggucacucuguaauggaacugauaagacuuuuguuguuauuaaccaaaaagguauugaccccaugagccuggauaugcuugccaaagaaggaauaauagcucucagaagagcuaagagacguaacauggagcgucuaucauuggcuugugguggaguagcuaugaacagcuuugaugaucugcaagaaucucaacuugguagagccggacauguauaugaacauguguugggagaaaauaaguauacauuuguggaagauugcaaaauuccucaaucaguuacuauuuuaaugaaagggcccaauaaacauacuuugacucagauuaaagaugcaguuagagauggauuaagggcuaucaauaaugccauugacgauaaagcaguuauuccaggugcuggugcauuugaagucacagccaauaaagaauugcuagcauuuaaagacacuguuaaggguaaagcucgucuaggaguugccgcuuaugcagaagcuuuacugguaguucccaagacuuuggcuguuaacucuggauuugaugcacaggacaccauucuaaaacuacaagaagaaucccguuugaauccagacccaaucgguuuagaucuaaccucuggggaacccaucaauccuaaagaugcuggcaucuaugacaacuauauuguuaaaaaacaaauaaucaauuccuguucggucauugccagcaaccucuuauugguugaugaaauuaugagggcuggaaugagcagcuuaaagggauaa

SEQ ID NO: 5596 - RNA, 3120 nt, Diabrotica virgifera
augucuagugguaguuuagcagacaacuccaucgauccuccagccaaaaagcggaagcuugaaucaaagauugcuacccucgaaauggcgaacaaugaagcuucaggauccuccaccagugauauugaugagggacuuuacucaagacaacuguacguuuuggggcacgaagcuaugcgccgcauggcaaauagugauguucuaauaucagguuuaggugguuuggguguagaaguagcuaaaaauguaauucuuggugguguuaaaucuguuacccuucacgaugaggcucuuuguacuauuaaagaccugucaucccaauuuuauuuaacagagggggacauugguaaaaaccgcgcagaagccugcuguaagcaguuaucugaacucaacacuuauguccccacaaagucuuacacagggccccuugaugaagcuuucaucuuaaaguucagugcuguugucuuaaccacaagcaaucgugaagagcaacuaagaaucagcgagauaacacaugaaaacaacauugcauuaauuauagcagacacgaaaggccuuuuugcacaaguauuuugugauuucggaaaauccuuuacuguuguagauguaaacggagaaccuuuagucucugcgaugauagcagacauuucgaaugaugucgaaaguguagucacuugcauugacgauacaaggcaugguauggaggauggagacuauguuaccuucucagaaguucagggaaugacugaauuaaauaacugugaaccaaucaaaaucaaaguauuaggaccauacacuuuuaguauuggugauaccaccaaguuuucuaaauacacccgaggugguauuguaagucaaguuaaaaugccaaaacaucuggaauucaaaucauuuaaagauucucuugaaaauccugagauaccgauuacugauuauucaaaaauggauuuuccuacgcagcuucaucuagcuuuuaccaccuuacauaaguuuguagaaaagucugcaaggcuaccuaaaccauggaacaaugaagaugcaacagaauuuguuaauuuagcuaaaucguuagcugcaaagggugauucugaaggagaaguuaauguagaccucuuagacacauuugccaagguaucggcuggagauuuaaauccuauaaaugcuacuauuggugguauuguagcccaagaaguaaugaaggcauguucuggaaaauuccaucccauuuuccaaugguucuacuaugaugccauagaaugccuaccacaagauaaaucagaaaucacugaagaacuagcugcacccacugguagcagauaugauggccaaguugcuguuuuuggaaaagaauuccaaaagaaguuagcaucacugaaauauuuuauuguuggugcuggagcuauugguugugaauuguugaagaacuuugcuaugauggguguaggaacacaaggagaaguuacaguaacugauauggauuuaauugaaaaaucuaauuugaacaggcaguuccuuuucagaccacauaacguccaacaaccaaaaucugccacagcugcaaaggucauuaaaaagaugaauccugauaucaauguuguugcacaugaaaaucguguuggacccgaaacugaaagugucuacaaugacgauuucuuugaaaagcuugauggaguugcuaaugcacuggauaauguagaugcuagaauuuauauggauagaagaugugucuacuaccgcaagccucuucuagagucuggaacccuaggaacuaagggaaauacucaagugguggcaccuuuccucucugaaucauacaguucuucucaagauccuccagagaaaagcauuccaaucuguacuuuaaagaauuuccccaaugcuaucgaacauacucuacaaugggcaagggauauguuugaaggauuguuuaaacaaaaugccgaaaaugcuucguuguacauaacagacccugauuuccucgauaggacuguuaagcuaccugguguacaaccuuuagagguauuggaauccguaaaggcugccuuaauugaugagagaccuaaagauuuaaaugauugcaucgcuugggcacguaaucauuggcaagaacaguauuccaaccaaauuaggcaguuguuguucaacuuuccuccugaucaauuaaccaguacggggcaguuguucuggucgggaccgaagagauguccagaagcgcuuacuuuugacguaaaugauccccugcacuuggauuauguuauugcugcagcuaauuugaaggcugaaguuuaugguauaccaacuaguagaaauagagaacaaaucgcagaagugguuaugcaagucaauguuccagaauucaucccuaaaucuggcguaaagauagcaguuacggauucucaaauggcuaugaaugguaauaauguggauuuggaucguguuucccaaauuaaagaagaauuaccuucaguagcagaacuagguggacuacgucuuacuccuuuagaauuugaaaaggacgaugacaccaauuuccacauggacuuuauaguugcugcuucaaaucuucgugcagcuaauuacaaaauaccgccugcugauagacauaaaucaaaacuuauugcugguaagauuauucccgccauagcaacaacaaccucaguaguugcuggaaugguuugcuuggaacucuacaaacucaccagaaguuauacaucccuaacuccauucaaaaauaauuucauuaaccucgcucugccuuucuucaguugcucagaaccaaucgcagcccaacaaauggaauacugugguaacaaauggacacuaugggaccgcuucgacguucagggagagaugacgcuuagugaauuuuuggaauacuucaaggaaaaacacggucuugaaauuacgauguugucccagggcgucugcaugcuguauucguucuucauggcaaaagcuaaagcucaagaacguuucggucuuucgaugucagaagucgucagacgggugucaaagaagaaaaucgaaccucacguaaaagcauugguauucgaacuguguugcaacgauuccacuggugaagacguggaaguuccauauguuaaauacaauuuauguuga

SEQ ID NO: 5597 - RNA, 789 nt, Diabrotica virgifera
auggcagacgcugaugaucuauuagauuaugaagaugaggaacagacagaacaaaccgcaacugaaacggcaacuacagagguacagaaaaagggugucaagggcacauauguaucaauacacaguucuggguuuagagauuuucuguuaaaaccagcaauucucagagcuauaguggacugcggguucgaacauccuucagaaguucaacaugaauguauuccucaagcugucauuggcauggauauucugugccaagcuaaauccgguaugggaaaaacggcuguuuuuguauuagcuacacuccaaguaauagauccuacagaaaauguuguauauguucucgucaugugccauaccagagaguuagccuuccagauaagcaaagaguacgaacguuucaguaaauauaugcccaauauuaaaguaggggucuucuuugguggcuugccuauccagaaagaugaggaaacguuaaaaaauaauugcccgcauaucguuguggguacuccaggaagaauuuuagcauuggucagaucgaaaaaacuuaaucucaaacaucuaaagcauuuuauuuuggaugaaugugauaaaauguuggaguuauuagacaugagacgugauguucaagaaauauaucguaacacuccccacgaaaaacaagucaugauguucagugccaccuuaaguaaagaaauuagaccaguuugcaagaaauuuaugcaagauguaauucaaaauucuuauaauacacaauuuuguaaugacgcacccacucgcaauguuuga

SEQ ID NO: 5598 - RNA, 1470 nt, Diabrotica virgifera
augguaacucucgaagacguugaaaugaaaaaugcagacaguccuccaggauuagaagcuggugauacaaagaaagauaccgaccuacaaaguguaauagaaauucgugaacaugcaagacaaauagaaaaaucagucacaaguaaagaaaaccguuucaucuuacgaguuuuacguugcuugcccaacacuagaaggaagcuuaauggacuggugcugagaagccucauuacucaaauauauccuguagcugaacgugaugcccuccuuaguuucgucgaggaagcuucuggagaacucgacgccacccagucacgagcaagaucagcuguuaagucaccuguucccgagguagauacauauauaaaucuuuuaauacuaguacguuuaauugauaccaauaaguuaguugaagcagagcgcuguucucaagcucuuaugaauaaaauaacuaaccaaaacagacguacuauagaucauauugcugccaaguguuauuucuaucacucaagaguugcugaauugaccaacaaauuggauucaauuagaggguuuuuacauucucgucuacguaccgcuacacucaggaacgacuuugaaggucaagcugugcuuauaaauugccuguugagaaauuauuugcauuauucguuguaugaucaagcugacaaacuagugaguaaaugcguauuuccugaaacugcaaguaacaaugaaugggccagauucuuauacuacuugggcagaauuaaggcggcaagauuagaauacaguguagcacauaaacaucuugugcaggccaugagaaaagcaccccagaaugcugccauugguuucagacagguuguucaaaagcuuacuguuguaguugaacuacugcuaggagauauaccagaacgacagauuuuuagacaaucuaguaugaggcacucccuugccccauacuuucaacuaacacaagcaguuagaaugggcaauuugcaaagauuuggugagguguuagagaacuucggcccacaauuuagacaagaucauacauuuacacuaauuuugagacugcgccacaauguuauuaaaacagcuauaagauccauaggauuaucauacuccagaauaucuccccaagacauagcuaagaaacuggggcuggauucagcugaagaugcagaauuuauaguagcaaaagcaaucagagauggggugauagaagcuacacuugauccacagggagguuacaugaggagcaaagaaaguacugacaucuacugcacaaaggaaccucaacuggcguuucaucaaagaauaucguuuugcuuagauuugcacaaucaaagugucaaagcuaugagauauccccccaaggcguauggcaaagaacuugaaucagcagaagagagaagggaaagagaacagcaggauuuggaguuggccaaggaaauggcugaagaagaugaugaugguuuuccuuaa

SEQ ID NO: 5599 - RNA, 1668 nt, Diabrotica virgifera
auggcuaccaaucaccaaaaccuuccaauuucgaguauccuuaaaucaaaaagugaaguugaugaugaaccaaagaagaaaucaagagaagauuggcguaaagccaaggagcuugaagaagccagaaaagcugguacagcuccggcugcagucgaugaagaaggaaaagauaucaacccccacauuccacaguacauuucuaaugcaccuugguauuauggcacaucuggaccuacccuuaaacaucaaaggccccaagaagagaaacagaaggaguacucaaacaucgacgaaugguacaagcgggguguugacacuucaaaaauaguuacuaaauaucguaaaggugcaugugaaaauuguggagcuaugacucauaaaaagaaagauuguauggaaagaccucgcaaaguuggagccaaauuuuccggggcaaauauugcaccagaugaauuugcccagaaaaacuuagcguugagcuuugauggaaaaagagaucgauggaguggauaugacccaucugagcacaaagcaguaauagaagaguuccagaaaguugaggaagcuaaaagacaacugaaggcugauaaguuaaaugcaaacgaaucuucugacgaugaagaaaaagaugaggacaaauauguagaugaaguugauaugccugguacuaaaguagacagcaaacagagaauuacuguaagaaauuugaggauaagagaagacacugcaaaauacuugaggaaucuugauuuagguucugcuuauuaugaucccaagacaagaucuaugagggaaaacccuaauccugaaaaagaugcuacguacaguggagagaauuucguucguuuuacaggcgauaccaccaaucaugcgaaggcucaguuauuugcuugggaagcguaugaaaaggguguggauguucaucuuuuagccgaaccaacaaaacuagaacugcucaaaaaagaauacgagaaaaagaaggaacaggucaaaucaacaauucaaggcagugugcucgauaaguauggaggacaggaacauuuagaagcaccaccaaaaagcuuguuguuggcucaaucagaaguuuauguggaauauucgagaucugguaggguuauuacuggagcggaaaaagaaguuauuagauccaaauaugaagaagauguguacauaaacaaccacacaucaguguggggaucguauuggagaggaggacaauggggauacaaauguugucacuccuucauaaagaauuccuauugccuaggcgaggcaggaaaaacgguuaacgcuccuguaacccaagauauuccaaaagaucaagacguuggugaagcaagcaguacaaaggaagcugggauaucagacggugagagcgaagauaguaguuccaguaauucaucagaaggcgagaaacugaagaagaaacagagaagauuaaagaaaaaggaaaagaaggcaaagaaaaaggagaaaaaagcaaaagaaaaauuaaagaaaaaacaggaaaaagaaaaggccccagaaauagacgaggaaauaauguuggacgauagaaaaaggccguacaacaguauguuugacgcuaaaaaacccacagaggaagaaauggaggaauauuauaaaaagagaaagagggaugaagauccuaugaacaacuuuauguaa

SEQ ID NO: 5600 - RNA, 627 nt, Diabrotica virgifera
auggguauuaguagagaccauuggcauaaacgaagguccacaggaggcaagaggaagccucuccguaagaagaggaaguucgaauuaggacguccagccgcaaauaccaaacuuggagcacguagaauucacuauguccguacacgaggagguaacuugaaguaccgugcauugaggauugaaaaaggaaauuucgcauggggcagcgaagguacugcucguaaaacacguauuauugaugucguuuacaaugccaguaauaacgaauugguacguaccaaaacauugguaaagaaugccaucguuguuauugacgcaaccccuuucagacaaugguacgaaagccacuauauuuuaccuuuaggacgcaagaagggggcaaaauugacagcggaagaugaagaaauguucaauaagaaacguagcaaaaaaguacagaaaaaauaugaaacuaggcaaaaaacagcuaaaguagaaccugcauuagaagaacaauucucaacuggaagguuauuagcuugcuuagcgucaaggccaggacaaugugguagagcugaugguuacgucuuagaggguaaagaacuggaauucuacauucguaagauuaagucuaagaaagcuaaauaa

SEQ ID NO: 5601 - RNA, 936 nt, Diabrotica virgifera
auggauagacuucuucgacuaggagguggaaugccagguuuaacucaggcaccgccgccuucugaugcuccuguuguggauacugccgaacaaguauacauauccuccuuagcacuauuaaaaauguugaagcacggccgagcuggaguacccauggaaguaaugggucuuauguuaggagaauucguagaugacuauaccguucguguaaucgauguauuugcuaugccucagacugguaccggugucaguguagaagcuguugauccaguguuucaagcaaaaaugcuugacauguuaagacagacugguaggccagaaaugguuguggggugguaucauucccauccagguuucggauguugguugucuggaguggauaucaacacccagcaaaguuuugaggcucucucggaaagagcuguagcaguaguaguugauccaauccagucagugaaaggcaaagucguuauugaugccuuuagguuaauaaauccgaauaugaugguauugggccaagaaccucgccaaacuacauccaacuuaggacaucuacagaaaccaucaguccaggcuuugauucauggucuaaaucggcauuacuacuccaucaguauuaauuacagaaagaaugaauuggaacaaaaaaugcuacuaaaucuccauaaaaaauccuggauggauggucuaacuuuagcagauuacucugaaaauuguagugugaaugaaaagacuguagcugauauguuagaacuagccaagaauuacaacaaggcauuagaagaggaggagaaaaugacuccagaacagcucgcuauuaaaaauguuggcaaacaagauccuaagaggcauuuagaagaaaagguugauauuuugaugaccaauaauaucguccagugcuugggagcuaugcuagauacaguuguuuuuaaguaa

SEQ ID NO: 5602 - RNA, 1215 nt, Diabrotica virgifera
augacgguaauuaacaagauggagguggacggagguccgaagggagaagguuuucggucauauuauauuacaaagauugaagaauugcagcuuauaguggccgaaaagagucaaaaucuuagacguuugcaagcucagagaaaugaacucaaugccaaaguucguauguugagagaagaacugauguuacuucaagagcaaggaagcuaugucggagaaguuguaaagcccauggauaagaaaaaaguccuugugaaaguucauccagaaggaaaauuuguaguugacauugacaaaaacauagacauaaaugauguuacuccaaauugucgaguagcccucagaaaugaaucuuacacauugcacaaaauacuuccaaacaagguugauccuuuaguuuccuugaugaugguggagaaagucccugauucaacuuaugaaaugguaggaggacuugacaagcaaauuaaagaaaucaaagaaguaauugaacuuccaguuaaacauccagaacuuuuugaugcucuugguauugcacaaccuaaggguguguuguuauauggaccaccaggcacuggaaaaacucuucuggcacgugcuguagcucaucacacagaguguacauuuauuagaguaucugguucagaauugguacagaaauucauaggagaaggaucccguaugguaagagaacucuucguaauggccagagaacaugcuccuucaauuauuuucauggaugaaauugauuccauuggaucuucccguauugaaucaggaucugguggugauucugaaguccaaagaaccauguuggaacuucuaaaucaauuggaugguuuugaagcuaccaaaaacaucaaaguaauuauggcuaccaacagaauugauauuuuggaucccgcuuuacucagaccaggaagaauugacagaaaaauugaauuccccccaccgaacgaagaagcuagauuggacaucuuaaagauucacuccagaaaaaugaaccucacaagaggaauaaaucugagaaaaauagcugaguugaugccaggugcuaguggagcugaaguuaaggguguguguacggaagcugguauguaugcacuaagagaacgaagggugcauguuacucaagaagauuuugaaauggccgucgccaaaguuaugcagaaggauucugagaagaauauguccaucaagaaguuguggaaauaa

SEQ ID NO: 5603 - RNA, 600 nt, Diabrotica virgifera
auggugaaaauauauugucucaguguuuuauacaaaggaccaacaacugcaaccugguugaaaucagccuucgaacuucaaagcuucagcuuuuuccaaagagggucaauucaggaguucaugucauucuuuugcaaaaccauaguggaaagaacaauaccagccucaaggcagaguguuaaagaaggagaauauuugugucauguauauguacgagcugauaacuuagcugguguuaucauaacugaucaugaauacccaucaaggguuucucacacacuaauaacaaaaauacuagacgaauuuggugccaaaauuccugcagcuaacuggcccagccuugaggagagagauguaccauuuccacaauuaaauaccuacuuagcgaaauaucaaaauccuagagaagcagaugcuauuacaaaaauucaagaagaucuugaugaaacgaagauuauuuugcauaauaccauacaagcaguuuuggaacgaggcgagaaacuagacgacuuagugagcaagucggaagguuuaagcauacaguccaaggcauucuacaagacagcgagaaaaacgaauaguuguuguaguuuuacauag

SEQ ID NO: 5604 - RNA, 729 nt, Diabrotica virgifera
auguuucuuacaagaagugaauacgauaggggagucaauaccuuuucacccgaaggaagauuauuucaaguagaauaugccauagaagcuauuaaguuaggaucuaccgcuauuggaauaugcaccagugguggaguagugcuugcuguagaaaaacgcauuacuuccccauuaauggaaccuacuacgauugagaaaauuguagaaguugacaaacauauuggaugugcgguuucaggacuuauggcagauucaaggacuaugauagauagagcucguguggaaugucagaaucauugguuugucuacaaugaaaauauaaguguagaauccugugcacaagguguaucaaauuuggcuauucaguucggagauucugaugaagauggugcagccaugucuagaccuuuuggaguagcaauuuuguuugcugguauagaugaaaaaggaccucaguuguaccauauggauccaucaggaacauuuguucaguuugacgcaaaggcgauaggaucaggauccgagggugcacagcaaaguuuacaggaggcauaucaucgcaguaugacccuggaagaagcuaccacaacugcuuuaacaauucuaaaacaaguuauggaagaaaaguugaauucuucaaauguugagguuaugacuaugacuccaaaagauauguuccacauguucacaaaggaacaaguggaagagguaauugcuaaauugucuuaa

SEQ ID NO: 5605 - RNA, 1674 nt, Diabrotica virgifera
augucgauuuuagcaaguccacugucuguagccggcuccagaacaacgggagcuucgguucgcacucaaaauguuauggcagccucuacuaucgcaaauguuguaaagaguucauugggaccaguuggucuagauaaaauguugguugaugacauuggagaugugacaguaacuaaugacggagcuaccauuuuacgucuuuuagaaguugaacauccugccgccagaguauuaguagaauuggcucaguuacaggaugaagaaguaggagaugguacaacuucaguuguuaucauagcugcagaauuacuaaagaaugcugaugaacucgugaaacaaaagauacauccaacuucaauuauaaguggauacagauuagcaugcaaagaggcuuguagguacauucaggaucauuugacuauuccagucgaagaauugggaaaggagugcaucauaaauguugccaaaaccucgaugagcucaaaaauuauuggagcugaugcugaucuuuuuucacaaaucguugucgaugccgccaaugcuguuaaagugacagauucaagaggaaauagcauguaucccauaaaggcugucaaugucuugaaagcacaugguaaaagcgccagagagagcuuccuuguaccagguuaugcauuaaacugcaccguugccagccaagcgaugcccaaaaaaauuguuaacgccaaaaucgcauguuuagauuuuucauugcagaaggcuaaaaugaagauggguguucagguuuugauuacugauccaaaucaacuggaagcaauccgcacaagagagcucgacaucaccaaagaacgcauccagaaaauccucucuaccgguguuaauguuauucuugcgaguggugguaucgaugaucuuugccuaaaauacuucguugaaaauggagcgauggguguaagaagaguaaagaaagcugacuuaaaacgcauugccaaagcaacuggugccacuuuccuaacuucucuuaguaacauggagggagaugaaaguuuugauucuagcaugguaggagaggcagcggaaguuguucaagaaagaauuucugacgaugaauugauaauuauuaaaggaccaaaagcacguacagcagccucuaucaucuugcggggacccaacgauuucuauugugaugaaauggaaagaucuguucacgacgccuuguccguuguaaaacgcguacucgaaucgaaaagcgucguagucgguggaggcagugucgaagcagcgcuuucgauauauuuggaaaacuucgcaaccacgcuaagcuccagagaacaauuggcuaucgccgaauucgccaggaguuuacugguuauuccuaaaacguuggcaguuaaugcagcgcaggacgcuacagauuuaguagcuaaguugagggcauaccagaauuccagucaaacgaaaaaggaucaugcgcauuugaaauauguaggauuagaucucauggaagguaccguucgagauaaccgaaaagccggaguuuuggaacccaccauguccaaaauaaaaucccuuaaguuugcgacagaagcugccauuaccaucuugagaauagacgauaugaucaaauuggauuccgaacaaagaggcggaaagagcuaccagcaagccauggagaguggagaauuauaugauuaa

SEQ ID NO: 5606 - RNA, 756 nt, Diabrotica virgifera
auguuuaauucugcugcuccuccuuuguggcauaacggccccguaccuggagaauuuuacaauuuucccggcaaacagaccagcuauuccaacccuauaacacauacacagucucccguuacaacaucaacuucuguauuagcuauuacuuacgauaaaggaguauugauagccggagaucugguugcuucauacggaucuuuagcuagguacagaaauugcccgaggguuauuaaagucaaucagaauaucaucuugggagccggaggagacuaugcugauuuccaauacgucaagaguuucauugagcaaaaaauaauugaugaagaaugcauugaugauggacuaaaaaugaaaccaaaaucauuguacugcuggcuuacuagaguaauguaccaacgcaggaguaaauuagacccuuuuuggaauaaucugguuauaggaggaauccaggauggaguccccuuucuuggaaccguagauaaauugggaacugcauauacagacaaaguuauauguacagguuauggagcccacauagccuugccucuucugagagacucuuuagauaaaaauggagcucuuaacuuggccgaugccaaaacucugauucacaaaugcauggaaguauuguucuauagagaugccagaaguuuuccuaaauaucagcuugguguuauugauaaagaugaugguguuaguauugaggggccuauuucagucgaagagaacuggagcauugcccauaugacauaa

SEQ ID NO: 5607 - RNA, 2112 nt, Diabrotica virgifera
uuuaaaaauauggaauuuucaaaagaaccgaauuuucaauuauuaagugcuagggauuuuacuccagaaaaauauguuaaaaacuuaucacaaaguuauguggguggaucugaguuacaaaaccuuaggaggaaacuucaaucccuuucggaagagacuagcaauaauuugaagaaaaacguguaugaaaacuauguucaauuuauugagacugccaaagaaauaucucauuuggaaagugaaauguaccaguugucccauuuacuaucagaacaaaaaucauuauuaagugcucugucaacaacaucuauuuuagaagacacucaacacuugaauauugaaagagagaauaagaguaaugacaaggacauagaagaggaaaauaagcaaaaacuugcagccauuuuagaaaaaguggaaggaugcaaggaauugcuagaaguaccgggaagaaaauuucuauaugaaggagauuuguuagaaauugauccaacagaaaauacgucuuugaaaacuguucauguguauuuauuuacagauggauuuaugauaacaaauagaaauuccaauagucgagguuugaugaaguacauuuaugaaauaauguacgauuuaaguagucuagcagugguuaacgucagagauuuaggaaauguuaagcaugcauuuaaauuguuaauuuuuccggacacgagaguuuuucaauguucuucuaauuccaacaagaaagagugguuggacaaguuugaccaagcaaagaagacuagauuagcccaagagcaacauaagagggagucaauuucggaaaaaucacccucacgaucagcuucgauagagucuccuaguuauaacccuuuugacgaaguugaagacgauguaggaaccguucagccagaaugguuuuuggacauuccagaggaacuugauguguguguagcucaaagacacuucgaagaggcucuuucauuguugcaaaaagcuaaggaauauauuagccaaaugacggcugguaaugagaaacacgaucauguguuccucgauauucaaagaaagguugaacaacgacaaaauagucuuaccgaaguuuuaaugaaagaacuggaaguuaauccugauaaaucuuugcaagguggauugagggcugcuagaagagcaguaagguuauuaaaucaauuaggaagagaaaaucaaucauguaacuuauuccugaaauuguguagcaguauguugaggacacaguguaagcguguuaaaagagaaggauccaccacaacauacauacguaauuuggcgaguguaguauucacuaacaugugucauaugucagaugaguuucuaagggcuuuucccgacucaccaacuugugcuucagcguauguuguuugggccagcaacgaguuacuucuuuuuacuggacauuuuauaaaacaaguauuuaugccccagacuucgcugucaacugugacagaaugcauaguauuaguccgaacgcaaugugaaagguuauacaguuauggucuggauuuauguuaccaauuggauggugcuuuacgaucuuccuuagucaaagcuuuaaaagacgcaagagauaaacuuauagauucgaucaaacuuagagcccuagaagauaaauggaucccaauuaacuugcauuccaaguccgcuuugggaagauuucuacacgaacauucgcaaaugggauuaaauuuggagagcuauguuucaggugacacuuggauucaacugacagcaaguacuuuaucguuuacaaaaauguuuuuccaauuguuaaaugacuguaugaaguuaaaaacgacugaauugguauacaccauagacgaaacuuuguauaauguguucgacgcucaauugaaacacaaugaaaaugcucuucgcaaugaguuaaaucaggaccaaagaagcuuccuaacuaaaaaugcugaauuuuuacuggucaauguagucgaaguaucgcagaaaauauauagucaaaaugugggcuaugagugugcaacacuuaaaaaacuacaaggcgaauauguggcuuuaaaaaagggcguuucuccaacaaccagaaguacuaaaacaaaauacucaucugaauuuuuguaa

SEQ ID NO: 5608 - RNA, 3717 nt, Diabrotica virgifera
auggaugaauuacagaaauuggaauaucuuuccuugguuucuaagguuuguacugaguuagaaaaccaucucgguaugaaugauaaagauuuggccgaauuuauuauucaucuuuccgagaagaaugguacauuugaaucuuucaaaaaggcacuuauagaaaauggagccgaguuuucagauuccuucaucucaaauuugcuaagaaucauucaacauaugaaaccgaagaaaaauaaaucgaaaguugaagcugauguguaucaaaaagaaacucucgcuaccaaauuuccugguuuagcuuuaccaaacgaaaaacaaaaaccuuuguuuauagaugaagaagcaccugcugaaaaaaaugaagaugaugacauuguagccgaccuaaugaaacaguuugaagcggacgcucccucaaacagucaaauccaaacaacaacuaaaucuggaagugcaaguccuauagaaagaaaaagaucgucaagaaguaggucuagaucuaaaccaagaaaaagacggaaaucuagaucaagggacagggacucuagaaaggacaaaagacgaaguagauccagagaccagaagaaaaacagaagagauagaagugguucuaggaacaaaagaaauaaagaaagaaguaggucuaggaauaggagaagcagaucaagggauagaagaaguagaucgagagacaggagaaacagaucuaaggaucgaaaauacaaaaauuauucuagagauaaagauaggagagaaagaagcaauucuagggauauaaaacgggauagaaguacugagaagaaguucaaaagugaaaaagauaauccagaguuugaagaugauccuaccccaggaaaaauauauaauggaaaaguaucaaauauuguaccuuuuggaugcuuuguccagcuggagggacuuaaaaggagaugggaaggcuugguucauauuucacagcuuagagcagaaggcagaguuacuaauguaucugaaguaacaucuagaggagcuagaguaaaggucaaaguauugacgguaacaggucagaaggugucauuaucuaugaaagaugucugucagauuacugguaaagaccuuaacccacauucccaugcuccgacugaaagagaagauagagauagaaauccugacaggccuguaaacagcaguacgucuguauugagacugccaguaaacauagaugaaggagaagaagacucccggaaacgaguaacaaggauuucaagucccgagagaugggaaauaaaacagaugauuucaucaggauguauugcuaaaagugaguugccugauuuugaugaagaaacuggauuguuacccaaggaugaagauggagaggcugauauugaaauugaauuggucgaagaugaagcuccauuuuugcaaggucacgguagggccuuacaugaucuuaguccuguaagaauagucaaaaauccagacgggucauuagcucaagcugccaugaugcaauccgcuuuggcuaaagaaagacgggaacagaaaaugauucagcgggaacaggaagucgauucccagccuuccgguaagaauaagaguuggauagauccucuuccagaagacgaaucaagaaugaugggcagaggaauaggauuacaaguucaagauuuaccagaauggaaaaaacauguaauagguggcaaaaagucaucauucggcaaaaagaccaacuuaacaauaauagagcaacgucaauccuuaccaauauauaagcucaaagaagaauuacgaaaagccguaacagacaaucaaauucuuauaguuauuggugaaacugguucaggaaaaacaacgcaaauaacacaguacuuagcugaagccggauuuacgucgagaggaaagauugguugcacccaaccaagaagaguagcagcuauguccguagcuaaaagaguugcugaagaauucggaugucguuugggacaagagguugguuacaccauucguuucgaagauuguacuagucccgaaacuaugauaaaauacaugacagaugguauguuacuaagagaaugccucauggaccuugaccucaaacaauacucaguaauaauguuggaugaagcucacgaacgaacuauacauacagauguucucuuuggauuacuaaaacaagcagucaugaaacgagaagaacugaaacugauaguaaccucagcuacguuagaugcuguaaaauuuucgcaguauuucuucaaagcgcccauauuuacuauacccgguaggacuuuccccguugagguucuauauacaaaagagccagaaacugauuauuuagaugcuaguuugauaacggugaugcagauacauuugagagagccgccaggagauauuuuacuuuuuuugacuggucaggaagagauugacacugcuugugaaauuuuguaugagagaaugaaaucuuuagguccagauguaccugaacuuauaauucuuccuguauauuccgcguugccuuccgagaugcagacaagaaucuucgaaccagcgccaccugggagcagaaaaguugugauagcuacaaauauagcagaaacgucuuugacgauagaugguaucuacuacguaguugauccaggcuuugugaaacaaaaagucuauaacuccaaaacuggaauggauucauugguaguuacaccgauuucacaggcucaagcaaaacaacgagcaggucgugcugguagaacgggaccugguaaauguuacagacuauacacagagagggcauacagggaugaaaugcuuccgacgccaguaccugaaauucaacguaccaaccuugcaacaacaguccugcagcuuaaaacuauggguaucaacgaccugcuucauuucgauuucauggacgcuccgccgguggagucguuaauuauggcuuuggaacaguuacauuccuugucagcucuugaugaugaaggguuauugacacgauuaggaagaaggauggcagaauuucccuuggaaccaaaucuuucaaagauguugauaaugucaguugcccuacaaugcucagacgaaauucuuacaauagucagcauguuaucaguucaaaauguauuuuaccggccaaaggauaaacaagcauuggcagaccagaaaaaagcaaaauucaaucaacccgaaggugaccacuugacgcuuuuggcgguauauaauaguuggaaaaacaauaaauuuucuaacgcuugguguuacgagaacuuuguacaaaucaggacauuaaagagggcucaagaugugaggaaacaacugcuaggaauuauggacagacauaaauuggacguaguauccgcugaaaggaacaccguuagaguacagaaggccauuuguucuggauuuuucaggaacgcuggaaaaaaggauccccaggaagguuauagagcucuaguagauagucagguuguuuacauacauccuucaagugccuuauuuaauaggcagccagaauggguaauuuaccacgaacugguccaaacaacuaaagaguacaugagagaaguuacaaccauagauccaaaaugguuggucgaguucgcuccugccuucuucaaguucuccgauccgacaaaacucaguaaauucaagaagaaccagagguuggaaccauuguauaauaaauaugaagagccgaaugcguggaggauaucgcgaguacgaaggagaagaaauuaa

SEQ ID NO: 5609 - RNA, 1245 nt, Diabrotica virgifera
augucgucgaaaagaaaaaguaaagaaagcauaauugcuagggugaauuucccacuauauacucuucagauguuaacgucaaggcauguaaucguuggugguggaggagggacauccaaaacugguguacacaaugguuuugaaauauuugagauuuuucaugacggcacacgcuuugcagcaaaagaaguaaccagacacgaaacuggaggcaauguuguuaugaacuguucuguuuacagugauagaaaauauucucuuuugguagcuggacaagaaagugagugucaauuguacaaacugaauccuaaacuagucgaggaaguggaaaauaucgguaauaauacucaucucaggcaacggaauacaaaaaacaaagaaguuacagaugacaacaaaaacgugacaaaagaguuauauuuugauguuaaugcaauagaaaauguucaaacugacuuuaaugggagugaaccauuaucgagggugguaaaaauuaaucaugaugguacauuauuagcuacaggugguacagauggagauguacgaauauggaaguuuccuaguaugcaaccucuauuuauucuuaaggcacauacaaaagaaauagacgauauagauuuuaguagguuugacaauuaugugauuaccauagccaaagaugguuuagcaguauugugggauuguaugacaggaaaagaaagaacaaaacuaacauggaagcagccaggaucaaaauauuuauauaaacgguguagauuuggcguaauagaaggacuagacaagaaaugugcacuauauacaauauccaauccaauaggaguagcuaaaaaacaaaaauccuaucuccagcaauggauaccugaggaaaacaucuuaagaagguguauagaauuugaugaaaguuuggcagcuuuagcuguucgugaugaugguagauuuguugcgguugguacaauguucaguggaucaguguccauucuuguagcauuuaauuuacagaaaauucuaaccauuguuggagcacauuccauguucgucacugggcuugaguuucugcccacccagaacuugaaccauuccauuaguaguguaguagaagccgcagucuugucaauuucuguagauaaccaacuaugcauacauaccgugccauacagaaaaaccauaccucuguggauugcuaucgcacuuuuaguuuuaacuuuauuuuugacuuucucacuauguucauacuuagguuuguga

SEQ ID NO: 5610 - RNA, 1242 nt, Diabrotica virgifera
auggccggagcaauguuauuugaaagagccccgucuguuucuucucaacacgagaagcuuuuaaaauuauccagggauucagaugaugaagaucaaaauauugucaauaaagaacaagacauccuuaaucuuggugagaaauauaaaaaggagggcaaggcaaaggaacucgcagagcuuauaaaggccaccaggccuuuuuugaguuuaauaagcaaagcaaaagcugcuaaauugguaaggucucuaguugacuacuuccuagauuuagaagcugguauugguaucgaaguacaacucugcaaagaauguauagaaugggcaaaggaagagagaagaacuuuucuacgucagucccuugaagccaggcugauugcucuuuauuuugacacuggaauguacagcgaagcgcuacaacuggaaucgaccuuacugaaagaguuaaaaaaguuggaugacaaaaauuuguugguggaaguacaacuacuugaaagcaaaacauaucaugcuuuaaguaauuuaccgaaggcuagagcugcacuaacuucagcacgaaccacagcuaacgcuaucuauugcccuccaaagaugcaggcagcuuuagauuuacaauccggaguauuacacgcugcagaugagaaggauuucaaaacagcuuauucuuauuuuuaugaagcuuuugaagguuuugauaguguugaauccccaaaagcccucacagcccuuaaauacaugcuuuugucaaaaaucaugauaaacaguccggaagacguccaacaaaucguuagugguaaauuggccuuuaaauacgcuggucaagauauagaggcuaugaaaucaguugcacaggcugcacacaaaagaucacuagcagauuuccaacaagcuguaaaacaguuuaaacaugaauuagaagaugauguuauuguuagagcacauuuaggaacguuguaugacaauauguuggagcagaaccuuugcagaauuaucgaaccauauucuaggguacaaguagaguauguagcaaaaaccauaaaacucccaguacuacaaguagagaagaaauugucacagaugauuuuagaugccaaguuucauggaauuuuggaccaaggcgaagguguccucauaguauucgaagaaagugcaguagacaaaacauaugaaauggcccuagaaacgauccagaguaugagcaaaguaguagauacucuuuaucaaaaagcaaagaaauugucauag

SEQ ID NO: 5611 - RNA, 1767 nt, Diabrotica virgifera
auggcaucgaaaucaaaaaaagggucaacaccguuagcuucacagcggccggcgagccccuuaaguccuaccagacauucuagauuacaggagaagcaugaacuucagaaucuuaacgaccguuuggcgggauauauagaucgaguaagguauuuagaaggugaaaacaacagauuaacgagggaaauacaaaguacccaggaaacaguaacaagggaaguuucaaacauuaaaucuauguaugaccaugaauuaucagaugcuagaaaacuauuagacgagacccaccgugaaaaagcacguuuagagauagauguuaaacgucuuuuagaagagaaugacgaacucaagucugaguuagcaaagaagaacaaggauuuggcucuagcugagaauucugccaggauauacgagaccagauguaacgaguuacagcucaaagcaaaucaagcggcugcugaugcuaagaaagcuauugcagaugcuaaggaacuugagaaagaacgugauaagcuacgcaaacuucuugauaaucaucguaaacaguuagaagaagaaucauuagcgagaguggaagucgaaaaugccaaccaaagucuucgagaagagcuguccuuuaaggaucagauccaucaacaacaguugacagaaacucguacucgucgucaaguagaaaucagcgaaaucgacggucgccuggcagaaaaauaugaggcuaagcuucaagaggcucuacaagaacucagagaucaauaugaaagucaaauggccaacaaccguggcgaaaucgaguugcuuuacgaacagaagauuaagaacuugcaaucagcuaaugacagacaugcugccucugccuccggugcucuugacgaauugagacaaguuagaaccagaaucgauacuuugaauucucgaauuagcgauuuagagaaccagaacgcuggcuuagcagcucgugcuagagauuuggagaaguuguuagagaaugagcgcaugcgccauguggaagaccucgcaauguuagaaagagaauugcauagacuccgagaagaaauggcuaaucaacuucaagaauaccaggaucuuauggacauuaagguuucucuugauuuagagauagcugcuuaucggaaacugcucgaaucugaagaagcucgucuuaauauuaccccaacagguagugaaguucaugaaguaacucacaguaggagccaacgcagcucgucgcaacgucgcacuccagucagauugggagccaaaagaaagcgaacacuacucgaagaaagccaagagucaagcaugaaugacuauacggugaacagcuccucaaaaggugacauugaagucgcugaugucgauccagaaggacacuauguuaaguugcacaauaaaaguaaucaagaagucgcacuuggaggauggcaagucauuagacguguuggugaggaggaaacuacauucaaauuucacaggucacuaaagcuugaagguaauggauuuguaacaauauggagcucugaccucaacaaagaucaugaaccuccaacuaauuuaguuaugaagagucagaaauggguuguaggugauaacauggucaccacauuauugaauaauaacggagaugaaguagcugucuccgaaagaguuaaaaggcaauuaacaagcucccaucuaagacacagagaacuagcagcuggcuaccucucagaagaacuccaccaucaacagggugauccacaaguagaugaaagauguaggcuuauguaa

SEQ ID NO: 5612 - RNA, 2412 nt, Diabrotica virgifera
auggccgaaaacaaaaauccagaggauuuggccaccgcaauucuccguaagaaagaucguccaaauagacuuuugguagaagaagcaguuaacgaugauaacuccgugguugcuuugucacaagcaaaaauggaugaacuacaacuuuucagaggagacacaguccuacugaagggcaagcgaaggaaagaaacuguuuguauaguauuaucugaugauacauguagcgaugaaaaaauucguaugaauagaaauguuagaaauaauuuaagaguuaggcuuucagauguaguuucuauccaagcuugcccugauguaaaauauggcaagagaauacauguacuucccauagaugauacaguggaaggacucacaggaaaucucuucgaaguauaccugaaacccuacuuccuggaggccuaucgaccaauacacaaagaugacguauucguuguacguggaggaaugagagcuguugaauucaaagucgucgagaccgaucccgcuccguacuguauaguggcuccagacaccgucauucauugugauggagauccaaucaagcgcgaagaggaagaagaagcucuuaacgcaguuggauacgacgacaucggagguuguagaaaacagcucgcucaaaucaaagaaaugguagaguuaccacugagacauccuagucuuuucaaggcuauuggaguuaaaccaccaagagguaucuuacuuuacgguccaccggguacugguaagacacucauugcacgugcaguagcuaacgaaacuggagcguucuucuucuugauuaacgguccugagauuaugagcaaauuggccggugaauccgaaagcaaucuucguaaagcuuucgaggaagccgacaagaauuccccagcuauuauuuucauugaugaauuggaugccaucgcucccaagagagagaaaacacacggagagguggaacgccguauaguaucccaacuucuaacuuugauggacgguaugaagaagaguucccacguuaucguuauggccgcuacuaacagaccaaacucaaucgauccagcuuuacguagauucggaagauucgacagggaaaucgauaucggaauaccugaugcaacuggcagacuugaaguuuuacguauucacaccaagaacaugaaauuggccgaugaugucgacuuagaacagaucgcugcagaaacucauggucacguaggugccgauuuagcuucacuauguucggaagcagcccuucaacaaaucagagaaaaaauggaccucaucgaccucgaagacgaccaaauugacgcagaaguccuaaacucacuggcaguuaccauggagaacuuccguuacgccaugacgaagagcagcccaagugcuuuacgugagaccauaguagaaguaccaaacgucacuugggacgauaucgguggcuuggcuaaugucaagaaagaguugcaagaauuggugcaauauccagucgaacauccagauaaguuccuuaaguucgguaugcaacccuccagaggaguguuguucuaugggccgccugguugcgguaaaacguuauuagcuaaggcuauugcgaaugaaugccaagccaacuuuaucucaguuaaaggaccagaguugcuuacuaugugguuuggugaaucagaagcaaaugucagagauaucuucgacaaggcucgaucugcggcaccuuguguucuauucuuugacgaauuagauucaauugccaaaucgcgugguggaaauguaggugaugccgguggugcagccgacagaguuauuaaucaaauucuaacagaaauggacgguaugggagccaaaaagaacguguuuauuaucggugcuacaaacagaccagauaucaucgauccugcaauauugcguccaggucgucucgaucaguugaucuacaucccucuacccgacgagaaaucuagggaagccaucuucaaagccaacuugaggaaaucgccuguagcuaaagacguagaucuuguauacauugcuaaaguaacucauggauuuucuggugccgauuugacugaaaucugccagagagcuugcaaacuggccaucaggcaaagcaucgaaacagaaauuaggagagaaagagaaagggcuuugaaccccaauguugcuauggauuuggacgaugacgauccagucccagaaaucaccagggcccacuucgaagaggccaugcguuucgccagacguuccguuucagacaacgacaucagaaaauacgagauguucgcccagaccuuacagcaaucucgcggauucgguaccaacuuccguuucccgacagcagcugguggaccugcugcuccaggagguaccggaggagaccaggccaacuuccaggacgauccugaagacgaucuguauaguuaa

SEQ ID NO: 5613 - RNA, 825 nt, Diabrotica virgifera
augggagaccaguuugauugugcuuuggacuuaaugaggagauuaccuccucaacaaauugaaaaaaacuuaagugaucuuauugauuuaguucccagucuaugugaagaucuauuaucaucuguggaucagccuuuaaaaaucgcaaaagauaaagaaacuggaaaagauuaucuucuuugugacuauaauagagauggagauuccuacaggucaccaugguccaauacauacuacccgccccuagaagaugguucaaugccaucugaaaaguuaagaaaacuagaacuagacgccaaucuugcauuugaucaauacagggaaauguauuuugaaggagguguaucuucuguuuauuuuugggacuuagaccauggauuugcaggagucauucuaauuaaaaagacuggagaugguaguaaaaagauuaaaggguguugggauuccuuacaugucguagaaguacaagagaagaguucgggaagaaacucccauuauaaaaugacuucaacugcuauguuauggcuucaaacuaauaaacagggaucuggaacuaugaacuuggguggaagucugacucggcagaucgaacaagaugcagcuguaaacgauaucaacccucacauagccaacauuggaagaaugguagaagauauggaaaacaaaauucgcaauacauugaacgaaauuuacuucagcaaaacgaaggacaucgucaacagucugcgaucaguucaaccacugaccgaaagccgggcacagcaggcacuuaagcaagaccucgcggcggcccuucaacguagacaaaacaaaacugagaacuga

SEQ ID NO: 5614 - RNA, 4167 nt, Diabrotica virgifera
auggaacgcccaccccgaaacgaacccacuguggacccagugaauggagugguccaaccacuaguccagccaccuccagagaguccgggccgcgucaccaaucaacuucaguuuuuacagaaaacuguguuaaaggcugucuggaagcaccaauucgcuuggcccuuccagcaacccgucgaugcuagaaaacucaacuugcccgacuaucauaggauaauuaaacagccaauggaccugggaacaauuaagaaaagacuagacaacaauuacuacuggucgggcaaagagugcauccaagacuucaacacgauguuuacaaacugcuaugucuacaacaagccuggagaggauguuguugucauggcucaaacguuagaaaagguauuuuugacaaaaguggcggauaugccaaaggaggaauuuguuguugaaucgcccgguaaagcgggagcggcaaaaggaaagaaggggcggaccaguacagcgggcgcugucagugcacccccaacaccaacuacagccaccgcugguucgggaggcagggguaggccucccgccacugucucuucuacaagcgccacuccaguugcuaccacuacaggaucuucaggguuaccuuuaggcacucaagcaccggcuacaguaccuggcagcaccgcaacuaccaccauagcggcggccagcaccaacaacagcucucugucgaaucagcaacugaacucuucuuccaguuccauucacggaagcggcuccaguuuaggaaauuccuuagauuccagcagcgucaugccugccaacguuauaccuccggcacaaccagccaagguaaaaaagggcgugaaaagaaaggccgauacuacgacgccugcuacagccuacgauuauccgccaacuuuggagucgaagucugcaaagauaucgacgcgccgagaguccgguaggcaaaucaaaaagcccaccaggccagaacuggacggucauccgccacaacccccuccacuuaaaccaaaagaaaaacuaccagaaucacugaaagccugcaaugaaauccuccuagaauuguucucuaagaaacauucuaguuacgccuggccuuuuuaucaacccguagacgcagaauuacucggucugcacgacuaccacgacaucauaaagaaaccgauggauuuuaguacuguaaaaaauaaaauggaaaaccgagaguaucgcacuccucaagacuuugccgccgacguuagacugauuuuuaguaauuguuacaaguacaacccuucugaccacgaugugguugcuauggcgaggaaguugcaggauguguuugaagugaaauaugcaaagauucccgaugaaccugucaauaggguaggagccccugccguuaauaauauaccugccaaaucagaaacgaguacauccgguuccaguucggauucuucuagcgacacggaagauucggaggaagaaaggcgaaacaaacaacugaagcugcuagaaaaagaguugacggcaaugcaagaaaaaaugcguaaauugguagacgagagcucgaaaaagaaaaaagaaaagaaaaaggacaaagugaaaaagaaaccgacaucaggugggucucuggcgaacgccucacuaucaacucuaccgaacagcagcagcgcgggcuuggguaagccgggugccgguggucacggggcucuaaacaagucaaacaacaacaacucaauagcggcggacagcguugacgacagcaucgccaguguugugucgggggccgaucuaaagauggccgagucgcaccauccgcaaacuggaacaggcgcucaccauccgccggcaggcaaaucccugaacaugcaucacaacaugacggcuaacgcuggcgccaacgcuuccgcgcaggcuaaaacaccuaaaaguaaaggacuccgcggcaauaaacccgcugcagcuaccaacgcggcucccaacaagagggucaaagccaacaacaaagcuggugcggguaggaagaagaacgcagcacaaccaccaccuaugcaguucgauucugaggacgaagacaacgccaaaccgaugucuuacgacgagaaacggcaguugucuuuggauauuaauaaauuaccaggugacaaauuggguagaguuguacauauaauccaauccagggaaccgucguugagggauuccaauccugacgaaaucgagaucgauuucgaaacgcugaaacccucaacacucagagaauuagagaguuacguugcgucgugucuucgcaaaaagccacauaaaaaaguagcgggcaaaucuaaggacgaacaaauagcggagaagaagcaagaguuagagaaaagacuaauagacguaaacgauaaaaucggcaacuccaagaaggcccccaaaaaagaugaagccaacaagguagacccaacgggcgcgggaggucccucaggccgccuauccucuaguuccagcaguucggacuccgacagcaguaguagcaguuuguccucuaguucuagcgacuccagugacagugaagcaggugggacggcgaaccggcaggccaaaaagaaagcgaauaaaaaaucacccaauccuucucuaggcaguuccaccaccacuacgacuauaaaagugccgccgccucaaacgacggcaacaccugcaccgccgucacaagccgcaccagcuaucacgacagcagcaaccgcuaauuuaaccacaacuguaaccguaccaccacuuacuaccacaacgacaaauacgauagcuccaccaauucaaccggcgccaguuccaaacgucgcaguucccgcgcaaacgacgccagccgcacccgccuucacgccgagcauaaccaucaaaccaucacuacaggccgccccuaucgcuccgacggugccgccucuuaucaagucaaucgagaaacugccugucacaacucucuuaccuccuaccguuccuacgauaacgccuccaacaguaccucaagcucccaaaucgguagcgcuaccgacuccuucuccugauaaaccuaaaccuaacauuauuucucccauugguaccuuuaccgacccuaucgaacaaucauuggcuagucuugaacacgauauuaagcagaaugauccuauggacgucauuacggcgucuacuaugaugcaaaugccuacuacacuaaccaauccuaucgugucacauccacauccuaacuuaaacuuaaaucccaccauuaaccauccuauuuuacagccuagcacacuuaguauggacuugaaagcgccuauuaugggcacuauggcgccgagcaauaccauguugcaucacggauugcaacaagcaauggaaacggauaucaguauaccuccaccccccaccaacaugcugcauggacagaacaacgguuuuggcaugaaacacaauuuugaucugacuacaaacaacaacggucuuuccucgaugggucugcccauggaaaugucgauaucgucaauguuugauccaauuccacaaaauauuaaucccaugaugaagaacgauucccaacucaagauggacgaucgcauggauaccuuagguggacuuuugaacgacaagaaguccaaucuccucauacaaaagccgaugucgcagucguuugguuucaagaaugacaaaccagaucauaacgucaaaaacgcuaguuccuggucgaguuuggccaaaggaaaaucaccacaaaacaauauuccgggcggcagcaguaaacaacaaguuauggauaguuuuaaggcauuccaaaauaaagcuaaagaaaaggccgauagagagaaacaaaggcuggagaacuuagaaaugaagcggcaacagagggaacaagcggagagggagagguuacgggcggaaaacgaaaggcgaagggaacgggaagaagaagaugcgcucgagaaagcaaggaaggcuguagcggagcagcaacagccuauagcaagccaaaggguggaagaacugaggucgucgccuggugaaggaaguacaucuccagguuccuuaaguucugguuccgaaaggauaucggagcgagaaaggcagagguugcaggagcaggaaaggcgaagaagagaagugauggccaauaagauagauaugaacaugcagagugaucuaauggcugcuuucgaagguucguuauga

SEQ ID NO: 5615 - RNA, 1224 nt, Diabrotica virgifera
augucguuauccaccgcucgcccauuagugagcguauacaaugagaaguccgaggaaguaaaggguucaaauauuucacuuccagcaguuuucaaggcuccaaucagacccgauguagucaauuucguucaccaacagguuucuaugaaccaucgucaacccuacagcguuagugacaaagcuggacaucaaacaucugcugaaucaugggguaccggacgugcuguugcucguauuccccguguaagaggaggugguacccaccguucuggucagggagcuuucgguaacauguguagaggugggcgcauguuugcaccaaccaagccauggcgucgcuggcacagacguguaaacaucaaucaacgucguuaugcuuuggcauccgcuguagcugcuaguggugugccagccuuaguuaugagcaaaggacaugucaucgaccaaaucccugaauugccauugguugucagugacaagguacaagaaaugagcaaaacuaaacaggcuguccaguucuugaggagaaucaaggcaugggcugacauucaaaagguuuacaagagucaacguuuccgugcugguaagggaaaaaugcguaauaggagacgcauccaacguaaaggaccauugguuguuuacuacaaagaucaaggucuucgucgugcuuuccguaacaucccaggcauugaccucauuagcguacagaaguuaaauuuguugaaacuugcuccugguggucauguaggucgcuuuguuauuuggacugaaucagcuuuccaacguuuagauaaauuguucggcacauggaaaacagcaucauuggaaaagaaggguuacaaucuaccccagccuaaaauggccaacacugaucuaucuagauuguugaaggcugaugaaaucaaagcuguauuacgugcuccucaaaagaagguuguacgucguguacgucgucucaauccauugaccaacgcuaaggccaugcuuaaguugaauccauaugcugcuguacucaaacgugaagccauuuugaagaaucaaaagagacaguuaaacagggaagaacuuuuggccaagaaacgugguauuaccgugagugccgacaacgucgugauuagauccagaaaauugcaagaaaggagaagggcacaaaucuugaaagauaagaaaucaaagccuaagaaggccaagaaggcuccagccaaggccgcaggaaagaaauaa

SEQ ID NO: 5616 - RNA, 5472 nt, Diabrotica virgifera
auggcagacuucauagauucugaagcagaagaaaguagugaggaggaggaauuagaucauagggaucguaaaaaagcccaaaaagccaaaguuguagauaguucagaugaagaugaugaagaugaugacgaaagacugagagaggaauuaaaggauuugauugaugauaauccuauugaagaaagugaugcugagucugaugcuucaggaagggaaaaacguaagaaaucugacgacgaggauuuggaugaucgacuggaagaugaagauuaugauuugcuugaagaaaauuuggguguuaaaguugaaagaaggaaauucaagcgacugcggcguuuugaagaugaagaaagugaaggagaagaagaacaugauccugaacaagauagggaacaaauugcuauggauauauuuucagaugaugacgaugaaagacgaucagaacgaagucacagaccugccgucgaacaagaaacuuaugguguaggcgaggaagaagaggaaggggaguacucggaugccgaugauuuuauaguugacgaugacgguagaccgauagcugaaaagaagaagaagaaaaaaccaauauuuacugaugccgcucuccaagaggcucaagaaaccuucggugucgauuuugauuaugaugaauuuaguaaauacgaugaagaugauuacgaagaugaagaggaggaggaugacgaauacgaggaagaugauguagagaaaaggaaacggccuaaaaagacuucaaagaaaaaaccgacgaagaaauccauuuuugaaguguaugaaccuagugaacuuaaaagaggguucuuuaccgaucucgauaaugaaauccgaaacacugauauucccgaaagaaugcaacuucgugauguuccaaucaccgcuguuccggaugacucaacugaacuugaugaugaagcagaauggauuuacaggcaagcguuuuguaacagaacuguuuccaauguggauucucauuuaucaucagaggcaagagagaaauuaaagaagacucaucaugccaucggaaaaaucagaaaagcauuagauuuuauaagaaaucaacaauuagaaguaccguuuauugcuuuuuauagaaaggaguauguucaaccggaacuuaauauuaacgauuuguggaaaguauauaaauacgaugcaaaguggugccaauugaaaacacgcaaagaaaaccucuugaagcuuuuugaaaaaaugaggucauaucaaacugaccacauaaugaaagauccagaugcaccaauuccagacaaccuucguauuaugacugaguccgacauugagcgauugaaaaauguucaaaccgccgaagaguuaaaugacguucacaaucauuucauuuuauauuaugcugcagauuugccagccaugcaugccgcguggagagucaaagaaagagaaaggagaagacaggaaagaaaggaggcuagacuuaagcucaucgcugaaagugaagaaggugcugaaauuccugaagagccugaggaaauugacgaugaugaaccagaagcugaaaccuuaaaauacgccaauagaucaggcagcuaugcacuauguaauaaaggagguuuggguccucuagcgaagaaauuugguuuaacgccugaagaauuugccgaaaaccugagagauaauuaucagaggcacgaaguagaucaagaacauauagaaccuguagaagucgcuaaagaauucguaucgccgaaauuuccuacaguggaagaaguguugcaagcuacuaaacacaugguagcuuuacaaauagcaagagaaccauuaguaaggaaaugcguaagagaaauuuucuuugaacgagcuagauuaaacguuuauccaaccaaaaagggugugaaaguuauagaugaagcucauaauugcuauaguaugaaguauguaaaaaauaaaccaguaagagaucuugcaggcgaccaauuuuuaaaauuauguuuagccgaagaggagaaccuccuuacuauuaccaucaaugaccauauucaaggaaacacuacuaacaauuacauugaugaagucaaacaauuauauauaaaggaugaauucagcaaacacguucaggauuggaaugcgcuaagaauggaaucgguagaaagggcuuuaacgaaaagugucuuaccagauuuaagaucugaauuaaaacgaacguugcucacagaggcuaaagaauucguauuaaaagcuugcuguagaaaauuauauaauuggauaaagauugcuccauacgcaauaacuuuucccgaugaagacgaagaugauugggauacauccaaagguguuagaacuauggguguagcauacguaccagagcacacaguaucagcuuuuaccuguauuucagcaccagacggagauauaacugauuaucucagauuaccaaauauucuaaaaagaaaaaauagcuuucgaacugaagaaaaacuuaugaaggaagcugaucuucaagcacugaaaaauuucauauuccuuaaaaagccucaugugauagcaguagggggugaguccagagaagccuuaaugaucgcugaugauaucagaggaguaauaagugaacuaauagaauccgaccaauucccacagauuaggguugaaauuauugauaaugaauuagccaaaguguacgcaaauuccauuaaagguucaacugauuucagagauuauccagaguuguuaaggcaagcuauuucauuagcucgaagaaugcaagauccuuugguugaauuuucccaauuauguaauagcgaugaggaaauuuugagucugagguuucaucccuugcaggaacaaguccagaaagaagaacuacuagaagcucucuguuuagaauuugucaacagaacaaaugaaguagguguagauauaaaucuugccguucagcagauucauaaaaguaguuuaguucaauucauaugcggucuaggaccgcguaaaggucaagcguuacuuaaaguucugaaacaaacuaaucagaggcuugaaaacagaacccaauugguuacauuuugucauauggguccaaaaguuuuuauuaauuguucuggauucauaaagauugauaccaauaguuuaggagacaguacugaggcauauguugaaauauuggauggcucucgaguucaucccgaaacuuaugaaugggcacgaaaaauggcuguggaugcuuuagaauaugacgaugaugagggagcuaauccggcgggagcuuuagaggaaauucucgaggcgccagagagguuaaaagaucuugacuuggaugcauuugcggaggaauuggaaagacaaggauuugguaacaagaguauaacauuguaugacauuagagcagaacugaacucgcgauauaaagauuugagacaaccuuuucguucugcaaauccugaagaacuauucgauaugcuuacuaaagaaacucccgaaacauuuuauauuggaaaaaugguuacaucuaccguguuuggcauugcaaggagaaaaccaaagucagaccagcucgaucaagcuaauccgguccguaaugacgaaacugguuuguggcagugccccuucuguuugaaaaaugauuuuccugaauuaucugauguauggaaucauuuugaugcaggagcauguccuggucaagcuacuggaguuaaacuaagacuggauaaugguauauuagguuauauuuauauaaaaaauauaagcgacaaaccaguugcuaauccggaagaaagaguaggcauaggacaauuaauucacuguagaauaauaaaaauugacguagagaaguuuaguguugauuguacaucgaaaucuagcgaucuugcugauaaaaaucaugaauggagaccucaacgagauccucauuaugaucaagaacgugaagacaaagacaaucgauuagaagccgagaagaagaaagagaaacagcguaugacguacaucaagaggguuaucguucauccggcguuccauaacauauccuaugccgaagccgaaaaauguaugguuaauauggaccagggugaaguuaucauuaggccuucgaguaagggugcggaucauuugaccauuacuuggaagguuacggauggaaucuaucaacacauugauauuaaggaacaagggaaaguuaacgcuuuuucuuuaggaaaaucauuauggauuggaaaugaagaauuugaagaucuugaugaaauaauagcuaggcacguuacaccaauggcggcgcaugcuagagauuuacuguauuuuagguauuacaaagauuuccaagguggucauaaagauaaggcugaggaauaucuaaaagaugaaaaaaagaaaaaugcuucuaaaauucauuauguaguuagugcugcuaagaauauaccugguaaauuucuucuuucguaccuuccacgcaacaaaguuagacacgaauauguaacaguuacuccagaaggcuuucgguuuagacaacaaauguuugauuccguuucuucguuauuuaaaugguucaaagaacauuuccgggagccuccaccaggcggugcaacaccagguagcacgccaaggauggcuucaagcagaacuggauauggaagugccacacccgcguauaguaugaauaaugaagcuauucaaagaguugcucaaaauuuaccaagucauguaguucaagcguuaucugcugccaccaaccaaacuccacauuauccccacaccccugguuauggaggcaauuauauuaauacgccuuacacuccaaguggucaaacuccauacaugacuccguacgcuacaccccauacgcagcaaacuccccgcuauggucaucaaacaccuucccaacacauggcgagcucagcaccacaaggucucaacaaucccuuuuuacauccuggcgcggugacucccucccaacgaacuccuauuuaucgcaaccauccugcacaaucuccaguaaugcuuccuacaagcccuguaccaaguccagguucccagaguucauacaguagucauuuaagucauaaucagcgaaguggaaguuaugcugaauccuuaagauuccaaccucccgaaucgccgagaagcucagugaguaauagaagcuuucaaacugauagauacggcggugauagguaugguaaaggaggaagucauagauaugguggaagcucaaacgaagauagauaugguaagggaggaggaggaaaugaaaauacggauuggcagaaagcugcagaagcaugggcucgaucuagaucuacuccgagaagugauggccguaauacuccaagaucuguaggucaacgaacuccuagauacgacaacgacgccgaacguucuagaaugaaacaccucagcaagagcccgaggucuguuaggucuacuccucgaaccaauacaucuccacauucuaugucccuaggugaugcuaccccucuguaugacgaaaguaucuaa

SEQ ID NO: 5617 - RNA, 2463 nt, Diabrotica virgifera
augccagauaccaaggauaccaauaccaaggaugcuaauuugaguucuccugaacguaaaagacgaagaaagaguagaucuaaaucuccagaacgaaaagagaaaaagucuuccaaaaagaaagcccacaauaguagagacagagauucaucagaggaagguuacaacccuaaagauuaucagagauacuauggggaagaucgcccaaacagugacaaauauuggaauaaauauccaaggaaagauacuaccaaaguuggccaaagauacuaugaugcggcucccgaagaaucuggcaagaaggggccagauagaaauucagaggagaaggaguuaccaaagccaauggagucuguuccugauaaaucagucaucaaaccaagagaaagaaaaacuguagauauguuaacaucgaggacugguggugcuuauauucccccagcuaagcuacgauuguuacaagccaguauuacagacaaaacaucagcagccuaucagcguauagcaugggaagccuuaaagaaauccguucaugguuacauuaauaaaauuaacaccucgaauauuggcaucaucgccagagaauuauugcaugaaaauauaguaagagguagagguuugcugugcaagucaauaauacaagcacaagcagcaucuccuacuuuuacaaacguuuacgcagccuuaguagcuguuauuaauucgaaguuuccaaguauaggagagcuuuuauugaagagguugguuuugcaguucaaaagaggguuuaaacaaaauaauaagucuauuugcauaucggcuacuacuuucguagcucauuuaguaaaucagagaguggcacaugaaauuuuggcuuuggagauacuuacauuguugguggagacuccuacagaugauucuguggagguggccauuucauuuuugaaggaauguggacaaaaacugacagaaguuucaaguagagguauuacugcuauauuugagauguuaagaaacauuuuacaugaaggccagcuagaaaaaagaauucaguacaugauugaaguuauguuucaaauaaggaaagacggauuuaaggaucaugcugcugucguagaagaauuagauuuaguagaagaggaagaucaauucacucaucuuauuauguuagaugauguuaaagaggcugaugcagaggauauauugaauguguucaaauuugaugagaguuaugaagaaaaugaagauaaauacaaaacccuuaguaaagaaaucuuaggcagugauggugagucugaaucagguuccgaagguucagaagaggaaucugauaaugaaaaugaggacgaagucaaggaccagggaacaauuauugacaauacugaaacgaauuuaauuucucuuagaagaaccauauauuugacuauucagucuaguuuagauuuugaagaaugugcacauaagcuacugaagauggaguugaaaccuggacaagaaauagaauugugucacauguuucuugacugcugcgcagaacaaagaaccuacgaaaaguuuuauggucuuuuggcucaaagauuuugucaaaucaacaaaguguauaucgagccuuuccaacaaauuuuuaaagauaccuauucuaccacucacagacuagaugcuaacagguuaagaaacgucagcaaauuuuuugcgcauuuacuuuuuacggaugccauuggaugggaaguccuugacaucaugaaauugaaugaagaggauaccaauaguucuaguaggauuuucauaaaaaucuuguuucaagaauuggcugaauauaugggacuaggaaaauuaaacgcaaggcuaaaggaugagacccugcaggcuuauuuuucaggacuguuuccuagagauaacccaaagaauaccagauuuucuauuaauuuuuuuaccucuaucgguuugggaggauuaacugaugaacucagagaacauuuaaaaaauauuccaaaaaugauggaaaugaaguuagccacuaaagaaaaggaaagcagugguaguaguaguucagaaaguaguucugaggaagauaguagugacgacagcucugaagauucaucaaguucugaagacgauagaggcaaaaagaagaaaaaaaccaaaaagcuagaagaaaaaaauucgaaaguaaauucuaagucuagaccuagaucaaaagagaaagaacacgcagacaaaccuagagacaaacauagaaaggaagauagacauaaaucugacaaaaaucccgauagauccucguccaaaaaauauucuaaagaagauaacaagaggaagaaagacuacgaauggaugaagagcagauaugaagaugauauuaagcaauuaaaaaacgauaaaaggguauuugaaaagucuuccaaacgacgaucaagaucuagagacaggguaaaagucaaggaagagcguagacguagaagcagagaaagaagaaggagcuaa

SEQ ID NO: 5618 - RNA, 1494 nt, Diabrotica virgifera
augaaugacuuugaaccaccaagacagauguacagaggggcacacguguuuuuuacagaaguaugcccggaggaacuguucaaugagcucugcaagucuugugcggccagaaaaauuaagacucucaaggaaaucaacauugcguucuugccguaugagucucagguguucucauuggauucaccagacacguuccaguguagcuacgauccaucauuuuccgcugcuagaaacgccaacauggaaagaauggcagaacaaauugcgacacucugugcgacucuaggggaauacccacacgucagauauagaacugauugggaaagaaauguugagcuggcucaacuaauucagcagaaauuggacgccuauaaagccgacgaaccuaccaugggagaggggccggaaaaggcgagaucacaauuaauuauccucgaccgagguuucgacuguguaucuccccuucuucacgaacuuacuuuccaagcaauggccuaugacuuacuacccauagaaaaugauguauauaaguacgaagcaucggcugguguuaugaaagaaguccuucuagacgaaaacgacgagcuuugggucgaucuacgccaccaacacaucgcgguggugucucagagcgucaccaagaaucugaagaaauucaccgacuccaaacgcaugacccagagcgacaagcagucgaugaaggaucucucaaccaugaucaaaaagaugccgcaauaucagaaagaauuguccaaguaugcuacgcaucuucaucucgcugaagacugcaugaaggccuaucagggguauauagacaaguuguguaaaguugagcaggauuuggcaaugggaacugaugccgaaggcgagaaaaucaaggaucacaugcgcaacaucguccccaucuugcuagaucccaaaaucaccaaugaauacgauaagaugcguauuauagcauuguacgccaugacgaaaaacggcaucacagaugaaaaucucuccaaauuggcuacccaugcccaaaucaaggacaaacagaccaucgccaaccuucaguuacuuggagucaacguuauuaaugauggaggaccaagaaaaaaacaauauacaguaccgcgcaaagaaagaauuacagaacaaacguaccaaaugucaagauggacaccuaucauuaaggauauaauggaggauugcauagacgacaaacuggaucagaaacacuacccguauuugagcggacgagcacagucuacgggauaccaugcagcgcccucuagugcccguuauggccaguggcacaaagacagaggucaacaagccgugaagaacguuccucgacugcucgucuucgucguggguggaaucaguuuuucagagaucaggugcgccuacgaagugaccaacgcgcagaagaacugggaagucaucaucggcucgucgcacauacucacucccgaggacuuccuaagcaaucuggcaacguuggccggcuag

SEQ ID NO: 5619 - RNA, 2139 nt, Diabrotica virgifera
augaugcaacaauauaugaaagaauuagagcaggaaccauuugaugcugaagaguuuguagaacguuuagcuuggaggacuuuagcugaaucuaaaggagauggagaggaacaugagauuaacccugcucuuuuacaugagucuuuuguacaagcuauaaaagaucuuaauuuacuucaugaacggcaacaaaagaaaugugaaaaauuagaaguugugguuagggaagaugaagcaaccuuuuuccaagaaauauauaauuuacuugaacaaaauaagcaagccauggauacuuuucaagaauuagauggcaaaauaaaucauguagcaacaaaaguacugcauuuaggagaccaguuggacagugucaaugggccuagaucuagaguaguagaugccuuaaaguuaaugauacauuuaacagaguucuugucugaugaaucaguauuaucaccuaucuuuacaaggccagaauugauagaugaugcugcugaugugauccaaaaauuauaccuuauaucucaagauuugccucccaaauuugauguugcuaagagaaaaauugaaagaaaauacucggauauagaaaaaucuuuaauagaggaauucguucuagcuauggauaacgaaaauuuaaauagaaugaaagaaauagcuaccguuuuaucucaguuuaaaggcuauucccagugcguagaugcuuauauugaucauagucaaaugggaugucugucgagcaaggacguauuugcuaacuuuuuaacgcuuuguaaauacaaucaugaaauaauugucaagguauuuaauaacccagaacaagugauggcaaaauuuguacugaacauauuucaacucaaacucgucgaauacaucgaucaaagauugaauuccaaguuaggaaccuauggcuauuuacaaguauuauaugaguuauauuauaagacuaaucaguuaucuaaugauuugagcauauuuaacaugggaaaugacaagaacuuuuuaucgaaguuaacgacaaauauuuuuaacaaauauauuagugauuauaucacgauggaauuaaaaggucugaaagauagguguucugcaaauuuacaaaaauauuaugaauccaaaggucaucagaagaagcagauucagucaggagguuuccaagaccuucgaagagaccuucaagcuguuauaggaacucgagcgaauauuaacauugcucagaucgaaaauuaugguggagaaaccuuuuuaucugaagaauuagcuauuacgauauuacaagauacaaaacacgcuuuccagagaugccaguuguuauccaaacccacagacagagccucaaacgcaacucaaauuuuggaucgacugauaaacagcuuauuaguagagcaugucgacuaugcaguagaauugggcuuacaagcuguuccuguuguagaagggaccaaaacuccuccagcgcuauauuuuuucagugucguccaccacaguaauaauauuauacaucuuguugagaaacaauucauggauuuauugguuccauuaguugaaaacaccccgaggcauaaugauuguguacagaagaaaaaguuugugcuggaagauauagaacggaagauuaauacaggacuagauaggugucucaaugccauuucgagcuggguuaaacuguaucuucaaacagaacagaaaaaaucugacuucaaaccugaaucugacgauuucgacacaguggcgucaaacgcuuguaaaaacgucauuaacuacgugaauaguauuguaaaagaaauaaaagcgaaccuggaugguaacaaugucacagccauauugcaagaacuuggcauaagauuacaucgaguaguguaugaucacauguugcaguuccaguauaacacagcaggugcgaugguggccaucugcgauuuaaacgauuaucgccauuguacaaaagcccucggcccauuagugauugaacuuuuugauacacugcaugcgcucugcaaucuuuugcuugucaagccugaaaauuuacagcaaguguguucugaggauucucuaguaaaacuggauagaacaauccuucacaauuuuauccaacuuagaagugacuuuaagguacaaaaacaaaugauucuaaaaguguaa

SEQ ID NO: 5620 - RNA, 813 nt, Diabrotica virgifera
auggauuuccaaaacagaccuggaggaaagaccgguggaggcggggucgccucuuggucggaaacuaacagggaucguagagaaaggcuucgacaacuagcuuuagaaacuauagaucuacaaaaagaucccuauuuuaugaaaaaccacuugggcucauacgaguguaaacuuuguuugacguugcacaacaacgaaggaaguuacuuagcccauacucaggguaaaaaacaucaggcaaauuuagcuagaagagcagccaaagaggcuaaggaugcuccuacgcuuuugcaaccagagaaacccagaguagaaccuaagaaguuugugaagauuggucgaccugguuauagaguaacgaaacaaagagaugccgaaaguggacaacagagucuucuguuccagauugauuauccagaaauaagugauaugauucuaccccgucaccguuuuaugucagcuuaugaacaaaaaaucgaaccaccagaucguaaauggcaguaucuucuauuugcagcagaaccguacgaaacaauugccuucaaaguaccaagcagagaaguagagaaaaccgacagcaaauuuuggacucauuggaacaaggauacuaagcaauucuuccuacaauuugcauuuaaaaaugacaauaagagaacuguuaauacagugguccaaagacauacgauuguuggugcagcaccaccacccccaaugcuaccuguuccaccaccaccaagaccaccgauguucaauccuauuccuccuccaccuccaauaaugagagcuguauuaccagugccuccuccacauuaa

SEQ ID NO: 5621 - RNA, 405 nt, Diabrotica virgifera
augucuauugguguaccuauuaaaguucuccaugaagcagaaggucauguaauaaccugcgaaacaauuaccggcgaaguauacagagggaaacugauagaagccgaagauaauaugaauugccaaaugacucaaauuacuguaacuuacagagauggaagagucgcucaauuggaaaauguuuauauuagaggaucgaaaauuagauuccugguauugccagauauguugaaaaaugcuccuauguucaaaaaacaaacuaaagcgggaacggcaggccgaggaaaaucugcuauacugcgagcccaagcucgggggagagguagggggcaacaacaaccgaugcgagguagagguaauuggcaacagaaccaacaacaagcaccugcaggaaggggaagauaa

SEQ ID NO: 5622 - RNA, 1467 nt, Diabrotica virgifera
aaaaaguugacgguugugcugucacuucugucaguuugugcugucacuucugucagauuaugcugucagguaauaaauucugaaaauuuugggaagaaagauauuuguuuuauaaguuuucacacaccuucauugagaaguauggcuucuacucuuacaagaacuccaaucuugcgagcaauuuccgcaagaagcuauucucaagcccugccaguaucagguaauccaagugcugaacucagaacuaguacucuucccaacaaacuaguuguugcagcaguagauaaugacgccagucuuacaagaguuucaauuguauucagagcuggaagccguaaugaaaaagccgauaauuuaggugccacucauauuguacgaacagcagcaggcuuguccacuaaaaaugcaucccaguuugccauaauccgaaacauucaacaaguuggugcaaaucuuacagccacaucugauagagaaaccaucuccuauaccuuagaaggaacaagaagugccguugaaaaggcucuaccauauuuagcagaaguagcuacccaccaagaauuuagaccuugggaagugucagagcucuccaacagauuaauuuuggauauuuuaaccagaccuuuacaguuaagagccaucgauuugcuucacaaugcugccuaccguagcaaagguuuagguaacucacucuucauuccaaaaucccaaguagguaaaguuucaucagaaacguuacaacauuacguagccagcaacuuuguagcuggccgugcugcaguuguugguacagguguaagcgagaguuuguugaaucaauucgcugcuaguuugggaauugcaaauggcgaaggcagcaccaauccaucuccuuacaaggguggugaacucagaucaaacaaagguggaccacuugcuuuuguugcaguaggaggagaaggagcuccauugaagaacaccaaagaagcucuugcguuugcaguucuacagaaagcuguaugugcuggcccucagaucaaauauggcguacuugauaauggagucuacagcaaagcucuugguggcucaucagauguaucugcgugcgcuguuaaugugagcuauucagacagcgguuuguuugguauuuugcucgcugcaccugcuggaucuguaggcaaagcaguucaaucagcuguuaaugucuugaaaucaggcuccguuacagaugcugauguucaacgaggcaaaaaucaauugaagacagccauccuucuuaacgcugaaaguggagcugacguuguaagggaacuuggaacccaagcaguuuuggcuggugcuccacaaagcgccaaugcuuuagccgcugccguagacuccgucagcaccagugauguacaaagugcucuaaggaaagcaggaggaaaauuaaccuuagcagcaauugguaacauuaacgauguaccauauuuagaugaauugaaauaa

SEQ ID NO: 5623 - RNA, 432 nt, Diabrotica virgifera
cgucaaucaaucuucauacaaaagacaaaguuuuguaaauacauauuuucuccauuuuucaaaguuauaaagccauauuuaaccguggcagccuacaagaugaggagagcccacgcagguaacuauuaugaaccauuaccacaagcuuccaacgaaaucgaagaugaaaacgauagaaugacuaaugaucugcaagaaaagauuggcgucuuaaaaucguugacuauagacauuggaaaugaaguuaaauaccaggacagaaugcucagagauguggacgacgaucuagauaagacuggaggcuucuugggcaccaccaugucaagaguacugagauuaucgaaaggaucucauaauuaccucauccuguauuuauuuguguuuucuguagugguguuuuuuauucuguaucuaguuauuaaguuuagguag

SEQ ID NO: 5624 - RNA, 1485 nt, Diabrotica virgifera
auggcuucgacgauaucggcaagacaggcuaacagagaacauguuuuggccguauccagagacuucauaucccaaccaagacucacuuacaaaacuguaucuggugucaacgguccacuaguaauccucgaagaugucaaauuuccuaaguucaacgaaauuguccaacucagauuaucugacggaaguuuaagaucaggucaaguacuugaagucagcgguuccaaggcuguaguacaaguauucgaagguacaucagguaucgaugccaaacacacugucugugaguucacaggagauauucucagaacuccagucucugaggauauguugggaagaguauucaacggcucuggaaaaccuauugacaaaggucccccaauucuggcugaagacuaccuagauauucaaggacaacccaucaacccauggucccguaucuacccagaggaaaugauccaaacugguaucacugccaucgaugugaugaacucgauugcccguggucagaagauucccuuuuucucagcugcuggucugccacauaacgauauugcugcccaaauuuguaggcaagccggucuugucaaaaucccaggcaaaucaguuuuggaugaccacgaagacaacuuugccaucguguucgcugcuauggguguuaacauggagacugcuagauucuucaaacaagauuucgaagaaaaugguucuauggaaaacguauguuuguucuugaacuuggcuaacgauccaaccaucgaaagaaucaucaccccacgucuugcucuaacagccgcugaauucuuggcuuaccagugcgaaaaacacguguuagucauuuuaacugacaugucuucauacgcugaagcuuugcgugagguaucugccgccagagaggaaguacccggucgucgugguuuccccgguuacauguacaccgauuuggccaccaucuacgaacgugccggucgugucgaaggccguaacgguuccaucacucaaauccccaucuugacuaugccuaacgacgauauuacucacccuauucccgauuugacagguuauauuaccgaaggacagaucuacgucgaccgucaauugcacaacaggcagaucuacccaccaauuaacguacugccaucucucucacguuugaugaagucugcuaucggcgaagguaugaccaggaaggaccacucugacguuucuaaccaauuguaugcuuguuaugcuaucgguaaggacguccaggccaugaaagccguaguaggugaagaagcucuaacacccgacgaucuucucuaccucgaguuccuaacgaaauucgaaaagaacuucaucacccaaggaaacuacgaaaaccgcaccgucuucgagucuuuggacaucggcuggcaacuacuccguaucuucccuaaggaaauguugaaacguaucccugcaagcacauuggcggaauucuauccaagagacucucgucacuag

SEQ ID NO: 5625 - RNA, 1173 nt, Diabrotica virgifera
augagucgcggacacgcaggaccccguauucacguuccagacgaauuaagagaaguacuccucgaauuuacaauuaguuauuuacuggaacaaccuggagauguuauuaguuacgccgccgaauauuuuacgcgcuugagggaaacccgggugacauccagaguguaugaugaagcugcugccucgcaggaggaauugguaucaccugacgaauccguaauguccaaagaugaagaaccuucaauccgguuugcugguaggcguaaaucaguguucgcagaaacuuacgauccagaagaggacgacgacgaugaugauggcgccaaguugguguauccaaaaucugaugagcaacgucagagauuggccacugcuguuaaaaacauauugcuguucagaucucuggauaaagaucaaaugaacgaugucuuggaugcaauguucgaaagaguggucaaaaaggaugaauugguaaucaaacaaggagaugacggcgauaauuuuuauguaauucaaaguggaacuuuccauguguuugucgcaccagauccaucgaaagaacccaaucauauucacacuuacgaaaauaguggcagcuucggagaguuggcguugcucuacaacaugccccgugcagcuacggucaaagcaaauagcgaagguucccuuugggcuauggauaggcagaccuucagaagaaucguucucaagucugcguucaaaaagaggaagauguacgaagcguugauagaaaguguuccgaugcuuaaaacucuucagccuuacgaacguaugaaucuugcugaugcauugguaccuagagucuucuacgauggagauaggauuaucaaacagggcgaugcagcggacgguauguacuucguagaacaaggugaaguggccauuaguguuuuagacgauagcgguaaagagguagagaucaaucguauuaguaaaggagguuacuuuggagagcuggcauugguuacacaucguccuagagcugcuucugcuuauugcgauggagaaguuagaugugcauuuuuggacguggaagcauuugaacguuuguuggguccuugcauggagaucaugaagcgcaacauuacugacuacgaagaacaaaugcucaaaauauucggcucaaagcaaaacauuagggacauccgauga

SEQ ID NO: 5626 - RNA, 2421 nt, Diabrotica virgifera
augaguuacaugcagucuaaccaaaauagaccaaugucucaaagcuaccaucaggguccuaaugaccugcccaugcagucuucuaaagaacagacuuuacuauggcagcagaauucauacaugggagacucuggcauucagucuggggcugcuacacagguuccaucacugacagguaaagaggaggaagaaauggaucuguuugauuuggaucaacccuaccaggguuuuacacaagagcaaguugaugacaugaauaaucaacugaaucauacuaggucccaaagaguuagagcugccauguuuccugaaacuuuggaugaagguauugaaaucccuuccacacaguuugauccuaaucaucaaacagcaguucaacgucuggcagaaccuagucaaaugcucaagcaugcuguaguuaaucuuauuaacuaucaagaugaugcugaccuugcaaccagggccauaccagaauugaucaagcuccuuaaugaugaagaccaaguaguaguaucccaggcagcuaugaugguccaccaacuaucuaagaaggaagcaucuagacaugcuauuaugaacaguccucaaaugguagcugccuuagugagagcuauaucaaacucuaaugacuuagagacuaccaaaggagcuguugguacccuacacaaguuaucacaccacagacaagguuuacuugcuauuuuuaaaagcggagguauuccagcacuuguaaaguugcucaguucuccuguagaaaguguucuugucuaugcuauaaccacccuucacaaccuuuuauuacaucaagauggaucaaagauggcuguuagacuugcaggugguuugcaaaagaugguugcacuacuccaaagaaaccaugucaaauuuuugucaauuguaacugauugcuuacaaauuuuggcuuaugguaaccaggagagcaaguugaucauuuuggcaagucaaggaccuauugaauuggucagaaucaugagaucuuacgauuaugagaaguuguuguggacuacuucuagaguucugaaaguucuuucaguuugugccaguaacaaaccugcuauaguugaagcaggaggaaugcaagcuuuggcaaugcacuugggaaauccaagcacaagauugguucaaaauugucuauggacauugcgaaaucuaucagaugcugcuacaaaaguugauggucuagaaagcuuauugcaaucuuugguacaaguauuagcaucuucugaugucaauguagugacaugugcugcugguauccuuuccaaucugacuuguaacaaucagcgcaauaaaguaacugugugccaagugggagggguugaugcacuugugcgcacuauagucagugcaggagauagagaagaaaucacggaaccagcuguuugugcacugcgucauuugacauccagacauguggaaucagaaauggcacagaaugcuguuagacucaacuacggcaugcagauuauaguaaaacuguugaacccaccuucccguuggccauuggugaaagcagugauugguuugaucagaaauuuggcuuuauguccugccaaucaugccccauugagagaacauggugccauacaucaucuuguacagcuguugaugagagcuuuccaagauacacagagacaaagagcaaguguugcgaguggcggcagccaaccuccuggcacauacgcagauggugugagaauggaagaaauuguggaggguacagugggagcucuucacauucugucaagagagucccauaaucgugccauaauaagacagcagaugguuguaccgauauuugugcagcuacucuuuaaugauauugaaaacauccaacguguugcagcaggagugcuuugugaauuagcagcugauaaagaaggagcugagaugauagaacaagaaggagccacugcacccuugacugagcuuuuacauucaagaaaugaagguguugcuacauaugcagcagcuguuuuauucagaaugagugaagauaaaccgcaggacuauaagaaacgacugucuauggaguuaacgaacuccuuguuuagagaagagaaccucuggaauccagaccuagggaugggcccugauuuacaggauauauugaguccagaucaagcuuacgacaauauguaugcacaagguccccccaguguucauagcagccacggcgguaggccuuaccagcaacaaggguaugaccagauacccauagauaugcaaggucuagauauuggcucccauggaggcggaaaugggucgaccuauagcgcaaucgacgccauggauguuaccagcggggauccggaucuuaacuucgauacuauugaucaacuucccaccccuccucaagauaauaaccacgccgcagcuugguacgauacagaccuguaa

SEQ ID NO: 5627 - RNA, 819 nt, Diabrotica virgifera
auggcccgaaacgccgaaaaagcgaugacaacauuagcucgauggagagcagcccaacuaggagaaauagauaagcacaaaaaacgaaggcccuaucuugcaucagaauguaaaaauuuacaugcuugugaaaaauggaggaugcagaucauaagagaaauugccaagaaaguagcucaaauucaaaaugcuggccuuggagaauuuaggauaagagacuuaaaugaugaaauaaauaaacuacugagggagaagaggcauugggaggaucaaauaaaggaauugggcgggccugacuaucagagaguuggacccaggauguuagaucaugaaggcaaagaaguaccuggaaauaggggguauaaauacuuuggagcagcuaaggaauuaccagguguucgagaacuuuuugagcaggagccgccuccuccuccaaggaaaaguagagcagaacuaaugaaagacauugaugcggacuacuauggauacauggacgacgaugacggaauuuugauuccauuggaaguuaaagcugaaaaaacagccguucaaaauacaguagcugaguggguuaguaaaaaagaacaaaauuuggagaacgcagagaaccaaacagaagaagaaaguauauaugcaguucaggagucugacgaugaagaaaguaaggaaacuguacaacaguuaguagauggaucacagcaaagauuuguugcacauguaccuguaccaucucaacaagauaucgaacaggcccugcugaggcgaagaaaacuugaacuuauggaaaaauaugguguagaagaggaaccgaaaucguag

SEQ ID NO: 5628 - RNA, 648 nt, Diabrotica virgifera
auggcuggcgaacaagauaugcccaccuucaaaugcgucuuggucggagauggagguacuggcaaaacuaccuuuguaaaaagacacaugacuggugaauucgaaaagaaauauguagcaaccuuaggaguagaaguucacccuuuaguuuuccacacaaauagaggacaaauucguuuuaacguaugggacacagcaggccaagaaaaguuugguggucugcgugauggauacuacauccaaggacaaugugccauaauuauguuugauguuacaucuagagucacuuacaaaaauguuccaaacuggcacagagaucuuguuagaguuugugaaaauaucccaauuguauugugugguaacaaaguugacaucaaagauaggaaaguuaaggcaaagagcauugucuuccauaggaagaagaauuuacaauacuaugacaucucugcaaaauccaacuacaacuuugaaaaacccuucuugugguuggcuaggaaacucauuggagaucccaacuuagaauucguagcugcaccugccuugcuuccuccagaaguccagauggauccccaauggcagcaacaaaucgaaaaggaucuuaaagaagccucagaaacugcacugcccgaugaugacgaagauuuauaa

SEQ ID NO: 5629 - RNA, 2511 nt, Diabrotica virgifera
augccuagaauaaugauaaaaggugguguuuggagaaacaccgaggaugaaauucucaaagcugcuguuaugaaauauggcaaaaaccaguggucuaggauagcuucgcuacuucacagaaagucugcaaaacaguguaaagcccguugguucgagugguuagaucccagcauuaaaaaaacugaauggucuagagaggaagaugaaaaacuguuacauuuggcuaaacuuaugcccacacaguggagaacaauugcucccauuauuggaagaaccgcagcacaguguuuggaaagauaugaauauuuauuggaucaagcgcaaaagaaagaagaaggugaggaugcaguggaugaucccaggaagcugaaaccuggagagauugauccaaauccagagacaaaaccugcaaggccugaucccaaagauauggaugaagaugaauuagagauguuaucugaagcuagagcuagauuagcuaauacucaaggcaaaaaggcuaagaggaaggcucgugagaaacaauuggaagaggcuagaagauuggcugcucuucagaaacgcagagaacugagagcugccggaauagaaguuacaucucguagaaagaaaaaacgaggaguagacuacaaugcugaaguaccguucgaaaagaggccagcgauuggauuuuaugacacgucuaaugaaguauuagauccuauggcucccgauuuuucaaaaaugaggcagcaacacuuggauggggagcugagaagugaacaagaggagagagaacguaagaaagauaaacagaaacuaaagcagcgcaaggaaaacgacauuccucaagcuauguuacaaaaccaggaaccagcuaagaaacgauccaaguuagugcuuccggaaccacaaauuucagaccaggaaaugcaccaaguggugaaguugggcaaagcgagugaagcagcuagggaaauaguuacagaaagcgguguugaaaccacugacacuuuguugaaugauuauacuuucaauccucaagcggcugcuacaccaaggacuccggcgccccagacugauaggauuuugcaagaagcucagaacaugauggcgcucacacacguagauacgccccucaaaggcggcauuaacacuccguuacacaauucagauuucagcgggguccugccccaagcucagaccgucagcaccccgaauaccgugcuugcuacgcccuucagauccaguaggagugacggagcuggcacuccuggcaguagcguuggauuuaugacgccuagaaguggcgcuuuggugccuguggggaagacgccgguaggaaugacgccuucgguuagggauaagcuuaguauuaauccagaggaagcaauggacguaggaagcacaccagcugagcacagaauguaccagaugucgaugaaagaucaauuaaaaaugggguugagcagucuaccacaaccgaaaaacgacuaugaaaucguggugcccgaaaaugaagaccaggaagaacccgagcaagcucagucacaaaugaucgaagaucaagcugauguagaugcacggaaacaagaagagcucaaggcgaaagccgccagggagcuggcgcuacguucucaagucauccaacgugauuuaccgagaccucaagaagugaacaugaccguccuucgaccgucccacgagagcuauuccuuauccgaucugcagcgagccgaagaacucaucaaacgcgagauggugacuauguuacauuucgauaaccuuaaaaauccgguuccgacgcagaguaagagauccaacaugucgcaggcccaucaauuggcguuuuuggagcagcauccauaugagucguucaggaaagaagauuuagggguggccaaggggauauugaagagggaaauggaggugguuaggaaugguaugaaucacggggaguugccuaucgaagucuacacucaggugugggaagaaugcuuaagccaaguucuguuccucccgaaccaaacgagauacacucgagccaacuuagcgaguaaaaaagacagacuggaaucggcggaaaaaagacucgaacagaacagaucucacauggcgaaagaagcuaaacgagcugccaaaauggagaaaaaauugaagauuuuaacaggcggguaccaguccagagcgcagguguugaucaaacaauuacaagauuguuaugagaaccuagauucgacuaauuuagaauugaauacguucaaguuucugcaagaacaagaaaaaucugcucuaccaagaagaauacagucucucacugaagacgucagccgacaaacagagcgagaacgaggcuugcaaaagaaauacggcgaucuucaagcagaaauaaaauacuuacaagagucauaccuuagucagcuucaaaaagagcagcgaaaggaagcggauaauacagcuaaugagguuucuuccacuaccaauggagaacucaacgcagaaacagucgaugaugaugaagagaugcaguga

SEQ ID NO: 5630 - RNA, 474 nt, Diabrotica virgifera
augaugcaauucauguuauuauucaguagacaagguaaacuaagguuacaaaaaugguauguggcucauccagacaagcucaagaaaaaaauuacaagagaauuaaucacaacuauuuuagcuagaaaaccuaaaauguguaguuuucuggaguggagagacuuaaaaauuguuuacaaaagauaugcaaguuuguauuuuugcugugcaauugaacaaugugacaaugaacuccuaacccuggaaauuauacaccguuauguagagcuccuugauaaauauuuuggaaguguuugugaguuagacauaaucuucaacuuugagaaagccuacuuuauauuggaugaguugauguuggggggugaaguucaggagacaaguaaaaagaauguuuuaaaagccauugcugcccaggaucuauuacaagaggaggaaacuccgcagggauuuuucgacgaccauggucuugguuag

SEQ ID NO: 5631 - RNA, 1251 nt, Diabrotica virgifera
auguauggauuacagagaauuucauaccgaaucuauauucgcaauggguuucgacauuauucccaacaaccugcaaagaggaauuccuuuaucggccggcucuuugaaaauuuuaaagaugagauggccaagaacaaagaaaugaaagaaucccugaaaaaauuucgagaggaagcucaaaaauuagaacaaagugaugcacugaaagcagcuagacagaaauuugaaaguguagaaaaagaagcuaguaaagguagcgaaguuuuuaaagaaaguuuagguucuguuaaggaaaggcuuaaaggaguuauagaugaagcuagcaagucagauuuagcaaagaaggcuggcaaauucacagaagaaguugguaaaacuacacauaaaauuagugaaacagcucaagaaauuaguaaaacuggagcguuucaaaguauaucucaagcuacuaaggcuguuaaacaagaaauagacaauacuaguauagaagguagaguauauguuaguccuaaaauacuacgcaagagaacagaaacaagugcaguuguccaucaaaaauauuaugaaccaaacacagaugcuacaggcguugaacuacacaaagauucuaaguuuuaugaaucuuggcaaaauuucaaagauaacaauccauauguacauaaaguuauggacuggaaauuaaaauacgaugaaagugaaaauccugucauccgugcuuccagagcucuaacagaaaaaguuggugauaucaugggugguuuauuucagaaaacugaacuaucugaaacacuuacagaaaucuguaagauagauccugcguucgauaccaaaagauuucugaaacaaugugagacagauauuauucccaauauucucgaagccaugacgagaggagaguuagaaguucuuaaagauuggugccaugaagguccauuuaaucuuuuugcuguuccuauaaaagaagccuauaaaaagggauacaagauugaaucaaaaauuuuagauaucgaucauguggauuuagucuuaggcaaagugauggaccaagggccaguuuugauaauaucuuuuacaucccagcaaguuauggcuguccgagaugccucagguggaguugucgagggagauccugacaaaguaaugagaguuaacuauguauggguacuaugcagagaugucacagaaccugauccuagggcggcauggagacugcuugaucuuucagccagcagcaaugaacaacugguuuaa

SEQ ID NO: 5632 - RNA, 930 nt, Diabrotica virgifera
augaguucugauucagaacuaagugauagcgacauugagcuccaacaagcauuugcagaugguaagcuucaaccuggcuuaaauacuguggaagaaggaccaaaacaguucacaaauaaugugagugguuuaaaacaaaaauuagaagaaaucaaacucaaguuaccauggauagaacgacuggacuguguaaaugcacaagccccuuuagcaccugaauuagcagcucaaauguugacccacgaggaaaaaagaaguaaugagcuuaaaaauaauaaaaagcucacacaguuuacuccaagugaagacccgguuuuaaacgacuuuaaaagagaaaugauguuccacagacaagcccaggcugccauucuagauucuauaccaaagcuaaaagauaugggaauacuaacuaaaaggccugacgauuacuuugcugaaauggcgaaaacggaugcccauaugcagaagauuagggaacaucuuaugaagaaacaggagcaacagaagagaagcgaacgagucaaacaacuuagacagcaacgaaaagaagguaaaauguuacaaguucagacaaaacuucaaagacaacaagaaaagaaagauaugcuugcucagguuaaaaaaguaagaaagggaauguccaaagaucuugacuuccuugacggaaaaaauaaaucugcugccaaaaaaauggcagaaaaacggaaaaugaaagacaaaaaguucgguuucgguggaaagaaaaagggaaugaaaagaaacacaagagauagugcugcagauauaagugaauuuaaaaauccggguaaaccuggaaaaaaauuuaacaauaguggaaaagggguaaaaggugguaaaaugggccaaggggcgaaacaaagaauggguaaaaguaaaaggauuaaaaugagaucuaaaggaaggaaguga

SEQ ID NO: 5633 - RNA, 3717 nt, Diabrotica virgifera; identical to SEQ ID NO: 5608

SEQ ID NO: 5634 - RNA, 1866 nt, Diabrotica virgifera
augaauccggcugccccaaauuauccuauggcgucuuuauacgucggcgauuuacauucugauauuacugaggccaugcuuuuugagaaauuuucaaccgcggguccugugcuuucgauucgcguguguagagacuugauuacacgucgauccuuggguuaugcauaugugaacuuccaacaaccugcagaugcugagcgugcuuuggauaccaugaauuuugacuugauaaaagguaggccuauccgcaucauguggucucaacgugauccaucauugagaaaaucuggcguuggaaauguuuuuaucaagaauuuagaucguuccauugacaacaaggccauguacgauacuuucucagcuuuugguaacauucuuaguuguaagguagcccaagaugaaaacagcucuaguaaagguuauggguuuguccauuuugaaaccgaagaagcugcaaauaagucuauugaaaagguaaaugguauguuguugaacggaaaaaaaguauauguaggucgcuuuauuccacacaaagaaagagaaaaggaacugggagaaaaagccaagcuguucacaaauguuuauguuaaaaauuuuggugaagauuuugcugaggaacaguuaaagguuauguuugaaaaguaugguaaaauuaccagcuacaagauaaugaguaaagaagaugguaaaucaaaaggauuugguuuuguagccuuugaaaguucagaggcagcagaagcggcaguugaagcuuuaaauggaaaagaguugguugaaggaaaaccuuuguauguuggaagagcccaaaagagagcugagcgucaacaagaacuaaaacgucgcuuugaagccuuaaaaauggaaagacuuaaucgcuaucaggguguaaaucucuauguuaaaaaucuagaugauacaauagaugaugaacgucuccguaaagaguuuacuccuuuuggaaccauaacaucugccaaagugauguuggaagaagguagaagcaaggguuuugguuuuguauguuuuuccucuccagaagaagcuacaaaggcgguaacagaaaugaauggcagaauuguugguucuaagccuuuauauguugccuuagcucagcguaaagaagaucguaaagcacauuuaacuucucaguacaugcagcguauggcaaauaugagaaugcaccagaugggucaguucauacaaccaggugcaucuagcgguuauuuuguuccuaccauuccugccgcacaaagauucuauggaccagcacagaugacucaaauucgugcuaguaccagaugggccgcccaaacaacuguaagacagggugcucaaggaggaacuacuguauaccccgguaugcaaaacacuuacagagcuacugcccgcccaccaaaucagucaacaaccaugcguagcaacaugaguguaccuaggcaaauuacuggacaacaaccacaaaaugcaauuguaccugcugcuguuaacagaacagccaacuucaaauacacuucaaacaugagaaauccaccacaaccuuugggagguuuaccaggugcugcugcuccaguacagcaggcuguacacauucaaggucaggaaccauugacagcaaccauguuggcugcugcuccaccacaggagcaaaaacagauguugggugaaagauuguuuccacuuauccaacgcauguauccagacauggcagguaaaaucacugguauguuauuggagauugacaacacugagcugcuacacauguuggaacaacaggagucccuuaagaacaaaguggaagaagcaguugcuguuuuacaagcccaucaagccaagcaagcugcuacuacucagauuaagaaagaguag

SEQ ID NO: 5635 - RNA, 2742 nt, Diabrotica virgifera
augacugacucaaaauauuuuacuacuaccaaaaagggagaaauauuugaauuaaagucagagcuaaauaaugauaaaaaggagaagaaaaaagaagcuguuaaaaagguuauugccucuaugacaguaggcaaagauguuucagcuuuauuuccagaugucguaaacugcaugcagacugauaauuuggagcucaaaaagcuaguuuauuuauauuuaaugaacuaugcuaaaucucaaccugacauggcuauuauggcaguaaauacuuuuguaaaggacugcgaagaucccaauccucuaauaagagcacuugcuguuagaacaauggguuguauuagaguagauaaaaucacugaauaucuuugugagccacugaggaaaugucuaaaagaugaagauccuuauguaagaaaaacagcagcuguuuguguugccaaauuauaugacauuucgucagguuugguagaggaucaaggcuuuuuagaacagcuaaaagaauuguugagugauuccaacccuaugguaguugcuaacgcugucgcagcuuuguccgagauaaaugaaagcaguccuacuggucaaccucuaguugaacucaguacaaacacuauuaauaaacuucuuaccgcucuaaacgaauguaccgaauggggccaaguguucauccucgauucacuuucaaauuacaccccucgugaugagcgcgaggcccaaaguauuugugaacguauuacuccgagauuggcgcaugcuaaugcugcugugguuuugucugcuguuaaaguuuugaucaaaaugauggagauucuagcuggagauacugauuucugcaauacuuuaagcaagaaacuagcuccuccauugguaacguugcuuaguucugaaccagaagugcaguacguggcauuaaggaauaucaacuuaauuguucagaagaagcccgacauacuuaaacaugagaugaaaguauuuuucgucaaauacaacgauccaaucuacguuaaauuggaaaaguuggacauaaugauccgucuagcaucucaagucaacauugcucaaguccucagugaauuaaaggaguaugcuacugaaguugauguagauuucgucaggaaggcaguuagagcuauugguagaugugccaucaaaguugaaccuucggcagaaagauguguggcuacacuuuuggaccuuauucaaacaaaagucaacuacguuguucaagaagcuauuguuguuaucaaggauauauuuagaaaauaucccaauaaguaugaaaguauuaucaguacacuuugcgaaaauuuggauacucuugaugagcccgaagcuagagccaguaugguauggauuauuggagaauaugcagaaagaauugacaaugcugaugagcuauuggacaguuuccuggaagguuucggagaugaaaaugcucaaguacaguugcaauuacugacagcuguggucaaacuguuuuugaaacgcccccaacauacgcaaggcuuaguucagcauguacuaaguuuagcuacacaggauuccgauaacccagaucuaagagaccgugguuuuaucuauuggagguuguugaguacugauccugcagcagccaaagaaguaguucucgcagacaaaccucugauuucugaagaaacugaucuacuagaaccuacacuucuugacgaacugaucugccauauaucuucccuagccaguguuuaucacaaacccccaacugccuucgucgaaggaagaucugcagguauccgcaagucuuugccagcuagacaaggaucugcugaagacacuaguagcgcuccagaaccaaccguuauuccuaaucaagagagucuuaucggugacuugcucucaauggaucuuaacgcuccagcuccugcggccgcacaagcagcuguaccagccaguaauguagaucucuuagguggaggauuggauucuuuguuggauauugguaccacucccgcaccuccuacaucuacgggacuucuuggugacauuuuuggaauaccaacugcuccaaccauguauaccccacccaaaacuauaugguuaccggcugaaaaaggaaaaggauuggaaauacauggggcguuuucaagaagagccggacagaugucaauggauuugacguucaccaacaaagccaugcaggcgaugucugcauucgcuauccaauucaacaaaaacagcuucggcauaguucccggcucaccacucaccgugccugcgcuccagcccggacagagcuuggaauacaauuuagcguuggcuacuaccggaccaguccaacguauggauccacucaccacucuccaaguggccaucaaaaacaacgucgauaucuucuauuacgccugccaaauucccauucagauucuguucaccgaagacgguacuuuggauaagaggguguuccuuaccacuuggagagacauuccggcagcuaaugagguccaauacacuguuaaugaugucaaaggaaacacagauggaguuucuagcaaaaugacacugaauaacaucuuuaccauagccaaacgcaauguggaaggccaagacauguuauaccaaucacugaagcugacgaauaauaucuggguuuuacucgaacugaaacuucaaccgggauuaaccacagcuacacuuaguuugaaaucuagaucuguagaagucgcaccuuacguuuuccaagcuuaugauucaauuuugaagaauuag

SEQ ID NO: 5636 - RNA, 498 nt, Diabrotica virgifera
augccacccaaguucgaucccaccgaaauuaaauauguuuacaugagaugugucggaggagaaguuggagcuaccucuucuuuggcuccuaaaauugguccucuagguuugucucccaaaaaaguuggugacgauauugccaaagguacugcugauuggaaaggucuuaaaaucacaguucaauugaaaauccaaaaucgucaagcuaccauuucuguagucccaucugcuuccucccugaucauuagggcucuuaaagaaccaccacgcgauaggaagaagcaaaagaacauuaaacacacugguaacauuacuuucgaugaaaucaucgcuauugccagacagaugaggcccaggucgauggccaaacaguuauccggaacuguaaaagagguuuuaggaacagcccaaucaguuggauguacaauugaugguaaagcagcacaugauguuauugacgagguuaaugaaggaaccauagaaguaccagaugaauaa

SEQ ID NO: 5637 - RNA, 1095 nt, Diabrotica virgifera
augccagaagaaggaaaaagggcauuaauuuugguuggagguuaugguaccagauugagaccuuuaacuuugaguagacccaaaccucuuguagaauuugcaaauaaacccauucuccuucaucaaauagaagcacuuguagaugcuggaguuacugaaguuauauuagcaguaucauaucgugcuaagcaaauggaagaagaguugacaguggaagccaaaaaacugggaauuaauauaauauuuucccaugaaacagaaccuuuagguacagcgggaccaauugcauuagccagggaucaucuuucuaaaagcacuaaaccauucuuuguguuaaauuccgauauuauuugcgacuucccauuuaaagcauuggcugaauuccauaaaaaccacggaaaggaagguacaauagugguuacuaaaguggaagaaccgucaaaauaugguguaguaguauaugauaaagacaacagcauccaaaguuuuguagaaaaaccucaagaauucauuucuaauaaaauuaaugcugguuuguacauucuaaauccaagcgucauuaauaggauagaauuaaaaccaacuucuauugagaaagaaguauuuccuuacauggcugcugauaaacaguuguaugcauuugaauuggaagguuuuuggauggauguuggucaaccaaaagauuuucugacaggaauguguuuauaucucaaacauuuaaggcagacaaaugaagacaaacuuuauaaaggaccaggugucguuggcaauguauuaguagauccuacugcuaaaauuggaaacaauugucaaaucgggccuaauguuacaauaggaccagguguuguuauagaagaugggguauguauaaaaagaucuacaauucuuaaagaugcuaccauuaguucaaauucuugguuagaaagcuguauuguuggauggaaguguuguguugggagauggguaagaauggaggguuccacaguacuaggagaagauguuauaguuaaagaugaaacauacauuaauggaggucaaguguugccucauaaaaauaucgcuacuucaguuccagaaccucagauuauuauguga

SEQ ID NO: 5638 - RNA, 876 nt, Diabrotica virgifera
aaccuaaacauggcgucagacggggacgacguuauuagugaccaagaaaaagugaaaauaguaucggauuuuauucuccauucgccacccggugaauuuaaugagguauuuaaugauguuagaaaacuuuuaaacgacgaugaccucuuaaaagaaggugccagcggggcauucgcccaguauaacaaagaucaacugacccccguuaaaauagaaaacgccgaucauuuagugcuuauuacggaauacaacgauuuagggaauaauagauucuucgaccccagaaguaagcagaguuuuaccuaugaucaccugagaaaagaagccuuagacuaccaagucuauacccccgauagugcuucugagccuuggcgggcagccuuagacuccgaguucauucaguacacuaggaaccauuacaaagauggaguauguagugugguaggccgcaaccagagcgggguuguuaacuuaacagcuuguaucgaagaccaccaguucucuccgaagaacuacuggaaugggagauggagaucucagugguccauuagucuaacugaugauuccacugcugaggugagagggguacucaaaguacagguccauuauuaugaagaggguaauguacaauuaguaaguacuaaagaaauaaaagaaacuguuccuguuucaucugaggcacaaacugccaaagaaaucauccaaguaauagaagccgcugaggaucucuaucagacggcaauuucagaaaacuaccagaacaugucagauacaaccuucaaggcccuacgaagacuucuuccugucaccaggacaaaaauggauuggaauaaaaucguauccuauagcauuggcaaagaacucaaaacgcaauga

SEQ ID NO: 5639 - RNA, 4071 nt, Diabrotica virgifera
augugguucaaguacuuuguuauuuuuguuuuguuuaguguuagcguuaaaggacuagauggugaucuuccaccagaugucgaaacuaucgauguggacacuaccaauguaagcaacgcggauccagacgcagggaaaccuaucccgguggaagauacgccuaauggagccccuccagugaauacaaacuaugaaguagauaaaaccuuaguuaauguaaccaauaguuugguaaaugugacuaaaaaucccagacggacuuaucagacaguuaauaaaaugggcaaauauucgacauuuuaugcugcagauuacgauccuaugaccucagacacagcuccaccagacacugaccaacgaggaggaggaggaacuccauacacuauaucagaaccgagacuggcagaaauaaggaaacauuuuauguacccauuuuucgauaaaggaggcagugauaauaacuugggagauuuccaaaaggacauucaaucuuccauuccucaggugcacaagaauuuaaacuuccaguugccuuucuuuggauucagguauaauuacacaagaguuucagugaauggguaucuggaauucagcgauccaccuccaaauuaugacuauccauuaguauuuccaauuaaagaauggcccaaaaagaaugauccugccuuuauuggcauuuucuucagcagaugcagaaucgguaaucuacgugauggagacauugaucaaagaacacccggggucuauuuuagaauggaaagagauuuaagaacgaggcaagacagaauggguguagaaauuagagaaagacuuaagugggacaucagaacaggagucauuggaucagaaacauucgauccuaagcacgccguuauugucacuuggaaaaauguuacuuucacuggaggauucgcuaaugcuaaauacaagacaaacaccuuccaaaugguucuugcaacugacgaagucuucacuuacgcgauguucaacuaccucaacuuggacuggaccucccacacugaagcggguggugauucccaaaacggagaagguggugucagugccuauguugguuuuaacgcuggaaacgguaccagaagcuacgaauacaauccuuacagucaagcuuccgucauucgagaucucacaucaguuggauuuggaaaugguuuuaagggaagacauauuuuccguauagacgaagacauuuugcuuggaucaugcaacaaagauauagauggugccaaccuuccccugaaauucgcuccugaaagugguaacauguuggguggaacagugguaaauauaacugguccaugcuucaauuugaaugauaggauucgaugcaaguuugacguaucaaaugaaguauuuggguauguuguugauaaaaacagagcuaucuguguacaaccucaacuuuaugccgaaggaugggugaaucuucaaauugcuguuaauuccgaagcauucaaguggaaggggaaguauuauguagaaucaccugcuagugcgacucaaaaaaucuucuuuaaggacaugaaauuacacgaaaaaucuccgagcgaauuaaaaaucacuugggagaagcagaauuugaccacaaacgacaacgcuaacauccgaauuucucucugggguuacagagaaacgacuaugaaaccaguguuuguuuauaucaccgauaucgcugauaauguucaaaacauuggagaacacacgauuguuccuucucaguuuagaacuagagucaaucaauaucugacugauauuaaguuuggauuccuccaaauuaauuuaacugagucuaucacaguuaauacauauacuacaagccagagcagcauagaauuaacaccgguaauauggagccgacccauuccacucgguugguacuuccaguuccaaugggaaaaccaguacgguaaaaauuggcccaaauaucuaugugacgauuggcugagaacggacagauaucuaaaaaacuucgcccacgaacuugcucaaugucccugcaccgucgaacaggcuuuagcugacaagggcagguuuaugccagacuucgauugcgacaaagauucgaacccgauuuguuacuauaacaaccaagcacuucauugugugaaaacuggaucucccacuuuagaaggcuccgaacaacaauguugcuaugauaaaaacggcuuuuugaugcucucuuacgaucagcaaugggguucuaguccgagacguugccacaacuuggguaaaaugccuuacaaugaagcgacaaaagugccuacucucucacaaugguuuaaugacaugguacccaaauauuuguguugucuuuggcaagacgagcaagcugugggaugugaaacacugagauuugaacggagaccuacacaggauuguguagcuuaccaagcaccagguguagcaggagucuacggugauccacacuuuguuacuuucgacgauguagaauauacguuuaauggaaagggagaauucgcauuggugaaaucaguuacgcaaacggacaaucuggaaauccaaggaagauuugagcaaauggacccuaacacuuauggugagguuagagcuacucagcugacuucuguaguagcuaaagguaauaacacaauagcaauugaagucagaaggagaccucuggauucuagauggagauauagguuggauguuauagcagauaauagaagacuuuauuuugauagacccucacuaaaauuccagcacuuccaagguguuacuauuuacacuccaagcuacauccuuaaucaaucagaagucaucauuauguuugacaauggagcuggaauggagguugucgacaaucaaggauucaugagugcaagaguauuuuugccuuggucguuuauaaauaaaaccauaggccuuuuuggaaauuggaguuuuaacaaagaagaugacuucacacuuccagaugguucuagagcagcaauagugaauaacauaaaugacauggaaaggguuuacaaugauuuugguuccaaauggauguuggaggauguguuagauccucaaaaggguagagcauuguuccacagggaauucggaagaacuucagcgacuuacaacaacaaaacguucaagccucaauuccuaaugaauccggaagauuuccuaccaaccaacagaucuacagaucuuaagcgaauauccgaaauauguccucuaaaguuguacgaauguuacuacgauuacgcuaugacgguugacagggauuuggcgcauuacaccaagaauuauaaagccacgaucuaucaauauaaagaaacgacaaggaggaaaguugugucuugcggaggacuagaaacaccgagauucggacgaaagaggacuuuccuguucgugcccgggacgaagguuaccuaugaaugcauccaagaguucguguugguaggugaucagcggagagagugucaagcggauggaacauggaauauuccugaauacggauacacauauugcuuacgucaagaagaauauucuucgcgucaagcugccaucacuucagguauaauccucgcaauuaucauaccauugguucuucuauuagguuacguuggcuacaaaauauacgaaagacuaacaaguaacaaucaaaacuaugacuacgacaccguacaaaagacucaaaaucuccaacaauucagucgaacuuuaaguccauacagagaagaagacgaggacgaaaaguauccucaaagcgacacugacucacuaagcaagaaacgaagaaguuacgacaaauccuacagaacucacgaaccuuugcccaauagaccaaauucugaguuugaggaaaaaccauuggacccuuacgaucaaaccuucgaagacgacaggguuucuagaacgccuacgggaaguccaaccagcccuacuucuaguauacaauauacaacgccuuauagucggccagacauuauuagagggaacagcucaaagaauuugaacuauaacgacauguaugcagagccaauaaagaaaccuaaagaaaggauuagcgcuagucagaguaguauagugacagacguuuag

SEQ ID NO: 5640 - RNA, 645 nt, Diabrotica virgifera
augaguucuucaacagacuugccacugagcucgcugaugacuuucuuuacucgugcccgggcggcuuuaguuccuuuuuauuucacuuuucacuccauuuuccuucuugauauuuugauauuuugucgguauacacguuucgugucucaagacuuaaaaaugcguuacguggcugcuuacuuauuggccguuuugggcggcaaagccucucccaaugcugcagaucuugaaaaaaucuugggaucuguagguguugaagcugaaggagaaagaguaaagaaagucaucagcgagcucaguggcaagucuguugaagaacucauugcucaaggucgugaaaaguugagcuccaugccaguuggugguggugccccagcugcugccggaggugccgcugcugcugcuccagcugcugaaguaaagaaagucaucagcgagcucaguggcaagucuguugaagaacucauugcucaaggucgugaaaaguugagcuccaugccaguuggugguggugccccagcugcugccggaggugccgcugcugcugcuccagcugcugaagaaaagaaagaggccaagaaggaagaaaagaagguugaaucugaaucagaagacgacgacaugggcuuugcucuauucgacuag

SEQ ID NO: 5641 - RNA, 2724 nt, Diabrotica virgifera
augaugacugaccgcuucgguuuaaaaugggacccgaaaaacuuagagauaagaaccaugucuguggaaaagacauuggaaccccuagugcuucaaguuaccacccucgucaauaccaaggggccuagcaaaaagaagaaaggaaagucuaaacgugccaaugcucugguuaguacuguugaaaaagccacggaaaacuucauagaaaagggggagcagauagccuaugagaauccagauauuacugaggaaaugcuggcagcuguugacgaagucaagaaaacgggacaugcuaugagcggagcugcaagagaauuuucagaagacccauguucuucuuuaaaaagaggaaauaugguuagggcugcuagaaaucuuuuaucggcuguaacucgucuuuuaauucuagcggacaugguugauguccaccuuuugcucaaauccuuacauguaguugaggaugaccucgaaaaacuaaaaaaugcuucaagcaauggcgaacuuuuagacaauauuaaagccuuuggucaaaaugccaacgaauuaaugaaucaggcugcuaaaaggcagcaagaacugaaagauccacaacuucgugaugaucuagcagcugcuagagcuguacuuaagaaacauuccacuauguuauuaacugccucuaagguuuauguacgucauccagagcuagcagcugccaaagcaaauagagauuaugucuugaaacaaguuugugaagcugugaauaccauuaaugauguagcucagggaagaacuccucaaccugcuucuggaccauaugauggaccuggagaguuggcugcugcuuuggaugauuuugaugaucacaugguaauggagccucuagcauacaaugaaguucauaccaggccuucauuggaagaacgucuagaaagcauuauaaguggugcagcucuuauggcagauucuaguuguacuagggaugaaagaagggaaaggauaguugcagaguguaaugcuguaagacaagcuuugcaagacuuguugacugaauauaugacaaauaugggcaauaaagauaaaagugagagccuaauacgagcaaucgacaauauggguagaaagacuaaggauuuaagaagacaacugagaaaagcuguuguagaucauguaucugacaguuucuuggaaaccaacguaccucuucucguuuuaauaaaggcagcucaaaauggcaacgaaaaggagguagaagaauaugcaguuguauuuacugaacauuccaauaaguuaguagaaguugcuaaccuugucugcagcaugucuaauaaugaagauggugucaaaaugguuagauaugcugcugcucagaucgacaaucuguguccugaaguaauaaaugcagcuagaauuuuagccgcuagaccucgcaguaaaguugcucaagaaaauauggacgcauucaagcaaucaugggagaaucaagugagacuucugacugaagcagucgaugacauuacuacuaucgacgacuuuuuggcuguuucugaaaaccauauucuggaagauguuaauaaauguguacuugccuugcaagaaggugauucugacacauuggaucgcacugccagugguauaagaggaagauccaauagggugugcaauguaguaacagcugaaauggauaauuacgaaccuugcauuuauaccaaacguguucuugaagccgucaaaguauugaaugaucaagugaugcccaaguuuacucaaagagugcaaguugcaguucaagcuuugggaaauaguccucccaaagaaguggaugaaaacgauuuuaucgaugcuucuagacuuguuuacgauggagugagagaaauaagaagagccguucuaaugaauagagccgaugaagauuuagauccagaagaugucgaauuggaugaaaacuaucuaauagaaacaagaagcaaaucgagcgcucacacaggcgaacauggaguugaugaguauccagauauuaguggaauuacaacggcuagggaagcuauggguaaaaugccggaagaagauaaacagaagauuuugcaacagguugaguucuucaggagugaaaaacucaaguuugaccgugaggucgcuaaaugggacgacacuggcaacgauauuaucguucuugcuaagcacauguguaugauuaugauggaaaugacagauuuuaccaggggucguggcccucuaaaaaccacuauggacguuauuaaugcggcuaaaaagauuuccgaagcuggaaccaaauuagauaaacuuacucgccaaauagcugaacagugcccagagaguuccaccaaaaaagauuuguuggcuuauuugcaacguauugcucuuuacugccaccagaugaacauuacaucaaagguuaaagccgauguucaaaacaucaguggagaacuuauuguaucuggguuggacagugcuacuucuuugauucaagcugcuaagaacuugaugaaugcuguaguucucacaguaaaagcuucauauguggcauccaccaaauacccaagacaaggaacuauugcaucgccgauuguugucuggaagaugaaagcgccagagaagaagccguuagucagaccagagaaacccgaagaaguucgugccaaaguacgcaaaggcucacaaaagaaaguucaaaauccaauucacgcucuuucugaauuccaaagcccaacugagucuguguaa

SEQ ID NO: 5642 - RNA, 1236 nt, Diabrotica virgifera
augucguucucguucggagccacuccaacaccaccucaaaaaaccguugccuccgguuuuacuuugccuucaaauccaauaguaacuucaacuacuggauuucaaagcaguuuugguucaggagauaauaaagaccaaaguaaaccgucauuauuugcaacccccucaagucaacccguuucauuuggguuaacuacaaaggccacuacagccccaacaacccucuccuuugguuuugcuacuccuacgacuguaccguuuggaucaucaacuacaauuacaccugcaacaacuccucaauuuggauuaucgcuuccaaaggcuagugccccggccacuacuaccuuuucacuucuaggaucugccccagccacuacugcagcagcaccuacagguauaucauuugguacugccacuacuacagcaacaacuucagcuacagguuuaucauuuggaacuccaauuggaacugcuacaacuacagcaacaacuucagcuucagguuuaucuuucggucuuacaacagcgucuucuacaaguucugcugcaccuacacuuuugucaucaacaaccacuucgacaacgucaucagugucugcaucuggugcuuugaguaguacaacaucagcaccgacuuuugccaccucaucguugucuucaacaggcaccuuaacauucucucaacucgaagauucgaucaacaaauggaccauggaucuagaagaacaaggaaaauucuucaucaaccaggcuaagcaauuaaaugcaugggauacuuuacuuauaucuaauggagagaaaauuuuaacccuuaacaguagcaucgagaaaguuaagcaacaacagcaacaguuagaccaagaauuagacuucgugcuggcacagcaaaaggaauuggaagagcugauuguaccgauagaaaaagaauuguuggggauaccuguuacggauaucgauagaaaucaaauguaccaauuuucggaaauagucgauucacaauuaaaacagaugucugaugauuugaaagaagucauugaacacauaaaugaagccaauaaagaggaagaagcgucaaacccacuaagccaaaucagucgcauauuaaaugcgcauaugaauucguugcaauggaucgauaggaguacagcucagauuagcucucaucuagaacaaauuggaaaaaugcaagauucaaacagaagaaaucacucuuuuaauaauuccaugaacuuuuaa

SEQ ID NO: 5643 - RNA, 582 nt, Diabrotica virgifera
auguuucugugggacugguuuacgggaaugcugggauaucuaggauuguggaagaaaucuggaaaacuauuauucuuaggacuggauaacgcaggcaaaacuacccuucuacauaugcucaaggaugacagacuggcccagcaucuucccacguuacaucccacaucagaggagcuuuccauugguaacaugagguuuacgacguucgauuuggggggccacgagcaggcuaggagaguguggagggacuacuuuccagcagucgaugccauaguguuccuuguugaugccaacgacagcucaagauuuguagaaagccaggaacagcuaaaugcccuccucucagacgaaacucuaucaaacuguccaauacuuaucuuagguaauaaaauugaucucccaggugcugcuucggaagaugaauuacgaacuagauucggcuuguuuggccaaaccacaggcaaaggcaaaguagccagaaaugaucuacccgguaggccucuagaacuauuuaugugcucuauacucaaaagacaagguuauggagaagguuuccguugguuggcacaauauaucgauuaa

SEQ ID NO: 5644 - RNA, 573 nt, Diabrotica virgifera
auggaggaaauuaaccuggauuuguuggagaaacguauagaagcuuuggaauuaaagguguuuccuucaggagaucccaguaccauugccgacaaaaaucaaacaauaacaaauauccuuacacaaguucagacauucguuaccacagcucucacuuguagagaaacaauaacguccauguugcaguuuuauggaacuuuaaacgacuaucucgacccagcugguggagcagaugaacucgagguugaggcaaaaagacauuauauauugcaguuacacccugagaucaaagacacccuacagacacauacucgaauuuugcagacuuuacuccccuuuguggaaucagaaaauauuucuaaagugguugaaaugacagcucaauuggaagaggcaucuguuagucaucucaguuuguauggagaguggagagauacaauguacaaaauggugguagcucuacaagauuuuacugauauaaugaguucgauuaagguauuguucucucaauuagauaauaccuugacgaaucuggaauacucacuucaaccuaaauuuguuacugaggaauga

SEQ ID NO: 5645 - RNA, 1749 nt, Diabrotica virgifera
augaauaacacaaaaacgcaggaagucuacagcgaccuaacauuauuuacaacuccagauaaguuuuucuuggagcccaaaaauggagaggaauugcuugugauagagagaguaacugaagagauuucaguuuauaaaaaccaccgucacaucauaccagcagcuaguaguaggaaagauuucuguggccuccuaggaaucauuaaucucuugucggggccuuauuuaguaauugccacacagagggauauaguggguuauauaucagguugugcaguauggaggcuaguaaaggcagaacuaauucccuucaggagcuccuuaaacuuaaguccagaaaaacaagccgacaaugaagucuaccuuaguaugauagaacaaguuuuaacgacacccuuucaguauuucuguuacgauuacgaccugacacauucccuucagcgccuucgggacauuucuccagauuucuggaaacagucccugugggaaagagccgaucaacgauuuguauggaauggauuccuauuaagcccuuucagaaaugugaucagcaaaaaguuuugucugccguugaugcuaggguuuguuucuauuaacuuuuguguuguuaaugggcauagcuugaacuggaucauuguuacgaggagaaguguuuuuagagcagguaccagauuauuccgcagaggcauagacaaagacggaaacguugcuaauuucgucgaaacugaacaaaucguagaguaccaaggcgaucaugcgaguuuuguucaaauuagaggcucuauuccacuuuucuggcagcaaaaucccgauuugcgucuuaaaccuccuccuaccaugaucgauauggacccacaagagcaacauuccaccuguuugaagcaucuagaagaaguggcaacuuuauauggcaaaguuguguuagucaaucucauugaccaaaagggagcugaagguaacauggagaaauccuuuaagaacgccaugaguucauugucguauccuucagcacgauacgaaccuuucgacuuccauucugaauguagcaaaaugaggugggaccgucugaaaauccucauagaccgucuagcucuggaccaagaugaaaugggcuucuuucucuuauugcgggaugguuccuuaagcucguuacaagacggagucuucaggacgaacugcauagauuguuuggacagaaccaaugugguccaaaguaugcuagcgcacagaaauuuagaaauaguuuuaaggaaguugaauauuuuacaccaaaaccagaacuuggaguuccaguauuccuucgagguuuuguuuaagaauguuugggcagacaacgcugauauuauaagcacacaauacucgggaaccggagcuuuaaaaacggauuuuacuagaacagguaaaaggacuaaggcuggaguuuuucgagacggagucaauucgcuuaccagauacuacaaaaauaauuuaacugacggguaucgccaggaugccauagauuuguucuuagguuacggcaaaccgauaucuccacuaagaguagacaaaucguggcgauauauuacuuacccuucgguacuuuuagucgcuguauccauguuuguagcuucugcuguguuuccuucggaauacucaaccgaaucucuucuguuuuuguuguuuugggguucuauggucuacgccacauugcacaccauauucagauacggcguugaguucguggacagaccuaggcucacgcagucuuag

SEQ ID NO: 5646 - RNA, 1761 nt, Diabrotica virgifera
auggcaccuacaauacagcaaaacaaccagaacggaacagccaauggcguugaaaaaagaccaguaaaaacuguagaaaaaaggucggauuuaauauguaaagugaaguacuguaacacuuuaccugauauuccuuucgauuugaaguuuauagcauauccuuuugaacccauaagguuuauucaauacaacccaacaucccuagagcguaauuacaaauaugaagugcuaacagagcaugauuuagguguuaguauugaucuuauaaacaaagauauauaugcuauugagccaggagcuacucuagauccugccgaugaaaaauuacuagaagaagacauuuuaacaccucaggacucaaaaagaucucgccaucaugccaagucaguauccugguugcgaagaacugaguacauuucaacggaacagaccagauuccagccucagacuauggacaaaguugaagcuaaggucgguuauaguauuaagaaaucccuuaacaaugaaacguuguacauggacagagauucucagauuaaggcuauugaaaagaccuuugaagacucuaagaaugucaucgagaagcauuacagcaaaccaaaugucguagcuguggauauuuugccuguguauccagauuucagccuuuggaaguacccuugugcccaaguuauuuuugauuccgauccagcuccuguuggcaagcaaguaccagcucagauugaagagaugucucaggcuaugaucagaggugugauggacgaaaguggagaacaauuuguugccuacuuuuugcccacagaagacacucuucagaaacgaagggaugauuuugucaaccagauaccauaucaagaugaugaggaauaugaguauaagauggcaagagaguacaacuggaauguaaagagcaaggcaagcaaaggguaugaagaaaacuacuucuuuguggcaagaccagauggaauuuauuacaaugaacuggagaccagaguaaggcugaguaagagaagggucaaagcuggugcuccaccuaguaacacaaggcuuauugucaaacacagacccauggaugcuaaugaguucagaaugcagagguaccgagagaaacagcuggaaccaccaggugaagaugaugaggaaauggagguugaugaaccacaagaagaagaagcuacucaagaagaacaggaacaagagaagggggagaaaucaccaucucgcucuagaucuagaucaaacucaucuaacagaagcagaucuagguccaaaucaagauccaagucuagauccaagucuagaucaaaaucaagguccaagucuagaucaagauccaagucuaagucacaaucuagauccagaucuaggucuaaaucucguuccagaucccauucaagaucacgaucaagaucaaaaucccguuccaaguccagaucccgcucuaaaucaaagucuaaaucuaaaucccggucccgaucaaaaucccaauccaaaucgccuucgagaucaagaucaaggucucguucuaagucaaagucgagauccagaucugcuucaggcucuagaucaccaucugguuccagauccaggucuccuuccaaauccaagucaagguccagaucuaggucuagaucagguucuaaaucugcuuccagaucuagaucgucuuccaaagcuucuuccaaaucgggaucaagguccagaucaggaucucgaucaggaucaggcucagaaucugggucuggaucugaaagugacuaa

SEQ ID NO: 5647 - RNA, 1260 nt, Diabrotica virgifera
cacagcuguccuuuacugugcuugucacgucaaaaauuuguuggucauuuugauuuaaaagaaaguucauuucauucacaacuaaacaaaaugccgauugaaaauuuagaagaccagggucuugagaaaaacccugauuuagaauuagcacauuguaaguuucuguuaacuuuaccagaauaucgcagugauaaaaacguccacuccaaaauaacagaagcuauaaagaaagaugauauggccccaugguaugaacuuauuuguaaagaugcugguuggaaacuugaugcuaaucuacugagugcauuaaaagcuaagaacgcugagaagaucaagcuuuuggaugaagccauagaagaugccgagaaaaauuuaggugaaauggaaguucgagaagccuacuuaagaaaagcagaauacuacagccgaauuggugauaaagacaacgcaguuaguacuuucagacaaacauaugauaaaacuguaucacuuggucaucguuuagauauuauuuuucacuugauaagaauugguuuguucuucauggaccaugaucucaucacaagaaauauugaaaaagcuaaaacccuuauugaagaaggaggugauugggauagaagaaaucguuuaaaaguguaucaaggugcauauuguaugucaguacgagacuucaaaucagcugcuaacuuguuuuuggacacaguaagcacuuuuacaucauacgaacuaauggacuauaaagcauuugucagguauacuguauacaccucuauuauuaguuugccaaggaaccaauuaagagauaaaguggucaaagguuccgaaauauuggaaguacugcauucagaaccauuuguaaaagauuaccuuuuuucuuuauauaauugucaguaugcugaauuuuucacaaaucuugcagaaguugaaacaguucucagaaaagauuauuucuugaauccucacuaucguuucuauguaagagagaugaagauacuugcuuauacacaauuauuggagucauauaggucucuuacuuuacaauacauggcagaagccuuuggaguuacuguugaauacauugauaaagaacuguccacauuuauagcagcaggaagauugcauuguaaaauugaucgaguugggggaauuguugaaacuaauagaccagauuuaaagaaugcccaauuuaauucugugguaaaacaaggagauuuacugcugaauagaguccaaaaauuaucuagggugaucaauaucuaa

SEQ ID NO: 5648 - RNA, 5328 nt, Diabrotica virgifera
auggaggaaauaaccucgggacuagaucccgacgaacugauggaucuagaugagccugaagguucagaucuagacgaggaugaggaagaccucauagacgaccauauuuccucaccguuuauuuuaucaucugccccuggaucaacaaccaauucaguugcuucuucuccaauaagugaagaguuuccuccaccuuucaguuuuucgggaaaaccacucaaugucaaacggggccguggaagaccaaggagagaaggagguaagccuggcuuaccgagaguuguaagaggaggaggaacagguaugacaagaguuaggaaaccuagaccaccagguuuuaguagaagaggcaugggaaauaggagugucagacaaccagacagaucggauuuugauuucucccccuuuacuccaucaccuauugaugagcaagcuauauuggauccagaaacaggagcacuuuuauauccagagagagaaaaguugcuuccaucuauggaagaaccuccguauuuuccagaacauuggccugggaagguuugugccuuuuguaauuuaggagaaaggagucaauugggacaaggggaaaugcuaagguugaacugcccagaagguuuuuuaccacacaaagucgcugcagaacaaauuuuagagaaagccuugcaagcuccugacaaggacagaggagauaagagucccaagggaccuguaaccuguagaaggcagaaggguuuuaacaaauguaggcauccaucuaugaauagugaauauguugacgaacuuacuauuauuggguauaaugaaguuugugauguaaccagucuauuugaaccaaauggucaguucuauguucauaggaacugugcucuguggucuaauggaguuacacgagcagaaaauucagcucugcuagauguggguccaguugucuuacaauguucuuccaaaaaguguucauuauguaaucauuauggagcuaguguaacauguaacuuggauucuuguaauaaaguuuuucauuuuccgugugcuaccgccgcuggugccuuucaggaaauuaugucgauuucuacuuucuguucuaaucauauaggacaaguugccaugcuuaaugaagcuacaccuuguuuuacaugccgcacuaugggagauauaucaaacuuaauguacugcucaacaugcggugcacauuaucauggaaccuguguugguuuagcgcaguuaccagguguucgagcuggauggcagugucgaaaaugccgaugcugucagguuugucggacugucggagaugagucaaaauuaaugucuugcgaacaaugugauaaagucuaccaugcaggaugucaaagaccgauaguuacuucuauuccaaaauauggauggaaguguagauguugcagaguaugcggcgauuguggaucucgcacgccaggagcugguuugucuucaagguggcaugcccauuacacaguuugcgauuccugcuaccagcagaggaauaaaggguucuccuguccucucugccauaaagccuaccgagcgcaugcucauagggagaugguucaaugcucuaauuguaaaaaauuuguacaugggacaugcgacgcugaagcagauguagcuacuuaccaucaaaagaaagaucuuaacccugaauaugaauauguauguuuacauugcaaaaacaguacugcuagacaaauaacugcaaaaagagcaaguauugaagacucaucggauguaccagcuucccaugaaucucuuuacgaugacaccucagaauucgaccugccuucuccggaugaauuugcucguaguauggguaugggcaaaggaaaaccguucgccagcaaaauugcuaaaaagcgcaugaccuuucccguuggugguaggccaaaagguacaggcaaaguaccucccgguaagauggguuucaugaaacgaucucgacuaucggauuuuaacaggaaaaggggccauaaaucaaaaaugugcgguauuuucggcguaccugguguuggccuucaacgaccgacugccgauggaaaaagcgacgaagagcccgguguggagaauagauugguuuuauguucugccaaagauaaguauacguugacgcaagauaucugugucauguguggagcgcuuggaauggaccaagaaggauguuugaucagcugcgugcaaugcggacaguguuaccauccauacuguaucaaugucaaaauaacaaaaguuauauuggagaagggauggagauguuuggacuguaccauuugcgaagguuguggucagcgaaacgacgaagcucgccugauacucugcgaugauugugacguaucguuucauaucuacugcauggauccaccacuugacuacguuccucacggcaauuggaaaugcaaauggugugcgaugugucucacuugcggggcuacugauccugguuuuaacugcaauuggaugaacagcucuacccagugcgguccaugcgcaucacaucucaauugucccaguuguaacgagccguauggugauggagaauugauuauucaguguguucagugcgagagauggcuccaugguuccugcgauuguauaaaaaacgaagacgaugccgaaaaaugcgcagaagacgguuacaacugcauccuuugccgaccaagagauguaccaccgccucaucuuguaccaccaccacccgcuccaaaaccaccaacuccuacgaagaguccugaaguugggaaaaguucgaguuuuuauuuggacggcguuuaccuaagcgagauggggaauagcuuuauuaaaucauuagcuuuggaacaucaugccucgcgaaagaaacggaaaaaacuuccuacggugcaggauaaagaagccgguauuauggcuacaauugaaucuguuauagcaggcggaaauucugggggagccacugcuuuagaugacagcgcuaaacuagaauuggucgacgucaaagacgagccucaagagcuauacaaagaaggcaugauuuggacaaaagaggauggucccgcaccugaagguuucacgguguucacgauggagagcggaaucagugucuuaaggcgcaagagacaacggaaucuacagaaacuaggcauaggugguuuucuagucagaaugagaggcauucgaaccggucaggauaacgaugaaaucgauuccucgguaauccaaucuggcagugccacaccuacagagcuccuaccucccaugcccguugacggagauaaaccaaaaagaaaaccgauuagaagaaaaccgaaaagcaagcuagcugaaacuuuuccggcguacuuacaagaagccuuuuucgguaaagaucuuuuagaaaccguugauuguaaaaaagaaguugacaguuguagcagcgaugacgaaaaaucugucaaguauaaaucuaucaauuugucucaggaugaacugauggcuguagcugcagucucgagcaaaagugaaaagcaagcaauagccaguauuaaagacucacugaaggauauuaaaucaucuucaaugauaaaggaagaagacgacgauaauacagaagacuuaaaagacgugcuugccuuaccaggugauuuacuugaugcagaaauagucaauagcauuauggaagaugacgacgagcuuacuaaaaauacagaaucacuggaugcuuuagauaccaaccugcaagaugcuaaugaguuggcugauacauugggcagcucuggaaauucgaaagaaaccaaagaugaguuaagugauauuuuagggccacauuuuaauuuggaaucgauuucuaauaucaacagcaaggacguagaagacauauuuaaggguguauugacugaugaaucacaggaaucacaagagagcagcaauuucgcucuacaaggaaguaaucuauuuuccaacaauacuccucaacaaagucuagcucagcauuccaugaugaccucugcuguucguccuaaaacguuacccaaugugagccaaguuaauuugaauucaccaguaggauuuccuccaccaucacccuaccacucagaauauagcaauagcccucaguucaguccugcuuuuacggaaucuccuaacgcuugggugggaguucccgaaacuccugaaauagacaguaccaaugucggaguuccuucaacguacaaucagcguuccucggaaaagaugaaagccgacgaaaguuugggcaacggugcuaccaucucagccguucuauaugcuaauaugaaucauccagaauggaagaaagauuucccgguuuggucugauagguacaagcaaauaaucaagaaguggaggacacuaagucaagaacagaaagcuccguaccuucaacaugccagagauaauagaagccaauugagaaugaagaaagcccagcagucacagaccuccaaggaguccaccgcauccacaucaacccccaacgugaccaagccaguccaugccgucccagcucuagugaccacccuccaggcaguaucgcagcagcccgugggggugacuacagcccccacggcucccauuacagaggaucaagagaagauggcgcugcaacagaaauccgccagggaagccgaacaagaaaggcaauggaagcagcuucaggcuaugaggcagcagcagacgcagcagcaacagaauauuauacacgaacaacguguucaggccaucgccagaguccagagaucaauaucgguggauccagcucagcaguuuuugucggaccaacaaagucccuuacaaccaaguacgccucaggagcuuagcccgucugcuacgccaacaccaagcccaagacaguucauaggaaugaaauccccgaccuucccucuuccuucaccagugccucagacagcaaucagaccuccuacacccucccauucuccacaugauguaagucaggcaagcaccucugacgguaaugaucacuuuauucagucaccuucuacuccuaaaccuaguuuuccuaauagauuaccuacagaucaauuuauccaucaaccugcaacuccuaggccccaguuuggaauacaacggccaacuuuacagaacuuugguaauacgaugaggacagaccagcaagauauuaauaucaaccgacaguugagagaucuccuacagcgacaacaagucaaaaaguuggaugaaauguuaccagguaaaguucaacaacaaagaguguggccuccaauugaacaacaagaaaaugaggccucagcaacuacugguacuucggcaguuguggcuacaacagcagauaccacuuucaggcaaccauugccgcccaguauugua

SEQ ID NO: 5649 - RNA, 4458 nt, Diabrotica virgifera
auggaagauucuccgcaagaggcacgauccaauagacgaucucgagauacuucuuacaaaucaaaggccuuugaaaaauucaaacaguuaaagaaaggauugaaaaauaaauaugagguugaugaaauagauaauguuuaugaaguaguugaagaaaaacaguaugucaaggagguuuugucaagauaugaugaugauuggauuguggaugaugauggcgguggcuauguggaagaugguagagauauauuugaugaugaucucgacauggagucaauugcucaagccucagcuaaaagcaaaggcacuaaacgaaaaacaaaaaauguaucugaaaaugcugggaaaggaaaaauucaacaaauguuauccaguuuaccuucaaagaaaaaaguggaaacgaaaauugaugaugaugagaugcugucagaaauucuuggagagauugauuccucgccuuccacuaguggacaaaagccaaagauuaacgaguauucagcuuuagcuaaaaaguuggcugcuaaggauuacaugaaaaauuucucccaaccuucuaaaaaacgugucauugagaggaaaucauuaccaaaugaggaagcuggggaggugacacaugggucuguguuaaaagaaguacagucuaaugugggaaaauccacaaagaagccccaaagaaaugucacagaacaaacuguuaucaacccuuucaaaaaagugaaagaaacuccugcagucaaacagccacaaacugaagcagcccaagaaguaauagaagaaacuccuuuagaaaccuuugaugacaccuugacagaagacuucgaugaugaucccauguuugaagagcuggauaaaacaccaaccccaguugcaucaugucaaaagguugcaagucagacuauugagacugauuuaacucaggaugacuuuggugaugauuucgaugucacccaaauugaagaauuugagucacagccuucuggggaugucgaagaagccagugaaaagcuuucggaugagcugcaggcugaauucgaaaccgagugggagaauuuuaugaacaaaacuguugauauugauaacaccaccgaggcuuuauuggauaagagugauauacccacaauagaugaugaagggaaaaagauauuccgauuuuuuuggugggaugcuuaugaggacccguugaagcaaaggggaacaguuuucuuauuuggaaggacuuacugugagaaaagcaagagcuucgucaguuguugcguagcugucagaaacauugauagacgucuauuuguuuuaccgaggccguaugaacucggaccagauggacaaccuacagacacuccgguuacauucaagaaaauguaugaagaauucaaugauaggguacuuaagccgauaggaguuaguaccuucagaucuagacagacuaguaagaaauaugcuuuugauccaaauauaccacaagaaucggaauauauggaagucagauauccugcaaaugauccaaaaauugacgcagaucucauaccuaaaaagacacgcaccuuuucaaaaauuuucggaguaaacacuaguuuccucgaaaucuucuuccuagaaagaaaaaucaagggaccuugcugguuggauauaucaaauccagucccaguuacgaaccccuuaaguugguguaaguucgaagugaacuguacgaagaugguggauuuaaaggugacagugacggaaaagccucucccuccaccuccuuuggugguaacugcuauuaacauaaggacuugcaucaacaggaaaacuuguggccaugaaauugugauggcgucuugcuugacgcauaaaaaauaugccguagauaugcagcccccagauccgcccuuucagcaacauuucugugugauugcuucucccggugaccagacauuaccuuuugauauccacgaugcccucagcaaauacaaagcaaccaaaguacaaaaaauggacucagaaaaaggauugcuaaacuuuuuuguaaaccaauucuccucuaucgaucccgauuuaauaguaggccacgacuugcagggcuaccaaauuaacaucuuagccgaaagacuuucaaaacucaauacgaacauuuucaauaaauugggucgcuugaagagauccgaaaagaagaauuuggagaaaagucuguuugcuggaagauuagugugugauauaaaaauaucagcuaaggaauugauaaaaucaaggucauacgauuuggacgccuuaugucaagucguucucaaacuuaacgaaaaucaaagaaucgaguuagaaccugaugauguaccaaauauguucaaaaccacuucagauauucugaaguugauaucguuuaccaugcaggacacuauguauauacuaaaaaucauguacaauuugaaugucauuccacuggcguuacagauaacgaauauagccggaaaugucaugucgaagacucugaugggugguagaucagaacggaaugaguuuuuguugcugcacgccuuuucugagaaaggcuauauacuuccagauaaggaguauaagaagagaggagaugggaagcagaguucgaaaaagaaaccuacguaugcgggagguuugguuuuggaucccaaagucggauucuacgacaaccuuauccuccugauggacuucaacucucuauaccccagcaucauucaggaauacaacaucuguuuuaccacauuaccaauaagcgacaaugacgaaaaccuuuucuuacccgacagcaaccuaccuccaggaguuuuaccaacagagaucagaaaacuagucgaaagccggcgccaagucaaaggaaugaugaaaaaaccggauauaucucuugauuuacgaaugcaguacgacauuagacagauggcuuuaaaguuaacagccaauaguauguacggaugucugggauuuucgaauucuagguucuaugccaaaaauuuggcugcgcuggugacgcagaaagguagagagauauugacgaauacuagggauaugauugagaagaugaauuuuaauguuguuuacggagauacugauaguauuaugauuaacaccaauauuuuggaauacgaucagguauuuaaaauuggugucaaaauuaaacaagaaguaaacaaauuauauaaacaagucgaacucgacauagaugguguguuuaaguacuuacugcuuuuaaaaaagaagaaguacgcugcaguaacauugaauaaagacaaaaacgggaaauugguggccgucaaagaguauaaagguuuggauauuguucgaagagauuggucccaaauaucuuccgaagcuggaaaauauauauugaaucaaauuuugagugaccaauccgccgaugaaagaauagagcauauccgugaauaucuaagaaaaauucgugaacauuuaacugagggcaaaguaccuacuccauuauuaauaauuaccaagcaguuaacgaaggagccccauauguaucccgacaaaaauagucuaccgcacgugcuagucgcucuucguuacaaccagaaaagcggaggacauuuuagggcaggagacaccguaccuuauauaaucugugaagaugguaccaccaauagcgccguacaaagagccuaccacguagacgaacuaaaaaguaauucugagcucaaaguugauguuauguauuauuuaggucagcaaauacaccccgugguauccagaaucugcgaaccgaucgaaggaauagauucauaugagauagccgagugcuuaggauuagauacgaaaaacauaaaaagacccagacaggcaguaaacgaauuagucggagaaaauauuagcagacccgaaguuaaguucagaaacguggacaaguuuaaauuuauuugcuauggcuguaagcaggauaauauuguggagggugcauugguaggaaacgcaccuuuucuggaacggugucgaaacgcugauugcaguuugaaaccaaucgauuacuuacccuccauacaaaaccaauugacccuuucgauccaaucauacauuaauaaguacuaugaaaauauccuaaucugugaagauccugcaugcacaaacgaaacaaaccgccuuccacuuaaauuugccaggaaauauccgauuuguacauuaugucagaagggagucauguucaggguguauaacgagcagcaauuguacacccaguugucuuauuuccagcauauauuugauuugaguaaacugaguaaaaagccucuaauggaacaggaaaucgaaucugguuauucgucacuccaagauguuguugaaaaguauuugaaucacuccggauacuccauaauagaccucacugaccuuuucuccaugcuagauccucacaaaaagcgggaaaccacaacaauugauguaaauagagauguagaugaagacguccaauauauggacgaggaugaagaagaggauguguaa

SEQ ID NO: 5650 - RNA, 1122 nt, Diabrotica virgifera
auggcuuuaagaaccuacggagauaaaccaauaaguuuucagcucgaagaaaauggagacuacuauuguguugguuccgaggugggaaacuaucuacgccucuuucgagguucucucuauaagaaauauccuggaauguucaggagaucaauuacaaaugaagaacggaaaagguuaauugaacuuggucuaagucaacauguucuagcuaguagcguaucacuacugagagcagcugaaguagaugauaucaucgaagggaaugacgaaaaauauaaagccguaucuguccauacuucagaaccaccaaugccuagagaaaguaaaucgaagaaaaauuugcaaugggugccaucuuugccaaauuccagucauuuagaugcaguuccucaagcuacuccuauuaauaggaacagaguagcaucaaaaaaggugaggacauucccauuauguuuugaugacacagauccacaaguaaacauugaaaauucuugucagcaagaaauacuuguuccuauuagacuugauauggaaauugaaggacaaaaacucagagauacuuuuacauggaauaaaaaugagaguuugauuucucccgaacaauuugcggaaguccuuugugaugaucucgauuuaaacccauugacguuugugccugccauagcucaagcaaucagacagcagcuggaagcuuuuccaaacgaaccgccaaguauacuggaagagaauugugaccagagaguaauuaucaagcugaacauacauguaggaaauacuucauuaguugaucagguggaaugggauaugagugaaaaacaaaauaacgccgaagaguucgcucucaaauuauguuccgagcugggucuaggaggggaauucguaacagccauagcauacucuauccguggucaacucucguggcaucagaggacuuacgcuuucagugaagcuccgcuuccgacaguugaaguuccguucagaacucccagcgagucagaucaaugggcgccguuuuuggaaacuuuaacagaugccgaaauggagaaaaagauaagagaucaagacaggaauacccgaaggauccggagauuggcgaauacaacgccggccgucaaccgauga

SEQ ID NO: 5651 - RNA, 4005 nt, Diabrotica virgifera
augaauacaacaacgagaguugauaauacacaaaauccaguacaaaaaauugaauuaacuucuagaaguauugaaaaugccuuaauauuggauaauaauucgccaagauuguuagaucuuaugaauaucaguucccaaaguggaucuacagcuagugguuuugcagaucaugacuauccaacuaucaguggaguaucacaaguuaucaacaauaugacacaaguuaaauguguuaauagcauuccuuuaccaacggaaauuguugaccacuuuucacggguucaaugccauugcaugaugggucucuuuugugaaaucaauagagcuuggcuuacuguggauagugauauuuauguauggacuuacgaacaaaauacugaucuggcauacuuugauggaauaagugagaccauuguuuguguuggucuuguaaagccaaagaugggagucuuccaugcuuuuauaaaguaucuucugaucuuggcaacuucuguugauauugugguuuuggguguaacuuuuacugagaagccaggugauaccacagaggaaauucaguugauaccagacccaguuuuuaguuuaccaacugauggugccacuguuacuaucaucaguaguacuaaugacggaagaauuuuuuauggcacaaaggagggaaagcucuuugaaauauacuaucaggcugaaagugguugguuugggcaaagauguaaaaagguaaacuugucuacaaguacccuaucuuuucuaguuccuucauuuuuaaaugcugcucuuagcgaagaagauggaauuugucagauuucaauagaugagagucggcauauauuguacaccuuaacagaaaaaggaacuauagaaguuugugauuugggcgaaagaggaaauacauuuucaaggauagcaaaauugggccaaaauacucuaguaaaucaagcuaugaauacugucaaaacuuuagauagucaaaacuucagaccaauagucaguauaucggcuauugaagccacagaaucugccaacuugaaucuaguugcuguaucccaaacaggaguucgauuuuaccugacaguaguuagucucuccaaucugcaaccaaaucagagaccauauacucuagcuuuagcucauguacgucuaccaccaggauauucugcuaauauaacaguaagaccuagagcuguccaugugucccauuauaacgauaggaauuuaguacugauuucaacuguuaaugauaaagauguacuuuggugcaugagcucagauauguuucccuuuggucagaccuugauggaggcuuauaguguuguaaauuuggauggaccagcauuagcuauaucagagguacggcauccgacuccuuuaccguuaccaccaaaccaagaagcgccaccucugguugucagacaacacgcggaaccgccuaagaaauaugugguucuaacaucucacaguguucagauuuuuauuaaacucaggccaguugauauucucaaucagauucuuagagauagccaaggcuuagauacugaagcacuuaagacauuuuuuacgauucaaaaagaggaucaggcuugcgcaacuuguuugauucuggcuucuuuagaaagugaugagaacguugagguugcagaauaugccacaagggcuuucuuuuuguaugguggagaaccuaaacuggugccagcuaauauauaugcgggacccagcguauuugcuccucaaauaauaucaacacccgcuccacacaauuaccagacgcagcaauaucaaaccgcucaacacuuucaaccuaauaugucacaaacagcgccaaauacuacaggauaugaauucacugguccguuuguuuuuucggcgaaacauaauaguuuauauuuguauuuaaguaggauauugcgaccaauuuggaacaugagaacgguugauaagcuuucuguugacggaaagguuucuacgacauacaguaccguauccagugacgacugcauauuuauucuaaauaaucuaacugcucuccauaauuuccuagcacgaaauacacaacugucaaccaugagcaagaaccaaaaucaauuccagaacaguacacuuaauaauacaucuuuaaauaugacgagaaugaaccauaccgugcaagacgcccaaauggaagaaaaagcaucacugaauucuuucaaaauucuuguuucgcuuuguugucaaauacugggucucuggcgaauccugugugaacaucaauuucauucauugguggcgucucuuacggaaaacgaacagcaaauucucgucaauacaacuuuuaaagacuuguuccuuuacagacacgacauuuguucgucauugauaucagcucucguucaaaccuaucuuggagacaacgcuucugucgauucuaucagcagcaaauugagagaaguuuguccacaaauguauaaaaccgaagauauggcauauucaaaggcaaucgaaauccuaaaaucugcucgaacaauacaaaaugucggagaaaaagaagaauugcucaauucagcgcuacaaauuuguaaaucuaucggaccuaauuugaacaucggugauguguguaaagaauuuuguaaucuuaaaggauacaaagccguaacugaacuauguugucauuaugccucaaaauuagacccagaaaauauugcagagauauauuacaaugcaccggauagcacuggagaccaggaagguuauaauuacuaucaaaacagaauggaaauuuauaggcauuuauugaauauguuaaaugccauguaucaagaacuuaauguaacuccaguaccgugucucaacuacgaccucgauuuuucaguaacucaaucaauuuugacagauacaccagaacagucacaaauuggauauaugaugaagcaagugaucacugauauuuugcaaacucccgaucaaauaaugcauauaaaccuauacgauuggcuaauaucuaaaaauaugacuggagauuuacuaacaauuaauaaugauuccuuggagacguaucuuaaaagaacagcagcucaaaauccaaaugauacuguugcuuuggaccuucuauggaaauucuaugaacaccgcaaugaucaugccgcugcagcuaaaauucuuaauagccuggcaucaagaacugguguuaacauuccuuuaaaagaaagauuggcguacuuagcccggucuauaauguguaugagaagcgacaaaauaggauaugcgccauauuuaggugucuuccuuagagauuuggaggauaaauuagaaguagccaagguacaagaacaaauuuuagaagcaguuaugaaccaacaaaaucaaaucgaaaauuauggagauauugucacagcucugaauucgggacuauuugaaauaucacagcuauaugaaaauuucgcugagccguucaaacuucucgaaugucaacuggccauuauugauugugccggauauacugauccagcguuaauagaaacuauauggcaacagauauugaccgacgagcuaaagaagacuaccggaacuggaacagacaaaguaugucaauuauuaaacaaagucaaacauuuagccaaauauuaugcuaaaucaaugaacuguuuuccuuuagauuauauuaucuaugaauuagaaauagugaaugcaaaguuaagaggcgauagacaacuaguaccuacagcucucgagaguaugaauauuccauuugacagucucaucgcuguuuauaauaauuugaauaccauaucgggaaacgaccauuucuggcaguuggaagaaaaugaauuucaucuuugugaagcuacagcuacucuaauuagcuguuuuaucagcaaccaagauucguacagcaguauagaaaagagaaaauacauaucauuaucucaggacaccguuguugcacugcugucuaauuuauacagcaaaccuaauacagaagcgauaguuaauaaguuacgaaauauucaggccagguuagccagaauuuaa

SEQ ID NO: 5652 - RNA, 4266 nt, Diabrotica virgifera
uucugucuacacaaccguaaaauauacaaauuuuuuauuaagaacaaaaugaccgaauuuacuuuaagcuaucgugaaguuauaccggaucaaacaguuuuugaaaauuggaaagaaaucucccuuaccacaggugggacacaaaguacucuccaagauauaaaaguagcugaacgagccaacggauuuuccuaugaagauucaacaaagcaucauacaagaaacagauuuaucuacuggagaaucaacuaugaugucuuggaauugguagaacauagccuggauaucaauuuaacagcaaauagaguuagauacaaguuuacagauacuccuauucuagauggaguuuccauucacgaaacuuaugaaaacauuauugugcuugucccaacuguuuguaguauacaccguuuaauauuuccacacccugauagguuucauagacaggaugauuuacuaggagugcauccagauuuggcugcucccucaauauuuucaaaagcuucaccuguggaugccagaaauccaaauacuuuuuauguuuuuaauaacccaaccacugccacugaccaacugcccaauuuagccaguucuuacuuguuaccugaaacggaggaagcauuuuuuauauuagcuuauccaucaacagaauuacuauugauaaaacaaaauccugacaauggccaaguuguauguacagagcugaaaggagaaucuuugaugccuagauuuuugucuggacuugcggaaaaguuuagaccaagaaauucugacggugauaccauagugagucucuuguuuuauauuguugauuaugaaacuuacguuuugacacugacaagagaugcccaucucaaguuuugguccugcacuaaaggacaaugugucgcaguuauagaugucagagaaaagacaggagaugguucaaaggaucgaguacagggagccauauuaaggaaagcaguagauggcaauaguacugaaaguaucuuggcgguguuuuuaaauuacuccaguguuggucaauuucauaucuuaaauccaauaauaaauggccaggaaauaacaauugacagauugguuacuuuauacucuccugagaaugaucuuaucgauuuugccuuacaaaccaaucgccuauggucuguauggcgaugcgaagauggcgacagcguagucuacacugccacacugccaguaucccguugugcuuccuacaaaucaagcaauuggucaccuauuauuuuggaaacauugcccgaugccaaccaagcaccugccaaugauggagacagugauccuagacaaguguauuugcaacacauuuuccgucccggcagauuuccuuugcacauaauaagcaaagcucuuuccauuuacaagaggucuacuauauuaucugaugcccaaauaucagccucagcuuuaaaacagagaauuugucuagcuguggauaaugaaauacaaaauacgguaaacggaucuaaugugaaugaugaugaauauuuagaaugugcagaaugguguuggcaaaaauucuacucuugcugcguacaguaucauaucgcuagcuuaaaaccucuaggucugauguuauuaccuucugucucuggagcaguauuuuugaaaaagucgacguuuucauuccuccgaccuuuggauccacuggaacacaugacucucugcuaugaagauguuuacagagaccaauuugucaauuuuucuauguuagcugaagaucuagacacaacggaugauguaaugaacuuguuuaaagucaucguauauuuagaacaacaaaugagugaaacauucguccaggcauucgagaaagaaauuuuuaaucuacaugcaccugauguuauaauggaagguuuauuagagaagauucagucugagauggauugucaguucgccucgcacauauuggaaaugaugaacgauguuacugacuuauacaaaggaaugcacaaaauuuuagaacucuuaagauaugaaaauacauuagccagcccggauaacgacauaaauccuggagcuauguaucauuuuaguuccuugcuggguacuucaguagucgcugaaaguuugagacaacaagcacagauaagauuccaaauauguagaaauuuacuucugaucugcaacauuuuguugaacgaaaaaacguuggauuggggcguauuagaagccauacguucaguuuguacuccggagauuguuguucucacacaggcuaguuauguaguucuauggcuguguggauuaacuacuauuguuaacuuaccuuucagugcucgcgaaucuucgauaaauagauuggcgccacucaaauuagcuccuguuuugaauuugaggccucuuacuacauguacgucguuauuggagcuuuucauauccucuaccgguggccaggaagccagaaaaucuuuugccagaguaaauugcagcgaugaggcuuuggcccauuggcauaucucacuucuaccuuauuugaaucacgugagacauauaauuuggcccauaacuggagguacaguucuugccgagugguuguuaagcaguggacaacauuuaugguugcaacaauacguucguuuacuuagcaacuggugugaauggaauaguuguacaagaaacuucuugcuagcuuccgccuuuuugucaacuggagaauauaacaaagcagaagauuuguuugaaacggcugcuaaagggguuuuaacagauggcuuuuuacaagaacguuguuuaaaagggaauuugccuaguccaacuggagcguauauucacuauuauuuaaagguuauucaacuauuugaucuucacaaggccaaagauuccguuauaagcauugcaaauacugcuuugagcauuguagacccagaagauccuuuagcggcuacuuuauauuccaucaaguucaaacaccacuuggcauuaaaacacuacgaauucgccuucgauucauugaaugcgaauccagaugcggaacggaaaaaagacaaucugagagauuugguuaaaacacuauuggaugaaaagaaauuggauacuuuauugaacuucacguacgguaguauggaugaguucuuuacaaauauacuguugaccagagcuagagcaaacgaugcaguuaacaacauuuucuacgacuucuuguauucuuaucaaauuaaaagaggaccccugucacacagacuagcugcaucaguaauguaugagcaggcuuucagauuaaaucauauuaacagcguugaagcacuggaaaaacaagugaaauguuacuuggcagccaaaaacguucuacaucugugucaaccagaacacgcuuggguagugagaccagcugauccagaugacgaagaugaaguaauaacuauucagccuuuagcaggaucaaacgaagaaaugaaaguauuuagauugagaaaacaacuugaagugguaaauauugaaacuguugagaaagaacuuauuuucgcaagugcaaaguuaaaauuggcaagauuuagcucgagccuaucaccgguuaauauaacaacuccuguggaauugguaacauuauuaaauacugccgguuuauucaaaacugccuuagauauuugcacgacguuugaauugucauaugcaagcauuuucgaaguacuaacaaagaacugugucucauugacggaagaagaaaaucccagugcuuggaacuggcugguagaaaacgauuugcaagaucuuccaguuaauagggauagugcagcugauguaguuuggcaguuccuacaggauugcuuggaaaaauaugaaaaaccuugcaugacuacgcuacauuaugugguuugcaaaaagauuauagguaugagaguauauuuuccccauuggcuuguagcuucuuacaagguucgaaauccugccgaguuuuuaagauuauuacaugguuccggaagauuagaagaagcaauugaauuuaccagcgaguauauacuaucugcaauggguuaugguaaagaauuuuucgguuuuacacaaccucuagcuccaacgucaccugcuuuuuguuuaccugucuacgccauccaaagguuaauugacgaauuaaaaauacagaauuccaugagucuggagcaaccuuaucugaaggaauaugaaaauuugaaaacauuguuuaccaaauauuuagaaacugccaccagaguaucgaaccagaugugucaaacaaaauuaacaucaggaucccuuagaacgaauguuuuuucaauagaugcuagauaa

SEQ ID NO: 5653 - RNA, 2907 nt, Diabrotica virgifera
auggagauguccgaugaaaauauucaaguuuuaaguaaauaucuacaggagacacuuaauccagauccaaauguucgcagaccggcugaaaaauuuuuggaagguguagaaguuaaucaaaacuauccuuuacuaauauuaaaucuuguccauaaaccagaaguggacaugacaauuagaauugcuggagcaguggcauuuaaaaauuauauaaaaagaaauugguuuguugaagaagauggaguugauaggauucaugaaucugaucgagcugcaauaaagaauuugauagucacuuuaauguuaaguucaccugaaucaauucaaaagcaguuaagugaugccauuagcauuauuggaaagacugauuuuccucuaaaguggccagaauuaaucucacaaaugguugaaaaguuuucuacaggagauuucaauguuauaaauggaguucuaagaacaggucauucccuuuuuaaaaaauaucgcuaugaauuuaaaucacaagaguuguggauagagauuaaguauguacuagaaaaauuggcacagccucuaacugacuuauuuguggcuaccauaaauuuggcacaaacccauagcaacgacgugaaugcauuaaaaguuauauacaguucauugguguuaauuuguaaaguauuuuauuccuuaaauuuucaagaucuuccagaauuuuuugaagauaacauucagauuuggaugucaaauuuccauacguuauuaacggcagaugucaaaugucuucaaaauacugauagcgaagaggcugguauuauggaacaauugagaucccaaguaugcgacaauauagcucuguaugcacaaaaauaugaugaggaauuucagcaguucuugccacaauuuguuacugacguuuggagucuuuuaguaucaacuggccuugaaccuaaauaugaucuguuaguuucaaaugcucuccaguucuugucaucgguugcagaaagaguucaguauagacauuuauuugaagauaacaauguuuugagcagcaucugcgaaaaagucauuauacccaauauggaauuuagaguuucagaugaggaguuauuugaagauaauccugaagaauauacacguagagacauugaagguucugauauugauacuaggcgaagagcugcuugugaucucguaaauacucucagccagaacuuugaacaaagaauuauagacauauuuggucaauauuuacaagugaugcuuggaaaauauguggaaaaugccaagcaguauuggagaagcaaagaugcugcauuauaucuuguaaccucauuaguuaguagaggugcuacucaaagacauggaguuacacaaacuagucagcuggucgauauaaaucaguuuugccaacagcacauauugucagaauuagagaggccugauguuaaugauuugcccguuuugaaagcagaugccauaaaauacaucaugacauuuagaucagugcugccaagugccauuguaauuucuacgauuccacaauuaauaaggcacaugacuagugaaagugcggugguacacacuuaugccgcuuguacauuagaaaaaauuuuaauuauaaaggccaauaaucagccaauagucacuggugcccaccuggaaccauuuacuacaacacuucuaacaaaucuuuuuggaauacuagaaaaaccuguuucagaagaaaacgaguauguuaugaaagcacugaugagaacauuuucuacguuacaagaaagaguucuaccauucuugaaugucgcauugccaaaauuaacagagaagcuacaaaugguugcaaaaaauccaucaaaaccucauuuuaaccauuaucuuuuugaaacauuuucauuagccauaagaaucguauguaaggcaaaucccacugcuguuacagcauuugaagauauauuguuucccauuuuccaaggaauucuacagcaggauauucaagaauuuauuccuuauguauuucaaauucuuucucuauugauggagaguacaccucaagguaauaaucuggagcccuacaugcagcuuuuaccauucuuauuggcuccugugcuaugggauagaccugcuaauauuaguccacuaguaagauuauuaugcgcuuucgcucuacaagcagccccacaaauuguagcgcaggauaaagugagcggauuccuaggaguauuccagaaauugauugcuucaaaaacucaugaucaugaggguuucuuuuugauucaaaguaugauucagcauuuaccaauggaagcccuagcaccuuaucacaaacggauauuuucccuuuuguuucuaagacucucuuccaguaagaccacaaaauauguaauuaaucucauaguuuucuuuucgcuguacguugugaaauauucagcaaaugaacugaucucgacuguugacgauauucaagcagaaauguuugguaaggugcuugaaaaacuauauauugcugaaauacaaaaaguuucuguagccgucgauagaaaaauuguagcuugcgguguaacaaaauuauuaugugaaaguccagagauauuuucaggaaaguaucaaaacuauuggccccagcuauugcaggcguuauuaaaauucuuugaaaugccaguggacucaagcaugcuacccgaugaucauuucauagaaguagaugauacucccacauaucagacaacuagugcaaaacugaauuuugcaaauacugucaagagcgauccucuccaagcuauugccgaaccccgccaguuucugguucaaagcuuagcaacucuuggaaauucucaaccuggacggcuuccaguauauauuagcaacauggauguacaaguucagacaauacuaaauaguuaccuaucuaaguuugcuguucagcuggucuaa

SEQ ID NO: 5654 - RNA, 609 nt, Diabrotica virgifera
auggcuaagguccaauuguguaacauaaccgugauggacaauccuaguccuuucuugaacccauuucaguucgaaauaacuuuugaauguauagaagaacuuagagaagauuuggaauggaaaaugauauauguaggcucagcugaaagugaagacuaugaucaaacuuuagacucaguuuuuguaggaccuauaccugaaggcaaacauauguucgucuuucaagcggauccuccaaaugucucacguauuccagaaaaugaugcucuugguguuacaguuguacuauuaacguguucuuauagaagucaggaguucauucguguaggauauuuuauuaauaaugaauauacugauccagaacuuaaagaaaauuuaccuaguccuccacaauuugauaagguaacccgaaauauucuagcauccgaaccaagaguuacccgcuuuaaaaucaacugggaagaaaccaaccccacagaaaauaacacaaacucugaccaaaguggagcaucagcacccacgacaucagaagcuggacccucugcuccugucgaaguaccugcuuuuaaugaaaauuccaauucgugggcuaccauggaauguucauaa

SEQ ID NO: 5655 - RNA, 951 nt, Diabrotica virgifera
auggaucaaaugcucccuaguccgggauuuaguaucccaaguauaggaacaccucuucaucaaccugaggaggaucaacuuaucuuaccaaaugcccuucaacagcaacagcagcagcaacaacagcagauugcgaccagcaauucccaaguaccuccuuuggcaccaaugggcggauugacaccuacacuuggacuuggcaugggccaugccaugucuguaccacaaaccaaauauguaacugguuucgcauugcccaugaguucuaugaaugcacaaacuccccaacacacaaugagcccuauggugaauuuaggggguucaauaacuacaggagcuggagugacuccaacgauggcaccuucaacuccuucaccuaugacgccaaugacuccucauucugcugacccuggcaucauuccacaguuacaaaauauaguguccacaguaaauuuaaguugcagauuagacuuaaagaaaaucgcucuccacgccagaaacgccgaguacaacccaaaacguuucgcagccgucaucaugaggauacgugaaccacguacuacagcccuaaucuucucuucgggaaaaauggugugcacgggagccaaaagugaagaagacucgagguuagcagcaagaaaguacgccaggauaauccaaaaacucggauucccagcgaaguuccuggauuucaaaauucagaauauggugggcaguugugacguuaaauucccuauaagacucgaagggcuugugcuaacccacagcucuuucagcaguuacgaaccagaguuguucccuggacucauuuaccguaugguaaaaccuagaaucguacuuuugaucuucgugucuggcaaagugguguugacaggugcgaaagugagacaggaaauauacgaagccuucgauaauauuuauccuauuuuaaaaaguuuuaagaaacaauga

SEQ ID NO: 5656 - RNA, 477 nt, Diabrotica virgifera
auggcugccaucagaucuaugucucgccuucuuauuaauagaucacuucaaaccacugcaaagaggaccuaugccgaccaaaugaacuucacauuugcagcuggaaaucagguuuacuauacugcaacuucaguuaaacaaguagaugugccaucuuucucugguagcuuugguauccuccccgcccauguacccacacuggcugugcuaaaaccuggaguagucacuguuuacgaagauggugguaauguuaagaaaaucuuuguuuccagugguacugucaccaucaaugaugauucaucaguucagauucuugcugaagaagcccacccaguagaaaacauugaugucaaugcagcaagagacauccuuaccaaagcccagagccaguuaucaucugcaaguacagaugaggcgaaagcugaagccuccauugccguugaagugggagaagcguuagucaaagcggcugaauaa

SEQ ID NO: 5657 - RNA, 987 nt, Diabrotica virgifera
augaguggugacgguagugacacugaacaauuugauacuuuauuucuaucuguagcucaauaucauccacagggaccaacacagcuccuggauacauuugugaguuuuuugaguagaaaaacagacuuuuucauuggcgccaaggaaggagaaugggaaaaguuagugauggacacauucagaaaauaugaaaagucgagcagggcaaaacacgaggaagaacuaaaagaaaagcgagaacaagaagcucgaaaaaaagcagcugcugccaaaaaggcagaagcagaaacugucaagccugcucaaaucaccgaauugacugaugaagaagcugaaaggcuucaggcugagauuaaugcuaagaaaaacacuucugauaaagcugaaaguucuucaaaugguccagaagcugcaaccacagcuaaaaaaguaggagaagacgaggaugaaucugaaaaaggcaagauacugcccaacucgggaaauggaugugaucuagagaaguacaaguggacgcaaaccuuaggagauauugaguuaaaaauuccccucaaaguaaacuucaggguaaaacagaaagaucucguaguaaauaugacgaagaaacacuugacgugugguaucaaaggucaaccaccuaucauagacgacgauuuuccacacgagaucaaauuggaagagucuucuugggugaucgaagauggaaaagaccuguuauuuacuuuugaaaagauaaauaaaaugaauugguggagccaaauagucaaauccgauccagaaaucagcacaaagaagaucaaucccgaaccauccaaacuuagcgaucucgacggagagacccguggaaugguggagaagaugauguacgaccagcgccaaaaagaaaugggccuaccuacgagcgacgaacaaaagaaacaagacguuauuaacaaguucaugcaacaacaccccgagauggauuucucgcaaugcaaauuuaacuag

SEQ ID NO: 5658 - RNA, 480 nt, Diabrotica virgifera
augcaaucuucgagugguaugguacaugguuauccgggaggcccuggauugcaauggagccccgauaaaaagcauagcgaccgagaaagguggauauguauuuacccugcuuacaucaacaacaaaaaaacauuggcacagggcagaaaaauagccaaagaaagaugcguugaaaaucccacucaccaggaaauucgugauguucuggucgcggcugguuugaaagugggugucgaaaacaaauuguacagcagagagagaaguaaagaaauguuauaucgugguagaauaaggauacaguuaaagaacgacgauggaaguuuguguaaugacaguuucccuaccagagacagcauuauguaccauuuaggagacaugauucccaaacugaaaagcaggcaaaauaaaagcucgaccgaggcuccucagcaagcaucuacugguucuaaaggcaagggaaaaggaaaaggacgaagauaa

SEQ ID NO: 5659 - RNA, 2259 nt, Diabrotica virgifera
auggauacaaaacaucauaaaaugcccaaaguggcaaaggugaaaaacaaagcuccagcugaaauucaaaucacugcugaacagcuucuaagagaagccaaagagcgagacuuagaaauucuuccuccuccaccaaaacagaaaaucucugauccagcagaacuagcggacuaucaauuacgaaggaggaaacaauucgaagauaauauaagaaaaaaccgaacugugauaucuaacuggauuaaauaugcccagugggaagaaucccaaaaagaaauacagagagcucggucaauaugggagagggcacuugauguugaccauaggaauauuaccauuugguugaaauauaccgaaauggaaaugagaaguagacagguuaaucaugcuagaaaucuaugggacagagccacaguucuuuugccacgaguuaaucaguuuugguacaaauauacuuauauggaagaaauguuagaaaauguaccaggugccagagcaguuuuugaacgauggauggacuggcaaccugacgaacaagccuggcaaaccuauauuaacuuugaacuccgcuauaaagagauugauagagccagacaaauauaugaaagauuugucauaacacaucccgaaguaaaacacuggauaaaauacgcccguuuugaggaaaaccauggcuucauacacucaucuagacagauauacgagagagcaguacaauucuauggugacgaucauuuagaugagaaacuguacauugcauuugcgaaguuugaggaaaaccaaaaggagcaugauagggcgagaguuauuuacaaguaugcucucgaucacauaccuaaagaugaaacuaaggaacucuacaaggcguauacaauacacgagaagaaauauggcgacagaagugguaucgaagaaguuauuaugucaaaacgaaaacuucaauaugagcaagaaauacugcaaaauccaaccaacuaugacgcaugguuugauuaucuucgacuaguggaaggagaaaaugaucucgauauuacacgagaaaccuaugaaagagcuauugcuaauauuccuccaacaaaaaacaaacaguuuuggagaagauauauuuauuuauggauuaauuaugcgauauuugaagaacuugaggcuaaagauuaugaaagaacucgucagguuuauaaggcuuguuuagaaauacuaccucacaagauauuuacuuuuuccaaaauaugguugcuguuugcacaauuugaaauucgucagaagaacuuaacugcagcaagaaaaauccuuggaaugucaauugguauguguccucgagauaagcuuuuuagaggauacauugaucuagagauucaacuaagagaauuugacagaugcagaaaauuguacgaaaaauuucuugaguucgguccggacaauugcauaaccuggaugaaguuugccgaacuggaaacacuauugggggauauagaaagagcuagagguauauucgaauuagccauuaaccaagccagacuugacaugccagaauuauuguggaaagcuuacaucgacuuugaaauaucacaagaugaaccagauaacgcaaggcagaucuacgaaagacuucuggaaaggaccucccacguuaagguuuggcuaucauaugcuaaauucgaacucaacaauccaacagaagacgaauuaaauguucguuuagcuagaagaaucuuugaaagggcuaaugaaaaucugaagagcuuuccagagaaagaagcaagagugcuacuauuggaaaauuggagggaguuugaaaauaaccauggagacgaaucgagcaaagaaaaaguuaaugccaaaguaccaagaaggaucaaaaagagacagaaaguuguugaugaagaugguauugaacaagggugggaagaaguauuugauuauauauucccugaagaugaagcuaguagacccaacuugaaacuucuugcagcugccaagaacuggaagaaaaaagcagaagauggagaugaagcagaaaguacuaauaauguuguuaaaaguagcagugauagaauaagagaaaaguugcuagcaucugcuaaaaauuggaagaaaaagcaagauggaauuaaggaaaccagugcagaagaaaacacuggugaagauaugcaagaagauaauauccaaaaccuggaacaagaaacugaaucuaaggacuuagauaaugaaaaucaagauuccaguaacgaaaaugauagcaaugaugauucuucuuaa

SEQ ID NO: 5660 - RNA, 1431 nt, Diabrotica virgifera
auggggauuaaauuuuuggaaguuauaaagccuuucugcagcauacugccugaaauagccaagccagaaagaaaaauccaauucagggagaaaguacuauggacugcaaucacucuuuucaucuuuuuaguauguugucagauuccauuauucgguauaaugaguucagauucugcagauccuuucuacuggauucguguuauucuugcaucaaacagagguacccuuauggaacuugguauuuccccaauuguaacuucaggucugauuaugcagcuguuggccggugccaaaauuaucgagguuggugacacuccaaaagacagagccuuauucaauggugcccaaaaauuguuugguaugguuauuacugucggucaagccaucguguauguaaugacaggcauguauggugauccggcugaaauuggagcuggagugugccuucucaucaucauccaacuguucgucgccggucuuauuguuuugcuucuugaugaacuucuccagaaaggauaugguuuagguucugguauuucccucuucauugccacaaacauuugugaaacuauuauuuggaaagccuucucaccagcaacaguaaacacuggaagaggaacagaauuugaaggagcugucauugccuuauuccacuuguugaccaccagacaagacaaaaucagaggauuacgugaagcuuucuacaggcaaaaucuucccaauuugaugaacuuguuggcgacaguacucguuuuugcuauaguaauauacuuccaaggauucagaguagaucuacccaucaagagugcaagauaccguggacaauauuccagcuauccaaucaaauuguucuacacuucgaacaucccuauuauucuacaaucugcucuuguaucuaacuuguaugucaucucacagauguuggcuguuaaauuccaagggaacuucuuaauuaaucuauuaggagucugggcugacguuggaggcgguggcccagcuaggucuuaccccauuggaggauuauguuacuacuuaucuccaccugaaaguguaagucacauucuagaagauccaauccacgcaaugcucuacaucgucuucauguugggcucuugugcuuucuuuuccaaaacauggauagaaguaucuggaagcucagccaaagaugucgcuaaacaauugaaagaacaacagaugguaaugagaggacacagagauaacuccaugauucacgaauugaacagguacauucccaccgccgcagcuuuuggaggucucuguauuggagccuugucaguacucgcugauuucaugggagccauugguucagguacugguaucuuguuagcugucaccaucaucuaccaauacuucgaaaucuucgucaaagaacaaagcgagauggguggaaugggagcguuacucuucuag

SEQ ID NO: 5661 - RNA, 483 nt, Diabrotica virgifera
augucgaugguaaccucaccuuccguagaacuuaguucuuacagagaccaacauuucaaggguacuagagccgaacaggacggauuauuaagacuaucaaccacauuauacguuggaaaucuaucuuuuuauacaacugaagaacagaucuaugagcucuuuucaaaauguggagacauaagaagaguuguaauggguuuggauaaauauaagaagacacccuguggguuuuguuuuguagaauacuauaacagagcugaugcagaaaacuguuuaagguauauaaaugguacucguuuagaugauaggauuguaagaacggauugggaugcaggauuuauagaagguagacaauaugguagaggaaaaacaggaggacagguacgugaugaauauaggacugauuaugauucuggaagaggagguuaugguaaaauaauccagcaaaagauuggaauugagaccccagcuuuuuugagauaa

SEQ ID NO: 5662 - RNA, 924 nt, Diabrotica virgifera
auggcugcaacaauaggacgaauuuguggagcuggucuuuuaaaaccaacaaacuuauccucugugggccaguuaaguucguauuccacaacaaaagaauggacccguggaagaaaagcacuuuugggaagcuuagggcuuauugcuggugguacuggugccuugcuguuugcuuuggaccaaucaguuaaagcaucugaucuugaauugcauccuccaaagaauguuuggagucauucuggaacuuucaauuccuuggaucaugcuaguguaagaagagguuaugaaguauacaaacaagugugugcugccugccacucaaugcgcuucauugcuuaccguaacuuaauuggaguuucccacacugaagcagaagccaaagcugaagcugaagaacaaaugauugaagauggucccgaugacacggguaacuuuuucaaaagaccaggaaaguuaucugacuacuuccccaguccauaccccaaugaagaagcagcucgugcugccaacaaugguuccuacccuccagauuugagcuauauuguaucugccagacauggaggcgaagauuacauauuugcccuuuugacggguuacugcgacgcgccagcgggcgugguccucagagacggacaauacuucaaccccuauuuccccgguggugccauuucgauggcacaagcccuauauaaugaaaccauagaauacagugacggaacaccagcaacugccagucaacucgccaaagacgucgcuguguuccuaaaauggacgucagagccagagcaugaugacagaaagaaaauguuaaucaaagugaucggcaucuuuucucuucuuauugguaucacuuacuaugcuaagaaacucaaauucucuucacugaaaucgagaaagauugaauuuaggcccaagaguaaauaa

SEQ ID NO: 5663 - RNA, 1722 nt, Diabrotica virgifera
auguuagcucugcaacaguauucgggcaguagugaugaagaugauacagacaauaacaaaaauaaagacaccucaguagauauaacugaaauccccauuaauuccgaauuuuccacuaaaaauaagcuugccauuugugccgcuccaaauguacugccuacagguuuagauggagaaaaaaaucauauacauccugauaguggagaacugacauauaauccaaaguaugauauacuauuugcuccuguaguagggccugcaaauccuuuuaaaacacaacaacaaucuguugagagaaacauacucucgggacauauugaaaaggcucauguaagugauuuucaauucgaaaaccagagaagaacguuuacgagcuaugguuacgcauuagacccaucgauaaguaaugauggagauggacaucuaaaaguugucgguucaacugaagaggguaaaaacguagaaaguguuaagacuguauuugaaacuucaaagauaagacccuuggauaagaggaaaaggaaaagaaaugauaauccgggugauauagaaggauuuuugggaccauggggugguuuuguugaugaacaaaaaguuucuagaccaacggaggaagaacaggcugaguuagaugaaauaacuucuaaaaagaauaagaaagguaaaccaacagaggacaaaccaauugaggaaaagucuguauugcauaucaaagauccaguggacuaucaaggaaggucuuuuuugcaugcuccacaagauguugggguuaaucucaaaucugauacaccuccagagaaauguuuuuuacccaagucccauauucauacauggacuggucacuccaaagguguugcagccaucaggugguuucccagaacggcacauuuguuccugucugcuaguauggauuguaggauuaagaucugggaaguuuauaaugagagaagaugcauuagaacuuacuaugggcauagacaagcugugagagacaucaacuuuaacaauucuggaaagcuuuuucucucagcuggauaugacagguauauuaaacuuugggacacagaaacuggacaagucguaucaagauucacuagucgaaaaauuccauauuguguuaaauuuaacccagauaaaaauaagcaacauuuauuuguugcugguacauccgacaagaaaauuaucugcugggauacuaggucuggugacaucguucaggaauaugauagacauuugggagcugucaacagcauuacuuuuguagacgaaaaccgaagguuuguuacuaccucagaugauaagucuuuaaggguaugggaaugggauauaccugucgacaugaaauacauugcagauccuacaaugcacagcaugccagcggucacaccagcaccuaaugggaagugguuagcgugucaaagcauggacaauaagaucgugaucuuuuccgccaugaaucguuucaaaaucaaccgaaagaagacauucaccggucacaugguggcagguuacgcaugcucguuagauuauucuccagacaugagcuauuugguguccggugacgcugauggaaaggucuacgucugggauuggaaaacgacaaaauuguacaaaaaauggaaagcccacgauaacguuuguaucagcguauuauggcauccacacgaagcgaguaagaugauaucggcaggaugggauggcguuauuaaauuuugggauuaa

SEQ ID NO: 5664 - RNA, 807 nt, Diabrotica virgifera
augguccaaaagaaaccuaagaagaagguaggaaagaaaguagcugcagcuccucuugcagucaagaaaauugaacagaaaaaagaaauuaacccacuuuuugaaaagaggccuagaaauuuuggaauuggucaggauauucaaccuccccgugauuuaucucgauuuguaaaauggccaaaauacauccguauucaaagacaaaaggcuguacuucaaaagagauugaaaguuccaccaccaauuaaccaauucucucaaaccauugacaaacaaacagccacccaauuauuuaaagucuuggaaaaauacaggcccgagacagcccuucaaaagaaaaauagguuaaaggcuaaggcugaagcuaagguugccaagaaagaggaggcaccugcuaaaaaaccaaacacauugaaggcugguaccaauacaguuacuaagcugaucgaacagaaaaaagcccaauugguuguuauugcacacgauguugacccaauugaguugguucuguuccuaccagcccucugcagaaaaaugggugucccauacugcauaguuaaagguaaagcaagacuuggacuucuaguaaggcgcaagacuuguucaucuguagcucuuacacaaguugacucuggagacagguccaacuucaacaaacuuuuggaaguaaucaaaacuaacuucaacgaccguguugaugaaaucaggaggcacugggguggugguuugcuuggauccaaaucugcugcucguauugcuaaguuagagagagccaaggcuaaagaauuggcucagaaacaagguuaa

SEQ ID NO: 5665 - RNA, 1002 nt, Diabrotica virgifera
auggcaacuuuaacaaaagauguaacacuccaggaaaacauuccaacacauauacuucuugacaagcacauagauuuuauuaaagaauauggacaaaaagaaaguacauaugaauaugguaugaccgauuauuugagaauaucuggcauguauuggggacuuacggcucuagaacuuaugaacgccacuccagcucaaaguauagaagagaucacagaauucauaaagaauugucaggauccagaaagugguggaauuagugccugccuauaccacgauccccauauuuuacauacacuuagugcuguucaaauucucugcaucuacaauaaauuagaggcaauaaacguagaggguguuguuaaauauaucgcaagccuucaguuacccgaugguaguuuuacaggagauaaauggggugaaguugauacuagguucucauuuugugcaguuaugacauuaucguugcuuaauaaaauggaugcaauugauguaaauaaagccguggacuuuguuuuacaauguaaaaacuuugauggggguuucggaucuaggccacuuucugaaagucaugcaggguuaauguauugcuguguuggcuuuuuaucuaucacaaauagguuagaugccauugauagagacacccuugcuuggugguuaugugaaagacaacuaccaucuggagguuuaaaugguagaccagaaaaauuaccugauguauguuacucaugguggguguuaucaucauuaaccauguugggcaggcuucauuggauugaugcgaaugcuuuaaaaaacuuuauuuuggcuugucaagacacagagacuggaggauuugcagauaggcccggugauaucgcagauccuuuucauaccauauuugguuuagcagcauugucccuuuugggacaugauucuguaaagaagguuaauccuacuuacuguaugccacaagaagucauugauagauuacaguuaaaaccucagagguuagagcaauaa

SEQ ID NO: 5666 - RNA, 2664 nt, Diabrotica virgifera
augcaucaggaggccauacaacucauccagguccuagaaaaaacaguuucaccggauaaaaaugaauuggaacaagcgucaucguuucucgaacaagcugcagugacuaaccuacuagaauuuaucaaaacucuaucagauauauuaagacauggcggaaauagcccuguggcccgaauggccgcagguuugcaguuaaaaaaucaacucaccucuaaagacuccaacauaaagaccaccuaccaacaacggugguuagcuuuuccagaggacguccggggguauauuaaaaauaacguugugugcgcacuuggaaccgaaaccagcagaccaucauccgcagcucagugcguagcauacgucgcaguaacagaacuaccacaagggcaauggccagaucucauagcaacguuggucaacaauguuugccaugcaaauuccacagaaaugcaaaaggaagccacauuagaagcuaucgguuauauaugccaagaaaucgacucggacguauuaguaucucaaucaaacgacaucuuaacagccauaguucauggaaugcgagccucggaaccgagcaaccacguucguuuagcagcuacacaggcccuacuaaacucucuagaauucacaaaggccaacuuugaccaaccgacggaacggaacuauaucauggaagucgucugugaagccacgcagucuccagauucacagaucagaguggccgcuuugcagugucuaguuaagauuaugucuuuguauuaucaacacauggaaccuuauauggcuccugcucuauucccuaucacucuagaagccaugaagucggaaaacgaugcuguuucucuacaggguaucgaauucuggucuaacguuagugaugaagagguugauuuggccaucgaagauaccgaagccacugaagcaggucgaccaccuacaagauguucacggcacuacgccaaaggugcccuacaauauauaguaccgauucugcugcaaaaauuaacgaaacaggaagaacuggacgacgaagacgauuggaauccuugcaaagcagccggcguuugcuuaaugcuucucgccacguguugcgaagacgaaaucguuccacacguucugcccuucaucaaagaaaauauuaagucugauaauuggcgauuccgagaugcuucuuugauggcuuucggaucuauuuuaggugguuuggagaguacuacuuugagaccgcuuguugaacaggcgaugccgaccuugauagaucugauguacgacaauagcguuaucguaagagacacagccgccuggaacuucggcagaauuugcgaaaucauuccggaggcggccaucaacgaaaccuuccucaaaccgcuauuagaaagcuugaucacaggccucaaggccgaaccucguguugccgccaaugucugcugggcguucucuggauugguggaggcagcuuacgaaaaugccgacguuaaugaagaaaccgguacuccagauacuuacgucuugucacaauacuucgaguucauuauacaaagacugcuugaaacaacggaucgacccgauggcgcccaacacaauuuacgaccugcagccuacgaagcccucauggaaauggugaaaaacucacccaaagauugcuaugucaccgugcaaaagacuacaauggucauuuuggacagauuacaucaggucuuacagauggaaacucacauaagcagccacaacgauagaucgcaauucaacgaucuccagagccuuuugugcgccacucuucagucaguacucagaaaaguuaccccagaagacgcgccucacaucucagacgccauaaugaccgccauguugaccauguucaauuccaauucauguaagaguggagguguucaagaagacgcuauuauggccgucucgacgcuggucgaaguccugggagaaaacuucauaaaauacauggacgccuucaaaccguuccucuaccucggauugaagaaccaccaagaauaccaagugugcguuacggcagugggcuuaaccggcgacaucuucagagcucucaaacugaaagcgcuaccauacugugaugaaauaaugaccuuauuacuagaaaaucuccgcgaucagucaguccaucguagugugaagccugagaucuugggcguguucggagacaucggucucagcaucggcuccgaguucaagaaguaccucgaggugguucuguccacuuuggcucaggcuucgcaggcgcaagucgaccgcaacgacuucgacaugaucgauuaucuuaacgaccuaagagagggaguuuuagaagcuuauaccggcaucauacaagggcuuaagggugacgggcccacuccacauccugacguuuugauacuugaaccccacauuccauuuaucguucaauuuauuacugucguagcacaagauacggaacauucugauaguauuauagcugccgcagcugguauuguaggugauauguguaauguuuucggagcuccaaugguucaauucuuagaucuggacccaauuaaugaaauguuagcacaagguagacguagucgaguaaauaggacuaagacuuuggccaauugggccguuaaagaauuaaagaagcugaaggccguaaacaccgcggcugcugcuagcuga

SEQ ID NO: 5667 - RNA, 1503 nt, Diabrotica virgifera
auggaaacaauuuuggaacaacagcgucguuaccaugaagaaaaagaacguuuaauugaugccaugguaaaagaaaugcuucacaaaaagacaacuuucagagaagcaauaaacucagaccaccgacaaaaguaccugcuggauagauauauggcuucaacagaaagacuaauagaucuuuaugaugauagagacggacagcguaaggcugaaguagccgcucuuacgggccccaacgaguuccaagaauucuacaguagguuaaaauuaaucaaagacuuuuacagaaggcauccaaacgaaaucaguguuccuaugucaguggaauuugaugaguuugccaaagccagggaaaauccuaacgaggauauggcuaacuuuguagaauuuacagaugaggagggcuacgggaaguauuuggauuuacaugaauguuacgaaaaguauauaaacuuaaaaggcauagaaaagguagauuacauuaccuauuuggguauguuugaccaacuauacgauauuccgaaggagagaaaaagcggugaauauaaaaaauauuuguuaugccuaauugaauauuugacuugguuugugcagcguauaaagccucuaaaggacuuagacauugaucuacaagaacaaguugagcagguucugcuaaacugggauaauggaaguguaccgggauggccaaaagaaacagggucugcacuaacaaauguuggagcccacuuggaccucucugcauuuucaaguugggaagaauuggcaucguuagguuuagacagacugaaaucugccuuaauggcguuaggauugaaauguggagguacuuuggaagaaagagcucaaagauuauucucaacaaaaggaaaagguuccuuggauccuucacuuaugacgaaaaauaacaaaggcaaagccaacaaagaaaaggaguuauugagacaaagagaacuugcaacuuuagaagcccaaguguacagauuagcagagugggucucaccgcagagagcugcgacaaaagaaaaugugcaaagaaaacaagcucguacugacggagaaagagacgacagcgaaaaugaagaaagcgaagaugauaguccugaugaaggugacgaugauguuccguauaauccaaagaaucuuccuuugggaugggauggaaaaccuauaccguacuggcuguauaaacuacaugguuuaaacaucagcuauaauugugagauauguggaaauuacguuuauaaaggcccaaaagcauuccaaagacauuuugcagaauggagacacgcccacggaaugagaugccuugguauuccuaacacugcacauuuugcaaauguuacacagauugaggaugcuuuggcacugugggaaaagcugaaaguccaaaaacaaagugagcguuggcaaccugaaacagaggaagaguaugaagauucucaaggcaaugugguaaauagaaagacuuacgaggaucuuaagagacaaggguuauuauag

SEQ ID NO: 5668 - RNA, 639 nt, Diabrotica virgifera
augacgauaggaaaaaauaauaagaugguacaacacauaaacuucagaguucggguaacucugcaagacucccguaccuucauuggaacuuucaaagcguucgacaagcacaugaauaugauauuaggcgacugugaagaguuucggaaaauuaaaucaaaacuguccaaaguugaacgugaggaaaaacgaguauuaggauuuguuuuacugagaggagaaagcauaguuucuuuaacaauagaaggcccucccccaccagaagaagguuuacccagaguaccaaucccuggagcagccccaggaccaggaauugguagagcuggagguagaggaaugccaccaggcauggcagguguaccuguaggccuucaaggaccuguaagaggagugggaggaccaucccaacaggucaugacaccaggagguagaggccaaguaucugcaccuccacagaugaaucaaggaccaccaaggaugggaggaccaccaccaggcaugaugggaccaccucccgguaugaugggcauggcuccccaaaugggaaugggacguggaggaccaccgccaaugggaaugagaggacccccaccugguaugaugagagguggaccaccuggaccuccaagaccuuuuuaa

SEQ ID NO: 5669 - RNA, 1317 nt, Diabrotica virgifera
auggauuugaaucgcagaauuuauguucguaaagcuaaucaagcccuauuauuaugucugcuucucucgcaaauucgcaaaaacaaaucaaaaccaaaugaaccaaacaaccaaaccaaaccaaaacguacaaugaggccaagaagauauugggugcgugaaauauauaagcagagaaagucacaaggggcuuuuaacaauuuaauucgggaaaugaaggaacaugauauucaaaaauauuucaauuaucuuagaaugcauccuugcacauuucaaaaauuauuuagucuaguuggaccagcauuagcaaaaacauauuguguucgugaaccaauuucgccagaagaaagacuugcuauuacuuuaagauaccuugcuaguggagacaguaugauguccauuucauaugcauuuaggguugcucacaauacaguuuccaaaauuauaaaggaagcaugcgaugcaauuugggauuguuuaaaccaagaccagcugcuaacaccaagugaagaagcuugguuaaauaucgcugaagguuuuggagaaagauggcaacugccucauuguguuggagcaauugaugggaagcauguaguaaugcaggcaccuucaaaaucaggcucuacauucuucaauuauaagggcagccacaguauaguuuuguuagcccucugugaugcaaguuaucgcuucacauugguggauauuggagcugaaggaagacacagcgauggggguauauucaaaaauuccaauaugggaaaauuaauuaauacaaauaauauaaauuuuccucaaccuucauugcugggucaaggagauacuccuuucaauuuuuauauuguaggugaugaagcuuuuccucuaacuacuucaauaaugcguccauauccaggucacuuucuuccucgagauaagcguauuuucaauuacagauuaagcagaggacguagagucauugaaaaugcuuuugguauauuggcuucucgguggcgaauauaccguagaaccauaauagcaagugaaucaacaguaguggcaauagugaaagcuacaguuugucuacauaauuuuaugaugaauaauggagagaaauuggggcaugaacacaaauauauuguugccaguacuguugaucaugaaaaugaagcuggggaauugguucauggugacuggagaagugaacauggcaacaauguacuacccauagguagaauggguaguaauauguaugcaaaaaaugcacaaacgaugaggcaaaaucucuugagauauuuuuuaaaugagggugcuauccaguuucaagaaaacaaauaa

SEQ ID NO: 5670 - RNA, 11073 nt, Diabrotica virgifera
gaaccucagggauuggaucaagagaagauggcgcugcaacagaaauccgccagggaagccgaacaagaaaggcaauggaagcagcuucaggcuaugaggcagcagcagacgcagcagcaacagaauauuauacacgaacaacguguucaggccaucgccagaguccagagaucaauaucgguggauccagcucagcaguuuuugucggaccaacaaagucccuuacaaccaaguacgccucaggagcuuagcccgucugcuacgccaacaccaagcccaagacaguucauaggaaugaaauccccgaccuucccucuuccuucaccagugccucagacagcaaucagaccuccuacacccucccauucuccacaugauguaagucaggcaagcaccucugacgguaaugaucacuuuauucagucaccuucuacuccuaaaccuaguuuuccuaauagauuaccuacagaucaauuuauccaucaaccugcaacuccuaggccccaguuuggaauacaacggccaacuuuacagaacuuugguaauacgaugaggacagaccagcaagauauuaauaucaaccgacaguugagagaucuccuacagcgacaacaagucaaaaaguuggaugaaauguuaccagguacuucggcaguuguggcuacaacagcagauaccacuuucaggcaaccauugccgcccaguauuguacgaccuagaguggcucuuucuuuagcuggucgagcagguccugguacuauuaggguuggccaguuagacgcccgaaugcaaggccuggauccuagaaugagauugauuuuacaacagcaaguuggccaacaacgguuaucugcgggaauucaacaccaguucguacgguuuaccucgacgccagcccgccccacgaccuuagaucaauaugaacaacuacuccacaggcccaguccuacccagauccgggcaccugaucagcaaaacgcaccucgaaugacuuugaaucaagcgagcgucauucaaagaccgcaacuugugcaaccuacuccaacuacuccugcaacuagugcugcugauagcaaucccagugaagaagguauucccgauaauguuacugcugaacuggagaagcuggaacaagaaacagguacuaugguagaguuacaaggugucagugagauccucggaggacugggagacgacgacgaugaacuguuagcugaaaugggugccgauuucaauauucuagaguaugccgaucccgagcuagaagcuuuaacaggcggcaagacaaauauauuagaucuggaacucgaagaagaaccagugaagaaagagaaaauaguauccagugcagaaaaccaaccgacuaaucaaucaguaaacguaauuucgagcccugugaaaccuaaacaagaaccaguugaaacgccuacuccaaaaccagagcccgcuucccuaccgccgccaccuccuccuuuggcguugccucaacagcagcaaccggcgccuguccaacauacgccgcccgucgcuauucaacaaccaacucaacauccgccgcaaguacaaccuacgaugcacuugacgccccaacagauucaucagcagaugguacaccagguucaacaggcagcagcucaaggcagacccaugccaccggggucaaagaugcaaacuccugauggauuuauugguauuguaaugccuaauaauagugugcaacuacagauaccucaaaacuaucaacagcgacuauuacuguuacagcaacuucaaaaucaaaagcuucaaaugcgcguaggcacuaccacuccacgaguagcggugguggcacagagucagcuaccagucgguuuggcgaccggccccaggaugguggcggcaccaccgccuccaccacccccgccguacccagguccaccgccgccuuauccaggaaacgcggcacagcaucaacaggaacaaccccucuugcuggaggaccuacucgaacaagagaaacgggaacaagagaaguugcagaaccaaccuucuagucaagaagugucuucaucaacuggaaacgaaagugaaucggcguugcucagcgaccacgauuucgagagacuaaaggcagacguauucaauaccggaccugucaccaguuuaccgucaacaauaacuaaucaaggaacuacuagccauacaaaccaaccauggcaacaguuacaaaaucggcagaucccugccccaccggcacaaccaacuauggaggugacaaccaggguacaaauguuuaaugccaaucuaauugcugcaccaccauugccuccggaaaauauugucacggaacaagacaaacagacucagaugauguaugaacagugguugaaucaucagaacaauguucuagcccaacaguugcgcuacuacgagacugagguacagaaacuuaggaagagcagaaagucacugaauagcaaacagagacaguugaagaaaucugguaaccagcugaccgacacagaugcagccgaacuccagagaauaucaggggaacaagcuauuuuacagaaacaucuagaaucgagcagaaaacagagucgacaacacggcauguuaauacaggaauacagaaacaagcauccugcaccgaagcagcggguagagcagauccaaucgccuuugggaccaccgucgucuucacccuugcaacacccaaguacgucgcagucgcccaugcugucgccaucuuuaucgccucugacacagcauaauucuccucugaacaguccgggaccgcugauuucgucgucgccaggaucuguaucgguucagaacauuuugcagagcccgaacaguaugcccacgaacagcaugucgccuuuacaaucguccucgaugcaagcgucaccuaugcagcagagccccaugcagccgucucccaggauaggaacaccgcauucucaaagugaagagaguccuggaucagcgcagucaccaucucaugugugccuucccccaccaaugccaagaaugacaaguccucaacacagacgaguaguaacuaguccgguugguaugacgcagaugagauucguaagcaaucaaguacugcaacagcgagugcggaugcaaucgcccauacaaaacuuucaacaaaaaccugcuacaccaucuccguuaaauagcccuacaucucaaacaaugaauguaagccaacaacuucaguuacauaaacuucaacagcaacaaagcaugcuacaacaacaacagagucuggaugguaaucaaggugaccccaauauuauccacucacagcgaacuacccaacuuuuacaacacagaaauuuuauuagacagcagguugcucagcaacaacagauaggccagccucagccuuuaacgccucaacaacaccaaauaaugcuccaacagcaaaagcaauuagcucaacaacagcagcaacaaauagcgcagaugaacgcagcuagguuacagcaacaaaauaauccuccucauucaccaaugccuccaaaaaguccuaugaucaaucaacaaauuaugucaccacauucuaugcccccgucuccuaugcaaaugccaccgaaaagccccauggugucuuuuaguucuucuaaccaaccaaauccuaacuccccugcggcaaggagcccugcuuuucaccaaggauuaagucaaacucccaccaguccuaugacucaccagccaccgucuccaaugccuagaaguccaaugguuaaucaaacacagucgccacauaguaugagaagaccaccgagcgcuaauaguagcccugcuaugccagauaggccacuaaguguugaaaauccuucaccgagaaugucuuauucaaucgaccauuuaaugcaagauacuuuacacagucagaguagccauaauucaaugcaguuuacugauaauuucacgacugauaugaauguucaaaauaguaucagagaaaacaugcaaaguggaggagggaaucccaauaauccauguaacccaauaccucuaccaccugaauauccuagauuuagauauuuuaaacuagguuugcgaggugguacaccaauguggggguuuggaagaggagcaaaacggauaccuacucccccaaaugcuccaacuaaaccggaagaaaaaauggcaaaccaagacaguaugauguuacaaaagaugaaaaaggagccucauuuaagcaaaguuucuauccuaaaaagaaaaguuggagcuggaaguggaaaaauuggcucucuuguuaguacagauuacaaugauauggacgauagcucauccacaccuccuauaacuccuccauuagcuacuacaagucgaggaggcauaccaaaaacauuacccaaaaagauuuuggagaaucaaagcagcaaggauuccguuauugucaugcacagcccagaggacaaacaacuugauaugauggauuuugacgaugacaccaauacuguuuuaucagcggaagugucucuaaguucugcagcucaaaaugacgaagauauguuggaaauggagacacuaucacaacaagauuuagccgaaggauuaucuagucccuuggaaccugaucaaauagcagaugaauauuuacuauuuccugggaauaugguaguugacaugucugcaggagaacauuuuuccgaaaaagaggaggaagaagaaaccguagaugaagaauucaacgaugaaaacaugcauauuaugauucgcaguccuacaaccagugacuaugaauacauaaugcaaaguaaggguaagaaguauaacguagguguucaugaugaaaaugaugagaugcccgaaucuccagaucaggaagacuuggcuguaccgucaccugaaguuucggacuuguugacaaauuacgaugaaaaugauguuuuaaugggcgaucaaaguaacagcacaccugaagaaucaauuucuaccaaagaagacuucgaagaguugauugaugaaggcucacguaagaacagcauaacgaagucagaaguaacaacuaaacagaucaaugaauuccacaaauacgcagggauauuuaauuauuccaaaggaguuguucaagcgacccagaaucagacagcuuuaaauaaaauuacgggcguagcuaacaaaaaagcaccugcaaaaauaucacucguagcggguccuauuguacauaaucuaucaacugggaaggucaaucccgaaaaauugauaaucacucaaaauccaaauauuuuaaauaccucacaagcugcuaaaguuacaaguauuauucuuacucauaauucugcgguacgaagaaauguucuuaauguaccaaagauuguaaguacgguaucuccagcuauuacuauaguaaaugcuaccacaucucaaauggcuucuauacuaccguccaaauucacgguaccugugauaagugccagugcugugcgacaacuuuccaacguaaaagugauggauaaaccaucuucaucaucacuaucuauuucuacacgcgacaauguuuuaccuaaaaagauauuugaagaugauuccgucucaccugacaguucuaauugcgaggacgauaaaucaaaagauucauucgaugagaaagcaaaauuggaaucuccuucgcgagaaauaaaaccuuuauuaaaaucagacgcaucuucgucgaauacaaucaucucaagaaguuuagaauauaaaacacaugaccagcaaaagaaagcugaacaucuucaggucaugaauauaauucagaaacagagaguaccuaguccgcuaaugccaaagucugcuucgccugugauuauacacaauacucccgaauugaagaugacugcgcaagucauucaagagacacaaacucguaugaagaugacagccacuacagaaacuuuggaugcauaugacgguucaguagaugauacgaagucuguugugauaucgauuccuucuccuacuccaucucaagaacaaauguuggacaauaucgccuaccaggcuuuggaaaauaggagaagagaauuugauucuaucgaagauguauuagauaugauagaaaauaucacugcagaaccaccugccauuuuagaagaaaauguaccuguacaaaauacuaaacguaauacgaccacugaaucaaaagaaaaggauauugacaaaccaaaaccagaaauagcaaauauaccaguaaguguaaguacuaaaucuucugcagugccacaacuuucaccauugucgcaaccaacagauuuaacuaugaacauggcaaaugcuucccagcaacuaagaucauuguugucuucacugcaaacuacuucgacgucuuccccaacuaacguagaaucaguaguuaaaaacuucggccacaaaauuagcagcagugcuucuccuacagccacccaaccuauuguugcgucuagaguuauacagcaggcugguagacagucgccagugguaacaacugugaacacuguaaucguaccgaauuuaaaacaaaaaguuacaguuaccacugcgagcaguucuagaaauaguccaguaaagacucaaguugugacuacucaacauguaccaucuucggcuaucauuacaucaacaauaaacuauauaccaaauagaacaauugcuaguaugcaaguuauggcagaacaucucaaauucucaucugguaguaugucuauaacaacuccuucaguuuccacucagcaagcaauugcuaaaacuacaauucauaaugaaaguaagaaaccuucauuaacauuaacggcuaugcugcaaaaucagccggcugcuaauaugauuacuaaaucuucagcggauacgauuacugcagccagcuugcucggaucaccuauuaguuugccuaaagcuggcuuaacguccuuaguacaagcgcaaccuacuguugucguucccgucauaacuacuucaaugauagcauuacagacucagccaucuauaguuucuacugucaaaagugcaccaaugaaaacaaaugcagauacuauaacggccgcaagucucuuaaguucaagcucuguuaacauagcaaaaaccgguauuacagcugcuuuauuacaagcucaaccgaauccaacucuuagcucuuuaucuacugcaacaccucuaacgcaaaccucuaauaauauuauaaccagcucgacccacagaguuccuacuucuaccacaaaucuuuuacacacucagcuaaccaaaguagugaggaguaaaucaguugaugacaucaaagagaucaaacaagaagauauaaaaucggaaucuauggauaccgguguugaugacaauaaauuuucacuuauuucaccuaguggcuguaaaaugucaacaauucagaauccaauacuaaauaaagcagaugauucgcaaaauguucugcugaaaaagcugcuacaaaacacugcuugugcuagcacacagucaccaccuccuacuacagcaagcacuguuacaacuauuugucccgcaccuaaacuuccuauuagagaaacaucuuuuguuucuagcccgaacguagaaccaccaguaucucaaccgaguguugcugcuguugugccuacucagccuuugcaauuggagauuaaaaaauguuugccaccuaguagaaguucuaguagagaugauuuguugucuccccaaacucccagauccucuacuaauagucaagauucuaguuuacaaacuccuccgauaauaaagaaagaaauaguuucuauuccacaaccccagccuaguccaauucacacaccacaagaagucaaaaaggaaauuauggaugagucgucgcaacauucugagguuucugauuacagucgaccagauguuccuauaaaagaagaaacagaaauggcugauauugcaauagaaaagccagugcuugauaaggaagaguuaaagaaacaaaagaggcggauguaucaacagaaaaggcggcagaaccaaauacuuaacaaagaauuggcugggcaaccuaagaaacgaccaagaaaaaauucgaaaauagaagaagacuaugauacuuauauagauggaguguuggcucaacuaaggcaguuaccuggaauuacagugucugaaccgguauuaaaucguaaccaugguauagucucacuuuucgggucuggagauauguccaaacuuggaacaaaaggguacucuacucaauuuggggauuuagacgggaaauauggcuaugcugaacugccagguuauucagauuuuuauuccaccaaaccuuauggagaucuggauccuauaccggaaaaaccacccucuucuacccaaagagguuucuacgaucaagaauucccauugauacgguuugacacagacgaucauaagaaauucgacauguuuuguagggaagauacuccagauucaguacucaguaguucaucuccggaguguguccaaguagauccagaggguagauuuaugggauuaagacuuauuagcgauagugaaggcgaggacgaggacaaugaaauagaaagggaaauacagcaagcuagagauagacugucgccgauaguaccuaugaucaaaccaguaccaauuagauugaaaccaguuggaggagugcuuguuaaggaaacucccagugauaacaaagaaaacaucaauacagauagucuuaacauaaugacaaagaucaaaucugaaagcaaaccuuuauuaccgacgaaggauucaggacauguuaccgugacauuaacacugacuucaucggccgcugaagacauaaugggugugcuaagggacuuagcaaacauucuacaaauuccagcuccuacuaguuaucaaauaguagaaaggacaacaacuccucccagccagaagcucggacucuacaggaccaagggcaaagacgguaaagagggagcgccaauagacauucaaaguauucuuaauggggcuaccaaguucuguaaacacugugauguaauuauuuuaagcaauuugauaaggagaaagguuuccgaccuuccuuucuuggccaaagacucggaacuuuuaagcgacggagaggaacuauucuucuguagcucgacuugcuacaugcaguuugcccuaaugcauagaucuccuucuaucuccgaagauaaggccgccgaaauaaucaaccauuuaucucagaaagauaacgagacaaaacagaaaaugcagaugauggaaccguuugacaauaaaucaauaauagcucaaagacucucguucacuaaucgagaaaugaagaaagaauaugaaccaauggacaccaacgauuacuauuccuacuugcauaauaacgcagagaauaaaccgaaucgguuuuaugacggugcuuacagaccgaugccgguuagcagaaucuacaagaacaucagauauaagguuuggucgccuggauguuuacaaccgaaucagaaacauaagauaccuacggauaaagaaaucauggaguuguuguauagaaugcaaauaacagucacgccgccaguuaugccggaugauacaagaaagugcauguuuugucaggguguuugugauggaguagcugauggcacggcaagauuacuuaacuuugaaguugauaaauggguucacuuaaauugcggucuuuggucugacggcguauacgaaacggugaauggggcguuaaugaauuuggagaaugcuuuacaaacaagccuaacgacgcccugcguacauugcaauauguuaggugcuacuauaagaugcuucaaaacgagauguuccaguguguaccaucugaauugugcaguaaaagacaauuguguauuuuucaagaacaaaacugucuauugcauagcgcaugucccuaagaacgaaaaggacaacgaguugacgacgcucucuguaucuagaagaguuuauguuaauagagaugaaaacagacaagucgcugcugugaugcacagcucagauacugacgaucuauuaagaguugguagccucauauuccuaaauguuggucaacuauuaccacaucagcuacaaaauuuccacacuuccaacuacauauauccgauaggcuacaagauaauaagguucuauuggaguaugaaaucuuuaaacaaacggugcaaauacaucugcucuauccacgaacaauuuggaaaaccugaguuuagggucguuguucaagaaccuccagaagacgauauagaguuuguagauccgacucccaaaggugcuuggcaaaggauccuugaccaaaucgccuuccuucgcaaagagaacgaauguuuacagauguucccuaaauucacgacuggagaagaucuuuuuggucucaccgaacccgccauaguaagaguacuggaaaguaugccagguauagagaccuuagccgauuauaaauucaaauauggacguaaucccuuauuggaacuuccuuuggcgaucaaucccucgggaucuuguaggacugaaucgaggucgagaacucaguugcauuggaaaaaacaucacacucaacggacuacgcugucuacagcucgaccuauauuugguccuucgccuuccggcccaacuccaaguacuccaacguuuggugagcugucguguccuuacagcaaacaguuuguucauucgaagagcucacaguacaaaaagaugaagcaggaauggaagaauaacguauaucuugcuagaucgaaaauucaaggguuaggucuauaugcugcuagagacuuagaaaaacacacuaugguuauugaauauauuggagaaauuauaagaacagaacuggcugaaagcagagaaaaacaauaugaagcaaagaaucgagguauauacauguuuagacuagaugaaaacagagugguagacgcuacguugagugguggcuuagcgagauauauaaaucacucuuguaaucccaauuguguagcugaaaccguggaaguagaacgugacguaaaaauuauuauuuucuccaagagaagaauuaugcgaggagaggagcuggcuuaugauuacaaauucgaauucgaagacgaccagaacaagauuuccugcaugugcggugcuccgaacugccgaaaauggaugaacuaa

SEQ ID NO: 5671 - RNA, 2067 nt, Diabrotica undecimpunctata
auggaacguagucgaaagcgaagagaucggucaauuucaaauaguucagaggacaguaauaaaaaaaaacaguauuccaaaaauucaaaaggaaaagacaaauauaaagauacacgggauaaaaguagugacaaaaguaaagaaaaacguaaaaaaucaaagaaaaagaaaaaaagauccaggagcaguucugaugaauccagcucuaacagugacaguucugauaauucaguaaaacuacuggaaaagcucacaaaagaaagaauuagacuugcagaagaacggaaaaagcaaaaagaacuaaucaaagcuaccgaaacagcagaggagaagcgaaugagacggcucgucaagaaggaaaacaaagagagauccaggaaagagagaaugggcugggauaaugaguauuuacauuauacaaauagugacaauccuuuuggggacggaaauuuguugucuacauuugugugguccaagaaguugacuaaagaaggauugaaagguguuagucaagcagaaauugaggcaauaaacaggacaaaacaagaagaaaacaaaagagaacuggaaaagguaaaaaagagacguuuagaaagggaauuagaaagacagaagagggaugaagaaacccagaugcuccaaagaagcaaggaagcagcacaauuugaagagugggaaaggcaagaagacaaauuccauuuagaacaagcaagacugagaucacauauaagaauccaagauggaagagccaaacccauagauuuauuagccaaauauauaagugcagaagaagagguagaugcuguggaaaugcaugaaccauacacauaucuaaauggucuacauauaaaagauuuggaagauuuaguagaggauauaaagguuuauaaagaguuagaaaggggaaaaaauuuagauuauuggaaugacauuacuguaauaguggaagaugaguugcagaagcuaagaaagcuugaaaaacagaaugauuuugauuuagguuugaauagaagagaagguauucaucagucaguagcuggggauguuacuucuguauuuaaagguaaaaccgcuguacaguuagcagcuuuggagaagcaaauagagagaaaaauaagcagcaaagccgaugguauugauauagguuacugggaaucccuguuaucacaacuuaaggcacacauggcuagagcuagacuaagagauagacaucaagaaagcuugaggagaaaacuucaaguuuugaaagcugaacaagccauaaacguaacagcuccaagugaaagucauuccaguggaggugaggaagcuccaacgaaagaugugcaagaaccaaagccugggccuucucaggaaccugaugauaaggaaaaugaugaagaugaacccgcagaugaggaagcugcuaauucguggcugaaugaguguuuugaugccuaugaagcugguggauauagucccaaguuucuuacuccagaugaaauagagccaggaacuauuguuguuauagaagaagaugaucugaaaagauuggaauuugcaagaauucaggugguugguaaaggaaaaaccguggaaaauguuauaacuaaggaagaauugauguuacaaaaagaagcucguaagggcauggaugcagaugaggcacaguucucuguagagcaagcuuuggacagucaagucuaucuguggucugauaaauaccguccuaggaaacccagguauuuuaauaggguacacacaggauuugaauggaacaaauacaaucaaacacauuaugauauggauaaucccccuccaaaaaucgugcagggauauaaguuuaacauauucuauccagauuuaaucgacaaaaguaguacuccagaguauuaucugacuccuugcccagaaaauaaagaauucgccauauugagauuucaugcugggccuccauacgaagauauugccuucaagauugucaauagagagugggaguauucguacaaaaggggauucaggugucaguuucacaauaacaucuuccaauugugguuccacuuuaaaagauauagguauaggagguaa

SEQ ID NO: 5672 - RNA, 1245 nt, Diabrotica undecimpunctata
auggauaauuuagaaaccaauauuauggauaagucaaugagaucagucuucguugggaauauuccauaugaagcaaccgaggaaaaauuaaaagauauauuuggcgaaguuggacaaguacuaucuuuuaagcuuguguuugaucgugaaacuggaaagcccaaaggauaugguuucugugaauacagagaucaagaaaccgccuugagugcaaugagaaauuugaaugguuaugaaauagggggaagaaauuuaagaguggacaaugcuuguacugaaaaaucuagaauggaaaugcaaaaucuucuuaaccaaccuauaguagaaaaucccuauggagaggcaguucaagcugaaaaggcuccugaggcuauaaguaaggcaguugcaucuuuaccuccugaacaaauguuugaauuaaugaagcaaaugaagacaaccauucagaauaauccaacagaagcaagacagaugcuuuugcagaauccacagcuugccuaugcucuuuuacaagcucaaguuguaaugaaaauuauugacgcagcuacugcaguuaguuuacuucauccuguaaaccaagugccagcaacacugaugccuggagacaaaaauguuccuguucaaguaccaauuaguaaucaguacagggagccuccagcaccuguccaaccaccaagacaggaauuucagccuguuccugcuccuguuauacauccaucccagaaucaaguauuugcaggucaagauauagaucuaagauccauuggugcugugccagaucugagauuaaggcccaugggugaccaggauaugagacaacugccaccugcuauucaaaaucccuuaccaccuacuauuggagaaagcuuuguucgagauccuagagguucacaggcguucgcaggagauccaagacaagcacgcauagauccacgccagaagacuauagugccuccuccagcuccacuaccuauaccaccucuaaaugcaagacccguaaugccuccucagccucaaguuccugugacgagaccagcacuuacgccucaaccggucccaacuccuacuccugcaacggccaguccaaauguugcaaaugcuggggcuucggaucaagaaaaggccgcgcucauuaugcaaguuuugcagcugucagaugaacagaucucuaugcuuccaccugaacagaggaauaguauuuugguauugaaggagcaaauugcuaaaagugcacacacacguuaa

SEQ ID NO: 5673 - RNA, 1179 nt, Diabrotica undecimpunctata
augacccaaauggauccugaacgugaaaaaagucuucaagaguauaggaaaaaauuauuagaacacaaagaaguugagucuagauuaaaagagaugcgagagcagcuaaaagaucuuacaaaacaauaugauaaaucagaaaaugaucuuaaagcuuugcagaguaugggccaaauaguuggagaaguacucaaacaacucacugaagaaaaauuuauagucaaagcuaccaaugguccccguuaugugguaggaugucgucgucaacuagacaaagcaaaguuaaaagcaggaacuagaguagcauuggacaugacuacauuaacuauuaugcgauauuugccuagagaaguggacccauugguguauaauaugagucaugaagauccuggagauguuacuuauuccgcuauuggugguuuaucugaacagauuagagaacuucgagagguuauugaauugccuuuguugaauccagaauuguuuaugagaguuggaauuaccccaccuaaagguuguuuauuauaugguccuccagguacuggaaaaacucuacuagcuagagcuguagcaucucaguuggaugcaaauuuccucaaaguagucuccagugcuauuguugauaaauauauuggagaaucugcaagacugaucagggaaauguuuaacuaugcuaaagaccaucaaccuugcauuauuuucauggaugaaauugaugcuauuggugguagaagauuuucugaagguacuucagcugauagagaaauccaaaggacucuuauggaacugcuuaaccagauggaugguuuugauucauuaggacagguaaaaaugauuauggcaaccaacagacccgauacucuagauccugcucugcuccguccuggucguuuggacagaaaaaucgagauaccucuuccaaacgagcaagcccgucuugaaauuuugaagauccaugcacucccaaucgcuaaacauggagaaauugauuaugaagcuaucguaaaauuaucugauacauuuaauggagccgauuuaagaaauguuugcacagaagcuggucuuuuugcuauaagagcugagcgagaguauguaauccaagaagacuuuaugaaagccgugagaaagguagccgauaacaagaaacuugaaaguaaauuagauuauaaaccuguauaa

SEQ ID NO: 5674 - RNA, 831 nt, Diabrotica undecimpunctata
auggcucgucgauaugauaccagaacuacaauauuuucuccugaagggagauuguaucagguggaauaugccauggaggcuauuucucaugcagguacuugucuaggcauuuuagcaaaugauggaauuuuguuggcugcugaaaggcguaacacuaacaaauuauuagaugagguuuuuauuucagaaaaaauauacaaacuaaaugaugauaugguuuguaguguagcuggaauaacaucugaugcuaauguuuuaacaaaugaauugagacuuauaggucaaagauauuuauaucaguauggugaaucuauuccuugcgaacaauuaguuuccuggcuuugugaugucaagcaggcauacacucaguauggagguaaacguccauuugguguuucaauauuauauaugggaugggauaagcauuauggguaccagcuguaucagucagaucccaguggcaacuauucugguuggaaagcuacuugcauaggcaacaacagcucagcagcaauuucaaguuuaaaacaagaauauaaagaaggucaaaugacuuugaaggaugcaaagacguuagcagugaagguucuggcaaaaacacuggauauggcaaaacuaacuucugaaaaaguggaaauggcuacucuuacccgcaaaaaugauaaaacuaugaucaaaauuuuaagcggcaaggaaguggaggaacugauuucagaguaugaaaaaagugaagcugcuguagaagcuagcaaaaaaagagcagaaggcaucagcuuaauuacuuuuaauugguuuuguuuagguucucuaaguuauaagucauugucauaa

SEQ ID NO: 5675 - RNA, 2670 nt, Diabrotica undecimpunctata
augggugacucaaagguagaaccuacaaagguggauaaaacaaaggguaaugaggacaaaaacaaaaaugaacuguccgaagaagacaaacagcuucaggaugaacuaaauuuauguguugagaaacuccaggauaaugaugaaaagagauacuugccugcucugcaagcuuuaucaaaucauauucaagccucaacuacuucgaugacuucuguaccuaagccguuaaaauuuaugaggccccauuaugacaccaugaagacaguacaugaaaaaauaacugauccugacacuaaaaaagugugugcagauauuauaucuguuuuagcuaugacaaugggagaagguagagaauguuuaaaauaccggcuucuuucuaauuuggauaaaauuggugaauggggacaugaauacguuaggcauuuggcaggagagauugcaggagaaugggccgagacugauuuuauaguaaacacugaaauuagagagaaacugauuuuacuuacaaaacaaauugugccauacaacauggcacacaacgcagaagcagaagcaugugauuugcuuauggaaauugaaaggcuugaucuacuagaacaguauguggaugaaaacauuuaccacaggguguguuuauaucuuaccaguuguguaccauauguggcagaucccgagaauacuacucuacuacagacugcucuuuuacuguuuagaaaguucgaucaauauccacaggcgcugagauuagcuaugcaguuaaaugacuuuggacuaauugaagagauuuuugucaacuguccugauucggauguacagaaacaacuggcguuuauguuaggacgacaacagauauauguugaaauuccugaacauacgccagaauaugaagacuuaaucgagauaauggcaaauugucaucuuaauaaucauuucuugaaccucgcucgcgaauuggacauuauggauccuaaaaccccggaagauguuuauaaaucccacuuggaaaauagucgucccccauucggcggaaaccaaguugauucugccagacaaaauuuagcugccagcuuuguuaacggauuuguuaaugcagcuuuuggccaagauaagcucuugauggaagauggaaauaaauggcuuuauaaaaacaaggaacauggaaugcuuagugcuacugcuucuuugggacuaauucuuuuaugggauguagaugguggucuuacucccaucgauaaauacuuauacucuucugaggaucauauuaagucuggcgcuuuauuagcuuguggcauuguaaacuguggugucagaaaugaaugugaucccgcacucgcacuuuugagugauuauguucuucacaauacaaauauaaugagaauaggagcuauuguaggucuagguuuagcuuauguugguucaaauagggaagcaguauuaucuuuaaucacaccugugcuaucugacccuaaaucaaauauggaagucauuggaauggcggcacuggcaugcggaaugauuucugcaggaucugguaauucccauguuacaacacaaauaaugcaaguucuuauggaaaaguccgaaauagaauuaaaggauacuuacgccagauuuuugccucugggucuuggauugugucauuuagguaaacaagaaaguauugauacaauuauagcagccuuagaaguuauaccugacccuuucagauccauggcaacuacuauggucgauauuugcgcuuaugcagguacaggaaauguuuugaaaguucaacauuuguuacauauauguucagaacauuacgaugcuccugaaacuccugacaaaacuucaaaagacaaagauaaaaaggaaacagagaaagaaaaagauaaagaucucucagcuagacaagcuauugcgguuuuggguauagcauuaauuagcaugggagaagacauugguagcgaaauggcguuccgcacauuuggccauuuacuaagauacugugaaccagcuaucaggcgagcuguucccuuggcccuaggcuuaauaucaguuucaaauccuaaauuaaguauucucgauacuuugaguaaauucucacaugauagcgaugcugaaguggcccauaaugccaucuuugcgaugggucuaguaggagcugguacuaacaaugcaagguuagcagcuaugcuacgacaguuagcacaguaccaugcaaaagaucccaauaauuuauuuaugguucgcaucgcccagggucucacucaucuugguaaaggaacuuuaacccucaguccauuccauagugauaggcagcugaugaguccaguagcuguagcuggucuaauggcgacucucaucggcuucuuggacguuaaaaauauuauauuggggaagucacacuacuuacuguacaccuuagcagcugcaaugcaaccaaggaugcuaguuacauuugaugaugagcuaaauccucuaccagugccugucaggguuggauuggcaguagauguuguuggccaagcaggaaaaccaaagacuauaacagguuuccaaacccauacaacuccugugcuuuuggcuuacggugagcgagcugagcucgcaacugaggaauacauugcguugacgccaauuauggaaggauuuguuauuuuaagaaaaaauccugaauuuaauucauaa

SEQ ID NO: 5676 - RNA, 1548 nt, Diabrotica undecimpunctata
augacugauaacgagauggacucgaaggacgaacagaauccuucaccugaagaaguuaaaccaaaaauagauacaucagacacagacucucaaccaccucagguuucuguuacuucugguggcggugugauacgaagaaauuuuauaacuacagcuggaaccauagucgaaacaaacgaagaacagccgccagaacccacuaccgaagagauuguuaauacagaaaauucaacuccgcaggaacaaaguccuguggaacacaaaauugagccuacagagacaacaacguaucaagaacugcaucaaacgcaucaaagagaacaauuuacggaaccaaagcaguauacaguagaaaugccagcagaaagcuuuucaggacaaaacuuuucacaggauaucgguuacacaagcaauauagcuacuguuaauauugaagguaaugagguaccuauaacaauaucuuccgaaauagaucaaccaggugauuauacaaguuugcaaacagcccaauacaacaacgguuauaccgaugguccacaguaucuugcccaacaucaguaucaaaauuuauacguugacagaggcaguguugguaauucaccuccagcuacuuuauuguuuaaagaugaucccaauuuagcagcagcuagauauccgacaaacuacgauguaucuagcagucaaucgcagcuuaaucuucuuccaaaugauaccuacuucacuacaacagccaauugggcuucaacgaguaccggauccuaucaacaacaauacagcaauaccauuaacauccuucaccaagcggauaguacgcagucauacggagguccuuacgugaauacagcauggucaucuaguucgauagaggauggacguccaccaagccaagagguacuagucaaagagugcgugaauuguggugcuaguguuacaccccuuuggcguagagacgguaccgggcauuaucuauguaacgcgugcggguuauaccacaaaauuaaugggguucacagaccuccgauuaggccuucgaaaaaaccacaggcgacaggaaacagaagaaaugguguaucaugugcaaauugcaaaacaaauaacacaacucuuuggcgaagaaauaaucaaggggaaccuguuugcaacgcuugcggacuuuacuuuaaauuacacgggguuaaccgaccgaugaguaugaaaaaggauggcauccaaacacguaagagaagaccaaaaaacucugguggaaauccagguccaucuggccaaguccggaucggcaacaucuaccaauaucaacaugcuccagaacuugaaauacaacaggacaccuaccaguugccuauaaacguauauccuucacccacucaaggaccuuacagacaauacgcagcugagaaucuucgaggcuuaaaugcucagccauugcaaccaauuauugccacagaugacgaacagacaagcgucauaacuucuaccucacagcaagcaagguuucgaguagauacagaagaggacgaugguaguaacaaccaaccugccaaugcuuag

SEQ ID NO: 5677 - RNA, 4419 nt, Diabrotica undecimpunctata
  misc_feature (810)..(810): n is a, c, g, or u
  misc_feature (1137)..(1137): n is a, c, g, or u
augcugucauguuuucgaauaugcuuugaaacaaggcuugucgaccucuugagaaaaacugccgaacacuauuuaaaagaaauggugcaauuaauuuuuaugagguugccgcaguuuagugaagaucugaaaguuucuuacauuaaacaguuaaaaaugaaaccuggagcuuuagaucaaacacguacuaagaggaaaaagcaguauucuucacuuaaaaaagauaagaaugacacugacauuaagucuccccaaaccccacaaggcaaucuugcaacaguagcacaaaguaguauaguagauaugcaagguuccuugcaaaauccugaaaacgcuaacccuguaacuccaaaugcuaguccaaaagaaaauuucaagugugauguagauaucauuguugacaguccuguuaguaauaaugaagauuuaaaaaauaucgauucuauaucgucugguguagaagaagcaguaacagaaccuaaaucacuuacugaagaagaaauuacagaagaacagagucagacuacucaagauuacauaaaucaaagaggcauaagguuuacuccacaauugcagcaagaagcuaacuugucgcccuaugguuuggcauguguaagagaauuacugagauuuuuaauaagccuguguaacccucuugauaaacaaaauacagaaaucaugauucaucuagguuugacccuuuuaacaguugcauuugaaauaagugcggauaauauugguaaauauaacacucuguuagcuuuaguaaaggaugauuuaugcagaaaucuauuuucucuuaugaguacnagacuagcaauauuuucauuggauuuacaggugucuuuuuuauuauuugaaucauugagaacacaucuuaaauaucaauuagaacacuaucuaaagaaauuaauagacaucauccucagcgauucuccuaaaguaaccuacgaacacaaggaaauagcauuagauaaucuacuucagcuguggcgaauaccaggguuucauacugaacuauauguuaauuacgauugcgauauguacugugcgaaucuguaugaggaauuaacuaaauuguuagcuaaacauucaauaucuucgacuacuggaguguaccauacccauuuguuaucnuuggaugcacuuaugauaaucacugaagggauugaaaaccgguguuaugaagaaaaagauagauuagacgcaggaaauagugaauugguucagcaaucaaaugacauuagcuucuaugucggaaaaaauucuaggacuaaaauuucuccaaucaugccaaagaaggaggaauuagcucaaaagaagaguauuaagaaguggcuaccgcaagguaccgaauacuucaacaaaaagccaaaaaagggaauagaauuucuucaagagcacggaguacuaaaacaggauauugauuuggaugaaaucgcuagauuuuuaagagaaaauccaguucugaacaaggcuaugauuggcgaauauauaaguaaucgaaguaauuugaaaauucugcaauccuucgucgauacuuuuaauuuuaccggagugcguaucgaugaagcuuuaagagcuuuccuagagacuuuuagguuaccaggugaggcacccacaaucucccugaucuuagaacauuucgccgaaacguggcacaaggccaacaacgaaccauuugcagauguggauucugccuuuacuuuagccuaugcgauaauaaugcucaacguugaccaacauaacgaaaaugcaaaaaaacaaacgacccccaugucggcuaaugcuuucaagaaaaauuugaagggcguuaacggagguaacgauuuugacgaagaaauguuagaugauauauauacaacaauaaaaaacgaagaaauaguuaugccagccgaacaagccggguuaguuagggaaaauuauuucuggaagauccugcugaggaagggacagacaaaagauggcauguacauacaugauaauagugguacuuacgauucugagcuuuuccagauuguguauggaccuauaguagcagcucugucuucuguuuacgagaaggcugaaaacgaaaguguacauaagaaagucaugcaaggauucgaaagaugcgccuuuaucgcugcaaaucucaauaugucgacaaauuuggauaugcucauucucgguauuuguaaauuuacuguguuuuacaaccaacagaaacagaacaacauugugguucaauuuggaaugaacagcaaggcgcaguuggcccuuaggacgguauuuuuccuaauucaucaacacggaaacaccaugagggauggauggaaacacuuauuugaucucuuguuagcacucuauagcaacggacuguugucaaaaacguuuguagagguagaagacuuuauugaaccaaguggcaaauuaauucuagucuacaaggaagcaccaucugcggcgaagcaggauaccgguuuacugaguucucuuuacucauacaugguuuccgcagaaaauuuaucaaaaauaccgacaccagaagagcaaaacuguauagaugcugcuaaagaauguauaaaggacuguaauuuagagcaaaugauaaccgacuccaaguuucuccacgaagaagcuuuauuugaacucguaaaaacuuuaauagaauuaucuagagguccggauguacacgaaaguguggcuuaugacuacaaugauaacguuaccguguucuuuuuggaguuauugaucaaaguuguuauacaaaauagagauagagugaugaccguguggcaaaauguacgggaucauauauacacuuuaguuaugaaugcaucuguuuucgauuuccaguucuuguuggagagaucuguuaucggucuauugcguauugcaauccgucugaugaggaaugaagaaaugagucauauuguucuucagucuuuaagaaugcuacugcuuuuaaaaagcaguacccuuucuaggauaucacggcaaauaucauuugguuuauacgagcuucugaaaacguccgcacagaacauucacaccaacaccgacuggacaauuauuuucacgcuuuuggaauguguuggagcaggagcucaaccaccuaagccuguuaguucagccgaagaaacagaauugaaaaauaaaucugauggugaaacuuccgauaaccacgaggaagagggcacgcucucagauucagaaggaagaaagaguccgaaagauaauacccagcgaucacaaaguccugugagugucguaacuucgccuguuggaacuccaaauacagguggauggauuuuggucggcaacgaaggugagauucaacccguuaugggccgcaccgucccuccaacccaauacggccuagcuuuagagaagaaccuuggaagccaugaccccagaaguaugaugaagugcugcgaaagucucgcguuucuaguaagagaugucgcccacauuacuccuuacaauuuugacguuuguguucauuguauaaggacuuuuguagaagcuagcuuacacgguucuaauuucaaaagguugagagauucuaggucuaggaagaaaacuuuggauaggucuagaacuagaaaaaguccgacgaguagucccgaugaggaagauagugacgacgaaaacauuccaagugguuaucaccaaauaucaauacaguuauuagauuuaaugcauacuuuacauacgcgaacggcucagauauucaaauggugggcugaagaagguggggaaauaucgcaagaaacuucucuuuggacgcaaggcuggugcccucuucugcaagguauagcaagacugugcugugauacgagaaggccuguaaggaugagugcuauaacguaccugcagagagcgcuguuaguccaugauuuacaaacuuugagugggucagaaugggaacaauguuuccaaagaguauuauuuccuuuacuuaguuaccuguuacagucaauaaguccuaaagaugccauauccauggaagaaacuaggauaaggguagcaacuguguugucuaaaguguuucuacaucaucugucuccucuauuagcacuucccaguuucuuuaauuuaugguuggugguuuuagacuuuauggauaaauauaugcaugcagauaaaagugaacuucuuuacgaagccauuccagaaaguuuaaaaaauaugcuuuuggugauggauucugcuaaaguuuuugacggucccgauggaaagaacauucucuggaaugccacuugggaaaggauagggaaauuucuaccuaacaugaaagacgacuuauuuaaggaaauagaagaccaaaauagaaaaaacgaagaaguuaguaacauagagauaauagugaauaaagaagagaaagauguaaauacagauaaauugacuacuaacgauaaccuuauuacguguuag

SEQ ID NO: 5678 - RNA, 618 nt, Diabrotica undecimpunctata
auguccauucuagcuuacaaugguggugcuaugguggcgaugaagggagaaaacuguguagccauugcagcagauaggcgauuugguauucaagcccaaacaguagcuacaaauuuccgaaaaaucuuugaaaugggaccacauuuauauguaggucuuccaggauuagcaacagauacucaaacaguuauggaaaaacuccguuuccgaaaaaacuuguaugaacuuaaggaaaaucgaaaaauaucuccaaaaguauuugcgucuaugauaucaaauauguuguaugaaaaaagauuugggccauuuuuuguggaaccuguaguagcuggacuucuaccugauacuuaugaaccuuuuaucuguaauauggauuuaauugguuguauaaaccaaccuucagacuuuguuguugguggaacagccucagcacaguuguaugguaugugugaagcacuuugggaaccuaaccuaggaccugaagaucuuuuugaaacaaucucucaagcacucauuaaugccuuugacagagaugccauuucugguuggggagcuacaguauacaucauagaaaaagauaaggucacuauaaaaaauuugaagacacguauggacuag

SEQ ID NO: 5679 - RNA, 2808 nt, Diabrotica undecimpunctata
auggaucagaaaccagggauagaucuggugauaucggcaguuucagcguuguacaauaacccuaacagcagugagaaggaaagggcuucuaaauggcuuuuggaacuccaaaaauccguccacgccuggacuguagcagacgaauuauuacauuugaaaacagacuuagaaucauguuauuuugcugcucaaacuaugaggacaaaaauucaccagucuuuccacgaacuuccucaagaaguacacacgucguuaagagauucauuacuugaacauauuggccaaauuaacgaagcaacuaacacuguuauaguaacacaauuauguguugcucuggcagauuuagcucuacaaaugccaucuuggcagaauccuacauuagaccuaaucaauagauucucccaaacuaauauauggccauugcuagaaauuuuaacuguguuaccugaagaacuggaaaguagaucugucaggcuaggugaaaacagaagaauagauguguuagaagagaugaaaguuugugcuccaacagugaaugaauuuuuaaaacauuguucuaaagucuaugaaacuaauuggcaagaucauguucaguucaauguaaaaauauuacguugcuuuacauccuggaucucaguaggagcuauuagucugaaugaucuuucugauaguauuguuauuaauagagcauucgagauacucaacuucaagccucaaaaugauaaacagaccauaucagcugccuuucaugaggcugccaccgacugcauuuguacucuuuuauuaagucucgaaaacaacaauaaccaacuugguuuggaaaauuaccucuucaauaauauuaucaaucuagacguaccuuaucaccuuucuguugcaaaugaagaucagggaaaauccauggauuauugcagacuguuuacagagcuggcagaaucauuuuuagaaaaaauaauagcaaauaguaauacgaaacagaugcacuaugcuauuaaaauuuuagaucuaguuuuaauguguguuggacaccacgacuaugagguagcagaaaucacuuuuaaccuuugguauguuuugagugaagaauuguaccaaaaaaauaacaaagaaaagacagaacuauuccgacccuauguagaacgauuaauaacagcccuguguaggcacugucaaauggagccagauagcgaaggauuguuagaagauggagaugaauuuaaagauuuuagguugaagguagcagaauuaauacgagaugugguuuucauagugggcaguagugccuguuucaaacaaauguucauuaauauacaagguccaggaguuacgugggauuccaccgaggcagcucuauuuguaaugcaagcuguagcaaaaaacguaauaccuggugaaagugaagugguaccucagguuguagaagcaauauuaaauguuccagaaaauacacauguagccguaaaauacacgucggugcuuuuauuaggagaacuuugugaauggauagagaggcauccgaacacacuggauccaguuuugaacuucuuagugugcuguuugccucaaccugguguaggagcugcugcagcgguggcucuucaaaacaucugugcuagcuguaaugaucauaugccaaggcacgucccgauacucuuacagcuucuucaccaagcggauuccuuugccaucaccaacacagcuaccuugggucuucuaagaggaguggccucgauaauaggucgaaugccgcacgaggaguugacgaaguccuuacgggaauuauguucuaugcagcucaauccgauaugucaaaucauagaacaggauguucauccagugaagggggccaacacagauccgguaauguggcucgauagacuuagugcagugcuuagauauguuaauguacauauucccgaagguguggaaaacccuuguaaaccgguaauucucgaaguguggccgguauugucucgcacguucgauaaauaccaaagugacauuaggauaauggagagauguugucgcgcugugcguuucaugcuucggugcguugcgcaagaagugcgagaacucuuagaaagucuaguuggacaaauagugaggaucuauacguuauaccaacauucguguuuucuguaugucgguaguauacuuguggacgaauacgcuauagauccgauaugcgugccaggacuacuggauaugcuacaagcguuucuagaaccuaccuuucacguguugcaggaggagaacggguugaagaaucaucccgauacgguagaugacuuuuuuagguugugcgcaagauuuaugcagagggcaccuuuagcauuuuuaaaauguucuuccuugguccacaucuuacagugugcacuuuuggcuucuucacuggaccaccgagaagcgaauaugucugugaugaaauucuuuuacgauuugauaaaccaaggccagagcgggagggcugaucccgaauucaaucaacgacagauguuaguuaaaagcauccucgacgaguauggccaacaacuagucucaaauuuaauccauucuugugucuucuaccuccauuccuacaugcucagcgaagucggcgacguauucgugcagcugcucgauuuugacagagagaucaccugcaaauggguagcggcgggucucgauguguuaccgaaaaacaguaacgguggcauuauggccgccacaccucaacaguugacggauauacauaccacuauuaguaggucgaauacuuccaaguccguaacgcaugcucucaaggaucuagccagguuauaucguuaa

SEQ ID NO: 5680 - RNA, 1506 nt, Diabrotica undecimpunctata
auggcucagcgguuucccggcccugugccaaaucaaaguccaggaggaccaccuccgcaaagauaucaacaacagcccccaaaucaaggaauucggcaauaugcacaacaaaauuuuccucaaagaccuggauacaauccuccaccaccaaauauaccauccaguggcgguacaaugauucaaagaccuacuggugcucccuauucaccaaugagagguggaauuauuccgccacagcagggaaauaaaaggccugcagauaauaggacccaacugcaacagaaaaguaaugaauacagccauaguacaaguaagaagaagaaaaagcuggcagauaaaauccugccacagaaagucagagauuugguuccagaaagucaagcuuacauggaucuauuagcauuugaaagaaaauuggacucuacuauaaugagaaaaagauuggacauccaagaagcucuuaagcguccuaugaagcaaaaaaggaaguugagaauauuuauuuccaauaccuucuauccugccaaggaaccucagccugaaggacccgauggaccaugucaggaaggcacuguugcuucuugggaauuaagaguagaaggucgucucuuagaagauccaaagaacgauccaaauaaaguuaaacgcaaguuuucuucuuucuuuaaaucccugguuaucgaauuggauaaagagcuguauggaccagacaaucauuuaguugaauggcauagaacacuaaccacccaagaaacagaugguuuccagguaaaacgcccuggugacaagaaugugagauguacuauuuuguugcuucuugauuaucaaccucugcaguuuaagcuugauccuagacuagcuagacuuuugggaguucacacucaaacuagaccagucauuauuucagcuuuguggcaauacauaaaaacucaucgcuugcaagaugcccaugaacgugaguuuauaguuugugacaaguaucuggagcaaauuuuuaacuguacacguaugaaauuugccgagauuccucaacgucugaauccacuauugcauccuccagauccaaucgucauaaaucaugugaucuccguagaaggaggggccgagagcaaacaaacugcuuguuacgauauugauguagagguugaugauacauuaaaaacccagaugaacaauuuccuauugaguacagcuagccaacaagaaauucaaggacuugaugccaagauucacgaaaccgucgauaccauuaaucagcuuaaaacgaauagggaauuuuuccugagcuucgcuaaagauccucaacaguucauucauaaguggauuguuucgcagacucgcgaucugaagacaaugacugacguggucggaaauccggaagaggaaagacgcuccgacuucuucuaucagccuugggcacaagaagcaguuuguagauauuucuauacuaagguacagcagaagagagcagaguuggagcaagcucuugguauucguaauaauuag

SEQ ID NO: 5681 - RNA, 435 nt, Diabrotica undecimpunctata
augccaaaaguacgacgaaguaaaaaaccuccuccugaggguugggaacugauagaacccacauuagaugaguuagaacaaaaaaugagagaagcugaaacagaaucacaugaggguaaaaggaaaaaugaaucauuguggccaauuuucaaaauccaucaucagaaauccagauauauauuugaucuuuuuuauagaagaaaagcaauuagcagggaacuauaugacuauugucuugaggaaaacauugcagauaaaaauuuaauagcgaaguggaagaagcaaggauaugagagucuuuguugccuacgauguauucaaacaagagacacuaacuuuggaacaaacuguauuugucguguaccuaaaucuaaguuagaagaaggaagaauuguugaaugugugcacugugggugcagagguuguucaggauag

SEQ ID NO: 5682 - RNA, 885 nt, Diabrotica undecimpunctata
augccagcagcuacucuagguagcauaccacauccuaauaaugaagacuguggcauuagagauguuugggcccauaaccuggaggaugaauucagaaccaucagacaaauaguacaaaaauaucaguauguugcuauggacacagaauuuccugguguaguugcaaggccuauuggagaauuuagaaguucugcagauuaccaauaccaaaugcugaggugcaauguagauuuauugaggauaauacagcuuggacugacguuucuugaugauaacggaaaaacuccagguggugccuauacuacauggcaguucaacuucaaauuuaaccuucaagaagacauguaugcacaggauaguauagaccuccugcaaaauucuggaauucaguuuaagaaacaugaggaugaagguauugaaccucucgaauuugcggaauugcuuaugucaucugguauuguccugguggaaaauauaaaauggcuauccuuccauucugguuacgauuuuggcuaccugauaaaacuguuaacggacaacaauuuaccucaagacgaaacagaauucuucgauuuguuaaaauuauauuuuccuaccauauaugauguaaaguaccuuaugaaaucgugcaaaaaucuuaaaggaggauuacaagaaguggcagaacagcuagaacuugaaaggauuggaccacaacaucaagcagguucggauucucuucugacaggaauggcauuuuucaagaugaaagagauguucuucgaagacaccauagacgacuccaaauucucgggccaucucuacggucucggcaccucuuucgcaguaaacggaacugccaacaacuacucgaacgacaacggagauaccacaaacucuucauga

SEQ ID NO: 5683 - RNA, 1215 nt, Diabrotica undecimpunctata
  misc_feature (42)..(42): n is a, c, g, or u
augguuuugaaaaacccucagccauucaacagagagcaauangacuuaucaaauguagaguuugaaacuagugaagaugucgaaguuaucgagaaguuuaaaaacaugaaccuuaaagaagaacuucuucgugguaucuucgcauaugguuuugaaaaacccucagccauucaacagagagcaauaaagccuauuaugaaaggcagagauguaauagcucaagcacaaucugguacugguaaaacagccaccuuuucuauuucgauuuuacaagcuuuagauuuaacaaugcgagaaacacaaguuuuauguuugucuccuacuagagaauuggcuguacagauucaaaaaguuauucuagcuuuaggugauuuuaugaauguucaaugucaugcuuguauuggagguacaaaucuuggagaagauaucaggaaacuggauuauggacagcaugugguuaguggaacaccugggagaguuuaugauaugaucagaagaagagcucuaagaacaagaucuguaaaaauguugguuuuggaugaggcugaugaaauguuaaauaaaggauucaaagaacaaauuuaugauguauauagauuccuucccccaucaacacaaguuguacucauuucagcuacacugccucacgaaauuuuggaaauuacuuccaaauuuaugacagauccuauuaggauuuugguaaaacgugaugaauugacauuggaagguauaaaacaguucuuuguggcaguugaaagagaagaauggaaauuugacacccucugugaccucuaugauacauuaaccauuacucaggcugucauuuucuguaacacaaagaggaagguggacuggcugacagagaaaaugagggaaaacaauuuuacaguuaguucaaugcauggagauaugccacaaaaggaacgugacaauauuaugaaagaguuuagaucgggacagaguaggguccuaaucacgacugauguuugggcuagagguauugacgugcaacaagucaguuuggucaucaauuaugacuuaccgaacaaucgugaauuguacauccaucguaucgguagaucugguagguucgggcgaaaggguguagccauuaacuucgugaaauccgacgacaucagaauucugagagauauugaacaauauuacucaacccaaauugaugaaaugccgaugaauguugcugauuuaauuuaa

SEQ ID NO: 5684 - RNA, 1605 nt, Diabrotica undecimpunctata
augacugccccuacagccgguggugacacaaauagaggaagaacgguggcauauaaggacaaaaguaaaccugcugauguuaggaccaguaauauuaacgccgcaaaagcuguuugcgaugcuauucguacaagucuugguccuagaggaauggauaaaaugauccaggcuggaaauggcgaagugacaauuaccaaugauggagcuacaaucuuaaagcaaauaaaugucauacacccugcugcuaaaauguugguagaauuaucaagagcccaagacauugaagcaggagaugguaccacuucuguuguuguaauugcaggagcuuugcuggaugcugcagaaaaguuauuacacaggggaauucacccaacagcaauaucugaaucuuuccaaagagcagcacacuuggcaguugauauuuuaucagacauuuccacuccaauugaaauuacuaacagagaauuguugauuaaaagugccuccacuucacuaaacucaaaaguuguuucccaacauucaagucuuuuggguccucuagcgguggaugcaguucuuaaaauuguugaaccugguagggaacaagcuuguaauuuaucagauaucaaaguuauuaagcaacugggaggaacaguagaagauacugaauuaguggaaggaauuacuuucccacaaagaucugcaaaugugucuggaccaaaaaggauugagaaagcuaaaauugguuuuauccaguucuguauuucaccuccaaaaacagauauggaucacaaugucauugugucugauuaugcugcuauggauagaguauuaaaagaagagagagcauauauuuuaaauaucgucaagcagauaaagaaagcuggauguaauguacuuuugguucaaaaaucaauuuugagagaugcaguuucggaucuugccuuacacuuuuuggauaaaaucaagugcaugguuauuaaggauauugaaagagaagauguugaauuuguauguaaaucuuuaggcugccguccuauugcaucuuuagaucauuuuguugcugaaaacuugguuaccgcugauuuaguugaagagguuggaguggcaggaaauagaauggucaaaauuacaggugcacaaaaugcaggcaggacaguaacucuacugguuagaggauccaacaaauugguucuugaagaggccgauagaucucuucaugaugcucuauguguaauucguugccuuguucgcaagaaggcacuuauugccgguggaggagcacccgagauugagguggcucuuaaacuagcugccauggccaacaaacuggacggcauugaugcuauuuguacaagggcauaugcgaaugcuuuagagauuauaccguuuacuuuggcugaaaacgcaggauugaaucccauacagacugucacugaacuaagaaacagacaugccaaaggggaaacgucugcuggaauaaacguucguaaaggggcuauuacagauauucucgaagaaaauguuguucaaccacuuuuaguuagcacuucagcauugaguuuagcuacagaaacugugagaucgaucuugaaaaucgaugauauuguuaacacauucacauaa

SEQ ID NO: 5685 - RNA, 1323 nt, Diabrotica undecimpunctata
  misc_feature (557)..(557): n is a, c, g, or u
auggaggcuauggauauuguuauaccagaaaaagaagaagguaguccuucggaaguaaaaccagugcugcaggauguggauacugaagauuuguauacuaaauauaaaaaacuccagcagcaguuggaguucuuggagguucaagaagaauacauuaaagaugagcaaaggaaucucaaaaaggaguauuuacaugcccaggaggaagugaaacguauccagucugucccgcuuguuauugggcaguuuuuagaagcaguagaucaaaacacuggcauuguuggcucaacuacagguucaaauuauuauguuagaaucuuaucaacaauugacagagaacuuuuaaaaccuucugcuaguguugcucuucauaaacacagcaaugccuuaguagauguucugccaccagaggcagauucuucaauaagcaugcuccaggcugaugaaaaaccagauguucaauacagugauauuggaggcauggauaugcaaaaacaagaaauaagggaagcuguagaguuaccuuugacucacuuugaauuguauaaacaaauugncagugauauuggaggcauggauaugcagaaacaagaaauaagggaagcuguagaguuaccuuugacucacuuugaauuguauaaacaaauugguauugauccccccagagguguguugauguauggaccuccuggaugugggaagacuauguuggccaaggcuguugcucaucauacuacagcugcuuuuauucguguagucggaucagaauucguacagaaauaucuuggugaagguccucgaauggugagagauguguuccguuuggcaaaagaaaauucuccagcaaucaucuuuauugaugaaauugaugcaauugcaaccaaacgauuugaugcgcagacaggugcugaucgugaaguccagagaauuuuauuggaauuacuuaaccagauggaugguuuugaucagacaacgaauguuaagguaaucauggcaacuaacagagcugauacauuagauccugcacuuuugagaccuggccgucuggacagaaaaaucgaauuuccuuuaccagauagaagacaaaaacguuugauuuucagcacuaucacaucuaaaaugaauuugucagaggaggucgacuuggaggacuauguagcuagaccagacagaauaucaggagcagauauaaacgccaucugccaggaagccgguaugcaugccguucgggaaaaccguuacaucguuuuaccuaaagauuuugagaaggguuauaagaauaacaucaagaaggaugagagcgaacacgaguuuuacaaauag

SEQ ID NO: 5686 - RNA, 489 nt, Diabrotica undecimpunctata
augccaaauauaaaguugcagucgucugauggugagaccuucgaaaucgauguugaaauugcaaaaugcucuguuacuaucaaaaccauguuagaagacuugggaauggaugaagaagaagaggaagugguuccuuuaccaaauguaaacucugcuauacucaggaaagucauucaaugggcgacuuaccacaaagacgauccuccaccaccugaagaugacgauaauaaagaaaaaagaacagaugauauuuccucuugggaugcagacuucuugaaaguggaccaaggaacccuuuucgaguugauuuuggcugcuaacuaucuggauaucaagggacucuuggaugucacauguaaaacuguugcuaauaugauuaaagguaaagcuccugaagaaaucagaaagacuuucaacaucaagaaugacuuuacagcgucugaagaagaacaagugagaaaagagaaugaauggugugaggaaaaguaa

SEQ ID NO: 5687 - RNA, 930 nt, Diabrotica undecimpunctata
auggacgauaaggcgucguguaaggaacuggauggauggauagaacagcuaaaugauugcaagcaauuaaccgaaaaucaaguuaaaacacuaugugauaaggcuaaagaaauauugucaaaagaaucaaauguacaagaagugaaaugcccaguaacaguauguggagauguccauggacaauuccacgaucugauggaacuguuuaggauaggagguaggagcccagauacuaauuaccuguucaugggagauuauguagaucguggauacuauucuguugagacugucaccuuacugguagcacugaaagucagguacaaagagagaauuacaauuuugagaggcaaccacgaaucaagacaaaucacacaaguuuacggauuuuacgaugaaugucuaaggaaauacgguaacgcaaauguuuggaaauucuucaccgaucuguucgauuauuugcccuuaacagcacucgucgauagucaaauuuucugccugcacgguggauugaguccuagcauugauaccuuggaucacauuagggcacuagaucguuuacaagagguaccucaugaagguccaaugugcgaucuucuauggucugacccggacgaccgcggaggcuggggcaucucuccccguggagccggcuacaccuucggacaggacauuucagaaacguucaaccauaccaacggucugucuuuaguaucuagagcgcaucagcucgucauggaggguuacaauuggugucacgaaagaaacguagugacuauuuucagcgcccccaauuauugcuaccgaugcgguaaccaggcggccauuauggaauuagaugaugcccuuaaauauucauucuuacaguuugauccagcaccaagacguggcgaaccucauguuacgcguagaacuccagacuauuuccuuuaa

SEQ ID NO: 5688 - RNA, 768 nt, Diabrotica undecimpunctata
auggguaucucaaaauuacuccuuguauuuggagcacucuuuugugccauaauugcaauucaagcagacaauaauggaaugcaaauuuuuguaaaaacacucaccggcaaaaccaucacccuugauguugaaccgucaaauaccaucgaguaugccaaagcuaaaauucaagacaaagaagguauuccaccgaaucaacaaagauuaaucuuugcuggaaagcaguuggaagacgaucguacuuucucagacuacaauauucaaaaagaaucuacccuacauuugguacuucgucuuaggggagguaugcaaauuuuuguuaaaucuuuaacuggaaagauuguuacccuagaaguagaaccuucagauacuauucaaaaugucaaagcuaaacuugaugauaaaauagguguaccaccagaacaacaaagauuaaucuuugguggaaaucaguuggaagauggucguacucucucagacuacaauauucaaaaagauucuacauucaauuugguacuucgucuuagaggagguaugcaaauuuuuguuaaaucuuuaacuggaaagauuacuacccuacaaguagcaccuucagauacuauucaaaguaucaaagcaaaacuugaugauaaaauagguguaccaccaagucaacaaagaauaaucuuugcuggaaaugaguuagaagauggccguacucucucagacuacaauauucaaaacgauucuacauuaaauuggguacuucgucuuaaaggagggaaauaa

SEQ ID NO: 5689 - RNA, 1623 nt, Diabrotica undecimpunctata
augaugcaaccacaaauauuacucuuaaaagagggaacugacucaucacaaggcaaaccucaguuaauaucaaacauaaaugccugccagaaugugacggaugcuguaagaacaacauuagggcccagagguauggacaagcucauaguacagaggcaaggcaaugcuacuauaucaaacgacggggcaacuauuuugaaauuauuggauaucguucacccugcugcgaaaacuuuggucgauauugcuaagucacaagaugcagagguuggggaugggacaacaaguguuguauuauuagcaggagaguuuuuaaaacaaauaaagccuuauguugaugaggguguucauccaagaauaauaauaaaagcagucagaagaucguuccaaauuugccuugagaaaauaagugaaauaucuguuaaaaucaauaaaucaaaugcugaugaauuuagaucucuauuggaaaagugugcugcaacagcaaugagcucgaaauuaauuaaucaacaaagaucuuucuuuucuaaaaugguuguagaugcuguucuauuacuagaugauuuacuaccucucaauaugauugguaucaaaaagguacaagguggaggucuugaggagucacuuuugguagcagguguagcauuuaagaaaacuuuuucuuaugcuggauuugaaaugcaacccaagguauacaaagauuguaaaauagcccuguuaaacauugaauuggaacuuaaagcugaaagagauaaugcagaaguaagaguagauaauguaaaagaauaucagaaaauuguugaugcagaguggacaauucuuuacaauaaacuucaaaaaauuuaugagucuggagcuaauguuguuuuguccaaauuacccauaggagauguugcuacucaauacuuugcugacagggauauguucugugcuggucguguucaagaagaugauaugaaacguacgcugaaagcauguggaggugcuguaaugaccacuguuaaugacaucaacgauucuguacucgguaaaugugagcuguuugaagaaaaacaaauaggaggagacagauuuaacuucuuuaaaggcugucccaaugccaaaacauguacuuuaauuuuacguggaggagcagaacaauuuuuagaagaaaccgaaagaucacuacaugaugccaucaugauuguuagaaggacuauuaaaaaugaugcaguuguagcuggugguggugccauagagauggaauuaucaaaaauuuuacgggaucauucucguacaauugccggcaaagaacagcuucugauuggugcaauagcuaaggcauuagagaucauccccagacaauuaugcgauaaugccggauuugacgccacuaacauucuuaauaaacuucgacagaaacacgcgcagggucacugcugguaugguguggacauaaacaaugaagacaucagugauaacuucgaagccugcguaugggaaccggccaucgucaaaauuaacgcccugacggcagccacagaagcaacguguuugauucugucuguugaugaaacgauaaaaaaucaaaaaucugagcagccaccucaaaugggaggucgugguaugggaaggcccauguaa

SEQ ID NO: 5690 - RNA, 3843 nt, Diabrotica undecimpunctata
  misc_feature (8)..(8): n is a, c, g, or u
  misc_feature (1953)..(1953): n is a, c, g, or u
  misc_feature (3779)..(3779): n is a, c, g, or u
augucaancgacgaacaauuauccaaucaaucucacuacgacuucgguuugagagccuuaaaauccguacuuauaucugccgguaaugucaagagagaccgaauucagcggauuaaagaaggaaugacccaacggggggaaaccaacauugaugaagccagcaucgcugagaauuuaccagaacaggaaaucuugauccaaucggugugcgaaaccaugguacccaaguugguggcugaagauauaccacuucucuucaguuuguugaaugauguauucccuaauguucaguauacaagagcagaaaugaaaggucucaaggaugaaaucaggaaaguauguucugaagaguauuugguauguggagaaggugacgaacgaggaucagcuuggauggagaagguacuucaacuuuaccaaauaucuaauuugaaucacgguuugaugauggucgguccaagugguuccgguaagaguucggcauggagaguucuucuuaaagcucuugaacgguucgaaggcguugaaggaguugcacacgucaucgauccaaaagcuauuagcaaagaggcacuguaugguguuuuggaucccaauaccagagaauggacagauggucuuuucacucacauauuaagaaaaauuauugacaacgucaggggagaaauuaacaaacgacaauggaucaucuucgacggugacgucgauccggaauggguagaaaacuugaauucaguacuugaugacaacaaauuguugacuuugcccaacggugaacgucuuucccuuccuccaaacguuaggguuauguucgagguucaagacuugaaauaugcgacacuagccacgguuucucguugcgguauggucugguucucugaagauguguugucaacugacaugauuuucgaaaacuauauccuucguuugaggaauauacccuuggaagaaagcgaagauagcagcuuuggcaagaaauccgacaaagacgauaugcuuucucccacucuucaacuacaagucgauguuguuaaucuacuacagccguacuuaucacccgauggucuagucguacguugucuggaauaugcgauggaacaagaacauauuauggacuucacacgccuucgagcacucaguucauuauucucuauguuaaaucaagccguaagaaacguucuucaauauaaucacaugcaucccgauuuuccauuaaccaaugaugucuuagagaaauauguuccaaaauguuugauauauuccauccuuuggaguuucgcuggagaugccaaacugaagauucguucugauuuaggagauuuuaucagaucuguaacaacaguaccucuuccuccagacaacaacaugcccauaaucgacuacgaggucaccaucgagggagaauggucgcuuugguccaauaaagugccacaaauugagaucgagacucacaaggucgcuucaccugauguuguaguucccacuuuggauacaguaaggcacgaauccuugcuuuauacuugguuagcugaacauaaaccauugguauuaugugggccacccgguucugguaaaacgaugacucuauucuccgccuuaagggcuuuaccugauauggaaguuguuggcuugaacuuuucaucugcuacaacuccugaauugcuucugaagacauucgaccacuacugugaauacagaaaaacgccuaauggugugguuuugucaccaauacagcugggcaaaugguuggugcuauucugugacgaaauuaauuuaccagacauggacaacuacggcacccaacguguuauaauguuccugcgucaaaucguggaacagaaagguuuuuacagagccucagaucaauccugggucucacuagaacguauacaauucguuggugcuuguaauccuccaacugaucccggcaggaagccucuaucccaccgauunguggaacagaaagguuuuuacagagccucggaucaauccugggucucacuagaacguauacaauucguuggugcuuguaauccuccaacugaucccggcaggaagccucuaucccaccguuuccugcggcacguacccguuauuuauguagauuacccaggagagacaucuuugaaacagaucuacgguacuuucaccagagcuaugcuaagguuggcgccuggucugaaagguuaugccgaaccauugacuaaugcuaugguugaauuuuauuuggcaucucaagauagauuuacucaagauaugcaaccucauuauguauauucuccaagagaaaugacgagauggguaagaggaauuugugaagcuauaaggccucuugauaaucuucauguugagggguugguaaggcuuugggcccacgaagcucuccggcuauuccaagacagauuagucgaagacaccgaaagacguuggaccaacgaaaacauugaugcuguagccuuaaaacacuucccaucagcuaacugugagaaagcuuuggaaagacccauucuuuacagcaauugguuaucuaaggauuauguaccuguuggaagagaacaacuaagagaauauguaaaggccagacuaaaaguuuucuacgaagaagagcuugauguuccuuuggugcuguucgaugagguguuggaccauguuuuaaggauugacagaauauucaggcaaccucaaggucacuuacuacuuaucggaguuucuggugcuggaaaaacaacucuguccagauucguagcuuggaugaaugguuuaucuauauuccaaauuaaaguacacaacaaauacacagcggaagauuucgaugaagaucuaagaucuguuuugagaaggaguggaugcaaacacgaaaagauugcuuucauuuuggacgaguccaauauguuagauuccaguuucuuggaaagaaugaacacuuuacuagcuaauggugaaguuccuggacuuuuugagggggaugaauauacaacucuuaugacccaguguaaggaaggugcccaaagggaagguuuaauguuggauuccaaugacgaauuauacaaaugguuuacacaacaaguaaugcguaauuugcauguugucuucacuaugaauccuucuaccgauggucugaaagauagggccgccacuucuccagcuuuguucaacaggugcgucuugaacugguucggugacuggucagauggagcucucuuccagguugguaaagaauucacgaaccguuuggaccuugaaaaacaaaguuggagauguccagacuucuucccggcugcuugcaaucacauuucagcgucucccacucauagagaagccgucauaaaugccuguguauauguacaucagacucuucacaaagccaacagcagauuggucaagagaggaagccguaccauggcgauuacuccaagacauuacuuagauuuuauucaucaucucguuaaacuguacaaugagaaacgcucagaucucgaggagcagcaguugcauuugaauguuggucugaauaagaucgccgaaacuguagaacagguugaagaaaugcaaaagaguuuggccgucaaaucucaggagcuacaggccaaaaaugaagcugccaacgcuaaacucaggcagauggugaaggaucaacaagaagcugaaaagaagaagguacagagucaagagauucagcagcaguuggcugaacaaacaauucacauugagcagaaacggucagaaguaauggcugaucuagaacaggucgaaccugccguuauugaagcccaacuagncaccaucucguuaaacuguacaaugagaaacgcucagaucuggaggagcagcaguugcauuuga

SEQ ID NO: 5691 - RNA, 1317 nt, Diabrotica undecimpunctata
gugacacaaccuuugggugauauacuaguauuuuugacuggacaagacgagauagaaacaugccaggagcuuuuacaagauaaaguucguaggcuagggucaaaaguuaaagaauugcuuauauugccauuauaugcaaacuuacccagcgauaugcaagguaaaauuuuugaacagacgccuccuggugcuagaaaaguuguuuuggccacaaauauagcugaaacgucuuuaacaauagacaauauuauauacguaauagauccugguuuugcuaaacaaaaucauuucaauucgagaacagggauggagaguuugaugguaguaccaauaucuaaagcuucugcaaaccagagagcuggcagagcaggcagaguagcagcuggaaaauguuuuagauuauacacugcuuggucuuauaaacaugagcuagaagacaauacuguaccugagauccagcgaauaaauuuaggaaacgcuguacucauguugaaggcacuaggaauaaaugacuugguacauuuugauuuuuuggauccuccuccucaugagacuuuaguguuagcauuagaacaauuauacgcuuugggagcuuuaaaucaucacggagaauugaccaaauugggcagaaggauggcugaguuaccuguagauccaaugauggcgaaaaugauuuuagcuucggaaaaauauaaaugcucugaagaaauagugaccauaggagccauguuaucuguaaacggagccauauuuuacagaccaaaggauaaaauaauucacgcugauacugcucgaaaaaauuucaaucacuuagcaggagaucauuuaagucuucuuaauguuuauaaucaauggagggauucugauuacucccuacaaugguguuacgaaaauuuuauacaauacagaucaaugaagcgagcccgcgaugucagggaacagcugguuaauuugaugacaagaguagaaauagaaauuguuuccaacguuucugaaaccguggacauccgcaaggcuaucacuuccgguuauuucuaccacauagcuagauuuuccaaagguggaaguuacaagacggugaagcacaaccagagugucaccauucauccuaacagugcacuuuuugaaucuuugccgagguggguucucuaccacgaauuaguuuuuacuucaaaggaguuuaugaggcaaguaauagagaucgagaguaaaugguuguuggaaguagcuccacauuauuauaagcaaaaggaauuagaagauucgacaaauaaaaagaugccuaaaacgguaggcaggaguaccagaacugauuag

SEQ ID NO: 5692 - RNA, 1371 nt, Diabrotica undecimpunctata
augaagguagaggaggugaaaaguacuguaaaaacccaaagaauaagugcucacagucauauuaaagguuuagguuuagaugaagcagguuuugcaauuccaucagcugccggcuugguuggacaagaacaggcaagggaggcggcuggcauaguaguggacaugauaaaaaguaaaaaaauggcuggaagggcuguacuucuagcuggcccaccagguacugguaaaacagcaauugcacuugcaauagcccaagaguugggaaauaaaguaccuuuuugcccaaugguaggaucugaaguguacaguucugaaauaaagaagacugaaguucuuauggagaauuuucgaagagcaauugguuugagaauuagggaaaccaaagaaguuuaugagggggaagucagugaauugacaccaguagaaacagagaacccugcuggagguuacggaaaaacuguaagucauguuaucauugggcuaagaacugcaaaggguaguaaacagcucaaacuggaucccaguauauaugaagcacuccaaaaagagaaaguugaaguuggagacgucauuuauauugaagccacaaguggugcaguuaaaagacaaggaagaucugaugccuaugccaccgaauuugauuuagaagcugaagaauauguaccauuaccaaaaggagauguacauaaaaagaaggaaguuauucaggacguuacauuacaugaucuagaugccgcuaaugcuaaaccucaagguggacaagacguucugucaaugaugggccaacuucuaaaaccaaagaaaacagaaaucacagauaaacuuagaaaggaaaucaauaaaauaguagauaaauauauugaucaagguauugcagaauuaguuccugguguacuauuuaucgaugaaguacacauguuggauauagaaacauucacuuaucuacacagagcuuuagaaagugccauagcucccauuguuauuuuugcaacgaauagaggucguugucuaauuagaggaacggacgauguuuuuucuccacaugguauuccuuuagaucuguuagauaggcuguugauuauucggacaauuccuuacgguagaagugacauggaacaaauauugaagcuaagagcuaccacagaaggcuuagaaauugaucaugaagcaaucacaucguuaggugaaauuggggcaaaagcaacuuuaagauaugccguucaguuauuaacgccagcacaucuaacggcaaaaauuaacggaagaaauaauauacuucaaagugacauugaagaaguugguuccuuauucuuagaugcuaaagcuucagcgaaaguuuuaucugaaaauaaagagaaguuuaugacguaa

SEQ ID NO: 5693 - RNA, 2199 nt, Diabrotica undecimpunctata
augacuucuauuauaaaacuucaagcuuugucaggagccaaagaugaaucucccccaugcuauauucuucaaauagaugaagugcgaauacuuuuagauugugggugggacgaaaaauuugacauggaauuuauuaaggaaauaaaaaggcauguucauaauauagaugcuguauuacugucuuauccagauauuuaucauuugggagcacuccccuauguaguuggaaaacuggguuuaaauugcccaauuuaugcaacuauaccuguauacaaaaugggacagauguuuauguaugauuuauaucaaucucaguauaauaugaaagaauuuuguauuuuuucacuggaugauguugaugcuacauuugaaaaaauuauucaauuaaaauacaaucaaaauguaccauuaaaagguaaagguuaugguuuaacaauuacacccuuaccagcuggucauaugauuggggguacaauauggaaaauaaugaaaauggaagaagauauaauauauuguaaugauuucaaucauaagaaagagcgacauuuaaaugguugugagcucgauagacugcaaaaaccuuccuuacuuauuacugaugcauuuaaugcuacuuaucaacaagccagaagaagggcuagggaugaaaaacuaaugacuaauauucuucaaacucuucguaacaaugguaacguacuuauagcaguagacacggcaggcaggguucuggaguuggcucacauguuggaucagcuauggcguaacaaagaaucuggccuguuagcauacuccuuagcguuguuaaacaaugucaguuauaacguuauagaauuugccaaaucccagauagaauggaugagugauaaauuaaugagaaguuuugaaggcgccagaaauaaucccuuucaauuuaagcacuugcaguggugucacaguuuagcagaauuaaguaaaguuccuaguccaaagguuguucuugcaaguucacccgauuuggaaaguggauucuccagagaauuguucuugcagugguguucuaauuccaacaacaguauuauauuaacaacaagaacauccccugguacuuuagcuagagacuuaauugauaacggagcagaaagaaauauagauuuaacgguagaaaggcgaguaaaacucgaagguguagaacuugaagaauaugaaaaacgacaacgagcgcgaggucacaauguagaaaaggaagaugcagauucggacucugauucugacauagaaaugucuguuaucaccaaagguagacacgacauaguuauuaaacaagagggaaaaauaaaugccgguuucuuuaaggucacgaaaaaaauguaccccauguauccuuuccaugaagaaaaaauuaagagcgaugaauauggagaaauuauaaaaccugaaaauuacaaauuggcagaugugacuggagaaggagaagacaauaaagaaaauguauugauaaaaaaggaaauagaggaagaaaucacugaaauacaugaacagccaacaaaaugcauaguacuucagagaacuguacaaguuaauugucagguacauuacaucgauuuugagggucgcucugauggagaaucccuuaugaaaauuuugucgcagcucaaaccucgaagaguaauagucguuagagguaccgaggaaaauacaucugucauagcaaaacauugcgaagguauaaaagccagaguuuuuacuccaucucgaggggaaauuguugaugcuacaagcgaaacacauauuuaccaaguuagguuaacagaugcacuagucucacaguuaagguuccaaaaagccaaagaagcagagguagcuuggauuacagcgaacguaguucuuaaagagagucaagcagacgcuaagcguguuuauguugaugaugaaccaauggaaguugaagauguggacacaaggauuuugacgcuggaaccuguacuugaaggagauugucaugauccaguuuuuauaaacgaguuaaaauuaucugaauuuaaacaaguuuuaggaagacaaaacauuacuucagaauuuucaggcgguguccugugguguuccaauggaacaauagccguaaggagaguggagucuggaaagauuaugcuggaaggcuguauaucugaagauuauuauagaauuaaggauuuauuauaugagcaguaugcuauauuguaa

SEQ ID NO: 5694 - RNA, 2286 nt, Diabrotica undecimpunctata
auggcuccuuuagagucaacuaauaacaacggcaaugaggaaccugguccaauaaauccaauugugggaaucauuuauccaccaccagaggugagaaauauugucgacaaaacugcaaguuuuguugcuagaaaugguccagaauuugaagcucguauuagacaaaaugaguuaggaaacccuaaguuuaauuuuuuaaacaguggggauccuuaccauucuuacuaucaacauaaaguuaaagacuuuagggaaggaaaaggacaagauccugccucuggauuaacucaagccgucucaaaacuuucuguuacugcaucagcucaacagaaacagcaggagauuuuaaagcagguagaacagcccuuuauaccuaaggaaacaccugcagaauuugaauuuauagcugauccaccaucaauuucagcucuagauuuagauauuguuaagcuuacagcucaguuuguagcuagaaaugguagagcuuuucugacacaauugaugaauagagaacaaagaaaucuacaguuugauuuuuugaggccucaacacucauuauuucaauacuucaccaaauuacuggaacaauauacaaagguucuuauucccccaaaaaguaugcaugagagccugcgaaaugaggcuaauaguccgaaaaauguauuagagcaagucaaauaucgugcagaaugguugaaguaucaagagcaacaaaaagcuaaggaagaggaacuuuuagaacgagaacggguugccuaugcacaaauugacuggcaugaguuuguagucgucgaaacuguugacuaccaacccuucgaaauuggaaauuuuccagcuccaacuaccccugaagaagucggagcccguaucuuaauucaagagagaauagaagaaggugaagauaucgaaaugcaacuagagagugaugaggaagaaucaccaguuacggaaucugguuuaaguaguaugcaggacaagaccaaucggaagacacgcgacgacaccagaauucaagacauggaagaagaaaguuccgaugaagagaaaggagaagacgacgaggaauuaguuuuaccuccgccaccaccgucuauucaaccaccguuacccccuauucccgauaaaguugucgugaaaaaauaugaucccaaacaagcugucaauguuagccgaccaacaaucggagaugauuaucucgugucacccaucacuggagagaaaauaccugcgaacaaagugcaagaacauaugcguauuggucuguuggauccgcguuggguagagcagcgcgacaaacaaauaacggacaaaaugaaccaagaaacaguauaugcugcugguagugccaucgaugcuucauugaaacugcucgccgagcgacguacugauauuuuugguguuggagaugaagaaacagcuauugguaagaagauuggcgaagaagauguuagaaaagacgagaagguaacuugggaugggcauacgagcagcguugaagccgcuacaagagcugcuagagcuaauaucaccuuggaggaacaaauucaucaaauacacaagguaaaggguuugcuuccugaugaagagaaagagaaaaucggcccaaagaauauugguucaaaaucugguaaaaucaacauacaaagcguaauuacuacgaagccaccuacugcacuuccuccaaaaccgccagucucuuuaauucaaacucaagcaacugcgucgcugauaucaguaccuccacaaccuaugcuaccaccucaaccuccuauuaugaugaugucagcgacaucuaugccuccaauuagaccaccuccaauaaugaugacaggaccuccaccaauaccugguuuucccguagcaccaauguccucaccuauggguccgccuaugaaucugcccccaauaaaacaucaggcggacgcgccucacgaagaugaaccgaguaacaaaaagaugagaaacgaagauucgcuuauacccgaaaaagucuuuuuagcaagacaucaaagccaaguggcuauuaagauuucgauuccucauaugccagaaaaaucugaauggaagcugacagguaaaaugauuucguggacuguaccgcuugccgaaucuguagcgaauuugaaggcgaaacugcaagaagaaacuaauaugccuccagcuaaacagaagcucuuuuuugaugguauguucuuuaaggauucuaacaguuuagcauacuacaacgugacuacugguucaaucauucagcuacagauuaaggagagaggaggaaggaaaaaauaa

SEQ ID NO: 5695 - RNA, 969 nt, Diabrotica undecimpunctata
augccgagucaagaauuaacaacuaauaaaguaauaguccauccuuugguccuucuaaguguaguagaccauuuuaaucggaugggcaaaaucggcaaucaaaagcguguuguugguguucuucuugguuguuggcgugcuaaaggaguuuuagauguuucuaacaguuuugcaguucccuuugaugaagaugacaaagauaaaucuguuugguucuuggaccaugauuauuuagaaaauauguauggaauguuuaaaaaaguuaaugcuagggaacgaguaguggguugguaccacacuggccccaaacugcaucaaaaugauauugccauuaaugaguuaaucagaagauauuguccaaauucaguucuaguuauuauagaugcuaaaccaaaagauuuagguuuaccgacugaggcuuaucaagcuguagaagaaguacaugaugaugguucaccuacuucuaaaacauuugagcauguuccuagugaaauuggagcugaagaggcagaagaaguugguguugaacacuuauugagagauauuaaagauacaacuguuggcacuuugucucagagaauaacaaaucagcuuuuaggauuaaaaggucuccauucacaguuacgugauauuagggacuauuuaguacaaguuugugcuaaccaacuuccaauuaaucaccaaaucaucuaucaauuacaagauauauuuaaucuuuuaccagauauaaaucaggaugcauuuaauacaucguuuuauguuaaaaauaaugaucaaauguuaguuguuuaucuggcagcuuuaguuagaucuauuguugcucuacauaaucuuauuaacaacaaacuaacaaauagagaugcagaagaaggaaaaaaggaagauaguaagaaagauagcaaagauaaggacaaagauaaagagaaggaaaaggauaaggaugccaagaaggaugaaaagaaaaaguaa

SEQ ID NO: 5696 - RNA, 1656 nt, Diabrotica undecimpunctata
auguuugguggaggacgugccccuauuuugguguuaagucaaaauaccaaacgagaauccggccgaaaaguucagcuggaaaacaucaaugccggaaagcaaaucgcggaugugauaaggacaugccuugguccucaagcuauguuaaaaaugcuuauggauccaaugggagguauugugaugacuaaugauggcaaugcuauuuuacgugaaauuacaguacaacauccagcugcuaaaaguaugauugaaauugcaagaacacaagaugaagaaguuggagaugguacuaccucaguaauugucuuagcaggagaaauguuaguggcagcugaacaguuuuuggaacaacacauucacccaacaaucauaauucgccaguacagacaagcacuugaagauaugauccaguuauuggaagguccauugaguauaccagucgauagaaaugauaaaaaugcucuugcacaaguuguuaaaggcugcauugguacaaaauucauaaguaaauggucagauuuagcaguaaauauugcuuuagaugcaguaaacacaguauuauuagaagaaaauggcagaacugaaguugauaucaagagguaugccaaaguugagaagauuccuggaggaucuauugaagagucuaaaauuuuaaaagguguuaugcuuaauaaagauguaacacaucccaaaaugaaaagauauauacagaauccgagaauaauacuuuuggauugcgcauuagaauauaaaaaaggggaaucucagacaaauguagaaaucacgggagacacagacuucaccaaacuauuagaacuggaagaggagcacguuaagcgucaaugcgaugacauaaucgcacucaaacccgacgucgucuucacagaaaaaggaguguccgauuuggcgcaacacuuuuugcugaaagccgguauuaccgcuaucagacguguacgaaaaucugauaauaacagaauugccagagccugcggagccacgauuguuaacagaacugaagaguuacaagaaagcgauguugguuuaggagcuggacucuucgaaaucaagaaaauuggggaugaguauuucugcuuugugguugaaugcaaaaauccaaaggcguguacaauuuuacucagaggugccaguaaagacauucucaacgaaacugaaaggaaucuacaagacgcucuacaagucgccagaaauauuauccuaucuccccguuuagugcccggagguggcgccauagaaauggccguagcucaacguuugaugcagaaggcgacgcacggaccuuauagagcucuugcacacgcuuuagaaauuauuccaaaaacucuuacucagaacugcggagcuaacaccaucagaacguuaacugcuuugagagcgaaacacgccaaccacacagacguuaacaaaccaugccuuugggguaucgauggcgaaacuggagaacucguggagauggacaagaaagaauugugggagccucuagcugucaaacuacaaacauacaaaaccgcuauagaaacugccauucucuuacuucgcaucgacggcaucguaucuggcuccaaaaagaaggggggcaacgaaccaccgacuccuagccaaaugcaacagcaagaagcuagaggagaugcugaauaa

SEQ ID NO: 5697 - RNA, 702 nt, Diabrotica undecimpunctata
augaugcaaaccgccaauaauguauauuaucccgauuauuccacugcuccaaugcaacgucaaauuaauccuuaugccgacaauggagggaguguaguagcaauagcaggugaagacuuuguaauaauuggugcagauacacguuugagugcuggauuuuccauuuacacuagagaacaaaacaaacuauucccgcuaucaggcacuacaguuuuaggcugugcaggauguuggugugauacucuaacauuaaccagaauccuuaaaucucgcaugcagauguaccaacaagagcauaacaaaacaaugucuacaacugcaugugcccaaauguugucaaccaugcucuacuacaagagauucuuuccuuauuauauaucaaacauucuuguugguuuagauaaugaaggaaagggcuguguuuacagcuaugauccaaucggacauugugaaaaagcuacuuauagagcaggugguucggcuggagcucugcuccaaccccuuuuggacaaucagauuggacaaaagaacaugcuuaaaacaucuggagaaccucuuagucaggagaaagcuuuggcuacacugaaagauguauuuauuucugcugcugaaagagauaucuacacuggagauaguguacuuauaaauauuauuacuaaagauggaguaaaggaagaguccuuccaguugagaagggauuag

SEQ ID NO: 5698 - RNA, 897 nt, Diabrotica undecimpunctata
auguuccaauuuggauucaacauguuuccugagauucccaggccuuuuaacaugacuuauaagugcuacucaguggcuauguuuccuggcaaugaacgagaagacguugaaagggguggaaaaauuaucaugcccccaucagcuuuggaacaauugacuagguuaaauaucaacuauccuauguuguuuaagcuugugaauaaaaagacucaucgcacaacacauuguggaguuuuagaauuuguugcugaugaaggaaaaguuuauuugccacuuuggaugaugaacaacuuaguacucacugaaggagauuugguucagauggaaaguguuucccuuccaguuggcacauuuucaaaauuccaaccucucaauccagacuucuuggacauuacuaauccuaaggcagucuuagaaaaugguuuaagaucuuuugcuugccuuacaacaggagaugucauugcaguaaaguacaaucaaaaggcuuaugaguuguguguucuagaaaccaaaccuggagaugcaauuagcaucauugaaugugauaugaauguggaauuugcugcuccuguuggauacaaagaacccgaacaagucaaaaaggaagaagaagaaauggccauagauccugcagauuuaaugccagaaccuucuggauuuguagcauuuagaggugcaggaaaucgacuugauggcaaaaagcguaaagauacuuccggagcugauaguucaguggcuaaaccaacuuaugugagaggaauuccagauuaugauuaccaaauaggcaacuuaacauucaucaggagaaugaucaagcagaaaucuaaugauaauacagaggacagcgaguucaaagcauuuaguggagcaggauuuaguuuaaaaucaagaacauaa

SEQ ID NO: 5699 - RNA, 1113 nt, Diabrotica undecimpunctata
augaccacacugggaucuaaaaucauuaacaaaugucauaaacagauggcagaaauagcuguuaaugcuguuuuagcuguugcagauuuagaacagaaagauguuaauuuugaacuuauuaaaguugaaggaaagguugguggaaaauuggaagacacaacauuaguuaaagguguaguuauugacaaaacaaugucccauccacaaaugcccaaagaacuaaaagauguaaaauuggcuauucucaccuguccauuugaaccaccaaaaccaaagaccaaacauaaguuggauguaagcaguguggaagauuauaaggaacuaagacaguaugaacaugauaaguucaaggaaauaguuggauuaguaaagaaagcuggagcuacauuagcaauuugccaauggggcuucgaugaugaagccaaucauuuauuguuacaacaagaguuaccagcuguaagauggguuggagguccagaaauugaacuuauagccauagcuacuggcgguaggauaguaccccguuuugaagagcuuacuccagaaaaacuugguuaugcugguuugguacgggaaauugcauuuggcaccacuaaagauagaauguugguuauugaagaauguucaaauucacgggcaguuacaauucuuguuagaggagguaaccaaauguuaguagcugaagccaagagaagucuccaugaugcauuauguguugucaggaguuuaguucaggaaccaagaguaguguauggugguggagcagcagaaauugccugcaguuuggcagucgcggcucaagcagaucaacuagcuuccuuggaacaguacgccuaucgugcauuugcugaggcuuuagaaaguauaccacuugcuuuggcugauaacaguggacugucugccauccauacauuaggagaagugaaggcuaaacaagcagcuacaggagauccagcucucgguaucgauuguaugaauacuggaaaccucaacaugagagaacaacauguuaucgaaucacucagaucaaagaggcaacaauuuuuguuggcuacccaguugguuaaaaugauauugaaaauugaugauguacgccaaccugcaucgggauaa

SEQ ID NO: 5700 - RNA, 342 nt, Diabrotica undecimpunctata
auggcuucugcuauggauguugaugccgaagaaguagaauugcccacuuccaguagcucaaaaggagaaaagaaacguuuugaaguaaaaaaguggaaugcuguagcuuugugggccugggacauuguaguggauaacugugccauuugccgaaaucauauuauggaucuauguauugaaugccaggcgaaccaggcgucagccaccagugaagaaugcacuguagcuugggguguuuguaaucaugcguuucacuuccacugcauaucuagaugguuaaaaacuagacaaguauguccuuuagauaauagagaaugggaguuucagaaguauggacauuag

SEQ ID NO: 5701 - RNA, 1605 nt, Diabrotica undecimpunctata
augguaucccuaaaucccguaagaauucucaagcaagaagccgaagaagaaagggcagagauugcccgacugaguaguuuugugggugcuauagcuauaggagauuugguuaggagcaccuugggaccaaaaggaauggauaaaauuuuaguauccagugguagaucugcaggaucaguugaaguuacuaaugauggagcaacuauucuaaaaucgguggguguugauaauccugcugcuaaaauuuugguagauaugucaaaaguccaggaugaugaaguaggagauggcacaacaucagugacaguauuagcaucugaacuacuuaaagaagcagaaaaacuuguagaacagaaaauccacccacaaacaaucauugcagguuggagaaaagcaguagauauugccagaaaagcucuucuagacacugccaaagacaacagcucugauuuagaaaaguucagagaagaucugaugaacauugccagaacuacacucagcucaaagauucugucacaacauaaagaacauuuugccaaacuggcaguagaugcuguguuaagauugaaagguucaggugauuuacagucuauccagcuaauuaagaaaacuggugguaccuuggaagaauccuuuuuggaugaagguuucuuauuggacaaaaaaccugguguacaucaaccaaagagaguagaaaaugcaaaaauccugauagccaacacuccuauggacacagauaaaaucaaaguauuugguucucacauuaagguagauucaauggcuaaaauugcagagcuggaaucugcagaaaaggaaaaaaugaaagauaaagucaacaaaauucuuaaacauaaugcuaauguauuuauuaauagacaguugauuuacaauuauccugaacaacuauuugcugaugcaggaguuauggcuauugaacaugcagauuuugauggaauugaaaggcuagcacuugucacaggaggagagauugucucaacauuugaccauccagaauugguaaaacuaggaacuuguaagcuuauugaacaaaucaugauuggagaagauauccugcuccguuucagugguguugcucuuggagaagcuugcacaauugucaucagaggugcuacacaacagaucauugaugaagcugaccgauccauucaugaugcuuuguguguauuagcagccacagucaaagagagucgaauuguguauggaggagguugcagugaaacccuaauguccacagcgguaucuagagcugcugcuaacacuccaggaaaagaagcuguagcaauggaagccuuugccagagccuuguugcaguugcccacaauuauugcagacaacgcagguuaugacucugcucaauuggucagugagcuuaaggcagcacauaacaguagccagagcaccaugggacuuaacauggagaagggugaauugggagauaugaaaaccuugggaaucacagaaucuuuuguuguuaaaagacaaguauuagucucggcaucugaagcagcugaaaugaucuugcguguugauaauaucaucaaagcugcaccaaggaggagaacagaagacaggggaaugugcuag

SEQ ID NO: 5702 - RNA, 789 nt, Diabrotica undecimpunctata
  misc_feature (412)..(412): n is a, c, g, or u
  misc_feature (777)..(777): n is a, c, g, or u
auguuucgaaaccaauacgacagcgaugugacaguguggagcccccagggucgucugcaucagguagaauaugccauggaagcaguuaaccuagguucagccacaguuggacuaaaaaguaaaacucaugcuguacuuauugcguugaagagggcuucuucagaacugucugccuaccaaaagaaaauuaucaauauagacgaucacauugguauuaccaucucuggacuuacagcagaugcuagaauucuuaguagauauaugcgaaacgaaugcuugaauuauaaguacucuuuggauacuuauaugccguuaaauaggcucauuaguauuuuaggcaacaaaaugcaaacauguacccaaagauaugaccgcaggccauucggugugggucuucuaguagcugguuaunugcgaaacgaaugcuugaauuauaaguacucuuuggauacuuauaugccguuaaauaggcuuauuaguauuuuaggcaacaaaaugcaaacauguacccaaagauaugaccgcaggccauucggugugggucuucuaguagcugguuaugaugaaucugguucccauaucuaccaaacgugcccuucugcuaauuucuacgauugcaaagcuauguccauuggagcucgaucccagagugccaggacuuacuuagaaaaacaucucgaugaacugccauccagugcuuuagaagaacuuaucaaacauggauugagggcucuuagagauacucuaccuccugagguugaccucacaaccaaaaanaugucuccauag

SEQ ID NO: 5703 - RNA, 2550 nt, Diabrotica undecimpunctata
augccgauaaagccuggaaaugaaacggaaaauauggaaauaaccuuuugugaugaagaucucccauaugaagaagaaauuuuaagaaacccuuauucaguuaaacacugguuaagauauauagaccacaaaaagacagcaccaaauaauggcgucaauauaaucuuugaaagagcucuaaaggaauuaccaggauccuacaaauuaugguauaauuauuuaagaacuagaagaaaccaaauaaagaguaaauguauaacagacccagguuaugaagaagugaauaaugcauuugaaaggucauuaguguuuaugcacaagaugccuagaauauggauggauuauugcacauucuuaacagaucaguguaaaauaacuaggacaagaaaaguauuugacagggcuuugagggcauuaccagugacccagcauaacagaauuuggcccuuguauuuaaaauuuguucagaaacaugauauuccagaaacugcaguaagaguauuucgaagauauaugaaauuauguccagaaaaugcagaagaauuuauagauuaccucacagguauugaaaggcuagaugaagcagcucagcugauggcaaagauugugaaugaugaggguuuuguuucucaacaaggaaaaucaaaacaucaguuguggaaugaauugugugaauugaucucaaaaaauccggaaaagguacauucucuaaauguagaugccauuauuaggggugguuugaggagauauacugaucaacugggucaccuauggaauucucuagccaacuacuauguucgcaguggucuauuugaaagagcucgugauauauaugaagaagcuauccaaacagugaccacuguuagggacuucacccaagucuuugaugcuuaugcccaauuugaggaacuaaguuuaagcaagagaauggaagaaguugcuaacaagucuaguccuacugaagaugaugauacugaauuagaauugagacuugcaagguaugaauauuugauggaaagaagauuauugcugcugaauucuguuuuguugagacagaauccacacaaugugcaggaauggcacaaacgaguacagcuuuaugaaggaaaaccaguagauauaaucaacacuuacacagaagcuguucaaacuguagauccaaaacuggcuguaggaaaacuucauaccuuauggguggacuuugccaaauucuacgaaacaaauggucaaauagaagaugcucgccucaucuuugaaaaagcaucccaaguuucuuacgucaaaguagaugauuuggcaacaguguggugugaaugggccgaaauggaaauaaggaacgagaauuaugaugaagcuuuaagacucaugcauaaagcaacuguuaugccuagucgaaaaguagcauaucaugaugacacugaaacaguccaaagucgucuuuauaagucucucaaaguuuggucuauguaugcagauuuagaagaaaguuucgguacauuuaagucuuguaaagccauuuacgacaaaauuauagauuugaagauugcaacuccgcaaauuauuauaaauuaugggauauuucuagaagaaaauaauuacuuugaagaggcauucagagcauaugaaaaaggaauaucucuauuuaaauggcccaauguauacgacauauggaacaccuauuugacgaaauuccuaacucguuauggaggaucaaaacuagaacgcgccagagauuuguucgaacaaugcuuggauggauguccacaacaguuugccaaacaucucuaucugcuuuaugcaaaauuagaagaggaacacgggauggcuagacaugccauggcuguauaugaaaggucaaccaaagcuguuccagagcaagaaauguucgauguuuuuaauaucuacaucaaacgagccgccgaaauuuaugggauucccaaaacgaggcagaucuacgaaaaggcuaucgaguuacuuccagaggacaaaacuagagaaaugugucuaagauuugcugauauggaaacaaaacuuggugaaauugauagagccagggcuauauaugcucacuguagccaaauuugcgauccgaggauaacggcagaguuuuggcagauuuggaaagaguucgaaguucgucaugguaaugaagauaccaugcgagaaauguugagaauaaaacguagcguacaagcuguguacaacacacaggugaacaugaugucagcccaaauguugaguuccgcgggcagcaugagcgguacaguagcggauuuggcgccggggguuaaagacgguaugagacuuuuagaagccaaagcuguugaaauggcuggaacuucacaacucgcuaaaccgggagguauuauguuuguuaggggagaaacucaaggagcuaauaaagauaagguuguuaauccugacgaaauugauauagacagugaagaaucugaagcagaagaggaagaaguaccagucgaaaagcagagcguaccaucagaaguuuuuggaagucuuaagaaacaaggagaggaagacgaugacgauuag

SEQ ID NO: 5704 - RNA, 1167 nt, Diabrotica undecimpunctata
auggccaacggaccuauagcagaaagaaaucgagaugccacuauuuaugugggaggccuagaugauaaaguuucggagucccuauugugggagcucuuuguacaagcagggccuuuagucaauguacauaugcccaaagaucgaguaacgacaaugcaccagggcuauggguuuguagaauuuaugggagaggaggaugcagauuaugcuauuaaaauuaugaacaugauaaaauuguaugggaagccuauaagaguaaacaaagcuucagcucaucagaaaaauuuggauguaggggcuaauauuuuuauuggaaauuuagacccagaaguagacgaaaaguuacucuacgauacuuuuucggcguuuggaguaauauuacaaacaccuaagauuaugagagauccugauacugguaacuccaaaggguucgcuuucaucaauuuugcaaguuuugaagcaucagaugccucuaucgaagccaugaauggccaauauuugugcaauagacccauaucagugucauaugcauucaagaaagacuccaaaggagagagacaugguucugcagcugaacgucuccuugcugcucagaauccauuaucacaggcugauaggccucaucaacuguuugcugaugcaccuccaauagguuugaugcccaugucaauggccccaccuccuccaccagucauaaugacaggaaugaugcccccgccaccuccaacacuuucaaacuugccaccaccuccuccuccuguaccaccaccaaguucuuucccaccaggaauaccaccuccuccauuaccucccucccaaccacccuuaccaccuggugcacccccaacaaugccaacugcagcaggaggccaagccagacccccucuaccaccuccuccaguggcaccucauggacugauaccuccaccuccaacauggacaggugcagcuccugggagcuugcccauuccuccagguccaccuacuccugcuggaagugcuucauuuggaggaauguuuccaccuccuccacccccuggaggaagaccaccaccgccuaacuggaggccaccuccuccaccaccaccagguuuugcaggaaauagaccagcuuucccaccgaggggaccuccaccacccccacccacuuuugauacuaaaauuuga

SEQ ID NO: 5705 - RNA, 774 nt, Diabrotica undecimpunctata
augggucguguaauucgugcacaacguaaaggugcgggaucuguauucaagucccacacaaaaaagaggaaaggagcacccaaacuucguuauuuagauuucucagaaagacaugguuacauuaaggguguuguaaaagauaucauacaugacccuggccguggugcuccauuggcaguaguacauuucagagaucccuacaaguuccaaaccaggaaggaauuauuuauugcuccugaaggaauguauacuggacaauuuuuguacuguggaaaaaaagcuaaccuccaaauuggaaauguauugccuguaggaacuaugccugaagguaccauuguaugcaauuuagaagaaaaaacuggugaccguggucgguuagcucgugcaucuggaaacuaugcuacuguaauugcccauaaucaugauacaaagaaaaccagaguuaaguugcccucuggagccaagaaaguuauuccaucaaacaauagggcuaugguugguauuguugcuggagguggucguauugacaaaccaaucuugaaagcaggucgugcuuaccacaaauacaaaguuaaacguaacugcuggccuaagguacgugguguugcuaugaacccuguugaacauccucacggaggugguaaccaucaacacauugguaaagcauccacaguuaaaagaggaacaucugcuggucguaaaguuggucuuaucgcugcuaggagaacugguaggauuaggggaggcaaaguugaugccaagaaagaagauuag

SEQ ID NO: 5706 - RNA, 423 nt, Diabrotica undecimpunctata
acgcgagaaauaauggcacguacaaagcaaacagcccgaaaauccacuggugguaaagcaccacguaaacaguuagcaaccaaagcugcucguaagagugcgccugccacuggaggaguuaaaaaaccucaucguuacaggccagguaccguagcucuucgugaaauuagacguuaccagaaaaguacugaauuacuuaucagaaaacuaccuuuccaacgucuuguucgugaaaucgcacaagauuuuaaaaccgauuuacguuuucagaguucggcaguuauggcuuuacaggaagcgagugaagcauauuugguagguuuguuugaagauaccaauuuaugcgcuauucacgccaagagagucacuauuaugccaaaggacauucagcuagccaggagaaucaggggcgaaagggcguaa

SEQ ID NO: 5707 - RNA, 1593 nt, Diabrotica undecimpunctata
auggcuauuaguuuguuaaaucccaaagcugaagucgcuagggcugcacaagcccuagccguuaauauaucagcugcaaaagguauucaagauguaaugaagucaaaccuugguccuaaaggaacgguaaaaauguugguaucuggugccggcgauauaaaaauaaccaaagauggaaauguuuuauugcacgaaaugcaaauucaacaccccacggccucccuuauugcucgagccucaacugcccaagaugauaugacuggcgauggcacuacaucuacaguuuuagucauaggugaacuauuaaaacaagccgauauuuucauagcugaaggucuucauccuagauuguuaacagaaggcuuugauaaggcuagggcaaaagcauuggaacuacuggacaagaugaagauuccaauugaugcaaacaaagaaacuuugacagauauuugcaggacaaguuuaagaacaaagcuacaucaaaaacuugcugauguuuugacagacguuuguguggaugcuguucuagcuauaaagaaagaugauaaaccuguugaucuucauaugguugaauuaauggaaaugcaacacaaaacagaaacugauacucaguuaauuaaggguuugguccuggaccauggcucacgucauccagauaugccuaaaagucucaacaauugcuacauuuuaacauguaaugucagcauggaauaugaaaaaagugaagucaauucaggauucuucuacaaaacugcagaagagagggagaaauuagugacugcugagcgugaauucauugaacagagaguuaagaaagucauugaauugaaaagaucacucuguaauggaacugauaagacuuuugucguuauuaaccaaaaagguauugaccccaugagucuggauaugcuugccaaagaaggaaucauagcucucagaagagcuaagcgacguaacauggaacgucuaucauuggcuugugguggaguagcuaugaacagcuuugaugaucugcaagaaucucaacuugguagagcuggacauguguacgaacauguguugggagaaaauaaguauacauuuguggaagauugcaaaaucccucaaucgguuaccauuuuaauaaaaggacccaauaaacauacuuugacacagauuaaagaugcuguuagagauggauuaagggcuauuaauaaugccauugaugacaaagcaguuauuccaggugcuggugcauuugaaguuacagccaauaaagaauugcuagcauuuaaagacacuguuaaagguaaagcucgucuaggaguugcugcuuaugcagaagcuuuacugguacuuccuaagacuuuggcuguuaacucuggauuugaugcacaggacaccauugugaaacuacaagaagaaucccguuugaauccagacccaauugguuuagauuuaacuucuggagaaccgaucaauccuaaagaugcuggcaucuaugacaacuauauuguuaaaaaacagauaaucaauuccuguucggucauugccagcaaccucuuauugguugaugaaauuaugagggcuggaaugagcagcuuaaagggauaa

SEQ ID NO: 5708 - RNA, 3120 nt, Diabrotica undecimpunctata
augucuagugguaguuuagcagacaacuccaucgauccuccagccaaaaagcggaagcuugaaucaaagauugcuacccucgaaauggcgaacaaugaagcuucaggaucuucuaccggugauauugaugagggacuuuacucgagacaacuuuacguuuuagggcacgaugcuaugcgccgcauggcaaauagugauguucuaauaucagguuugggugguuugggaguagaaguagcuaaaaauguaauucuuggugguguuaaaucuguuacccuucaugaugaggcucuuugcacuauucaggauuuguccucucaauuuuauuuaacagaggcggacauuggcaaaaaccgcgcagaagcuugcuguaagcaguuaucugaacuuaacacuuauguccccacaaagucuuauacagggccccuugaugaagauuucaucuuaaaguucagugcuguugucuuaaccacaagcagucgugaagaacaauuaaggauuagcgagauaacacaugaaaaaaacauugcuuuaauuauagcagacacaaaaggccuuuuugcacaaguauuuugugauuuuggaaagucauuuacuguuguugauguaaauggagaaccuuuaguaucugcaaugauagcagauauuucaaaugauguugaaaguguagucacuugcauugaugauacaaggcaugguauggaggauggagauuauguuaccuucucagaaguucagggaaugacugaauuaaauaacugugaaccaaucaagaucaaaguauuaggaccauacaccuuuaguauuggugauacuaccaaauuuucuaaauacacuagaggugguauuguaagucaaguuaaaaugccuaaacaucuggaauuuaaaucauuuaaagauucucuugaaaauccugaaauaccgauuacugauuuuucaaaaauggauuuuccugggcagcuucauuuagcuuucaccaccuuacauaaauuuguagagaagacuggaaggcuaccuaaaccauggaacaacgaagaugcuacagaauuuguuaauuuagcaaaaucauuagcugcaaagggugauucugauggagaaguuaauucagaccucuuagaaacauuugccaagguaucagcuggagauuugaaucccauaaaugccaccauuggugguauuguagcccaagaaguaaugaaggcauguucuggaaaauuccauccuauuuuccaaugguucuacuaugaugccauagaaugcuuaccacaagacaaaucagaaaucacugaagaauuagcugccccgacuggaaguagauaugauggccaaguugcuguuuuuggaaaagaauuccaaaauaagauagcaucauugaaauauuuuauuguuggugcuggagcuauugguugugaauuguuaaagaacuuugcuaugauggguguaggaacucaaggagaaguuacaguuacugacauggauuuaauugaaaaaucuaauuugaacaggcaguuccucuucagaccacauaacguccaacaaccaaaaucugucacagcugcaaaggucauuaaaaagaugaaucccgauaucaauguuguugcacaugagaaucguguuggaccugaaacugaaaaugucuacaaugaugauuucuuugaaaaguuagauggaguugcuaaugcacucgauaauguagaugcuaggauuuauauggacagaagauguguuuacuaccgcaagccucuucuagagucuggaacucuaggaacuaagggaaacacucaagugguggcgccuuuucucucugaaucauauaguucuucucaagaucccccagagaaaagcauuccaaucuguaccuuaaagaauuucccuaaugcuauugagcauacucuacaaugggcgagagauauguuugaaggauuauuuaaacaaaaugcugaaaaugcuucguuguauauaaccgaccccgauuuucuugauagaacuguuaaacuaccugguguacaaccuuuggagguacuggaaucuguaaaggcugccuuaguugaugagagaccuaaagauuuaaaugauugcauugcaugggcacguaaucauuggcaagaacaguauuccaaccaaaucaggcaguuguuguucaacuucccaccugaucaauuaaccaguacaggccaguuguucuggucuggaccaaaaagauguccagaagcgcuaacauuugauguaaaugauccgcuacacuuggauuauguuauagcagcagcuaauuugaaggcugaaguuuaugguauaccaacuaguagaaauagagaacaaauugcagaaguuguuaagcaagucaauguuccagaauuuaucccuaaaucuggcguaaagauagcaguuaccgauucucaaauggcaaugaaugguaauaauguggauuuggaucgcguuucccaaauuaaagaagaacugcccucaguagcagaacuagguggacuacgucuuacuccuuuagaauuugaaaaggaugaugacaccaauuuccacauggacuucauaguggcugcuucaaaucuacgugcagcuaauuacaaaauaccaccugcugauagacauaaaucaaaacuuauugcugguaagauuauucccgcgauagcaacaacaaccucaguugucgcuggaaugguuugcuuggaacucuacaaacucgccagaaguguuacaucguuagcuccauucaaaaauaauuucauaaaccuugcucugccuuucuucaguugcucagaaccaauagcagcccaacaaauggaauauugugguaacaaauggacacucugggaucgcuucgauguucaaggagaaaugacacuuagugaauuuuuggaauauuucaaagagaaacauggucuugaaauuacgauguugucccaaggcguuuguaugcuguauucauucuuuauggcaaaagcuaaagcccaagagcguuuuggucuuucaaugucagaagucgucagacggguaucaaagaagaaaauugaaccucacguaaaagcauuaguauuugaacuguguugcaacgauucuacuggcgaagacguggaaguuccuuauguuaaauacaauuuauguuga

SEQ ID NO: 5709 - RNA, 762 nt, Diabrotica undecimpunctata
agaauuuuagcauuggucagaucuaaaaaacuaaaucucaaacaucuaaagcauuuuauuuuggaugaaugugauaaaauguuggaguuauuagauaugagacgugauguucaggaaauauaucguaacacuccccaugaaaaacaagucaugauguucagugccaccuuaaguaaagaaauuagaccaguuugcaagaaauuuaugcaagaucccauggaaguauauguugacgaugaagcuaaauuaacauugcauggucuacaacaacauuauguaaaacuaaaagaaaaugaaaagaauaaaaaguuauuugaguuacuagauguuuuggaauucaaccagguuguuauuuucguaaaauccguacaaagguguguggcgcuggcacaacuacugacugaacaaaacuuuccagcaauaggaauccacagaggaauggaucaaaaagaaagacugucccgguaugaacaauucaaggauuuccaaaagagaauucuaguagccacuaacuuauuuggacgugguauggauaucgaaagagugaacauugucuucaacuaugauaugcccgaggauuccgacacuuaccugcacagaguggcgcgagcuggucguuucgguaccaaaggucuagccauuaccuucguaucagaagagggggaugccaaaauauugaaugaaguacaagaacgauuugauguuaauauuaccgaauuaccugacgaaauagaucucaguucauacauugaaggaagauaa

SEQ ID NO: 5710 - RNA, 1032 nt, Diabrotica undecimpunctata
augaauaaaauaacuaaucaaaacagacguacuauagaucauauugcugccaaguguuauuucuaucauucaaggguugccgaauuaaccgauaaauuggauucaauuagaggcuuuuuacauucucgucuacguacugcuacacucaggaaugauuuugaaggucaagcugugcuuauaaauugccuguugagaaauuauuugcauuauucuuuguaugaucaagccgauaaacuagugaguaaguguguauuuccugaaacugcaaguaacaaugaaugggcaagauucuuguauuacuuaggcagaauuaaggcugcacgauuagaauacaguguagcacauaaacaucucgugcaggccaugagaaaagcaccccagaaugcugcuauugguuucagacagacuguucaaaagcuaacaguuguaguugaacuauuguuaggagauauaccagaaagacagguguuuagacaaucuaguaugaggcacucccuugcuccauacuuucaauuaacacaagcaguuagaaugggaaauuugcaaagauuuggugagguguuagagaacuuuggcccacaauuuagacaagaucauacauuuacacuaauuuugagacugcaccacaauguucuuaaaacagcuauaagaucuauaggauuaucauacuccagaauaucuccccaagacauagcuaagaaacuggggcuggauucagcugaagaugcagaauuuauaguagcaaaagcaaucagagauggggucaucgaagccacacuugauccacagggcgguuuuaugaggagcaaagaaaguacugauaucuacugcacaaaggaaccucaacuggcguuucaucagagaauaucauuuuguuuagauuugcacaaucaaagugucaaagcuaugagauauccccccaaggcuuauggaaaagaacuugaaucagcugaagagagaagggaaagagaacagcaggaucuggaguuggccaaggaaauggcugaagaagaugaugaugguuucccuuaa

SEQ ID NO: 5711 - RNA, 1668 nt, Diabrotica undecimpunctata
auggcuaccaaccaccaaaaccuuccaauuucgaguauucuuaaaucaaaaagugaaguugaugaugaaccaaagaaaaaaucaagagaagauuggcguaaagccaaggaacuugaagaagcccgaaaagcugguacagcuccggcugcagucgaugaagaaggaaaagauaucaacccucauauuccacaguacauuucuaaugcaccuugguauuauggaacaucuggaccuacucuuaaacaucaaagaccccaagaagagaaacagaaggaguacucgagcaucgacgaaugguacaagcgugguguugacacuucaaaaauaguuacuaaauaucguaaaggugcaugugaaaauuguggagcuaugacucauaaaaagaaagauuguauggaaagaccucgcaaaguuggagccaaauuuucuggagcaaauauugcaccagaugaauucgcccagaaaaacuuagcauugagcuuugauggaaaaagagauagauggaguggguaugacccaucugagcacaaagcuguaauagaagaguuccagaaaguugaggaagcuaaaagacaacugaaggcugacaaauuaaaugcaaacgaaucuucugacgacgaagaaaaagaugaggacaaauauguagaugaaguagauaugccugguacuaaaguagacagcaaacagagaauuacuguaagaaauuugaggauaagagaagacacugccaaauauuugagaaaucuugauuuggguucugcuuauuaugaucccaagacgagaucaaugagggaaaacccuaauccugaaaaagaugcuacguacaguggagagaauuucguucguuuuacuggugauacgaccaaucaugcuaaggcucaguuauuugcuugggaagcguaugaaaaggguguggauguucaucuuuuagcugaaccaacaaaauuagaacuacucaaaaaagaauaugagaaaaagaaagaagagguuaaaucgacaauucaaagcaguguguuagauaaguacggaggacaggaacauuuagaggcaccaccuaagagcuuguuguuggcucaaucagaaguuuauguggaauauucaagaucugguaaagucauuacuggggcggaaaaagaagucauuagauccaaauaugaagaagauguguacauaaauaaccacacaucaguguggggaucguauuggagaggaggacaauggggguacaaauguugucacuccuucauaaagaauuccuauugccuaggcgaggcaggaaaaacgguuaacgcuccuguaacgcaagauauuccaacggaucaagacguuggugaagcaagcaguacaaaggaagccgggauaucagauggugaaagcgaagauaguaguuccaguaauucaucagaaggugagaaacugaaaaagaaacagagaagauuaaagaaaaaggaaaagaaggcaaagaaaaaggagaagaaagcuaaagaaaaguugaagaaaaaacaggaaaaagaaauggccccagaaguagaugagcaaauaauguuggacgauaggaaaaggccguacaacaguauguuugacguuaagaaacccacagaagaagaaauggaggaauauuauaaaaggagaaagagggaugaagauccuaugaacaacuuuauguaa

SEQ ID NO: 5712 - RNA, 627 nt, Diabrotica undecimpunctata
auggguauuaguagagaccauuggcauaaacggagggccacaggaggcaaaaggaaaccucuccguaagaagaggaaguucgaauuaggacgcccagccgcaaauaccaagcuuggagcucguagaauucacuauguccguacacgaggcgguaacuugaaauaucgugcauugaggauugaaaaaggaaauuucgcauggggcagcgaagguacugcucguaaaacacguauuauugaugucguuuacaaugccaguaauaacgaauugguacguaccaaaacauugguaaaaaaugccaucguuguuauugaugcaaccccuuucagacaaugguaugaaaaccacuacauuuuaccuuuagggcgcaagaagggggcaaaauugacaacagaagaugaagaaauuuucaauaagaaacguaguaaaaaaguacagaaaaaauaugaaacuaggcaaaaaacagcuaaaguagaaccugcucuagaagaacaauuccaaacuggaagauuauuagcuugcuuagcaucaaggccaggacaaugugguagagcugaugguuacgucuuggaggguaaagaacuggaauucuacauucguaagauuaagucuaagaaagcuaaauaa

SEQ ID NO: 5713 - RNA, 936 nt, Diabrotica undecimpunctata
auggauagacuucuucgacuaggaggugguaugccagguuuaacccaggcaccgccgccuucugaugcuccuguuguggauacugccgaacaaguauacauauccuccuuagcccuauuaaaaauguuaaagcacgggcgugcuggaguacccauggaaguaaugggucuuauguuaggagaauucguggacgacuauaccguucgaguaauugauguauuugcuaugccucagacugguaccgguguuaguguagaagcuguugauccaguuuuucaagcaaaaaugcuugacaugcuaagacagacugguagaccagaaaugguugugggaugguaccauucacauccagguuuuggauguugguugucaggaguugauaucaacacccaacaaaguuuugaggcucucucagaaagagcuguagcaguaguaguugauccaauacagucagugaaaggcaaaguuguuauugaugcauuuagguuaauaaauccuaauaugaugguauugggucaagagccucgccaaacuaccucuaacuugggacaucuacagaagccaucagugcaggcuuugauucauggucuaaaucggcauuacuacuccaucaguauuaauuacagaaaaaaugaauuggaacaaaaaaugcuacuaaaucuccauaaaaaauccuggauggauggucuaacuuuagcagauuacucagaaaauuguagugucaaugaaaagacuguugcugauauguuagaacuagccaagaauuacaacaaggcauuagaagaggaggaaaaaaugacuccagaacaacuugcuauuaaaaauguugguaaacaagauccuaagaggcauuuagaagaaaagguugauauuuugaugaccaauaauauuguccagugcuugggagcuaugcuagauacuguuguuuuuaaguaa

SEQ ID NO: 5714 - RNA, 1215 nt, Diabrotica undecimpunctata
augacgguaauuaacaagauggagguagacggagguccgaagggagaagguuuucggucguauuauauuacaaagauugaagaacugcagcuuauaguagcugaaaagagucaaaaucuuagacguuugcaagcucaaagaaaugaacucaaugcuaaaguucguauguugagagaagaacuuauguuacuucaagagcaaggaaguuacguuggagaaguuguaaagcccauggauaagaaaaaaguccuugugaaaguucauccagaaggaaaauuuguaguugacauugacaaaaacauagacauaaaugauguuacuccaaauuguagaguggcccucagaaaugaaucuuacacauugcacaaaauacuuccaaauaagguugauccuuuaguuuccuugaugaugguggagaaagucccugauucaacuuaugaaaugguaggaggacuugacaagcaaauuaaagaaaucaaagaaguaauugaacuuccaguuaaacauccagaacuguuugaugcacuugguauugcacaaccuaaggguguguuguuauauggacccccagguacuggaaaaacucuucuggcacgugcuguagcucaucauacagaauguacauuuauuagaguaucugguucagaauugguacagaaauucauaggagaaggaucccguaugguaagagaacuauucguaauggccagagaacaugccccuucaauuauuuucauggaugaaauugauuccauuggaucuucccguauugaaucaggaucugguggugauucugaaguccaaagaaccauguuggaacuucuaaaucaauuggauggcuuugaagcuaccaaaaacauuaaaguaauuauggcuaccaacagaauagauauuuuggauccugcuuuacucagaccaggaagaauugacagaaaaauugaauuccccccaccgaaugaggaagcgagauuggacaucuuaaagauucacuccaggaaaaugaaccuuacaagaggaauaaaucuuagaaaaauagcugaguugaugccaggugcuaguggagcugaaguuaagggcguguguacggaagcugguauguaugcacuaagagaacgaagagugcauguuacucaagaagauuuugaaauggcuguugccaaaguuaugcagaaagauucugagaagaauauguccaucaagaaguuguggaaauga

SEQ ID NO: 5715 - RNA, 600 nt, Diabrotica undecimpunctata
auggugaaaauauauugucuuaguguuuuauauaaaggaccaacaacugcgaccugguuaaaaucugguuucgagcuucaaagcuucagcuuuuuccaaagagggucaauucaggaguuuaugucauucuuuugcaaaaccauaguggaaagaacaauaccagcuucaagacagaguguuaaagaaggagaauauuugugucauguauauguaagagcugacaacuuagcugguguuaugauaacugaucaugaguacccaucaaggguuucucacacacuaauaacaaaaguacuagacgaauuugcugccagaauucccgcagcuaacuggcccaaccuugaggagagagauguagcauuuccacaauuaaauaccuacuuagcaaaauaucaaaauccuagagaagcagaugcuaugacuaaaauucaagaagaucuugaugaaacgaaaauuauuuugcauaauaccauacaagcaguuuuggaacgaggcgagaaacuagaugacuuggugagcaagucggaagguuuaagcauacaguccaaggcauucuacaagacagcgagaaaaacgaauaguuguuguaauuuuacauag

SEQ ID NO: 5716 - RNA, 729 nt, Diabrotica undecimpunctata
auguuucuuacaagaagcgaguacgauagaggaguaaauaccuuuucacccgaaggaagauuguuucaaguagaauaugccauagaagcuauuaaguuaggaucuacugcuauuggaauauguaccagugguggaguagugcuugcuguagaaaaacguauuacuucccccuuaauggaaccuacuacgauugagaaaauuguagaaguugacaaacauauuggaugugccguuucaggacuuauggcagauucaaggacuaugauagauagagcucguguggaaugucagaaucauugguuugucuacaaugaaaauauaaguguagaauccugugcacagggaguaucaaauuuggcuauucaguuuggagauucugaugaagauggugcagccaugucuagaccuuucggaguagcaauuuuguuugcugguauagaugaaaaaggaccucaauuguaccacauggacccgucaggaacauucguucaguuugaugcgaaggcaauaggaucaggauccgagggggcacagcaaaguuuacaggaggcauaucaucgcaguaugacccuggaagaagcuaccacaacugcuuuaacaauucuaaaacaaguuauggaagaaaaguugaauucuucaaauguugagguuaugacuaugacuccaaaagauauguuccacauguucacaaaggaacaaguggaagagguaauugcuaaauugucuuaa

SEQ ID NO: 5717 - RNA, 1176 nt, Diabrotica undecimpunctata
augcugaucuuuuuuucacaaauuguugucgaugccgccaaugcuguuaaaguuacagauucaaaaggaaauagcauguaucccauaaaggccgucaaugucuugaaagcucaugguaaaagcgccagagagaguuuucucguacccgguuaugcauugaacugcaccgucgccagccaagcuaugcccaaaaaaauuguuaacgcuaaaaucgcauguuuagauuuuucauugcagaaggcuaaaaugaagauggguguucagguuuuaauuacugauccaaaucaacuggaagcaauccguacaagagagcucgacaucaccaaagaacgcauccaaaaaauccucucuacugguguuaauguuauucuugugaguggugguaucgaugaucuuugccugaaauacuucguggaaaauggagcgauggguguaagaagaguaaagaaagcagacuuaaaacgcauugccaaagcaaccggugccacuuuccuaaccucucuaaguaacauggaaggagaugagaguuucgauucuagcaugguaggagaggcagcggaaguuguucaagacagaauuucugaugaugaauugauaaucauuaaaggaccaaaagcacguacugcagccucaauaaucuugcgaggacccaacgauuucuauugugaugaaauggaaagaucuguucaugacgcccuguguguuguaaaacguguacucgaaucaaaaagcgucguaguggguggaggcagugucgaagcagcgcuuucgauauauuuggaaaacuuugccaccacacuaagcuccagggaacaauuggcuaucgccgaauucgccaggaguuuacugguuaucccuaaaacguuggcaguuaaugcagcgcaggacgcuaccgauuuaguagcuaaguugagagcauaccaaaacuccagucaaacgaaaaaggaucaugcgcacuugaaauauguaggauuagaucucauggaagguaccguucgagauaaccgaaaagcgggaguuuuggaaccgaccauguccaaaguaaaaucacugaaguuugcaaccgaagcugccauuaccaucuugagaauagacgauaugauuaaauuggauuccgaacaaagagguggaaagaacuaccagcaagcgauggacaguggagaauuauaugauuaa

SEQ ID NO: 5718 - RNA, 882 nt, Diabrotica undecimpunctata
aaaguuauaaaaguuuccggguacggggccauuaugccacaaaggaggugcagcagaauuaaacauuuucuuuuuaaaacaacuguaacuucagcaaauucaacaaugacuuacaguuuacacuuacuguuuaaguuuucgguuuugacuuuguggcauaauggccccguacccggaaacuuuuauaacuuucccggcucgcacaccagcuauucaaacccuauaacacauacacagucucccguuacaacaucaacuucuguauuagcuauuacuuacgauaaaggaguacugauggccggagaucugguugcuucauauggaucuuuagcuagguacagaaauuguccaaggguuauuaaagucaaucagaauaucauauugggagccggcggagacuaugcugauuuucaauacgugaagaguuuuauugagcaaaaaauaauugaugaagaaugcauugaugauggacuaaaaaugaaaccaaaaucauuguacuguuggcuuaccagaguaauguaccaacggaggaguaaauuggacccauuuuggaauaauuugguuauaggaggaauccaggauggagucccauuucuaggaacuguagauaaauuaggaacugcauauacagacaaaguuaucuguacagguuauggagcgcacauagccuugccccuucugagagacuccuuagauaaaaauggggcucuuaacuuagcugaugccaagacucugauacacaaaugcauggaaguguuguucuauagagaugcuagaaguuuuccuaaauaucagcuugguauuauugauaaagaugauggugucaguauugaggggccuauuucaguugaagagaacuggaauauugcucauaugacauaa

SEQ ID NO: 5719 - RNA, 1869 nt, Diabrotica undecimpunctata
auguaucaguugucccauuuacuaucagaacaaaaaucauuauuaagugcucugucaacaacaucuauuuuagaagacacucagcaccugagcauugaaagggagaauaagaguaaugacaaggauguagaagaggaaaauaagcagaaacuugcagccauuuuagaaaaaguggaaggaugcaaggaauuguuagaaguaccaggaagaaaauuuuuauaugaaggagauuuguuagaaauugauccaacagaaaauacaucuuugaaaacuguucacguguauuuauuuacagauggauuuaugauaacaaauagaaauuccaauagucgagguuugaugaaguacauuuaugaaauaauguacgauuuaaguagucuggcagugguuaacgugagagauuuaggaaauguuaaacacgcguuuaaauuguuaauuuucccggacacgagaguuuuucaauguucuucuaauuccaacaagaaagaaugguuggacaaauuugaccaagcaaagaagacuagacuagcucaagagcaacaaaagagagaaucuauuucggaaaaaucacccucacgaucagcuucaauagagucuccgaguuauaauccauuugacgaaauugaagacgauguaggaauggugcacccagaaugguuuuuggacauuccagaggaacuugauguguguguagcucaaagacacuucgaagaagcucuuucauuguuacaaaaagcuaaggaauauauuaaccaaaugacggccgguaaugagaaacacgaucauguguuccucgauauucaaaggaagguugaacaaagacaaaauagccuuaccgaaguuuuaaugaaagaacuggaaguuaauccugauaaaucuuuacaaggaggauugagggcugccagaagagcaguaagguuauuaaaucaguuaggaagagaaaaccaaucauguaacuuauuccugaaauuguguagcaguauguugaggacgcaguguaagcguguaaaaagagaaggauccaccacaacauacauacgaaauuuggcgaguguaguauucacuaauaugugucauaugucugaugaguuucuaagggccuuucccgauucaccaacuugugcuucagcuuauguugugugggccagcaacgaacuacuucuuuuuacuggacauuuuauaaaacaaguauuuaugccccagaccucgcuaucaacuguuacagaaugcauaguauuaguccgaacgcaaggugaaagguuauacagcuauggccuggauuuauguuaccaacuggacggugcuuuacgaucuuccuuagucaaagcuuuaaaagacggaaaagauaaacuuauagauucgauaaaacuuagagcccuagaagauaaauggaucccaauuaaccugcauuccaaauccgcuuugggaagauuucuacacgaacauucgcaaaugggauuaaauuuggagaguuauguuucaggugacacuuggauacaacucacagcgaguacuuuaucguuuacgaaaauguuuuuccaauuguuaaaugacuguaugaaguuaaaaacgacugaauugguauacaccauagaugaaacuuuguauaauguuuucgacgcucaauugaagcacaaugaaaaugcucuucgcaaugaguuaaaucaggaucaaagaaacuuccucacuaaaaaugcugaauuuuuacugguaaaugugaucgaaaugucgcagaaaauauacaaucaaaauguaggcuacgagugugcaacacuucaaaaacuacaaggcgaauauguggcuuuaaagaagggcguuucuccaacaacuagaaauacuaaaacaaaauacucaucugaauuuuuguaa

SEQ ID NO: 5720 - RNA, 2652 nt, Diabrotica undecimpunctata
augaaagaugucugucaaauuacugguaaagaccuuaacccacauucccaugcuccaacugaaagagaagauagggauagaaauccugacaggccuguaaacagcaguacaucuguguuaagacuuccaguaaacauagaugaaggagaagaagacucccggaaaagaguaacaagaauuucaagucccgagagaugggaaauaaaacagaugauuucaucaggauguauugcuaagagugaguugccugacuuugaugaagaaacuggauuguuacccaaggaugaagauggagaggccgauauugaaauugaauugguugaagaugaagcuccauuuuugcaaggucacgguagagccuuacaugaucuuaguccuguaagaauagucaaaaauccagacgggucauuagcccaagcugccaugaugcaauccgcuuuggcuaaagaaagacgggaacagaaaaugauucagcgggaacaggaggucgauucccagccuuccgguaagaauaagaguuggauagauccucuuccagaggacgaaucaagaaugaugggcagaggaauaggcuuacaaguucaagauuuaccagaauggaaaaaacauguaauagguggcaaaaaaucaucauucgguaaaaagaccaacuuaacaauaauagagcaacgucaauccuuaccaauauauaagcucaaagaggaauuacgaaaagccguaaccgacaaucaaauucuuauaguuauuggugaaacugguucaggaaaaacaacacaaauaacacaguacuuagcugaagcuggauuuacaucgagaggaaagauugguuguacucaaccaagaagaguggcagccaugucuguagcuaaaagaguugcugaagaauucggaugucguuugggacaagagguugguuacaccauucguuucgaagauuguacuagucccgaaacuaugauaaaauacaugacagaugguauguuauuaagggaaugucucauggaucuggaccucaaacaauacucaguaauaauguuggaugaagcucaugaacgaacuauccauacagauguucucuuuggauuauuaaaacaagcagucaugaaacgagaagaacugaaacugauaguaaccucagcuacuuuagaugcuguuaaauuuucacaguauuucuuuaaagcacccauauuuacuauucccgguaggacuuuccccguugagguuuuauauacaaaagagccagaaacugauuauuuagaugcuaguuugauaacggugaugcaaauacauuugagagaaccuccaggagauauuuuacuuuuuuugacuggucaggaggaaauugacacugcuugugaaauuuuguaugagagaaugaaaucuuuagguccggauguaccugaacuuauaauucuuccuguguauuccgcguugccuucagagaugcagacaagaaucuucgaaccagcgccaccugggagcagaaaaguugugaucgcuacaaauauagcagaaaccucguugacgauagaugguaucuacuacguagucgauccaggcuucguaaaacaaaaagucuacaacuccaaaacuggaauggauucguugguaguuacgccgauuucacaggcucaagcaaaacaacgggcaggucgugcugguagaacugggccugguaaauguuacagacuauauacagagagagcauacagggaugaaaugcuuccgacaccuguaccugaaauucaacgaaccaaccuugcaacaacagugcuacagcuuaaaacgauggguaucaacgaccugcuucauuucgauuucauggacgcuccaccgguugagucguuaauuauggcuuuggaacaguuacauucuuugucagcgcuugaugaugaaggauuacuaacacgguuaggaagaaggauggcagaauuucccuuggaaccaaaucuuucaaagauguugauaaugucaguugcccuacaaugcucagacgaaauucuuacaauagucaguauguuaucgguccaaaauguauuuuaccggccaaaggauaaacaagcauuggcagaucagaaaaaagcaaaauucaaucaacccgaaggugaccacuugacgcuuuuggcaguauauaauaguuggaaaaacaauaaauuuucuaaugcuugguguuacgagaacuuuguacaaauccggacauuaaagagggcgcaagaugugagaaaacaacuguuaggaaucauggacaggcauaaauuggacguaguauccgcugaaaggaacacuguuagaguacagaaggccauuugcucuggauuuuucaggaacgcuggaaaaaaggauccucaggaagguuauagagcucuaguagacagucagguuguuuacauacauccuucaagugccuuauuuaauaggcaaccagaauggguaauuuaccacgaauugguccaaacaacuaaagaguacaugagagaaguuacaacuauagauccaaaaugguuggucgaguuugcuccugccuucuuuaaauucuccgauccuacaaaacuuaguaaauucaagaagaaccagagguuagaaccauuguauaauaaauaugaagagccgaaugcuuggaggauaucgcgaguaagaaggagaagaaauuaa

SEQ ID NO: 5721 - RNA, 1248 nt, Diabrotica undecimpunctata
augucgucgaaaagaaaaaguaaagaaagcauaauugcuaggguuaauuuuccacuauauacucuucagauguuaacaucaaggcauguaauugucggugguggaggaggaacauccaaaacugguguacauaaugguuuugaaauauuugagauuuuucaugauggaacacgguuugcagcaaaagaaguaacuagacaugaaacuggaggcaauguuguuaugaacuguucuguuuacagugauagaaaauauucucuuaugguagcuggacaagaaagugacugucaauuguacaaacugaauccuaaacuagucgaggaaguagaaaauaucggcaauaauacucaucucaggcaaagaaauacaaaaaacaaagaaguuacagaugacaacaaaaaugugacaaaagaguuauauuuugauguuaaggcuauagaaaauguucaaacugacuuuaauggcagugaaccauuaucgaggguaguaaaaauuaaucaugaugguacauuauuagcuacaggugguacagauggagauguacgaauauggaaguuuccuaguaugcaaccuuuauuuauucuuaaggcacauacaaaagaaauagaugauauagauuuuaguagguaugacaauuaugugauuaccauagccaaagaugguuuagcaguauugugggauuguaugacaggaaaagaaagaacgaaacuaacauggaaacagccugaaggaucaaaauauuuauauaaacguuguagauuuggugugauagaaggacuagacaagaaaugugcacuauacacaauaucaaauccaauaggaguagcuaaaaaacaaaaauccuaucuccagcaguggguaccugaagaaaacauguuaagaagguguauagaauuugaugagagucuggcugcuuuagcuguucgugaugaugguagauuuguugcuguugguacaauguuuaguggaucaguguccauucuuguagcauuuaauuuacagaaaauuuuaaccauuguuggagcacauuccauguucgucacagggcuggaguuucuucccacccagaacuugaaccauuccauuaguaguguaguagaagccgcagucuugucaauuucuguagauaaccaacuaugcauccauaccgugccauacagaaaaacuauaccauuguggaucgcuaucgcacuacuaguuuuaacuuuauuuuugacuuuuucacuauguucauauuuagguuuguga

SEQ ID NO: 5722 - RNA, 1242 nt, Diabrotica undecimpunctata
auggccggagcaauguuauuugaaagagcucagucuguuucuucucaacacgagaagcuuuuaaaauuauccagggaugaagaagaugacgaacaaaauauugucaauaaagaacaagacauccuuaaucuuggugagaaauauaaaaaggagggcaaggcaaaggaacucgcagaacuuauaaaggccaccaggccuuuuuugaguuuaauaagcaaagcaaaagcugcuaaauugguaaggucucucguugauuauuuucuggauuuagaagcuggcauugguauugaaguacaacucugcaaagaauguauagaaugggcaaaggaagagagaagaacuuuucuacgucagucccuugaagcuaggcugauugcccuuuauuuugacacuggaauguacagcgaagcguuacaacuggaaucaaccuuacugaaagaguuaaaaaaguuggaugauaaaaauuuguuaguggaaguacaacuacuugaaagcaaaacauaucaugcuuuaaguaauuuaccgaaggcuagagcugcacuaacuucagcacgaaccacagcuaaugcuaucuauugcccuccaaagaugcaggcagcuuuagauuuacaaucaggaguauuacaugcugcagaugagaaggauuucaaaacagcuuauucuuacuuuuaugaagcuuuugaagguuuugauaguguugaauccccaaaagcccucacagcgcuuaaauacaugcuuuugucaaaaauuaugaucaacaguccagaagauguccaacaaauuguuagugguaaauuggccuuuaaauaugcuggucaagauauagaggcuaugaaaucaguugcacaggcugcacacaagcgaucccuagcagauuuccaacaagcuguaaaacaguuuaaacaugaauuagaagaugauguuauuguuagagcacauuuaggaacuuuguaugacaauauguuggagcagaaucuuugcaggauuaucgaaccauauucuaggguacaaguggaguauguagcaaaaaccauaaagcucccaguacuacaaguggagaagaaauuaucccagaugauuuuagaugccaaguuucauggaauuuuggaccaaggagaagguguccucauaguauucgaagaaagugcaguagacaaaacuuacgaaauggcccuagaaacgauccagaguaugagcaaaguaguagauacucuuuaucaaaaagcaaagaaauugucauag

SEQ ID NO: 5723 - RNA, 1764 nt, Diabrotica undecimpunctata
auggcauccaaaucaaaaaaagggucaacaccguuagcuucacagcgaccggcgagccccuuaaguccuaccagacauucuagauuacaagagaagcaugaacuucagaaccuuaaugaccguuuggcuggauauauagaucgaguaagauauuuagaaggugaaaauaacagauuaacgagggaaauacaaaccacucaggaaacgguaacaagggaaguuucaaacauaaaaucuauguacgaccaugaauuaucagaugcuagaaaacuauuagacgaaacccaccgugaaaaagcacguuuagaaauagauguuaaacgucuuuuagaagagaaugacgaacucaagucugaguuagcgaaaaagaauaaagauuuggcucuagcugaaaauucugccagaauauacgagacaagauguaaugaauuacagcuuaaagcaaaucaagcagcuucugaugcuaagaaagcaaucgcagaugcuaaagaacuugaaaaagaacgugauaagcuacguaaacuucuugauaaccaucguaaacagcuagaagaagaaucauuggcgaggguggaaguugaaaaugccaaccaaagccuucgagaagagcuaucauuuaaggaucagauccaucaacaacaguugaccgaaacucguacucgucgucaaguagaaauuagcgaaauugauggucgucuggcagaaaaauacgaggcuaaacuucaagaggcucuacaagaucucagagaucaauaugaaggucaaauggccaacaaccguggcgaaaucgaauugcuauaugaacagaagauuaaaaacuugcaaucggcuaaugacagacaccagacaucugcuuccggugcucuugaugaauugagacaaguuagaaccagaauugauaguuugaauucucgaauuagugaauuagagaaccaaaaugcugguuuagcagcgagagcuagagauuuggagaaguuauuagagaacgagcgcuugcgucacguggaagaucuugcaaugcuagaaagagaauuacauagacuccgagaagaaauggcuaaccaacuucaagaauaccaggaucuuauggauauuaaaguuucucuugauuuagagauagcugcuuaucguaaacuucucgaaucugaagaagcucgucugaauauuaccccaacagguagugaaguucaugaaguaacucacagaagucaacgcagcucgucccaacgucgcacuccagucagauugggagccaaaagaaaacgaacacuacuugaagaaagccaagaaucaagcuuaaaugacuauucuguaaacaguucuucaaaaggugacauugaagucacagaugucgauccagaaggacacuauguuaaguugcacaauaaaaguaaucaagaagucgcacuuggaggauggcaagugauuagacguguuggugaugaggaaaccacauuuaaauuucacaggucauuaaaacuggaggcuaaugguuauguaacaauauggagcucugaccucaacaaagaucacgaaccuccaaauaauuuaguuaugaagggucaaaaauggguuguaggugauaacauggucaccacaauauugaauaauaacggcgaugaaguggcgaucucugaaaggguuaaaagacaauuaacaagcucccaucugagacacagagaauuagcagcugguuaccuaucagaagaacuccaccaucaacaaggugauccacaaguagaugagagauguaggcuuauguaa

SEQ ID NO: 5724 - RNA, 2283 nt, Diabrotica undecimpunctata
auggaugaacuacaacuuuucagaggagacacaguccuacugaagggcaagcgaaggaaagaaacuguuuguauaguauuaucugacgacacauguagcgaugaaaaaauucguaugaauagaaauguuagaaauaauuuaagaguuaggcuaucagauguaguuucuauccaagcuugcccugauguaaaguauggcaagagaauucauguacuucccauagaugauacaguggaaggacuuacaggaaaucucuuugaaguauaccugaaacccuacuuucuggaggccuaucgaccaauacacaaagaugacguauucguuguacguggaggaaugagagccguugaauucaaagucgucgaaaccgauccugcuccguacuguauaguggcuccagauacagucauucauugugauggagauccaaucaagcgcgaagaggaagaagaagcucuuaacgcuguuggauacgacgacaucggagguuguagaaaacagcucgcucaaaucaaagaaaugguagaguuaccacugagacaucccagucucuucaaggcuauuggaguuaaaccaccuagaggcaucuuacuguacgguccaccggguacugguaagacccucauugcacgugcaguagccaacgaaacaggagcuuucuucuucuugauuaacgguccugaaauuaugagcaaauuggccggugaauccgaaagcaaucuucguaaagccuucgaggaagccgacaagaauuccccagcuauuauuuucauugaugaauuggaugccaucgcucccaaaagagagaaaacacauggagagguugaacgucguauaguaucucaacuuuuaacuuugauggacgguaugaagaagaguucccacguuaucguuauggccgcuacuaacagaccaaacucaaucgauccagcuuuacguagauucggaagauucgacagggaaaucgauauaggaauacccgaugcaacuggcagacuugaaguuuuacguauucauaccaagaacaugaaauuggccgaugaugucgacuuggaacagaucgcugcggaaacucauggucacguaggugccgauuuagcuucgcugugcucggaagcagcccuucaacaaauuagagaaaaaauggaccucauugaccucgaagacgaccaaauugacgcagaaguccuaaacucacuggcaguuaccauggaaaacuuccguuacgccaugacgaagagcagcccaagugcuuuacgugagaccguaguagaagugccaaacgucacuugggacgauaucggaggauuggcuaacgucaagaaggaauugcaagaauuggugcaauauccaguggaacauccagauaaguuccuuaaguucgguaugcaaccguccagaggaguguuguucuauggaccgccugguugcgguaaaacguuauuagcgaaggcuauugccaaugaaugucaagccaauuuuaucucaguuaaaggaccggaguugcuuacuaugugguuuggugaaucugaagcaaacgucagagauaucuucgacaaggcucgaucugcagcaccuuguguacuauucuucgacgaauuagauucaauugccaagucacgugguggaaauguaggugacgccgguggugcagccgacagaguuauuaaucaaauucuaacagaaauggacgguaugggagccaaaaagaaugucuuuauuaucggugcuacaaacagaccagauauuaucgauccugcaauauugcguccaggucgucucgaucaguugaucuacaucccucugcccgacgagaaaucuagagaagcaaucuucaaagccaaccugaggaaaucgccuguagccaaagacguagaucuuguauacaucgcuaaaguuacucaugguuuuucuggugccgauuugacugaaaucugccagagagcuugcaaacuugccaucaggcaaagcaucgaaaccgaaauuaggagagaaagagaaagggccuugaaucccaauguugcuauggauuuggacgaugacgauccagucccagaaauuaccagggcccacuucgaggaggccaugcguuucgccagacguuccguuucagacaacgacaucagaaaauaugagauguucgcccagaccuugcagcaaucucgcggauucgguaccaacuuccguuucccgacagcagccgguggaccugccgcucccggaggcacagcaggggaucaggccaacuuccaggacgauccugaagaugaucuguauaguuaa

SEQ ID NO: 5725 - RNA, 825 nt, Diabrotica undecimpunctata
augggagaccaguuugauugugcuuuggacuuaaugaggagguuaccuccucagcaaauugaaaaaaacuuaagugaucucaucgauuuaguucccagucuaugugaagaucuacuaucaucuguggaucagccauuaaaaauugcaaaagauaaagaaacuggaaaagauuaucuucuuugugauuauaauagagauggcgauuccuacaggucaccaugguccaauacauacuacccaccccuagaagaugguucaaugccaucugagaaguuaagaaaacuagaacuagaugccaaucuugcauuugaucaauacagggaaauguauuuugaaggagguguauccucuguuuauuuuugggauuuagaccauggauuugcaggagucauucuaauuaaaaagacuggagaugguaguaaaaagauuaaaggauguugggauuccuuacauguaguagaaguacaagagaagaguucgggaagaaacucccauuauaaaaugacuucaacugcuauguuauggcuucaaacuaauaaacagggaucuggaacuaugaacuuggguggaagucuaacucggcagaucgaacaagaugcagcuguaaaugauaucaauccccacauagccaacauuggaagaaugguagaagauauggaaaacaaaauucgcaauacauugaacgaaauuuacuucagcaaaacaaaggacaucgucaacagucugcgaucaguucaaccguugaccgaaagccgccaacagcaggcacuuaagcaagaucucgcggcggcccuucagcguagacaaaacaaaacugagaacuga

SEQ ID NO: 5726 - RNA, 3768 nt, Diabrotica undecimpunctata
auggaacgcccaccccgaaacgaacccccuguggaaccagugaauggagugguccagccgccaguccauccaccuccagagaguccgggccgcgucaccaaucaacuucaguuuuuacagaaaacuguguuaaaggcugucuggaagcaccaauucgcuuggcccuuccagcaacccgucgaugccagaaaacucaacuugcccgacuaccauagaauaauuaaacagccaauggaccugggaacaauuaaaaaaagacuagacaacaauuacuacuggucgggcaaagagugcauucaagacuucaacacgauguuuacaaacugcuaugucuacaacaagccuggagaggauguuguugucauggcucaaacguuagaaaagguauuuuugacaaaaguggcggauaugccaaaggaggaguucguuguugaaucgccuaauaaagcgggagcggcaaaaggaaagaaggggcggaccaguacagcgggcgcugccagugcacccccaacaccaacuacagccaccgcugguucgggaggcagggguaggccucccgccacugucucuucuacaagcgccacuccaguugcuaccacuacaggaucuucagggauaccuuuaggcacucaagcaccggcuacaguaccuggcagcaccgcaacuaccaccauagccgcggcuagcaccaacaacagcucucugucgaaucagcaacugaacucuucuuccaguuccauucacggaagcggcuccaguuuaggaaauuccuuagauuccagcagcgucaugccugccaacguuauaccuccggcacaaccagccaagguaaaaaagggcgugaaaagaaaggccgauacuacgacaccugcuacagccuacgauuauccgccaacauuggagucgaaguccgcaaagauaucgacgcgccgagaguccgguaggcaaaucaaaaagcccaccaggccggaacuggacggucacccgccacaacccccuccacuuaaaccaaaagaaaaacuaccagaaucacugaaagccugcaaugaaauccuccuagaauuauuuucuaagaaacauucuaguuacgccuggccuuuuuaucaacccguagacgcagaauuacucggucugcacgacuaccacgacaucauaaagaaacccauggauuuuagcacuguaaaaaauaaaauggagaaccgagaguaucgcacuccucaagacuuugccgccgacguuagacugauuuuuaguaauuguuacaaguacaacccuucugaccacgaugugguugcuauggcgaggaaguugcaggauguguuugaagugaaauaugcuaagauucccgacgaaccugucaauaggguaggagccccugccguuaauaacaucccuaccaaaucagaaucgaguacauccgguuccagcucagauucuucuagcgauaccgaagauucagaggaagaaaggcgaaauaaacaacugaagcugcuagaaaaagaguugacggcgaugcaagaaaagaugcguaaacugguagacgagagcacgcguaagaaaaaagagaagaaaaaggacaaaguaaaaaagaaaccgacaucaggugggucucucgcgaacgccucccuaucaacucuaccaaacagcagcagcgcgggcuuggguaagccgggugccgguggucacggggcucuaaacaagucaaacaacaacaacucaauagcggcggacagcguugacgacagcaucgccaguguugugucgggcgccgaucuaaagauggccgagucgcaccauccgcaaacuggaacaggcgcucaccauccgccggcaggcaagucccugaacaugcaucacaacaugacggcaaacgcuggcgccaacgcuuccgcgcaggcuaaaacaccuaaaaguaaaggacuccgcggcaauaaacccgcugcagcuaccaacgcggcucccaacaagaggguuaaagccaacaacaaagcuggcgcggguaggaagaaaaacgccgcacagccaccaccgaugcaguucgauucugaggacgaagauaaugccaaaccgaugucuuacgacgaaaaacggcaauugucuuuggauauuaauaaauuaccaggugacaaauuggguagaguuguacauauaauccaauccagggaaccgucguugagggauuccaauccugacgaaaucgagaucgauuucgaaacgcugaaacccucaaccuuaagagaauuagagaguuacguugcgucgugucuucgcaaaaagccacauaaaaaaguagcuggcaaaucuaaggacgaacaaauagcggaaaaaaagcaagaguuagaaaaaagacuaauagauguaaacgauaaaaucggcaacuccaagaaggcccccaaaaaagaugaagccaacaagguagauccaacgggcgcgggaggucccucaggccgcuuauccucuagcuccagcaguucggacuccgacagcaguaguagcagucuguccucuaguucuagcgacuccagugacagugaagcaggugggacggcgaaccgacaggccaaaaagaaagcgaauaaaaaaucaccuaauccuucucuaggaaguuccaccaccaccaccacuacgacuauaaaaguaccgccgccucaaacaacggcaacaccugcaccaccgucacaagccgcaccagcuaucacaacagcagcaacugcuaauuuaacaacaacugucagcguaccaccacuuacuacuacaacgacaacgauagcugcaccaauucaaccggcggcaguuccaaacgucgcaguucccgcgcaaacgacgccagucgcacccgccuucacgccgagcguaaccgucaaaccaucacuccaagccgcuccuaucgcuccaacggugccgccucuuauuaagucgaucgagaaacugccuauuacaacucacuuaccuccuaccguuccuacgauaacgccuccaacuguaccucaagcuccuaagucgguagcguuaccgacuccuucgccugauaaaccuaaaccuaacauuauuucucccauugguacuuuuaccgacccuaucgaacaaucauuggcuagucuugaacacgauauuaagcagaacgacccuauggacguuauaacggcgucuacuaugaugcaacugccuacuacauugaguaauccugucgugucacauccacauccuagcuuaaacuuaaauccaaccauuaaccauccuauuuuacagccuagcacacuuaguauggacuugaaagcgccuauuaugggaacuauggcgccgagcaauaccauguugcaucacggauugcaacaagcgauggaaacggauaucacgauaccuccaccacccaccaauauguuacaugggcagaacaaugguuuuggcaugaaacacaauuuugaucugacuacaaauaacaacggucuuucgucgaugggacuaccgauggaaaugucgauaucgucaauguucgauccgauuccgcaaaauauuaacaaucccaugaugaagaacgauucccaacuuaagauggacgaucgcauggauaccuuaggcggacuuuugaacgauaaaaagucuaauccucucauacaaaagccgaugucgcaaucguuuggcuucaagaacgacaaaccagaucacaacgucaaaaacgcuaguuccuggucgagcuuggccaaaggaaaaucaccacaaaacaauauuccgggcggcagcaguaagcagcaaguuauggauaguuuu

SEQ ID NO: 5727 - RNA, 1224 nt, Diabrotica undecimpunctata
augucguuauccaccgcucgcccauuagugagcguauacaaugagaagucggaggaaguaaagggcucaaacauuucacuuccagcaguguuuaaggccccaaucagacccgauguaguaaacuucguucaccaacagguuucuaugaaccaucgucaacccuacagcguuagugacaaagcuggacaucaaacaucugccgaaucaugggguaccggacgugcuguugcucguaucccccguguaagaggaggugguacccaccguucuggucagggagcuuucgguaacaugugucgcgguggacgcauguuugccccaaccaagccauggcgucgcuggcacagacgcgugaacaucaaucaacgccguuacgcuuuggcgucugcuguagcugcuaguggcguaccagccuuaguuaugagcaaaggacaugucauugaccaaaucccugaauugccauugguugucagugacaagguacaagaaaugagcaaaacuaaacaggccguucaguucuugagaagaaucaaagcaugggcugacauucaaaagguuuacaagagucaacguuuccgugcugguaagggaaaaaugcguaauaggagacgcauccaacguaaaggaccauugguuguuuacuacaaagaucaaggucuccgucgugcuuuccguaacaucccaggcauugaccucauuagcguacagaaguuaaacuuguugaaacuugcuccugguggucauguaggucgcuucauuauuuggaccgaauccgcuuuccaacgguuagauaaauuguuuggcacauggaaaacaccaucauuagaaaagaaggguuacaaucuaccccaaccuaaaauggcaaauacugaucuaucuagauuguugaaggcugaugaaaucaaagcuguauuacgugcuccucaaaagaagguuguacgucguguacgucgucucaauccauugaccaacgccaaggcuaugcuuaaauugaauccauaugcugcuguacucaaacgugaagccauuuugaagaaucaaaagagacaguuaaacagagaagaacuuuuggccaagaaacgugguauuaccuugagugccgacaacgucgugauuagauccagaaaauugcaagaaaggagaagggcacaaaucuugaaggacaagaaaucaaagccuaagaaggucaagaaggcuccagccaaggcugcaggaaagaaauaa

SEQ ID NO: 5728 - RNA, 5466 nt, Diabrotica undecimpunctata
auggcagacuucauagauucugaagcagaagaaaguagugaggaggaggaauuagaucacagggaucguaaaaaagcccaaaaagccaaaguuguagauaguucagaugaagaugaugaagaugaugacgaaagacugagagaggaauuaaaggauuugauugaugauaauccuauugaagaaagugaugcugagucugaugcuucaggaagggaaaaacguaagaaaucugaugacgaggauuuggaugaucgacuggaagaugaagauuaugauuugcuugaagaaaauuuggguguuaaaguugaaagaaggaaauucaagcgacugcggcgauuugaagaugaggaaagugaaggagaagaagaacaugaucccgaacaagacagggaacaaaucgcuauggauauauuuucagaugaugacgaugaaagacgaucggaacggagucacagaccugccgucgaacaagacaauuauggugucggcgaagaagaagaggaaggggaguacucggaugccgaugacuuuauaguugacgaugacggcagacccauagccgaaaagaagaagaaaaagaaaccaauauuuacugaugccgcucuccaagaggcucaagaaaccuuuggugucgauuuugauuaugaugaauuuaguaaauaugaugaagaugauuacgaagaugaagaggaggaggaugacgaauacgaggaagaugauguggagaaaaggaaacggccuaaaaagacuucaaagaaaaaaccgacgaagaaauccauuuuugaaguguaugaaccuagugaacuuaaaagagguuucuuuaccgaucucgauaaugaaauccguaacacugauauucccgaaagaaugcaacuucgugauguuccgaucaccgccguuccugaugacucaacugaacuugaugaugaagcagaauggauuuacaggcaagcauuuugcaacagaacuguuucuaauguggauucucauuuaucaucagaggcaagagagaaauugaagaagacuccucauaccaucggaaagaucagaaaagcguuagauuuuaucagaaaucaacaauuagaaguaccauuuauugcuuuuuauagaaaggaguauguucaaccagaacuuaauauuaacgauuuguggaaaguauauaaauacgaugcaaaguggugccaacugaaaacacgcaaagaaaaccucuuaaagcuuuuugaaaaaaugaggucguaucaaacugacaccguaaugaaagauccagaugcaccaauuccagacaaccuucguaucaugacugagucggacauugagcgauugaaaaauguucagaccgccgaagaguugaaugacguucacaaucauuucauuuuguauuacgcugcagauuugccagccaugcaugccgcguggagaaucaaagaaaaagaaaggagaagacaggaaagaaaggaggcuagacuuaagcucaucgcugaaagugaagaaggagcugaaauuccugaagagccugaagaaaucgaugaugacgaaccugaaacugaaaccuuaaaauacgccaauaggucaggcagcuaugcacugugcaguaaaggagguuugggcccgcuagcgaagaaauuugguuuaacaccugaacaauuugccgaaaaccugagagauaauuaucaaaggcacgaaguagaucaagaacauauagaaccuguagaaguggccaaggaauucgugucgccgaaauuuucuacaguggaagaaguauuacaagcugcuaaacacaugguagcauuacaaauagcaagggaaccguuaguaaggaaaugugucagagaaauuuucuuugaacgagcuagauuaagcguuuauccaaccaaaaaggguaugaaaguuauagaugaagcucauaauugcuauaguaugaaguauuuaaaaaauaaaccaguaagagaucuugcaggcgaccaauuuuuaaaguuauguuuagccgaagaggagaaccuacuuacuauuaccaucaaugaccauauacaaggaaacacuacuaacaauuacaucgaugaagucaaacaauuauauauaaaggaugaauucagcaaacacguucaggacuggaaugcgcuaagaauggaaucgguagaaagggcuuuaacgaaaagugucuugccagauuuaagaucugaauuaaaacgaacguugaucacagaggcuaaagaauucgugcugaaagcuugcuguagaaaauuauauaauuggauaaagauugcuccauacgcaauaaaauuucccgaugaagacgaagaugacugggauacauccaaaggugucagaaguauggguguggcauacguaccagagcacacaguaucagcuuuuaccuguauuucagcaccagacggagauauaacugauuaucucagauuaccaaauauucuaaaaagaaaaaauagcuuucgaacugaugaaaaacuuaugaaggaagccgaucuucaaucacugaaaaauuucauauaccuuaaaaagccucaugugauagcaguagggggugaguccagagaagccuuaaugaucgcugaugauaucagaggaguaauaaaugaacuaauagaauccgaucaauuuccacagauuaggguugaaauuauugauaaugaauuagcaaaaguguacgcaaauuccauuaaggggacgacugauuucagagauuauccggaguuguugaggcaagcuauuucauuagcgcgaagaaugcaagauccuuuaguugaauuuucccaauuauguaauagugaugaggagauuuugagucuuagguuucauccuuuacaggaacaaguccaaaaagaagaacuacuagaagcucucuguuuagaauuugucaacagaacaaaugaaguaggugucgauauaaaccuugccguucagcaaauucauaaaaguaguuuaguucaauucauaugcggucuaggaccgcguaaaggacaagcguuacuuaaaguucugaaacaaacuaaucagaggcuugaaaacagaacucaauugguuacauuuugucauaugggcccaaaaguuuuuauuaauuguucuggauucauaaagaucgauacuaauaguuuaggagacaguacugaggcauauguugaaauauuggauggcucucgaguucaucccgaaacuuacgaaugggcacgaaaaauggcuguggaugcuuuagaauaugacgaugacgagggagcuaauccugcgggcgcuuuagaggaaauucucgaggcgccagagagguuaaaagaucuugacuuggaugccuuugcggaggaauuggaaagacaaggauuuggaaacaagaguauaacauuguaugacauuagagcagaauugaacucgcgauauaaagauuugagacagccuuuucguucugcaaauccugaagaacuauucgauaugcuuacuaaagaaacucccgaaacauuuuauauuggaaaaaugguuacaucuaccguguuugguauugcaaggaaaaaaccaaaaccagaccagcucgaucaagcuaacccgguccguaaugacgaaacuggcuuguggcagugucccuucuguuugaaaaaugauuuuccugaauuauccgauguauggaaucauuuugaugcaggcgcauguccuggucaagcuacuggaguuaaacuaagacuggauaaugguauuuuagguuauauuuauauaaaaaauauaagcgacaaaccagucgcuaauccugaagaaagaguaggcauaggacaauuaauucacuguagaauaauaaaaauagauguagagaaguuuaguguugauugcacaucgaaaucuagcgaucuugcagauaaaaaucaugaauggagaccucagcgagauccucauuaugaucaagaacgugaagacaaagacaaucgaacggaagccgagaagaagaaggagaaacagcguaugacguacauuaagagaguuauuguucauccggcguuccauaacauauccuacgccgaagccgaaaaaugcaugguuaauauggaucagggugaaguuaucauuaggccuucgaguaagggugcggaucauuugaccauuacuuggaaagugacugauggaaucuaucaacauauugauauuaaggaacaaggaaaaguuaacgcuuuuucuuuaggaaaaucauuauggauuggaaaugaagaauuugaagaucuugaugaaauaauagcuagacacguuacaccaauggcagcgcaugcuagagauuuacuguauuuuagauauuacaaagauuucgcggguggucauaaagauaaggcugaagaauaucuuaaagaugaaaaaaagaaaaaugcuucuaaaauucauuauguaauuagugcugcuaagaauauaccugguaaauuucuucuuucguaucuuccacgaaacaaaguuagacacgaauauguaacaguuacuccggaaggcuuccgguuuagacaacaaauguuugauuccguugguucguuguuuaaaugguucaaagaacauuuccgggagccuccgccagguggcgcaacgccggguaguacgccaaggcuggccucaagccgaacuggauauggaacugccacaccugcguuuaguaugaauaaugaagcuauucaaagaguugcucaaaauuugccaagucauguaguucaagcguuaucugcugccaccaaucaaacuccacauuauccccacacuccugguuauggcggcaauuauauuaauacgccuuacacuccaagcggucaaacuccguacaugacuccauaccauacaccgcacacucagcaaaccccccgcuauggucaucaaacgccuucccaacacauggcgagcucagcaccacaaggucucaacaaucccuuuuuacauccuggcgcuguaacgccuucccaacgaacuccuaguuaucguaaccauccugcacaaucuccaaugcuuccuacaaguccuguaccgaguccaggcucccagaguucauacaguagucauuuaagucauaaucagcgaaguggaaguuaugcugacucauugagauuccagccacccgaaucaccgcgaagcucaguaaguaauagaagcuuccauucugauagauauggcggugacagguaugguaaaggaagucauggcggaagauauggcggaagcucaaaugaagauagauauggaaagggaggaaaugaaaauacggauuggcagaaagcugcagaagcaugggcucgaucuagaucuacuccgcgaagugauagccgcaauacuccaagaucuguaggucaacgaacuccuagauacgacagcgaugccgaacguucuagaaugaaacaccucagcaagagcccgaggucugucaggucuacuccucgaaccaauacaucuccacauucuauguccuuaggugaugcuaccccucuguaugacgaaaguaucuaa

SEQ ID NO: 5729 - RNA, 2451 nt, Diabrotica undecimpunctata
augccacauaccaaggaagcuaauuugaguucaccagaacguaaaagacgaagaaagaguaagucuaaaucuccagaacgaaaagagaaaaagucuuccaaaaagaaagcacacaauaguagagacagggauucaucagaggaagauuacaacccuaaagauuaucaaagauacuauggggaagaucgcccgaacagugacaaauauuggaauaaauauccaaggaaagauaagaccaaaauuggucaaagauauuaugaugcgguuccugaagaaucugucaagaagggcgcugauaaaaauucagacgaaaaggaguuaucaaagucaguggagccuguuccugauaaaucagucaucaaaccaagagaaagaaaaacuguagauauguuaacaucaaggacugguggugcuuauaucccuccagcuaaauuacgauuguugcaagcuaguauuacagacaaaacaucagcagccuaucaacgaauagcaugggaagccuugaagaaauccguucauggauacauuaauaaaauuaacaccucaaauauuggcaucauugcuagagaauuauugcaugaaaauauaguaagagguagagguuuguugugcaagucaauaauacaagcucaagcagcaucuccuacuuuuacaaauguuuaugcagccuuaguagcuguuauuaauucaaaguuuccuaguauaggagaacuuuuauugaagagguugguuuugcaguucaaaagaggauuuaaacaaaauaauaaaucuauuuguauaucagcuacuacuuucguagcucauuuaguaaaucagagagucgcacaugaaauuuuagcuuuagaaauacuuacauuguuaguagagacaccuacagaugauucuguggaaguggccauuucauuuuugaaggaauguggacaaaaacuuacagaaguuucaaguagagguauuacugcuauauuugagauguuaagaaacauuuuacaugaaggucaguuagaaaaaagaauucaauacaugauugaaguuauguuccaaauaaggaaagacggauuuaaggaucaugcugcuguuguagaagaauuagauuuaguagaagaagaagaucaauucacucaucuuauuauguuagaugauguuaaagaggcuaaugcagaggauauauugaauguguucaaauuugaugauaauuaugaagaaaaugaagauaaauacaaaacccuuaguaaagaaauauuaggcagugauggugaaucugaaucagguucugaagguucagaagaggaaucugaagaugaaaaugaggaugaagucaaggaucaggggacaauaauugacaauacugaaacuaauuuaauuucucuuagaagaacaauauauuugacuauucagucuaguuuagauuuugaagaaugugcacauaagcuacugaagauggaguugaaaccuggacaagaaauagaauugugucacauguuucuugacuguugugcagaacaaagaaccuacgaaaaauuuuauggcuuguuggcucaaagauuuugucaaaucaacaaaguguacaucgagccuuuccaacaaauuuuuaaagauacuuauucuacaacucacagacuagaugccaauagguugagaaauguuagcaaauuuuuugcacauuuacuuuuuacugaugccauuggaugggaaguacuggaaaucaugaaauuaaaugaagaagauaccaauaguucuaguaggauuuucauaaaaaucuuguuucaagaauuggcugaauauaugggacuaggaaaauuaaaugcaagauuaaaggaugagacccuacaggcuuauuuuucaggacuguuuccuagagauaacccaaagaauaccagauuuucuauuaacuuuuuuaccucuaucgguuugggaggauuaacugaugaacugagagaacauuuaaaaaauauuccaaaaaugauggaaaugaaguuagccacugguaaagaaaaggaaagcagcgauagcagcaguucagaaaguaguucugaagauaguagugacgauagcucugaagauucgucaaguucugaagacgacaaagucaaaaacaagaagaaaucaaaaaaguuaaaagaaaaaaaaucgaaaacaaauucuaaaucuagaccuagaucgaaagaaaaagaacacgcagauaaacccagagacaaacguagaaaggaagauagauauaaaucugacaaaaaucccgauagauccucguccaaacaauauuccaaagaagauaacgacaagcgaagaaaagauuacgaauggaugaaaaguagauaugaagauaauauuaagcaguuaaaaaacgauaaaaggguauuugaaaagucuuccaaacgacgaucaagaucuagggacaagguaaaaggcagggaagagcguagacguagaagcagagaaagacgaagaagcuaa

SEQ ID NO: 5730 - RNA, 1782 nt, Diabrotica undecimpunctata
auggcguuaaagaaucaaguuggucaaaaaaucaugaaugaagucauuaagcacaagcccaccaagaagaaugggccaacuccaggacagcaagcucaugggguagaguggaggauccuugugguggaucagcuugccaugcggaugguuucagcaugcuguaaaaugcaugauauaucagcagaaggcauuacauugguugaagauauuaugaagaagagggaaccacuugguaccauggaagcuguguacuugauaacuccuucagaaaagucaguucaugcuuuaaugaaugacuuugaaccuccaagacagauguacagaggggcacauguguuuuuuacagaaguaugcccggaagaacuguucaaugagcugugcaagucuugugcggccagaaaaauuaagacucucaaggaaaucaacauugcguucuugccguacgagucucagguguucucauuggauucaccagacacguuccaauguagcuacgaucccucguuuuccgccgccagaaacgccaauauggaaagaauggcggaacaaauugcgacucucugugcaacucuaggagaauauccucacgucagauauagaaccgauugggaaaggaauguugagcuggcucaacuaauucagcaaaaauuggacgccuauaaagccgaugaaccuaccaugggagagggaccggaaaaggcgagaucgcaguugcuaauucucgaucgagguuucgacuguguaucuccucuucuucacgaacucaccuuccaagcaauggccuaugacuuauugccaauagaaaaugauguguauaaguacgaagcaucagcuggcguucugaaggaaguccuucuggaugaaaacgacgaacuuugggucgaucuacgccaccaacauaucgcaguggugucucaaagcgucacgaagaaucugaagaaauucacagacucaaaacgcaugacccagagcgacaagcagucgaugaaggauuuguccaccaugaucaaaaagaugccgcaauaucagaaggaauugucuaaguaugcgacgcaucuucaucucgcugaggacuguaugaaggccuaucaaggguauaucgacaagcuguguaaaguugaacaggauuuggcaaugggaacugacgccgaaggcgagaaaaucaaggaucacaugcgcaacaucguccccaucuugcuagaucccaaaaucaccaaugaauacgauaagaugcguauuauagcauuguacgcuaugacgaaaaacgguauaacagaugaaaaucucuccaaauuggcuacccaugcccaaaucaaggacaaacagaccauugccaaccuucaguuacucggagucaauguuauuaaugauggaggaccaagaaaaaaacaauauacaguaccgcgcaaagaaaggauuacagaacagacauaccaaaugucaagauggacacccaucauuaaggauauaauggaggauugcauagacgacaaacuggaucagaaacacuacccauacuugagcggacgagcacaaucgacuggauaccaugcagcgcccuccagugcccguuacggccaguggcacaaagauagaggccaacaagcugugaagaacguuccccggcugcucgucuucgucguggguggaaucagcuucucagagaucaggugcgccuacgaagugaccaacgcccagaaaaacugggaaguaaucaucggcucgucgcacauacucacucccgaggacuuccuaagcaaucuggcaacguuggccggcuag

SEQ ID NO: 5731 - RNA, 2139 nt, Diabrotica undecimpunctata
augaugcaacaauauaugaaagaauuagaacaggaaccauuugaugcugaagaauuuguagaacguuuagcuuggagaacuuuagcugaaucuaaaggcgauggggaggaacaugagauuaauccugcucuuuuacacgagucuuuuguacaagcuauaaaagaucuuaauuuacuucaugaacggcaacaaaagaaaugugaaaaacuagaaguugugguuagggaagaugaagcgaccuuuuuucaagagauauauaauuuacuugaacagaauaagcaagccauggacacuuuucaagaguuagaugguaaaaucaaucauguagcaacaaaaguacuacauuuaggugaucaguuggacaguguuaaugguccuagaucuagaguaguagaugcuuuaaaguuaaugauacauuuaacagaguucuuaucugaagaaucaguauuaucaccuaucuuuacaagaccagaauugauagaugaugcugcugaugugauucaaaaauuauaccuuauaucucaagauuuaccuccuaaauuugauguugcuaagagaaaaauugaaagaaaauacucagauauagaaaaaucuuuaauagaagaauucguucuagcuauggauaaugaaaauuuaaauagaaugaaagaaauagcuacuguuuuaucucaguuuaaaggauauucucaguguguagaugcuuacauugaucacagucaaaugggaugucuaucgagcaaggacguauuuucuaacuuuuuaacgcuuuguaaauacaaucaugaaauaauugucaagguuuuuaauaauccagaacaagugauggcaaaauuuguauugaacauauuucaacucaaacucguggaauacaucgaucagagguuaaauuccaaguuaggaaccuacagcuauuuacaaguauuauaugaguuauauuacaagacuaaucaguuauccaaugauuugagcguauuuaacaugggaaaugacaagaacuuuuuaucgaaguuaacaacaaauauuuuuaauaaauauauuaaugauuauaucacaauggaacuaaaaggucugaaagauaggugcucugcaaauuuacaaaaauacuaugaauccaaaggucaucagaagaagcagauucagucaggggguuuucaagaucuucgaagagaucuucaagcuguuauaggaacucgagcaaacauuaauauugcacagaucgaaaauuaugguggggaaacuuuuuuaucugaagaauuagcuauuacgauauuacaagauacaaaacacgcuuuucaaagaugucaguuguuauccaaacccacagaaagggccucaaacgcaacucaaauuuuggaucgauugauaaacagcuuauuaguagagcaugucgacuaugcaguagaauugggcuuacaagcugugccuguuguagaaggaaccaaaacucccccagcgcuauauuuuuuuagugucguccaccacaguaauaauauuauacaucuuguugagaaacaguucauggauuuauugguuccauuaguugaaaacaccccaaggaauaacgauuguguacaaaagaaaaaguuuguacuggaagauauagaacggaagauuaacacaggacuagauaggugucucaaugccauuucgagcugggucaaacuguaucuccaaacagaacagaaaaaaucugacuucaaaccugaaucugacgacuucgacacaguagcgucacccgcuuguaaaaacgucaucaauuacguuaauaguauuguaaaagaaauuaaagcgaaccuggaugguaauaaugucacagccauauugcaagaacuuggcauaagauuacaccgagugguguaugaucacauguugcaguuccaguauaacacagcaggugcgaugguggcuaucugugauuuaaacgauuaucgucauuguacaaaagcgcucggcccauuaguuauugaacuuuuugauacacugcaugcccucugcaaucuuuugcuuguuaagccugaaaauuuacagcaaguguguucugaagauucucuaguaaagcuggauagaacaauccuucacaauuuuauccaacucagaagcgacuucaagguacaaaaacaaaugauucuaaaaguguaa

SEQ ID NO: 5732 - RNA, 813 nt, Diabrotica undecimpunctata
auggauuuccaaaacagaccuggaggaaagaccgguggaggcggugucgccucuuggucagaaacuaacagggaucgcagagaaagacuucgacaacuugcuuuagaaacuauagauuuacaaaaggaucccuauuuuaugaaaaaccauuugggaucauacgaauguaaacucuguuugacauugcacaacaacgaaggaaguuacuuggcccacacucaggguaaaaaacaucaggcuaauuuagcuaggagagcagccaaagaggcuaaagaugcaccuacacuuuugcaaccagagaaacccagaguagaaccuaagaaguuugugaagauuggucgaccugguuauaggguaacgaagcaaagggaugcugaaaguggacaacagagucuuuuguuccagauugauuauccagaaauaagugauaugauucuaccucgucaccguuuuaugucagcuuaugaacaaaaaaucgaacccccagaucguaaauggcaguaucuccuauuugcagcagaaccuuaugaaacaauugccuucaaaguaccaagcagagaaguagagaaaaccgacagcaaauuuuggacucauuggaacaaggauacuaagcaauuuuuccuacaauuugcauuuaaaaaugacaauaagagaacuguuaauacagugguccaaagacauacaauuguuggugcagcaccaccaccuccaaugcugccaguuccaccaccaccaagaccaccaauguucaauccuauuccuccaccaccgccaauaaugagaacuguauuaccagugccuccuccacauuaa

SEQ ID NO: 5733 - RNA, 405 nt, Diabrotica undecimpunctata
augucuauugguguaccuauuaaaguccuccaugaagcagaaggucauguaauaaccugcgaaacaauuaccggcgaaguauauagaggaaaacugauagaagcugaagauaauaugaauugccaaaugacucaaauuacuguaacuuacagagauggaagaguagcucaauuggaaaauguuuauauuagaggaucaaaaauuagauuucuaguauuaccagauauguugaaaaaugcuccuauguucaaaaaacaaacuaaagcgggaacggcaggucgaggaaaaucugcuauacugcgagcccaagcucgggggagaggcagggggcaaacacaaccaguacgagguagagguaauuggcaacagaaucaacaagcagcaccugcaggaaggggaagauaa

SEQ ID NO: 5734 - RNA, 1452 nt, Diabrotica undecimpunctata
uugcgcagacguuugugcugucacuucugucguucugucagauuaugcugucagguaauaaauucugaaaauuuagggaagaaagauauuuguuuuauaaguuuucacacaacuucauugagaaguauggcuucaacuauuacaagaacuccaaucuugcgagcaauuuccgcaagaagcuauucucaaguucugccaguaucugguaauccaaguguugaaccaaaaacuaguacucuucccaacaaacuaguuguugcagcaguagauaaugacgccagucuuacaagaguuucaguuguguuuagagcuggaagccguaaugaaaaagcugauaauuuaggugcugcucauguuauaagaauagcagcgggauuauccacuaaaaaugccucccaguuugccauaauccgaaacauucaacaaguuggugcaaaucuuacagccacaucugauagagaaaccauauccuauaccuuggaaggaacaagaagugcuguugaaaaggcucuaccauaucuagcagaaguagcuaccaaccaagaauuuagaccuugggaacuuucagaacuguccaacagauuaauuuuggauauuuuaaccagaccuuuacaauuaagagccauugauuugcuucacaaugcugccuaccguagcaaaggguuagguaacucacucuucauuccaaagucucaagugggaaaaguuucaucugaaacauuacaacauuauguagcuaacaacuuuguagcuggccgugcugcaguuguugguacagguauaagugagaguuuguuaaaucaauuugcugcuaguuuggaaauuccaaauggugaaggcagcaccaauccauccccuuacaaagguggugaacucagaucaaacaaagguggaccacuugcuuuuguugcaguuggaggagaaggagcuccuuugaaaaacaccaaagaagcucuugcauuugcaguucuacagaaagcuguaugugcuggcccucagaucaaauaugguguacuugauaauggagucuacagcaaagcucuugguggaucaucggauguaucugccugcgcuguuaaugugagcuauucagacagugguuuguuugguauuuugcuugcugcaccugcuggaucuguaggcaaagcaguucaaucagcuguuaaaguuuugaaaucaggcuccguuacagaugcugauguucaacgaggcaaaaaucaauugaagacaucuauccuucugaaugcugaaaguggugcugacguuguaagggaucuuggaacccaagcaguuuugucuggugcuccacacagcgccagugcuuuagcugcugccguagacucugucagcaccagugauguacaaagugcucuaaggaaagcaggaggaaaauuaaccuuagcaucaauuggaaacauuaaugauguaccauauuuagaugaauugaaauaa

SEQ ID NO: 5735 - RNA, 333 nt, Diabrotica undecimpunctata
augaggagggcccacgcagguaacuacuacgaaccauuaccacaaacuuccaacgaaaucgaagaugaaaaugauagaaugacuaaugaucugcaagaaaagauugguguccuaaaaucguugacuauagacauuggaaacgaaguuaaauaccaggacagacuucucagagaugucgaugacgauauagauaagacaggagguuucuugggcacaacuaugucaagaguacugagauuauccaaaggaucccauaauuaccucauccuauauuuauuuguguuuucuguaauuguauuuuuuguucuguaccugguuauuaaguuuagguag

SEQ ID NO: 5736 - RNA, 1158 nt, Diabrotica undecimpunctata
auguugggaagaguauucaacggcucuggaaaaccuauugacaaaggucccccaauucuggcugaagauuacuuagauauccaagggcaaccuaucaacccauggucccguaucuaccccgaggaaaugauccaaacugguaucacugccaucgaugugaugaacucuauugcucguggucagaagauucccauuuucucagcugcuggucugccacauaacgauauugcugcccaaauuuguaggcaagccggucuugucaaaauuccaggcaaaucaguuuuggaugaucaugaagacaacuuugccauuguuuucgcugcuauggguguuaacauggaaacugcuagauucuuuaaacaagauuucgaagaaaacgguucuauggaaaauguaugucuguucuugaacuuggcuaaugauccaaccauugaaagaaucaucaccccgcgucuugcucuaacagcugccgaauucuuggcuuaccagugugaaaaacacguguuggucauuuuaacugacaugucuucauaugcugaagcuuugcgugagguaucugccgccagagaagaaguacccggucgucgugguuucccagguuacauguacaccgauuuggccaccaucuacgaacgugccggucgugucgaaggccguaacgguuccaucacucaaauccccaucuugacuaugccuaacgacgauauuacucacccuauuccugacuugacagguuauauuaccgaaggacagaucuacgucgaucgucaauugcacaacaggcaaaucuauccaccaauuaacguacugccaucucucucacguuugaugaagucugccaucggcgaagguaugaccagaaaggaccacucugacguuucuaaccaauuguaugcuugcuaugcuauugguaaggacguccaagccaugaaagcuguaguaggugaagaagcucuaacaccagacgaucuucucuaccucgaguuccuaacgaaauucgaaaagaacuucaucacccaaggaaacuacgaaaaccguaccgucuucgagucauuggacaucggcuggcaacuacuccguaucuuccccaaggaaauguugaaacguaucccugcaagcacauuggcggaauuuuauccaagagacgcucgucacuag

SEQ ID NO: 5737 - RNA, 741 nt, Diabrotica undecimpunctata
  misc_feature (701)..(701): n is a, c, g, or u
augagucgcggacacgcaggaccccguauucacguuccagacgaauuaagagaaguacuccucgaauuuacaauuaguuauuuauuggaacaaccuggagauguuauuaguuacgccgccgaauacuuuacgagguugagggaaaccaggguaacauccagaguguaugaugaagcugcugccucgcaggaggaacuuguaucaccugacgaaucuguaauguccaaagaugaagaaccuucaauccgguuugcugguaggcguaaaucaguauucgcagaaacuuacgauccagaagaagacgacgacgaugaugauggcgccaaauugguguauccgaaaucugaugagcaacgucagagauuggccacugcuguuaaaaacauauugcuguucagaucucuagauaaagaucaaaugaaugaugucuuggaugccauguucgaaagaguagucaaaaaggaugaauugguaaucaagcaaggagaugacggcgauaauuuuuauguaauucaaaguggaacuuuccauguguuugucgcaccagauccaucgaaagaacccaaucacauucacacuuacgaaaauaguggcagcuucggagaguuggcguugcucuacaacaugccccgugcagcuacggucaaagcgaauagcgaagguucccuuugggcuauggauaggcagaccuucagacguanaagucugcguucaaaaagaggaagauguacgaagcguuga

SEQ ID NO: 5738 - RNA, 2421 nt, Diabrotica undecimpunctata
augaguuacaugcagucuaaccaaaauagaccaaugucucaaagcuaccaucagggucccaacgaccugcccaugcagucuucuaaagaacagacuuuacuauggcagcaaaacucauacaugggagacucuggcauucaaucuggggcugcuacacagguaccaucucugacagguaaagaggaagaagaaauggaucuguuugauuuggaucaacccuaucaggguuuuacacaagagcagguugaugaaaugaacaaucaacugaaucauacuaggucucaaagaguuagggcugccauguuuccugaaacuuuggaugaagguauugaaaucccuuccacacaguuugaucccaaccaucaaacagcaguccaacguuuggcagaaccuagucagaugcucaagcaugcuguaguuaaucuuauuaacuaucaagaugaugcugaccuugcuacuagagcaauaccagaauugaucaagcuucuuaaugaugaagaccaaguaguaguaucucaggcagcuaugaugguccaccagcuaucuaagaaggaagcaucuagacaugcuauuaugaacaguccucaaaugguagcugccuuaguaagagcuauaucaaacucuaaugacuuggagacuaccaaaggagcuguugguacccuacacaaguuaucacaccaccgacaagguuuacuugcuauuuuuaaaaguggagguauuccagcacuuguaaaauugcucaguucuccuguagaaaguguucuugucuaugcuauaaccacucuucacaaccuuuuauuacaucaagauggaucuaagauggcuguuagacuugcaggugguuugcaaaagaugguugcacuacuccaaagaaaccauguaaaauuuuugucaauuguuacugauugcuugcaaauuuuggcuuaugguaaccaagagagcaaguuaaucauuuuggcaagucaaggaccuauugaauuggucagaaucaugagaucuuacgauuaugagaaguuguuguggacuacuucuagaguucugaaaguucuuucaguuugugccaguaacaaaccggcuauaguugaagcaggaggaaugcaagcuuuggcaaugcacuugggaaauccaaguacaagauugguucaaaauugucucuggacauugagaaaucuaucagaugcugcuacgaaaguugauggucuagaaagcuuauugcaaucuuugguacaaguauuagcaucuucugaugucaauguagugacaugugcugcugguauucuuuccaaucugacuuguaacaaucagcgcaauaaaguaacuguuugucaagugggagggguugaugcacuuguacgcacuauagucagugcaggagauagagaagaaaucacagaaccagcuguuugugcacugcgucauuugacauccagacauguggaaucagaaauggcacagaaugcugucaggcucaacuauggaaugcagauuauuguaaaacuguugaacccaccuucccguuggccauuggugaaagcagugauugguuugaucagaaauuuggcuuuauguccugcgaaucaugccccguugagagaacauggugcaauacaucaucuuguacagcuguuaaugagagcuuuccaagauacacagagacaaagagcaaguguugcgaguggcggcagccaaccaccugguacauaugcagauggugugagaauggaagaaauuguggaggguacagugggagcucuucacauuuuaucaagagagucccauaaucgugccauaauaagacagcagaugguugugcccauauuugugcagcuacucuucaaugauauugaaaacauccaacguguugcagcaggagugcuuugugaacuagcagcugacaaagaaggagcugagaugauagaacaagaaggagccacugcacccuugacugagcuuuuacauucaagaaaugaaggugucgcuacauaugcagcagcuguuuuauucagaaugagugaagauaaaccacaggacuauaagaaacgacuaucuauggaguuaacgaacuccuuguuuagagaagagaaccucuggaauccagaccuagggaugggcccugauuuacaggauauauugaguccagaucaagcuuaugacaacauguacgcacaaggucccccuaguguucacaguagccacggcgguaggccuuaccagcaacaaggguaugaccagauacccauagauaugcaaggucuagauauuggcucccauggaggcggaaaugggucgaccuauagcgcaaucgacgccauggauguuaccagcggggauccggaucuuaacuucgauacuauugaucaacuucccaccccuccucaagauaauaaccacgccgcagcuugguacgauacagaccuguaa

SEQ ID NO: 5739 - RNA, 816 nt, Diabrotica undecimpunctata
auggcccgaaacgccgaaaaagcgaugacaacauuagcucgauggagagcagcacaacuaggagaaauagauaagcauaaaaagcgaaggccuuaucuugcaucagaauguaaaaauuuacaugcuugugaaaaauggagaaugcagauaauaagagaaauugcgaaaaaaguagcucaaauucaaaaugcuggccuuggagaauuuaggauaagggacuuaaaugaugaaauaaauaaacuacugagggagaagcgacauugggaggaccaaauaaaggaauuggguggacccgacuaucagagaguuggaccgaggauguuggaucaugaaggaaaagaaguaccuggaaauagaggguauaaauacuuuggggcggcuaaggaauuaccagguguucgagaacuuuuugagcaggagccgccuccuccuccaaggaaaaguagagcagaacuaaugaaagacaucgaugcggacuacuauggauacauggacgacgaugacggaauuuugauuccacuggaaguuaaagcugaaaagauagccguucaaaauacaguagcugaguggguuaguaaaaaagaacaaaauuuggagaacgcagaagaccaaacagaagaaaauauauaugcaguugaagagucugaagaugaagauaguaaggaaacuguacaacaguuaguagauggaucacagcaaagauucguagcacauguaccuguaccaucucaacaagauauagaacaggcccuacugaggcgaagaaaacuugaacuuauggaaaaauacggcguagaagaggaaccgaaagcguag

SEQ ID NO: 5740 - RNA, 648 nt, Diabrotica undecimpunctata
auggcuggagaacaagauaugcccaccuucaaaugcgucuuggucggagacggaggcaccgguaaaacuaccuuuguaaaaagacauaugacuggugaauucgaaaagaaauauguagccaccuuagggguagaaguucacccuuuaguuuuucacacaaauagaggacaaauucguuuuaauguaugggacacagcaggccaagaaaaguuugguggucugcgugauggauacuacauccaaggacaaugugccauaauuauguuugauguuacuucuagagucacuuacaaaaauguuccaaacuggcacagagaucuuguuagaguuugugaaaauaucccaauuguauuguguggaaacaaaguugacaucaaagauaggaaaguuaaggcaaagagcauugucuuccauagaaagaagaauuuacaauacuaugacaucucugcaaaauccaauuacaauuucgaaaaacccuucuugugguuggcuaggaaacucauuggagauccaaacuuagaauuuguagcugcaccugccuugcuuccuccagaaguccaaauggauccccaauggcaacaacaaaucgaaaaggaucuuaaagaggccucagaaacugcacugccugaugaugaugaagauuuauaa

SEQ ID NO: 5741 - RNA, 1035 nt, Diabrotica undecimpunctata
  misc_feature (1023)..(1023): n is a, c, g, or u
augccuagaauaaugauaaaaggugguguuuggagaaacacugaggaugaaauucucaaagcugcuguuaugaaauaugguaaaaaccaauggucuaggauagcuucgcuacuucacagaaagucugcaaaacaguguaaagcccguugguucgaaugguuagaucccaguauuaaaaaaacugaauggucuagagaggaagaugaaaaacuauuacauuuggcuaaacuuaugccuacucaguggagaacaauugcucccauuauuggaagaaccgcagcacaguguuuggaaagauaugaauauuuauuggaucaagcacaaaagaaagaagaaggugaggaugcaguggaugaucccagaaagcugaaaccuggagagauugacccaaauccagagacaaaaccugcaagaccagaucccaaagauauggaugaagaugaauuagagauguuaucugaagcuagagcuagauuagccaauacucaaggcaaaaaggccaagaggaaggcucgugagaagcaauuggaagaggcgagacguuuagcagcucuccagaaacgcagagaacugagagcugccggaauagaaguuacuucucgcagaaagaaaaaacgaggaguagacuacaacgccgaaauaccauucgaaaagagaccagcaauuggauuuuaugauacaucuaaugaaguauuagauccuauggcucccgauuuuucaaaaaugaggcaacagcacuuggauggggagcuaagaagugaacaagaggagagagagcguaaaaaagauaaacagaaauuaaagcagcgcaaggaaaacgacauuccucaagcgauguuacaaaaccaggaaccagcuaaaaaacgaucgaaguuggugcucccagaaccacaaauuucagaccaagaaaugcaucaaguggugaaguugggcaaagcgagugaagcagcuagggaaauaguuacagaaagcgguguugaaaccacugauacuuuguugaaugauuauacuuucaacccucanaucaagugguga

SEQ ID NO: 5742 - RNA, 474 nt, Diabrotica undecimpunctata
augaugcaauucauguuauuauuuaguaggcaaggcaaacuuagguuacaaaaaugguauguggcucauccagacaagcucaagaaaaaaauuacaagagaauuaaucacaacuauuuuagcuagaaagccuaaaauguguaguuuucuggaguggagagacuuaaaaauuguuuacaaaagauaugcaaguuuguauuuuugcugugcaauugaacaaugugacaaugaacuccuaacccuggaaauuauacaccguuauguagagcuccuugauaaauacuuuggaaguguuugugaguuggauauaaucuucaacuuugagaaagccuacuuuauauuggaugaacugaugcuggggggugaaguucaggaaacaaguaaaaagaauguuuugaaagccauugcugcccaggaucuauuacaagaggaggaaacuccgcagggauuuuucgacgaccauggucuugguuag

SEQ ID NO: 5743 - RNA, 1251 nt, Diabrotica undecimpunctata
auguauggauuacagagaauuucauaccgaauauauauucgcaauggguuucgacauuauucccaacaaccugcaaagagaaauuccuuuauuggccggcucuuugaaaauuuuaaagaugagcuggccaaaaacaaagaaaugaaagaaucucugaaaaaauuucgagaggaagcucaaaaauuagaacaaagugaugcauuaaaagcagcuaggcagaaauuugaaaguguagaaaaagaagcuaguaaaaguagugaaguuuuuaaagaaaguuuagguucuguuaaggaaaaacuuaaaggaguuauagaugaagcuaguaagucagauuuagcaaagaaggcuggcaaauucacagaagaaguugguaaaacuacacauaaaauaagcgaaacagcucaagaaauuaguaaaacuggagcauuucaaaguauaucucaagcuacuaaggcuguuaaacaagaaauagacaauacuaguauagaagguagaguauauguuaguccuaaaauacuacggaagagaacagaaacaagugcaguuguccaucaaaaauauuaugaaccaaacacagaugcuacagguguugaacuacacaaagauucaaaguuuuaugagucuuggcaaaauuucaaagauaacaauccauauguacauaaaguuauggacuggaaauuaaaauaugaugaaagugaaaauccugucauccgugcuuccagagcacucacagaaaaaguuggugauaucaugggugguuuauuucagaaaacagaacuaucugaaacacuuacagaaauauguaagauagauccugacuuugauaccaaaagauuucugaaacaaugugagacugauauuauucccaauauucuugaagccaugacgagaggagaguuagagguucuuaaagauuggugucaugaagguccauuuaaucuuuuugccguuccuauaaaagaagcuuauaagaagggauacaaaauugaaucaaaaauuuuagacaucgaucauguggauuuaguuuugggaaaaguuauggaacaagggccaguuuuaauaauaucuuucacaucccaacaaguuauggcuguccgagaugccucagguggaguuguugagggagauccugacaaagugaugagaguuaacuauguguggguacuaugcagagaugucacagaaccggauccuagagcggcauggagacuccuugaucuuucugccaacagcaacgaacaacugguuuaa

SEQ ID NO: 5744 - RNA, 930 nt, Diabrotica undecimpunctata
augaguuccgauucagaacuaagugauagcgacauugagcuucaacaagcauuugcagaugguaagcuaaaaccuggcuuaaauacuguggaagaaggaccaaaacacuucacaaauaaugugagugguuuaaaacaaaaauuagaggaaauacaacucaaguuaccauggauagaacgacucgacugcguaaaugcucaagccccuuuagcaccugaauuagcagcucaaauguugacacaugagcaaaaaagaaguaaugagcuuagaaauaauaaaaagcucacgcaguuuacuccaaaugaagacccgguuuuaaacgacuuuaaaagggaaaugauguuccauagacaagcucaggcugcuauucuagauucuauaccaaagcuaaaagauaugggaguacuaacuaaaagacccgaugauuacuuugcugaaauggcgaaaacagaugcccauaugcagaagauuagggaacaucuuaugacgaagcaggagcaacagaagagaagugagcgagucaaacaacuuagacaacagaggaaagaagguaaaauguuacaaguucagacaaaacuucaaagacaacaagaaaagaaagauaugcuugcccagguuaaaaaaguaaggaagggaauguccaaagaucuugacuuccuugacggaaaaaauaaaucuucugccagaaaaauggcagaaaaacggaaaaugaaagauaaaaaguucgguuuugguggcaagaaaaagggaaugaaaaggaacacaagagauagugcugcagauauaacugaauuuaaaaauccugguaaaccuggaaaaaaauuuaacaauaguggaaaagggguaaaaggugguaaaguaagcaaaggaggaaaccaaagaauggguaaaaguaaaaggauuaaaaugagaucuaaaggaaggaaguga

SEQ ID NO: 5745 - RNA, 3723 nt, Diabrotica undecimpunctata
auggaugaacuacagaaauuggaauaucuuuccuugguuucgaagguuuguacugaguuagaaaaccaucucgguaugaaugauaaagauuuggcugaauuuauuauucaucuuuccgagaagaaugguacauuugaaucuuucaaaaaggcacucauagaaaauggagcugaguucucagauucuuucaucucaaauuugcuacgaauuauucaacauaugaaaccaaagaaaaauaaaacgaaaguugaagcugauguauaucaaaaagaaacucuggcuaccaaauuuccugguuuagcuuuaccaaaugaaaaacaaaaaccuuuguuuauagaugaagaagcaccuguuggagaaaaugaagaugaugacauuguagcugaccuaaugaaacaguuugaagcggaugcucccucaaacaaucaaaagcaaacaacaacuaaaucuggaagugcaaguccuauagaaagaaaacgaucagauaggucaagaaguaggucuggaucuagaccaagaaaaagacggaaaucuaaaucaagggacagggacucuagaaaggacaaaaggcgaaguagauccagagaccagaagaaaaacagaagagauagaagugguucuagaagcaaaagaaauaaggaaagaaguaggucuaggaaucggagaagcagaucaagagauagaagaaguagaucgagagacaggagaaacagaucuaaggauagaaaauacaaaaacuauucuagagauaaagauagaagagaaagaagcaauucacgaggcauaaaacgggaaagaaguacugaaaagaaguucaaaagugaaaaagauaauccugaauuugaagaggauccuaccccaggaaagauauauaauggaaaaguaucaaauauuguaccuuuuggaugcuuuguccagcuggagggacuuaaaagaaggugggaaggcuugguucauauuucacagcuuagagcagaaggcagaguuacuaauguaucugaaguaacaucuagaggagcuagaguaaaggucaaaguauugacaguaacaggccagaagguaucauuaucuaugaaagaugucugucaaauuacugguaaagaccuuaacccacauucccaugcuccaacugaaagagaagauagggauagaaauccugacaggccuguaaacagcaguacaucuguguuaagacuuccaguaaacauagaugaaggagaagaagacucccggaaaagaguaacaagaauuucaagucccgagagaugggaaauaaaacagaugauuucaucaggauguauugcuaagagugaguugccugacuuugaugaagaaacuggauuguuacccaaggaugaagauggagaggccgauauugaaauugaauugguugaagaugaagcuccauuuuugcaaggucacgguagagccuuacaugaucuuaguccuguaagaauagucaaaaauccagacgggucauuagcccaagcugccaugaugcaauccgcuuuggcuaaagaaagacgggaacagaaaaugauucagcgggaacaggaggucgauucccagccuuccgguaagaauaagaguuggauagauccucuuccagaggacgaaucaagaaugaugggcagaggaauaggcuuacaaguucaagauuuaccagaauggaaaaaacauguaauagguggcaaaaaaucaucauucgguaaaaagaccaacuuaacaauaauagagcaacgucaauccuuaccaauauauaagcucaaagaggaauuacgaaaagccguaaccgacaaucaaauucuuauaguuauuggugaaacugguucaggaaaaacaacacaaauaacacaguacuuagcugaagcuggauuuacaucgagaggaaagauugguuguacucaaccaagaagaguggcagccaugucuguagcuaaaagaguugcugaagaauucggaugucguuugggacaagagguugguuacaccauucguuucgaagauuguacuagucccgaaacuaugauaaaauacaugacagaugguauguuauuaagggaaugucucauggaucuggaccucaaacaauacucaguaauaauguuggaugaagcucaugaacgaacuauccauacagauguucucuuuggauuauuaaaacaagcagucaugaaacgagaagaacugaaacugauaguaaccucagcuacuuuagaugcuguuaaauuuucacaguauuucuuuaaagcacccauauuuacuauucccgguaggacuuuccccguugagguuuuauauacaaaagagccagaaacugauuauuuagaugcuaguuugauaacggugaugcaaauacauuugagagaaccuccaggagauauuuuacuuuuuuugacuggucaggaggaaauugacacugcuugugaaauuuuguaugagagaaugaaaucuuuagguccggauguaccugaacuuauaauucuuccuguguauuccgcguugccuucagagaugcagacaagaaucuucgaaccagcgccaccugggagcagaaaaguugugaucgcuacaaauauagcagaaaccucguugacgauagaugguaucuacuacguagucgauccaggcuucguaaaacaaaaagucuacaacuccaaaacuggaauggauucguugguaguuacgccgauuucacaggcucaagcaaaacaacgggcaggucgugcugguagaacugggccugguaaauguuacagacuauauacagagagagcauacagggaugaaaugcuuccgacaccuguaccugaaauucaacgaaccaaccuugcaacaacagugcuacagcuuaaaacgauggguaucaacgaccugcuucauuucgauuucauggacgcuccaccgguugagucguuaauuauggcuuuggaacaguuacauucuuugucagcgcuugaugaugaaggauuacuaacacgguuaggaagaaggauggcagaauuucccuuggaaccaaaucuuucaaagauguugauaaugucaguugcccuacaaugcucagacgaaauucuuacaauagucaguauguuaucgguccaaaauguauuuuaccggccaaaggauaaacaagcauuggcagaucagaaaaaagcaaaauucaaucaacccgaaggugaccacuugacgcuuuuggcaguauauaauaguuggaaaaacaauaaauuuucuaaugcuugguguuacgagaacuuuguacaaauccggacauuaaagagggcgcaagaugugagaaaacaacuguuaggaaucauggacaggcauaaauuggacguaguauccgcugaaaggaacacuguuagaguacagaaggccauuugcucuggauuuuucaggaacgcuggaaaaaaggauccucaggaagguuauagagcucuaguagacagucagguuguuuacauacauccuucaagugccuuauuuaauaggcaaccagaauggguaauuuaccacgaauugguccaaacaacuaaagaguacaugagagaaguuacaacuauagauccaaaaugguuggucgaguuugcuccugccuucuuuaaauucuccgauccuacaaaacuuaguaaauucaagaagaaccagagguuagaaccauuguauaauaaauaugaagagccgaaugcuuggaggauaucgcgaguaagaaggagaagaaauuaa

SEQ ID NO: 5746 - RNA, 1620 nt, Diabrotica undecimpunctata
augaauccaggcgccccaaauuaccccauggcgucuuuguacguuggggauuuacacucugauauuacugaggccaugcuuuuugagaaauuuucaacagcgggcccuguucuuucgauucgcguuugcagagacuugauuacacguagauccuuggguuaugcguauguaaauuuucagcaaccugcugaugcugagcgugcauuggauacaaugaacuuugacuugauuaaaggacgucccaucagaauaauguggucucaacgagauccaucauugagaaaaucugguguugggaauguuuuuauuaagaauuuggaucguucuauugacaacaaggcuauguaugauacuuucucagcuuuugguaacauucuuaguuguaagguagcucaagaugaaaacggcuccaguaaaggauauggguuuguacauuuugaaacugaagaagcugcaaauaaaucuauugaaaagguaaaugguauguuguuaaauggaaaaaaaguauauguuggccgcuuuauuccacgcaaagaaagagaaaaggaacugggagaaaaggccaaacuuuucacaaauguauauguuaaaaauuuuggugaagauuuaucugaggaagaguugcggaauauguuugaaaaauaugguaaaauuaccagcuacaagauaaugaguaaggaugaugguaaaucuaaaggguuuggcuuuguugcauuugaaaauccagaggcggccgaaacagcaguagaagcauugaauggaaaagaguugauggaaggaaaaccuuuguauguaggaagagcccaaaagaaagcugagcgccagcaagaacuaaaacgucgauuugaagcccuuaaaauggaaagacuuaaucguuaucaggguguaaaucucuauguuaaaaacuuggaugauacuauagacgaugaacgucuccguaaagaauucucuccguucggaaccauaacuucugccaaaguaaugauggaagaagguagaagcaaggguuuugguuucguaugcuuuuccucuccggaagaagcuacaaaagcaguaacagagaugaacggcagaauugucgguacgaagccuuuauauguugccuuagcucagcguaaagaagaucgcaaagcacauuuaacaucucaguacaugcagcgcauggcaaauaugcguaugcaccagaugggccaguucauucaaccaggugcgucuagcggcuauuucgucccuaccauuccuaccgcacagagauucuauggaccagcccagauggcucagauucguaccagucccagauggccugcccaaacaccuguaagaccaggugcucaaggaggagcuacugccuacacuggcaugccaaacacuuacagagcggcuacucguccaccaaaccagucaacaacuaugcguagcaacaucaguguaccuagaccaauuacuggacaacaaccucaaaguggcgucguaccuucaacuggucgaacagcaaacuucaaguauacuucgaacaugagaaauccaccacaauccaugggagguauaccaggagccgcagcuccuguacagcaagcuguacacauccaggguacgcauguaugcagauauggcagguaa

SEQ ID NO: 5747 - RNA, 2742 nt, Diabrotica undecimpunctata
augaccgacucuaaauauuuuacuacuaccaaaaagggagaaauauuugaauuaaagucagagcuaaauaaugauaaaaaggaaaagaaaaaagaagcuguuaaaaagguuauugcuucuaugacaguaggcaaagauguuucagcuuuguuuccagauguaguaaacugcaugcagacugauaauuuagagcucaaaaagcuaguuuauuuauauuuaaugaacuaugcuaaaucucaaccugacauggcuauuauggcaguaaauacuuuuguaaaggacugugaagaucccaauccacuuauuagagcgcuugcuguuagaacaauggguuguauuagaguagauaaaaucacugaauaucuuugugagccacuaaggaaauguuuaaaagaugaagauccuuauguaagaaaaacagcagcuguuuguguugccaaauuguaugacauuucaucugguuugguagaggaucaaggcuuuuuagaacagcuaaaagaauuguugagugauuccaacccuaugguaguugcuaaugccguugcagcuuuauccgagauaaaugagagcaguccuacuggucaaccucuaguugaacucaguacaaacacuauuaacaaacuucuuaccgcccuaaacgaauguaccgaauggggccaaguauucauccuugauucccuuucaaauuauaccccucgugaugaacgcgaggcacaaaguauuugugagcguauuacuccgagacuggcucaugcaaaugcugcugugguuuugucugcuguuaaaguuuugauuaaaaugauggagauucuggcuggagauacugauuucugcaauacuuuaagcaagaaacuagcuccuccucugguuacauugcuuaguuccgaaccagaagugcaguacguggcauuaaggaauauuaauuugauuguccagaagaaaccugauauacuuaaacacgaaaugaaaguauucuuugucaaauacaaugauccaaucuaugugaaauuggaaaaguuggacauaaugauccgucuagcaucucaagucaacauugcucaaguccucagugaacuaaaagaguaugcuacagaaguugauguagacuuugucaggaaggccguuagagccauugguagaugugccaucaaaguugaaccuucugcagagagaugcguggcuacacuuuuggaccuuauucaaacuaaagucaacuacguuguucaagaagccauuguuguaauuaaagauauauuuagaaaauaucccaauaaguaugaaaguauuaucaguacacuaugugaaaauuuggauacucuugaugagcccgaagcgagggccaguaugguauggauuauuggagaauaugcagaaagaauugacaaugcggaugaguuauuggauaguuuccuggaagguuuuggagaugaaaacgcucaaguucaguugcaauuauuaacagcuguuguaaaacuguuuuugaagcggccucaacauacacaaggcuuaguucagcauguauuaagcuuagcuacacaggauucugauaacccagaucuaagagaucgugguuuuauuuauuggagguuauuaaguaccgauccugcagcagccaaagaaguaguucuugccgacaaaccucugauuucugaagaaacugacuuacuagaaccuacacuucuugacgaacugaucugccauauaucuucccucgccaguguuuaucauaaaccuccaacugccuuugucgaaggaaggucugcagguauucgaaagucuuugccagcuagacaaggaucugcugaagaaacaaguagcgcuccagaaccaacuguuauuccuaaucaagagagucuuauuggugacuuacucucaauggaucuuaaugccccagcuccuccgaucgcacaaccagcuguaccagccaguaauguagaucuuuuagguggaggauuggauucuuuguuggauauugguaccacuccugcaccucccacaacuacgggacuucuuggugacauuuuuggaauaccaacugcuccuaccauguauaccccacccaaaacuauaugguuaccggcugaaaaaggaaaaggauuggaaauacauggagcguuuucaagaagagccggacagaugucuauggauuugacauucaccaacaaagccaugcaggcgaugucugccuuugcuauucaauuuaacaaaaacagcuucggcauaguucccgguucaccacucacuguaccugcccuucagccuggacagagcuuggaauauaauuuagcguuggcuacuacuggaccaguacaacguauggauccacucaccacucuccaaguggcaauuaaaaacaacgucgacaucuucuauuacgccugccaaauucccauucagauucuguuuaccgaagacggcacuuuggauaagaggguuuuccuuacuacuuggagagauauuccggcagcuaaugagguccaauacacuguuaaugauguuaaggggaacaccgauggaguuucuagcaaaaugacauugaauaacaucuuuacuaucgccaaacgcaauguggaagggcaagacauguuauaucagucacugaaguugacgaauaauaucuggguuuuacuugaacugaaacuucagccuggauuaaccacagcuacacuuaguuugaaaucuagaucuguagaagucgcaccguacguuuuccaagcuuaugauucaauuuugaagaauuag

SEQ ID NO: 5748 - RNA, 498 nt, Diabrotica undecimpunctata
augccacccaaguucgaucccacagaaauuaaauauguuuacaugagaugugucggaggugaagugggagcuacuucuucuuuggcuccuaaaaucgguccucuagguuugucucccaaaaaaguuggugacgauauugccaaagguacugcugauuggaaaggucuaaaaaucacaguucaauugaaaauccaaaaucgucaagcuacuauuucuguaguuccaucugccucuucccugauuauuagggcucuuaaagaaccaccacgagacaggaagaagcaaaagaacauuaaacacagugguaacauuacuuuugaugaaaucauugcuauugccaggcaaaugaggcccagaucaauggccaaacaguuaucuggaacuguaaaagaaguuuuaggaacagcccaaucaguuggauguacaauugaugguaaagcagcacaugauguuauugaugagguuaaugaaggaaccauagaaguaccagaugaauaa

SEQ ID NO: 5749 - RNA, 1095 nt, Diabrotica undecimpunctata
augccagaagaaggaaaaagggcauuaauuuugguuggagguuaugguaccagauugagaccucuaacuuuaaguagacccaaaccucuuguagaauuugcaaauaaacccauucugcuucaucaaauagaagcucuuguagaugccggaguuacugaaguuauauuagcagugucauaucgugcuaaacaaauggaagaggaauugacaguggaagccacaaaauuggguguuaguauaauauuuucccaugaaacagaaccuuuagguacagcaggaccaauugcauuagccagggaacaucuuucuaaaagcacuaaaccauucuuuguccuuaauucagauauuauuugcgauuucccauuuaaagcauuggcagaauuccauaaaaaccauggaaaagaagguacaauagugguuacuaaaguggaagaaccaucaaaauaugguguaguaguauaugacaaagacaacagcauccaaaguuuuguagaaaaaccucaagaauuuauuucuaauaaaauuaaugcugguuuauacauuuuaaauccaagugucauuaauaggauagaauuaaaaccaacuucuauugagaaagaaguauuuccuuacauggcggcugauaaacaguuguaugcauuugaauuggaagguuuuuggauggauguuggucaaccaaaagauuuucuuacuggaauguguuuauaucugaaacauuuaaggcaaacaaaugaagaaaaacuuuauaaaggaccaggugcuguuggcaaugucuuaguagauccuacugcuaaaauugggaacaauugucaaauugggccuaauguuacaauaggaccagguguuguuauagaagaugggguauguauaaaacgaucuacaauacuuaaagaugcuacgauuagcucaaauucuugguuagaaagcuguauuguuggauggaaguguuguguuggaagauggguaagaauggaggguuccacaguacuaggagaagauguuauaguuaaagaugaaacauacauuaauggaggucaaguguuaccucauaaaaauauugcaacuucaguuccagaaccucaaauuaucauguga

SEQ ID NO: 5750 - RNA, 897 nt, Diabrotica undecimpunctata
aaucugucaacuagaaaacccaaccuaaacauggcgucagacggggacgacguuauuagugaccaagaaaaagugaaaauaguaucggauuuuauucuccauucaccaccuggugaauuuaaugagguauuuaaugauguuagaaaacuuuuaaacgacgaugaccuuuuaaaagaaggcgcuagcggagcauucgcucaguauaauaaagaucaacugacccccguuaaaauagaaaacgccgaucauuuagugcuuauuacggaauacaacgauuuagggaauaauagauucuucgaccccagaaguaagcagaguuuuaccuaugaucacuuaagaaaagaagcauuagacuaucaagucuauacccccgauagcacuucugagccuuggagggcugccuuagacucagaguucauucaguacacuaggaaccauuauaaagauggaguauguagugugguaggccgcaaccagagcggaguuauuaacuuaacagcuuguauugaagaccaccaguucucuccuaagaacuacuggaauggaagauggagaucucagugguccauuagucuaacugaugauuccacugcugagguucgaggcguacucaaaguacagguccauuauuaugaagaggguaauguacaauuagugaguacuaaagaaauaaaagaaacuguuccuguuucaucugaggcacaaacugcuaaagaaaucauccaaguaauagaagccgccgaggaucucuaucaaacggcaauuucagaaaacuaucagaauaugucagauacaaccuucaaggcccuacgaagacuucuuccugucaccaggacaaaaauggauuggaauaaaaucguauccuauagcauugguaaagaacucaaaacgcaauga

SEQ ID NO: 5751 - RNA, 2127 nt, Diabrotica undecimpunctata
augaaaccaguguuuguuuauaucaccgauaucgcagauaguguucaaaacauuggagaauacacgauuguuccuucucaguauagaacuagaguaaaccaauauuugacugauauuaaguuuggauuccuccaaauuaauuuaacugagucuaucaaaguuaauacauacacuacaacccaaacaaccauagaauuaacaccgguaguauggagccggcccauuccacuagguugguauuuucaauuccaaugggagaaccaguacggcaaaaauuggcccaaaacucuaugugacgauuggcugagaacggacagauaucuaaagaacuucgcucacgaacuugcucagugucccugcaccgucgaacaggcuuuagcugacaagggcagguuuaugccagauuucgacugugacaaagauucgaauccgauuuguuacuauaacaaccaagcacuucauugugugaaaacuggaucucccacuuuagaaggcucugaacaacaauguugcuaugauaaaaacggcuuuuugaugcucucuuacgaucaacaaugggguucuaguccgagacguugccacaacuuagguaaaaugccuuacaaugaagcgacaaaaguuccuacucucucacaaugguuuaaugauaugguacccaaauauuuguguugccuuuggcaagaagagcaagcugugggaugugaaacacuaagauuugaacguagaccaacacaagauuguguagcuuaccaagcaccaggcgucgcaggagucuauggugauccacacuuuguuacuuucgacgauguagaauauacguucaauggaaaaggggaauucgcauuggugaaaucaguuacacaaacggacaaucuggaaauccaaggaagauucgagcaaauggacccuaacgcuuauggugagguuagagcuacucagcugacaucuguaguagcuaaagguaauaacacaauagcaguugaagucagaaggcgaccacuagauucuagauggagauauagguuggauguuauagcagauaauagaagacuguauuucgauagacccucacuaaaauuccagcacuuccaaggaguuacuauuuauacuccaaccuacauccuuaaucaaucagaagucaucauuauguuugacaauggagcuggaauggagguugucgauaaucaaggauacaugagugcaagaguauuuuugccuuggucguuuauaaauaaaaccauaggccuuuuuggaaauuggaguuucaacaaagaagacgacuuuacacuuccagaugguuccagagcagcaauaguaucuaacauaaaugacauggaaaggguuuacacugauuuugguuccaaauggauguuagaugauguguuagauccucaaaaggguagagcguuauuccauagggaauuuggaagaacuucagccacuuacaacaacaagacguucaagccucaauuccuaaugaccccggaagauuucauaccagccaacagaacugcggauauucagcgaacauacgaaauauguccucuaaggauguacgaauguuacuacgauuacgguaugacgcuugauagggauuuggcacauuauaccaagaauuauaaagccacaauauaucaauauaaagaaacuacaaggaccaaaguugugucuugugguguacuggaaacaccgagguuuggacgaaagaguacuuuccuguucgugccuggaacuaagguuaccuacgaaugcauucaggaguucgugcugguaggugaucagcgcagggagugucaagcggauggaacguggaauauuccugaauacggauacacuuauugcuuacgucagcaagaauacucccaacgacaggcuggucuggcuuccgggauaauuauggcaauucuuauaccgcucaucuugcuuuucgucuaucuagcguaucguuucuuacaaaaaaagcagaaagagaaagaagcugaaaaauuagaagagcagcaauuuauggaucaacaaagaagggcacacgaagcagcuacuaagaaguuaacagaagccgaauaugcuucagaagaugaagacaguaauguuacaagcacgggcgcaaaagaaacaacuguauauuaa

SEQ ID NO: 5752 - RNA, 303 nt, Diabrotica undecimpunctata
augucgucgucuucugauucggauucaaccuucuuuucuuccuucuuggccucuuucuuuuccucagcagcuggagcagcagcaggggcaccuccggcagcaggugcagcaccaccaccaacuggcauggagcucaauuucucacggccuugugcaaugaguucuucaacugacuugccacugagcucgcugaugacuuucuuuacuuuuucuccuucagcuucaacaccuacagacccuaauauuuuuucaagaucugcagcauugggagaggcuuuuccgcccaaaacggccaauaaguaa

SEQ ID NO: 5753 - RNA, 2724 nt, Diabrotica undecimpunctata
augaugacugaccguuucgguuuaaaaugggacccgaaaaacuuagagauaagaaccaugucuguggaaaagacauuggaaccccuagugcuucaaguuaccacucucgucaauacaaaggggccuaguaaaaagaagaaaggaaagucuaaacgugccaaugcucugguuaguacuguggaaaaagccaccgaaaacuucauagaaaagggggagcagauagccuaugagaacccagauauuacugaggaaauguuagcagcuguugacgaagucaagaaaacuggacaugcuaugaguggggcugcaagagaauuuucagaagacccaugcucuucuuuaaaaagaggaaauaugguuagggcugcuagaaaucuuuuaucugcuguaacucgucuucuaauucuagcagacaugguugauguccaucuuuugcucaaauccuuacauguaguugaggaugaccuugaaaaacuaaaaaaugcuucaaguaauggcgaacuuuuagacaauauuaaagccuuuggucaaaaugccaacgaauuaaugaaucaagcugcuaaacggcagcaagaacugaaagauccacaacuucgugaugauuuagcagcugcuagagcuguacuuaagaaacauuccacuauguuauuaacugcaucuaagguuuauguacgucauccagaauuagcagcugccaaagcaaauagagauuauguuuuaaaacaagucugugaagcugugaauacuauuaaugauguagcucagggaagaacuccucaaccugcuucuggaccauaugauggaccuggagaguuggcugcugcuuuggaugauuuugaugaccacaugguaauggagccucuagcauacaaugaaguucauaccagaccuucauuggaagaacgucuagaaagcauuauaaguggugcagcccuuauggcagauuccaguuguacuagggaugaaagaagggaaaggauaguugcagaguguaaugcuguaagacaagcucugcaagacuuguugacugaauauaugacaaauaugggcaauaaagauaaaagugagagccuaguaagagcaaucgacaauauggguagaaagacuaaggauuuaagaagacagcugagaaaagcuguuguagaucauguaucugacaguuucuuggaaaccaauguaccucuccucguuuuaauaaaggcagcucaaaauggcaacgaaaaggagguagaagaauaugcaguuguauuuacugaacauuccaauaaguuaguagaaguugcuaaccuugucugcagcaugucuaauaaugaagauggcgucaaaaugguuagauaugcugcugcucagauugacaaucugugccccgaaguaauaaaugcagcuagaauuuuagcugcuagaccucgcaguaaaguugcucaagaaaauauggacgcauucaagcagucaugggagaaucaagucagacuucugacugaagcaguggaugacauuacuacuaucgaugacuuuuuggcuguuucugaaaaccauauucuggaagauguuaauaaauguguacuugcguugcaagaaggugauucugacacauuggaucgcacugccagugguauaagaggaagauccaauaggguaugcaauguaguaacagcugaaauggauaauuaugaaccuugcauuuauacaaaacguguucuugaagcugucaaaguauugaaugaccaagucaugccgaaauuuacucaaagagugcaaguugcaguccaagcuuugggaaauaguccucccaaagaaguggaugaaaacgauuuuaucgaugcuucuagacuuguuuacgauggaguaagggaaauaagaagagccguucuaaugaauagagccgaugaagauuuagauccagaggauguugaauuggaugaaaacuaucugauagaaacaagaagcaaaucgagugcucacacaggcgaacauggaguugaugaguauccagauauuaguggaauuacaaccgcuagggaagcuauggguaaaaugccggaagaagauaaacagaagauuuugcaacagguugaguucuucaggagugaaaaacucaaauuugaucgggaaguugcuaaaugggacgacacuggcaacgacauuaucguucuugcuaaacacauguguaugauuaugauggaaaugacagauuuuaccaggggucguggcccucuaaaaaccaccauggacguuauuaaugcggcuaaaaagauuuccgaagcuggaaccaaauuagauaaacuuacucgucaaauagccgaacaguguccagagaguuccaccaaaaaagauuugcuggcuuauuugcaacguauugcucucuacugccaccagaugaauauuaccucgaaggucaaagcggauguucaaaacaucaguggagaacuuauugugucuggguuggauagugcuacuucuuugauucaagcugcuaagaacuugaugaaugcuguaguucucacaguaaaagcaucauacguggcauccaccaaauacccaagacaaggaacuaucgcaucgccaaucgucguuuggaagaugaaagcgccagagaagaagccguuagucagaccagagaaaccagaagaaguucgugccaaaguacgcaaaggcucacaaaagaaaguucaaaauccaauucacgcucuuucugaauuucaaagcccaaccgagucuguguaa

SEQ ID NO: 5754 - RNA, 1236 nt, Diabrotica undecimpunctata
augucguucucguuuggagccaccccaguuccaacucaaaaaaccguugccucugguuuuacuuugccaucgaauccaauaguaucuucaacuacuggaauucaaagcacauuugguucaggagauaauaaagaccaaaguaaaccuucauuguuugcaacucccucaagucagccuguuucauuuggguuaacuacaaaagccaauacagccccaacaacccucuccuuugguuuugcuacuccuacgacuuuaccguuuggaucaucaacuacaauuacaccugcaacaacuccucaauuuggauuaucgcuuccaaaagcuagugcuccagccacuacuaguuuuucacuucuaggaucugcuccagccacuacugcagcagcaccuacagguauaucauuugguacugccacuacugcagcaacaacuucaguuacagguuuaucauuuggaacuccaauugggacugcuacaacugcagcaacaacuucagcuucagguuuaucuuucggucuuacaaccgcuucuucuacaaguucugccgcaccuacacuuuugucuucaacgacaacuucgacaacaucaucagugucugcaucuggugcuuugaguaguacaacaucagcaccgacuuuugccaccucaucguugccgucaacaggcaccuuaacauucucucaacucgaagauucgaucaacaaauggaccauggaucuagaagaacaaggaaaauucuucaucaaccaggcuaagcaauuaaaugcaugggauacuuuacuuauaucuaacggagagaagauuuuaacgcuuaacagcagcaucgaaaaagucaaacaacaacagcaacaguuagaccaagaauuagacuucgugcuggcacagcaaaaggaauuggaagagcugauuguaccgauagaaaaagaauugcuggggauaccuguuacggauauugacagaaaucaaauguaccaauuuucggaaauagucgauucacaauuaaaacagaugucugaugauuugaaagagguuauugaacacauaaacgaagccaacaaagaggaagaagcaacaaauccacuaagccaaaucagucgcauauuaaaugcgcauaugaauuccuugcaauggaucgauaggaguacagcgcagauuagcucucaucuagaacaaauuggaaaaaugcaagacucaaacaggagaaaucacucuuuuaauaauuccaugaauuuuuaa

SEQ ID NO: 5755 - RNA, 582 nt, Diabrotica undecimpunctata
auguuucugugggacugguuuacgggaaugcugggauaucuaggauuauggaagaaaucuggaaaacuauuauucuuaggacuggauaaugcagguaaaacuacccuucuacauaugcucaaggaugacagacuggcacagcaucuucccacguuacaucccacaucagaagagcuuuccauugguaacaugagguuuacgacguucgauuuagggggccacgagcaagcuaggagaguuuggagggacuauuuuccagcagucgaugccauaguguuccuuguugaugccaacgacagcucaagauuuguagaaagccaggaacagcuaaaugcccuccucucagaugaaacucuuuccaacuguccaauacuuaucuuagguaauaaaauugaucucccaggugcugcuucagaggaugaacuacgaacuagauuuggcuuguuuggccaaacaacaggcaaaggcaaaguagcuagaaaugaucuaccugguaggccucuagaacuauuuaugugcucuauacucaaaagacaagguuauggagagggauuccguugguuggcacaauauauugauuaa

SEQ ID NO: 5756 - RNA, 573 nt, Diabrotica undecimpunctata
auggaugaaauuaaccuagauuuguuggagaagcguauagaagcuuuagaauuaaagguguuuccugcaggugaucccacuacuauugccaacaaaaaucaaacaauaacaaacauucuuacacaaguucagaccuuuguuaccacagcucucacuuguagagaaacaauaacguccauguugcaguuuuauggaacuuuaaaugaauaucuugacccagcugguggugcagaugaacucgagguagaagcaaaaagacauuauauauugcaguugcacccagagaucaaagacacccuacagacccauacucgaauuuugcagaguuuacuuccauauguagaaucagaaaacauuuccaaagugguugaaaugacugcucaauuggaagaagcaucuguuagucaccucaauuuguauggagaguggagagauacaauguacaaaauggucguugcucuucaagauuucacugauauaaugaguucaauuaaaguauuguucucccaacuagauaauacauuaacaaaucuggaauacucacuucaaccaaaauuuguuacagaggaauaa

SEQ ID NO: 5757 - RNA, 1725 nt, Diabrotica undecimpunctata
augaauaauacaaaaacgcaggaagucuacagugaccuaacauuauuuacaacuccagauaaguucuucuuggagcccaaaaauggggaggaauuauuagugauagagagaguaacugaagagauuucaguuuacaaaaaucaccgucacaucauaccagcagcuaguagucgaaaagauuucuguggccuccuugguauaauuaggcuguugucugggccauaucuaguaauugccacucagagagauauaguggguuauauaucagguugugcaguauggaggcuaguaaaggcagaacucauucccuucaggagcucccuaaacuuaaguccagaaaaacaagcugacaaugaaguguaccuuaguaugauagaacaaguuuuaacaacacccuuucaguauuucuguuaugauuacgaccugacacauucccuccagcgccuucgggacauuucgccagauuucuggaaacagucccugugggaaagagcugaucaacgauuuguauggaauggauuccuguugagcccuuucaaaaauguaaucagcaaaaaguuuugucugccuuugauccucggauuuguuucuauuaacuuuuguguuauuaaugggcauagcuugaacuggaucauuguuacaaggaggagcguuuucagggcagguaccagauuauuccgcagaggcauagacaaagauggcaacgucgcuaauuucgucgaaaccgaacaaaucguagaauaccaaggggaccaugcgaguuuuguucaaaucagaggcucuauuccacuuuucuggcagcaaaaucccgauuugcgucuuaaaccuccuccaaccaugaucgauauggacccacaagagcaacauuccaccuguuugaagcaucuagaagaauuggcaacuuuauauggcaaaguuguguuagucaaucucauugaccaaaagggagcggaagguaacauggagaaauccuucaaggaggccaugaguucauugucguauccuucagcucgauacgaaccguucgauuuccauucugaauguagcaaaaugagaugggaucgucucaaaauccuaauagaccgucuagcccuggaccaagacgaaaugggcuucuuucucuuauuacgggaugguuccuuaagcucguuacaagacggagucuucagaacgaacugcauagauuguuuggacagaacuaacgugguccaaaguaugcuagcgcacagaaauuuagagguaguuuuaagaaaauugaauauuuuacaccaaaaccagaacuuggaguuccaguauuccuucgagguuuuguuuaagaauguaugggcagauaacgccgauauuauaaguacccaguacucgggaaccggggcuuuaaaaacagauuuuacuagaacagguaaaaggacuaaggcuggaguuuuucgagauggaguuaauucgcuuacuagauacuauaaaaauaauuuaacagacggguaucgccaggaugccauagauuuguucuuaggcuauggcaaaccgauaucuccacuaagaguagacaaaucguggcgauauauuacguacccuucgguacuuuuggucgcuguauccauguuuguagcuucugcuguauuuccuucggaauacucaaccgaaucucuucuguuuuuguuauuuugggguucuauggucuacgccacauugcacaccauauucagauacggcguugaguucguggac

SEQ ID NO: 5758 - RNA, 1749 nt, Diabrotica undecimpunctata
augccuccuacaauccagcaaaacaaccagaacgggacagccaauggcguugaaaaaagaccaguaaaaacuguagaaaaaaggucagauuuaauaugcaaagugaaguacuguaauacuuuacccgauauuccuuucgauuugaaguuuauagcauauccuuuugaacccauaagauuuauucaauacaacccaacaucccuagagcguaauuacaaauaugaaguguuaacagaacaugacuuagguguuaguauugaucuuauaaacaaagauauauaugcuauugaaccaggagcuacuuuagauccugcugaugaaaaauuacuagaagaagacauucuaacaccgcaagacucaaaaagaucucgccaucaugccaagucaguguccugguugcgaagaacugaauacauuucaacagaacagaccagauuccagccucagacuauggacaaaguugaagcuaagguugguuauaguauuaaaaagucccuuaacaaugaaacuuuguacauggacagagacucucagauuaaggcuauugaaaagaccuuugaggauucuaagaaugucauugagaagcauuacagcaaaccuaaugugguagcuguggauauuuugccuguuuauccagauuucagccuuuggaaguacccuugugcccaaguuauuuuugauucugauccagcuccuguuggcaagcaaguaccagcucagauugaagagaugucucaagcuaugaucagaggugugauggacgaaaguggagaacaauuuguagccuacuuuuugcccacagaagacacucuccaaaaacgaagagaugauuuugucaaccagauaccauaucaagaugaugaggaauaugaauauaagauggcaagagaguacaacuggaauguaaagagcaaggcaagcaaaggguaugaagaaaauuauuucuuuguggcacgaccagauggaauuuacuacaaugaacuggagaccagaguaaggcugaguaagagaagggucaaagcuggugcuccaccuaguaacacaaggcuuauuguuaaacauagaccuauggaugcuaaugaguuccgaaugcagagguaccgggagaaacagcuggaaccaccaggugaagaugaugaggaaauggaaguagaugaaccacaagaagaagaagcuacucaagaagaacaagaacaagaaaagggggagaaaucaccaucccgcucuagaucuagaucaaacucaucuaacagaagcagaucuaggucaaaaucaagauccaaguccagaucaaaaucaagauccaagucuaagucacaaucuagauccagaucuaggucuaaaucucguuccagaucccgaucgagaucuaaaucccgcuccaaguccaggucucauucaaaaucgaagucuaaaucuaaaucccguucccgaucgaaaucuaagucuaaaucccguuccagaucgaagucucaauccaaaucgccuuccagaucaagaucaaggucucguucuaagucaaagucgagauccagaucugcuucaggcucuagaucaccuucuggcucuagauccaggucaccuuccaaaucaaagucaagguccagauccaggucuagaucagguuccaaaucugcuucuagaucuagaucgucuuccaaagcuucuuccaaaucgggaucaagguccagaucaggaucucgaucaggaucgggcucagaaucggggucuggaucugaaagugacuaa

SEQ ID NO: 5759 - RNA, 1170 nt, Diabrotica undecimpunctata
augccgauugaaaauuuagaagaccagggucuugagaaaaacccugauuuagaauuagcacauuguaaguuucuguuaaauuuaccagaauaucguagugauaaaaauguccacgcaaaaauaacagaagcuauaaagaaagaugauauggccccaugguaugaacucauuuguaaagaugcugguuggaaacuugauacuaaucuacuaagugcauuaaaagcuaagaacgcugagaagaucaagcuuuuagaugaagccauagaagaugcugagaaaaauuuaggugaaauggaaguucgagaagccuacuuaagaaaagcagaauacuacagccgaauuggugauaaagacaacgcaguuaguacuuucagacaaacauaugauaaaacuguaucacuuggccaucguuuagauauuauuuuucacuugauaagaauugguuuguucuucauggaccaugaucucaucacaagaaauauugaaaaagcuaaaacccuuauugaagaaggaggugauugggauagaagaaaucguuuaaaaguuuaucaaggugcauauuguaugucugucagagacuucaaaucagcugcuaacuuguuuuuggacacaguaagcacuuuuacaucguaugaacuaauggacuauaaagcauuugucagauauacuguauacaccucuauuauuaguuugccaaggaaccaauuaagagauaaagugguaaaagguucagaaauauuggaaguauugcauucggaaccauuuguaaaagauuacuuguuuucuuuauauaacugucaguaugccgaauuuuucacaaaucuugcagaaguugaaauagugcugagaaaagauuauuucuugaauccucacuaucguuuuuauguaagagagaugaaaauacuugcuuauacacaauuguuggagucauauaggucucuuacguuacaauacauggcggaagccuuuggcgucacuguugaauacauugauaaagaacuguccacauuuauagcagcaggaagauuacauuguaaaauugaucgaguugggggaauuguugaaacuaauagaccagauuuaaagaaugcccaauuuaauucuguuguaaaacaaggagauuuacugcugaauagaguccaaaaauuaucuagggugaucaauaucuaa

SEQ ID NO: 5760 - RNA, 4707 nt, Diabrotica undecimpunctata
  misc_feature (15)..(15): n is a, c, g, or u
  misc_feature (1548)..(1548): n is a, c, g, or u
  misc_feature (4681)..(4681): n is a, c, g, or u
augucaaaggccggnuaccacgcaggaugucaaaggccgauuguuacuucuauuccaaaauauggauggaaguguagauguugcagagugugcggcgauuguggaucccgaacucccggagcuggcuugucuucaagguggcacgcccauuacacaguuugcgauuccugcuaccagcaaagaaauaaaggcuucucauguccucucugccauaaagcuuaccgagcgcaugcucauagggagaugguucaaugcucaaauuguaaaaaauuuguccaugggacgugcgacgcugaagcagauguugcuaccuaccaccaaaagaaagaucuuaacccugaauaugaauauguaugcuugcauugcaaaaauaguacugcuagacaaauaacugcaaaaagagcaaguauugaagauucaucggauguaccagcuucucaugaaucucuuuacgaugacaccucagaauuugaccugccuucuccagacgaauuugcccguagcauggguaugggcaaaggaaaaccguucgccagcaaaauugcgaaaaagcgcauuaacuuucccauugccgguaggccaaaagguacagguaaaguaccucccgguaaaauggguuuuaugaaacgaucucgauuaucggauuuuaauaggaaaaggggccauaaaucaaaaaugugcgguauuuucggcguaccugguguuggacuucaaagaccgacugccgauggaaaaagcgacgaagagccgggcguggagaauagauugguuuuauguucugccaaagauaaguauacguugacgcaagauauuugugucauguguggagcgcuuggaauggaccaagaaggauguuugaucaguugugugcagugcggacaguguuaccauccauacugcaucaaugucaaaauaacaaaaguuauauuggagaagggauggagauguuuggacuguacgauuugcgaagguuguggucagcgaaacgacgaagcucgccugauacucugcgaugacugugacguaucguuucauaucuacugcauggauccaccacucgacuacguuccucacggcaauuggaaaugcaaauggugugcgaugugucucaauuguggggcuaccgauccugguuuuaacugcaauuggaugaacagcucuacccaguguggcccaugcgcaucacaucucaauuguccuaguuguaacgagccguacggugauggagaauugauuauucagugcguucaaugugagagauggcuucaugguuccugugauuguauaaaaaacgaagacgaugccgaaaaaugcgcagaagacgguuacaacugcauccuuugucggccaagagauguaccaccgccccaccuuguaccgccgccgcccgcuccaaaaccaccaaccccuacgaagaguccugaagucgggaaaaguucgaguuuuuauuuggacgguguuuaccuaagugagauggggaacagcuuuauuaaaucauuagcuuuggaacaucauggcucgcgaaagaaacgaaaaaaacuuccuacnggcggaaaugcugguggagcgacugcuuuagaagacagugcuaaacuagaauuggucgacgucaaagacgaaccucaagagcuauacaaagaaggcaugauuuggacaaaggaggauggucccgcaccugaagguuucacgguguuuaccauggagagcggaaucagcgucuuaaggcgcaagagacaacggaaucuacagaaacuaggcauaggugguuuucuagucagaaugagaggcauucgaaccggucaggauaacgaugaaaucgauuccucgguuauccagucuggcagugcuacaccuacggagcuccuaccucccaugccuguugauggagauaaaccaaaaagaaaaccgauuagaagaaaaccaaaaagcaagcuagccgaaacuuuuccggcguacuuacaagaagccuuuuucgguaaagaucuuuuagaaacuguugauuguaaaaaagaagucgacaguuguaguagcgacgacgaaaaaucugugaaguauaaauccaucaauuugucucaggaugaauugauggcuguagcugcagucucgggcaaaagugaaaagcaagcaauagcuaguauuaaagacucacugaaggauauuaaaucaucuccaaugauaaaggaagaagacgacgauaauacagaagacuuaaaagauguacuugccuuaccuggagauuuacuugaugcagaaauaguuaauaguauuauggaagacgaugacgagcuuacuaaaaauacagaaucacuggaaguuuuagauaccaaccuucaagaugauacugaguugacugacacauugggcagcuccggcaacucgaaagaaaccaaagaugaguugagugauauucuaggaccacauuuuaaucuggaaucgauuucuaauaucaacagcaaggauguagaagacauauuuaaggguguauugacugaugaaucacaggaaucacaagagagcagcaauuuugccauacaaggaaguaaucuuuuuuccaacaauacuccucagccaaguuuagcucagcauuccaugaugacuccugcuguucguccuaaaacguuacccaaugugagccaagucaauuuaaauucaccaguaggauuuccuccaccaucaccuuaccacucagaauauagcaacagcccucaguucaguccugcuuuuaccgagucuccuaacgccugggucggaguucccgaaacuccugaaauagacaguaccaacguaggaguuccuucaacguacaaucagcguuccucggaaaagaugaaagccgacgaaaguuugggcaacggugcuaccauuucugcaguucucuaugcuaauaugaaucauccagaauggaagaaagauuuuccgguuuggucugauagauacaagcaaauaaucaagaaauggaggacacuaagucaagaacagaaagcuccauaucuucaacaugcaagagauaauagaagccaauugagaaugaagaaggcccagcagucacagaccuccaaggaguccaccgcauccgcaucaacccccaacgugaccaagccaguccaugccgucccagcucuagugaccacccuccaggcaguaucgcagcagcccgugggggugacuacagcccccacggcucccauuacagaggaccaagaaaagauggcacugcaacagaaaucugccagggaagccgaacaagaaaggcaauggaaacagcuucaagcuaugagacagcagcagacgcagcaacaacagaauauuauacacgaacaacguguucaggccaucgcgagaguccagcgacaaauauccguggauccagcucaacaguuuuugucggaacaacaaagucccuugcaaccaaguacgccucaggagcuuaguccgucugcuacaccaacaccaagcccaagacaguucauaggaaugaaauccccgaccuuuccucuuccuucaccaguggcucagacagcaauuagaccuccuacacccucucauucuccacaugauguaagucaggcaagcaccccugacgguaaugaucacuuuauucaaucaccuucuacuccuaaaccuaauuuuccuacuagauuaccuacagaucaauuuauccaccaaccugcaacuccuaggccccaguuuggaauacaacggccgccuuuacagaacuuugguaauacgaugaggacagaucagcaggauauuaauaucaaccggcaguuacgagaucuucuccagcgacaacaggugaaaaaauuggaugaacuguuaccagguaaaguucaacaacaaagaguguggccuccaauugaacaacaagaaaaugaggccucggcaacuacugguacuucggcaguuguggcuacaacagcagauaccacuuucaggcaaccauuaccgcccagcauugugcgaccuagaguggcucucucuuuagcuggucgagcagguccugguacuauuaggguuggccaguuagaugcccgaaugcaaggccuggauccuagaaugagauuaauuuugcaacagcaaguuggccaacaacgauuaucuacgggaauucagcaucaauucguacgguuuaccucgacaccagcucgccccgcgaccuuggaucaauaugaacaacuacuccacagacccacugcuacucagauccgagcaccugaucagcaaaacgcaccucgaaugacuuuaaaucaagcuagcgucauucaaagaccgcaaaugguacaaccuacucaaaguacuccugcaacuagugcugcugauaguaaucccagugaagaagguauucccgauaauguuacugcugaacuggaaaagcuugaacaagaaacagguacuaugguagaguuacaaggugucagugagauccucggagggcugggagaugacgacgaugaacuuuuagcugaaaugggugccgauuucaauauccuagaguaugccgaucccgagcuggaagcuuuaacaggcggcaaaacaaauauauuagaucuggaacucgaagaagaaccagugaagaaagagaaaauaguauccagugcagaaaaccaaccgacuaaucaaacaguaaacgcuauuucgagcccugugaaaccuaaacaugaagaaccaguugaaacgccungcaauuucgagcccugugaaaccuaa

SEQ ID NO: 5761 - RNA, 2913 nt, Diabrotica undecimpunctata
auggaaaucagauauccagcaaaugauccaaaaauugaugccgaucuuauacccaaaaggacacgcaccuuuucaaaaauuuucggauuaaacacuaguuuucuugagaucuuuuuccuagagagaaaaauuaaggggccuuguugguuggacauaucgaauccagugccaguuacgaaccccuuaaguugguguaaguucgaagugaacugcgcgaagaugguugauuuacaggugacagugacagaaaagccacugccuccaccuccgcugguuguaacugcuauuaacauaaggacuugcaucaacagaaaaacuuguggccaugaaauugugauggcuucuugcuugacacauaaaaaguaugccguagauaugcagccuccagauccuccguuucaacaacauuucugugugauugcuacuccuggugaucagacguugccuuuugauauccacgaugcccucaguaaguacaaagcaacaaaaguacaaaaaauggacuccgaaaaaggauuguugaacuuuuuuguaaaccaauucucuucuauugaucccgauuugauaauaggccaugacuuacagggcuaccaaauuaauauuuuagccgaaagacuuucaaaacucaauacaaauauuuucaauaaauugggucgcuugaaaagaucggaaaagaaaaauuuggaaaaaagucuuuuugcuggaagauuaguaugcgauauaaaaauaucagcuaaggaauuaauaaaaucacguucauacgauuuggacgccuuaugccaaguuguucugaaacuuaacgaaaaucaaagaaucgaauuagaacccgaugauguaccaaagauguuuaaaaccacuucagauauucugaaauugguaucguuuaccaugcaggacacuauguauauauuaaaaaucauguauaauuugaauguuauuccauuggcguugcagauaaccaauauagcugguaaugucaugucuaagacuuugaugggugguagauccgaacgaaaugaguuuuuguuguugcacgcuuuuuccgagaaaggcuauauaccuccagauaaggaguauaagaagaaaggagauggaaagcagaguucaaaaaagaaaccuacguaugcaggagguuugguuuuggaucccaaagucggauuuuacgacaaucuuauucuccuaauggacuucaauucucuauaccccagcaucauucaggaauacaacauuuguuuuacuacauuaccgguaagcgacagugacgaaaaccucuucuuaccagacagcaaccuuccuccgggaguuuuaccaaccgagauuagaaaacucgucgaaagccgucgucaagucaaaggaaugaugaaaaaaccagaucuaucugcugauuuacgaaugcaguacgacauucgacagauggcuuuaaaguuaacagcuaacaguauguacgguugucugggauuuucaaauucuagguucuaugccaaaaauuuggcugcgcugguaacgcagaaagguagagaaauauugacaaauacuagggauaugaucgagaagaugaauuuuaacguuguuuauggugauacugacaguauuaugauuaauaccaauauuuuggaauacgaccagguauuuaaaauuggugucaaaauuaaacaagaaguaaacaaauuauacaaacaaguagaacucgauauagaugguguauuuaaauauuuacugcuuuuaaaaaagaaaaaguaugcugcaguaacauugaacaaagacaaaagcggaaaauugguugccgucaaagaauauaaagguuuggacauuguucgaagagauuggucccaaauaucuucugaagcuggaaaauauauauugaaucaaauuuugagugaccaauccgccgaugaaagaauagagcauauucgugaauaucuaagaaaaauucgugaacauuuaaccgagggcaaaguacccacuccguuauuaauaauuaccaagcaguuaacgaaggagccccauauguaucccgacaaaaauucucugccgcacguacaggucgcucuucguuacaaucagaaaagcggagggcauuuuagggcuggagacaccguaccuuauauaauuugugaagauggaaccaccaauagcgccguacaaagagccuaccacguagaugaacuaaaaaguaauucugaucucaaaguugauauuauguauuauuuaggucagcaaauacaccccgugguaucgcgaaucugcgaaccuauugaaggaauagauucuuaugagauagccgaaugcuuaggauuagauacaaaaaacaucaaaagaccuaggcaggcagucaacgaacuuauuggggaaaauauuagcagacccgaaaucaaguucagaaauguggacaaguuuaaguuuauuugcuuuggcuguaaacaggaaaauauuguugaaggagcauugguaggaaacucaccuuuccuggaacggugucgcaacucggauugcaguguaaaaccaauagauuacuuaccuuucauacaaaaccaguuggcccuuucgauccaaucauacauuaauaaguacuacgaaaauaucuuaauaugcgaagaucccgcauguacaaacgaaacaaaucaucuuccacuuaaauuugccaggaaauacccaauuuguacauuaugucagaagggagucauguucaggguauauaacgagcagcaauuauacacccaguuaucuuauuuccagcacauauuugauuugagcaaacuaaguaaaaagccgcuaauggaacaugaaaucgaaucugguuauucgucacuucaagauauuguugaaaaauauuuaaaccauuccggauacuccauaauagaccucacugaacuguucuccaugcuagauccucacaaaaagcgggaaaacaca

SEQ ID NO: 5762 - RNA, 1116 nt, Diabrotica undecimpunctata
auggcuuuaagaaccuacggagauaaaccuauaaguuuucagcucgaagaaaauggagacuacuauuguguuggauccgaggugggaaacuaucuacgccucuuucgagguucucucuauaagaaauauccuggaauguucaggagaucaauuacaaaugaagaacggaaaagguuaauugaacuuggucuaagucaacauguucuagcuaguaguguuucacuucugagagcagcugaaguagaugauauaauugaagggaaugacgaaaaauauaaagcuguaucuguccauacuucagaaccaccaaugccuagagaaaguaaaucaaagaaaaauuugcaaugggucccaucuuugccaaauuccagucauuuagaugcaguuccucaagcuacuccuauuaacaggaacagaguagcagcaaaaaaggugaggacguucccauuauguuuugaugacacagauccacaagugaacaucgaaaauucuugucagcaagaaguucuuguuccuauuagacuugauauggaaauugaaggacaaaaacuaagagauacuuuuacauggaauaaaaaugagaguuugauuucuccagaacaauuugcagaaguucuuugugaugaucuugauuuaaacccauugacauuugugccugccauagcucaggcaaucaggcagcaguuggaagcauuuccaucagaaccgccaaguauaauugaagagaauugugaccagagaguaauuaucaagcugaacauacauguaggaaauacuucauuaguugaucagguggaaugggauaugagugaaaaacaaaauaacgccgaagaguucgcucucaaauuauguuccgagcugggucuaggaggggaauuuguaacagccauagcauacucuauccguggucaacucucguggcaucagaggacuuacgcuuucagugaagcuccgcuuccuacaguugaaguuccguucagaacucccagcgagucagaucaaugggcgccauuuuuggaaacuuuaacagaugccgaaauggagaaaaagauaagagaccaagacaggaauacucgacgcauccggagguuggcgaauacaacgccggguugguag

SEQ ID NO: 5763 - RNA, 4161 nt, Diabrotica undecimpunctata
  misc_feature (2179)..(2179): n is a, c, g, or u
augaauacaacgagaguugauaauacacaaaauccaguacaaaaaauugaauuaacaucuagaaguauugaaaaugcucuaauauuggauaauaauucgccaagacuguuagauuuuaugaauauaaauucccaaaguggaucuacagcuagugguuuugcagaucaugacuauccaacuaucaguggaguuucacaaguuaucaacaauaugacacaaguuaaauguguuaauagcauuccuuuaccaacggaaauuguugaccauuuuucacggguccaaugccauugcaugaugggccucuuuugugaaaucaguagagcuuggcuuacuguggauagugauauuuauguauggacuuacgaacaaaauacugauuuagcauacuuugauggaauaagugagaccauuguuuguguuggucugguaaagccaaaagugggagucuuccaugcuuuuauaaaguaucuucuuauccuggcaacuucaguugauaucguaguuuuggguguaacuuuuacugagaaaccaggugauaccacagaggaaauucaguugauaccagacccaguuuuuaguuuaccaacugauggugcuacuguuacuaucaucaguaguacuaaugauggaagaauuuuuuauggcacaaaagagggaaagcuauuugaaauauacuaucaggcugaaagugguugguuugggcaaagauguaaaaagguaaaccugucuacaaguacccuaucuuuucuaguuccuucauuuuuaaaugcugcccuuagugaagaagauggaauuugucagauuucaauagaugagagucggcauauauuguacaccuuaacagaaaaaggaacuauagaaguuugugauuugggugaaaaaggaaauauguuuucaaggauagcaaaauugggccaaaauacucuaguaaaucaagcuaugaauacuguaaaaacuuuagauagucaaaacuuuagaccgauagucaguauaucagcuauugaagcaacagaaucugccaacuugaauuuaguugcuguaucccaaacaggaguucgauuuuaccuaacaguaguuagucucuccaauaugcaaccaaaucagagaccauauacacuaacuuuagcucauguacgucuaccaccaggauauucggcuaauauaacuguaagaccuagagcuguacaugugucccauuauagcgacagaaauuugguacugauuucgacuguuaaugauaaagaugugcuuuggugcaugaguucagauauguuucccuuuggucagacuuugauggaggcuuauaguguuguaaaucuagauggaccagcauuagcuauaucagaggugcggcauccaacuccuuuaccguuaccaucaaaccaagaagcgccaccucugguugucagacaacacgcggaaccaccuaagaaauauguggucuuaacaucucacaguguucagauuuuuauuaaacugaggccaguugauauucucaaucagauacuuagagauagucaaggcuuagacacugaagcgcuuaagacguuuuuuacgauucaaaaagaggaccaagcuugcgcaacuuguuugauucuggcuucuuuagaaagugaugagaacguugaaguugcagaauaugccacaagggcuuucuuuuuguaugguggagaaccuaaacuggcgcaagccaauauauaugccggacccaguguauuugcuccucaaauaauaucaacaccugcuccacaccaauaccagucucagcaguaccaaaccgcucaacacuuccaaucuaauaugucacaaacacugccaacuguuccaaauacuaccggauaugaauucaccgguccguuuauuuuuucggcgaaacauaauaguuuauauuuguauuuaaguagaauauugcgaccaguuuggaacuugagaacgguugauaagcuuucuguugacggaaagguuucuacgacauacaguaccguuuccagugaugacugcauauuuauucuaaauaaucuaacugcucuccauaauuuccuagcacgaaauacacaacugucaaccguuagcaagaaccaaaaucaauuccagaacacuacacuuaauaauacaucucuaaauaugacgagaaugaaccauacagugcaagacgcccaaauggaagaaaaagcaucanuccauaauuucuuagcacgaaauacacaacugucaaccguuagcaagaaccaaaaucaauuccagaacacuacacuuaauaauacaucuuuaaauaugacgagaaugaaccauacagugcaagacgcccaaauggaagaaaaagcaucacugaauucuuucaaaauucuuguuucgcuuuguugucaaauauugggucuguggagaauccugugugaacaucaauuucauucauugguggcgucucuuacggaaaacgaacagcaaauucucgucaauacaacuuuuaaagacuuauuccuuuacagacacgacauuuguucuucguugauaucagcucugguucaaacguaucugggugacaacgcuucuguagacucaaucagcagcaaauuaagagaaguuuguccacaauuguauaaaaccgaagauauggcauauucgaaggcaaucgaaauccuaaaaucugcucgaacaauacaaaaugucggagaaaaagaagaauugcuuaauucagcgcuacaaauuuguaaaucuaucggaccgaauuugaacauaggugaugucuguaaagaguucuguaaucuuaaaggauauaaagcuguaacugaauuauguugucauuaugccucaaaauuagacccagaaaacauugcggagauauauuacaaugcacccgauagcacuggagaccaggaagguuauaauuacuaucaaaacagaauggaaauuuauaggcaucuauugaauauguuaaauuccauguaucaagaacuuaauguaacuccaguaccgugccucaacuacgaccucgauuuuucaguaacucaaucaauuuugacagauaccccagcacagucacaaauugguuauaugaugaaacaagugaucaccgauauuuuggaaacucccgaucaaauaaugcauauaaccuuauacgauuggcuaauaucuaaaaauaugacuggagauuuacuaacaauuaacaacgauuccuuggagacauaucuuaaaagaacagcagcucaaaauccaaaugauacuguugcuuuggaccuucuauggaaauucuaugaacaccgcaaugaccaugcugcugcagcuaaaauucuuaauagccuggcaucaagaagugguauuaacauuccucuaaaagaaagauuggccuacuuagcccgauccauaauguguaugagaagcgacaaaauaggauaugcgccauauuuaggugucuuccugagagauuuggaggauaaauuagaaguggccaagguacaagaacaaauuuuagaggcuguuaugaaucaacaaaaucaaaucgaaaauuauggagauauuguugcagcucugaauucgggacuuuuugaaauaucacaguuguacgaaaauuucgcugagccguucaaacuccucgaaugucagcuggccauuauugauugugccggauauaccgauccagcguuaauagaaacuauauggcaacaaauauugaccgacgagcuaaagaagacuaccggaacuggaacagacaaaguaugucaauuauuaaacaaagucaaacauuuagccaaaaauuaugcuaaaucaaugaacuguuuuccuuuagauuauauuaucuaugaauuagaaauagugaaugcaaaguuaagaggcgauagacaacuaguaccuacagcucuugagaguaugaauauuccguuugacagucucaucaccguuuauaauaauuugaauaccauaucuggaaacgaccauuucuggcaauuggaagaaaaugaauuucaucuuucugaagcuacagcuacucuaaucagcuguuucauuaguaaccaagauucguauagcaguauagaaaagagaaaauacacauccuuaucucaggacaccguuguugcauuacugucuaauuuauacagcaaaccuaauacagaagcgauaguuaauaaguuacgaaauauucaggccagguuagccagaauuuaa

SEQ ID NO: 5764 - RNA, 3561 nt, Diabrotica undecimpunctata
augaccgaauuuacuuuaaguuaucgugaaguuauaccggaucaaacaguuuuugaaaauuggaaagaaaucucccuuaccacaggugggacacaaaguacucuccaagauauaaaaguagcugaacgagcaaauggauuugcuuaugaagauucaacaaagcaucauacaaggaauagauuuauuuauuggagaaucaacuaugaugucuuggaauugguagaacacagccuggauaucaauuuaacagcaaauagaguuagauacaaguuuacagauacuccuauucuagauggaguuuccauucacgaaacuuaugaaaacauuauugugcuugucccaacuguuuguagcauacaccguuuaauauuuccacacccugauagguuucauagacaggaugauuuacuaggagugcauccagauuuggcugcucccucaauauuuucaaaagcuucaccuguggaugccagaaauccaaauacuuuuuauguuuuuaauaacccaaccacugccacugaccaacugcccaauuuagccaguucuuacuuguuaccugaaacugaggaagcauuuuuuauauuagcuuauccaucgacagaacuacuauugauaaaacaaaauccugacaauggccaaguuauauguacagagcugaaaggggaaucuuugaugcccagauuuuugucuggucuugcagaaaaguuuagaccaagaaauucugacggugauaccauagugagucucuuguuuuauauuguugauuaugaaacuuacguuuugacauugacaagagaugcccaucucaaguuuugguccuguacuaaaggacaaugugucgcuguuauagaugucagagaaaagacaggagauaguucaaaggaucgaguacaaggagccauauuaaggaaagcaguagauggcaauaguacugaaaguaucuuggcaguguuuuuaaauuacgccagugguggccaauuccauaucuuaaauccaauaauaaaaggccaggaaauaacaauugacagauuggccacuuuauacucuccugagaaugaucuuauugauuuugcguuacaaaccaaucgccuauggucuguuuggcgaugugaagauggcgacagcguaguguacacugccacacugccaguaucccguugugcuuccuacaaaucgagcaauuggucaccuauuauuuuagaaacauuaccugaugccaaucaagcaccugcuaaugauggagauagugauccuagacaaguguauuugcaacacauuuuccaucccggcagauuuccuuugcacauaauaagcaaagcucuuucuauuuacaagaggucuacuauuuuaucugaugcccaaauaucagccucagcuuuaaaacaaagaauuugucuagcuguggauaaugaaauacaaaauacguuaaacggaucuaaugugaaugaugaugaauauuuagaaugugcagacugguguuggcaaaaauucuauucuugcuguguacaguaccauaucgcuagcuuaaaaccucuuggucuaauguuauuaccuucugucucuggagcaguauuuuugaaaaaaucgacguuuucauuccuuagaccuuuggauccucuggaacacaugacucucugcuaugaagauguuuacagagaccaauucaucaauuuuuccauguuagcugaagaucuagacacgacagaugacguaaugaacuuguuuaaagucaucguauauuuagaacaacaaaugagugaaucauucgcccaggcauucgagaaagaaauuuuuaaucuacgugcaccugaugucaucauggaagguuuauuagagaagauucaaucugagauggauuaccaguucgcaucgcacauauuggaaaugaugaacgacguuacugaccuauacaaagcaaugcacaaaauuuuagaacucuuaagauaugaaaauacauuagccagcccugauaacgacauaaauccuggagcuauguaucauuucaguuccuuguugggcacuucaguagucgcugaaagcuugagacaacaagcacagauaagauuucaaauauguagaaauuuacuucugaucugcaacauuuuguugaacgaaaaaacguuggauugggguguacuagaagccauacguucagucuguaccccggagauuguuguacucacacaagcuaguuauguaguucuauggcugugcggauuaacuacuauaguaaacuuaccuuucagugcucgcgaaucuucgauaaacagauuggcgccacucaaauuagccccuguuuugaauuugagaccuguuacuacaugcacgucguuauuggaacucuucauauccucuaccgguggccaggaagcaaggaaaucuuuugccaggguaaauugcagcgacgaagcuuuggcccacuggcauaucucgcuuuuaccuuauuugaaucacgugagacauauaauuuggcccauaacuggagguacaguucuugccgaguggcuguuaagcaguggacaacauuuaugguuacagcaguacguucguuuacuuagcaacuggugcgaauggaauaguuguacaagaaacuucuugcuagcuucugccuuuuugucaacuggagaauacaacaaagcagaagauuuguuugaaacgggugcuaaagggguuucaacagaugccuuucuacaagaacguuguuuaaaagggauuuuacccagcccaacuggagcguacauucacuacuauuuaaagguuauucaacuauuugaacuucacaaggccaaagauuccguuauaagcauugcaaauacugcucugaguauuguagacccagaagauccguuagcggcuacuuuauauuccaucaaguucaaacaccacuuggcauuaaagcacuacgaacucgccuucgauucguugaaugcuaauccagaugcggaacggaaaaaagacaaccugagagauuuggucaaaacacuauuggaugaaaagaaauuggauacuuuauugaacuuuacguaugguagcauggaugaguucuuuacaaauauacuguugacuagagcuagagcaaacgaugcagucaacaacauuuucuacgacuucuuguauucuuaucaaauuaaaagaggaccucugucacacagacuagcugcaucaguaauguacgagcaggcuuucagauuaaaucauauuaacaguguugaagcacuggaaaaacaagugaaaugcuacuuggcagccaaaaacguucuacaucuauguaaaccagaacacgcuuggguagugcgaccagcugauccagaugaagaagaugaaguaauaacuauucagccuuuggccggaucaaacgaagaaaugaaaguguuuagauugagaaaacaaguugaaguuguuaauaucgaaacuguuaagaaggaacuuauuuucgcaagugcaaaauuaaaauuggcaagguuuaguucgagccuaucaccaguuaacauaacaacuccuguggaauugguaacauuauuaaauacugcuggucuauucaaaacugcccuagacauuugc

SEQ ID NO: 5765 - RNA, 2907 nt, Diabrotica undecimpunctata
auggaaauguccgaugaaaauauucaaguuuuaaguaaauaucuacaggagacgcuuaauccagaucccaauguucguagacccgcugaaaaauuuuuggaagguguagaaguuaaucaaaauuauccuuuauuaauauuaaaucuuguacauaaaccagagguggacaugacaauuagaguugcuggagcuguagcauuuaaaaauuauauaaaaagaaauugguuuguggaagaagauggaguagauaggauucacgaaucugaucggguugcaauaaagaauuugauaguuacuuuaauguuaagcucaccugaaucaauucaaaaacaguuaagugaugccauuagcauuauuggaaagacugauuuuccucuaaaguggccagaauuaaucucacaaaugguugaaaaguuuucuacaggggauuucaauguuauaaauggaguucuaagaacaggucauucccuuuuuaaaaaauaucgguaugaauuuaaaucacaagaguuauggauagaaauuaaguauguacuagaaaaauuggcccagccgcuaacugacuuauuuguggcuacuauaaauuuggcacauacucauagcaacgacgugaaugcauuaaaaguuauauacaguucauugguuuuaauuugcaaaguauuuuauuccuuaaauuuucaagaccuuccagaauuuuuugaagauaacauucagauuuggaugucaaauuuucauaccuuauuaacggcagaugucaaaugucuucaaaauacugauagcgaagaggcugguauuauggaacaauuaagaucacagguaugcgauaauauagcucuguaugcacaaaaauaugaugaggaauuucagcaguucuugccacaauuuguuacugacguuuggaguuuguuagugucaacuggucuugagccuaaauaugaucuguuaguuucaaaugcucuccaguucuuaucgucaguugcagaaagaguucaguauagacauuuauuugaagauaacaauguuuuaagcagcaucugcgaaaaagucauuauacccaauauggaauuuagaguuucagaugaggaguuauucgaagauaauccagaagaauauacacguagagauauugaagguucugauauugauacuaggcgaagagcugcuugugaucucguaaauacucuuagucagaacuuugaacaaagaauuauugacauauuuggccaauauuuacaagugaugcuuggaaaauauguggaaaaugccaagcaguauuggagaagcaaagaugcugcguuauaucuuguaaccucacuaguuaguagaggugcuacucaaaaacauggaguuacacaaacuagucagcuggucgauaucaaucaguuuugccaacaacacguauugucagaauuagaaaggccugauguuaaugauuugcccguuuugaaagcagaugccauaaaauacaucaugacauuuagaucagugcuuccaaaugcgaucguuauuucuacgauuccacaauuaauuaggcauaugacuagcgaaagugcggugguacacacuuaugccgcuuguacauuagaaaaaauuuuaauuauaaaggccaauaaucagccaauaguuacuggugcccauuuggaagcuuuuacuacaacgcuucuaacaaaucuuuuuggaauacuagaaaaaccuguuucagaagaaaaugaguauguuaugaaagcacugaugagaacauuuucuacauuacaagaaagaguccuaccauucuugaacgucgcauugccaaaauuaacagaaaagcuacaauugguugcaaaaaauccaucaaaaccucauuuuaaccauuaucuuuuugaaacauuuucauuggccauaagaaucguauguaaggcaaaucccacugcuguuacagcauuugaagauauauuguuucccauuuuucaaggaauucuacagcaggauauucaagaauuuauuccuuauguauuucaaauucuuucucuuuugauggagaguacaccucaagguaauaaucuggaacccuacaugcagcuuuuaccauucuuguuggcuccugugcuaugggauagaccugcuaauauuaguccacuaguaagauuauuaugcgcuuucgcucuacaagcagcuccacaaauuguaucgcaggauaaagugagcggauuucuaggaguauuccagaaauugauugcuucaaaaacucaugaucaugaggguuucuuuuugauucaaaguaugauucaacauuuaccaauggaagcccuagcgccuuaucacaaacggauauuuucccuuuuguuucuaagacucuccuccaguaagaccacaaaauauguaauuaaucuuauaguuuucuuuuccuuauacguggugaaauauucagcaaaugaacugaucucuacuguugacgauauucaagcagaaauguuugguaaggugcuugaaaaacuauauguugccgaaauacaaaaaguuucugcagccgucgauagaaaaauuguagcuugcgguguaacaaaauuguuaugcgaaaguccagagauauuuucuggaaaguaucaaaacuauuggccccagcuauuacaggcguuauugaaauucuuugaaaugccaguggaugcaagcauacuacccgaugaucauuucauagaaguagaugauacucccacauaucagacaacuagugcaaaacugaauuuugcgaauacuaccaagagcgauccucuccaagcuauugccgaaccccgacaguuucugguucaaaguuuagcagcucuuggaaauucucaaccuggacggcuuccgguauauaucagcaacauggauguacaaguucagacaauacuaaauaguuaccuaucuaaguuugcuguucagcuggucuaa

SEQ ID NO: 5766 - RNA, 609 nt, Diabrotica undecimpunctata
auggcuaagguccaauuguguaacauaaccguaauggacaauccuaguccuuucuugaacccauuucaguucgaaauaacuuucgaguguauagaagaacuuagagaagauuuggaauggaaaaugauauauguagguucagcugagagugaagacuaugaucaaacuuuagauucaguuuuuguaggaccuauacccgaaggcaaacacauguucguguuucaagcggauccuccaaaugucucacguauuccagaaaaugaugcucuugguguuacaguuguacuuuuaacauguucuuauagaagucaggaguucauucguguaggguauuuuauuaauaaugaauauacugauccagaacuuaaagaaaauuuaccuaguccuccacaauuugauaagguaacccgaaauauucuagcaucugaaccuagaguaacccgauucaaaauaaauugggaagaaacuaaccccacagaaaauaacacaaacucagaccaaaauggagcaucagcacccucgacaucagaagcuggaccuucugcuccgguugaaguaccugccuuuaaugaaaauuccaauucgugggcaaccauggaauguucauaa

SEQ ID NO: 5767 - RNA, 951 nt, Diabrotica undecimpunctata
auggaucaaaugcucccuagucccggauuuaguaucccaaguauaggaacaccgcuucaccaaccugaggaggaucaacuuaucuuaccaaaugcccuucaacagcaacagcagcagcaacaacagcagauugcaacuaguaguucccaaguaccuccuuuggcaccaaugggaggcuuaacaccuacucuuggacuuggcaugggucaugccaugucuguaccacaaaccaaauauguaacugguuuugcauugcccaugaguucaaugaaugcacaaacuccucaacacacaaugagcccuauggucaauuuaggggguucuauaacaacaggagcaggaguaacuccaacaauggcuccaucaacuccaucgccaaugacuccaaugacaccucauucugcagauccaggaaucauuccacaauuacaaaauauaguguccacaguaaaucuaaguuguagauuagacuuaaagaaaauugcccuacaugccagaaaugcugaguacaacccaaaacguuuugcagcuguaaucaugaggauacgugaaccacguaccacagcucuaaucuucucuuccggaaaaauggugugcacuggagccaaaagugaagaagacucaagguuagcggcccgaaaguaugccaggauaauccaaaaacucggauucccugcgaaguuuuuagauuucaaaauucagaauauggucggcaguugugacguuaaauucccuauaagacuugaagggcuugugcuaacucacagcucuuucaguaguuacgaacccgaguuguuccccggacuuauuuaccguaugguaaaaccuagaaucgugcuuuugauuuucgugucuggcaaaguuguguugacgggugcaaaagugaggcaggaaauauaugaagccuucgauaauauuuauccuauuuuaaaaaguuuuaagaaacaauga

SEQ ID NO: 5768 - RNA, 477 nt, Diabrotica undecimpunctata
auggcugccaucagaucuaugucucgccuucuucuuaauagaucacuucaaacuacugcaaggaggaccuaugcagaccaaaugaauuucacuuuugccgcuggaaaucagguuuacuauacugcaacuucaguuaaacaggucgauguaccaucuuucucugguagcuuugguauccuuccugcccacguacccacacuggcuguguuaaaaccuggaguugucacuguuuaugaagaugaugguaaaguuaagaaaaucuuuguuuccagugguacugucaccauaaaugaugauucaucaguacagauucuugcagaagaagcccacccaguagaaaacauugaugucaaugcagcaagagauauccuuaccaaagcccagagccaguuaucaucugcaaguacagaugaggcgagagcugaagccuccauugccguugaaguaggagaagcuuuagucaaagcggcugaauaa

SEQ ID NO: 5769 - RNA, 987 nt, Diabrotica undecimpunctata
augaguggugacgguagugacacugaacaauuugauacuuuauuuuuaucuguagcucaauaucauccucagggaccaacacagcuucuggauacguuuguaaauuuuuugaguagaaaaaccgacuuuuucauuggcgccaaggaaggagaaugggaaaaguuggugauggacacuuucaaaaaauacgaaaaguuaagcaggucaaagcacgaggaggaacuaaaagaaaagcgugaacaagaagcucgaaaaaaagcagcugcugccaaaaaggcagaagcugaaguuguuaagccugcucaaaucacugaauugacugaugaagaagcugaaaggauucaggcugagauaaaugcuaaguuaaacacuucuguuaacgcugaaaguucuucaaaugguucagaagcugcagcugcgacuaaaaaaguagaagaagaugaggaugaaucugagaaaggcaagauacugccuaacacaggaaauggaugugaucuagagaaguacaaguggacacaaaccuuaggagauauugaguuaaaaauuccccucaaaguaaacuucaggguaaagcagaaggaucucguaguaaauaugacgaagaagcacuugacgugugguaucaaaggccagccgccuaucauagacgacgauuuuccacaugaaaucaaauuagaagagucgucuugggugaucgaggacggaaaggaccuauuauuuacuuuugaaaagguaaacaaaaugaauugguggagucaaauagucaaauccgauccagaaaucagcacaaagaagaucaaucccgagccauccaaacuuagcgaucucgacggagagacccguggaaugguggagaaaaugauguacgaccaacgccaaaaagaaaugggccuaccuaccagcgacgaacaaaagaaacaagacguuauuaagaaguucauggagcaacauccggaaauggauuucacacaaugcaaauuuaauuag

SEQ ID NO: 5770 - RNA, 480 nt, Diabrotica undecimpunctata
augcagucuucgagugguaugguacaugguuauccaggagguccuggauuacaauggagccccgauaaaaagcauagcgaucgcgaaagguggauauguauuuauccugcuuacauuaacaacaaaaaaacauuggcacaagggagaaaaauagccaaagaaagaugcguggaaaauccuacccaucaggaaauucgugauguucugguggcggcugguuugaaaguggguguugaaaacaaauuguacaguagggagagaaguaaagaaauguuauaucgugguagaauaagaauacaguuaaaaaaugacgaugguaguuuguguaaugacgguuucccuaccagagaaagcauuauguaucauuuaggagacaugauucccaaacugaaaagcaggcaaaauaaaagcucaggcgaggcuccucagcaagcaucuacugguacuaaaggcaaggggaaaggaaaaggacggagauaa

SEQ ID NO: 5771 - RNA, 2259 nt, Diabrotica undecimpunctata
auggauacaaaacaucauaaaaugcccaaaguggcaaagguuaagaacaaagcuccagcugaaauucaaaucacugcggaacagcuuuuaagagaagcuaaagagcgagauuuagaaauuuugcccccuccuccuaaacagaaaaucucagauccagcugaauuagcagacuaucaauuacgaaggagaaaacaauuugaagauaauauaagaaaaaaccgaacuguuauaucuaacuggauuaaauaugcucagugggaagaaucccaaaaagaaauacagagagcccgaucaauaugggagagagcacuugauguugaccauaggaauauuaccauuugguugaaauauacugaaauggaaaugagaaguagacagguuaaucaugcuaggaaucuaugggacagggccacgguucuuuugccaagaguuaaucaguuuugguacaaauacacuuauauggaagaaauguuagaaaauguaccaggugcuagagcaguuuucgaaagauggauggacuggcaaccugaugaacaagccuggcaaaccuauauuaacuuugaacuccgcuauaaagagauugauagagccagacaaauauaugaaagauuugucauaacacaucccgaaguaaaacauuggauaaaauacgcccgcuuugaggaaaaccauggcuucauacacucaucuagacagauauaugagagagcaguacaauucuauggugacgagcauuuagaugagaaacucuacauugcguuugccaaguuugaagaaaaucaaaaggagcaugauagggcgaggguuauauacaaguaugcucucgaucauauaccuaaagaugagacuaaggaacucuacaaggcguauacaauacacgagaagaaauauggugacagaagugguaucgaagaaguuauuaugucaaaacggaaacuucaauaugagcaggaaauacuacaaaauccaaccaacuaugacgcaugguuugauuaccuucgauuaguggaaggagaagaugaucucgauauuacacgagaaacauaugaaagagcuauugcuaauauuccuccaacgaaaaacaaacaguuuuggaggagauauauuuauuuauggauuaauuaugcgauauuugaagaacuugaggcuaaagauuaugaaagaacucgccagguuuauaaggcuuguuuagaaauacuuccucauaagauauuuacuuuuucaaaaauaugguugcucuuugcucaauuugaaauucgucagaagaacuuaacuacagcaagaaaaauucuuggaaugucaauugguaugugcccucgagauaaacuuuuuagaggauacauugauuuagagauucaauuaagagaguuugacagaugcagaaaauuauacgaaaaauuucuugaguuuggaccagaaaauugcaucaccuggaugaaguuugccgaauuggaaacacuuuugggagauauugauagagcuagagguauauuugaauuggcgauuaaucaagcaaggcucgacaugccagaauuauuguggaaagcuuacauugacuuugaaauaucacaagaugaaccggacaaugcacggcagauauaugaaagacucuuggaaagaaccucccacguuaagguuuggcuaucguaugcuaaauuugaacuuaacaauccaacagaagaugaauuaaaugugcgcuuagcuagaagaaucuuugaaagggccaaugaaaaucuaaagagcucuccggagaaagaagcaagagugcuccuauuggaaaauuggagggaguuugaaaauaaucauggggacgaaucgagcaaagaaaaaguuaaugccaaaguaccaagaagaaucaaaaagaggcagaaaguuguugaugaggacgguguggaacaaggaugggaagaaguauuugauuacauauuccccgaagacgaggcuaguagacccaacuugaaacuucuugcagcugcuaagaacuggaagaaaaaagcggaagauggagaugaaaaagaaaauacuaauauuguuguuaaaaguagcagugauagaauaagagaaaaguugcuagcaucggcuaaaaauuggaagaaaaaacaagauggacuuaaggaaaacaauccagaagaaaauacgagugaagauaaacaagaagauaauaauccaauccuggaacaagaaacugaaucuaacgaccuggauaaugaaaaucaaaacuucaguaacgaaaaugauaguaaugaugauuccucuuaa

SEQ ID NO: 5772 - RNA, 1431 nt, Diabrotica undecimpunctata
auggggauuaaauuuuuggaaguuauaaagccuuucugcagcauacugccugaaauagccaagccagaacgaaaaauccaauucagggagaaaguacuauggacugcaaucacucuuuucaucuuuuuaguauguugucagauuccauuauucgguauaaugaguucagauucugcagauccuuucuacuggauucguguuauucuugcaucaaacagagguacccuuauggaacuugguauuuccccaauuguaacuucaggucuaauuaugcagcuguuggccggugccaaaauuauugagguuggugacacuccuaaagacagagccuuauucaauggugcccaaaaauuguuugguaugguuauuacugucggccaagccaucguguacgucaugacaggcauguauggugauccggcugaaauuggagcuggagugugccuucucaucaucauccaacuguucguugccggucucauuguuuugcuucucgaugaacuucuucagaaaggauaugguuuagguucugguauuucccucuucauugcaacaaacauuugugaaacuauuauuuggaaagcguucucaccagcgacaguaaacacuggaagaggaacagaauuugaaggagcugucauugccuuguuccacuuauugaccacaagacaagacaaaaucagaggauuacgugaagcuuucuacaggcaaaaucuucccaauuugaugaaccuuuuggcgacaguacucguuuuugcuauaguaauauacuuccaaggauucagaguagaucuacccaucaagagugcaagauaccguggacaauacuccagcuauccaaucaaauuguucuacacuucgaacaucccuauuauucugcaaucugcccuuguaucuaauuuguaugucaucucacagauguuggcuguuaaauuccaagggaacuucuuaauuaaucuauuaggaguuugggcugacguuggaggcgguggcccagcuaggucuuaccccauuggaggauuauguuacuacuuaucuccaccugaaaguguaagucacauucuggaggauccaauccaugcaaugcucuacaucgucuucauguuaggaucuugugcuuucuucucuaaaacauggaucgaaguaucuggaagcucagccaaagaugucgcuaaacaacuaaaagaacaacagaugguuaugaggggacacagagauaacuccaugauucacgaauugaacagguacauucccaccgccgcagcuuuuggaggucucuguauuggagcuuugucaguacuugcugauuucaugggagccauugguucagguacugguaucuuguuagcugucaccaucaucuaccaauacuuugaaaucuucgucaaagaacaaagcgagauggguggaaugggagcguuacucuucuag

SEQ ID NO: 5773 - RNA, 483 nt, Diabrotica undecimpunctata
augucgaugguaacuucaccuuccauagaacuuaguucuuaccgagaccaacauuuuaaggguacuagagccgaacaggacggauuauuaagacuaucgaccacauuauacguuggaaauuuaucuuuuuauacaacugaagaacaaaucuaugagcucuuuucaaaauguggggauauaagaagaguuguaauggguuuagauaaauauaagaagacacccuguggguuuuguuuuguagaguacuauaauagagcugaugcagaaaacuguuuaagguauauaaacgguacucguuuggaugauaggauaguaagaacagauugggaugcuggauuuauagaagguagacaauaugguagaggaaaaacaggaggacagguacgugacgaauauaggacugauuaugacucuggaagaggaggguaugguaaaauaauccagcaaaaaauuggaauugagacuccagcuuuuuugagauaa

SEQ ID NO: 5774 - RNA, 687 nt, Diabrotica undecimpunctata
  misc_feature (638)..(638): n is a, c, g, or u
auggcugcaacaauaggacgaauuuguggagcuggucuuuuaaaaccaacaaacuuauccucuguuggccaguuaaguucguauuccacaacaaaagaauggacucguggaagaaaagcacuuuugggaagcuuagggcuuauugcuggugguacuggagccuugcuguuugcuuuggaccaaucaguuaaagcaucugaucuagaauugcauccuccaaagaauguuuggagucauucuggaacuuucaauuccuuggaucaugcuaguguaagaagagguuacgaaguauacaaacaaguaugugcugccugccacucaaugcgcuucauugcuuaccguaauuuaguuggaguuacccacacugaagaggaagccaaagcugaagcugaagaacaaaugauugaagauggcccugaugacacggguaacuucuucaaaagaccaggaaaguuaucugacuacuuccccaguccauaucccaaugaagaagcagcccgugcugccaauaaugguucauauccuccagauuugaguuauauuguaucugccagacauggaggugaagauuacauauuugcccuuuuaacgggcuauugcgacgcuccagcgggcguuguccucagagacggacaaunaccccuacuuccccgguggugccauuucgauggcacaagcucuauauaa

SEQ ID NO: 5775 - RNA, 1716 nt, Diabrotica undecimpunctata
auguuagcucuucaacaauauucgggcaguagugacgaagaugauacagacaaaaauaaaaguaaagacauuccaguaaauacaacugaaauuaccauuaauuccgaguuuuccauuaaaaauaagcuugcuauuugugcagcuccaaauguagugccuacaggucuagauggagaaaaaaugcauauacauccugauaguggagaacugacauauaauccaaaguacgauguauuauuugcuccuguuguagguccagcaaaucccuuuaaaacgcaacaacaaucuguugaaagaaacaugcucucgggacauauugaaaaagcucauguaagugauuuucaauuugaaaaccagagaagaacuuuuacgagcuaugguuaugcauuagacccaucaauaaguaaugauggccaucuaaaaguuguugguucaacugaugaagguaaagacguagaaaguguuaagacuguauuugaaacuucaaagauaagaccuuuggauaagaggaaaaggaagaaaaaugauaauccaggugauauagaaggauuuuugggaccguggggugguuuuguugaugaacaaaaaguuucuagaccaacagaggaagaacaggcugaguuagaugaaauaacuucuaaaaagaauaagaaagguaaaccaacagaggacaaaccaauugaggaaaagucuguauugcauaucaaagauucaguggacuaucaaggaaggucuuuuuugcaugccccacaagauguugggguuaaucucaaaucugauacaccuccugaaaaguguuuuuuacccaagucucauauucauacauggacugggcacuccaaagguguugcagccaucagaugguuucccagaacagcacauuuguuccugucugcuaguauggauuguaggauuaagauuugggaaguuuauaaugagagaagauguauuagaacuuacuaugggcauagacaagcugugagagauauuaacuuuaauaauucuggaaagcuuuuccuuucagcuggauaugacagguauauuaaacuuugggacacagaaacuggacaaguuguuucaagauucacuagucgaaaaauuccauacuguguuaaauuuaacccagauaaaaauaagcagcauuuauuuguugcugguacauccgacaagaaaauuaucuguugggauacuaggucuggugacaucguucaggaauaugauaggcauuugggagcugucaacagcauuacuuucguagacgaaaaccgaagguuuguuacuaccucagaugauaagucguuaaggguaugggaaugggauauaccugucgacaugaaauacauugcagauccuacaaugcacagcaugccagccgucacaccagcaccuaauggaaagugguuggcgugucaaaguauggacaauaagauugugauuuucuccgccaugaaucguuuuaaaaucaaccgaaaaaagacuuucaccggucauaugguagcagguuacgcaugcucguuagauuauucuccagacaugagcuauuugguauccggugacgcagauggaaaaguauacgucugggauuggaaaacaacaaaauuauacaaaaaauggaaagcccacgauaacguuugcaucaguguauuauggcauccacaugaagcgagcaagaugauaucggcaggcugggauggcguuauuaaauuuugggauuaa

SEQ ID NO: 5776 - RNA, 807 nt, Diabrotica undecimpunctata
augguccaaaagaaaccuaagaagaagguaggaaagaaaguagcugcagcuccucuugcagucaaaaaaguugaacagaaaaaagaaguuaacccacuuuuugaaaagaggccuagaaauuuuggaauuggccaggauauucagccuccccgugauuuaucucgauuuguaaaauggccaaaauacauucguauucagagacaaaaagcuguacugcaaaagagauugaagguuccaccaccaauuaaccaauuuucucaaacuauugacaaacaaacagccacccaauuauuuaaagucuuggaaaaauacaggccugagacagcccuucaaaagaaaaauagguuaaaggcuaaggcugaagcuaagguugccaaaaaagaagaggcaccugcuaagaaaccaaacacauugaaggcuggugccaauacaguuacuaaguugauugaacagaaaaaagcccaauugguuguuauugcacaugauguugacccaauugaguugguucuguuucuaccagcccuuugcaggaaaaugggugucccauacugcauaguuaaagguaaagcaagacuuggacuucuuguaaggcgcaagacuuguucagcuguagcucuuacacaaguugacucuggagacagguccaacuuuaacaaacuuuuggaaguaauuaaaacuaacuucaacgaccguguugaugaaaucaggaggcacugggguggugguuugcuuggauccaaaucugcugcucguauugcuaaguuagagagagccaaggcuaaagaauuggcucagaaacaagguuaa

SEQ ID NO: 5777 - RNA, 1002 nt, Diabrotica undecimpunctata
auggcaacuuuaauaaaagauguaacacuccaggaaaacauuccaacacauauacuucuugacaagcacauagauuuuauuaaagaauauggacaaaaagaaaguacauaugaauacgguaugacagauuauuugagaauaucgggcauguauugggcucuuggggcucuagagcuuaugaacgccacuccagcucaaaguauagaagagaucacagaauacauaaagaauugccaagauccagaaagugguggaauuagugccugcuuaaaccaugauccccauauuuuacauacacuuagugcuguucaaauucucugcaucuacaauaaauuagaggcaauaaauguagaggguguuguuaaauauauugcaagccuucaguuaccugaugguaguuuuacaggagauaaguggggugaaguugacacuagguucucauuuugugcaguugcaacauuaucauugcuuaauaaaauggaugcaauugauguaaauaaagccauagacuuuguuauacaauguaaaaacuuugauggugguuucggaucuaggccacuuucagaaagucaugcaggguuaauguauugcuguguuggcuuuuuaucuauuacaaauagguuagaugccauugauagagauacccuugcuuggugguugugugaaagacaauuaccaucaggugguuuaaauggcaggccagaaaaauuaccugauguauguuacucaugguggguauuaucaucauuaaccauguuaggcaggcuccauuggauugaugccaaugcucugaaacacuuuauuuuggcuugucaagauacagagacaggaggauuugcagauaggccuggugauauugcugauccuuuucauacuauauuuggguuagcagccuugucccuuuugggacaugauucuguaaagaagauuaauccuacuuacugcaugccacaagaagucauugauagguuacaauuaaaaccucagagguuagagcaauaa

SEQ ID NO: 5778 - RNA, 2664 nt, Diabrotica undecimpunctata
augcaucaggaggccauacaacucauccaggugcuagaaaaaacaguuucaccggacaaaaaugaauuggaacaagcgucgucguuucuggaacaagcugcagugacuaaccuacuagaauucaucaaaacucuaucagauauauugagacauggcggaaauagcccugucgcccgaauggcugcagguuugcaguuaaaaaaucaacucacaucuaaagacucuaacauaaagaucacuuaccagcagcggugguuagcuuucccagaggacguuaggggguauauuaaaaauaacguugugugcgcacuuggaaccgaaacaagcagaccuuccuccgccgcucagugcguagcauacgucgcaguaacagaacuaccacaagggcaauggccagaucucauagcaacuuuggucaacaauguaugccacgcaaauuccacagaaaugcaaaaggaagccacauuagaagcuaucgguuauauaugccaagaaaucgacucggacguuuuaguaucucaaucaaacgacaucuuaacagccauaguucauggaaugagagccucggaaccgagcaaucacguacguuuagcagcuacacaggcccuacuaaacucucuagaauucacaaaggccaacuuugaccaaccgacggaacggaacuauaucauggaagucguuugugaagccacacagucuccagauucacagaucagaguagccgcuuugcagugucuaguuaagauuaugucuuuguauuaucaacacauggaaccguauauggcuccugcucuauucccuaucacucucgaagccaugaaguccgaaaacgaugccguggcucuacaggguaucgaauucuggucuaacguuagcgaugaagagguugauuuggccaucgaagauacggaagcuacugaagcaggucgaccaccuacaagauguucacggcacuacgccaaaggugcacuucaguauauaguaccgauucugcugcaaaaauuaacgaagcaagaagagcuggacgacgaagacgauuggaacccuugcaaagccgccggcguuugcuuaaugcuucucgcaacguguugcgaagacgaaaucguuccgcacguucugccauucauuaaagaaaauauuaagucugauaauuggcguuuccgggaugcuucggugauggcuuucggaucuauuuugggcggcuuggagaguacuacguugagaccgcuuguugaacaggcgaugccaaccuugauagaucugauguaugacaauagcguuaccguaagagacacagcagcuuggaacuucggcagaauuugcgaaaucauuccagaagcagcgaucaacgaaaccuuccuuaaaccgcuauuggaaagcuugaucacaggccucaaggcugagccucgaguugcugccaauguguguugggcauucucuggauugguggaggcagcuuacgaaaaugccgauguuaaugaagaaaccggugcuccagauacuuacgucuugucacaauacuucgaguucauuauacaaagacugcuugaaacaacggaccgacccgauggcagccaacauaaucuacgaccugccgcuuacgaagcucucauggaaauggugaaaaacucaccgaaagauugcuacgucaccgugcaaaagacuacaaugguuauuuuggacagauuacaucaggucuuacagauggaaaaucacauaagcagccacaacgauaggucgcaguucaacgaucuccagagucuuuugugcgccacccuucaguccguacucagaaaaguuacuccggaagacgcgccgcacaucucagacgccauaaugaccgccauguugaccauguucaauuccaauucguguaagaguggagguguucaagaagaugcuauuauggccgucucgacgcugguggaaguccugggagaaaacuucauaaaauacauggacgcguucaaaccguuccucuaccucggauugaagaaccaccaagaauaccaagugugcguuacagcaguaggcuuaacuggcgauauuuucagagcccucaaacuaaaagcgcuaccguacugugaugaaauaaugaccuuauuacuagaagaucuccgcgaucagucgguucaucguagcguaaagccagaaauuuugggcguauucggagacaucggucuuagcaucggcuccgaauucaagaaguaccucgacgugguucuguccacuuuggcucaggcuucgcaggcccaagucgaucgcaacgacuucgauauggucgacuaucucaacgagcuaagagaaggaguuuuagaagcuuauacgggcaucuuacaaggucucaaaggcgacggucccacuccacauccugacguuuugauacuugaaccccacauuccauuuauuguucaauuuauuacugucguagcacaagauacggaacauucugauaguauuauagcugccgcagcugguauuguaggugauauguguaauguuuucggagcuccaaugguucaauucuuagaucuggauccuauuaaugaaauguuagcacaagguagacguaguagaguaaauaggacuaagacuuuggccaauugggccguuaaagaauuaaagaagcugaaggccguaaacaccgcggcugcugcuagcuga

SEQ ID NO: 5779 - RNA, 1503 nt, Diabrotica undecimpunctata
auggaaacaauuuuggaacaacagcgucguuaccaugaagaaaaagaacguuuaauugaugccaugguaaaagaaaugcuucacaaaaagacuacuuuuagagaagcuauaaacucagaccaccgacaaaaguaccuacuggauagauauauggcuucaacagagaggcuaauagaucuuuaugacgauagggacggacaacguaaggcugaaguagcugcacuuacgggccccaacgaguuucaagaauucuauaguagauuaaaauuaaucaaagacuuuuauagaaggcauccaaacgaaauuaguguuccuaugucaguggaauuugacgaauuugccaaagccagggaaaauccuaacgaagauauggcuaacuuuguagaauuuacugaugaggaggguuaugggaaguauuuggauuuacaugaauguuaugaaaaguauauaaacuuaaaaggcauagaaaagguagauuacauuaccuacuuggguauguuugaccaacuauaugauauuccaaaagaaagaaaaagcggugaauauaaaaaauauuuguuaugccuaauugaauauuugacuugguuuguacagcguauaaagccucuaaaggauuuagacauugaucuacaagaacaaguggagcagguucuggcaauuugggauacuggaagugucccaggguggccaaaagaaacaggaucugcacuaaccaauguuggggcccacuuggaucucucagcauuuucaaguugggaagaauuggcaucguuagguuuagacagacugaaaucugccuugauggcguuaggauuaaaauguggagguacuuuggaagaaagagcucaaagauuauucucaacaaaaggaaaagguuuuuuggauccuucacuuaugacaaaaaauaauaaaggcaaagccaacaaagaaaaggaauuauugaggcaaagagaacuugcaacauuagaagcccaaguguacagauuagcagagugggucucaccgcagagagcugcaaccaaagaaaaugugcaaaggaaacaagcucguaccgauggagaaagagaugacagcgaaaaugaagaaagugaugaugauaguccugacgaagcggacgaugauguuccuuauaacccaaagaaucuuccuuugggaugggauggaaaaccuauaccauacuggcuguauaaacuacacgguuuaaacaucagcuauaauugugagauauguggaaauuacguuuauaagggcccaaaagcauuccaaagacauuuugcagaauggagacacgcucacggaaugagaugucuugguauuccuaauacugcacauuuugcaaauguuacacagauugaagaugcacuggcacugugggaaaaguugaaaguccaaaaacaaagugaacguuggcaaccugaaacugaggaagaguaugaagauucucaaggcaauguggugaauagaaagacuuacgaggaucuuaagagacaaggguuauuauag

SEQ ID NO: 5780 - RNA, 639 nt, Diabrotica undecimpunctata
augacgauaggaaaaaauaauaaaaugguacaacacauaaacuucagaguucggguaacucugcaagacucucguacuuucauaggaacuuucaaagccuucgacaagcacaugaauaugauauuaggagacugugaagaguuucgaaaaauuaaaucaaaaauguccaaaguugaacgugaggaaaaacgaguauuaggauuuguuuuacugagaggagaaagcauaguuucuuugacaauagaagguccucccccuccagaagaagguuugcccagaguaccaauuccuggcgcagccccaggaccaggaauugguagagcuggagguagaggaaugccaccaggcauggcagguguacccguaggcuugcaaggaccuguaagaggagugggaggaccaucccaacagguuaugacaccaggagguagaggccaaguaucagcuccuccacaaaugaaucaaggaccaccaaggaugggaggaccaccgccagguaugaugggaccuccuccuggaaugaugggcauggccccccaaaugggaaugggacguggaggaccaccgccaaugggaaugaggggaccgccaccugguaugaugagagguggaccaccuggaccuccaagaccuuuuuaa

SEQ ID NO: 5781 - RNA, 942 nt, Diabrotica undecimpunctata
augcucuuccauuuuuuuuguaaugauguuccuguaauagauaaaauauuguuacuuuguugcagauauuuggcaaguggauguucuaugggugaauuacauuauucuuauaagauuggaaggucuacuguggcaggaauaauucaugaaguauguaaaguguuauggagagaacuaaaaacuguaguaauggaaauacccacagcagauaaauggagagaaauugcuaacggguuugagaaacacgcuaaguuuccuaacugcauuggcgcaaucgaugggaaacauauacgguuauuccaaccggcacagucugcuucacuauauuauaauuauaaacacuuuuucucacuacuacuacuagcauugugugaugcaaauuauuguuuuacauggguugauauuggugcauaugggaaaaauagcgacucgggaguauuucaagaaucuacauuguacagaaugcuuauggagaagacacugaacauuccugaaccaacggcaauaacagguggguccauugugcccuauguaauagugggugaugaagcuuuugcucugauggaaaauuuaaugaaaccauuugguggaaaauuacucacguacgaaaaaaaaauuuuuaauuaucguuuaacucuugcaagacgguauaucgaauguacauuugguaucaugugcaacaaauggcgaauauuacaucgaccguuagauguaaauauuaauuucgcugaagauauugugaaagcuauuugcguacuccacaauuauguuaggcaaagagaugguucuacguuugaagagacgcuuuauacagcaccgcuaacuaaucuacaacaauccuccacucgacgcacuggaagagugacagaaaauguacgaaauaaauuuaugcauuauuucguuaaugaaggcaaaguggacuggcaaaauagcaugauuuga

SEQ ID NO: 5782 - RNA, 15177 nt, Diabrotica undecimpunctata
uauuuuccagaacauuggccugggaagguuugugccuuuuguaauuuaggagaaaggagucaauugggacaaggggaaaugcuaagguugaacugcccggaagguuuuuuaccacacaaagucgcagcagaacaaauuuuagagaaagcuuuacaagcuccugacaaggauaggggagauaagaguccuaagggaccuguaaccuguagaaggcagaaggguuuuaauaaaugcaggcauccaucuaugaauagugaauauguugaugaacugacuauuauuggguauaaugaaguuagugacguaaccagucuauuugaacccaauggacaguucuauguucauaggagcugugcucuguggucucauggaguuacacgagcagaaaauucagcucugcuagauguggguccaguugucuuacaauguucuuccaaaaaguguucauuauguaaucauuauggagcuaguguaacauguaacuuggauucuuguaauaaaguuuuucauuuuccgugugcuaccgccgcuggugccuuucaggaaauuaugucgauuucuacuuucuguucuaaucauauaggacaaguugccaugcuuaaugaagcuacuccuuguuuuacaugccguacuaugggagauauaucaaacuuaauguacugcucaacaugcggggcccauuaucauggaaccuguguugguuuagcgcaguuaccagguguucgagcuggauggcagugucgaaaaugccgaugcugucaagucugucggacuguuggagaugagucaaaauuaaugucuugcgaacaaugugauaaaguguaccacgcaggaugucaaaggccgauuguuacuucuauuccaaaauauggauggaaguguagauguugcagagugugcggcgauuguggaucccgaacucccggagcuggcuugucuucaagguggcacgcccauuacacaguuugcgauuccugcuaccagcaaagaaauaaaggcuucucauguccucucugccauaaagcuuaccgagcgcaugcucauagggagaugguucaaugcucaaauuguaaaaaauuuguccaugggacgugcgacgcugaagcagauguugcuaccuaccaccaaaagaaagaucuuaacccugaauaugaauauguaugcuugcauugcaaaaauaguacugcuagacaaauaacugcaaaaagagcaaguauugaagauucaucggauguaccagcuucucaugaaucucuuuacgaugacaccucagaauuugaccugccuucuccagacgaauuugcccguagcauggguaugggcaaaggaaaaccguucgccagcaaaauugcgaaaaagcgcauuaacuuucccauugccgguaggccaaaagguacagguaaaguaccucccgguaaaauggguuuuaugaaacgaucucgauuaucggauuuuaauaggaaaaggggccauaaaucaaaaaugugcgguauuuucggcguaccugguguuggacuucaaagaccgacugccgauggaaaaagcgacgaagagccgggcguggagaauagauugguuuuauguucugccaaagauaaguauacguugacgcaagauauuugugucauguguggagcgcuuggaauggaccaagaaggauguuugaucaguugugugcagugcggacaguguuaccauccauacugcaucaaugucaaaauaacaaaaguuauauuggagaagggauggagauguuuggacuguacgauuugcgaagguuguggucagcgaaacgacgaagcucgccugauacucugcgaugacugugacguaucguuucauaucuacugcauggauccaccacucgacuacguuccucacggcaauuggaaaugcaaauggugugcgaugugucucaauuguggggcuaccgauccugguuuuaacugcaauuggaugaacagcucuacccaguguggcccaugcgcaucacaucucaauuguccuaguuguaacgagccguacggugauggagaauugauuauucagugcguucaaugugagagauggcuucaugguuccugugauuguauaaaaaacgaagacgaugccgaaaaaugcgcagaagacgguuacaacugcauccuuugucggccaagagauguaccaccgccccaccuuguaccgccgccgcccgcuccaaaaccaccaaccccuacgaagaguccugaagucgggaaaaguucgaguuuuuauuuggacgguguuuaccuaagugagauggggaacagcuuuauuaaaucauuagcuuuggaacaucauggcucgcgaaagaaacggaaaaaacuuccuaccgugcaggauaaagaagccgguauuauggcuacaauugaaucuguuauagcaggcggaaaugcugguggagcgacugcuuuagaagacagugcuaaacuagaauuggucgacgucaaagacgaaccucaagagcuauacaaagaaggcaugauuuggacaaaggaggauggucccgcaccugaagguuucacgguguuuaccauggagagcggaaucagcgucuuaaggcgcaagagacaacggaaucuacagaaacuaggcauaggugguuuucuagucagaaugagaggcauucgaaccggucaggauaacgaugaaaucgauuccucgguuauccagucuggcagugcuacaccuacggagcuccuaccucccaugccuguugauggagauaaaccaaaaagaaaaccgauuagaagaaaaccaaaaagcaagcuagccgaaacuuuuccggcguacuuacaagaagccuuuuucgguaaagaucuuuuagaaacuguugauuguaaaaaagaagucgacaguuguaguagcgacgacgaaaaaucugugaaguauaaauccaucaauuugucucaggaugaauugauggcuguagcugcagucucgggcaaaagugaaaagcaagcaauagcuaguauuaaagacucacugaaggauauuaaaucaucuccaaugauaaaggaagaagacgacgauaauacagaagacuuaaaagauguacuugccuuaccuggagauuuacuugaugcagaaauaguuaauaguauuauggaagacgaugacgagcuuacuaaaaauacagaaucacuggaaguuuuagauaccaaccuucaagaugauacugaguugacugacacauugggcagcuccggcaacucgaaagaaaccaaagaugaguugagugauauucuaggaccacauuuuaaucuggaaucgauuucuaauaucaacagcaaggauguagaagacauauuuaaggguguauugacugaugaaucacaggaaucacaagagagcagcaauuuugccauacaaggaaguaaucuuuuuuccaacaauacuccucagccaaguuuagcucagcauuccaugaugacuccugcuguucguccuaaaacguuacccaaugugagccaagucaauuuaaauucaccaguaggauuuccuccaccaucaccuuaccacucagaauauagcaacagcccucaguucaguccugcuuuuaccgagucuccuaacgccugggucggaguucccgaaacuccugaaauagacaguaccaacguaggaguuccuucaacguacaaucagcguuccucggaaaagaugaaagccgacgaaaguuugggcaacggugcuaccauuucugcaguucucuaugcuaauaugaaucauccagaauggaagaaagauuuuccgguuuggucugauagauacaagcaaauaaucaagaaauggaggacacuaagucaagaacagaaagcuccauaucuucaacaugcaagagauaauagaagccaauugagaaugaagaaggcccagcagucacagaccuccaaggaguccaccgcauccgcaucaacccccaacgugaccaagccaguccaugccgucccagcucuagugaccacccuccaggcaguaucgcagcagcccgugggggugacuacagcccccacggcucccauuacagaggaccaagaaaagauggcacugcaacagaaaucugccagggaagccgaacaagaaaggcaauggaaacagcuucaagcuaugagacagcagcagacgcagcaacaacagaauauuauacacgaacaacguguucaggccaucgcgagaguccagcgacaaauauccguggauccagcucaacaguuuuugucggaacaacaaagucccuugcaaccaaguacgccucaggagcuuaguccgucugcuacaccaacaccaagcccaagacaguucauaggaaugaaauccccgaccuuuccucuuccuucaccaguggcucagacagcaauuagaccuccuacacccucucauucuccacaugauguaagucaggcaagcaccccugacgguaaugaucacuuuauucaaucaccuucuacuccuaaaccuaauuuuccuacuagauuaccuacagaucaauuuauccaccaaccugcaacuccuaggccccaguuuggaauacaacggccgccuuuacagaacuuugguaauacgaugaggacagaucagcaggauauuaauaucaaccggcaguuacgagaucuucuccagcgacaacaggugaaaaaauuggaugaacuguuaccagguaaaguucaacaacaaagaguguggccuccaauugaacaacaagaaaaugaggccucagcaacuacugguacuucggcaguuguggcuacaacagcagauaccacuuucaggcaaccauuaccgcccagcauugugcgaccuagaguggcucucucuuuagcuggucgagcagguccugguacuauuaggguuggccaguuagaugcccgaaugcaaggccuggauccuagaaugagauuaauuuugcaacagcaaguuggccaacaacgauuaucuacgggaauucagcaucaauucguacgguuuaccucgacaccagcucgccccgcgaccuuggaucaauaugaacaacuacuccacagacccacugcuacucagauccgagcaccugaucagcaaaacgcaccucgaaugacuuuaaaucaagcuagcgucauucaaagaccgcaaaugguacaaccuacucaaaguacuccugcaacuagugcugcugauaguaaucccagugaagaagguauucccgauaauguuacugcugaacuggaaaagcuugaacaagaaacagguacuaugguagaguuacaaggugucagugagauccucggagggcugggagaugacgacgaugaacuuuuagcugaaaugggugccgauuucaauauccuagaguaugccgaucccgagcuggaagcuuuaacaggcggcaaaacaaauauauuagaucuggaacucgaagaagaaccagugaagaaagagaaaauaguauccagugcagaaaaccaaccgacuaaucaaacaguaaacgcuauuucgagcccugugaaaccuaaacaugaagaaccaguugaaacgccugcuccaaaaccagagcccgcuucucuaccgccgccgccuccuccuuuggcauugccacaacaacagccugcgccuguccaacauacaccaccugucgcuauucaacaaccaacuccacauccuccgcaaguacaaccaacaaugcacuugacgccccaacagauucaucaacagaugguacaucagguucaacaggcagcagcucaaggcagacccaugccaccggggucaaagaugcaaacgccugauggauuuauugguauuguaaugccuaauaauagcgugcaacuacagauaccucaaaacuaucaacaaaggcuauuacucuuacaacaacuucaaaaucagaaacuucaaaugcgcguaggcacuacaacuccacgaguagcggugguggcacagagucagcuaccagucgguuuggcgaccggccccagaaugguugcggcaccaccgcccccaccaccuccgccguacccagguccaccgccgccguauccaggaaacgcggcucaacaucaacaggaacaaccccuuuugcuggaggaccugcucgaacaagagaaacgggaacaagagaaguugcagaaucaaccuucuagucaagaagugucuucaucaacuggaaacgaaagugaaucagcguugcucagcgaccacgauuucgagagacuaaaggcagacguauucaauaccgggccugucaccaguuuaccgucaacaaauaaucaaggaacugcuagucauacaaaccaaccauggcaacaguuacaaaaucgacaaaucccugccccgccugcccaacccacuuuggagguuacaaccagggugcaaauguuuaacgccaaucuaauugcugcgcccccauugcccccggaaaauauuguuacggaacaagacaagcagacucagaugauguaugaacagugguugaaucaucagaauaauguucuagcccaacaguugcgcuacuacgagacugaagugcagaaacuuaggaagagcagaaagucacugaauagcaaacagagacaguugaaaaaaucugguaaccagcuaacugacacggaugcagccgaacuccagagaauaucagcagaacaagccauuuuacagaaacaucuagaaucgagcagaaaacagagucgacaacacggcauguuaauacaggaauacagaaacaaacauccugcaccgaagcagcggguagagcaaauucaaucgccuuuaggaccaccgucgucgucuccuuugcaacacccaaguacgucgcagucgcccaugcugucaccaucuuuaucgccucugacacagcauaauucuccucugaauaguccgggaccgcuuauuucaucgucgccaggaucuguaucgguucaaaacauuuugcagagccccaacaguaugccuacgaacagcaugucaccuuuacaauccuccucgaugcaagccucaccuaugcagcagagccccaugcagccgucucccaggauaggaacaccgcauucucaaagugaagagagccccggaucggcgcaguccccaucucaaguaugccuuccuccaccaaugccaagaaugacaaguccucaacacagaagaguagugacuaguccgguugguaugacgcagaugagauucguaagcaaucaaguacuucaacagcgaguacgaaugcaaucgcccauacaaaacuuucagcagaaaccugcuacaccauccccgcuaaauagcccuacaucgcaaacgaugaauguaagccaacagcuucaguuacauaaacuucaacagcaacaaagcaugcuacaacaacagagucuagaugguaaucaaggugaccccaauauuauccauucacagcgaacuacucaacuuuuacaacauagaaauuuuauucgacaacagguugcucagcaacagcaacaacagauaggucagccucagccuuuaacgccucaacaacaccaaaugaugcuccaacagcaaaagcaguuagcucaacaacagcagcaacaaauagcgcagaugaacgcagcuagguuacagcaacaaaauaaucccccucauucaccaaugcccccaaaaaguccuaugauuaaucaacaaauuaugucaccacauucuaugcccccuucuccuaugcaaaugccaccaaagagccccauggugucuuuuagcucuucuaaucaaccaaaucccaacuccccugccgcaagaagcccugcuuuucaccaaggauuaagucaaacuccaaccaguccuaugacucaucagccaccguccccaaugccuagaaguccaaugguuaaucaaacacagucgccacauaguaugagaagaccaccgagcgcuaauaguagcccugcuaugccagauaggccacuuaguguugaaaauccuucaccaagaaugucuuacucaaucgaccauuuaaugcaagauacuuuacacagucaaaguagccauaauucaaugcaguuuacugauaauuucaccacugauaugaauauucaaaauaguauuagagaaaauaugcaaaguggaggagggaaucccaauaauccauguaauccaauaccuuuaccaccugaauauccuagauuuagauauuuuaaacuagguuugcgaggugguacgccaauguggggguuuggaagaggggcaaaacggauaccuacucccccaaaugcuccaaauaaaccggaagaaaaauuaguaaaccaagacaguaugauguuacaaaagaugaaaaaggagccccauuuaagcaaaguuucucuucuuaaaagaaagguuggagcuggaaguggaaaaauuggcucucuugugaguacagauuacaaugauauggacgauaguucauccacgccuccuauaacuccuccauuagcuacuacaagucgaggaggcauaccaaaaacauugcccaaaaaaauuuuggaaaaucaaagcagcaaagauuccguuauugucaugcacagcccagaagacaaacaacuugauaugauggauuuugacgaugauacuaauacuguuuuaucagcggaagugucucuaaguucugcagcucaaaaugacgaagauauguuagaaauggagacacuaucacaacaagauuuagcugaaggauuaucuagucccuuagaacccgaucaaauagcagaugaauauuuacuauuuccuggcaauaugguaguugacaugucugcuggggaacauuuuuccgagaaagaggaggaggaagaaaccguagaugaagaauuuaaugaugaaaacaugcauaucaugauucguaguccuacaaccagugacuaugaauacauaaugcaaaguaaggguaagaaauauaauguagguguucaugaugaaaaugaugacaugcccgaaucuccggaucaggaagacuuagccguaccgucaccugaaguuucagacuuguugacaaauuacgaugaaaaugauguuuuaaugggugaucaaaguaacagcacacccgaagaaucaauuucuaccaaagaagacuucgaagaguugauugaugaagguucacguaagaauagcauaacgaagucagaaguaacaacuaagcaaauaaaugaauuucauaaauacgcgggaauauuuaauuauuccaaaggaguuguucaagcgacucagaaucagacagcuuuaaauaaaauuacgagcguggcuaacaaaaaagcaccugcaaaaauaucacucguagccgguccaauuguacauaaucuaucaaccgggaagguaaauccugaaaaauuaauaaucacucaaaauccaaauauuuuaaauacuucacaagccgcuaaaguuacgaguauuauucuuacccauaauucugcgguacggagaaauguccuuaauguaccaaagauuguaaguaccguaucuccagcuauuacuauaguaaaugccaccacaucucaaauggcuucuauacuaccgucgaaauucacaguaccugugauaagugccagugcugugcgacaacuuuccaacguaaaagugaucgauaaaccaucuucaucgucacugucuaucucuacacgugacaauguuuuaccuaaaaagauauucgaagacgauuccgugucaccugacaguucuaauugcgaggaugauaaaucaaaagauucauucgacgaaaaaggaaaauuggaaucuccuucgcgagaaauaaaaccuuuauuaaaaacagacgcaucuucgucgaauacaaucaucgcaagaaguuuagaauauaaaacacacgaucaccaaaagaaagcugaacaccuucaggucaugaauauaauacaaaaacagagaauaccuaguccgcuaaugccaaagucugcuucgccugugauuauacacaauacucccgaauugaagaugacugcacaaguuauucaagaaacacaaacucguaugaagaugacagccacuacggaaacuuuggacgcauaugacgguucaguagacgauacuaagucuguuguaauaucgauucccucuccuacuccaucucaagaacaaauguuggacaauaucgcuuaccaggcuuuggaaaauaggagaagagaauuugauucuaucgaagauguauuagauaugauagaaaauaucaccgcugaaccgccugcuauuuuagaagaaaauguaccuguacaaaauccuaaaaagaauacaaauacugaaacuaaagaaaaggauauugacaaaccaaaaccagaaauagcaaauauaccaguaaguacuaaaucuucugcagugccacaacuuucgccauugucgcaaccaacagauuuaacuaugaacauggcaaacgcuucccagcaacuaagaucauuguugucuucacugcaaacuacuucaacgucuucaccaacuaauguagaaucaguaguuaaaaauuucggccacaaaauuagcaguagcgcuucuccuacugccacccaaccuauuguugcgucuagaguuauacagcaggcugguagacaaucaccaguuguaacaacagugaacacuguaaucguaccgaauuuaaaacaaaaaguuacaguuaccucggcaagcaguucuagaaauaguccaguaaaaacucaaguugugaccacucagcauauaccaucuucggcuauuauuacaucaacaauaaacuauauaccaaauagaacaauugcuaguaugcaaguuaugacagaacaucuuaaauuaucaucugguaguaugucuauaacaacuccuucaguuuccacucagcaagcaauugcuaaaacuacaagucauaaugaaaguaagaaaccuucauuaacauuaacggcuaugcugcaaaaucaaccugcugcuaauaugauuacuaaaucuucggcggauacaauuacugcagccagccugcuuggaucaccuauuaguuuaccuaaaacugguuuuucaacuuccuuaguacaagcgcaaccuacuguugucguucccguuauaacuacuucaaugauagcauuacaaacucagccaucuauuguuucuacuguaaaaaguucaccgaugaaaacaauugcagauacuauaacggccgcaagucuuuuaaguucgaguucuguuaacauuguaaaaaccgguauuacagcugcuuuauuacaagcucaaccgaauccaacucuuagcucuuuaucuacugcaacaccucuaacgcaaaccucuaauaauauuauaaccagcucgacccacagaguuccuacuucuacuacaaaucuuuuacacacccagcuaaccaaaguagugaggaguaaaucaguugacgauaucaaagagauaaaacaagaagagauaaaaacggaaauuauggauaccggugucgaugacaauaaauuuucacuuauuucaccuaguggcuguaaaaugucaacaauucagaauccaauauuaaauaaaggggaugauucgcaaaauguuuugcugaaaaagcugcuacaaaauacugcuugugcuaguacacagucaccaccuccuacuacagcaagcacuaucacaacuauuugucccacaccuaaacuucccauucgagaaacaucuuuuguuucuagcccgaacguagaacuaccaguaucucaaccgaguguugcugcuguuguuccuacucagccuuugcaauuggagauuaaaaaauguuuacccccuaguagaaguucuaguagagaugaacuguuaucuccccaaacucccagaucuucuaccaauagucaagauucuaguuuacaaacuccuccaauaauaaagaaagaaauaaugucuguaccaccaccucagccaaguccaauucacacaacacaugaagucaaaaaggaacuuauggaugagucuucgcaacauucugagguuucugauuacagccgaccagauauucccauaaaagaagaaacagaaauggcugauauugcaauagaaaagccagugcuugauaaagaagaguuaaagaaacaaaagaggcggauguaucaacagaaaaggcggcagaaucaaauacuuaauaaagaauuggcugggcaaccuaagaaacgaccaagaaaaaauucaaaaauagaagaagacuacgauacuuauauagauggaguguuggcucaauuaagacaguuaccuggaauuacaguaucugaaccgguauuaaaucgcaaccaugguauagugucacuuuucgggucuggagauauguccaaacuuggaacaaaaggauacucuacccaguuuggggauuuagucgggaaguauggcuaugcugaacugccaggcuauucagauuuuuauuccaccaaaccuuauggagaucuggauccuauaccggaaaaaccucccucuucaacccaaagagguuucuacgaucaagaauucccauugauacgguuugacacagacgaucauaagaaauucgacauguucuguagagaagauacuccagauucaauacucaguaguucaucuccggaauguguccaauuagauccacaguguagauuuaugggauuaaaacuuauuagcgauagcgaaagcgaggacgaggacaaugaaauagaaagggaaauacagcaagcuagagauagacugucgccgauaguaccuaugaucaaaccaguaccaauuagauugaaaccaguuggaggauugcuuguuaaagaaacucccagugauaacaaagaaaacaucaauacagauagucuuaacguaaugacaaagaucaaaucugaaaacaaaccgucgauaccgacgaaagauucaggacauguuaccgugacauuaacauuaacuucaucugcugcugaagacauaauggguguacuaagggacuuggcaaacauucuacaaauuccagcuccuacgaguuaucaaauaguggaaaggacaacaaccccucccagucagaaacucgggcucuaccggaccaagggcaaggaugguaaagagggagcgccaauagacauucaaaguauucuuaauggggcuaccaaguucuguaaacacugugauguaauuauuuuaagcaauuugauaaggagaaagguuuccgaccuuccuuucuuggccaaagacucagaacuuuuaagcgacggagaggaacuauucuucugcagcucgacuugcuacaugcaguuugcccuaaugcauagaucaccuucuauuuccgaagauaaggccgccgaaauaaucaaccauuuaucucagaaggauaacgagaguaaacaaaaaaugcagaugauggaaccauuugacaauaaaucauuaauagcucaaagacucucguucacaaaucgcgagaugaagaaagaauaugaaccaauggauaccagcgauuacuauuccuacuugcauaauaaugcagagaauaaaccgaaucgauuuuaugacggugcuuacagaccgaugccgguuagcagaauuuacaaaaacaucaaguauaaggcuuggucgccuggauguuuacaaccgaaucagaaacauaagauaccuacggauaaagaaaucauggaacuguuguauagaaugcaaauaaccgucaugccgccaguuaugccggaugacacaagaaagugcauguuuugucaggguguuggugaugggguagcugauggcacggcaagauuacuuaacuuugaaguugauaaauggguucacuuaaauugcggucuuuggucugacgggguauacgaaacggugaauggggcguuaaugaauuuggagaaugcuuuacaaacuagcuuaacgacgaacugcguacauugcaauauguuaggugcuacuauaagaugcuucaaaacgagauguuccaguguauaucaucugaauugugcaguuaaagacaauuguguauuuuucaagaacaaaacuguuuauugcauagcgcauguuccuaagaacgaaaaggacaacgaguugacgacgcucucuguaucuagaagaguuuauguuaauagagaugaaaacaggcaggucgcugcugugaugcaccacucagacacugacgaucuauuaagaguugguagccucauauuccuaaauguaggucaacuauuaccacaccagcuacaaaauuuccacacuuccaacuacauauauccaauaggcuacaagauaauaagguucuauuggaguaugaaaucuuuaaacaaacggugcaaauacaucugcucuauccacgaacaauauggaaaaccugaguuuagggucauuguucaagaaccuccagaggacgauauagaguuuauagauccuacucccaaaggugcuuggcaaaggauccuugaccaaaucgccuuccuucgcaaggagaacgaauguuugcagauguucccuaaauuuacgacuggagaagaucuuuuuggucucacugaacccgcaauaguaagaguacuugaaagucugccagguauagagaccuuacccgauuauaaauucaaauauggucguaacccuuuauuggaacuuccuuuggcgauaaaucccucaggauguuguaggacugaaucgaggucgagaauucaguugcauuggaaaaaacaucacacucaacggacuacuuugucuacagcucggccuuuguuugguccuucgccuucagguccaacuccaaguacuccaacguugggugagcugucguguccuuacagcaaacaguuuguucauucgaagagcucgcaguacaaaaagaugaagcaggaauggaagaauaauguauaucuugcuagaucgaaaauucaaggauugggucuauaugcugcuagagacuuagaaaaacacacuaugguuauugaauauauuggggaaauuauaagaaccgaacuggcugaaugcagagaaaaacaauaugaagcaaaaaaucgagguauauacauguuuagacuagaugaaaacagagugguggacgcuacguugagugguggcuuagcgagauauauaaaucacucuuguaaucccaauuguguagcugaaaccguggaaguagaacgugacguaaaaauuauuauuuucuccaagagaagaauuaugagaggagaggagcuggcuuaugauuacaaauucgaauucgaagacgaccaaaacaagauuuccugcauguguggcgcuccgaacugccgcaaauggaugaacuaa

SEQ ID NO: 5783 - RNA, 1272 nt, Diabrotica barberi
guagaugcuguugaaaugcaugaaccuuacacauaccuaaacgguuuacauaucaaagauuuagaagaucuaguagaggauauuaaggucuauaaagaguuagaaagggggaaaaauuuggauuauuggaaugauauaacuguaauaguggaagaugaguugcagaagcuuaggaagcuggaaaaacagaaugauuuugauuuagguuugaauagaagagaagguauacaucagucaguagcuggagauguuacuuccguauuuaaagguaaaaccgcuguccaguuagcagcuuuagagaagcaaauagagggaaaaauuagcggcaaagcugaugguauugauauagguuacugggaaucccuguuaucacaacuuaaggcacacauggcuagagcaagacuacgagauagacaucaagaaagcuugagaagaaaacuucaaguuuugaaagccgaacaagccaucauuguaacagcuccaagcgaaagucauuccaguggaggcgaggaagcuccaacgaaagauguacaagaaccaaagccuggaccuucucaggaaccugaugauaagcaaaaugaugaggaggaaccugcagaugaggaagcagcuaauucauggcuaaaugaguguuuugaugccuaugaagcugguggauauagucccaaguuucuuacuccagaugaaauagagccgggaacaauuguugugauagaagaagaugauuugaaaagauuggaauuugcaagaauucagguuguugguaaagguaaaacuguggaaaauguuauaacgaaggaagaguugaugcuacaaaaagaggcucguaaaggcauggauggagacgaggcacaguucucuguagagcaagcuuuggacagccaagucuaucuuuggucugacaaauaccguccuaggaaacccagguacuuuaauagaguacacacuggauucgaauggaacaaauacaaucaaacacauuaugauauggacaaucccccuccuaaaaucguucagggauacaaguucaacauauucuauccugauuuaauagacaaaaguaguaccccagaguauuuucucacuccuugcccagaaaauaaagaauuugccauauugagauuucaugcugggccuccguacgaagauauugcuuucaaaauugucaauagagagugggaguauucguauaaaagaggauuuaggugccaguuucacaauaacaucuuccaacugugguuccacuuuaaaagauauagguauaggagauaa

SEQ ID NO: 5784 - RNA, 1263 nt, Diabrotica barberi
auggacaaccuagaaaccaauauuauggauaagucgaugagaucagucuucguggggaauauuccauaugaagcaacugaggaaaaauugaaagauauauuuggcgaaguuggacaaguacuaucuuuuaagcuuguauuugaucgugaaaccggaaaacccaagggauaugguuucugugaauacagagaccaagaaaccgccuugagcgcaaugaggaauuuaaacgguuaugaaauaggcggaagaaauuuaagaguggacaaugcuuguacagaaaaaucuagaauggaaaugcaaaaucuccucaaccaaccuccaguagaaaaucccuauggagaggcaguucaagcugaaaaggcuccugaggcuauaaguaaggccguugcaucucuaccuccugaacaaauguuugaauugaugaagcaaaugaagacaacuauucagaauaauccaacagaagcaaggcagaugcuuuuacagaauccgcagcuugccuaugcucuuuuacaagcucaaguuguaaugaaaauuauugacgcagcuacugcaguuaguuuacuucauccugugaaccaaguaccagcgacacuuaugccuggagacaagaauguuccuguccaaguaccaguuaauaaucaguacagggagcccccagcaccuguucaaccgccuguccauccaagacaagacuuccaaccuguuccuccuccuguuaugcauccaucucaaaaucaaguauuuccaagucaagauauagaucugagauccauugguggugugccagaucuaagaaaccuaagacccaugggugaccaggauaugagacaaaugccaucugcuauucaaaaucccuuaccaccuacuaucggagaaagcuuuauucgagauccuagagcagcacaggcguuugcaggagauccaaggcaagcacgcauggacccacgucaaaaacccauggugccuccuccucaaggccaaaugcccauaccaccuccaaucgcaagaccaccuguaaugccgccucagccucaaguuccugugacgagagcagcaccucuaccucaaccgucuccagcuccuacuccugcaacggccaguccaaauguugcaaaugccggggcuucggaucaagaaaaggccgcacucauuaugcaaguauugcagcugucagaugaacagaucucuaugcuuccaccugaacagaggaauaguauuuugguauuaaaggagcaaauugcaaaaagugcacacacacguuaa

SEQ ID NO: 5785 - RNA, 999 nt, Diabrotica barberi
augacccaaauggaccccgaacgugaaaaaagccuucaagaguacaggaaaaaauuauuagaacacaaagaaguugaaucuagauuaaaagagaugcgagagcagcuaaaagaucuuacaaaacaauaugauaaaucagaaaaugaucuuaaggcuuuacagagcaugggccaaauaguuggagaaguacucaaacaacucacugaagaaaaauuuauaguuaaagcuaccaacgguccccguuaugugguaggaugucgucgucaacuggacaaggcaaaguuaaaagcaggaacuagaguagcauuggauaugacuacauuaacuauuaugagguauuugccuagagaaguggacccauugguguauaauaugagucacgaagaucccggagauguuacuuauucugcuauuggugguuuaucugaacagauuagagaacuucgagagguuauugaacugccuuuguugaauccagaauuguuuaugagaguuggaaucacuccaccuaaagguuguuuguuguaugguccuccagguacuggcaaaacucuacuagcuagagcuguggcgucucaguuagaugcaaacuuccucaaagucguuuccagugcuaucguugauaaauauauuggagaaucugcaagacugaucagagaaauguuuaacuaugcuaaagaccaucaaccuuguauuauuuucauggaugaaauugaugcuauuggugguagaagauuuucugaggguacuucagcugauagggaaauccaaaggacucuuauggaacugcuuaaccaaauggaugguuuugauucauuaggacagguaaaaaugauuauggcaaccaacagacccgauacucuagauccugcucugcuccguccuggucguuuggacagaaaaaucgagauaccucuuccaaaugagcaagcccgucuugaaauuuugaagauccaugcccucccgaucgcuaaacauggagaaaucgauuaugaagcc

SEQ ID NO: 5786 - RNA, 777 nt, Diabrotica barberi
auggcucgucgauaugauaccagaacuacaauauuuucuccugaagggagguuguaucagguggaguaugccauggaggcuauuucucaugcagguacuugccugggcauuuuagcaaaugauggcauuuuguuggcugcugagaggcguaacacuaacaaauuauuagaugagguuuuuauuucagaaaaaauauacaaacucaaugaugauaugguuuguaguguggcuggaauuacaucagaugcuaauguuuuaacaaaugaauugagacuuauaggucaaagauauuuauuucaguaugccgaaucuauuccuugcgaacaguuaguuuccuggcuuugugaugucaagcaggcauacacucaguauggagguaaacguccauuugguguuucaauauuauauaugggaugggauaagcauuauggauaccagcuauaucagucagaucccaguggcaacuauucugguuggaaagcuaccugcauaggcaacaacaguucagcagcaauuucaaguuugaaacaagaauauaaagaaggucaaaugacuuugaaggaugcaaagacguuagcaguaaagguucuggcaaaaacauuggauauggcaaaacuaacuucagaaaaaguggaaauggcuacacuuacccgcaaaaaugauaaaaccaugaucaaaauuuuaagcggcaaggaaguagaagaacugauuucagaguaugaaaaaagugaagcugcugcagaagcuagcaaaaaagagcagaaggcaucagcuuaa

SEQ ID NO: 5787 - RNA, 2739 nt, Diabrotica barberi
augggcgauacaaagguagaaccuacaaaggucgauaaagcaaaggggacggaggacaaaaacaaaaaugaacugucggaagaagacaaacagcuucaagaugaauuaaauuuguguguugagaaacuccaggauaacgaugaaaagagauaccuaccugcuuugcaagcuuuaucaaaucauauucaagccucaacuacuucgaugacuucuguuccuaagccguuaaaauuuaugaggccccauuacgaaaccaugaagacaguacaugaaaaaauuacugauccugauacuaaaaaagucugugcagauauuauaucuguuuuagcuaugacaaugggagaaggcagagaauguuugaaauaccgucuucuuucuaauuuggauaaaauuggcgaauggggacaugaauauguuaggcauuuggcaggagagauugcaggagaaugggccgagacugauuuuauagugaacacugaaauuagggaaaaacuuaucuuacuaacaaaacaaauugugccauauaauauggcacacaaugcagaagcagaagcaugugacuugcuuauggaaauugaaaggcuugaucuacuagaacaguauguugaugaaaacauauaccauagaguguguuuauaucucaccagcuguguacccuauguagcagauccugagaauacuacucuacugcagacugcucuuuuacuguuuagaaaguuugaucaguauccccaggcacugagauuagcaaugcaguuaaaugacuuuggauuaauugaagaaauuuuugucaacugcccugauucggacguacaaaaacaacuggcuuuuauguuaggacgacaacagauauauguugaaauuccugagcauacgccugaauacgaagaucuaaucgagauaauggcaaacugucaucuuaauaaccacuucuugaaccuagcccgcgaguuggacauuauggauccuaagaccccagaagauguuuacaaaucccauuuagaaaauagccgucccccauucgguggaaaccaaguugauuccgccagacaaaaucuagccgccagcuuuguuaacgguuuuguuaaugcagcuuuuggucaagauaagcucuuaauggaggaugggaauaaauggcuuuacaaaaacaaagaacauggaaugcuuagugcuacugcuucuuugggacuaauucuuuuaugggauguagacgguggucuuacuccuaucgauaaauacuuguacucuucugaggaccauaucaagucuggcgcuuuauuagcuuguggcauuguaaacugcgguguaagaaaugaaugugaucccgcacucgcacuuuugagugauuauguucuucacaacacaaauauaaugagaauaggggcuauuguaggucuagguuuagcguauguugguucaaauagggaagcaguauuaucucuaaucacaccugugcuaucugacccuaaaucaaauauggaggucauuggaauggcggcucuagcaugcggaaugauuucugcaggaucugguaauucacaugugacaacaucaauaaugcaaguucuuauggaaaaguccgaaauagaauuaaaggacacuuacgccagauuuuugccucugggucuuggauugugucauuuagguaaacaagaaagcauugauacaauuauagcagcauuagaaguuauaccugacccuuucagauccauggcaacuacuauggucgauauuugcgcuuaugcaggcacaggaaauguuuuaaaaguucaacauuuguuacauauauguucagaacauuacgaugcuccugagacuccugacaaaacuucaaaggacaaagauaaaaaggaaacagagaaagaaaaagauaaagaucuuucagcuagacaagcucuguuccaaccuccugacaaaacuucaaaggacaaagauaaaaaggaaacagagaaagaaaaagauaaagaucuuucagcuagacaagcuauugcuguuuuggguauagccuuaauuagcaugggagaagacauugguagcgagauggcuuuccgaacauuuggucauuuacuaagauacugcgaaccagccaucagacgcgcuguaccauuggcucuaggcuuaaucucaguuucaaaucccaaauuaaguauucucgauacuuugaguaaauuuucacaugauagcgaugcugaaguggcccacaaugccaucuuugcgaugggucuggugggagcugguacuaacaaugcaagguuagcagcuaugcuaagacaguuagcacaguaccaugccaaagaucccaauaauuuauuuaugguucguauugcucagggucucacucaucuugguaaaggaacuuuaacccucaguccauuccacagugauaggcagcugaugaguccaguagcuguagcuggucuaauggcgacacucaucggcuucuuggauguuaaaaacauuauauuggggaagucccacuaccucuuguacaccuuagcagcugcaaugcaaccaaggauguuagugacauuugacgaugagcuaaauccucuaccagugccugucagaguuggauuggcaguggauguuguuggccaagcaggaaaaccaaagacuauaacagguuuccaaacccauaccacuccugugcuucuggcuuauggugagcgagcugagcucgcaacugaagaauacauugcauugacgccaauuauggaaggauuuguuauuuuacgaaag

SEQ ID NO: 5788 - RNA, 861 nt, Diabrotica barberi
gguagugauuacgaagggggcacuauguuuaaugguaacuuugaaggcacguacgggacugcguaugcccacgguauucaugggggcucguauucgcccucgaacaagcagcauuuaggggucaauggggcgcaaggcguucagucgcccaauaagccacggaauaaaucuagaacuagcgccgaggguagagagugcgucaacugcggggcgacaaguacuccacuguggagaagggacggcacuggucauuaucuaugcaaugcauguggacuuuauuacaagaugaauggacaaaacaggccacucaucaaacccaaaagaagacugaguuuacaaagugcggcgaggcgagcaggaacgaguugcgcgaacuguaaaaccacaacuacgacccucuggaggcgcaaucagaacggggagccugucuguaacgccugcggacucuacuauaaacuacacaacguuaacaggccauugacgaugaaaaaggaaggcauucaaacucgcaacagaaaacuuucuucaaagaguaaaaagaaaaaaucgggugcaucgugucugucuuugggcggcaugaugggugacaugaugaagccuuuagauagcaaaggugccuucgguggaggcuucggcgcagguauggguggcggacauccgcaucuuaacgcugcucuucauccucaccacgcuaugacacauuggcaucaguaucagcauacccaaggguucguuucagguccaccuccacccgccccaccauccgcagcuucguaucaccaucauaugaguucguuaagcgcugcuggguuaggauugacgucaaacggaaugacaaguuggagaucagaauacacguga

SEQ ID NO: 5789 - RNA, 5010 nt, Diabrotica barberi
auggcacuuccagggaacgggauauuugucgucaaaggagaaaucuccaacaugauggcggcuaugaaaagaggaacaagguggucgucucauucuuaucaggacgaugauguagauuccuuacuaagaaacuuucaagaacuaagagauauucuagacaauguagacgacuuaagauucguagaacccaacacauucuuggcccccuuuuugaaugucauaagguccgaagaaaccacugggcccgugaccagucucgcccuaucagcuguuaauaaguuuuuguccuauggauuacuggaucccuugcaugcaucuaucccucaaaccauccacaguauagcagaugcagucacccaugcccguuucguuggaacagaucagucgucagauggaguaguucucauaaggauauugcaaguccuaagaacucuaacauuaucuccagaagguaccgccuuaacuaaugaaagccucugugagauaaugcugucauguuuucgaauaugcuuugaaacaaggcuugucgaccuauugagaaaaacugccgaacacuauuuaaaagaaauggugcaauuaauuuuuaugagguugccgcaguuuagugaggaucucaaaguuucuuacauuaaacaguugaagaugaaaccuggagcuuuagaucaaacacgaacuaagaggaaaaagcaguauucuucacuuaaaaaagauaagagugacacagacauuaagucuccccaaaccccacaagguaaucuugcagcaguagcacaaaguaguauaguagauaugcaagguuccuugcaaaauccugaaaacgcuaacccuguaaccccaaaugcuaguccaaaagaaaacuucaagugugauguagauaucguuguugauaguccuguuaguaauaaugaagaucuaaaaaauaucgauucuauaucgucugguguagaagaggcagcaacagaaccuaaaucacuuacugaagaagaaauuacagaagaacagagucagaguacucaagauuacauaaaucagagaggcauaagguuuacuccacaauugcagcaagaagcuaacuugucacccuaugguuuggcauguguaagagaauuacugagauuuuuaauaagccuuuguaacccucuugauaaacaaaauacagaaaucaugauccauuuagguuuaacucuuuuaacaguggcauuugaaauaagugcugauaauauugguaaauauaacacuuugcuagcuuuaguaaaggaugauuuauguagaaaucuauuuucucuuaugaacacugaaagacuagcaauauuuucauuggauuuacaagugucuuuuuuauuauuugaaucauugaggacacaucuuaaauaccaauuagaacacuaucuaaagaaauuaauagaaaucauucucagcgauucuccaaaagugaccuacgaacacaaggaaauagcauuagauaaucugcuucaacuguggcgaauaccaggguuucauacugaacuauauauuaauuacgacugcgauauguacugugcgaaucuguacgaggaauuaacuaaauuguuagcuaaacauucaauaucuucuaauacuggaguguaccauacacauuuguuaucuuuggaugcacuuaugauaaucacugaagggauugaaaaccgguguugcgaagaaaaagauagguuagacgcaggaaauagcgaauugguucaacaaucaaaugacauuagcuucuaugucggaaaaaauucuaggacuaaaguuucuccaaucaugccaaagaaggaggaauuagcucaaaagaaaaguauuaagaaguggcuaccgcaagguacugaauacuucaacaaaaagccaaaaaagggcauagaauuucuucaagaacacggaguauuaaaacaggauauugauuuggacgaaaucgcuagauuuuuaagggaaaauccaguucuaaacaaggcuaugauuggugaauauauaaguaaucgaaguaauuugaaaauucugcaauccuucguugauacuuuuaauuuugucggagugcguaucgaugaagcuuugagagcuuuucuagagacuuuuagauuaccaggugaggcacccacaaucucccugaucuuggaacauuucgcagaaaccuggcauaaagccaacaacgaaccuuucgcagauguggauucggccuucacuuuagccuaugcgauaauaaugcucaacgucgaccaacauaacgaaaaugccaaaaaacaaacgacucccaugucggcuaaugcuuucaagaaaaauuugaaaggcguuaacggagguaacgauuuugacgaagaaauguuagaugauauauauacaacaauaaaaaacgaagaaauaguuaugcccgccgaacaagcuggguuaguuagggaaaauuauuucuggaagaucuugcuuagaaagggacagacgaaagauggcaucuacauccaugauaauagugguacuuacgauucugagcuuuuccagauuguuuauggaccuauaguagcagcucugucuucuguuuacgagaaggcugaaaacgaaaguguacauaaaaaagucaugcaaggauucgaaagaugcgccuuuauugcugcaaaucucaauauaucuacaaauuuagauaugcucauucuaggcauuuguaaauucacuguguucuacaaucagcagaaacagaacaacauuguggugcaauuuggaaugaacagcaaggcucaguuggcacuuaggacgguauuuucucuaauucaucaacacggaaacaccaugagggagggauggaaacauuuauuugaucucuuguuagcacucuauagcaacggacuguugucaaaaacauuuguagagguagaagacuuuauugaaccaaguggcaaauuaaugcuagucuacaaggaagcaccaucugcggcgaagcaggauaccgguuuacugaguucucuuuacucauacaugguuuccgcggaaaauuuaucaaaaauaccgaccccagaagagcaaaacuguauagaugccgcuaaagaaugcauaaaagacuguaaucuagagcaaaugauaaccgacuccaaguuucuccacgaagaagcucuguuugaacucguaaaaaccuuaauagaguuaucuagagggccggauguacacgaaagcguggcuuaugacuacaaugauaacguuaccguguucuucuuggaguuauugaucaaaguuguuauacaaaauagagauagagugaugaccguauggcagaaugugcgggaucauauauacacuuugguuaugaaugcgucuguuuucgauuuccaguucuuguuggagagaucuguuauuggucuauuacguauugcuauccgucugaugagaaaugaagaaaugagucauauaguucuucaguccuuaagaaugcuacugcuuuuaaaaagcaguacccuuucuaggauaucccggcaaauaucauuugguuuauacgagcuucugaaaacguccgcacagaacauucauaccaacacugacuggacuauuauuuucacgcuuuuggaaugugugggagcaggggcucaaccaccuaagccuguuagcucagccgaagauacagaacugaaaaguaaaucugacggugaaacuuccgauaaccacgaggaagagggcacccuuucagauucagaaggaaggaagaguccgaaagauaauacccagaggucacaaaguccugugaguguuguaacuucgccuguuggaacuccaaauacagguggauggauuuugguaggaaacgaaggugaaauucaacccgucaugggccgcaccgucccuccaacccaauacggccuagcguuagagaagaaccuuggaagccaugaccccagaaguaugaugaagugcugcgaaagucuugcguuucuaguaagagaugucgcccauauuacaccuuacaauuuugacguuuguguucauuguauaaggacuuuuguagaagcuagcuuacaugguucuaauuucaaaagguugagagauucuaggucuagaaagaaaacuuuagauaggacuagaacuagaaaaaguccaacaaguagucccgaugaggaagauagugacgacgaaaacauuccaagugguuaucagcaaauaucaauacaguuauuagauuuaaugcauacuuuacauacgcgaacggcucagauauuuaaauggugggcugaagaagguggugaaauaucgcaagaaacuucucuuuggacucaagguugguguccucuucugcaagguauagcaagacugugcugugauacgagaaggccuguaaggaugagugcuauaacguaccugcaaagagcgcuauuaguccaugauuuacaaacuuugaguggaucagaaugggagcaauguuuccaaagaguauuauuuccuuuacuuaguuaccuguuacagucaauaaauccuaaagaugccauaucgauggaagaaacuaggauaaggguagcaacuguguugucgaaaguguuucuacaucaccuuacuccucuauuagcacuucccaguuucuuuaaucuauggcuggugguguuggacuuuauggauaaauauaugcaugcagauaaaagugaacuucuuuacgaagcuauuccagaagcacuucccaguuucuuuaaucuauggcuggugguuuuggacuuuauggauaaauauaugcaugcagauaaaagugaacuucuuuacgaagcuauuccagaaaguuuaaaaaauaugcuuuuggugauggauucugcuaaaguuuuugacggucccgauggaaagaacauucuauggaaugccacuugggaaaggauagggaaauuucuaccuaacaugaaagacgacuuauuuaaggaaauagaagaccaaaauagaaaaaacgaagaaguuaguaacauagagauaauagugaauaaagaagaaaaagauguaaauacagagaaauugacuacuaaugauaaccuuauuacguguuag

SEQ ID NO: 5790 - RNA, 786 nt, Diabrotica barberi
ucaauuucacuguuucacguuuguaaguacguuugcagacuguauucaguguauuguauuuuaguauuuuacaauucuuugaauugcagauuauuuagcaguuuaguacaaaaaccugaaguaaauucuauaaucuauaacgaaaagugcuuaaauuuuaguggcaaaauguccauucuagcuuacaaugguggugcuaugguggcgaugaagggagaaaacuguguagcaauugcagcagauaggcgguuugguauucaagcccaaacaguagcuacaaauuuccaaaaaaucuuugaaaugggaccacauuuauaugugggucuuccaggauuagccacagauacccaaacaguuauggaaaaacuccguuuccgaaaaaacuuguacgaacuuaaggaaaaucgaaaaauaucuccaaaaguauuugccucuaugauaucaaacauguuguaugaaaaaagauuugggccauuuuuuguggaaccuguaguagcuggacuucuaccuaauacuuaugaacccuuuaucuguaauauggauuuaauugguuguauaaaccaaccuucagacuuuguuguugguggaacagccucagcacaguuguaugguaugugugaagcacuuugggagccuaacuuaggaccugaggaucuuuuugaaaccaucucucaagcucucaucaaugccuuugacagagaugccauuucugguuggggagcuacaguguacaucauagaaaaaaauaaggugacuguaaaaaauuugaagacacguauggacuag

SEQ ID NO: 5791 - RNA, 2808 nt, Diabrotica barberi
auggaucagaaaccagauauagaucuggugauaucggcaguuucagcguuguacaauaacccuaacagcagugagaaggaaagagcuucuaaauggcuuuuggaacuccaaaaauccguccaugccuggacuguagcagacgaauuauuacauuuaaaaagagacuuggaaucauguuacuuugcugcucaaacuaugaggacgaaaauccaccagucuuuccacgaacuuccucaagaagugcacacgucauuaagagauucauuacuugaacauauuggccaaauuaacgaagcaacuaacacuguuauagugacacaauuguguguugcucuggcagauuuagcucuacaaaugccaucuuggcagaauccuacguuagaccuaaucaauagauucucccaaacuaauauauggccauugcuagaaauuuugacuguguuaccugaggaacuggaaaguagaucugucaggcuaggugaaaacagaagaauagauguguuagaagagaugaaaauuagugcuccaacaguaaaugaauuuuuaaaacauuguuccaaacucuacgaaacuaauuggcaagaucacguucaguucaauguuaaaauauuacgcugcuuuacauccuggaucucaguaggagcuauuagucugaacgaucuuucugauaguauuguuauuaacagagcauucgagauacucaacuucaagccucaaaaugauaaacauaccauaucagcugccuuccaugaggcugccacugacugcauuuguacucuuuuacuaagucuugaaaacaacaauaaccaacuugguuuggaaaauuaccucuucaauaauauuaucaaccuagauguaccuuaucaccuuucuguugcgaaugaggaucaaggaaaaucuauggacuacugcagacuguuuacagaacuggcagaaucauuuuuagaaaaaauuauagcuaauaguaauacaaaacagaugcacuaugcuauuaaaauuuuagaucuaguuuuaauguguguuggacaccaugacuaugagguagcagaaaucacauuuaaccuuugguauguuuuaagugaagaauuauaccaaaaaaauaacaaagaaaagacagaacuauuccgacccuacguagaacgauuaauaacagcacuauguaggcauugucaaauggagccagauagcgaaggguuguuagaagauggagaugaauuuaaagauuuuagguugaagguagcagaauuaauacgagauguaguuuucauagugggcaguagugccuguuucaaacaaauguucauuaauauacaagguccaggaguuacgugggauuccacggaggcagcucuauuuguaaugcaagcuguagcaaaaaacguaauaccuggugaaagugaagugguaccucaggucguagaagcaauauuaaauguuccagaaaauacacauguagccguaaaauacacgucagugcuuuugcuaggagaacuuugugaauggauagagaggcauccgaacacgcuggauccaguuuugaacuuuuuagugugcuguuugccucaaccuggaguaggagcugccgcagcgguggcccuucaaaacaucugugccaguuguaaugaucauaugccaaggcacgucccgauacucuuacagcuucuucaccaagcugauuccuucgccaucaccaacacagcuaccuugggucuucugcgaggaguggcuucgauaauaggucgaaugccgcacgaggaguugacgacggcuuuacgggaauuauguucuaugcagcuuaauccgauaugucaaauaauagaacaggauguucauccagugaagggagcccaaacggauccaguaauguggcuagauagacuuagugcggugcuuagauauguuaauguacauauuccggaagguguggaaaacccuuguaaaccgguaauucucgaaguguggccgguauugucucgcacguucgauaaauuccaaagugacauuaggauaauggagagauguugucgugccgugcguuucaugcugcggugcgucgcgcaagaagugcgugaacucuuagaaagccuaguuggacaaauagugaggaucuauacguuauaccaacauucguguuuucucuaugucgguaguauacucguggacgaauacgcaauagauccgauaugcgugccaggacugcuggauaugcugcaagcguuucuggaaccuaccuuucacguguugcaggaggagaacgggcugaagaaucauccugauacaguggaugacuuuuuuagguugugugcaagauuuaugcagagggcgccuuuagcauuuuuaaaauguucuuccuugguccacaucuuacagugugcccuuuuggcuucuucccuggaccaccgagaagcgaauaugucugugaugaaauucuuuuacgauuugauaaaccagggccagagcgggagggcugaucccgaauucaaucaacgacagauguuaguuaaaagcauccucgacgaguauggccaacaacuagucucgaaucuaauccauucuugugucuucuaccuccauuccuacaugcucagcgaagucggcgacguauucgugcagcugcucgauuucgacagagagaucaccugcaaauggguagcggcuggucuugacguguuaccgaagaacaguaacggcggcaucauggccgccacaccucaacaguugacggauauacauaccacuauuagcagggcgaauacuuccaaguccguaacgcaugcucucaaggaucuagccagguuauaccguuaa

SEQ ID NO: 5792 - RNA, 1554 nt, Diabrotica barberi
auggcucagcgguuucccggcccugugccaaaucaaaguccaggaggaccgccuccucaaagauaucaacaacagcccccuaaucaaggaauucggcaguaugcacaacaaaauuuuccucaaagaccuggauacaauccuccaccaccaaauauaccaucuaguggcgguacgaugauucaaagaccugcuggugcucccuauucaccaaugagagguggaauuauuccgccacagcaaggaaauaaaaggccugcagacaauaggacucaaaugcaacagaaaaguaaugaauacagccauaguacaaguaagaagaagaaaaagcuggcggauaaaauccugccacagaaagucagagauuugguuccagaaagucaagcuuacauggaucugcuagcauuugaaagaaagcuggacucuacuauuaugagaaaaagauuggacauccaagaagcucuuaagcguccgaugaagcaaaaaaggaaguugagaauauuuauuuccaauaccuucuauccugccaaggaaccucagccugaaggacccgauggaccaugucaggaaggcacuguugcgucuugggaauuaagaguagaaggucgucuuuuagaagauccaaagaacgauccaaauaaaguuaaacgcaaguuuucuucuuucuuuaaaucccugguuaucgaauuggauaaagagcuguauggaccggacaaucauuuaguugaauggcacagaacccuaaccacucaagaaacagaugguuuccagguaaaacgcccuggugacaagaaugugagauguacuauuuuguugcuucuugauuaucaaccucugcaguuuaagcuugauccuagacuagcuagacuuuugggaguucacacucaaacuagaccggucauuauuucagcuuuguggcaguacauaaaaacucaucgcuugcaagaugcccaugaacgcgaguuuaucguuugugacaaguauuuggaacaaauuuucaacuguacccguaugaaauuugccgagauuccucagcgucugaauccacuguugcauccuccagauccaaucgucaucaaucacgugaucuccguagaaggaggggccgagagcaaacaaacugcuuguuaugauauugauguagagguugaugauacauuaaaaacgcagaugaacaauuuccuauugaguacagcuagccagcaagagauucaaggacuugaugccaagauucacgaaaccguugauaccauuaaucagcuagaaggaggggccgagagcaaacaaacugcuuguuaugauauugauguagagguugaugauacauuaaaaacccagaugaauaauuuccuauugaguacagcuagccagcaagagauucaaggacuugaugccaagauucacgaaaccguugauaccauuaaucagcuuaaaacaaauagggaauuuuuccugagcuucgcuaaagauccacaacaguucauucauaaguggauugugucacagacucgugaucuaaagacgaugacugacguggucggaaauccggaagaagag

SEQ ID NO: 5793 - RNA, 435 nt, Diabrotica barberi
augccaaaaguacgacgaaguaaaaaaccuccuccugaggguugggaacugauagaacccacauuagacgaguuagaacaaaaaaugagagaaguugaaacacaaucucaugaggguaaaaggaaaaaugaaucauuguggccaauuuucaaaauccaucaucaaaaauccagauauauauuugaucuuuuuuauagaagaaaagcaaucagcagggaacuauaugacuauugucuuggugaaaacauugcagauaaaaauuuaauagcgaaguggaagaagcaaggauacgagagucuuuguugcuuaagauguauucaaacgagagacaccaacuuuggaacaaacuguauuugucguguaccuaaaucuaaguuagaagaaggaagaauuguugaaugugugcacugugggugcagagguuguucaggauag

SEQ ID NO: 5794 - RNA, 885 nt, Diabrotica barberi
augccagcagcuacucuagguagcauaccacauccuaauaaugaagacuguggcauuagggauguuugggcccauaaccuggaggaugaauucagaaccaucagacaaauaguacaaaaauaucaguauguugcuauggacacagaauucccugguguaguugcgaggccuauuggagaauuuagaaguucugcagauuaccaauaccaaaugcugaggugcaauguagauuuauugaggauaauacagcuugggcucacauuucuugaugauaauggaaaaacuccagggggugccuauacuacauggcaguucaacuucaaauucaaccuucaggaagacauguaugcacaggauaguauagaccuccugcaaaauucuggaauucaguuuaagaaacaugaggaugaagguauugaaccucuugaauuugcggaacugcugaugucaucugguauuguccugguggaaaauauaaaauggcuguccuuccauucugguuaugauuuuggcuaucugauaaaacuguuaacggacaacaacuuaccucaagacgaaacagaauucuucgauuuguuaaaauuauauuuuccuaccauauaugauguaaaguaccuuaugaaaucgugcaaaaaucuuaaaggaggauuacaagaaguggcagaacagcuagaacuugaaaggauuggaccacaacaucaagcagguucagauucucuucugacaggaauggcauuuuucaagaugaaagagauguucuucgaagacacaauagacgacuccaaauucucgggccaucucuacggucucggcaccucuuucgcagucaacggaacugccaacaacuacucgaacgacaacggagauaccacgaacucuucauga

SEQ ID NO: 5795 - RNA, 1209 nt, Diabrotica barberi
auggcaauuccaaauagaggugccucaguuuuugaggacuuaucaaauguagaguuugaaacuagugaagaugucgaaguuaucgagaaguuuaaaaacaugaaccuuaaagaagaacuucuucgugguaucuucgcauauggcuucgaaaaacccucagccauucaacagagagcaauaaagccuauuaugaaaggaagagacguaauagcucaggcacaaucugguacugguaaaacagcuaccuuuuccauuucgauuuuacaagccuuagauuugacaaugcgagaaacgcaaguuuuaugcuugucuccuacuagagaauuggcuguacagauucaaaaaguuauucuagcuuuaggugacuucaugaauguucaaugucaugcuuguauuggaggcacaaaucuuggagaagauauuagaaaacuugauuauggacagcaugucguuaguggaacaccuggaagaguuuaugauaugaucagaagaagagcucuaagaacaagaucuguaaaaauguugguuuuggaugaggcugaugaaauguuaaauaaaggauucaaagaacaaauuuaugaugucuacagauuccuucccccaucaacacaaguuguacucauuucagcuacacugccucaugaaauuuuggaaauuacuuccaaauuuaugacagauccuauuaggauuuugguaaaacgugaugaauugacauuggaagguauaaaacaguucuuuguggcugucgaaagggaagaauggaaauucgauacccucugugaccucuaugacacauuaaccauuacacaggcuguuauuuucugcaacacaaagaggaagguagacuggcugacagagaaaaugagggaaaacaauuuuacaguuaguucaaugcacggagauaugccacaaaaggaacgugacaauauuaugaaagaguuuagaucaggacagaguaggguccuaaucaccacugauguuugggcuagagguaucgacguacaacaagucaguuugguuaucaauuaugacuuaccgaacaaucgugaauuguacauccaucguaucgguagaucugguagguucggccgaaaggguguagccaucaauuuugugaaaucagacgauaucagaauucugagagauaucgaacaauauuacucgacccaaauugacgaaaugccgaugaauguugcggacuuaauuuaa

SEQ ID NO: 5796 - RNA, 1605 nt, Diabrotica barberi
augacugccccuacagccgguggugauacaaauagaggaagaaccguugcauauaaggacaaaaguaaacccgcugaugucaggaccaguaauauuaacgccgcaaaagcuguuugcgaugcuauccguacaagucuuggcccuagaggaauggauaaaaugauccaggcuggaaauggugaagugacaauuaccaaugauggagcuacaaucuuaaaacaaauaaacgucauucacccugcugcuaaaauguugguagaacuaucaagggcccaagacauugaagcaggagaugguaccacaucuguuguuguaauugcaggagcuuuguuagaugcugcagaaaaguuauuacauaggggaauucacccuacagcaauaucugaaucuuuccaaagagcagcacaguuggcaguugauauuuugucagacauuucuacuccaauugaaauuacuaauagagaauuguuaauuaaaagugcauccacuucccuaaacucaaaaguuguuucccaacacucaagcuuuuuggguccacuugcugucgaugcaguucuuaaaauuguugaaccugguagagaacaagcuuguaauuuaucugauaucaaaguuauuaagcaacuuggagguacaguagaagauaccgaauuaguagaaggaauuuguuucccucaaagaucugcaaaugucucuggaccaaaaaggauugagaaagcuaaaauugguuucauccaguucuguauuucaccuccaaaaacagauauggaccacaaugucauuguaucugauuacgcggcuauggauagaguauuaaaagaagagagagcauauauuuugaauauugucaagcagauaaagaaagcuggaugcaauguacuuuugguucaaaaaucaauuuugagggaugcaguuucagaucuugccuuacacuuuuuggauaaaaucaaguguaugguuauuaaggauauugaaagagaagaugucgaauuuguauguaaaucuuuaggaugccgcccuauugcaucuuuggaucauuuuguugcugaaaacuugguuacugcugauuuaguugaagagguuggauuggcaggaaauagaauggucaaaauuacaggugcacaaaaugcaggcaggacaguaacucugcugguuagaggauccaacaaauuaguucuugaagaggcugauagaucucuucaugaugcucuauguguaauucguugucuuguucgcaagaaggcacuuauugccggaggaggagcaccagagguugagguggcucuuaaacuagcggcuauggccaacaaacuggaaggcauugaugccauuugcacacgggcauaugcgaaugccuuagagauuauaccauuuaccuugucugagaaugcaggauuaaaucccauacagaccgucacugaacuaagaaacagacacgccaaaggagagacgucugcuggaauaaacguucguaaaggagcuauuacagauauucucgaagaaaauguuguucaaccacuuuuaguuagcacuucagcauugaguuuagcuacagaaacugugagaucgaucuugaaaaucgaugauauuguuaacacauucacauaa

SEQ ID NO: 5797 - RNA, 1116 nt, Diabrotica barberi
auggaggcuauggauauuguuauaccagaaaaagaagaagguaguccuucggaaguaaaacaagugcugcaggauguggauacugaagauuuauacacuaaauauaaaaaacuucaacagcaguuagaguucuuagagguucaagaagaauacaucaaagaugagcaaaggaaucucaaaaaggaguauuuacaugcccaggaggaagugaagcguauccagucugucccguugguuauuggacaguuuuuagaagcuguagaucaaaacacugguaucguuggcucaacuacagguucaaauuauuauguuagaaucuuaucaacaaucgacagagaacucuuaaaaccuucugcuaguguugcucuucauaaacacagcaaugccuuaguagauguucuaccuccagaggcagauucuucaauaagcaugcuccaggcugaugaaaaaccagauguucaauacagugacauuggagguauggauaugcagaaacaagaaaucagggaagcaguagaguuaccuuugacucacuucgaauuguauaaacagauugguauugauccccccagagguguguugauguauggaccuccuggaugcgggaagacuauguuggccaaggcuguugcucaucauacuacagcugccuuuauucguguagucggaucagaauucguacagaaauaucuuggugaagguccgcgaauggugagagacguguuccgucuagcaaaagaaaauucuccagcaaucaucuuuauugacgaaauugaugcaaucgcuaccaaacguuuugaugcccagacgggugcugaucgugaaguccagagaauuuuauuggaacugcuuaaccagauggaugguuuugaucagacaacaaauguuaagguuaucauggcaacuaacagagcugauacauuagauccugcacuucugagaccuggucgucuggacagaaaaaucgaauuuccuuuaccagauagaagacaaaagcguuugauuuucagcacuaucacaucuaaaaugaauuugucagaggaggucgacuuggaggacugcccuuuugagaccuggucgucuggacagaaaaaucgaauuuccguuaccagauag

SEQ ID NO: 5798 - RNA, 432 nt, Diabrotica barberi
augccaaauauaaaauugcagucgucugauggcgagaccuucgaaaucgauguugaaauugcuaaaugcuccgucacuaucaaaacuauguuagaagacuuaggaauggacgaggaagaagaagaagugguuccuuuaccaaacguaaauuccgccauacucaggaaagucauccaaugggcgacuuaccacaaagaugauccaccaccgccagaggaugacgauaacaaagaaaaaagaacagaugauauuuccucaugggacgcagacuuccugaaagucgaccaaggaacucucuucgaguugauuuuggcugcuaacuaucuggauaucaaggggcucuuagaugucacauguaagacuguugcuaauaugaucaaagguaaagcuccugaagaaaucagaaagacuuucaacaucaagaaugacuuu

SEQ ID NO: 5799 - RNA, 930 nt, Diabrotica barberi
auggacgauaaggcgucguguaaggagcuagauggauggauagaacaguuaaaugaaugcaagcaauuaacggaaaaucaaguuaaaacacuaugugauaaggcuaaagaaauauugucaaaagaaucaaauguacaagaagugaaaugcccaguaacaguauguggagauguccauggacaguuccacgaucugauggaacuguuuaggauaggagguaggaguccagauacuaauuaccuguucaugggagauuauguagaucguggauacuauucuguugagacugucaccuuacugguagcacugaaagucagguacaaagagagaauuacaauuuugagaggcaaccacgaaucaagacaaaucacacaaguuuacggauuuuacgaugaaugucuaaggaaguacggaaacgcgaauguauggaaauucuucaccgaucuguucgauuauuugccccuaacagcgcucgucgauagucaaauuuucugucugcacgguggauugaguccuagcaucgacaccuuggaucacauuagggcgcuagaucguuuacaagagguaccucaugaaggcccuaugugcgaccuucucuggucagacccugacgaccgcgggggcuggggcaucuccccccguggagccggcuacaccuucggacaggacauuucagaaacguucaaccauaccaacggucugucuuuaguaucuagggcacaucaacucgucauggaagguuacaauuggugucacgaaagaaauguagugaccauuuucagcgcccccaauuauugcuaccgaugcgguaaccaggcggccauuauggaauuagaugaugcccugaaauauucauucuuacaguuugauccagcaccaagacguggagaaccucauguuacgcguagaacuccagacuauuuccuuuaa

SEQ ID NO: 5800 - RNA, 948 nt, Diabrotica barberi
gguaugcaaaucuuuguaaaaacucucacugguaagaccaucacccucgagguugaaccaucagauaccaucgagaaugucaaagcuaaaauucaagacaaagaagguauuccaccagaucaacagagauuaaucuucgcuggaaagcaauuggaagauggccgcacccucucagacuacaacauucaaaaagaaucuacccuccauuuggugcuucgucuuagaggagggaugcaaauuuuuguuaaaaccuuaacuggaaagaccaucacccuugaaguagaaccuucagauaccauugaaaacgucaaagccaaaauucaagacaaagaagguauuccaccagaucaacagagauuaaucuuugcuggaaagcaguuagaagauggccguacucucucagacuacaauauucaaaaagagucuacccuccauuugguacuucgucuuagaggagguaugcagauuuuuguuaaaacacucacugguaagaccaucacccucgagguugaaccaucagauaccaucgagaaugucaaagcuaaaauucaagacaaagaagguauuccaccagaucaacagagauuaaucuucgcuggaaagcaauuggaagauggccgcacccucucagacuacaacauucaaaaagaaucuacccuccacuuggugcuucgucuuagaggagguaugcaaaucuuuguaaaaacacucacugguaagaccaucacccuugagguugaaccaucagauaccaucgaaaaugucaaagccaaaauucaagacaaagaagguauuccaccagaucaacagagauuaaucuuugcuggaaagcaguuggaagauggccguacucucucagacuacaacauucaaaaagaaucuacccuccauuugguacuucgucuuagaggagguaugcagauuuuuguuaaaacacucacugguaag

SEQ ID NO: 5801 - RNA, 966 nt, Diabrotica barberi
augaugcaaccacagauauuacucuuaaaagagggaacugacucaucacaaggaaaaccucaguuaaucucaaacauaaaugccugccagaaugugacggaugcuguaagaacaacauuggggcccagggguauggacaaacucauaguacagaggcaaggacaugcuacuauaucaaacgauggggcaacuauuuugaaauuauuggacaucguucacccugcugcgaaaacuuugguagauauugcuaagucacaagaugcagaggucggggacgguacgacaaguguaguauuacuagcaggagaguuuuuaaagcaaauaaagccuuacguugaugaggguguucacccaagaauaauaaucaaagcagucagaagaucguuccaaauuugccucgagaaaauaagugaaaucucuguuaaaaucaauaaaucaaaugcugacgaauuuagaucucuauuggaaaagugugcugcaacagcgaugagcucgaaauuaauuaaucaacaaagaucuuucuuuucuaaaaugguuguagaugcuguucuauuacuggacgauuuacuaccucucaauaugauugguaucaaaaagguacaagguggagcccuagaagagucacuuuugguagccggaguagccuuuaagaaaacuuuuucuuaugcuggguuugaaaugcaacccaagguauacaaagauuguaaaauagcucugcugaacauugaauuggaacuuaaagcugagagggauaacgcagaaguaagaguagauaauguaaaagaauaucagaaaauuguugaugcggaguggacgaucuuguacaauaaacuucaaaaaauuuaugagucuggagcuaauguuguuuuguccaaauuacccauuggagauguugcuacucaauauuuugcugacagggauauguucugugcuggucguguucaagaagaugauaugaagcguaca

SEQ ID NO: 5802 - RNA, 3645 nt, Diabrotica barberi
augauggucggcccaagcgguuccgguaagaguucggcauggagaguucuucuuaaagcucuugaaagauucgaaggcguugaaggaguugcacaugucaucgauccaaaagcuauuagcaaagaagcgcuguaugguguuuuggaucccaauaccagggaauggacggacggucucuucacucacauauuaaggaaaauuauugacaacgucaggggagaaauuaacaaacggcaauggauuaucuucgacggugacgucgauccugaguggguagaaaacuugaauucaguacuugacgacaacaaauuguugacucugcccaacggugaacgucuuucccuaccuccaaacguuaggguuauguucgagguucaagacuugaaauaugcaacacuggccacgguuucucguugcgguauggucugguucucugaagaugucuugucaacugacaugaucuucgaaaacuauauccuucguuugaggaauaucccucuggaagaaagcgaagauagcggcuuuggcaagaaaaacgacaaagacgauaugcuuucucccacucuucaacuacaagucgacguugucaaucuacuacaaccguacuuaucacccgauggucuugucguacguugucuggaauaugcgauggaacaagaacauauuauggacuucacacgucuucgagcgcucagcucguuauucucuauguuaaaucaagccguaagaaacguucuccaauauaaccacaugcaucccgacuuuccauuaaccaaugaugucuuagacaaauauaucccaaaauguuugauauauuccauccuuuggaguuucgcuggugacgccaaacugaagauucguuccgaucuaggagauuuuaucagaucuguaacaacgguaccucuuccuccagacaacaacaugccuauaaucgacuacgaggucaccaucgagggcgaauggucgcuuuggucaaauaaaguaccacaaauugagauugagacgcauaagguugcuucaccugauguuguagugcccacuuuggauacaguaagacacgaauccuugcuuuacacuugguuggcugaacauaaaccauuagucuuaugcggcccucccgguucugguaaaacgaugacucuauucuccgcuuuaagggcguuaccugauauggaagugguuggcuugaacuuuucaucugcuacaacuccugaauugcugcuaaagacauucgaccacuacugugaauacagaaaaacgccuaaugguguaguuuugucaccaauacaguugggcaaaugguuaguucuauucugugacgaaauaaauuuaccagacauggacaacuacggcacucaacguguuaucauguucuugcgucaaaucguggaacagaaagguuuuuacagagccucagaccaauccuggguugcacuagaacguauccaauuugucggugccuguaauccuccaacugaucccggcagaaagccucuaucccaccgauucuugcgacacguacccguuauuuauguagacuacccuggagagacaucuuugaaacagaucuacgguacuuucaccagggcuaugcuaagauuggcgccuggucugaaagguuaugccgaaccauugacuaaugcuaugguugaauuuuauuuggcaucucaagauagauuuacucaagauaugcaaccacauuauguuuauucuccaagagaaaugaccagauggguaagaggaauuugugaagcaauaagaccucuugauaaucuugcuguggaggguuugguaaggcuuugggcucaugaagcucuccgucucuuccaagacagauuagucgaagacaccgaaagacgguggacuaacgaaaacauugaugcuguagcuuuaaaacacuucccgucagcuaacugcgagaaagcuuuggaaagacccauucuuuacagcaauugguuaucuaaggauuauguaccuguuggaagggaacaacuaagagaauauguaaaggccagacugaaaguguucuacgaggaagaacuugauguuccuuuggugcuguucgaugagguguuggaucauguuuuaaggauugaccgaauauucagacaaccucaaggucacuuacuacugaucggaguuucuggugccggaaaaacaacucuguccagauuuguagccuggaugaaugguuuaucuauauuccaaauuaaaguacacaacaaauacacagcggaagauuucgaugaagaucuaagaucgguuuugagaaggaguggaugcaaacaugaaaagauugcuuucauuuuggacgaguccaauauguuagauuccaguuucuuggaaagaaugaacacucuacuagcuaauggugaaguuccuggacuuuucgaaggggaugaauauacuacucuuaugacccaguguaaggaaggagcccaaagggaagguuuaauguuggauucaaaugacgaauuauacaaaugguuuacacagcaaguaaugcgcaauuugcauguggucuucaccaugaaucccucuaccgauggucugaaggauagggcugccacuucuccagcucuguucaacaggugcgucuugaacugguucggugacuggucagauggagcucucuuccagguugguaaagaauucacgaaccguuuggaucuugaaaaacaaagcuggagauguccagacuucuucccggcugcuugccaucacaucucagcgucuccuacucauagagaagcugucaucaaugccuguguguauguacaucagacucuucauaaagcaaacaguagauugguuaagagaggaagccguaccauggcgaucacuccaagacauuacuuagacuuuauucaucaucucguuaaacuguacaaugagaaacggucagaucuggaggagcagcaguugcauuugaacguuggucugaauaagaucgccgaaacuguagaacagguugaagaaaugcaaaagaguuuggccgucaaaucucaggagcuucaggccaaaaaugaagcugccaacgcuaaacucaggcagauggugaaagaucaacaagaagcugaaaagaagaaggugcagagucaagaaauucagcagcaguuggcugaacaaacgauucauauugaacagaaacggucagaaguaauggcugaucuagaacaggucgaaccugccguuauugaagcccaauuagcuguaaaauccaucaaaaaacaacaguugguagaaauccguacuauggcuaacccaccagcucuugugaaguuggcuuuggaauccauuuguuuacugcucggugaaaaugcuagcgauuggaaaucuauucgugcuguaauuaugagagacaacuucaucaauaccguuguuaacaacuucaacacugaagauauuagugaugauguaagggaaaaaaugaagaaccgcuaccucagcaauccagauuacaacauugauaagaucuaccacgccaguaacgcuugcgguccacuugucaaaugggcuugugcgcaaguucaauacgcagacaugcugaaaaaggucgagccucuccgugaagagcucaaaucucuagaacaacaagcugaaaccaaccaaaagagaggugaagauguuaaagcacucauuagc

SEQ ID NO: 5803 - RNA, 2679 nt, Diabrotica barberi
uucagaauggaucgaccgaguacaaguaagcgaaaugucuuugacuccgauucagauagugucgacagcacugaagaagcucgccgaagagaucugaaggaaagagaugaauucgcaaauaggcucaaaaaacgcgaugaagaacguacuagaaacguugccaguacuucugauaagcgugcuuaugaagaggcugcuaaaagacuuaaauuggacaaugcagaaaaagagaaacuuauuccugcucucagaguugcuuccaggaggaaguauuuggaaaaaagaaaagaggacaaacuacaagaauuggaagcugauauugccgaugaugaguaccuuuuugaggaagauguuuugacugaaagagagaaaaaagaucguguacacaagaaagagcuguuaaaauuggcacaggaacaugaaaaggccagggaacuugagcggguucaaagguaucacaugcccagagauuugggcaaggacuccacugcugauuacauugaaguugaugacuuggagaagguaccacaaucugaacagaagaaaugggaaaaagaucagauggccucggcaguguuuaaguuuggagcaaaagauggaauuaaaaaagaagaguaugaguuaguauuagaagaucaaauucaguuuauacaagcacuacaaaugccaggagugucugauaagaaagaaccccaacuaacggaaacagaaaagaaaaaacuuacuauagaagaaacaaagaaaagccuuccuauauacccuuuuaaagacgacuuaauacaggccauuagagaacaccaaguuuuaauuaucgaaggugaaacgggcuccggcaaaaccacccaaauuccgcaguauuuauacgaagcugguuucugcgaagacgggaagaagauugguuguacucaaccaagacgaguagcagcuaugucaguagccgcuaggguagcacaagaaaugagcguuaaauuagguaaugaaguaggauaugccaucagauuugaggauugcaccucugaaaggacaguuauuaaauacaugacagaugguaccuuacauagagaguuccuaucagaaccagauuuagcgucuuauaguguuaugauuauugacgaagcucaugaaaggacuuuacacacugacauauuguuugguuuaguuaaagacauagcuagauuuagaccagacuuaaagcucuuaauauccagugcaacacuugacguaacaaaauuuucugauuuuuuugacgaugcgccuguuuaccaaauaccaggaagaagguuuccaguugacauuuauuacacgaaagcuccugaagccgacuacgucgaugcuuguguaguaucaguacuucagauucaugugacacaacccuugggugacauacuaguauuuuugacuggacaagacgaaauagaaacgugccaagagcuuuuacaagauaaaguucguaggcuagggucaaaaguuaaagaauuacuuauauugccacuauaugcaaauuuacccagcgauaugcaagguaaaauuuuugaaccaacgccuccaggcgcuagaaaaguuguuuuggccacaaauauagcugaaacgucuuuaacaauagacaauauuauauacguuauagauccuggguuugcgaaacaaaaucauuucaauucgaggacaggaauggagaguuugaugguaguaccaauauccaaagcuucugcaaaccagagagcuggcagagcugguagaguagcagcuggaaaauguuuuaggcuauauacugcuuggucuuauaaacaugagcuagaggacaauacuauaccggagauccagcggauaaauuuaggaaacgccguacugauguugaaggcgcuaggaauaaaugauuugguacauuuugauuuuuuggauccgccuccucaugagacuuugguguuagcauuagaacaauuauacgcuuugggggcuuuaaaucaucacggagaauuaaccaaauugggcagaagaauggccgaguuaccgguggaucccaugauggcgaagaugauauuagcuucggaaaaauacaaaugcucugaagaaauagucaccauaggagccauguuaucaguaaauggugccaucuuuuaccgaccaaaggauaaaauaauucacgcugauacugcucgaaaaaauuucagucacuuagcaggagaucaucuaagucuucuaaauguuuauaaucaauggagggauucugauuacucccuacagugguguuacgaaaauuucauacaauacagaucgaugaagcgagcccgagacgucagggaacagcugguuaacuugaugacaagaguagaaauagaaaucguuuccaacguuucugaaaccguggacauccgcaaggcuaucaccuccgguuauuucuaccacauugcuagauuuuccaaaggaggaaguuacaagacggugaagcacaaccaaagugucaccauccacccuaacagugcacuuuucgaaucauuaccuagguggguccucuaccacgaauuaguuuuuacuucaaaggaguucaugaggcaagugauagagaucgagaguaaaugguuauuggagguagcuccacauuauuauaagcaaaaggaauuagaagauccgacgaauaaaaagaugccgaaaacgguaggcaggaguaccagaacugauuag

SEQ ID NO: 5804 - RNA, 1371 nt, Diabrotica barberi
augaagguagaggaggugaaaaguacuguaaagacacaaagaauaagugcucauagucauauuaaagguuuagguuuggaugaagcagguuuugcaauuccaucagcugccggcuugguuggacaagaacaggcaagggaggcugccggcauaguaguggacaugauaaaaaguaaaaaaauggcuggaagggcugugcuucuagcugguccaccagguacugguaaaacagcaauugcacuugcaauagcccaagaguugggaaauaaaguaccuuuuugcccaaugguaggaucugaagucuacaguucugaaauaaaaaagacugaaguucuuauggagaacuuucgaagagcaauugguuugaggauuagggaaaccaaagaaguuuaugagggggaagucagugaauugacaccgguagaaacagagaacccugcuggagguuacggaaaaacuguaagucauguuaucauuggucuaagaacugcaaaggggaguaaacagcucaaacuggaucccaguauauaugaagcacuccaaaaagagaaaguugaaguaggagacgucauuuauauugaagccacaaguggugcaguuaaaagacaaggaagaucugaugcuuaugccaccgaauuugauuuagaagcugaagaauaugugccauuaccaaaaggagauguacauaaaaagaaagaaguuauucaggacguuacauuacaugaucuagaugccgcuaaugcuaaaccucaagguggacaagacguuuugucaaugaugggccaacuucuaaaaccaaagaaaacagaaaucacagauaaacuuagaaaagaaaucaacaaaauaguagauaaauauauugaucaagguauugcagaauugguuccugguguacuauuuauugaugaagugcacauguuggauauagaaacauucacuuaucuacacagagcuuuagaaagugccauagcucccauuguuauuuucgcaacgaauagaggucguugucuaauuagaggaacagacgauguuuauucuccacaugguauuccuuuagaucuguuagauaggcuguugauuauucggacaauuccuuacgguagaaaugacauggaacaaauacugaagcugagagcuaccacagaagguuuagaaauugaucaugaagcaauugcaucguuaggcgaaguuggggcaaaagcaacuuuaagauaugcaguucaguuauuaacuccagcacauuuaacggcaaaaauaaauggaagaaacaauauacuucacagugacauugaagaaguugguucccuauuuuuagaugcuaaagcuucagcgaaaguuuuaucugaaaauaaggagaaguuuaugacguaa

SEQ ID NO: 5805 - RNA, 2199 nt, Diabrotica barberi
augacuucaauuauaaaacugcaagcuuugucaggagccaaagaugaaucucccccaugcuauauucuucaaauugacgaagugcgaauacuuuuagacuguggaugggacgaaaaauuugacauggaauuuauuaaggaaauaaaaaggcauguucauacuauagacgcaguguuacugucuuauccagacauauaucauuugggagcccuuccguauguaguuggaaaacuggguuuaaauugcccaauuuaugcaacuauaccuguauacaaaaugggacagauguuuauguaugauuuauaucaaucucaguacaauaugaaagaguuuugcauuuuuucacuggaugauguugauacuacauuugaaaaaauuauucaauuaaaauauaaucaaaauguaccauugaaagguaaagguuaugguuuaacaauuacacccuuaccagcuggucauaugauuggagguacaauauggaaaauaaugaaaauggaagaagauauaauauauuguaaugauuucaaucauaagaaagagcgacauuuaaaugguugugagcucgauagacugcaaaaaccuuccuuacuuauuacugaugcguuuaaugcuacuuaucaacaagccagaagaagggcuagagaugaaaaacuaaugaccaauauucuucaaacucuucggaacaaugguaacguacuuauagcaguagacacggcaggcaggguucuggaguuggcucacauguuggaucagcuauggcguaacaaagaaucuggccuauuggccuacucuuuagcguuuuuaaacaacgucaguuauaacguuauagaauuugccaaaucccagauagaauggaugagugauaaguuaaugagaaguuuugaaggcgccagaaauaaucccuuucaauuuaaacacuugcaguggugucacaguuuagcagaauuaaguaaaguuccuaguccaaagguuguucuggcaaguucacccgauuuggaaaguggguucuccagagaguuguuccugcagugguguucuaauuccaauaacaguauuauauuaacaacaagaacauccccugguacuuuagcuagagacuuaauugacaacggagcagaaagaaauauagauuuaacgguagaaaggcgaguaaaacucgaaggcguagaacuugaagaauaugaaaaacgacaacgagcgcggggucaaaauguagaaaaggaagaugcagauucggacucugauucugacauagaaaugucuguuaucaccaaagguagacaugacauaguuauuaaacaagagggaaaaauaaaugccgguuucuuuaaggucacgaaaaaaauguaucccauguaucccuuccacgaagaaaaaauuaagagcgaugaauauggagaaauuauaaaaccugaaaauuacaaauuggcagauguggcuguagaaggagaggacaauaaagaaaauguauugauaaaaaaggaaguggaggaagaaaucacugaaauacaugaacagccaacaaagugcauaguacuucagagaacuguacaaguuaauugucagguacauuauauagauuuugaaggucgcucggauggagaaucccuuaugaaaauuuuaucgcagcucaagccuagaagaguaauagucguuagaggugacgaggaaaauacaucugucauagcaaaacauugugaagguauaaaagccagaguuuuuacgccaucucgaggggaaauuguugaugcuacgagcgaaacacauauuuaccaagucagauuaacagaugcacuaguaucgcaguuaagcuuucaaaaagccaaagaagcagagguagcuuggauuacagcgaacguaguucuuaaagagagucaagcagacgcuaagcguguuuauguggaugaugaaccaauggaagucgaagauguggacacaaggauuuugacgcuggaaccuguacuagaaggagauugucacgauccaguuuuuauaaacgaauuaaaauuaucugaauuuaaacaaguuuuaggaaggcacaacauuaguucggaauuuucagguggugucuugugguguuccaauggaacaauagccgugcggaggguggagucuggaaagauuaugcuagaaggcuguauaucugaagauuauuauagaguuaaggauuuauuguaugagcaguaugcuauauuguaa

SEQ ID NO: 5806 - RNA, 2283 nt, Diabrotica barberi
auggcuccuuuagagucaacuaauaacaacaacaaugaggaaccuggcccaauaaauccaauugugggaauuauuuauccaccaccagaggugagaaauauugucgacaaaacugcaaguuuuguugcuagaaaugguccagaauuugaagcucguauuagacaaaaugaguuaggaaacccuaaguuuaauuuuuuaaacaguggggauccuuaccauuccuacuaucaacauaaaguuaaagacuuuagggaaggaaaaggacaagauccuaccccuggauuaacucaagccgucucaaaacuuucugucacugcaucagcucaacagaaacagcaagaaauuuuaaagcaaguagaacagcccuuuauacccaaggaaacaccuucagaauuugaauuuauagcugaucccccaucaauuucagcucuagauuuggauauuguuaagcuuacagcucaguucguagcuagaaaugguagagcuuuucugacacaauugaugaauagagaacagagaaaucugcaguuugauuuuuugagaccucagcacucuuuauuucaauacuucaccaaauuacuggagcaauauacaaagguucuuauucccccaaaaaguaugcaugaaagccugcgaaacgaggcuaauaguccgaagaauguuuuagagcaagucaaauaucgugcagaaugguuaaaguaucaagagcaacaaaaagccaaggaggaggagcuuuuagaacgagaaaggguugcguaugcacaaauugacuggcaugaguuuguagucgucgaaacuguugacuaccaacccuucgaaauuggaaauuuuccggcuccaacuaccccugaagaagucggagcccguauuuuaauucaagagaggauagaagaaggggaagauaucgaaaugcaauuagagagugaugaggaagaaccaccaguuacggaagcugguuuaaguagcaugcaggacaaaaccaaucggaagacacgcgacgauaccagaauucaagauauggaagaagaaagcuccgaugaagaaaaagaagaggaagaggaauuagcuuuaccuccaccaccaccaucuauucaaccaccguuaccuccuauuccugauaaaguugucgugaaaaaauaugaucccaaacaagcugucaauguuagccggccaacaauuggagaugacuaucucgucucacccauuacuggagagaaaauaccugcgaacaaaguccaggaacauaugcguauuggucuguuggauccgcguuggguagagcagcgcgacaaacaaauaacggacaaaaugaaccaagaaacaguauaugcugcugguagugccaucgaugcuucauugaaacugcucgccgagagacguacugauauuuuuggaguuggagaugaagaaacagcuauugguaagaagauuggugaagaagauguuagaaaagacgagaagguaacuugggaugggcauacgaguagcguugaagccgcuacaagagcugccagagccaauauaacauuggaggaacaaauucaucaaauacacaagguaaaggguuugcuuccugaugaagaaaaggagaaaaucgguccaaagaauauugguucaaaaucugguaaaaucaacauucaaagcguaauuacuacgaagccgccuacuucacuucaaccaaaaccgccagucucuuuaauucaaacccaagcaacugcgucgcuaauaucgguaccaccacaaccuauguuaccaccucaaccucccauuaugaugaugucagcuacaucuaugccucccauuagaccaccuccaauaaugaugacaggaccuccuccaauaccggguuuuccuguagcaccaauguccucaccuauggguccaccuaugaaucugcccccaaugaaacaucaggcugaagcaccucacgaagaugaaccgaguaacaaaaaaaugagaaacgaagauucgcuuauaccggaaaaaguauuuuuagcaagacaucaaagccaaguagcuaucaagauuucgauuccacauaugccagaaaaaucagaauggaagcugacggguaagaugauuucguggaccguaccacuugccgaaucuguagcgaauuugaaggcgaaacuacaagaagaaacuaacaugccuccagcuaaacagaagcucuuuuuugaugguauguucuuuaaggauuccaacaguuuagcauacuacaacgugacuacugguucaaucauucagcuacagauuaaagagagaggaggaaggaagaaauaa

SEQ ID NO: 5807 - RNA, 969 nt, Diabrotica barberi
augccgagucaagaauuaacaacuaauaaaguaauaguccacccuuugguucuucuaagugugguggaccauuuuaaucgcaugggcaaaaucggcaaucaaaagcguguuguugguguucuucuuggcugcuggcgugcuaaaggagucuuagauguuucuaacaguuuugcaguuccuuuugacgaagaugacaaggauaagucugugugguucuuggaccaugauuacuuagaaaacauguauggaauguucaaaaaaguuaaugccagggaacgaguaguagguugguaccacaccggccccaaacugcaucaaaaugauauugccauuaaugaguuaaucagaagguauuguccaaauuccguucuaguuaucauagacgcuaaaccaaaagauuuagguuuaccaacugaagcuuaucaagcuguagaagaaguacacgaugaugguucaccuacgucuaaaacauuugagcauguuccuagugaaaucggagcugaggaggcugaagaaguugguguugaacacuuauugagagauauuaaagacacaacuguugguacuuugucccagagaauaacgaaucagcuucuaggguuaaaaggucuccauucacaguuacgugauauuagggacuauuuggugcaagucugugguaaccagcuuccaauuaaucaccaaaucaucuaccaauuacaagacauauuuaaccuuuugcccgauauaaaucaggaugcauuuaauacaucguuuuacgugaaaaauaacgaucaaauguuagucguuuaucuagcagcuuuaguuagaucuauugucgcucuacacaaucuuauuaacaacaaacuaacaaauagagacgcggaagaaggaaaaaaggaggauaguaagaaagaaagcaaagauaaggacaaggauaaagagaaggaaaaggauaaggaugcuaagaaggaugagaagaaaaaguaa

SEQ ID NO: 5808 - RNA, 1587 nt, Diabrotica barberi
auguuugguggaggacgugccccuauuuugguguuaagucaaaauaccaaacgagaauccggucgaaaaguucagcuggaaaacaucaaugccggaaagcaaaucgcggaugugauaaggacaugccuugguccucaagcuauguuaaaaaugcuuauggauccaaugggagguauugugaugacuaaugauggcaaugcuauuuuacgugaaauuacaguacagcauccagcugcaaaaaguaugauugaaauugcaagaacacaagacgaagaaguuggagaugguaccaccucaguaauugucuuagcaggagaaauguuaguggcagcugaacaguuuuuggaacaacacauucauccgacaaucauaauucgccaguacagacaagcacucgaagauaugauccaguuauuggaagguccauuaaguauaccagucgauagaaacgauaaaaaugcucuugcccaagucguaaaaggcugcaucggcacaaaauucauaaguaaauggucagauuuggcaguaaauauugcuuuagaugcaguaaauacaguauuauuagaagaaaauggcagaacugaaguugauauuaagagguaugccaaagucgagaagauuccuggaggauccauugaagaaucuaaaauuuuaagagguguuaugcuuaauaaagauguaacccaucccaaaaugaaaagauauauacagaauccgagaauaauucuuuuggauugugcauuagaauauaaaaaaggggaaucucagacaaacguagaaauuucagcagaaacagacuucaccaaacuauuagaacuggaagaggagcaugucaagcgucaaugugaugagauuauugcacucaaaccugacgucgucuucacagaaaaaggagugucagauuuggcccaacacuuuuuacugaaagcugguauuaccgcuaucaggcguguucgaaaaucugauaauaacagaauugccagagccuguggagccacgauuguuaaccgaacagaagaauuacaagaaagcgauguugguuuaggagcuggacucuucgaaaucaagaaauuuggugaugaguauuucugcuuuguggucgaaugcaaaaauccaaaggcuuguacaauuuuacucagaggugccaguaaagacauucuuaacgaaaccgaaaggaaucuacaagaugcccuacaagucgccagaaauauuguccuaucuccccguuuagugccuggagguggcgcuguagaaauggcuguagcccagcguuugaugcagaaggcuacgcacggaccuuauagagcucuugcacaugcuuuagaaauuauuccaaaaacucuuacucagaacugcggagcaaacacaaucagaacauuaacugcuuugagggcgaaacacgccaaccacacggacguuaacaaaccaugccuuugggguauugauggcgaaacuggagagcucguggagauggacaagaaagaauugugggaaccucuagcugucaaacuacaaacauacaaaaccgcuauagaaacugccauucucuuacuucgcauugacgacauuguaucuggcuccaaaaag

SEQ ID NO: 5809 - RNA, 702 nt, Diabrotica barberi
augaugcaaacagcuaauaaugcauauuaucccgauuauuccacugcuccaaugcaacgucaaauuaaccccuaugcagauaauggagggaguguaguagcaaucgcaggugaagacuuuguaauaauuggugcagauacacguuugaguacuggauuuuccaucuauaccagagaacaaaacaaacuuuucccacuaucaggcacuacaguuuuggguugcgcaggauguuggugugacacucuaacauuaaccagaauccuuaaaucucgcaugcagauguaccaacaagagcauaacaaaacaaugucuacaacugcaugugcccagauguugucuaccaugcucuacuacaagagauucuuuccuuauuauauaucaaacauucuaguagguuuagauaaugaaggaaagggcuguguuuacagcuaugauccuauuggacauugugaaaaagcuacguauagagcaggugguucagcuggagcucuucuucagccucuguuggacaaucaaauuggacagaagaacaugcuuaaaacaucuggagaaccucuuagucaggagaaagcuuugucuacccuuaaagauguauuuauuucugcugcugaaagagacaucuacacuggagauagcguacuuauaaauauuauuacuaaagauggaguaaaggaagaguccuuccaguugagacgggauuag

SEQ ID NO: 5810 - RNA, 897 nt, Diabrotica barberi
auguuucaauuuggauucaacauguuuccugagguccccaggccuuuuaauaugacuuauaagugcuacucaguggcuauguuuccuggcaaugaacgagaagacguugaaagagguggaaaaauuauuaugcccccaucagccuuggaacaauugacuagguuaaauaucaacuaucccauguuguuuaaacuugugaauaaaaagacacaucgcacaacgcauuguggaguuuuagaauuuguugcugaugaaggaaaaguuuauuugccacuuuggaugaugaacaacuugguacugacugaaggagauuugguucaaauggaaaguguuucccuuccaguuggcaccuuuucaaaauuccaaccucucaauccagacuucuuggacauuacuaauccuaaagcagucuuagaaaaugguuugagaucuuuugccugccuuacaacaggagaugucauugcaguaaaguacaaucaaaaggcuuaugaguuguguguucuagaaaccaaacccggagaugccauuaguaucauugaaugugacaugaauguggaauuugcugcuccuguuggauacaaagaacccgaacaagucaaaaaggaagaagaagaaauggcuauagauccugcagauuuaaugccagaaccuucuggauuuguagcauucagaggugcaggaaaucgacuugauggcaaaaagcguaaagauacuucaggagcugauaguucagugggcaaaccaacuuaugucagaggaauuccagauuaugauuaccaaauaggcaacuuaacauuuaucaggagaaugaucaagcagaaaucuaacgauuaugcagaggacagcgaauucaaagcauuuaguggagcaggauuuaguuuaaaaucgagaacguaa

SEQ ID NO: 5811 - RNA, 1623 nt, Diabrotica barberi
augagugcuauaccaggaaguauugcauuugaugaauauggacgacccuucauaauucuuagagaccaagauaagcaaaagagguugaccgggguagaugcacugaagucacauauuuuggcagcgagacaaaucgcucaaacuauaaguacuucuuugggucccaaagguuuagacaagaugauggugucaccugacggugaaguaacagucacuaaugauggugcuacuauuuugaaaaugauggauguugaacaugaagucgcuaaauugcuaguacagcuaucacagucccaagaugaugaaauuggugaugguaccacagguguuguaguuuuggcuggugcccuguuagagcaagcaggaucuuuauuagacagagguauucaucccauaaggauugcugaugguuuugagcuagcuugucaaacagcuguagcucauuuggaaaaaauugcagagcuauuuccaguaucagcagaaaacacugaaccauuaauaaaaguugcaaugaccacucugggaucuaaaaucauuaacaagugucauaaacagauggcagaaauagcuguuaaugcuguuuuagcuguugcagauuuagaacagaaagauguuaauuuugaacuuauuaaaguugaaggcaagguugguggaaaauuggaagacacaacauuaguuaaagguguaguuauugacaaaacaaugucccauccacaaaugcccaaagaacuaaaagauguaaaauuggcuauucucaccugcccauucgaaccaccaaaaccaaagaccaaacauaaguuggaugucagcaguguggaagauuauaaggaacuaagacaguaugaacaagaaaaguucaaagaaauaguugguuugguaaagaaagcuggagcuacauuagcaauuugucaauggggcuucgaugaugaagccaaucacuuauuguuacaacaagaguuaccagcuguaagauggguuggagguccagaaauugaacuuauagcaauagcuacuggggguaggauaguaccccguuuugaagagcuuacuccugaaaaacuuggucaugcugguuugguacgagaaauugcauuuggcaccacuaaggauagaauguugguuauugaagaauguucaaauucacgggcaguuacgauucuugucagaggagguaaucaaauguuaguagcugaagccaagagaagucuccaugaugcauuauguguugucaggaguuuaguucaggaaccaaggguaguguauggugguggagcagcagaaauugccugcaguuuggcagucgcggcucaagcagaucaacuagcuuccuuggaacaauacgccuaucgugcauuugcugaagccuuagaaaguauaccacuugcguuggcugauaacagugggcuguccgcgauccauacacuaggagaagucaaggcuaaacaagcagcuacaggagauccagcucucgguaucgauuguaugaauacuggaaaccucaacaugagagaacaacauguuaucgaaucacucagaucaaaaagacaacaauuuuuguuggccacccaguugguuaaaaugauauugaaaauugacgauguacgccaaccugcaucgggauaa

SEQ ID NO: 5812 - RNA, 342 nt, Diabrotica barberi; identical to SEQ ID NO: 5588

SEQ ID NO: 5813 - RNA, 1605 nt, Diabrotica barberi
augguaucccuaaaucccguaagaauucucaagcaagaagccgaggaagaaagggcagagauugcucgacugaguaguuuuguaggugcuauagcuauaggagauuugguuaggagcaccuugggaccaaaaggaauggauaaaauuuuaguauccagugguagaucugcaggaucaguugaaguuacuaacgacggagcaacuauccuaaaaucgguggguguugauaauccugcugcuaaaauuuugguagauaugucaaaaguccaggaugaugaaguaggagauggcacaacaucagugacaguauuagcaucugaacuacuuaaagaagcagaaaaacuuguagaacagaaaauucacccacaaacaaucauugccgguuggagaaaagcaguagauauugccagaaaagcucuucuagaaacugccaaagauaacagcucugauucagaaaaguucagagaagaucugaugaacauugccagaacuacacucagcucaaagauucuuucacaacauaaagaauauuuugccaaacuggcaguagaugcugugcugagauuaaaagguacaggugauuuacaauccauccagcugauuaagaaaacuggugguacuuuggaagauuccuuuuuggaugaagguuucuuauuggacaaaaaaccugguguacaucaaccaaagagaguagaaaaugcaaaaauccugauagccaacacuccuauggacacagauaaaaucaaaguauuugguucucacauuaagguagauucaauggcuaaaauugcagagcuggaaucugcagaaaaggaaaaaaugaaagauaaagugaacaaaauucuuaaacauaaugcuaauguauuuauuaauagacaguugauuuacaauuauccugaacaauuguuugcugaugcaggaguuauggcuauugaacaugcagauuuugauggaauugaaaggcuagcacuugucacaggaggagagauugucucaacauuugaccauccagaauuaguaaaacuuggaacuuguaagcuuauugaacaaaucaugauuggagaagauauccugcuccguuucagugguguugcucuuggggaagcuugcacaauugucaucagaggugcuacacaacagaucauugaugaagcugaccguucccuucaugaugcuuuguguguauuagcagccacagucaaagagagucgaauuguguauggaggagguugcagugaaacucuaauguccacagcgguaucaagagcugcugcuaacacuccaggaaaagaagcuguagcaauggaagcuuuugccagagcuuuguugcaguugcccacaauuauugcagacaaugcagguuacgacucugcccaauuggucagugagcuuaaggcagcacauaacaguggccagagcaccaugggacuuaacauggaaaagggugaauugggggauaugaaaaccuugggaaucacagaaucuuuuguuguuaaaagacaaguauuaguaucggcaucugaagcagcugaaaugaucuugcguguugauaauauuaucaaagcugcaccaaggaggagaacagaagacaggggaaugugcuag

SEQ ID NO: 5814 - RNA, 852 nt, Diabrotica barberi
auguuucgaaaccaauacgauagugaugugacaguguggagcccccagggccgucugcaucagguagaauaugccauggaagcaguuaaccuagguucagccacagugggacugaaaaguaaaacucaugcuguacuuaucgcguugaagagggcuucuucagaacugucugccuaccagaagaaaauuaucaacauagacgaucacauugguaucaccaucucgggacuuacagcugaugcuaggauucuuaguagauauaugcgaaacgaaugcuugaauuauaaguacucuuuggauacuuauaugccauugaauaggcuuaucaguauuuuagguaacaaaaugcagacauguacccaaagauaugaccguagaccauucgguguaggucuucuaguagcugguuaugacgaaucugguucucauaucuaccaaacgugcccuucugcuaauuuuuaugauugcaaagcuauguccauuggagcccgaucccagagugccaggacauacuuagaaaaacaucuggaugaauugccauccaguucuuuggaagaacuuaucaaacauggauugagggcucuuagagauacucuaccuccagagguugaccuuacaaccaaaaaugucuccauaggcuacacuggaaaaggcgugaccuucaaaauccuugaagaagaagaaacugcccccuacuugucccuuauugagggugaagaacgcagaggaggaggagcugcagcugccgcaauugaggaucuuccugcagauccauugagagaugaugcgggggacgagcccagggaugcagucccugcaguggaaaugucugccauggauaccacagaauag

SEQ ID NO: 5815 - RNA, 2547 nt, Diabrotica barberi
augcccauaaagccuggacaugaaacggaaaauauagaaauaaccuuuagugaugaagaucucccauaugaagaagaaauuuuaagaaacccuuauucaguuaaacacuggcuaagauauauagaccacaaaaagacagcaccaaauaauggcgucaauauaaucuuugaacgagcccugaaggaauuaccaggaucuuacaaauuaugguauaauuauuuaagaacuagaagaaaucaaauaaagaguaaauguauaacagacccagguuaugaagaagugaauaaugcauuugaaagaucauuaguguuuaugcacaagaugccuagaauauggauggauuauugcacauuuuugacagaucagugcaaaaucacuaggacaagaaaaguauuugacagggcuuugagggcauugccaguuacccagcacaacagaauuuggccucuguauuuaaaauuuguucaaaaacaugauauaccagaaacugcaguaagaguuuuucgaagauauaugaaauuauguccagaaaaugcagaagaauuuauagauuaccucacagguauugaaaggcuagaugaagcagcucagcugauggcaaagauugugaaugaugaggguuuuguuucucaacaaggaaaaucaaaacaucaguuguggaaugaacugugugaauugaucucaaagaauccggaaaagguacauucucuuaauguggaugccauaauuaggggugguuugaggagauauacugaucaacuaggccaccuauggaauucucuagccaauuacuauguucgaaguggucuauuugaaagagcucgugacauguaugaagaagcuauucaaacagugaccacuguuagggacuucacccaagucuuugaugcuuaugcccaauuugaggaacugaguuuaagcaaaagaauggaagaaguugcuaacaagucuaguccuacugaagaugaugauacugaauuagaauugagacuugcaagguaugaauauuugauggagagaagauuguugcugcugaauucuguuuuguugaggcagaauccacauaaugugcaggaauggcacaaaagaguacagcuuuaugaaggaaaaccaguagauauaaucaacaccuacacagaagcuguucaaacuguagauccaaaacuggcuguaggaaaacuucauaccuuauggguggacuuugccaaauucuacgaaaccaauggucaaauagaagauucacgccucaucuuugaaaaagcaucccaaguuucuuacgucaaaguagacgauuuggcaacaguguggugugaaugggccgaaauggaaauaaggaacgagaauuaugaugaagcuuuaagacucaugcauaaagcaacuuuuaugccuagucgaaaaguagcauaucaugaugacacugaaacaguucaaagucgacuguauaagucucucaaaguuuggucuauguacgcagauuuagaagaaaguuucggcaccuuuaaaucuuguaaagcuauuuacgacaaaauaauagauuugaaaauugcaacaccucaaauuauuauaaacuaugggauauuucuagaagaaaauaauuauuuugaagaggcauucagagcguaugaaaaaggaauaucucuauuuaaauggcccaauguauacgacauauggaacaccuauuugacgaaauuccuaacucguuaugggggaucaaaacuagaacgugccagagaucuguucgaacaaugcuuggauggauguccacaacaguuugccaaacaucuuuaccugcucuacgcgaaacuagaagaagaacauggaauggcuagacacgcuauggcuguauaugaaagaucaaccaaagcuguuccagagcaagaaauguucgacguuuuuaauauauauaucaaacgagccgccgaaaucuaugggauucccaaaacgagacagaucuacgaaaaggcuaucgagguacuuccagaggauaaaacuagagaaaugugucuuagauuuucugauguggaaacaaaacuaggugaaauugauagagcccgagcuauauaugcucacuguagccaaauuugugauccgaggauaacggcagaguuuuggcagauauggaaagaguucgaaguucgucaugguaaugaagauaccaugagagaaauguuaagaauaaaacguagcguacaagcuguuuacaacacgcaggugaauaugaugucggcacagauguugaguucggcgggcagcaugagcgguacaguagcggauuuggcgccgggaguuaaagacgguaugagacucuuggaagccaaagccguugaaauggcgggaacuucacaagucgccaaaccuggagguauuauguuuguuaggggagaaacucaaggagcuaauaaagauaagguuguuaauccagacgaaauugauauagacagugaagaaucggaagcggaagaagaaguaccagucgaaaagcagaacguaccgucagaaguuuucggaagucuuaagaaacaaggacagggagucgaugacgauuag

SEQ ID NO: 5816 - RNA, 1176 nt, Diabrotica barberi
auggccaacggaccgauagcagaaagaaaucgagaugccacuauuuaugugggaggccuagaugauaaaguuucggagucccuauugugggagcucuuuguacaagcagggccuuuagucaauguacauaugccaaaagaucgaguaacaaccaugcaccagggcuauggguuuguagaauuuaugggagaggaggaugcagauuaugcuauuaaaauuaugaacaugauaaaauuguaugggaagccuauaagagucaacaaagcuucggcucaucagaaaaauuuagauguaggagcuaacauuuuuauuggaaauuuagacccagaaguagacgaaaaguuacucuaugauacuuuuucggcauuuggaguaauauuacaaacaccuaagauuaugagagauccugauacugguaacuccaaaggguucgcuuucaucaauuuugcaagcuucgaagcaucagaugccuccaucgaagccaugaauggccaauauuugugcaauagacccauaucaguaucuuaugcuuucaagaaagacucaaaaggagagagacauggaucugcagcugagcgucuucuugcugcucagaauccauuaucacaggcugauaggccucaucaacuguuugcugaugcaccuccaauagguuugaugcccauguccauggccccaccuccuccaccagucauaaugacaggaaugaugcccccaccgccuccaacacuaucaaacuugccaccgccuccuccaccuguaccaccaccaggaaugggaaguuccuucccagcaggaauaccaccuccuccauuaccucccucccaaccacccuuaccaccuggugcaccaccaacgaugccaacugcggcaggagcccaagccagacccccuuuaccaccgccuccaguggcaccucauggacugauaccuccaccuccaacguggacaggugcagcuccugggagcuugcccauuccuccagguccaccugcuccugcgggaggugcugcauuugguggaauguucccgccucccccaccaccuggaggaagaccaccaccgccuaacuggaggccuccuccaccaccaccaccagguuuugccggaaguagaccagcuuucccuguaaggggaccuccaccacccccaccuacuuuugauacuaaaauuuga

SEQ ID NO: 5817 - RNA, 774 nt, Diabrotica barberi
augggucguguaauucgugcacaacguaaaggugcgggaucuguauucaaaucccacacaaaaaagaggaaaggagcacccaaacuacguuauuuagauuucucagaaagacaugguuacauuaaggguguuguaaaagauaucauacaugacccuggccguggugcuccauuggcaguaguacauuucagagaucccuacaaguuccaaacuaggaaggaauuguuuauugcccccgaaggaauguacacuggacaauuuuuguacuguggaaagaaagcuaaccuccaaauuggaaauguauugccuguaggaacuaugccugaagguaccauuguaugcaacuuagaagaaaaaacuggugaccguggucggcuagcucgugcaucuggaaacuaugcuaccguaauugcccauaaucacgauacaaagaaaaccagaguuaaguugccuucuggagccaagaaaguuauuccaucaaacaacagggccaugguugguaucguugcuggagguggucguauugacaaaccaaucuugaaagcaggucgugcuuaucacaaauacaaaguuaaacguaacugcuggccuaagguacgugguguugcuaugaacccuguugaacauccucacggaggugguaaccaucaacacauugguaaagcauccacaguuaagagaggaacaucugcuggucguaaaguuggucuuaucgccgccaggagaacugguaggauuaggggaggcaaaguugaugccaagaaagaggauuag

SEQ ID NO: 5818 - RNA, 417 nt, Diabrotica barberi
gaaauaauggcacguacaaagcaaacagcccgaaaauccacuggugguaaagcaccacguaaacaguuagcaacuaaagcugcucgcaagagugcaccugcuacuggaggaguuaaaaaaccucaucguuauaggccagguaccguagcgcuucgugaaauuagacguuaccagaaaaguacugagcugcuuaucagaaaacuaccuuuccaacgucuuguccgugaaauagcucaagauuuuaagacagauuuacguuuucagaguucggcaguuauggcuuuacaggaagcgagugaagcauauuugguagguuuauucgaagauaccaaccuaugcgcuauucaugcuaagagagugacuauuaugccuaaagacauucaguuggccagaagaaucagaggagaaagggcauaa

SEQ ID NO: 5819 - RNA, 1593 nt, Diabrotica barberi
auggcuaucaguuuguuaaauccaaaagcugaaguggcuagagcugcacaagcccuagcuguuaauauaucagcggcaaaaggcauucaagauguaaugaagucaaaccuuggucccaaaggaacagugaaaauguugguaucuggugccggcgauauaaaaauaaccaaagauggaaauguucuauugcacgaaaugcaaauucaacaccccacagccucccuuauugcucgagccucaacugcccaagaugauaugaccggcgacggcacuacaucgacuguguuagucauaggugaacuauuaaaacaagccgauauuuacauagcagaaggucuccacccuagauuguuaacagauggcuuugauaaggcuaggacaaaagcguuggaaguacuggagaaaaugaagauuccaguugaggcuaacaaagaaacuuugacagauauuugcaggacgaguuuaagaacaaaguugcaucaaaaacuggcugauguuuugacagacguuuguguggaugcuguucuagcuauaaagaaagaugacaaaccuguugaucuucauaugguugaauuaauggaaaugcagcacaaaacagaaacagauacucaguuaauuaaggguuuaguccuggaccauggcucccgucauccagauaugccuaaaagucucaacaacugcuacauuuuaacauguaaugucagcauggaauaugaaaaaagugaagucaauucaggauucuucuacaaaacugcagaagagagagaaaaauuagugacugcagagcgugaauucauugagcagagaguuaagaaagucauugaacugaaaagaucacucuguaauggaacugauaagacuuuuguuauuauuaaccaaaaagguauugaccccaugagccuggauaugcuugccaaagaaggaauaauagcucucagaagagcuaagagacguaacauggagcgucuaucauuggcuugugguggaguagcuaugaacagcuuugaugaucugcaagaaucucaacuugguagagcuggacauguauaugaacauguguugggagaaaauaaguauacauuuguggaagauugcaaaauuccucaaucaguuacuauuuuaauaaaaggacccaauaaacauacuuugacucagauuaaggaugcuguuagagauggauuaagggcuaucaauaaugccauugacgauaaagcaguuauuccaggugcuggugcauuugaagucacagccaauaaagaauugcuagcauuuaaagacacuguuaaagguaaagcucgucuaggaguugccgcuuaugcagaagcuuuacugguaguucccaagacuuuggcuguuaacucuggauuugaugcacaggacaccauucuaaaacuacaagaagaaucccguuugaauccagacccaaucgguuuagaucuaaccucuggggaacccaucaauccuaaagaugccggcaucuaugacaacuauauuguuaaaaaacaaauaaucaauuccuguucggucauugccagcaaccucuuauugguugaugaaauuaugagggcuggaaugagcagcuuaaagggauaa

SEQ ID NO: 5820 - RNA, 3285 nt, Diabrotica barberi
augucuagugguaguuuagcagacaacuccaucgauccuccagccaaaaagcggaagcuugaaucaaagauugcuacccucgaaauggcgaacaaugaagcuucaggauccuccaccagugauauugaugagggacuuuacucgagacaacuguacguuuuggggcacgaagcuaugcgccgcauggcaaauagugauguucuaauaucagguuuaggugguuuggguguagaaguagcuaaaaauguaauucuuggugguguuaaaucuguuacccuucacgaugaggcucuuuguacuauuaaagaccugucaucccaauuuuauuuaacagagggggacauugguaaaaaccgcgcagaagccugcuguaagcaguuaucugaacucaacaccuauguccccacaaagucuuacacagggccucuugaugaagccuuuaucuuaaaguucagugcuguugucuuaaccacaagcaaucgugaagagcaacuaagaaucagcgagauaacacacgacaacaacauugcauuaauuauagcagacacgaaaggccuuuucggacaaguauuuugugauuucggaaaauccuuuacuguuguagauguaaacggagaaccuuuagucucugcgaugauagcagacauuucaaaugaugucgaaaguguagucacuugcauugacgauacaaggcaugguauggaggauggagacuauguuaccuucucggaaguucugggaaugacugaauuaaauaacugugaaccaaucaaaaucaaaguauuaggaccauacaccuuuaguauuggugauaccaccaaguuuucuaaauacaccagaggugguauuguaagucaaguuaaaaugccgaaacaucuggaauucaaaucguuuaaagauucucuugaaaauccugagauaccaauuacugauuuuucaaaaauggauuuuccuacgcagcuucaucuagcuuuuaccaccuuacauaaguuuguagagaagucuggaaggcuaccuaaaccauggaacaaugaugaugcaacggaauuuguuaauuuagcuaaaucauuagcugcgaagggugauucugaagcagaaguuaacguagaccuccuagacacauuugccaagguaucagcuggagauuugaauccuauaaaugccacuauuggugguauugucgcccaagaaguaaugaaggcauguucuggaaaauuccauccuauuuuccaaugguucuauuaugaugcuauagaaugccuaccacaagauaaaucagaaaucacugaagaacuagcugcaccuacuggaagcagauaugacggccaaguugcuguuuuugguaaagaauuccaaaagaagauagcaucacugaaauauuuuauuguuggugcuggagcuauugguugugaauuguugaagaacuuugcuaugauggguguaggaacacaaggagaaguuacuguuacugacauggauuuaauugaaaaaucuaauuugaacaggcaguuccuuuucagaccacauaacguccaacaaccaaaaucugccacagcugcaaaggccauuaaaaagaugaauccugauaucaauguuguugcacaugaaaaucguguuggacccgaaaccgaaagugucuacaaugacgauuucuuugaaaagcuugauggaguugccaaugcacucgauaacguagaugcuagaauuuauauggacagaagaugugucuacuaccgcaagccucuucuagagucuggaacccuaggaacuaagggaaauacucaagugguggcgccuuuccucucugaaucauacaguucuucucaagauccuccagagaaaagcauuccaaucuguacuuuaaagaauuucccuaaugcuaucgaacauacucuacaaugggcaagagauauguuugaaggauuguuuaaacaaaaugccgagaaugcuucguuguacauaacagacccugauuuccucgauaggacuguuaagcuaccugggguacaaccuuuagagguauuggaauccguaaaggcugccuuaauugaugagagaccuaaagauuuaaaugauugcaucgcuugggcacguaaucauuggcaagaacaguauuccaaccaaauuaggcaguuguuguucaacuuuccuccugaucaauuaaccaguacggggcaguuguucuggucgggaccgaagagguguccagaagcgcuuacuuuugacgucaacgauccccugcacuuggauuauguuauugccgcagcuaauuugaaggcugaaguuuaugguauaccaacuaguagaaauagagaacaaaucgcagaagugguuaugcaagucaauguuccagaauucaucccuaaaucuggcguaaagauagcaguuacggauucucaaauggcuaugaaugguaauaauguggauuuggaucgcguuucccaaauuaaagaagaacuacccucaguagcagaacuagguggacuacgucuuacuccuuuagaauuugaaaaggacgaugacaccaauuuccacauggacuuuauaguugcugcuucaaaucuucgugcagcuaauuacaaaauaccucccgcugauagacauaaaucaaaacuuauugcugguaagauuauucccgccauagcaacaacaaccucaguagucgcuggaaugguuugcuuggaacuuuacaaacucaccagaaguuacacaucccuaacuccauucaaaaauaauuuuauuaaccucgcucugccuuucuucaguugcucagaaccaaucgcagcccaacaaauggaauacugugguaacaaauggacacuaugggaccgcuucgauguucagggagaaaugacgcuuagugaauuuuuggaauacuucaaggaaaaacacggucuugaaauuacuaaccucgcucugccuuucuucaguugcucagaaccaaucgcagcccaacaaauggaauacugugguaacaaauggacacuaugggaccgcuucgacguucagggagaaaugacgcuuagugaauuuuuggaauacuucaaggaaaaacacggucuugaaauuacgauguugucccagggcguuugcaugcuguauucguucuucauggcaaaagcuaaagcucaagaacguuucggucuuucaaugucagaagucgucagacgaguaucaaagaagaaaaucgaaccucacguaaaagcauugguauucgaacugugcugcaacgauuccacuggugaagacguggaaguuccauauguuaaauauaauuuauguuga

SEQ ID NO: 5821 - RNA, 1008 nt, Diabrotica barberi
auggcagacgcugaugaucuauuagauuaugaagaugaggaacagacagaacaaaccgcaacugaaacggcaacuacagagguacagaaaaagggugucaagggcacauauguaucaauacacaguucuggauuuagagauuuucuauuaaaaccagcaauucucagagcuauaguggacugcggguucgaacauccuucagaaguucaacaugaauguauuccucaagcuguuauuggcauggauauucugugccaagcuaaauccgguauggggaaaacugcuguuuuuguauuagcuacacuccaaguaauagauccuacagaaaauguuguauauguucucgucaugugccauaccagagaguuagccuuccagauaagcaaagaguaugaacguuucaguaaauauaugcccaauauuaaaguaggggucuucuuugguggcuugccuauccagaaagaugaggagacguugaaaaauaauuguccgcauauuguuguggguacuccaggaagaauuuuagcauuggucagaucgaaaaaacuuaaucucaaacaucuaaagcauuuuauuuuggaugaaugugauaaaauguuggaguuauuagacaugagacgugauguucaagaaauauaucguaacacuccccacgaaaaacaagucaugauguucagugccacccuaaguaaagaaauuagaccaguuugcaagaaauuuaugcaagaucccauggaaguauauguugaugacgaagcuaaauuaacauugcauggucuacagcaacauuauguaaaacuaaaagaaaacgaaaagaauaaaaaguuauuugaauuacuagauguuuuggaguucaaccagguugucauuuucguaaaauccguacaaagguguguggcccuggcacaauuacugacggaacagaacuucccagcgauaggaauccacagaggaauggaccaaaaagaacgacugucccgguaugaacaauucaaggauuuccaaaag

SEQ ID NO: 5822 - RNA, 1470 nt, Diabrotica barberi
augguaacucucgaagacguugaaaugaaaaaugcagacaguccuccaggauuagaagcuggugauacaaagaaagauaccgaccuacaaaguguaauagaaauucgugaacaugcaagacaaauagaaaaaucagucacaaguaaagaaaaccguuucaucuuaagaguuuuacguugcuugcccaacacuagaaggaagcuuaauggacugguguugagaagucucauuacucaaauauauccuguagcugaacgugaugcccucauuaguuucgucgaggaagcuucuggagaacucgacgccacccagucaagagcaaggucagcuguuaagucacccguucccgagguagauacauauauaaaucuuuuaauacuaguacguuuaaucgacaccaauaaguuaguugaagcagagcgauguucccaagcucucaugaauaaaauaacuaaccaaaacagacguacuauagaucauauugcugccaaguguuauuucuaucacuccaggguugcugaauuaaccaacaaauuggauucaauuagaggcuuuuuacauucucgucuacguaccgcuacacucagaaaugacuucgaaggccaagcugugcuuauaaacugucuguugagaaauuauuugcauuauucauuguaugaucaagccgacaaacuagugaguaaauguguauuuccugaaacugcaaguaacaaugaaugggcaagguucuuauacuacuugggcagaauuaaggcggcaagauuagaauacaguguagcgcauaaacaucuugugcaggccuugagaaaagcaccccagaaugcugcuauugguuucagacagguuguucaaaagcuuacuguuguaguugaacuacugcuaggagauauuccagaacgacagauuuuuaggcaaucuaguaugaggcacucccuugccccauacuuucaacuaacacaagcaguuagaaugggcaauuugcaaagauuuggugagguguuggagaacuucggcccacaauuuagacaagaucauacauuuacacuaauuuugagacugcgccacaauguuauuaaaacagcuauaagauccauaggauuaucauacuccagaauaucuccccaagacauagcuaagaaacugggacuggauucagcugaagaugcagaauuuauaguagcaaaagcaaucagagauggggugauagaagcuacacuugauccacagggagguuacaugaggagcaaagaaaguacugacaucuacugcacaaaggaaccucaacuggcguuucaucaaagaauaucguuuuguuuagauuugcacaaucaaagugucaaagcuaugagauauccccccaaggcguauggcaaagaacuugaaucagcugaagagagaagggaaagagaacagcaggauuuggaguuggccaaggaaauggcugaagaagaugaugaugguuuuccuuaa

SEQ ID NO: 5823 - RNA, 1668 nt, Diabrotica barberi
auggcuaccaaucaccaaaaccuuccaauuucgaguauucuuaaaucaaaaagugaaguugaugaugaaccaaaaaagaaaucaagagaagauuggcguaaggccaaggaacuugaagaagccagaaaagcugguacagcuccggcugcagucgaugaagaaggaaaagauaucaacccccacauuccacaguacauuucaaaugcaccuugguauuauggcacaucuggaccuacccuuaaacaucaaaggccccaagaagagaaacagaaggaguacucaaacaucgacgaaugguacaaacgggguguugacacuucaaaaauaguuacuaaauaucguaaaggugcgugugaaaauuguggagcuaugacucauaaaaagaaagauuguauggaaagaccucgcaaaguuggagccaaauuuuccggagcaaauauugcaccagaugaauuugcccagaaaaacuuagcguugagcuuugauggaaaaagagaucgauggaguggguaugacccaucugagcauaaagcaguaauagaagaguuccagaaaguugaggaagcuaaaagacaacugaaggcugacaaguuaaaugcaaacgaaucuucugacgaugaagaaaaagaugaggacaaauauguagaugaaguugauaugccugguacuaaaguagacagcaaacagagaauuacuguaagaaauuugaggauaagagaagacaccgccaaauauuugagaaaucuugauuuagguucugcuuauuaugaucccaagacaagaucuaugagggaaaacccuaauccugaaaaagaugcuacguacaguggagagaauuucguucguuuuacuggugauaccaccaaucaugcuaaggcucaguuauuugcuugggaagcauaugaaaaggguguggauguucaucucuuagcugaaccaacaaaacuagaacugcucaaaaaagaauaugagaaaaagaaagaagagguuaaaucaacaauucaaagcagcguucuagauaaauauggugggcaggaacauuuagaagcaccaccuaaaagcuuauuguuggcucaaucagaaguuuauguggaauauucgagaucugguaaagucauuacuggggcggaaaaagaagucauuagauccaaauaugaagaagauguguacauaaacaaccacacaucaguguggggaucauauuggagaggaggacaauggggauacaaauguugucacucuuucauaaagaauuccuauugccuaggcgaggcaggaaaaacgguuaacgcuccuguaacccaagauauuccaaaagaucaagacguuggugaagcaagcaguacaaaggaagcugggauaucagacggugaaagcgaagauaguaguuccaguaauucaucagaaggcgaaaaacugaagaagaaacagagaagauuaaagaaaaaggaaaagaaggcaaagaaaaaggagaagaaagcaaaagaaaaauuaaagaaaaaacaggagaaagaaaaggccccagaaauagacgaggaaauaauguuggacgauagaaaaaggccguacaauaguauguuugacgcuaaaaaacccacagaggaagaaauggaggaauauuauaaaaagagaaagagggaugaagauccuaugaacaacuuuauguaa

SEQ ID NO: 5824 - RNA, 717 nt, Diabrotica barberi
uauuugcggcuggacguccuaauucgaacuuccucuucuuacggagaggcuuccucuugccuccuguggauuuuaguuuauucguucagaauggguauuaguagagaccauuggcauaaacgaagguccacaggaggcaagaggaagccucuccguaagaagaggaaguucgaauuaggacguccagccgcaaauaccaagcuuggagcacguagaauucacuauguccguacacgaggagguaacuugaaguaccgcgcauugaggauugaaaaaggaaauuucgcauggggcagcgaagguacugcucgucaaacacguauuauugaugucguuuacaaugccaguaauaacgaauugguacguaccaaaacauugguaaagaaugccaucguuguuauugacgcaaccccuuucagacaaugguaugaaagccacuauauuuuaccuuuaggacgcaagaagggggcaaaauugacagcagacgacgaagaaauuuucaauaagaaacguagcaaaaaaguacagaaaaaauaugaaacuaggcaaaaaacagcuaaaguagaaccugcguuagaagaacaauucucaacuggaagguuauuagcuugcuuagcgucaaggccaggacaaugugguagagcugaugguuacgucuuggaggguaaagaacuggaauucuacauucguaagauuaagucuaagaaagcuaaauaa

SEQ ID NO: 5825 - RNA, 936 nt, Diabrotica barberi
auggauagacuucuucgauuaggagguggaaugccagguuuaacccaggcaccgccgccuucagaugcuccuguuguggauacugccgaacaaguauacauauccuccuuagcacuauuaaaaauguugaagcacggccgagcuggaguacccauggaaguaaugggucuuauguuaggagaauucguagaugacuauaccguucguguaaucgauguauuugcuaugccccagacugguaccggugucaguguagaagcuguugauccaguuuuucaagcaaaaaugcuugacauguuaagacagacugguaggccagaaaugguuguggggugguaucauucccauccagguuucggauguugguugucuggaguggauaucaauacccaacaaaguuuugaggcucucucggaaagagcuguagcaguaguaguugauccaauacagucagugaaaggcaaagucguuauugaugccuuuagguuaauaaauccgaauaugaugguauugggccaagaaccucgacaaacuacauccaacuuaggacaucuacagaaaccaucaguccaggcuuugauucauggucuaaaucggcauuacuacucuaucaguauuaauuacagaaaaaacgaauuggaacaaaaaaugcuacuaaaucuccauaaaaaauccuggauggauggucuaacuuuagcagauuacucugaaaauuguagugugaaugaaaagacuguugcugauauguuagaacuagccaagaauuacaacaaggcauuagaagaggaggagaaaaugacuccagaacagcucgcuauuaaaaauguuggcaaacaagauccuaagaggcauuuagaagaaaagguugauauuuugaugaccaauaauaucguccagugcuugggagcuaugcuagauacaguuguuuuuaaguaa

SEQ ID NO: 5826 - RNA, 1098 nt, Diabrotica barberi
augacgguaauuaacaagauggagguggacggcgguccgaagggggaagguuuucggucguauuauauuacaaagauugaagaauugcagcuuauaguggccgaaaagagucaaaaucuuagacguuugcaagcucagagaaaugaacucaaugccaaaguucguauguugagagaagaauugauguuacuucaagagcaaggaaguuauguuggagaaguuguaaagcccauggauaagaaaaaaguccuugugaaaguucauccagaaggaaaauuuguaguugacauugacaaaaacauagacauaaaugauguuacuccaaauugucgaguagcccucagaaaugaaucuuacacauugcacaaaauucuuccaaauaagguugauccuuuaguuuccuugaugaugguggagaaagucccugauucaacuuaugaaaugguaggaggacuugacaagcaaauuaaagaaaucaaagaaguaauugaacuuccaguuaaacauccagaacuguuugaugcccuugguauugcacaaccuaaggguguguuguuauauggaccaccagguacuggaaaaacucuucuggcacgugcuguagcucaccauacagaguguacauuuauuagaguaucugguucagaauugguacagaaauucauaggagaaggaucccguaugguaagagaacucuucguaauggccagagaacaugcuccuucaauuauuuucauggaugaaauugauuccauuggaucuucccguauugagucaggaucugguggugauucugaaguccaaagaaccauguuggaacuucucaaucaauuggaugguuuugaagcuaccaaaaacaucaaaguaauuauggcuaccaacagaauugauauuuuggaucccgcuuuacucagaccaggaagaauugacagaaaaauugaauuucccccaccgaaugaagaagcuagauuggacaucuuaaagauucacuccagaaagaugaaccuuacaagaggaauaaaucuuagaaaaauagcugaguugaugccaggugcuaguggggcugaaguuaaaggugugcagaccaggaagaauuga

SEQ ID NO: 5827 - RNA, 600 nt, Diabrotica barberi
auggugaaaauauauugucucaguguuuuauacaaaggaccuacaacugcgaccugguugaaaucagcuuuugaacuucaaagcuucaguuuuuuccaaagagggucaauacaggaguucaugucauucuuuugcaaaaccauaguggaaagaacaauaccagccucaaggcagaguguuaaagaaggagaauauuugugucauguauauguaagagcugauaacuuagcuggcguuaucauaacugaccaugaauacccaucaaggguaucucacacucuaauaacaaaaauacuagaugaauucggugccaaaauuccugcagcuaacuggcccaaccuugaagagagagauguagcauuuccacaauuaaauaccuacuuagcgaaauaucaaaauccuagagaagcagaugcuauuacuaaaauucaagaagaucuugaugaaacgaagauuauuuugcauaauaccauacaagcaguuuuggaacgaggcgagaaacuagacgacuuggugagcaagucggaagguuuaagcauacaguccaaggcauucuacaagacagcgagaaaaacgaauaguuguuguaguuuuacauag

SEQ ID NO: 5828 - RNA, 606 nt, Diabrotica barberi
accagugguggaguagugcuugcuguagaaaaacguauuacuucccccuuaauggaaccuacuacaauugagaaaauuguagaaguugacaaacauauuggaugugccguuucaggacuuauggcagauucaaggacuaugauagauagagcucguguggaaugucagaaucauugguuugucuacaaugaaaauauaaguguagaauccugugcacaagguguaucaaauuuggcuauucaguucggagauucugaugaagauggugcagccaugucuagaccuuuuggaguagcaauuuuguuugcugguauagaugaaaaaggaccucaguuguaccauauggauccaucaggaacauuuguucaguuugacgcaaaggcgauaggaucaggauccgagggugcacagcaaaguuuacaggaggcauaucaucgcaguaugacccuggaagaagcuaccacaacugcuuuaacaauucuaaaacaaguuauggaagaaaaguugaauucuucaaauguugagguuaugacuaugacuccaaaagauauguuccacauguucacaaaggaacaaguggaagagguaauugcuaaauugucuuaa

SEQ ID NO: 5829 - RNA, 930 nt, Diabrotica barberi
augaagauggguguucagguuuugauuacugauccaaaucaacuggaagcaauccgcacaagagagcucgacaucaccaaagaacgcauccaaaaaauccucucuacugguguuaauguuauucuugcgaguggugguaucgaugaucuuugcuugaaauacuucguugaaaauggagcgauggguguaagaagaguaaagaaagcugacuuaaaacgcauugccaaagcaacuggugccacuuuccuaacuucucuuaguaacauggagggagaugaaaguuuugauucuagcaugguaggagaggcagcggaaguuguucaagaaagaauuucugaugaugaauugauaauuauuaaaggaccaaaagcacguacagcagccucuaucaucuugcgaggacccaacgauuucuauugugaugaaauggaaagaucuguucacgacgcguuguccguuguaaaacgcguacucgaaucgaaaagcgucguagucgguggcggcaguguugaagcagcacuuucgauauauuuggaaaacuucgccaccacgcuaagcuccagagaacaauuggcuaucgccgaauucgccaggagcuuacugguuauuccuaaaacguuggcaguuaaugcagcgcaggacgcuacagauuuaguagcuaaguugagggcauaccauaauuccagucaaacgaaaaaggaucaugcgcauuugaaauauguaggauuagaucucauggaagguaccguucgagauaaccgaaaagccggaguuuuggaacccaccauguccaaaauaaaaucccuuaaguuugcaacagaagcugccauuaccaucuugagaauagacgauaugaucaaauuggauuccgaacaaagaggcggaaagagcuaccagcaagccauggacaguggagaauuauaugauuaa

SEQ ID NO: 5830 - RNA, 993 nt, Diabrotica barberi
auguuuaauucugcugccccuccuuuguggcauaacggccccguaccuggagaauuuuauaauuuucccggcaaacagaccagcuauuccaacccuauaacacauacacagucucccguuacaacaucaacuucuguauuagcuauuacuuacgauaaaggaguauugauagccggagaucugguugcuucauacggaucuuuagcuagguacagaaauugcccgaggguuauuaaagucaaucagaauaucaucuugggagccggaggagacuaugcugauuuccaauacgucaagaguuucauugagcaaaaaauaauugaugaagaaugcauugacgauggacuaaaaaugaaaccaaaaucauuguacugcuggcuuacaagaguaauguaccaacgcaggaguaaauuagaccccuuuuggaauaauuugguuauaggaggaauccaggauggagucccguuccuuggaacuguagauaaauugggaacugcauauacagacaaaguuaucuguacagguuauggagcccacauagccuugccucuucugagagacucguuagauaaaaauggagcucuuaacuuggcugaugccaaaacucugauucacaaaugcauggaaguguuguucuacagagaugccagaaguuuucccaaauaucagcuugguguuauugauaaggaugauggcgucacgauccagggaaccauagauaaauugggaacugcauauacagacaaaguuaucuguacagguuauggagcccacauagccuugccucuucugagagacucuuuagauaaaaauggagcucuuaacuuggcugaugccaaaacucugauucacaaaugcauggaaguguuguucuacagagaugccagaaguuuuccuaaauaucagcuugguguuauugauaaggaugauggcguuaguauugaggguccgauuucagucgaagaaaacuggaguauugcccauaugacauaa

SEQ ID NO: 5831 - RNA, 1698 nt, Diabrotica barberi
guggaaggaugcaaggaauugcuagaaguaccgggaagaaaauuucuauaugaaggagauuuguuagaaauugauccaacagaaaauacaucuuugaaaacuguucauguguauuuauuuacagauggauuuaugauaacaaacagaaauuccaauagucgagguuugaugaaauacauuuaugaaauaauguaugauuuaaguagucuagcaguggucaacgugagagauuuaggaaacguuaaacaugcguuuaaauuguuaauuuuuccggauacgagaguuuuucaauguucuucuaauuccaacaagaaagagugguuggacaaguuugaccaagcaaagaagacuagauuagcccaagagcaacauaagagggagucaauuucggaaaaaucacccucucgaucagcuucgauagagucuccuaguuauaacccuuuugacgaaguugaagacgauguaggaauggugcacccagaaugguuuuuggacauuccagaggaacuugauguguguguagcucaaagacacuucgaagaggcucuuucauuguugcaaaaagcuaaggaauauauuagccaaaugacggcugguaaugagaaacacgaucauguguuccucgauauucaaagaaagguugaacaacgacaaaauagucuuaccgaaguuuuaaugaaagaacuggaaguuaauccugauaaaucuuugcaagguggauugagggcugcuagaagagcaguaagguuauuaaaucaauuaggaagagaaaaccaaucauguaacuuauuccugaaauuguguagcaguauguugaggacacaguguaagcguguaaaaagagaaggauccaccacaacauacauacgaaauuuggcgaguguaguuuucacuaacaugugucauaugucggaugaguuucuaagggccuuucccgacucaccaacuugugcuucagcuuauguuguuugggccagcaacgaauugcuucuuuuuacuggacauuuuauaaaacaaguauuuaugccccagacuucgcugucaacugugacagaaugcauaguauuaguccgaacgcaaugugaaagguuauacaguuauggucuggauuuauguuaccaauuggauggugcuuuacggucuuccuuagucaaagcuuuaaaagacgcaagagauaaacuuauagauucgaucaaacuuagagcccuagaagauaaauggaucccgauuaacuugcauuccaaguccgcuuugggaagauuucuacacgaacauucgcaaaugggauuaaauuuggagaguuauguuucaggugacacuuggauucaacuaacagcaaguacuuuaucauuuacaaaaauguuuuuccaauuguuaaaugacuguaugaaguuaaaaacgacugaauugguauacaccauagacgaaacuuuguauaauguguucgacgcucaauugaaacacaaugaaaaugcucuucgcaaugaguuaaaucaggaucaaagaagcuuucuaacuaaaaaugcugaauuuuuacuggucaauguagucgaaguaucgcagaaaauauacagucaaaaugugggcuaugagugugcaacacuuaaaaaacuacaaggcgaauauguggcuuuaaaaaagggcguuucuccaacaaccagaaguacuaaaacaaaauacucaucugaauuuuuguaa

SEQ ID NO: 5832 - RNA, 3105 nt, Diabrotica barberi
auggaugaauuacagaaauuggaauaucuuucauugguuucuaagguuuguaccgaguuagaaaaccaucucgguaugaaugauaaagauuuggccgaauuuauuauucaucuuuccgagaagaaugguacauuugaaucuuucaaaaaggcacuuauagaaaauggagcugaguuuucagauuccuucaucucaaauuugcuaagaaucauucaacauaugaaaccgaagaaaaauaaaucgaaaguugaagcugauguguaucaaaaagaaagucuggcuaccaaauuuccugguuuagcuuuaccaaacgaaaaacaaaaaccuuuguuuauagaugaagaagcaccugcugaaaaaaaugaagaugaugacauuguagcugaccuaaugaaacaauuugaagcggacgcucccucaaacagucaaauccaaacaacaacuaaaucuggaagugcaagcccuauagaaagaaaaagaucgucaagaaguaggucuagaucuaaaccaagaaaaauacggaaaucuagaucaagggacagggacucuagaaaggacaaaagacgaaguagauccagagaccagaagaaaaacagaagagauagaagugguucuaggagcaaaagaaauaaagaaagaaguaggucuaggaauaggagaagcagaucaagggauagaagaaguagaucgagagacaggagaaacagaucuaaggaucgaaaauacaaaaauuauucuagagauaaagauaggagagaaagaagcaauucgagggauauaaaacgggauagaaguacugagaagaaguucaaaagugaaaaagauaauccagaguucgaagaugauccuaacccaggaaaaauauauaauggaaaaguaucaaauauuguaccuuuuggaugcuuuguccagcuggagggacuuaaaaggagaugggaaggcuugguucauauuucacagcuuagagcagaaggcagaguuacuaauguaucugaaguaacaucuagaggagcuagaguaaaggugaaaguauugacaguaacaggucagaaggugucauuaucuaugaaagaugucugucagauuacugguaaagaccuuaacccacauucccacgcuccgacugaaagagaagauagagauagaaauccugacaggccuguaaacagcaguacaucuguauugagacugccaguaaauauagaugaaggagaagaagacucucggaaacgaguaacaaggauuucaagucccgagagaugggaaauaaaacagaugauuucaucaggauguauugcuaagagugaguugcccgauuuugaugaagaaacuggauuguuacccaaggaugaagauggagaggcugauauugaaauugaauuggucgaagaugaagccccauuuuugcaaggucacgguagggccuuacaugaucuuaguccuguaagaauagucaaaaauccagacggaucauuagcucaagcugccaugaugcaauccgcuuuggcuaaggaaagacgggaacagaaaaugauucagcgggaacaggaggucgauucccagccuuccgguaagaauaagaguuggauagauccucuuccagaagaugaaucaagaaugaugggcagaggaauaggauuacaaguucaagauuuaccagaauggaaaaaacacguaauagguggcaaaaaaucaucauuuggcaagaagacuaacuuaacaauaauagagcaacgucaauccuuaccaauauauaagcucaaagaagaauuacgaaaagccguaaccgacaaccaaauucuuaucguuauuggugaaacugguucaggaaaaacaacucaaauaacacaguacuuagcugaagccggauuuacgucgagaggaaagauugguugcacccaaccaagaagaguagcagcuauguccguagcuaaaagaguugcugaagaauucggaugucguuugggacaagagguugguuacacuauucguuucgaagauuguacuagucccgaaacuaugauaaaauacaugacagaugguauguuacuaagagaaugccucauggaccuugaccucaaacaauacucaguaauaauguuggaugaagcucacgaacgaacuauccauacagauguucucuuuggauuacuaaaacaagcagucaugaaacgagaagaauuaaaacugauaguaaccucagcuacguuagaugcuguaaaauuuucgcaauauuucuucaaggcgcccaucuuuacuauaccugguaggacuuucccuguugagguucuauauacaaaagagccagaaacugauuauuuagaugcuaguuugauaacggugaugcagauacauuugagagagccgccaggagacauuuuacuuuuuuugacuggucaggaagagauugacacugcuugugaaauuuuguaugagagaaugaaaucuuuagguccagauguaccugaacuuauaauucucccuguauauuccgcguugccuuccgagaugcagacaagaaucuuugaaccagcgccaccugggagcagaaaaguugugaucgcuacuaauauagcagaaacgucuuuaacgauagaugguaucuacuacguagucgauccaggcuucguaaaacaaaaagucuacaacuccaaaacuggaauggauuccuugguaguuacaccgauuucacaggcucaagcaaaacaacgagcaggucgagcugguagaacgggaccugguaaauguuacagacuauauacagagagagcauacagagaugaaaugcuuccgacgccuguaccugaaauucaacguaccaaccuugcaacaacagucuuacagcuuaaaacuauggguaucaacgaccugcuucauuucgauuucauggacgcuccgccgguggagucguuaauuauggcuuuggaacaguuacauucuuuaucagcgcuugaugaugaaggguuacugacacgguuaggaaggaggauggcagaauuucccuuggaaccaaaucuuucaaagauguugauaaugucaguugcccuacaaugcucggacgaaauucuuacaauagucagcauguuaucaguucaaaauguauaa

SEQ ID NO: 5833 - RNA, 1248 nt, Diabrotica barberi
augucgucgaaaagaaaaaguaaagaaagcauaauugcuaggguuaauuucccucuauauacucuucagauguuaacgucaaggcauguaaucguaggugguggaggagggacauccaaaacugguguacacaaugguuuugaaauauuugagauuuuucaugauggaacacgcuucgcagcaaaagaaguaaccagacaugaaacuggaggcaauguuguuaugaacuguucuguuuacagugauagaaaauauucucuuuugguagcuggacaagaaagugagugucaauuguacaaacugaauccuaaacuagucgaggaaguggaaaauaucgguaauaauacucaucucaggcaacggaauacaaaaaacaaagaaguuacagaugacaacaagaaugugacaaaagaguuauauuuugauguuaacgcaauagaaaauguucaaacugacuuuaaugggagugaaccguuaucaaggguaguaaaaauuaaucacgacgguacauuauuagcuacagguggcacugauggagauguacgaauauggaaguucccuaguaugcaaccuuuauuuauucuuaaggcacacacaaaagaaauagaugauauagauuuuaguagguaugacaauuaugugauuaccauagccaaagaugguuuagcaguauugugggauuguaugacaggaaaagaaagaacaaaacugacauggaaacagccugaaggaucaaaauauuuauauaaacguuguagauuugguguaauagaaggacuagacaagaaaugugcacuauacacaauauccaauccaauaggaguagcuaaaaaacaaaaauccuaccuccagcaguggauacccgaggaaaacauguuaagaagguguauagaauuugaugagaguuuggcugcuuuagcuguucgugaugaugguagauuuguugcgguugguacaauguucaguggaucaguguccauucuuguagcauuuaauuuacagaaaauuuuaaccauuguuggagcacauuccauguucgucacagggcucgaguuucugcccacccagaacuuaaaccauuccauuaguaguguaguagaagccgcagucuugucaauuucuguagauaaccaacuaugcauacauacagugccauacagaaaaaccauaccucuguggauugcuaucgcacuuuuaguuuuaacuuuauuuuugacuuucuuacuauguucauacuuagguuuguga

SEQ ID NO: 5834 - RNA, 1242 nt, Diabrotica barberi
auggccggagcaauguuauuugaaagagccccgucuguuucuucucaacacgagaagcuuuuaaaauuauccagagauucagaugaugaagaucaaaauauugucaauaaagaacaagacauccuuaaucuuggugagaaauauaaaaaggagggcaaggcaaaggaacucgcagagcuuauaaaggccaccaggccuuuuuugaguuuaauaagcaaagcaaaagcugcuaaauugguaaggucucuaguugacuacuuccuagauuuagaagcugguauugguaucgaaguacaacucugcaaagaauguauagaaugggcaaaggaagagagaagaacuuuucuacgucagucccuugaagccaggcugauugcucuuuauuuugacacuggaauguacagcgaagcgcuacaacuggaaucgaccuuacugaaagaguuaaaaaaguuggaugacaaaaacuuguugguggaaguacaacuacuugaaagcaaaacauaucaugcuuuaaguaauuuaccgaaggcuagagcugcacuaacuucagcacgaaccacagcuaacgcuaucuauugcccuccaaagaugcaggcagcuuuagauuuacaauccggaguauuacacgcugcagaugagaaggauuucaaaacagcuuauucuuauuuuuacgaagcuuuugaagguuuugauaguguugaauccccaaaagcccucacagcccuuaaguacaugcuuuugucaaaaaucaugauaaacagucccgaagacguccaacaaaucguuagugguaaauuagccuuuaaauaugcuggucaagauauagaggcuaugaaaucaguugcacaggcugcacacaaaagaucacuagcagauuuccaacaagcaguaaaacaguuuaaacacgaauuagaagaugauguuauuguuagagcacauuuaggaacguuguaugacaauauguuggagcagaaccuuugcagaauuaucgaaccauauucuaggguacaaguagaguauguagcaaaaaccauaaaacucccaguacuacaaguagaaaagaaauugucgcagaugauuuuagaugccaaguuucauggaauuuuggaccaaggcgaagguguccucauaguauucgaagaaagugcaguagacaaaacauacgaaauggcccuagaaacgauccagaguaugagcaaaguaguagauacucuuuaucaaaaagcaaagaaauugucauag

SEQ ID NO: 5835 - RNA, 1767 nt, Diabrotica barberi
auggcaucgaaaucaaaaaaagggucaacaccguuagcuucacagcggccggcgagccccuuaaguccuaccagacauucuagauuacaggagaagcaugaacuucagaaucuuaacgaccguuuggcgggauauauagaucgaguaagguauuuagaaggugaaaacaacagauuaacgagggaaauacaaaccacucaggaaacgguaacaagggaaguuucaaacauuaaaucuauguaugaccaugaauuaucagaugcuagaaagcuauuagacgaaacccaccgugaaaaagcucguuuagagauagauguuaaacgucuuuuagaagagaaugacgaacucaagucugaguuagcaaagaagaacaaggauuuggcucuagcugagaauucugccaggauauacgagacgagauguaaugaguuacagcucaaagcaaaucaagcagcugcugaugcuaagaaagcuauugcagaugcuaaggaacuugagaaagaacgugauaagcuacgcaaacuucuugauaaccaucguaaacaguuggaagaagaaucauuggcgagaguggaagucgaaaaugccaaccaaagucuucgagaagagcuguccuuuaaggaucagauccaucaacaacaguugacagaaacucguacucgucgucaaguagaaaucagcgaaaucgacggucgccuggcagaaaaauaugaggcuaagcuucaagaggcucuacaagaacucagagaucaauaugaaagucaaauggccaacaaccguggcgaaaucgaguugcuuuacgaacagaagauuaagaacuugcaauccgcuaaugacagacauucugccucugcuuccggugcucuugacgaauugagacaaguuagaaccagaaucgauacuuugaauucucgaauuagcgauuuagagaaccaaaacgcuggcuuagcagcucgugcuagagauuuggagaaguuguuagagaacgagcgcaugcgccauguggaagaccucgcaauguuagaaagagaauuacauagacuccgagaagaaauggcuaaccaacuucaagaauaccaggaucuuauggacauuaagguuucucuugauuuggagauagcugcuuaucggaaacugcucgaaucugaagaagcucgucugaauauuaccccaacggguagugaaguucaugaaguaacucacaguaggagccaacgcagcucgucgcaacgucgcacuccagucagauugggagccaaaagaaagcgaacacuacucgaagaaagccaagagucgagcaugaaugacuauucggugaacagcuccucaaaaggugacauugaagucgcagaugucgauccagaaggacacuauguuaaguugcacaacaaaaguaaucaagaagucgcucuuggaggauggcaagucauuagacgugucggugaggaggaaaccacauucaaauuucacaggucacuaaagcuugaagguaauggauauguaacaauauggagcucugaccucaacaaagaucaugaaccuccaacuaauuuaguuaugaagagucagaaauggguuguaggugauaacauggucaccacauuauugaauaauaacggagaugaaguagcugucuccgaaaggguuaaaaggcaauuaacaagcucccaucuaagacacagagaacuagcagcuggcuaccucucagaagaacuccaccaucaacagggugauccacaaguagaugaaagauguaggcuuauguaa

SEQ ID NO: 5836 - RNA, 2055 nt, Diabrotica barberi
gaggauuuggccaccgcaauucuccguaagaaagaucguccaaauagacuuuugguagaagaagcaguuaacgaugauaacuccgugguugcuuugucacaagcaaaaauggaugaacuacaacuuuucagaggagacacaguccuacugaagggcaagcgaaggaaagaaacuguuuguauaguauuaucugacgauacauguagcgaugaaaaaauucguaugaauagaaauguuagaaauaauuuaagaguuaggcuuucagauguaguuucuauccaagcuugcccugauguaaaguauggcaagagaauacauguacuucccauagaugauacaguggaaggacucacaggaaaucucuucgaaguauaccugaaacccuauuuccuggaggccuaucgaccaauacacaaagaugacguauucguuguacguggaggaaugagagcuguugaauucaaagucgucgagaccgauccagccccguacuguauaguggcuccagacaccgucauucauugugauggagauccaaucaagcgugaagaggaggaagauggaggaaugagagcuguugaauucaaagucgucgagaccgaucccgcuccguacuguauaguggcuccagauaccgucauucauugugauggagauccaaucaagcgugaagaggaggaagaagcucuuaacgcaguuggauacgacgacaucggagguuguagaaaacagcucgcucaaaucaaagaaaugguagaguuaccacugagacauccuagucuuuucaaggcuauuggaguuaaaccaccaagagguaucuuacuuuacgguccaccggguacugguaagacacucauugcacgugcaguagcuaacgaaacuggagcguucuucuucuuaauuaacgguccugagauuaugagcaaauuggccggugaauccgaaagcaaucuucgcaaagccuucgaggaagccgacaagaauuccccagcuauuauuuucauugaugaauuggaugccaucgcucccaaaagagagaaaacacacggagagguggaacgccguauaguaucccaacuucuaacuuugauggacgguaugaagaagaguucccacguuaucguuauggccgcuacuaacagaccaaacucaaucgauccagcuuuacguagauucggaagauucgacagggaaaucgauaucggaauaccugaugcaacuggcagacuugaaguuuuacguauucacaccaagaacaugaaauuagccgaugaugucgacuuggaacagaucgcugcagaaacucauggucacguaggugccgauuuagcuucacuguguuccgaagcagcccuucaacaaaucagagaaaaaauggaccucaucgaccucgaagacgaccaaauugacgcagaaguccuaaacucacuggcaguuaccauggagaacuuccguuacgccaugacgaagagcagcccaagugcuuuacgugagaccauaguagaaguaccaaaugucacuugggacgauaucgguggcuuggcuaaugucaagaaagaguugcaagaauuggugcaauauccugucgaacauccagauaaguuccuuaaguucgguaugcaaccguccagaggaguguuguucuaugggccgccugguugcgguaaaacguuauuagcuaaggcuauugcgaaugaaugccaagccaacuuuaucucaguuaaaggaccagaguugcuuacuaugugguuuggugaaucagaagcaaacgucagagauaucuucgacaaggcuagaucugcggcaccuuguguucuauucuucgacgaauuagauucaauugccaaaucgcgugguggaaauguaggugaugccgguggagcagccgacagaguuauuaaucaaauucuaacagaaauggacgguaugggagccaaaaaaaaacguguuuauuaucggugcuacaaacagaccagauaucaucgauccugcaauauugcguccaggucgucucgaucaguugaucuacaucccucugcccgacgagaaaucuag

SEQ ID NO: 5837 - RNA, 825 nt, Diabrotica barberi
augggagaccaguuugauugcgcuuuggacuuaaugaggagguugccuccucaacaaauugaaaaaaacuuaagugaucuuauugauuuaguucccagucuaugugaagaucuacuaucaucuguggaucagccuuuaaaaauugcaaaagauaaagaaacuggaaaagauuaucuucuuugugacuauaauagagauggagauuccuacaggucaccaugguccaauacauacuacccgccccuagaagaugguucaaugccaucugaaaaauuaagaaaacuagaacuagacgccaaucuugcauuugaucaauacagggaaauguauuuugaaggagguguaucuucuguuuauuuuugggacuuagaccauggauuugcaggagucauucuaauuaaaaagacuggagaugguaguaaaaagauuaaaggauguugggauuccuuacauguaguagaagugcaagagaagaguucaggaagaaacucccauuauaaaaugacuucaacugcuauguuauggcuucaaacuaauaaacagggaucuggaacuaugaacuuggguggaagucuaacucggcagaucgaacaagaugcagcuguaaacgauaucaacccucacauagccaacauuggaagaaugguagaagauauggaaaacaaaauucgcaauacauugaacgaaauuuacuucagcaaaacgaaggacaucgucaacagucuacgaucaguucaaccacugaccgaaagccgggcacaacaggcacuuaagcaagaccucgcggcggcccuucaacguagacaaaacaaaacugagaacuga

SEQ ID NO: 5838 - RNA, 4002 nt, Diabrotica barberi
auggaacgcccaccccgaaacgaacccacuguggaaccagugaauggagugguccaaccacuaguccagccaccuccagagaguccgggccgcgucaccaaucaacuucaguuuuuacagaaaacuguguuaaaggcugucuggaagcaccaauucgcuuggccuuuccagcaaccugucgaugcuagaaaacucaacuugcccgacuaucauaggauaauuaaacagccaauggaccugggaacaauuaagaaaagacuagacaacaacuacuacuggucgggcaaagagugcauccaagacuucaacacgauguuuacaaacugcuaugucuacaacaagccuggagaggauguuguugucauggcucaaacguuagaaaagguauuuuugacaaaaguggcggauaugccaaaggaggaauuuguuguugaaucgccugguaaagcgggagcggcaaaaggaaagaaggggcggaccaguacagcgggcgcugccagugcacccccaacaccaacuacagccaccgcugguucgggaggcagggguaggccucccgccacugucucuucuacaagcgccacuccaguugcuaccacuacaggaucuucaggguuaccuuuaggcacucaagcaccggcuacaguaccuggcagcaccgcaaccaccaccauagccgcggcuagcaccaacaacagcucucugucgaaucagcaacugaacucuucuuccaguuccauucacggaagcggcuccaguauaggaaauuccuuagauuccagcagcgucaugccugccaacguuauaccuccggcacaaccagccaagguaaaaaagggcgugaaaagaaaggccgauacuacgacgccugcuacagccuacgauuauccgccaacuuuggagucgaaguccgcaaagauaucgacgcgccgagaauccgguaggcaaaucaaaaagcccaccaggccagaacuggacggucauccgccacaacccccuccacuuaaaccaaaagaaaaacuaccagaaucacugaaagccuguaaugaaauccuccuagaauuguucucuaagaaacauucuaguuacgccuggccuuuuuaucaacccguagaugcagaauuacucggucugcaugacuaccacgacaucauaaagaaacccauggauuuuagcacuguaaaaaauaaaauggaaaaccgagaguaucgcacuccucaagacuuugccgccgacguuagacugauuuuuaguaauuguuacaaguacaacccuucugaccacgaugugguugcuauggcgaggaaguugcaggauguguuugaagugaaauaugcaaagauucccgacgaaccugucaauaggguaggagccccugccguuaauaauauaccugccaaaucagaaacgaguacauccgguuccagcucugauucuucuagcgacacggaagauucggaggaagaaaggcgaaacaagcaacugaagcugcuagaaaaagaguugacggcgaugcaagaaaagaugcguaaauugguagacgagagcucgaaaaagaaaaaagaaaagaaaaaggacaaagugaaaaagaaaccggcaucaggugggucuauggcgaacgccucacuaucaacucuaccgaacagcagcagcgcgggcuuggguaagccgggugccgguggucacggggcucuaaacaagucaaacaacaacaacucaauagcggcggacagcguugacgacagcaucgccaguguugugucgggggccgaucuaaagauggccgagucgcaccauccgcaaacuggaaccggcgcucaccauccgccggcaggcaaaucccugaacaugcaucacaacaugacggcuaacgcuggcgccaacgcuuccgcgcaggcuaaaacaccuaaaaguaaaggacuucgcggcaauaaacccgcugcagcuaccaaugcggcucccaacaagaggguuaaagccaacaauaaagcuggcgcggguaggaagaagaacgcagcacaaccaccaccuaugcaguucgauucugaggacgaagacaaugccaaaccgaugucuuacgacgagaaacggcaguugucuuuggauauuaauaaauuaccaggugacaaguuggguagaguuguacauauaauccaauccagggaaccuucguugagggauuccaauccugacgaaaucgagaucgauuucgaaacgcugaaacccucaacacucagagaauuagagaguuacguugcgucgugucuucgcaaaaagccacauaaaaaaguagcgggcaaaucuaaggacgaacaaauagcggagaagaagcaagaguuagaaaaaagacuaauagacguaaacgauaaaaucggcaacuccaagaaggcccccaaaaaagaugaagccaacaagguagacccaacgggcgcgggaggucccucaggccgccuauccucuaguuccagcaguucggacuccgacagcaguaguagcagucuguccucuaguucuagcgacuccagugacagugaagcaggugggacggcgaaccggcaggccaaaaagaaagcgaauaaaaagucacccaauccuucacuaggaaguuccgccaccacuacgacuauaaaagugccgccgccucaaacgacggcaacgccugcaccgccgucacaagccgcaccagcuaucacaacagcagcaaccgcuaauuuaacaacaacuguaaccguaccaccacuuacuaccacaacgacaaguacgauagcgccaccaauccaaccggcgccaguuccaaacgucgucguucccgcgcaaacgacgccagccgcacccgccuuuacgccgagcauaaccgucaaaccaucacuccaggccgccccuaucgcuccgacggugccgccucuuaucaagucgaucgagaaacugccuguuacaacucuuuuaccuccaaccguuccuacgauaacgccuccaacgaucgagaaacugccugucacaacucuuuuaccuccaaccguuccuacgauaacgccuccaacaguaccucaagcucccaagucgguagcgcuaccgacuccuucgccugauaaacccaaaccuaacauuauuucucccauugguacuuuuaccgacccuaucgaacaaucauuggcuagucuugaacacgauauuaagcagaaugauccuauggacgucauuacggcgucuacuaugaugcaaaugccuacuacgcuaaccaauccuaucgugucacauccacauccuaacuuaaacuuaaaucccaccauuaaccauccuauuuuacagccuagcacacuuaguauggacuugaaagcgccuauuaugggcacuauggcgccgagcaauaccauguugcaucacggauugcaacaagcaauggaaacagauaucaguauaccuccaccacccaccaacaugcuacauggacagaacaacgguuuuggcaugaaacacaauuuugaucugacuacaaacaacaacggucuuuccucgaugggucugcccauggaaaugucgauaucgucaauguuugauccaauuccacaaaauauuaaucccaugaugaagaacgauucccaacucaagauggacgaucgcauggauaccuuaggaggacuuuugaacgacaagaaguccaaucuccucauacaaaagccgaugucgcagucguuugguuucaagaaugacaaaccagaucacaacgucaaaaacgcuaguuccuggucgaguuuggccaaaggaaaaucaccacaaaacaauauuccgggcggcagcaguaaacaacaaguuauggauaguuuuaaggcauuccaaaauaaagcuaaagaaaaggccgauagagagaaacaaaggcuggagaacuuagaaaugaagcggcaacagagggaacaagcggagagggagagguuacgggcugaaaacgaaaggcgaagggaacgagaagaggaagaugcgcucgagaaagcgaggaaagcugua

SEQ ID NO: 5839 - RNA, 1224 nt, Diabrotica barberi
augucguuauccaccgcucgcccauuagugagcguauacaaugagaagucggaagaaguaaagggcucaaauauuucacuuccagcaguuuuuaaggccccaaucagacccgauguagucaacuucguucaccaacagguuucuaugaaccaucgucaacccuacagcguuagugacaaagcuggacaucaaacaucugcugaaucaugggguaccggacgugcuguugcccguauuccccguguaagaggaggugguacccaccguucuggucagggagcuuucgguaacauguguagaggugggcgcauguuugccccaaccaagccauggcgucgcuggcacagacguguaaacaucaaucaacgccguuaugcuuuggcaucugcuguagcugcuagugguguaccagccuuaguuaugagcaaaggacaugucaucgaccaaaucccugaauuaccauugguugucagugacaagguacaagaaaugagcaaaacuaaacaggcuguccaguucuugaggagaaucaaggcaugggcugacauucaaaagguuuacaagagucaacguuuccgugcugguaagggaaaaaugcguaauaggaggcgcauccaacguaaaggaccauugguuguuuacuacaaagaucaaggucuucgucgugcuuuccguaacaucccaggcaucgaccucauuagcguacagaaguuaaacuuguugaaacuugcuccugguggucauguaggucgcuuuguuauuuggaccgaaucagcuuuccaacgguuagauaaauuguucggcacauggaaaacagcaucauuggaaaagaaggguuacaaucuaccccaaccuaagauggccaacacugaucuaucuagauuguugaaggcugaugaaaucaaagcuguauuacgugcuccucaaaagaagguuguacgucguguacgucgucucaauccauugaccaacgcuaaggccaugcuuaaauugaauccauaugcugcuguacucaaacgugaagccauuuugaagaaucaaaagagacaguuaaacagggaagaacuuuuggccaagaaacgugguauuaccuugagugccgacaacgucgugauuagauccagaaaauugcaagaaaggagaagggcacaaaucuugaaagauaaaaaaucgaagccuaagaaggccaagaaggcuccagccaaggccacaggaaagaaauaa

SEQ ID NO: 5840 - RNA, 5709 nt, Diabrotica barberi
auggcagacuucauaaauucugaagcagaagaaaguagugaggaggaggaauuagaucauagggaucguaagaaagcccaaaaagccaaaguuguagauaguucagaugaagaugaugaagaugaugacgaaagacugagagaggaauuaaaggauuugauugaugauaauccuauugaagaaagugaugcggagucugaugcuucaggaagggaaaaacguaagaaaucugacgacgaggauuuggaugaucgacuggaagaugaagauuaugauuugcuugaagaaaauuuggguguuaaaguugaaagaaggaaauucaagcgacugcggcguuuugaagaugaggaaagugaaggagaagaagaacaugauccugaacaagauagggaacaaauugcuauggauauauuuucagaugaugacgaugaaagacgaucagaacggagucacagaccugccgucgaacaagagacuuaugguguaggcgaggaagaagaggaaggggaguacucggaugccgaugauuuuauaguugacgaugacgguagaccgauagcugaaaagaagaagaagaaaaaaccaauauuuacugaugccgcucuccaagaggcucaagaaaccuucggugucgauuuugauuaugaugaauuuaguaaauacgaugaagaugauuacgaagaugaagaggaggaggaugacgaauacgaggaagaugauguagagaaaaggaaacggccuaaaaagacuucaaagaaaaaaccgacgaagaaauccauuuuugaaguguaugaaccuagugaacuuaaaagagguuucuuuaccgaucucgauaaugaaauccguaacaccgauauucccgaaagaaugcaacuucgugauguuccaaucaccgcuguuccggaugacucaacugaacuugaugaugaagcagaauggauuuacaggcaagcguuuuguaacagaacuguuuccaauguggauucucauuuaucaucagaggcaagagagaaauugaagaagacucaucaugccaucggaaagaucagaaaagcauuagauuuuauaagaaaucaacaauuagaaguaccguuuauugcuuuuuauaggaaggaguauguucaaccggaacuuaauauuaacgauuuguggaaaguauauaaauacgaugcaaaguggugccaacugaaaacacgcaaagaaaaccucuuaaagcuuuuugaaaaaaugaggucauaucaaacugaccacauaaugaaagauccagaugcaccaauuccagacaaccuucguaucaugacugaguccgacauugagcgauugaaaaauguucaaaccgccgaagaguuaaaugacguucacaaucauuucguuuuauauuaugcugcagauuugccagccaugcaugccgcguggagagucaaagaaagagaaaggagaagacaggaaagaaaggaggcuagacugaagcucaucgcugaaagugaagaaggugcugaaauuccugaagagccugaggaaauugacgaugacgaaccagaagcugaaaccuuaaaauacgccaauagaucaggcagcuaugcacuauguaauaaaggagguuuggguccucuagcgaagaaauuugguuuaacgccugaagaauuugccgaaaaccugagagauaauuaucagaggcacgaaguagaucaagaacauauagaaccuguagaagucgcuaaggaauucguaucgccgaaauuuccuacaguggaagaaguguuacaagcuacuaaacacaugguagcuuuacaaauagcaagagaaccauuaguaaggaaaugcguaagagaaauuuucuuugaacgagcuagauuaaacguuuauccaaccaaaaagggugugaaaguuauagaugaagcucauaauugcuauaguaugaaguauguaaaaaauaaaccaguaagagaucuugcaggcgaccaauuuuuaaaauuauguuuagccgaagaggagaaccuccuuacuauuaccaucaaugaccauauucaaggaaacacuacuaacaauuacaucgaugaagucaaacaauuauauauaaaggaugaauucagcaaacacguucaggauuggaaugcgcuaagaauggaaucgguagaaagggcuuuaacgaaaagugucuuaccagauuuaagaucugaauuaaaacgaacguugcucacggaggcuaaagaauucguauugaaagcuugcuguagaaaauuauauaauuggauaaagauugcuccauacgcaauaacguuucccgaugaagacgaagaugauugggauacauccaaagguguuagaacuauggguguagcauacguaccagagcacacaguaucagcuuuuaccuguauuucagcaccagacggagauauaacugauuaucucagauuaccaaauauucuaaaaagaaaaaauagcuuucgaacugaagaaaaacuuaugaaggaagcugaucuucaagcacugaaaaauuucauauuccuuaaaaaaccccaugugauagcaguagggggugaguccagagaagccuuaaugaucgcugaugauaucagagcccuuaaaaagccucaugugauagcaguagggggugaguccagagaagccuuaaugaucgcugaugauaucagaggaguaauaagugaacuaauagaauccgaccaauuuccacagauuaggguugaaauuauugauaaugaauuagcaaaaguguacgcgaauucuauuaaagguucaacugauuucagagauuauccagaguuguuaaggcaagcuauuucauuagcucgaagaaugcaagauccuuugguugaauuuucccaauuauguaauagcgaugaggaaauuuugagucuuagguuucauccuuuacaggaacaaguccagaaagaagaauuacuagaagcucucuguuuagaauuugucaacagaacaaaugaaguagguguagauauaaaucuugcuguucagcagauucauaaaaguaguuuaguucaauucauaugcggucuaggaccgcguaaaggucaagcguuacuuaaaguucugaaacaaacuaaucagaggcuugaaaacagaacccaauugguuacauuuugucauauggguccaaaaguuuuuauuaauuguucuggauucauaaagauugauaccaauaguuuaggagacaguacugaggcauauguugaaauauuggauggcucucgaguucaucccgaaacuuaugaaugggcacgaaaaauggcuguggaugcuuuagaauaugacgaugaugagggagcuaauccggcgggagcuuuagaagaaauucuggaggcgccagagagguuaaaagaucuugacuuggaugccuuugcugaagaauuggaaagacaaggauuugguaacaagaguauaacauuguaugacauuagagcagaacugaacucgcgauauaaagauuugagacaaacuuuucguucugcaaauccugaagaacuauucgauaugcuuacuaaagaaacucccgaaacauuuuauauuggaaaaaugguuacaucuaccguguuuggcauugcaaggagaaaaccaaagucagaccagcucgaucaagcuaauccgguccguaaugacgaaacugguuuguggcagugccccuucuguuugaaaaaugauuuuccugaauuaucugauguauggaaucauuuugaugcaggagcauguccuggucaagcuacuggaguuaaacuaagacuggauaaugguauauuagguuauauuuauauaaaaaauauaagcgacaaaccagucgcuaauccggaagaaagaguaggcauaggacaauuaauucacuguagaauaauaaaaauugauguagagaaguuuaguguagauugcacgucgaaaucuagcgaucuugcugauaaaaaucaugaauggagaccucaacgagauccucauuaugaucaagaacgugaagacaaagacaaucgauuggaagccgagaagaagaaagagaaacagcguaugacguacaucaagaggguuaucguucauccggcguuccauaauauauccuacgccgaagccgaaaaauguaugguuaauauggaccagggugaaguuaucauuaggccuucgaguaagggugcggaucauuugaccauuacuuggaagguuacggauggaaucuaucaacauauugauauuaaggaacaaggaaaagucaacgcuuuuucuuuaggaaaaucauuauggauuggaaaugaagaauuugaagaucuugaugaaauaauagcuaggcacguuacaccaauggcggcgcaugcuagagauuuacuguauuuuagguauuacaaagauuuccaagguggucauaaagauaaggcugaggaauaucuaaaagaugaaaaaaagaaaaaugcuucuaaaauucauuauguaguuagugcugcuaagaauauaccugguaaauuucuucuuucguaucuuccacgcaacaaaguuagacacgaauauguaaccguuacuccagaaggcuuucgguuuagacaacaaauguuugauuccguugcuucguuauuuaaaugguucaaagaacauuuccgggagccuccaccaggcggugcaacaccagguagcacgccaaggauggcuucaagcagaacuggauauggaagugccacaccugcguauaguaugaauaaugaagcuauucaaagaguugcucaaaauuugccaagucauguaguucaagcguugucugcugccaccaaccaaacuccacauuauccccacaccccugguuauggaggcaauuauauuaauacgccuuacacuccaaguggucaaacuccauacaugacuccguacgcuacaccccauacgcagcaaacuccccgcuauggucaucaaacaccuucccaacacauggcgagcucagcaccacaaggucucaacaaucccuuuuuacauccuggcgcggucacucccucccaacgaacuccuaguuaucgcaaucauccagcacaaucuccaaugcuuccuacaagcccuguaccaaguccagguucccagaguucauacaguagucauuuaagucauaaucagcgaaguggaaguuacgccgaguccuuaagauuccagccucccgaaucaccgagaagcuuagugaguuaucgcaaccauccagcacaaucuccaaugcuuccuacaagcccugugccaaguccagguucccagaguucauacaguagucauuuaagucauaaucagcgaaguggaaguuaugcugaguccuuaagauuccagccucccgaaucaccgagaagcuuagugaguaauagaagcuuucaaacugauagauacggcggugauagguaugguaaaggaggaagucauagauaugguggaagcucaaacgaagauagauaugguaagggaggaggaggaaaugaaaauacggauuggcagaaagcugcagaagcaugggcucgaucuagaucuacuccgagaagugauggccguaauacuccaagaucuguaggucaacgaacuccuagauacgacaacgacgccgaacguucuagaaugaaacaccucagcaaaagcccgaggucuguuaggucuacuccucgaaccaauacaucuccacauucuaugucccuaggugaugcuaccccucuguaugacgaaaguaucuaa

SEQ ID NO: 5841 - RNA, 2448 nt, Diabrotica barberi
augccagauaccaaggaugcuaauuugaguucuccugaacguaaaagacgaaaaaagaguagaucuaaaucuccagaacgaaaagagaaaaagucuuccaaaaagaaagcccacaauaguagagacagagauucaucagaggaagguuacaacccuaaagauuaucagagauacuauggggaagaucgcccaaacagugacaaauauuggaauaaauauccaaggaaagauaacaccaaaguuggccaaagauacuaugaugcggcucccgaagaaucuggcaagaagggcccagauagaaauucagaggagaaggaguuaccaaagccaguggagccuguuccugauaaaucagucaucaaaccaagagaaagaaaaacuguagauauguuaacaucgaggacugguggugcuuauauucccccagcuaagcuacgauuguugcaagccaguauuacagacaaaaccucagcagccuaccagcguauagcaugggaagccuuaaagaaauccguucaugguuacauuaauaaaauuaacacgucgaauauuggcauuaucgcuagagaauuauugcaugaaaauauaguaagagguagagguuugcugugcaagucaauaauacaagcacaagcagcaucuccuacuuuuacaaacguuuaugcagccuuaguagcuguuauuaacucuaaguuuccuaguauaggagagcuuuuguugaagagguugguuuugcaguucaaaagaggguuuaagcaaaauaauaagucuaucugcauaucggcuacuacuuucguagcucauuuaguaaaucagagaguggcacaugaaauuuuggcuuuggagauacuuacguuguugguggagacuccuacagacgauucuguggaaguggccauuucauuuuugaaggaauguggacaaaaacugacagaaguuucaaguagagguauuacugcuauauuugagauguuaagaaacauuuuacaugaaggccagcuagaaaaaagaauucaguacaugauugaaguuauguuccaaauaaggaaagacggauuuaaggaucaugcugcuguuguagaagaauuagauuuaguagaagaagaagaucaauucacucaucuuauuauguuagaugauguuaaagaggcugaugcagaggauauauugaauguguucaaauuugaugagaguuaugaagaaaaugaagauaaauacaaaacccuuaguaaagaaaucuuaggcagugauggugagucugaaucagguucugaagguucagaagaggaaucugaugaugaaaaugaggaggaagucaaggaccagggaacaauuauugacaauacugaaacgaauuuaauuucucuuagaagaaccauauauuugacuauucagucuaguuuagauuuugaagaaugugcacauaagcuacugaagauggaguugaaaccuggacaagaaauagaauugugucacauguuucuugacugcugcgcagaacaaagaaccuacgaaaaguuuuauggucuuuuggcucaaagauuuugucaaaucaacaaaguguacaucgagccuuuccaacaaauuuuuaaagauaccuauucuaccacucacagacuagaugcuaacagguuaagaaacgucagcaaauuuuuugcgcauuuacuuuuuacugaugccauuggaugggaaguucuugacaucaugaaauugaaugaagaggauaccaauaguucuaguaggauuuucauaaaaaucuuguuucaagaauuggcugaauauaugggacuaggaaaauuaaaugcaaggcuaaaggaugagacccugcaggcuuauuuuucaggacuguuuccuagagauaacccaaagaauaccagauuuucuauuaauuuuuuuaccucuaucgguuugggaggauuaacugaugaacucagagaacauuuaaaaaauauuccaaaaaugauggaaaugaaguuagccacuaaagaaaaggcaaacagugguaguaguaguucagaaaguaguucugaggaagauaguagugacgacagcucugaagauucgucaaguucugaagacgauagaggcaaaaagaagaaaaaaaccaaaaagcuagaagaaaaaaauucgaaaguaaauucuaaaucuagaccuagaucaaaagagaaagaacacgcagacaaaccuagagacaaacauagaaaggaagauagacauaaaucugacaaaaaucccgauagauccucguccaaaaaauauucuaaagaagauaacaagaggaagaaagacuacgaauggaugaagagcagauaugaagaugauauuaagcaauuaaaaaacgauaaaaggguauuugaaaagucuuccaaacgacgaucaagaucuagagagaggguaaaagucaaggaagagcguagacguagaagcagagaaagaagaaggagcuaa

SEQ ID NO: 5842 - RNA, 1875 nt, Diabrotica barberi
auggcguuaaagaaccaaguuggucaaaaaauuaugaaugaagucaucaagcacaagcccaccaagaagaaugggccaacuccaggacagcaaccccauggaguagaauggaggauccuugugguggaccagcucgccaugaggaugguuucagcgugcuguaaaaugcaugauauaucagcagaaggcauuacauugguugaagauauuaugaagaaaagggaaccgcuugguaccauggaagcuguguacuugauaacaccuucagaaaagucaguucaugcucugaugaaugacuuugaaccaccaagacagauguacagaggggcacacguguuuuuuacagaaguaugcccggaggaacuguucaaugagccucugaugaaugacuuugaaccaccaagacagauguacagaggggcacacguguuuuuuacagaagcguguccagaccaauuauuuaguaccuugugccaccacccuguagcaaaauuuauuaaaacccuaaaagaaaucaacauagcauucauuccgacugagucacagguguucucguuggauucaccagacacguuccaauguagcuacgaucccucauuuuccgcugcuagaaacgccaacauggaaagaauggcagaacaaauugcgacacucugugcgacucuaggggaauacccucacgucagauauagaacugauugggaaagaaauguugagcuggcucaacuaauucagcagaaauuggacgccuauaaagccgacgaaccuaccaugggagaggggccggaaaaggcgagaucacaauuaauuauccucgaccgagguuucgacuguguaucuccccuucuucacgaacuuacuuuccaagcaauggccuaugacuuacuacccauagaaaaugauguauauaaguacgaagcaucggcugguguuaugaaggaaguccuucuggacgaaaacgacgagcuuugggucgaucuacgccaccaacacaucgcgguggucucucagagcgucaccaagaaucugaagaaauucaccgacuccaaacgcaugacccagagcgacaaacagucgaugaaggaucucuccaccaugaucaaaaagaugccgcaauaucagaaggaauuguccaaguaugcuacgcaucuucaucucgcugaagacugcaugaaggccuaucagggguauauagacaaguuguguaaaguugagcaggauuuggcaaugggaacugaugccgaaggcgagaaaaucaaggaucacaugcgcaacaucguccccaucuugcuagaucccaaaaucaccaaugaauacgauaagaugcguauuauagcauuguacgccaugacgaaaaacggcaucacagaugaaaaucucuccaaauuggcuacccaugcccaaaucaaggacaaacagaccaucgccaaccuucaguuacuuggagucaacguuauuaaugauggaggaccaagaaaaaaacaauauacaguaccgcgcaaagaaagaauuacagaacaaacguaucaaaugucaagauggacaccuaucauuaaggauauaauggaggauugcauagacgacaaacuggaucagaaacacuacccguauuugagcggacgagcacagucuacaggauaccacgcagcgcccucuagugcccguuauggccaguggcacaaagacagaggucaacaagccgugaagaacguuccucgacugcucgucuucgucguggguggaaucaguuucucagagaucaggugcgccuacgaagugaccaacgcgcagaagaacugggaagucaucaucggcucgucgcacauacucacucccgaggacuuccuaagcaaucuggcaacguuggccggcuag

SEQ ID NO: 5843 - RNA, 2139 nt, Diabrotica barberi
augaugcaacaauauaugaaagaauuagagcaggaaccauuugaugcugaagaauuuguagaacguuuagcuuggaggacuuuagcugaaucuaaaggcgacggagaggaacaugagauuaauccugcccuuuuacaugagucuuuuguacaagcuauaaaagaucuuaauuuacugcaugaacgccaacaaaagaaaugugaaaagcuagaaguugugguaagggaagaugaagcgaccuuuuuccaagagauauauaauuuacuugaacaaaauaagcaagcaauggacacuuuucaagaguuagauggcaaaauaaaucauguagcaacaaaaguacugcauuuaggugaccaguuggacagugucaaugggccuagaucuagaguaguagaugcuuuaaaguuaaugauacauuuaacagaguucuugucugaggaaucaguauuaucgccuaucuuuacaagaccagaauugauagaugaugcugcugaugugauucaaaaauuauaccuuauaucucaagauuuaccucccaaauuugauguugcuaagagaaaaauugaaagaaaauacucggauauagaaaaaucuuuaauagaagaauucguucuagcuauggauaacgaaaauuuaaauagaaugaaagaaauagcuaccguuuuaucacaguuuaaaggauauucucagugcguagaugccuacaucgaucacagucaaaugggaugucugucgaguaaggacguauuugcuaacuuuuuaacucuuuguaaauacaaucaugaaauaauugucaagguuuuuaauaauccggaacaagugauggcaaaauuuguacugaacauauuucaacucaaacucgucgaauacaucgaucagagauuaaacucuaaguuaggaaccuauggcuauuuacaaguauuauaugaauuauauuacaagacuaaucaguuaucuaaugauuugagcauauuuaacaugggaaaugacaagaacuuuuuaucgaaguuaacgacaaauauuuuuaacaaauauauuagugacuauaucacgauggaauuaaaaggucugaaagauagguguucugcaaauuuacaaaaauauuaugaauccaaaggucaucaaaagaagcagauucagucaggagguuuccaagaucuucgaagagaccuucaagcuguuauaggaacucgagcaaauauuaacauugcccagaucgaaaauuaugguggagaaacuuuuuuaucugaagaauuagcuauuacgauauugcaagacacaaagcacgcuuuucaaagaugccaguuguuauccaaacccacagacagagcaucaaacgcaacucaaauuuuggauagacugauaaacagcuuauuaguagaacaugucgacuaugcaguagaauugggcuugcaagcuguuccuguuguagaaggggccaaaacuccuccagcgcuauauuuuuucagugucguccaccacaguaauaacauuauacaucuuguugagaaacaguucauggauuuguugguuccauuaguugaaaacaccccgaggcauaaugauuguguacagaagaaaaaguuuguacuggaagauauagaacggaagauuaacacaggacuagauaggugucucaaugcuauuucgagcuggguuaaacuuuaucuucaaacagaacagaaaaaauccgacuucaaaccugaaucugacgacuucgacacaguggcgucaaacgcuuguaaaaacguaauuaacuacgugaauaguauuguaaaagaaauaaaagcgaaccuggaugguaacaaugucacagccauauugcaagaacuuggcauaagauuacaccgagugguguaugaucacauguugcaguuccaguauaacacagcaggugcgaugguggccaucugugauuuaaacgauuaucgccauuguacaaaagcccucggcccauuagugauugaacuuuuugauacacugcaugcccucugcaaucuuuugcuuguuaagccugaaaauuuacagcaaguguguucugaggauucucuaguaaaacuggauagaacaauccuucacaauuuuauccaacuuagaagugacuuuaagguacaaaaacaaaugauucuaaaaguguaa

SEQ ID NO: 5844 - RNA, 813 nt, Diabrotica barberi
auggauuuccaaaacagaccuggaggaaagaccgguggaggcggggucgccucuuggucggaaacuaacagggaucguagagaaaggcuccgacaacuagcuuuagaaacuauagaucuacaaaaagaucccuauuuuaugaaaaaccacuugggcucauacgaguguaaacuuuguuugacguugcacaacaacgaaggaaguuacuuagcccauacucaagguaaaaaacaucaggcuaauuuagcuaggagagcagccaaagaggcuaaggaugcuccuacgcuuuugcaaccagagaaacccagaguagaaccuaagaaguuugugaagauugguaggccugguuauagaguaacgaagcaaagagaugccgaaaguggacaacagagucuucuguuccagauugauuauccagaaauaagugauaugauucugccccgucaccguuuuaugucagcuuaugaacaaaaaaucgaaccaccagaucguaaauggcaguaucuucuauuugcagcagaaccguaugaaacaauugccuucaaaguaccaagccgagaaguagagaaaaccgacagcaaauuuuggacucauuggaacaaggauacuaagcaauucuuccuacaauuugcauuuaaaaaugacaauaagagaacuguuaacacagugguccaaagacauacaauuguuggugcagcaccaccacccccaaugcuaccuguuccaccaccaccaagaccaccgauguucaauccuauuccuccuccaccuccaauaaugagagcuguauuaccagugccuccuccacauuaa

SEQ ID NO: 5845 - RNA, 405 nt, Diabrotica barberi
auguccauugguguaccuauuaaaguucuccaugaagcagaaggucauguaauaaccugcgaaacaauuaccggcgaaguauacagagggaaacugauagaagccgaagauaauaugaauugccaaaugacucaaauuacuguaacuuacagagauggaagggucgcucaauuggaaaauguuuauauuagaggaucgaaaauuagauuucugguauugccagauauguugaaaaaugcuccuauguucaaaaaacaaacuaaagcgggaacggcaggccgaggaaaaucugcuauacugcgagcccaagcucgggggagagguagggggcaacaacaaccgaugcgagguagagguaauuggcaacagaaccaacaacaagcaccugcaggaagggguagauaa

SEQ ID NO: 5846 - RNA, 1254 nt, Diabrotica barberi
augcugucagcauugagaaguauggcuucuacucuuacaagaacuccaaucuugcgagcaauuuccgcaagaagcuauucucaagcccugccaguaucagguaauccaagugcugaccucagaacuaguacucuucccaacaaacuaguuguugcagcaguagauaaugacgccagucuuaccagaguuucaauuguauucagagcuggaagccguaaugaaaaagccgauaauuuaggugccacucauauuguacgaacagcagcaggcuuguccacuaaaaaugcaucccaguuugccauaauccgaaacauucaacaaguuggugcaaaucuuacagccacaucugauagagaaaccauuuccuauaccuuagaaggaacgagaagugcuguugaaaaggcucuaccauauuuagcagaaguagcuacccaccaagaauuuagaccuugggaagugucagaacuaucuaacagauuaauuuuggauauuuuaaccagaccuuuacaguuaagagccaucgauuugcuucacaaugcugccuaccguagcaaagguuuagguaacucacucuucauuccaaaaucccaaguagguaaaguuucaucagaaacguuacaacauuacguagccagcaacuuuguagcuggccgugcugcaguuguugguacagguguaagcgagaguuuguugaaucaauucgcugcuaguuugggaauuggaaauggcgaaggcagcaccaauccaucuccuuacaaggguggugaacucagaucaaacaaaggugguccacuugcuuuuguugcaguagggggagaaggagcuccauugaagaacaccaaagaagcucuugcguuugcaguucuacagaaagcuguaugugccggcccucagaucaaauauggcguacuugaucauggagucuacagcaaagcucuugguggcucaucagauguaucugcgugcgcuguuaaugugagcuauucagacagcgguuuguuugguauuuugcucgcugcaccugcuggaucuguaggcaaagcaguucaaucagcuguuaaugucuugaaaucaggcuccguuacagaugcugauguucaacgaggcaaaaaucaauugaagacauccauccuucuuaaugcugaaaguggagcugacguuguaagggaacuuggaacccaagcaguuuuggcuggugcuccacaaagcgccaaugcuuuagccgcugcuguagacuccgucaaguggagcuga

SEQ ID NO: 5847 - RNA, 333 nt, Diabrotica barberi
augaggagagcccacgcagguaauuauuacgagccauuaccucaagcuuccaacgaaaucgaagaugaaaaugauagaaugacuaaugaucugcaagaaaagauuggcgucuuaaaaucguugacuauagacauuggaaacgaaguuaaauaccaggacagaaugcucagagauguggacgacgaucuagauaagacuggaggcuucuugggcaccaccaugucaagaguacugagauuaucuaaaggaucucauaauuaccucauccuguauuuauuuguguuuucuguagugguguuuuuuguucuguaucuaguuauuaaguuuagguag

SEQ ID NO: 5848 - RNA, 1290 nt, Diabrotica barberi
auggcuucgacguuaucagcaagacaggcuaacagagaacauguuuuggccguauccagagacuucauaucccaaccaagacucacuuacaaaacuguaucuggugucaacgguccacuaguaauccucgaagaugucaaauuucccaaguucaacgaaauuguccaacucagauuaucugacggaaguuuaagaucaggucaaguacuugaagucagcgguuccaaggcuguaguacaaguauucgaagguacaucagguaucgaugccaagcacacugugugugaguucacaggagauauucucaggaccccugucucugaggauauguugggaagaguauucaauggcucuggaaaaccuauugacaaaggucccccaauucuggcugaagacuaccuagauauccaaggacaacccaucaacccauggucccguaucuaccccgaagaaaugauccaaacugguaucacugccaucgaugugaugaacuccauugcccguggucagaagauucccauuuucucagcugcuggucugccacauaacgauauugcugcccaaauuuguaggcaagccggucuugucaaaaucccaggcaaaucaguuuuggaugaccacgaagacaacuuugccaucguguuugcugcuauggguguuaacauggaaacugcuagauucuucaaacaagauuucgaagaaaaugguucuauggaaaacguaugucuguucuugaacuuggcuaacgauccaaccaucgaaagaaucauuaccccacgucuugcucuaacagccgcugaauucuuggcuuaccagugcgaaaaacauguguuggucauuuuaacugacaugucuucauacgcugaagcuuugcgugagguaucugcugccagagaagaaguacccggucgucgugguuucccagguuacauguacaccgauuuggccaccaucuacgagcgugccggucgugucgaaggccguaacgguuccaucacacaaauccccaucuugacuaugccuaacgacgauauuacucacccuauucccgauuugacggguuauauuaccgaaggacagaucuacgucgaucgucaauugcacaacaggcaaaucuacccaccaauuaacguacugccaucucucucacguuugaugaagucugccaucggcgaagguaugaccaggaaggaccacucugacguuucuaaccaguuguuuuuggaaagaaaucaaccuuuccuucuucggaaaccuaagccucacgcaccaccggugaugcaacuuuaa

SEQ ID NO: 5849 - RNA, 336 nt, Diabrotica barberi
augagucgcggacacgcaggaccccguauucacguuccagacgaauuaagagaaguacuccucgaauuuacaauuaguuauuuacuggaacaaccuggagauguuauuaguuacgccgccgaauauuuuacgcgcuugagggaaacccgggugacauccagaguguaugaugaagcugcugccucgcaggaggaauugguaucaccugacgaauccguaauguccaaagaugaagaaccuucaauccgguuugcugguaggcguaaaucaguguucgcagaaacuuacgauccagaagaagacgacgacgaugaugauggcgccaaguugguguau

SEQ ID NO: 5850 - RNA, 2421 nt, Diabrotica barberi
augaguuacaugcagucuaaccaaaauagaccaaugucucaaagcuaccaucaggguccuaaugaccugcccaugcagucuucuaaagaacagaccuuacuauggcagcagaauucauacaugggagacucugguauucagucuggggcugcuacacagguaccaucacugacagguaaagaggaggaagaaauggaucuguuugauuuggaucaaccauaucaggguuuuacacaagagcagguugaugacaugaauaaucaacugaaucauacuaggucccaaagaguuagagcugccauguuuccugaaacuuuggaugaagguauugaaaucccuuccacacaguuugauccuaaucaucaaacagcaguucaacgucuggcagaaccuagucaaaugcucaagcaugcuguaguuaaucuuauuaacuaucaagaugaugcugaccuugcaaccagggccauaccagaauugaucaagcuucuuaaugaugaagaccaaguaguaguaucccaggcagcuaugaugguccaccaacuaucuaagaaggaagcaucuagacaugcuauuaugaauaguccucaaaugguagcugccuuagugagagcuauaucaaacucuaaugacuuggagacuaccaaaggagcuguugguacccuacacaaguuaucacaccacagacaagguuuacuugcuauuuuuaaaagcggagguauuccagcacuuguaaaguugcucaguucuccuguagaaaguguucuugucuaugcuauaaccacucuucacaaccuguuauuacaucaagauggaucuaagauggcuguuagacuugcaggugguuugcaaaagaugguugcacuacuccaaagaaaucaugucaaauuuuugucaauuguaacugauugcuuacaaauuuuggcuuaugguaaccaggagagcaaguuaauaauuuuggcaagucaaggacccauugaauugguccgaaucaugagaucuuacgauuaugagaaguuguuguggacuacuucuagaguucugaaaguucuuucaguuugugccaguaacaaaccugcuauaguugaagcaggaggaaugcaagcuuuggcaaugcacuugggaaauccaagcacaagauugguucaaaauugucuuuggacauugagaaaucuuucagaugcugcuacaaaaguugauggucuagaaagcuuauugcaaucuuugguacaaguauuagcaucuucugaugucaauguagugacaugugcugcugguauucuuuccaaucugacuuguaacaaucagcgcaauaaaguaacugugugccaagugggagggguugaugcacuugugcgcacuauagucagugcaggagauagagaagaaaucacggaaccagcuguuugugcacugcgucauuugacauccagacauguggaaucagaaauggcacagaaugcuguuagacucaacuacggcaugcagauuauaguaaaacuguugaacccaccuucccguuggccauuggugaaagcagugauugguuugaucagaaauuuggcuuuauguccugccaaucaugccccauugagagaacauggugccauacaucaucuuguacagcugcuaaugagagcuuuccaagauacacagagacaaagagcaaguguugcgaguggcggcagccaaccaccuggcacauacgcagauggugugagaauggaagaaauuguggaggguacagugggagcucuucacauucugucaagagagucccauaaucgugccauaauaagacagcagaugguuguacccauauuugugcagcuacucuuuaaugauauugaaaacauccaacguguugcagcaggaguacuuugugaauuagcagcugauaaagaaggagcugagaugauagaacaagaaggagccacugcacccuugacugagcuuuuacauucaagaaaugaagguguugcuacauaugcagcagcuguuuuauucagaaugagugaagauaaaccgcaggacuauaagaaacgacugucuauggaguuaacgaacucuuuguuuagagaagagaaccucuggaauccagaccuagggaugggcccugauuuacaggauauauugaguccagaucaagcuuacgacaauauguaugcacaaggucccccuaguguucacagcagccacggcgguaggccuuaccagcaacaaggguaugaccagauacccauagauaugcaaggucuagauauuggcucccauggaggcggaaaugggucgaccuauagcgcaaucgacgccauggauguuaccagcggggauccggaucuuaacuucgauacuauugaucaacuucccaccccuccucaagauaauaaccacgccgcagcuugguacgauacagaccuguaa

SEQ ID NO: 5851 - RNA, 819 nt, Diabrotica barberi
auggcccgaaacgccgaaaaagcgaugacaacauuagcucgauggagagcagcccaacugggugaaauagauaagcacaaaaagcgaagaccuuaccuugcaucagaauguaaaaauuuacaugcuugugaaaaauggagaaugcagauaauaagagaaauugccaagaaaguagcucaaauucaaaaugcuggacuuggagaauuuaggauaagagacuuaaaugaugaaauaaauaaacuacugagggagaaacggcauugggaggaucaaauaaaggaauuaggugggccugacuaucagagaguugguccacggauguuggaucaugaagggaaagaaguaccuggaaauaggggguauaaauacuuuggggcggcuaaggaauuaccagguguucgagaacuuuuugagcaggagccgccuccuccuccaaggaaaaguagagcagaacuaaugaaagacauugaugcggacuacuauggauacauggacgacgaugacggaauuuugauuccauuggaaguuaaagcugaaaaaacagccguucaaaaugcaguagcugaguggguuaguaaaaaagaacaaaauuuggagaacgcagagaaccaaacagaagaagaaaguauauaugcaguucaggagucugacgaugaagaaaguaaagaaacuguacaacaguuaguggauggaucacagcaaagauuuguugcacauguaccuguaccaucucaacaagauaucgaacaggcccuacugaggcgaagaaaacuugaacuuauggaaaaauacgguguagaagaggaaccgaaaucguag

SEQ ID NO: 5852 - RNA, 648 nt, Diabrotica barberi
auggcuggcgaacaagauaugcccaccuucaaaugcgucuuggucggagacggagguacuggcaaaacuaccuuuguaaaaagacacaugacuggugaauucgaaaagaaauauguagccaccuuaggaguagaaguucacccuuuaguuuuccacacaaauagaggacaaauucguuuuaauguaugggacacagcaggccaagaaaaguuugguggucugcgugauggauacuacauccaaggacaaugugccauaauuauguucgacguuacaucuagagucacuuacaaaaauguuccaaacuggcacagagaucuuguuagaguuugugaaaauaucccaauuguauugugugguaacaaaguugacaucaaagauaggaaaguuaaggcaaagagcauugucuuccacaggaagaagaauuuacaauacuaugacaucucugcaaaauccaacuacaacuucgaaaaacccuucuugugguuggcuaggaaacucauuggagaucccaacuuagaauucguagcugcaccugccuugcuuccuccagaaguccagauggauccccaauggcagcaacaaaucgaaaaggaucuuaaagaagccucagaaacugcacugcccgaugaugacgaagauuuauaa

SEQ ID NO: 5853 - RNA, 2508 nt, Diabrotica barberi
augccuagaauaaugauaaaaggugguguuuggagaaacaccgaggaugaaauucucaaagcugcuguuaugaaauauggcaaaaaccaguggucuaggauagcuucgcuacuucacagaaagucugcaaaacaguguaaagcccguugguucgagugguuagaucccagcauuaaaaaaacugaauggucuagagaggaagaugaaaaacuguuacauuuggcuaaacuuaugccuacacaguggagaacaauugcucccauuauuggaagaaccgcagcacaguguuuggaaagauaugaauauuuacuggaucaagcgcaaaagaaagaagaaggugaggaugcaguggaugaucccaggaagcugaaaccuggagagauugacccaaauccagagacaaagccugcaaggccugaucccaaagauauggaugaagaugaauuagagauguuaucugaagcuagagcuagauuagccaauacucaaggcaaaaaagcuaagaggaaggcucgugagaaacaauuggaagaggcuagaagauuggcugcucuucagaaacgcagagagcugagagcugccggaauagaaguuacaucucguagaaagaaaaaacgaggaguagacuacaaugcugaaauaccguucgaaaagaggccagcgauuggauuuuaugacacguccaaugaaguauuagauccuauggcucccgauuuuucaaaaaugaggcagcaacacuuggauggggagcugagaagugaacaagaggagagagaacguaagaaagauaaacagaaacuaaagcagcgcaaggaaaacgacauuccucaagcuauguuacaaaaccaggaaccagcuaagaaacgauccaaguuagugcuuccggaaccacaaauuucagaccaggaaaugcaccaaguggugaaguugggcaaagcgagugaagcagcuagggaaauaguuacagaaagcgguguugaaaccacugacacuuuguugaaugauuauacuuucaauccucaagcggcugcuacaccaaggacuccggcgccccagacugauaggauauugcaagaagcucagaacaugauggcgcucacacacguagauacgccucucaaaggcggcauuaacacuccgcuacacaauucagauuucagcgggguucuaccccaagcucagaccgucaguaccccgaauaccgugcuugcuacgcccuucagauccaguaggagugacggagcuggcacuccuggcaguagcguuggauuuaugacgccuagaaguggcgcuuuggugccuguggggaagacgccgguaggaaugacgccuucgguuagggauaaacuuaguauuaauccagaggaagcaauggacguaggaagcacaccagccgagcacagaauguaccaaaugucgaugaaagaucaauuaaaaaugggguugagcagucuaccacaaccgaaaaacgacuaugaaaucguggugcccgaaaaugaagaccaggaggaacccgagcaagcucagucacaaaugaucgaagaucaagcugauguagaugcgcggaaacaagaagagcucaaggcuaaagcagccagggagcuggcgcuccguucucaagucauccaacgugaucuaccgagaccucaagaagugaacaugaccguccuucgaccaucccacgagagcuauuccuuauccgaucugcagcgagccgaagagcucaucaaacgcgagauggugacuauguuacauuucgauaaccuuaagaauccgguuccgacgcagaguaagagguccaauaugucgcaggcucaucaauuggccuuuuuggagcagcauccguaugagucguucaggaaagaagauuuagaggcggccaaggggauauugaagagggaaauggaggugguuaggaaugguaugaaucacggggaguugccuaucgaagucuacacucaggugugggaagaaugcuuaagccaaguucuguuccucccgaaccaaacgagauacacucgagccaacuuagcuaguaaaaaagacagacuggaaucggcggaaaaaaggcucgaacagaacagaucucacauggcgaaagaagccaaacgagcugccaaaauggagaaaaaauugaagauuuuaacaggcggguaccaguccagagcgcagguguugaucaaacaauuacaagauuguuaugagaaccuagauucgacuaauuuagaauugaauacguucaaguuucugcaagaacaagaaaaaucugcucuaccaagaagaauacagucucucacugaagacgucagucgacaaacagaacgagaacgaggcuugcaaaagaaauacggcgaucuucaagcagaaauaaaauacuuacaagaaucauaccugagucagcuucaaaaagaacagagaaaggaagcugauaauacagcuaacgagguuucuuccacuaccaauggagaacucaacgcagaagcagccgaugaugaugaagauauguag

SEQ ID NO: 5854 - RNA, 474 nt, Diabrotica barberi
augaugcaauucauguuauuauucaguagacaagguaaacuaagguuacaaaaaugguauguggcucauccagacaaacucaagaaaaaaauuacaagagaauuaaucacaaccauuuuagcuagaaaaccuaaaauguguaguuuucuggaguggagagacuuaaaaauuguuuacaaaagauaugcaaguuuguauuuuugcugugcaauugaacaaugugacaaugaacuccuaacccuggaaauuauacaccguuauguagagcuccuugauaaauauuuuggaaguguuugugaguuagauauaaucuucaacuuugagaaagccuacuuuauauuggaugagcugaugcuagggggugaaguucaggagacaaguaaaaagaauguuuugaaagccauugcugcccaggaucuauuacaagaggaggaaacuccgcagggauuuuucgacgaccauggucuugguuag

SEQ ID NO: 5855 - RNA, 1251 nt, Diabrotica barberi
auguauggauuacagagaauuucauaccgaaucuauauucgcaauggguuucgacauuauucccaacaaccugcaaagaggaauuccuuuaucggccggcucuuugaaaauuucaaagaugagauggccaagaacaaagaaaugaaagaaucccugaaaaaauuucgagaggaagcucaaaaauuagaacaaagugaugcacuaaaagcagcuagacagaaauuugaaaguguagaaaaagaagcuaguaaagguagcgaaguuuuuaaagaaaguuuagguucuguuaaggaaaggcuuaaaggaguuauagaugaagcuaguaagucagauuuagcaaagaaggcuggcaaauucacagaagaaguugguaaaacuacacauaaaauuagugaaacagcucaagaaauuaguaaaacuggagcguuucaaaguauaucucaagcuacuaaggcuguuaaacaagaaauagacaauacuaguauagaagguagaguauauguuaguccuaaaauacuacggaagagaacagaaacaagugcaguuguccaucaaaaauauuaugaaccaaacacagaugcuacagguguugaacuacacaaagauucuaaguuuuaugaaucuuggcaaaauuucaaagauaacaauccauauguacauaaaguuauggacuggaaauuaaaauacgaugaaagugaaaauccugucauccgugcuuccagagcucuaacagaaaaaguuggugauaucaugggugguuuauuucagaaaacggaacuaucugaaacacuuacagaaaucuguaagauagauccugcguuugauaccaaaagauuucugaaacaaugugagacagauauuauucccaauauucuugaagccaugacgagaggagaguuagaaguucuuaaagauuggugucaugaaggcccauucaaucuuuuugcuguuccuauaaaagaagccuauaaaaagggauacaaaauugaaucaaaaauuuuagauaucgaucauguggauuuagucuugggcaaagugauggaccaagggccaguuuugauaauaucuuuuacaucccagcaaguuauggcuguccgagaugccgcagguggaguugucgagggagauccugacaaaguaaugagaguuaacuauguauggguacuaugcagagaugucacagaaccugauccuagagcggcauggaggcugcuugaucuuucagccagcagcaacgaacaacugguuuaa

SEQ ID NO: 5856 - RNA, 930 nt, Diabrotica barberi
augaguucugauucagaacuaagugauagcgacauugagcuccaacaagcauuugcagaugguaagcuucaaccuggcuuaaauacuguggaagaaggaccaaaacaguucacaaauaaugugagugguuuaaaacaaaaauuagaagaaauaaaacugaaguuaccauggauagaacgacuggacuguguaaaugcacaagccccuuuagcaccugaauuagcagcucaaauguugacccacgaggaaaaaagaaguaaugagcuuaaaaauaauaaaaagcucacacaguuuacuccaagugaagacccgguuuuaaacgacuuuaaaagagaaaugauguuccacagacaagcccaggcugccauucuagauucuauaccaaagcuaaaagauaugggaauacuaacuaaaaggccugacgauuacuuugcagaaauggcgaaaacggaugcccauaugcagaagauuagggaacaucuuaugacgaaacaggagcaacagaagagaagugaacgagucaaacaacuuagacagcaacgaaaagaagguaaaauguuacaaguucagacaaaacuucaaagacaacaagaaaagaaagauaugcuugcucagguuaaaaaaguaagaaagggaauguccaaagaucuugacuuccuugacggaaaaaauaaaucugcugccaaaaaaauggcagaaaaacggaaaaugaaagacaaaaaguucgguuucgguggcaagaaaaagggaaugaaaaggaacacaagagauagugcugcagauauaagugaauuuaaaaauccugguaaaccuggaaaaaaauuuaacaauaguggaaaagggguaaaaggugguaaaaugggccaaggggcgaaacaaagaauggguaaaaguaaaaggauuaaaaugagaucuaaaggaaggaaguga

SEQ ID NO: 5857 - RNA, 2052 nt, Diabrotica barberi
augaauccaggcgccccaaauuaccccauggcgucuuuguacguuggggauuuacacucugauauuacugaggccaugcuuuuugagaaauuuucaacugcgggcccuguucuuucgauucgcguuugcagagacuugauuacacguagauccuuggguuaugcguacguaaauuuccagcaaccugcugaugcugagcgugcgcuggauacaaugaacuuugacuugauuaaaggacgucccaucagaauaauguggucucaacgagauccaucauugagaaaaucugguguugggaauguuuuuauuaagaauuuggaucguuccauugacaacaaggcuauguaugauacuuucucagcuuuugguaacauucuuaguuguaagguagcucaagaugaaaacggcuccaguaaaggauauggguuuguacauuuugaaacugaagaagcugcaaauaaaucuauugaaaagguaaaugguauguuguuaaauggaaaaaaaguauauguuggccgcuuuauuccacgcaaagaaagagaaaaggaacugggagaaaaggccaaacuuuucacaaauguauauguuaaaaauuuuggugaagauuuaucugaggaagaguugcggaauauguuugaaaaauaugguaaaauuaccagcuacaagauaaugaguaaagaugaugguaaaucuaaaggcuuuggcuuuguugcauuugaaaauccagaggcagcugaaacagcaguagaagcauugaauggaaaagaguugauggaaggaaaaccuuuguauguaggaagagcccaaaagaaagcugagcgccagcaagaacuaaaacgucgauuugaagcccuuaaaauggaaagacuuaaucguuaucaggguguaaaucucuauguuaaaaacuuggaugauacuauagacgacgaacgucuccguaaagaauucucuccguucggaaccauaacuucugccaaaguaaugauggaagaagguagaagcaaggguuuugguuucgucugcuuuuccuccccggaagaagcuacaaaagcaguaacggagaugaacggcagaauugucgguacgaagccuuuauauguugccuuagcucagcguaaagaagaucgcaaagcacauuuaacaucucaguacaugcagcgcauggccaauaugcgcaugcaccagaugggucaguucauucaaccaggugcgucuagcggcuauuucguuccaaccauuccuaccgcacagagauucuauggaccagcccagauggcucagauucguaccagucccagauggccugcccaaacaccuguaagaccaggugcucaaggaggagcuacugccuacacuggcaugccaaacacuuacagagcggcuacucguccaccaaaccagucaacaacaaugcguagcaacaucaguguaccuagaccaauuacuggacaacaaccucaaaguggcgucguaccuucaacuggucgaacagcaaacuucaaguauacuucgaacaugagaaauccaccacgagcuacugccuacacuggcaugccaaacacuuacagagcggcuacucguccaccaaaccagucaacaacaaugcguagcaacaucaguguaccuagaccaauuacuggacaacaaccucaaaguggaguuguaccuuccgcuggccgcacagcaaacuucaaauauacuucgaacaugagaaauccaccucaauccaugggagguauaccaggaacugcggcuccuguacagcaagcuguacacauccagggucaagagccacuuacagcaacaauguuggcugcugcucccccccaagaacaaaaacagauguugggugaaagauuguuuccacuuauccaacgcauguaugcagauauggcagguaaaaucacugguauguuguuggaaauugacaauacugaguuguugcacauguuggaacaccaggagucgcuuaagaauaaaguggaagaagcaguugcuguacuacaagcccaucaagccaaacaggcugcuacacagauuaaaaaagauuag

SEQ ID NO: 5858 - RNA, 2556 nt, Diabrotica barberi
augaccgacucaaaauauuuuacuacuaccaaaaagggagaaauauuugaauuaaagucagagcuaaauaaugauaaaaaggagaagaaaaaagaagcuguuaaaaagguuauugccucuaugacaguaggcaaagauguuucagcuuuauuuccagaugucguaaacugcaugcagacugauaauuuggagcucaaaaagcuaguuuauuuauauuuaaugaacuaugcuaaaucucaaccugacauggcuauuauggcaguaaauacuuuuguaaaggacugugaagaucccaauccucuaauaagagcacuugcuguuagaacaauggguuguauuagaguagauaaaaucacugaauaucuuugugagccauugaggaaaugucuaaaagaugaagauccuuauguaagaaaaacagcagcuguuuguguugccaaauuauaugacauuucgucagguuugguagaggaucaaggcuuuuuagaacagcuaaaagaauuguuaagugauucuaacccuaugguaguugcuaaugcugucgcagcuuuauccgagauaaaugaaagcaguccuacuggucaaccucuaguugaacucaguacaaacacuauuaacaaacuucuuaccgcccuaaacgaauguaccgaauggggccaaguauucauccucgauucccuuucaaauuacaccccucgugaugagcgcgaggcccaaaguauuugugaacguauuacuccgagauuagcgcaugcuaaugcugcugugguuuugucugcuguuaaaguuuugaucaaaaugauggagauucuagcuggagauacugauuucugcaauacuuuaagcaagaaacuagcuccuccacuggugacguugcuuaguucugaaccagaagugcaguacguggcauuaaggaauaucaacuuaauuguucagaagaaaccugacauacuuaaacaugagaugaaaguauuuuucgucaaauacaaugauccaaucuacguuaaauuggaaaaguuggacauaaugauccgucuagcaucucaagucaacauugcucaaguccucagugaacuaaaggaguaugcuacugaaguugauguagauuucgucaggaaggcaguuagagcuauugguagaugugccaucaaaguugaaccuucggcagaaagauguguggcuacacuuuuggaucuuauucaaacaaaagucaacuacguuguucaagaagcuauuguuguuaucaaggauauauuuagaaaauaucccaauaaguaugaaaguauuaucaguacacuuugcgaaaauuuggauacccuugaugagcccgaagcuagagccaguaugguauggauuauuggagaauaugcagaaagaauugacaaugcugaugaacuauuggacaguuuucuggaagguuuuggagaugaaaaugcucaaguacaguugcaauuauugacagcuguugucaaacuguuuuugaaacgcccucaacauacgcaagguuuaguucagcaugugcuaaguuuagcuacacaggauuccgauaacccagaucuaagagaccgugguuuuaucuauuggagguuguugaguacugauccugcagcagccaaagaaguaguucuagcagacaaaccucugauuucugaagaaaccgaucuacuagaaccuacacuucuugacgaacugaucugccauauaucuucccucgccaguguuuaucacaaacccccaacugccuucgucgaaggaagaucugcagguauccgcaagucuuugccagcuagacaaggaucugcugaagacacuaguagcgcuccagaaccaaccguuauuccuaaucaagagagucuuaucggugacuugcuaucaauggaucuuaaugcuccagcuccugcggcugcacaagcagcuguaccagccaguaauguagaucucuuagguggaggauuggauucuuuguuggauauugguaccacucccgcaccucccacuucuacgggacuucuuggugacauuuuuggaauaccaacugcuccaaccauguauacaccacccaaaacuauaugguuaccggcugaaaaagguaaaggauuggaaauacauggagcguuuucaagaagagcugggcagaugucaauggauuugacauucaccaauaaagccaugcaggcgaugucugccuucgcuauucaguucaacaaaaacagcuucgguauaguucccggcucaccacucaccgugccugcgcuucagcccggacagagcuuggaauacaauuuagcguuggccacuacuggaccaguacaacguauggauccacucacuacucuccaaguggcaaucaaaaacaacgucgauaucuucuauuacgccugccaaauucccauucagauucuguucaccgaagacggcacuuuggauaagaggguguuccuuacuacuuggagagacauuccggcagcuaaugagguccaauacacuguuaaugaugucaaaggaaacacagauggaguuucuagcaaaaugacacugaauaacaucuuuaccaua

SEQ ID NO: 5859 - RNA, 498 nt, Diabrotica barberi
augccacccaaguucgaucccaccgaaauuaaauauguuuacaugagaugugucggaggagaaguuggagcuaccucuucuuuggcuccuaaaauugguccucuagguuugucucccaaaaaaguuggugacgauauugccaaagguacugcugauuggaaaggucuuaaaaucacaguacaauugaaaauccaaaaucgucaagcuaccauuucuguagucccaucugccuccucccugaucauuagggcucuuaaagaaccaccacgcgauaggaagaagcaaaagaacauuaaacacacugguaacauuacuuucgaugaaauaauugcuauugccagacagaugaggcccaggucgauggccaaacaguuauccggaacuguaaaagagguuuuaggaacagcccaaucaguuggauguacaauugaugguaaagcagcacaugauguuauugaugagguuaaugaaggaaccauagaaguaccagaugaauaa

SEQ ID NO: 5860 - RNA, 1095 nt, Diabrotica barberi
augccagaagaaggaaaaagggcauuaauuuugguuggagguuaugguaccagauugagaccucuaacuuugaguagacccaaaccucuuguagaauuugcaaauaaacccauucuccuucaucaaauagaagcacuuguagaugcuggaguuacugaaguuauauuagcaguaucauaucgugcuaagcaaauggaagaagaguugacaguggaagccaaaaaauugggaauuaauauaauauuuucccaugaaacagaaccuuuagguacagcgggaccaauugcauuagccagggaucaucuuucuaaaagcacuaaaccauucuuuguguuaaauuccgauauuauuugcgacuucccauuuaaagccuuggccgaauuccauaaaaaccacggaaaggaagguacaauagugguuacuaaaguggaagaaccgucaaaauaugguguaguaguuuaugauaaagacaacagcauccaaaguuuuguagaaaaaccucaagaauucauuucuaauaaaauuaaugcugguuuguacauucuaaauccaagugucauuaacaggauagaauuaaaaccaacuucuauugagaaagaaguauuuccuuacauggcugcugauaaacaguuguaugcauuugaauuggaagguuuuuggauggauguuggucaaccaaaagauuuucugacaggaauguguuuauaucucaaacauuuaaggcagacaaaugaagacaaacuuuauaaaggaccaggugucguuggcaauguauuaguagauccuacugcuaaaauuggaaacaauugucaaaucgggccuaauguuacaauaggaccagguguuguuauagaagaugggguauguauaaaaagaucuacaauucuuaaagaugcuaccauuaguucaaauucuugguuagaaagcuguauuguuggauggaaguguuguguugggagauggguaagaauggaggguuccacaguacuaggagaagauguuauaguuaaagaugaaacguacauuaauggaggucaaguguugccucauaaaaauaucgcuacuucaguuccagaaccucagauuauuauguga

SEQ ID NO: 5861 - RNA, 915 nt, Diabrotica barberi
cuaaacauggcgucagacggggacgacguuauuagugaccaagaaaaagugaaaauaguaucggauuuuauucuccauucgccacccggugaauuuaaugagguauuuaaugauguuagaaaacuuuuaaacgacgaugaccucuuaaaagaaggugccagcggggcauucgcccaguauaacaaagaucaacugacccccguuaaaauagaaaacgccgaucauuuagugcuuauuacggaauacaacgauuuagggaauaauagauucuucgaccccaggaguaagcagaguuuuaccuacgaucaccugagaaaagaagccuuagacuaccaagucuauacccccgauagcgcuucugagccuuggcgggcagccuuagacucagaguucauucaguacacuaggaaccauuacaaagauggaguauguagugugguaggccgcaaccagagcgggguuguuaacuuaacggcauguaucgaagaccaucaguucucuccgaagaacuacuggaaugggagagaagaccaccaguucucuccgaagaacuacuggaaugggagauggagaucgcagugguccauuagucuaacugaugauuccacugcugaggugagagguguacucaaaguacagguccauuauuaugaagaggguaauguacaauuaguaaguacuaaagaaauaaaagaaacuguuccuguuucaucugaggcacaaacugcuaaagaaaucauccaaguaauagaagccgcugaggaucucuaucagacggcaauuucagaaaacuaccagaacaugucagauacaaccuucaaggcccuacgaagacuucuuccugucaccaggacaaaaauggauuggaauaaaaucguauccuauagcauugguaaagaacucaaaacgcaauga

SEQ ID NO: 5862 - RNA, 4068 nt, Diabrotica barberi
augugguuaaaguacuuuguuauuuuuguuuuguuuaguguuagcguuaaaggacuagauggugaucuuccaccagauguugaaacuaucgauguggagccuaccaauguaaguaacgcggauccagaugcagggaaaccuauuccgguggaagauacaccuaauggagccgcuccaguuaauccaaacuaugaaguagauaaauccuuaguuaauguaaccaauaguuugguaaaugugacuaaaaaucccagacggacuuaucagacaguuaacaaacugggcaaauauucgacauuuuaugcugcagauuacgauccuaugaccucagacacagcuccaccagacacugaccaacgaggaggaggaacuccauacacuauaacagaaacaagacuggcagaaauaaggaaacauuuuauguacccauuuuucgauaaaggaggcagugauaauaacuugggagauuuccaaaaggacauucaaucuuccauuccucaggugcacaagaauuuaaacuuccaguugccuuucuuuggauucagauauaauuacacgagaguuucagugaauggguaucuggaauucagcgauccaccuccaaauuaugacuauccauuaguauuuccaauuaaagaauggcccaaaaagaaugauccugccuuuauugguauuuucuucagcagaugcagaaucgguaaucugcgugauggagacauugaccaaagaacacccggggucuauuuuagaauggaaagagauuuaagaacgaggcaagacagaauggguguagaaauuagagaaagacuuaagugggacaucagaacaggagucauuggaucagaaacauucgauccuaagcacgccguuauugucacuuggaaaaacguuucuuucacuggaggauucgcuaaugcuaaauacaagacaaacaccuuccaaaugguucuugcaacugacgaagucuucacuuacgcgauguucaacuaccucaacuuggacuggaccucccacacugaagcggguggugauucccaaaacggagaagguggugucagugccuauguugguuuuaacgcuggaaacgguaccagaagcuacgaauacaauccuuacagucaagcuuccgucauucgagaucucacugcaguuggauuuggaaaugguuuuaagggaagacauauuuuccguauagacgaagacauuuugcuuggaucaugcaacaaagauauagauggugccaaccuuccccugaaauucgcuccugaaagugguaacauguuggguggaacagugguaaauauaacugguccaugcuucaauuugaaugauaggauucgaugcaaguuugacguaucaaaugaaguauuuggguauguuguugauaaaaacagagcgaucuguguacaaccucaacuuuaugccgaaggaugggugaaucuucaaauugcuguuaauuccgaagcauucaaguggaaggggaaguauuauguagaaucuccugcuagugcgacucaaaaaaucuucuucaaggacaugaaauuacacgaaaaaucuccgagcgaauuaaaaaucacuugggagaagcagaauuugaccacaaacgacaacgcuaauauucgaauuucucucugggguuacagagaaacaacuaugaaaccaguguuuguuuauaucaccgauaucgcagauaauguucaaaacauuggagaauacacgauuguuccuucucaguuuagaacuaaagugaaccaauauuugacugauauuaaguuuggauuccuccaaauuaauuuaacugagucuaucaaaguuaauacauauacuacaagccagagcagcauagaauuaacaccgguaguauggagccgacccauuccacucgguugguacuuccaguuccaaugggaaaaccaguacgguaaaaauuggcccaaauauuuaugugacgauuggcugagaacggacagauaucuaaagaacuucgcucacgaacuugcucaaugucccugcaccgucgaacaagcucuagcugacaagggcagguuuaugccagacuucgauugcgacaaagauucgaacccgauuuguuacuauaacaaccaagcacuucauugugugaaaacuggaucucccacuuuagaaggcuccgaacaacaauguugcuaugauaaaaacggcuuuuugaugcucucuuacgaucaacaaugggguucuagucccagacguugccacaacuuggguaaaaugccuuacaacgaagcgacaaaagugccuacucucucacaaugguuuaaugacaugguacccaaauauuuguguugucuuuggcaagacgagcaagcugugggaugugaaacacugagauuugaacguagaccuacacaggauuguguagcuuaccaagcaccagguguagcaggagucuacggugauccacacuuuguuacuuucgacgauguagaauauacguuuaauggaaaaggagaauucgcauuggugaaaucaguuacgcaaacggacaaucuggaaauccaaggaagauuugagcaaauggacccuaacacuuauggugagguuagagcuacucagcugacuucuguaguagcuaaagguaauaacacaauagcaauugaagucagaaggagaccucuagauucuagauggagauauagguuggauguuauagcagauaauagaagacuuuauuuugauagacccucacuaaaauuccagcacuuccaagguguuacuauuuacacuccaaccuacauucuuaaucaaucagaagucaucauuauguuugacaauggagcuggaauggagguugucgacaaucaaggauucaugagugcaagaguauuuuugccuuggucguuuauaaauaaaaccauaggccuuuuuggaaauuggaguuucaacaaagaagaugacuucacacuuccagaugguucuagagcagcaauagucaauaacauaaaugacauggaaaggguuuacaaugauuuugguuccaaauggauguuggaggauguguuagauccucaaaaggguagagcgcuguuucacagggaauucggaagaacuucagcgacuuacaacaacaaaacguucaagccucaauuccuaaugaauccggaagauuuccuaccaaccaacagaucuacagaucuuaagcgaauauccgaaauauguccucuaaaguuguacgaauguuacuacgauuacgcuaugacgguugacagggauuuggcgcauuacaccaagaauuauaaagccacgaucuaucaauauaaagaaacgacaaggaggaaaguugugucuugcggaguacuagaaacaccgagauucggacgaaagaguacuuuccuguucgugcccgguacgaagguuaccuaugaaugcauccaagaguucguguugguaggugaucagcggagagagugucaagcggauggaacauggaauauuccugaauacggauacacauauugcuuacgucaagaagaauauucuucgcgucaagcugccaucacuucagguauaauccucgcaauuaucauaccauugguucuucuaauagguuacgguggcuacaaaguauaucaaagacuaacaaguaacaaucaaaacuaugacuacgacaccguacaaaagacucaaaaucuccaacaauucagucgaacuuuaaguccauacagagaagaagacgaggacgaaaaguauccucaaagcgacacugacucgcuuagcaagaaacgaagaaguuacgacaaguccuacagaacucacgaaccuuugcccaauagaccgaauucugaguucgaggagaagccauuggacccuuacgaucaaaccuucgaagacgauaggguuucuagaacgccuaccggaaguccaacuaguccuacuucuaguauucaauauacaacgccuuauagucgaccagacauuauuagagggaacagcucaaagaauuugaacuauaacgacauguaugcagaaccaauaaagaaaccuaaagaaaggauuagcgcuagucagaguaguauagugacagacguuuag

SEQ ID NO: 5863 - RNA, 462 nt, Diabrotica barberi
agauuuuuucaagaucugcagcauugggagaggcuuugccgcccaaaacggccaauaaguaagcagccacguaacgcauuuuuaagucgguauacacguuucgugucucaagacuuaaaaaugcguuacguggcugcuuacuuauuggccguuuugggcggcaaagccucucccaaugcugcagaucuugaaaaaaucuugggaucuguagguguugaagcugaaggagaaagaguaaagaaagucaucagcgagcucaguggcaagucuguugaagaacucauugcucaaggucgugaaaaguugagcuccaugccaguuggugguggugccccagcugcugccggaggugccgcugcugcugcuccagcugcugaagaaaagaaagaggccaagaaggaagaaaagaagguugaaucugaaucagaagacgacgacaugggcuuugcucuauucgacuag

SEQ ID NO: 5864 - RNA, 2724 nt, Diabrotica barberi
augaugacugaccgcuucgguuuaaaaugggacccgaaaaacuuagagauaagaaccaugucuguggaaaagacauuggaaccccuagugcuucaaguuaccacccucgucaauaccaaggggccuagcaaaaagaagaaaggaaagucuaaacgugccaaugcucugguuaguacuguugaaaaagccacggaaaacuucauagaaaagggggagcagauagccuaugagaacccagauauuaccgaggaaaugcuggcagccguugacgaagucaagaaaacgggacaugcuaugagcggagcugcaagagaauuuucagaagacccaugcucuucuuuaaaaagaggaaauaugguuagggcugcuagaaaucuuuuaucggcuguaacucgucuuuuaauucuagcggacaugguugauguccaccuuuugcucaaauccuuacauguaguugaggacgaccucgaaaaacuaaaaaaugcuucaagcaauggcgaacuuuuagacaauauuaaagccuuuggucaaaaugccaacgaauuaaugaaucaggcugcuaaaaggcagcaagaacugaaagauccacaacuucgugaugaucuagcagcugcuagagcuguacuuaagaaacauuccacuauguuauuaacugccucuaagguuuauguacgucauccagagcuagcagcugccaaagcaaauagagauuaugucuugaaacaaguuugugaagcugugaauaccauuaaugauguagcucagggaagaacuccucaaccugcuucuggaccauaugauggaccuggagaguuggcugcugcuuuggaugauuuugaugaucacaugguaauggagccucuagcauacaaugaaguucauaccagaccuucauuggaagaacgucuagaaagcauuauaaguggcgcagcucuuauggcagauucuaguuguacuagggaugaaagaagggaaaggauaguugcagaguguaaugcuguaagacaagcuuugcaagacuuguugacugaauauaugacaaauaugggcaauaaagauaaaagugagagccuaguacgagcaaucgacaauauggguagaaagacuaaggauuuaagaagacaacugaggaaagcuguuguagaucauguaucugacaguuucuuggaaaccaacguaccucuucucguuuuaauaaaggcagcucaaaauggcaacgaaaaggagguagaagaauaugcaguuguauuuacugaacauuccaauaaguuaguagaaguugcuaaccuugucugcagcaugucuaauaaugaagauggugucaaaaugguuagauaugcugcugcucaaaucgacaaucuguguccugaaguaauaaaugcagcuagaauuuuagccgcuagaccucgcaguaaaguugcucaagaaaauauggacgcauucaagcaaucaugggagaaucaagugagacuucugacugaagcagucgaugacauuacuacuaucgacgacuuuuuggcuguuucugaaaaccauauucuggaagauguuaauaaauguguacuugccuugcaagaaggugauucugacacauuggaucgcacugccagugguauaagaggaagaucuaauagggugugcaauguaguaacagcugaaauggauaauuacgaaccuugcaucuauaccaaacguguucuugaagccgucaaaguauuaaaugaucaagugaugcccaaguuuacgcaaagagugcaaguugcaguccaagcuuugggaaauaguccucccaaagaaguggaugaaaacgauuuuaucgaugcuucuagacuuguuuacgauggaguaagagaaauaagaagagccguucuaaugaauagagccgaugaagauuuagauccagaagaugucgaauuggaugaaaacuaucugauagaaacaagaagcaaaucgagugcucacacaggcgaacaugggguugaugaguacccagauauuaguggaauuacaacggcuagggaagcuauggguaaaaugccagaagaagauaaacagaagauuuugcaacagguugaguucuucaggagugaaaaacucaaguuugaccgugaggucgcuaaaugggacgacacuggcaacgauauuaucguucuugcuaagcacauguguaugauuaugauggaaaugacagauuuuaccaggggucguggcccucuaaaaaccacuauggacguuauuaaugcggcuaaaaagauuuccgaagcuggaaccaaauuagauaaacuuacucgccaaauagcugaacagugcccagagaguuccaccaaaaaagauuuguuggcuuauuugcaacguauugcucuuuacugccaccagaugaacauuacaucaaagguuaaagccgauguucaaaacaucaguggagaacuuauuguaucuggguuggacagugcuacuucuuugauucaagcugcuaagaacuugaugaaugcuguaguucucacaguaaaggcuucauacguggcauccaccaaauacccaagacaaggaacuauugcaucgccgauuguugucuggaagaugaaagcgccagagaagaaaccguuagucagaccagagaaacccgaagaaguucgugccaaaguacgcaaaggcucacaaaagaaaguucaaaauccaauucacgcucuuucugaauuccaaagcccaacugagucuguguaa

SEQ ID NO: 5865 - RNA, 1236 nt, Diabrotica barberi
augucguucucguucggagccacuccaacaccaccucaaaaaaccguugccuccgguuuuacuuuaccuucaaauccaauaguaacuucaacuacuggauuucaaagcaguuuugguucaggagauaauaaagaccaaaguaaaccgucauuauuugcaacucccucaagucaaccuguuucauuuggguuaacuacaaaggccacuacagccccaacaacccucuccuuugguuuugcuacuccuacgacuguaccguuuggaucaucaacuacaauuacaccugcaacaacuccucaauuuggauuaucgcuuccaaaggcuagugcuccggccacuacuacuuuuucacuucuaggaucugccccagccacuacugcagcagcaccuacagguauaucauuugguacugccacuacuacagcaacaacuucagcuacagguuuaucauuuggaacuccaauuggaacugcuacaacuacagcaacaacuucagcuucagguuuaucuuucggucuuacaacagcgucuucuacaaguucugcugcaccuacacuuuugucaucaacaaccacuucgacaacgucaucagugucugcaucuggugcuuugaguaguacaacaucagcaccgacuuuugccaccucaucguugucuucaacaggcgccuuaacauucucucaacucgaagauucgaucaacaaauggaccauggaucuagaagaacaaggaaaauucuucaucaaccaggcuaagcaauuaaaugcaugggauacuuuacuuauauccaauggagagaaaauuuuaacccuuaacaguagcaucgagaaagucaagcaacaacagcaacaguuagaccaagaauuagacuucgugcuggcacagcaaaaggaauuggaagagcugauuguaccgauagaaaaagaauugcuggggauaccuguuacggauaucgauagaaaucaaauguaccaauuuucggaaauagucgauucacaauuaaaacagaugucugaugauuugaaggaagucauugaacacauaaaugaagccaauaaagaggaagaagcgucaaauccacuaagccaaaucagucgcauauuaaaugcgcauaugaauucguugcaauggaucgauaggaguacagcucagauuagcucucaucuagaacaaauuggaaaaaugcaagauucaaacagaagaaaucacucguuuaauaauuccaugaacuuuuag

SEQ ID NO: 5866 - RNA, 582 nt, Diabrotica barberi
auguuucugugggacugguuuacgggaaugcugggauaucuaggauuauggaagaaaucuggaaaacuauuauucuuaggacuggauaacgcaggcaaaacuacccuucuacauaugcucaaggaugacagacuggcccaacaucuucccacguuacaucccacaucagaggagcuuuccauugguaacaugagguuuacgacguucgauuuggggggccacgagcaggcuaggagaguguggagggacuacuuuccagcaguggaugccauaguguuccuuguugaugccaacgacagcucaagauuuguagaaagccaggaacagcuaaaugcccuccucucagacgaaacucuaucaaacuguccaauacuuaucuuagguaauaaaauugaucucccaggugcugcuucggaagaugaauuacgaacuagauucggcuuguuuggccaaaccacaggcaaaggcaaaguagccagaaacgaucuaccugguaggccucuagaacuauuuaugugcucuauacucaaaagacaagguuauggagaagguuuccguugguuggcacaauauaucgauuaa

SEQ ID NO: 5867 - RNA, 573 nt, Diabrotica barberi
auggaggaaauuaaccuggauuuguuggagaagcguauagaagcuuuggaauuaaagguguuuccuucaggagaucccaguaccauugccgacaaaaaucaaacaauaacaaauauccuuacacaaguucagacauucguuaccacagcucucacuuguagagaaacaauaacuuccauguugcaguuuuauggaacuuuaaacgacuaucucgacccagcugguggagcagaugaacuggagguugaggcaaaaagacauuauauauugcaguuacacccugagaucaaagacacccuacagacacauacucgaauuuugcagacuuuacuucccuucguugaaucggaaaacauuucuaaagugguugaaaugacagcucaauuggaagaggcaucuguuagucaucucaguuuguauggagaguggagagauacaauguacaaaauggugguagcucuacaagauuucacugauauaaugaguuccauuaaaguauuguucucucaauuagauaauaccuugacgaaucuggaauacucacuucaaccuaaauuuguuacugaggaauag

SEQ ID NO: 5868 - RNA, 1749 nt, Diabrotica barberi
augaauaacacaaaaacgcaggaagucuacagcgaccuaacauuauuuacuacuccagauaaguucuucuuggagcccaaaaauggggaggaauugcuugugauagagagaguaacugaagagauuucaguuuauaaaaaccaccgucacaucauaccagcagcuaguaguaggaaagauuucuguggccuccuagguaucauuaaucuguugucugggccuuauuuaguaauugccacacagagggauauaguggguuauauaucagguugugcaguauggaggcuaguaaaggcagaacuaauucccuucaggagcuccuuaaacuuaaguccagaaaaacaagccgacaaugaaguguaccuuaguaugauagaacaaguuuuaacuacacccuuucaguauuucuguuaugauuacgaccugacacauucccuucagcgccuucgggacauuucaccggauuucuggaaacagucccugugggaaagagccgaucaacgauuuguauggaauggauuccuauugagcccuuucagaaaugugaucagcaaaaaguuuugucugccauugauccuaggguuuguuucuauuaacuuuuguguuauuaaugggcauagcuugaacuggaucauuguuacgaggaggaguguuuuuagagcagguaccagauuauuccgcagaggcauagacaaagacggaaacguugcuaauuuugucgaaacugaacaaaucguugaguaccaaggcgaucaugcgaguuuuguucaaauuagaggcucuauuccacuuuucuggcagcaaaaucccgauuugcgucuuaaaccuccuccuaccaugaucgauauggacccacaagagcaacauuccaccuguuugaagcaucuagaagaaguggcaacuuuauauggcaaaguuguguuagucaaucucauugaccaaaagggagcugaagguaacauggagaaauccuuuaagaacgccaugaauucauugucguauccuucagcacgauacgaaccuuucgacuuccauucugaauguagcaaaaugaggugggaccgucugaaaauccucauagaccgucuagcucuggaccaagaugaaaugggcuucuuucucuuauugcgggaugguuccuuaagcucguuacaagauggcgucuucaggacgaacugcauagauuguuuggacagaaccaaugugguccaaaguaugcuagcgcacagaaauuuagaaauaguuuuaagaaaguugaauauuuuacaccaaaaccagaacuuggaguuccaguauuccuucgagguuuuguuuaagaauguuugggcagacaacgcggauauuauaaguacacaauacucgggaaccggggcuuuaaaaacggauuuuacuagaacagguaaaaggacuaaggcuggaguuuuucgagacggagucaauucgcuuacuagauacuacaaaaauaauuuaacugacggguaucgccaggaugccauagauuuguucuuaggguaugguaaaccgauaucuccacuaagaguagacaaaucguggcgauauauuacuuacccuucagugcuuuuagucgcuguauccauguuuguagcuucugcuguauuuccuucggaauacucaaccgaaucucuucuguuuuuguuguuuugggguucuauggucuacgccacauugcacaccauauucagauacggcguugaguucguggacagaccuaggcucacgcagucuuag

SEQ ID NO: 5869 - RNA, 1773 nt, Diabrotica barberi
auggcaccuacaauacagcaaaacaaccaaaacggaacagccaauggcguugagaaaagaccaguaaaaacuguagaaaaaaggucggauuuaauauguaaagugaaguacuguaacacuuuaccugauauuccuuucgauuugaaguuuauagcauauccuuuugaacccauaagguuuauucaauacaacccaacaucacuagagcguaauuacaaauaugaagugcuaacagagcaugauuuagguguuaguauugaucuuauaaacaaagauauauaugcuauugagccaggagcuacucuagauccugccgaugaaaaauuacuagaagaagacauuuuaacaccucaggacucaaaaagaucucgccaucaugccaagucaguauccugguugcgaagaacugaguacauuucaacggaacagaccagauuccagccucagacuauggacaaaguugaagcuaaggucgguuauaguauuaagaaaucucuuaacaaugaaacauuguacauggacagagauucucagauuaaggcuauugaaaagaccuuugaagacuccaagaaugucaucgagaagcauuacagcaaaccaaaugucguagcuguggauauuuugccuguguauccagauuucagccuuuggaaguacccuugugcccaaguuauuuuugauuccgauccagcuccuguuggcaagcaaguaccagcucagauugaagagaugucgcaggcuaugaucagaggugugauggacgaaaguggagaacaauuuguugccuacuuuuugcccacagaagauacucuucagaaacgaagggaugauuuugucaaccagauaccauaucaagaugaugaggaauaugaguauaagauggcaagagaguacaacuggaauguaaagagcaaggcaagcaaaggguaugaagaaaacuacuucuuuguggcaagaccagauggaauuuauuacaaugaacuggagaccagaguaaggcugaguaagagaagggucaaagcuggugcuccaccuaguaacacaaggcuuauugucaaacacagacccauggaugcuaaugaguucagaaugcagagguaccgagagaaacagcuggaaccaccaggugaagaugaugaggaaauggagguugaugaaccacaagaagaagaagcuacucaagaagaacaggaacaagagaagggggagaaaucaccaucucgcucuagaucuagaucaaacucaucuaacagaagcagaucuagguccaaaucaagauccaagucuagaucaaaaucaagguccaagucuagaucaaaaucaagauccaagucuaagucacaaucuagauccagaucuagaucuaaaucucguuccagaucuagaucuaaaucucguuccagauccccuucaagaucacgaucaagaucuaaaucccguuccaaguccagaucccgcucuaaaucgaagucuaaaucccggucccgaucaaaaucccaauccaaaucgccuucgagaucaagaucaaggucucguucuaagucaaagucgagauccagaucugcuucggguucuagaucaccaucugguuccagaucgaggucuccuuccaaauccaagucaagguccagaucuaggucuagaucagguucuaaaucugcuuccagaucuagaucgucuuccaaagcuucuuccaaaucgggaucaagguccagaucaggaucucgaucaggaucaggcucaggaucugggucuggaucugaaagugacuaa

SEQ ID NO: 5870 - RNA, 1170 nt, Diabrotica barberi
augccgauugaaaauuuagaagaccagggucuugagaaaaacccugauuuagaauuagcacauuguaaguuucuguuaacuuuaccagaauaucgcagugauaaaaacguccacuccaaaauaacagaagcuauaaagaaagaugauauggccccaugguaugaacuuauuuguaaagaugcugguuggaaacuugaugcuaaucuacugagugcauuaaaagcuaagaacgcugagaagaucaagcuuuuggaugaagccauagaagaugccgagaaaaauuuaggugaaauggaaguucgagaagccuacuuaagaaaagcagaauacuacagccgaauuggugauaaagacaacgcaguuaguacuuucagacaaacauaugauaaaacuguaucacuuggucaucguuuagauauuauuuuucacuugauaagaauugguuuguucuucauggaccaugaucucaucacaagaaauauugaaaaagcuaaaacccuuauugaagaaggaggugauugggauagaagaaaucguuuaaaaguguaucaaggugcauauuguaugucaguacgagacuucaaaucagcugcuaacuuguuuuuggacacaguaagcacuuuuacaucauacgaacuaauggacuauaaagcauuugucagguauacuguauacaccucuauuauuaguuugccaaggaaccaauuacgagauaaagugguaaaagguuccgaaauauuggaaguacugcauucagaaccauuuguaaaagauuacuuguuuucuuuauauaauugucaguaugcugaauuuuucacaaaucuugcagaaguugaaacaguucucagaaaagauuauuucuugaauccucacuaucguuucuauguaagagagaugaagauacuugcuuauacacaauuauuggagucauauaggucucuuacuuuacaauacauggcagaagccuuugggguuacuguugaauacauugauaaagaacuguccacauuuauagcagcaggaagauugcauuguaaaauugaucgaguugggggaauuguugaaacuaauagaccagauuuaaagaaugcccaauuuaauucugugguaaaacaaggagauuuacugcugaauagaguccaaaaauuaucuagggugaucaauaucuaa

SEQ ID NO: 5871 - RNA, 2358 nt, Diabrotica barberi
augaugaccucugcuguucguccuaaaacguuacccaaugugagccaaguuaauuugaauucaccaguaggauuuccuccaccaucacccuaccacucagaauauagcaauagcccucaguucaguccugcuuuuacggaaucuccuaacgcuugggugggaguucccgaaacuccugaaauagacaguaccaacgucggaguuccuucaacguacaaucagcguuccucggaaaagaugaaagccgacgaaaguuugggcaacggugcuaccaucucagccguucuauaugcuaauaugaaucauccagaauggaagaaagauuucccgguuuggucugauagguacaagcaaauaaucaagaaguggaggacgcuaagucaagaacagaaagcuccguaccuucaacaugccagagauaacagaagccaauugagaaugaagaaagcccagcaggaucaagagaagauggcgcugcaacagaaauccgccagggaagcagaacaagaaaggcaauggaagcagcuucaggcuaugaggcagcaucagacgcagcaacaacagaauauuauacacgagcaacguguucaggccaucgcaagaguccaacgaucaauaucgguggauccagcucaacaguuucugucggaccaacaaagucccuugcaaccaaguacgccucaggagcuuagcccgucugcuacaccaacaccaagcccaagacaguucauaggaaugaaauccccgaccuucccucuuccuucaccagugccucagacagcaaucagaccuccuacacccucccauucuccacaugauguaagucaggcaagcaccucugacgguaaugaucacuuuauucagucaccuucuacuccuaaaccuaguuuuccuaauagauuaccuacagaucaauuuauccaucaaccugcaacuccuaggccccaguuuggaauacaacggccaacuuuacagaacuuugguaauacgaugaggacagaccagcaagauauuaauaucaaccgacaguugagagaucuucuacagcgacaacaagucaaaaaguuggaugaaauguuaccagguaaaguucaacaacaaagaguguggccuccaauugaacaacaagaaaaugaggccucagcaacuacugguacuucggcaguuguggcuacaacagcagauaccacuuucagacaaccguuaccgcccaguauuguacgaccuagaguggcucucucuuuagcuggucgagcaggaccugguacuauuaggguuggccaguuagaugcccgaaugcaaggccuggauccuagaaugagauugauuuuacaacagcaagucggccaacaacgguuaucugcgggaauucaacaucaguucguacgguuuaccucgacgccagcccgccccacgaccuuagaucaauaugaacaacugcuccacaggcccacuccuacccagauccgggcaccugaucagcaaaacgcuccucgaaugacuuugaaucaagcgagcgucauucaaagaccgcaacuugugcaaccuacuccaacuacuccuacaacuagugcugcugauagcaaucccagugaagaagguauucccgauaacguuacugcugaacuggaaaagcuggaacaagaaacagguacuaugguagaguuacaaggugucagugagauccucggaggacugggagacgaugacgaugaacuguuagcugaaaugggugccgauuucaacauccuagaguaugccgauccugagcuggaagcuuuaaccggcggaaagacaaauauauuagaucuggaacucgaagaagaaccagugaagaaagagaaaauaguauccagugcagaaaaccaaccgacuaaucaaucaguaaacacaaugucgaguccugugaaaccuaaacaagaaccaguugaaacgccugcuccgaaaccagagccugcuucucuaccgccaccaccuccuccuuuggcguugccucaacagcagcaaccggcgccuguucaacaacauacgccaccugccgcuauucaacaaccaacucaacauccgccgcaaguacaacccacaaugcaccugacgccucaacagauucaucagcagaugguacaccagguucaacaggcagcagcucaaggcagacccaugccaccggggucaaagaugcaaacuccugauggauuuauugguauuguaaugccuaauaauagugugcaacuacagauaccucaaaacuaucaacagcgacuauuacuguuacagcaacuucaaaaucaaaagcuucaaaugcgcguagguacuacgacuccacgaguagcggugguggcacagagucagcuacca

SEQ ID NO: 5872 - RNA, 360 nt, Diabrotica barberi
guggauuuaaaggugacggugacggaaaaaccucuuccuccacccccguuggugguaacugcuauuaacauaaggacuugcaucaacaggaaaacuuguggccaugaaauugugauggcgucuugcuugacgcauaaaaaauaugccguagauaugcagccuccagaucccccguuucagcaacauuucugugucauugcuucucccggugaccagacguugcccuucgacauccacgaugcucucaguaaguacaaagcaaccaaaguacaaaaaauggacucagaaaaaggauugcuaaacuuuuucguaaaccaauucuccucuaucgaucccgauuuaauaguaggccacgacuug

SEQ ID NO: 5873 - RNA, 1122 nt, Diabrotica barberi
auggcuuuaagaaccuacggagauaaaccaauaaguuuucagcucgaagaaaauggagacuacuauuguguugguuccgaggugggaaacuaucuacgccucuuucgagguucucucuauaagaaauauccuggaauguucaggagaucgauuacaaaugaagaacggaaaagguuaauugaacuuggucuaagucaacauguucuagcuaguagcguaucacuacugagagcagcugaaguagaugauaucaucgaagggaaugacgaaaaauauaaagccguaucuguccauacuucagaaccaccaaugccuagggaaaguaaaucgaagaaaaauuugcaaugggugccaucuuugccaaauuccagucauuuagaugcaguuccucaagccacuccuauuaauaggaacagaguagcaucaaaaaaggugaggacauucccauuauguuuugaugacacagauccacaaguaaacauugaaaauucuugucagcaagaaauacuuguuccuauuagacuugauauggaaauugaaggacaaaaacugagagauacuuuuacauggaauaaaaaugagaguuugauuucuccagaacaauuugcggaaguccuuugugaugaucucgauuuaaacccauugacguuugugccugccauagcucaagcaaucagacagcagcuggaagcuuuuccaaacgaaccgccaaguauacuggaagagaauugugaccagagaguaauuaucaagcugaacauacauguaggaaauacuucauuaguugaucagguggaaugggauaugagugaaaaacaaaauaacgccgaagaguucgcucucaaauuauguuccgagcugggucuaggaggggaauucguaacagccauagcauacucuauccguggucaacucucguggcaucagaggacuuacgcuuucagugaagcuccgcuuccgacaguugaaguuccguucagaacucccagcgagucagaucaaugggcgccguuuuuggaaacuuuaacagaugccgaaauggagaaaaagauaagagaucaagacaggaauacccgaaggauccggagauuggcgaauacaacgccggccgucaaccgauga

SEQ ID NO: 5874 - RNA, 4017 nt, Diabrotica barberi
augaauacaacaacgagaguugauaauacacaaaauccaguacaaaaaauugaauuaacuucuagaaguauugaaaaugccuuaauauuggauaauaauucgccaagauuguuagauuuuaugaauaucaguucccaaaguggaucuacagcuagugguuuugcagaucaugacuauccaacuaucaguggaguaucacaaguuaucaacaauaugacacaaguuaaauguguuaauagcauuccuuuaccaacggaaauuguugaccacuuuucacggguucaaugccauugcaugaugggccucuuuugugaaaucaauagagcuuggcuuacuguggauagugauauuuauguauggacuuacgaacaaaauacugaucuggcauacuuugauggaauaagugagaccauuguuuguguuggucuuguaaagccaaagaugggagucuuccaugcuuuuauaaaguaucuucugaucuuggcaacuucuguugauauugugguuuuggguguaacuuuuacugagaagccaggugauaccacagaggaaauucaguugauaccagacccaguuuuuaguuuaccaacugauggugccacuguuacuaucaucaguaguacuaaugacggaagaauuuuuuauggcacaaaggagggaaagcucuuugaaauauacuaccaggcugaaagugguugguuugggcaaagauguaaaaagguaaacuugucuacaaguacccuaucuuuucuaguuccuucauuuuuaaaugcugcucuuagcgaagaagauggaauuugucagauuucaauagaugagagucggcauauauuguacaccuuaacagaaaaaggaacuauagaaguuugugauuugggcgaaaaaggaaauacauuuucaaggauaacaaaauugggccaaaauacucuaguaaaucaagcuaugaauacugucaaaacuuuagauagucaaaacuucagaccaauagucaguauaucagcuauugaagcaacagaaucugccaacuugaaucuaguugcuguaucccaaacaggaguucgauuuuaccugacaguaguuagucucuccaaucugcaaccaaaucagagaccauauacucuagcuuuagcucauguacgucuaccaccaggauauucugcuaauauaacaguaagaccuagagcuguccaugugucccauuauaacgauaggaauuugguacugauuucgacuguuaaugauaaagauguacuuuggugcaugaguucagauauguuucccuuuggucagaccuugauggaggcuuauaguguuguaaaucuggauggaccagcauuagcuauaucagaggugcggcauccgacuccuuuaccguuaccaccaaaccaagaagcgccaccucugguugucagacaacacgcggaaccgccuaagaaauaugugguucuaacaucucacaguguucagauuuuuauuaaacucaggccaguugauauucucaaucagauucuuagagauagccaaggcuuagauacugaagcgcuuaagacauuuuuuacgauucaaaaagaggaucaggcuugcgcaacuuguuugauucuggcuucuuuagaaagugaugagaacguugagguugcagaauacgccacaagggcuuucuuuuuguaugguggagaaccuaaacuggugccagcuaauauauaugcgggacccagcguauuugcuccucaaauaauaucaacacccgcuccacacaauuaccagucgcagcaauaucaaaccgcucaacacuuucaaccuaauaauaugucacaaacacugccaacagugccaaauacuacaggauaugaauucacugguccguuuguuuuuucggcgaaacauaauaguuuauauuuguauuuaaguaggauauugcgaccaauuuggaacaugagaacgguugauaagcuuucuguugacggaaagguuucuacgacguacaguaccguauccagugaugacugcauauuuauucuaaauaaucuaacugcucuccauaauuuccuagcacgaaauacacaacugucaaccaugagcaagaaccaaaaucaauuccagaacacuacacuuaauaauacaucuuuaaauaugacgagaaugaaccauaccgugcaagacgcccaaauggaagaaaaagcaucacugaauucuuucaaaauucuuguuucgcuuuguugucaaauacugggucucuggcgaauccugugugaacaucaauuucauucauugguggcgucucuuacggaaaacgaacagcaaauucucgucaauacaacuuuuaaagacuuguuccuuuacagacacgacauuuguucgucauuaauaucagcucuaguucaaaccuaucuuggagacaacgcuucugucgacucuaucagcagcaaauugagagaaguuuguccacaaauguauaaaaccgaagauauggcauauucaaaggcaaucgaaauccuaaaaucugcucgaacaauacaaaaugucggagaaaaagaagaauugcucaauucagcgcuacaaauuuguaaaucuaucggaccuaauuugaacaucggugauguguguaaagaauuuuguaaucuuaaaggauacaaagccguaacugaacuauguugucauuaugccucaaaauuagacccagaaaauauugcagagauauauuacaaugcaccggauagcacuggagaccaggaagguuauaauuacuaucaaaacagaauggaaauuuauaggcauuuauugaauauguuaaauuccauguaucaagaacucaauguaacuccaguaccgugucucaacuacgaccuugauuuuucaguaacucaaucaauuuuagcagauacaccagcacagucacaaauuggauauaugaugaagcaagugaucacugauauuuuggaaacucccgaucaaauaaugcauauaaaccuauacgauuggcuaauaucuaaaaauaugacuggagauuuacuaacaauuaauaaugauuccuuggagacguaucuuaaaagaacagcagcucaaaauccaaaugauacuguugcuuuggaccuucuauggaaauucuaugaacaccgcaaugaccaugccgcugcagcuaaaauucuuaauagccuggcaucaagaacugguguuaacauuccuuuaaaagaaagauuggcguacuuagcccggucuauaauguguaugagaagcgacaaaauaggauaugcgccauauuuaggugucuuccuuagagauuuagaggauaaauuagaaguggccaagguacaagaacaaauuuuagaagcaguuaugaaccaacaaaaucaaaucgaaaauuauggagauauugucacagcucugaauucaggacuauuugaaauaucacagcuguaugaaaauuucgcugagccguucaaacuucucgaaugucaacuggccauuauugauugugccggauauacagauccagcguuaauagaaacuauauggcaacaaauauugaccgacgagcuaaagaagacuaccggaacuggaacagacaaaguaugucaauuauuaaacaaagucaaacauuuagccaaauauuaugcuaaaucaaugaacuguuuuccuuuagauuauauuaucuaugaauuagaaauagugaaugcaaaguuaagaggcgauagacaacuaguaccuacagcucucgagaguaugaauauuccauuugacagucugaucucuguuuauaauaauuugaauaccauaucgggaaacgaccauuucuggcaguuggaagaaaaugaauuucaucuuucugaagcuacagcuacucuaauuagcuguuucaucagcaaccaagauucguacagcaguauagaaaagagaaaauacacaucauuaucucaggacaccguuguugcacugcugucuaauuuauacagcaaaccuaauacagaagcgauaguuaauaaguuacgaaauauucaggccagguuagccagaauuuaa

SEQ ID NO: 5875 - RNA, 4344 nt, Diabrotica barberi
  misc_feature (34)..(77): n is a, c, g, or u
auguuaaugacuuucgccauauguuguucaaaannnnnnnnnnnnnnnnnnnnnnnnnnnnnnnnnnnnnnnnnnnnuuucugucuacauaaccgucaaauauacaaauuuuuuauuaagaacaaaaugaccgaauuuacuuuaaguuaucgugaaguuauaccggaucaaacaguuuuugaaaauuggaaagaaaucucccuuaccacaggugggacacaaaguacucuccaagauauaaaaguagcugaacgagccaauggauuuuccuaugaagauucaacaaagcaucauacacgaaauagauuuauuuacuggagaaucaauuaugaugucuuggaguugguagaacauagucuggauaucaauuuaacagcaaacagaguuagauauaaguuuacagauacuccuauucuggauggaguuuccauucacgaaacuuaugaaaacauuauugugcuugucccaacuguuuguaguauacaccguuuaauuuuuccacacccugauagguuucauagacaggaugauuuacuaggagugcauccagauuuggcugcucccucaauauuuucaaaagcuucaccuguggaugccagaaauccaaauacuuuuuauguuuuuaauaacccaaccacugccacugaccaacugcccaauuuagccaguucuuacuuguuaccugaaacggaggaagcauuuuuuauacuagcuuauccaucaacagaacuacuauugauaaaacaaaauccugacaauggccaaguuguauguacagagcugaaaggagaaucuuugaugccuagauuuuugucuggacuugcagaaaaguuuagaccaagaaauucugacggugauaccauagugagucucuuguuuuauauuguugauuaugaaacuuacguuuugacacugacaagagaugcccaucucaaguuuuggucauguacuaaaggacaaugugucgcaguuauagaugucagagaaaagacaggagaugguucaaaggaucgaguacagggagccauauuaaggaaagcaguagauggcaauaguacugaaaguaucuuggcgguguuuuuaaauuacuccaguaguggucaauuucauaucuuaaauccaauaauaaaaggccaggaaauaacaauugacagauugguuacuuuauacucuccugagaaugaucuuaucgauuuugccuuacaaaccaaucgccuauggucuguauggcgaugcgaagauggcgacagcguaguguacacugccacacugccaguaucccguugugcuuccuacaaaucaagcaguuggucaccuauuauuuuggaaacauugcccgaugcuaaccaaucaccugccaaugauggagacagugauccuagacaaguguauuugcaacacauuuuccaucccggcagauuuccuuugcacauaauaagcaaagcucuuuccauuuacaagaggucuacuauauuaucugaugcccaaauaucagccucagcuuuaaaacagagaauuugucuagcuguggauaaugaaauacaaaauacguuaaacggaucuaaugugaaugaugaugaauauuuagagugugcagauugguguuggcaaaaauucuacucuugcugcguacaguaucacaucgcuagccuaaaaccucuaggucugauguuauuaccuucugucucuggagcaguauuuuugaaaaagucgacguuuucauuccucagaccuuuggauccacuggaacacaugacucucugcuaugaagauguuuacagagaccaauuugucaauuuuucuauguuagcggaagaucuagauacaacggaugauguaaugaacuuguuuaaagucaucguauauuuagaacaacaaaugagugagucauuugugcaggcauucgagaaagaaauuuuuaaucuacaugcuccugauguuauaauggaagguuuauuagagaaaauucagucugagauggauugccaguucgcaucgcacguauuggaaaugaugaacgacguuaccgacuuauacaaaggaaugcacaaaauuuuagaacucuuaagauacgaaaauacauuagccaguccugauaacgacauaaauccuggagcuauguaucauuucaguuccuugcuagguacuucaguagucgcugaaagcuugcgacaacaagcacaaauaagauuccaaauauguagaaauuuacuucugaucugcaacauuuuguugaacgaaaaaacguuggauugggguguauuagaagccauacguucaguguguacaccggagauuguuguccucacgcaggcuaguuauguaguuuuauggcugugcggauuaacuaccauaguuaacuuaccuuucagugcucgcgaaucuucgauaaauagauuggcgccacucaaauuagcuccuguuuugaauuugagaccucuuacuacauguacgucguuauuggaacuauucauaucaucuaccgguggccaggaagccaggaaaucuuuugccagaguaaauugcagcgaugaagcuuuggcccacuggcauaucucacuucuaccuuauuugaaucacgugagacauauaauuuggcccauaacuggagguacaguucuugccgaguggcuguuaagcaguggacaacauuuaugguugcagcaauacguucguuuacuuagcaacuggugugaauggaauaguuguacaagaaacuucuugcuagcuuccgccuuuuugucaacuggagaauauaacaaagcagaagauuuguuugaaacggcugcuaaagggguuuuaacagauggcuuuuuacaagaacguuguuuaaaggggaauuugccuaguccaacuggagcguacauucacuauuauuuaaagguuauucaacuauuugaucuucacaaggccaaagauuccguuauaagcauugcaaauacugcucugagcauuguagacccagaagauccuuuagcggcuacuuuauauuccaucaaguucaaacaccacuuggcauuaaaacacuacgaacucgccuucgauucauugaaugcgaauccagaugcggaacggaaaaaagacaaucugagagauuugguuaaaacacuguuggaugaaaagaaauuggauacuuuauugaacuucacguacgguagcauggaugaguucuuuacaaauauacuguugagcagagcuagagcaaacgaugcaguuaacaacauuuucuacgacuucuuguauucuuaucaaauuaaaagaggaccucugucacacagacuagcugcaucaguaauguacgagcaggcuuucagauuaaaucauauuaacagcguugaagcacuggaaaaacaaguaaaauguuacuuggcagccaaaaacguucuacaucugugucaaccagaacacgcuuggguagugagaccagcugauccagaugaagaagaugacguaauaacuauucagccuuuggcaggaucaaacgaagaaaugaaaguauuuagauugagaaaacaacuugaagugguaaauauugaaacuguugagaaagaacuuauuuucgcaagugcaaaguuaaaauuggcaagauuuagcucgagccuaucaccgguuaauauaacaacuccuguggaauuaguaacauuauuaaauacugcugguuuauucaaaacugccuuagacauuugcacgacguuugaauugucauaugcaagcauuuucgaagucuuaacaaagaacuguguuucauugacggaagaagaaaaucccagugcuuggaacuggcugguagaaaacgauuugcaagaucuuccaguuaauagggauagugcagcagauguaguuuggcaguuccuacaggauugcuuggagaaauaugaaaaaccuugcaugaccacgcuacauuaugugguuugcaaaaagauuauagguaugagaguauauuuuccccauuggcuuguugcuucuuacaagguucgaaauccugccgaguuuuuaagauuauuacaugguuccggaagauuagaagaagcaauugaauuuacaagcgaguauauacuaucugcaauggguuacgguaaagaauuuuucgguuuuacacaaccuuuagcaccaacgucgccugcuuuuuguuuaccugucuacgcuauccaaagguuaauugacgaauuaaaaauacagaauuccaugagucuggagcaaccuuaucugaaggaauaugaaaauuugaaaacauuguuuaccaaauauuuagagacugccaccagaguaucgaaucagaugugucaaacaaaauuaacaucaggaucccuuagaacgaauguuuuuucaauagaugcuagauaa

SEQ ID NO: 5876 - RNA, 1404 nt, Diabrotica barberi
auggagauguccgaugaaaauauucaaguuuuaaguaaauaucuacaggagacacuuaauccagauccaaauguucgcagaccggcugaaaaauuuuuggaagguguagaaguuaaucaaaauuauccuuuacuaauauuaaaucuuguccauaaaccagaaguggacaugacaauuagaauugcuggagcuguagcauuuaaaaauuauauaaaaagaaauugguuuguugaagaagauggaguugauaggauucaugaaucugaucgagcugcaauaaagaauuugauagucacuuuaauguuaaguucaccugaaucaauucaaaagcaguuaagugaugccauuagcauuauuggaaagacugauuuuccucugaaguggccagaauuaaucucacaaaugguugaaaaguuuucuacaggagauuucaauguuauaaauggaguucuaagaacaggucauucccuuuuuaaaaaauaucgcuaugaauuuaaaucacaagaguuguggauagagauuaaguauguacuagaaaaauuggcccagccucuaacugacuuauuuguggcuaccauaaauuuggcacaaacccauagcaacgacgugaaugcauuaaaaguuauauacaguucauugguguuaauuuguaaaguauuuuauuccuuaaauuuucaagaucuuccagaauuuuuugaagauaacauucagauuuggaugucaaauuuccauacguuauuaacggcagaugucaaaugucuucaaaauacugauagcgaagaggcugguauuauggaacaauugagaucccaaguaugcgacaauauagcucuguaugcacaaaaauaugaugaggaauuucagcaguucuugccacaauuuguuacugacguuuggagucuuuuaguaucaacuggucuugaaccuaaauaugaucuguuaguuucaaaugcucuccaguuccugucaucgguugcagaaagaguucaguauagacauuuauuugaagauaacaauguuuugagcagcaucugcgaaaaagucauuauacccaauauggaauuuagaguuucagaugaggaguuauuugaagauaauccugaagaauauacacguagagacauugaagguucugauauugauacuaggcgaagagcugcuugugaucucguaaauacucucagccagaacuuugaacaaagaauuauagacauauuuggucaauauuuacaagugaugcuuggaaaauauguggaaaauaccaagcaguauuggagaagcaaagaugcugcauuauaucuuguaaccucacuaguuaguagaggugcuacucaaagacauggaguuacacaaacuagucagcuggucgauaucaaucaguuuugccaacagcauauauuguca

SEQ ID NO: 5877 - RNA, 609 nt, Diabrotica barberi
auggcuaagguccaauuguguaacauaaccgugauggacaauccuaguccuuucuugaacccauuucaguucgaaauaacuuuugaguguauagaagaacuuagagaagauuuggaauggaaaaugauauauguaggcucagcugaaagugaagacuaugaucaaacuuuagacucaguuuuuguaggaccuauaccugaaggcaaacacauguucgucuuucaagcggauccuccaaaugucucacguauuccagaaaaugaugcucucgguguuacaguuguacuauuaacguguucuuauagaagucaggaguucauucguguaggauauuuuauuaauaaugaauauacugauccggaacuuaaagaaaaucuaccuaguccuccacaauuugauaagguaacccgaaauauucuagcauccgaaccaagaguuacccgcuucaaaaucaacugggaagaaaccaaccccacagaaaauaucacaaauucagaccaaaguggagcaucagcacccacgacaucagaagcuggacccucugcuccugucgaaguaccugcuuuuaaugaaaauuccaauucaugggcuacaauggaauguucauaa

SEQ ID NO: 5878 - RNA, 951 nt, Diabrotica barberi
auggaucaaaugcucccuaguccgggauuuaguaucccaaguauaggaacaccccuucaccaaccugaggaggaccaacucaucuuaccaaaugcccuucaacagcaacagcagcagcaacaacagcagauugcgaccagcaguucccaaguaccuccuuuggcaccaaugggcggcuugacaccuacacuuggacuuggcaugggccaugccaugucuguaccacaaaccaaauauguaacugguuucgcauugcccaugaguucuaugaaugcacaaacuccccaacacacaaugagcccuauggugaacuuaggggguucaauaacuacaggagcuggagugacuccaacgauggcaccuucaacuccuucaccuaugacgccaaugacuccucauucugcugauccuggcaucauuccacaguuacaaaauauaguguccacaguaaaucuaaguugcagauuagacuuaaagaaaaucgcucuccacgccagaaacgccgaguacaacccaaaacguuucgcagccgucaucaugaggauacgugaaccacguacuacagcccuaaucuucucuucgggaaaaauggugugcacgggagccaaaagugaagaagacucgagguuagcagcccgaaaguacgccaggauaauccaaaaacucggauucccagcgaaguuccuggauuucaaaauucagaauauggucggaaguugugacgucaaauucccuauuagacucgaagggcuugugcuaacccauagcucuuucagcaguuacgaaccagaguuguucccuggacucauuuaccguaugguaaaaccuagaaucguacuuuugaucuucgugucuggcaaagugguguugacgggugcgaaaguaagacaggaaauauacgaggccuucgauaauauuuauccuaucuuaaaaaguuuuaagaaacaauga

SEQ ID NO: 5879 - RNA, 390 nt, Diabrotica barberi
auggcugccaucagaucuaugucucgccuucuuauuaauagaucacuucaaaccacugcaaagaggaccuaugccgaccaaaugaacuucacauuugcagcuggaaaucagguuuacuauacugcaaccucaguuaaacagguagauguaccaucuuucucugguagcuuugguauccuucccgcccauguacccacacuggcugugcuaaaaccuggaguagucacuguuuacgaagauagugguaauguuaagaaaaucuuuguuuccagugguacugucaccauuaacgaugauucaucaguucagauucuugcugaagaagcccacccaguagaaaacauugaugucaaugcagcaagagacauccuuaccaaagcccagagccag

SEQ ID NO: 5880 - RNA, 987 nt, Diabrotica barberi
augaguggugacgguagugacacugaacaauuugauacuuuauuucuaucuguagcucaauaucauccacagggaccaacacagcuccuggauacauuugugaguuuuuugagucgaaaaacagacuuuuucauuggcgccaaggaaggagaaugggaaaaguuagugauggacacauucagaaaauaugaaaagucgagcagggcaaaacacgaggaggaacuuaaagaaaagcgagaacaagaagcucgaaaaaaagcagcugcugccaaaaaggcagaagcagaaacugucaaaccugcucaaaucaccgaauugacugaugaagaagcugaaaggcuucaggcugagauuaaugcuaagaaaaacacuucugauaaggcugaaaguucuucaaaugguucagaagcugcaacuacagcuaaaaaaguaggagaagacgaggaugaaucugaaaaaggcaagauacugcccaacucgggaaauggaugugaucuagagaaguacaaguggacgcaaaccuuaggagauauugaguuaaaaauuccccucaaaguaaacuucaggguaaaacagaaagaucucguaguaaauaugacgaagaaacauuugacgugugguaucaaaggucaaccaccuaucauagacgacgauuuuccacacgaaaucaaauuagaagagucuucuugggugaucgaagauggaaaggaccuauuauuuacuuuugaaaagauaaauaaaaugaauugguggagccaaauagucaaauccgauccagaaaucagcacaaagaagaucaauccugaaccauccaaacuuagugaucucgacggagagacccguggaaugguggagaaaaugauguacgaccagcgccaaaaagaaaugggccuaccuacgagcgacgaacaaaagaaacaagacguuauuaacaaguucaugcagcaacaccccgagauggauuucucacaaugcaaauuuaacuag

SEQ ID NO: 5881 - RNA, 480 nt, Diabrotica barberi
augcaaucuucgagugguaugauacaugguuauccgggaggcccuggauuacaauggagccccgauaaaaaacauagcgaccgcgaaagguggauauguauuuaccccgcuuacaucaacaacaaaaaaacauuggcacagggcagaaaaauagccaaagaaagaugcguugaaaaucccacucaccaggaaauucgugauguuuuggucgcggcuggcuugaaagugggugucgaaaacaaauuguacagcagagagagaaguaaggaaauguuauaucgugguagaauaaggauacaguuaaagaaugacgaugguaguuuguguaaugacaguuucccuaccagagacagcauuauguaccauuuaggagacaugauucccaaacugaaaagcaggcaaaauaaaagcucgaccgaggcuccucagcaagcaucuacugguucuaaaggcaagggaaaaggaaaaggacgaagauaa

SEQ ID NO: 5882 - RNA, 1380 nt, Diabrotica barberi
aaacaauucgaagauaauauaagaaaaaaccgaacuguuauaucuaacuggauuaaauaugcucagugggaagaaucccaaaaagaaauacagagagcucggucgauaugggagagagcacuugauguugaccauaggaauauuaccauuugguugaaauauaccgaaauggaaaugagaaguagacagguuaaccaugcuaggaaucuaugggacagagccacaguuagaaguagacagguuaaucaugcuagaaaucuaugggacagagccacaguucuuuugccacgaguuaaucaguuuugguacaaauauacuuauauggaagaaauguuagaaaauguaccaggugccagagcaguuuuugaacgauggauggacuggcaaccugacgaacaagccuggcaaaccuauauuaacuuugaacuccgcuauaaagagauugauagagccagacaaauauaugaaagauuugucauaacacaucccgaaguuaaacacuggauaaaauacgcccguuuugaggaaaaccaugguuucauacacucaucuagacagauauacgagagagcaguacaauucuauggugacgaucauuuagaugagaaaucuaggcagauauacgagagagcaguacaauucuauggugacgaucauuuagacgagaaacucuacauugcguuugccaaguuugaagaaaaccaaaaggagcaugauagggcgagaguuauauacaaguaugcucucgaucacauaccuaaagaugaaacuaaggaacucuacaaggcguauacaauacaugagaaaaaauauggcgacagaagugguaucgaagaaguuauuaugucaaaacgaaaacuucaauaugaacaagaaauacugcaaaauccaaccaacuaugaugcaugguuugauuaccuucgauuaguggaaggagaaggugaucucgaaauuacucgagaaaccuaugaaagagcuauugcuaauauuccuccaacgaaaaacaaacaguuuuggaggagauacauuuauuuauggauuaauuaugcgauauuugaagaacuugaggcuaaagauuaugaaagaacucgucagguuuauaaggcuuguuuagaaauacuaccucacaagauauuuacauuuucaaaaauaugguugcuguuugcacaauuugaaauucgucagaagaacuugacuacagcaagaaaaauccucggaaugucaauugguauguguccucgagauaagcuuuuuagaggauacauugaucuagagauucaguuaagagaauucgacagaugcagaaaauuguacgagaaauuucuugaauuuggaccagacaauugcauaaccuggaugaaguuugccgaacuggaaaca

SEQ ID NO: 5883 - RNA, 1431 nt, Diabrotica barberi
auggggauuaaauuuuuggaaguuauaaagccuuucugcagcauacugccugaaauagccaagccagaaagaaaaauccaauucagggagaaaguacuauggacugcaaucacucuuuucauauuuuuaguauguugucagauuccauuauuugguauaaugaguucagauucugcagauccuuucuacuggauucguguuauucuugcaucaaacagagguacccuuauggaacuugguauuuccccaauuguaacuucaggucugauuaugcagcuguuggccggugccaaaauuauugagguuggugacacuccaaaagacagagccuuauucaauggugcccaaaaauuguuugguaugguuauuacugucggucaagccaucguguacguaaugacaggcauguauggugaucccgcugaaauuggagcuggagugugccuucucaucaucauccaacuguucgucgccggucucaucguauugcuucucgaugaacuucuccagaaaggauaugguuuagguucugguauuucccucuucauugcaacaaacauuugugaaacuauuauuuggaaagccuucucaccagcaacaguaaacacuggaagaggaacagaauuugaaggagcugucauugccuuauuccacuuauugaccaccagacaagacaaaaucagaggauuacgugaagcuuucuacaggcaaaaucuucccaauuugaugaaccucuuggccacaguacucguuuuugcuauaguaauauacuuccaaggauucagaguagaucuacccaucaagagugcaagauaccguggacaauauuccagcuauccaaucaaauuguucuacacuucgaacaucccuauuauucuacaaucugcucuuguaucuaacuuguacgucaucucacagauguuggcuguuaaauuccaagggaacuucuuaauuaaucuauugggaguuugggcugacguuggaggcgguggcccagcgaggucuuaccccauugguggauuauguuacuacuuaucuccaccugaaaguguaagucacauucuagaagauccaauccacgcaaugcucuacaucgucuucauguugggaucuugugcuuucuucuccaaaacauggaucgaaguaucuggaagcucagccaaagaugucgcuaaacaauugaaagaacaacagaugguaaugagaggacacagagauaacuccaugauucacgaauugaacagguacauucccaccgccgcagcuuuuggaggucucuguauuggagccuugucaguacucgcugauuucaugggagccauugguucagguacugguaucuuguuagcugucaccaucaucuaccaauacuucgaaaucuucgucaaagaacaaagcgagauggguggaaugggagcguuacucuucuag

SEQ ID NO: 5884 - RNA, 483 nt, Diabrotica barberi
augucgaugguaaccucaccuuccguagaacuuaguucuuacagagaccaacauuucaaggguacuagagccgaacaggacggauuauuaagacuaucaaccacauuauacguuggaaaucuaucuuuuuauacaacugaagaacagaucuaugagcucuuuucaaaauguggagacauaagaagaguuguaauggguuuggauaaauauaagaagacacccuguggguuuuguuuuguagaauacuauaacagagcugaugcagaaaacuguuuaagguauauaaaugguacucguuuagaugauaggauuguaagaacggauugggaugcaggauuuauagaagguagacaauaugguagaggaaaaacaggaggacagguacgugaugaauauaggacugauuaugauucuggaagaggagguuaugguaaaauaauccagcaaaagauuggaauugagacuccagcuuuuuugagauaa

SEQ ID NO: 5885 - RNA, 924 nt, Diabrotica barberi
auggcugcaacaauaggacgaauuuguggagcuggucuuuuaaaaccaacaaacuuauccucugugggccaguuaaguucguauuccacaacaaaagaauggacccguggaagaaaagcacuuuugggaagcuuagggcuuauugcuggugguacuggugccuugcuguuugcuuuggaucaaucaguuaaagcaucugaucuugaauugcauccuccaaagaauguuuggagucauucuggaacuuucaauuccuuggaucaugcuaguguaagaagagguuaugaaguauacaaacaaguaugugcugccugccacucaaugcgcuucauugcuuaccguaacuuaauuggaguuucccacacugaagcagaagccaaagcugaagcugaagaacaaaugauugaagauggucccgaugacacggguaacuuuuucaaaagaccaggaaaguuaucugacuauuuccccaguccauaccccaaugaagaagcagcucgugcugccaacaaugguuccuacccuccagauuugagcuauauuguaucugccagacauggaggcgaagauuacauauuugcccuuuugacggguuacugcgacgcgccagcgggcgugguccucagagacggacaauacuucaaccccuauuuccccgguggugccauuucgauggcacaagcccuauauaacgaaaccauagaauacagugacggaacaccagcaacugccagucaacucgccaaagacgucgcuguguuccuaaaauggacgucagagccagagcaugaugacagaaagaaaauguuaaucaaagugaucggcaucuuuucucuucuuauugguaucacuuacuaugcuaagaaacucaaauucucuucguugaaaucgagaaagauugaauuuaggcccaagaguaaauaa

SEQ ID NO: 5886 - RNA, 1722 nt, Diabrotica barberi
auguuagcccugcagcaauauucgggcaguagugacgaagacgauauagacaaaaacaaaaguaaagacaccucaguagauauaacugaaauccccauuaauuccgaauuuuccaccagaaauaagcuugccauuugugccgcuccaaauguacugccuacagguuuagauggagaaaaaaaucauauacauccugauaguggagaacugacauauaauccaaaguaugauauacuauuugcuccuguaguaggucccgcaaaucccuuuaaaacacaacaacaaucuguugagagaaacauacucucgggacauauugaaacggcucauguaagugauuuucaauuugaaaaccagagaagaacuuuuacaagcuaugguuaugcguuagacccaucgauaaguaaugauggagauggacaucuaaaaguuguugguucaacugaagaagguaaagacguagaaaguguuaagacuguauuugaaacuucaaagauaagacccuuggauaagaggaaaaggaagagaaaugauaauccgggugauauagaaggauuuuugggaccauggggugguuuuguugaugaacaaaaaguaucuagaccaacggaggaagaacaggcugaguuagaugaaauaacuucuaaaaagaauaagaaagguaaaccaacagaggacaaaccaauugaggaaaagucuguauugcauaucaaagauccaguggacuaucaaggaaggucuuuuuugcaugcuccacaagauguugggguuaaucucaaaucugauacaccuccagagaaauguuuuuuacccaagucccauauucauacauggacuggucacuccaaagguguugcagccaucaggugguuucccagaacggcacauuuguuccugucugcuaguauggauuguaggauuaagauuugggaaguuuauaaugagagaagaugcauuagaacuuacuaugggcauagacaagcugugagagacauuaacuuuaacaauucuggaaagcuuuuucucucagcuggauaugacagguauauuaaacuuugggacacagaaacuggacaagucguuucaagauucacuagucgaaaaauuccauauuguguuaaauuuaacccagauaaaaauaagcaacauuuauuuguugcugguacauccgacaagaaaauuaucugcugggauacuaggucuggugacaucguucaggaauaugauagacauuugggagcugucaacagcauuacuuuuguagacgaaaaccgaagguuuguuacuaccucagaugauaagucuuuaaggguaugggaaugggauauaccugucgacaugaaauacauugcagauccuacaaugcacagcaugccagcggucacaccagcaccuaaugggaagugguuagcgugucaaagcauggacaauaagaucgugauauuuuccgccaugaaucguuucaaaaucaaucgaaagaagacauucaccggucacaugguggcagguuacgcaugcucguuagauuauucuccagacaugagcuauuugguguccggugacgcugauggaaaggucuacgucugggauuggaaaacgacaaaauuguacaaaaaauggaaagcccacgauaauguuuguaucagcguauuauggcauccacacgaagcgaguaagaugauaucggcaggaugggauggcguuauuaaauuuugggauuaa

SEQ ID NO: 5887 - RNA, 807 nt, Diabrotica barberi
augguccaaaagaaaccuaagaagaagguaggaaagaaaguagcugcagcuccucuugcagucaaaaaaguugaacagaaaaaagaaguuaacccacuuuuugaaaagaggccuagaaauuuuggaauuggccaggauauucagccuccccgugauuuaucucgauuuguaaaauggccaaaauacauccguauucaaagacaaaaggcuguacuucaaaagagauugaagguuccaccaccaauuaaucaauucucucaaaccauugacaaacaaacagccacccaauuauuuaaagucuuggaaaaauacaggccugagacagcucuucagaagaaaaauagguuaaaggcuaaggcugaagcuaagguugccaagaaagaggaggcgccugcuaaaaaaccaaacacauugaaggcugguaccaauacaguuacuaagcugaucgaacagaaaaaagcccaauugguuguuauugcacacgauguugacccaauugaguugguucuguuccuaccagcccucugcagaaaaaugggugucccauacugcauaguuaaagguaaagcaagacuuggacuucuaguaaggcgcaagacuuguucauccguagcucuuacacaaguugacucuggagacagguccaacuucaacaaacuuuuggaaguaaucaaaacuaacuucaacgaccguguugaugaaaucaggaggcacugggguggugguuugcuuggauccaaaucugcugcucguauugcuaaguuagagagagccaaggcuaaagaauuggcucagaaacaagguuaa

SEQ ID NO: 5888 - RNA, 1002 nt, Diabrotica barberi
auggcaacuuuaauaaaagauguaacacuccaagaaaacauuccaacacauauacuucuugacaagcacauagauuuuauuaaggaauauggacaaaaagaaaguacauaugaauaugguaugaccgauuauuugagaauaucuggcauguauuggggacuuacggcucuagaacuuaugaacgccacuccagcucaaaguauagaagagaucacagaauucauaaagaauugucaggauccagaaagugguggaaucagugccugccuauaccacgauccccauauuuuacauacacuuagugcuguucaaauucucugcaucuacaauaaauuagaggcaauaaacguagaggguguuguuaaauauaucgcaagccuucaguuaccugaugguagcuuuacaggagauaaauggggugaaguugauacuagguucucauuuugugcaguuaugacauuaucguugcuuaauaaaauggaugcaauugauguaaauaaagccguggacuuuguuuuacaauguaaaaacuuugauggggguuucggaucuaggccacuuucugaaagucaugcgggguuaauguauugcuguguuggcuuuuuaucuaucacaaauagguuagaugccauugauagagacacccuugcuuggugguugugugaaagacaacuaccaucuggagguuuaaaugguagaccagaaaaauuaccugauguauguuacucaugguggguguuaucaucauuaaccauguugggcaggcuucauuggauugaugcgaaugcuuugaaaaacuuuauuuuggcuugucaagacacagagacuggaggauuugcagauaggcccggugauaucgcagauccuuuucauacuauauuuggguuagcagccuugucccuuuugggacaugauucuguaaagaagguuaauccuacuuacuguaugccacaagaagucauugauagauuacaauuaaaaccucagagguuagagcaauaa

SEQ ID NO: 5889 - RNA, 2847 nt, Diabrotica barberi
augcaucaggaggccauacaacucauccaggugcuagaaaaaacaguuucaccggauaaaaaugaauuggaacaagcaucgucguuucuggaacaagcugcagugacuaaccuacuagaauucaucaaaacucuaucagauauauuaagacauggcggaaauagccccguggcccgaauggccgcaggucugcaggcugcagugacuaaccuacuagaauucaucaagacucuaucagauauauuaagacauggcggaaauagcccuguggcccgaauggccgcagguuugcaguuaaaaaaucaacucaccucuaaagacuccaacauaaagacuacuuaccaacagcggugguuagcuuucccagaagacguucggggguauauuaaaaauaacguugugugcgcacuuggaaccgaaaccagcagaccauccuccgcagcucagugcguagcauacgucgcaguaacagaacuaccacaagggcaauggccagaucucauagcaacguuggucaacaauguuugccacgcaaauuccacagagaugcaaaaggaagccacauuagaagcuaucgguuacauaugccaagaaaucgacucggacguauuaguaucucaaucaaacgacauccuaacagccauaguucauggaaugcgagccucggaaccgagcaaucacguucguuuagcagcuacacaggcccuacuaaacucucuagaauucacaaaggccaacuuugaccaaccaacggaacggaacuauaucauggaagucguuugugaagccacgcagucuccagauucacagaucagaguggccgcuuugcagugucuaguuaagauuaugucuuuguauuaucaacacauggagccuuauauggcuccugcucuauucccuaucacucuagaagccaugaagucggaaaacgaugcuguuucucuacaggguaucgaauucuggucuaacguuagugaugaagagguugaucuggccaucgaagauacggaagccaccgaagcaggucgaccaccuacaagauguucacggcacuacgccaaaggugcgcuacaauauauaguaccgauccugcugcaaaaauuaacgaaacaagaagaacuggacgacgaagacgauuggaauccuugcaaagcagcuggaguuugcuuaaugcuucucgcaacguguugcgaggaugaaauuguuccacacguuuugcccuucaucaaagaaaauauuaagucugauaauuggcgauucagagaugcuucuuugauggcguucggaucuauuuugggcgguuuggagagcacuacguugagaccgcuuguugaacaggcgaugccgaccuugauagaucugauguacgacaauagcguuaucguaagagacacagccgcuuggaacuucggcagaauuugcgaaaucauuccggaagcggccaucaacgaaaccuuccucaaaccgcuauuggaaagcuuaaucacaggccucaaggcugagccucgaguugccgccaaugucuguugggcguucucuggauugguggaggcagcuuacgaaaaugccgacgucaaugaagaaaccgguacuccagauacuuacgucuugucacaauacuucgaguucauaauacaaagacugcuugaaacaacggaucgacccgauggcgcccaacacaauuuacgaccugcagccuacgaagcccucauggaaauggugaaaaacucacccaaagauugcuaugucaccgugcaaaagacuacaauggucauuuuggacagauuacaucaggucuuacagauggaaacucacauaagcagccacaacgauagaucgcaguucaacgaucuccagagucuuuugugcgccacucuucaguccguacucagaaaaguuaccccagaagacgcgccaagaucgcaguucaacgaucuccagagucuuuugugugccacucuucaguccguacucagaaaaguuaccccagaagacgcgccacacaucucagacgccauaaugaccgccauguugaccauguucaauucgaauucauguaagaguggaggcguucaagaagaugcuauuauggcugucucgacgcuggucgaaguuuugggagaaaacuucauaaaauacauggacgccuucaaaccguuccucuaccucggauugaagaaccaucaagaauaccaagugugcguuacagcagugggcuugaccggcgacaucuucagagcucucaaacugaaagcgcuaccauacugugaugaaauaaugaccuuauuacuagaaaaucuccgcgaucagucgguccaucguagcgugaagccagagauucugggcguguucggagacaucggccucagcaucggcuccgaauucaagaaguaccucgaggugguucuguccacucuggcucaggcuucgcaggcgcaagucgaccgcaacgacuucgacaugaucgauuaucuuaacgaccuaagagagggaguuuuagaagcuuauaccggcaucauacaagggcuuaagggugacgggcccacuccacauccugacguuuugauacuugaaccccacauuccauuuaucguucaauuuauuacugucguagcacaagauacggaacauucugauaguauuauagcugccgcagcugguauuguaggugauauguguaauguuuucggagcuccaaugguucaauucuuagaucuggagccuauuaaugaaauguuagcacaagguagacguagucgaguaaauaggacuaagacuuuggccaauugggccguuaaagaauuaaagaagcugaaggcaguaaacaccgcggcugcugcuagcuga

SEQ ID NO: 5890 - RNA, 1503 nt, Diabrotica barberi
auggaaacaauuuuggaacaacagcgucguuaccaugaagaaaaagaacguuuaauugaugccaugguaaaagaaaugcuucacaaaaagacaacuuucagagaagcaauaaacucagaccaccgacaaaaguaccugcuggauagauauauggcuucaacagagaaacuaauagaucuuuaugaugauagagacggacagcguaaggcugaaguagccgcucuuacgggccccaacgaguuccaagaauucuacaguagguuaaaauuaaucaaagacuuuuauagaaggcauccaaacgaaaucaguguucccaugucaguggaauuugaugaguuugccaaagccagggaaaauccuaacgaggauauggcuaacuuuguagaauuuacagaugaggagggcuacgggaaguauuuggauuuacaugaauguuaugaaaaguauauaaacuuaaaaggcauagaaaagguugauuacauuaccuauuuggguauguuugaccaacuguacgauauuccgaaggagagaaaaagcggugaauauaaaaaauauuuguuaugccuaauugaauauuugacuugguuugugcagcguauaaagccucuaaaggacuuagacauugaucuacaagaacaaguugagcagguucugauaaacugggauaauggaaguguaccgggauggccaaaagaaacagggucugcacuaacaaauguuggagcccacuuggaccucucugcauuuucaaguugggaagaauuggcaucguuagguuuagacagacugaaaucugccuuaauggcguuaggauugaaauguggggguacuuuagaagaaagagcucaaagauuauucucaacaaaaggaaaagguuccuuggauccuucacuuaugacgaaaaauaacaaaggcaaagccaacaaagaaaaggaguuauugagacaaagagaacuugcaacuuuagaagcccaaguguacagacuagcagagugggucucaccgcagagagcugcaacaaaagaaaaugugcaaaggaaacaagcucguacugacggagaaagagacgacagcgaaaaugaagaaagcgaagaugauaguccugaugaaggcgacgaugauguuccguauaauccaaagaaucuuccuuugggaugggauggaaaaccuauaccguacugguuguauaaacuacaugguuuaaacaucagcuauaauugugagauauguggaaauuacguuuauaaaggcccaaaagcauuccaaagacauuuugcagaauggagacacgcccacggaaugagaugccuugguauuccuaacacugcacauuuugcaaauguuacacagauugaggaugcuuuggcacugugggaaaagcugaaaguccaaaaacaaagugagcguuggcaaccugaaacagaggaagaguaugaagauucucaaggcaaugugguaaauagaaagacuuacgaggaucuuaagagacaaggguuauuauag

SEQ ID NO: 5891 - RNA, 639 nt, Diabrotica barberi
augacgauaggcaaaaauaacaaaaugguacaacacauaaacuucagaguucggguaacucugcaagacucccguaccuucauuggaacuuucaaagcguucgacaagcacaugaauaugauauuaggcgacugugaagaguuucggaaaauuaaaucaaaauuguccaaaguugaacgugaggaaaaacgaguauuaggauuuguuuuacugagaggagaaagcauaguuucuuuaacaauagaaggcccucccccaccagaagaagguuuacccagaguaccaaucccuggagcagccccaggaccaggaauugguagagcuggagguagaggaaugccacccggcauggcagguguaccuguaggucuucaaggaccuguaagaggagugggaggaccaucccaacaggucaugacaccaggagguagaggccaaguaucugcaccuccacagaugaaucaaggaccaccaaggaugggaggaccaccaccagguaugaugggaccuccacccgguaugaugggcauggcuccccaaaugggaaugggacguggaggaccaccgccaaugggaaugagaggacccccaccugguaugaugagagguggaccaccuggaccuccaagaccuuuuuaa

SEQ ID NO: 5892 - RNA, 987 nt, Diabrotica barberi
augaauuuugaaaguuuugaugaaauuuuagaucugauaaaaaaugacaucaccaaacaacaaacaaauuuuagggaaccaauugaugccacagaacgacuaucuguuacuuuaagauuuuuagcuagcggugauucauacaaaacgauugggaacagcuuucgguuaggauuuucaaccguugcaacuaucguggaugaaacaucugaagcuauauggaaccgguuacaaccgauuuauaugccagagccaacagaagaaauaugggaaaaaucaauccuaggcuucaaaaauguauggcaguuccccaauuguuuaggaagcauagauggcaaacacgugaccaucagauguccccagaagaguggaucaaauuacuuuuccuauuuaaaaaaauuuuccauaguucuuauggcaauuguugacccagaauauaaauuuauuuguauagauguaggugguuaugguaaaaauagugacggugguauuuuugagacaucggcuaugggcagaaaauuugcaaaugaaacuaugaauauaccacccaacagaccauuagcuaaugaaaaugaagagauuccauguguauuaauuggcgaugaagcuuuuacacuaagcccuuacuuaaugaggccguuuccuuauagacaggcacgaaaugacaacagaaaagagagauuuaauuaucaucuaugcagagcccgacgcguaguggaaaaugccuuuggaauauuggcacauaaauggcgucuauuuuuuagaccacuagaaguuaaaguucaaacagcuacaaaacuugugaaggcagcaugcguauugcacaauuugcugcgcacaaaaaacacugacgagcaaucuuugcauuuacaagaaaacugcaauauuccuuuaccaguaguugauaaucuggcgguugacggaagaagagcaguaaacgaagcuuuugaaauacgugaaaaauucguuacuuauuuuaguaauuuauaa

SEQ ID NO: 5893 - RNA, 1248 nt, Diabrotica barberi
aauccauguaauccaauaccuuuaccaccugaauauccuagauuuagauauuuuaaacuggguuugcgaggugguacaccaauguggggauuuggaagaggagcaaaacggauaccuacucccccaaaugcuccaacuaaaccggaagaaaaaauggcaaaccaagacaguaugauguuacaaaagaugaaaaaggagccucacuuaagcaaaguuucuauccuuaaaagaaaaguuggagcuggaaguggcaaaaucggcucucuuguuaguacagauuacaaugauauggacgauagcucauccacgccuccuauaacuccuccauuagcuacuacaagucgaggaggcauaccaaaaacauugcccaaaaagauuuuggagaaucaaagcagcaaggauuccguuauugucaugcacagcccagaggacaaacaacuugauaugauggauuuugacgaugacaccaauacuguuuuaucagcggaagucucucuaaguucugcagcucaaaaugacgaagauauguuggaaauggagacacuaucacaacaagauuuagcugaaggauuaucuagucccuuggaacccgaucaaauagcagaugaauauuuacuauuuccugggaauaugguaguugacaugucugcaggggaacauuuuuccgaaaaagaggaggaagaagaaaccguagaugaagaauuuaacgaugaaaacaugcauaucaugauucguaguccuacaaccagugacuaugaauacauuaugcaaaguaaggguaagaaauauaacguagguguccacgaugaaaacgaugaaaugccagaaucuccagaucaggaagacuuggcuguaccgucaccugaaguuucagacuuguugacaaauuacgaugaaaaugaugucuuaaugggcgaucaaaguaacagcacacccgaggaaucaauuucuaccaaagaagacuucgaagaguuaauugaugaaggcucacguaagaacagcauaacgaagucagaaguaacaacuaaacagaucaaugaauuccacaaauacgcaggaauauuuaauuauuccaaaggaguuguucaagcgacucagaaucagacagcuuuaaauaaaauuacgagcguagcuaacaaaaaagcaccugcaaaaauaucacucguagcggguccuauuguacauaaucuaucaaccgggaaggucaauccugaaaaauugauaaucacucaaaauccaaauauuuua

SEQ ID NO: 5894 - RNA, 2061 nt, Phyllotreta armoraciae
augccuagagaagauucacuugaaaggcacaaacacaaaagucacaaaggaaagaaaagccgguccaguagccguuccgaacguagucaagaaaaacgcaaacauucaucuagcucaaagaaaaagaguaguuuucacgaagaugucgaccgaaagaaaaagaaaaagcgaucuaagagcucuucuagugaaucagaauccacuaguagcgaaaguucagguaaaucgguggaacuauuaaaaaaacucgaaaaggaaagauugcgaacagcugaacagaagaagaaggaaaaggagcuucucaaagcuacggaaacagccgaggagaagagauugagaagauugaugaagaaagaggcgaaggaaagaaggcgaaaagaaaaaaugggcugggacaacgaauacuuacauuacacgaacagcgacaauccauucggagacggaaauuuacugaccacauucguuuggaacaaaaaacuguccaaagaaggcaucaaagacgucggccaugaagaaauugaagcgauaaacagauuaaaacaagaagagaauaaaagggaacuggaaaaagucaagaagcgaagauuagagagagaauuagagaggcaaagaagagaggaagaaacgcaaaugaugcaaagaacuaaagaagcagcccaauucgaggaaugggaaaggcaagaagauaaauuccaccuggaacaagcucgauugagaucucacauaagaauacaagacggacgagcuaagccgauugaucuacuagcaaaguacauaagcgcugaagaagaagucgaugcuguugaaaugcacgaaccguauacuuaccucaaugguuugcaaaucaaagaccuagaagacuuagucgaagacaucaaagucuacaaagaacuagaaagggggaaaaaccuagauuacuggaacgauauaacagucauagucgaagacgagcuacaaaaguugagaaaaauagaaaaacaaaacgauuucgacuuuggauugaacagaagggaagggauacaucaaucuguagccaccgauguaacuucgguauuuaaaggcaaaacagccgcacaauuagcagcguuagaaaaacaaaucggaaguaaaauuagcagcaaagccgauggaauagacauaggcuauugggaaucuuugcugucgcaacucaaagcccacauggcaagggcgagauuacgggaccgacaucaagauagccuaagaagaaaacugcaaguauuaaaagcagaacaagcuaucacaggaguaggucaaagucacagcgaaacucauucuacugauaacgaagaaaccacuucggaaccuaaaccaggcacuucucaggauucguuggaaacgauggcgauggaagaaagcaacgaaaaaagcgaagacgcugcucaugcauggcugagcgaaugcuuuucggcauaccaagcaggcggauacagccccaaguuuuuaacuccagacgauaccgagccuggcacgauuguggucucggaaguagacgacguaaauagauuggaauucgcuaggaugcaggugaugggucaaggauccaaaauugaaaacgccauuacaaaggaagaauugcugcuacaaaaggaggcgagaaaaggaauggauggggaugaggcucaguuuucgguugagcaagccuuggauaauccgguguaccuuuggucggauaaguaccguccacgaaaacccagguacuucaauagagugcacaccggauucgaauggaacaaauacaaucaaacucauuacgacauggacaauccaccgccgaaaauuguacaaggguauaaauucaacauauuuuacccugauuugaucgacaaaagcagcacgcccgaguauuauuuaacgccuagccccgagaauagggaauuugcuauacuucgauuccaugcuggaccgccuuaugaggacaucgcuuucaaaauugucaaccgagagugggaauauucauacaaaagaggauuuagaugucaguuucauaauaacauauuucaauugugguuccauuucaagagauauagguaucgaagauga

SEQ ID NO: 5895 - RNA, 1323 nt, Phyllotreta armoraciae
auggacaauuuagaagcuaacauaauggacaagucgaugagaucggucuucgugggaaacauccccuacgaagccaccgaagaaaagcuaaaggacauuuucggcgaaguuggccaaguguuguccuucaagcuggucuuugaccgugaaacggggaagcccaaaggcuacggguucugcgaauaccgagaccaggaaaccgcccugagcgccaugaggaauuuaaacggauacgaaauaggcgggaggaauuuacgcguagacaacgcuuguacggaaaagucccgcauggaaaugcaaaauuugcucaaccagccgcccaucgagaacccuuacggggagcccauucaggccgagaaggcacccgaagcgaucaguaaagcgguugcuucgcugccacccgagcaaauguucgaacucaugaagcaaaugaagacuaccauacaaaauaaucccacagaggcgagacaaaugcuauugcagaauccccaauuggcuuaugcucuguuacaagcgcaagucguuaugaagauuaucgauccucacacggcuuccacucuacugcacccuguuaaucaaguaccugcgacuuugcugccgggcgauaaaaauguggccgugcaaguaccgauuagcaaucaguaucgggaaccuccgguuccagugcaagccccucgacaggaguaccagccgguaccggcgccugcaguacaucccaaucaugugcaacagcccguuuuuacaggucaagauguugauuugcgaucgauggguaacgugacugauccgagaaucaggccgaugaucgucgaucaggauaugagacaaaugccaaaugucauccagaauccucuaccgccuacuauaagcgaaagucucgccaaagcgggagauucgaaacuugauaauuuuucgagggauccucgaagugucaccggugguuucccaucagauccaaggcaagcuaggauggacccgcgacaaaaaaauauaauaccgccgacgagccagcaaguaccuucaucggugaaucccaaaauaauggcgaaucaagccggcccugccgccaucagaccggcccaaaacgucaccgugcaagcucaaucugcggguguugugcccgcugcaucggcugcagcugcaccggccaaugugaugaguccaggaauaggaggagcuggggcuacagaucaagaaaaagccgcccugauuaugcaaguccuccaauuauccgaugagcaaauugcaauguugccgcccgaacagagaaauagcauuuugguguuaaaagagcaaauugcgaagagcgcgcauguucguuaa

SEQ ID NO: 5896 - RNA, 1179 nt, Phyllotreta armoraciae
auggcacauauguaugcagaacgggaaaaaagccuccuagaguacaggaagaaaugguuggagcacaaagagguugaauccagacuaaaagaaaugcgagaacagcucaaagauuuaacuaaacaguacgauaaaucagaaaacgauuugaaagcccuccagaguauggggcaaauuguaggugaaguuuugaagcaacugacagaagagaaauucauuguaaaagcaacaaacgguccucguuauguagucgguugccgucgucaguuggauaaagccaaguuaaaggccggcacgagaguagcucucgacaugaccacuuuaaccauaaugcgguauuuaccgagagaaguugauccguuaguuuacaacaugagccacgaagaucccggagaugucacuuauuccgccauaggugggcuuuccgagcagauaagggaguuacgagaagucauugaauugccucuuaugaaucccgaauuguucaugcgagugggaauuacaccaccaaaagguugucuguuguaugggccuccuggaacugguaaaacccuguuagcuagagccguagcuucucaacuggacgcaaacuuuuuaaaagucguaucgagugcuaucguagacaaauacaucggugaaucugcuaggcuuauuagggaaauguuuaacuaugccaaagaccaucagccgugcaucaucuucauggaugaaaucgacgcuaucgguggucguagguuuucagaagguacaucggcagauagagaaauccaaaggacucuuauggaguugcugaaucaaauggacggauucgauucguuaggacaaguaaaaaugauuauggcgacaaauaggccugauacuuuggauccugcucugcuccguccuggucguuuggacaggaaaaucgagauuccucugccgaacgaacaagcucgucuugaaauuuugaagauucacgcacuuccuauugcuaaacacggggaaauugauuaugaagcuauuguuaaauugucagacaccuucaauggggccgauuuaagaaauguguguacugaagcaggacuuuucgccauuagagcagaaagagaguacgugauucaggaagauuuuaugaaagcuguaagaaaaguugccgauaacaagaaacuggagaguaaauuagauuauaaaccuguauaa

SEQ ID NO: 5897 - RNA, 780 nt, Phyllotreta armoraciae
auggcucgccgguaugacacaagaacgacgauauuuucucccgagggaagauuguaucaaguggaguaugccauggaggccauaucccaugcuggaacaugucuaggcauccuggcaaacgacggaauccuucuugccgcagaaagacguaacaccaacaagcugcuggacgaaguuuuuauuucugagaaaauauacaaacuuaacgaugauaugguuugcaguguggcaggaauuaccucggaugcuaauguucuaacuaaugaauugcguuugauugggcaacgguacuuguaucaguauggugaaucaauucccugcgaacaauuaguuucgugguugugcgauguuaaacaagcuuauacucaauacggaggaaaaaggccuuuugguguaucgaucuuguacaugggcugggauaagcauuaugguuaucaauuguaccaguccgauccgaguggaaauuauuccgguuggaaagcaacuugcauaggaaauaacaguucugcugccauuucgaguuugaaacaggaauacaaagaaggcaauaugacuuugaaagaugcaaaaaguuuggcuguaaaaguucuggcaaaaacguuagauauggcuaaauugacgucggaaaaaguggaaauggcuacgcugacacgaagaaaugauaaaaccaucauaaauauauuaaauaacaaagaaguggaagaacuuauuuccgaguacgaaaaauccgaagcggccgcagaagccauuaagaaacaagaacaaaaauccgcugcuuaa

SEQ ID NO: 5898 - RNA, 2661 nt, Phyllotreta armoraciae
augagugaaucaaaagccgaaccuauaaagguggaaucaaaagcaaaugaugacaaaaacaaaaacgaucuuucugaugaagauaaacaacuucaagaggaauugaacuugugcguggaaaaauuacaagaaaaugacaguaaacuguauaugcccgcauugcaagcuuugggaaaccacauucgggccucgacuacuucaaugacuuccgugcccaaaccacugaaguucaugaagccucacuacgauacaaugaaacagauuuucgagaaaauaacugaggccccaguuaaaucucucugugcagacauuaucuccguacuagcuaugacuaugggagaaggaagagacugcuuaaaauacaggcuaguguccgauuuggacaagaucggugaauggggucacgaauaugucagacauuuggcuggagaaauugccggugaaugggcugaaaccgauuucuuaguaaacacagaaauuagggauaagcucauacucuuaacaaagcagaucguuccuuacaauauggcccauaaugcugaagcagaagcuugcgauuuauuaauggaaaucgaaagacuagacuugcucgagcaauacguggaugauaauauuuaccaaaggguuugcuuguaucuuacaagcugugugccuuacguagcggauccggaaaauacuacucuucuucaaaccgcuuuaaugcuauucaggaaauucaagcaguacccucaagcacuccgacuggcuaugcaauugaaugaucacagccucaucgaagaaauauuccuaaauugucccgauacugauguacagaaacaauuggcauucaugcugggcaggcaacagauuuacauagaaguucccgacagcacuccggaauacgaagaccucauugaaauaauggcgaauugucaucugaacaaccacuuuuugaaucuugcccgugaauuggacauuauggacccgaagaccccggaagauguuuacaaaucccacuuggaaaacagccgaccuccguucgguggaagccaagucgauucugccagacagaacuuggcugcaagcuucguuaaugguuucguaaacgcugcuuucgggcaagauaagcucuugauggaagaugggaauaaauggcucuauaagaacaaagaacacgguaugcuaagcgcuaccgcuucauuggguuuaguauuguuaugggacgucgauggaggucuuacgccuauugauaaauacuuguauuccucugaagaucacaucaaaucuggagcucuauuggcgugugguauugucaauuguggagucagaaaugagugugaucccgcucuggcucuauugagugacuauguucuucauaacacgaauauaaugaggauaggugcuauugugggccuugguuuagcuuacguuggauccaacagagaagcaguuuuaaguuuacucacuccugucuucuccgauccaaaaucuaacauggaagugaucgguaugugugcgcuggcuugcggaaugaucgcagugggauccggaaaucuccaaguuacuaccacgauuaugcagacguuaauggaaaaaucagaaacugaacugaaagauacauacgcuagauuuuugcccuuaggucuuggcuuguguauguugggcaaacaggagggugucgauuccauaauugccgcgcuggaaguuauaccggagccuuuuaaaucaauggcaacuacgauggucgacauuugcgcuuacgcuggcaccggcaacguacuuaaaguucaacauuuacuucacauuugcucugagcauuacgauggugacagcucagacaagaguucuaaagauaaggacaaaaaagaugcuucagagaaggagaaagaucuuucaucgagacaagcaguggccguacucggcauagcuuugaucaguaugggugaagacaucgguagugaaauggccuuccgaaccuuugggcauuuguugcgcuacugcgagccaguaaucagaagagcaguaccauuagcucuaggacucauuucaguaucaaauccuaaauugagcauacucgauacuuugaguaaauucucgcacgacagugaugcugaaguagcccauaaugccauauuugcuaugggcuuaguuggagcggguacgaauaaugcaagauuggccgcgaugcucaggcaauuggcgcaguaucacgcuaaagauccaaacaaccuauuuaugguucguaucgcucagggucuaacacauuuagguaaaggaacauugacauuaaguccuuaucacagcgaccggcagcucaugagcccuguagcaguagcaggauuaauggcuacgcuuguuggauuuuuggauguuaaaaacauuauuuugggaagaucgcauuaucuccuauacacuuuagcagcggcuaugcagccuaggaugcucgugacauuugaugaagauuugaacccauuaccgguaccugugagagugggauuggcuguagauguaguuggucaagcugguaaaccaaaaacuauaaccgguuuccaaacgcauaccacuccuguucuucucgcauauggugaaagagcugaacuggcuacugaagaauacuuggcacucacuccgauuauggaagguuuuguuauauuaagaaaaaaucccgacuucaaugcauaa

SEQ ID NO: 5899 - RNA, 1356 nt, Phyllotreta armoraciae
augaccgacaguaauauggauucaaaagaagagaaacaagcaucaccggaaaacgugaagcugaaacuagaagcauccgcgcccgagacuccuccaacucaaaccaccgcaaccggcgugauccgaagaaauuuuaucacuccggccggcacaauaguugaaaccaacgaagagcaaccgccggaaccaacgauagaagaagucgucaaaacgacaucgucgaauccaagucccgccgaacagaaaacggaacccgcagaaauagucaccuacgcugcggagguccugccgcaggagcagagagagcaauucgcugacgccaaaucuuacgccguggaaaugccugccgaaaauuuucaaaaucagagcuauacgcaggacauuaguuacgugaauauagaaggaacuguugugccaguuacaauaucggaaauagaacauccuggggacuacgccaaucuacaaaccgcucaauacaauaacggcuauacggacgguacacaauauuuaaccaaucaucaauaccaaaauuuguauauagauagaaguacaguugauaauucuccuucugcuacaguuuuauaccguggcgaugauccaaauuugggagcuuccagauuccaaggaaacuacgacauauccaguucucaaucgcaagugaaccuucuucccgcuuccggagaagccuacuauccaucaacgucuaacuggacgccaaccagcagcgggucuuaccaacaacaauacccgucgggaaacguccuucaagcugauucgacucaagcuuucgcagguccuuacauaaacgcuaccuggucgucgaauucgauggaggacggacggcaaucuagucaagagaccggaaauagaagaaacggcguaacgugugcaaauugcaaaacuaacaacaccacacuuuggagaagaaacaaccaaggcgagccaguuuguaacgcuugcgggcuuuacuuuaaauuacacaauguuaacaggccgaucaguaugaaaaaggaagguauccaaacgcgcaaaagaaggcccaaaaacucuucggucggaaacccugcgagugcugcuggucaaguaagaauggggcuucccucuuaucaauaccaagauauugaaguacagcaagaucaauaccaauuaccaguuaacguuuauucucaaagaccacaaguuucuuaucggcauuacggaacagaaaauauuggaacuuuaaaugcccaaccacugcagccaauaauuacucacgaagaugaacaggcaagcgucauuacaucgacuucacaacaggcuagguuuaggacgaagguggaagaagacgaaggaagcaauccauccaugcaauccuaa

SEQ ID NO: 5900 - RNA, 4827 nt, Phyllotreta armoraciae
auggcacuaccgggcaacgggauauucgucgucaaaggcgaaauaucgaacuugauggccgccaugaagaggggccccaaauggucgucgcacuccuaucaagacgacgacgucgacgcgcugcugaggaauuuccaagagcucagggacauuuuacacaacguaaacgaucuaggauacgucgagcccaacaccuucuuggccccuuucuuaaacgucauccggucagaagagacuacggguccugucaccaguuuagcccuaucugcuguuaacaaguuccucucuuacggucuuuuagauccuguacaaacuucuauuccgcaaacuauucacacaaucgcagaugcaguuacgcacgcucgauucgugggcacugaucaauccuccgauggaguaguacuaaugcguauccugcaaguccuacgaacucucacccucucccccgagggcuccacacugaccaacgaaagucucugcgagauaaugcugucuugcuuucggauaugcuucgaaacgagacuauccgaacugcuccguaaaaccgcugaacauuaccugaaggacauggugcaauugauauucaugaggcugccucaguucuccgaagacccgaagcucuccuaugugaaacguuugcggaugcagccgggggaccucgagcagacgagaacgaagaggaaaaaguacuugaagaaggagaauaaagagguuguuaaagugcagcagcaagaaauuaauguagaaacugauauaguagauaugcaaggugcuauucuucguaauaacgaaacuacugguguuaguacgccuucuaguccgaauccgaacgauacagauguugcuguagacauuccuguagaugauaguacgaagaauuuagaaacgucuuuagacgauagugcggagaaggaagucgaugaaccguuucaagacuaugucaaucaaagggguauucgguuuacgccucaauuccaacaggagaccaaccuaucuccuuaugguuuagccugcguacgcgaacuguuuagauuccuuauaagccucugcaauccuuuggauaagcagaauacggacguaaugauaaauuuagggcucgguuugcucacaguagcguuugaaauaagcgcagacaacauaggcaaauacagcacauuauuagcccuaguggaagaugauuuaugcaggaauuuauucgcuuugaugaacaccgaucgauuaacaauauucgcagcgaauuugcaaguaucuuuuuugcuguucgagucguuacgagcucauuuaaaguaccaauuagaguguuauuugaagaagcuuauggaaaucaugcguagcgaaucgaauaaagugaguuaugagcacaaagaaaucgccuuggauaauuugcugcaguuguggagggugcccggguuccacgccgagcucuauguaaacuaugauugcgacauguacugugcuaauuuguacgaggagcucaccgagcugcuggccgaacgguccauuucuaccguugugggaguuuaucaugcgcauuugcugucgcucgacgggcuuuugauuauaaucgaugggauagggaagagauucgaugaagcgaaagaucgaucagauaccgaugagauuagcaguuauacaggagagaauacgaggauuaaagguuguguuaaaguucccgauaagaagguuuuggcugcgaagaaggcgaucaaaaaaugguugccgcaagguacggaguauuucaaucagaagccgaagaaagguauacaguuccugcaagagcacggcguuuuaaagcaggaacucgacguggaggagauugcuagauucuugcgggagaauccugcguugaacaaagcuaugaucggagaguauauuagcaaucgggggaauuugaagauacuagaggcuuucgugagcacauucgauuucaccggaauacgaaucgacgaagcgcuuagagcguuucuggagacauuucgauuaccaggugaagcucccacaauuucgcugauccuggaacauuucgccgagcacuggcacaaaagcaacggagaacccuucgcugacguagauucugcuuuuaccuuagcguaugcuguuauuaugcuaaauguugaccaacacaacgaaaacgccaaaaaacaaaccauuccaaugucaccaaacgcuuucaagaagaaccugaaaggcguaaauggaggugacgauuucgaggaagagaugcucgacgaaaucuacacgucuaucaaaagcgaggagaucgugaugcccuccgaacgaacgggucucgugcgcgacaacuaccuguggaaaguccugcugcgcaaaggcagaucgcccgaaggcggcguuuacaugcgcgacgacggcggcgccuacgacucagaauuguucagcaucgccuacgguccucuagcagccgcauugaauucagucuacgagcgagcagaccacgaaggcguccaaaagaaagucaugcgagguuucgaacgaugcgcuuccauagcgucuaaucuaaauaugacuuccaaucucgacauguugcuggucaguuuggcgaaauucaccguauuccacaaccaucagaagcaaacugcuguuguggugcaauucgguucgaacgguaaagcucaauuagcucugaagacgcuuuuuaugcugauccaccagcacgguaacuccacgagggagggcuggaagcaucucuucgaucuccuacucgcuuuguacagcaacgauuugcucagcaagggcuucguggaggucgaagacuucguagaaccuucggguaaauuauguuuaguguauaaagaugcaccgagcgcagccaaacaggauacaggauuguuaagcucuuuguacuccuacaugauaucugucgagaauuuaucuaaaauaccuucuccagaagaacagaguuugauagacaaagccagggaauguaucaaagaguguaacuuggagcaaaugauuacugauucgaaauuccuccaucaacaagcucuuuuccaacuggucgauacucuaauagaauuauccagagguccugaaauacaagaagguucaucguacgacuacaacgaaaacauaacagucuucuuccucgaauuacucgugaaaaucgucauacaaaacagggacagagucaugaccauaugggaucgcgucagagaccacgucuacacccuagucaugaauucaucgcugaugagcuaccaguuucuccuggagagaucggugguggguuuguugaggauugccgugcgguugaugcgcaacgaggagaugagccacgugguguugcagucgcugcgcaugcugcuguugcugcugaagggcggcgugcuggcgaggauauccagacagauggcguucggguuguacgagaugcugaaaacuucggcgcagaauauucacacgacggccgauuggacggugguguucgcgcuguuggagugcgugggagccggggcgaagccucccagacccgucuugacugccgaagaaaccgaugcuaaacccaaaccugacgaagaaacuugcucuaaacaagacgaagaaagcgcagaaaaaaccaacgacacuaccaaaacugcgucccaaaggccccaaaguccgguaaccucgaucaccucaccggucggcacccccaacaccggcggauggaucaucgucagcgacgaagaagaucuccaaccccaccaaacucgccagcaaaccuuaccgauucacuaccaccugcgccucgacgccgauuuauccccccacgauccgcucagcaugcucaaaugcugcgagagcuuggccuuuuuagugcgcgacgucgcccacaucacaccguacaacuucgacgugugcgugcgcugcgugcgcaccuucgucgaggccgcgcucaaaccuccucccggcaaccaaucgaacgagcgaagauccaacgcgaggaaaagcaggaagagaaguccugcgggaagccaagaggaagacagcagcggcggcgacgaggacgaagaccugcccagcggcuaccaccagguccccauacaacuacuagaccugaugcacacguugcacacgcgcacagcgcagauauucaaauggugggcagaagaaggcggggagauauccggggaaacuuccuuguggacgcaagguugguguccuuugcugcaagggaucgcgcgauccugcugcgacguccgcaaaacggucagaaccagcgccaucgcuuaccuccaaagagcucuccuggugcacgaucuccaaacucuaacgccccgcgaaugggagcagugcuuccgaagggugcucuucccucuuaugaacuaccuacugcaauccggaagucccagagacgccguauccaccgaagaaacgaggauaagagcugccggagugcugucgaagguguuccuucaccaucuggcaccgcugucuucauuagcgggcuucgcugaucuuuggucgacggugcuggagcugauggacggguacaugcacgccgacgguagcgagcugcugcuggaggccgugcccgagagccugaagaauauguuguuggugauggaggcggcgggcguguucgacgcgcccgacggcaagaagaacguuuuguggacggcgacgugggagagaauagggaaguuucugccgggguugaaggacgagcuguuuagggagauggggucgaggaagaaggucguggaggaacgggagagggaggugaaugacucugaugugaggaaggaggcggaguguugggagaagaacguugggggaagggagcaagauguggaugggagggagaaggaggaagugguugcuuguuga

SEQ ID NO: 5901 - RNA, 618 nt, Phyllotreta armoraciae
augucgauuuuggcguacaacgggggcgcgaugguagcgaugaagggagagaauugcguagcaauagccgccgaccguagauucggcauacaagcccaaacaguagccacgaauuucgagaaagucuucgaaaugggcccgcaccuguucguaggccuccccggccucgccaccgacacgcaaacggucauggagaagcucagguuccgcaagaaccuguacgaauugaaagagaaccggcggaucucgcccaagguguucgcagccaugauaucgaacaugcuguacgagaagagguucgggccguuuuucguugaaccggucguggccggucuagcgcccgauaccuuugagccuuacauaugcaauauggauuugaucgguugccuuaacgagcccagcgauuucgucgugggcgguacggccucugcgcaauuguacggaaugugcgaguccuugugggagcccaaucucgcgcccgaugaucuauucgaaacuauaucgcaggcuuugauaaacgcuuucgauagggacgccauauccgguuggggagcuaccguuuauauuguagaaaaggauaaaguaaccauaagaaaccugaagacucgcauggauuaa

SEQ ID NO: 5902 - RNA, 2886 nt, Phyllotreta armoraciae
auggacggaaaaccagauuuggaaguggugaaaucagccguaucaacauuauacaacaacccggaugguggagaaaaagaaagagccucccgauggcuauuggaauuacagaaaucgguucacgcauggaccguugccgacgaguugcugcgucguugcacaaacgccgacgaucuccaaacccgcuauuucgcggcucaaacgaugcgcaccaaaauacaccaaucuuuccacgaacuacccagagaaguccacgagucucuuagggacucgcuucuggagcacaugggagcuugcgcuggcgucgaugagggcgcaggugccgccauagugacgcaauuaucgcuugcacuugcggauuuggcccuacugaugcccgauuggcgaacgccugcacuggauuugaucagcagauucagugcggggaauaacguguggccguuguuggagguauugacugugcucccugaagaauuggagagcagaucaguaagacuaggggaaaaccgacgauacgagguauuagaagauaugaaauucugcgcacccacugugaaugaauuuuugaagcauugcuccaauuuauauggaagagggggaucggaaagguuagcagcaggucauagaccaaucgacguaaaaauccucagauguuuugcuucuuggauaucaguuggagcaauuggaccuagucaauuaagcgaggaucgggucguagucgacauggcuuuugacguguugaaagcagaugaaaaagaaaacauaacaggucaacuucacgaagccgccacagacuguauuugcaccuugcuauuacgucucgaggauaacaacaaucacgucgcauuagaaacccauuuauuugaaaauauagugaauuuagaaguggccuaucacgcauccgucgcccucgaagaucaagcaaagucgacggauuauugucgacuauuuaccgaguuggcggaaucguuuuuggggaagauuguagacgacgguggaggcgggagcggcgacggcggaggagcgaagaggcguaccguguacgccguuaaaugccuggauuugguacugaugugcgucggccaucaugauuacgagguggccgagauaacuuuuaaccuuuggcauaugcuaagugaggaauuauaucagaaaaauaauaaggaauuaacggaauuauucaaaccauauguggaacgauugaucacagcuuuauguaggcauugucagauggagccagacauggaggguuuacucgaaaaaggagaugaauuuaaagauuuuaggaugaaagucucugauuuaauaaaggacgucgucuuuauaguaggaagcagcaguugcuucagacaaauguuuaucaauuugcaaaccucugguguaacgugggaugccagugaagccgcucucuuuguaaugcaggcuguagccaaaaacgucuuaccaacggaaaacgaaguuguuccuaaagucguugaagcaauacugaacauacccaacagcgcacacgucgcugugaaguacaccucuguucucuuacuaggcgaacuggccgaauggauagaaaagcacccggacgcuuuggaucccguccuuaauuuccuaauuugcugccuucgaagcggugccgaagguggaggcgucgcaacggcggcggcggcggcgcugcagaacguaugcacgugcuguggagcucacaugggcaggcacguucccauucuguuacaguugcuucaacagucggauucguucggcaucggcaacacggcgaucauaggauuauugaagggcgucgcgucgguggugaguugcggcaucggaagcagcgccgaaacggccuccgccguacgggaauuguguucuuugcaauugucgccguugugcaguuugaucgaaaacaacguucgacccguuaaagcaacuuuaacggauccggugcugugguuggauagauugaguucaguuuugagauacguuaaugucaauguuguugaaggagaaauccauccuugcaaaccgguaauaauggagauauggccgauauuaucucgcgcauucgacacauaccacagcgacguccggauaauggaaagguguugucgcucggugcguuucauguugcguugcguagcucgacaacuccaagauuugcugccuucuuuggucggccaaaucgugcacauuuaccgucucuacggacauucuuguuguuuguacgucggcagcauuuuaguggacgaauacgccggagaugcgacuugcguucaaggucuucucgacauguuaaaugccuuuuuggaaccgacguuucguuuguugcaagaagaaaauggcuugaagaaccauccggauacuguggaugacuucuuuagguugugcgcccgguucguccagagggcgccgaaggcguuucuaagcggaggggcccaucuggcgcccauuaugcaaugcucccuucucgcugccaccuuagaucacaaggaggcuaacgugucugucaugaaauuuuucuacgauuuaauaaaucagggacugagcggcagaggggaacccgacuucgacgagagaaaagccuugguuaggagccugcuaaacgaauacggccaacaacucgugucuaauuuaauucacucuugcguauuuuaccugcauucauacauguuaagcgaagugggugacguuuuugugcaauuguuagauuucgauagacagauaacgagugaaugguuagcgaacgguuuggaauuauuacccaaacagcagaaugguggaauaauggcggcuaagccuaaacaauuaaaugauguucaugcuucuauaacgagaucaaacaguucuaaaucggugacgcacgcccugaaagaccuaaccaggcuauaucguuaa

SEQ ID NO: 5903 - RNA, 1506 nt, Phyllotreta armoraciae
auggcucaaagauuucccggaccggugucgaaucaagucccagggggcccgccgccgccucaaagguaccaacaacagccgccuaaucaaggaaugaggcaauacggccaacaggccuuuccucccagaccgggcuacaaugcuccaccuccaaugcagucgagcggaggcacuaugauucaaagaccgcccggggcccccuauucgccgaugcgaggaggccccaugccgccccagccggugggaaagaggccuucggauaacaggaauccuuugcaacagaaaacuggugauuacagccacgguacgaguaagaaaaaaaagaagcuugcugauaaaauuuuaccccaaaaaguaagagauuuagugccggagagucaagcuuacauggacuuguuagcuuucgaaagaaaauuagauuccacgauuaugcgaaagagauuggauauucaagaagcuuuaaagcguccgaugaaacagaaacgaaaauuaagaaucuucauuucaaacacuuucuauccggcgaaggagccccaacccgaaggccccgauggcccuugccaagaaggcacgguagccucuugggaacuuagaguggaaggaaggcucuuggaagacucgaagaacgauccgaacaaaguaaaacgcaaauucuccucguuuuucaagucgcuggucaucgagcucgacaaagaacucuacggccccgacaaccacuuagucgaauggcacagaaccuugaccacccaagaaaccgacgguuuccaagugaaaagacccggcgacaagaacgugagguguacaauucuacugcuccucgacuaccaaccgcugcaguucaagcucgauccgagacuagcccgguuacucgggguacacacgcaaaccagaccggugauuauaucagccuuguggcaguacauuaaaacgcaccggcugcaagacggucacgagcgcgaguacaucauuugcgacaaguaucuagagcagauuuucaacuguacucguaugaaguuugcagaaauuccccaacgauugaacccccugcugcauccgcccgauccgaucguaauaaaucacguuauaucagucgaaggcggugcugaaagcaaacagacagcuugcuaugauauagauguggaaguggacgauacccuuaagacucagaugaauaauuuccuguugaguaccgcuagccagcaggaaauucagggauuggacgcgaaaauucacgagacagucgauacgauaaaucagcugaaaaccaacagggaguuuuuccugaguuucgccaaggauccgcagcaauuuauacauaaguggaucgugucucaaacgagagaucucaagacuaugaccgaugugguugggaauccggaggaggagagacggucagauuucuucuaucagccuugggcucaggaggcugugugucgguacuuuuacacuaaggugcagcagaaaagggccgaauuggagcaggcacuugguauucguaauaauuag

SEQ ID NO: 5904 - RNA, 885 nt, Phyllotreta armoraciae
augccagcagcuacuuuggguagcauuccacauccuaacaaugaagacugcggcauucgggacguuugggcucacaauuuagaagacgaauuucgaacuauaaggcaaauagugcagaaauaccaauaugucgcaauggacaccgaauuucccgggguuguggcuagacccauaggagaauuucgaaguucagccgauuaccaauaccaaauguuaaggugcaacguagacuuacugaggauuauucaacuagguuuaacguucuuagacgauaauggcaaaacgccgggaggaguuuauacuaccuggcaauucaauuuuaaauuuaaccuucaagaagacauguacgcacaagauagcaucgauuuacugcaaaacucagggauccaauuuaagaagcacgaagaugaagguaucgagccauuagaauuugccgaacuacuaauguccucuggaaucgugcucauggaaaauauuaaaugguuaucguuucauuccggcuacgauuuuggcuauuuaauaaaguuacuaaccgacaacaaucucccacaagacgaaaccgaauuuuucgaucuauuaaaauuguauuuuccuacgauauacgacguuaaguauuuaaugaaaucguguaaaaauuuaaaagguggucuucaagaaguugcagaacaacuagaauuggaaaggauugggccucaacaucaagccggaucugacucacuucugaccggaauggccuuuuucaaaaugaaagagauguuuuuugaggauacuauugacgauucgaaauuuucgggccaucuuuacggacucggaacgucuuucacaguuaaugguacaacuaacaauuacggaaacgauaacggcgacacgacaaacuccucauga

SEQ ID NO: 5905 - RNA, 1212 nt, Phyllotreta armoraciae
auggcggaagcucagaaaaggggagcuucgguuuucgaggaccucucgaacgucgaauucgagaccagcgagaauuuggaugugaucgaaaaguucaaagauaugaagcugaaggaggaacugcuucgcggcaucuucgcauaugguuucgagaagccuucggcuauucagcaaagagccauuauuccugugaugaaaggccgggauguuauagcccaagcacagucggguacugguaaaaccgcuacauuuuccauagcuauucuacaagcccuagauuugacaaugagagaaacccagguguuguguuuauccccgacuagagaauuggcuguacaaauucaaaaaguuauacuagcucuaggcgauuucaugaauguacaaugucacgcuuguaucggggguacgaaucuuggagaagacaucaggaaguuagauuacggacagcauguuguuagcgguacacccggaagaguuuaugauaugauucguagaagagcuuugaggacuagaucggugaaaaugcugguccuagaugaagccgacgaaauguugaacaaaggcuucaaagaacaaaucuaugauguguacagauuucuuccuccguccacucaagucguuuuaauuucugcuacguuaccccacgaaauccuugaaauaacauccaaauucaugaccgaucccaucaggauucuaguaaaacgugaugaacugacgcuggagggaaucaaacaguuuuucgucgccguggagagggaagaauggaaauucgacacucuaugcgaucuguacgacacccuaaccaucacgcaagccguaauuuucugcaacaccaaaagaaaggucgauugguugacugaaaagaugcgagaaaacaacuucaccgugagcuccaugcacggagacaugccccagaaggagcgcgacaacauuaugaaagaauucagaucgggccaaagcagaguuuugaucacuacugacguaugggccagagguaucgacguacaacaaguuucguugguuaucaacuacgauuugcccaacaaucgugaguuguauauucaucgaaucggucgguccggucgguucggcaggaaggguguugcuaucaauuuuguuaaaucggacgacauuaggauucugagagauaucgaacaauauuauuccacgcagaucgaugaaaugcccaugaauguagccgauuuaauuuaa

SEQ ID NO: 5906 - RNA, 1632 nt, Phyllotreta armoraciae
augaccgcuccugcugccgguggcgaugcaagaggaagaacucuugccuacaaagacaaaagcaaacccgccgauguccggacuagcaacauuaacgccgcuaaggcugucugcgaugcaauucguacuaguuuggggcccagaggaauggacaaaaugauacaagcugguaacggugaaguaacuauuaccaaugauggagcaacgauuuuaaaacaaaucaacguuauucaucccgcagcaaaaauguugguggaacugucgagagcucaagauaucgaagccggugaugguacgacauccguugugguuauugccggagcucuucuagaugcugcagaaaaauuacuacaaaagggaauucaccccacggcuauuucggagucuuuccagagagcugcucaacuagcugucgaaauucuacaaggaauuucaacaccaguagaaaucaccaacagggaguuauuaauuaaaagugcuucuacuucuuugaauuccaaaguuguaucucaacagucgagucucuuaggcccucuggcggucgaugcuguucuuaaaguugucgaaccagggcacgaacaagcguguaacuugauagaugucaaaguuauuaagcaauugggcgguacuguggaagauaccgaguugaucgaggguaucguuuucucgcagaaaucugccaacguaucuggcccgaagaaaaucgaaaaagccaagauugguuucauccaauucugcauuuccccuccuaaaaccgauauggaccacaacgugaucguaucugauuacgcugcgauggaucgaguuuugaaggaagaacgagcuuauaucuugaauauuguuaaacagauuaagaaagccgguuguaacguacuucugguucagaaaucgauucuccgagaugcuguauccgaucuggcccuucacuuuuuggauaaaauaaagugcauggucaucaaggaugucgaacgagaagacguugaauuugugugcaaaucguuggguuguagaccgaucgcaucucucgaucauuucaccgcagagaauuuaguaacagccgauuuggucgaagaaguuggacuaggcgguaaccgaauggugaaaaucacggguauucaaaaugcggggcguacugucacccugcucguaagaggcucgaauaaacuaguauuagaagaggccgaaaggucucugcaugacgcucuuugugucauucggugucuuguucgcaagaaggcguugaucgcagguggcggagcacccgaaauugaaguugcucucaagcuggcugcuauggcuaauaaguuggagggcauugaugcuauuuguaccagagcuuacgcuacugcuuuggaaauuauaccguuuacuuuggcggagaaugcuggauugaauccuauacagacgguuaccgaauugaggaauagacaugcaaaaggugaaacuucugcggguauuaauguucguaagggcacuauuacggauauuuuggaagaaaauguuguacaaccgcuguuaguuagcacaucugcuuugagcuuugccacugaaaccgucagguccauauugaaaauugaugauauuguaaguaaaaauuuugauuacuuuuggauaaaugguaaaauuucuuga

SEQ ID NO: 5907 - RNA, 1230 nt, Phyllotreta armoraciae
auggaggcuauggauauuguaauaccagaaaaagaggaaggcagcccuuccgaagugaaacagguccugcaagauuuagacauggaagaucuguacacgaaauacaagaaauuacagcagacguuggaguuuuuggaaguucaggaagaauacaucaaagacgagcagaggaauuugaaaaaggaguacuugcacgcccaagaagaagucaaacguauucagucaguacccuugguuaucgggcaauucuuagaagcaguugaucagaauaccggcauuguuggaucaacuacagguucuaauuauuacguucgcauucucucuacaaucgauagggaauuauugaagcccucagcuaguguagcccuacacaagcacagcaaugcucugguggauguguuaccccccgaagcagauuccucgauuagcaugcuucaggccgaugagaaaccagauguacaauacagcgauaucggagguauggauaugcaaaagcaggagauacgagaggcuguagaacuuccguugacccacuucgagcuguacaaacaaaucgguauagacccuccgagagguguguugauguacgguccgcccgguugcggcaagaccauguuagccaaagcuguagcucaucacaccacagccgcuuuuauucgaguggucgguucggaauucgugcagaaguaccugggcgaagggcccaggauggugagagacguguuccguuuggccaaggagaauuccccugccaucauauucaucgacgaaaucgaugcuauagccacuaaacgguucgaugcccagacgggagccgaucgagaggugcagagaauucugcuggaauuguugaaucaaauggacggguuugaucaaaccaccaacgugaaggugauaauggcgacgaaucgagccgauacguuagauccugcgcuucuucgaccgggucguuuggauaggaaaaucgaguuuccguugcccgauagaagacagaaacgguugauauucaguacuaucacgucgaaaaugaaucuaucugaagagguugauuuggaggauuacguugcuaggccggauagaauaucgggggcugauauuaacgcuauuugccaggaagccggaaugcacgcuguaagagagaaucgcuacaucguuuugccgaaagauuucgaaaaggguuacaagaauaacaucaaaaaagaugaaagcgaacacgaauuuuauaaauaa

SEQ ID NO: 5908 - RNA, 489 nt, Phyllotreta armoraciae
augccaaacauaaagcugcaaucuucggacggcgagacguucgaaaucgacgucgaaaucgccaagugcucggugaccauaaaaaccauguuggaggaccucggcauggacgaggaagaggaagagguaguaccguugcccaacguaaacucagcaauucuacggaaggucauccaaugggccaccuaccacaaggacgacccgccgccgccugaagacgacgacaacaaggagaagagaacggacgacauauccucgugggacgcggauuuccugaaagucgaccaagggacccuguuugagcugauccuggccgcaaacuaucucgauaucaaagggcugcucgauguaacuugcaagacuguagccaacaugauaaaaggcaaagcaccggaggagauacggaaaacguuuaauauuaaaaacgauuuuaccccguccgaggaagagcaagugcgcaaggagaacgaguggugcgaggagaaauag

SEQ ID NO: 5909 - RNA, 1038 nt, Phyllotreta armoraciae
augaaggcagcaaauaacacuaaauccguuaaaaugacaucgccaaaauugaauaacgucgaaagcgucgauaaaucggagaaaggaaagauaaaaaacguaguaauaauggacgauaaggcuucauguaaggaacuagaucaauggauagaacaguuaaaugacuguaagcaauuaaccgaaaaccaagugaaaacucugugugauaaggcgaaagaaauacuguccaaagaaucaaaugugcaggagguaaaaugcccugucaccguuugcggagauguacauggacaauuucacgaucugauggaauuauuuaggauaggcggccgaaguccagauacgaauuaccuuuuuaugggugacuaugucgaucguggauauuauuccgucgagacuguuacucuuuugguggcuuugaaagucagguauaaagaaagaauuacaauucugagaggaaaccacgaaucgagacaaaucacucaaguauauggauucuacgacgagugccuacggaaauacggaaacgcgaacguuuggaaauucuucaccgauuuguucgauuaucugccgcuuacagcgcucgucgauagucaaauauucuguuugcacggaggucucagucccagcaucgacaccuuggaccauauuagagcgcuagaucguuuacaagagguaccucaugaagguccgaugugcgaucuucucuggucggaucccgacgaucgcggagguuggggcauuucuccucgcggugccgguuauacuuucggacaggauauaucggaaacguucaaccacagcaacgguuugacauuggucucucgagcccaucagcucgucauggagggguacaauuggugccacgacagaaacgucgugacuaucuucagugcuccgaacuacugcuauagaugugguaaucaagcugccauuauggaauuagaugaugcgcuuaaauauucauucuuacaauuugauccagcaccgagacguggcgagccucacguuacccgcagaacuccggauuauuuccuuuaa

SEQ ID NO: 5910 - RNA, 1602 nt, Phyllotreta armoraciae
augcagaucuucguaaaaacccucacuggcaagaccauuacucuugaagucgaaccaucugacaccaucgagaaugucaaagcuaaaauucaggacaaggaagguaucccaccagaccagcaaagauugaucuuugccgguaagcaauuggaagauggccguacucuuuccgacuacaacauccagaaggaaucuacucuucacuugguuuugagacuucguggugguaugcagaucuucguaaaaacucuuaccggcaagaccauuacucuugaagucgaaccaucagacaccauugagaacgucaaagccaagauucaggacaaggaagguaucccaccagaccagcagagauugaucuucgcuggaaaacaacuugaggauggccguacucuuucugacuacaacauucagaaagaaucuacucuucacuugguuuugagacuucgugguggaaugcagaucuucgugaaaacucucaccgguaagaccaucacucuugaagucgagccaucagacacaauugagaauguuaaggcuaaaauucaggacaaagaagguaucccaccagaccagcagagauugaucuucgcuggaaaacaacuagaagauggccguacucuuucugacuauaacauccaaaaggaaucuacucuucacuugguuuugagacuucgugguggaaugcaaaucuucguaaaaacucuuaccggcaagaccauuacucuugaagucgaaccaucagacaccauugagaaugucaaagcuaaaauucaggacaaggaagguaucccaccagaccagcagagauugaucuucgccggaaaacaacuagaagauggccguacucuuucugauuacaacauccagaaggaauccacucuucacuugguacuuagacuucgugguggaaugcagaucuucgugaaaacuuuaaccggaaagacuaucaccuuagaagucgagccauccgacacaaucgagaauguuaaggcuaaaauucaggacaaagaagguaucccaccagaccaacagagauugaucuucgccggaaaacaacuagaagauggccguacucuuucugauuacaacauccagaaggaauccacucuccacuugguacucagacuucgagguggaaugcagaucuucgugaaaacuuuaaccggaaagacuaucaccuuggaagucgagccauccgacaccauugagaaugucaaagccaaaauucaggacaaggaagguaucccaccagaccaacagagauugaucuucgccggaaaacaacuagaagauggccguacucucucugauuacaacauccagaaggaauccacucuucacuugguacucagacuucguggugguaugcagaucuucguaaaaacucuuaccggcaagaccauuacucuugaagucgaaccauccgacacaaucgagaauguuaaggcuaaaauucaggacaaggaagguaucccaccagaccagcagagauugaucuuugcugguaaacaacuugaagauggccguacucuuuccgauuacaacauccaaaaagaaucuacauugcauuugguacuccgucuuagaggaggacaguaa

SEQ ID NO: 5911 - RNA, 1623 nt, Phyllotreta armoraciae
augaugcaaccucaaauacuacuccucaaagaaggcaccgauucaucgcaaggcaagccgcaauugauauccaacauaaaugcgugccagaauauaguggacgcuauacgcaccacccuggggccccgagguauggacaaauugaucguuuccaacagaggcucggcgaccauuucaaacgacggagcgacaauauuaaauuuacuagacgucgugcauccagcggcgaaaacucuagucgacauugcgaagucacaagaugccgaaguaggcgauggcacgaccucagugguguugcuagccggcgaguuuuugaagcaacugaaguccuacaucgaagaaggcgugcacccgaggaucaucaucaaagccguacgaaaggcaacgcagauuugcuuggagaaaaucaacucccuggccguuaaaaucgacaaaacgaacgccgaugacuacagaucgcuguuggagaagugcgccgcgacggcgaugagcucgaaauugaucaacaaacagaaaucguucuucuccaaaaugguggucgaugcugucuuacugcucgaugaacuucuaccguugaacaugaucggcaucaagaaggugcaaggcggugguuuggaggaguccauguuagucgccggaguggccuuuaagaaaaccuucucguaugccggguucgaaaugcagcccaagauuuacaaagacugcaagaucgcucuguugaauauagaauuagagcugaaagcugagagagacaacgccgagauccgucugagcagcgucaaggaguaccagaaaguugucgaugccgaguggaacauuuuguacaacaaacuccagaaaauuuacgaauccggagccaacguuguucugucgaaauuaccuaucggcgacguugcuacgcaauacuucgccgacagagacauguucugcgcuggaaggguccaagaagaagauaugaagaggaccuugaaagcaugcgguggcuccguaaugaccacagucaacgauuuaaaagacgaugugcuagguaacugccagcucuucgaagagaaacaaauuggaggggaccgauacaacuucuucaaaggcugccccaacgccaaaaccugcaccauaauccuacgaggaggagccgagcaauuuuuggaagaaaccgagagauccuuacacgaugccaucaugauuguccgcagaacaaucaaaaacgacuccgucguggcaggaggaggagcaauagaaauggagcuaucgaaacuacuuagggacuauucccguacuauugcugguaaagagcaacugcugauuggagccauagcaaaagcacuagaaauaaucccuaggcaacugugugacaaugccgguuucgacgcuaccaauauacugaacaaauugcgacagaagcaugcucagggcaauucuugguacgggguggaugucaacauggaagauauugccgauaacuaugagacuugcgugugggagccagcgauuauaaaaauaaacgcuuugacugcagcugcggaggccacuugcuugauccugucugucgaugagaccaucaaaaaccagaaaucugaagcgcccccgcaaguaggaggucgcggaaugggcagaccuauguaa

SEQ ID NO: 5912 - RNA, 13968 nt, Phyllotreta armoraciae
augggggacuccuuggaagccucggaagcggcucaugaaacucaaaauguggcauuaguggauuuuacugcguuuacaaauuuuauucuaaaagcggcuacuguacuuuugcccgaagaugauagccaagcggagccggcuaaccucguagcagcuauagaugacaaaaccaaucaagaauguauuaaaaaauucauaagcgauccccaaauugugauacuguacguccaaaggaacucuucaaaagaugaugacaacguccagccucccgaaggggaagaagaaaaagaacccguuacauacuauauuagcaaugaagugcacuauucaaauucaaaaauguccaguuuggugugcaucaagagagguccggugauagaagcagauaaaaguauucgagcucagguucguuugaugaacuucagcgaggggucgccauaugaaauucugcaugauuaugucagcagaacgguugccccuuacuucaaaucuuacguaaaagagucugguagagcugaucgugauggugauaaaauggcgccugcaguugaaaaaacaaucgcugaauuggaaaugggacugcugcauuuacaacaaaauauagauauuccggaaauuacgcuucaagugcacccguacguugccagucuuauaaagcaaugcgccgaugaaggaaggaagccgaaagucgccgauuuuagugacaaaguggacgacucgaacuuucuuaaccaacuucaacauggaguuaaucguuggaucaaagaaauucaaaaaguaacaaaauuagacagagaccccucuucuggcacagcucuucaagaaauuagcuuuuggcucaaucuggaaagggcccuucaccgcauccaagaaaaacgcgaaagcauggaagucgcucuaacauuagacauucugaagcacgguaaacguuuucacgccacagugucuuucgauaccgauacaggcuuaaaacaagccauagcuacaguuaacgauuacaauccgcucaugaaggauuuucccaucaacgauuuguuagcugcaaccgagcuggagagaauucgcgccgcaguucaguugauuuuuucccaucuaagaaaggucagaucgacuaaauaucccauuacgaggugcuugagacuggucgaagccauuucgagagaucuaggcaugcaguuauugaaaguauugggcacccgccgguuaaugcacauuccauucgacgaauucgagaaagucaugacccaauguuuugaaguguucucgauuugggaugacgaauacgagaaauuacaaggucuccucagagauaucaugaaaaagaaacgagaugaacauaugaaaauggucuggcgcauuucgccgcaacauaaaaaacuucaaagccguauggaucaaaugcgcaaauuucgcagacagcacgaacaacugcguacaguuauagugcguguauugagaccaaguauuaaagagagugcagugccugcugaaggaagugauaucgaaccuccgaaaccaacauuuucccuugaugcugcagacgcaaaugcuauagaggaaguaaauuuggcuuaugagaacgugaaagaagucgacugucuggacauuaccaaggaaggacaagaugcuugggaugcugcaguacagagauacgaagagcgaaucgauagagucgaaaccaggaucacagcacaucuacgcgaucaauugggaacggccaaaaacgccaaugagauguuuagaauuuucucgcguuuuaacgcucuauucgucagaccucacauaagaggagcuauaagagaauaucaaacucaucuaauucaaagggugaaagacgauauugaagcccuacaugaaaaauucaagguucaauauccgcaaaguaacagugcuaaaaucaguaaagugagagauuugccgccuguagcugguucuauagugugggccaagcagauugaucaucaacuaacgacauauuuaaggcgcguugaagauguguuaggaaaaggaugggagaaccacaucgaaggacaaaaacucaaagccgauggagacagcuuccguuuaaagcuaaacacgcaggaaauauucgaugauugggcgcgaaacgugcaacaacguaaucucggcguaucuggaagaauauuuaccauugaagccgugagaucaaggagcggucgugguaacguucuuaaauugaaagucaacuuucuaccggagaucauuacgcuggcuaaggaaguacggaauuugaagugccuggguuuuagagugccguuggcaaucgucaauaaggcacaucaagcgaaucaacuuuauccguucgccauaucgcuuaucgaaagcauccgaacauaugaaaugacuuuggagaagaucgaggacaaggccagcaucaucccacucgucgcuggcaugagaaaagaaguccagcuaguccuagccgaaggaauacaauuaguaugggaaaguuacaaacucgaccucuacgugcaaagacuuuccgaccuaguaguggguuuccaagagcgagucgaagagcucguuuucgucggcgagcaauuagaaguagacgucagaucguuggaaacuuguccuuacucugccaacacuuuugccgacauauuaucgaagauccaacacgccguagacgaucuaucccucaaacaauacucaaauuuacacauuuggguguugcgauuagacgaggaagucgagaaaaaccucgccaggcggcuccaagcggggauugaggccuggacggaaacucugaguggccagaagaaagaaaucgaucacagcauggacaccgacgcuccugcccaacccacccauaaacccggaggcgauccccaaauucaaaccaugauacacgaagugcgaauaaccaaucaaacuauguacuuguuuccgaguaucgaagaggccagguuccugaucaugcagcaguuauucgcuuggcaggcgaucgugacgugccaacaacgucuucaaagcagucgcuaccaaguugguguggacaagccggugguugaaacuuacaggaauauuuugacuagauuaccggcuggagcucaaccguugaucaacgcuuacagcgcuauuucuucuaaaauuaaggagguucaaaacuauguaaacgaaugguuaacuuaccaaucccugugggaucugcaagcagauaaucuuuacgggaaacugggagaagauauuaguaaauggauggaaugucugaaugauauaaagaaaacucgaacuacauucgauacaucugacacucgucgcgaauucggccccauagucauagacuuugccaaaguccagagcaaaguuucucuuaaauaugacuccuggcacaaagaaaccuuaagcaaauucggcagccucuugagcaacgaaaugaccucguuccacgcuaacguauccaaauccagauccgaucuggaauuacaaagcaucgaggcagcaagcacuuccgaugccgucagcuucauaacguacguucaacaauuaaaacgaaacaugaaagcuugggagaagcagguagacaucuacaaagaaggucaaagaauccuggaacgccagagauuccaguucccgacaaacugguugcacguggagaacuuggagggcgaauggggagcauucaaugaaaucaucaaaaggaaagauucgagcauucaaacucaagucgcuagucuucagcaaaagauuguuucggaagacaaggcagucgaaagccgcacgaacgauuucuugguagacugggaaaggagcaagccggucgaaggccaucucagaccagacgacgcccucucucagcuacaauuauucgaaaguaaauuuucgcgccucaaagaagaacgcgauaacgucgcuaaagcuaaagaggcuuuagacuugcaagacccggguggcauaagcaccagcgaagauagaaugcaagucguuuacgaagaauuacaagauuugagaggcguuugguccgaauuguccagaauuuggcagcaaaucgacgaaaccagagaaaaaccauggcuuuccauucaaccgaggaagcugcgacaacaacuggaccaacucucgacgcaacucagagaauuaccggcccgucugagacaauacgcuuccuacgaauacgucaagaagacucuccaaaccuacaccaaagucaacaugcugauagucgaauugaaauccgacgcccucaaggaacgucacuggaagcaacucaugaagcagcugagaguaaacuggguccucuccgauuuaacgcucggccaagucugggacgugaaucuccagaaaaacgaagcuaucguuaaagacgucauauuaguagcacaaggagaaauggcgcucgaagaguuccugaagcaagugcgcgaguccuggcaaaacuacgaacuggacuugaucaauuaccaaaacaaaugcaaacugaucagaggaugggacgaucucuucaacaaagucaaggaacacaucaauuccgucgccgccaugaagcugucuccguacuacaaggucuucgaagaagaagcuucgacuugggaagaaaaguugaaucgcauaaacgcgcuguucgauguauggaucgacgugcaaaggcgcuggguuuauuuagaaggaauauucuccggaagcgcugauaucaaaacgcuccucccgguggaaacgucgcguuuccaaagcaucagcuccgacuucuugggguuaaugaagaaggucagcaagaguccaauggugauggauauuguaaauauucuaggcgugcaacguguacuggaaagacucgcugauuuauugggaaaaauccagaaagcgcuaggcgaauaucuggaaagagaacguacaucuuuuccucgauucuacuucgugggagacgaagaucuccuggaaauaaucgguaacagcaagaaugucgcgagguugcagaagcauuucaagaaaauguucgccgguguagcuuccauauuacuaaacgacaacaacacugucauaaccgguauagcuucaagagaaggugaagaaguuguauucaaaacaccaguuuccaccguggagcauccgaaaaucaacgaauggcugacuuuggucgaaaaagaaaugcgaguuacauuagccucgaaucuaacgcaggccgugcaagauaucaaacaauucaaagaugaaaucgacucgaaauccuacauggaaugggucgacaaguaccaagcgcagauugugguauuggcagcccagauucucuggagcgaagaugucgaagccgcgcucgucaaaaugaacagcgaaccccaaaaaggcguguuggaaaaaguccuacaacaagucgagaauacucuuaacguacuagcggauuccguuuugcaagaacaaccucaauugagaaggaagaaacuggagcauuuaaucaacgaguuugugcacaaaagaacugugacuagaaggcucaucgcuaacgggguuuguagcaacaaggcguucgaauggcugugcgaaaugagguucuauuucgauccgagacaaacagaaguacuuaagcaauugacgauucauauggcgaaugcgagguucuauuacggauucgaauaccucgguguucaggauagauuagugcaaacuccucuaacugacagauguuacuugacuaugacccaagcuuuggaagcccggcucggaggaucaccguucggacccgccggaacugguaagaccgaauccgucaaagcgcucggaaaccagcuaggucguuucgugcucguguuuaacugcgacgaaacguucgacuuccaagccaugggcaggauauucgucgguuugugucaagugggcgcuugggguuguuucgacgaauucaacagauuagaagaaagaauguuguccgccguuucgcagcaaauucaaaccauacaagaagcguugaaaucacagaaggaagccgccgcugaaggaguagcuaucggcaguauaagcgucgaacucguaggaaaacaagucaaaguaucccccgauauggcuaucuuuauuacgaugaauccuggcuaugcgggucguucgaaucugccggauaauuugaaaaaauuguucagaucguuagccaugacuacgccugacagacaacuuaucgccgaagugaugcuguucucucaaggauucagacaggccgaaaaacuggcuucgaaaauuguaccuuucuucagauuaugcgaugaacaacuguccaaucaaucucauuacgauuucgguuugagagccuugaaaucuguacuaauaucggcaggaaaugugaaaagggauagaauucaaagaauaaaagaagguaugacccaacgaggcgaaaccaacauagaugaggcaaacauagccgagaauuuaccggagcaagaaauauuaauucaaucgguuugugaaacuaugguucccaaauuagucgcagaagauauuccauugcuauucagcuuguuaaacgacguguuucccaacguacaauacaccagagccgaaauggaaggucuuaaagaugaaauuagaaaaguguguacugaagaauaccucguuugcggagaaggcgacgaaagggguucagcuuggauggaaaaaagagacacauggcuaucaaagguauuacaauuauaccaaauuucaaaucuuaaccacggucuuaugauggucggcccgagugguucggguaaaagcucagcauggcgaguucugcucaaagcucucgaacgauucgaaggaauagaaggcguggcccauguaauugauccuaaagcgaucagcaaagaaacucuauaugguguuuuggaucccaauacuagagaguggaccgauggucuguucacccauauucuaagaaaaaucauagacaacgugagaggugaaauuaacaaacgccaauggauuaucuucgacggugacgucgaucccgaauggguagaaaacuugaacuccguucuugacgacaacaaauuauugacucuucccaacggagaacgucuuucucuaccacccaacauuagaguuauguuugagguacaagauuuaaaguaugccacuuuagcuacagucucgcguugugguauggugugguucucagaagacguacuauccaccgaaaugauauucgaaaacuacauucuucgauugaagaacauuccgcucgaagaaagcgaagagggcuucggcaagaaaucugacaucaaagacgacauguugucucccacccuucaacugcaaguagaugucgugaaucuacuucaaccguuuuugggacccgauggucuuguaguacguuguuuagaguacgcuauggaacaagagcauauaauggacuucacucggcucagagcgcugagcucauuguucuccaugcuaaaucaagcagugagaaaugucuugcaguacaaucacaugcaucccgauuuuccucucuccagcgaagcccuggauaaauacauacccaaauguuugauauauucgaucuuauggagcuucgcaggcgaugcuaaacuuaaaguuagaucggaauugggcgauuuuauuagaucuguuaccaccgugcccuuaccauccgaucgcaauuugcccauuauagauuacgaaguuacuauugaaggcgaauggucgcuuuggucuaauaaagugccgcaaaucgaggucgaaacucacaaagucgcuacaccugauauuguggugccuacguuggacacgguuagacacgaaucuuuguuguacacuugguuggcugaacauaaaccgauaguauugugugguccaccugguuccgguaaaacgaugacguuauucuccgcauuaagagcuuuaccagauauggaagucguuggguugaauuucuccucagcuacaacuccagaauugcuguuaaaaaccuuugaucauuacugugaauacaggaaaacaccaaauggcguaauccuaucgccaauacaguuaggcaaauggcugguccucuucugcgaugaaaucaacuuaccagacauggacaauuacggaacccaacgcgucaucauguuccuucgacaaauaguggaacaaaaaggauucuaccgcgcuucagaccaaaccuggguaacauuggaacgcauacaauucguaggcgcauguaaucccccaacggaccccggaagaaagccccucucucaccguuuucucagacacguacccgucguuuacgucgacuacccgggagaaacgucgcucaaacaaauuuauggcaccuucacgagagcaaugcucagauuagcuccaggacuaaagggcuacgcggaacccuuaacuaacuccaugguggaauucuacuuauccucgcaagauagguucacccaagauaugcaaccucacuacguguauuccccucgugaaaugacgagaugggugagaggcauaugcgaagccaucagaccuuuggacaaucuuucugucgaagguuuggugagguugugggcgcacgaagcgcuucgacuguuccaagauagguuaguggaagacaccgaaagacgauggacgaacgaaaacaucgaugccgucgcuuugaagcauuucccgucggcgaauugcgagaaagccuuagaacggccuauucuauacaguaacuggcuguccaaggauuacgugccgguuggaagggagcaauugagagaauacgucaaggcuagguuaaagguguucuacgaagaagaacucgacguuccuuuggugcucuucgaugaggugcuggaucacgugcucaggaucgacaggauuuucagacaaccgcaaggucauuugcucuugauaggugugucuggagccgggaaaacgacccuauccagauucguggcuuggaugaacggauugucuauuuuccaaaucaaaguucacaacaaauauaccgcugaugauuucgacgaagacuuaagaucggucuugagaagaagcggauguaaacacgaaaagaucgcuuucauuuuagacgagucgaauauguuggauucgaguuucuuggaaagaaugaauacucuucuagcuaacggagaaguucccggauuauucgaaggagacgaauacacaacucuaaugacacagugcaaagaaggagcccaaagagaaggauuaauguuggauucgaacgaugaacuguacaaaugguucacacaacaaguuaugcgaaauuugcacguaguuuuuacgaugaauccuucaaccgauggauuaaaggacagggcugcuaccucaccugcuuuauucaacagauguguuuugaauugguucggagauuggucggauggagcucuuuuccaggugggaaaagaauuuacgaaccguuuggaucucgacaaacaaaguuggaaauguccagacuucuucccugcuucuugcaaccacauuucugcuacgcccaaucacagggaagccgucaucaacgccugcguuuacguccaucagacgcuucauaaagccaacggcagauuaguaaagagaggaagucgcacgauggcgaucaccccuaggcacuacuuagauuucauacaucaucucgucaaauuguacaaugaaaaacgguccgauuuggaggaacaacaacuccaucuuaacgucgguuugaacaagaucgcugaaaccguagaacagguggaagagaugcaaaagaguuuggcuguaaaaucgcaagaauuacaagcgaaaaacgacgccgccaacgccaagcucagacaaauggugaaagaucagcaagaagccgaaaagaagaaaguucaaagucaagaaauucaacagcagcucgcucagcaaacugugcacaucaagcagaaaaagucugaaguaauggccgauuuggagcaaguagaaccagccgucaucgaagcacagcaagcuguaaaauccaucaagaaacaacaauuaguagaaauccguaccauggcgaauccuccagcccuaguaaaacuggcgcucgaaucaauuugccuacuauuaggagaaaacgccagcgaguggaaauccauucgagcuguuauuaugagagacaauuucaucaacagcgugguuaauuucaacaccgaagacauuggugacgaugucagagaaaaaaugaagagccguuauuugagcaaucccgauuacaacaucgacaaaaucuaucacgccaguaacgccugcggcccgcuggugaagugggcuugcgcccaagucgaauacgccgacaugcugaagaaagucgagccgcuacgugaagagcucaacucucuggaaacccaagccgaaaccaaccagaaacgcggcgaagacgucaaaguccucaucggccaacuggagcaaagcaucgccucuuacaaagaggaauacgcgcaguuaaucgcccaagcucaggccaucaaaaccgauuuggagaacguccaagccaaagucgacagaucgauagcccuucucaaaucgcuuguuaucgaaagggaacgaugggaggccagcagcgagacguucaggucgcaaaugucuacuaucaucggagacguucuauuaucagccgcauucaucgcguacggaggauacuucgaccaacauuaccgucagaaucucuucagcacuuggucucaacauuuaacccuagcuaacauccaauacagagcugauaucgcuagaaccgaauacuuaucgaaccccgacgagagacucagauggcaagccaacgcgcugccuucggacgauuuaugcacagaaaacgccaucauguuaaagagauucaacagauacccgcucauuaucgacccuucgggucaagcaacugaauuuauaaugaacgaauucaaggacaagaagaucaccaagacuagcuucuuggacgauuccuucaggaagaaccuagaaucagcccuacguuucggcaacccccuucuuguccaagacgucgaaaacuacgacgccauauugaaccccgugcucaacagggaacugagaagaaccggaggacguguguuaauaacacucggugaucaagacaucgauuuaucgccuucguucgugauauucuuaucuaccagagaccccacggucgaauuuccuccggacauuugcucgagagucacuuucgucaacuucacggugaccaggagcucguugcagagccaaugcuugaaucaagugcucaaagccgagcgucccgacaucgacgccaagcgaucggaucugcugaagcugcaaggcgaguuucaccucagauugcggcagcucgagaagucgcuuuugcaagcucucaacgacgcuaaaggaaaaauucucgacgacgauagcgucauuacgacguuggaaacgcugaaacaggaagccgccgagaucgggcagaaagucgaggagacugauaagguuauuucggagaucgagacgguuucucagcaauacuugcccuuaucgcaggcgugcaguaauacuuacuuuacuauggauaguuugaaucaaguacauuuccucuaucaguacuccuugaagauguuuuuggauguauuugcuacuguguugcauaauaacgugaaguuagauggaaucaccgauuaucaaucuagguugaacgucaucaccaguaauuuguuuucgguuguuuaugagcgaguagcuagaggaaugcuucacaacgaucgcaugacguucgccauucuacuaugcagaauccaccugaaagggcgaccaacggaacccaaucuagaccaagaguucaacuucuuccucagaggcaaagagggugucuuuagcaaccccaauucggccaucgucgacgguuugaacagcgaucagcaggaagccaucacgagacucucgaccaaacuacccgccuucaaaaaacuaccggaacaaaucaaagacaugccggaguucggagcguggcugcaacaaagcagucccgagcaggccgugccgcagcuguggaucgaagagaagcagcucagcgccgucggcaggggcauguaccagaugcuagugauccaggccuucaggccggaucgcgugauagccgcggcgcagaacuucguugccgccgugcuaggcgcggacuuuauguaccuggccgagaaggaaauggacuuugcgacuugcgucgaaaaggagaucaggucgaacgugccggcgcuguugugcuccgugcccgguuucgacgcuuccagucgcgucgacgaucuggcugccgagcucaacaagcagauauccagcauugccaucgguuccgccgaagguuucaaccaggcugauagggcuauuaacauggcuugcaaaacuggaagaugggucaugcuuaaaaacguucaucuggcgccucaauggcucguacaacucgaaaagaaacuucacucccuucaaccacacgcccaguucagacuguuccucaccauggagauuaauccuaagcuaccggucaauuuacugagagccggaaggauauucguauucgaacccccgccggguaucagagcuaauuuauugagaacauucagcacuguuccugcaagcagaaugaugaaagcgccaaacgaaagagccagauuguacuuccuauuagcuugguuccacgccaucgugcaagaaagacugcgguacuguccauuagguugggccaaauauuacgaauuuagcgaaucggauuugcgcguugcuugcgauacuuuagauacguggauugacgcaacagcgaugggaagaaccaauuugccaccagagaaaguaccgugggacgcgcucgucacgcuccucucucaauccaucuauggcgguaaaauagacaacgauuucgaucagagacucuugcauuccuuccuaaacaaauuauuuacgccuaaaagcuucgacagcgauuucgcuuugguagcgaacauagacaacggacccggaggcaaucgucacauaaccaugccggacgguacucgaagggaucauuucuugaaauggaucgaaagucucgccgacaggcaaacaccggcuugguugggauuaccuaauaacgcagaaaagguacuuuuaaccacaagggguaccgaccucauagcgaaacugcucaaaaugcagcaauuggaagacgacgaugaauuggccuacucucucgacgauagcucgccguccgauccggccgcucaaaucgacgggcguccgucguggaugaaaacccuacacaacagcgccgcuaccugggucaauuuguugcccacgucguugcagacucucagaaggacggucgauaacaucaaagauccuuuguacagauauuucgaaagggaggucaauucugcuucuaaauugcuuauggauguuuugcacgaucuucacgauguacuuuuaaucugucaaggagaaaagaaacaaacuaacuaccaucguacgauguugucugaauuagucagaggaauuauuccgaagaacuggcaucgguacacaauacccaaagguuguacgguuaugcaauggaucaccgacuuuagucagcguguuaagcaauugcaaaaagugucgcaaguggucucauccgcaggugcuaaagaauuacagaguuuuccgguuugguugggaggacuucugaauccggaagcuuacauaacagcaacgagacagugugucgcacaagcuaauagcuggccucucgaagaacuccacuuagauguuacuauuacggauuccaaugauaaaaauuccauuccucaugauuguuucgccguuguuggaaucaaauugcaaggagcccaaugcagaaacaaccaacuccugcucaccucgagcaucaugaucgaacuucccaucacgcucuuccguugggugaggguaacgggggaugaaaaacuaaaggaagggaaauuaucuuuaccgcuuuauuugaauucaacuagaaccgagcuuuuauacacaaucgaacuuaauauugcagcagggcaagacccucacagcuucuaugaacgugguguagcuguuuuaacuucuacuucuuuaaacuaa

SEQ ID NO: 5913 - RNA, 2673 nt, Phyllotreta armoraciae
augagucgucagggccccagcaaacguuacgaaucggacucggauuccgauagcguggacagcgcugaggaggcccgaaggcgcgacuugcaggaacgggacgaguucgccaaucggcucaaaaagcgcgaugaagaccguacgagaaacgucgugcagaauuucgacaagaagaccuacgaggaggcggcgaagcgccugaaguuagacaacgccggcagggacaaggugauaucggagcuucgcaaaaccucgagauuuaaguacuuggagaagaggaaggacgacaaauugcaggaguuggaggcugauaucgucgacgaugaguacuuguucgaggaggaaauauuaacggagagggaaaagaaggaacgccagcauaaaaaggaauuauugcaacuagcccaggaacaugaaaaggcacgggaacucgaacgaauacaacgcuaucacaugccgagggacuuggguaaggacucgacggcagauuacaucgaaguggacgagcucgagaaaguaccgcaauccgaacagaagaaaugggaaaaagaccaaauggccucagcugucuucaaauuuggugcuaaagaugucaagaaaaccgacgauuacgaacuguuacuggaagaucaaaucgauuucauacaagcucugcaaaugccgggauccaccgagaagaaagucucgcaacuauccgauguacaaaagaagaaacuaaccaucgaggaaacaaagaaaagccugccgauuuauccauucaaagaugauuuaauacaagccguuaaagaguaccaaguguugauuauaaaaggugaaaccgguucgggaaaaaccacgcaaauaccccaguaucuccacgaagcugguuucacagcugacgguaagaaaaucgguuguacacagccucggagagucgcugccaugucgguagcagccagaguagcccaagaaauggacguaaagcuaggcaacgaagucgguuacgcuaucagauucgaagauugcacuuccgaaagaaccauuauaaaauacaugacugacgguacguuacacagagaauuucuaucagaaccagaccugcaaucguacagcgugaugauuauagacgaagcucacgaaagaacccuucacacugauauauuguucggacuagugaaagacauagccagguucagaccggauuuaaaacuguuaauauccagugcuacuuuggauguuaccaaguuuucugaguucuucgacgacgcgccgguguaccaaaucccaggccggagauuccccguggauauuuacuauacgaaagccccggaggcagauuacguagacgccugcguuguuuccauacugcaaauucacgugacucaaccguugggcgacauuuugguguuccuuacuggucaagacgaaaucgaaaccugucacgaacuccugcaggaucgagugagacgcuugggguccaaagucaaagaacugauuauacuuccuuuauacgccaaccuucccagugaucugcaagcuaagauauucgaaccgacuccaccgggagcgaggaaggucauucuggcgacaaacauugcggagacuucgcuaacaaucgacaacauuaucuacguuaucgauccggguuuugccaagcagaaucacuucaauuccaggaccggcauggagaguuugauggucgugcccauaucuaaggcuucagcuaaccagcgagcagggagagcugggagaguagcggccgguaaaugcuuuaggcuguacacugccugguccuauaagcacgaacuggaagaaucuacuguucccgagauacagaggaucaauuuggggaaugccguguugauguugaaggcguugggaauuaacgauuuggugcauuucgauuuucuggauccaccuccacacgaaaccuuaguguuggcuuuggaacaguuguaugcuuuaggagcuuugaaucaucacggagaauuaacuaaauugggaagaagaauggcugaauuaccgguagauccgaugauggcuaaaaugauauuggcaucugagaaauacaaguguucagaagaaauuguuacgauaggugcaauguugucgguaaacggggccauauuuuacaggccgaaagauaagauuauccacgcggauacggcuaggaagaauuucaaucacuuggcuggcgaucacuugagccuucugaacguuuauaaucaauggagagacuccgauuacucguugcagugguguuacgaaaauuucauucaacacagaucgaugaaacgagccagagacgucagagagcaacuagucaacuuaaugaccagaguagaaaucgaaauaguaucgggaaucgacgaaaccgauaacguucgcaaagcuauuacagccgguuauuucuaucacauagccagguuuucgaaagguggaaguuacaagacagugaagcauaaucaaagcgugacuauacacccgaacagcgcuuuguucgaaacgcuaccgcgguggcuguuauaccacgaauuaguguuuacgacuaaagaguucaugaggcaagucaucgaaaucgagagcaaguggcuguuggaaguggcuccucauuacuacaaggccaaggaauuggaagauucaacuaauaaaaaaaugcccaaaaccaucggaagaaguaaaaugacugauuaa

SEQ ID NO: 5914 - RNA, 1371 nt, Phyllotreta armoraciae
augaagguagaagaggugaaaagcaccgugaaaacucaaagaauaagcgcccauacucacauaaagggcuuggguuuagaugaagcggguuuugcaaucccuucggcagccggccuggucggucaggagcaggcaagagaggcugcgggagucgucguggacaugauaaggaguaagaaaauggcuggaagggcuguccuucuagcuggcccuccagguaccgguaaaacagccauugcucuagcaauugcccaagaacugggcaacaaaguuccauuuugccccauggucggcucggaagucuacagcucagagauaaagaaaaccgaagugcucauggaaaauuuuagacgagccauuggccuuagaauuagagaaacgaaggaagucuacgaaggagaaguuagcgaacuaacacccgucgaaacagaaaacccagcaggagguuacgguaaaacuguuagucacguuguaaucgguuugcgaacagccaagggcagcaagcaauugaaacuugaccccaguauuuacgaagcccugcaaaaagaaaaaguggaagugggagaugucauuuacaucgaagccaccaguggggcuguuaaaagacaaggaagaucugaugcuuacgcuacagaauucgauuuggaagccgaagaauaugugccgcuuccuaagggagaugugcacaagaagaaggaaguuguacaggauguuacuuuacacgauuuggacgcugcuaaugcaaaaccacaggguggucaagacguguuguccaugauggggcaacuguuaaaaccaaagaaaacugaaauuacagacaaacucagaaaagaaauaaacaaaaucguugacaaauacauugaucaaggcauugcggaauugguaccaggaguauuauucauugacgaaguucauauguuggauauagaaacguucacuuaucuccauagagcuuuggaaagcgcuauagccccuauuguuauuuuugcuacuaauagaggucguugucucauuagaggaaccgaugauguauuuucuccacauggaauuccauuagaucuucuagauagacugcugauuauacgcaaaauuccuuacaacaaauccgaaauggagcaaauuauuaaauugcgagcuguuacagaagguuuggaaauugagcaggaagcaaucucgaguuugggagaagucgggacaaaagccacccugagauaugcaguucagcuuuuaacgccgucguuuuuaacugcuaaaauuaacggaagggguaacauucucaaaagcgacguggaggagauugguacucuauuccucgaugccaaaucuucggcuaaaauacuuaccgagcacaaagauaaauuuaugacguaa

SEQ ID NO: 5915 - RNA, 2256 nt, Phyllotreta armoraciae
augacuucaauaauaaaaguacaagccuuauccggcgccaaagacgaaucucccccuuguuaccuauuacaaguugacgacguuagaauucuuuuagauugcgguugggaugaaaaauuugauauggaauucauuaaagagcucaagaggcacguacauaccauagaugcgguguuaauuucuuacccagauaacuaucauuugggagcucuaccuuacgcuguagguaaauuaggcuuaaauuguccaauauacgccacuauaccuguauacaaaaugggccagauguucauguacgaucuuuaccagucccaguacaauaugaaagaauuuuguauauuuucucuugaugauguugaugccacuuuugaaaagguuguucaauugaaauauaaccaaacaguuccuuuaaaagguaaaggauauggcauaacuguaacaccuuugccagccggucauaugaucggaggaaccauauggaagauaaugaaaguaggcgaagaagauauuguguauugcaacgauuuuaaccauaaaaaagaaaggcauuugaacgguugugaacugaagaaacuucaaaggccaucguuacucauaacagacgcauuuaaugccacauaucaacaggcuagacgaagggcgagagaugaaaaauuaaugacaaauauucugcagacucuacgaaaccacgggaacguccuuauagccguagacacagcugguagaguacuggaauuagcucacauguuggaucaacuguggagaaacaaggaauccggacuuuuggcuuauucucuggcuuuuuugaacaacgucaguuauaauguugucgaauuugcuaaaucucaaauagaauggaugagcgauaaucuaaugagaaguuucgaaggagcaagaaacaaucccuuccaguucaaauauuugcagcuaugccacaguuuaggggaguugagcaaagugcccaguccgaaggugguacuggcuaguucgccugauuuggagagcggauuuuccagggaacuguuuuuacagugguguucuaauccaaauaacaguauuauauuaacuacaaggaccucgccugggacuuuagccagggauuuaauugacaacggaggaggaagaaacauagacuugauaguagagcgaaggguuaaauuagaaggacaagagcuugaugauuaugaaagucgucaacggucuaaauaugacaaauuagaagaugaggaagccgauuccgauucagauuccgauauugaaauguuagucacaacuaaaggcaaacaugacauuguuaucaaacaagaaggcaaaauauccacaggauuuuuuaaagugacaaaaaaaauguacccgauguauccuuucaaggaagauaaaauaaaauccgaugaauauggcgaaauaauaaaagcagaagauuacaaacuagcugaaauuucagccgaagccgaagauaauaaagaaaacauagugauuaaaaaagaggaagaggaaauaaguaaauauuauucauuuauaaacgaucuaauaguuacgcaugaaucauuuuuagcugaaauuaccgagcaaccgaccaaauguauaauucuucaaagaaccguucaagugaguugucaaguucaguacaucgauuucgaagguagaucagacggagaaucguugaugaagauuuuaacgcaauugaaaccgagaagagugaucguagugcaugggacugaagaaaacacaucuguuauagaaaaacacugcuuggauaauuuagaagcuaggguuuucacuccauccagaggcgaaauaaucgaugcuaccagugaaaaucacauuuaucaggugaggcugacggacgcuuugguuucacaauugaguuuucagaaagccaaagaagcugaaguugcuuggcuuggggcucagauuguacucagggaaagccaagcugacgcuaaaaggaugaauuuggauaaugaggaaauggaaguggaagaagaggauacgagaauccugacgcuugaaccauugccggaagguauuccacacgauccuguuuucauaaaugaaguuaaacuugccgaauucaagcaaguuuuagggagaaauaauauaaauucugaauuuuccggcggcacuuugugguguuccaacggcucuuuagcagugagaaagguugauaacggcaaaaucauguuggaagguugcauauccgaagauuauuauaagguuaaagaauuguuguacgaacaguacgcuauuuuauag

SEQ ID NO: 5916 - RNA, 2283 nt, Phyllotreta armoraciae
augccuccuuuggagguaacagcaaauaccaacaacgaagaaucggcuccaauuaauccagucgugggcauaauuuacccuccaccagagguuagaaauaucgucgacaaaaccgccaguuucgucgcgagaaauggccccgaauucgaagcccguaucagacaaaacgagcucggcaaucccaaauucaauuuccucaacggcggcgaucccuaucacgccuauuaccagcacaaaguuaaggauuucagggaaggaaaaggacaagaaccuaauccggguuugagccaagccguagccaaauuauccgugagcgcuucggcgcagcaaaagcaacaagagauauugaagcaagucgagcagccuuucguuccgaaagauccuccggcugaguucgaauuuauugcggauccuccuucgauuucugcuuuagauuuggauaucgugaagcuuacugcucaguuuguggcgagaaacggucgggcuuuucuaacgcaauugaugaauagggagcagaggaauuuucaauucgauuuuuugaggccucagcauucgcuuuuccaguauuuuaccaagcuuuuggaacaguacacgaaggugcuuauaccuccgaagagcauggagcagaggcucagagacgaggcgaaaagcgccaaagccgugcuugagcaagucaaguacagggccgaaugguugcgguaucaagaacagcaaaaggccaaagaggaggaaauacucgaaagagaaaggguggcuuacgcgcaaauagauuggcacgauuucgugguagucgaaacaguagauuaucaaccguucgaaauagguaauuucccuccuccgacuacgcccgaagaagugggagcaagaauauugauacaggagaggaucgaagaaggcgaagauaucgaaaugcaauuggaaagcgacgaagacgaagauccuucaaacgcggaugacgguuugagcuccaugcaggauaaaacuaaacgcaaaggaggcgacgauaaucgccuacaagacauggaagaagauacuucugaugaagauaacgaugaugaaacugguaaaacuucgaguucgucuucgcucauucaaccgccuuugccgcccauacccgauaaagugcucguuaaaaaauacgauccuaaacaagcugucaaaguguccagaccgacaguaggcgacgauuaucuaguaucaccaaucacaggcgagaagauaccggccagcaaaguacaagagcacaugcgcauaggccucuuggacccaagaugggucgaacaacgugacaaacaaauguccgauaagaugaaucaagacacgguauaugcugcaggaagcgccaucgacgcuucguugaaauuacuagccgaaagacguacggacauuuuuggugugggagacgaagaaacggcaauugguaagaaaauaggcgaagaggacgugagaaaagacgaaaaagugacgugggacggucacaccagcagcguggaggcggcgacgagggcggcucgcgccaauaucaccuuagaagagcaaauacaucagauacauaagguaaaaggucuucuaccugacgaggagaaggagaagaucgguccgaagaauauugguucgaagaaaauuaacauacaaaguguuauuacuaccaaaccgccuaauccgucuucacagcaacccaaacaacagguuucuaugauucaaacgggcgcacagccaaucaugccgguuccaacgcaaccuacgaugcucgcgccccaaccgucuauuaugaugaugcccgccccuccuaugccuaacauucguccgccuccuuugaugaugcccggcgguguggcuaugggcgguuauucgguggguccgaugcccggcccgccgggucccggcaugaauauggcccccaugaaacaucccagcgacggucccagcgaagaagaaccgaccaauaagaaauugagaaacgaggauucuuuggugccagaaaacguguuucuauccagaaauccaagccaagugucuauaaagauuuccauuccgguuaugccggagaaauccgaauggagguuaaagggccaaaugguauccuggacauuggcgcucacagaaucaguuucgaauuugaaagccaaaauacaggaggaaaccaacaugccgccggccaaacagaaauuauuuuuugacggaauguucuucaaagauucaaacacuuuagccuacuacaauguaacccaaggagcugucauucaacuacaaaucaaagaaagagguggaaggaagaaauaa

SEQ ID NO: 5917 - RNA, 975 nt, Phyllotreta armoraciae
augccgaguacagagguuacaacgacuaagguaauagugcacccgcuggugcuucucagcguaguggaccauuucaaucgaauggggaaaaucggcaaucaaaagcgcguugucgguguucuacucgguugcuggagggcuaaaggagucuuagauguguccaacaguuuugcagucccuuucgaugaggacgacaaagauaaaucuguaugguuuuuggaccacgacuacuuggaaaacauguacggcauguuuaagaaagucaaugcuagagaacgcgucguugguugguaccacacgggcccuaaauuacaccagaaugauaucgcuauuaacgaauuaauucgaagauacugucccaauuccgugcuggugauuauagaugcgaaaccuaaagauuuggggcuuccuaccgaagcuuaccaagcgguagaagaaguccacgaugauggcucucccacgucaaaaacauuugaacaugucccgagcgaaauaggcgcagaagaagcugaagaagucggaguggaacauuuacugagagauaucaaagacacuacagugggaacuuugucucagaggaucacuaaucaguuauuaggccuuaaaggguugcauuugcaauugagagauauuagagacuauuugaugcaagugugcgauaacaaacugcccaucaaucaucagaucaucuaucaauugcaagauauuuucaauuuguugcccgauauaaaccaagaugcauucaacaauucguuuuauguuaaaaauaacgaucaaaugcuaguaguuuauuuagcugcucucguucgaucuaucguugcacugcacaaccuaaucaacaacaagcucaccaacagagacgcagaagaagguaaaaaggaagagaaaaaggacaaggauaaagagaacaaagacaaagauaaggaaaaaacggauaaagacaaggagacgaagaaggacgagaagaaaaaauaa

SEQ ID NO: 5918 - RNA, 1653 nt, Phyllotreta armoraciae
auguuuggaggaggacgcgcccccaucuuaguguugagccagaauacaaagcgcgagucgggccgaaaaguucaguuggagaacaucaaugccggcaagcaaaucgcagaugucauuagaacaugucucgguccacaagccauguugaaaauguugauggaccccauggggggcaucgucaugaccaacgacgguaacgccauucugcgagagaucacugugcagcauccugcugcuaaaaguaugauagaaauagccagaacccaagacgaagaggugggagauggaaccacuucuguaauaguauuagcuggagaaauguuggccgcugcugagcaguuccucgaacagcaaauccacccuacgaucaucauucgacaauacaggcaggcccucgaagauauggugcaguuccuggaaggaccuuuaagcgugcccuuagaucgaaacgacaaaaacgccguagccgaagugguuaaagguugcauaggaacgaaauucuugagcaaauggucggauuuggccguaaauaucgcuuuagaugcggugaauaccguccuauuagaagagaauggucgaacggagguggauaucaagagauaugccaaagucgaaaagauuccuggugguucuguggaggaauccaaaauuuugagaggcguaauguugaacaaagacguuacccauccuaaaaugaagcgacacauuaagaauccgagaaucauccuuuuggauugcgcuuuggaauacaagaaaggagaaucucaaaccaacguugaaauuaguaccgaaacugauuuuaccaaacuucuugaauuggaagaagaucaugugaaacgccaaugcgacgagauuaucgcccucaagccggacguaguguucacagaaaagggaguauccgauauagcccagcauuuccugcucaaggccggcaucacugccaucaggcgugucagaaagucugacaacaaccgaaucgcuagagcuuguggagccgucauuguaaacagaaccgaggaacuccaggaguccgacgugggcaccggagcugguguauuugaaaucaaaaaaaucggcgacgaguacuucuguuuugucgacgaaugcaaagauccaaaggccuguacaauccuccuccgaggagccagcaaggauauucugaacgaaaucgagaggaaucugcaagacgccuuacaagucgcuaggaacauuauauugucuccgcguuuagugcccggcgguggggcuaucgaaauggccguugcccaacgauugaugcagaaggcaacacacggccccuacagggcgcuugcucacgcuuuggaaaucauuccgaggacuuuagcgcaaaauugcggugcuaauaccaucagaacguugacggcccugagggcuaagcacgccaaccacacugaaaccgacaaacccugcacuugggguaucgacggugagacuggggaauugguugauaugaaagucaaaggcuugugggagcccuuaucuguuaaacuccagacuuacaagacagccguugagaccgccauucuccuuuuacguaucgacgauauuguaucgggauccaaaaagaagggcgacaaggaggucccaacgcccagccagaugcaacagcaggaagccaaagagacggauuaa

SEQ ID NO: 5919 - RNA, 702 nt, Phyllotreta armoraciae
augaugcaaacaggaauacgucccuauuauccagacuauucuacaguucccguugaacgccagauuaauccguacgcugacaauggaggaagugucguagcaauugcaggaaaagauuucgugguuauuggugcagauacucgucuuaguuccggcuuuuccauuuacacuagaaaccaaaacaagcuguuuccucuuuccgaaacgacuguuuuaggauguucagguuguuggugcgauacuuuaacguugacucguauuuuaaagucucguaugcaaauguaccaucaagagcauaacaagaacaugucuacaacagcggcugcucaaauguugucgaccauguuguacuacaagcgauuuuucccuuauuacauaucgaacauucucguuggauuagauaaugagggaaaagguugcgucuacagcuacgaucccguugggcauugugaaaaagccacauacagagcaggugguucugcgggggcuuugcuucagccuuuguuggacaaucaaauugggcaaaaaaaucugcagaagccuucgcaagaagaucuuacucaggaaaaggccauuucuacacugaaagauguuuucauauccgcugcagaaagggauauuuacacuggugauaguguacuuauuaaaaucauaacuaaagaugggacuaaagaggaaacauuugauuugaggaaagauuga

SEQ ID NO: 5920 - RNA, 900 nt, Phyllotreta armoraciae
auguuccaauuugguuucaacauguucccggacaucccgagacccuucaacaugaccuacaaaugcuacucaguggccauguucccggggaacgaaagacaggacgucgaacguggaggaaaaauaaucaugccaccuucagcacuggaacagcucacucgauuaaacaucaacuaccccauguuauuuaaacuaguuaauaagaagacgagccgcacgacucauugcggcguguuggaguucguagcggacgaaggaaaagucuaccuuccauuauggaugaugcacaauuuaguacuauccgaaggcgauuugguucaaauggaaagcgucucgcugccggugggcacuuucucgaaauuccaaccguugaauccggauuuccucgacauaaccaauccgaaagccgugcuggagaauugccugcggucuuucgcuugucugaccaccggcgaugucauagcggugagguauaaucaaaaggcguacgaauugugcguguuggaaaccaaaccgggaaacgccaucagcauaaucgaaugcgacaugaacguugaauucgccgcuccgguuggcuacaaggagcccgaacaugcgaaaaaagaagaagaaaugucgguggaucccgcugauuugaugcccgaaccgucgggauucgucgcauuucggggggccgguaaccgauuggacgggaaaaaacgcaaggauucuuccuccagcgaugcuccuucguccaaaccggccuacguccggggaauucccgauuacgauuaucaaauaggcacgcuggacuucaucaggcguacgguggugaagccgaaggaaaaggagagcagcgaugacgcggaugauuucaaggcuuuuagcggcacuggguucaguuugaggaguaggaauuag

SEQ ID NO: 5921 - RNA, 1623 nt, Phyllotreta armoraciae
augucggccuuaccaggagcuaucgcuuucgaugaauauggaagaccuuuuauaauuuuaagggaccaagacaggcaaaaacgauugaccggaaucgaugcccugaagucgcacauuuuagccgcgagccaaauugcccacacuguucgcaccucuuuggggcccaaaggccuagacaagaugaugguauccucugauggagaaguuacuguaacgaaugauggggcuacuauuuugaagaugauggauguugaacaugaaguagcuaaauuguuaguucaacuaucucaaucccaggaugaugaaauaggggacggaacuaccgguguaguaguauuagcaggggcucuucuggaacaagcuggcgcucuucuggaccgcggaauccauccgauaagaauagccgaugguuucgaauuggcaugccaaacagcuguggaucaucuagagaaaaucgccgaacuguuuccaguguccgcugaaaacaccgagccccuuauuaaagucgcgaugacuacauuagguucgaagauaauuaacaaaugucacaggcaaauggccgaaaucgccguaaauggcguguuagcaguagcugaucucgaacaaaaggaugucaacuuugaacucauuaaaguagaaggaaagguuggagggaaauuggaagacaccacauuagugaaaggugucguuauagauaaaacaaugucucauccucaaaugccgaaggagcuaaagaauguuaaauuggccauccucaccugcccguuugaaccccccaaacccaagaccaagcauaaguuggaugucaccagcguagaagacuacaaagaacuaagauuguacgagcaagagaaauucaaggaaauuguuggcuugguaaaaaaagcaggagcuaccuuggcuauuugccaauggggauucgacgaugaagccaaccauuugcuguugcagcaggaguuaccugcuauuagauggguuggagguccugagauagagcuaauagccauugcgaccggaggaagaauaguuccaagauucgaggaacuuagcccugaaaaacuagguucugcugguuugguucgcgagauaucauucggaacuaccaaagauaagaugauggugauugaagaaugcucaaauucucgggcgauuaccauucuuguuagaggcgguaaucaaauguugauugaugaagcuaagaggaguuuacacgaugcuuuguguguugugaggagucucauucaggaaccaagagucguguauggaggaggugcagcugaaauagcuugcaguuuagcuguggcagcucaagccgaucagcuagcuucuuuagaacaguaugcuuaucgggcauuugccgaagcguuggaaagcauuccgcuggcucuggcugagaauucagguuuuucugccauucauacuuugggagaaaucaaggcaaaacaagcugcuucgggagauccggcacuuggcgucgauugcaugaauaucggcaacauaaacaugagagaacagcauguuacagaaucucugcgaucuaaaaggcaacaauuguuauuggcuacucaguuagugaaaaugauucucaaaauugacgauguacgucagcccggcuccggcuaa

SEQ ID NO: 5922 - RNA, 342 nt, Phyllotreta armoraciae
auggccacugcuauggacgucgauuccgaagaaauugaauuaccaacuucaagcaguucgaaaggcgagaaaaaacgauuugaagugaaaaaguggaaugcuguagcacuuugggcuugggauauuguuguugauaacugugcuauaugccgaaaccacauaauggacuugugcaucgagugccaggcaaaucaggccucugcaacuagugaagaaugcacuguagcuuggggaguaugcaaccacgcuuuucacuuucacuguauuucaagaugguuaaaaacuaggcagguaugcccuuuggacaauagagaaugggaauuccaaaaauauggucacuag

SEQ ID NO: 5923 - RNA, 1605 nt, Phyllotreta armoraciae
auggugucauuaaacccggugaggauucucaaacaagaggccgaggaugaacggggcgaaauagcgcguuugagcagcuucgucggcgcaauugccauuggagauuuggucagaaguaccuuggggcccaaagguauggacaaaauuuuaguaucgagcgguagaaacaccggaaugguagaagucacaaacgauggagcuacuauacuaaaauccgugggugucgauaacccggcugcgaaaauacucguuaacaugucgaaaguacaagaugacgaaguaggcgauggcaccacaucaguaacaguauuugcgucagaauuauugaaagaagccgaacguuugaucgagcaaaagauacauccgcagaccaucauagcugguuggagaaaauccguagauaucgccagaaaagcgcuuuuggacgcuuccaacgacaacagcgccgauuuagcagcguuccgagaagaucugaugaacaucgcucgaaccaccuugagcucgaaaauucuaucgcaacacaaagagcauuucgcgaagcucgccgucgacgcggugcugagauuaaagggguccggcgacuuacaagccauccaauugaucaaaaaaaccggcgggacccugcaggaauccuuccucgacgaagguuuucugcucgacaagagacccggcgugcaccagcccaagcgagucgagaacgccaaaauccugaucgccaacacuccgauggacaccgauaaaaucaaaguguuuggcucgcacaucaaagucgauucgauggccaaaaucgccgagcuggaaucggccgaaaaggauaaaaugaaagacaaggucaacaaaauccucaagcacaacgccaacgucuucaucaaccggcaacucauuuacaacuaucccgaacaguuguucgccgacgccggagugauggccauugagcacgccgauuucgaugguaucgaaagacuggcgcuggucaccggaggagaaauagucucaacuuucgaucaccccgagcuggugaaacuugguacuugcgaccucaucgagcaagugaugauaggagaagacacucuccugcguuucagcgguguggccuuaggagaagcuugcacgauagucauccgaggagccacccagcagaucauagaugaagcugaucgaucccugcacgaugcccuuugcguguuagccgcaacuguaaaagagagcaggaucguguucggaggcgguugcagcgagacuuuaauggcuacugcuguggcuagagcgucuguuaacacagcugguaaggaggcgcucgccauggaugccuucgccagagcucugcuccagcuaccgaccaucaucgcugauaaugccgguuacgauucggcucaguuaauuagcgaacugaaagcagcccacaacagcgggcuuaauacaauggguuugaacauggagaagggcgaagugggcgauaugcgugcguugggcaucaccgaaucguucguuguuaaacgacagguguugauaucggccggugaggcugccgaaaugauucuucguguugauaauaucaucaaagcggcgcccagaaagcggaccgaagacagaggaauguguuaa

SEQ ID NO: 5924 - RNA, 846 nt, Phyllotreta armoraciae
augaaaauguucagaaaucaauacgacagcgacguaacaguauggaguccacaaggacgucuucaucaagucgaauaugcaauggaagcgguuaaucuugguucggcaacaguaggacuaaaaagcaacagucaugcuguuagaauagcauugaaaagagcuucaucugaauuaucugcuuaccaaaagaagauaauucaaaucgaugaucacauuggcauuacuauaucuggucuuacagcugaugcaagaauuuuaagcagauauaugagaaacgaauguuugaauuacaaguacuccuuagacgcuuacaugccuuugaauagauuaauuaauauuuuagguaucaaaaugcagcauuguacgcaaagauacgaucguagaccguuugguguaggucucuugcuagccgguuacgaugacaacggcgcccauauuuaccaaacauguacgucugcuaauuucuacaauugcaaggccaugucgaucggagcucgaucucaaagcgcuagaacuuauuuggaaaagaaacucgacgaguuaccuucgaguucuuuagaagauuugaucaaacacgguuugagagcucucagagauacucuuccaccggaagucgauuugaauacgaagaacgucuccauaggauacgucgguaaagggauuaccuuuaaaauuuuggaagaagaagaaacugcuccuuaucuugcuuuaaucgagggugaagaacgucguggaggugguggaggaggagguaguucggaaggacaagcugauccuuugagagaaucgggggacgauggucccaaagaucccacaccaacuguagcaacggauaccacagaauaa

SEQ ID NO: 5925 - RNA, 2553 nt, Phyllotreta armoraciae
augguuuuaaagccaggaaguaaacaggaaccuauggaaauuacuuucaacgacgaugauuugccuuaugaagaagaaauuuuacgaaaucccuucucggucaaacacuggcuucgauauauagaucacaagaaaacggcuccuuauaacgaaaugaacauaaucuuugaaagggcccucaaggaauuaccggguucauauaaauugugguacaauuauuuacggaccagaagaaaucaaauuaaaagcaaaugcaucacugauccgaguuuugaagagguaaauaacgccuuugagcguucguugguauucaugcacaagaugccucgaauuuggauggauuauugcacguuccucacugaccaauauaaaauaacgagaacccgaaagguguucgacagggcucuucgagccuuaccuguaacucagcauaacaggauauggccuuuguauuugaaauucgugcagaaacaugauauaucagaaacggcuguucgaguuuucagaagguauaugaaauuaugucccgaaaacgcugaagaauacaucgauuacuuaacgaaaguggaaagauuggaugaagcugcuauaauuacagcuaaaauaguaaacgaugauaauuuugugucucaacaaggcaaaucaaagcaucaacuuuggaacgaauugugcgaguugauuucgaaaaaucccgaaaaaguucgcucuuuaaacguugacgccaucaucagaggcggcuugcgaagauacacugaccaauuaggccacuuguggaacuccuuagccaauuauuacguucgcagcggcuuauuugaacgggcuagagauauauacgaagaggccauucaaaccguuacgaccgucagagauuucacgcaaguauucgacgcuuaugcgcaauucgaggaauuaagucugagcaaaagaauggaagaaguggcagccaagcagaaucccagcgaagaugaugauacggaauuagaauugcgauuagcgcgauuugaauaccucauggaaagacgguuguugcucuuaaauucaguauuauugcgacaaaauccgcauaaugugcaagaguggcacaaaagagugcaacucuaugaagguaaaccucaugaaauuaucaacacguacacugaagccgugcaaacuguggauccgaaauuggccgugggcaaguugcacacgcucuggguggaauuugccaaguucuacgaaaguaaugaucaaaucgaagaggcccggcugauauucgagaaagccucgcagguccccuacguaaaaguugacgaucuggcuacaguauggugcgaauggacagaaauggaaauccgcaacgaaaauuacgaugaagcuuugaaacucaugcaaaaggcgaccguaaugccuagccguaaaguggccuaucaugaugacacugaaacuguucaaaguagacuguacaagucccuuaaaguguggucgauguacgcggauuuagaagaaaguuucggcagcuucaaauccugcaaggccauuuacgacagaaucauugaacuaaaaaucgcuacgccgcaaauaaucauuaauuacggcguguuucuggaagaaaacaauuauuucgaagaagcuuucagggcuuacgagaagggcauuucccuauucaaauggcccaacguauacgacauauggaacaccuauuuaaccaaguuuuugaaacguuacgguggcaguaaauuggaacgagcgcgugaucuauucgagcagugcuuggacgguugucccucgcaauucgccaaacaucucuauuuauuauacgcuaaguuggaagaggagcacggaauggccaggcaugcaauggccguguacgaaagggccacuaaagccguaccggaaaacgagauguucgacauuuuuaacauauacauaaaaagagccgcugaaauauauggcauaccgaaaacgaggcaaaucuacgagaaggccauugaaguccuuccggaggauaaaaccagggaaaugugcuugagauucgccgacauggaaacgaaauuaggugaaaucgaucgagccagggccauuuacgcgcauugcagccaaaucugcgauccccgagucacggccgaguucuggcaaauuuggaaggaguucgaaguucgacacgguaacgaggacacgaugagggaaauguugaggauuaaacgcagcguucaggcgguguacaacacucaggugaauaugaugucagcucagauguugagcucggcgggcagcucgagcggcaccauagcagacuuagcgccugggguuaaagacggaaugaggcuuuuggaggcaaaagcggccgagauggcgggcucggcggcggcgcagaaauccaacauaauguucguuagaggggaaacucaaggggacaauaaagacaaaguggucaaucccgaugaaauugacauaggaagcgaagaugacgaagaagaggaagaggaggagauuccguuggagaagcaaaacgugccguccgaaguguucggaagccucaagaaaaaagggcacgaugaagaugaggaugauuaa

SEQ ID NO: 5926 - RNA, 1110 nt, Phyllotreta armoraciae
auggcaaacggaccgauagcugaaagaaauagagaugcuacuauauacgucggugguuuagacgauaaaguaucagaaucccugcuaugggaacucuucguacaagcagggccguuggugaauguacacaugcccaaagaucgcgucaccaugaugcaccagggcuacgguuuugucgaauucaugggcgaagaggacgccgauuacgcuauaaagauaaugaauaugauaaaauuguaugggaaaccuauaagagucaacaaagcuucugcucaucaaaagaauuuggacguaggagcgaacauuuucauagggaacuuggacccggaggucgacgagaaacucuuguacgauaccuuuucggccuucgguguaauauuacaaacgcccaagauaaugagagauccugagacuggaaauuccaaaggcuuugcguuuauaaacuuugccagcuucgaagcuuccgacgcuuccaucgaggccaugaacggccaguaucuuugcaaucgaccgauaucuguguccuaugcauucaaaaaggauuccaagggcgagagacacgguucggcggccgagcgauuguuagccgcccagaauccgcuaucgcaggccgacaggccucaucaguuguucgcagaugcuccaccaauaggaaugaugccgaugaguauggcgccgcccccuccgccucuaaucaccggcaugaugcccccuccaccaccaacgccgggcggcaugccaccucccccuccgccagucccuccaccgagcuccuuccccgcggguauaccgccgccgcccuuaccgccuucucagccaccuuuaccgccaggcgcuccgcccacgcuugcuccugugcccgguggugcggccagaccgccgccgccgccuccuugguccggugcggcugccaacgugccgaugccuccgggucccccuggaccgaacgcaaacuucgggggaaugcuaccaccuccuccuccgccgggcggcaggccgcuaccgccuaauuggagaccgccgccuccgccgccgccgaauuuuggcggggccagaccgccuuucccgccgcggggaccuccuccuccgccgccgacguucgacggguaa

SEQ ID NO: 5927 - RNA, 774 nt, Phyllotreta armoraciae
augggucguguuauucgagcacaacguaaaggagcgggauccguauucaaaucccacacuaaaaggaggaaaggagcacccaagcuccguuauuuagauuucuccgaaaggcauggcuacaucaaggguguagugaaagacaucauccacgaccccggucgcggcgcccccuuggcuuuaguucacuucagggacccuuacaaguuccaaacuaggaaggaaauauucauugcucccgagggaauguacacaggacaauuuuuguacuguggaaagaaagcuaaccuccaaauuggaaauguguugccuguaggaacuaugcccgaggguacaauugucuguaauuuggaagaaaaaacuggugaccguggccgauuggcucgagcaucugguaacuacgcaaccgugauugcccacaaucacgauacaaagaaaacuagaguuaaauugccaucgggagcuaaaaaaguuaucccaagcaacaacagagcuaugguugguauuguugccggagguggucguaucgacaagcccauccugaaagccggucgugccuaccacaaguacaaggugaagcguaacugcuggccgaaggugcgugguguugccaugaaccccgucgagcauccucacggaggugguaaccaccagcacauugguaaagcuuccaccgucaagaggggaacuuccgcuggucgcaaggucggucuuauugcugcgcguaggaccggucguaucagaggagguaaggucgaaacuaagaaggacgauuaa

SEQ ID NO: 5928 - RNA, 411 nt, Phyllotreta armoraciae
auggcucgaaccaagcaaacugcucguaaaucaaccggugguaaagcuccacgaaaacaguuagcugccaaagccgcucgaaagucugcaccuucaacuggugguguuaagaagccucaccgauaccgcccugguacuguugcccuuagagaaaucagacgguaucagaaaucuaccgaacuacuuauccgaaaacuuccauuucaacgauugguucgagagaucgcccaagacuuuaagacugaucuaagauuucaaucaucagcuguuauggcacuccaggaaucugcugaagcuuaccuagucggguuguuugaagauacuaaucuugcugcaauucaugccaagcgugucacuauucaaccuaaagacauucaauuggcucgaagguugagaggagagcgaucuuaa

SEQ ID NO: 5929 - RNA, 1593 nt, Phyllotreta armoraciae
auggccauaaguuuauugaauccaaaagccgaaguggcgagagccgcucaagcguuggccguuaauauaacugcagccaaaggaauuucagaagugaugaaaacgaacuugggaccgaaggguaccaugaaaauguugguguccggugccggcgacaucaaaauaaccaaagacggcaacguucuucuccacgaaaugcaaauccagcaucccacggcuucguuaauagccagagcuucuacggcacaagaugauaugaccggagacggaaccacaucuacaguuuuagugaucggugaacuccugaaacaagccgacauauacaucgcagaaggcuugcaccccaggacacucacagaagguuucgacaaagcgagagcaaaggcccuagaaauuuuggacaagcugaaaauaccgauugaaaucaacaaagaaucguuaagcgacguuugucgaacaagcuuaagaacaaaacugcaucaaaauuuggcugauauccuuacugaugugugcgucgaggccauucucgcuaucaagcaguccgauaaaccggucgauuugcacaugguugagcucauggaaaugcagcacaaaacggagaccgacacccaacuggucaaagguuuagugcuugaucacggcggucgucaccccgauaugccgaagagcuugaagaauuguuacauccucaccuguaacgucagcauggaguacgaaaagagugaagucaauucagguuucuucuacaaaaccgcugaagagagggagaaauugguguuggccgaaagagauuuuaucgaacagcgaguuaagaaaguggucgaguugaagaaggcucuuugcaaagacacaaacaagacguuuguugucauaaaccaaaaagguauugaccccaugagcuuggacaugcucgccaaagaggggaucauugcucuccgaagggcuaagaggcguaacauggaacguuuggcguuagcuugugguggaacggcugugaacaguuucgacgauuuacaagaaucucaccuugguuaugccgggcauguuuacgaacacguccugggcgaaaacaaauauaccuuuguagaagaaugcaaagugccucaaucuguaacgauuuuaaugaaaggacccaacaagcacacuuuguuacagaucaaagacgcuguuagagauggcuugagagcuauuaauaacgccaucgaagacaaagcccuuauuccgggugguggugcuuuggaaguggcaguaaacaaggaauuacuggcguacaaggacgaaauaaagggaaaagcucgcuugggcguagccgcuuacgcugaagcucuguugguuauuccgaaaacucuggcuguaaacuccggguucgacgcgcaggauaccaucgugaagcugcaagaggaagcucgacuaaguuccgaaccgaucggccucgacuuaacgucaggcgaacccaucaaucccaaagaugcgggcaucuacgacaacuacguggugaagaagcagaucauuaauucgugcucgauaaucgccagcaacuuguugcucgucgacgaaaucaugagagccgguaugagcagcuugaaaggcuaa

SEQ ID NO: 5930 - RNA, 3126 nt, Phyllotreta armoraciae
augucuagugcuggaaucgcagacagccccaucgauccuccagcaaagaagcgaaagcucgacucgaaaaauugcggcaccgacauggcgaauaaugaagcuucaggauccuccaacgccggcgaaaucgacgagggacucuacucgaggcagcuguacguguugggacacgaugccaugcgccgcauggccaccagugaugugcucguaucggguuuaggcgguuugggugucgaaguagcuaaaaaugugauccuaggcggugucaaaucagugacucuucaugacgaugcucuuugcaccguccgggauuugucgucgcaauuuuaccucaccgaggccgacguggggaagaaccgcgccgaagccugcugcaagcaccuauccgaacucaacaccuacguccccaccaagcccuacacgggcccgcucgacgagaagauccuccagaaauacagggugguaguucuaacgaauagcacucgagccgaacagcuccguauuagcgagauaacgcauaacaacgauaucgcuuugauaaucgcagauacgaaaggccuguucgcacaggucuucugcgacuucggcaaggccuucuccguuguagacgucaacggggaaccccccguauccaccaugauagcagauauaucgaacgauacagagagcguaguuacuugcauagacgauacgaggcacggcauggaggaaggagauuacguuaccuucuccgagaucuugggcaugacggaguugaacaacugcaagcccauuaaaaucaaaguauuagguccguacacguucagcaucggcgacaccaccaaauucuccaaguacguacgaggcgguauagucacgcagguaaaaaugcccaaagaagugcacuuuaagccguugaaggagucucugcagaaucccgaauucguggugaccgauuucggcaaguucgaucauccgauucaauugcaccucgcuuuuuccacucuccacaaguucguggagaagaccggccgauugccgaagcccuggaacaaagacgacgcuucggaguuuaucgcucuggcgaaaucguuggccguaaaugguuccacggauaccgaggucaacaccgauauucucaacauuuucuccaaauguuguucgggcgaucuuaauccuauuaaugcuacgaucggugguaucguggcgcaagaagucaugaaagccuguucggggaaauucuuucccauuuaccagugguuguauuucgaugccauugaaugccugccucaagacaaggaggaaaucacugaagagcucgcagcuccaguugauggaagauacgauggacagaucgcuguauucggaaaagauuuccagaagcgauuaggugaacugaaauauuucauugucggugccggagccaucgguugcgaguuauugaagaacuucgccaugaugggauugggcacgcaaggcggucaaaucacuguaaccgacauggauuugaucgaaaaaucgaacuuaaacaggcaauuuuuauucaggccccauaacguucagcaacccaagucugcuaccgcugccaagguaauaaagaagaugaaucccgacguuaacauagucgcccacgagaaccgagugggccccgaaacggaaagcgucuacaacgaugaguucuucgagguuuuagacggcguagccaacgccuuggauaacguagacgcgagaauauacauggacagacgaugcguuuacuaucgcaagccucuccuggaguccggcacguugggaaccaaaggaaauacucaaguagucguuccauuucuaucggaaucguacaguucaucgcaagauccucccgagaagagcauaccgauuugcacucugaagaauuuccccaaugccaucgaacacacuuuacaaugggccagggacaauuucgagggauuguucaggcagaacgccgagaacgcuucgcaguaccucagagacccggaguucaucgaaagaaccgucaagcuaccugguguccagccuuuggaaguucuagaauccguaaaggccgcuuugaucgacgaaagaccgaaggauuacgacgauugucuggccugggcgcgucuacauugggaggaccaauacgccaaucagauaaagcaacuguuguuuaauuucccgccggaucaacucaccagcaccggccagcuguucuggucuggaccgaagaggugucccgaaccgcucguauucgauaucaaugaagauuugcacguggauuacguaauagcugcggcuaauuugaaagcucaaguuuacggcaucccuacgaauagaaacagauguuaugccaaacaaguagucaccagcauugagguaccuccguuugugcccaaaucgggcgugaaaaucgccgugacggauucccaaauggccaugaacgguaacaacgucgacuuggaucguaucaaucaaaucaaacaggagcuacccucgauggaagagcucaacggccugacgcucacaccacuggaauucgaaaaggaugacgacaguaauuuccauauggacuucaucgucgcggccucgaacuugagagccgccaacuacaagauuccacuggccgaucgacacaaaucuaaacucauagcugguaaaauuauaccggcuauagcgacuacuacgucagugguagcuggucugguuuguuuggaauuguacaaacuggccaggaguaucaagaguuuaacgccguuuaaaaacgguuucguaaaucuggccuugccguucuucggguucuccgagccgaucgcagcccccaaaauggaguauugcgguaaccaguggacguugugggacagguucgaggugcaaggcgaaaugacgcucgccgaauuucuggaguauuucaaggagaagcauggcuuggagauuacgauguugucccaaggggugugcauguuguacucguucuucaugccgaaagccaaagcucaagaaagguugggacuaacgaugucugagguggugaggagagugucgaagaagaagauagagccucacguuagagcauugguguuugaguugugcugcaaugacgccgacggugaagacguggagguuccguauguuaaauacaaccuguauuaa

SEQ ID NO: 5931 - RNA, 1287 nt, Phyllotreta armoraciae
auggccgacgcugaugccgccgacgaucuauuagauuacgaagaugaggaaaacccagaacagaccgcaaaugaaaauaaugcgacugaaggucagaaaaaagggguuaaaggaacauacguuucgauacacagcuccggcuuucgggauuuccuucuaaaaccagaaauccuccgagcuauugcagacugcgguuucgaacacccuucggaagugcaacacgaaugcauuccucaagcaguaauuggcauggacauccuuugccaagcgaaaagugguauggguaaaacagcgguauuuguacuagccacccuacaacagcuagaacccaccgaaaaugucguuuacguacucguaaugugccauacgcgcgaauuggccuuccaaaucagcaaggaauacgaacguuucagcaaguacauguccaacaucaaagucggcguguucuucggaggcuugcccauccaaaaagacgaagaaguauuaaaaaacagcuguccgcacaucgucgucggaacgcccggucgaaucuuggcucucgucagaucgaagaaacucaaucucaagcacauaaaacacuuuauucucgacgaaugcgauaaaauguuggagcuacuagacaugagacgcgacguucaagaaauauacagaaauacaccgcacgaaaaacaaguaaugauguucagugcgacgcucagcaaagaaauucggccaguuugcaagaaauucaugcaagaucccauggaaguguauguugacgaugaagcgaaauugacguuacacggucuacaacaacauuauguuaagcuuaaagagaacgaaaagaauaaaaaauuauuugaguuacuugauguauuggaguuuaaucagguggugauauuuguaaaaucggugcaaagaugcguagcauuagcacaacuuuugacggaacaaaauuuucccgcgauuggaauacaccgaggaauggagcaaaaggaacgauuauccagauacgaacaauucaaagauuuccaaaagagaauauuaguggccacuaaucucuuuggucgugguauggauaucgagagagucaacauuguuuucaacuacgacaugccggaagauucggacacuuaccuucacaggguagcccgagcaggucguuucgguacgaaggguuuggccauuacuuucguuuccgaagaaggagaugccaagauuuugaaugaaguacaagacagauucgauguuaacauuaccgaauuaccugaugaaauugauuugaguucauacauugagggacgauag

SEQ ID NO: 5932 - RNA, 1473 nt, Phyllotreta armoraciae
augggagcucucgagacagacgucgagaugaaaaacgccgauagccccacggggcuggaagccggagacaacaagagagacaaagauuugaacaguuucacggaaauccgagagcaggccaagcaaauagaaaaaggcauaaucaacaaggagggccgcuuuauucugagagugcuccgcugcuugccgaauaccagacgaaagcugaacggaauuguccucagaacucuuauaaaucauauuuacccggcgguugaucgugauguacuccugagcuucaucgaagaauccgccggugagcuugacacuacccaaacuaaagcuagaccggccaccaagucgcccguagcagaaaucgauaccuacaucaacuugcucugcuuagugcauuuaaucgacaccaacaaauuaguagaagccgaacgcuguucgcaaauccucaugaacaagaucaccagucaaaacagacgaacauuggaccuaaucgcagcgaaauguuacuuuuauuacuccagaguagcagagcucaccgacaagcuggacucgaucaggagauuccugcacucccgucuucgcacggccacgcucaggaacgauuucgaaggacaagccguacuaaucaacuguuuauuaaggaacuacuuacacuauucccuguaugaucaagcagauaaguugguuaauaaaugcguguuuccugagacugccagcaacaacgaaugggcgagauuuuuguacuacuuggggaggaucaaagcggcucgguuggaguacagcguggcgcauaagcaucuaauacaagcgaugcguaaagcgccucagaauacugcgaucgguuuucggcaaacuguucagaagcugacggucguagucgaauugcuguugggggauauaccggagagacaaauauuccggcaggcgagcaugcggcauucucuugcgcccuauuuccagcucacgcaggccgugagaaugggaaacuugcauagguuuggagagguacuggagaauuucgguccacaauuuagacaagaucauacuuuuacuuugauccuacgccuucggcauaaugucaucaaaacagcuauuagaucaaucggucugucguacuccagaauaucuccccaggauauagccaaaaaacugggacuggauucagcagaggaugcagaauucaucguagcgaaggcuauucgugaugguguuaucgaagcuauuuuagacccccaagggggauacaugaggaguaaagagagcacugauaucuacugcacuaaagagccucagcuagccuuucaccagagaauauccuucuguuuggacuugcacaaucagagcgugaaagccaugagauacccgcccaaugcguacggaaaggaacuggagucggccgaagagaggcgggaaagggaacagcaggauuuagaauuggccaaggaaauggccgaagaugaugaugauaguuuuccuuaa

SEQ ID NO: 5933 - RNA, 1683 nt, Phyllotreta armoraciae
auggccuccagccaucaagcccuuccagugucggcuauccugaaauccaaaagcgaagucgaggaugagccuaagaagaaguccagggaggauuggcguaaggcuaaagagcuagaggaggcucgaaaagccgguacagcuccggcggcagucgacgaagaagguaaagauaucaauccccauauuccgcaguacauaucuacggcuccuugguauuacggaacgaccggacccacguugaagcaucaaaggccacaggaugagaaaaauaaagaguauucggauuugaacgauugguauaagagaggcguagauacuucgaagauuauaacaaaguaucggaaaggcgcuugugaaaacugcggggcuuugacucacaaaaagagggacugcauggacagaccccguaaagucuuagcuaaguauuccggugcgaauauagcaccugaugaguuuauccaaaagaauuuaucacuaaguuuugacgguaaacgagauagguggagugguuacgauccuucugaacauaagacgguuaucgaggaauuccagaaaguagaggaagccaaacggcaauuaaaauccgacaaauugaacgcaaacgaagaguccgaagacgaagaaaaagacgaggauaaauacgucgaugaaguggacaugcccggcacgaaagucgacaguaaacaaagaauaacggucaggaauuugcguauacgagaagauacggcuaaauacuugagaaauuuggauccgaacucggcguacuaugaccccaaaaccagaucgaugagggaagauccgaaccccgggaacgacgcuacauaccauggggaaaauuucguucgcuuuuccggcgacacuacaaaucacgccagagcgcagcuguucgcuugggaagcacacgguaaaggaguggacguucauuuacuagcagaacccacgaaauuggaauuacugaagaaagaauacgagaaaaagaaggaugaggugaagucgaauauucaggguacaguuuuagagaaauacggaggugaggaauaucuugaagcgccaccaaagaguuuguuguuggcucaaacugaaaacuacguugaauauucgagaucggguaagauuauuaaaggagcagaaaaagaaguuauuaaaucaaaguacgaggaagauguuuauauuaauaaucauacgucaguauggggcucuuacuggcgcggaggacaaugggguuaucgauguugucauuccuuuauuaagaauucuuauuguuugggcgaagcaggaaaaucaguaaacgcucaaccuacaucagaaauaaaaaauaaugaugaacccaaagaggagcaacuacaagaagaugaagaaaaagaaaagagcgagguacuagauaaagaaagugaagaaucugauucuaguaguucgucggaagaugaaaaauccaaagcaaaaucgaagaagaaauuaaaaaagaaacugaagaagcagaagaagaagcaaaagaaaaaggacaaggauaaggagguuaaagcgucggcgucgauaaaggaaguagacgaagaagugauuuuagacgauagaaagcggccuuacaacagcauguucgaggcgaagaaacccacagacgagcaaauggaggaauacuucaagaaaagacgaagagacgaagauccgaugaaccaauucauguaa

SEQ ID NO: 5934 - RNA, 627 nt, Phyllotreta armoraciae
auggguauaagccgagaucauuggcauaaacgaagggccaccggaggcaagaggaagccucuucgcaagaagaggaaguucgaauuaggccguccggcggcuaacacgaaacuaggaaccagaaggauccauuauguucguacaaggggaggcaacuugaaguaccgugcccuaagauuagacaccggaaacuuuucuugggguagcgaaggaacugcccgucaaacacguauuaucgaugucguuuacaacgcuaguaauaacgaauugguucguaccaagacguugguaaagaaugcuauuguuguuauugacgccaccccauucagacaaugguacgaaagucacuacaucuuaccauugggacgcaagaagggugccaaaaugacgccugaggaggaggagauuuucaauaaaaaacguagcaaaaaaguacagaagaaguacgaaacuaggcaaaaaaccgcuaaaguagaaccugcgaucgaagaacaguuccacacuggaagauuguuggcaugccuagcaucaagacccggacaaugcggcagggccgaugguuauguccucgaaggaaaggaacuugaauucuacaugcguaaaauuaagucuaagaaagcuaaauaa

SEQ ID NO: 5935 - RNA, 936 nt, Phyllotreta armoraciae
auggauagauugcuucgucucggaggcggcaugccggguuugacccaagccccgccgccuuccgacgcccccgucgucgacaccgccgagcaggucuacaucuccucacuagcccuacugaaaaugcucaaacacggcagggccggcgugcccauggaagucaugggacucauguuaggugaauucgucgacgauuacacggugagagugauagacguguuugcuaugccccaaacgggcacaggagugagcguagaagccguagauccgguuuuucaagcgaaaauguuggauauguuaaggcagaccggcaggcccgaaaugguugucgguugguaccauucccauccggguuucggcuguugguuguccggcgucgauaucaacacucaacagagcuuugaggcccuuucugagcgagccguggccguagucguggaucccauucaaucggucaaaggaaaaguugucaucgaugccuuuagguuaaucaaucccaacaugaugguguugggucaggaaccccgucagacgacuucgaauuugggucauuugcagaagccuuccguacaagcgcugauacacgguuuaaaucgccauuacuacucuauaagcauuaauuauaggaagaacgaguuggagcaaaagaugcugcugaauuugcacaagaaauccuggauggacgggcucacuuuggccgauuacucggagaauugcagugugaacgagaaaaccguagccgauaugcuggaauuggcuaaaaauuacaacaaagcuuuggaggaagaggagaaaaugacgccugaacaacuggcuaucaagaauguugguaaacaggaucccaagaggcauuuggaggagaaagucgauauauugaugaccaauaauaucguacaauguuugggggccauguuggauaccguuguguuuaaauga

SEQ ID NO: 5936 - RNA, 1461 nt, Phyllotreta armoraciae
augagguacguaaagaauuacuuucauauucaucuuuuucgaaucuauacguucagucacuuaauugucuuuuguuauuuccaaaaugucaucaaauuaauauuguucgaaaauuucgguaaaaugggacaaggcucccugacaaaauuaaaaagaaauaaaaggaaaaaaaguuuauuagccaguacaucaaagggucucgaaauuaaaccuuccucagaauuaauugucaacaugguuacuugugucgaaagaaauccaaagauggaggucgaugggccucucaagggugaaggguucagguccuauuauaucaccaaaauugaggaauugcaacuaaucguugcugaaaaaagccagaaccucagaagauuacaagcccaaaggaacgaacuuaaugcuaaaguucguaugcuuagagaagaacugaugcuucuucaagaacaaggaagcuaugugggggaaguggucaaacccauggauaagaagaaaguacuugugaaaguccauccagagggaaaauuuguuguugauauugacaaaaauaucgacauuaaugacguuacaccaaauuguagagucgcucuucgaaaugaaucguacacuuugcauaagauuuuaccgaauaagguggauccuuuaguaucccucaugaugguugaaaaaguuccagauuccacuuacgaaauggucggugguuuggacaagcaaaucaaagagaucaaagaggugauugaauugcccguaaaacaucccgagcucuuugaugcauuggguauugcucagcccaaggguguguuguuguauggaccgccaggaacugguaaaacucuuuuggcuagagccguagcucaccacacugaauguacguuuauuagaguaucuggaucagaguugguacaaaaauucaucggggaagguuccaggaugguaagggagcuguucguaauggcuagggagcacgccccuucaaucauuuucauggaugaaaucgauucaauuggauccucucguaucgaaucagguucugguggugauuccgaaguucaaagaacuauguuggaguugcugaaucaacucgauggauuugaagcuacgaagaacauuaaagugauaauggcuacaaacagaaucgacauuuuggaucccgcuuugcugaggccagguagaauugacaggaaaaucgaguucccuccaccgaacgaggaagcccgauuggauauucugaaaauucacucgagaaaaaugaaucugaccagaggaaucaauuugaggaagaucgccgaauugaugccaggugccagcggugccgaagugaagggaguguguacugaggcugguauguacgcgcuaagggaaagaagggugcauguaacccaagaagauuucgaaauggcuguggccaaggucaugcagaaggauucagagaagaauaugucuauuaagaaauuauggaaauaa

SEQ ID NO: 5937 - RNA, 600 nt, Phyllotreta armoraciae
augguaaaauuauauugcaucaguauucucuacaaagauacuaccuacgcuacgugguugaagucugcuuucgauuugcaaagcuucaguuucuuccaaagagggucuauacaggaauucaugucauucuuuuguaagacuauuguggaaaggacuauaccaucaucgagacaauccgucaaagaaggagaauauaugugccauguuuauguaagacaugauaacuuagcugguguugugauaucagaucacgaauauccgucuagggugucgcauacgcugauuacgaaaauuuuggacgaauuugccgcuaaaauaccugcuguuaauuggccuaccuugcaagagaaggauguaacguuuccgcugcuaaauacauaccuugccaaauaccaaaaccccaaggaagccgaugcaaugacuaaaauacaagaggaccuugacgaaaccaagauuauucugcauaauacgauucaagcuguccuggaaagaggcgaaaaauuggaugacuugguaaauaaaucagagggcuuaaguauacaguccaaagcuuucuacaagacugcaagaaaaacgaacaguugcugcaauuucacuuaa

SEQ ID NO: 5938 - RNA, 729 nt, Phyllotreta armoraciae
auguuucuaacaagaagcgaauacgauagagguguuaacacauuuucccccgaaggaagguuauuucaaguggaauaugccauugaagcuauuaaauugggauccacagcuaucggaauaugcaccagcgaaggggucgugcuagcagucgaaaagcguauuacuucuccauuaauggagccuacaacgauugaaaagaucguagaaguagauaaacacaucggcugugcuguuucggggcucauggcagauucacgcacaaugaucgauagggcaagaguagaaugccaaaaucauugguuuguuuacaaugaaaacaucacuaucgaaucaugugcucagggaguaucgaacuuagcuauucaauucggagauucggacgaugauggugcugcuaugucgaggccauuugguguggccauuuuguuugcuggcauagacgaaaaagggccucaacuuuaccacauggauccuucagguacauuuguucaguucgaugcgaaagcuauaggaucugguucagagggcgcacagcaaagcuuacaagaaguauaucaccguagcaugacuuuagaggaagcuaccacagcagcauugacuauucucaagcagguuauggaggagaaauugaacucguccaauguagaagucaugacaaugacgccaaaggauauguuucacauguuuacuaaggaacaaguggaggagguaauuacuaaauuaucuuaa

SEQ ID NO: 5939 - RNA, 1158 nt, Phyllotreta armoraciae
augacagaauacugguugauuuccgccccaggugacaagacuugucaacaaacaugggauacaaugaauaaucugacuaguaaacagaacaauuugucugcaaauuacaaguuccaaauacccgauuuaaagguuggaacucuugaccaauuaguugggcuauccgacgauuugggaaagcuggaugguuucguggagcagguuacucggaagguggcucaguaccucggcgagguucuugaagaccagagggacaaguugcaggagaauuugcaggcgaacaacaccgauuugccaaguuauuuaaccagauuccaaugggacaucgccaaauaccccaucaagcaaucgcuccgcaacaucgcugauauaaucagcaagcaaguuggacaaaucgaugccgaucuuaagaccaaguccucagcguacaauaauuuaaaagggagucuucaaaauuuggagaaaaagcaaacagggaguuugcuaacccguaacuuggcagaucuggucaagaaggagcacuuuauuuuagauucugaguacuugcaaacguugcucgucaucguucccaaaucucaguuuaaugaguggaacgccacuuacgaaaaaaucacggacaugaucgucccucgaucgucggagcuuaucauucaggaccacgacuacggcuuguucaccgugucgcucuuuaagaaagucgucgaggaguuuaagcugcacgccagagagaagaaguuuaucgugcgagauuucacguacaacgaggaggaauuggcggccggcaaaaacgaaaucaccaagcucguuaccgauaagaagaagcaauacgguccguuagugagaugguugaaagugaacuucagcgaaugcuuuugugcuuggauacacguuaaagcgcugagaguguucgucgaguccguguugagauacggguuaccagucaauuuucaggccauucugauccauccaaauaagaagcaagccaaacguuuaagagauguuuugaaucaacuauacggucaucuagacaguagugcagcucuuuccggaccuaauguugauagcguagacauuccaggauuagguuucggccaaucagaauauuaucccuacguguacuacaaaauaaauguugauaugauagaaucgaaggucuaa

SEQ ID NO: 5940 - RNA, 1674 nt, Phyllotreta armoraciae
augucgauuuuagcgaguccccuauccguagccgguucgagaacgacgggcgcuucgguucgcacccaaaacgucauggcagcuucgaccauagccaacguggugaagagcucguugggcccggugggccuggacaagaugcucgucgacgacaucggcgacgugaccgugaccaacgacggcgccaccauuuugcggcugcuggaagucgaacaucccgccgccagggugcucgucgaauuggcccagcugcaggacgaggaggucggcgacggcaccaccuccgucgucaucauagccgccgaacugcuuaaaaacgccgaugaacuuguaaaacaaaaaauccacccuacgucgaucauaagcggauacagauuggcuugcaaggaagcuugccgauacauacaagaccauuugacuauaccaguagaggaauugggcaaggaauccaucguaaacgucgccaagacuucgaugagcuccaaaauuaucggagcugaugcugauuucuuuucgcaaaugguagucgacgccgcgacagccgugaaaguaacggacuccaaaggcaacucgauguaucccauaaaggcggugaacguguugaaagcgcacggcaaaagcgcccgggagaguuuccugguggccggcuacgccuugaacugcacggucgccagccaggccaugcccaagaagauuuuaaacgccaaaaucgccugucuggauuucucauugcaaaaggccaaaaugaagaugggcgugcaaguucugauuacggaccccaaucaauuggaaggcgugcgcgccagagagcuggacaucaccaaggagcgcauccagaagauccuggcuaccggcgugaacguggugcuucuguccggcggcaucgacgacgucuguuugaaguacuucguggagcgcggcgccauggccgugcggcgcgucaaaaaggccgauuugaaacgcaucgccaaggcuacgggcgccgcuuucgucacgucguugagcaacauggagggcgaggagaccuucgacgccgccauggugggcgaggccgcagaggucguacaggagaggauauccgaugacgaauugaucguuaucaaaggaccgaaagcucguacugcugcaucgauaauccugcgcgguccgaacgauuucuacugcgacgagauggagcguucggugcacgacgcccugucuguggugaagcgcgugcuggaaucgaagagcgugguggccggaggcgguagcgucgaggcggcgcucucgaucuaccuggagaauuucgccacgacguugagcucgcgcgaacaacucgccaucgccgaguucgccaggaguuugcuggucauaccgaagacuuuggcggugaacgcggcgcaggacgccacugauuugguggccaaauugagggccuaucagaauucuagccagacuaagaaggaucaugcgcauuugaaguacgucggguuagaucugauugaagguacugugagagauaauaggaaagcugggguguuggagccgacuaugucuaaggugaaaucguugaaauucgcuacugaagcggcgauaacuauacucagaaucgacgauaugaucaaauuggacgcugagcagaagggcgggaagagcuaccacgaugcuauggagagcggugaacuguacgauuag

SEQ ID NO: 5941 - RNA, 768 nt, Phyllotreta armoraciae
auguuuaauucuaccuauucggcgccuccgccguuuuggagcaacggcccagccccaggggcuuucuacaacuucccgggaaccgaauggaaaccuauaacaaacccaauaacucauacucaaucuccuguaacuacuucaacuucuauugugucuauaacguacgauaaaggaguacuaauagccggagacuugcuggccucuuacgggucuuuagcuagauacaaaaauugcccuaggguaaucgaaaucaauccgaauaucauccuaggagcaggaggagauuacgcugauuuucaauauguuaaaagcuuuaucgagcagaaaauaaucgaugaagauugccuagaugaugguuugaaaaugaaaccgaaaucucuuuauugcuggcugacuaggauuauguaccaacggagaaguaaacucgacccguucuggaacaacuuaguugucggagggauacaggaugguguaccauuccuaggaacagucgauaaacuugguacagcuuacacagauaaaguaauuuguaccgguuacggggcucauauagcccuuccuguccugcgagaugcccucgauaagaaaccaaauuuaaauuuaaacgaagccaagcagcuuauuaaaaaguguauggaaguuuuguucuacagggaugcgaggaguuacccgaaauaucaguuggggaugaucgaugcggaugaaggugugaagauugaggggccgauugcggucgaggaaaauuggaauaucgcuuauaugacuuaa

SEQ ID NO: 5942 - RNA, 2103 nt, Phyllotreta armoraciae
auggaauuuucgaaagaacccaacuuugaauuaacagcuaaggauuuuucaccagaaaaauauguaaaaaaauugucccagaauuauguggguggauccgaauuacagaaucuucgaagaaaaauucaagggcucuccgaagaaacaagcucuaauuuaaagaaaaauguuuacgaaaacuacauucaauuuaucgaaacugccaaagagauuucacaucuugaaagugagauguaccagcuuucccacuuacucuccgagcaaaaagcauugcuuaauuguuuaucggccacaucaauauuggaagacguacagccaguuaacauugauagggauaauaaaguaaacgaaaaggaucuugaagaagaaaacaaacaaaaaauagcugcuauuuuagaaaaaguagaagguugucaggaaauguuaaaaguaccaggaagaauuuucuuguacgaaggagauuuauuggaaaucgaacccaccgaaaacaccgccuuaaaaauaguucacguuuauuuauuuaccgauaguuuuaugauaacuacaagaaauucaaacagucgaggucucaugaaauacaucuacgaaagcauauacgacuugagcagccuagcgguugugaacguaagagauuugggaaacguuaagcacgccuuuaagcuucucauuuuccccgauacaagaguuuuccaaugcuccucgaacuccaauaaaaaagaguggcuagacaaguucgaucaagccaagaaaaccaagcuggcccaagaacagcaaaaaagggaauccguaucggaaaaaucucccacucgcguauccuucgaaucgcccagcuacaauccuuuugacgauguggaagaagaaacgagcgcguugcauccagaaugguucguggacauuccggaagagcuggacguuugcguggcccaaaggcacuucgaagacgcccuuucuuuacugcaaaaagccaaagaauauuugacucaagcauccucugcgacaggagacaagcgagacaccguuuucacggauauccagaggaaaguagagcaaaggcagaacaauuuaacggagguguugaugaaggaauuagaaguaaacccggauaaaucgcugcagggcgguuugagagcggcucgcagggcugugagauugcugaaucaauuaggaagggaaacacaaucuuguacgcuguuccuaaaguugugcagcagcaugcuaaggacucagugcaaacgaguuaaaagagaaggcucuacuaccacuuacauaaagcaucuuucgagcgugguuuucaccaauaugugucacaugucugaugaauuucugagagcuuuccccgacucuccagccugcgccucagcguaugugguuugggcgagcaaugaacugcugcaauuuacuacccauuuuauuaagcagguuuucaugccucagacuuccuuaucaacggugaccgaaugcauaguuuuagugagacaacagugugaaaggcuguacguuuacggauuagaccuuuguuaucaauuagacggugcuuugagaucuucccugaugaaagcauugaaagacgcucgagauaaacuaaucgacucgauaaaguugcgaguucuagaugauaaauggauaccuauuaauuugcacagcaaaucggcuuuaagucguugcgugcaagaguauucccaaaugggacucacuaacguuggaaguuacguuucuggcgauacuugguuacaauuaacggcuaguacuuuaucguucacgaaaauguuuuugaacuugcuaaacgauuguaugaaauugaaaacuacagaguuaauguacacgaucgaugagacuuuguauaacguguucgaagcucaagucaggcacaacgaaaacgcucucaggagcgaauugaaucaagaccaaaggaacuuucucacgaaaaacgccgaguuuuuauugguuaguuugaugcagguggugcaaaagaaguacgaggagaauguugguuacgaaugucccacgcucgcgaaauugcaaaaggaauauguagcauuacagaaaggcguuacgccagcgucgagaaguacaaaagccaaguauucaucagaguuuauuuaa

SEQ ID NO: 5943 - RNA, 3705 nt, Phyllotreta armoraciae
augaacgaauuggagaaacuagaauaccucucuuuggucucaaaaauuugcacagaauuggacaaccaucuuggaaugaacgauaaagauuuagcugaauuuauaauacaucuuuccgaaaaaaacaacacuuuggaaucauuuaagaaggugcuuucagaaaauggugccgaauucucagacucuuuuguuucuaaccuguugcgaauuauccagcacaugaaaccgaagaaaucgacaaauaaggaagaagccgauaaaguggaaaaagagggauuggcuuuuaaauuucccgguuuagcgauaccuaaugagaaacaaauaccuuuacaauuagaagaauuugacgaggaaaauaaaaaugaugaaauagacguuguagccgacaugaugaaacagcuugaagcugacgcaccuucccaaaagcaaacaaaagaaaaguccagaagcccaagcauugaaaagaaaucaagaguaagaucuagaaguaggucaaaggaaagaagaagaucgagaagcagaucaaauaauaggcgaagaacuagaagcagaucuagagauagaagaagaucuagaucuaaagauagacauucuagaagagaaaaaagacacagaaguaggucaaaugaagacuacaagaggagaagaagagacaacaguuacucgagagauagaagagaaagagguagguccaaagaaucggaacgaagagacagaaauagaucaagagaugauagaaaaagagaaagaaguagaucgagaacgaggaggcgagaaaggaguuacgaaaaaaaauucaaaagcgaaaaggauaauccugaauuugaggaugauccuacuccaggaaagauuuauaauggaaaaguaucaaaugucguuccguuuggauguuucguacaacuggaaggucuaaaaagaagaugggagggucuagugcauauuucucagcugagagcagaagguagaguuaccaauguuucugauguugucucuagaggaagcaaaguuaaaguaaagguauuaacaauaacuggucagaaaguaucccuuucaaugaaagaugucugccaaacgacaggaaaagauuugaauccccuaucccaugccacuacggaaagagaagauaaagaccguaacccugacaggcccacaaacaauagcacaucuguguugaggcugccaguuagcaucgaugaaggagaagaagauuccaggaaaaggguaacucgaauguccagccccgagagaugggaaaucaagcaaaugauuucuucuggcugcauagacaaaagugaauugccagaauucgaugaagauacugguuugcugccuaaagaugaagacggugaagcugauauugaaauugaauugguugaagaugagccaccauuuuuacaaggucacgguagagcuguucacgaucuaagccccguaagaauaguaaaaaauccagaugguucgcuagcccaagccgcuaugaugcaaucggcuuuggcaaaggaaagacgcgaacagaaaaugcugcaaagagaacaagaaguggauucgcagccuucuggaaagaacaaaaacuggaucgauccccuuccagaagaggaaucuaaaucgauggcaagaggaauaggucuucaaagucaagauuugcccgaauggaaaaaacacguuaucggcgguaaaaagucaucuuuugguaaaaaaacuaacuuaacgaucgucgagcaaaggcagucucuuccuauuuacaagcucaaagaagaguuacgaaaagccguaacagaaaaucaaauauugaucguuauuggugaaaccggcuccggaaaaacaacacaaaucacccaguauuuagcugaggccggguucacagccagagggaaaauuggaugcacgcagcccagaagaguugcugcaaugucgguggcuaaaagaguggccgaggaguuuggaugcagauugggccaagaaguugguuacaccauuagauucgaagauugcaccagucccgaaacgaugaucaaauacaugacagacgggauguugcuacgugaaugccuuauggauuuggaucuuaaaaauuacucuguaauaauguuggacgaagcucacgaacguacgauucacacugacguacucuuuggacuuuugaagcaagcuguuaugaaacgagacgaacugaaauugauuguaacuucugcuaccuuagacgcgguuaaguuuucgcaguauuucuuuaaagccccgauauucacgauucccgguaggacauucccgguagaaguucuguacaccaaggagccggagacugauuauuuagaugcuaguuuaauaacggugaugcaaauacaucucagagaaccuccgggcgauauuuuacuguuuuuaacgggucaagaagaaaucgauacugcuugugaaauauuauacgaaagaaugaaaaguuugggucccgauguacccgaacugaucauucuaccuguauacucugcuuuaccguccgaaaugcaaacuagaauauucgaaccagcaccuccuggcaguagaaaagucguaauugcuacgaacaucgcagaaacuucauuaacaaucgauggaauauauuacguaguagauccaggauucgucaagcaaaaaguuuauaauucuaagacuggaauggauucauuaguaguuacaccaauuucgcaggcacaagcgaaacaacgagcaggccgagcuggcagaaccgguccuggcaaauguuacagacuuuacacggagagagcuuauagagacgaaaugcuuccgacaccggugcccgaaauccagcgaacuaauuuggcaacaaccguacuucaacugaaaacuaugggcauaaaugauuuguugcauuuugauuuuauggaugccccuccggucgaaucccuuauaauggcucucgagcaguugcauucucuaucugccuuagacgaugaagguuuauuaacuagacuaggaagaagaauggcugaauuuccacuggagccgaauuugugcaagauguugaucaugucgguagcucuucaaugcuccgaugaaauauugacuauagugagcauguuaucuguucaaaacguguuuuaccguccgaaagauaagcaagcauuggcugaccagaagaaggcgaaguucaaucaaccugaaggcgaucauuugacgcuuuuggcggucuacaacaguuggaagaacaauaaguuuucgaaugcgugguguuaugaaaauuucgugcagaucaggaccuuaaaaagagcgcaagacgugagaaaacaguuguuggguaucauggacaggcacaaauuggacgucgugucggcggaaaggaacacggugagagugcaaaaggccauuuguuccggguuuuucaggaaugcggggaaaaaggauccgcaagaaggcuacaggacuuuggucgauagucagguuguguauauucacccuuccagcgcuuuguuuaaucggcaacccgaauggguaaucuaucacgaauugguucaaacuacgaaggaauacaugagagaagucacaacgauagauccgaaauggcugguggaguuugcgccugcauuuuucaaguuuucugauccuacgaaguugagcaaauucaagaaaaaucaaagauuggaaccuuuguauaacaaauaugaagaacccaaugcguggagaauuucuagaguuaggagaagacgaaauuaa

SEQ ID NO: 5944 - RNA, 1248 nt, Phyllotreta armoraciae
auggccacaaaaaggaaaaacaaaaaaaacauacuggcaaaagugaauuuuccuuuauacaccguccagauguuaacgucaaggcauguuaucguaggaggcggcgguggaacuucgaagacugggguugaaaacgguuucgaaauauacgaaaucuuucaugacggucacaaauucucagccaaagaaguuacaagacacgaaacuggaggaaacguagucaugaauuguuguguguuuagugauaggaaaaauucauuuuuaguagcuggucaagaaaacuacucucaacuuuauaaagucaauacgaaauuaaucgagcaugaacaaguagaaacaguuggagacacugcaagcguucggcacagaaauaccaaguccaaagaacacguagauaauaauaaaaacauuaaaaaggagcugguuuuugaccugaauccuuuagauagcauacaaaccgauuuuaaggguucugaaccccuauguagaguaguuagaauuaaucacucgggaaagauauuagcuacuggaggaacugacggcgauguaagacuuuggaaauucccuaugaugcagcccuuguccauucuaaaaggacauacaaaggaaauagacgauauagauuucaguaaauuugauaaccucaucauaacuuuggcaaaagacgguuuggcuauuuugugggacgcccaaacgggaaaauugaaaucaaaauugacauggaaaacuccagagggaucgaaauauuuguacaagaggugcagauuuggcguuaucgaagaccaaaaaaauaagugcaugcuguacaugauagcgaaugcgacuaauucgaagcaaacaucguuucuucaacaauggauaccugaggagaauacuuuaaaaaaguucucggaauucaaugaaacccuaucggcacuugcggugagagacgauggacgauuuguagcugucgggacaauguucagcggcucuguuuccauucacauugcauuuaguuuacagaaaauauuaguaguugugggcgcucacucgauguuuguaacuggccuagaauuccuaucucaugaaaauaccaaucauuccauaaguaguguugcggagacugcuguauugucuauuucgguggauaaucagcuuuguauacauucagugccauacagacgaaguauaccuuuauggauuggaauaaugguguuaguuuuaguauuauuuauuacauuuauguuaugugcauucauggguuuguga

SEQ ID NO: 5945 - RNA, 1242 nt, Phyllotreta armoraciae
auggcuggugcaauguuauucgaaagagcucaguccguaccuucccaacacgacaaguuguuaaaauuaaauccaacagacgaagaugacgaagagaauaucguuaacaaagagcaagacauccucaacuugggcgagaaguacaagaaggagggcaaggcuaaagaacuagcggagcugauaaaggcuaccagaccauuucugagucuuauuagcaaagcaaaagcagcaaaauuaguuagaucacugguugauuacuuuuuggacuuggaagcaggcaucgguaucgagguacaacuguguaaagaauguauagaaugggcgaaagaggagagaagaacguuuuugcgccaaucgcuggaagcgcgccucaucgcucuguauuucgacaccggcauguacaccgaugcccuacaacuggaauccaccuuguuaaaagagcuaaagaaacuggacgacaaaaaucugcuggucgaagugcagcuacuugaaagcaaaacauaucacgcucuaagcaauuuacccaaagcacgagccgcucuaacauccgcuagaacgaccgcgaacgcuaucuauugcccuccgaagaugcaggccgcccuagaccugcagucaggcgugcuacacgcagccgacgaaaaggauuucaagacugcuuacuccuacuuuuacgaagccuucgaagguuucgacagcgucgagucucccaaagcucuaacugcucucaaguacaugcuucuguccaaaauuaugauuaauaguccugaagauguacagcaaauuguuaguggaaaauuagccauaaaguaugccgguaaagauauugaugccaugaaagcagucgcacaagcagcccacaaaagaucucuugcagauuuucaacuugccguaaaacaauucaaacaugagcuggaagaugacguuaucguaagagcacauuuaggaacccucuacgacaauauguuagaacaaaacuuaugcaggaucauugaaccuuacucacguguccaaguagaauauauagccaagacgauuaagcuuccuguguuacaaguagagaagaaacuaucgcagaugauuuuagaugccaaguuucauggaauuuuagaccagggugaugguguccugauaguguuugaagaaacgccgguagacaaaaccuacgaaauggcucuagaaaccauccagaguaugaguaaaguaguagacacucucuaucaaaaagcgaaaaaguugucauag

SEQ ID NO: 5946 - RNA, 1737 nt, Phyllotreta armoraciae
auggcuucgcggucgaaaaaaagcucaacgccgucggcccaacagcggccggcuagcccgcuaagcccgacgaggcauuccagguugcaggagaaagcggaacuccaaggucugaacgaccgcuuggccgguuacauagauaaagugagauuuuuggaagccgaaaacaacaaacuauccagagaaauccagacgacccaggaaacuguuacgcgcgaagucuccaacaucaagucuauguacgaucaugaauuaggggaugcuaggaaacugcuggacgacacgcaccgcgagaaagcccgccuggaaaucgacgugaaacgucucauagaagagaacgaggagcucaaagccgagcuggccaaaaagagcaaggaucugguaguagccgagaaccaugccaggauauacgaauccagguguaacgaguaccagcucaaguccaaccaagcgacugcagaugcuaaaaaggccaucgcugacgccaaggaguuggaaaaggaaagggacaagcugaagaagcuucucgaugcugcucguaaacaacuggaagaggaaucccuggccagagucgaggucgagaaucacaaucagagcuuaagggaagagcuaaccuucaaagaucagauccaucaacaagaacucacagagacucgcacucgccggcaagucgagaucagcgaaaucgacggccgucuggcgcaaaaauacgaggccaagcuucaagaggcccuccaagagcugcgcgaccaguacgaaucgcaaauggccaacaaucgaggggagaucgaauugcucuacgagcagaaaaucaaaaaccuccaagccgccgccgacaggcaucaaucgaccgccuccggcgcucucgacgaacugagacagguucgaacgaggaucgacagcuucucgucgaagaucgacgaccuggagaaccagaaccgcggucuagcagccagagcuagagauuuggagaaauugcucgagaacgagcgcauucgucacgccgaagaucuggcguuggucgagagggaauugcacaggcugcgagaggaaauggcccaacaacuucaggaauaccaggaccucauggauaucaaaguaucgcucgauuuggaaaucgcagcuuaccguaaacuucucgaagcagaagaagcucgauugaacaucacaccgacaggcauggaacacgaggugcaccauaggaguucuucucaacgucggacgccggugagaaugggggccaaaaggaaacgagcccugcucgaggagacucaggagucgagcuugucggauuacagcgugaacaguucaucuaaaggggacaucgaaguggccacagucgauccggacggucaguuugugagauugcacaacaaaaguaaccaagaggugccgcucagcggauggcaagucauaaggcgggcgggugaugaggagacuuucuacaaauuccacaggacuguuaaaguagaaggaaaugguacaguaaccauuuggaguucggauuuaaauaaagaucacgaacccccuaguaaccugguuaugaaaggccaaaaauggguuacuggagacaacaugauuacgauaguauugaacaacaauggagaagaaguagcgucaucugaaaggguaagaaggcagauuucaacgucgcauuuaagacacagggaauugggggaugaagaacuuuaucaccagcagggggaccugcaaggugaaaagugcggacugauguga

SEQ ID NO: 5947 - RNA, 2079 nt, Phyllotreta armoraciae
auggacgaacugcagcucuucagaggagacacuguucuacuuaagggcaagcgucgaaaagaaaccgucugcauaguucuguccgacgauaguuguagugacgaaaagauccgcaugaaccgaaacguucggaauaacuuaagagucagguugucugacgucguuucuauucagcccugcccugauguuaaguaugguaaaagaauccacguucuucccauugaugacacaguagaaggacuuacaggaaaucuguuugaaguguaucugaaaccguauuuccuggaagcuuaucggcccauacacaaggacgacguguuuaucguaagaggcggcaugagagccguagaauuuaagguaguggaaacugauccggcuccuuacugcauagucgcgcccgauacggucauccauugcgacggggauccgaucaaacgcgaagaagaagaggaggcucuuaacgcugucggcuacgaugacaucggagguugcagaaaacagcuggcccagaucaaagaaauggucgaguugccguuaagacauccgagucucuucaaggcuaucgguguuaagccgccucgagguauucuuuuguacgguccaccggguacuggaaaaacucugauagccagagccguugccaacgaaaccggagcguucuucuuuuugauuaacgggccggaaaucaugagcaaacuugccggugaaucggagagcaaccugcgcaaagcuuucgaagaagccgacaagaacuccccggcuaucaucuucaucgaugaguuggaugcuaucgcuccgaaaagagagaaaacgcacggagagguggagcgucguaucguuucgcaauugcuuacucugauggacggcaugaagaagagcucgcacgucaucguuauggcagcuacgaacaggccgaacuccaucgaucccgcucuacgucgauucggaagauucgacagggaaaucgacaucggcauuccggacgcuaccggcagauuggaagugcugagaauccacacuaagaacaugaaguuggccgacgacgucgauuuggagcaaauugcggccgagacucacggucacgugggcgccgauuuggccucgcuuuguucagaagcggcgcugcaacagaucagagaaaagauggaccuaaucgaucucgaagacgaucaaauagaugcggagguucucaauucguuggccgugaccauggagaacuuccguuacgcuaugacgaagagcaguccgagcgcucugcgcgaaacggugguagaaguaccgaacgucacgugggaggauaucggcgguuuggcuaacgucaagaaggaguugcaggaguuggugcaauauccggucgagcauccugauaaguuccucaaguuuggaaugcagccguccaggggagugcuguuuuacgggccgcccgguugcgguaagacccuauuggcaaaggccaucgcuaacgaaugucaggccaacuucauaucggucaaaggaccggaauuguuaacgaugugguucggugaaucugaagcuaauguuagggacauuuucgauaaggccagaucagcagcuccuuguguacuuuucuucgaugaguuagauucaaucgcuaagucgagaggcggaaauguaggagaugccggcggugccgccgauagggugauuaaucaaauuuuaacugaaauggaugguaugggagcgaaaaagaacguuuucaucauuggugcuacaaauagaccagauaucauugaucccgcuauauuacgucccggucguuuggaucaguugaucuacaucccauugccagacgaaaagucuagagaagcaaucuuuaaagccaacuuaaggaaaucaccuguagcuaaagacguagaucuuacuuauauugccaaaguuacacacggcuuuucgggugccgauuuaacagaaauaugucagagagcuugcaaacucgcuauaaggcaaagcaucgaaacggagauuagacgagaacgggagagagcauugaaucccaacguagcaauggacguaaguauuuguuugcauuuauuaaaauccugucuuaaaaaaauauaa

SEQ ID NO: 5948 - RNA, 825 nt, Phyllotreta armoraciae
augagugaccaauuugacugugcacucgauuuaaugaggcgcuugccuccgcagcaaaucgaaaaaaauuugagcgauuuaauugauuuagugccaagucuuugcgaggaucuucuuucgucuguagaucaaccauuaaaaaucgcuaaggacaaggauucgggcaaggauuuucuauuaugugauuacaauagggacggggauucuuacaggucaccauggucgaauaccuauuacccuccauuagaagacggcucgaugcccuccgagaggcuaagaaaauuagaauuagacgccaauuuagcguucgaucaauauagagaaauguauuucgaagguggcguaucuucuguuuauuuuugggacuuagaucacgguuucgcaggaguaauuuuaauuaaaaaaacuggagaugguaguagaaaaauuaaagguuguugggauucccugcacguaguggaggugcaagagaagaguucuggaaggaauucccacuacaaaaugaccuccaccgcuaugcuguggcugcaaaccaauaaacaaggcucgggaaccaugaauuugggcgguagcuuaacccggcagaucgagcacgaugcagcaguaaaugacaucaacccucacaucgcgaacaucggucgaaugguggaagacauggaaaacaaaauucggaacacuuuaaacgaaaucuacuuuagcaaaaccaaggacauagucaauagcuugagaucggugcaacccuuaacggagagccgucaacagcaagcgcuuaaacaagacuuggccgccgcccuucagcguagacaaaauaaauccgagaacuga

SEQ ID NO: 5949 - RNA, 3813 nt, Phyllotreta armoraciae
auggaacguccaccccgcaaugaaccgcccguggagccugucaacggaguggugcaaccgccggugcauccgccgccugacaguccgggacgcguaacgaaccaacugcaauuccugcagaaaaccguacuaaaggcuguauggaaggacaaauucgccuggcccuuucaacaacccgucgacgcuaagaaacucaaccugcccgacuaucauagaauaaucaaacagccgauggaccugggaacgauaaagaagcguuuagagaacaacuacuauuggucggguaaagagugcauucaagauuucaacacgauguucaccaauugcuacguguacaaccagcccggcgaggacguagucgucauggcccaaacauuagaaaaaguauuuuuaaccaaaguggccgacaugccuaaacaagaauuugucguugaaauuccaaugaaaggcaagaaagggcgaguuagcgucggcggugggagcaccccaucuuccagcggaccggugccggcagcuguacccggaggugucagaggcaggccgcccgcgaccguuucuuccaccaguaccacaccaauugccaccacuacugguucguccggucuaccguugggcacacaagcgccugcgacguugccgggaagcacugccacgacgacgauagcgccggccaacaacaacaacagcucucugacgccgcagcagcucggcacgcccgucagcucgaugcacggaacccccggagcgccucuauccaauucccucgaucccacaggaguguugcccggaaacgucaugccgccggcgcaaccagccaagguaaaaaaaggcgugaagagaaaggccgacacaacgacgccggcgacggccuacgauuauccgacgguauuagaaucgaaaucggcgaagauuucgacucgcagagaaucgggcaggcagauaaagaaaccggcgcggcgggaaaucgaccuucauguaccucaaccggcgauccacaaacccaacgauaaguugacggaaucgcuuaaagcuugcaaugaaauucuuauggaauuguucuccaagaaacauucgaauuacgcauggccuuucuaucaaccggucgaugcagaacuauugggucugcacgacuaccacgacaucauaaagcgaccgauggacuuuggcacggucaaagagaaaauggacaacagagaguaccgcaccccgcaggacuuugccgccgacguuagacugauuuuuaguaauuguuacaaguacaaucccucugaccacgauguggucgccauggcgcggaagcugcaggacguguucgaagucaaauuugcgaagauccccgaugaaccaguaaaccggauaggaggagguguaaauaauuugcccauuaagucggaaucgaguaguuccgguucgaguucagauucguccagcgaguccgaggauucggaggaggaaaggcguaauaaacaauuaaaaguacuggaaaaagagcugacggcguugcaagagaagaugcgcaagcuggucgaagaaaguucgcgccggaaaaaggagaaaaagaaaaacaaaaugaaaaagaaaccgagcggggcgcugccggcgggcgcucugccgaacagcagcagcggucucgguuugcgcggcaacaaacccgccgccgcuucgaacgccgcccccaaacgggugaaggcuaacaacaagaccggagccggcaggaagaagaacgccgcccaaccgcccccgaugcccuucgauucagaggacgaggacaacgccaaaccgauguccuacgacgagaaacgacaacuuucauuagauauuaacaaauuacccggcgacaaauugggucgaguuguacauauaauccaaucgagggagccgucguugagggauucgaaucccgaugagaucgagaucgauuucgagacguugaaaccgucgacguugcgggaauuggagaguuacgucgcgucgugucugcguaaaaagccacauaaaaaaguagccggcaaaucuaaagacgaacaaauggcggagaaaaagcaggagcuagaaaaaagacuaaucgauguaaacgauaaaaucggcaauuccaaaaaagcaccuaaaaaagaugaagggaacaagguggacccgacgggcgcgggcggucccuccggucgccucuccuccagcucgagcagcucggauucggacagcagcaguagcagccugucgucgaguucgagcgauuccagcgacagcgaagcaggugguacgaccaacagaucuacuaaaaagaaagugaacaaaaagagcccaaacccuucagucgauaauacuacaauaacgaaaccacagcaaccaacaacagcaccaccaaugucacaaacacccgccaacgcaucggucaaugcuaaucuaaacguaucgguaucggcuaauucaaacgcaccgccacaaucaguaccugcgacgacgacggccacgccgaccgucaacaauaacuucccccagucgcagcaacagcagcccgugcagcaggcgcagcagauggcucccaacaagcaacagcacaauuuaaacguuaacgugucgucugcgcagcaacagcucgugccgccguugaacauaaaacccacggggauagauaaauugucggccgugaacccggugacgccggccagcguaccgcaagcgccgaaauccgucgcgcugccgacgcccucgcccgacaaaccuaaacccaacgugaucgcgcacauggaaaccuacaccgaucccaucgaacagagccucgccaauuuggaacaggacaccaucaccguacaacaauugaccaaucccaucccaucccauccgcacaugaaccucaauccuaacuugaaccaucccguuuugcagccagguucuuuaaacauggaccugaaggcgccggugacgauguccgcggcgaugcuccaccacggcgugccgaugucgauggacgucggcgacauaccggcccugaugcagacgcaggcgagccugaugcacgcccagaacaacgguuucggcaucaaacacgaauucgauuugacggcgaacaacaacggcaucacgucgaugggccugcccauggagaugucgauaucgucgauguucgaucagcugccgcagcaccugcacggccagcugaucaagcccgaucccggccaggaccggcucgacgggcugaucaacgacagaaaaccgccgcagggcguuguuaucggcgccggccccccggccgccuccaagccgcagccgcagggccagucguucggguacaagcaggagaagucggagcacaacgugaagaacgccagcucguggucgagccucgccaaggggaagaguccgcagaacaacacgcccggcggcaguagcaagcaacaggugauggacagcuuuaaagcguuccagaacaaggcgaaggagaaggcggauagggagaagcagcgauuggagaaccucgaaaugaagcggcagcagcgcgagcaggccgaacgcgagcgguugcgcgccgagcacgagaggaggcgagaaaaagaagaggaagaugccuuggagaaggccaggaaagcaguagcggaacaacagcccauaacgaaucagaggguggaagagcugcgaucgucgcccggugagggcagcacgucgccgggaucuuugaguucgggcuccgaaaggauaucggaaagggaaaggcaacgauugcaggagcaggaaagacgaagacgagaagugauggagaacaagauagauaugaauaugcaaagugauuuaauggccgcuuucgaagguucguuauga

SEQ ID NO: 5950 - RNA, 1224 nt, Phyllotreta armoraciae
augucuuuauccacagcucguccuuuagugagcguauacaaucagaaaucggaagaaguaaaaggcagcggcguagcucugcacgcugucuucaaggccccaaucagaccagaugucgucaauuucguucaucagcaggucucaaugaaccaucgccagcccuacagcgucagcgacaaagcuggucaccaaaccuccgcggaguccuggggaacaggucgugccguagcccguauaccucguguacgcgguggcgguacccaccgaucgggucagggagccuucgguaacaugugucgcgggggucgcauguucgcgcccaccaagccguggcgccguuggcacagacgcgucaacaucaaccagcgucgcuacgcccuggcgucggccgucgccgccagcggcgugcccgcuuuggucaugagcaaggggcacguggucgaucagauacccgaguugccguuggucgucagcgauaaggugcaggagaugcacaagaccaaggaggccgugcaguuuuugagaaggaucaaagcaugggcugacauccagaagguuuacaagagccaacgguugcgugccgguaaaggaaaaaugcguaacaggagacguauccaacguaaaggaccacucaucguuuacuacaaagaucaaggucuucgucaagcuuuccguaacaucccuggcauugaccucauuaguguccaaaaguugaacuugcuaaaacuggcuccugguggucacguaggucgauuugucaucuggaccgaaucggcauuccaacguuuagacaaauuauucgguacauggaagaacccaucgaccgaaaagaaggguuacaauuuaccccaacccaagauguccaacaccgauuugucuagguuguugaaagcugacgagauuaaagcuguucuuagggcuccucaaaagaaggugguacgucguguucgucgucucaauccuuugaccaacacuaaggcuaugcuuaaguugaacccguaugcugcuguacucaagagagaagcuaucuugaagaaccaaaaaaggcaauugcaaagggacgaagcuuuggcuaagaaacgaggaaucacccugacuccugacaacgcuguaaucaggaccaggaaauugcaggaaagacgaagagcucaaauuuugaaagauaagaagucgaaacccaagaaggccguuaaagcgccggccaagccugcuggaaagaaauaa

SEQ ID NO: 5951 - RNA, 5394 nt, Phyllotreta armoraciae
auggcagauuaucuuaauucagaagcugaggaaucuagcgaggaggaagaauuagaccauagggaucgaaagaaggcacaaaaagcaaaacuaguagauaguucugacgaggaagaggaagaagaugaugaagagaaaauuagagaagaauuaaaagaucuuaucgacgauaauccgauugaagaaagugaugcugaauccgauacuucaggucgugaaaaaagaaaaaaaucagacgaugaagaccucgaugaucgauuggaagacgaagauuacgaucuguuggaagaaaauuugggucauaaaguagaaagaaggaaauucaaacguuugcgucgguucgaugaugaagaaagcgaaggagaagaagaacaugaucccgagcaagaucgugaacaaaucgccauggacauauuuuccgacgaugaaaaagacgaucgucagaaaaaggaugaagaacgaaggucagaacgaagucaaagaccggucguugagcaagaaucuuucggagugggcgaagaggaagaagaaggcgauuauucagaugcugaugauuuuauuguagacgaugaugguagaccuuuaaucgagaaaaagaggaagaagaaaccgauuuucacugacgccgcgcugcaagaggcccaagaaacauucggcguugauuucgacuacgacgaguucaccaaauaugaccaagacgaguaugaagacgaggaggaugaagaagaagacgaauacgaagaagaugacaacgaacgaagaaaacauccgaagaaagcggcgcggaagaaguugaccaaaaaguccauuuuugaaguguaugagccgagcgaauugaaaagggguuucuucaccgaucucgauaaugagguucguaacaccgauauacccgaacggaugcaacuucgcgacguucccauuacucccguaacggacgauucgaccgagcuggaagacgaagcagaguggauuuacagacaagcuuuuugcaacaaggcaauauccaauguugaugcccaccuuucagccgaggcaagagagaaaaugaagaagggcucucaaacuguagggaaaauaaagaaagcauuagauuucaugaggaaucaacaacucgaggugcccuuuauugcuuuuuacagaaaggaguacguucaaccugaacuaaauauuaacgauuuauggaaaguuuauaaauacgaugcuaaguggugucaacuaaagucucgaaaggaaaaucuccuuaaacucuucgacaaaaugagguauuaucaacuagaucaacucguaaaaaauccggacgcuccuauuccggacaacgugcgaguaaugaaagauucggauaucgaaagacuaaaaaacguccaaacugcagaagaacucaaugacguucacaaucauuucauauuguauuauuccggagacuuaccugccaugcaugccgcuuggagaaucaaagaaagagagcagaggaaauacgagaaacgucaaaaaagacucagacaaauugccgaagcggaagaaggugcugagauucccgaugaaccagaagacgacgaugaugaugaaccagaaacggaaacuuugaaguacgcuaaucggucgggcaguuacgcauuauguucgaaagcuggauuagauccuuuggcaaagaaguuugguuuaucacccgagcaguuugcugaaaauuuaagagauaauuaucaaagacaugaagucgaucaagagccugucgaacccuccgacguugccagagaguuuauuucuccuaaauuuucaacugucgaugaaguauuacaagcgucuaaauauauggucgccuugcaaauagcuagagaaccauuaguaagaaaaugcguuagggaaguauauuuugaaagagccaggauuaauguauauccgacaaagaaaggacaaaaagucaucgaugagucucacaauuguuacaguaugaaguauuuaaaaaacaagccggugagagauuuaaacggagaucaguuuuuaaaguugugcuuagccgaagaagaaaaccuucuuacuauuacaauuaacgauaacaucgaagggaauacaucaaacucuuacauagaggaaguuaaacagcucuacaucaaggacgaauuuaguaaaaauguacaagauuggaacgcgcugaggauggagugcguagaaagggcgcuaaccaaaagcguuuugcccgauuugagaacagaauugaagaggaccuuguuauccgaagccaaagaauucguccuuaaggcguguugcaggaaacucuacaacagcauuaaaauugcuccauacucgauuacauuucccgaugaagacgaacaugaaugggauacaucuaaaggugucagaguuauggguuuagcuuacgugccggaauauucaguuucagcauuugcuuguauagcagcuccugauggagauaucacugauuauuugcguuuaccucacauauuaaaacgaaaaaacaguuucagaacagaagaaaaauuaaugaaggaaggagauuugcaagccuugaagaacuuuaucuuuuugaaaaaaccacacgugauugcaaucggcggagaauccagagaagcucucaugauagcggacgauuuaaaagcucuaauuaacgaauugguugaauccgaucaauuucccgaaaucaaagucgaaauuaucgacaacgaauuagccaaaauuuacgcaaacuccaacaaaggccagucggacuucagagacuaucccgagcuguugagacaggccauuuccuuggccaggaaaaugcaagauccucucaucgaguauucgcaguuguguaacggagacgaagaaauauugaguuuaagauuccauccacuacaagaacaaauagcgaaagaagaacucaucgaagcucugugccucgaauucgucaacagaacuaacgaagucggugucgauauuaauuuggccguacagcaggcgcacaaaagcagucucguucaauucguuugcgggcucggcccucgcaaagggcaagcccugcugaaaguccuuaagcagaccaaucaaaggcuagaaaauagaacgcaguugguuacugcuugucacaugggcccaaaaguguucauuaauuguuccgguuucaucaaaaucgauacuaauaguuugggagauaguacugaagcguauguggaaauauuggaugguucucguguucauccggagacguacgaaugggcuaggaagauggcuguagacgcuuuggaauacgacgaugacgagagcgcuaauccggcaggugcuuuggaagaaaucuuggaaacucccgaaagauuaaaagaucuggauuuggaugcuuucgccgaagaauuggagagacaaggauucggcaacaagagcaucacuuuguaugacauaagagccgaauugaacuguagauacaaagauuugaggcaaccuuuucauucggcaaauccugaagaauuguuugauaugcuaacgaaagaaacgccggaaacauucuauauaggaaaauugguuacugcuucgguuauagguauugcaagaaaaaaaccuaaaccugaccaacucgaucaggccaaucccgucagaaaugaugaaacgggucuuuggcaauguccguuuuguuugaaaaacgauuuuccggaauuaucugaugucuggaaucauuucgaugcuggugcauguccuggccaagcaaccggagucaaacuuagauuagauaauggaauaauggguuacauuuauauaaagaauauuagugauaaaccgguaucgaauccggaagaaagaguaggaguuggucaauuaauuaguugucguauaauaaaaaucgacguugaaagauucagcguugauuguacgucgaaaucuagcgauuuguuggauaaaaaucacgaauggagaccaccaagagauccccauuacgauacagaacgcgaagaaaaagacaacagaacugaggcggaaaagaaaaaagaaaaacaacgcuugacauacauaaagagaguaauaguucacccggcuuuucacaauauuucuuacgccgaagcugaaaaaugcauggucaacauggaucaaggcgaagucaucaucagaccguccagcaaaggagccgaucauuugacgauaacauggaaagucgccgauaacauuuaucaacacauugauauuagagaagaaggaaaaacuaacgcuuuuucuuuggguaaaucguuguugauaggcaacgaagaguuugaagauuuagaugaaauaauagcgagacaugucacuccgauggcggcgcacgcucgcgauuugcucuacuucagauauuacaaagacuucgagggcggucacaaagacaaggccgaagaguaucuaaaagacgagaaaaagaagaacgccucgaaaauacauuacgucguuagcgcagcaaagcacauaccuggcaaauucuuacuuucguauuuaccgagaaacaaaguuagacacgaauacguaacggugacuccugaaggauuuagauucagacagcaaauguucgauucgauaacgucgcuguucaagugguucaaggagcacuuuagagagccaccgccgggcggaaugacacccggaacuccaagaauguccacuggaagaacaccuuaugauaugaguacugaagcuauucaaagaguugcacaaaaucuuccaagcgauaugguccaagcuuuaucugcugcaacgaaccagacuccucacuauccacacacuccuggcgguuacggugguaauuacaucaauacaccguacaccccuagcggucaaacgcccuacaugacuccauuccaaacgccucacgcucaacaaacuccgcgauacggccaacagacgccgucucagccgucucugagcaacccguuccuccaucccggcgccgugacuccgucgcaacgaacccccagcuacaggaaccuaucgacucaaaguccgaugauaccgcaaaguccggugccgaguccuggaucgcagaguucguacagcagccacaugagccaccacacgagggcgaguuacggggauucgaugagauuccaaccgccggaaucgccgagggguuacccgagcagcaggggcucauauccugauggaagguacggggguagcgaaucgauggauuggcagaaggccgcugaagcuugggcuucgagguccaaaucaacaccacggagcgaaggucgcgggacucccagaucgucuggucacagaacuccucguaacuacgauaaucuaucugaaagcgaucgaucuaggaugaagcauaugagcaguaagagcccaaaaucgguacggucgacuccccguaccaauucuucgccuagaucuaugucauugggcgacgcaacuccuuuguacgacgaaaauauuuaa

SEQ ID NO: 5952 - RNA, 2583 nt, Phyllotreta armoraciae
augccagaaguggacaacagcgaagcgcgcucuccucggcguaaacgccgcagguccaaauccggcgaucgcaaggaagagaaaucguccaaaaggaagucaucgaggaaacguucgucggacgacgauuacaaugagcgagauuauccacgcuauuacggcgaagaucggccgaacagcgacagcuacuggaacaaauaucccaggagagacaacaugaaagucggucgaagguauuacgaucacccugagcacgagaagaauagggauagggaugucucgaacgagaggagcagagauagagauagagaaaguaccagagggaagaaagaggagaacgaggauaaauccguuauuaaacccagagaacguaaagucgucgauaugcuaacuuccagaacaggaggagccuacauaccaccagcaaagcuccgucugaugcaagagaguauaacagacaaaucuucagcugcuuaccaacguaucgccugggaggcccuuaaaaaauccgugcaugguuacaucaacaaaaucaacacaucuaacaucggcauaaucgccagggaaauccugcacgaaaacauaguaagaggcaggggucugcuuugcaaaucaauaauccaagcgcaagcugccucuccaacuuucacaaacguuuacgcugcccuaguggccguuaucaauuccaaauuucccaauaucggagaguuguuguugaaaagacuggugcuccaguucaaaaggggcuacaagcagaacaacaagucuauuugcauuucggcuacuacauucguggcucacuuggucaaucaaaggguggcucaugagauucuggcgcuugaaauucugacucugcucgucgaaacuccuacugaugauuccguagaaguggcuauuucuuuucugaaagagugugggcagaagcuuacggaagucucgaguaaaggaauaacugcuauauucgagaugcugaggaauaucuugcaugaaggccagcucgagaaaagaauacaguacaugaucgaggugauguuccaaauuagaaaggacgguuuuaaagaccacgccgcuguaaccgaggaauuagauuuaguggaagaagaggaucaauuuacccaccuaaucaugcucgaugauguaaaggaggcaaaugcugaagauauucuaaauguauucaaguuugacgaacauuaugaagaaaacgaaggcaaauacaaaacucugaguaaagaaaucuugggaagcgauagcgaaucagauacgggaucggagggaucugaagaggauucugaaggcgaagacgaggaugaagaaguuaaagaugccgggaaaaucaucgauaauacugaaacaaaucuaauagcccuuagaaggacaauauauuugacuauacaaucuaguuuggauuucgaggaaugugcucauaagcuuuugaaaauggaguuaaaacccggccaagaaaucgaauuaugccauauguuuuuagauuguugugccgaacaaagaacauacgaaaaauucuacggacuucuagcucaaagguuuugccaaauaaacaaaauauacaucgagcccuuucagcaaauauucaaagacaccuacgcuacuacccaucgguuggacaccaauagauugaggaacgucagcaaauuuuucgcucacuugcucuucacggacgccauaggcugggagguguucgagauuaugaagcugaaugaagaagacacuaacagcucgagcaggauuuuuauuaaaaucuuguuucaagaauuagcagaguacaugggccuaggaaaguugaauaccagauugaaggaugaaacacuucagcagcauuuugcagggcuguuuccuagagacaauccgaaaaauaccagguuuuccauuaauuucuucacguccauugguuuaggaggucuaacagacgaacuucgggagcauuuaaaaaacgucccuaaaauuauggaaacuaaaacggccucugugaaggaagaaaguggcaguagcaguaguagcagcagcagcucuaguagcagcaguucgagcgaagaagaaagcagugaugauaguucuggggauucgaguucagaggaugaaaaacaaaaggaaaaaucgaaaaagaagaaaaagaaacgcgauucggaaagcaaaucgucaaaaucagauucaaaaaguaaucguaaagcugaaaagcgugauagcaguaagcacaagaaaaaggacaaggaagaucacaaagaaacccacaaaaauaaagagaauagaagcgauacggacaagcacguuucaagggagaagcaaaacucgaggcaagauaaaagaaaagacgacggcgauaguaaagaaaaacacagaaaagaugauagagaggacagggagaggcaacggaggaacgaagaaaagggugggaagaaaaaggacuacgaauggaucaaaaguagacacgaggauaacauacaucaauuaaaaacuucuaaaaaaguguuugaaaaaccaucaaagcacagaucgagaucgagagacaaaauuaguaguaaagaaaaggaccgaaggcauagaaguaaagaaaggcgaaaaaguuaa

SEQ ID NO: 5953 - RNA, 1788 nt, Phyllotreta armoraciae
auggcguugaaaaaccaagucggucaaaaaauaaugaacgaggugauaaaacacaaacccuccaagaagaacgggccugcaguugcacaaccccauaacgcugccgguguugacuggagaauccugguggucgaucaacuggcaaugagaaugguaucggcuugcuguaaaaugcaugacauaucugccgaggguaucacauuggucgaagauauaaugaagaagagagaaccgcuugcuacaauggaagcuguguauuugaucacgccuuccgagaagucuguucaugcucucaugaacgauuucgaaucuccgagacccauguauagaggagcacauguauuuuucacugaagcauguccagacgaauuauuuaacaaauuaaguaagagucaugcagcaaaauauauaaaaacguuaaaagaaaucaacauagcauuuguuccaacagagucacagguauuuucuuuagauuccccagacacuuuccaauguaguuacgauccuucauuugcugccgcacgaaaugcgaauauggaaagaauggccgaacagauugcaacguugugugccacuuugggggaauacccgcacguccgauauaggagcgauugggaacguaacguggaguuggcgcaauugauucagcagaaauuggacgcuuacaaagcugacgagccgacuaugggagaagggccggagaaggccaggucgcaacugcugaucuuagaccgaggcuucgauugcguuucaccguugcugcaugaacugacguuucaagcuauggccuacgacuugcuuccaaucgaaaaugacguguacaaauacgaagcuuccgcuggggugcagaaggagguccucuuggaugaaaacgacgagcuguggguggaauugcgccaucaacacaucgccgugguuucucaaagcguuaccaagaauuugaaaaaguucaccgauucaaagcgcaugacccagagugauaaacaauccaugaaggauuuguccacuaugauuaaaaagaugccgcaguaucagaaagaauugucgaaauacgcuacucacuuacaucucgccgaagacugcaugaaggccuaccaaggguauaucgacaaguuaugcaaaguugagcaggauuuggcaaugggaacugacgccgaaggggagaaaauuaaagaucacaugcgcaacaucguuccgauucuuuuagacaccaaaauaacaaacgaguacgauaagaugcgcaucauagccuuguacgcuaugacuaaaaauggaauaaccgaggaaaaucuuucaaaacuaggacaacaugcaucaauuaaagacaaacaaacuaucgcuaaucuacagcuccugggaguuaaugucauuaaugaugguggucccagaaaaaagcaguacaccguaccgcgcaaagagcgaauuacggaacaaacuuaccagaugucgagauggacuccuguuauuaaagacaucauggaggauugcaucgaggacaaauuggaucagaaacauuuucccuaucuaaguggaagggcgcaaaccaccggauaccacgcagcgccuuccagugcucgauauggacaauggcacaaagauagaggccagcaggcagucaagaacgucccgcguuugcuggucuucgucguuggaggcauaaguuucucggaaauucgcugcgcguacgagguaacaaacgcccagaagaauugggaagucauaaucggaucgucgcauauucuuacaccagaagguuuccucagugauuuagcgacguuagccggcuag

SEQ ID NO: 5954 - RNA, 2139 nt, Phyllotreta armoraciae
augaugcaacaauauaugaaagaauuagaacaagagccuuucgaugcugaagaauuuguagaacguuuagccuggagaacuuuagcugaaucaaaaagcgauggagaggagaaugaaauuaauccggcucuucuucacgaauccuucguucaagccauaaaggaccuuaauuuauugcacgaaaggcaacagaaaaaaugcgaaaaauuagaaguugccguuagagaagacgaagcgacguuuuuccaagaaguuuauaauuuauuggaacagaauaagcaagcuauggagacauuucaagaacuggauggaaaaauuaaucauguggcaacuaaaguucuucacuuaggagaucaguuagacaguguuaaugguccuagaucuagaguugucgaugcguuaagcuuaaugacucacuugagggaauuucuaucaaacgaaccaguuucauccacaauauuuaccaaugaaaaauacauugaugaagcagcagauguaauucaaaaguuguauuuaauaucgcaagauuugccacccaaguuugaaucgauaaaaagaaaaauagaaagaaaauauucagauaucgagaaaacacugauagaagaguuuguuggggcuauggauaaugagaauuuaacaagaaugaaggagauagcauugguacugucucaauuuaaaggcuacucucagugcauugaugcauauauagaucacagccaaguggguuguuuaucuaguaaagaugucuucuauaacuuuuugaauuuguguaaauacaaggaugaaauaauuagaaaaguuuucaagaauccggagcaagugauggcgaaauucguuuuaaauauauaucaauugaaacuuguggaauauauagaucaaaaacuaaauucuaaauuggguacauacaguuauuuacaaacguuauaugaguuguauucaaagacuaaucaucuuucgaacgaauuagccguuuuucauaugggcaaugacaaaaacuuucucacuaaacuaacaacaaauauuuuuaauaaguacauuaaugauuacauuucuauggagcugaagugucucaaagacagauguucaacuaacuuacaaaaauauuacgacucaaaaaaucaucaaaagaaacagauucaaucugggggcuuucaagaucuuagaagagauuuacaagcagugauagguacaagggcaaauauuaacauagcacaaauagaaaauuauggcggugaaacuuucuuaucagaggaauuggcuaucaugauucuucaggauacuaaacaagcuuuucaacguugcuuauuguuaucaaaaggcagugaaaaagcuucuaaugccacucaaauuuuggauagacuuauuaauaguuugcuaauagaacauguagacuaugcaguugaauugggucuacaagcuguacccguugucgaaggcguuaaaaaucccccuguuuuguauuuuuuuaaugucguccaucaaagcaauaauauaacccaucucgucgagaaacaguucauggauuugguggucccauuaguagaaaauacuccaaaauacagcgauugcguccagaagaaaaaauuuguuuuggaggauauagaaagaaaaauuaauacaggauuggauaggugcuugagugccauauuaaauugggugaaguuguauuuacaaucugaacaaaagaaaucagauuuuaagccagagucugaugauuuugauacaguggccucaucagcuugcaagaacguacuuaauuauguuaauggcauuauuaaagaaauuaaaacgaauuuggauggcaauaauguaacagcuauucuucaagaauuagggauuagauugcauagaguuguuuacgagcacauguugcaguaucaauacaacacugcaggugcaaugguggcaauuugcgaucuaaacgaauauagaucuuguacuaaacaauuagguccuuuaguugcggaacuuuuugauacuuuacaugcuuuaugcaaccuuuuacugguuaaaccagaaaaccuucaacaagugugcucugaagauucuuuggguaaauuagacagagcaauccuucauaguuuuauacaauuacgaagugauuuuaaaguucaaaagcagacuauguugaaaguuuag

SEQ ID NO: 5955 - RNA, 813 nt, Phyllotreta armoraciae
auggauuuccaaaaccgacccggugggaaaacgggcggaggcggcgucgccuccuggucggaaaccaaccgagaccgcagagaacgacugcggcaacuggccuuagaaaccaucgaucugcagaaggaccccuauuuuaugaaaaaccaccugggcuccuacgaauguaagcuuugccuaacauuacacaacaacgaaggaaguuacuuggcgcacacgcagggcaaaaagcaccaggccaauuuggcucggagggcagccaaggaggccaaagaugcccccucguugcuccagcccgagaagcccagaguggagcccaagaaauucgugaaaaucgguagacccgguuaucggguaacuaaacagagggaucccgaaaccggccaacagaguuuacucuuccaaaucgauuauccagaaauaagcgacuugguuuugccucgacaccguuucaugucugcguacgagcaaaaaaucgaaccgcccgaccguaaauggcaauacuuacucuucgcagccgaacccuacgaaaccauagccuuuaaaguacccagcagagaagucgaaaaaaccgauacuaaauuuuggacucauuggaacagagacaccaagcaauuuuuucugcaauucgcuuucaagaacgagaacaaacgauccguuaacuccguuguucaaaggcauucgaucgucgguggaguuccaccgccucccaugcugccgguaccgccgccgcccaggccuccuauguuuaaucccauuccaccgccgccgccgaugaugagggccguuuuacccguaccuccaccgaacuaa

SEQ ID NO: 5956 - RNA, 402 nt, Phyllotreta armoraciae
augucuaucggcguaccuauuaaaguucuccacgaagccgaagggcauauuauaaccugcgaaaccauaaccggcgaaguuuacagggguaaacucauagaagccgaggauaauaugaauugccaaaugacccagauaacuguaacguacagagacggacgaguggcacaauuagaaaacguuuacauuagagguuccaaaauaagguucuugauauuaccggauauguugaagaaugcuccgauguuuaaaaagcaaaccaaagcuggcacugcagguagagggaagucugcaauucuacgagcucaagcucggggaagaggccggggccaaccgccugugcgaggaggcagaggagcauggcagaaucagcaaaaugccccugcgggucgagcaaaauaa

SEQ ID NO: 5957 - RNA, 1329 nt, Phyllotreta armoraciae
auggcuacaaauuugucccgaacaucgcuccugagaauccuuaacgcaaggggcuauucugccuguccgcauccacuuuccggcauuccaaaugcagaaguaaaaagcaccguucuccccaacaaaaccguuaucgcugcuguugauaacagcgccucucucaccagaguuucaaucguauucagggccggaagucguaacgaagacccagaaaauuuagguguagcucacguuuugaggacggccgccggucugaguacgagaaacuguucgcaauucgcuauuauccgcaacauucagcaagucggagccaauuuaacggccacauccgacagagaaacuaucuguuacacguuggaagguacccccgaagcuguggaaugcgcuauaccauucuuaaccgaaguagccacccaacaagaauuuagaccuugggaaguuuccgaauuguccaguagauugcaguuggauaucgccacuagaccauugcaguugagagcuaucgauuugcugcacaacgcugcuuuuagaggacgcggcuuggguaauucuuuguuuauuccgaaaacucaaauuggcaaaauaucguccgaaacucuacaacauuacguuagcucgaacuucuugagcggacguauggcagucguugguucggggaucagccaaaaggaauugacgucuuuugcuaauuccuuaaaaguagaaaacggcgaaggcaauaacgccccuucuccuuacguaggcggugaauuaagaucgaacaaagguggucaacuggccuuuauugcuguagcaggagagggcgcugcucucaaaaaccacaaggaagcuuuagcuuuugcuguacuucaaggagcccuuggaggaggcccccaaguuaaauacggaguuucugauaauggaaucuuccgaaaggcucuuggaaauaacccuagcguuaguucaguagccauaaaugccaguuacuccgauaccggucucuuuggacuucuucuggcuguuccgacgaauucugcgagaagugcucuagaaagcgcuguuaaaguacucaagaguggaucgguauccgaugaagaugucagcagagguaaaaaucaauugaaagcaucgauccucuucaacgcugaaagcggggcagauauuguaagaacuauuggacaagaagcuguuuugacgcaaaaaguuacaagugcugaugcacuuuuggcugaaguagaugcuguuuccaccagugacgucgcaaaugcucuuaagaaagcaggcaagaaauuaucgcucgcaucuguuggaaacuuagcuggaguaccauuuuuagaugaacuaaaguaa

SEQ ID NO: 5958 - RNA, 330 nt, Phyllotreta armoraciae
uacaaccaacaacuccauggcucaaccucaucaaacuaccuguuaccagucucuaacaggucuucauccucucucucuaaucaucggacggcugaagagcuggaaucucagaacgaugaagccaucgaugggcuaagugcaaaaguuaaaaugcuaaaggagauuacaguugggauuggaaaugaagugaaagaaucgucuaagcuuaucacuggaaucaaugauucuuuuucagaagcuagugggaucuuaagugggacguuuagaaagaugaacaggaugucuaagaaacauacugguagaugguacuacuggcugcuauuucugguu

SEQ ID NO: 5959 - RNA, 1491 nt, Phyllotreta armoraciae
augucuuucccaucgacgauaaacgcaaaacaggccgcacacgaacacguuuuggccguguccagagacuucguaucccagccgaggcucaccuacaaaacagugucuggugucaacggaccguugguaauccucgaagaugucaaauuuccgaaauucaacgaaaucguccagcucaaacuggccgauggcagcuugcgauccggucaaguauuggaagugagcggcucaaaagccguaguacaaguguuugaagguacuucgggaaucgacgccaaaaacaccaugugcgaauuuaccggcgauauucucagaacgcccgugucagaagacauguuggguagaguguuuaacggcucaggaaaacccaucgacaaagggccuccgauuuuggcugaggacuacuuggacauccaaggucaaccgaucaauccuuggucgcguaucuacccggaggaaaugauccaaaccgguaucuccgcuaucgaugugaugaacucgaucgcucguggucagaagauucccaucuucucggcggccggucugccucacaacgaaaucgccgcgcaaauuuguagacaagccggucuugucaaagugcccggcaaguccgcuuuggacgaucacgaagacaacuucgccaucguguucgccgcuaugggagucaacauggaaacugcucguuucuucaaacaagauuucgaagagaacgguucgauggagaacguaugucuguucuugaauuuggccaacgauccuaccauugagagaaucaucacgccucguuuggcucugaccgcagccgaauuuuuggccuaucaaugcgagaaacacguguuggucauauugacugacaugucuucguacgcugaagcuuugcgugagguaucagccgccagggaagaagugcccgguagacgugguuucccagguuacauguacaccgauuuggcuaccauuuacgaaagagccggacguguggagggccgaaacgguuccaucacucaaauccccaucuugacuaugcccaacgacgauauuacucacccgauucccgauuugaccgguuacauuaccgaaggacaaaucuacgucgaucgucagcuacacaacaggcaaauuuacccgcccauuaacgucuuaccgucguugucgcgucucaugaaguccgccauuggcgagggaaugaccaggaaagaucacucugacguuucuaaccaauuguaugcuugcuacgccauugguaaggacguucaggcgaugaaggccguggugggagaggaggcccugacgcccgacgauuugcucuauuuggaguuccugaccaaguucgagaagaauuucaucacgcagggcagcuacgagaaccguacgguguucgaaucgcuggacauuggcuggcaguuguugcguaucuuccccaaggaaauguugaaacguaucccggccgccacguuggccgaauucuacccgagggacucgcgucauuag

SEQ ID NO: 5960 - RNA, 1515 nt, Phyllotreta armoraciae
augaacgaaauacgcgaacgggaaagggcaggaauccgaguccccgacgaauuacgagccauguugcucgaauucaccugcagcuauuugcucgaacagcccgaagacguagucucauacgcgcaggaauacuucacuaaauuuaaagaaagcaggggcacugcguugaucuaugaccaggacauguacgaucaggaaacaauggguaucaaaauggguaucaaaaccguuuuggcucgccagauauucgacuccagaggcaacccgaccgucgaagucgacaucaccaccgauuuggggcuauuccgagcagccguaccauccggagccaguaccgguaucuacgaagcccucgagcuccgcgacaacaucaaaaccgaauaccacggcaaaggcgugagccaggccaucaaaaacaucaacaccaucaucgccccggagcugaucaaggccggcuucgaggagacacaacagaagaaaaucgacgaguucaugaucaagcuggacggcaccgagaacaaguccaaauugggcgccaacgccauccucggcguuuccuuggccauuugcaaagccggagcggccaggaaaaacgugccguuguacaaacauaucgcagauuuggccgguaacaaggauaucauccuaccaguacccgcuuuuaacguuaucaacggugguucccacgcuggaaacaaacuggccaugcaagaguucaugauucucccuacuggcgccacaaccuucaccgaagccaugcgaauggguuccgaaauauaccaucaccugaagaagguaauccacgccaaguucggcuuggacgcgacggccgucggcgacgagggcgguuuugccccgaacauccucaacaacaaagaaggucucgagcucaucaaaguggccauccaaaacgccggcuacaccggcaaaaucgacaucggcauggacguggccgcuucggaauucuucaaagaagguaaauacgauuuggacuucaagaaccccaacagcgacaaaucgaaauggauauccuccgacgaacuagaagcuuuauaccaggaguucaucaaagaguacccgaucguuuccaucgaagaccccuucgaucaggacgauugggccgccuggagcaagcucaccggcaacaccaaaauccaaaucguaggcgacgauuugaccgucaccaaucccaagcgcauucagacggccguggagaagaaggccugcaacugccuguugcugaaggucaaccagaucgguacggucacggaaucgaucgaggcccaucugcuggccaaggcgaacgguuggggcaccauggugucucacagguccggggagaccgaggacacguucaucgccgauuuggucgucggacuguccaccggacaaaucaagacuggggccccgugcagguccgaacgguuggccaaguacaaucagauucuucguauugaggaggaauugggggccggugccaaguacgccggaaaggcauuccguaaaccgcaguaa

SEQ ID NO: 5961 - RNA, 2421 nt, Phyllotreta armoraciae
augaguuacaugcagacuaaccaaaauagaccaaugucucaagguuaucaucagggcggcaacgaucucccgaugcagucguccaaagaacagacccugcuauggcagcagaacuccuauaugggagacucaggcauccagucgggggcugccacucaagugccaucgcucuccggcaaagaagaggaagagauggaccucuucgaucuggaccagcccuaccaaggauucacgcaagagcaaguagacgaaaugaacaaccaguugaaccacaccagaucucaaagggugagggcagcuauguuccccgaaaccuuggaugaagggaucgagauuccuucgacucaguucgauccaaaccaucaaacggcuguucaacguuuggcugaacccagccagaugcucaaacacgcugugguuaauuugaucaauuaccaagacgacgcugauuuggcgacgagggccauaccagaauugauaaagcugcucaacgaugaagaucaaguagugguaucgcaagccgcuaugauggugcaccagcucucgaagaaagaagcuucucgccacgccaucaugaacagcccgcaaaugguggccgcuuugguucgagccauuucgaacuccaacgauuuggagacgaccaaaggugcugucgguacguugcacaaauuaucgcaccacaggcaggguuugcuggccauuuucaagagcggcgggaucccggcacucgugaaauugcugaguucuccggucgaaagcguacuguucuacgcuauaaccacccuucacaacuuguugcuccaucaggacgggucgaaaauggcgguuagauuggccgggggauugcagaaaaugguggcguugcuccagagaaaccacgucaaauucuuggcuauucucaccgacuguuugcaaaucuuggcuuacggcaaucaagagagcaagcucaucauacucgccucucaaggcccuaucgaauuggucagaauaaugagaucguacgauuacgagaagcuuuuguggacuacaucgagaguauugaaaguguugucgguguguuccagcaauaaaccggcuauuguagaagcuggcgguaugcaagcccucgccaugcauuugggcaaccccagcacucgguugguucaaaacugccuuuggacccucagaaaucuaucggacgcggcuacuaaagucgacggauuggagaguuuguugcaaucauuaguucaagugcugcaaucgucugacgugaacguggugacuugcgccgccgguauccugucgaauuuaacgugcaacaaucaacgcaacaaagugacggugugccaagugggcggcguggacgcccuggugcguaccaucgucagcgcgggcgaucgcgaggagaucaccgagccggcggugugcgcccuacgccaccuuacaucgaggcacgucgaguccgagauggcgcagaacgccguucggcugaacuacggcauacaagugaucgucaagcuguugaauccgccgucgcguuggccgcuggugaaggcggucaucgguuugauuagaaaccuggcgcuguguccggccaaucacgcuccguugagagagcacggcgcaauccaucauuuggugcagcugcugaugagggccuuccaagacacucaaagacaacggaguagcgucgccagcggaggcagccagccgccgggaacguacgcggacggggugcgcauggaggagauuguagaaggaacggugggagcguugcauauauuagcgagagaaucgcacaaucgggccaucauuagacagcaaauggugauuccgauauucgugcaauugcuguucaacgauaucgagaacauacagcgcgucgccgccgguguucuuugcgaauuggccgccgacaaagagggggccgaaaugaucgaaaacgagggcgccaccgcuccuuugacugaguuguugcauucgagaaacgaagguguugcuacguacgcagccgcgguuuuguuuagaaugagcgaagacaaaccgcaggauuauaaaaagcgacuaucgauggaguugacuaauucuuuguuuagagaagaaaaucuuuggaaucccgaccuaggcauggguccggauuugcaggauauuuuaagucccgaccaggcauacgacaacauguaugcucagggucccccgaguguucacaguagucacggcggccgaccuuaucaacagcaaggguaugaccagauacccauagacaugcaggguuuagagaucgguucucacggagggggcaacggguccacuuacagugcaauagacgcgauggacguuaccagcggggaacccgaucucaauuucgauaccauugaucaacucccuaccccuccucaagauaacaaccaugccgcugcuugguaugauaccgauuuauaa

SEQ ID NO: 5962 - RNA, 801 nt, Phyllotreta armoraciae
auggcccgaaacgcagagaaggcaaugacaacauuggccagauggagggcggcccaauugggcgaaaucgacaagcacaaaaaacgccggcccuauuuggcguccgaaugcaagagccuguacgccugcgagaaauggcgcaugcagauaaucagggaaauagcgaaaaaaguggcccaaauccagaacgccgggcugggcgaguuccggauacgcgaucugaacgacgaaaucaacaaacuccugcgcgagaaacgccacugggaggaccaaaucaaggaguuaggaggcccagauuaccagcgagucggcccgaggaugcuggaucacgaaggcaaagaaguacccggcaacaggggcuacaaguacuucggagccgccaaggaacuaccaggcguucgagagcuguucgaacaggaaccgccgccuccgccuaggaagagccgggccgagcugaugaaggacaucgaugccgauuacuacggcuacauggacgacgacgacgggauauuaauaccgcucgaagucaaagcugaaaaaaucgccguucaaaacgccguaucggaaugggugagcaacaaggaaaagaaccuggacucgagcaagguaaucgaagagagcauuuacgcgguggaggacuccgacgaagaggaugccguucaacaguucgauggcucgcaacagcgauucguugcucacguacccguaccgucacaacaggacaucgaacaggcuuuguugaggagaagaaagcaggaguugauggaaaaguauggcguacaagacgaacaagauguauga

SEQ ID NO: 5963 - RNA, 645 nt, Phyllotreta armoraciae
auggcugcgaaagacaugcccacauucaaaugcgucuuagucggagacggugguaccggcaaaaccacuuucgucaaacgccacaugaccggcgaguucgagaaaaaguacguagccacccugggugucgaaguccaucccuuaguguucacgacaaaccgaggcaaaaucugcuuuaacgugugggacacggcgggccaggagaaguucgggggccucagagacgguuauuacauucagggacagugugccauuaucauguucgaugucacguccaggguuacauacaaaaacguucccaacuggcacagggauaucgucagggugugcgaaaacauaccgaucguacuauguggaaacaaggucgacaucaaggauaggaagguuaaggcuaaaaguaucguguuccauaggaagaagaaccuucaguauuaugacauaucugccaagucgaacuacaacuucgagaagcccuucuugugguuggcgcgaaaacuuauuggcgaucccaacuuagauuucgucgcugaaucggcccuucucccuccggaaguucaaauggauccccaguggcagaaacagcucgaaaacgauuugaaagaagcuucggagaccgcucugccagaugacgaugaagauuuguaa

SEQ ID NO: 5964 - RNA, 2505 nt, Phyllotreta armoraciae
augccgagaauaaugauaaagggugguguuuggaggaacacagaggaugaaauucuuaaggccgccgugaugaaauacggcaaaaaucaaugguccagaauagcaucucugcuucacaggaagucugcgaaacaauguaaagcccggugguucgaauggcuagacccuagcauuaaaaaaaccgaaugguccagggaagaagaugaaaaguugcugcauuuagcuaaacuaaugcccacucaauggagaacuauugcgccuauaauaggcaggaccgcagcccaaugucuagaaagauacgaauauuuacuggaucaagcgcaaaaaaaggaagaaggcgaggacgccguggaugauccgaggaaguuaaaacccggagaaauugaucccaauccagaaacuaaaccggcaagacccgauccuaaagauauggacgaagacgaauuagaaaugcuuuccgaagcuagagccagacuggccaauacccaaggcaaaaaagccaaacguaaagcucgcgaaaagcaauuggaggaagcucgccguuuggcagccuugcagaagcgacgagaacugagagcagccgguauugaagucacuucgaggcgcaagaagaaacgcgguguagauuacaacgcggaaauuccauucgaaaaacaaccagccaucgguuucuacgacacuuccaacgaagcccuagacuugauggccccagauuuuuccaaaaugagacaacaacaucuagacggugaacucagaagcgaaagagaggagagagaacggaaaaaggacaagcaaaaguuaaagcaacgcaaggaaaacgacauuccgcaagccauguugcaaaacgaagagcccgcuaagaaacgaucgaaauugguauugccagaaccucagauauccgaucaagagaugcaucaagugguuaaguugggcaaagcgagcgaaacugcccgagaaaucgcaacagaaagcggagucgaaaccaccgauacucuccucaaugauuacauguucacaccgcaagcugcugccacaccaagaacucccgcaccccaaaccgacaggauacuucaagaagcucagaauaugauggcccuuacccacgucgauacaccucucaaaggcgguuugaauacgccccugcacaacucggacuucagcgggguucugccgcaaucgcaagccauuaccacuccaaauacaguacucgcaacgccguucagaucuucuagaagcgaugggggagccacuccuggaaguacggccggauucaugacucccaaaagcggagccuugacuccgguugguaaaaacgcgacgccuucugucagagauaaacugaauauaaaugcugaagaaaguuuagauguggcaaguacuccggccgaacauagaauguaucaaaugucgaugaaagaccaguugaagcugggacugagcagcuugccgcaacccaggaacgauuaugagauugucgugccugaaaacgaagcgcaggaugaacccgaagaagcccaaucucaauugguugaagaucaagcggauaucgaugcuagaaaacaagaggaacugagagccaaagcggcucaagaauuagcuucccguucgcaagucauccaaagagaauuaccgaggccucaggaggugaauuugaccgugcuccgaccgcccaacgaaagcuacuccuugacugaccuucagcgugccgaagaguugaucaaaugcgaaaugguuaccauguugcaauacgacaaccugaaaaacccucugccggcgcaaaguaagagaucgaacaugucgcaagcucagcaauuagccuuucucgagcaacauccuuacgauucguucaaacaagaagauuuagaaguggcuaaaacguuguugagaagcgaaauggacguaguaaaaagcgguaugaaccacggagaauugccauuggacguguacaaucaggugugggaagagugccugagccaagugcuguaucuuccuaaucagacgagguacacucgcgcgcauuuggcgagcaaaaaagauagauuagaauccgcggagaagcgucuggaacagaaucgaucgcacauggcuaaagaggcgaagcgcgccgccaagauggagaagaaauuaaagauauuaacgggcgguuaucaaucuagagcgcaggugcugauuaaacaguuacaggaucaauaugagagcaucgaucaaucgacuuuggaguugaacacguucaaauuccuggcugagcaggaaaagaaugcucugccgaugagaauacagucucuuaccgaggauguuaauagacaaauggaaagagagaagguacuucaaaagaaauacgccgauuaucagggucagauuaaacaguuacaagaggaguauuuaguucagaugcaaaauguuccaaaugaagaaucuauuaaguaugacgaagucacuucgaccacaaacgaagaaaaugguauggauacaacggaaaaugauaaaauuaccgcugaaaacuaa

SEQ ID NO: 5965 - RNA, 474 nt, Phyllotreta armoraciae
augaugcaauuuauguuauuguucaguaggcaaggaaaguugcgauugcaaaagugguauguggcucauccagauaagcugaagaaaaaaauuacuagggaauuaauuacuaccauucuugccagaaaaccaaaaaugugcaguuucuuagaauggagggauuugaaaaucguuuacaaaagguaugcuagcuuguauuuuugcugcgcgauagaacagugcgacaaugaacuguuaacuuuggaaaucauucaucguuacguugaacuuuuggauaaguacuucggaagcguaugcgaauuggacauaauuuuuaacuucgaaaaggccuauuucauucuggacgagcugaugcuugguggcgaggugcaggaaaccaguaagaagaauguucuaaaggcaaucgcugcacaggaucuccuacaagaggaggaaacgccgcaaggauucuucgacgaucacggauugggcuaa

SEQ ID NO: 5966 - RNA, 1251 nt, Phyllotreta armoraciae
auguauggauuacaacgauauucguuugguuacacucucaaaaaugcggugcguuauuacucgagagaacccgcuaagagaucgucguuucucagccgauuguacgacaauuucaaagacgaaauggccaaaaacaaagaaaugaaagagucgcugaaaaaauuccgcgaagaagcgcaaaaacuagagcaaagcgaugccuugaaagcugcccggcaaaaguucgaaaccguagagaaagaggccagcaaaagcggcgaagucuucaaagagaguuuagguucaaucaaagaaagagucaaaggcgucauagacgaggccaguaaaucggauuuagccaagaaagcugguaaauucaccgaagaagugggaaaaacuacucacaaaaucagcgaaaccgcacaagaaaucagcaagaccggagcguuucaaagcauaucggaggccaccaaagcgguuaaacaagaaaucgacaacaccagcauggaaggucgaguguacgugagcccuaaaaagcugcgaaaacgaaccgaaaccagcgcgguaguccaacaaaaguacuacgaaccgaacacagacgcaaccggcguagagcuacacaaagacuccaaauucuacgaguccuggcaaaacuucaaaaacaacaacccguacgugcacaaagucauggacuggaaacucaaauucgacgaaagcgaaaaccccaucauucgagccucccgagcgcucaccgagaaagucggcgacauaaugggaggccucuuucaaaaaaccgaacucuccgaaacccucacggaaaucuguaaaaucgaccccgcuuucgauacgaaacgauuccugaaacagugcgaaaccgacaucaucccgaacgugcucgaagccaugacgagaggagaccucgaaguccugaaggacuggugucacgaaggacccuucaauuuguucgccgugcccaucaaggaagccuacaagaaaggcuacagaaucgagucgaaaauccuggacguagaccacguggauuuggugauggguaaagugauggaucaagggcccguguugaucauuucuuuuacuucgcagcaagucauggcugugcgggacgguucgggggcgguggucgaaggcgacccggacaagguuaugcggguuaauuacguguggguguugugcagggauguggucgagcccgauccgagggcggcuuggagauugcucgaucuaucggcgagcaguaacgaacaguuaguguaa

SEQ ID NO: 5967 - RNA, 909 nt, Phyllotreta armoraciae
augaguagcagugauucggaauuaagcgauagugaugcugaguugcaacaagcguuguuagaugguaagcugaaaccuggauuaaauaaaaucgaagaagccccuaaacaauucgugaacaacauaagcggcuuaaaucagaaaaucgaagaauucaaauugaaacugccauggaucgaacggcuggauuguacgaaugcccaagcccccuuggcgcccgaguuagcggcagaaauguugguucacgaggaaaagaggaguaaucaacugagaaacaacaaaaaacuuccccaauuucaacccgcccaagaucccguucugaacgauuucaaacgagaacucauauuccaccggcaagcacaagcuacaauucuagaggcaauuccgaaaaucaaagaauuagggauacuuacuaaaaggccagaugauuauuuugcugaaauggccaaaucggaugagcacaugcacaagaucagagagaaccugaagcaaaagcaggagcaacagaagcggauugaacgggugaagcaauugaggcagcaaaggaaagagggaaaaucgcugcaggugcagaugaaauugcaacgcuccaaagagaagaaagaaaugauggaucaagugaagaaggcaagaaaaaacuucgacuuuuuggaugauaaaaauaagcccaugggaaggaaggcugcagaaaaacggaagaugaaggacaagaaauucgguuucggugguaagaaaaaggggaugaaaaagaauacaaaggacagugcgggcgauauuagugaguauaaaaauccugggaagccggccaagaaacagauggggaaaaaauucgucaauaaaaacaaaccaaaaaaucaaagaaugggcaaaaauaggaggauuaaaacuaaggcuaaaggaagaaaauaa

SEQ ID NO: 5968 - RNA, 1533 nt, Phyllotreta armoraciae
augaauccaggcgccccaaauuaccccauggcgucucuguacgucggagacuugcauuccgauaucaccgaggccaugcucuuugaaaaguuuucaucggcuggccccguuuuauccauccgcgucugcagggauuugauaacccgcagaucuuuggguuaugccuacguuaauuuccagcaaccugcugacgcugaacgugcccuagacacuaugaauuucgacuugaucaaaggcaggcccauucguaucauguggucucaacgugacccuucuuuacgaaaauccggaguuggcaauguuuucaucaagaacuuggaccgauccaucgauaacaaggcuauguacgauacuuucucugccuucgguaacauucucagcugcaaaguggcucaagacgagagcggagucagcaagggauacgguuuuguccacuucgaaaccgaagaagcugccaauaaauccauugaaaagguaaaugguaugcuguugaacggcaaaaaggucuacguuggucgauucaucccacgcaaagaaagggaaaaggaauugggcgaaaaagccaagcucuucacaaacguuuacguuaaaaauuucggagaggacuuguccgaggaacagcugcgaacgauguucgagaaauacggcaagauaacuagcuacaaaauaaugagcaaggacgauggaaaaucgaaaggauucggauucgucgcuuucgagagccccgaggcagccgaaacagcugucgaggcccucaacggcaaagaaauauuggaaggcaaaccuuuguacgucggcagagcccagaagaaggccgagcgucaacaggaauugaagcggcgcuucgaagcucugaaaauggaaaggcugaaccguuaccaaggcguaaaucucuacgugaaaaacuuggaugauaccauagacgacgagcgccuucgcaaggaauuuucaccguucggcaccaucacuucggccaaaguaaugauggaagaaggcagaagcaaaggcuucgguuucgugugcuucuccuccccggaagaagccaccaaggccgugaccgaaaugaacgguagaaucgucgguacaaaaccgcuguacgucgccuuggcccaacgcaaagaggaccgcaaggcccauuugacgucgcaauacaugcagcgcauggcgaacaugcgcaugcaccagaugggccaguucauccagccgggcggcucgagcggcuacuucgugcccaccauccaagccacggcgccccguuucuacgggccggcccagaugccgauucguacgagcccgagauggccggcgcagacgcccgugcgucccggcgcccagggaagcaccgcuaccuacaccggaaugccgaacagcuacagagcugcagcgagaccgccgggucaaucuacgaugcgcagcaacaucagcguaccgcgacccaucaccggacaacaaccaccaaguaugcacggucguccacuuguuggacaagguguggcugcugcuggaaaucgugcagccaacuucaaguacacc

SEQ ID NO: 5969 - RNA, 2766 nt, Phyllotreta armoraciae
augaccgacucaaaguauuuuacgaccaccaaaaagggagaaauauucgaauuaaagucagaacucaacaaugauaagaaggagaaaaagaaggaagccguuaaaaaggucauugcuucuaugacuguaggcaaagaugucucagcauuauuuccugaugucgugaauugcaugcaaacugacaauuuggaacucaaaaaauugguuuacuuauauuugaugaacuacgcuaaaucgcagccugauauggcuauuauggcaguaaacaccuucguuaaagauugcgaagaucccaauccacugauuagagcacucgcuguuagaacgauggguugcauucgagucgauaaaaucaccgaauauuuaugcgaaccucuaaggaaaugucugaaagaugaagauccguauguuagaaaaacugcugcuguuuguguugcuaaauuguaugauauuucgucaggguuaguugaagaucagggauuucucgaacaguuaaaggaauuauuaagcgauuccaauccgaugguagucgcaaaugcuguugcugcuuuguccgaaaucaaugaaagcaguccgaccggacagccucuuguugaauugagcaccaacacgauaaacaagcuucuaacagcucuaaacgaaugcaccgaauggggccaaguuuucauacucgauucccugucgaacuacaccccacgagacgaaagagaagcccaaaguauaugcgaaaggaucacuccacguuuagcccacgcuaacgcugccguaguacuaucagccguuaaaguauugaucaaaaugauggagauuuuggcaggagauaccgaauucugcaacacgcucagcaaaaaauuagcgccuccuuugguaacucugcugaguucagaacccgaggugcaguauguugcauugagaaacaucaauuugaucguacaaaagaagcccgacauauugaaacacgaaaugaagguguucuucgugaaauacaaugacccgauuuacgugaaacuggagaagcucgacauaaugauucgauuggcuucucaagucaacaucgcucaaguucucagcgaacucaaagaauacgcgaccgaagucgauguugacuuugugaggaaagccgugagagccaucggucggugugccaucaaaguggagccuuccgcagaaagaugcguagccacgcuguuggauuugauucaaacuaaaguuaauuacgucguacaagaggccaucguagucaucaaagacauauuuagaaaauauccgaauaaauacgaaaguauuaucagcaccuugugcgaaaauuuggauacucuggaugagccagaagccagagcuaguaugguguggauuauaggagaauacgccgagagaaucgacaacgcagaugagcuacuggacaguuucuuggaagguuuuggugacgagaacgcucaaguacaacuccaguugcuaacggccguugugaagcuauuccuaaagcguccccaacacacgcaaggcuuaguccagcacguacucaguuuagccacccaggacuccgauaaucccgauuugagagacagagguuucauauauuggagauuauugaguaccgauccggccgcagccaaggagguggugcuggcagacaaaccucugauaucugaagaaacggaccucuuagagcccacucuucucgacgagcucaucugccacauaucgucgcuagccagcguuuaucacaagccacccacggcguucguggaaggccgaagugcagguaucagaaagacguugccggcuagacaaggcuccgaugaaggugcugccgcugccgaaacgacgguuauuccgaaccaagaaagccucaucggcgauuugcuuucuauggauaucaacgcaccggcuccgucagcugcugcugcuccugccgccccucagaccagcaacgucgauuuacucggaggcggacuggauguuuuguugggaggaggcaacgauaucggaggugcuccugcuagcgcugcugcucccaccaccacaggccugcucggcgacauauucggcauaccuacugcaccuacgauguacacaccgccgaaggucgucuggcugccggccgaaaagggcaagggcauggaaaucuacgguacuuucuccagacgaucaggccaaauggccauggagaugaccauuaccaacaaagcuaugcaggcaauguccgguuucgcuauucaauucaacaagaacaguuucgggaucacgccgagcucgccuuugaacaucccgacuuugcaaccgggccagaaucuggaguacagcuugccguugaacacuaccgguccgguacaacguauggauccuuugaugacgcuccagauugccauaaaaaacaacgucgacguguuuuacuacgcuugucagauacccauccagauauuguucggggaggacgguacucuggauaagaggguguuucucaccacuuggagggacauucccggagcuaaugaggugcaguacacgcugaacgauaucaaaggcaacaccgacacgguuucgaacaaaaugacguugaacaacaucuucacuauagccaaaaggaacguggaagggcaggacaugcuguaucagucgcugaaauugacgaacaacauuuggguguuguuggagcugaaguugcagccgggcgucccgacggcgacgcugagcuugaaaucgaggucgguggagguggccccguacguuuuucaagccuacgagucgauuuugaagaguuaa

SEQ ID NO: 5970 - RNA, 498 nt, Phyllotreta armoraciae
augccgccuaaauucgaucccacggaaguaaaauacguuuacuuaagauguguaggaggagaaguaggagcuacaucauccuuggcuccgaaaaucgguccccuugguuugucucccaaaaaaauuggugacgauauugccaaagguacagcugacuggaaagguuuaaaaauuacgguccaauugaaaauucaaaaccgucaagccaccaucuccgucguaccaucggcugcuuccuuaauuauuaaggcuuugaaagaaccuccucgugacagaaagaagcagaaaaacauuaaacacaguggaaauauuacauuugaugaagugauuuccauugccaagcaaaugaggcauagaucaauggccaagagccuugcuggaacuguuaaggaagugcuggguacagcucaaucuguagguuguacaauugacggcaaagccccucaugaugucauagaugaagucaacgaggguacuguagaaguuccggaugaguaa

SEQ ID NO: 5971 - RNA, 1095 nt, Phyllotreta armoraciae
augagcgaggaagggaagagagcguuaauuuuagucggagguuacggcacaagacugaggccucuaacuuugagccguccgaaaccucucguagaauucgcaaacaaaccaauauuauuacaccaaauagaagcauuaguagaugcgggaguaacagaagucauacuggccguaucauaucgugccaagcaaauggaggaagaacuuacaguugaagcggcuaaacugggcauuucuauaguauuuucgcaugagacugagccuuuaggcaccgcaggaccaauagcauuagcuaaagaacacuuaucgaaaaguacaaaaccguuuuuuguauugaauuccgauauaauaugcgacuucccguuuagggagcuagagaaguuccacgaaggccacggaaaggaaggaacuauagucguuacaaaggucgaagaaccauccaaguacggcguuguaguuuacgaucaaaacaacugcaucgagaguuucguugagaaaccgcaggaauucauuucgaauaaaaucaacgccggccuguacauucuaaaucccagcgugaucaacaggauugaacuccgaccgacuuccauugaaaaggaaguguuuccuuacauggcaucugacaagcagcuuuaugcuuucgagcugaaaggguuuuggauggacguugggcaacccaaagacuuccugacuggaaugugcuuguauuuaaaccauuugcgggaaacuaauagccagaagcuguacaaaggacccgguguagucgggaacgugcuggucgauccgacagcaaaaauuggcagcaauugccaaauuggacccaacguuacaaucggaccagguguuguaauagaagaugggguuuguauaaaacgcucgacgauccuaaggggugcggucgugugcucuaacucuugguuggagaguugcauugugggauggaagugucacguagguaaaugggugaggauggaaggaaguaccguacucggagaagauguuauugugaaagaugagacguacauaaauggagggcagguucuuccucauaaaaguauugcuacaucuguuccggagccccagauuauuauguag

SEQ ID NO: 5972 - RNA, 858 nt, Phyllotreta armoraciae
gacggugaagaagugauaagugaccaagaaaaaguaaaaauaguuucggacuucauccuccauuccccgcccggcgaauuuaacgaagucuucaaugauguaaggaagcuuuugaauaacgacgaccuucugaaagaaggcguaaccggggcguucgcccaauacaauaaagaccaacucacccccguuaggauagaaaacgccgaucaaauggugcugauuacagaauacaacgauuuagguaacaauagauucuucgacccccguaguaagcaaaguuucaaauaugaacauuuaagaaaggaagcuucugauuaccagccuuauagugucgauacgacggcggagcccuggcgggccgcucuagauaacgaguuuauacaauauacgagaaaccauuauaaagacggcguuuguagcguguucggucgcagucaaaacggugcgaucacccuuacugcuugcaucgaagaccaccaauuucagcccaagaacuuuuggaacggucgauggagaucccaaugguccguuagccuaaccgaugaaucuacugcagaaguacggggcguccugaaagugcaaguccauuauuacgaagaaggaaacguucaacuggugaguacuaaggaaaucaaggagucgauuccgguuucuaacgaagcgcaaacggcuaaggaaaucauccacguaauagagaacgcugagaaucuguaucaaacugcgauuucugagaauuaccagacgaugucggacacgacguuuaaggcucugcgaagacuccugcccgucaccaggacaaaaauggauuggaauaagauuguaucuuauaguauugggaaagaacuaaaaacgcaauga

SEQ ID NO: 5973 - RNA, 4116 nt, Phyllotreta armoraciae
augcucgugaaaaugaacuuucuacuaguuuuaacaaucagugcgguggccgugggggcucaagagggcgcggcgccggccguggcgagucaggauaauacgggagacguggagagcaucgacgugggugcagcaggaagcgaugucggcgaagauuccaggcccguuccuguaggagaaaacgacgggccgguuacgaauagucccaguuacgacgcuccuguagaaguauuaacaaauaucgauagcgaaacaauugauacuaacaguuccagacccaacuggacuuuccagaaaaaaacuaaaucugggaaauacguuacuuauuaugcggcuaauuaugaccccaugacgucagacacugccccuccagacacggaccaaagggguggaggcaucccuuacuccauuaccgaaaacagguuagcugaaaucaggaaaaacuuuauguacccguacuucgauaaagggggcaacguggacaacgagggggauuaccagaaggaaauccaauccuccacgccccaaguccacaagaaucugaacuuccaagugccuuuuuucggauucagguauaauuacacgagaguuuccaucaaugguuauuuggaauucagcgauccaccuuccaacuuaaauuauccacuggucuuucccauaaaggacuggccuaagcaaaacgauccuucguuuauugguauuuucuacaguaaauguaaaaucgguaaucuucgugacgaagacguggacaaaaggaaacccggcguguacuucagaauggaacgagaccucagggacaggcaagacaggaugggaguugaaauaagggagagauugaaaugggauauaagagaaggagugaucgguucggauaccuucgauccaaaacacgcuauaaucgugacguggaaaaacgugucauuuaauggaggauaugcaaacgcaguuuaucaaaccaacacauuccaaaugguacucgcuaccgacgagguauucacuuacgcaauauucaacuaucuaaauuuggcguggaccagucacacggaagccgguggagacaccagaacaggcgaaggcgguguaccggcguuugucggauucaacgccgguaaugguacgagaagcuuccaguacgcgcccuacagucaagcgucugucauucgagauuugguaucgaccgguuggggcaacaacaaacccggaaggcauauuuuccgaaucgacgagaauauucugcuggguucuuguaacaaagauauagauggugcuaauuuaccccuucaauucgcgccggagagcggcaauaugcugggcggaaccgucguuaacaucacagguccuugcuuuaaccccaacgauagaauuagauguaaauucgacguguacgaugaggucgugggauacguuguagacagaaaccgcgcgauuugcauucaaccucgccuuuacucagaagguugggugagacuccaaaucgccaucaauucggacgcuuuuaaauggaagggaaaguauuacgucgaaucgcccgccagcgccucccagaagaucuucuucaaagacaugaaguaccacgagaaaucgcccagcgagauucgcaucacguggcaaaagcagaacuugaccaccaacgaaaacgccaacaucaggaucuccuuguggggcuacagggaaaccaccaugaggcccacguucguuuacauaacggacauagccgauaauguucaaaauaccggggaguacacgaucguaccgucgcaguacaggggcaaaaucaaccaguaccuguccgacaucaaguucgguuucuugcagauaaauuugaccgaaucgauagaggucaacacuuacucuacgaacaaucaaaacaucaaaauuacaccgauaauauggagcaggccgauaccgcuggguugguacuuccaauuucaaugggagaaucaauacggcaaaaauuggccaaaauaccugugcgacgauuggcucagaacggacagauauuugaagaacuucgcccacgaauuaccccaauguccuugcacgguccagcaggcauuggcggauaagggaaaauucaugcccgacuuugauugcgacaaagauucgaauccuguuuguuauuacaacaaucaagcucuacauugcgucaaaacuggugcucccacgauggaagguucugagcaacaauguugcuacgacaaaaacggcuaccugaugcuguccuaugaucaacaaugggguucgaguccccgucgaugccacaaucucgguaaaaugccuuacaacgaggccaccaaaguccccacgcuaucgcagugguucaacgacgucgugcccaaguaccuuuguugucucuggcaggaagagcaagccgugggcugcgaaacccugcgauucgagagaaggccaucgcaggauugcgucgccuaucaagcgccugccguagcaggaguguacggugacccucacauagucaccuucgacgauguggaguacacuuucaacggcaaaggagaguacuccuuggugaaaucgguuaaaguagacgauaauuuggaaauacaggccagauucgagcaaauggguaccaaugccuauggugaaguuagagcgacacaacuuacggcgaucguggcuaaaggaaacaagacaauuccuauugaagucagaagaagaccgccggaagccagauggagguauagauuggacguuaucgccgaaaacagaagguuguucuucgauagaccuuccuugaaauuccaacauuuucaagguguuacuguuuacacaccaacauacauucugaaucaaucugaaguacuaauaauguuugacaacggagccgguguugagguacuggacaaucaaggauacaugagcgccagaguauaccuaccuuggucauuuauaaacaaaacggugggccuguucggcaacuggagcuucaacaaagaagaugacuucacgcugccggacggauccaaagcggccguggcgagcaacauuaacgacauggagagagucuucaacgaauucgguucgaaauggaugcucgacgacgucgccgacgcgaacaaaggccaaucguuguucuacagggaauucggacgcaccucggccaccuacaacaacaagaccuucagaccgcaguuccucaugcugcccgaggacauccugccggcgaacagaucggagcaaauacagcgcacguacgacgugugcucgacgaagauguacgaaugcuacuacgacuacgccaugacguugaacagggaccucgcgcacuucacgcaaaacuacaaggcgaccaucuacgaacugaaacaaaccacgagggagaagaucacgucgugcggcgugcuggaaacgccgagguucggcaggaagaguacguuccuguucguaccuggcaccaaggugaccuacgaauguauacaagauuuugugcuggucggcgauccucgacgagagugcggggccgauggaaaauggaacauaccugauuuuggguacacuuauuguuuacgucaagaagaauauuccucccgccaagcggcaauagcguccgguaucguacucgcgauucucauaccacucauacugcuauuccuauacuuaggcuauaagauauacaaacgguuguucgcgaacgacgacggcucguggaaguaccaaucggccgcgcaaaaauccagcgccccgccgacguucaggcgcagcuuuucucccuaccgugacgaggacgacgacgacauccugcgcagccccuccgacggcgauacgcugccgaagaagcgcaggagcuacgagaaaucguacaggacgcacgagccguugaccgaucggccgagcaucgauuucgaagacaagccguuggaucccaacgaucccaguuacgaugauaucgauaggacuucggcggcuuugucgagccccgcgagucccacgagccccacgucuagcgugcaguauacgacuccguacaacgcgaggcccgauauauugggaaauggcaauaggaauuuggaauacgcggagaacgauuacgcgaugcccguuaaaaagccuaagaauagguucagucagagucaaagcaguauuguuacggauguuuga

SEQ ID NO: 5974 - RNA, 342 nt, Phyllotreta armoraciae
augcguuacguggcugcuuacuuauuggccgcuuugggcggaaacgcuucuccaagcgcugcugaugucgaaaaaauccuuggcuccguaggaguugaagccgaagcugaaaaggucaagaaagucuuaggcgaacucaacggcaaauccaucgaagagcucauuacuaaaggucgcgagaaauugaguuccaugccaguagguggugcagccccuguagcugcugcugcaguugccgcugcuccugcugccgcagaagaaaagaaagaagccaagaaggaagaaaagaaaguugaaucagaaucagaagacgaugacaugggcuuuggucuuuucgacuaa

SEQ ID NO: 5975 - RNA, 2724 nt, Phyllotreta armoraciae
augaugacugaccguuuuggauuaaaaugggaccccaaaaaucuagaaauuagaaccaugucaguggagaaaacucuggagccccuuguguugcaaguaacaacccuuguuaacacgaaggggcccaguaaaaagaaaaagggcaagucaaaacgugccaaugcucucguuaguacaguagagaaggccacugagaauuucaucgagaaaggugagcaaauugcuuaugagaaucccgauauaacggaugagaugauugcugcuguugaagaagucaggaagacuggcaaugcaaugagcauagcugccagggaauuuucagaagaucccuguucuucuuugaagaggggcaauaugguacgcgcagcuagaaaucuacuaucugcugucacgagacuucugauucucgcugauaugguugauguucaucuucuacuacaaucacugcacguagucgaagaugauuuggaaaaacuaaaaaaugcuucaagccacggggaacuucuugacaauauuaaggccuuuggucauaacgcaaacgagcuuaugaaucaggcugcuaaaagacaacaggaacuaaaagauccacagcuacgcgaugauuuggcugccgcuagagcaguacuuaagaaacauuccacaaugcuucuaacggcuucuaaaguuuacguucgucauccggagcuagcugcagcuaaagcuaacagagacuacgugcuaaagcaaguuugcgaagcuguuaauacaauaaaugaugucgcccaggggagaacaccgcagcccgcuucuggcccuuaugauggaccgggagaacucgcagcugcuuuagaugauuucgaugaucacaugguuauggagccucuggcuuauaaugagguucacacgagaccaucguuggaggaacgucuggaaagcaucaucagcggggcugcuuuaauggcugauucgaguugcacuagagacgaaagaagagaacguaucguugcugaauguaaugcugucagacaggcauugcaggauuugcuguccgaauacaugacuaacauggguaagaaggauaagagcgacaaucuuaacagagccaucgauaauaugggcagaaagacccgcgaccucagaaggcagcucagaaaggccguugucgaccacguuucagauagcuucuuggagaccaacgugccccuuuugguccugauaaaagcagcucaaaacggcaacgaaaaggagguggaagaauacgccguuguauuuaccgaacauuccaauaaacugguggaaguagccaaccucgucugcagcaugucgaacaacgaagacggcguuaagaugguucgauacgcugccgcucaaaucgacaaucuguguccugaaguaauaaacgccgcuaggaucuuagcggcgagaucucgcaguaaaguugcucaagaaaacauggaagcuuucaaacaaucaugggagaaccaagugcgcaucuugaccgaagccgucgaugauaucacgacuaucgacgacuuuuuggcuguguccgaaaaccacauucuggaagacgucaacaaaugcguacuagcccuucaagaaggcgaugcugauacauuggaucguacagccagcggcauaaagggcagaucgaacagagugugcaauguuguaacagcugaaauggauaacuacgaaccgugcauuuacacuaaacgcguuuuggaggcggugaagguuuugaacgaucaagugaugcccaaauucacccaaagagugcagguagcuguacaggcuuugggcaacagcccgccuaaagaggucgacgagaaugauuucaucgaugcaucgagauugguuuacgacggugucagggaaauaagaagagcugugcucaugaacagagcugacgaagauuuggaucccgaagacgucgaacucgaugaaaacuaucugauugagaccaggaguaaaucgagugcucauacuggagaacauggcguugaugaauauccugauaucaguggaaucacaaccgcuagggaagccauggguaagaugcccgaagaggauaagcaaaaaauauugcagcaaguggaguuuuucaagaacgagaagcucaaguucgauaacgaagucgcuaaaugggacgauacuggcaacgacaucaucguuuuggcuaaacacaugugcaugaucaugauggaaaugacagauuuuaccaggggaaaaggcccucugaaaacuaccauggacgucauaaaugcggccaagaaaauuucagaagcagguacuaaauuggacaagcuaaccagacagauugccgaacaguguccggaaaguucaacgaagaaagacuuacucgccuauuuacagcguaucgcucucuacugccaucagaugaauauuacuucuaaggucaaagcagacguccagaauaucaguggagaauugauugugucuggucuugacagugcuacaucauugauacaagcagccaaaaauuugaugaacgcugucguucugacggugaaagcuucauacguugcaucuacuaaguauccuagaccaggaacuguagcuucuccgauuguuguguggaagaugaaggcuccagaaaagaaaccucugguaagacccgagaaaccugaagaaguucgugccaaagugcgcaaaggcucacaaaagaaagugcaaaaucccauacacgcuuuauccgaauuucaaagccccacagagucuguguaa

SEQ ID NO: 5976 - RNA, 789 nt, Phyllotreta armoraciae
augcaaauuuacauguuugauuuuuuaucagggaccccccuuuuuggaguugcuccuaccucaagcagcacuacuacaauagccaguguccccgcuuuagguuuaucgacuacuguuucuuccgcugcuucaacaacuccaucgacuucauuagguacaacaacagcagcuccuccagcuuauucaacaucgacacuuccuucuucugguucguuaacuuucagccaacuagaagauucuaucaacaaauggacuauugauuuggaagagcaaggcaaauuuuucauuaaucaagcgaaacagcuuaaugcuugggauucgcuacuuauuucgaauggcgaaaagauucucaaucugaaugguaguaucgagagaguuaagcagcagcaacagcaauuggaccaagaacucgauuucgucuuggcgcaacagaaggaauuagaagaguugauaacaccacuagaaaaagaauuguuggaaauuccuguaacggacauagaucgaaaucaaauguaucaauuuucggaaauaaucgauucucaauugaagcaaauguccgaugauuugaaggaaauuaucgagcauauuaaugaaucuaauaaaagcgaagaaauuucaaauccguugacgcaaauuagccgcauaaugaaugcucacaugaauucacuccagugguuagacagaaauacggcacaaauuguuucucaucucgaacaaaucaguaaaaugcaggacucuaauagaagaaauuuuccucucaaucauucuuuuaauaauucacuccuuuaa

SEQ ID NO: 5977 - RNA, 582 nt, Phyllotreta armoraciae
auguucauaugggauugguucacgggagugcuggguuacuuaggauuauggaagaaguccgggaaauugcucuuuuuaggacuggauaacgcugguaaaacgaccuuauuacacaugcuuaaagacgacagacuggcccagcacuugcccacauugcauccgaccuccgaggaacuguccaucggaaacaugagauucacuacguucgauuuaggagggcauucgcaagcuagaagaguguggaaggauuacuuccccgccguagacgcuaucguauuucuuauugaugcuaacgacagaucgagauucgucgagagcaagcaagaauuagaugccuuguuaacggacgaaacccuagccaauugccccgugcugauuuuaggcaauaaaaucgauuuaccggacgccgccucugaggaugaguuacgaaacguuuacucgcuguacgggcagacgaccgguaaagguaaaguggcucgaucggauuugcccggacgaccgcucgagcuuuucaugugcuccauucugaagaggcagggauacggggaggguuuucguugguuggcgcaguacauugauuaa

SEQ ID NO: 5978 - RNA, 702 nt, Phyllotreta armoraciae
gucaaugucaccugucacuacugucaacaccaaccaaaaacauacauauuuuuaaucaaaauuucccuuauucaacuaauauuaacgagcaauuucgauaaaaaaucgaaacgaaccgauacagccagccuuucagucauggacccgaucgccgugcuggaaaaacgcaucgaggcgcucgagcugcagguguucccuuugggugacuacaaucaaauaucgaacaagacgcugaccauaacgaaucugcugguggagacgcaaacgaugauaaauucggcuuuaacuugucgcgaauccaucacgucgaugcugcaacaccugguggugaucaacgacuaccugaaccccgucagcgaggcggacgagcuggaggucgaagcgaaaaggcaguauuuacucgaauuguaucccgaauugaaggauacgauacagacggugagcacguuggaaucgcuguugccuuuuaucgauucaauuaauauauccaaagugguggaguucucggggaagcuggaggagguggccgugagcaaucucaaguuguacggggaaugcagggauaucacgaagaaggugcuggucgcguuacagcaauauaacgacauauccaauuccauuaaauuguuauuuucgcaauuggauacggccguuacgaauuuagaauacgcuuugcagcuucgagaugcuaacgaagaauga

SEQ ID NO: 5979 - RNA, 1752 nt, Phyllotreta armoraciae
augaacaacgcuaaacuucaagaaguguacagugaccuaacgcucuauaccacuccagauaaauucuucaucgagccgaaggcuggcgaggaauugaugguaauagagcgaaauuccgaaaauauaauauguuucaaaagcgaccacagacaccugauaccugcagcgaauagccggaaggauuucugcggguuaauagguauaauccaacuguuagcuugucccuacuuaguaguagcaguucaaagagaauuagucgguuauauagcagguugcgcuaucuggcgccucgccaaagcugaauuaauaccauacaggagcuccgcacacuugacuccugaaaagcaagcagacaacgaugucuauuuguccaugguguauuccguacuauccacuccauuucuauacuuuuccuacgacuacgaucuuacgcauuccuugcaacgcuugcacggcauaagccccgauuuuuggaagcaaucguuguuugagcgagccgaucaaagguuuguuuggaauggaaaccuauuguauucguucaaaggauuuucgauacacagauuuugccugccucucaugcacggauucauuuccauaaauuucugcguagugaacgggcacaguuuaaacuggucaauuguuaguagaagaagcauucaacgagccggcaccagauuacacagaagagguuuagauaaagaaggaaacguggcuaauuucguugaaaccgagcagauagucgaauaucaaggcgaucgggcgaguuucgugcaaauacgaggcagcauuccccuguuuuggcaacaagaucccgaccugagauacaaaccaccgccuacuauacucgaugucgauccacaagaucagcacucgaugugucuaaagcacaugaacgauuuaaugacuuucuacggaaaggucguuugcgugaaucuagucgaucaaaaaggagcagaaggaaauauggaaacagcauuuaaaaacgccauugccaacguuucgucuccuucgguuaaauacgaaucguucgauuuccacgccgagugcagcaaaaugagaugggacagacuguugauucucaucgaucgauuagcgcacgaucaagacgaaaugaguuucuuuuuauugcuaagagacggcucguugaguucguuacaagacggcguauucagaacgaacugcaucgauugcuuggaccgcacgaacgucgugcaaagcaugcuggcccaucgaaaccucgaaagcgugcugaggaaauugcaaauccuucaucagaaucaaacguuggaauuccaguauucguuugagguguuguuuaagaacguuugggcggacaaugcggauauaauaagcacccaguauucggguaccggcgcuuugaaaacggauuucacgaggaccggcaaacguacgcguuacggauugcuucaggacgguaugaauucccuuacgagguacuacaagaauaauuucgcugacgggcuccggcaagacgccaucgaucuguuuuuagguaacgguaaacccauuucacccuugcauauugauaaagguuggaaauacgugacuuauccgucgauucuacugaucgcuguggcgauguucguagcuugugcugucacuccuuccgaguauucgacggauucguugcuguuucucuuguucugggguuccauggucuaugcaacuuugcacacuauuuugaaguaugguucggaguuuguugauaaaccuaggcucacccauucuuag

SEQ ID NO: 5980 - RNA, 1488 nt, Phyllotreta armoraciae
augccuccuacuauucaacagaauaaucagaacgccgcaaauggcguggaaaaaagacaaguaaagacugucgaaaaaagguccgauuuauuauguaaagugaaauauuguaauacacuacccgauauaccguucgaucugaaguuuauaaccuauccuuucgaaucuauucgauucauucaguauaaucccacauccuuggaacguaauuacaaguacgaaguauuaacagaacacgauuuagguguaagcauagaccuuauaaauaaagauauauacgcaaucggagcuggcgcugccuuggauccggccgaugagaaacuccuagaagaagacauccuuacuccccaagacuccaagaggucccgucaccaugccaaauccgugucguggcuucgacgaacugaauacaucuccacagaacagaccagauuccagccccaaaccauggacaaagucgaagccaaagugggcuacagcaucaagaaaucccuuaacaacgaaacccuuuacauggacagagacucgcaaauaaaggcuaucgaaaaaacguucgaagauaccaaaacgaccauugauaagcauuacagcaagccgaacguaguccccguggauguccugccaguuuauccagauuucaguuuguggaaauauccuugugcgcagguuauuuucgauucugauccagcucccgugggaaaacaaguacccgcucaaaucgaagagaugucucaagccaugaucagagguguaauggaugaaaguggugagcaguucguagccuacuuccuucccaccgaagagacucuccaaaagcgcagggaagacgucgcgaaccaaguccaauaccaagaugaagaggaauacgaauacaaaauggccagagaguacaacuggaacguuaagagcaaggcaagcaaaggcuacgaggagaauuacuucuucgucguacgaucgagcgguauuuacuacaacgaauuagaaaccagaguuagguuaagcaagcgaaggcagaaaguaggccagcccccgagcaacacucggcucaucguuaaacacaggccuauggaugcuaaugaauuuagaaugcaacgguacagggaaaagcagcuggaaccuacaggcgaggaugacgaagagauggaaaucgacgagccccaagacgaggaaaacgugcucgagccggacaacgaaagccgcgacaaagaaaccgagagcgacaacgaaaagaaacgauccagagcuuccucaguaucuucccaaaggcgauccagauccagaucgaauucuucggcuaaaucgaauucgagaucuaguucuagauccuugucaaaguccaggucucguucgagaucgaagucgucgucgaggucucggucuaggacgccgucgaagucccccucuagaucaagguccguuucgaaguccccuucuaagucaagaucaccgucaccaugccaaauccgugucguggcuucgacgaacuga

SEQ ID NO: 5981 - RNA, 1170 nt, Phyllotreta armoraciae
augccgauugaaaauuuggaagaucaagguuuagaaaagaacccagaccuagagcuagcucacuacaaguuucuccugacgcucccggaauaucgcagcgaccggaauguccacucgaagaucaccgaagccaucaagaaggaugauauggccccaugguacgaacuccuuugcaaagagguaggcuggaaguuggacucggccuugcugaaggcccucaaggccaagaaugccgaaaaggucaagcuccuggacgaagccaucgaggacgcggagaaaaacuugggagagauggaggugcgggaggcuuauuugcguaaagcggaguuuuacagcaggaucggcgacaaagaaaacgccgugaguaccuucaggcaaacuuacgauaaaacagugucuuugggccaccguuuggacaucauauuucacuuaauuagaauaggcuuguucuuuauggaccaugaccucaucaccaggaauaucgacaaagcgaagagccuaaucgaagaaggaggcgauugggacaggagaaaccgauugaaagucuaccaaggugcuuauuguaugucggugagagacuucaaaaccgccgcuaaccuauuuuuggacacugugagcacauucacgucuuacgagcucauggacuacaaggcguucgugagauacaccgucuacacuuccauaaucagccugccgagaaaccaacuaagagauaaaguaauaaaaggcucggagauacuagagguccuccacucugagccguucguuaaagacuaccuguuuucguuguacaacugccaguacgcggaguuuuucucgaauuuggccgaggucgagacgauucugaggaaagacuacuuccugaauccucauuaccgguauuacguuagggaaaugaagauuucggcuuacacgcagcugcuggaguccuaucgaucucucacguugcaguauauggccgaagcuuucggcguuaccaucgaguacaucgaugaggaguugucgacuuucauugcugcuggaagacugcauuguaaaauugaucgaguuggaggcaucguggagacgaauaggccggauuuaaagaaugcucaguucaauuccgucgugaaacaaggggauuuguugcuuaaucgaguucagaaacucuccagaguuauuaauauuuag

SEQ ID NO: 5982 - RNA, 15381 nt, Phyllotreta armoraciae
auggaggaauuaaccucggguuuggaucccgacgauuugauggaucuagacgagccagaaggguccgauuuggaagaggacgacgaggaucucaucgaugaucacgucucgucgccuuucaucucguccucggcgccggaauccacggccaacuccgucgccuccucuccgauccacgaagacuucccuccgcccuucaauuucaccgggaaaccucuacacguuaaacgcggaagaggaagacccagaagagaaggagguaagccuucggcgccgagaacgacaaggggcgguggaacuggagugucgagaguacguaggccgagaccuccggguuuuucgagaagaggaucguuaggaggaaguagaaguguuaggcaaguagacagaucggauuacgaaaugucucuuuucgccggcucgccgguggaugacgguuuguuggaucccgagacggguucgaugaucuuucccgagaaguuuguuccugcgaucgaggagccuccguauuuuccggagcauuggccagggaaaguuugugccuuguguaauuuaggugaacggagccagcuaggacaaggugaaaugcuaagguuaaauugucccgaaggauucucgccggagaaaguuauuagugagcaaauauuagaaagagccuugcaagcuccagauaaagaaugcggggauaaaagcccgaaagguccugugacauguagaaggcaaaaaaguuucaauaaaugcagacauccuucgauaaccagugaauacguugaugaauuaacuauaauuggauauaaugaaguaccugauguaucuaguuuguuugaacccaauggacaguuuuacguucaccguaauugugcguuguggucuaauggaguaacgaaagcagaaaauucggcguuguugaauguagggccuguaguuucgcaauguucuuccaaaaaauguuccuucuguaaucauuacggagccagccugaccugccacguugacaaauguaccaaaauuuaccacuuuccuugugcuacugcugcuggugccuuucaggacguuucuucauugacaacuuugugcaacgaccauuuaggacaaguggccgugcucacuaacgcaucuccauguuuaacuugcgcaucuaugggagauauagcaaauuugauguuuuguucggguugcggcgcgcauuaucauggaauuugcgugggauuagcucaguugccaggcguuagaucuggcuggcaauguagaaaaugccguuguugccaaguuugucgagucguuggagacgagucuaaacugaugacuugugaacaaugcgauaaaauuuaccaugcuaguugucaaagaccgauaguuacuucaauaccgaaauacgguuggaaguguagauguuguagagugugcggcgauugcggcgcgcgaacucccggagcugguuuaucuucaagauggcacgcucacuauacaguaugcgauucuugcuaccaacaaaggaauaaaggguuuucuugcccuguaugccauaaagcuuaccgagcucacgcacauagggaaaugguccaguguucgaguugcaagaaguuuguucauggaaccugugauccugaagcagacguugucaccuacagucaaaagaaagaaauaagcguggacuacgaauacguaugcuugcauugcaaaaacagcacagccagacaaauaacugcgaaaagagcuaguaucgaugauccuucugauguaucugcuucucaugauucccuguacgacgauacguccgaauuggaucuucccucgcccgaugaguucgccagaaacauggguuugggaaaaggaaagccguauagcgcgaauaaaauagccaaaaagcgccuuagcuucaccgugaauccgguuggcaggccgaaaggcaccggaaaagugccucccgggaaaaugggcuuuaugaaacgguaccgauuaacagaguucaacagaaaacgcggccccaaagccaaaaugagggguauuuucggcgugcccggcgucggucugcaaagaccgauuucagacgggaaaaccgaugaagaaccaggagucgaaaaucgauugguacucuguucagcuaaagauaaauuuacgcucacgcaagauauuugcguaaugugcggggcauuuggaaccgaucaagaggguuguuugaucaguugcguacaaugugggcaauguuaccaccccuauugcaucaacguuaaaguaacaaaagugauccuacagaaagguuggagaugcuuggacugcacgguuugcgagggcugcggucaacgaaacgacgaaggccgucugauccucugcgacgacugcgacguguccuuucacaucuacugcauggacccgccacucgacuacgugccgcacggcaacuggaagugcaaauggugcgccaucugccaauccugcggagccaccgauccggguuucaauugcacguggaugaacagcucgacccaaugcggcccgugcgcuucgcacgugaauugccccagcugcaacgagcccuacggcgagggcgauuugaucauacagugcgugcagugcgaaagauggcugcauggagcuugcgauuuuauuaaaugcgaagaagacgcagagaaaugcgccgaagaaggguacaauugcauuuuauguagaccgagagacgugccaccgccgcauaugguuccugcugcaguuaccccgaagccuccgacuccgacgaagagucccgagcugggcaagaguaccagcuacuacauggacggcgugugucucagcgaauucggcaguaauuugaucaaaucauuggcgcucgaauaucacggaucgaggaagaaacggaaaaagauaccaacuguacaagauaaggaagccgguaucauggcuacgauugaaucuguuguugccggaggaaauauuauuccuacuaauauggaagacagcgcuaaacuagagcucgucgacaucaaagacgagccucaagagcuguacaaggagggcaugauguggacuaaagaggacgguccuccucccgaagguuuuacgauaauaacgauggagaacggguugaacgugcugcgaaggaagagacaacgcaaucugcagaagcucggcauaggcggguucgucgucaggaugagagguaucagaacgggucaggauaacgaugauguggauucgaccaucggucaaagugggcucaacgccaacgacauuguuccaucgccugcagacgucgauaaacccagaaggaaagcuauucgacgaaagccgaagaguaaauuagcugaaacguuucccgccuaucuccaagaggcuuucuucggaaaggaccucauggacacaguggauuguaaaaaagaagaagucgauuguuauagcagcgaugaggagaaaacggacaagcauuauaaauccauuaauuugucucaggaugaaauaauagcaaucguggcaucggguaaaaccgaaaaauuggaaaacaauaacaaagauucgaccaaagaagucaaaccaacuguauugaaagaggaagaagaagauaauccggaggauuugaaagauguucuugccuuaccgggcgauuugcucgauaccgauuugguuaauaguauuauggaagaugaggaggaacugagcaaaacgacugcaucucuuguugcuuuagauucaaauuuaccgcaugauacggagcuaacggacacucugaguaguucaggaaauucaaaagaaaccaaagaugaauugagcgacauuuuaggcccucauuucaaccucgauuccauaucgaacauaaacagcaaggacgucgaagauauauuuaagggcguguuaacggaugagucgcaagaaucccaagaaagcagcaacuuuuccuuacaaggaaacaguauguucucgaacaauaaugcucaacagaccguugcccaacaccccauuauuaaucaaccagugagaccgaaaacuuugccuacuguuaaccauaauuugaauuccccggucaguuuuccaccaccgucacccuaucacucggaguacagcaacaguccucaauuuaguccugccuucaccgaaucgucguguucguggguaagcgggaacgaaacgccggaaauugauaguacgaauguaacggugacgucgacguacaaucagagguccuccgauaaaaugaaagccgaugaaaguuugggcaaaagcgcuacgauuucggcuguuuuauacgcgaauaucaaccauccugaauggaaaaaggaguacccgaauuggcccgauagguacaagcaaauaauaaaaaaauggagaacguugagucaagaacagaaagcgccguuuuugcaacacgcaagagauaauaggagucaauugaggaugaagaaagcgcaacagucacagaccgucaaggaaaccgccucugccgccacguccccgaacgcgagcaagccucuucaccaagccggccaagccuuagugacaacucuccaggcgguaacgcaacagccggcggggguucccgcggcccccgcggcgcccguuucagaggaccaggaaaaaaucgcccuccaacaaaaaucagccagggaagcagaacaggaaagacaauggaagcaauugcaggcccucaggcaacagcaaacccaacaaacccagaacauccugcacgaacagcgcguacaagccauugcucgcguacaacgucagauaucaaccgaucccgcgcaacaguucauaaacgagcagcagagcccguugcaggugaacacgccucaggaauugagcccuucgacuacaccggcccccaguccccgucaauuucucggcauuaaauccccgacguuccccguccccucgccuauccaacaaacuagcgucagggccaacacgcccucacaaucgccccacgacgucucccaaccgagcacgcccgacgguaacgaucacuuuauccauucccccaccaauccuaaaccuaauuuccaaccuagauugcccaacgauccguucgccgcgcaacccgccacgccgcgaccccaauucggaauggcccggccaccucuacagaacuucggcgguaccguucgcaacgagcaacaggacaucaacaucaaucgccaauugagggagcuguugcagcgacagcagguuaagaagcuggaugaauuguugcccggcaaagcgccaccucagaggcuguggcacgcuaaugaucagcaggaggguagcgaugcuucgaugacgucgccuguagcucaaggcgcccagagugcucaaggcgcugacgccaccuuccggcaaccuuuaccgcccggcguugucaaaccuaggcuggcgauuucuucaguuaacaggccgauauugaacgcuguuagagucaaucaauuggaucccagaauucaaaauuuggauccgaggaugagguugauuuuacaacaucagcaacaaaggcucgccacggguauucagcagcaauucauccguuucacgucgaacgugcgaccgacgaccguggaacaguacgagcaacuguugcagcgucaggguaauaaucagaaucaaauucacgcggaggaacagcagcagggugucgcgcgaauacccauaacgcaggccagcguuauacaaaggccucacgucgcucaggcuguggugacuggcgcugcugcugcuacaaauaguuccacagaaaguaaucccagcgaagagggaaucccggauaaugucacagcugaauuggagaaacuggaacaggaaacagguacuaugguagagcuucaaggcgugagcgauauuuugggcgguuuggacgacgacgacgagcuucuagccgaaaugggcgcggauuucaacauacucgaauacgcugaucccgaauuagaagccuugacgggcggaaaaacgaacauuuuagaccuggagcucgaagaggaaccggucaaaaaagaaaaacuagccucaaacgcgaacacuagcgcuccuucucaaaaaccgacgccuaacgucgccacuacggccacuagcaacaguacagcuguuacuacaccgaccgaagccaauacggaacccaaaauugacaauacgauucaacagaacauuccgaaaacggugcaagcggcgccucaacagcuacaacaucccgcuucucugccacagcagcagaacaugccccagcacggcgcucagguucaagugcaaucccaacagucucagccgcauccgccgcagcaaaugcccauucaaucgacgcugcauauccagcagauucaccagcaaauggugcaucaagugcaacaagcggcugcucaaggaaggccgaugccuccggguucgaagaugcaaacuacugauggguucguuggcgucgugauggcgaacaacgccgugcaauugcagauucccccgaauuaucaacaacgguugcuucuuuugcaacaacugcaaaaucagaaguuaaugcgaguuggaagcacucagccaagggcagcuuugcaaguggccccuaaucaaauacccguagguaugaauccgggaccuaggaugccgguuucggcaccgccgccgccuccgccaccuuaucccggcccgcccccgccuuauccgggaaacgcgaaucaacaucagcaggaacaaccgcuguuauuggaagaucugcuugagcaagagaaacgcgagcaggagaagcugcaaaaccaaccgccuaaccacgaagucaccucuuccaccggcaacgaaaccgaaucugcgcucaugagcgaccaagacuucgaacgucucaaagcagacguguucaacagcgcucccguaaauaauauauccucuacaaaucaagggaacgccgggcaaacgucgcaagcguggccucaguugcaaaaccgucaagcggugguucccgcggccgcuucucagcacaccauggaagugacgacuagaguacaaauguuuaacccgaauuugguaccggcgccgccucuuccgccggagaauaucgccaccgagcaggauaagcaggcgcagcuuuuguacgagcaguggcugaaccaucagaacaacacgcuggugcagcaauugcgcuauuaugagaccgaagugcagaaacuucguaagaguaaaaagucguuaaauaguaagcaacgccaguugaggaaagcugguaaucaguugacugagguagaugcuacugagcuucaaagaaucacagcugaacaggcuauauuacaaaagcaucuggaaucgaguagaaaacaaaaucgccaacacggaauguugauacaggaauauagaaacaagcaucccgcuaucaagcagcgaaccggaacugaucagauccaaucaccguugggccauccggcuucuucgcccauacaacaaucgagcgcuucguuaucgcccauguuaucaccaucugucucgccgaugacccagaacaguucgccuuugaacagccccgggccgauggugccuucuucucccggccacggucccguucagaacauuuuacagagcccuaacggcgccaacgcggcucaaaugucuccgaugcaaucuucgcccagaauaggaacgccccauucccaaagugaugagaguccagggucggcgcaaucgccuucgcaaguaugccugccgccgcccaugccuagaaugacgucgccucaacacagacgagucgugaccaguccggugggaaugucgcaaaugcguuuuaucaacaacaacauguugcagcaacgcguucgcaugcaaucgcccauacaaaauuuucaacagaaacccggcacgccuucgccguugaacagcccgacgucccaacagaugagcgucaaccagcaacaucaaauccagaagcagcuccagcaacagcagcaacaacagacguuguugcagcaaaauuuggagggcgauccuaacgccauucacucgcagagaaccacgcaguuguugcagcaccggaauuuuaucaggcaacaggugucccagcagcaaauaucgccucagacguugaccccgcaacagcaucaguugauguugcaacagcaaaaacagcuggcgcagcagcaacaacagcagauugcucaaaugaacgccgcgagauugcaacaacaacagcaacagcagcagcaacaacagaacaauccuccgcauucgccgaugccuccuaaaaguccuaugaucaaccagcagauaaugucgccgcauucuaugccgcaaucgcccaugcagaugccgccgaagagucccauggugccuuucaaucccaaccagaauccuaauucuccagcggccagaagcccggcuuuccaucagggcaucaaccagccgacgagucccaucacucacggccaucaaccucccaguucuccgaugcccaggaguccgaugaucaaccaaacgcacucuccgcauaacguucggaggccucccagcgccaacagcagcccggccaugcccgacaggccgcacagcguagaaaacucuuccccuagaauguacucuauagaucaauuggugcaggagaguuuggccaaucaaaauguaaacgcgcaguauaauuacgcuucggauaugauuaaugaaagcggcggagggaauucgaacaacccgauacccugucccccggagauacccagauuucguuacuuuaagcucgguuugagagguggagcacccauguggagcuucggcagaggugcuaaaagaauuccggcuccuccgaaugccaaaccggacgaaccgaaggcgaagaaggagucgcauuugagcaaaguuucgauccucaaaagaaaaaccucgaucgguucuaucgguaaagugggcucguuaguuaguucugauuacaacgauuuggaugacaguucaacgacgccuccgguaaccccaccguuggccucgaccagcagggguauggugucgaagaagaagaaucucgagcuucaagcgcaaaaagaauccgugaucgucaugcacaguccggacgauaacaaacagcucgaaauaauggauuacgacgacgacaacaauacuguucugucuucagaaguuucuuugaguucagcagcucgaaacgacgacgacuugguggaaaucgaaacgauaucgcaagaccucgccgaagggcuauccagcccguuggaauccgaucaaaucggagacgaauuccuguuguuuccaggcaauauggugguggauaugucaggcgaggggcauuacucggagaaagaggaagaagaaaccgaggaauucaccgaucagaacaugcacaucgugauacgcagcccgacgaccagcgacgacgaguucaucaugccgugcaaagucaagcaguacaacgaggacgagcaggaggacaaucccgaaucgccggaucaagaggaauucggcgaauccuccgacauguugaccgguuacgauaacgaagaaaccgauauuauccucuccgaucaaacuaccagcguucccgaagacucgauauccacuaaagaggacuucgaggagcucaucgacgaggggucacggaaaaacaacaucagcaaacaggaggugaccgcgaaacacauucaggauuuccacagguacaccgaauuguucgauuacggcaaaccugacacucaaacagcuaagaaaccuguaaccaaaaaauuucaaccgaaagugucuguaguucgaggaguagcuuugccuaguaaacccaacaccgagaagauuauuaucacgcaaaauucgaacguguuaaacacuucucaggcuucgaaagugacuagcaucauuuugacucacaacgccaacgugaggaggaacauuauaagcgugccgaaaauagugaguaccguuucaccggcuauaacuauagugagcgccaguacaucgcaaauggccucgauauugccuucuaaauucacggugccagucauaagcgccagugcaguacgccagcuuuccaacgucaaagucaucgauaaaccuuccucuucgucccuaucgauuucuacgagagauaacguccugccgaagaagauauucgaggacgauucggugucuccggauagcucuaauugcgaagaugaaaagucgaaagauucguucgacgauaaaguuaaaucggagucuccuccgcaggaaaucaaacagcccgcguucguaaaauccgacgcuaauccgcagguuauaucguugaaaucgaaaaacuacuccgaucaaucgaagaagaucgaacaucuccaaauaguaaacauaucuucgaaggacgugguucaaaggcaaagaauaccgagucccaugauaucgaaggcuucuccggucaucauacacaacacgcccgaguugaaaaugaccgcucaaguuauucaagagagccaaacucgcaugaaaauuacuacuacuacugauacugaacauuacgaugagucuacggacgauacgaagucggucguaauuucaauucccucaccuacaccuucgcaagaacaaauguuagauagcauagccuuccaagcgcuggaaaacaggagaagagaauacgauucaaucgaagacguauuagacaugauugaaaauauagaaaacaucaccgccgaaccgccagagauacuagaagaaaacacacugcaaaguuccgauuccaacagcaauaucgaaaacaaaaacaccgaaacgaaggaauugcaacuaccuaccagcgaaagcgaaccuucugucacgaaauccuccaucgugccucaauuaucgccccuuucccagcccacggaauugaccacgaacauggccaacgccucgcagcaacucagaacucugcugucgucgcuacaaaccaccuccacgucguccccaacgagcguggaguccauagcgaagaguaucggccagaagaucaucacguccucgucggcuaaccagcccauagucgcuucgagggugaucagccaacaggccggcaggcaaucgcccgucgucaccagcgucuccaccgucauagugccgaauuucaagcagaaaaucaccgucacggcgaccagcacguccaggagcagccccgugaagguggucaccaccucgcaacaacuggcgggauccauaauaaccucgacucugaauuaucuaccgaacaggacgaucgguauacaaauggugccggagcagucgaaauuaccaccggcuagcaucgugacuaccaugcaacagaucaacucgauuacuuccagucaggagucgaagaagccuucguugacucuuacggcaaugcugcaaaaccaacccgcggcgaauaugaugaccaaaucaucagcugauaccauuacagcugcuaguuugcuagguucaccuaucaguuugccgaaaaccggguucaccacgucuuuggugcaagcgcaaccgagcguggugcuuucuaacauaccgccagcgccuagucaaccuucugcugugacuaaaaccaccgcggauucgaucacagccgcuaguuuauuggguaacaucgccaaaagcaguuucucgaugcaaccgagcagcaccgucggcguggcgacaaguugccccaacaaaaccccuacuuccacuacgaauuugcuacacacgcaacuaacgaaagugguaagaaguaaaucagucgacgauguuaaagaauuggccaaaaucgacgagaacaaaccgaauguuaguaacgaaaacguugaugauagcaguaauagcggguguaaguuaucgcaauuaacuacugcuguuugcaacaaaaccgaggauucgcagaacguguugcugaagaaauugcugcaaaauacggcuugugccagcacgcaauccuccccgcccgcuucuaccagcauugucaccacgagcgcugcuaaugcuauaucuaaaguagcuaauuccaguucuaacgcuagcguagagcaaccgcccguuagcgcuccuucuaucguuccaauccaaaggagcgcgagcagagacgaauuacuauccccgccacaagacguacaaaccaugauagugauuaagaaagagcccccgcucgugccgcugucccaacccagucccgugaugaauucgaauuuaaacgcucacacgcccgagguaaagaaagaauucaucgacgaaucgucccagcacucugaaguauccgaccacagcagaucugacgcuccaaucaaagaagaacuggaaaccauggaaaacgcagcagagaaaauguugcucgacaaggaggagcugaagaagcagaagcgcaggauguaccagcagaagcgccgccagaaccagauacucaacaaggagcuggcgcaacagcagccuaagaaaaggccgcggaagaauucgaagaucgacgaggacuacgacacguacaucgacggcgugcuggcccagcugaggcaauuaccgccgauccaggucuccgagccgguguugaaccgcaacuucggcguugugccgcucuucgggugcggcgaucuguccaaaaucggcgccaaggacuauucgacgcaccugggcgaguugacggggagcuacggcuacggcgagcugcccgguuucacggauuucuacucgacgaaaccguacggggauauggauccucugccugagaaaccgccgucguccacgcagcgcggcuucuacgaccaggaguucccgcucauuagauucgacgcggacgagcacaagaaguucgacguguucugcagggaggauucgcccgauucgauauugagcagcucgucuccggagugcacgcgcgaacccgaaaccaaauucgucggguugaagcucaucagcgacagcgaagaggacgaggaagaugaugccaaagaagcgguugcgaaaggaaggaugucaccgguuguucccguuaucaaaccuguaccuauuagacugaagcccgcgggagaauuguacuucaaagagagccuuaacgagaacaaggagaacaucaacagcgacucguugcacguaaugacgaaauccaaauucgacaacaagcagucuccaccggcgaacguuuccggacacguuacagugacuuuaacucugacaucgucggcggccgaagacauaaugggcgugcugagggauuuggcgaauauuuugcacauacccgcgccgacgagcuaccaaaucgucgagcgaacggcgucgccgcccagccagaaauuggguuuauaucgcaccaaaggcaaggacgguaaagaaggggcuccgaucgacauacagagcauccucaacggcgcuacgaaguucugcaagcacugcgacgugaucauuuugagcaauaucaucaggaggaagguguccgauuugccguuucucgccaaagauucggauuuacucagcgacggggaggaauuguucuuuugcaguucagcuuguuacaugcaguucgcuuugaugcaccggucgccuucgauauccgaagauaaggcugcugaaauuauuaaucaccuaucgcagaaagacaauuuggauucgaagcaaaaauuauccucugcagauucguuggacagcaacaaaucgauagcccagaaauuaucuuuuaacaucaaagauucgaaacgggaauucgagccgauggagacgaacgaugcguucgcuuacuucgcccguacggcuaccaauaaacaggguaauaacuuuuacgauggcgcuccauucaaaccggucccugcuagggugcacaggaacgacagguacaaacucuggacgcccgggugucuucaacccacccagaaacacaaaacgcccacagauaaggagauuauggaacuacuuuacaggaugcagaucaccguuacgccuucugucaugccggaagauacuagaaagugucuguuuugucacgguauuggagauggcguggcugacggcccggcgaggcugcugaacuucgacguggauaaauggguucaccugaacugcggccucuggucggauggaguauacgaaacaguaaacggggcauugaugaacgucgaaaacgcccuacaguccggauuacuagcuacuugcguacauugccaaagcaacggagccaccaucaagugcuucaaaacgaggugcucgagcauauaccacuugaauugcgccgucaaagacaacugcguguuuuacaaaaacaagacgguguuuuguaaagugcacgcgccgaagaacgaaaaagauaacgaacucaccacgcuaucggugucccguagaguguacaucgaacgagacgaaaacaagcaaguagccgccgucaugcaccauuccgauuccacggauuuacugagaguggguaguuugauauuccugagcguggggcagcugcugccgcaccagcugcaaagcuuccacacgccgaaccacaucuaucccaucggcuacaagaucaucagguucuauuggagcaugaggaacuugaacaagcgcugcaaguacauuuguaccauuagggaggugucgggcaagccggaguuucgggugaugauccaagagccucccgaagccgacguggaguucuccgauuccacgccgaagggcgccuggcagaagauccuggauaacgucgcuagcauucguaaagagaacaacuguuugcacauguucccgaaauucgccacgggcgaggauuuguucggucuaacggaacccgcuauagucagaguguuagaaagcaugccgggcaucgaaacccugucagauuacaaauucaaauacggcaggaaucccuuguuggagcugccgcucgccauaaacccuucgggcucggccaggaccgagccgagacugaggagccaguugcauuggaagaaagcgcacacucagagaaccaccggcgguacuucgucaauucgaccgauguucggaccgucucuaacagggucuauuaguacucccgcucagggcgagcucgcuugucccuacagcaagcaauucguucauucgaagaguucgcaguacaagaaaaugaagcaggaauggaggaauaacguuuauuuagcgaggucaaaaauucaagggcuugguuuguacgcugccagagauuuggagaaacacacgaugguuaucgaauauauaggggaaauuauuagauccgaauuggcugagugcagggaaaagcaauacgaagcgaggaaucgaggaauauacauguucagacuagacgaagaacguguuguugaugcuacuuuaugcggcgguuuggccagauauaucaaucacucguguaauccgaauugcguggcugaaaccguagaagucgauagggauguucgaauaauuauauuuucuaaacggagaauucuaagaggagaagaguuggcauacgauuacaaauucgauaucgaagacgaucaaaacaaaauauccuguaugugcggagcuccgaauugucgcaaguggaugaauuaa

SEQ ID NO: 5983 - RNA, 4494 nt, Phyllotreta armoraciae
augggggauucucaucaggauucucaggaaggaaggaguagcaggagaaguaggacguucaaagccaaggcuucagaaaaguuuaagcaguucaagaaaggcgugaaaaauaaguaugagaucggcgaaguggaaaauguuuacgaaguugucgaugaaaaacaguacauuaaagaaguuaugucgagauaugaugaugauuggaucguuggugacuccaguggguauaucgaggaugguagagauauauuugaugaugacuuggacguagaaucuguagcucaagcuucgaguaaaggcaaagguauaaaacgaaagcacaagaauguaucggaaaaugcuggcaagggaaaguugcaacaaauguuuucaaccaugccgacuaaacagaaaacgguagcaaaagucgaugaugacgaaaugcucucggaaaucuugggugaaaucgauucugauacaccaaauacaucugcugucgagaaaccaaaaauuucccaguacucuacacuagcaauuaacuuaucggcuaaggauuacaugaaaaauuugucgcaacccuuuaaaaaacgcgccaucgaaaaaaaaguacaaaaaguaccaaaaauacaacccagugcauccaaaccaaucgaaaauacaaacaaaaaaguaccaguuaaaccaguaacagaaaaaauaguaccuguuaaaauucaaaauacugaaaaggaggagauugauucugaaaaaaaugcagaaaaagaaaagauagauccugauaaaaaugccgaaaaagaaaagcuugaucuagauacaucucacuuugaugacgauuuggaugaaacucuacuugaagaauuuaacgaagaucucaaugaaacuguaucccaaguaacagaaucugaaaugaacguagacgauuucacaggggauauagauacaacagcaauagacgaaauugaggaacgaauuaauguugcuggugaacaacugauaaacgauauucaagcagaagucgaaacggaauggcaauauuuuaacaaugcuaacgaaagcuuuaaaauagcaacagaagguucagaagaucccgauucuucuguugaaauuacggcugauguuccauucguaaaagucgaagggaaaaauguguuuagguucuuuuggugggaugcuuacguggauccacuauaucaacaaggaacuguuuuccuguuugguaaaacauacugcgaaacuuccaagaaauaugaaaguugcugugugccuguaaagaacauagaacgaacaauauuuguuuuaccuagaccuuuugaacuagaugagaacggaaagcccacagaaaaaccggucacguuuaaaacaguucacgaugaauuuaacaaucagguuuuaaagcgaaugggcauuacaucuuucaaaucgagauugaucacgaaaaaauucgcauucgauccaagcguaccagucgaauccgaauacuuagaagucagauauccugcuucauuuccacggauuuuuugcaaugaugacgaggaccaaaaagacgauuuaagugacuucgaugaucccagcuauaaaacuuuuucaaagauauucggcauaaaaacgaguuucuuggaaucgcuuuuucucgaacguaaaaucaaaggccccuguuggaucgacauaucugaccccgaacccgcaacuaauccgaugagcuuuugcaaauucgaaguaaacugucuuaaaccuaccaacuugaaaaucacccaauucgagaaaccuguuccuccuccuccgcuuguaguugccacuauaaacaugagaaauuucaucaaucgaggaucguccuaucacgaaaucgucaugauuucuuguuuggugcaaaaucgauacgcugugaacaaaccgccuccugaacccgcuuuucaacaccauuuuugcguuuuuagcugcccgcgaggacaagucuuaccacuaaauuuguacgaagcccugcaaaauuacaaaauaacgaaagugcugaaaaccgacaacgaaaaggccaugcugaauugcuucaucaacaacaucgugcaaaucgauccagaucuaauagucgggcacaauuuacaaggauaucaaaccgcuaucuuggcagauagauugcugaaauugaacugccgaucuuacaauagacugggcaggcucaagaaaagaacaacgaacacgagacaauuggagagaacuuuguuuuugggacgauuaguuugcgacauaaaaguauccgcgaaagagcugauaaaauccagaucguacgauuuggauacgcucugccaggucguucugaaguuaaaggagaaccaacggguggauuuggagccugaggaugugaucaaaauguucaaaacgucacaggauuugauuaaacuaauuuccuucacuaugcaagauuccggguauauuaugaaaaugauguacaaucugaacauuauaccucuggcuuugcaaauuaccaauauagcagguaacgucauguccaagacuuugaugggaggaagaucugaaagaaaugaguuccugcuguugcacgcuuuccaugagaaaggguauauuuuaccagacaagguucuuagaaaaaaugaaaacgaauccaaagggaguuccaagaagaaacccacauacucgggagguuugguauuggagccgaaaguaggcuucuacgacaagcuaauacuccugauggauuucaauuccuuguaccccagcauaauccaagaauacaacauuugcuucaccacgcuccccauaauggauuccgacgaaaauuuaguacugccagacaguaauuuaccgcccggaauacucccaacagaaauuagaaaauuagucgaaagccgucggcaagucaaaucucugaugaaaaagccggacaucuccaaagauuugaaauugcaauacgacauucgacagauggcgcugaaauuaaccgccaacucgauguacgguuguuugggcuucggacauuccagauucuacgcuaggaaucuagcagcucugaucacccaaaagggccgggagauucucgugaauaccaaagauuugaucgaaaagaugugcuuggacgucgucuacggggauacggacagucuuaugaucaacacaaacauuuuggaauacgaucaaguauuuaaagucggcguuaaaaucaagcaagaagucaacaaauuguacaagcaagucgaacucgauaucgauggaguguucaaguauuuguugcuguuaaaaaagaagaaauacgccgcaguaacgcucgcuaaaagcccguccggcgaauugauagccacuaaagaguacaaaggauuagauauagugcguagggauuggucacaauuauccucagaaaccggcaaauugguccucgaacaucugcucagcgaucagucuucggacgaaaaaauacaaaacaucuacgaucacuuggcuaaaaucaaaucggauuugaucgaggguaaaauaccgauaccucuguuggugaucacgaagcagcugaacaaguccccgcacauguacaccgacaagaauuccaugccgcacguucaggucgcccugcgcuacaaccagaagagccgggaucacuucagaaugggcgacacggugcccuacgugaucugccucgacggcaccagcaacggccccaugcagcgcgccuaucaccuagacgaacugaaggcuaacccggaccugaaaaucgacuacgacuauuauuuggagcagcagauucauccggugauagcgagaauuugcgaacccauugagggcuuggacgcuuaccaguuagcugaguguuugggcgugaacaugaaacgggugaagauucccaaacuucaaggggguaaagagaacauucagggcgagaacgucguuaaagccgaaguaaaauucaagaacgccgagaaauuuacguuuguuuguuacauuuguaaacgcuacaauaucgucagcgagccauugaucaacaacauucccuuccuggagaagugucaaaacgccgacugccaaucgaagcccaucgauuacuuaccgagcauucaaaaucaacucuaccgaucuauccguucgcacauaacuaaauauuacagaaaacuuuuaacgugcgaagacccuaguugcccgaacucucccagacgauugccccugaaguuccugaagaaacgucccuuaugcagcauguguugcaacgccguaauguauaagguuuacaccgaauuccacuuguacaaccagcuggcuuacuaucgguacauguucgauuugagcaaacuuaaaaauaagccucugauggauggugaaaccgaacuggguuaucgggcgcuucaagauauuguggauaaauucaugaaucaaucggaauacucgcucauaaaucugagugagguguucggucaacucgguugggccgcuccgagucaaaaaguugauucggaagagucgaaaaccagcauccuuuuuaacgaagaagguaaugaagaugccuaugaugaugaugaauga

SEQ ID NO: 5984 - RNA, 1398 nt, Phyllotreta armoraciae
auggcggcugcugcagcggcaaaaauugccgaaguacgcgagacaacccgcguagaaagaaucggcgcccauucucacauuagaggccuaggauuagacgacagucuugaagcuagacauguaucucaagguauggucggacaagucucagcuagaagagcaguugguauuguuuugcaaaugguacgcgaugguagaauagcaggaagagcuguuuuauuagcuggacagccugguacugggaagacugcgaucgcaacugcuuuagcucaugcuuuagggcaagacacgccauucacuaguauggcuggaucagagauauauucauuagagaugaguaaaaccgaggcauugacgcaagcuauuagaaagaguauuggaguaagaauaaaggaagagagcgaaaucaucgaaggcgaaguuguugaucugaguauugaacguccagcuacaggaguugguacuaaagucgguaaacugauucucaaaacuacagauauggaaaccguguaugauuugggcgguaaaaugauugauaguauucuaaaagaaaaaguucaaucuggugauguuauaaccauugauaaagcuacaggaaaaauuacgagauugggcagaucuuuugcuagagcuagagauuaugaugcuacuggccaacaaacgagauucguucaauguccggaaggugaauugcaaaaacgcaaagaaguuguccacacagugacuuugcacgaaauugauguaauuaacagucgcacucacggguucuuggcacucuuuucgggugauacgggagaaauuaaaucagaaguaagagagcagauuaauggcaaaguagccgaauggcgugaagaaggcaaggcugaaaucauaccaggcguacucuuuauugaugagguucacauguuggauauagaaugcuucuccuuuuuaaacagagcuuuagaaaaugaaaugucuccaaucgucauaauggccaccaauagaggaaucacgaaaauucgagguacaacuuacaaaucuccucacggcauaccauuggacuugcuggaucgaacaauuauuguuccuacucagccauaugacgaaaaggaauugaaagaaauauuaaacauucgaugcgaagaagaggacugucaaaugucugauaaugcuuuagugguuuuaacgaggaucuguaaggagacaucuuugcguuacggcaugcagcucaucaugacaucgaguuuaauagcuagaaagcguaaagcccacgaagucgauguggaggacauuaaacgagccuaucaauuauucuuugaugaaggucgcucugugcaauuucucaaagaauaucaacaagaauuuauguuuaacgagauugaugagaaagaugauauggaaauggaaacgauuuaa

SEQ ID NO: 5985 - RNA, 1170 nt, Phyllotreta armoraciae
auggcguuaagaacuuacggagauaaacccaucaguuuccaguuggaggaaaauggagaguacuacugcguuggauccgaaguaauuuuuauugguaucuucuggauauacuugaugauacguucgaauuuacaggugggaaauuaucuucgacucuucagaggaucccuauacaaaaaguacccuggaauguucaggaggucuauaaccaaugaagaaagaaggagguugauugaacucgguuugagccagcacguucuagcgaguagcguaucacugcuuagagcagaagaaguugaagauauaauugaaggaaaugaugaaaaguauaaagcuguaucuguacacacuucugaaccuccuaugccaagagaaggaaaauccaagaaaaacaugcaguggguaccuucauuacccaauuccagucauuuagaugccguuccgcaagcuacacccauuaacaggaacagaguagcugcuaaaaaggugagaacauuuccacuauguuuugaugauaccgauccccaauuaaacauagaaaacgcuugucaacaagaauugcuaguuccuauuagacuggauauggaaaucgaagggcagaagcucagagauacauuuacuuggaauaaaaaugagaguuuaauaacgccugaacaauuugcugaaguccucugcgacgaucuugauuuaaaucccuuaacuuuuguaccagcgauugcucaagcaauuagacaacaacucgaagcauucccgacagaaccucccaguauuauagaggaaaccugcgaucaaagagucauuauuaaguuaaacauucacgugggaaauacuucuuuagucgaucaaguugaaugggacaugagugaaaaacagaauaaucccgaagaauuugcguugaaacuuugcgcagaauugggucuugguggugaguuugucacugcaauugcuuauucgauuagaggucagcucucuuggcaccagaggacuuaugcuuuuagugaagcaccccuuccuacuguagagguaccauucagaaaucccagugaaucagaucaaugggcuccauucuuggagacccugacugaugcagaaauggaaaagaaaauucgcgaccaggacagaaauacucguagaauuagaagauuggcuaacacuacgccggguugguag

SEQ ID NO: 5986 - RNA, 561 nt, Phyllotreta armoraciae
augaccaauaacaacguaaaaguaacaguagucggggauggaaucgugggaaaaacuugcauguuaaguacuuacacuacgggcgaauuuccagaggaauacauaccgacaguauuugaacauuauggacaagaaauuacggucgaugguacacauuacaauaugacuuuaugggacacugcaggucaagaagauuaugaaagacuaaggccucuaucuuaucccaauacaaacuguuuucuaguuuguuuuucuguggacaaaaaucuagccuccuacgacaacguaugguugaaauggguaccagaaguucggcauuuuaacccaaacgugccgauuauauuaguagcgaccaaaacugaucuaagagacgauccgagccuggcuuguuacucgaccgaggaaggcaagaaguugaaaagaaaagucagggcgcaaugcuacauggaaugcucggcauugagguaccaaggacucgaggaaauuuucgccgaagccaucagaguguucuugaagagcaaaucuaagaagccaaaggcgaggcacugucggauauuguag

SEQ ID NO: 5987 - RNA, 4017 nt, Phyllotreta armoraciae
augaauacaaccacuuuuaauccaagaauggacgccgcucaaaacccggugcaaaaaauggaauuggcguccaggaacguggaaaauucuuuguuaaucgacaacaaugcuccgagauugaucgauuuuaugaauauuaauccgcaaagcgguuccacagcaagcgguuuugcugaccaugauuauccaacuuuaaguggauuaucgcauauuaucaacaguaugacccaaaucaagugcguuagcaauguuccuauaccuucggaaauugucgaccauuuugcccguguacaaugccacugcaugauggguuuauuuucagaaauaaacagagcuugguuaacuguugauagugauauuuauguauggacuuacgaggaaaacaccgacuuggcuuauuucgacgggauaagugaaacgauuguuugugugggacuaguaaaacccaaagcaggaguuuuccacgccuuuauaaaguaucuccugauuuuagcgacuucuguugauauuguuguauuggggguuacuuucacugagcgaccuggugacaacgcugaugaaauucaacuuauaccugaccccgucuucauauuacccaccgaugguuccacugucacgauaauuaacaguaccgaugaugggaggauuuuuuaugguacgaaagaaggaaauuuguucgagauugcuuaucaagcugaaagugguugguucggcaagagaugcaaaaagauuaauuuaucgaccagcacuuugucguuccugguucccucauuuauuaaugcggcauuaagugaagaggauggaauaacgcaaauuucaaucgacgacagcagacauauucucuauauucugacggaaaaaggauccauagaaauuugcgaucuaggagagaaagggaauucauucuccagaauuaguaaaaucucucaaaacacguugguuaaccaagcgaugaauacuguuaaaacucucgacagucaaaauuuucgaccgaucgugagcauauccgccaucgaagcgucagaaucgguuaauuuaaauuuaguggcugugucucaaacgggaguaagauuuuacaugaccguuacgaguuugucgaaccaaaaucccaaucaaagaccauacacccuaacccuagcucacguaaggcuuccgccugguuauucagccaacauuacuguacgaccgagggcuguacaugugucccaguauagagacagaaacuugauauuaauaucaacuguuaacgagaaagauguguugugguguaugagcucggacuuauuuccauucggccaagggcugacugaagcuuacacagcuauuaauuuagacggaccagcucuagcuaucucugaagugagaaaugauaguccccuucaaauaaaagauauacaugaagcgccuccuuuagucguccggcaacaugccgaaccuccgaaaaaguacauuguccucacuucgcacagcauucagauuuucauuaaguuaagaccaguagauguauugaaacaaauuuugaaagacagccaugggcaagacaccgaagcguuaaaagcuuucuuuaccauucaaaaagaggaucaagcgugcgcuaccgcuuugauacuagcuucacuggaaaacgaagauaacauggacauagccgaguuugcgaccagagcuuucuucuuauucggaggcgaaccaaaauuggcagcuccaauuaauacuuuuucuggaccguccguauucuguccacccgucaugucuacuccuaauaugcaucaauaucaucaacagcaacagcaauuucaaacaucaccgcaauaccaacacaacuuuccgcauggcauuucgcccgcagcaaaugcauacgaauugaccaguccguucguuuuuucucccaagcacaacggccucuauuuauauuuagguagaauauuaagaccuauauggaaucgaagaacaguggauaagcuuugcuuagauggaaaaauuguuacaaaucacaguacagugacuagcgaagacugcauauuuauuuugaacuauguaacgucccugcauaauuuccuaacgcguaauacucagcuuucaacguuaagcgccgcucccagucacaauccucaaaccuuuaauaauacuacgaugaauaugaccagauuaaaccauaccauucaagacguccaguuagaggaaagggcuucucuggaugcuuugaaaacauucgugugucacuguugucaaauauuaggucuguggagaauucuuugugaacaucaauuccacacauugauagcuuccuugccugaaacugagcagcagauauugcagaauacaaccuuuaaggaucugcuuuuauacagacacgauaucuguacauuguuaauugcgacauuaguggauaguuauuuaggugauaacgccucagucgauucgauuagcagcaaauugagagaagucuguccgcuguuuuauaaaacggaagaugcagcauuuucaaaagcugucgaaauauuaaaaaugacacggacaauucaaaacaacgaugaaaaggaggagaugauccaaucggcucugcagauuugcaaaucaaucggccccacuauuaauauaacugauauaugcaaggaauucgcuaaucucaaagcguauaaagcuguuacggaauugugugcgcauuucggcaagaaaaucgauccggauaaaauagcagaaaguuacuauaacgcggaagacaacaguggugaccaagaaggguacaauuauuaucaaagaagguuggaaauuuaucgucauauuuuaaauauguuggaucaauuauacaacgaacaaaaucaaacgcaagucguuaguagagauccagcauacucaguuaaucagaccauauuacuggaugguguggaacagucucaaguaggauaugugaugaagcaaguaauaaaagacguuauggaaacgcccgaugaaauuaugcacuucgcccuuuacgauuggcuaguauucaagaacaugacuggagauuugauaaacauccaaaauccgucuuuggaaacguauuugaaacgaacauccacccagaaccccaacaacaucgaggccaugaauuuguuauggaaauacuaugaaaguuguaacaaccacgcggccgcugccaaaauuuugaacaaccucgccucaaggacuggcauaaacguuccuuugaaagagagacugucuuaccuggcgagagcuaucaugugcaugcgaagcgauaaaauagguuaugcgccguaucuugguguauuucugagagaucuugaagauaaaauggagguggcgaaggugcaagaacaaauuuuggaugccauuguaaauuugcaaggacaaguaccuaacgcucaggaaauuauaagugcacuuaauucuggcuuguacgaaauuucgcaguuguaugaaaauuucgcugaacccuucaaacuauuagaaugucaauuggcgaucauugaaugcgccggauacaccgaucaaguuuugauugaguccauuuggcagcaaauuuugacugaagaacuaaggaaaaccuacggaacggguacagauaaagucugucaacuuuugaacaaaguaaagcaguugucgaagcaauacgcucagucugccaacuguuuucccuuaaguuacauuguuuaugaauuggaaauagugaacgcaaaacuuagaggagacaaacagcucguucccugugccuuggaaaguaugaauauuccauucgaaaauuuaaucaacguuuacaauaguuugaauacgauuucuauaaaugaucauuucuggcaauuagaggagaacgaauuucaucuuucugaagccacugcugcguuaauaaauuguuuccugagccaucuugaacaguacagcaguguggaaaaacgaaaaauaacuucacucugucaagaugcagugguugcuuugcuauccaacuuguacagcaagcccaacaccgaaguguuaguuaauaaguuaagaaauauacaagccaaauugucaagaauuuag

SEQ ID NO: 5988 - RNA, 4140 nt, Phyllotreta armoraciae
augagcgaauucacuuuaagcuacagagaagucacuccggaacaaauagauuucgaaaauuggaaagaaauaacccuuacuacaggaggaacgcaaagcaccuuacaagauauaaaaguagccgagaaagccaauggauacuguuacaaagacuccgcuaaacacugcacaaggaauagauucaucuauuggagaauuaaucacaauguauuggaauugguggagcacaguuuagauauaaaucucacaggaaaucgaaucagauacaaguuugauacuccaauuuuagaugguguuucgauacacgagguacucgauaacauuguuauuuugguuccuacaguuugcaguguucacaggcugauauuuccccauccaaauguuuuucacgcacaggaugauuuacugggcauauauccggauuuaacagcuuuaucuauauuuucgaaagcaucgaucgucgauaccagaaauccgaacagcuuuuacguuuucaacaaucccagcacugccaaugaucaauugccgaaccuagccaauucguacuucguaccggaaaccggggaagcuuauuucguuuuggcauuuccuucgaccgaacuucuacuaaucaggcaaaguccugaucaaguuacuugugcagaacucaaaggggaaucuuuaguucccagauuuuucgccgguaucgcagacaaauucaggcacaagaauucggacagcgaaaauauugugagcuugcuauucuacgauuuggacgaagaaacuuacguacuaucguuaacgcaagaugcucauuugaaauuuugguccugcaguaaaggccaauguguagcaguaauagauguucgugaaaaaauaacgaacuugaaauauagaguucagucggcgauucuaaagaaagcugaagaugggaacaauucggaaaauauucugguuuuauuccuaaguuucggaaauaaaugccaguuccacauuuugaaaccuucgguuagagaccaagaaaucucucuacauagauuagccacucucgaaucgccuuugaacgauuugauagauuucgccgcacaaauagauugcuuauggucaguauggcgaucggacgugggcgaaacagugguuuacauggcaucguucaaauccaaccgauggacccaaguaauccuggaaaccgaaccgugcgauaaauauuuucccguaaaauacaacgacgucaagacgcuuuacuuacagcauauuuuucauccaggcagauucccucugcacguuauuaacaaaacucuuucgauauacaaaaugccuacgauuggcucggacagccaucuguccauuucagcgcuaaagcaaagagugugcauggccgucgaaaaugauauacaaaaucuguucaacaaagacgguacugauguuaacaguguugaaguugaugaauacguagagugugccgaaugguguuggcaaaaguucgacuccugcugcguccaauaccagaucgccagcaggaaaccgcuggguuugaugcuucuaccaucgguaucgggagccaugcugcugaagaaaucugcuuuuucauuccugcggcccgucgauucgcuggaacacaugacuuugucuacggauuuguacagagagcaguucuucaauuucuccauguuggccgaugauuuggauacgguagaggacgugauaaacguguucaaagugaucguuuacaucgaacaacaguuaaaggauaauuucaugcaaucguucgaaacggaacuucucaaucuccaaucgccugaugucguuauagaagaucugcuaaagaagauuuauguugaaauggauucggauuuuuuuucgcacauuuugcaucuaaucaaagacgucaacgauuuguacaaagccauacacaaaauccuggagcugcugagauacgaaaacaccuuagcuaaucccgauaaugacauuaauccagccgcuauguacuauuucaauucgcucuuaggcaccucguuaguagcccaaaguuuucgacaacaagcugaaaucagauuucaaauuugccgcaauuuguugcuccuaugcaacuucuuggugauggacaggacguugaacgggggcguuuuggaagggguucgaucggucuguaugccggauauugucguuuuaacccaagccaguuucgucgugcucuggcuaagcggcuugacgauguucgaaagugacucgauucgggauucuucaaugagcacgcugaauccguuaaaauuaacgcccguuuacaaucuguugccguucacucguugcacgucuuuauuggaaguguuuauaucuucaucgggcguucaagaugccaggaaaucguucgcuagagucucuugcaaagacgaagccuuggcucguuggcauuggucucuguugcccuacgugaaucacaucaggcaucuuauuuggcccauaagcggguguacgguguucgaggaauggcucuuaucgaguggccagcacguguggcugcagcaguauguucgguuacucagcaauuggugcgaauggaacguuuguacacgaaacuucuuauuggccucgucguuucugacuuccggcgaauuuuacaaggccgaagagcucuucgaaaccgcgucgaaaggcguuuuuaccgacacguuuuugaaaaacagaaucaaaagugucgaugaaaauaauauuagaaccacuauucauuauuauuuaaaggugauccaauuauucgaguuguguaacgcuagaagucaugugauuaauguggccaauacggcucugugcguagucaaaagggacgauccauuagcagcuacguuguuuucgaucaaauucaagcaucauuuggcuuugaagcacuaccaauuggccuucgacucgcugaauucgaacccggacggcgaacgaaggaaagauaaucucagggauuuggugaagacguugcuggacgagaaaaaacugaauguauuguugaauuucacguacggaagcauggaugaauucuucgcgaacauuguuuugacuagagcuagagcggcagacgucaugaauaacguguuuuaugauuucuuguauucguaccaaaucaagaaaggcccaccaucuuucagauuagccgcuucggcuauguaugagcaagcguuucgauugagccagaaaaccaccaucgaggccuuggagaagcaagugaaaugcuauuuagcagccaaaaauguucuacacuugugcccgacacaacacgcuugggucgucaggccugcugaucccgaugaagaagacgaacaagucaucuuucaaccuuuagccggcucaaacggggaaauccguacguucaaaaucaagaaacaaaucgaaguaguagacaucgaaaccauaggaaaagaacuaaccuucgccagcgccaaauugaaauugcugcaauucaacccuucgguuuccauuaacauuugcgaccccuuggagcuggugauuucgcuaaacaacuccggcauguucaaaguggccuuugagauuugcucuacguucgauuuacccuauucgcugguauucgaggcccuuacaaaacguugcguuuuacucaccgaagccgaggaucccaacgcuuggaauuggcugguggagaacgauuugcaagauuugccgguuaauagagagucagcugcugaugugguuuggaaauuccugcaggauuguuuggagaaguacgaagagccuaacaugucuuguuugcauaacgucguuugcaggaaaauuaucaacaugcaaauuuacuugccucauugguugaaagcuucuuacaaggcucgaaauccauccgaauugcugagguugcugcacgccuccgggcguuuggaagaagccguggaauuggccaaagacuacauucuaucagcgaugggauacggcaacgaggacuucgguuucgcgcagccuuuggcaccgacuucgccggcuuucugucuucccgucuacgccauacagcgacucgucgacgaauuggacaugcaaaacuccaugaacaucgaaaaacccuucguucacgagcacgaugauuugaagguguuguuuucgaaguaucucgaaacggcuauuagaguuuccaaucagaugugccagguuaagaguaaagcuauuuaa

SEQ ID NO: 5989 - RNA, 2907 nt, Phyllotreta armoraciae
auggaggucuccgacaagaauuuagaaacuuugagcagauauuugcaagaaacucucaauccggacccgaacgugcguagaccagcggaaaaauuucuggaaggagucgaagucaaccaaaacuacccgcuguugcugcucaaucuggugcacaagcccgagguggacaugacgaucaggguggccggcucgguggcguucaagaauuacauaaaaagaaacugggugguggaggaagaucagacggaucguauucacgaauccgaucgauuggccaucaagaaucucauugugacuuugauguugagcucgccggaguccauucaaaagcagcucagcgacgcuaucagcauaauagggaaaaccgacuuuccguugaaauggccggaacucaucacggaaauggucgagaaauuuucuacaggggacuuuaacguuauuaacggcguguugagaacagcccauucgcuauuuaagaaguacagauacgaauuuaagucgaacgaauuguggacggaaauuaaauacgugcucgagaaguuagcgaaaccucuuacagaucuuuuggucgcgaccauaaauuuaucucaaacccacgcaaacgacguggcugcauugaaaauaaucuacaguucgcuagugcucaucugcaaaguauucuacucguugaauuuccaagauuuacccgaauucuucgaagauaacauucaaguuuggaugaccaauuuccauacgcugcucuccguugauguuaaagcgcuacaaagccaagaagacagcgaagcugguguauuagaacagcugaaaucacaagugugcgauaacguagcuuuauaugcccaaaaguacgaugaagaauuccagccguacuugccucaguucguuacggacguuuggagcuuacuagucgcuacaaauuuacagcccaaauacgauuuguugguuucgaacgcccugcaauuccuuucgucuguggccgaacguucgcaguacaggaaccucuucgaggacgauaacguacugagcagcauaugcgagaaaguuauuauaccaaacauggaauucagaacuuccgaugaggaauuguucgaagacaacccggaagaguacacgagaagggacaucgaaggcuccgauaucgacacgcgcagacgagccgccugcgauuuggucaacacauugagucagaacuucgagcagagaaucauagaaauauucgggcguuauuuacaagugaugcuggcgaaguacgcggagaauccgaagcaguauuggcgcagcaaagacgccgccuuguacuuaguaacgucucuaguuagcaggggcucuacucagaagcacggggucacgcaaaccagccaguugguggacauuacgcaguucugucggcagcacauuuugcccgaauuagaacgaccugauguuaacgauuuaccgguguugaaagccgaugcuauaaaguacgucaugacguucagaucggugcuucccagcgauauagucguaucgacuuugccacaauuaauaaggcacaugccgagcgaaaguugugugguucacacguacgcugcgugcacguuagagaagauucucauguugaaauucaacaaucagcccauugugaccggagcucaguuggagccguuggccuccgaauuguugaccaauuuauucgccguacuccagaaaccgguguccgaggaaaacgaguacauaaugaaggcccuuaugagaacguucgcuacgcuacaggacaggaucauacccuauuugaacguggcuuugccuaaaaugacggaaaagcugcaaauggucgccaagaauccgucgaaaccgcucuucaaucauuaccuguuugaagccuuuucguuggcuauuaaaaucguuugcaagguaaaucccacagcgguaaccucuuucgaagauauauuguuuccgauauuucaaggaauuuugcaacaagauauacaagaauuuauuccguacguguuucaaauuuugucguuguuaauggagaacacaccacaaggcuccuuaucugaucccuacaugcaauugcuaccuugucuauuggcuccgauacugugggaacguccggccaacaucagcccguuggugagauuauuagcagcuuucgcuacucaagcugcuccgcagaucguacugcaggauaaagugggcgguuuuuuggguguauuccagaaauuguuggcuucaaaaucgaacgaccacgaagguuuucgacugaugcaaagccuuauucagaaucuaccuauugaagcucuuacgccguaucacaagcagauauuuuuccuucuguuccaacgauugucgucuagcaaaaccaccaaauacguuauuaauuugaucguguucuuuugcuuguauguggugaaguauucggccaacgauuuggugacuuugaucgaugaaauucaagcucagauguuugguaugguucuggagaaacuccuaaucgcagaacuacagaaaaucgccggcgauguugaaagaaaaauugucgcuugugguguuacuaaauuacugugcgauugcccccaaauguauacgggaucuuaccagaaauauuggccgcaauugcugcaggcgcucuuagcguucuucgagaugcccagagacgagacaacauuccccgaugaucauuucaucgaaguggacgacacgccggccuaucaagcgaccagcgccaaauugaauuucgccgaugguaccaaaaacgauccccuucaaggugucagcgagccgcgucaguuucuaguucaaaguuuggccacucugggggcuucgcagcccggucguuugcccacuuacauaaacaacaugaaugcccaaucgcagacgauacugcagggcuauuuggccaaguucggaguccaauugguguga

SEQ ID NO: 5990 - RNA, 600 nt, Phyllotreta armoraciae
auggcaaaaguacaauuaugcaauaucacaguuauggacaauccuaguccuuucuuaaacccauuucaauuugaaauuacguucgagugcauagaggaauugaaagaagauuuagaauggaagaugauuuacguagguuccgcugaaaccgaagaacacgaucaaaucuuagacucuguguuuguaggaccuauuccagaagguaaacacauguucgucuuucaggccgauccuccgaacgucucccguauaccugaaaaugaugccauugguguaacaguuguucugcucacuugcuccuacaagagucaagaauuuauucguguagguuacuuuauaaauaacgaauacagcgauccggaaaugagggaaaauuugcccagcccaccucaguucgauaagguaauuagaaauauauuggcgucagagccaagggugacgagguuuaaaaucaauugggaagaaucaaguggcacucaggaaaacggaaccacaauugccgaagcacccgcuaaccaaacaaccgaaacuuccgcuucgguagaaguaccugcuuucaacgagaauucgaauucgugggccaccauggaguguucauaa

SEQ ID NO: 5991 - RNA, 939 nt, Phyllotreta armoraciae
auggaucaaaugcuaccgagccccgguuuuaguauaccuagcauagguacaccucuucaucaacccgaggaagaccagcuaauuuuaccgaacgccauacagcaacaacaaagucuaccuacuacuaacucacaagugccuccucuagcuccaaugggagguucuacuccaacacuuggucuagguuuaggccaugcuauguccaugccacauacgaaguauguaacuggauuuucacugccuaucaguucuaugacuccucaaacaccacaacauacaaugaugaguccuaugguaaauguagguggaacugguaccacuaguuccgguguaacgccuacguuaggucccucuacaccuucaccaaugacuccuaugacaccacacucggcagauccuggaaucguuccacaauuacaaaacaucgucucaacaguaaacuugagcuguaaauuagauuuaaagaaaauugccuugcaugcgagaaaugccgaauauaauccuaaacguuuugcugcugugauuaugagaauacgagagccgagaacgacagcuuugauauuuucgucggguaaaaugguguguacgggugcgaaaagugaggaagacucgaggcuagcugcgagaaaguaugcucgaauuauacaaaaauugggauucccugcgaaauuuuuggauuucaaaauacagaauauggugggaaguugugauguuaaauuuccaauacgauuggaaggauugguucugacucacaguucguucaguaguuacgagcccgaauuguucccuggucucauauaucguauggugaaaccaagaauuguucuguuaauauuugucucugguaagguuguucugacuggugcuaaaguuagacaggaaauuuacgaagcauuugauaauauuuauccaauuuuaaaaaguuuuaagaaacaauga

SEQ ID NO: 5992 - RNA, 567 nt, Phyllotreta armoraciae
cugguccugcugucaguuuugggguuauuaaagauuuuuaaagaaucuuuuauauuuuaucuaccaaagucccuuuucaaagcucauaaaauggcugcaauucguuccaugucucgccuguuauucuccagaucauuacaaacuacuguaaaaagggguuacgcugaucaaaugagcuucacuuuugcugcuggaaaucaggucuucuaugacgcaaaaucuauaaaacaaguggauguuccuucuuucuccgguagcuucgguauccucccagcucauguucccacucuugcuguucugaaaccuggaguaguuacuguuuacgaagacggcggugcagucaagaaaauuuuuguauccagugguacggucacuguuaaugacgauucaucaguucaaaucuuagcugaagaggcccacccaguagaaaauuuagauguuagugcggccagagaucuucuuaacaaagcacaaagucaauugucaucggccacuacugaucaggccagagcugaagcugccauugccauugaagugggagaagcacuuguaaaagcugcugaauag

SEQ ID NO: 5993 - RNA, 966 nt, Phyllotreta armoraciae
augagcggagauggcagucaaaacgagcauuucgauacguuauuucuaucaaucgcccagcaucauccccaggggcccacgcaacuccuggacacuuuugugaacuuccugagcagaaaaacggacuuuuucacgggcggaaaggaaggagaaugggaaaagcuaguauugaauacguucaagaaauacgagaagucgagcagggaacaacacgcugccgaauugaaagagaaacucgagcaggaagcgcguaggaaggcgaaaaaagaggccgaaucggccaaacaggcucaaauaaccgaauuaacggacgaacaagcggagaaacuacaagccgaacucaacgcuaaaaagucccccucaucggcagccccuucgaauagcucaaauacuccuucgacuucgaagaucgaagaagacgaagacgaguccgagaaggguaaauuauuaccgaacaaaggaaacggcugcgauuuagaaaaauacaauuggacacagacgcuuagugauauagagcugcgcgugccgcucgaaugcgauuucagaguaaagcaaaaggaucucacggugaacauaacuaaaaagcaccucaccugcggccugaaaggccguccgcccaucaucgacgacgauuuccagcacgagaucaagcuggaagaguccaauugggucaucgaggacgggaaaucgcugcucuucgccauagagaaggugaacaaaaugaauugguggagcaaaaucgucaaguccgauccggagauuagcaccaagaaaaucaauccggagccuucgaagcugagugaccuggacggugagacucgcgguauggucgagaagaugauguacgaucagagacagaaggaaaugggauugcccacgagugacgagcgcaagaaacaggacgugcucaagaaguuuauggaacagcauccggagauggauuuuuccaaaugcaaguucaacuga

SEQ ID NO: 5994 - RNA, 477 nt, Phyllotreta armoraciae
augcagucucccagcggaauggugcacgguuauccccaggccucaauacuacaauggagcccugauaaaaaauacagcgauagagaaagguggauuugcguuuauccagcguacauuaauugcaaaaaaaccauagcccaaggcaggaaauuaaacaaagaaaaaugcguggagaaccccacucaucaagagaucagagacguuuuggucgcagcagguuugaagguuggcguagaaaauaaauuguacagcagggaacgaagcaaagaauuguuguaucgaggacgaauuagaguucaauugaaaaacgacgaugguacacugugcaauccaaauuuugcuaccagagauagcauaaugcuccauuugggagacaugauuccuaaauuaaaaaguagacaaaacaagggcaguggagauccccaaccgcagaccaccagcucgaaaggaaagggaaaaggcaaaggaaggcguuaa

SEQ ID NO: 5995 - RNA, 2196 nt, Phyllotreta armoraciae
auggaagaaccggagccuacuaaacgccaaaaaaugcccaaaguggcaaaagugaaaaacaaagccccagcugaaauccagaucacagcugaacagcuauugagagaggcgaaagaaagagacuuggaaauccuuccgccgccgcccaaacaaaaaauuuccgauccggcggaguuggcggacuaucaauuaaggcgcagaaagcaauucgaagauaacaucaggaaaaaucgggcggucauuucaaacuggaucaaauaugcccaaugggaggaaucgcaaaaagaaauacaaagguccaggucaauaugggagagagcccucgauguggaccacagaaacauuacgauuugguugaaauauaccgaaauggaaaugcggaacagacaaguaaaucaugcccgaaacuuaugggauagagcuacaguacuuuuacccaggguaaaucaguuuugguacaaguacaccuauauggaagaaauguuggaaaauguagccggugcaagagcaguguucgaaagauggauggauuggcaaccugaugaacaagcuuggcaaacuuacauuaauuucgaacugagauacaaagaaauugauagagccaggcaaauauacgaaagauuuguuauaacgcauccggaaguaaaacauuggauuaaauaugcccguuucgaagaaaaucaugguuuuauucauucugcuagacagauuuaugaaagagcuguacaguuuuauggagacgaucauuuggacgaaaagcuuuacauagcuuucgccaaauucgaagaaaaccaaaaagagcacgauagagcgagaguuaucuacaaguaugcucuagaacacauuccaaaggaugaaacgaaggaacuguauaaggcuuauaccauccaugaaaagaaauauggagacagaagcgguaucgaggaaguuauaaugucuaaaagaaaacugcaauacgaacaagaaauacuccaaaaucccaccaauuaugaugcuugguucgauuaucucagauugguagaaggugaagcagauuuggaaacaacccgagaaaccuacgagagagccaucgcaaacauaccuccaucaaaaaacaaacaauacuggagaagauacauuuauuuauggaucaauuaugcuuuauucgaagaacuugaugcaaaagauuaugaacgaacuagacagguuuauaaagcuugccuggaaauccugccgcacaaaacauucacauuuuccaaaauuuggcugcucuaugcgcaguucgaagugcgacagaaaaauuuaaaagcagcccguaaaauucuaggcauguccauaggaauguguccuagggauaaauuguuccgggguuacauagagcuggagauacaacuccgggaguucgauagaugucgaaaauuguacgagaaauuccuggaauucgguccggaaaauugcguuacuuggaugaaauucgcugaacuggagacucuuuugggcgauaccgacagagcaagaggcauuuacgaauuagccauaaaucagacgagauuagacaugccggaguugcuuuggaaagcuuacauagauuucgaaauaucucaagaggagccuaacaaugccaggcaaauuuaugaaagauugcuggagagaacgucucacgucaaaguguggcuaucguacgccaaauucgaauugaacaauccgagugaggaagauuucaacguacguuuagccagaaggauuuuugagagagccaacgaaaacuugaaaaacuucccagaaaaggaagcaaggguauuauugcuagaaaauuggaaggaguucgaaaacaaucacggcgaugacgagcacaaagaaaaaguuaacgcuaagaugcccagaaggauuaaaaagaggcaaaagguuaucgaugaggacggcgucgagcaaggcugggaagaaguauuugauuauauauucccugaagaugaagccagcaggccgaacuugaaacuacuagccgcugcuaaaaacuggaagaagaauacugacgagccggaugaggauuccgaaaguagaacaacccuuuccagcaguagccaaaggaugaaggaaaaguuauuagcuuccgugaaaaauuggaagaauaaugacaaagaaaauagugauucuaauaaagaugacugcucaaaugaagaggaaguucagauugacaacaaugaaguagaagauuaa

SEQ ID NO: 5996 - RNA, 1431 nt, Phyllotreta armoraciae
augggaauuaaauuuuuggaaguuaucaagccuuuuugcaguauccugccagaaauugcaaaaccagagcgaaagauacaauuuagagagaaagugcuauggacggcgauaacacuauuuaucuuucuaguauguugucagauuccucuauucgggaucaugaguucggauucugcggaucccuuuuacuggauucgaguuauccucgcguccaacagagguacccucauggaacuggguauuucuccaaucguaacaucuggcuugaucaugcaacucuuggccggagcgaagaucaucgaaguuggcgacacuccuaaagacagggcucuuuuuaacggugcacagaaacuguuugguaugguuauaacggucggucaagcuaucguguauguaaugacaggaauguacggagauccagcugaaauaggagcuggagucugccuucuuaucaucauccaacuauucguggcaggucuuauugugcuccuucuugacgaguuguugcagaaaggauauggucucgguuccgguauuucucuuuucaucgcuacgaacaucugugagacgaucauauggaaggcuuucucgccggcuacugucaauacuggaagaggaaccgaauucgaaggagcuguuaucgccuuguuccacuugcucaccaccagacaggauaagauuagaggauuacgagaggcuuucuaccgucagaaucuuccuaauuugaugaaccuccuagcaacaguuuuaguguuugcuauaguaauauacuuccaagguuuuagagucgauuugcccauuaagagugccagauaccguggccagcauucgagcuaucccaucaaacuuuucuacacuucuaacauuccgaucauuuugcaaucugcuuugguauccaacuuguauguuauaucccagauguuggccguuaaauuucaaggcaacuucuucaucaaucucuuaggggugugggcugacguuggaggcggcggcccggcuaggucuuacccaaucggcgguuugugcuauuacuugucuccgcccgaaagcguaagccacauuuuggaagaucccguccacgcuguuauguacauuauuuucauguuggguucuugcgcuuucuucucgaaaacguggaucgaaguauccggcaguucggcuaaggacguugccaaacaacuuaaagagcaacagauggugaugaggggucacagagaccauucuaugauacacgaacucaaccgauacauucccacugccgcugcuuuuggcgguuuguguaucggagcucugucuguucucgccgauuucaugggagcaauugguucuggaaccgguauuuuacucgcaguuacaaucauuuaucaauauuucgaaauauuugucaaagaacaaagcgaaaugggcggcaugggcgcuuuacuuuuuuaa

SEQ ID NO: 5997 - RNA, 489 nt, Phyllotreta armoraciae
augucgaugguuucaucuucagcuguugaauuaaguucauauagggaucagcauuucaaggguagucgagcugagcaggacaaguuauuaaggcuuucuacgacguuguauguaggaaaccuaucauuuuacaccacagaagaacaaauuuaugaauuauuuucuaaaugcggcgacauuagacgaaucgugaugggucuggacaaguauaagaaaacaccuuguggguuuuguuucaucgaguauuacacucgcaaugaugcggagaauuguuuaagguauauuaacgguaccagauuggacgauagaauaguacguacagacugggaugcggguuuuauagaaggcagacaauacggaaggggaaaaaccggugggcagguaagggaugaauacagaacugauuuugacuccggcagaggaggguaugguaaaauaacccaacaaagaauuggaccuauggauacgccuaguuauuucagaaaauaa

SEQ ID NO: 5998 - RNA, 921 nt, Phyllotreta armoraciae
auggcugccaccguaggacgaauuugugguguagggcuguuaaagccgaauaauuuaaccaccaucggucagaucggcucuuauucgacggccaaagaauggacuagagguaaaaaagcacuguuaggaacauuagggauguuagcaggcggcacgggugccguauuaauugcucucgaccaauccguuaaagcaucggaacuagaacugcacccgccgaagaacaucuggagccacagcggaauauucagcucguuggaccacgcuagcguccgaagggguuucgaaguguacaaacaagucugcgccgccugccacucguugcguuucguagccuaccguaaccuaguaggaguaucccacacggagcucgaagcgaaggccgaagccgaggaacagaugauccaagacgggccgaacgauguaggagaaauguuuaugcgucccggcaaguuaucggacuacauccccagcccguaccccaacgaggaggcugcccgugcggccaacaauggcgcuuacccgcccgauuugagcuacauuacagcugcgagacacggagccgaagauuauauauucgcgcuuuugacggguuacugcgaggcuccggcagguguggugcucagagaagggcaauauuacaauccguauuuccccggaggugccauuucgauggcucaggcuuuguauaacgagacgauugaauacggagaugguacuccggcgacggcaagucagcuggccaaagacgugucgacuuucuugaaauggaccgcugagcccgagcacgaugauagaaaaagaaugcugauuaaaguuauaggaauauucucguucuuguuaggggugacuugguauaucaaaaaggugaaauucgccucgcugaagucgcgcaagaucgaauuuaggccaaaaaauuga

SEQ ID NO: 5999 - RNA, 1695 nt, Phyllotreta armoraciae
auguuggccuuacaacaauacucagggaguagcgacgaagaagaagacaaacaaaaaucccccgguaauaacgagcccucaacuccuucggaauacucguuaaaaggucagcucgcgauuugcgcagcaccagaaguccuucccaccgggcuagaggaagaucaaaugcacaucgacguagauacgaaagagcuagcauuuaaucccaaguucgauguauuauucgcaccggcucuuggcccugccaauccuuuuaaaacgcaacaacaguugguagaacgaaacaugcucucgggccacaucgaaagggcccacgucagugaauuucaguuugaaaaccaaaggcgaacuuucgccaguuaugguuacgcuuuggacccgucuguaacuaacgacgggcaaauaaaaguggugggaucuucggaagccgaagaaaguagcauuaagacuguauucgaagcuuccaaaacgagaccuuuggauaaacgaaaaagaaagaaaaacgacgauccgagugauguggacggguuucuaggccccugggguggauucguggacgaacaaaaaauaucaaaacccaccgaggaagaacaaaucgaacuggacgagauaucguccaaaaagaauaaaaaggguaaacccaacgaagauaaaccccucgaagaaaaaucagucuugcacaucaaagacgccguggauuaccaaggacguucguuccuccacgcgccucaagacgucggcgucaaccucagaucggacacaccaccggacaaauguuuccuaccaaaggcucacauucacaccuggacgggccauucgaagggcaucgcugccaucagauuguuccccaggacggcucaucuucuguuaucagccggaauggacugucguauuaaaauuugggaggucuacaaugaaagacggugcauaaggaccuacuaugggcaucgacaagcuguuagggacaucaauuucaauaauuccggaaagcauuuucuuucugccgguuacgacagguauaucaaacugugggauacggaaacaggucagguuuugucucgcuucaccagcagaaaaauacccuauugcguuaaauuuaacccugauaagaacaaacaacauuuguuuguggccgguacaucggauaagaagauaauuuguugggauacgaggucaggggauaucgugcaggaguacgauaggcauuugggugcugucaauaguauuacauuuguggaugaaaaucgacgauucgugaccacaucagacgauaaaucguugagaguaugggaaugggacauucccguugauaugaaauacauugcugauccuacaaugcacaguaugccuucaguaacuccagcaccaaacgguaaaugguuagcuugucaaaguauggacaacaaaguggucauauucucuuccaugaauagauuuaagauuaaucguaaaaagacguucagcggucauaugguggccgguuaugcaugcuccuuggacuuuucgcccgacaugaguuaccuaacaucuggagaugccgaugguaaaguuuacauaugggacuggaaauccacuaagcuuuucaagaaguggaaggcucacgauaacguuugcaucagcguccuguggcauccacacgaaccgagcaaacugauaucugcuggaugggacggccuuauuaaguacugggauuga

SEQ ID NO: 6000 - RNA, 807 nt, Phyllotreta armoraciae
auggugcagaaaaagcccaagaagaaggugggaaagaagguagccgcggcuccuuuggcagugaaaaaagucgagccaaaaaaagaagucaaccccuuauucgaaaagcgacccaggaauuucggaauaggccaagacauccaacccccgagggacuugucgagguucgugaaauggcccaaauacauccguauccaaaggcagaaagccgucuugcagaaacgcuugaaaguuccgccgccgaucaaccaguucucccaaaccaucgacaaacaaacggccacucaauuauucaaaguauuggagaaauaccgaccggaaaccgccuugcagaaaaagaaccgacugaaggccaaagccgaagcuaaaguggccaagaaggaagaggccccgacuaaaagacccaacacuuugagagccgguacuaacacaguuaccaaauuggucgaacagaaaaaagcccaauuagucgucaucgcacacgacguagacccuauugaauugguacucuuccuucccgcgcuuugcagaaaaaugggaguccccuacugcauagucaaagguaaagccaggcuaggguugcucguuaggcguaaaacuugcgcgacugucgcucuuacgcaagucgauuccggagacagguccaacuucaacaaacucuuggagguuaucaagaccaacuucaacgaccgugccgaugaaaucaggagacacuggggaggcgguauccucgguucgaaaucagcugcccguauugcuaaauuggaaagggccaaggccaaggaacucgcccagaaacaggguuaa

SEQ ID NO: 6001 - RNA, 1065 nt, Phyllotreta armoraciae
auggcaacaauaauuaaggauauaacauuacaggaaaacauuccacaaaauauacuuuucgaaaagcacaucgacuucauaaaggaauacggucaaaaggaaaacaacuuugaauaugcaaugaccgacuauuugaggauauccggcauguauuggggccucacggcucucgaguugaugaaugccucgccuccgcacacuauagaagagauuucagauuacaucaaacauugucaagaccccgaaagcgguggaauaagcucuugccugaaccacgacccucacauacuccacaccuugagcgccguccagauacugugcauguacgacaauuuaaaagccaucgacguggagggcgucgugaaauacgugaaaaaccuacaauuaccugaugguagcuucacgggagacaaauggggcgaaguagacacgagauucucauucugcgccgucgccacccugucgcucuugaacagaauggacgcuauugacguuaauaaagcagucgauuucguagcuucguguaaaaacuucgacggaggcuucggcucgaggccucuuuccgaaagccacgccgguuuaauauacugcugcuuaggauuuuugucuguuaccaauagauuggauauuguggaucgagacaugcuggcuugguggcugugcgaacgacaacuaccuucgggcgguuugaacgggcguccggagaagcugcccgacgucugcuacuccuggugggugcuuucuucucuaaccauacugggaaagcugcauugcaucgacgccaacgcuuugaagaaauucauauuggccugccaagacacugaaagcggaggcuucgcugauagacccggagacauuccggauccuuuccacacagucuucggaauauccgcgcuuucauuacuaggaaacgauacaguucagaaaguuaaucccacuuauugcaugccccagcacgucaucgauaggcuucagcugaaaccuggugcacgaaacgagcgggguccccacuaugaauuccacgacgaccggcgagcuacaaaagagguaacgcucgccggguag

SEQ ID NO: 6002 - RNA, 2670 nt, Phyllotreta armoraciae
augcaccaagaaaccuugcaacuaauccaaauauuagaaaaaacaguuucacccgacaagaaugaauuggagcaagcuucgagcuuuuuggaacaagcaucccaaacaaauuuauuaggauucauaaagacccugucagauauacugcggcauggcgggaacaguccgguggccagaauggccgccgguuugcaacugaaaaaucaacucacuucgaaagauucaaccaucaaagccaccuaccaacaacgcuggcugcuauuuuccgaagaagucagagacuacaucaagaagaauguggucggugcccuugggacggagaccaacaggccauccucggccgcccaaugugucgcuuacauagccguaacugaauuaccacaaggacaauggccggaucucauaucgacgcuuguuagcaacauuugccaugggaauucgacggaaaugcaaaaggaagcuacacucgaagcuaucgguuacaucugccaagaaauagagucggacguuuuaguuucucaaucaaaugauauacuuacggccauuguucacgguaugagaucgucggaaccgagcaaucacguacgauuagcugcaacgcaggcuuuacuaaacucauuggaauucaccaaggcuaacuucgauuugaccaccgaaagaaauuacauuauggagguuguuugcgaagcuacacaaucgccggugucgcaaauuaagguggccgcuuugcaauguuuagugaaaauaaugucgcuguauuaucaacacauggagcccuacauggcucccgcuuuguuucccauaacguuagaggccaugaaauccgagaacgaugccgucgcccugcaagguauagaauuuuggucaaacguaagcgacgaagaagucgauuuggccaucgaagauacggaagcugccgaagcuggaagacccccuacgagaguaucgaggcauuaugcgaaaggugcucugcaguacauaauaccgauuauucuucaaaaacuaacgaaacaagaggaauuggacgacgaggacgauuggaaucccaguaaagcggccggcguuugccucaugcuucuugccacuugcugcgaagacgaaaucguuccgcaugugcugccuuuuauuaaagaaaauaucaagucagacaauuggcguuuccgagacgcuuccuugauggcauucgguucuauucugggcggauuggaaccaaacacucugagaccgcucguugaacaagcaaugccgacuuugauugaauuaauguacgacaacagcgucauugugagagauacggcggcuuggacguuuggaaggauaugcgaaauuauaccggaagccgccaucaacgagaauuacuugaaaccuuugcuggaaagucugauaacagauuugaaagcggagccccggguggcggccaacgugugcugggcuuucuccggauuggccgaagcugccuacgaagcggccgcaguuaacgaggaaacuggaacaccggauacguacauuuugucgccguacuacgaauucauuauacagagauuacucgagacaaccgauagagcugacggggcucaggcgaacuugagaccggcagcguacgaggcccugauggagaugguuaaaaauuccccgaaagacuguuacguuacgguucagaaaacuacgaugguuauuuuagaaagacugcaacagguacugcagauggaaacucacauuaccagccauaaugacagaucacaauuuaacgauuugcaaagucuuuugugcgccacauugcagucgguuuuaaggaaagucacuccggaggaugccccgcauauuucugaugcuauaaugacggccaugcugaccauguuuaauucgaauucuuguaaaaguggaggcguacaagaagacgcucugauggccguuucaacgcucgucgagguucuaggugaaaauuucauaaaauacauggacgccuucaagcccuuccucuauaucggcuuaaaaaaucaccaagaauaucaagugugcggcaccgcugucgguuugacaggugauauuuuucgcgcuuuaaaacucaaagcucucccuuacugcgacgaaaucaugacgcuacuauuggaaaaucuccgagaucaauccguucaucguagcguaaagccgcaaauucucuccguauucggcgacaucggucucagcauugguucagaauucaagaaauaccuggacgucgugcugucgacguuggcgcaagcuucucaagcgcaagucgaccgaaacgauuucgauaugcucgauuaucucaacgaauugagagagggcguauuggacgcuuacaccggcaucauacaagguuugaagggcgacggauugacgcccaauccggacguaaugguacucgaaccacacauuccguuuaucgugcaguuuauuaucgucguggcgcaggauaccgaacauuccgauggaacgguugccgucgcggcugguauuguuggagauuugugcacagccuucggcagcccgauggugcaauuguuggauuuggcaucgaucaacgauauguuggcgcaagguagacgcagucgcgucagcagaaccaaaacguuggcgacgugggcaucgaaagaauugagaaaacuaaagaugccggcuccugcggcggcagcugcuagcugguga

SEQ ID NO: 6003 - RNA, 1503 nt, Phyllotreta armoraciae
auggaaacgauuuuagaacaacaacgucgauaucacgaagaaaaagagcgucugaucgacgccauggugaaagagaugcuccacaaaaaaaacaccuacagagaagcgauaaauucggaccacaggcaaaaguaccuucuagacagauacaugacuuccacggagagacugauagauuuguacgaagacaaagacgggcagcguaaggccgaaguggccgcucugacgggccccaacgaauucaacgaguucuacagcagauugaagcaaaucaaagauuucuacagaagacacccgaacgagauaagcguaccgauguccguggaguucgaugaauuugccaaagcgagggaaaacccuaacgaagauauggcuaauuucguagaguuuacagacgaagaaggcuacgguaaauacuuagauuuacacgagugcuacgagaaguacauaaauuuaaaaggcaucgagaaagucgauuauaucacuuacuuggcuauguucgaucaacuguacgacauaccgaaagaacgaaagaccggcgaauacagaaaauaucuguuguaccucaucgaauaccuuacgugguucgugcaacgcaucaggccucugauggaucucgauagcgauuuacaggaacaagucgaucaggcgauggguaauugggauaacggaacggugcccggguggccgaaagaaacaggcucggcuuuggccaacgugggcgcccauuuggaccuaucggccuucuccaguugggaggaauuggcuucguugggcuuggaucguuuaaaaucagcccucauggcgcuaggauugaaaugcggaggaacguuagaggagcgagcccaaagguuguucucgacgaaaggcaaagguucucuggacccuucgcucaugacgaagaacagcaagaaccgagugacgaaggagaaggaagcgcucaggcaaagagaacuggccacguuagaagcgcaaauuuacagauuggccgaucuggugucagcccaacgagcagccaccaaagagaacgugcagaggaaacaagcccguacagacggcgaacgggacgacagcgagaacgaagaaagcgaagaagagagccccgacgaggccgacgacgacgugcccuacaaccccaagaaccucccgcucgguugggacgguaaacccauuccguauuggcuguacaaauugcacggguugaauauaagcuacaauugcgagauaugcgguaacuacguguacaaaggccccaaggcuuuucaaaggcauuuugccgaauggagacacgcgcacggaaugcgguguuugggcauaccgaauacggcucauuucgcuaaugucacucagaucgaggacgcuuuagcccugugggaaaagcugaaggugcaaaaacaaagcgaaagguggcagccggagacugaggaggaauacgaggauucacaagggaacguagugaauaggaagacguacgaagauuuaaaacgacaagguuuauuguaa

SEQ ID NO: 6004 - RNA, 639 nt, Phyllotreta armoraciae
augacgauaggaaagaauaauaaaaugauccaacacauaaacuauaggguccgaauaacauugcaggacucuaggacguuuaucggcaccuucaaagcuuucgacaagcauaugaacaugauacucggcgacugcgaagaauuccgaaaaauuaaacccaaaaacucuaaagucgaacgagaagaaaaacggguauuaggauuuguauugcugagaggcgagagcauagucucgcugaccguagaagggccuccaccaccagaagagggacuucccagaguacccauucccggagcagcccaagggccagguauaggaagagcagcagguaggggaaugccacccggcauggcuggaguuccaguaggucuccaaggucccgugagaggagucggaggaccgucccagcaaguaaugacaccuacagguagaggacaggucucagcgccgccacaaaugaaccaagcgccuccaaggauggguggcccuccgccuggcaugauggggccuccgcccggcaugaugggcaugccgccccaaaugggcaugggccguggagggcccccuccgaugggcaugaggggucccccgcccgguaugaugagaggcgggccgcccggaccgccgagaccuuauuaa

SEQ ID NO: 6005 - RNA, 387 nt, Phyllotreta armoraciae
uuuccacauuguauaggagcgaucgauggaaaacauauuagauugauaagaccugcgaauagugacucuauguucuucaauuauaaacaauauuuuucaauggugcuuuuugcaaugguugauagcaauuauuuauuuacauuugucgacauuggcucauauagaaaaucuagugacucuggaauuuucaaaaauuucgcacuauaugaaaaaauguuaaaugguacacugaacauacccacagcaacgcccaucgaaggagauuugguagaauauccauuuguaaucguaggagaugaagccuuuccccuaucugaaaauuugcuuagacccuauggcggaacaaauuuaucuuuugaaaaaagaauuuucaauuauagauuauaa

SEQ ID NO: 6006 - RNA, 15711 nt, Phyllotreta armoraciae
auggaggaauuaaccucggguuuggaucccgacgauuugauggaucuagacgagccagaaggguccgauuuggaagaggacgacgaggaucucaucgaugaucacgucucgucgccuuucaucucguccucggcgccggaauccacggccaacuccgucgccuccucuccgauccacgaagacuucccuccgcccuucaauuucaccgggaaaccucuacacguuaaacgcggaagaggaagacccagaagagaaggagguaagccuucggcgccgagaacgacaaggggcgguggaacuggagugucgagaguacguaggccgagaccuccggguuuuucgagaagaggaucguuaggaggaaguagaaguguuaggcaaguagacagaucggauuacgaaaugucucuuuucgccggcucgccgguggaugacgguuuguuggaucccgagacggguucgaugaucuuucccgagaaguuuguuccugcgaucgaggagccuccguauuuuccggagcauuggccagggaaaguuugugccuuguguaauuuaggugaacggagccagcuaggacaaggugaaaugcuaagguuaaauugucccgaaggauucucgccggagaaaguuauuagugagcaaauauuagaaagagccuugcaagcuccagauaaagaaugcggggauaaaagcccgaaagguccugugacauguagaaggcaaaaaaguuucaauaaaugcagacauccuucgauaaccagugaauacguugaugaauuaacuauaauuggauauaaugaaguaccugauguaucuaguuuguuugaacccaauggacaguuuuacguucaccguaauugugcguuguggucuaauggaguaacgaaagcagaaaauucggcguuguugaauguagggccuguaguuucgcaauguucuuccaaaaaauguuccuucuguaaucauuacggagccagccugaccugccacguugacaaauguaccaaaauuuaccacuuuccuugugcuacugcugcuggugccuuucaggacguuucuucauugacaacuuugugcaacgaccauuuaggacaaguggccgugcucacuaacgcaucuccauguuuaacuugcgcaucuaugggagauauagcaaauuugauguuuuguucggguugcggcgcgcauuaucauggaauuugcgugggauuagcucaguugccaggcguuagaucuggcuggcaauguagaaaaugccguuguugccaaguuugucgagucguuggagacgagucuaaacugaugacuugugaacaaugcgauaaaauuuaccaugcuaguugucaaagaccgauaguuacuucaauaccgaaauacgguuggaaguguagauguuguagagugugcggcgauugcggcgcgcgaacucccggagcugguuuaucuucaagauggcacgcucacuauacaguaugcgauucuugcuaccaacaaaggaauaaaggguuuucuugcccuguaugccauaaagcuuaccgagcucacgcacauagggaaaugguccaguguucgaguugcaagaaguuuguucauggaaccugugauccugaagcagacguugucaccuacagucaaaagaaagaaauaagcguggacuacgaauacguaugcuugcauugcaaaaacagcacagccagacaaauaacugcgaaaagagcuaguaucgaugauccuucugauguaucugcuucucaugauucccuguacgacgauacguccgaauuggaucuucccucgcccgaugaguucgccagaaacauggguuugggaaaaggaaagccguauagcgcgaauaaaauagccaaaaagcgccuuagcuucaccgugaauccgguuggcaggccgaaaggcaccggaaaagugccucccgggaaaaugggcuuuaugaaacgguaccgauuaacagaguucaacagaaaacgcggccccaaagccaaaaugagggguauuuucggcgugcccggcgucggucugcaaagaccgauuucagacgggaaaaccgaugaagaaccaggagucgaaaaucgauugguacucuguucagcuaaagauaaauuuacgcucacgcaagauauuugcguaaugugcggggcauuuggaaccgaucaagaggguuguuugaucaguugcguacaaugugggcaauguuaccaccccuauugcaucaacguuaaaguaacaaaagugauccuacagaaagguuggagaugcuuggacugcacgguuugcgagggcugcggucaacgaaacgacgaaggccgucugauccucugcgacgacugcgacguguccuuucacaucuacugcauggacccgccacucgacuacgugccgcacggcaacuggaagugcaaauggugcgccaucugccaauccugcggagccaccgauccggguuucaauugcacguggaugaacagcucgacccaaugcggcccgugcgcuucgcacgugaauugccccagcugcaacgagcccuacggcgagggcgauuugaucauacagugcgugcagugcgaaagauggcugcauggagcuugcgauuuuauuaaaugcgaagaagacgcagagaaaugcgccgaagaaggguacaauugcauuuuauguagaccgagagacgugccaccgccgcauaugguuccugcugcaguuaccccgaagccuccgacuccgacgaagagucccgagcugggcaagaguaccagcuacuacauggacggcgugugucucagcgaauucggcaguaauuugaucaaaucauuggcgcucgaauaucacggaucgaggaagaaacggaaaaagauaccaacuguacaagauaaggaagccgguaucauggcuacgauugaaucuguuguugccggaggaaauauuauuccuacuaauauggaagacagcgcuaaacuagagcucgucgacaucaaagacgagccucaagagcuguacaaggagggcaugauguggacuaaagaggacgguccuccucccgaagguuuuacgauaauaacgauggagaacggguugaacgugcugcgaaggaagagacaacgcaaucugcagaagcucggcauaggcggguucgucgucaggaugagagguaucagaacgggucaggauaacgaugauguggauucgaccaucggucaaagugggcucaacgccaacgacauuguuccaucgccugcagacgucgauaaacccagaaggaaagcuauucgacgaaagccgaagaguaaauuagcugaaacguuucccgccuaucuccaagaggcuuucuucggaaaggaccucauggacacaguggauuguaaaaaagaagaagucgauuguuauagcagcgaugaggagaaaacggacaagcauuauaaauccauuaauuugucucaggaugaaauaauagcaaucguggcaucggguaaaaccgaaaaauuggaaaacaauaacaaagauucgaccaaagaagucaaaccaacuguauugaaagaggaagaagaagauaauccggaggauuugaaagauguucuugccuuaccgggcgauuugcucgauaccgauuugguuaauaguauuauggaagaugaggaggaacugagcaaaacgacugcaucucuuguugcuuuagauucaaauuuaccgcaugauacggagcuaacggacacucugaguaguucaggaaauucaaaagaaaccaaagaugaauugagcgacauuuuaggcccucauuucaaccucgauuccauaucgaacauaaacagcaaggacgucgaagauauauuuaagggcguguuaacggaugagucgcaagaaucccaagaaagcagcaacuuuuccuuacaaggaaacaguauguucucgaacaauaaugcucaacagaccguugcccaacaccccauuauuaaucaaccagugagaccgaaaacuuugccuacuguuaaccauaauuugaauuccccggucaguuuuccaccaccgucacccuaucacucggaguacagcaacaguccucaauuuaguccugccuucaccgaaucgucguguucguggguaagcgggaacgaaacgccggaaauugauaguacgaauguaacggugacgucgacguacaaucagagguccuccgauaaaaugaaagccgaugaaaguuugggcaaaagcgcuacgauuucggcuguuuuauacgcgaauaucaaccauccugaauggaaaaaggaguacccgaauuggcccgauagguacaagcaaauaauaaaaaaauggagaacguugagucaagaacagaaagcgccguuuuugcaacacgcaagagauaauaggagucaauugaggaugaagaaagcgcaacagucacagaccgucaaggaaaccgccucugccgccacguccccgaacgcgagcaagccucuucaccaagccggccaagccuuagugacaacucuccaggcgguaacgcaacagccggcggggguucccgcggcccccgcggcgcccguuucagaggugugcacucaaacgaggccaacacuaacaccggcuuccguuagcucugugucugugccaaccccaucaccuaaaccaccuuccccgaccacccaucagcaauuuaccgugcacggcaguuucgccgggccgggggaccgcgucgggcccgcgcccaacguaacggucaauccucauuaccaaccuaacggcgaaagcgccgcgccgcaccaccccagauuaauugcgcagaguagcgcgucagaucagcaaauucggguauugacucccucagagaucaugcguacacuuccuucccucuaucaggaaaauuaugagccucagggaucggaccaggaaaaaaucgcccuccaacaaaaaucagccagggaagcagaacaggaaagacaauggaagcaauugcaggcccucaggcaacagcaaacccaacaaacccagaacauccugcacgaacagcgcguacaagccauugcucgcguacaacgucagauaucaaccgaucccgcgcaacaguucauaaacgagcagcagagcccguugcaggugaacacgccucaggaauugagcccuucgacuacaccggcccccaguccccgucaauuucucggcauuaaauccccgacguuccccguccccucgccuauccaacaaacuagcgucagggccaacacgcccucacaaucgccccacgacgucucccaaccgagcacgcccgacgguaacgaucacuuuauccauucccccaccaauccuaaaccuaauuuccaaccuagauugcccaacgauccguucgccgcgcaacccgccacgccgcgaccccaauucggaauggcccggccaccucuacagaacuucggcgguaccguucgcaacgagcaacaggacaucaacaucaaucgccaauugagggagcuguugcagcgacagcagguuaagaagcuggaugaauuguugcccggcaaagcgccaccucagaggcuguggcacgcuaaugaucagcaggaggguagcgaugcuucgaugacgucgccuguagcucaaggcgcccagagugcucaaggcgcugacgccaccuuccggcaaccuuuaccgcccggcguugucaaaccuaggcuggcgauuucuucaguuaacaggccgauauugaacgcuguuagagucaaucaauuggaucccagaauucaaaauuuggauccgaggaugagguugauuuuacaacaucagcaacaaaggcucgccacggguauucagcagcaauucauccguuucacgucgaacgugcgaccgacgaccguggaacaguacgagcaacuguugcagcgucaggguaauaaucagaaucaaauucacgcggaggaacagcagcagggugucgcgcgaauacccauaacgcaggccagcguuauacaaaggccucacgucgcucaggcuguggugacuggcgcugcugcugcuacaaauaguuccacagaaaguaaucccagcgaagagggaaucccggauaaugucacagcugaauuggagaaacuggaacaggaaacagguacuaugguagagcuucaaggcgugagcgauauuuugggcgguuuggacgacgacgacgagcuucuagccgaaaugggcgcggauuucaacauacucgaauacgcugaucccgaauuagaagccuugacgggcggaaaaacgaacauuuuagaccuggagcucgaagaggaaccggucaaaaaagaaaaacuagccucaaacgcgaacacuagcgcuccuucucaaaaaccgacgccuaacgucgccacuacggccacuagcaacaguacagcuguuacuacaccgaccgaagccaauacggaacccaaaauugacaauacgauucaacagaacauuccgaaaacggugcaagcggcgccucaacagcuacaacaucccgcuucucugccacagcagcagaacaugccccagcacggcgcucagguucaagugcaaucccaacagucucagccgcauccgccgcagcaaaugcccauucaaucgacgcugcauauccagcagauucaccagcaaauggugcaucaagugcaacaagcggcugcucaaggaaggccgaugccuccggguucgaagaugcaaacuacugauggguucguuggcgucgugauggcgaacaacgccgugcaauugcagauucccccgaauuaucaacaacgguugcuucuuuugcaacaacugcaaaaucagaaguuaaugcgaguuggaagcacucagccaagggcagcuuugcaaguggccccuaaucaaauacccguagguaugaauccgggaccuaggaugccgguuucggcaccgccgccgccuccgccaccuuaucccggcccgcccccgccuuauccgggaaacgcgaaucaacaucagcaggaacaaccgcuguuauuggaagaucugcuugagcaagagaaacgcgagcaggagaagcugcaaaaccaaccgccuaaccacgaagucaccucuuccaccggcaacgaaaccgaaucugcgcucaugagcgaccaagacuucgaacgucucaaagcagacguguucaacagcgcucccguaaauaauauauccucuacaaaucaagggaacgccgggcaaacgucgcaagcguggccucaguugcaaaaccgucaagcggugguucccgcggccgcuucucagcacaccauggaagugacgacuagaguacaaauguuuaacccgaauuugguaccggcgccgccucuuccgccggagaauaucgccaccgagcaggauaagcaggcgcagcuuuuguacgagcaguggcugaaccaucagaacaacacgcuggugcagcaauugcgcuauuaugagaccgaagugcagaaacuucguaagaguaaaaagucguuaaauaguaagcaacgccaguugaggaaagcugguaaucaguugacugagguagaugcuacugagcuucaaagaaucacagcugaacaggcuauauuacaaaagcaucuggaaucgaguagaaaacaaaaucgccaacacggaauguugauacaggaauauagaaacaagcaucccgcuaucaagcagcgaaccggaacugaucagauccaaucaccguugggccauccggcuucuucgcccauacaacaaucgagcgcuucguuaucgcccauguuaucaccaucugucucgccgaugacccagaacaguucgccuuugaacagccccgggccgauggugccuucuucucccggccacggucccguucagaacauuuuacagagcccuaacggcgccaacgcggcucaaaugucuccgaugcaaucuucgcccagaauaggaacgccccauucccaaagugaugagaguccagggucggcgcaaucgccuucgcaaguaugccugccgccgcccaugccuagaaugacgucgccucaacacagacgagucgugaccaguccggugggaaugucgcaaaugcguuuuaucaacaacaacauguugcagcaacgcguucgcaugcaaucgcccauacaaaauuuucaacagaaacccggcacgccuucgccguugaacagcccgacgucccaacagaugagcgucaaccagcaacaucaaauccagaagcagcuccagcaacagcagcaacaacagacguuguugcagcaaaauuuggagggcgauccuaacgccauucacucgcagagaaccacgcaguuguugcagcaccggaauuuuaucaggcaacaggugucccagcagcaaauaucgccucagacguugaccccgcaacagcaucaguugauguugcaacagcaaaaacagcuggcgcagcagcaacaacagcagauugcucaaaugaacgccgcgagauugcaacaacaacagcaacagcagcagcaacaacagaacaauccuccgcauucgccgaugccuccuaaaaguccuaugaucaaccagcagauaaugucgccgcauucuaugccgcaaucgcccaugcagaugccgccgaagagucccauggugccuuucaaucccaaccagaauccuaauucuccagcggccagaagcccggcuuuccaucagggcaucaaccagccgacgagucccaucacucacggccaucaaccucccaguucuccgaugcccaggaguccgaugaucaaccaaacgcacucuccgcauaacguucggaggccucccagcgccaacagcagcccggccaugcccgacaggccgcacagcguagaaaacucuuccccuagaauguacucuauagaucaauuggugcaggagaguuuggccaaucaaaauguaaacgcgcaguauaauuacgcuucggauaugauuaaugaaagcggcggagggaauucgaacaacccgauacccugucccccggagauacccagauuucguuacuuuaagcucgguuugagagguggagcacccauguggagcuucggcagaggugcuaaaagaauuccggcuccuccgaaugccaaaccggacgaaccgaaggcgaagaaggagucgcauuugagcaaaguuucgauccucaaaagaaaaaccucgaucgguucuaucgguaaagugggcucguuaguuaguucugauuacaacgauuuggaugacaguucaacgacgccuccgguaaccccaccguuggccucgaccagcagggguauggugucgaagaagaagaaucucgagcuucaagcgcaaaaagaauccgugaucgucaugcacaguccggacgauaacaaacagcucgaaauaauggauuacgacgacgacaacaauacuguucugucuucagaaguuucuuugaguucagcagcucgaaacgacgacgacuugguggaaaucgaaacgauaucgcaagaccucgccgaagggcuauccagcccguuggaauccgaucaaaucggagacgaauuccuguuguuuccaggcaauauggugguggauaugucaggcgaggggcauuacucggagaaagaggaagaagaaaccgaggaauucaccgaucagaacaugcacaucgugauacgcagcccgacgaccagcgacgacgaguucaucaugccgugcaaagucaagcaguacaacgaggacgagcaggaggacaaucccgaaucgccggaucaagaggaauucggcgaauccuccgacauguugaccgguuacgauaacgaagaaaccgauauuauccucuccgaucaaacuaccagcguucccgaagacucgauauccacuaaagaggacuucgaggagcucaucgacgaggggucacggaaaaacaacaucagcaaacaggaggugaccgcgaaacacauucaggauuuccacagguacaccgaauuguucgauuacggcaaaccugacacucaaacagcuaagaaaccuguaaccaaaaaauuucaaccgaaagugucuguaguucgaggaguagcuuugccuaguaaacccaacaccgagaagauuauuaucacgcaaaauucgaacguguuaaacacuucucaggcuucgaaagugacuagcaucauuuugacucacaacgccaacgugaggaggaacauuauaagcgugccgaaaauagugaguaccguuucaccggcuauaacuauagugagcgccaguacaucgcaaauggccucgauauugccuucuaaauucacggugccagucauaagcgccagugcaguacgccagcuuuccaacgucaaagucaucgauaaaccuuccucuucgucccuaucgauuucuacgagagauaacguccugccgaagaagauauucgaggacgauucggugucuccggauagcucuaauugcgaagaugaaaagucgaaagauucguucgacgauaaaguuaaaucggagucuccuccgcaggaaaucaaacagcccgcguucguaaaauccgacgcuaauccgcagguuauaucguugaaaucgaaaaacuacuccgaucaaucgaagaagaucgaacaucuccaaauaguaaacauaucuucgaaggacgugguucaaaggcaaagaauaccgagucccaugauaucgaaggcuucuccggucaucauacacaacacgcccgaguugaaaaugaccgcucaaguuauucaagagagccaaacucgcaugaaaauuacuacuacuacugauacugaacauuacgaugagucuacggacgauacgaagucggucguaauuucaauucccucaccuacaccuucgcaagaacaaauguuagauagcauagccuuccaagcgcuggaaaacaggagaagagaauacgauucaaucgaagacguauuagacaugauugaaaauauagaaaacaucaccgccgaaccgccagagauacuagaagaaaacacacugcaaaguuccgauuccaacagcaauaucgaaaacaaaaacaccgaaacgaaggaauugcaacuaccuaccagcgaaagcgaaccuucugucacgaaauccuccaucgugccucaauuaucgccccuuucccagcccacggaauugaccacgaacauggccaacgccucgcagcaacucagaacucugcugucgucgcuacaaaccaccuccacgucguccccaacgagcguggaguccauagcgaagaguaucggccagaagaucaucacguccucgucggcuaaccagcccauagucgcuucgagggugaucagccaacaggccggcaggcaaucgcccgucgucaccagcgucuccaccgucauagugccgaauuucaagcagaaaaucaccgucacggcgaccagcacguccaggagcagccccgugaagguggucaccaccucgcaacaacuggcgggauccauaauaaccucgacucugaauuaucuaccgaacaggacgaucgguauacaaauggugccggagcagucgaaauuaccaccggcuagcaucgugacuaccaugcaacagaucaacucgauuacuuccagucaggagucgaagaagccuucguugacucuuacggcaaugcugcaaaaccaacccgcggcgaauaugaugaccaaaucaucagcugauaccauuacagcugcuaguuugcuagguucaccuaucaguuugccgaaaaccggguucaccacgucuuuggugcaagcgcaaccgagcguggugcuuucuaacauaccgccagcgccuagucaaccuucugcugugacuaaaaccaccgcggauucgaucacagccgcuaguuuauuggguaacaucgccaaaagcaguuucucgaugcaaccgagcagcaccgucggcguggcgacaaguugccccaacaaaaccccuacuuccacuacgaauuugcuacacacgcaacuaacgaaagugguaagaaguaaaucagucgacgauguuaaagaauuggccaaaaucgacgagaacaaaccgaauguuaguaacgaaaacguugaugauagcaguaauagcggguguaaguuaucgcaauuaacuacugcuguuugcaacaaaaccgaggauucgcagaacguguugcugaagaaauugcugcaaaauacggcuugugccagcacgcaauccuccccgcccgcuucuaccagcauugucaccacgagcgcugcuaaugcuauaucuaaaguagcuaauuccaguucuaacgcuagcguagagcaaccgcccguuagcgcuccuucuaucguuccaauccaaaggagcgcgagcagagacgaauuacuauccccgccacaagacguacaaaccaugauagugauuaagaaagagcccccgcucgugccgcugucccaacccagucccgugaugaauucgaauuuaaacgcucacacgcccgagguaaagaaagaauucaucgacgaaucgucccagcacucugaaguauccgaccacagcagaucugacgcuccaaucaaagaagaacuggaaaccauggaaaacgcagcagagaaaauguugcucgacaaggaggagcugaagaagcagaagcgcaggauguaccagcagaagcgccgccagaaccagauacucaacaaggagcuggcgcaacagcagccuaagaaaaggccgcggaagaauucgaagaucgacgaggacuacgacacguacaucgacggcgugcuggcccagcugaggcaauuaccgccgauccaggucuccgagccgguguugaaccgcaacuucggcguugugccgcucuucgggugcggcgaucuguccaaaaucggcgccaaggacuauucgacgcaccugggcgaguugacggggagcuacggcuacggcgagcugcccgguuucacggauuucuacucgacgaaaccguacggggauauggauccucugccugagaaaccgccgucguccacgcagcgcggcuucuacgaccaggaguucccgcucauuagauucgacgcggacgagcacaagaaguucgacguguucugcagggaggauucgcccgauucgauauugagcagcucgucuccggagugcacgcgcgaacccgaaaccaaauucgucggguugaagcucaucagcgacagcgaagaggacgaggaagaugaugccaaagaagcgguugcgaaaggaaggaugucaccgguuguucccguuaucaaaccuguaccuauuagacugaagcccgcgggagaauuguacuucaaagagagccuuaacgagaacaaggagaacaucaacagcgacucguugcacguaaugacgaaauccaaauucgacaacaagcagucuccaccggcgaacguuuccggacacguuacagugacuuuaacucugacaucgucggcggccgaagacauaaugggcgugcugagggauuuggcgaauauuuugcacauacccgcgccgacgagcuaccaaaucgucgagcgaacggcgucgccgcccagccagaaauuggguuuauaucgcaccaaaggcaaggacgguaaagaaggggcuccgaucgacauacagagcauccucaacggcgcuacgaaguucugcaagcacugcgacgugaucauuuugagcaauaucaucaggaggaagguguccgauuugccguuucucgccaaagauucggauuuacucagcgacggggaggaauuguucuuuugcaguucagcuuguuacaugcaguucgcuuugaugcaccggucgccuucgauauccgaagauaaggcugcugaaauuauuaaucaccuaucgcagaaagacaauuuggauucgaagcaaaaauuauccucugcagauucguuggacagcaacaaaucgauagcccagaaauuaucuuuuaacaucaaagauucgaaacgggaauucgagccgauggagacgaacgaugcguucgcuuacuucgcccguacggcuaccaauaaacaggguaauaacuuuuacgauggcgcuccauucaaaccggucccugcuagggugcacaggaacgacagguacaaacucuggacgcccgggugucuucaacccacccagaaacacaaaacgcccacagauaaggagauuauggaacuacuuuacaggaugcagaucaccguuacgccuucugucaugccggaagauacuagaaagugucuguuuugucacgguauuggagauggcguggcugacggcccggcgaggcugcugaacuucgacguggauaaauggguucaccugaacugcggccucuggucggauggaguauacgaaacaguaaacggggcauugaugaacgucgaaaacgcccuacaguccggauuacuagcuacuugcguacauugccaaagcaacggagccaccaucaagugcuucaaaacgaggugcucgagcauauaccacuugaauugcgccgucaaagacaacugcguguuuuacaaaaacaagacgguguuuuguaaagugcacgcgccgaagaacgaaaaagauaacgaacucaccacgcuaucggugucccguagaguguacaucgaacgagacgaaaacaagcaaguagccgccgucaugcaccauuccgauuccacggauuuacugagaguggguaguuugauauuccugagcguggggcagcugcugccgcaccagcugcaaagcuuccacacgccgaaccacaucuaucccaucggcuacaagaucaucagguucuauuggagcaugaggaacuugaacaagcgcugcaaguacauuuguaccauuagggaggugucgggcaagccggaguuucgggugaugauccaagagccucccgaagccgacguggaguucuccgauuccacgccgaagggcgccuggcagaagauccuggauaacgucgcuagcauucguaaagagaacaacuguuugcacauguucccgaaauucgccacgggcgaggauuuguucggucuaacggaacccgcuauagucagaguguuagaaagcaugccgggcaucgaaacccugucagauuacaaauucaaauacggcaggaaucccuuguuggagcugccgcucgccauaaacccuucgggcucggccaggaccgagccgagacugaggagccaguugcauuggaagaaagcgcacacucagagaaccaccggcgguacuucgucaauucgaccgauguucggaccgucucuaacagggucuauuaguacucccgcucagggcgagcucgcuugucccuacagcaagcaauucguucauucgaagaguucgcaguacaagaaaaugaagcaggaauggaggaauaacguuuauuuagcgaggucaaaaauucaagggcuugguuuguacgcugccagagauuuggagaaacacacgaugguuaucgaauauauaggggaaauuauuagauccgaauuggcugagugcagggaaaagcaauacgaagcgaggaaucgaggaauauacauguucagacuagacgaagaacguguuguugaugcuacuuuaugcggcgguuuggccagauauaucaaucacucguguaauccgaauugcguggcugaaaccguagaagucgauagggauguucgaauaauuauauuuucuaaacggagaauucuaagaggagaagaguuggcauacgauuacaaauucgauaucgaagacgaucaaaacaaaauauccuguaugugcggagcuccgaauugucgcaaguggaugaauuaa

SEQ ID NO: 6007 - RNA, 2064 nt, Phyllotreta nemorum
augccuagagaggcuucacuugaaaggcacaaacacaaaagccacaaaauaaagaaaagccgguccaguagccguuccgaacguagucaagaaaaacgcaaacauucaucuagcucaaagaaaaagaguaguuuccacgaagaugccgaccgaaagaaaaagaaaaagcgauccaagagcucuuccuccucuuccagugaauccgaaucuaccagcagcgaaaguucagguaaaucgguggaacuacuaaaaaaacucgaaaaggagagauugcgauuagcugaagagaagaagaaggaaaaggagcuucucaaagcuacggaaacggccgaggagaagagauugagaagauugaugaagaaagaggcgaaggagagaagacgaaaagaaaaaaugggaugggacaacgaauacuuacauuacacgaacagcgacaauccauucggagacggaaauuuacugaccacauucguuuggaacaaaaaauugucgaaagagggcaucaaaaacgucggccaugaagaaaucgaagccauaaaucgauuaaaacaagaagagaauaaaagggaacuggaaaaagucaaaaaacgaagauuagaaagagaauuggagaggcaaagaagagaagaagaaacgcaaaugaugcaaagaacaaaagaagcagcccaauucgaggaaugggaaaggcaagaagaucaauuccacuuggagcaagcucgauugagaucucacauaagaauacaagacggacgagccaagccgauugaccuacuagcaaaguacauaagcgcugaagaagaagucgaugcuguugaaaugcacgaaccauauacuuaccucaacgguuugcaaaucaaagaccuagaagacuuagucgaggacaucaaagucuacaaagaacuagaaaggggaaaaaaccuagacuacuggaacgauauaaccguaauaguugaagacgagcuucaaaagcuuagaaaaauagaaaaacaaaacgauuucgacuugggauugaaccgaagggaagggauacaucaaucagucgcuaccgauguaacuucaguauuuaaaggcaaaacagccgcacaauuagcugcgcuagaaaaacaaaucgggaguaaaauuagcagcaaagccgauggaauagacauaggcuacugggaaucucuacugucccaacucaaagcccacauggcaagggccagacuacgggacaggcaucaagauagcuugagaaggaaacugcagguucuaaaagccgaacaagccaucacaggaguagguaaaacucacagcgaaacucauucaaccgauaacgaagaaaccacuauggaaccuaaaccaggcacgucccaggauuccuuggaaacgauggaagaaagcaacgaaaaaagcgaagacgcugcccaugcguggcuaagcgaaugcuuuucggcauaccaagcaggcggguacagccccaaguuuuuaacuccggacgauaccgagcccggcacgauuguagucucggaggaagacgacguaaagagacuggaauucgccaggaugcaggugaugggucaaggaaccaacaucgaaaacgucauuacaaaggaagaauugcugcuacaaaaggaggcgaagaaaggaauggauggggaugaggcucaguuuucggucgagcaagccuuggauaauccgguguaccuuuggucggauaaguaccguccaagaaaacccagguacuuuaauagagugcacacaggauucgaauggaacaaauacaaucagacccauuacgacauggacaauccuccgccgaagauuguacaaggguauaaauucaacauauuuuacccugauuugaucgacaaaaacaguacgcccgaguauuacuugacgccuagccccgagaauagagaauuugcuauacuacgauuccaugcuggaccgccuuaugaggacaucgcuuuuaaaauugucaaccgagaaugggaauauucauacaaaagaggauuuagaugccaauuucauaacaacauauuucaauugugguuccauuucaagagauauagguaucgaagauga

SEQ ID NO: 6008 - RNA, 1314 nt, Phyllotreta nemorum
auggacaauuuagaagcuaacauaauggacaagucgaugagaucggucuuugugggaaacauccccuacgaagcaaccgaggaaaagcucaaggacauuuucggcgaaguaggccaaguauuauccuucaagcuggucuuugaccgcgaaacgggcaagcccaaaggcuauggguucugcgaauaccgagaccaagagaccgcccucagcgccaugaggaauuugaacgguuacgaaauaggcggcaggaauuuacgcgucgacaacgccuguacggaaaagucccgcauggaaaugcaaaaccuccucaaccagccgcccaucgagaaucccuacggagaaccuauucaagccgaaaaggcgcccgaggccaucaguaaagccguggcuucgcugccucccgagcagauguuugaacucaugaagcaaaugaaaacuaccauacaaaauaaucccacagaggcuagacaaauguuauugcagaauccccaguuggcuuacgcucuauuacaagcucaagucgucaugaagauaaucgauccucacacggcugccagccuacuacacccugucaaucaaguaccggccacucugcugccgggcgauaagaacgugaccguacaaguaccgaucggcaaccaguaccgggaaccuccggcuccgguacaagcaccucgacaggaauaccagccgguaccgccgcccgccguccauccaaaucacguucaacaacccguuuuuaccggucaagaugucgauuugcgauccauggguaacgugaccgauccgagaaucaggccgaugauggucgaucaggauaugagacaaaugccaaaugucauccagaauccucuaccgccuacuauaagcgaaagucucgccaaagcgggagauucgaaauccgauaacuauucgagggauccccgaagcgucuccggcgguuucccauccgauccaaggcaagcuaggauggauccgcgacaaaaaaguuuagcuccgacgagccagcaaguaccuucgucugugaauccgaagauaaugccgaaucaagccgguccugcggcuaucagacccguccagaacgucauagcgcaauccgcgaguguugcaccagcugcgucggcugcagcugcaucggccaacgugaugaguccugguauaggaggagccggugcuacagaucaagaaaaagccgccuugauuaugcaaguccugcaauugucugacgagcagauugcgauguugccgccugaacagcgaaauagcauuuugguguugaaagaacagauugcgaagagcgcgcaugugcguuaa

SEQ ID NO: 6009 - RNA, 1179 nt, Phyllotreta nemorum
auggcacaaauggaugcagaacgugaaaagagccgccaagaguacaggaagaaaguguuggagcacaaagaaguggaguccagacuaaaagaaaugagagaacagcucaaagacuuaaccaagcaguacgauaaaucagaaaacgauuugaaagcccuccaaaguauggggcaaauaguaggugaaguuuugaagcaacugacagaagagaaauucauuguaaaggcgacaaacgguccccguuauguaguuggcugccgucgucaguuggauaaggccaaguuaaaggccggcacaagaguagcucucgacaugaccaccuuaaccauaaugcgguacuuaccgagagaagucgauccuuuaguguacaacaugagccacgaagaucccggagaugucacuuauuccgccauagguggacuuuccgagcagauuagggaacuacgagaagucaucgaauugccucucaugaauccugaauuguuuaugcgagugggcauuacaccaccgaaagguugucuucucuacgggccuccuggaacugguaaaacucugcuagccagagccguagcuucucaauuggacgcgaacuuuuuaaaggucguaucgagugcuauuguagauaaauacauaggugaaucugcuaggcuuauuagagagauguuuaacuacgccaaagaccaucagccuugcaucauuuuuauggaugaaauagaugcuauagguggucguagguuuuccgaggguacaucggcugacagagaaauucaaaggacacuuauggagcugcugaaucaaauggacggauuugacucguuaggacaaguaaaaaugauuauggcgaccaauaggccggauacuuuggauccugcccugcuccguccgggucguuuggacaggaaaaucgagaucccucugccgaacgagcaagcucgucuugaaauuuugaaaauucacgcacuucccauugcuaaacauggagaaauugauuacgaagcuauuguuaaauugucggacaccuucaauggggcugauuuaaggaauguguguacugaggcaggacucuucgccauuagagcagaaagagaguaugugauccaggaagauuucaugaaagcuguaaggaaaguugccgauaacaagaagcuugagaguaaauuagauuacaaaccuguauaa

SEQ ID NO: 6010 - RNA, 780 nt, Phyllotreta nemorum
auggcucgccgguaugauacgagaacgacgauauuuucucccgaagggagguuguaucaagucgaguaugccauggaggccauaucccaugcaggaacgugucuaggcauccuggcaaacgacggaauccuucuugccgcagaaaggcguaacaccaacaagcuucuggacgaaguuuuuauuucugagaaaauauacaaacuuaaugaugauaugguuugcaguguggcaggaauuaccucugacgcuaauguucuaacuaacgaauugcguuugaucgggcaaagguacuuguaucaguauggggaaucgauucccugcgaacaauuaguuucgugguugugcgauguaaaacaagcuuauacucaguacggaggaaaaaggccuuuugguguaucgaucuuguacaugggcugggauaagcauuauggguaucaauuguaccaauccgaucccaguggaaauuauuccgguuggaaagcgacuugcauaggaaacaacaguucugcugccauuucgaguuugaaacaggaauacaaggaaggcgauaugauguugaaggaugcgaaaaguuuggcuguaaaaguucuggcaaaaacguuagauauggcuaaauugacgucugaaaaaguggaaauggcuacgcugacacguagaaaugauaaaaccaucauaaauauauugaauagcaaagaaguggaagaacuuauuucagacuacgaaaaauccgaagcggccgcugaagccauuaagaaacaagagcaaaaauccgcugcuuaa

SEQ ID NO: 6011 - RNA, 2661 nt, Phyllotreta nemorum
augagugaaucaaaagccgaaccuauaaagguugaaucaaaagcaaaugaugacaaaaauaagaacgaucuuucugaugaagauaaacaacuucaagaagaauugaacuugugcguggaaaaauuacaagaaaaugacaguaaacuguauaugcccgcauugcaagcuuugggaaaccauauucgggccucgacuacuucaaugacuuccgugcccaaaccacugaaguucaugaaaccucauuacgauaccaugaaacagauuuucgagaaaauuacugagcccccaguuaagugucuuugcgcagacauuauuuccguacuagcuaugacuaugggagaaggaagagacugcuuaaaauacaggcuacuguccgauuuggacaaaaucggugaauggggucaugaauaugucagacauuuggcuggagaaauugccggugaaugggcugaaacugauuucuugguaaacacagaaauuagggauaagcucauauuguuaacaaagcagaucguuccuuauaauauggcccauaacgccgaagcagaagcuugcgauuuauuaauggaaaucgaaagauuagauuugcucgauaaauacguggaugaaaauauuuacccuaggguuugcuuauaucuuacaagcuguguaccuuacguagcugauccggaaaauaccacucuucuucaaacugcuuuaaugcuauucaggaaauucaagcaguacccucaagcacuucgauuggcuaugcaauugaacgaucacagccucauugaagaaauuuuccuaaauuguccugauacugauguacagaaacaauuggcauucauguugggcaggcagcagauuuacauagaaguccccgacagcacaccggaauaugaagaccucauugaaauaauggcgaauugucaucuaaacaaccacuuuuugaaucuagcacgugaauuagacaucauggacccgaagaccccggaagauguuuacaaaucccacuuggaaaacagccguccuccauuugguggaagccaaguugauucugccaggcagaacuuggccgcaaguuuugucaaugguuucguaaacgcugccuucgggcaagacaagcuccugauggaagauggaaauaaauggcucuauaagaacaaagagcacgguaugcuuagcgcuaccgcuucacuggguuuaauauuauuaugggacgucgauggaggucuuacgccuauugauaaauacuuguauucuucugaagaucacauuaaaucuggagcucuacuggcgugugguaucgucaauuguggagucagaaaugagugugaucccgcucuggcucuauugagugacuauguccuucauaacacaaauauaaugaggauaggcgcuauugugggccucgguuuagcuuauguuggaucaaacagggaagcaguuuuaagucuacucacucccgucuucuccgauccaaaauccaacauggaaguuaucgguaugucugcgcuggcuugcggaaugaucgcaguaggaucuggaaaucuccaaguuaccaccaccauuaugcagacgcuaauggaaaaaucagaaaccgaacugaaagauacauacgcuagauuuuugccccuaggucuuggcuuguguauguugggcaaacaagaaggugucgauuccauaauagccgcacuggaaguuauaccggagccguuuaaaucuauggcaacuacgauggucgacauuugcgcuuacgcuggcaccggcaacguacuuaaaguucaacauuuacuucacauuugcuccgaacauuacgauggcgacagcucagacaagaguucuaaggauaaggacaaaaaagacgcuucagagaaggagaaagaucuuuccucgagacaagcaguggccgugcuggguauagcuuugaucagcaugggugaagacauugguagcgaaauggccuaccguaccuucgggcauuugcugcgcuacugcgaacccguaauuagaagagcgguaccguuagcuuuaggacucauuucaguaucgaauccuaaguugagcauacucgauacuuugaguaaauucucgcacgacagugaugcugaaguagcccauaacgccauauuugccauggguuuagucggagcugguacgaauaacgcaagauuggccgcgauguugaggcaauuggcgcaguaucacgcuaaagauccuaacaaccuauuuaugguucguauugcucaaggucuuacgcauuuagguaaaggaacauugacgcugaguccuuaucacagcgaccgucagcucaugagcccuguagcaguagcaggauuaauggcuacccuuguuggauuuuuggauguuaaaaauauuauuuugggaagaucgcauuaucuccuauacacucuagcagcggcuaugcaaccuaggaugcuugugacauuugaugaagauuugaauccauugccggugccugugagagugggauuggcuguagauguaguuggucaagcugguaaaccaaaaacuauaacggguuuucaaacgcauaccacuccuguucuucuugcauacggugaaagagcugaacuggcuacugaagaauacuuggcccucacuccgauuauggaagguuucguuauauugagaaaaaaccccgacuucaaugcauaa

SEQ ID NO: 6012 - RNA, 1515 nt, Phyllotreta nemorum
augaccgacaguaauauggaaucgaaagaagagaaacaagcaucaccugagaacgugaagcuaaagccagaagcaaccgagcccgaggcucccccagcucaaaccaccgcaaccggcgugauccgaagaaacuucaucaccccggcaggaacaauaguagaaaccaacgaagagcaaccuccugaaccaacgacagaggaagucgugaaaacgacaucuucgaauccaaguccggccgaacagaaaacugaacccgcagaaauagucaccuacgcugcggagguccugccgcaggagcagagagagcaauucgcugacgccaaaucuuacgccguggaaaugccggccgaaaauuuucaaaaucccagcuuuacucaggacauuaguuacgugaauauagaaggaacuguugugcccgucacaauaucggaaauagaacauccuggggacuacgccaauuuacaaacugcucaauacaauaacggcuauacugauggcucacaauauuuaaccaaucaucaguaccaaaacauguauaucgauagaacuacagucgauaauucuacuucugcuacaguuuuauaccgugaugauccaaauuugggagcuuccagauuccaaggaaacuacgacauauccaguucucaaucgcaagugaaccuccuucccgcuuccggugaagccuacuauccaucaacaucuaauuggacgccaaccaguagcgguucuuaccaacaacaauauccaucagggaacauaaacguccuucaagcugauucgacucaagcuuucgcagguccuuacauaaacgcgaccuggucgucgaauucgauggaggacggacggcaaucuagucaagagguacuagugaaagagugcguuaauuguggugcuagcguuacaccacuuuggcguagagacgguacggggcauuaucuauguaacgcgugugguuuauaccacaaaauuaauggggugcacagaccgccgacuaagccaaccaaaaaaccacaggcgaccggaaauagaagaaacggcguaacgugcgcaaauugcaaaacuaacaacacuacacuuuggagaagaaacaaccaaggcgagccagucuguaacgcuugcgggcuuuacuauaaauuacauaauguuaacaggccgaucaguaugaaaaaagaagguauccaaacgcgcaaaagaaggcccaaaaacucuucgguuggaaacccugccagugcugcaggucaaguaagaauggggcuucccucuuaucaauaucaagauauugaaguacagcaggaucaguaccaauuaccagugagcguuuauucucaaagaccacaaguaucuuaucgacauuacggggcagaaaauauuggaacuauaaaugcacaaccacugcagccaauuauuacucaugaagaugaacaggcaagugucauuacaucgacuucacaacaggcuagguuuaggacgaagguggaagaggacgaaggaagcaauccauccaugcaauccuaa

SEQ ID NO: 6013 - RNA, 2952 nt, Phyllotreta nemorum
augaacaccgaucgccugaccauauucgcugcgaacuuacaaguauccuuccugcuguucgagucguuaagagcucaucuaaaguaccaauuggaguguuauuugaagaagcugacggagaucaugagaagcgaaucgaacaaagugagcuaugagcacaaggagaucgccuuggauaaucugcugcagcuguggagggugccgggguuccacgcggagcucuacgugaacuacgauugcgacauguacugcgcgaauuuguacgaggagcuuacggagcugcuggccgaacgggcuguuucuaaugugggaguguaucacucucauuugcugucgcuugaugggcuuuugauuauaauugacgggauagggaagagauuugacgaagcgaaggaucgaucagauaccgaugagauuagcaguuauacuggggaaaauacgagaguuaaagguuguguuagagcuccugauaagaagguuuuggcugccaagaaagggauuaaaaaaugguugccccaagguacggaguauuucaaucagaagccgaagaaagguauacaguuccugcaggagcacggcguuuugaagcaggagcuggacgucgaggagaucgccagauuucugagggagaauccugcguugaacaaggcgaugaucggggaguauaucagcaaucgagggaauuugaagauacuggaggcuuuugugggcacguucgauuucacagggauacggaucgacgaggcgcucagagcguuuuuggagacguuucgauugccuggugaggcuccgacgauuucgcugauccuugaacauuucgccgagcauuggcauaaaagcaacggagaacccuucgccgacgucgauucagccuuuaccuuagcguacgccguuaucaugcuuaacgucgaccagcacaacgaaaacgccaagaaacaaaccauuccaaugucgccgaacgcuuucaaaaagaaccugaaaggagucaauggaggcgacgauuucgaagaagaaaugcucgacgaaaucuacacgucgaucaaaagcgaagagaucgugaugccguccgagcgcacgggguuggugcgcgacaacuaccuguggaagguccugcugcgcaaaggccgaucgcccgaaggcggcgucuacaugcgcgacgacgccggcgccuacgacuccgaauuguucagcaucgccuacggcccucuggcggccgcccugaauuccgucuacgagcgggccgaacacgaaggaguccugaagaaagucaugcgagguuucgaacgaugcgcuucgauagcguccaaucuaaauaugacagcgaaccucgacauguugcuggucaguuuggcgaaauucaccguauuccacaaucaccagaagcaaacugcugucguggugcaauucgguucgaacgcuaaagcucaacuagcucuaaaaacgcuuuuuaugcugauacaccagcacgguaacuccacgagggaaggcuggaagcaccucuucgaccugcugcuggcuuuguacagcaacgauuugcucagcaaagguuucguggaagucgaggauuucguagaaccuuccgguaaauuguguuugguguacaaggacgcgccgagcgcagccaaacaggauacaggccuguugagcuccuuguacuccuacaugauaucuguagagaaccuguccaaaauaccuucucccgaagagcagaguuugauagacaaagccagggaguguauaaaagaguguaauuuagagcaaaugauuaccgauucuaaauuucuacaccaacaagcccucuuccaacuggucgauacucugauagaguuguccagagguccggaacugcaagaagguucuuccuacgacuacaacgaaaacauaacggucuucuuccucgaauugcucgugaaaaucgucauacagaaccgcgacagggucaugaccauaugggaccgcgucagggaccacgucuacacccuggucaugaacucgucgcugaugagcuaccaguuccugcuggagagaucggugguggggcuguugaggauagccgugcggcugaugcgcaacgaggagaugagccacgugguguugcagucgcugcgcaugcugcuguugcugcugaagggcggcgugcucgccaggauaucccgccagauggcguucggcuuguacgagaugcugaagacgucggcgcagaacauacacacgacggccgauuggacggugguguucgcgcuguuggagugcguuggggccggggcgaagccuccuaggccuguuuugaccgccgaagaaaacgacgcgaaacccaaacccgacgaagaaacuugcuccaaaccagacgaagaaggcgccgaaaaauccaccaaaacagcgucccaaagaccccaaagccccaugaccucaaucaccucaccggucggcacgcccaacaccggcggcuggaucaucgucagcgacgaagacgaucuccaaccccgccagcaaacccuacccguucacuaccaccugcggcucgacgccgaccucucgccccacgacccgcucagcaugcucaagugcugcgagagccuggccuuuuugguccgcgacgucgcccacaucacgccguacaacuucgacgugugcgugcgcugcguacgcaccuucgucgaggccgcccucaaaccccccaccgcccaccaauccaacgucaaaagauccaaagcgagcaaaagcaggaagaagagccccgcggggagccaagaggaagacagcagcggcggagacgaggaagaagacuugcccagcggcuaccaccagguccccauacaacuacucgaccucaugcacacccugccacgcgcacggcucaaauauucaaauggugggccgaagaaggcggcgagauauccggcgaaaccucccuguggacgcaaggcugguguccuuugcugcagggcauag

SEQ ID NO: 6014 - RNA, 618 nt, Phyllotreta nemorum
augucgauuuuggcguacaacgggggcgcgaugguggccaugaagggcgagaacugcguagccauagcggccgaccgccgguucggcauacaggcccaaaccgucgccaccaacuucgagaaagucuucgaaaugggcccccaccucuucgucggccuccccggccucgccaccgacacccaaacggucauggagaagcucagguuccgcaagaaccuguacgaguugaaagagaaccgccggaucucccccaagguguucgcggccaugauaucgaacauguuguacgagaagagguucgggccguuuuucguggaacccgugguggccgggcuggcgcccgacacguucgagccuuacauaugcaacauggauuugaucgguuguauuaacgagcccagcgauuucgucgugggcggcacggcguccgcucagcuguacggaaugugcgagucgcugugggagcccaaucucgcgccggaggaccuguucgaaaccauaucgcaggcuuugauuaacgcuuucgauagggacgcuauauccgguuggggagcuacgguuuauauuguagaaaaggauaaaguaaccguaagaaaccuaaaaacucguauggauuaa

SEQ ID NO: 6015 - RNA, 2805 nt, Phyllotreta nemorum
auggcuauuggaauuacagaaaucgguucacgcguggaccgucgccgacgagcugcugcgucgcugcaccagcgccgacgaucuccaaacccgcuauuucgccgcucaaaccaugcgcaccaaaauccaccaauccuuccacgaacuacccagagaggugcacgagucccuccgagacucgcuucuggagcacaugggggcuugcgcuggcgucgacgagggcgcggggccgccauagugacgcaacuaucgcucgcacucgccgauuuggcccugcagaugcccgauuggcgaacgccugcgcuagauuugaucagcagguucagugcggggaacaacguguggccguuauuggagguguugacugugcugccugaggaauuggagagcagaucaguaagauuaggagaaaaccgaagauaugagguacuagaagauaugaaauuaugcgcucccacugugaacgaauuucugaaacauuguuccaauuuguacggcagaagaggaucggagagguuagcaacaggugauagacaaaucgacguaaaaauccucagauguuucgcuuccuggauaucaguuggggcaauuggaccuagucaauugagcgaggaucgggugguaguugacguggcuuucgacguguugaaagcggacauaagaggagaugaaaaaguaaacguaacaggucaacuucacgaagccgcuacagacuguauauguacuuuacuguuacgucucgaggauaacaacaaucacgucgcauuggaaacccacuuauuugaaaauauaguaaauuuagaaguguccuaucacgcguccgucgcgcucgaagaucaagcaaagucgacggauuauugucgguuguucacugaguuggccgagucguuuuugggaaagauuguagacgacgguggaggcgggggcggcgacggcggaggagcgaagaggcguacaguguacgccguuaaaugcuuagauuugguacugaugugcgucggccaucaugacuacgagguggccgagauaacuuuuaaccuuuggcauaugcugagugaggaauuauaucagaaaaacaauaaggaguuaacggaauuauucaaaccguacguagaaagauugauuacggccuuauguagacauugucagauggagccugacauggagggucugcucgaaaaaggagaugaauuuaaagauuuuaggaugaaagucuccgaucuaauaaaggacgucgucuuuauaguagguagcagcaguugcuucagacaaauguuuaucaauuugcaaaccccugguguaacgugggaugccagcgaagccgcucucuuugugaugcaggcuguagccaaaaacguucuacccacggaaaacgaaguuguuccuaaagucgucgaagcaauacugaacauacccagcagcgcacacgucgcugugaaguacacaucuguucuucuacugggcgaacuggccgaauggauagaaaaacacccggacgcuuuggaucccguccugaauuuccuaguuugcugccuccggagcggcgccgaaggaggaggcgucgccacggcggcggcggcggcgcugcagaacgugugcacuugcuguggggcucacaugggcaggcacguucccauucuguuacaguuacuucaacagucggauucguucgguaucggcaacacggcgaucauaggauuauugaagggcgucgcgucgguggugagcugcggcauuggcagcggcgccgaaacggcuuccgccguacgggaauugugcuccuugcaauugucgccgcugugcaguuugaucgaaaacggcguucgacccguuaagggaacucuaacggauccggugcugugguuggaucgauugaguucaguuuugagauacgucaaugucaauguaguugaaggggaaauccauccuugcaaaccgguaauaauggagauauggccuauacuaucccgcgcauucgacacauaccacagcgacgcuaggauaauggagagguguugucgcucggugcguuucauguugcguugcgucgcccgacagcuccaagauuugcuucccucuuuggucggccaaaucgugaacaucuacugccucuacggccauucguguuguuuguacgucggcagcauucuagucgacgaauacgccggcgaugcgacuugcguucaaggucuccucgacaugcugaacgccuuuuuggagcccacguuucgcuuguugcaggaagagaacggcuugaagaaccauccggauacuguggacgacuucuucagguugugcgcucgguuuguccagagggcgccgaaggcguuucuaagcggagggccccaucuggcgcccauuauccagugcgcccuucucgcugccaccuuagaccacaaggaggccaacguguccgucaugaaauuuuucuaugauuugauaaaucaaggacugagcggcagaggggagcccgacuuugacgagagaaaagccuuggugaggagcuugcuaaacgaauacggucaacaacucguaucuaauuuaauucacucuugcguauuuuaccugcauucauacauguugagcgaggugggcgacguuuuugugcaauuguuggauuucgauagacaaauaacgagugaaugguuagcgaacgguuuggaguuauugcccaaacagcagaauggugggauaauggcggcuaagccuaaacaauuaaaugacguucaugcuucgauaacgagaucgaacaguucgaaaucugugacgcacgcccugaaagaccuaacuaggcuauaucguuaa

SEQ ID NO: 6016 - RNA, 1509 nt, Phyllotreta nemorum
auggcucaaagauuucccggacccguaucgaaccaagucccgggggggccgccgccuccucaaagguacccacaaccgccgccgaaucaaggaaugcggcaauacggacaacaggcuuucccucccaggccgggcuacagugcuccaccgccaaguaugcagucgagcggaggcacgaugauacaaagaccgcccggggcucccuauuccccgaugcgcggagggcccaugccgccccagccggugggcaagaggccuucggacaacaggaauccucugcagcagaagaacagcgacuacagccacgguacgaguaagaaaaaaaagaagcuugcagauaagauuuuaccccaaaaaguaagagauuuggugccggagagccaggcuuacauggauuuguuggcuuucgaacgaaaacucgauuccacgauuaugagaaaaagauuggauauucaagaggcuuuaaagcguccgaugaagcagaaacgaaaacugcgaauuuuuauuuccaacacuuucuacccggcgaaagagccccaacccgagggccccgacggcccuugccaagaaggcacgguagccuccugggagcucagagucgaaggcaggcugcucgaagacuccaagaacgauccgaacaaagucaaacgcaaauucuccucguucuucaagucccucgucaucgagcucgacaaagaacucuacggccccgacaaccacuuggucgaauggcaccgaacgcugaccacccaagaaaccgacgguuuccaagucaaaagacccggcgacaagaacgugaggugcaccauccugcugcuccucgacuaccagccgcugcaguucaagcucgacccgagacuggcccgauuacucgggguacacacccaaaccagaccggucauuauuucggccuuguggcaguacaucaagacucacaggcugcaagauggccacgagcgcgaguacaucaucugcgacaaauaccucgagcagaucuucaacuguacucgaaugaaguucgccgaaaucccccaacgguugaacccccugcugcacccgcccgaucccaucgucauaaaucacguuauaucggucgaaggcggcgcugagagcaagcaaacggccugcuacgauaucgacgucgaaguggacgauacucugaagacccagaugaauaauuuccuguugagcacggccagccagcaggagauucagggauuggacgcgaagauucacgagacugucgacacgauaaaucagcugaaaaccaacagggaguuuuuccugaguuucgcuaaggauccgcagcaguucauacauaaauggaucgugucccaaacgagggaucugaagagcaugacggaugugguugggaauccggaggaggagagacggucggauuucuuuuaccagccuugggcgcaggaggccgugugccgguacuucuacacuaaggugcagcagaagagggccgagcuggagcaagcgcuugguauucguaauaauuag

SEQ ID NO: 6017 - RNA, 1044 nt, Phyllotreta nemorum
augccagcagcuacuuuggguagcauuccacauccuaacaaugaagacugcggcauucgggacguuugggcucacaauuuagaagaugaauuucgaacuauuaggcaaauagugcagaaauaccaauaugucgcaauggacaccgaauuucccggaguuguggccaggcccauuggagaauuucgaaguucagccgauuaccaauaccaaauguuaaggugcaacguagacuuacugagaauuauucaacuagguuuaacguucuuagacgauaauggcaaaacaccgggaggaguuuauaccaccuggcaauucaauuuuaaauucaaccuucaagaagacauguacgcacaagauagcauugauuugcugcagaauuccgggauccaauucaagaagcacgaagaugaagguaucgaaccgcuagaauuugccgaauuacuaauguccucuggaaucguucuuauggaaaauaucaaaugguuaucguuccauuccggcuacgauuucggcuauuuaauuaaguuacuaaccgacaacaaucucccgcaagacgaaaccgaauucuucgaucuguugaaauuguacuuuccuaccauauacgacguaaaguauuuaaugaaaucguguaaaaauuuaaaagguggucuucaagagguggcggaacaacuggaauuggaaaggaucgggccucaacaucaagcuggaucugacucgcuuuugaccuucgaucuauugaaauuguacuuuccuaccauauacgacguaaaguauuuaaugaaaucguguaaaaauuuaaaagguggucuucaagagguagcggaacaacuggaauuggaaaggaucgggccucaacaucaagcuggaucugacucgcuuuugaccggaauggccuuuuucaaaaugaaagagauguuuuuugaggauacuauugacgauucgaaauuuucgggccaucuuuacggacucggaacaucuuucacgguuaaugguacaacuaacaauuacgggaacgauaacggcgacacgacaaacuccucauga

SEQ ID NO: 6018 - RNA, 1212 nt, Phyllotreta nemorum
auggcggaaguucagaaaaggggcgcuucgguuuucgaggaccucucgaacgucgaguucgagaccagcgagaaccuagauguuaucgaaaaguuuaaagacaugaagcugaaggaggaacugcuucgcggcaucuucgcauaugguuucgagaagccuucugcuauucagcaacgagccaucauucccgugaugaaaggcagggauguuauagcccaagcacaguccgguaccgguaaaaccgcuaccuuuuccauagcuauacuacaagcucuggauuuaacgaugagagaaacacaagugcuguguuuaucacccacgagagaauuggcuguacaaauucaaaaaguuauauuagcucuaggcgauuucaugaacguacaaugucacgcuugcaucggggguacaaaucucggggaagacaucaggaagcuagauuacggacagcauguuguuagcgguacacccggaagaguuuacgauaugauucguagaagagcuuugaggacuagaucggugaaaaugcugguccuggaugaagccgaugaaauguuaaauaaaggguuuaaagaacaaaucuacgauguguacagauuccuuccacccuccacucaagugguuuuaauaucagcuaccuuaccccacgaaauucuggaaauaacauccaaauucaugaccgaucccaucaggauccuaguaaaacgugaugaacugacgcuggagggaaucaagcaguuuuucgucgccguggaaagggaagaauggaaauucgacacgcucugcgaccucuacgacacccugaccaucacgcaagccgucauuuucugcaacacgaagagaaaggucgauuggcugaccgaaaagaugcgagaaaacaacuucaccgugagcuccaugcacggggacaugccccagaaggagcgcgacaacaucaugaaagaguucaggucgggccaaagcagaguuuugaucaccaccgacguuugggccagggguaucgacguacagcagguuucuuugguuaucaauuacgauuugccgaacaaucgugaauuguauauccaucgaaucggucgguccggucgauucggcaggaagggugucgcuaucaauuucguuaagucggacgacauuaggauucugagagauaucgagcaauauuauuccacgcagaucgaugaaaugccuaugaauguagccgauuuaauuuaa

SEQ ID NO: 6019 - RNA, 1602 nt, Phyllotreta nemorum
augaccgcuccugcugccgguggcgaugcaagaggaagaacucuugcuuacaaagacaaaagcaaacccgccgauguccggacuagcaacauuaacgccgcuaaggcugucugcgaugcaauucguacaaguuugggccccagaggaauggauaaaaugauacaagcugguaacggagaaguaacuauuacuaacgauggagcaaccauuuuaaaacaaaucaacguuauccaucccgcagcaaaaauguugguggaacuguccagagcucaagauaucgaagccggugacgguacgacuuccguagugguuauugccggagcucuuuuagaugccgcagaaaaauugcuacaaaaaggcauucaccccacagccaucucggagucuuuccagagagcugcucuacuagcugucgaaauucuacaagaaauuucaacgccaguagaaaucaccaacagggagcuguugauuaaaagcgcuucuacuucucugaauucuaaagucgugucccagcagucgagucucuuggguccuuuggcggucgaugcuguucuuaaaguugucgaaccaggacaggaacaagcuuguaacuugguggaugucaaaguuaucaagcaauugggcgguacuguggaagauaccgaguugauugaggguaucguguucucgcagaaaucagccaauguaucaggccccaagaaaaucgaaaaagccaagauugguuucauccaauucugcauuucucccccgaaaaccgauauggaccacaaugucauaguauccgauuacgcugcgauggaucgaguccugaaggaagagcgagcguauaucuugaacauuguuaaacaaaucaagaaagccgguuguaacguacuacugguucagaaaucgauucucagagaugccguauccgaccuggcacuccacuuuuuggauaaaauaaagugcauggucaucaaggaugucgagcgagaagacgucgaguuugugugcaaaucguuggguugcagaccgaucgcuucccucgaucauuucaccgccgaaaaucuaguaacagccgauuuggucgaagaagucggggugggcgguaaccgaauggucaaaaucacagguauucaaaacgcugggcguacugugacccugcucguaagaggcucgaauaaacuaguauuagaggaggccgagaggucccugcaugacgcucuuugcgucauucggugucuuguucgcaagaaggcgcuuaucgcaggcggcggggcacccgagauugaaguugcucucaagcuggcugcuauggcuaauaaguuggagggcauugacgcuauuugcaccagggcuuaugcuacugccuuggaaauuauaccguuuacuuuggcugagaaugcuggguugaauccuauacagacgguuacugaauugaggaauagacaugcgaaaggggaaacuucggcggguauuaauguucguaagggcacuauuacggauauuuuggaagagaauguugugcagccgcuguugguuagcacgucugcuuugagcuuugccacugaaaccgucagguccauauugaaaauugaugacauugugaacaccuuaaauuaa

SEQ ID NO: 6020 - RNA, 1143 nt, Phyllotreta nemorum
auggaggaucucuacaccaaauacaagaaauuacagcaaacguuggaguuccuagaaguccaggaagaauacaucaaagacgagcagcgaaauuugaaaaaggaauaccugcacgcgcaggaagaagugaaacguauccaaucaguaccguugguuaucggucaauuccuggaagcaguugaucagaauaccggcauuguuggaucaacuacaggcucuaauuacuacguucgcauucucuccaccaucgacagggaguuguugaaaccguccgcuagcguagcccuacacaagcacagcaaugcccugguggacguguuaccccccgaagcggacuccucuaucagcaugcuucaggccgaugagaaaccggacgugcaguacagcgauaucggagguauggauaugcaaaagcaggaaauccgagaggccguggaacuuccgcugacccacuucgagcuguacaaacaaauaggcauagacccgccgagaggcgugcugauguacggcccgcccgguugcggcaagaccauguuagccaaagccguggcucaucacaccacugccgccuucauucgaguggucgguucggaguucgugcagaaguaccugggcgaggggccucguauggugagagacguguuccgcuuggccaaggaaaacucgccggccaucauauucaucgacgaaaucgacgccauagcgacgaagcgguucgacgcccaaacgggggcggaccgcgaggugcagcggauccugcuggaguugcugaaccaaauggacggguucgaucagaccaccaacgugaaggugaucauggcgacgaaucgggccgauacguuggaucccgcgcugcugaggccgggucguuuggauaggaagaucgaguuuccguugcccgauagaagacagaaacgguugauauucagcacuaucacguccaaaaugaaucugucugaggagguugauuuggaagauuauguugccaggccagauagaauaucgggggcggacauaaacgcuauaugucaggaagccgggaugcacgccguacgagagaaccguuacaucgucuugccgaaagauuucgaaaagggguauaagaauaacaucaagaaagaugagagcgaacaugaauuuuau

SEQ ID NO: 6021 - RNA, 489 nt, Phyllotreta nemorum
augccaaacauaaagcugcagucuucggacggcgagacauucgagaucgacgucgaaaucgccaagugcucggugaccauaaaaaccaugcuggaggaccucggcauggacgaggaagaggaagaggucgugccguugcccaacguaaacucagccauccuacguaaagugauccagugggccaccuaccacaaagacgacccgccgccgcccgaagacgacgacaacaaggagaagcgaacggacgacauauccucgugggacgcggauuuccucaaggucgaccaaggcacccuguucgagcugauccuggccgcgaacuaucucgacaucaaaggccugcuggaugugaccugcaagaccguggccaacaugauuaagggcaaagcgccggaggagauacggaaaacguucaauaucaaaaacgauuucacgccguccgaggaggagcaagugcgcaaggagaacgaguggugcgaggagaaauag

SEQ ID NO: 6022 - RNA, 930 nt, Phyllotreta nemorum
auggacgauaaggcuucauguaaggaacuagaucaauggauagaacaguuaaaugacugcaagcaauuaaccgaaaaccaagugaaaacucugugugauaaggcgaaagaaauacuguccaaagaaucaaaugugcaggagguuaaaugucccgucaccgucugcggagauguucacggacaauuucacgaucugauggaauuauuuaggauaggcggucgaaguccagauacgaauuaccuuuucaugggcgauuacgucgaucguggauauuauucggucgagacuguuacucuguugguggcucugaaagucagguauaaagaaagaaucacgauuuugagaggcaaccacgaaucgaggcaaaucacucaaguauacgguuucuacgacgagugccugcggaaauacggcaacgccaacguuuggaaauucuucaccgaucuguucgacuaccugccucugacggcgcucgucgacagccaaauauucuguuugcacggcggccucagucccagcaucgacaccuuggaccacauucgagcccuagaucguuuacaagagguaccucaugaagguccgaugugcgaucuucuguggucggaucccgacgaucgcggaggcuggggcauuucuccucgcggcgccgguuauacguuuggacaggauauaucggaaacguucaaccacagcaacggucugacguuggucucgcgcgcccaucaguuggucauggagggguacaauuggugucacgacagaaacguggugacgaucuucagugcucccaauuacugcuauagauguggcaaucaggcggccauuauggaauuagaugaugcgcuuaaauauucauucuuacaauuugauccagcaccgagacguggcgagccucacgugacccgcagaacuccggauuauuuccuuuaa

SEQ ID NO: 6023 - RNA, 1341 nt, Phyllotreta nemorum
augcaaauauucgugaaaacucucacugguaaaacuauuacucucgaaguugaaccaucugauacuauugagaacgugaaagccaaaauccaagacaaagaggguauucccccagaucagcaacgucuuaucuuugccggaaagcagcuagaagauggacgaaccuuguccgacuacaauauucagaaagaaucuacucuacacuugguacuucgucucagaggaggaaugcaaauauucgugaaaacucucacugguaaaacuauuacucuugaaguugaaccaucugauaccauugagaacgugaaggccaaaauucaagacaaagaggguauucccccagaucagcaacgucuuaucuuugcuggaaagcaacuggaagauggaagaaccuuaucugacuacaauauucaaaaagaaucuacucuacauuugguacuucgucucagaggaggaaugcaaauauucgugaaaacucucacugguaaaacuauuacucucgaaguugaaccaucugauacuauugagaacgugaaggccaaaauccaagauaaagagggaaucccaccagaucagcagcgucucaucuuugccggaaagcaacuggaagauggaagaaccuuaucugacuacaauauucagaaagaaucuacucuacacuugguacuucgucucagaggaggaaugcaaauauucguaaaaacucucacugguaaaacuaucacccucgaaguugaaccauccgauacuauugaaaacgugaaggccaaaauccaagacaaagaggguauucccccagaucagcaacgucucaucuuugcuggaaagcagcuagaagauggaagaaccuuguccgacuacaacauucagaaagagucaacucuucacuugguucuucgucuaagggguggaaugcaaauauuuguuaaaacucuuacugguaaaaccaucacccucgaaguugaaccauccgauacuauugagaacguaaaggccaaaauccaagacaaagaggguauucccccagaucagcaacgucuuaucuuugccggaaagcagcuggaagauggacgaacauuguccgacuacaacauucagaaagaaucuacucuacacuugguacuucgucuaagggguggaaugcaaauauuuguuaaaacucucacugguaaaacuauuacucucgaaguugaaccaucugauacuauugagaacguuaaggccaaaauccaagacaaagaggguauucccccagaucagcaacgucucauuuucgccggaaagcagcuagaagauggaagaaccuuaucugacuacaauauucagaaagaaucuacucua

SEQ ID NO: 6024 - RNA, 1623 nt, Phyllotreta nemorum
augaugcaaccucagauauuacuccucaaagaaggcacugauucgucgcaaggcaagccgcaauugauaucaaacauaaaugcgugccagaauauaguggacgccauucgcacaacccuggggcccagagguauggacaaacugaucguuuccaacagaggcucggcgaccauuucaaacgacggagcgacaauauuaaauuuacuagacgucguccauccagcggcgaaaacucuagucgacauagcgaagucacaagacgccgaaguaggcgauggcacgaccucagucgugcuguuagccggcgaguuucugaaacaacugaaauccuacaucgaagaaggcgugcacccucggaucaucaucaaagccguacgcaaggccacccaaauuugccucgagaaaaucaacucccucgccgucaaaaucgacaaauccaaggccgacgaauacagaucgcugcuggagaagugcgccgcgacggcgaugagcuccaaacucaucaacaaacagaaauccuucuucuccaaaaugguggucgaugcgguucuacugcucgacgaacuccucccguugaacaugaucggcaucaagaagguccaaggcggcgguuuggaggaguccauguuagucgccgggguggcguucaagaaaaccuucucguacgccggcuucgaaaugcagcccaagaucuacaaagacugcaagaucgcccugcugaacaucgagcuggaacugaaagccgaacgggacaacgccgagauccggcugagcagcgucaaggaguaccagaaagucgucgacgccgaguggaacauccucuacaacaaacuccagaaaauccacgaauccggagcgaacgucguccuauccaaacuccccaucggcgacgucgccacgcaguacuucgccgacagggacauguucugcgccggacggguccaagaagaagauaugaagcgaacccucaaggccugcggcggcuccauaaugaccacagccaacgauuugaaagacgaggugcugggccgcugccagcucuucgaagagaaacaaaucggaggcgaacgguacaacuucuucaaaggcugucccaacgccaagaccugcaccauaauccugcgaggaggcgccgagcaguuucuggaggaaaccgagcggucccugcacgacgccaucaugaucguacgcagaacgaucaagaacgacucgguaguagcgggcggaggggcgauagaaauggagcugucgaaguuacucagggacuauucccguacuauugcugguaaagagcagcuccugauaggagccauggcuaaggcgcuggaaauaaucccuaggcagcugugcgacaacgccggguucgaugcuacuaauauauugaacaaguugaggcagaagcaugcucaggguaauucuugguaugggguugauguuaacauggaagauauugcggauaacuaugaaacuugcgugugggagccggccauuauuaaaauuaacgcuuugacugcggcugcggaggccacgugcuugauccugucggucgaugagacgauuaagaaccagaagucugaggcgccgccgcagauggggggccggggaaugggcaggccuauguaa

SEQ ID NO: 6025 - RNA, 6804 nt, Phyllotreta nemorum
augaacagcgagccccaaaagggcguguuggagaaaguccugcagcaagucgagaacacucugaacguacuagccgacuccguucugcaggaacaaccucaguugaggaggaagaaacuggagcauuugaucaacgaguuugugcacaaaagaacggugaccagaaggcucaucgcuaacggggugugcagcaacaaggcguucgaauggcugugcgaaaugagguucuacuucgaucccagacaaaccgaagugcuuaagcaacuaacgauucauauggcgaacgcgagguucuauuacggauucgaauaccucggcguucaggacagauuggugcaaacuccucugacugacagguguuacuugaccaugacccaagcuuuggaagcccgacucggaggaucaccuuucggaccugccggaacugguaagacugaaucggucaaagcgcuaggaaaccagcuagggcguuucgugcuuguguuuaacugugacgaaacguucgacuuccaagccaugggcaggauauucgucgguuugugucaagugggcgcuugggguuguuucgacgaauucaacagauuggaagaaagaaugcugucugccguuucgcagcaaauacaaacuauacaagaagcucuaaaaucccagaaggaagccgcugcugaaggagucgcuaccggcaguauaagcguggagcucgugggaaaacaaguaaaaguauccccugauauggcuauauuuauuacgaugaauccuggcuaugcgggucguucaaaucugccggauaauuugaaaaaauuguuuagaucgcuggcuaugacuacgccugacagacagcuuaucgccgaagugaugcuguucucucaaggauucagacaagccgaaaaauuggcuucgaaucugccggauaauuugaaaaaauuguucagaucgcuggccaugacuacgccugacagacagcuuaucgccgaagugaugcuguuuucucaaggauucagacaggccgaaaaauuggcuuccaaaaucguacccuucuucagauuaugugaugaacaacuguccaaucaaucucauuacgauuucgguuugagagcuuugaaauccgugcuaauaucugcaggaaacguaaaaagggauagaauucaaagaauuaaagaaggcaugacccaacgaggcgaaaccaacauagaugaagccaacauagccgagaauuuacccgagcaagaaauauuaauucaaucgguuugcgagacuaugguucccaaauuagucgccgaagauauuccguuguuauucagcuugcuaaacgacguguuucccaacguucaauacaccagagccgaaauggaaggucucaaggaugaaauuagaaaagugugcaccgaagaauaccucguuugcggagaaggcgacgaaagggguucagcuuggauggaaaaaguauuacaauuguaccaaauuucaaaucuuaaccauggucuuaugauggucggcccgagcgguucgggcaagaguucagcauggcgaguucugcucaaagcucucgaacgguucgaagggauagaagguguggcccacgugauugaucccaaagcgaucagcaaggagacccuauaugguguuuuggaucccaauacuagagaauggaccgauggucuguucacccauauucuaagaaaaaucauagacaacgugagaggugaaauuaacaaacgucaauggauuauauucgauggugaugucgaucccgaauggguagaaaacuugaacucgguucuugacgauaacaaacuguuaacucuucccaacggagaacgucucucucuaccacccaacauuagaguuauguuugagguacaagauuugaaguacgcgacuuuagcuacaguaucgcguuguggaaugguaugguucucagaagacguccuauccacugaaaugauauucgaaaacuacauucuucgauugaagaacaucccgcucgaagaaagcgaagauagcuucggcaagaaauccgaccucaaagacgacaugcugucuccgacccuccaacugcaaguagacgucguuaaucuacuccaaccguuuuugggacccgacggucucguaguacgcugucuagaguacgccauggagcaagaacacauaauggacuucacgcggcucagagcgcugagcuccuuguucuccaugcuaaaucaagcagugaggaacgucuugcaguacaaucacaugcacccagauuuuccucucuccagcgaagcccucgacaaauacauacccaaauguuuaauauauucgaucuuguggagcuuugcuggcgaugcuaagcucaaaguuagaucggaguugggcgauuuuaucagauccgucaccacugugcccuuaccguccgaccgcaaucugccuauuauagauuacgaagugacuauugaaggagaauggucgcuuugguccaauaaaguaccccaaauagaggucgaaacucacaaagucgcuacacccgauaucguggugccuacguuggacacgguuagacacgaaucuuuguuguacaccugguuggcugaacauaaaccgauaguauuguguggcccaccugguuccgguaaaacgaugaccuuauucucugcauuaagagcucuaccagacauggaagucguuggguugaauuucuccucugcuacaacuccugaauugcuguuaaaaaccuuugaucacuacugugaauacagaaaaacaccaaauggcguaauucuaucgccaauacaguugggcaaauggcugguccucuucugcgaugaaauuaaccuaccggauauggacaacuacggaacccaacgcgucaucauguuccuccgucaaauaguggagcaaaaaggcuucuaccgcgccucagaccaaaccuggguaacauuagaacgcauucaauucguaggcgcuugcaaucccccaacagaccccggacgaaaaccgcucucucaccgauuccucaggcacgugcccgucguuuacgucgacuacccgggagaaacuucccucaaacaaauuuacggcaccuucaccagagccaugcugagauuagccccgggucugaagggcuacgcggaaccacuaaccaacuccaugguggaauucuacuuauccucgcaggauagguucacucaagacaugcaaccucauuaugucuauuccccucgugaaaugacgagaugggugagaggcauaugcgaagccaucaggccuuuggacaaucuuucugucgaagguuuggucagguugugggcacacgaggcgcuucgacuguuccaagauagguuaguggaagacacugaaaggcgguggacgaacgaaaacaucgaugccgucgcuuugaagcauuucccuucagcaaauugcgagaaggccuuggaacggccuauucuauacagcaacugguuaucuaaagauuauguaccggucggaagggagcaauugagagaauaugucaaggcuagauugaaaguguucuaugaagaagaacucgacguuccuuuggugcucuucgacgaaguuuuggaucacgugcucaggaucgacaggauuuucaggcagccccaaggccacuugcuccugaucggugugucuggagccgggaaaacgacucuauccagauucguagcuuggaugaacggauuguccauuuuccaaaucaaaguucacaacaaauauacggcugacgauuucgaugaagacuugagaucggucuugagaaggagcggguguaaacacgaaaagauagcguuuauuuuagacgagucgaauauguuggacucgaguuucuuggaaaggaugaauacucuucuggcuaacggagaaguuccuggauuauucgaaggggacgaauacacuacucuaaugacacagugcaaagagggagcccaaagagaaggauuaauguuggauucgaacgaugaacuguacaaaugguucacacagcaaguuaugcgaaauuugcauguaguuuuuacgaugaauccaucaacagauggguuaaaggacagggcugcuacaucuccugcuuuauucaacagauguguuuugaauugguuuggagauuggucagauggagcucuuuuccaggugggaaaagaauuuacgaaccguuuggaucucgacaaacaaaguuggaaauguccagauuucuucccugcuucuugcaaccacauuuccgcuacgcccaaucacagggaagccgucauuaacgccugcguuuacguccaccagacgcuucacaaagccaacggcagauugguaaagagaggaagucgcaccauggccaucacccccaggcacuacuuggauuucauacaccaucucgucaaauuguacaaugaaaaacgguccgauuuggaggagcaacagcuccaucucaacgucgguuugaacaaaaucgccgaaaccguagaacagguggaagagaugcaaaagaguuuggcugugaaaucgcaagaauugcaagcgaaaaacgacgccgccaacgccaagcucagacaaauggugaaagaucagcaagaagccgaaaagaagaagguucaaagucaggaaauccaacagcagcucgcucagcaaacugugcacaucaagcagaagaaauccgaaguaauggccgauuuggagcaaguagaaccggccgucaucgaagcucagcaagccguaaaauccaucaagaaacagcaacugguagaaauccguaccaugucgaauccuccagcucuaguaaaacuagcucucgaaucaauuugccugcuauuaggagaaaacgccagcgacuggaaauccauucgagcugugaucaugagagacaauuucaucaacagcgugguuaacuucaacaccgaagacauuggugacgauguaagagaaaaaaugaagagccgcuaccugagcaaccccgauuacaacaucgacaaaaucuaccacgccaguaacgccugcggcccgcuggugaagugggcuugcgcccaagucgaguacgccgacaugcugaagaaggucgagccgcugcgugaagagcucaacucucucgaaacccaagccgaaaccaaccagaaacgcggcgaagacgucaaaguccucaucagccaauuagagcaaaguaucgccucauacaaagaggaauacgcccaacugaucgcccaagcucaagccaucaaaaccgauuuggagaacguccaggccaaagucgaccgaucgauagcccuccucaaaucgcucguuauagaaagggagcgaugggaggccagcagcgagaccuucaggucccaaaugucuacuaucaucggagacguucuguuaucagcagcuuucauugcguacggaggguacuuugaccaacauuaccgucagaaccucuucagcaccuggugccaacaucuaacuuuagcuaacauccaauacagagccgacaucgcuagaacagaauacuuaucgaaccccgacgaaagacucagauggcaagcuaaugcuuuaccuucggaugauuugugcacagaaaacgcuauaauguuaaagagauucaacagauacccgcucauuaucgacccuucaggucaagcuacugaauucauaaugaacgaguucaaggacaagaagaucaccaagacgaguuucuuggacgauuccuucaggaagaaccuggaaucagcccugcguuucggcaacccccuucuaguccaagacguggaaaacuacgacgccauauugaacccggugcucaaccgggaacucagaagaaccggcgggcgugugcugauaacccucggcgaucaagacaucgauuuaucgccuuccuucgugauuuuccucuccaccagagaccccacuguugaauuuccuccagacauuugcuccagagucaccuucgucaacuucacggugaccaggagcucguugcagagccagugcuugaaccaagugcucaaggccgagcgacccgacaucgacgccaagcgaucggaccugcugaagcugcaaggggaguuccaccugcgguugcggcagcucgagaagucgcuuuugcaggcgcucaacgacgccaaggggaagauucucgacgaugacagcgucauuacuacguuggagacgcugaagcaggaagccgccgagaucgggcagaaggucgaggagacugauaagguuauuucggagaucgagacgguuucucagcaguacuugccguugucgcaggccugcaguaacacuuacuuuacuauggauagcuugaaucaagugcauuuccuguaucaguacucuuugaagauguuuuuggauguguuugcuacuguguugcacaauaacgugaaguuggaugggaucaccgauuaccaagcuagauugaacgucaucaccaguaacuuguuuucgguuguuuaugagcgaguagcaagaggaaugcuccacaacgaccgcaugacguucgccauuuuacuaugcagaauccacuuaaaaggacgaccuacagaaccuaaccuagaccaagaguucaacuucuuccucagaggcaaagagggcgucuucagcagcaccaacucggccaucgucgacgguuugaacagcgaccaacaggaagccaucacgaggcucuccaccaagcuacccgcguucaaaaaacuccccgagcagaucaaagacaugccggaguucggcgcguggcugcagcagagcagccccgagcaggccgugccgcagcuguggaucgaagagaagcagcugagcgccgugggcaggggcauguaccagaugcuggugauccaggcguuc

SEQ ID NO: 6026 - RNA, 2016 nt, Phyllotreta nemorum
augcccggaagcagcgaaaagaaaguccccgaacuauccgaaguacaaaaaaagaaacucaccaucgaggaaacgaaaaaaagccuacccaucuaccccuucaaagacgaucuaauacaagccguuaaagaguaccaaguguugauuauaaaaggcgaaaccgguuccggaaaaaccacccaaaucccccaguaccuccacgaggccggcuucaccgccgacggcaagaaaaucggcugcacgcagccucgcagagucgccgccaugucaguagcagccagaguagcccaggaaauggacgugaagcucggcaacgaagucggcuacgccaucagguucgaagacugcacguccgaacgaacuaucaucaaauacaugaccgaugguacccugcacagggaauuccugucggaacccgaccugcaguccuacagcgucaugaucauagacgaagcccacgaaaggacccuccacaccgauauuuuauucggauuggugaaagacauagccagguucagaccggacuugaagcuguugauauccagcgccaccuuggacgucaccaaguucuccgaguucuucgacgacgcuccggucuaccaaaucccaggccguagguucccaguggacauuuacuacaccaaagccccggaagcggauuacguagacgccugcgugguuuccauacuccaaauccacguaacucaaccguugggggacauccugguguuccugaccggccaagacgaaaucgaaaccugccaagaacuccugcaggaccgaguaagacgcuugggcuccaaaguaaaagagcugaucguacugccuuuguacgccaaccuucccagcgaccugcaagcuaaaauauucgagccgaccccuccgggagccaggaaggucauucuggcuacgaacauugccgaaacuucgcuuacgaucgauaauauuaucuacgugauugauccagguuucgccaagcagaaucacuucaauuccaggaccggaauggagagucugaugguggugcccauaucgaaagcuucggccaaccagcgagccgggagggcugggaggguggcggccgggaagugcuucaggcuguacacggccugguccuauaagcacgaguuggaggaagcgaccguuccggagauacagaggaucaauuuggggaaugcaguguugauguugaaggcguuggggaucaacgauuuggugcacuucgauuuucuggacccgccuccgcacgaaacgcucguguuggcucuggagcagcuguacgcuuugggggcucugaaucaucacggggaauugacuaaauuggggaggaggauggcugaguugccgguggaucccaugauggcuaaaaugauauuggcguccgaaaaauacaaguguucugaagaaauagucacgauaggcgccauguugucggugaacggggccauauuuuacagaccgaaagacaagauuauccacgcagacacagccaggaagaauuucaaucaccuggcuggcgaucacuugagccuucugaacguuuacaaucaauggagagacuccgauuacucgcugcaauggugcuacgaaaauuuuauccaacacaggucgaugaaacgagccagagacgucagagagcaacuagucaaucuaaugaccagaguagaaaucgaaauagugucgggaaucgaagaaaccgacaacauucgcaaagccaucaccuccggauacuucuaucacauagcgagguuuucgaagggcgggagcuacaaaacggugaagcauaaucagagcguuaccauucacccgaacagcgcuuuguucgaaacgcugccgcgguggguguuguaccacgaauugguguucacgaccaaagaguucaugaggcaagucaucgaaaucgagagcaaguggcugcuggaaguggcuccgcauuacuacaaggccaaggaauuggaggauucuaccaauaagaaaaugcccaaaacuguuggaagaaguaaaaugacugauuga

SEQ ID NO: 6027 - RNA, 1371 nt, Phyllotreta nemorum
augaagguagaagaggugaaaagcaccgugaaaacucaaagaauaagcgcccauacucacauaaaggguuuggguuuggaugaagcggguuuugcaauccccucggcggccggccuggucggccaggagcaggcaagagaggcugcgggagucgucguggacaugauaaggagcaagaaaauggccgguagggcuguccuucuggcuggcccuccagguaccgguaaaacagccauagcucuagcaaucgcccaagaacuaggcaacaaaguaccguuuugcccuauggucggcucggaaguguacagcacagaaauaaagaaaaccgaagugcuaauggaaaauuucagacgagccauuggccuuagaauuagagaaacgaaggaagucuacgaaggagaagucagcgaacugacaccugucgaaacagaaaauccagcaggagguuacgguaaaacuguuagucacguuguaaucgguuugcggacagccaagggcagcaagcagcugaaacuagaucccagcauuuacgaagcccugcaaaaggagaaaguggaagugggagaugucauuuacauagaagccaccaguggggcuguuaaaagacagggaagaucugaugcguacgcuacagaauucgaucuagaagccgaagaauaugugccgcuucccaagggagaugugcacaagaaaaaggaaguuguacaggauguuacuuugcaugauuuggaugcugcuaaugcaaaaccacaggguggucaagacguguuguccaugauggggcaacuguuaaaaccaaagaaaaccgaaaucacagacaaacucagaaaagaaauaaauaaaaucguggacaaauacauugaucaagguauugcggaauugguaccaggaguauuauucauugacgaaguucacauguuggauauagaaacguuuacauaccuucauagagcuuuggaaagcgcuauagccccuauuguuauuuuugcuacuaauagaggucguugucuuauuagaggaacagaugauguauuuucuccgcauggaauuccauuagaucuucuggauagacugcugauuauacgcacaauuccuuacaacaaaucugaaauggagcaaauuauuaaauugagagcuguuacagaagguuuggaaauugaggaggaagcaaucucaaguuugggagaaguugggacaaaggccacccugagauaugcgguucagcuuuuaacgccgucguuuuuaacagcuaaaauuaacggaaggagcaacauucugcaaagcgacguggaggagauuggcacucuauuccucgaugccaaaucuucugcuaaaauacuuacugaacacaaagauaaauuuaugacguaa

SEQ ID NO: 6028 - RNA, 1581 nt, Phyllotreta nemorum
augacuucaauaauaaaaguacaagccuuauccggcgccaaagaugaaucucccccuuguuaucuauuacaagucgacgacguuagaauucuuuuagauugugguugggaugaaaaauuugauauggaauuuauuaaagagcucaagaggcacguacauacgauagaugcuguguuaauuucuuacccggauaacuaucauuugggggcucuaccauacgcaguggguaaauuaggcuuaaauuguccaauauacgccacuauaccaguguacaaaaugggucagauguuuauguacgaucucuaccagucucaguacaauaugaaggaauuuuguauuuuuucucuugaugaugucgaugccacuuucgaaaagguuguucagcuaaaauauaaccaaacggucccuuuaaaagguaaaggauacggcauaacuguuacaccucuaccagccggucauaugaucggaggaaccauauggaagauaaugaaaguaggcgaggaagauauuguauacugcaacgauuuuaaccauaaaaaagaaaggcacuugaacgguugcgaacugaagaaacuucaacgaccaucauuacuuauaaccgaugccuuuaaugcaacauaucaacaggccagacgacggacgagagaugaaaaauuaaugacaaauauucuccagacuuuacgaaaccacgggaacguccucauagccguagacacugcuggaagaguacuggaauuggcucacauguuggaucaacuguggagaaacaaggaaucggggcucuuggcuuacucuuuggcuuuuuugaacaacgucaguuacaauguagucgaauuugccaaaucgcaaauagaauggaugagcgauaaccugaugaggaguuucgaaggagccagaaacaaccccuuccaguucaaauauuugcagcuaugccacaguuugggggaacugagcaaagugccaaguccgaaggugguacuggccagcucgccggauuuggagagcggguuuuccagggaacuguuucuacagugguguuccaauccaaauaacaguauuauuuuaacuacgaggaccucaccuggaacguuggccagggauuuaauugacaauggaggaggaaggaccauagacuugauaguagagcgaagaguuaaauuggaaggacaagagcucgaugaguaugaaagacgacagcggucuaaauaugacaaacuagaggaugaggaagccgauucugauucggauucagauauugaaauguuggucacaacuaaaggcaagcacgacauucuuaucaaacaagaaggcaaaauauccacaggauucuucaaagugaccaaaaaaauguacccgauguauccuuucaaggaagauaaaauaaaauccgacgaauacggcgaaauagugaaagcagaagauuacaaguuagcugaaauuucagcugaaacagaagauaacaaagagaauaucgugaucaaaaaagaggaagaagaaauaaguaaacauuacucauuuauuuauuuauuuauuuuauuuuuuccaagaaaauugcaguacagagaaauaaauauaaauuag

SEQ ID NO: 6029 - RNA, 2283 nt, Phyllotreta nemorum
augccuccucuggagguaacagcgaacaccaacaacgacgacucggcccccaucaacccggucgucggaauaaucuaccccccgccggagguuagaaauaucgucgacaaaaccgccagcuucgucgcccgaaauggccccgaauucgaagcccgcaucagacaaaacgagcucggcaaucccaaauucaauuuccucaauggcggcgaucccuaucacgccuacuaccagcacaaagucaaagauuucagagaaggaaaaggacaagaaccuacgccggguuugagccaggccguggcgaaguugucggugagcgcuucggcucagcagaagcagcaggagauauugaagcagguggagcagccguucgugccgaaagacccgccggcugaguucgaguuuauagccgauccuccuucgauuucagcucuggauuuggauaucgugaagcuuacggcccaauuuguagcgagaaacggccgggcuuuccucacgcaacugaugaacagggagcagagaaacuuccaguucgauuuucugagaccccagcauucgcucuuccaguauuucaccaagcuucuggaacaauacaccaaggugcuuauuccaccgaagagcauggagcagaggcucagagacgaagcgaaaagcgccaaggccgugcuggagcaggucaaguacagggccgaaugguugcgguaucaggaacagcaaaaggccaaggaagaggagauacucgaacgagaaaggguggcuuaugcucaaauagauuggcacgauuucgucgugguggaaacaguggauuaccaaccguuugaaauagggaauuucccuccuccgacgacgcccgaagaagugggagcgaggauauugauacaggagaggaucgaagaaggcgaagauaucgaaaugcagcuggagagcgacgaagaagaugauccuucgaacgcugaugaugguuugagcuccaugcaggauaagacgaaacgcaaaggaggcgaugauaauaggcugcaggacauggaagaagacacuucugaugaagauaaugaugaugaaguugguaaaacuucgacuucgucuucgcucauucaaccgccuuugccgcccauacccgauaaagugcucguuaaaaaauacgaucccaaacaagcugucaaaguauccagacccacaguaggcgacgauuauuuaguaucgccaaucacaggcgagaagauaccggccagcaaaguacaggagcacaugcgcaucggccuacuagacccgagaugggucgaacaaagagacaaacaaauguccgauaaaaugaaucaagacacgguauacgcagccggcagcgccaucgacgccucgcugaagcugcuggccgaacgacguacggacauauucggcgugggcgacgaggagacggccaucggcaagaaaaucggcgaagaggacgugcgaaaggacgagaaggucacgugggacgggcacacgagcagcgucgaggcggcgacgagggccgcccgcgccaacaucaccuuggaagagcaaauacaucagauucauaaggugaaaggccuuuuaccugaugaggagaaggagaagaucgguccgaagaacauugguucgaagaaaaucaauauacaaagcguaauuacuaccaaaccgcccaauccaucuaaucaacaacccaaacagcccguuucgaucauccaaucgagcgcccagccgaucaugccgguuccaacgcaaccuacgaugcucgccccgcaaccguccaucaugaugaugcccgccccucccaugccuaccauacguccgccgccuuugaugaugcccggcgguguggcgaugggaggguauucgguggggccgaugcccggccagccgggucccggcaugaacauggcgcccaugaaacaucccggcgacggucccggcgaagaggagccuccuaauaagaaauugaggaacgaggauucguuggugccggaaaacguguuuuuauccaggaauccgagccaaguguccaucaagauuuccauaccgguuaugccggagaaauccgaauggcgguugaagggccaaacguugucguggacuuuggcgcucacggaaucggucucgaauuugaaggcgaaaauccaggaggagacgaacaugccgccggcgaaacaaaaguuauuuuucgacggaauguucuucaaggacuccaacaccuuggccuacuacaacgucacgcaaggcgccgucauccagcuacaaaucaaagaacgaggcggaaggaagaaauaa

SEQ ID NO: 6030 - RNA, 984 nt, Phyllotreta nemorum
augccgaguacagagguuacaacgacuaagguaauagugcacccgcuggugcuucucagcgugguggaccauuucaaccgaauggggaaaaucggcaaucaaaagcgcguugucgguguucuacucgguugcuggagggcuaaaggagucuuggauguguccaacaguuuugcagucccuuucgaugaggacgacaaggauaaaucuguaugguuuuuggaccacgacuacuuggaaaacauguacggcauguuuaagaaagugaaugcuagagaacgcgucgucgguugguaccacacgggcccuaaauugcaucaaaaugauauugcgauuaacgaauugauucgaagauacugcccgaauuccgugcuggugauuauugacgcuaaaccuaaagauuuggggcuucccacugaagccuaccaagcgguagaagaaguccacgaugauggcucucccacguccaaaacauuugaacacgucccgagcgaaaucggcgccgaagaagcugaagaggucggcguggagcauuuacugagagauaucaaagauacuacagugggaacuuuaucccagaggaucaccaaucaguuauuaggccuuaaagggcugcauuugcaauugagagauauaagagacuauuugaugcaagugugcgauaauaaauugcccauuaaucaucagaucaucuaucaguugcaggauauuuucaauuuguugcccgauauaaaccaagaugcguucaacaauucguuuuauguuaaaaauaacgaucaaaugcuuguaguuuauuuagcggcucucguucgaucuaucgucgcacugcacaaccuaaucaacaacaaacucaccaacagagacgcggaggaagguaaaaaggaagagaaaaaggacaaggauaacaaggauaaagauagcaaagacaaagauaaggaaaaaacggauaaggacaaggaggcgaagaaggacgagaagaaaaaauaa

SEQ ID NO: 6031 - RNA, 1653 nt, Phyllotreta nemorum
auguuuggaggaggacgcgccccgauuuuaguguugagccagaauacaaagcgcgagucgggccgaaaaguucaguuggagaacaucaaugccggcaagcaaaucgcggaugucauuaggacaugucucgguccacaagccauguuaaaaauguugauggaccccauggggggcaucgucaugaccaacgacggcaacgccauucugcgagagaucaccgugcagcauccugcugcuaaaaguaugauagaaauagccagaacccaagacgaagaggugggagauggaaccacuucuguaauaguauuagcuggagaaauguuggccgcugccgaacaguuccuugaacagcaaauucaccccacgaucaucauccgacaauacaggcaggcccuggaagauauggugcaguuucuggaagguccuuugagcgugcccuuggaccgaaacgacaaaaacgccauagcugaagugguuaaagguugcauuggaacgaaguucuugagcaaauggucggauuuggccgucaauaucgcuuuggaugcggugaauaccgucuuauuggaagaaaacggucgaacggagguggauaucaagagauacgccaaagucgaaaagauuccuggugguucgguggaggacuccaagauuuugagaggcguaauguugaacaaagacguuacccaucccaaaaugaagcgacacauuaagaauccgagaaucauccuuuuggauugcgcuuuggaguacaagaaaggagaaucucaaaccaacguugaaauuaguaccgaaaccgauuucaccaaacuccucgaauuggaagaagagcacgucaagcgccaaugcgaagagauuaucgcccucaagccggacguuguguucaccgaaaagggaguauccgauauagcccagcacuuccugcucaaggccggcaucacugccaucaggcgugucagaaaauccgacaacaaccgaaucgcuagagcuugcggcgccgucaucguaaacagaaccgaggaacuccaggaguccgacgugggcaccggagcugguguguucgauaucaaaaaaaucggcgacgaguacuucuguuucgucgacgaaugccaaaauccaaaggcuuguacgauccuccuccgaggagccagcaaggacauucugaacgagaucgaaagaaaucuucaagaugcccugcaaguggccaggaacauuguauugucuccgcgucuagugcccggcgguggggcuaucgaaauggccguagcccaacgguugaugcagaaggcuacgcacggucccuacagggcgcuugcgcacgcuuuggaaaucauuccgaggacguuggcgcaaaauugcggcgcuaauaccaucagaacguugacggcccugagggccaagcacgccaaccacacugaaaccgacaagccgugcacuugggguaucgauggugaaacuggggaguugguugauaugaaaguuaaaggcuugugggagccguuaucugugaaacuucaaacuuacaaaaccgccguugagacagccauucuccuguuacguaucgacgauauuguaucgggauccaaaaagaagggcgacaaggaggucccgacgcccagccagaugcaacagcaggaaaccaaagagacggauuaa

SEQ ID NO: 6032 - RNA, 702 nt, Phyllotreta nemorum
augaugcaaacaggaguacgucccuauuaucccgacuauucuacaguucccauggaacgccagauuaauccuuacgcugauaauggagggagcgucguagcgauugcaggaaaagauuucgugguuauuggcgccgauacgcgucuuaguuccggcuuuuccauauacacuagaaaccagaacaagcuguucccucuuucugaaacgacuguuuuaggauguucagguuguuggugcgauacuuuaacgcugacucguauuuuaaagucucgcaugcaaauguacuaucaagagcauaacaagaacaugucuacgacagcggcugcucaaauguugucgaccaugcuguauuacaagcgauuuuucccuuauuacauaucgaacauucucguuggauuggauaaugagggaagagguugcgucuacagcuacgaucccguugggcauugcgagaaagccaccuacagagcaggugguucugcaggggcuuugcuucagcccuuauuggacaaucaaauuggacaaaaaaaucugcagaagccuucgcaggaagaucuuacucaggaaaaggccauuucuacgcugaaagauguuuucauauccgcugcagagagggauauuuacacuggugauaguguacuaauuaaaaucauuacuaaagauggaacuaaagaagaaacauuugaucugagaaaagauuaa

SEQ ID NO: 6033 - RNA, 900 nt, Phyllotreta nemorum
auguuccaauucggcuucaacauguucccggacaucccgcgccccuucaacaugaccuacaagugcuacucgguggccauguucccgggaaacgagcggcaggacgucgaacgcggaggaaaaauaaucaugccgccuucggcgcuggaacagcucacuagauuaaacaucaacuaccccauguuauuuaagcuuguuaacaagaagacgagccguacgacucauugugguguuuuggaguucguagccgacgaaggaaaagucuacuuaccauuauggaugaugcacaauuuggugcugaccgagggagauuuaguucaaauggaaagcguaucguugccggucggcacguucucgaaauuccagccguuaaacccggacuuccucgacaucaccaacccgaaagccgugcuggagaauugccugcgguccuuugcuugucugaccaccggcgacgugauagccgucagguacaaucaaaaggcguacgaauugugcguguuggaaaccaagccgggcaacgccaucagcauaaucgaaugcgacaugaacguugaauucgcggccccgguuggcuauaaagagcccgagcaggcuaaaaaagaagaagaaaugucgguggaucccgccgacuugaugccggagccgucgggguucguggcuuuuagaggggcugggaaccgauuggacgggaagaaacggaaggauucgucuucgagcgacgcuccuucggcuaagccggcuuacguucgggggauacccgauuacgauuaucaaauaggcacgcuggacuuuaucaggcguacgauagcgaagccuaaggaaaaggagggcagcgaugacggggaugauuuuaaggcuuuuagcggcaccggguuuaguuugaggaguaggaauuag

SEQ ID NO: 6034 - RNA, 1623 nt, Phyllotreta nemorum
augucggcuuuaccaggagcuaucgcuuucgacgaauauggaagaccguuuauaauuuuaagggaccaagacaagcaaaaacgauugaccggaaucgaugcccugaagucgcacauuuuagccgcaagucaaauugcucacacuguucgcaccucucuggggcccaaaggccuagacaagaugaugguauccucugauggggaaguuacuguuacaaacgauggggcuacgauuuugaagaugauggauguugaacaugaaguagcuaaauugcuaguucaacuaucucaaucccaggaugaugaaauaggugauggaaccacugguguaguaguauuagcaggggcucuucuggaacaagccggcgcucuccuggaccguggaauccauccgauaagaauagcugaugguuucgaauuggcaugccaaacggcuguggaacaucuagagaaaaucgcugagcuguuuccaguuucugcugaaaacaccgagccccuuauuaaagucgcgaugacuacacuagguucgaaaauaauuaacaaaugucacaggcaaauggccgaaauugccgucaauggcguauuagcuguagcggaucucgaacaaaaggaugucaacuuugaacucauuaaaguugaaggaaagguuggugguaaauuggaagacacgacauuagugaaaggugucguuauagauaaaacaaugucucauccucaaaugccgaaggagcuaaaggauguuaaauuggccauccucaccugcccguuugaaccucccaaacccaagaccaagcauaaguuggaugucaccagcguagaagacuacagagaacugagauuguacgaacaagaaaaauucaaggaaauuguucgccuggucaaaaaaucgggagcuaccuuggcuauuugccaauggggauucgaugacgaagcuaaccauuugcuguugcaggaggaguuaccugcuauaagauggguuggaggaccugagauagagcugauagcuaucgcgaccggaggaagaauaguuccacgauucgaggaacuuagcccugaaaaacuugguucggccgguuuggugcgugagauauccuuuggaaccaccaaagauaagaugauggugauugaagauugcucgaauucccgugccguuaccauucuugucagaggugguaaucaaauguugguugaugaagccaagaggaguuuacaugaugcucuguguguugugaggagucucauucaggaaccgagagucguguauggaggaggugcagcugaaauagcuugcaguuuagcuguggcagcucaagccgaucagcuagcuucuuuggaacaguacgcuuaucgagcauuugcugaagcuuuggaaagcauuccgcuggcccuggcugagaauucaggauuuucugccauccauucuuugggagaaaucaaggcgaagcaagcugcuucgggagauccggcacuuggcgucgauugcaugaauacuggcaacauaaacaugagggaacagcauguuacagaaucucugcgauccaagagacaacaguuguuauuggcuacgcaauuagugaaaaugauucugaaaauugacgauguacgucagcccggcucuggcuaa

SEQ ID NO: 6035 - RNA, 342 nt, Phyllotreta nemorum
auggccaaugcuauggacgucgauuccgaagaaauugaauuaccaacuucaagcaguucgaaaggcgagaaaaaacgauucgaagugaaaaaguggaaugcuguagcacuuugggccugggauaucguuguugauaacugcgcuauaugccgaaaccacauaauggauuugugcauugagugccaggcaaaucaggccucugcaacuagcgaggaaugcacuguagcuuggggaguuugcaaccacgcuuuucacuuucacuguauuucaagaugguuaaaaacuaggcagguaugcccuuuggacaauagagaaugggaauuccaaaaauauggucacuag

SEQ ID NO: 6036 - RNA, 1605 nt, Phyllotreta nemorum
auggugucauuaaaccccguaaggauucucaaacaagaggccgaagacgaacggggcgaaauagcgcguuugagcagcuucgucggcgccauugccauuggagauuuggucaggaguaccuuggggcccaaagguauggacaaaauucuuguaucgagcggcagaaacuccgggaugguagaagucaccaacgacggggcuaccauuuuaaaauccgugggcgucgauaacccggcugcgaaaauacucguuaacaugucgaaagugcaagacgacgaaguaggcgauggcaccacaucaguuacaguauuugcgucagaauuauuaaaggaagccgaacguuugaucgagcaaaagauccacccgcagaccaucauagccgguuggagaaaauccguggauaucgcgagaaaagcgcuuuuggaagcuucugcagacaacagcgccgauuuagaagccuuccgagaagaucugaugaacaucgcccgaacgaccuugagcucgaaaauucuaucccagcacaaagagcacuucgccaagcucgccgucgacgccgugcugcgauuaaagggauccggcgacuugcaagccauccagcugaucaaaaaaaccggcgggugccugcaagauuccuuccucgacgaaggcuuccugcucgacaaaaaacccggaguacaccagcccaagcgagucgagaacgcuaaaauccuaaucgccaacacuccgauggacacggauaaaaucaaaguguucggcucgcacaucaaagucgacucgauggccaaaaucgccgaacuggagucagccgagaaagacaaaaugaaagacaaggucaacaagauccuccagcacaaagccaacgucuucaucaaccggcaacucaucuacaacuaccccgagcaguuguucgccgacgccggcguaauggccauagagcacgccgacuucgacgguaucgaaagacuggcgcuggucaccggaggagaaauagucucaacauucgaucaccccgagcuggugaaacuuggaacuugcgacuugaucgagcaagucaugaucggagaagacacucugcugcguuucagcggaguggccuuaggagaagccugcacgauagucauucgaggagccacccagcagauuauagacgaggccgaucguucccuacacgacgcccucugcguacuagccgcuaccguaaaagagagcaggauugucuucggaggcgguugcagcgagacucuaauggcuaccgcuguggcuagagcuuccgugaauacggccggaaaggaagcguuggccauggacgccuucgccagggcucugcugcagcuaccgaccaucauagcugauaaugcggguuacgauucggcucaguugauuagcgagcucaaggcggcgcacaacagcgggcagagcacuaugggguugaauauggagaagggggagauaggcgauaugcgggcguugggcaucaccgaaucguucguugugaaacggcagguguugauaucggccggugaggcugccgagaugauucuucguguugauaauaucaucaaggcggcgcccaggaagcggaccgaagacagaggaauguguuga

SEQ ID NO: 6037 - RNA, 840 nt, Phyllotreta nemorum
auguucagaaaucaauacgacagcgacguaacaguauggaguccacaaggacgucuucaucaagucgaauaugcaauggaagcgguuaaucucgguucggcaacgguaggacuaaaaagcaacagucaugcuguuauaauagcauugaaaagagcuucauccgaauuauccgcuuaccaaaagaagaucauucaaaucgacgaucacaucggcauuacuauaucuggucugacagcagacgcaagaauuuuaagcagauauaugagaaacgaauguuuaaauuacaaguacuccuuggacgcuuacaugccauugaauagauuaauaaacauauuagguaucaaaaugcagcauuguacgcaaagauacgaucguagaccguucgguguaggucuauugguagccgguuacgaugacaacggagcccacauuuaccaaacauguccgucugcuaauuucuacaauugcaaggccaugucgaucggagcucgaucucaaagcgcucgaacuuauuuggagaagaaacucgacgaauuaaauuuguguucuuuagaggauuugauuaaacacgguuugagagcucucagagauacucuuccuccugaagucgauuugaauacgaagaacgucuccauaggauaugucgguaaagggauuaccuuuaaaauuuuggaagaagaagaaacugcuccuuaucuugcuuuaaucgagggugaagaacgucgaggugguggcgguggaggagggaguucggaaguacaagcugauccuuugagagaaucgggggacgauggucccaaggaucccauaccgacuguagcaauggauacuacggaauaa

SEQ ID NO: 6038 - RNA, 2613 nt, Phyllotreta nemorum
aaaaaaaaaaaaaaaaaaaaaaaaagagcgauuuguuuuaaauuuauuucaaaaaugguuuuaaagccgggaaguaaacaggaaccuauggaaauaacuuucaacgacgaugauuugccuuacgaggaagaaauuuuacgaaaucccuacucggugaaacacuggcuucgauacauagaucacaagaaaacggcucccaacaacgaaacgaacauaaucuucgaaagggcccucaaagaauuaccggguucguacaaauugugguacaauuaucuacggaccagaaggaaucaaaucaaaagcaaaugcaucaccgauccggguuucgaagagguaaacaacgccuucgagcguucgcugguauucaugcacaagaugccucguauuuggauggacuacugcacguuccucaccgaucaauguaaaauaacgagaacucgaaagguuuucgaccgggcccuucgagccuuacccguaacucagcauaacaggauauggccuuuguauuugaaauucgugcagaaacaugauauaucagaaacggccguucgaguuuucagaagguauaugaaauugugucccgaaaacgccgaagaauacaucgauuaccuaacgaaagcagaacgauuagacgaagccgcuauaauaacagcuaaaauaguaaacgacgauaauuucgugucccaacagggcaaaucgaaacaccaacuguggaacgagcugugcgagcugauuucgaaaaacccggaaaaaguucgcucgcuaaacgucgacgcgaucauaagaggcggccugcgaagguacaccgaccaauugggccaccuguggaacucuuuggccaauuauuacguucgcagcggcuuauucgaacgggcuagagacauuuacgaagaggccauccaaaccguuacgaccgucagagauuucacccaaguauucgaugcguacgcgcaauucgaagaauuaagucugagcaaacgaauggaagaaguggccggcaagcggaaucccagcgaagaagacgauacggaguuggaauugagauuggcgcgauucgaguaccucauggaaagacgauuguugcugcuuaauucgguguuguugcgacaaaauccgcacaacgugcaagaguggcacaaaagaguacaacucuacgaagguaaaccucaugaaaucaucaacacguacacggaagccgugcaaacagucgaucccaaauuggcggugggcaaguugcacacgcucuggguggaauucgccaaguucuacgaaagcaacgaucaaaucgaagaggcccggcugauauucgagaaagccucgcagguccccuacgugaaagucgacgaucuggcuacgguguggugcgaauggaccgaaauggaaauucgcaacgaaaauuacgaccaagcuuuaaaacucaugcaaagagcgaccguaaugccuagccguaaaguggccuaucacgaugacaccgaaaccguucaaaguagacuguacaagucccuuaaaguuuggucgauguacgccgauuuagaagaaagcuucggcagcuucaaauccugcaaggccaucuacgacaggaucaucgaacugaaaaucgccacgccgcagauaaucaucaauuacgucgugguucuggaagaaaacaauuauuucgaagaagccuucagggcuuacgagaagggcauuucucuguucaaauggccgaacguauacgacauauggaacaccuauuugaccaaguuucugaaacgauacggcgguaguaaauuggaacgggcgcgagauuuguucgaacaauguuuggacgguugucccucgcgauucgccaaacaccucuauuuguuguacgccaaauuggaggaggagcacggaauggccaggcaugcgauggccguauacgaaagggccacugaagccguaccggagaaugagauguucgacauuuucaacauauacauaaaaagagccgcagaaauauacggcauaccgaaaacgaggcaaaucuacgagaaagccauccagguccuucccgaggauaaaacaagggaaaugugcuugagauucgccgacauggaaacgaaauuaggcgaaaucgaucgagccagggcgauauacgcgcauugcagccaaaucugcgauccucgagugacggccgaguucuggcaaauuuggaaggaguucgaagugcgacacggcaacgaggacacgaugagggaaauguugaggaucaaacgcagcguucaagccguuuacaacacccaggugaacaugaugucggcucagauguugagcuccgcgggcggcucgagcgguaccguagcggacuuggccccggggguuaaagacggcaugaggcuguuggaggcgaaggcggccgagauggccggcucggccucggcggcgcagaaauccaacauaauguucgucagaggcgaaacucaaggagauaauaaagacaaaguggucaaucccgaugaaauugauaucggaagcgaggaugacgaggaagaggaggaggagguggagauuccguuggagaagcaaaacgugccguccgaaguguuuggaagucucaagaaaagagggaacaaugaggaugaggaugauuaa

SEQ ID NO: 6039 - RNA, 906 nt, Phyllotreta nemorum
auggcgaacggaccgauagccgaaagaaauagagacgcuacuauauacgucggcgguuuagacgauaaaguaucggaaucccugcuaugggagcuguucguacaagccggaccauuggugaacguacacaugcccaaagaucgcgucaccaugaugcaccagggcuacgguuuuguggaauucaugggcgaagaggacgcagauuaugcuauaaaaauaaugaauaugauaaaauuguacggaaaacccauaagagucaacaaagcuuccgcucaucaaaagaacuuggacgucggagccaacauuuuuauagggaacuuggacccggaggucgaugagaaacucuuguacgauacguuuucagccuucgguguaauauuacaaacgcccaagauaaugagagauccagagacugggaauuccaaaggguucgcguuuaucaacuucgccagcuucgaagccuccgaugcuucaaucgaggccaugaauggccaguaccucugcaaucgaccgauaucuguuuccuacgcauucaagaaggacucgaagggcgagagacacgguucggccgccgagcgauuguuagccgcccagaacccgcuaucgcaggccgacaggccccaucagcuguucgcagacgcuccaccgauaggaaugaugccgaugagcauggcgccgcccccaccgccucuaaucaccggcaugaugccucccccuccgccaacuccuggcggaaugccgcccccuccgccgccggucccuccaccgagcuccuuccccgcuggcauaccgccgccgccguuaccgccuucucaaccgccccugccaccgggcgcgccgcccacgauggcggcugugcccggcgguggagccagaccuccgccgccgccuccgugguccggugcu

SEQ ID NO: 6040 - RNA, 774 nt, Phyllotreta nemorum
augggucguguuauucgagcacaacguaaaggugcgggauccguauucaaaucccacacuaaaaggaggaaaggagcacccaagcuccguuauuuggauuucuccgaaaggcauggcuacaucaaggguguagugaaagacaucauccacgaccccggucgcggcgcccccuuggcucuaguucacuucagggacccuuacaaguuccaaacuagaaaggagauauucauugcccccgagggaauguacacagggcaauuuuuguacuguggaaagaaagcuaaccuccaaauuggaaauguguugccuguaggaacuaugccugaagguacaauugucuguaauuuggaagaaaaaacuggugaccguggccgauuggcucgagcaucugguaacuacgcaaccgugauugcccacaaucacgauacaaagaaaacuagaguuaaauugccaucaggagcuaagaaaguuaucccaagcaacaacagagcuaugguugguaucguugccggugguggucguaucgacaagcccauccugaaagccggucgugccuaccacaaauacaaggugaagcguaacugcuggccgaaggugcgugguguugccaugaaccccgucgagcauccucacggaggugguaaccaucaacacauugguaaagccuccaccgucaagagaggaacguccgcuggucgcaaggucggucuuauugcugcgcguaggaccggucguaucagaggagguaaggucgaaacuaagaaggacgauuaa

SEQ ID NO: 6041 - RNA, 411 nt, Phyllotreta nemorum
auggcgcguaccaagcaaacggcucgaaaaucgacgggagguaaagcuccuagaaaacaauuagccacgaaagcggcccgaaaaagugcuccggcaacgggaggaguaaagaaaccucaucguuacaggcccgguacgguagcucuucgagaaauuagacguuaccaaaaaaguaccgaacuccugauuagaaaauuacccuuccaacguuuagugagagaaauugcccaagauuuuaaaaccgauuugcguuuucagaguucggcuguuauggcguugcaagaggcuagugaagccuauuuggucggucuuuuugaagauaccaaccugugcgccauucacgcuaaacguguaacgaucaugccuaaagauauucaauuggcaagaagaauucguggugaacgugcuuaa

SEQ ID NO: 6042 - RNA, 1593 nt, Phyllotreta nemorum
auggcaauaaguuuauugaauccaaaagcugaaguggcgagagccgcccaagcguuggccguuaauauaacugcagccaaagguauuucugaagugaugaaaaccaacuugggaccgaagggaaccaugaaaauguugguguccggugccggugacauuaaaauaaccaaagacggcaacguucucuugcacgagaugcaaauccaacaucccacggcuucguuaauagccagagcuucgacggcucaagaugauaugacuggugacggaaccacaucuaccguuuuaguuaucggggaacuccugaaacaagccgacauauacaucgcagaaggcuuacaccccagaacacucacagaagguuucgacaaagcgagagcaaaggcccuagaaauuuuggagaagcugaaaguacccaucgaaaucaacaaagaaucguugacugauguuugucgaacaagcuuaagaacaaaauugcaccaaaauuuggcugaccuccucacugaugugugcgucgaggccauucucgccaucaaacaguccgacaaaccagucgacuugcacaugguggagcucauggaaaugcagcacaaaaccgagaccgacacucagcuggucaaaggauuggugcucgaucacggcgcucgucaccccgacaugccgaagagcuugaagaauuguuacauccucaccuguaacgucagcauggaguacgaaaagagcgaagucaauucgggcuucuucuacaaaaccgccgaagagagggagaaacugguguuggccgaaagagacuucauugaacagcgaguuaagaaagucgucgaguugaagaaggcucuuugcaaaggcacaaacaagacguuuguuguuauuaaccaaaaagguauugaccccaugagcuuggacaugcuggccaaggagggaaucauugcucuccgaagggcuaaaagacguaacauggaacgucuggcuuuagcaugcgguggaacggcugugaacaguuucgacgauuuacaagaaucucaccuugguuacgcugggcauguuuacgaacauguucugggcgaaaacaaauacacauucgucgaagaaugcaaagugccucaaucuguaacgauuuuaaugaaaggacccaacaagcacaccuugcugcagaucaaagacgccguuagagauggccugagagcuauuaauaacgcaaucgaugacaaagcccuuauuccaggugguggugcuuuggaaguggcaguaaacaaggaauuguuggcguacaaggacgaaauaaagggaaaagcucgcuugggcguagccgcuuacgccgaagcccuuuugguuaucccgaaaacucuggccguaaacuccggguucgacgcgcaggauaccaucgugaagcugcaagaagaagcucgacugagugccgaaccgaucggccucgacuuaacuuccggcgaacccaucaaucccaaagaugcgggcaucuacgacaacuacguggugaagaagcagaucauuaauucgugcucgauaaucgccagcaacuuguugcucgucgacgagaucaugagggccgguaugagcagccugaaaggcuaa

SEQ ID NO: 6043 - RNA, 3126 nt, Phyllotreta nemorum
augucuagugcuggaaucgcagacagccccaucgauccuccagcaaaaaagcgaaagcucgacucgaaaaacugcggccccgacauggcgaacaacgaagcuucgggauccuccaacgccggcgaaaucgacgagggacucuacucgaggcagcuguacguguugggacacgacgccaugcgccgcauggccaccagugacgugcucauaucgggucuaggcggccugggcgucgaaguagccaaaaacgugauccuaggcggcgucaaaucagugacucuccacgacgaugcccucugcaccguccgggaucuauccucgcaauucuaccucaccgaggccgacguggggaagaaccgagccgaggccugcuguaagcaccuguccgaacucaacaccuacguccccaccaagcccuacacgggcccccucgacgaaaagguccuacaaaaauacagggugguaguuuuaacaaauaguacucgagccgaacagcuccguauaagcgagauaacgcauaauaacgauaucgcuuugauuguagccgauacgaaagguuuauucgcccagguguucugcgacuucggcaaggccuucuccgugguggacgugaacggggaaccccccgucuccaccaugauagccgauauaucgaacgauacggagagcguggucaccugcauagacgauacgagacacggcauggaggagggcgauuacgucaccuucucggagauccugggcaugaccgagcugaacaacugcaagcccaucaagaucaaggugcuggggccguacacguucagcauuggcgacaccaccaaguucuccaaguacguacgaggcgguaucguaacgcaggucaaaaugccuaaggaggugcauuuuaagccgcugaaggaggccuugcagaaucccgaauucguggugaccgacuucgccaaguucgaucacccgauucagcugcaccucgccuucuccacucuccacaaguucguggagaagaccgggcgguugccgaaggccuggaauaaagacgacgccucggaguuuaucgcucuggcgaagucguuggcuguaaacgguucuacggauaccgaggucaauacugauauucucaauauuuucucuaaauguugcucgggugaucuaaauccuauuaaugcuacuauuggggguaucguggcgcaggaagucaugaaagccuguucggggaaguucuaccccauuuaccagugguuguauuucgaugccaucgaaugccugccccaggacaaggaggagaucaccgaggaacuggcggcuccgguugaugguagauaugaugggcagaucgcuguguuuggaaaagacuuccagaagcgauuaggugagcugaaguauuucauugugggugccggggccaucgguugugagcuguugaagaacuuugccaugaugggaauaggcacgcaaggaggucaggucacugugaccgacauggauuugauugaaaaguccaauuugaacaggcaauuuuuauucaggccccacaacgugcagcaacccaaaucagccacugcugcaaagguaauaaagaagaugaaucccgacgucaacauaguggcccacgaaaaccgagugggccccgaaacggaaaacgucuacaacgacgaguucuucgagguccuagacggcguagccaacgcuuuagacaacguagacgcgagaauauacauggacaggcgaugcguuuacuaccgcaaaccucugcuggaauccggcacguugggaaccaaaggcaacacccaaguagucgugccguuccuuucggaauccuacagcucgucccaagacccccccgagaagagcauacccauuugcacucugaagaacuuccccaacgccaucgagcacacuuugcaaugggccagggacaauuucgagggacuguucaggcagaacgccgagaacgccucgcaguaccucagagaccccgauuucaucgaacgaaccgucaagcugccggguguacagccacuagaaguccuggaauccguaaaggcugcucugaucgacgaaagaccgaaggauuacgacgauugccuggccugggcucgucugcauugggaggaccaauacgccaaucagaucaagcagcuguuguucaauuucccaccggaucagcucaccagcaccggccaauuguucuggucuggaccgaagagguguccagaaccgcuuguauucgauaucaaugaagauuugcacguggacuacguaauagcugcggcuaauuugaaggcucagguuuacggcaucccuacgaauaggaauagguguuacgccaagcaaguggucaccggcauugaggugcccccguucgugcccaaaucgggcgugaaaaucgccgugacggauucgcagauggccaugaacgguaacaacgucgacuuggaucguaucaaucagaucaaacaggagcugcccucgauggaggagcucagcgagcugacccucaccccguuggaauucgaaaaggacgaugauuccaauuuccacauggacuucaucguggcggccucgaacuugagagcggccaacuacaagaucccgauggccgaucgccacaaauccaaacucauagcuggaaaaauuauaccagcuauagcgacuacuacuucagugguggcugguuugguuuguuuggaauuguacaagcuggccaggaguauuaagaguuuaacgccguuuaaaaacgguuuuguaaacuuggcauugccguucuucggguucucugagccgaucgcggcccccaaaauggaguacugcgguaaccaguggaccuuaugggacagauucgaaguacaaggagaaaugacgcucgccgaguuucuggaguauuucaaggagaagcacgguuuggagauuacgaugcugucccaaggggugugcauguuguacucguucuucaugccgaaagccaaagcucaagaaagauuaggacuaacgauguccgagguggugaggagagugucgaagaagaagauagagccgcacguuagagcauugguguuugaguugugcuguaacgacgccgacggugaagacguggagguuccuuacguuaaauacaacuuguauuga

SEQ ID NO: 6044 - RNA, 1287 nt, Phyllotreta nemorum
auggccgacgcugaugccgccgacgaucuauuagauuacgaagaugaggaaaacccagaacagaccgcaaacgaaaauaaugcuacagaaggucagaaaaaagggguuaaaggaacauacgucucgauacacaguuccgguuuucgggauuuccuucuaaaaccagaaauccuccgagcuauugcagacugcgguuucgaacacccuucagaaguacaacacgaauguauuccucaagcgguaauuggcauggacauccuuugccaagcgaaaagugguauggguaaaacggcgguguuuguacuagccacgcuacaacagcuagaacccaccgaaaacgucguuuacgugcucgucaugugccacacgcgcgaauuggccuuccaaaucagcaaagaauacgaacguuucagcaaguacauguccaacaucaagguuggcguguucuucggaggccugcccauucaaaaagacgaagaaguauuaaaaaacagcuguccgcacauuguagucggaacgcccggucgcauccuggcucucgucagaucgaagaaacucaaucucaagcacauuaaacacuuuauucucgacgaaugcgauaaaauguuggagcuacuagacaugagacgcgacguucaagaaauauacagaaauacaccgcacgaaaaacaaguaaugauguucagugcgacgcucagcaaagaaauucggccaguuugcaagaaauucaugcaagaucccauggaaguguauguugacgaugaagcgaaauugacguuacacggucuacaacaacauuauguuaagcuuaaagagaacgaaaagaauaaaaaauuauuugaguuacuugauguuuuggaguucaaucagguggugauauuuguaaaaucggugcaaagauguguagcauuggcacaacuuuugacggagcaaaauuucccagcgauuggaauacaccgaggaauggagcaaaaggaacgauuauccagauacgaacaauucaaagauuuccaaaagagaauauuaguugccacuaaucucuucggucgugguauggauauugaaagaguaaacauuguuuucaacuacgacaugccggaagauucggacacuuaccuucacaggguggcuagagcgggucgguucgguacaaaagguuuggccauuacuuucguuuccgaagaaggagaugccaagauuuugaaugaaguacaagacagauucgauguuaacauuaccgaauuaccugacgaaauugauuugaguucauacauugagggacgauag

SEQ ID NO: 6045 - RNA, 1473 nt, Phyllotreta nemorum
augggagcucucgagacagacgucgagaugaaaaacgccgacagccccacgggacuggaagccggagacaacaaacgagacaaagauuugaacaguuucacggaaauccgggaacaggccaagcaaauagaaaaaggcauaaucaacaaggagagccgcuucauccuaagagugcuccgcugcuugccgaacaccagacguaagcugaacggcaucguccucagaacucucauaaaccacauuuacccugcggucgaccgagacguacuccucagcuucaucgaagaauccgccggugagcuagacacuacucaaacuaaagccagaccggccaccaagucgcccguagcagaaaucgacaccuacaucaaccugcuaugcuuagugcauuuaaucgacaccaacaaauuggcagaagccgaacgcugcucgcaaauccucaugaacaagaucaccagucaaaacaggcgaacauuggaccuggucgcagcgaaaugcuacuuuuacuacuccagaguagcggagcucaccgacaagcuggauucgaucaggggcuuccugcacucccgccuucgcacagccacccuccggaacgauuucgaaggacaagccguacugauuaacugcuuguuaaggaauuaccugcacuauucccuguacgaucaagccgauaaguugguuaauaaaugcguguuuccggagacugccagcaacaacgaaugggcgagauuccuguacuacuugggcaggaucaaagcggcccgauuggaguacagcguggcucauaaacaucucauacaagcgaugcguaaagcgccccagaacaccgccaucggguuccggcagaccguccagaagcuaacaguuguuguggaauugcuguugggggacauuccggagaggcagauauuccggcaggcgagcaugcggcauucucuggcccccuauuuccagcugacgcaggcggugcgaauggggaacuugcagagguucggagagguguuggagaauuucgggccgcaauuuaggcuggaucauacguuuacuuugauccugcggcuucggcauaauguuaucaaaacggcuauuagaucgaucggucugucguacuccagaauauccccgcaggauauagccaagaaacuggggcuugacucagcagaggaugcggaguucaucguagcgaaggccauucgugaugguguaaucgaagcuauuuuagauccccaaggagguuauaugaggaguaaagagagcacugauaucuacugcacuaaagagccccaacuagcuuuucaucagaggauauccuucuguuuggauuugcacaaucagaguguaaaagccaugagauacccgcccaaugcguacggaaaggagcuggagucggcugaagagagacgggaaagggaacagcaggacuuggaguuggcuaaagaaauggccgaagaugaugaugauaguuucccuuaa

SEQ ID NO: 6046 - RNA, 1449 nt, Phyllotreta nemorum
uccagggaggauuggcgcaaggccaaagagcuagaagaagcucguaaagccgguacagcuccugcagcagucgacgaagaagguaaagauaucaauccccacauuccucaguacauaucuacugcuccuugguauuacgggaccagcggacccacuuuaaagcaucaaaggccccaggaugaaaaaaacaaagaguauucggauuugaacgauugguacaagagaggcguagauacuucgaagauuguuacgaaguaucgaaaaggcgcuugcgaaaacuguggagcuuugacucacauuaaaagggacugcauggacagaccccguaaagugggagcuaaguauuccggugcuaauauagcacccgaugaguuuauucaaaagaauuuaucacuuaguuuugaugguaaacgagauagguggagugguuaugauccuucugaacacaagacgguuaucgaagaauuucagaaaguagaggaagccaaacggcaauuaaaauccgacaaauuaaaugcaaaugaagagucugaugaugaagagaaagacgaggauaaauacgucgaugaaguggacaugcccggcacgaaaguagacagcaaacaaagaauaacagucaggaauuugcguauacgagaagauacggcuaaauacuugagaaauuuggaucccaacucggcuuacuacgaccccaaaaccaggucgaugagggaggaucccaaucccggaaacgacgcuacauaccauggggagaauuucguucgcuuuuccggcgacacgacgaaucacgccagggcgcagcuguucgcuugggaagcacacggcaaagggguggacguucaucugcuagcggaacccacgaaauuggaauugcugaagaaagaauacgagaaaaagaaggaugaggucaagucgaauauucaggguacuguuuuggagaaauacggaggugaggaauaccucgaagcgccaccgaagaguuuguuguuggcucaaaccgaaaacuacguugaauauucgagaucggguaaggugaucaaaggagcugaaaaagaaguuaucagaucaaaauacgaggaagauguuuauauuaauaaucacacgucagugugggguucuuauuggagcgcuggacaaugggguuacaagugcugucauucuuuuaucaagaauucuuauuguuugggagaagcuggaaaaucaguaaacgcucaaccuacagcagaaauaaauacuaaugaagagcuuaaagaggaaggucaagaggaagaaaaagaaaagagcgaagcaguagauaaggaaagugaagaaucugauucuaguaguucgucugaagaggaaaaauccaaggcgaaaucuaagaaaaaguuaaaaaagaagaugaagaagcagaagaagaagcagcaaaagaaaaaggacaaggacaaggaggcuaaaaugucugcuucg

SEQ ID NO: 6047 - RNA, 549 nt, Phyllotreta nemorum
uucgaauugggccguccggcggccaacacgaaacuaggaaccagaaggauccauuauguucguacgaggggaggcaacuugaaguaccgugcccuaagauuagacaccggaaacuuuucuugggguagcgaagguacugcccgucaaacacguauuaucgaugucguuuacaacgcuaguaauaacgaauugguccguaccaagacguugguaaagaaugcuauuguugucauugacgccaccccguucaggcaaugguacgaaaaucacuacaucuuaccauugggacgcaagaagggugccaaaaugacgccugaagaggaggagauuuucaauaaaaagcguagcaaaaaaguacagaagaaguacgagacuaggcaaaaaaccgcuaaaguagaacccgcgaucgaagaacaguuccacaccggaagauuguuggcaugccuugcaucuaggcccggacaaugcggcagggccgaugguuauguccucgaaggaaaggaacuugaauucuacaugcguaaaauuaagucuaagaaagcuaaauaa

SEQ ID NO: 6048 - RNA, 936 nt, Phyllotreta nemorum
auggacagauugcuucgucucgggggcggcaugcccgguuugacccaggcgccgccgccuuccgacgcccccgucgucgacaccgccgagcaggucuacaucuccuccuuagcccugcugaaaaugcucaaacacggcagggccggcgugcccauggaagucauggggcucauguuaggugaauucguggacgauuacacggugagggucauagacguguucgcaaugccccagacggguacgggugugagcguagaagccguagauccgguguuccaggcgaaaauguuggauaugcugagacagacgggcaggccggaaaugguggucggcugguaccauucccauccggguuucggcuguugguuguccggagucgauaucaacacucagcagagcuucgaggcccucucggagcgggccguggccgucgucguggauccgauucaaucggucaaaggaaaaguugucaucgacgccuuuagguuaaucaauccgaacaugaugguguugggucaggaaccccgucagacuaccuccaauuugggacauuuacagaaaccauccguacaggcucugauucacggccugaaccgccauuacuacuccauaagcauaaauuauaggaagaacgaguuggagcaaaagaugcugcugaauuugcauaaaaaaucguggauggacgggcucacguuggccgacuauucggagaauugcagcguaaacgagaagaccguagccgauaugcuggaauuggcaaagaauuacaacaaagcguuggaggacgaggagaagaugacucccgagcaauuggcuauuaagaacgucgguaagcaggaucccaagaggcauuuggaggagaaagucgauauauugaugaccaauaacaucgugcaauguuugggcgccaugcuggauaccgucguguuuaaguag

SEQ ID NO: 6049 - RNA, 1164 nt, Phyllotreta nemorum
augacuguuauuaauaagauggaggucgauggaccucucaagggugaaggauucagguccuauuauaucaccaaaauugaggaauugcaacuaauuguugcugaaaaaagccagaaccuccgaagauuacaagcccaaaggaaugaacuuaaugcuaaaguucgaaugcuuagagaagaauuaaugcuccuucaagaacaaggaagcuacgugggggaaguagucaaacccauggauaagaagaaaguacuugugaagguucauccggagggaaaauuuguuguugauaucgacaaaaauaucgacauuaacgacguuacaccaaauuguagagucgcucuucgaaaugaaucguacacuuugcauaagauuuuaccgaauaagguggauccuuuaguaucacucaugauggucgaaaaaguaccagauuccacuuacgaaauggucggugguuuggacaagcaaaucaaagagaucaaagaaguaauugaauugccagugaaacaucccgagcucuuugaugcguuagguauugcucagcccaaggguguguuauuguacgggccuccaggaacuggaaaaacucuccuggcuagagccguagcucaccacaccgaauguacguuuauuagaguaucuggaucggaauuggugcaaaaguucauuggugaaggcuccaggaugguuagagagcuguucguaauggccagggagcaugccccuucgaucaucuucauggaugaaauagauucuauuggauccucccguaucgaaucagguucugguggugauucggaaguucaaagaacaaugcuggaguugcugaaucaacucgacggauucgaagccacuaagaacauuaaagucauaauggcuacuaacagaaucgacauuuuggaucccgcuuugcuaaggcccgguagaaucgacaggaagaucgaguucccgccaccgaacgaggaagcccgauuggauaucuugaaaauucacucgagaaaaaugaaucugaccagaggaaucaauuugaggaaaaucgcugaauugaugccgggugccagcggugcugaagugaagguauucuguuuuaaucuguuguuuauuuuuggguuuauaaugguguauuguugcagggagugugcacugaggccggcauguacgcgcuaa

SEQ ID NO: 6050 - RNA, 600 nt, Phyllotreta nemorum
augguaaaauuauauuguauuaguauucucuacaaagauacuacauacgcgacgugguugaagucugcuuucgauuugcaaaguuucaguuuuuuccaaagaggauccguacaggaauucaugucuuucuuuuguaagacuauuguagaaaggacuauaccaucaucgagacaaucugucaaagaaggagaauacaugugucauguuuauguaagacaugauaacuuagcugguguugugauaucagaucacgaauaucccucuagggugucacauacgcucauuacgaaaauuuuggacgaauucgccgcaaaaauacccgcugccaauuggucuaccuugcaagagaaggauguaacguuuccacagcuaaacacauaccuugccaaauaccaaaaccccaaggaggccgaugcaaugacuaaaauucaggaggaucuugacgaaaccaagauaauucugcauaauacgauucaggcuguccuggagagaggcgaaaaauuggaugacuugguaaacaaaucagagggcuuaaguaugcaguccaaagcuuucuacaagacugcaaaaaaaacgaacaguugcugcaauuucacuuaa

SEQ ID NO: 6051 - RNA, 729 nt, Phyllotreta nemorum
auguuucuaacgagaagcgaauacgacagaggcguuaacacguucucgcccgaaggaagauuauuccaaguggaauaugccauugaagcuauuaaacugggauccacagcuaucggaauaugcaccagcgaaggggucgugcuggcggucgaaaagcguauuacuucuccauuaauggagcccacgaccaucgagaagaucguagaaguagauaaacacaucggcugugcuguuucggggcucauggcagauucacguacaaugaucgauagggcaagaguagagugccaaaaucauugguuuguauacaaugaaaacauuacuaucgaaucgugugcucagggaguaucgaaccuagcuauucaauucggagauucggaugaugauggugcugcuaugucgaggccauuuggcguggccauuuuguuugcuggcauagacgaaaaagggccucaacuuuaccacauggaccccucagguacauuuguucaguucgaugcgaaagccauaggauccgguucggagggcgcacagcaaagcuuacaagaaguguaccaucgcagcaugacuuuagaggaagcuaccacagcggcguugacuauucucaagcaggucauggaggagaaauugaacucguccaauguagaagucaugacgaugacgccgaaggauuuguuccacauguucacuaaggagcagguggaggagguaauuacuaaauuauauuaa

SEQ ID NO: 6052 - RNA, 1158 nt, Phyllotreta nemorum
augacagaauacugguugauuuccgccccaggugacaagacuugucaacaaacaugggauacaaugaauaaucugacaaguaaacagaacaauuugucugcaaauuacaaguuccaaauacccgauuugaagguugggacucuugaccaauugguugggcuauccgacgauuugggaaagcuggaugguuucguggagcagguuacccggaagguggcucaguaccugggugagguucucgaagaccagagggacaaguugcaggagaauuugcaggcgaacaacaccgauuugccaaguuauuuaaccagauucacaugggacaucgccaaauaucccaucaagcaaucgcugcgcaacaucgccgauauaaucagcaagcaagucgggcaaaucgaugccgaucuuaagaccaagucgucagcguacaauaacuuaaaggggagucuucaaaauuuggagaaaaaacaaacagggaguuugcuaacccguaacuuggcagaucuggucaagaaggagcacuucauuuuagauucugaguacuugcaaacguugcucgucaucguucccaaagcucaguuuaaugaguggaacgccacuuacgaaaaaaucacggacaugaucgucccucgaucgucgcagcugaucauucaggaccacgauuacggccuguucaccgugucgcucuucaagaaggucgucgaggaguucaagcugcacgccagagagaagaaguucaucgugcgagauuucacguacaacgaggaggaauuggcggccggcaaaaacgaaaucaccaagcucguuaccgacaagaagaagcaauacgguccguuagugagaugguugaaaguuaacuucagcgaaugcuuuugugcuuggauacacguuaaagcgcugagaguguucgucgaguccguguugagauacggguuaccagucaauuuccaggcuauucugauccauccaaauaagaaacaagccaagcguuuaagagauguuuugaaucaacuguauggccaucuagauaguagugcagcucuuuccgggccuaauguugauagcguggacauuccaggauuagguuucggccaaucagaauauuaccccuacguguacuacaaaauaaauguugauaugauagaaucgaaggucuaa

SEQ ID NO: 6053 - RNA, 1674 nt, Phyllotreta nemorum
augucgauauuagcgaguccucuauccguagccgguucgcgaacgacgggcgccucaguucgcacccaaaaugucauggcagccucgaccauagccaacguggugaagagcuccuugggcccggucggccucgacaagaugcucgucgacgacaucggcgacgugaccgucaccaacgacggcgccaccauuuugcggcugcucgaagucgagcaucccgccgcccgagugcucgucgaauuggcccagcuccaggacgaggaagucggcgacggcaccaccucagucguuaucauagcugcagaacuucuuaaaaacgccgaugagcuugugaagcaaaaaauccauccuacaucgauuauaagcgguuacagguuggcuugcaaggaagcuugccgauacauacaagaccauuugacuauacccguggaggaauugggaaaggaaucuaucgugaacguagccaagacaucgaugagcuccaaaauuauaggagcugacgcggauuucuuuucgcaaaugguaguagacgccgccaacgccguuaaagucaccgacgccaaaggcaacucgauguaucccauaaaggcggugaacguguugaaagcgcacggcaaaagcgccagggaaaguuuccucguggccggcuacgccuugaacugcacggucgccagccaggccaugccgaagaagauccucaacgccaaaaucgccugucuggauuucucauugcaaaaggccaaaaugaagaugggcguccaagugcugauaacggaccccaaucaacuggaaggcgugcgcgccagggagcuggacaucaccaaggagcgcauccagaagauccuggcuacuggagugaacguggugcuucugucgggcggcaucgacgaucucuguuugaaguacuucgucgagcgcggcgccauggccgugcggcgagucaagaaggccgauuugaaacgcauagccaaggcuaccggagcggccuucgucacgucgcugagcaacauggagggcgaggagaccuucgaugccuccauggugggcgaagccgccgaggucgugcaggacaggauauccgacgacgaauugaucgucaucaaaggaccuaaagcucguacagcggcuucgauaauccugcgagguccgaacgauuucuacugcgacgagauggagcguucggugcacgacgcccugucgguggugaagcgcgugcuggaaucgaagagcgucguggccggcggcgguagcgucgaggcggcguugucgaucuaccuggagaauuucgcuacgacguugaguucgcgcgaacagcuggccaucgccgaguucgccaaaagccuguuggucauaccgaagacguuggcugugaacgcggcgcaggacgccaccgaccucguggccaaauugagagccuaucagaacuccagccagaccaagaaggaucacgcucaucugaaguacgucggguuggaucugauugaagguacugugagagauaacagaaaagcugggguguuggagccgacaaugucuaaggugaagucguugaaauucgcuacggaagcugcgauuacgauacucagaaucgacgauaugaucaaauuggacgcugagcagaagggugguaagaacuaucacgaugcuaugaacaguggugaauuguacgauuag

SEQ ID NO: 6054 - RNA, 768 nt, Phyllotreta nemorum
auguuuaauuccagccauucggcgccuccgccguuuuggagcaacggcccggccccgggagcuuucuacaacuucccgggcaccgaauggaaacccgcaacgaauccaauaacucauacucagucuccugugaccacuucaacuucaauuguauccauaacguacgacaaaggagugcugauagccggagacuugcuggccucuuacgggucucuagccagguacaaaaauugccccagggugaucgaaauuaauccuaauaucauccugggagccgggggagauuacgccgauuuucaauacgugaaaagcuuuaucgagcagaaaauaaucgaugaagauuguuuagaugacgguuugaaaaugaaaccgaaaucucuuuacugcuggcugacuaggauuauguaccaacgaagaaguaaacucgacccguucuggaacaauuuaguagucggaggaauacaggauggcgugccuuucuuaggaacuguagauaaacucgguacagcuuacacugauaaaguaauuuguacggguuauggggcccauauagcucuuccgguguugcgagaugcgcucgauaagaagccgaauuugaaucugaacgaagccaagcagcuuauuaaaaagugcauggaaguuuuguucuacagagacgcgaggagcuacccgaaguaccaguuggggaugaucgaugcggaugaaggggugaagaucgaggggccgauugcgguugaggaaaauuggaauaucgcuuauaugacuuaa

SEQ ID NO: 6055 - RNA, 2106 nt, Phyllotreta nemorum
auggaauuuucgaaagaacccaacuuugaauuacuagcaacuaaggacuuuucaccagaaaaauauguaaaaaaauugucccagaauuauguggguggaucugaauugcagaaucuucgaagaaaaauucaaggacucuccgaagaaacuagcucuaauuuaaagaaaaauguuuacgaaaacuacauucaauuuauugaaacugccaaagagauuucacaucuugaaagugaaauguaccaacuuucccacuugcuuucggagcaaaaagcauuacuuaauuguuuaucagccacuucgauauuggaagacguacagccaguuaacaucgauagggauaauaaagugaacguaaaggaucuugaagaagaaaauaaacaaaaaauagcugcuauuuuagaaaaaguagaagguugucaggaauuauuaaaaguuccgggaagauuuuuuuuguacgaaggagauuuauuagaaaucgaacccaccgaaaacaccgccuuaaaaauaguucacguuuauuuauuuaccgacaguuucaugauaaccacaagaaauucaaauagucgaggucucaugaaauacaucuacgaaagcauauacgaccugagcagccuagcagucguaaacguaagagaucuggggaacgucaagcacgccuuuaagcuucucauuuuccccgauaccagaguuuuucaaugcuccuccaacucgaacaaaaaagaguggcuggacaaguucgaucaggccaagaaaaccaagcuggcccaagaacagcaaaaaagggaauccguaucggagaaaucgcccacucgcgucucauucgaaucgcccagcuacaauccuuucgaugaagcagaagaagaaaccggcgcgucgcauccggaaugguucguggagauucccgaagagcuggacguuugcguggcccaaaggcauuucgaagacgccauuucucugcugcaaaaagccaaggaauauuuggcucgaacgucuuccacguccggugauaagcgggacaccgucuuuacggauauccagagaaaaguggagcaaagacagaacaauuuaacggagguguugaugaaggaauuggaagugaauccggauaaaucgcugcagggcgggcugagggccgcucgcagggcugugagauugcugaaucaauuaggaagggaaacacaaucuuguacgcuguuuuugaaauuaugcagcaguaugcugaggacgcaaugcaaacgagucaaaagagaagguucuacgaccacuuacauaaagcaucuuucgagcgugguuuuuaccaauaugugucacaugucugaugaauuucuaagagcuuuucccgauucuccggccugcgcgucagcguaugugguuugggcgagcaaugagcuauugcaauuuaccacccauuucauuaagcagguuuucaugccucagacuucccuaucgacggucaccgagugcguaguuuuagucaggcaucaaugcgaaaggcuguacguuuacggauuggaucuuuguuaucaauuggacggcgcuuugagaucgucccuauugaaggcguugaaagacgcucgagauaaacugaucgauucgauuaaauugcgaguucuagacgauaaauggauaccuauuaauuuacauaccaaaucggcuuugagccguuaugugcaugaguauucucaaaugggacucguuaacgugggaaguuauguuucuggcgauacuugguuacaauugacggccaguacuuuaucguucacgaaaauguuuuugaauuugcucaacgauugcaugaaauugaaaacuaccgaauugauguauacgaucgaugagacuuuguauaacguguucgaaacucaaauuaggcacaacgaaaacgcucuaaggagcgaauugaaucaagaucaaaggaauuuucucacgaaaaacgccgaguuuuuauuaguuaguuuaaugcaaguggugcaaaaaaaguacgaggagaacgucgguuacgaauguccaacguuggcgaaauugcaaaaggaauacguagcgcugcaaaaaggaguuacgccugcgucgagaaguacaaaagccaaguauucaucagaguuuauuuaa

SEQ ID NO: 6056 - RNA, 3801 nt, Phyllotreta nemorum
augucaaauuucuuaugucggucauuaaaacguugugaauuguaugcuuuaucaauuuuaaaaauuaaauuaauauugcauuuaaaauucaacacgaugaacgaauuagagaaacuagaauaccucucuuuagucucaaaaauuugcacagaauuggacaaccaucuuggaaugaacgauaaagauuuagccgaauuuauaauacaucuuuccgaaaagaacaacacguuggaauccuuuaagaaggugcuuucagaaaauggcgccgaauucucagacucuuucguuucuaacuuguugcgaauuauccaacacaugaaaccgaagaaaucgucgaauaaggaagaagccgauaaaguggaaaaagagggacuggcuuuuaaauuucccgguuuagcgauaccuaaugagaaacaaauacccuuacaauuugaagaauuagacgaggaaaauaaaaaugaugaaauagacguuguagccgacaugaugaaacaacuugaagcugacgcgccuucucauaaacaaacaaaagaaaaauccagaagcccgaguguugaaaggaaaucaagaguacgaucuagaagcaggucgaaggaaaaaagaagaucgagaagcagaucaaaagauagacgaagauccagaagcaggucuagggacagacggagaucuagaucuaaagauagacauucuagaagagauaaaaggcauagaaguaggucaaaugaagacuacaagaggagaagaacagaaaacaguuacucgagagauagaagggaaagggguagguccagagaaucugaaagaagagacaggaauagaucaagagaugauagaaagagggaaagaaguagaucgagaacgagaaggcgagaaaggaguaacgaaaaaaaauucaaaagcgaaaaggauaauccugaguucgaggaugacccuacuccaggaaagauuuauaauggaaaaguaucgaacgugguuccauuuggauguuucgugcaacuagaaggucuaaaaagaagaugggagggucuggugcauauuucucagcuaagagccgaggguagaguuaccaauguuuccgauguugucuccagaggaagcaaaguuaaaguaaagguauuaacaauaaccggucaaaaaguaucucuuucuaugaaagaugucugccaaacgacaggaaaggauuugaauccucuaucccaugccacuacagaacgggaagauaaagaucguaaccccgacaggcccaugaacaacagcacgucgguguugaggcuaccaguuagcaucgacgaaggagaagaagauuccaggaaaagagucacccgaauguccagcccggaaagaugggaaaucaagcaaaugauuucuucuggcugcauagacaaaagugaauuaccagaauuugaugaugaaacuggauugcugcccaaagacgaagacggugaagcugauauugaaauugagcugguugaagaugagccaccauuuuugcaaggucacgguagagcuguucacgaucugaguccaguuagaauaguuaaaaauccagaugguucccuggcccaagccgcuaugaugcaaucggcuuuggccaaagaaagacgcgaacagaagaugcugcaaagagaacaggaaguggauucgcagccuucuggaaagaacaaaaacuggauugauccucugccugaagacgaauccaaaucgauggcaagaggaaucggucuucagacucaagauuugccugaauggaaaaaacacguuaucggcgguaaaaagucaucuuuugguaaaaaaacuaacuugacgaucauugaacaaaggcagucucuuccuauuuacaagcucaaagaagaguuacgaaaagcaguaacagaaaaucaaauauugaucguuauuggugaaaccggcucaggaaaaaccacacaaaucacccaguauuuagccgaggccggguucacagccaggggcaaaauuggaugcacgcagcccagaagaguugccgcaaugucagucgcuaagagaguagccgaggaguuuggaugcagauuaggucaagaggucgguuacacuauuagauucgaagauugcaccagucccgaaacgaugaucaaauacaugacagacgguauguugcuacgugaaugccucauggauuuggaucuuaaacaguacucuguaauaauguuggacgaagcucacgaacguacaauucacacugauguacuauucggacuccugaagcaagcugucaugaagcgagacgaacugaaauugaucguaacuucugcuaccuuagacgccgucaaguucucgcaguauuucuucaaagccccgauauucacgauucccggcaggacguuuccggucgaaguauuguacaccaaggagccggagaccgauuauuuagacgcuagcuuaauaacagucaugcaaauacaucucagggaacccccgggcgauauuuugcuguuucugacgggucaagaagaaaucgauacugcuugcgaaauauuauacgaaagaaugaaaaguuugggucccgacguacccgaauuaaucauucuuccuguguacucugcuuuaccguccgaaaugcagacuagaauauucgaaccggcuccuccuggcaguaggaaaguugugauagcuacgaacaucgcagaaacuucacuaacaaucgauggaauauauuauguaguagauccuggauucgucaagcaaaaaguuuauaauuccaagacuggaauggauucauuggugguuacuccaauuucgcaggcacaagcgaaacaaagagcaggucgagcgggcagaaccgguccugguaaauguuacaggcuuuacacggagagagcguaccgggacgaaaugcuuccgacaccggugcccgaaauccagcgaaccaauuuggcgacaaccguacuucaacugaaaacuaugggcauaaacgauuugcugcacuucgauuuuauggaugccccuccggucgaaucccuuauaauggcccucgagcaguugcauucucuaucugccuuagacgaugaaggcuuauugacuagacuaggaagaagaauggccgaauuuccacuggagccgaaucugugcaagauguugaucaugucuguagcucuucaaugcuccgaugaaauauugacuauagugagcaugcuaucuguucagaacguguucuaccgcccgaaagauaagcaagcguuggcugaccaaaagaaggcgaaguucaaucaacccgaaggcgaucauuugacgcuucuggcggucuacaacagcuggaagaacaauaaguuuucgaaugcgugguguuacgagaauuucgugcagaucaggacuuugaaaagagcgcaggauguuagaaaacaguuguuggguaucauggacaggcacaaauuggacgucgugucggcugaaaggaacacggugagggugcaaaaggcgauuugcuccggguuuuucaggaaugcggggaaaaaggauccgcaagaaggcuacaggacuuugguggauagucaggugguguacauucacccuuccagcgcuuuguucaaucggcagccugaauggguaauuuaucaugaauugguucaaacuacgaaggaauauaugagagaagucacaacgauagauccuaaauggcugguggaauuugcgccugcauucuucaaguuuucugaucccacgaaguugagcaaauucaagaaaaaucaaagauuggaaccuuuguacaacaaauaugaagagcccaaugcguggaggauuucuagaguuaggagaagacgaaauuaa

SEQ ID NO: 6057 - RNA, 1248 nt, Phyllotreta nemorum
auggccacaaaaaggaaaaacaaaaaaaacauacuggcaaaagugaauuuucccuuguacaccguccagaugcuaacgucaaggcacguuaucguaggaggcggcgguggaacuuccaagacugggguugaaaacgguuucgaaauuuacgaaaucuuccacgacggccacaaauucucagccaaagaaguuacaagacacgaaacuggaggaaacguagucaugaauuguugugcguuuagugauaagaaaaaugcauuucuaguagccggccaagaaaacuacucucaacuuuacaaaaucaauacgaaauuagucgagcaugaagaaguagaaacaaucggagacacugcaagcguucggcauagaaacaccaagcccaaagaacacguagauaauaauaaaaacauuaaaaaggagcugguuuuugaccugaauccuuuagauugcauacaaaccgauuuuaagggguccgaaccccuauguagaguacuuagaauuaaucacucgggaaagauauuagcuacuggaggaacugacggcgauguaagacuuuggaaauucccuaugaugcagccauuguccauuuuaaaggggcauacaaaggaaauagacgauauagauuucaguaaauacgauaaccucaucaucacucuagcaaaagacgguuuggcuauucugugggacgcccaaacgggaaaaaugaaaucaaaacugacauggaaaacuccagagggaucaaaguauauguacaagaggugcagauuuggcguuaucgaagaucaaaaaaacaagugcaugcuauacaugauagcgaacgcgacuaauucgaagcaagcaucguuucuucaacaguggauaccugaggaaaauacuuuaaaaaaguuuucugaauucaaugaaacccuaucggcacuugcagugagagaugacggacgauuuguugcugucgggacaauguucagcggcuccguuuccauucacauugcauuuaguuuacagaaaauauugguaguugugggugcucacucgauguuuguaacuggucuggaauuccuaucucaugaaaauacuaaucauuccauaagcaguguugcugagacagcuguauuaucuauuucgguggauaaccagcuuuguauacauucagugccauacagacgaaguauaccuuuauggauuggaauaaugguguuaguuuuaguauuauuuauuacauuuauguuaugugcauucauggguuuguga

SEQ ID NO: 6058 - RNA, 1242 nt, Phyllotreta nemorum
auggcuggugcaauguuauucgaaagagcucaguccguaccuucccaacacgacaaguuguuaaaauuaaacccgacagacgaagaugacgaggaggauaucgucaacaaagagcaggacauccucaacuugggcgagaaguacaagaaggagggcaaggcuaaagaacuagcggagcugauaaaggcuaccagaccauuucugagucuuauuagcaaagcaaaagcagcaaaauuaguuagaucgcugguugauuacuuuuuggacuuggaggcagguaucgguaucgaggugcaacuguguaaagaauguauagaaugggcgaaagaggagagaagaacguuuuugcgccaaucgcuggaagcgcgccucaucgcuuuguacuucgacaccggcauguacaccgaugcuuuacaacuggaauccaccuuguuaaaagagcugaagaaacuggacgacaaaaaucugcuggucgaaguacagcugcucgaaagcaaaacauaucacgcccuaagcaauuuacccaaagcacgagccgcccuaacguccgcuagaacgaccgcuaaugcuaucuauugcccuccgaagaugcaggcagcccuagaccugcagucuggcguacuacaugcagccgacgaaaaggauuucaagaccgcuuacuccuacuuuuacgaagccuucgagggcuucgacagcgucgagucucccaaagcucuaacugcucuuaaguacaugcuuuuguccaaaauuaugauuaauaguccugaagauguacagcaaauuguuaguggaaaauuagccauaaaguaugcagguaaagauaucgaggccaugaaagcagucgcacaagcagcccacaaaagaucucuugcagauuuucaacuugccguaaaacaauucaagcacgagcuggaggaugacguuaucguaagagcacauuuaggaacccucuacgacaauauguuggaacaaaacuugugcaggaucauugaaccuuacucgcguguccaaguagaauauauagcaaagacgauuaagcuuccuguguuacaaguagagaagaaacuaucgcagaugauuuuagaugccaaguuucauggaauucuagaccagggugaugguguccugauaguguuugaagaaaccccgguagacaaaaccuaugaaauggcucuagagaccauccagaguaugaguaaaguaguagacacucucuaucaaaaagcgaaaaaguuguccuag

SEQ ID NO: 6059 - RNA, 1737 nt, Phyllotreta nemorum
auggcuucgcggucgaaaaaaagcucgacgccgucggcccaacagcggccggccagcccgcugagcccgacgaggcauuccagguugcaggagaaagcggaacuccaacaucugaacgaccgccuggccgguuacauagauaaagugagauuucuggaggccgaaaacaacaaauuauccagagaaauccagacgacccaggaaacuguuacacgcgaaguguccaacaucaagucuauguacgaucacgaacuaggggacgccaggaagcugcuggacgacacgcaccgcgagaaggcccgccuggagaucgacgugaaacgucucauagaagagaacgaggagcucaaagccgagcuggccaaaaagagcaaggaucugguuguagccgagaaccaugccaggauauacgaauccagguguaacgaguaccagcucaaguccaaccaagcuucugcagacgccaagaaggccaucgccgaugccaaggaguuggaaaaggaaagggacaagcugaagaagcuccucgaugcugcucguaaacaacuggaagaggaaucucuggccagaguagaggucgagaaucacaaucagagcuuaagggaagagcuaaccuuuaaagaucagauccaucaacaagagcucacagagacccgcacucgccggcaggucgagaucagcgaaaucgacggccgucuggcgcagaaauacgaggccaagcugcaagaggcccugcaggaucugcgcgaccaguacgaaucgcaaauggccaacaaccgacaggagaucgaauugcuguacgagcagaaaaucaaaaaccuccaagcggccgccgacaggcaccagucgaccgccuccggcgcgcucgacgaacugagacagguucgcucgaggaucgacaccuucucgucgaagaucgacgaccuggagaaccagaaccgcggucuggcagcuagaaauagggauuuggagaaauugcucgagaaugagcgcauucgucacgccgaagaucuggcguuggucgagagggaauugcacaggcugcgggaggagauggcccagcaacuucaggaauaccaggaccucauggacaucaaaguaucgcucgaucuggaaaucgcagcguaccguaaacuucucgaagcagaagaagcucgauugaacaucacaccaacagggguugaacacgaggugcaccacaggagcuccucucaacguaggacgccggugagaaugggggccaagaggaaacgagcgcugcucgaggagacgcaggagucgagcaugucggauuacagcgugaacaguucgucuaaaggggacaucgagguugcagcagucgauccggacggucaguuugugagauugcacaacaaaaguaaccaggaggugccgcucagcggauggcaagucaucaggcgggccggcgaugaggagacuuucuacaaauuccacaggaccguuaaaguagagggaaaugguacgguaacaauuuggaguucggauuuaaauaaagaucacgagccccccaguaaccuggucaugaaaggccaaaaauggguuacuggagauaacaugauaacgauaguauugaacaacaacggagaagaaguagcgucaucugaaaggguaaagaggcagauuucgacgucgcauuuaagacacagggaauugggggaugaagagcuuuaucaccagcagggggaccugcaaggugaaaagugcggacugauguga

SEQ ID NO: 6060 - RNA, 2226 nt, Phyllotreta nemorum
auggcugauagcaaaagccccgacgauuuagcgacugcgauucuucgcaagaaggaccguccgaacaggcuuuuaguagaagaagccguuaacgaugauaauuccguuguggcccugucccaggcgaaaauggacgaacugcagcucuuuagaggagacaccguucuacuuaagggcaagcgccgaaaagaaacugucugcauaguucuguccgacgauaguuguagugacgaaaagauccgcaugaacaggaacguucggaauaacuuacgagucagguugucugacgucguuuccauucagcccuguccugauguuaaguacgguaaaagaauccacguucuucccauagaugacacaguagaaggacuuacaggaaaucuguuugaaguguaucugaaaccguauuuccuggaagcuuaucggcccauacacaaggacgacguuuucaucguaaggggcggcaugagagcuguagaauuuaagguaguggaaaccgauccggcuccuuacugcauagucgcccccgacacggucauccauugcgacggggauccgaucaaacgcgaagaagaggaggaggcucuuaacgcugucggcuacgaugacaucggagguugcagaaaacagcuggcccagaucaaagaaauggucgaguugccguugagacaucccagucucuuuaaggcuauugguguuaagccgccuagagguauucucuuguacggaccaccagguaccgguaaaacucugauagccagagccgucgccaacgaaaccggagcuuucuucuuuuugauuaacgggccggaaaucaugagcaaacuugcuggagaaucggagaguaaccugcgcaaggccuuugaagaagccgacaagaacuccccagcuaucauuuucaucgaugaauuggaugcuaucgcucccaagagagagaaaacacacggagagguggagcgucguaucguuucgcaauugcucacucugauggacggcaugaagaagagcucccacgugaucguuauggccgcuacgaaccgaccgaacuccaucgaucccgcgcuacgucguuucggaagauucgacagggaaaucgacaucggcauuccggacgccaccggccgauuggaggugcugagaauccacaccaagaacaugaaguuggccgacgacgucgauuuggagcaaaucgcggccgagacucacggucacgugggcgccgauuuggccucgcucuguucggaagcggcgcuacaacaaaucagagaaaagauggaccugaucgaucucgaagacgaucaaaucgacgccgagguccucaauucguuggccgugaccauggagaacuuccguuacgccaugacgaagagcagcccgagcgcucugcgcgaaacgguggucgaaguacccaacgucacgugggacgauaucggcggucuggccaacgucaagaaggaauugcaggaguuggugcaauauccggucgagcaucccgauaaguuccucaaguucggcaugcagccguccaggggagugcuguuuuacgggccgcccgguugcgguaagacccuguuggcaaaggccaucgccaacgaaugucaggccaacuucauauccgucaaagggccggaguuguugacgaugugguucggugaaucugaagcuaauguuagagacauuuucgauaaggccagaucagcagcuccuuguguacuuuucuucgacgaguuggauucgaucgcuaagucuagagguggaaaugugggagaugccggcggugcagccgauagggugauuaaucaaauuuuaacugaaauggaugguaugggagcgaaaaagaacguuuucaucauuggugcuacaaauagaccagauaucauugauccggcuauauuacgucccggucguuuggaucaguugaucuacaucccguugccagacgaaaaguccagagaagcaaucuucaaagcgaacuuaaggaagucaccuguagcuaaagacguagaucuuguuuauauugccaaaguuacacacggcuuuucgggugccgauuuaacagaaauaugucaaagagcuugcaaacucgcuauaagacaaagcaucgaaacggagaucagacgagaacgagagagagcauugaaucccaacguagcaauggacguaaguauuuaucauguauuuaaaucauauauaaaaaaaauguguuuucuuugcgcagcuggauga

SEQ ID NO: 6061 - RNA, 825 nt, Phyllotreta nemorum
augagugaccaauuugacugugcacucgauuuaaugaggcgcuugccuccgcaacaaaucgaaaaaaauuugagcgauuuaauugauuuagugccaagucuuugcgaggaucuucuuucauccguagaucaaccguuaaaaaucgcuaaagacaaggauucgggcaaggauuuucuuuuaugugauuacaauagggacggagauucuuacaggucaccauggucgaauacuuacuaccccccauuagaagacgguucgaugcccuccgagagguuaaggaaauuagaauuagacgccaauuuagcguucgaucaauauagagaaauguauuucgaagguggcguaucuucuguuuauuuuugggacuuggaucacgguuuugcaggaguaauuuuaauuaaaaaaaccggagaugguaguaggaaaauaaaagguugcugggauucccugcacguaguggaggugcaagagaagaguucgggaagaaauucccacuacaaaaugaccuccaccgccaugcuguggcugcaaaccaauaaacaaggcucggggaccaugaauuugggcgguagcuuaacccggcagaucgagcaagaugcagcgguaaaugauaucaacccccacaucgccaacaucggucgaaugguggaagacauggagaacaaaauucggaauacguugaacgaaaucuacuuuagcaaaaccaaggacauagucaauagcuugagaucggugcaacccuuaacggagagccgucagcagcaggcgcuuaaacaagacuuggccgccgcccuucagcguagacaaaauaaauccgagaacuga

SEQ ID NO: 6062 - RNA, 2013 nt, Phyllotreta nemorum
auggaacguccgccccguaaugaaccgcccguggagccugucaacggaguggugcaaccgccggugcauccgccgccggacaguccgggacgcgucacgaaccagcugcaauuccugcagaaaaccguacugaaggccguguggaaggacaaauucgccuggcccuuucaucagcccgucgacgcuaagaaacucaaccugcccgacuaucauagaauaaucaagcaaccgauggaccugggaacgauaaagaagcguuuggagaacaacuacuauuggacggguaaagagugcauucaagauuucaacacgauguucaccaauugcuacguguacaaccagccgggcgaggacgucgucgucauggcccaaacauuagaaaaaguauuuuuaaccaaaguggccgacaugccuaaacaagaaguuguuguugaaauuccaaugaaaggcaagaaagggcgaguuagcgucggcggcggcggcggcgggagcaccccgucuuccagcggaccggugccggcagcuauacccggaggugucagaggcaggccgcccgcgaccguuucuuccaccaguaccacgccaaucgccaccacuacugguucguccgggcuaccguugggcacccaagcgcccgccacguugccgggaagcaccgccaccacgacgauagcgccggccaacaacaacaacagcucucugacgccccagcagcucggcacgcccgucaccacgaugcacggaacgcccggagcgccccuguccaacucccucgaucccaccggcggagugcugcccggaaacgucaugccccccgcccaaccagccaagguaaaaaaaggcgugaagagaaaggccgacacgacgacgccggcgacggccuacgauuauccgacgguauuggaaucgaagucggcgaagauaucgacgcgcagggagucgggcaggcagauaaagaaaccggcgcggcgggaaaucgaccuucauguaccucaaccggcgauacacaaacccaacgauaaguugacugaaucgcugaaagcuugcaaugaaauucuuauggaauuguucucaaagaaacauucgaauuacgcauggccuuucuaucaaccggucgaugcggaacuacugggccugcacgacuaccacgacaucaucaagcgacccauggacuuuggcacggucaaagagaaaauggacaacagagaguaccgcacgccgcaggacuuugccgccgacguuagacugauuuuuaguaauuguuacaaguacaaucccucugaccacgauguggucgccauggcgcggaagcuccaggacguguucgaagucaaauuugcgaagauccccgaugagccugugaaccggauaggaggaguuguaaauaauuugccuauaaaauccgaaucgaguaguuccgguucgaguucggauucguccagcgaaucggaggauucggaggaggaaaggcguaacaaacaauugaaagugcuggagaaagaguugacggcguugcaagagaagaugcgcaagcuggucgaggagaguucgcgccggaaaaaggagaaaaagaaaaacaaaaugaaaaagaaaccgagcggcgcgggggcgcugacggcggcgggcgcgcugccgaacagcagcagcggucucgguuugcgcggcaacaaacccgccgccgcuucgaacgccgcccccaagcgggcgaaggcgaacaacaagaccggcgccggcaggaagaagaacgccgcccagccgcccccgaugccguucgacucggaggacgaggacaacgccaagccgauguccuacgacgagaaacgacaacuuucgcuagacaucaacaaauuacccggggacaaauugggucgaguugugcauauaauccaaucgagggagccgucuuugagggauucgaaucccgacgagaucgagaucgauuucgagacguugaaaccgucgacguugagagaauuggagaguuacgucgcgucgugucugcguaaaaagcca

SEQ ID NO: 6063 - RNA, 1224 nt, Phyllotreta nemorum
augucuuuauccacagcucgcccuuuagugagcguuuacaaugagaaaucggaagaaguaaaaggcagcggcguagcucuuccggcugucuucaaggccccaaucagaccagaugucgucaauuucguucaucagcaggucucaaugaaccaucgccagcccuacagcgucagcgacaaagccggucaccaaaccucggccgaguccuggggaaccggucgcgccguggcccguauaccgcguguacgcggcggcgguacccaccgaucgggccagggagccuucggcaacaugugucgcggcggucgcauguucgcgcccaccaagccguggcgccgcuggcacagacgcgucaacgucaaccagcgucgcuacgcgcuggcgucggccgucgccgccagcggcgugcccgcccuggucaugagcaagggccacguggucgaucagauacccgagcugccguuggucgucagcgauaaggugcaggagaugcgcaagaccaaggaggccgugcaguuccugaggaggaucaaggcuugggcugacauccaaaagguuuacaagagccagcgguuccgugcugguaaaggaaaaaugcguaacaggagacguauccaacguaaaggaccucuaaucguuuacuacaaagaucaaggucuucgucaagcuuuccguaacaucccuggcaucgaccucaucaguguccaaaaguugaacuugcugaaacuggcucccgguggucacguaggucgguucaucaucuggacugaaucugcuuuccagcguuuagacaaauuguucgguacauggaagaacccgucgaccgaaaagaaggguuacaauuugccccagcccaagauguccaacaccgauuugucuagguuguugaaagcugacgagauuagagcuguucuuagggcuccucagaagaaggugguacgucguguucgucgucucaauccuuugaccaacacuaaggcuaugcuuaaauugaacccguaugcugcuguacucaagagggaagccaucuugaagaaccaaaaaaggcaguugcaaagggacgaagcuuuggcuaagaaacgaggaaucacuuugacuccugacaacgcuguaaucaggaccaggaaauugcaggaaagacgaagagcucaaauucugaaagauaggaagucgaaacccaagaaggccgcgaaagcgccggccaagccugcuggaaagaaauaa

SEQ ID NO: 6064 - RNA, 5370 nt, Phyllotreta nemorum
auggcagauuacaucaauucagaagcagaggaaucuagcgaggaggaagaauuagaccauagggaucgaaagaaggcacaaaaagcaaagcucguagauaguucugacgaggaagaggaagaagacgaugaagagaaaauuagagaagaauuaaaggaucuuaucgacgauaauccaauugaagaaagcgaugccgaauccgaugcuucaggccgugagaaaagaaaaaaaucugacgaugaagaccucgaugaucgauuggaagacgaagauuacgaucugcuggaagaaaauuugggucauaaaguagaaagaaggaaauucaaacguuugcgucgguucgaugaugacgaaagugaaggggaagaagaacaugaucccgagcaagaccgcgaucaaaucgccauggacauauucuccgacgaugaugaagaaagaaggucggaacgaagucaaagacccgucgucgagcaagaaucuuuuggagugggcgaagaggaagaagaaggcgauuacucagacgccgaugauuuuaucguagacgaugacggcagaccuuuaaucgagaaaaagaggaaaaagaaaccgauuuucaccgacgccgcgcugcaagaggcccaagaaacauuuggcguugauuucgauuacgaugaguucagcaaauacgaccaagacgaguaugaagacgaggaggacgaagaagaagacgaauacgaagaagaugacaacgaacgaaggaaacauccaaagaaagcggcgcgaaagaagcugacgaaaaaguccauuuucgaaguguacgagccgagcgaacugaaaaggggcuuuuucaccgaucucgauaaugaaguucguaacaccgauauaccggaacgaaugcaacuucgugacguucccauuacccccgucacggacgauucgaccgagcuggaagacgaggcggaguggauuuacagacaagcguucuguaacaaggcaauauccaauguugaugcccaccuuucggccgaggccagagagaagaugaagaaggguucccaaacuguagggaaaauaaagaaagcgcuggauuucaugaggaaucaacagcuagaggugcccuucauugccuuuuacagaaaggaguacguucaaccugaacugaauauuaacgauuuauggaaaguuuauaaauaugaugccaaguggugucaacuaaagucucgaaaggaaaaucuccugaagcucuucgacaaaaugaggcauuaucaauuggaucagcucaucaagaauccggacgcucccauuccggacaacgugcgagugaugaaagauucggacaucgaaagacugaaaaacguccaaacugcggaagaacucaaugacguucacaaucauuucauauuguauuauuccggagauuugccugccaugcaugccgcuuggagaaucaaggaaagagagcagaggaaauacgagaaacgucaaaaaagacuaaggcaaauugcugaagcugaagaaggggcugagauuccugaugaaccggaagaugacgaugaugaugagccagaaacagaaacuuugaaguacgcuaaucgaucgggcaguuaugcauuaugcucaaaagcuggauuagauccuuuggcgaagaaguuugguuuaucucccgagcaauuugcugaaaauuuaagagauaauuaucaaagacaugaagucgaucaagagcccguugaacccucugaaguugccaaagaauuuauuucuccuaaauucucuacugucgaugaaguauuacaagcuuccaaguauauggucgcccugcaaauagcuagagaaccauuaguaagaaaaugcguuagggaaguauauuuugaaagagccaggcuuaguguauaucccacaaagaaaggacaaaaagucauugaugagucucacaauuguuacaguaugaaauauuuaaagaacaaaccggugagagauuugaacggagaucaguuucuaaaacugugcuuagccgaagaagaaaaccuucuugcuauuacaauuaacgauaauaucgaagggaacacaucaaacucuuacauagaggaaguuaagcagcucuacaucaaggaugaauuuaguaaaaaugugcaagauuggaacgcgcugagaauggagugcguagaaagggcgcuaacuaaaagcguuuugcccgauuuaaggacagaauugaagaggaccuuguuauccgaagccaaagaguucguccuuaaggcguguugcaggaaacucuacaacagcauuaaaauugcuccauacucuauuacauuucccgaugaagacgaagacgaaugggacacaucuaaaggcguuagaguuaugggcuuagcuuacgagccagaauauacaguuucagcguuugcuuguauagcagcucccgauggggauaucaccgauuauuugcguuuaccucacauauugaaaagaaaaaacaguuucagaacggaagaaaaauuaaugaaggaagccgauuugcaagcacuuaagaacuuuaucuuuuugaaaaaaccucacgugauugcgaucggcggcgaauccagggaagcucugaugauagcggacgauuugaaagcucugauuaacgaauuggucgaauccgaucaauuucccgaaaucaaagucgaaaucaucgacaacgaauuggccaaaauuuacgccaacuccaacaaaggccaggcggacuucagagacuaucccgagcuguugaggcaggcuauuuccuuggccaggaaaaugcaagauccucucaucgaguauucgcaauuguguaacggagacgaagaaauauugaguuuaagauuccauccacuacaagaacaaauagcaaaagaagaacucauugaagcucugugccucgaauucgucaacagaacuaacgaagucgguguugauauaaauuuggcuguacaacaggcgcacaaaaguagucuuguucaauucguuugcggucucggcccucgcaaaggacaagcucuguuaaaaguccuuaaacagaccaaccaaaggcuagaaaacagaacacaguugguuacggcuugucacaugggcccaaagguguucauuaauuguucagguuucaucaaaaucgauaccaacaguuugggugauaguacugaagcguauguggaaauauuagaugguucccguguucauccggagacguacgaaugggcuagaaagauggcuguagacgcguuggaauacgacgaugacgagggcgccaauccggcaggugcuuuggaagaaauccuggaaacuccggagagauugaaagaucuggauuuggaugcuuuugcugaagaauuggaaagacaaggauucggcaauaagagcaucacauuguacgacauuagggccgaauugaacuguagauacaaagauuugaggcagccuuuucauucggccaauccagaagaguuguuugauauguuaacgaaagaaacgccggaaacauucuauauaggaaaauugguuacugcuucaguuauagguauugcgagaaagaagccuaaaccugaccagcucgaccaggccaaucccgucagaaacgacgaaacgggucuuuggcaauguccguuuugucugaaaaacgauuuuccggaauuauccgaugucuggaaucauuucgaugccggggcauguccuggucaagccaccggagucaaacuuagauuagacaauggaauaauggguuauauuuauauuaagaauauuagugauaagccgguaucuaaucccgaggaaaggguaggaguuggucaauuaauuaguugucguauaauaaaaaucgauguagaaagauuuagcguugauuguacgucgaaaucuagcgauuugcuagacaaaaaucacgaauggagaccaccaagagauccccauuacgauacggaacgcgaagaaaaagacaacagaacugaggcggaaaagaaaaaagaaaaacaacguuugacguacauaaagagaguaauaguucauccggcuuuucacaacauuuccuacgccgaagcugaaaaaugcauggucaacauggaucaaggcgaagucaucaucagaccuuccagcaaaggagccaaucauuugaccauuacauggaaagucgccgauaacauuuaucaacauauugauauuagggaagaaggaaaaacuaacgcuuuuucauuggguaaaucguuguugauaggcaacgaagaguucgaagauuuagaugaaauaauagcgagacacgucacuccgauggcagcgcacgcucgcgauuugcucuacuucagauauuucaaagacuucgaaggcggccacaaggacaaggccgaggaguaccugaaagacgagaaaaagaagaacgccucgaaaauacauuacgucguuagcgcagcaaagcacauaccuggcaaauucuuacucuccuauuugccgaggaacaaaguuagacacgaauacauaacggugacucccgaaggauuuagauucaggcagcaaauguucgauuccauaacuucacuguucaagugguuuaaggagcauuuuagagaaccacccccgggcggaaucacacccggaacuccgagaauguccaccggaagaacaccuuaugauaugaguacugaagcuauucaaagaguugcacaaaaucuucccagcgauaugguccaagcucuaucugcugcaacgaaccaaacuccucacuauccacacacuccuggcgguuacggcgguaauuacaucaacacaccguacaccccuagcggucaaacgcccuacaugacuccauaccaaacgccucacgcccaacaaacuccgcgguacggccagcagacgccgucccagccgucucugagcaacccguuccugcaucccggcgccgugacgccgucgcaacgcacucccagcuacaggaaccugccgacucagaguccgaugauaccgcagagcccggugccgaguccgggaucgcagaguucguacagcagccacaugagccaccacacgagggcgaguuacggggauucguugagauuccaaccgcccgaaucgccgaggaacuacccgagcagcaggggguccuaucccgauggaagguacggcgguagcgagucgauggauuggcagaaggccgcugaagcuugggcuucuagguccaaaucaacgccacgaagcgaaggucgcgggacucccagaucgucuggucacagaacuccucguaacuacgauaaucugucugaaagcgaacgguccaggaugaagcauaugagcaguaaaagcccgaaaucgguacggucgacuccccguaccaacucuucgccuagauccauguccuugggcgacgcuacuccuuuguacgacgaaaacauuuaa

SEQ ID NO: 6065 - RNA, 2586 nt, Phyllotreta nemorum
augccagaaguggacagcagcgaaucgcgcucuccucgccgcaaacgccgcagguccaaauccgccgaucgcaaggaagagaaaucguccaaaaggaagucaucgaggaaacguucgucggacgacgaauacaaugagcgagauuauccacgcuacuacggcgaggaucggccgaacagcgacagcuacuggaacaaauaucccaggagagauaacacgaaagucggucguagguauuacgaucacccugaccaccagaagaauagggacagggaugucucgaacgagaggagcagagauagagauagggaaagcacuagagagaaaaaggaagagaaugaggauaaauccaucaucaaacccagggaacguaaaguaguugauaugcuaacuuccagaacaggaggggcuuacauaccaccagcaaagcuccgucuaaugcaagagaguauaacagacaaaucuucagcugcuuaccaacguaucgccugggaggcccuuaaaaaauccguacacgguuacaucaacaaaaucaacaccuccaacauuggaauaaucgccagagaaauccugcacgaaaacauaguaagaggcagaggucugcuuugcaaaucgauaauccaagcgcaagccgccucuccaaccuucaccaacguuuacgcugcccuaguggccguaaucaauuccaaauuucccaacaucggagagcuuuuauugaaaagacuggugcuucaguucaaaaggggcuauaagcagaacaacaagucuauuugcauuucggcuacuacauucguggcucacuuggucaaucaacgcguggcucaugagauuuuggcgcuugaaauucucacuuugcucgucgaaacuccuacugaugauuccguagaaguggcuauuucuuuucugaaagagugcgggcagaagcuuacggaagucucaaguaaaggaauaacugcuauauucgagaugcugaggaacauccugcacgaaggccagcucgagaaaagaauacaguacaugaucgaggugauguuccaaauuagaaaggacgguuucaaagaccacgcugcuguaaccgaagaauuagauuuaguagaagaagaagaucaauucacccauuuaaucaugcucgaugauguaaaggaggcuaaugcugaagauauucuaaauguauucaaguuugaugaacauuaugaagaaaacgaaggcaaauacaaaacucugaguaaagaaaucuugggcagcgauagcgagucagauacaggaucggaggggucugaagaggaauccgaaggugaagacgaggaugaagaaguuaaagaugccggaaaaaucauagacaauacugaaacaaaucuaauagcccuuagaaggacaauauauuugacuauacaauccaguuuggauuucgaggaaugcgcucauaagcuucugaaaauggaguuaaaacccggccaagaaaucgaauuaugccacauguuuuuagauuguugugccgagcaaagaacauacgaaaaauucuacggacuucuagcucaaagguuuugccaaauaaauaaaauauacaucgagcccuuccagcagauauucaaagacaccuacgccacuacccaucgucuggacaccaacagauugaggaacguuagcaaauuuuucgcacaccugcucuucaccgacgccauaggcugggagguguucgagauuaugaagcugaacgaagaagacaccaacagcuccaguagaauuuuuaucaagauuuuguuccaagaauuagccgaguauaugggccuaggaaagcugaaugcgagauugaaagaugaaacgcuucagcagcauuuugcaggacuauuuccuagagacaauccgaaaaauaccagguuuuccauuaauuucuucacgucaaucgguuuaggagggcuaacagacgaacuuagggagcauuuaaaaaacgucccuaaaacuuuggaaauuaaaacggccguugugaaggaagagagcgauaguagcaguagcagcagcagcagcagcgcuaguagcagcaguucgagcgaagaagaaagcagcgaugauaguucuggggauucgaguucagaggaugaaaagcaaaaggaaaaaucgaaaaagaagaaaaagaaacucgauucggagagaucuuccaaaucagauuccaaaaguaaucguaaagccgaaaagcgcgauacuaguaagcacaugaaaaagagagacaaggaagauaacaaagaagcccacaaaaauaaagagaauagaagcgaugcggacaaacacgcuucaagggagaagcaaaauucgaggcaagauaaaagaaaggacgacggcgauaguaaagaaaaacacaggaaagaugauagggaggacagggagaggcaacggaggaacgaagaaaagggugggaggaaaaaggacuacgaauggauaaaaaguagacacgaggauaacauacaucaauugaaaacuacuaaaaaaguguuugaaaaaucgucaaagcacagaucuaggucgagagacaaaauuagcaguaaagaaaaggacagaaggcauagaaguaaagaaaggcgaaaaaguuaa

SEQ ID NO: 6066 - RNA, 1869 nt, Phyllotreta nemorum
augcaacauuuacuacgcucuuuuucucaaucugcucccaucauaauuuuuauuuuauucuucucuaugaucaauccagucccaaacaccgaguuuugcucuaucacagaaauaaugaacgaggugauaaaacacaaacccuccaagaagaacgggccugcaguggcacaaccccacagcgcuggcgguguggacuggagaauccugguggucgaucaacuggcaaugagaaugguaucggcuuguuguaaaaugcacgacauaucugcugagggcauuacacuggucgaagauaucaugaagaagagggagccccuugcuacaauggaagcuguguacuugaucacuccuuccgagaagucuguccaugcucucaugaacgauuucgaaucuccgaggcccauguauagaggagcacauguauuuuucacagaagcauguccagacgaauuauuuaacaaauuaaguaagagucaugcggcaaaauauauaaaaacguuaaaagaaaucaacauagcauuuguuccgacagagucacagguauuuucuuuagauuccccagacacuuuccaauguaguuacgauccuuccuuugcugccgcacgaaaugcgaauauggaaagaauggccgaacagauugcuacguugugcgccacucugggggaauacccgcacguccgauauaggagcgauugggaacguaacguagaguuggcgcaauugauucagcagaaauuggaugcuuacaaagccgacgagccgacuaugggagaagguccugagaaagccagaucgcagcugcugaucuuagaccgaggcuucgauugcguuucgccguugcugcacgagcugacguuucaagcuauggcuuacgacuugcuuccaaucgaaaacgacguguacaaauacgaagcuuccgcugggguacaaaaggagguccuguuggaugaaaacgacgagcuguggguggaauugcgccaucaacacaucgccgugguuucucaaagcguuaccaagaauuugaaaaaguucaccgauucaaagcgcaugacccagagcgauaaacaguccaugaaggauuuguccacuaugauuaaaaagaugccccaguaucagaaggaguugucgaaauacgcuacucacuuacaucucgccgaagacugcaugaaggccuaccaaggguacaucgacaagcuaugcaaaguugaacaggauuuggcaaugggaacugacgccgaaggggagaaaauuaaagaucacaugcgcaacaucguuccgauucuucuagacaccaaaauaacgaacgaguacgacaaaaugcgcaucauagccuuguacgcuaugaccaaaaacggaauaaccgaggaaaaucuuucaaagcuuggacaacacgcgucgauuaaagacaaacaaaccaucgcuaaucuucagcucuugggaguuaacgucauuaaugaugguggucccagaaaaaagcaguacaccguaccgcgcaaagagcgaauuaccgaacaaaccuaccagaugucgagauggacuccuguuauuaaagacaucauggaggauugcaucgaugacaaauuggaucagaaacauuuccccuaucuaaguggaagggcgcaaacgaccggauaccacgcagcaccuuccagugcucgauaugggcaauggcacaaggauagaggccagcaggccguaaagaacgucccgcgucuauuggucuucgugguuggaggcauaaguuucucggaaauucgcugcgcguacgagguaacaaacgcccagaagaauugggaaguuauaaucggaucgucgcauauucuuacaccagaagguuuccuuagugauuuagcgacguuagccggcuag

SEQ ID NO: 6067 - RNA, 2139 nt, Phyllotreta nemorum
augaugcaacaauauaugaaagaauuagaacaagagccuuucgaugcugaagaauucguagaacguuuagccuggagaacuuuagcugaaucaaaaagcgauggagaggaaaaugaaauuaauccggcacugcuucacgaauccuuuguucaagccauaaaggaccuuaauuuauuacaugaaagacaacagaaaaaaugcgaaaaauuagaaguugccgucagggaagacgaagcgacguuuuuucaagaaauuuacaauuuauuggagcagaauaagcaagcuauggauacauuucaagaacuugauggcaaaaucaaucauguagcaacuaaaguucuucacuuaggagaucaguuagacaguguuaaugguccuagauccagagugguugaugcuuuaaguuuaaugacucauuugagggaauuccugucaaacgaaccaguuucauccacaauauuuaccaauggagaauacauugaugaagcagcagaugugauucaaaaguuauauuuaauaucgcaagauuugccacccaaguuugaaucgauaaaaagaaagauagaaaggaaauauucagacaucgagaaaacacugauagaagaguucguuggggcuauggauaaugagaauuuaacaagaaugaaggagauagcauugguacugucucaauuuaagggcuacucucaguguguugaugcuuauauagaucacagccaaguggguuguuuauccaguaaagaugucuucuauaacuuuuugaauuugugcaaauacaacgaugaaauuauucgaaaaguuuucaagaauccggagcaagugauggcaaaauucguuuuaaauauauaccaguugaaauugguggaauauauagaucaaaaacucaauucuaaauuggguacauacagcuauuuacagacguuauaugaauuguauucaaagacuaauaaucuaucaaacgaauugagcguuuuucauaugggaaacgacaaaaacuaucucacuaaacugacgacaaauauuuauaacaaguacauuaaugauuacauuuccauggagcuuaagugucucaaagacagguguucagccagcuuacaaaaauauuaugacucgaaaaaucaucaaaagaagcagauucaaucuggggguuuucaagaucuaagaagggauuugcaagcgguaauaggcacuagggcaaacauaaacauagcucaaauagaaaauuaugguggugaaacuuuuguaucggaggaauuggcaauaaugauucuucaggauacuaagcaagcuuuucaacguuguuuauuguuaucaaaaggcagcgaaaaagcuuccaacgccacccaaauuuuagacagacuuauuaacaguuugcucauagaacauguagacuaugcaguagaauugggccuucaagcuguacccguugucgaaggcguuagaaaucccccuguuuuguauuuuuuuaaugucgugcaccaaagcaauaauauuacccaucucgucgaaaaacaguucauggauuuggugguuccauuaguagaaaacacuccaaaauacagcgauugcauacagaagaaaaaauuuguuuuggaggauauagaaagaaaaauuaauacgggauuggauaggugcuugagugcgauauuaaauugggugaaauuguauuuacaaucugagcagaagaaauccgauuucaagccugagucugaugauuuugauacaguggccucaccagcuugcaagaacguacuuaauuauguaaauagcauuaucaaagaaaucaaaacaaauuuggauggcaauaauguaacagcuuuucuucaagaauuggggauuagacugcauagaguuguuuacgaacacuuguugcaguaucaauauaacacugcaggugcaaugguggcaauuugcgauuuaaacgaauauaggucuuguacuaaacaauuagguccuuugguugcggagcuuuuugauacuuuacaugcguuaugcaaucuucugcugguuaaaccagaaaaccuucaacaaguuugcucugaagauucuuuggcuaagcuagacagagcuauacuccauaguuuuauacaauuacgaagugauuucaaaguucaaaagcagacuauuuugaaagucuag

SEQ ID NO: 6068 - RNA, 813 nt, Phyllotreta nemorum
auggauuuccaaaaccggcccgguggaaagacgggcggcggcggcgucgccuccuggucggaaaccaaccgagaccgaagagaacgacugaggcaacuggccuuagaaaccaucgaucugcagaaggacccguauuuuaugaaaaaccaccuggguucuuacgaauguaagcuuugcuugacgcuacacaacaacgaagguagcuacuuggcgcacacgcaaggcaaaaagcaccaggccaauuuggcccggagggcggccaaggaagccaaagaugccccgucguugcuccaacccgagaagccccgaguggagccgaaaaaauucgugaaaaucgguagacccgguuaucggguaacuaaacaaagggaucccgaaaccggccaacagaguuuacucuuccaaaucgauuauccagaaaucagcgacuugguuacgacccgacaccgcuucaugucagcguacgagcaaaaaaucgaaccuccagaccgcaaauggcaguacuuacucuucgcagccgaaccguacgaaaccauagccuucaaaguaccgagcagagaagucgagaaaacggauaccaaauuuuggacucacuggaacagagacaccaagcaguuuuuccugcaauucgcuuucaagaacgaaaacaaacgaaacguuaacgcagucguucagaggcauucgauugucgguggaguuccaccgccucccaugcugccgguaccgccgccacccaggccucccauguuuaaucccauaccaccgccacccccgaugaugagggcuauuuuaccaguaccuccaccgaauuaa

SEQ ID NO: 6069 - RNA, 402 nt, Phyllotreta nemorum
augucuaucggcguaccuauuaaaguucuccacgaagccgaaggccauauaauaaccugcgaaaccauaaccggcgaaguuuacagggguaaacuuauagaagccgaggauaauaugaauugccaaaugacucagauaacuguaacguacagagacggacgaguggcgcaauuagaaaacguuuacauuagaggauccaaaauaagguucuuaauauuaccggauauguuaaagaaugcuccgauguuuaaaaagcaaaccaaagcuggaacugcagguagagggaagucugcaauucuacgagcucaagcucggggaagaggccgagggcagccgccugugcgaggaggcagaggugcuuggcagaaucagcaaaaugccccugcaggucgagcaaaauaa

SEQ ID NO: 6070 - RNA, 1329 nt, Phyllotreta nemorum
auggcuacaaacuugucccgaacaucgcuccucagaguccuuaacgccaggggcuauucagccugcccgcauccacuuucuggcauuccaaaugcagaaguaaaaagcaccguccuccccaacaaaacagucguagcugcuguagacaacaacgccucucucaccagaguuucaaucguauucagggcuggaagucguaacgaagaccacgaaaauuuaggaguagcccaccuuuugaggacggccgccggucugaguacgaaaaacugcucgcaauucgcuauuauccgcaacauccagcaggugggagccaaucuaacggccacguccgacagagaaacuaucuguuacacguuggaggguaccccagaagcuguggaaugcgcuauaccguucuuaaccgaaguagccacccagcaggaauucagacccugggaaguuuccgaauuguccaguagauugcaguuggauauugccacucgaccauugcaguugagagcuguggauuugcugcacaaugccgcuuucagaggacgcggcuuggguaauucauuguuuaucccgaaaacucaaauuggcaaaauuucgaccgaaacccugcagcauuacguuugcucgaacuucuugagcggacguacggccgucguagguucggguaucagcgaaaaggauuugacgucuuuugccaauuccuugaaaauagaaaacggcgaaggcgaaaccgccccuucuccuuacguaggcggugaacuaagaucgaacaaagguggugaacuggcguuuauugcuguagcaggagagggagcugcucucaagaaccacaaggaagcucuggcuuuugccgugcuucagggagccauuggaggaggcccucaggucagacacggaguuucggacaacggaaucuucaggaaggcucuuggaaguaaccccaacguuaguucuguagccauaaacgccaguuacucggacaccggucucuuuggacugcuacuggccguuccuacgaaguccgccagaggugcuauagaaagcgcuguuaaaguacucaagagcgggacgguuucugaugaggaugucagcagagguaaaaaucaauugaaagcgucgauccucuucaaugcugaaagcggggcagauauuguaagaacucuuggacaagaggcuguuuugacgcaaaaaguuacgaguguugaugcacguuuggccgaaguggauucgguuucuaccagugaugucgcaaaugcucuuaagaaagcaggcaagaaguuaucgcuagcaucuguuggaaacuuggcuggaguaccguuuuuagaugaacuaaaguaa

SEQ ID NO: 6071 - RNA, 333 nt, Phyllotreta nemorum
  misc_feature (282)..(282): n is a, c, g, or u
augagaagaucccaugcagguaacuacuacgagccauugccgcagaauucgaacgaaauugaagacgaaaaugaucggaugacuaacgaauugcaagagaaaaucggaguucugaaaucccuaacuauagauaucggaaaugaaguuaaauaccaggauagaaugcucagggauguugacgacgauuuagaaaagacuggaggguuccugggaacaacuaugaacaaaguauuaaggcugucgaaaggaggccacaauuacauuauuguguauuuguuuuunuuuucgauugugguauuuuuuauacuguacuuuguuauuaaauuuagguag

SEQ ID NO: 6072 - RNA, 1491 nt, Phyllotreta nemorum
augucuuucccaucgacgauaaacgcaaaacaggccgcacacgagcacguuuuggccguguccagggacuucguaucccagccaaggcucaccuacaaaacaguguccggugucaacggaccguugguaauccucgaagaugucaaauuuccgaaauucaacgaaaucguccagcucaaacuggccgacggcagcuuacgauccggucaaguguuggaagugagcggcucgaaagccguaguacaaguguucgaagguacuucgggaaucgacgccaaaaacaccaugugcgaauucaccggcgauauucucagaacgcccgugucagaagacauguuggguaggguguuuaacggcucaggaaaacccaucgacaaaggaccuccaauuuuggcugaggacuaccuggacauccaaggucagccgaucaauccuuggucgcguaucuacccggaggaaaugauccaaaccgguaucuccgcuaucgacgugaugaacucgaucgcucguggucagaagauccccaucuucucggcggccggucugccccacaacgaaaucgccgcgcaaauuuguagacaagccggucuugucaaagugcccggcaaguccgcucuggacgaucacgaagacaacuucgccaucguguucgcugcuaugggagucaacauggaaaccgcucguuucuucaagcaagauuucgaagagaacgguucgauggagaacguaugucuguucuugaacuuggccaacgauccuaccauugagagaaucaucacgccccguuuggcccugaccgcugccgaauucuuggccuaucaaugcgagaaacacguguuggucauauugacugacaugucuucguacgcugaagcuuugcgugagguauccgcagcuagggaagaaguacccgguagacgugguuuccccgguuacauguacaccgauuuggccaccauuuacgaacgagccggacguguugaaggaaggaacgguuccaucacucaaauccccaucuugacuaugcccaacgacgauauuacucacccgauucccgauuugaccgguuacauuaccgaaggacagaucuacgucgaucgucagcugcacaacaggcaaauuuacccgcccauuaacgucuuaccgucgcugucgcgucucaugaaguccgccauuggcgagggcaugaccaggaaagaucacucugacguuucuaaccaauuguacgcuugcuacgccauuggaaaggacgugcaggcgaugaaggccguggugggagaggaggcguugacgcccgacgauuugcucuacuuggaguuccugaccaaguucgagaagaacuucaucacgcagggcggcuacgagaaccguacgguguucgagucgcuggacaucggcuggcaguuguugcguaucuuccccaaggagauguugaagcguaucccggccgccacguuggccgaauucuacccgagggacucgcgucauuag

SEQ ID NO: 6073 - RNA, 1503 nt, Phyllotreta nemorum
augaacgaaauccgcgaacgcgaacgugccggcauccgagucccggacgaacuacgagccaugcugcucgaauucaccugcagcuacuugcucgaacagcccgaagacguaguaucauacgcccaagaauacuucaccaaauucaaagaaagccgaggcacugccuugaucuacgaccaggacauguacgaucaggaaacaaugggcaucaaaaccgucuuggcucgccaaauauucgacuccagaggcaaccccaccgucgaagucgacaucaccaccgacuugggccucuuccgagcggccguaccaucaggagccaguaccggcaucuacgaggcgcucgagcuucgcgacaacaucaaaaccgaguaccacggcaaaggcgugaaccaggccaucaaaaacaucaacaccaucaucgcccccgagcugaucaaagccggcuucgaggugacccagcagaaggaaaucgaugaguucaugaucaagcuggaugguaccgagaacaaguccaaauugggagccaaugcuauccuuggaguauccuuagcuauuugcaaggcuggagcagccaggaaaaacgugccguuguacaagcauaucgcugauuuggcuggaaacaaggauaucauuuuaccaguaccggcuuuuaacguuauuaacgguggaucccaugcugguaacaagcuggccaugcaagaauucaugauucuuccuacgggggcuacaaccuucacugaagccaugcgaauggguuccgaaaccuaccaucaccucaagaagguuauucacgccaaguucggcuuggacgcgacagccguuggagaugaaggcgguuucgccccgaacauccucaacaacaaagaggggcucgaguugaucaagguggccauccagaacgccggauacaccggaaaaaucgacaucggcauggacguggccgccucggaauucuucaaagaagguaaauacgauuuggacuucaagaaccccaacagcgacaaauccaaauggauacccuccgacgaacuggaagcuuuauaccaagaauucaucaaagaguacccgaucguuuccauugaggaccccuucgaccaggacgauugggccgcuuggacgaagcucacgggcaacaccaaaauccagauaguaggcgacgaucugacggucaccaaucccaagcgcauccagacggccguggagaagaaggccugcaacugccuguugcugaaggugaaucagaucgggacgguuacggaaucgaucgaggcccaucugcuggccaaggcgaacgguuggggcacgauggugucgcacagguccggggcgacggaggacccguucaucgccgauuugguggugggccugucgacggggcagaucaagaccggggcgccgugcagguccgaacgguuggcuaaguacaaucagauucuucguauugaggaggagcugggggccggugcuaaguaugccgguaaggcguuccguaagccgcaguaa

SEQ ID NO: 6074 - RNA, 2421 nt, Phyllotreta nemorum
augaguuacaugcagacuaaccaaaauagaccaaugucucaagguuaucaucaggguggcaacgaucucccgaugcagucguccaaagagcagacucugcuguggcagcagaacuccuacaugggagacuccggcauccagucaggcgcugccacucaaguaccgucgcucuccggcaaagaagaggaagagauggaccucuucgaccucgaccagcccuaccaaggauucacgcaagagcagguagacgaaaugaacaaccagcugaaccacaccagaucccagagggugagggcagcuauguuccccgaaaccuuggaugaagggauugagauuccuucgacucaauucgauccgaaccaucaaacggcuguccaacguuuggcggagcccagccagaugcucaaacacgcugugguuaauuugaucaauuaccaagacgacgcugauuuggccaccagggccauaccagaauugaucaagcugcucaacgacgaagaucaaguggugguaucgcaagccgccaugauggugcaccagcucucgaagaaagaagcuucucgacacgccaucaugaacagcccgcaaaugguggccgcuuugguucgagccauuuccaacuccaacgauuuggaaaccaccaaaggcgcuguugguacuuuacacaaauugucgcaccacaggcaggguuugcuggccauuuucaagagcggcgggaucccggcgcucgugaaauuacugagcucuccggucgaaagcguacuguucuacgcuauaaccacccuucacaacuuguugcuccaccaggaugguucgaaaauggccguuagauuggccgguggguugcagaagauggucgcguugcuccagagaaaccacgucaaauuccuggcuauucucaccgacugucugcaaaucuuggcuuacggcaaucaagagagcaagcucaucauccucgccucccaagggcccaucgaauuggucagaauaaugagaucguacgauuacgagaagcuuuuguggaccacuucgagaguguugaaaguguugucggugugcuccagcaauaaaccggcuauaguagaagcuggcgguaugcaagcucucgccaugcauuugggcaaccccagcacgcgguugguccaaaacugccuguggacccucagaaaucuaucagacgcggcuacuaaaguagacggauuggagaguuuguugcaaucuuuggugcaaguguugcaaucguccgacgugaacguggugaccugcgcggccggcauccugucgaacuugacgugcaacaaucagcgcaacaaagugacggugugccaggugggcggcgucgacgcgcuggugcgcaccaucgucagcgccggcgaucgcgaggagaucaccgagccggcggugugcgcgcugcgccaccugacgucgcggcacgucgagucggagauggcgcagaacgccgugcgacugaacuacggcauacaagugaucgucaagcuguugaacccgccgucgcguuggccgcuggugaaggcggucaucggcuugaucaggaacuuggcgcuguguccggccaaucacgcuccgcugagggagcacggcgccauccaucaucuggugcagcugcucaugagggccuuccaagacacucaaagacaacgggguagcgucgccagcggggguagccagccgccugggacguacgcggacgggguucgcauggaggagauuguagaaggaacggugggagcguugcauauauuggcgagggaaucgcacaaucgggccaucaucagacagcaaauggugauuccgauuuucgugcaguugcuguucaacgauaucgagaacauacagcgcgucgccgccggcguucuuugcgaauuggccgccgacaaggagggggccgaaaugaucgaaaacgagggcgccaccgccccuuugacugaguuguugcauucgagaaacgaagguguugcuacguacgcagcggcgguuuuguucagaaugagcgaagacaaaccgcaggauuauaaaaagcgacuaucaauggagcugacuaauucuuuguuuagagaagaaaaucuuuggaaucccgaccuaggcauggguccggauuugcaggauauuuuaagucccgaccaggcauacgacaauauguaugcucagggucccccgaguguucauaguagccauggaggccgaccguaucaacagcaaggguaugaccagauacccauagacaugcaggguuuggagaucgguucucacggaggggggaauggguccacuuacagugcaauagacgcgauggacguuaccagcggagagccugaucucaauuucgauaccauugaucaacucccuaccccuccucaagauaacaaccacgcugcugcuugguaugauaccgauuuauaa

SEQ ID NO: 6075 - RNA, 801 nt, Phyllotreta nemorum
auggccagaaacgcagagaaggcaaugacgacuuuggcgagauggcgggcggcccaauugggcgaaaucgacaagcacaaaaaacgccggcccuauuuggcguccgaaugcaagagccucuacgcgugcgagaaauggcgcaugcaaaucauccgagaaauagcgaaaaaaguggcccaaauccagaacgccgggcucggcgaguuccgcauacgcgaucucaacgacgaaaucaacaaacuccugcgcgagaagcgccacugggaggaccaaaucaaagagcucggcgggcccgauuaccagcgagucggcccccggaugcucgaccacgagggcaaggagguccccggcaaccggggcuacaaguacuucggagccgccaaggagcuaccaggcguccgggagcuguucgagcaggagccgccgccuccgccgaggaagagccgggccgagcugaugaaggacaucgacgccgauuacuacggcuacauggacgacgaugacggcauacugauacccuuggagaacaaagcugaaaaaaucgccgugcaaaaggccauaucggauugggugagcaacaaggagaagaaccuggacucgagcaaagggaucgaagagagcauuuacgugguggaggagucggacgaagaggacgcuguccaacaguucgacgguucgcagcagcgguucguggcucacgugccgguaccgucccagcaggacaucgaacaggccuuguugaggaggaggaagcaggaguugauggagaaguacggcguucaagacgaacaagauguauaa

SEQ ID NO: 6076 - RNA, 645 nt, Phyllotreta nemorum
auggcugcgaaagacaugcccacauucaaaugcguccuagucggcgacggugguaccggcaaaacgacuuucgucaaacgccacaugaccggcgaguucgagaaaaaguacgucgccacccugggcgucgaaguucaucccuuaguguucacgacaaaccgaggcaaaaucugcuucaacgugugggacacggcgggccaggagaaguucggcggccucagagacgguuauuacauucagggacagugugccauuauuauguucgaugucacguccaggguuacauacaaaaacguucccaacuggcacagggauauugucagggugugcgaaaacauaccgaucguacuauguggaaacaagguugauaucaaggauaggaagguuaaggcuaaaaguaucguguuccauaggaagaagaaccuucaguauuaugacauaucugcaaagucuaacuacaauuucgagaagcccuucuugugguuggcgagaaagcuuauuggcgaucccaacuuggacuucgucgccgaaucggcccuucucccuccggaaguucaaauggauccgcaguggcagaaacagcuagaaaacgauuugaaagaagcuucggagaccgcucugcccgaugacgaugaagauuuguaa

SEQ ID NO: 6077 - RNA, 354 nt, Phyllotreta nemorum
guauuaaacuugauaugcauaauacuauacaggacggguuaccagggauccuucuugggaguaggaggaacauggaacuuaaacgaagaaaaaaauccugaugcggaaauuguggcaucuggaaucuuugucgguuucaugaucuacacugucguaucucuuauaaguuucuguuuugccagcggugaucacaaaacaucuuucaccgauauuuuaaugaacauaguuggaguauucauguggguggccguuggggcaacagcucuucacuacuggcucgguuauuugucagaauauaaauacucgaccgucgauuccgagcgacagguaaguuuaucaaugcagcaauauuaa

SEQ ID NO: 6078 - RNA, 2526 nt, Phyllotreta nemorum
aaauuaaucuucaaaaugccgcgaauaaugauaaagggugguguuuggaggaacacagaggaugaaauucuuaaggcggccgugaugaaauacggcaaaaaccaaugguccagaauagcaucucugcuucacaggaagucugcgaaacaaugcaaagcccguugguucgaauggcuagacccuagcaucaaaaaaaccgaaugguccagagaagaagaugaaaaguugcugcauuuagcuaaacuaaugcccacucaauggagaacuaucgcgccuauaauaggcaggaccgcagcccaaugucuagaaagauacgaauauuugcuggaucaagcgcaaaaaaaagaagaaggcgaggaugcuguggaugaucccaggaaguuaaaacccggagaaaucgauccuaauccagaaaccaaaccugccagacccgauccuaaagauauggacgaagacgaauuagaaaugcuuuccgaagccagagccaggcuagccaacacccaaggcaaaaaagccaagcguaaagcucgcgagaagcaauuggaggaagcccgucguuuggcugcuuugcagaagcgucgagaacugagagcagccggcaucgaagucaauucgaggcgcaagaagaaacgaggcguagacuacaaugcugaaauuccguucgaaaagcaaccagcaaucgguuucuacgacacuuccaacgaagcccuagacuugauggcgccggauuucuccaaaaugagacaacaacauuuagacggugaacucaggagugaaagagaagagagagaacggaaaaaggacaagcaaaaguugaagcaacgcaaggagaacgacauuccgcaagcgaugcugcaaaacgaagaaccggcuaagaaacgaucgaaauuggugcugccggaaccucagauauccgaucaagagaugcaccaaguggucaagcuaggcaaagccagcgaaacagcccgagaaaucgcuacagaaagcggagucgaaaccaccgacacucuucucaacgauuacauguucacaccacaagccgcugccaccccaagaacccccgcaccccaaaccgacaggauacuucaagaagcucagaacaugauggcccucacccacgucgauacgccucucaaaggcggucugaauacgccccugcacaacucugauuucagcgggguccugccgcaaucgcaagcgauaaccacuccgaauacagugcucgcaacuccauucagaucaucuagaagcgacgggggagcgacucccggaagcacggccggguucaugacucccaaaagcggagcacugacuccggucggcaaaaacgcgacgcccucugucagagacaagcuuaauauaaacgcugaagaaaguuuagacguggcgaguacuccggccgaacacagaauguaucaaaugucgaugaaggaccagcugaagcugggacugagcagcuugccgcagcccaggaacgauuacgagauugucgugccugaaaaugaggcgcaggacgaacccgaagaagcccaaucccaacugguugaagaccaagcggacguggaugcuagaaaacaagaggaacugagagccaaagcggcucaggaauuggcgucgcguucgcaagucauccaaagagaacugcccagaccucaagaggugaaccugaccgugcuccgaccgcccaacgaaagcuacuccuugacugaucuucagcgggccgaagaguugaucaaaugcgaaaugguuaccauguugcaauacgacaaccugaagaacccucugccggcccaaagcaagagaucgaacaugucgcaagcccagcaauuggccuuucucgagcagcauccuuacgauucguucaagcaagaagauuuggaaguggccaaaacgcuguugagaagcgaaauggaaguaguuaaaaacggaaugaaccacggagagcucccauuggacguuuacaaucaggugugggaagagugccugagccaagugcuguaucuucccaaucagacgagguacacccgcgcgcauuuggcgagcaagaaagacagauuagaauccgcggaaaagcggcuggaacagaaucgaucgcacauggccaaggaggcgaagcgcgccgccaagauggagaagaaauugaagauuuuaacgggcggcuaucaguccagagcgcaggugcuuauuaagcaguugcaggaucuauacgagagcaucgaucaauccgcuuuggaguugaacacguucaaauuuuuggccgagcaggaaaagaacgcuuugccgaugagaauacagucucuuacugaggauguuaauagacagauggaaagagagaaggugcuucagaagaaauacgccgauuaucaggaucaaauuaaacagcuacaagaggaguauuuaguucaaaugcaagguguuccgaaugaagaguccaauaaguaugacgaagucacuucgaccacgaaugaggaaaauguuauggauacaucggaaaaugauaaugauaaaauuguugcugaaaacuaa

SEQ ID NO: 6079 - RNA, 474 nt, Phyllotreta nemorum
augaugcaauuuauguuacuguucaguaggcaaggaaaguugcgauugcaaaagugguauguggcucauccagauaagcugaagaaaaaaauuaccagggaauuaauuacaaccauucuugccagaaaaccaaaaaugugcaguuuuuuagaauggagggauuuaaaaaucguuuacaaaagguaugcuagcuuguauuuuugcugcgcuauagaacagugcgacaacgaacuguuaacuuuggaaaucauucaucguuacguugaacuuuuggacaaauacuuuggaagcgugugugaauuggauauaauuuucaacuucgagaaagccuauuucauccuggacgagcuauugcuuggcggcgaggugcaggaaaccaguaagaagaauguucugaaagcaaucgcugcacaggaucuccuacaagaggaggaaacgccgcaaggauucuucgacgaucacgguuugggcuaa

SEQ ID NO: 6080 - RNA, 1251 nt, Phyllotreta nemorum
auguauggauuacaacgauauucguuucguuacacccucaaaaaugcggugcguuauuacucgagagaacccgccaagagaucgucguuucucagucgauuauacgacaauuucaaagacgaaaugaacaaaaacaaagaaaugaaagaaucuuuaaaaaaauuccgugaagaagcccaaaaacuggagcaaagcgacgccuuaaaagccgcccgacaaaaguucgaaaccguagagaaagaggccagcaaaggcggcgaagucuucaaagagaguuuagguucgauuaaagaaagagucaaaggaguuauagacgaggccagcaaaucggauuuagccaagaaagccgguaaauucaccgaagaaguaggaaaaaccacacacaaaaucagcgaaaccgcacaagaaauuagcaagacaggagccuuccaaagcaucucggaagccaccaaagcuguuaaacaggaaaucgacaacaccagcauggaaggucgaguguacgugagcccuaagaagcugcgaaaacgaaccgaaaccagcgcaguaguccaacagaaauacuacgaaccgaacacggacgcgaccggcguggagcuacacaaagacuccaaauucuacgaauccuggcaaaacuucaaaaacaacaacccguacgugcacaaagucauggacuggaagcucaaauucgacgaaagcgaaaaccccaucauccgagccuccagggcgcucaccgaaaaagucggcgacaucaugggcggcuuguuccaaaaaaccgaacuguccgaaacccucacggagaucugcaaaaucgacccggacuucgacaccaaacgauuccugaaacaaugcgaaaccgacaucaucccgaacgugcucgaagccaugacgagaggagaccuggagguccugaaggacuggugccacgaaggacccuucaaccuauucgcugugcccauuaaagaagccuacaagaaaggcuacaaaaucgaguccaagauacuagacguagaccauguggacuuggugaugggcaaggugauggaucagggccccguguugauuauuucuuuuacuucgcagcaaguuauggccguuagggacgcgucggggaccgugguggaaggcgauccggacaaagugaugagggugaauuacguguggguguugugccgggacgugguggagccggacccaagggcggcuuggagguugcuggaucuuucggcgagcaguaacgagcaauugguguag

SEQ ID NO: 6081 - RNA, 909 nt, Phyllotreta nemorum
augaguagcagugauucagaauuaagcgauagugaugcugaguugcaacaagccuuauuagaugguaagcugaaaccuggguuaaauaaaaucgaagaggccccuaaacaauucgugaacaacauaaguggcuuaaaucagaaaaucgaagaauucaaauugaaacugccauggaucgaacggcuggauuguacgaaugcccaagcccccuuggcgcccgaauuagcagcagaaaugcuaguucacgaggaaaagagaaguaaucaacucaggaacaacaagaaacuuccccaauuccaaccauccgaagaucccguucuaaacgauuuuaaacgagagcuaauauuucacaggcaagcacaagccacaauucuggaggcaaucccgaaaaucaaagaguuuggguuaccuacuaaaaggccagaugauuauuuugcugaaauggccaaauccgaugagcacaugcacaaaaucagagaaaaccugaagcaaaagcaggagcaacagaagcggauugaacgggugaagcaauugaggcagcagaagaaagaaggaaagucgcugcaggugcagaugaaauugcaacgguccaaggagaagaaagaaaugauggaucaagugaagaaagcgaggaaaaacuucgacuuuuuggaugacaaaaauaagcccaugggaaagaaggcggcggaaaaacguaaaaugaaggacaagaaauucgguuucgguggcaagaaaaagggaaugaaaaaaaauacaaaggauagugcgggcgauauuagugaguauagaaauccugggaagccggccaagaagcagauagggaacaaauucgucaacaaaaacaaaccgaaaaaucaaagauugggcaaaaauaggagaaucaaaacuaaggcuaaaggaaaaaaauaa

SEQ ID NO: 6082 - RNA, 3801 nt, Phyllotreta nemorum; identical to SEQ ID NO: 6056

SEQ ID NO: 6083 - RNA, 1851 nt, Phyllotreta nemorum
augaauccaggcgccccgaauuaccccauggcgucucuguacgucggagaccugcauuccgauaucacggaggccaugcucuuugaaaaguuuucaucggcuggccccguuuuauccauucgcgucugcagggauuugauaacccgcagaucuuugggcuaugccuacguuaauuuccaacaaccugcugacgccgaacgugcccuagacacuaugaauuucgacuugaucaaaggcaggcccauucguaucauguggucccaacgcgacccuucucuacgaaaauccggagucggcaacguuuucaucaagaacuuggaccgauccaucgacaacaaggccauguacgacaccuucucggccuucgggaacauucucagcugcaaaguggcucaagacgagagcggagucagcaagggcuacgguuucguccacuuugaaaccgaagaagcugccaauaaauccaucgaaaagguaaaugguaugcuguugaacggcaagaaggucuacguuggucgauucaucccgcgcaaagaaagggaaaaggaacugggcgaaaaggccaagcucuucacgaacguuuacgugaagaauuucggagaggacuuguccgaggagcagcugcgaacgauguucgagaaguacggcaagauaaccagcuacaaaauaaugagcaaggaugacggcaaauccaaaggguucggauucgucgcuuucgagagccccgaggcagccgaaucagcugucgaggcccuaaauggcaaagaguuacuggaaggcaagccuuuguacgugggaagagcccagaagaaggccgagcgccaacaggagcugaagcggcgcuucgaagcccugaaaauggaacggcugaaccgcuaccaaggcguaaaucucuacgugaaaaacuuggaugacaccauagacgacgaacgccugcgcaaagaguuuuccccguucggcaccaucaccucggccaaagucaugauggaggaaggccgaagcaagggcuucggcuucgugugcuucuccuccccggaggaggccaccaaggccgugaccgagaugaacggccggaucgucggcacgaaaccgcucuacgucgcccuggcccaacgcaaagaggaccgcaaggcccaucugacgucgcaguacaugcagcgcauggccaacaugcguaugcaccaaaugggccaguucauccagccgggcggcucgagcggcuacuucgugccgaccauucaagcgacggcgccgcguuucuacgggccggcccagaugccgauucgcacuaguccgagauggcaggcgcagacgccggugcgucccggcgcccagggcggcaccgccgccuacgcgggaaugcagaacagcuacagggccgcggcgaggccgcccggucaaucgacgaugcgcagcaacaucagcgugccgcgacccaucaccggacaacaaccaccaaguguugcugcugcuggaaaucgugcagccaacuucaaauacaccgccaacaugcguaauccgccgcaggcguuguugccgggagcucaggcucaagugcaacaggcagugcacauucaagggcaggaaccgcuuacugcgaccauguuggcagcggcuccgccgcaggagcagaaacagauguugggagagagauuguucccucugauucaaaggauguauuccgauuuggcugauguugcagguaaaaucaccgguauguuguuggagaucgacaacacggagcuguugcacauguuggaacaccaggaaucgcugaagaacaaaguggaagaggccguggcugugcugcaagcccaucaagcuaaacaagcugcuauaaaaaaagauuaa

SEQ ID NO: 6084 - RNA, 2703 nt, Phyllotreta nemorum
augaccgacucgaaguauuuuacaaccaccaaaaagggagaaauauucgaauuaaagucagaacucaacaaugauaagaaggagaaaaagaaggaagccguuaagaaggucauugcuucuaugacuguaggcaaagaugucucggcauuguuucccgaugucgugaauugcaugcaaaccgacaauuuggaacucaaaaaauugguuuaccuauaucugaugaacuacgcuaaaucccagcccgauauggcuauaauggcagucaacaccuucguuaaagauugcgaagaccccaacccgcuaauuagagcacuagcugucagaacgauggguugcauucgagucgauaaaaucaccgaauauuuaugcgaaccucugagaaaaugccugaaagaugaagauccauaugucagaaaaacagcugcuguuugugucgcuaaauuguacgauauuucaucaggguuagucgaagaccagggauuucucgaacagcuaaaagaacuacuaagcgacucuaauccgaugguaguagccaaugcuguagcugcuuuguccgaaaucaacgaaagcagccccaccggccagccccuaguugaauuaagcaccaacacgauaaacaagcuucugacagcucuaaacgaaugcaccgaauggggccaaguguucauacucgacucccucucgaacuacaccccccgagacgaaagggaagcgcagagcauaugcgaaaggaucacuccgcguuuggcccacgccaacgccgcuguaguguugucggccguuaaggugcugaucaaaaugauggagauuuuggcgggagauaccgaauuuugcaacacgcucagcaaaaaauuagcgccuccuuugguuacucugcugagcuccgagcccgaagugcaguauguugcgcugagaaacauuaauuugauuguucaaaagaagccggacauauugaaacaugagaugaagguguuuuucgugaaauacaaugacccgauauacgugaaacuggagaagcuugacauaaugauucgauuggcuucucaagugaacauugcucaaguucugagcgaacuuaaagaauacgcgacugaaguggacguggacuuuguaaggaaagcuguaagagcuauuggccggugugcuaucaaaguggagccuucggcggagagaugcgucgcgacgcuguuggauuugauucaaacuaaaguuaauuacgucguacaagaagcuauagucguuaucaaagauauauuuagaaaauauccgaauaaauacgagaguauuaucagcaccuugugcgaaaauuuggauacucuggaugagccggaagcgagagcuagcaugguguggauuauaggagaauacgccgagagaaucgauaacgccgaugaguuacuggauaguuucuuggaagguuucggugacgagaacgcucaaguacaacuccaguugcugacggccguugugaagcuauucuuaaagcguccccaacacacgcaagguuuaguccagcacguacucagcuuagccacucaggacuccgacaauccagauuugagagacagagguuucauauauuggagauuguugaguacagauccggccgcagccaaggaggugguucuggcagauaaaccgcucauaucagaagaaaccgaccucuuggagcccacucuucucgacgagcucaucugucacauaucaucucuggccagcguuuaucacaagccaccuacagcguucguggaaggucgaagcgcugguaucaggaagacguuaccggcuagacaaggcucugaugaaggcgcuaccgcugccgaaacaacugucaucccgaaccaagagagccucaucggagauuugcucaguauggauaucaacgcucccgcuccugccgcugcugcuccugcagccccucagaccagcaacaucgauuuacucggagguggccuggacguuuuguugggaggagguaccgauauuccugcuagcgcugcuacugcugcugcgcccacuaccacaggauuacugggagacauauucgggauaccuacagcgccuacuauguacacgccgcccaaaguuaucuggcugccggccgaaaagggcaagggcauggaaaucuacgguaccuuuuccagaagaucaggccaaauggccauggaaaugaccauuaccaauaaggcuaugcaggcuaugucugguuucgcuauacaauucaacaagaacaguuucgggaucaccccgagcucaccuuugaacaucccgacuuugcagccggggcaaaaccuggaauacagcuugccguugaacacuaccgguccgguacaacguauggauccuuugaugacgcuccagauugcuauaaagaacaacguggacguguuuuacuacgccugucagauucccauccagauauuguucggggaggaugguacucuggauaagaggguguuccuuaccacuuggagggacauuccuggagcuaaugaggugcaguacacgcugaacgauauaaaaggcaacacggacacgguuucgaacaaaaugacguugaacaacaucuucaccauagccaagaggaacgucgaggggcaggacauguuguaccagucgcugaaauugacgaacaacauuuggguguuguuggagcugaaguugcagccgggcgugccgacggcgacgcucagcuugaagucg

SEQ ID NO: 6085 - RNA, 498 nt, Phyllotreta nemorum
augccgccuaaauucgaucccacggaaguaaaauacguuuacuugaaauguguuggaggagaaguaggagcuacaucauccuuggcuccgaaaaucgguccucuugguuugucucccaacaaaauuggugacgauauugccaaagguacagcugacuggaaagguuugaaaaucacgguccaauugaaaauucaaaaccgucaagccaccaucuccguaguaccgucggcugcuucauuaauuauuaaggcuuugaaggaaccuccucgugacagaaagaaggugaaaaacauuaaacacaguggaaacauuacguuugaugaaguuauugcccuugcccagcaaaugaggccuagaucaauggccaaggcccuuucuggaacaguuaaggaagugcuggguacagcucaaucuguagguugcacaauugauggcaaagccccucacgacgucauagaugaagucaaugaggguacuguagaaguuccagaugaguaa

SEQ ID NO: 6086 - RNA, 1095 nt, Phyllotreta nemorum
augagcgaagaagggaaaagagcguuaauuuuagucggggguuacggcacaagacugaggccucuaacuuugagccgucccaaaccccucguggaauucgcgaacaaaccaauacuauuacaccaaauagaggcucuaguagacgcgggaguaacggaagucauacuggccgugucguaucgagccaagcaaauggaggaggaacuuacagucgaagcgaccaaacugggcguuuccauaguauuuucgcacgagacugagccucuaggcaccgcagggccaauagccuuagcuagagaacaccuuucgaaaaguacaaaaccguuuuuuguauugaacuccgauauaauaugcgacuucccguuuagggagcuggccaaguuccacgaaggccacggcaaggaaggcaccauagucgucacgaaggucgaagagccuuccaaguacggcguaguaguuuacgaugaaaacagcugcaucgagagcuuuguggaaaaaccgcaggaguucauuucgaacaaaaucaacgccggccuguacauucugaaccccagcgugaucgacaggauugaacuccggccgacuuccaucgaaaaggaaguguuuccuuacauggcuaaggacaagcagcuguacgccuucgagcugaaaggguucuggauggacgucgggcagcccaaggacuucuugaccgggaugugcuuguacuugaaccauuugcgggaaacuaacagccagaagcuguacaagggacccgguguggucgggaacgugcugguagauccaacugcaaaaauuggcaguaauugccaaaucgggcccaacguaacaaucggaccagacgugguaauagaagacgggguuuguauaaagcgcucgacgauacugaggggugcggucgugugcucgaacucuugguuggagagcugcauugugggguggaagugucacguggguaaaugggugagaauggaaggaaguaccguacugggagaggauguuaucgucaaggaugagacuuacauaaacggagggcagguucuuccucauaaaaguauugcuacaucuguuccagagccccagauuauuauguag

SEQ ID NO: 6087 - RNA, 915 nt, Phyllotreta nemorum
augaaaaacaaaaaaaaaaaaaaaaaaaaaaaaaaacccaaccuaaacauggcgucggacggugaagaagugauaagugaccaagaaaaagugaaaauaguuucggauuucauccuccauuccccgcccggcgaauucaacgaaguuuucaaugauguaaggaaacuuuugaauaacgacgaccuucugaaagaaggcguaaccggggcguucgcccaauacaauaaagaccaacucacccccguuaggauagaaaacgccgaucaaauggugcugauuacagaauacaacgauuuagguaacaauagauucuucgacccccguaguaaacaaaguuucaaauacgaacauuuaagaaaggaagcuucugauuaccagccuuauagugucgauacgacggcggagcccuggcgggccgcucuagauaacgaguuuauucaauacacuagaaaccauuauaaagacggcguuuguagcguauucggucgcagucagaacggugcgaucacccuuacugcuugcaucgaagaccaccaauuucagcccaagaacuucuggaacggccgauggagaucccagugguccguuagcuuaaccgaugaauccacagcugaaguacguggcguccugaaagugcaaguccauuauuacgaagaaggaaacguucaauuggugaguacuaaggagaucaaggagucgauuccgguuucuaacgaagcucaaacggccaaggaaaucauccauguaauagagaaugcugagaaucuguaccaaacugcgauuucugagaauuaccagacgaugucggacacgacuuuuaaggcccugcgaagacuccugccggugaccaggacaaaaauggauuggaauaagauuguaucuuauaguauugggaaagaacuaaaaacacaauga

SEQ ID NO: 6088 - RNA, 4098 nt, Phyllotreta nemorum
augucagcgaaaaugcucgugaaaaugaacuuucuacuaguuuuaauaaucagugcgguggcucaagagggcguagcgccggacguggcgggccaggauaauacgggagacguggaaaccaucggcgugggugcagcagggggcgacgauuccaggcccguuccugugggagaaaacgacggaacgguuacgaacaguccuaauuacgacgcuccagaaguauuaacaaauagagauaguacuaacaguuccaggcccaacuggacuuuccaaaaaaaaacuaaaucugggaaauacauaacuuuuuaugcccccaauuaugaccccaugacaucagauacugccccucaggacacggaccaaagggguggagguaucccuuacuccauaacugaaaccagguuggccgaaaucagaaaaaacuuuauguauccguucuacgauaaaggaggcaacguggacaacgagggggauuaccagaaggaaauccaauccuccacgccccaaguccacaagaaucugaauuuccaauugccuuucuucggauucagguauaauuacacaagaguuuccaucaaugguuauuuggaauuuagcgauccuccuuccaacuuaaauuauccauuggucuuuccuauaaaagacuggcccaagcaaaacgacccugcguuuaucgguauuuucuacaguaaauguaaaaucgguaaucuucgcgacgaagacguggacaaaagaaaaccgggaguguacuucagaauggaaagagaccuuagggacaggcaagacagaaugggaguggaaauaagagaaagauuaaaaugggauauaagagaaggagugaucgguucggauaccuuuaauccaaaacacgcuauuaucgugacguggaagaacgugucauuuaauggaggauaugccaacgcaguuuaucaaaccaauacauuccaaaugguccucgccaccgacgagguauuuacuuacgcaauauuuaacuacuuaaauauugauuggaccagucacacagaguccgguggagacacuagaaaaggcgaaggagguguaccggcauuugucggauucaaugccgguaacgguacgagaagcuaccaguacgcgcccuacagucaagcaucuguuauucgagauuugacaucaaccgguugggguaacaacaaaccuggaaggcacauuuuccgaaucgacgagaacauccuguuggguucuuguaacaaagauaucgauggugccaauuugccccuucaauucgcaccggagagcggcaauaugcugggcggaaccgucguuaacaucacagguccuugcuuuaaccccaacgauaggauaagauguaaauuugacguguacgaugaagucgugggauacgugguggacaggaaccgugcgauuugcauucaaccccgccuuuacgcagaagguugggugagacuccaaaucgccaucaauucugaggccuucaaauggaaaggaaaauauuacgucgaaucuccugccagcgccucacagaagaucuuuuucaaagacaugaaguaccacgagaagucgcccagcgagauucgcaucacguggcagaagcagaacuugacaaccaacgaaaacgccaacaucaggaucuccuuguggggcuacagggaaaccaccaugaggcccacguucguuuacauaacggaaauagccgauaauguucaaaauaccggagaguacaccaucguaccaucgcaguacaggggcaaagucaaccaguuuuuguccgacaucaaguucggauuccugcagauaaaucugaccgaaucgauaaaggucaacacuuacacuacaaacaaucaaaacgucgauaucacaccaauaauauggagcaggccgauuccgcuggguugguacuuccaauuccaaugggagaaucaauacgguaaaaauuggcccaaauaccucugcgaugauuggcucagaacggacagauaucugaagaauuuugcccaugaauugccgcaauguccuugcacggugcagcaagcuuuggcggacaaaggaaaauucaugccugacuuugauugcgacaaagauucaaauccuguuuguuauuacaacaaucaagcuuuacauugcgucaaaacuggugcucccacaauggaagguuccgaacaacaauguugcuacgacaaaaacggcuaccugaugcuguccuacgaucaacaaugggguucaaguccucgucgaugccacaaccucggcaaaaugccuuacaacgaggccaccaagguccccacgcuaucucaaugguucaacgacgucgugcccaaguaccucuguugccucuggcaggaagagcaagccgucggcugcgaaacacugcgauucgagagaaggccgucgcaggacugcgucgcauaucaagcgcccgccguagcgggaguuuacggugacccccacauagucaccuucgaugauguggaauacacguucaacggcaaaggagaguacuccuuggugaaaucgguuaaaguggacgauaacuuggaaauacaggccagauucgagcaaauggaucccaaugcuuacggugaaguuagagcaacgcaacuuacggcgaucguggcuaaaggaaacaagaccauuccuauugaagucagaagaagaccgccagaagccagauggagguacagauuggauguuauagccgagaacaggaggcuguauuucgauagaccuucguugaaauuucaacauuuucaaggcguuacuguuuacacaccaaccuacauucugaaccaaucugaaguacuaauaauguucgauaacggagccgguguugagguacuggacaaucaaggauacaugagugcuagaguauaccuacccuggucauuuauaaacaaaacggugggccuguucggcaacuggagcuucaacaaagaagacgacuucacgcuaccggacggauccaaggcggccguggcgagcaacaucaacgacauggaaagagucuuuaaugauuucgguucgaaauggaugcucgacgacgucucggacgcgaacaaaggccaaucuuuguucuacagggaauucggccgcaccucggccaccuacaacaacaagaccuucagaccgcaguuccucaugcugcccgaggacauccugccgccgaacagaucggagcaaauacagcgcacguacgacgugugcucgacgaagauguacgaaugcuacuacgacuacgccaugacguugaacagggaucucgcccacuucacgcaaaacuacaaggcgaccaucuacgagcugaaacaaaccacgagggagaaaaucacgucgugcggcgugcuggaaacgccgagguucggcaggaagagcacguucuuguucguacccggcaccaaggugacuuacgaauguauacaggauuucgugcugaucggugauccucgaagagagugcaaggcagaugggaaaugggacacgccggaauuuggauauacuuauuguuugcgucaagaagaauauucuucccgccaagcggcaauagcguccgguaucguacucgcgauucucauaccacucauacugcuauuccuuuacuuaggcuauaaaauauacaaaagguuguucggcaacgacgacggcucguggaaguaccaaucgacugcgcagaaauccggcggcccgcaaacguuccgacgcagcuuuucucccuaccgggacgaggacgacgacgacaucccgcaaagcccuuccgacagcaauucgcugccgaagaagcgcagaagcuacgagaaaucguacaggacgcacgagccguugaccgaucggccgagcaucgaguucgaggacaaaccuuuggaucccaaugaucccaauuacgacgauaucgauaggacuucggcggcuccgucgagccccgcgagucccacgagucccacgucuagcgugcaguacacgacuccguacaacgcgaggcccgauguuuuauuggggaauagugauggaaauuugggguauacggagaacgauuacgcgaugcccauuaaaaggccuaagaauagguucagucauagucagagcaguauuguuacggauguuuga

SEQ ID NO: 6089 - RNA, 387 nt, Phyllotreta nemorum
  misc_feature (267)..(303): n is a, c, g, or u
augcguuacguggcugcuuacuuauuggccguuuugggcggaaacgcuuccccaagcgcugcugauguugaaaaaauucuugguucuguaggaguugaagccgaagcugaaaaggucaaaaaaguuuugggcgaacucaauggcaaauccaucgaagagcucaucacuaaaggucgcgagaaauugaguuccaugccaguggguggugcugcuccuguagcugcugcugcuguugccgcugcuccugcugccgccgaagaaaagaannnnnnnnnnnnnnnnnnnnnnnnnnnnnnnnnnnnncagaagacgacgacaugggcuuuggucuuuuugacuaaaaguuacuuuguaagauucaacaugauuuuuguaauauauuucuaa

SEQ ID NO: 6090 - RNA, 2724 nt, Phyllotreta nemorum
augaugacugaccguuuuggauuaaaaugggaccccaaaaaucuagaaauuagaaccaugucaguggagaaaacucuggagccccuugugcugcaaguaacaacccuuguuaacacgaaggggcccagcaagaagaaaaagggcaagucaaaacgugcuaaugcucucgucagcacaguagagaaggccacugagaauuucaucgagaaaggugagcaaauugcuuaugagaauccugacauaacggaugagaugauagcugcuguugaagaagucaggaagacuggcaaugcaaugagcauagcugccagggaauuuucagaagauccuuguucuucucugaaaaggggcaacaugguacgugcagcuagaaaucuacuaucugcugucacgagacuucucauucucgcugauaugguugacguucaucuucuauuacaaucucugcacguagucgaagaugauuuggagaaacuaaaaaaugcuucaagccacggggaacuucuugacaauauuaaggccuucggucacaaugcaaacgaacuuaugaaucaggcugcuaaaagacaacaggaacuaaaagauccacagcuacgcgacgauuuggcugccgccagagcaguauuaaagaaacauuccacaaugcuucuaacggcuucuaaaguuuacguucgccacccggagcuagccgcagcuaaggcuaacagggacuacgugcugaagcaaguuugcgaagcuguuaauacgauaaacgauguugcucagggaagaacaccccagcccgcuuccggucccuacgauggaccaggggaacucgcagcugcuuuagaugauuucgaugaccacaugguuauggagccucuggcuuauaacgagguucauacgagaccgucguuggaggaacgucuggaaagcaucaucagcggggcugcuuuaauggcugauucgaguugcacuagagaugagagaagagaacguaucguugcugaauguaaugcugucaggcaggcuuugcaggauuugcuguccgaauacaugacgaacaugggcaagaaggauaagagcgacaaucuaaacagagccauugacaauaugggcaggaagacccgcgaccucagaaggcagcucagaaaggccguugucgaccacgucucagacagcuucuuggagaccaacgugccucuuuugguccugaucaaagcagcucaaaacggcaacgagaaggaaguggaagaguacgccgucguguucaccgaacauuccaauaaacugguagaaguggccaaccucgucugcagcaugucgaacaacgaagacggcguuaagaugguucgauacgcugccgcucaaaucgacaaucucuguccugaaguaauaaacgccgccaggauccuggcggcgagaaaccgcaguaaaguugcucaagaaaacauggaagcuuucaaacaaucaugggagaaccaagugcgcauccuaaccgaagcugucgaugauaucacaacuauagacgacuuuuuggcuguguccgaaaaccacauccuagaagacgucaacaaaugcgugcuagcccuucaagaaggcgaugcugauacguuggaccgcacagccagcggcauaaagggccguucaaacagaguuugcaauguuguaacagcugaaauggauaacuacgaaccuugcauuuacaccaaacgcguuuuggaagcggugaaaguuuugaacgaucaagugaugcccaaguucacccaaagagugcagguggcuguacaggccuuggguaacagcccgccuaaggaagucgacgaaaacgauuucaucgaugcuuccagauugguuuacgacggugucagggagauaagaagagcugugcucaugaacagagccgaugaagauuuggauccugaagacgucgagcucgaugagaauuaccugauugagaccaggaguaaaucgagugcucauacuggggaacauggcguugaugaguauccugauaucaguggaauuaccaccgccagggaagcuauggguaagaugccggaagaggacaagcaaaaaauauugcagcaaguggaguuuuucaagagcgagaagcucaaguucgaucgcgaagucgcuaaaugggacgacaccggcaacgacaucaucguuuuggcuaagcacaugugcaugauuaugauggaaaugacagauuucaccaggggaaaagguccucugaaaaccaccauggacgucauaaacgcagccaagaaaauuucagaagcaggcacuaaauuggacaagcucaccaggcagauagccgaacaguguccggaaaguucaacgaagaaagacuuacucgccuauuuacagcguaucgcucucuacugccaucagaugaauauuacuucuaaagucaaagccgauguucagaauaucaguggagaauugauugugucuggucuugacagugcuacaucauugauacaagcggccaaaaauuugaugaacgcugucguucugaccgugaaagcuucauacguugcaucuaccaaguauccuagacaaggaacuguagcuucuccgauugucguguggaagaugaaggcuccagagaagaaaccucuggugagaccggagaaaccugaagaaguucgugccaaagugcgcaaaggcucacaaaagaaagugcaaaaucccauucacgcucuauccgaauuucaaagccccacagagucuguguaa

SEQ ID NO: 6091 - RNA, 1254 nt, Phyllotreta nemorum
augucuuucaauuucggaaauacuagugcuccaaaaccagcugcuacaggcuucacauuaccgucaaauccggccacuaccagcgcaacaggauugcaguuuaauuucggaggaggcgacaccaaaaccgagguaaaaccgucaucuaccuuauuucccacagccacaagugccgcuccggcaccagcuuucgggaucgccccgaaaccugcgacuccuucaucugcugcugcugcugcaccgucuuuuaauuuuggcacgcccacgacccaacagacaacagcguccgcuuucggaacuaccacaccagccucguuuaguacuccaaaugcuucuacucugcaauucguaaccucucgaccgcaaacagacgugucuggguuguuuggaucaacugcaacugcagcugcgacgccuauuucagcuucgacuggacuuaguuucggaacaacaguuucaacaaccccaguuucagcaacuccagcugcuacagggaccccccuuuuuggagcugcuccuaccucaagcagcacuacuacaauauccagugugcccgcuuuagguuuaucgacuacaguuucuucagcugcuucaacaacuccgucuacuucauuaaguaacacaacaucagcuccuccuccugcuuauucggcaucgacacuuccuucaaccgguucguugacuuucagccaacuggaagauucuauuaacaaguggacuauugauuuggaggagcaagggaaguuuuucauuaaucaagcgaagcagcugaacgcuugggacucguuacuuauuucgaacggggaaaaaauucucaaucugaacgguagcaucgagagaguuaagcagcagcaacagcaauuggaccaggagcucgauuucguguuggcucagcagaaggaguuggaggaguugauaacgccgcuggaaaaggaguuguuggaaauuccuguuacggacauagaucgaaaucaaauguaucaauuuucggaaauaauugacucccaacugaagcaaaugucugaugaucugaaagaaauuaucgagcauaucaaugaaucuaauaaaagcgaagaaauuucgaauccuuugacgcaaauuagccgcauaaugaaugcccacaugaauucacuccagugguuagacagaaauacggcccaaauaguuucccaccucgaacagaucagcaaaaugcaggacuccaacagaagaaauuuuccccuaaaucauucuuuuaauaauucacuacuuuaa

SEQ ID NO: 6092 - RNA, 582 nt, Phyllotreta nemorum
auguucauaugggauugguucacgggagugcugggcuacuuaggacuauggaagaaguccggaaaacugcucuuuuuaggacuggauaacgcugguaaaacgacccuauuacacaugcuuaaagacgacagacuggcccagcacuugcccacguugcacccgaccuccgaggaauuguccaucgguaacaugagauucaccacguucgauuuaggagggcauucgcaggccaggagaguguggaaagacuacuucccugccguagacgcuaucguauuucucauugacgccaacgacagaucgagauucguagaaagcaagcaggaauuagacgcuuuguuaacggacgaaacucuagccaauugccccgugcuaauuuuaggcaauaaaaucgauuugccggacgccgcgucugaagaugagcugcgaaacguuuacucuuuguacggccagacgaccgguaaagguaaagucgcucgaucggaccugcccggccggccucucgagcuuuucauguguuccauuuugaagaggcagggauacggggaggguuuucgcugguuggcgcaguacauugauuaa

SEQ ID NO: 6093 - RNA, 564 nt, Phyllotreta nemorum
auggauccgauuaugggauuggaaaaacaaaucgaagcauuggaauugcaagcuuuacaaaacgaagacgaaucucaaaucaaaagcaaaauccacgcaauuaccgggcuauuguugcaaacuagaaugaugauaaauucagcucucaguugccgagaagcauuaacaucaauguuacaaccuuuaacgacuguuaacgauuauuugaauccuucgacuaguagcaaugauguagaaguggaagcaaaaaggcaguauuuacucgaaucguaucccgaauuaauagguaccguacaaacaauaggaaccuucgaaucgcucuuaccguuucuuggaucgauuaauauaucuaaagugguggaguuuugcgagauuuuggaagaauuggcuucgaacaacacugaacucuacggagaauguagagauguuauaaaggaaguucuuggugcauugcaagauuauaaugauauaucaaauucaauuaaagcauuacuuucacagugggauuuuaccauaucuaaucuugagcaugcuuugcaaccuaaauuucuugauguuccguga

SEQ ID NO: 6094 - RNA, 1752 nt, Phyllotreta nemorum
augagcaacgcuaaauuccaagaaguguacagugaccuaacgcucuacaccacuccagauaaauucuucaucgagccgaaggccggcgaggaauugauggugauagagcgaaauuccgagaauauaauaugcuucaaaagcgaccacagacaucugauaccugcagcgaacagccggaaggauuucugcggguuaauagguauaauccaacuguuagcuugucccuacuuaguaauagcaguucaaagagaauuggucggcuacauagccggcugcgcuaucuggcggcucgccaaagcugagcuaauaccauacaggagcuccgcucacuuaacacccgaaaaacaagccgacaacgacgucuauuuguccaugguuuacuccguacuauccacuccauuccuauacuuuuccuacgacuacgaccuaacgcauuccuugcaacgcuugcacggcauuagccccgauuuuuggaagcaauccuuguucgagcgggccgaccagagguucgucuggaacggaaaccuauuguauucguucaagggauucuccauacacagauucugcuugccucuaaugcacggauucguuucgauuaacuucugcguagugaacgggcacagccuaaacuggucgauuguuaguagaaggagcguucaacgagccggcaccagguugcaccgaagaggcuuggacaaggaagggaacguggccaauuucgucgaaaccgagcagauagucgaguaccaaggcgaccgggcgaguuucgugcaaauacgaggaagcauuccgcuguuuuggcaacaagauccggaccugagguacaaaccgccgccuacuuugcucgacgucgacccgcaggaucagcacucgaugugucugaagcacaugaacgauuuaaugacucucuacgggaaggugguuugcgugaaucuaguagaucaaaaaggagccgaaggaaacauggaagucgcguuuaaggacgccguuagcaacgugucgucuccuucgguuaaguacgaaucguucgauuuccacgccgagugcagcaaaaugagaugggacagacugucgauucugaucgaucgguuggcgcacgaucaggacgagaugagcuucuuuuuguugcucagagacggcucguugaguucgcugcaagacgguguguucagaacgaacugcaucgauugcuuggaccgcacgaacguggugcaaagcaugcuggcccaucggaaucucgagggcguguugaggaaauugcaaauccuccaucagaaucaaacguuggaauuccaguauucguucgagguguuguuuaagaacgucugggcggacaaugcggauauaauaaguacccaguauacggguaccggugcuuugaagacggacuucacgaggaccggcaagcguacgcauuacggacugcuucaggacgguauaaacuccguuacgagguacuacaagaauaauuucgcggacgggcuccggcaggacgccaucgaucuguuuuugggccacgguaagcccguuucgccguugcacaucgacaaagguuggaaguacgugacuuauccgucgauucugcugaucgcuguggcgauguucguggccugcgcugucacuccuuccgaguauucgacggauuccuugcuguuucucuuguucugggguucgauggucuaugcaacuuugcacacuauuuucaaguacgguucggaguuugucgauaaaccuaggcucacccaaucuuag

SEQ ID NO: 6095 - RNA, 1497 nt, Phyllotreta nemorum
augccuccuacgauccaacagaauaaccagaacgccgcgaauggcguggaaaaaagacaaguaaagacugucgaaaaaaggucagauuuauuauguaaaguaaaauauugcaacacacugcccgauauaccauucgauuugaaguucauaaccuacccuuucgaauccauaagauucauccaguauaaccccacguccuuggaacgcaauuacaaguacgaaguauuaaccgaacacgauuuaggaguaagcauagaccuaauuaacaaagauauauacgccaucggagcgggcgccuccuuggauccggccgacgagaaacuccuagaagaagacauccucacgccccaggacuccaagcggucccgucaccaugccaaauccgugucguggcuccgacgaaccgaguacaucuccaccgaacagacccgauuccagccgcaaaccauggacaaagucgaagccaaagugggcuacagcaucaagaagucccucaauaacgagacccuuuacauggacagagauucccaaaucaaggcuaucgaaaaaacguucgaagacaccaaaacgaucaucgacaagcauuacagcaagcccaacguagugccuguggacguccugccggucuauccagauuucagcuuguggaaauauccuugugcucagguuauuuucgauuccgauccggccccagugggcaaacaaguaccggcucaaaucgaggagaugucgcaagccaugaucagagguguaauggacgaaagcggcgagcaguucguagccuacuuccuccccacagaggaaacucuacaaaagcgcagggaagacgucgcgaaccagguccaauaccaagacgaugaggaauacgaguacaaaauggccagggaguacaacuggaacguuaagagcaaggcgagcaaaggcuacgaggagaacuacuucuucgucguucgaucgagcgguaucuauuacaacgaauuagaaaccagagucagguugagcaagcgaaggcagaaagugggccagcccccgagcaacaccaggcucaucguuaaacacaggccuauggaugcuaaugaauucaggaugcaacgguacagggagaagcagcucgaaccuacaggcgaggaugaugaagagauggaaaucgacgagccccaagacgaggaaaacgugcuggagccggauaacggcaaggaaacggagagcgacaacgaaaagaaacgauccagagcuuccucggugucuucccaaagaagguccagauccaggucgaauucuucggcuaaaucgaauucgagaucuaguuccagguccgcgucgaaguccaggucucggucgagaucgaagucgucgucgaggucucgguccaggacgccgucgaagucuccuacuagguccaggucagcuucgaagucgccuucuaggucuagaucgccgucgagcgccagauccaaaucggcuuccaguuccggcucgaauucagauagcgaguga

SEQ ID NO: 6096 - RNA, 1170 nt, Phyllotreta nemorum
augccgauugaaaauuuggaagaucaagguuuagaaaagaacccagaccuagagcuagcucacuacaaguuucuccugacgcucccagaauaucgcagcgaccgcaauguccauucgaagaucacugaagccaucaagaaggaugauauggccccaugguaugaacuccuuugcaaagaaguaggcuggaaguuagacucugccuugcugaagacccucaaagccaagaaugccgaaaaggucaagcuucuggacgaagccaucgaggacgcggagaagaacuugggagagauggaggugcgggaggcuuauuugcguaaagcggaguuuuacagcaggaucggcgacaaagaaaacgccgugagcaccuuuaggcagacuuacgauaaaaccgugucuuugggccaccgcuuggacaucauuuuccacuuaauuagaauaggcuuguucuuuauggaccacgaccuuaucaccagaaauaucgacaaagcaaagacccucauagaagaaggaggcgauugggacaggagaaaccgauugaaagucuaccaaggugcuuacuguaugucgguaagagacuucaaaaccgccgcuaaccuauuuuuggacaccgugagcaccuucacguccuacgagcucauggacuacaaggcuuucgucagauacaccgucuacacuuccauaaucagucugccgagaaaccagcuuagagauaaaguaauaaaaggcucggagauacuggagguacuccacuccgagccguucguuaaagacuaccuguuuucguuguacaacugccaguacgcagaguucuucucgaauuuggccgaggucgagacgauucugaggaaagacuacuuucugaauccgcauuaccgguauuacguuagggaaaugaagauuucggcuuacacgcagcugcuggaguccuaucgaucucucacauugcaguacauggccgaagcuuuugggguuacuaucgaguacaucgaugaggaguugucgacuuucaucgcggccggaaggcugcauuguaaaaucgaucgagucggaggcaucguugagacaaacaggccugauuugaaaaacgcucaguucaauuccgucgugaaacaaggggauuuguugcuuaaucgaguucagaaacucuccagaguuauuaauauuuag

SEQ ID NO: 6097 - RNA, 8325 nt, Phyllotreta nemorum
auggaggaauuaaccucggguuuggaucccgacgauuugauggaucuggacgagccugaaggguccgauuuggaagacgacgacgaggaucucaucgaugaucacgucucgucgccuuucaucuccuccucggcgccggaauccacggccaacuccgucgccuccucuccgauccacgaagacuucccuccgcccuucaauuucacuggcaaaccucuacacguuaaacgcggaagaggaaggcccagaagagaaggagguaagccuucggcgccgagaacgacaaggggcgguggaacuggagugucgagaguacgcaggccgagaccuccggguuuuucaagaagagggucauuaggaggaaguagaagcguuaggcaaguagagagaucggauuacgaaaugucucuuuucuccggcucaccgguggacgaugguauguuggaucccgaaacggguucgaugaucuuucccgagaaguuuguucccgcgaucgaggagccuccguauuuuccggagcauuggccggggaaagcuugugccuuguguaauuuaggugaaaggagccagcuaggucaaggugaaaugcuaagauuaaauuguccugaaggauucucgccggaaaaaguuauuagugagcaaauauuagaaagagccuugcaagcuccggauaaagagugcggggauaaaagcccgaaagguccugugacuuguagaaggcaaaagaguuucaacaaaugcagacauccuucgauaaccagugaauacguugaugaauuaacuauaauuggauauaaugaaguaccugauguaucuaguuuguuugagccuaacggacaguuuuacguucaccguaauugugcgcuguggucuaacggaguaacgaaagcagaaaauucggcguuguugaauguaggaccuguaguaucgcaauguucuuccaaaaaauguuccuucuguaaucauuacggagccagccugaccugccacguugacaaauguaccaaaauuuaucacuuuccuugugcuacugcugccggugccuuucaggacguuucuucauuggcaacuuugugcaacgaccauuuaggacaaguggcuaugcucacuaacgcgucuccauguuuaacuugcgcuacuaugggagauauagcaaauuugauguuuuguucggguugcggcgcgcauuaucauggaauuugcgugggauuagcucaguugccaggcguuagauccggcuggcaauguaggaaaugccguuguugccaaguuugucgaguacuaggagacgagucuaagcugaugacuugcgaacaaugcgauaaaauuuaccaugcuaguugucaaagaccgauaguaacuucuauaccgaaauacgguuggaaguguagguguuguagagugugcggcgauuguggcgcaaggaccccaggagcugguuuaucuucaagauggcacgcucacuacacaguaugcgauucuugcuaccaacaaagaaauaaaggauuuucguguccuauaugccauaaagcuuaccgugcacacgcucauagagaaaugguccaguguuccaguugcaagaaguuuguucauggaaccugcgaucccgaagcagacguugucaccuacagucaaaagaaagaaauaagcauggacuacgaauacguuugcuugcauugcaaaaauagcacggccagacaaauaaccgcgaaacgagcgaguaucgacgauccuuccgacguauccgcuucucacgauucccuguacgacgauacguccgaauuggaccuuccuucgcccgacgaguucgccagaaacauggguuugggcaaagggaagccguauagcgcgaauaaaauagccaagaagcgccuuaguuucacaguaaauccggucggcaggccgaaaggcaccggaaaggugccucccgggaaaaugggguuuaugaaacgcuaccgacuuaccgaauucaacagaaaacggggccccaaggccaaaaugagagguauuuucggagugcccggcgugggucugcaaagaccgauuucagauggaaaaaccgacgaagaaccaggagucgaaaaccgauuaguacuguguucagcuaaagauaaauuuacgcuuacacaagauauaugcguaaugugcggggcguucggaaccgaucaagagggcuguuugaucagcugcguacaaugcgggcaauguuaccaccccuauugcaucaacgucaaaguaacuaaagugauccuacagaaaggauggagaugcuuagacugcacagucugcgaaggcugcggccaacguaacgacgagggccgucugauccucugcgacgacugcgacguguccuuucacaucuacugcauggacccgccgcucgacuacgugccgcacggcaacuggaagugcaaauggugcgccaucugccaauccugcggcgccaccgaccccgguuucaacugcacguggaugaacagcucgacgcaaugcggcccgugcgcuucgcacgucaacugccccagcugcagcgagcccuacggcgagggcgauuugaucauacagugcgugcagugcgaaagauggcugcacggcgcgugcgauuucaucaaaugcgaagaggacgcggagaagugcgcagaagaaggguacaauugcauuuuguguagacccagagacgugccgccgccgcauaugguuccugcggcggucacgccgaagccuccgaccccgacgaagagccccgagcuggggaagagcaccagcuacuacauggacggcgugugucuuagcgaauucggcaguaacuugaucaaaucgcuggcgcucgaauaccacgggucuaggaagaagcggaaaaagauacccacugugcaggauaaggaagccgguaucauggcuacuauugaaucuguaguugcuggaggaaauauuauuccuacuaacauggaagacagcgcuaaauuggagcucgucgacaucaaagacgagccucaggaguuguacaaagaaggcaugauguggaccaaagaggacgguccuccucccgaaggcuucacgauaauaaccauggagaacgggcugaacgugcugcgaaggaagaggcaacgcaaucugcagaagcucggcaucgguggguucgugguaagaaugagagguaucagaacgggucaggauaacgaugaaguggauucgaccaucggucaaagcgggcucaaccccaacgauauugucccaucaccugcggacggugauaaaccuaggaggaaagcuauucguagaaagccgaagaguaaauuagcugaaacguuuccugcuuaucugcaagaggcuuucuucgggaaagaucuuauggauacggucgauuguaaaaaagaagaagucgauuguuauagcagcgaugaugagaaaacugacaagcauuauaaauccauuaauuugucucaggacgaaauaauagcaaucguggcaucggguaagaccgaaaaauuggaaaccaauaacaaagauucgaccaaagaagucaaaccgacuguauugaaagaggaagaagaagauaauccggaggauuugaaagacguucuugcccuaccgggcgauuugcucgauaccgauuugguuaauagcauuauggaagaugaggaggagcuuagcaaaaccacagcgucucuugucgcuuuagauucgaauuuaccgcaugauacugagcucaccgacacuuugaguaguucgggaaauucgaaagaaaccaaagaugaauugagcgacauucugggcccucauuucaaccucgauuccauaucgaacauaaacagcaaggacgucgaagauauauuuaaggggguauugacagacgagucucaagaaucccaagaaagcagcagcuuuuccuuacaaggaaacaguauguucucgaauaauaaugcucagcaaaacguugcccaacaccccauuauuaaccaaccagugaggccgaaaacuuugccuacuguuaaccuuaaucugaauuccccagucgguuuuccuccacccucaccuuaucacucagaguacagcaacagcaguccucaauuuaguccugcguucacugaaucguccuguucguggguaagcggaaacgaaacgcccgaaaucgacaguacgaacguaacggugaccucuacguacaaucagagguccuccgauaaaaugaaagccgacgaaaguuugggcaaaagcgccacgauuuccgcuguauuauaugcgaacaucaaucaucccgaauggaagaaggaguacccgaauuggcccgacagguacaagcaaauaauaaaaaaauggagaacguugagucaagaacagaaggcgccguuuuugcagcacgcaagagauaauaggagucaauugaggaugaagaaagcgcaacagucacagaccgucaaggaaaccgccucugccgccacgucccccaacgcgagcaagccucuccaccaagccggccaagcccuagcgacaacucuccaggcgguagcgcaacagccggcgggggcucccgcggcccccgcggcgcccguuucagaggaccaagaaaaaaucgcccuccagcaaaaauccgccagggaggccgagcaggaaagacaauggaagcaauugcaggcucucaggcagcagcaaacccaacaaacccagaacauccugcacgaacagcgcguucaagccauugcccgcguacaacgccagauaucgaccgaucccgcucagcaauucauaagcgaucagcaaagccccuugcaggugaacacuccccaagaauugagccccucgacuacgccagcccccaguccccggcaauuucucggcaucaaauccccgaccuuccccgugccuucaccuauucagcaaaccggcgucagggccaacacgcccucgcaaucgccccacgauaucgcccaaccgagcacgcccgacgguaacgaucacuuuauccauucccccaccaauccuaaaccuaauuuccaaccuagauugcccaaugauccguucgcugcgcaacccgccacgccgagaccccaauucgcuauggcccggccaccccuacagaauuucggcgguacgguucgcaacgagcaacaggauaucaacauaaaucgacaguugagggagcuguugcagcgacagcagguuaagaagcuggacgaguuguugcccggcaaagcgccgccucagaggcuuuggcacggcaaugaucagcaggagggcggcgacgcuucgaugacgucgccuguagcacaaggccccggugcccaaggcacagacgccaccuuccggcaaccucuaccgcccggaguggucaaaccuaggcuggccauuucgucgguaaauaggcccguauugaacgcuguuagagucaaucaauuggaucccaggauucaaaauuuggauccaaggaugagguugauuuuacaacaucaacaacaaagacuacccacggguauucaacagcaauuuauucguuucgcuucgaacguacgaccgacuaccguagaacaguacgagcaauuguugcagcgucaggguaauaaucagaaucaaauucacgcugaggaacagcagcagggcgucgcgcgaauacccauagcccaggccagcgucauacaaagaccucacgucgcucaagcugcugcgacuggcgcugcugcugccacaaccaguuccacggaaagcaaucccagcgaggagggaaucccggauaaugucacagcugaauuggagaaacucgaacaggaaacagguacuaugguggagcuacaaggcguaagcgauauacuaggcggauuggacgaugacgaugagcuuuuagcggaaaugggcgcugauuucaacauacucgaauacgcugaucccgaauuggaagcuuuaacaggcgggaaaaccaacauucuagaccuggagcucgaagaggaaccggucaaaaaagaaaaacucgcuucaaacgcaaacacuagcgcuccuucucaaaaaccaacgccuaacgugaccacuacggcuauuagcaacagcaccgcuguuacuacaccgaccgaagccaacacggaacccaaaauggacaauacgauucaacagagcauuccgaaaacgcagccucaacagcuacaacauccugcgucccuuccacagcagcagaacaugccccagcacaacgcacaaguucaggugcaaucccagcaacagucucagccgcauccuccgcagcaaaugcccauucaaccgacgcugcauauccagcagauucaccagcaaauggugcaccaaguucaacaagcagcugcgcaaggaagaccaaugccuccggguucgaagaugcaaaccaccgauggguucguugggguggugauggcgaacaacgccgugcaauugcagauccccccgaauuaucagcaaauggugcaccaaguucaacaagcagcugcgcaaggaagaccaaugccuccggguucgaagaugcaaaccaccgauggguucguugggguggugauggcgaacaacgccgugcaauugcagauccccccgaauuaucagcaaagauugcuucuguugcaacaacuacaaaaucagaaacugaugcgagugggaagcacucagcccagggcggcccugcaaguggcgcccaaucaaaugcccguagguaugaauccgggcgccaggaugccgguggcggcgccgccgccgccuccgcccccuuaucccggcccgccgccgcccuauccgggcaacgcgaaucaacaucaacaggaacaaccgcugcuguuggaagaucugcucgagcaagagaaacgcgaacaggagaagcugcaaaaccaaccucccaaccacgaagucaccucuuccacaggaaacgaaaccgaaucggcccucuuaagcgaccaagacuucgaacgccucaaagcagacguguucaacagcgcucccgugaauaauauaucaucuacaaaucaagggaacgccgggcaaacgucgcaagcuuggccucaguugcaaaaccgucaagcggcgguuccggcuaccgcuucgcagcacaccauggaagugacgacaagaguacaaauguucaaucccaauuugauaccggcgccgccgcuuccgccggagaauaucgccaccgagcaggacaagcaggcgcagcucuuguacgagcaauggcugaaccaucagaacaacacgcuggugcagcaguugcgcuauuacgagaccgaagugcagaagcuucguaagaguaaaaagucguuaaauaguaagcaacgccaauugaagaaagcugguaaucaguugacugacgcggaugcgacggagcuucagagaaucacggccgaacaggcuauacuacagaagcaucuggagucuaguagaaagcaaaaucgccagcacgggauguugauacaggaauauagaaacaagcaucccgccaucaagcagagaacaggaacggaucagauccaaucgccuuugggccacccggcuucuucgccaauacaacaaucaagcgccucguuaucgcccauguuaucaccgucugucucgccgaugacccaaaacagcucgccuuugaacaguccggggccuaugguaccuucuucacccggccacggucccguucagaacauccuacagagcccuaacaaugccaauacagcucaaaugucucccaugcaaucuucgccccgaauaggaaccccucauucucaaagugaugagagucccgggucggcgcaaucgccuucucaagucugccugccgccgcccaugccucgaaugacgucgccucaacacaggcgagucgugaccagcccggugggaaugucgcaaaugcguuucaucaacaacaacauguugcagcaacgcguucgcaugcaaucgcccauacagaauuuccaacagaaacccggcacgccgucgccguugaacagcccgacgucccaacagaugagcgucaaccaacagcaucaaauccagaagcagcuccagcaacagcagcagcaacagacguuguugcagcaaaauuuggaaggagauccgaacgcuauacacucgcagagaacuacucaauugcugcagcaccggaacuucaucagacagcaggugucucagcagcaaauaucgccgcaaacguugacaccgcaacagcaccaguugaugcugcagcagcagaagcagcuggcccagcagcaacagcagcagaucgcccaaaugaacgccgccagauugcaacaacaacagcagcaacaacaacaaaauaauccuccgcauucuccgaugccuccuaagagccccaugaucaaccagcagaua

SEQ ID NO: 6098 - RNA, 4524 nt, Phyllotreta nemorum
augggagauucuccucaggaaggaaggaguagcaggaggaguaagacguucaaagcuaaggcuucggagaaguuuaagcaguucaagaagggcgugaaaaauaaguaugagaucggugaaguggagaacguguacgaagucguggaggagaaacaguauauuaaagaaguuaugucgagauaugaugaugauuggauaguuggugacuccaguggguauauugaggaugguagagauauauuugaugaugacuuggacguggagucuguagcccaagcuucaaguaaaggcaaagguuugaagagaaaacauaaaaauguaucggaaaaugcuggcaagggaaaauugcagcaaauguuuuccaccaugccaacuaaacagaaaacggcagcaaaagucgaugacgacgaaaugcucucagaaaucuugggugaaaucgauuccgacacaccaaauaccucuaccguugagaaaccgaaaauaucccaguacucuucacuagccauuaacuuaucggccaaggauuacaugaaaaauuuggcacagccuguuaaaaaacgcgcaaucgaaaaaaguaccaaaguaccaaaauuucugcccaguguauccaaaccgauugaaaaaguaccaauuaaaccaguaccaauuaaaccaguaccagauaaaaccguaccaguugaaauucaaaacaccgcaaaggaacaggucaauccugaugaaaaugucgaaaaagaaauaauaaauccagcuaaaaauguugaagaggaaaagacagauccagauacaucacacuuacaauuugaugaugauuuggaugaaacuuuacuagaagaauuuagcgaagaucuaaaugaaaccgccacuacaucccaaacaacagaaucugaaaugaacggggacgauuucacaggggaaauggauacaacacuaauagacgaaauugaggaacgaauuaauguugcuggugaacaacugauuaacgacauucaagcggaagucgagacggaauggcaguacuuuaaugcagcaaacgguauggaguccuucaaauuagcauccgaaaguuuugaaaguucccaaggucccgauucucccgcugaaacuauggaugauauuccauuagaaaaagucgaagggaaaaacguguuuagguucuuuuggugggaugcuuacguggauccccagcaucagcaaggaacuguguuccuguucgguaaaacauacugcgaagcuuccaagaaauacgaaaguugcuguguagcuguaaagaacauagaaaggacacuguuuguuuugccuagaccuuucgaacuggaugagaacaagaagcccacagauaaaccggugacauuuaagucgguucacgacgaauucaacaaucagauuuuaaagcgaaugggcauugucucuuucaaauccagacugaucacgaagaaauacgcguucgauccgagcguaccagccgaauccgaauacuuggaagucagauauucggcaucauuuccacggauauuuuccaacgaagaugucaaccaaaaaguguccgauggagauauugauaccgaugaucucggcuacagcacauuuucaaaaauauucggcauaaaaacgaguuuccuggaaucgcucuuccucgaacgcaagaucaaaggccccuguuggaucgacauauccgaucccgaacccgccgcuaacccuaugaguuucugcaaauucgaagugaauugccucaagcccaccaacuugaaagucgccucguucgagaaaccgcuuccuccgccgccguuaguagucgccacuauaaacaugaggaauuucaucaaucacggaucguccgcucaagaaaucgucaugcucucgugcuuggugcaaaaccaguacgcugugaacaaaccgccuccggaacccgccuuucaaaaccauuuuugcguauuuagcugcccgcgaggagaagucuuaccucuaaauuuguucgaugcccugcaaaacuacaaaauaacgaaagugcugaaaaccgacaacgaaaaggccaugcugaauugcuucgucaacaacaucguacaaaucgacccggaucuaauagucggccacaauuugcaaggauuccaaaccgccauauuggccgauagauugcugaaaucgaacugccgcuuauacaacagacugagcaggcucaagaagcgaucaacgcuauccagacagcuggagagaaaucuguuuuugggccgacuagugugcgacauaaaaauauccgcgaaggagcugaucaaauccagaucguacgaucugggcacgcucugccaggucguguugaaguugaaggagaaccaacggguggaccuggagcccgaggacgugaugaaaauguucaaaacgucgcaggauuugaucaagcugauuucuuuuacuaugcaggacaccggcuacauuuugaaaaugauguacaaucugaacaucauaccgcuggcuuugcaaaucacgaacauagccgguaacgucauguccaggacguugauggggggaagguccgaaaggaacgaguuccugcugcugcacgcuuuccacgagaaaggguauauuccuccugauaagguuuauaggaaaaaugaagacccagaguccaaagggaguucuaagaagaaacccacguacucaggagguuugguauuggagccgaaaguaggcuucuacgacaagcuaauacuccugauggauuucaauucuuuauaccccagcauaauccaggaauacaacauuugcuucaccacgcucccaguaauggauucagacgaaaauuugguacuuccagacagcaauuuaccgcccggaauacugccaacagaaaucaggaaguuagucgaaagccgucggcaagugaaaucccugaugaaaaauccggacaucucgaaagauuugaaauugcaauacgacauucgccagauggcgcugaaacugaccgccaacucgauguacgguugcuugggcuucggccauuccagauucuacgcgagaaaucuagccgcccuggucacccaaaagggacgggagauucucgugaacaccaaggauuugaucgaaaagauguguuuggacgucguguauggggacacugacagucuuaugaucaacaccaacauuuuagaauacgaucaaguguucaaagugggcguuaagaucaagcaagaagucaacaaauuguacaagcaagucgagcucgacaucgacggaguuuucaaguaccuguugcuguugaaaaagaagaaauacgccgcuguaacgcucacuaaaagcccuucgggcgaacugauagccaccaaagaguacaaaggauuagauauagugcgcagggauuggucgcaauuaucuucagaaaccggaaaacugguccuggaacaucuacugagcgacgagucuucagacgaaaagguacaaaacaucuacgaccacuuggccaaaaucaaaucggauuugaucgaggggaaaguaccgguaccccuguuggugaucaccaagcagcugaacaaguccccgcacauguacaccgacaagaacuccaugccgcacguccagguggcgcugcgcuacaaccagaagagccgggaccacuucagaaugggcgacacggugcccuacgugaucugccucgacggcaccgagaacggccccacgcagcgcgccuaucaccucgacgaguugaagaacaacccgaaccugaaggucgauuacgacuauuauuuggagcagcagauuuauccggugauaacgaggauaugcgagcccaucgaggguuuggacucuuaccaguuggcggaguguuugggcgugaacaugaaacgggugaggaagccuaagauuccagggagcaacgagaacauucagggagagaacgugguugacgcagaaguaaaauucaagaacgcugagaaauuuacguucguuuguuacauuuguaaacacgaaaaugucguuagcgagccauuaaucaaaaauguaccuuuccuggaggugugucagaaccccgaaugccaaucgaagcccaucgacuaccuaccgagcguccagaaucaacucuaccgaaccauccguucucacauaaccaaauauuacagaaaaauucugacgugcgaagaccccaguugcccgaacgcuccgagacgauuaccgcugaacuuccugaagaaacgucccauaugcggcuugugcggcaacgcuguaauguauaaaguuuacaccgaauuccacuuguacaaccaacuggccuacuaccgguacauguucgauuugagcaaacuuaaaaauaagccugcgauggauggggaaaccgaaucgggguaucaggcgcuucaagauauuguggauaaauucaugaaucaaucugaauacucgcucauuaauuugggugacguuuucagucaacucgguuggcccguuccaagucaggcaaaucgaaagauugaauuggaagagucgaaaacugguauccuguuuaacgaagaagguaauggagaugccuaugaugaauga

SEQ ID NO: 6099 - RNA, 1398 nt, Phyllotreta nemorum
auggcggcugcugcagcggcaaaaauugccgaaguacgcgagacaacacgcguagaaagaauaggggcccauucucauauuagaggccuaggauuagacgacagucuugaagcuagacaugucucucaagguaugguugggcaagucucagcuagaagagcaguugguauaguuuugcaaaugguucgcgacgguagaauugcaggaagagcuguuuuguuagcuggacagccugguacugggaagacugcgauugcaacugcuuuagcucaugcuuuagggcaagauacaccauucaccagcauggcuggaucagagauauauucguuggagaugaguaaaaccgaggcauugacucaagccauuagaaagagcaucggaguaagaauaaaggaggagagcgaaauuaucgaaggagaaguugucgaucugagcauugaacguccagccacaggaguugguacuaaaguggguaaacuaauucuuaaaacuaccgauauggaaacuguauaugauuugggcgguaaaaugauugauaguauucuuaaagaaaaaguucaaucuggugauguuauaaccauugacaaagcuacaggaaagauuacgagauuggguagaucuuuugcuagagcuagagauuaugaugccaccggucaacaaacaagguucguucaaugcccggaaggugaauugcaaaaacgaaaagaaguuguccacacggugacuuugcaugaaauugauguaauuaacagucguacccacggauucuuggcacucuuuucuggugauacgggagaaauuaaaucagaaguaagagagcagauuaauggcaaaguagcugaauggcgcgaagaaggcaaggcugaaauuauaccaggcguacucuuuauugaugagguucacauguuggauauagaaugcuucuccuuuuuaaacagagccuuagaaaacgaaaugucuccaaucgucauaauggccaccaacagaggaaucacgaaaauucgaggcacaacuuacaaaucuccgcacggcauaccauuggacuugcuggaucgaacaauuauuguuccuacucagccguaugacgaaaaggaacugaaagaaauauugaauauccgaugcgaagaagaggacugucagaugucugauaaugcuuuggugguuuuaacgagaaucuguaaggagacgucuuugcguuacggcaugcagcucauuaugacaucgaguuuaaucgcuagaaagcguaaagcccacgaagucgauguagaggacauuaaaagagccuaucaauuauucuuugaugaaggucgcucugugcaauuucucaaggaauaccaacaagaauuuauguuuaacgaaauugaugagaaagaugauauggaaauugaaacgguuuaa

SEQ ID NO: 6100 - RNA, 1170 nt, Phyllotreta nemorum
auggcguuaagaacuuacggagauaaaccgaucaguuuccaguuggaggaaaauggagaauacuacuguguuggaucugaaguaauuuuuaucggcaucuucuggauaugcuugaugauacguucgaauuuacaggugggaaauuaucuucgacucuucagaggaucucuguacaaaaaguacccuggaauguucaggaggucuaucacuaaugaagaaagaaggagguugauugaacucgguuugagccagcacguucuagcgagcagcguaucacugcuuagagcagaagaaguugaagauauaauugaaggaaaugaugaaaaguauaaagcuguaucuguacacacuucggagccuccuaugccaagagaggggaaauccaagaaaaacaugcaguggguaccuucguuacccaacuccagucauuuagaugcaguuccacaagcuacacccauuaauaggaacagaguagcugcuaaaaaggugaggacauuuccacuauguuuugaugacaccgauccccaaauaaacauagaaaacgcuugucaacaagaauugcugguuccuauuagacuagauauggaaaucgaaggccagaagcucagagauacguuuacuuggaauaaaaaugagaguuuaauaacgccugaacaauuugcugaaguccuuugcgacgaucuugauuuaaauccuuuaacauuugugccagcaauugcucaagcaauaagacaacagcucgaugcguuuccgacugaaccucccaguauuauagaggaaaccugcgaucaaagagucauuauuaaguuaaauauucacgugggaaauacuucuuuagucgaucaaguugaaugggauaugagugaaaaacagaauaaucccgaagaauuugcguugaaacuuugcgcugaauugggucuuggcggugaauuugucacugcgauugcuuauucuauuagaggucagcucucuuggcaccagaggacuuaugcuuucagugaagcaccccuuccuacuguagaaguaccauucagaaauccuagugaaucugaucaaugggcuccguucuuggaaacccugacugaugcagaaauggagaagaaaauucgcgaccaggacagaaauacucguagaauuagaagauuggcuaacacuacgccggguugguag

SEQ ID NO: 6101 - RNA, 489 nt, Phyllotreta nemorum
ccggaaguguacgugcccaccguauucgaaaauuauguggccgacaucgagguggacggcaagcaaguggaacucgccuuaugggauacggcgggccaggaggacuacgaccgccugcggccccuuuccuacccggacacggacgugauuuuaauguguuucucgaucgacucgcccgacucccuagaaaacaucccggaaaaguggacgccggaggugaaacauuuuuguccgaacgugccgauuacccugguaggcaagaagaaggaucugcguaacgaucccacuaccauuaacgaacugaaaaaaaugaagcaggagccugucaagccgcaagacggucggucgauggccgaaaagauaaacgccuucgccuacuuggaauguucggccaaaagcaaggagggcgucagagaaguguuugagaacgccacccgggccgcgcugcaggucaaaaagaagaagaagcaucguugcguaauguuuuga

SEQ ID NO: 6102 - RNA, 4017 nt, Phyllotreta nemorum
augaauacaaccacuuucaauccaagaauggaugccgcucaaaacccggugcaaaaaauggaauuggcguccaggaacguggaaaauuccuuguuaaucgacaacaacgcuccgagauugaucgauuuuaugaauaucaguccacaaagcgguuccacugcaagcgguuucgcugaccaugauuauccaacuuugaguggauuaucgcauauuaucaacaguaugacccaaaucaaguguguaagcaauguuccuauaccuucggaaauugucgaccacuuugcccgugugcaaugccauugcaugauggguuuguuuuccgaaauaaacagggcuugguuaacugucgauagugauauuuacguauggacuuacgaggaaaacaccgacuuggcuuauuucgaugguauaagugaaacgauuguuugcgugggacuagugaaacccaaagcaggaguuuuccacgccuuuauaaaauaccuccuaauuuuagcgacauccguggauauugucguauuaggaguuacuuucacugaacgacccggugacaaugcugaugaaauucaacuaauaccugauccuguuuucauauuaccuaccgaugguucuacugucacgauaaucaccaguacugaugaugguaggauuuuuuaugguacaaaagaaggaaauuuguucgaaauugcuuaucaagcugaaagugguugguucggcaagagaugcaaaaaaaucaauuuaucgaccagcacuuugucguuccuggucccuuccuuuauuaacgcggcauugagugaagaggauggaauaucgcaaauuucaauugacgauagcagacacauucucuacauucuaacggaaaaaggauccauagaaguuugcgaccugggagaaaaggggaacucguuuuccagaauuagcaaaaugucucaaaacacguugguuaaccaagcaaugaauacugucaaaacucucgacagucaaaauuuucgaccaaucgugagcauauccgccaucgaagccucagaaucggucaauuuaaauuuaguggccguuucucaaacggguguaagauuuuacaugucuguaacuaguuuaucgaaccaaaaucccaaucaaagaccguacacccuaacccuagcucacguaaggcuuccaccggguuauucagccaacauuacuguaagaccaagggcgguacaugucucccaguacagagacagaaacuugguauuaauaucaacuguuaacgaaaaagauguguugugguguaugagcucagacuuguuuccauucggccaaggacugacagaagcuuacacagcuauuaauuuagauggaccggccuuagcuaucucugaggugagaaacgcuaguccucuucaaauaaaggauuuacacgaagcgccuccuuuaguggucaggcaacacgccgaaccuccgaaaaaguacauuguccuuacuucgcacagcauucagauuuucaucaaguuaagaccaguggacguauugaaacaaauuuugaaagacagccaugggcaagauacggaggcauugaaagccuucuucacuauucaaaaagaggaucaagcgugcgcuaccgcuuugauucuagcuucacuggaaaacgaagauaacauggacauagccgaguuugcaaccagagcuuucuucuuguucggaggcgagccgaaauuggcggcuccaaugaauacuuuuucuggaccguccguauucugcccgcccgucaugucuacuccaaauauacaccaauaucaucaacaacagcagcaauaucaaacuucaccacaauaccagcauaacuuuccgcauggcaucucgcccgcagcgaacgcauacgaauugaccaguccguucguuuuuucucccaagcacaacggccucuauuuauauuuaaguagaauauuaagaccuauauggaaccgaagaacagucgauaagcuuuguuuggauggaaaaauuguuacuaaucacaguacugugaccagcgaagacugcauauucauauugaacuacguaacgucccuacauaauuuccugaugcguaauacucagcuuucaacuuugagcgccgcgcccggucagaauccucaaacccucaauaauacuacgaugaauaugacuagauugaaccauaccauucaagacguucaacuagaggaaagggcaucucuggaugcuuugaaaacauuugugugccacuguugucaaauauuaggucuguggagaauucuuugcgaacaucaauuccacacguuaauagcuuccuugccugaaacugagcagcagauuuugcaaaauaccaccuuuaaggaucuacuuuuacacagacaugauaucuguacguuguugauugcgacauuaguggacaguuauuuaggugauaacgccucaguggauucgauuagcagcaaauugagagaaguguguccgcuguuuuauaaaacugaagaugcagcauuuucaaaggcugucgagauauuaaagaugacacggacaauucaaaacaacgaugagaaggaagagaugauccaaucggcucugcagauuugcaaaucaaucggccccacuaucaacauaaccgauauaugcaaggaauucgcuaaucuuaaagcguacaaagccguuacggaauugugcgcgcauuucggcaagaaaauugauccggauaaaauagcagaaagcuacuauaacgccgaagacaacagcggugaccaagaaggguacaauuauuaucaaagaagguuggaaauuuaucgucauauuuugaauauguuggaucaguuauacaacgaacaaaaucaaacacaagucguuaguagagauccugcauacucaguuaaucagaccauauuacuggauggugucgaacagucccaaguaggauacgugaugaagcaaguaauaaaagacguuauggaaacgcccgaugaaauuaugcacuucgcccuuuacgauuggcugguguucaagaacaugacuggagauuugauaaacauccaaaauccgucuuuggaaacguauuugaagcgaacauccacccagaaucccaacaacaucgaggccaugaauuuguuauggaaauacuacgaaaguuguaacaaucacgcagcagcugccaaaauuuugaacaaccucgccucgagaaccggcauaaacguuccauugaaagagaggcugucuuacuuagcgagagcuaucaugugcaugcgaagcgauaaaauagguuacgcgcccuaccuugguguguuccugagagaucuugaagacaaaauggagguagcgaaggugcaagaacaaauuuuggacgccauuguaaaucugcaaggacaaauaccuaacgcucaggaaguaauaagcgcgcuaaauucuggcuuguacgaaauuucgcaguuguaugaaaauuucgcugaaccauucaaacuauuagaaugccaauuggcaaucauugagugcgccggauacacugaccaaguuuugaucgaguccauuuggcagcaaauuuugacugaagaacucaggaaaaccuaugggacagguacagauaaagucugucagcuuuugaacaaagugaagcaguuguccaagcaauaugcucaaucugcaaauugcuuucccuugaguuacauuguuuaugaauuggagauagugaacgcaaaacuuagaggagacaagcaacucguucccugugccuuggaaaguaugaauauuccauucgaaaauuuaaucaacguuuacaauaguuugaauacgauuucuauaaaugaucacuuuuggcaauuagaggaaaacgaauuucaucuuucugaagcuacagcugcguuaauaaauuguuuccugagccaucuugaacaguacagcagcguugaaaagcggaaaauaacuucgcucugccaagaugcagugguugcuuuacuauccaacuuguauagcaagcccaacacugacgugcuaguuaauaaguuaagaaauauacaagccaaguugucgagaauuuag

SEQ ID NO: 6103 - RNA, 4140 nt, Phyllotreta nemorum
augagcgaguucacuuugagcuacagagaagucacuccggaacaaauagauuucgaaaacuggaaagaaauaacccucacuacaggagggacgcaaagcacccugcaagauauaaaaguagccgagaaagccaauggauacuguuacaaagacuccgcuaaacacugcacgaggaauagauuuaucuacuggagaauuaaucacaacguuuuggaauugguggagcacaguuuggauauaaaucuuacaggaaaucggaucagauacaaguucgauacuccgauuuuggaugguguuucgauacaugaaguacucgauaauguuguuauuuugguaccuacaguauguaguguacacaggcugauauucccccauccaaauguguuucacgcucaggacgauuuacugggcauauacccggauuuaacagcuuuauccauauuuucgaaagcaucgaucguugauaccagaaacccgaacagcuuuuacguuuucaacaaucccagcacugccaacgaucaauuaccgaauuuggccaacucguacuuuguacccgaaacaggagaagccuacuucauuuuggcguuuccuucgaccgaacucuugcuaaucaagcaaagcccugaucaagugaccugugcggaacucaaaggggagucuuuaguucccagauuuuucgcuggaauagccgacaaguucaggcauaagaauucggauagcgaaaauauagugagcuuguuauucuacgauuuggaugaagaaacuuacguguugucacuaacccaagaugcucauuugaaauuuugguccugcaguaaagcucaauguguagcaguaauagauguucgugagaaaauaacgaacuugaaauauagaguucagucggcgauuuuaaagaaagccgaagauggaaacaguuccgaaaacauucugguucuauuccugaguuucggaaauaaaugccaguuucauguauugaaaccuucaguuagagaccaagaaaucucucugcauagauuagccacucucgaaucgccucugaacgauuugauagacuucgccgcacaaguagacugcuuguggucgguauggcggucggacgugggcgaaacggugguguacauggcuucguucaaauccaaccgauggacucaaguaauacucgaauccgaaccgaccgauaaauuuuucccuguaaaaugcaacgacgucaagacgcuuuaccuacagcacauuuuccauccaggcagauucccucugcacgucauuaacaaaacucuuucgauuuauaaaaugccuacgauugggucagacagccacauguccauuucagcgcugaagcaaagaguuuguauggccguggaaaaugacauacaaaaccuguucaauaaagacgguacugauauuaacagcguugaaguugaugaguauguagagugugcugaaugguguuggcaaaaguucgacuccugcugcguucaguaccagauagccagcaggaaaccgcuggguuugaugcuucuaccguccguaucgggagcuauguugcugaagaaaucggcuuuuucguuccugcgacccguagauucguuggaacacaugacuuugucuacugauuuguacagggagcaguucuuuaauuuuuccauguuauccgaugauuuggauaccguagaagacgugauaaacguguucaaagugaucguuuacaucgaacaacaguuaaaggaugauuucaugcaaucguucgaaacugaacuucucaaucuccaaucgcccgauguggucauagaagaucugcugaagaagauuuacguagaaauggauucagauuuuuuuucgcacauuuugcaccugaucaaagacgucaaugacuuguacaaagccauucacaaaauccuggagcuguugagauacgaaaacaccuuguccaaucccgauaacgacaucaauccagccgcuauguacuauuucaauucucuucuaggcaccuccuugguggcccaaagcuuccgacaacaagcugaaaucagauuucaaauuugucguaauuuguugcuccuguguaacuucuuggugauggacaggacuuugaaugggggcguuuuagaaggaguccgaucggucuguaugccggacauugucguuuuaacccaagccaguuacgucgugcuguggcugagcggccugacgauguucgaaagcgauucgguucgggauucuuccaugagcacucuaaauccguugaaauugacucccguuuacaauuuguugccguucacucguugcacgucguuauuggaaguguuuauaucuucuucgggcguucaggacgccaggaaaucguucgcuagaguuuccugcaaggacgaggccuuggcucguuggcauuggucgcuguugccauacgugaaccacaucaggcaucucauuuggcccauaagcgguuguacgguguucgaggaauggcuccugucgagcggccagcacguguggcugcagcaguacguaaggcugcugagcaauuggugcgaauggaacguuuguacacgaaauuucuuauuggccucgucguuucugacuaccggugaauuuuacaaggccgaagagcuguucgagaccgcuucgaaaggcguuuuuaccgauacauuuuuacaaaacagaaucaaaagugucgacgaaaauaauuuuagaaccaccauucauuauuauuuaaaggugauccaguuauucgagcuauguaacgccagaagucaugugaucaauguggccaauacggcccugugcguagucaaacgggacgauccauuagccgcuacguuguuuucgaucaaauucaagcaccauuuggcucugaagcacuaccagcuggccuucgacucgcugaauucgaacccggacggcgaacggaggaaggacaaucucagggauuuggugaagacguugcuggacgagaaaaagcugaauguguuguugaauuuuacguacggaagcauggaugaauucuucgcuaacaucguuuugaccagagccagagcggcagacguuaugaauaacguauuuuacgauuuucuguauucguaccaaaucaagaaaggcccgccaucuuucagauuagccgcuucggccauguacgaacaagcguuucgauugagccaaaaaaccaccaucgaagccuuggaaaagcaagugaaaugcuacuuggcggccaaaaacguucuccauuugugccccgcccaacacgcuugggucgucaggccugcugauccggacgaagaagacgaacaagucauuuuucaaccccuagccggcucaaacggggaaauccguacguucaaaaucaagaaacaaaucgaagugguggacaucgaaaccauaggaaaagaauugacguucgccagcgccaaauugaaauugcugcaauucaacccgucgguuucgauaaacguuugcgauccguuggaguuggugauaucgcugaacaacucgggcauguucaaaacggccuucgagauuugcucgacguucgauuugcccuauucgcugguguucgaggcgcuuacgaaacguugcguuuugcucaccgaagccgaggaucccaacgcuuggaauuggcuggucgagaacgaucugcaagauuugccgguuaauagagaguccgcugcggaugugguuuggaaauuccugcaggauuguuuggagaaguacgaagagccuaacaugucuuguuugcauaacgugguuugcaagaaaauuaucaacaugcaaauuuaccugccucauugguugaaagcuucuuauaaggcucgaaauccuucggagcuguugagguugcugcacgccuccgggcguuuggaagaagccuucgaauuggccaaagacuacauuuugucagcgaugggauacgguaaagaagaauucgguuucucacagccuuuggcgccuacuucgccggcuuucugucuucccgucuacgccauacagcggcuuguagacgaauuggauauacaaaauucuaugaauauagaaaagccuuauguucacgagcacgaugauuugaagguguuguuuuccaaguaucucgaaacugccauaagaguuuccaaucaaaugugccagguuaaggguaaaguuauuuaa

SEQ ID NO: 6104 - RNA, 2247 nt, Phyllotreta nemorum
auggaagucuccgacaagaauuuagaaacuuugagcagauauuugcaggaaacgcucaauccggacccgaacgugcguagaccagcggaaaaauuccuggaaggagucgaagugaaccaaaacuacccgcugcugcugcucaaccuggugcacaagcccgaaguggacaugacgaucaggguggccggcucgguggcguucaaaaauuacauaaaaagaaacugggugguggaggaggaucagaccgaucguauccacgaauccgaucgacuggccaucaagaaucucauagugacuuugaugcugagcucgcccgaguccauucaaaagcagcucagcgacgccaucagcauaauagggaaaaccgacuuuccuuugaaauggccggaacucaucacggaaaugguugaaaaauuuucuacgggcgauuuuaacguuauuaauggcguguugagaacggcccauucgcuguucaagaaguaccgguacgaguucaagucgaacgaguuguggacugaaaucaaauacgugcucgagaaguuggccaaaccucuuacagaucuuuuagucgccacaauaaacuugucuguaacccauucgaacgauguagccgcucugaaaauaaucuacaguucgcuagugcucaucugcaaaguguucuacucgcugaauuuccaagauuugccggaauucuucgaagauaacauccaagucuggaugaccaacuuccacacgcugcuguccgucgaugucaaagcacuacaaagccaagaagacagcgaagccggcguauuggaacagcuaaaaucccaagugugcgauaacguggccuuguacgcccaaaaguacgacgaagaguuccagccuuacuuaccccaauucguuacggacguuuggagucugcuagucgcuacgaauuuacaacccaaauaugauuugcuggucucgaacgcccugcaguuccuuucgucagucgccgaacguucgcaguacaggaaccucuucgaggacgauaacgugcugagcagcauaugcgagaaggucaucauacccaacauggaguucagaacuuccgaugaagaauuguucgaagacaacccggaagaguacacgagaagggacaucgaaggcuccgauaucgacacgcgccgacgggccgccugcgauuuggucaacacccucagccagaacuucgagcagaggaucguggaaauauucgggagauaucuacaagugaugcuggcgaaguacgcggagaauccgaaggaguauuggcgcagcaaagacgcggccuuguacuugguaacgucgcuggucagcaggggauccacucaaaagcacggcgucacgcagaccagccaguuaguggacauuacgcaguucugucagcagcauauuuugccugaauuggaacgacccgacguuaacgauuuaccgguauugaaagccgacgcuaucaaguacguaaugacguucagaucgguacuucccagcgaucuagucguaucgacuuuaccucaacuaaucaggcacaugccgagcgaaagcugugugguccacacguacgcugccugcacguuagaaaagauccucauguugaaauucaacaaucagcccauugugaccggagccgagcuggagccuuuggccucggaauuguugaccaauuuguucgccgugcuccagaagccggucuccgaggagaacgaguacauaaugaaggcgcugaugaggacguucgcuacccuacaggacaggaucauaccguauuugaacguggccuuacccaaaaugaccgaaaagcugcaaauggucgccaagaauccauccaaaccgcucuucaaucauuaucuguucgagugcuuuucguuggccauaaagaucguuugcaaggugaaucccacagcgguuacuucguucgaagacauuuuguuucccauauuucaaggaauuuugcaacaagauauacaagaguuuauuccauacguguuccaaauuuugucuuuauugauggaaaauaccccacaaggcucguuauccgaucccuacaugcaacugcugccuugccuguuggcuccggugcugugggaacguccggccaacaucagcccguuggugaacuauuggcggcuuucgcuacucaagcugccccucagaucgugcugcaggauaaagugggcgguuucuuggggguguuccagaagcuguuggcuucgaaaucgaacgaccacgaagguuuucggcuga

SEQ ID NO: 6105 - RNA, 600 nt, Phyllotreta nemorum
auggcaaaaguacaauuaugcaauaucacaguuauggacaauccgaguccuuuccuaaacccauuucaauuugaaaucacguucgaaugcauagaggaauuaaaagaagauuuagaauggaagaugauuuacguagguucagcugaaacugaagaacacgaucaagucuuagacucuguguucguaggaccuauuccagaagguaaacacauguucgucuuucaggcagauccuccgaacgucucccguauaccugaaaaugaugccauugguguaacaguuguucugcuaacuugcucuuacaggagccaagaauucauucgcguaggcuauuuuauaaauaacgaauacagcgauccggaaaugagggaaaacuugccuaguccaccccaguucgauaagguuauaagaaauauauuggcguccgagccgagggugacgagguucaaaaucaacugggaggaaucuagcgguacucaggaaaacggaacuacaguugccgaagcacccgcuaaccaaacagccgaaacuuccgcuucgguggaaguaccugcuuucaacgagaauucaaauucgugggccaccauggaguguucauaa

SEQ ID NO: 6106 - RNA, 957 nt, Phyllotreta nemorum
auggaucaaaugcuaccgagcccugguuucaguauaccuagcauagguacaccucuucaucaacccgaggaagaccagcuuauauuaccaaacgccauacaacaacaacaacagcagcaacaacaacaaagucuaccuacuacuaacucacaagugccuccucuagcuccaaugggagguucuacuccaacacuuggucuagguuuaggccaugcuauguccaugccacauacgaaguauguaacuggauauucacugcccaucaguucuauggcuccucaaacaccccaacauacaaugaugagcccuauggugaauguaggaggaacugguaccacuaguucugguguaacgccuacguuaggucccucuacaccuucaccaaugacuccuaugacaccgcauucagcagauccuggaauuguuccacaauuacaaaacaucgucucgacuguaaauuugagcuguaaauuagacuugaagaaaauugccuugcacgcgagaaaugccgaauauaauccuaaacguuuugccgcagugauuaugaggauacgagagccgaggacgacagcuuugauauuuucgucggguaaaaugguguguacgggugcgaaaagugaagaagacucgagacuagcugcgagaaaguacgcucgaauuauacaaaaauugggauucccugcgaaauuucuggauuucaaaauacagaacauggugggcaguugugauguuaaauuuccaauacgauuggaaggauugguucuaacucacaguucguucagcaguuacgagcccgaauuguuuccuggucuuauauaucguauggugaaaccaagaauuguucuguuaauauuuguguccgguaagguuguucugacuggugcuaaagucagacaggaaauuuacgaagcauuugauaauauuuauccaauuuuaaagaguuuuaagaaacaauga

SEQ ID NO: 6107 - RNA, 654 nt, Phyllotreta nemorum
augaugauugauuauucuucuuuuaaucguuauccguuucuaacuucucacuccucugcuguugcugucauacucaucugucauauuuauaauuuuuugacaguuuugggguuauugaagauuuuugaagaaucuuuuauauuuuaucuaccaaaguccccuuucaaagcucacaaaauggcugcaauucguuccaugucucgccuguuauucuccagaucauuacaaacuacuguaaaaaggggcuacgccgaucaaaugagcuucaccuuugcugcuggaaaccaggucuucuaugacgcaaaaucuguaaaacaaguagacguuccuucuuucuccgguagcuucgguauacugccagcccauguucccacccuugcuguucuaaaaccuggaguaguuacuguuuacgaagacggcgguucaguccaaaaaauuuucguauccagugguacugucacuguuaaugacgauucaucaguucaaaucuuagcugaagaggcccacccaguagaaaacuuagaugucagugcggcccgagaucuucuccacaaagcacaaggucaauugucaucggccacuacugaucaggucagagcugaagcugccauugccauugaagugggagaagcacuuguaaaagcugcugaauag

SEQ ID NO: 6108 - RNA, 972 nt, Phyllotreta nemorum
augagcggcgauggcagccaaaacgagcauuucgacacguuauuucuaucaaucgcccagcaucauccgcauggucccacgcaacuccuggauacuuuugugaacuuccugagcagaaaaacggacuuuuucacgggcggaaaggaaggagaaugggaaaagcuaguguugaacacauucaagaaauacgagaaguccagcagggagcagcacgcggccgaauugaaggagaaacucgagcaggaagcgcgcaggaaggcgaaaaaagaggccgaaucggccaaacaggcucaaauaaccgaauugacggaagaacaagcugagaaauuacaagccgagcucgacgcuaaaaaguccccugcuucggcagcaccuucgaauagcuccgauacuccuucgacuucuacugcgaagauugaggaagacgaggacgaguccgagaaggguaaauuauugccgaacagagggaacggcugcgauuuagaaaaauacaauuggacacagacgcuuagugauauagagcugcgcgugccgcucaaaugcgauuucagaguaaagcaaaaggaucucacggugaacauuacuaaaaagcaccucaccugcggccugaaaggccacccgcccaucaucgacgaugauuuccagcacgagaucaaacuagaagagaccaauugggucauagaagacgggaaaucguugcucuucuccauagaaaaggugaacaaaaugaacugguggaguaaaaucgucaaguccgauccggagauaagcaccaagaaaaucaauccggagccaucgaagcugagcgaucuggacggcgagacgcgcggcauggucgagaagaugauguacgaucagcgacagaaggagauggggcugcccaccagcgacgagcgcaagaaacaggacgugcucaagaaguuuauggaacagcauccggagauggacuuuuccaaauguaaguucaacuga

SEQ ID NO: 6109 - RNA, 477 nt, Phyllotreta nemorum
augcagucucccaguggaauggugcacgguuauccccaggccucaauacuacaauggagcccugauaaaaaauacagcgauagagaaagguggauuugcguuuauccagcguacauuaauugcaaaaagaccauagcccaaggcaggaaacuaaacaaagauaaaugcguggagaaucccacucaucaagagaucagagacguuuuggucgcagcagguuugaagguuggcguggaaaauaaauuguacagcagagaacgaagcaaagaauugcuguaucgagggcgaauaagaguucaauugaaaaacgacgaugguucguugugcaauccaaauuuucccacuagagaugccauuaugcuccauuuaggagacaugauuccuaaguugaagaguagacagaacaagggcaguggagauccucaaccgcagaccaccagcucgaaaggaaagggaaaaggcaaaggaagacguuaa

SEQ ID NO: 6110 - RNA, 1971 nt, Phyllotreta nemorum
auggaggaaccggagccuacuaaacgccagaagaugcccaaaguggcuaaagugaaaaacaaagccccagccgaaauccagaucacagccgaacagcuauugagagaggcgaaagaaagagacuuggagauccucccgccgccgccgaagcagaaaauuuccgauccggccgaguuggccgacuaccaauugaggcgcagaaagcaauucgaagauaacaucagaaaaaaccggacggucauuucgaacuggaucaaauaugcccaaugggaggaaucgcagaaggaaauacaaagggccagguccauaugggagagagcccucgauguggaccaccggaacauuacgaucuggcugaaauacaccgaaauggaaaugcggaacagacaaguaaaucaugccaggaauuugugggauagagcuaccguucuuuuacccaggguaaaccaguuuugguacaaguacacuuauauggaggaaauguuggaaaauguagccggagcgagagcaguauucgaaagauggauggauuggcaaccugacgaacaagcuuggcaaacauacaucaacuucgaacugagauacaaagaaaucgauagagcccgacaaauauacgaaagauucguaauaacccauccggaaguaaaacauuggauuaaauaugcucguuucgaggaaaaucaugguuucauucauuccuccaggcaaauuuacgaaagagcuguccaguuuuauggagacgaucauuuggacgagaagcuuuacauagccuucgccaaauucgaggaaaaccagaaggagcacgacagagcgagaguuaucuacaaguacgcuuuagaccacauuccuaaggaugaaacgaaagaacuguauaaggcguauaccauccaugagaagaaauauggagauagaagcgguauugaggaaguuauaauguccaaaagaaagcugcaguacgaacaagaaauacuccaaaauccuacaaacuaugaugcuugguucgauuaucucaggcugguagaaggagaagcagauuuggaaacgacccgagaaacuuacgagagagcuauugcaaauauaccuccgucaaaaaacaaacaauacuggagaagauacaucuauuuguggaucaauuaugcuuuauucgaagaacuugaugcuaaggauuacgaacgaaccagacagguauauaaagcuugccuggaaauccugccgcacaaaaccuucacauuuuccaaaauauggcugcucuaugcgcaguucgaagugcgccagaaaaaucuaacagccgcccguaaaguucuaggcauguccauaggaaugugucccagagauaaauuguucaggggcuacauagagcuagagauccaacucagggaguucgauagaugucgaaaacuguacgagaaauuccuggaguucggcccggagaauugcguuaccuggaugaaauucgccgaacuggagacccuucugggcgacaccgaccgagcgagaggcaucuacgaacuggccauaaaccagccgagacuagacaugccggaguugcucuggaaagcuuacauagacuucgagauaucccaagaggagccgaacaaugccaggcaaauuuacgagcgauugcuggagagaacgucucacgugaaaguguggcuuucguacgccaaauucgagcugaacaauccgagcgaagaagauuuuaacguacguuuggccagaaggauuuucgagagagccaacgagaauuugaaaaacuuccccgagaaagaagccagaguguuacuguggaaaauuggaaggaguucgaaagcaaccacggcgaugacgagcacaaggaaaaagucaacgccaagaugcccaggagaaucaaaaagaggcagaaggucaucgacgaggacggcguggagcaaggcugggaagaaguguuugacuacauauuccccgaagacgaggccagcaggccuaacuuga

SEQ ID NO: 6111 - RNA, 1431 nt, Phyllotreta nemorum
augggaaucaaauuuuuggaaguuaucaagccuuucugcaguauccugccagaaauugccaaaccggagcgaaagauucaauuuagagagaaagugcuauggacggcgauaacacuauuuaucuuucuaguauguugucagauuccccuauucgggaucaugaguucggauuccgcggaucccuuuuacuggauucgugucauccucgcguccaaccgaggcacccucauggaauuggguaucuccccgaucguaacauccggcuugaucaugcagcucuuggccggagcgaagaucaucgaaguaggcgacaccccuaaagacagggcucuuuuuaacggcgcacagaagcuguucgguaugguuauaacggucggucaagccaucguguacguaaugacggggauguacggagacccagcggaaauuggagccggagucugccuucugaucaucauccagcuguuuguggccggucucaucgugcugcugcucgacgaauugcugcagaaaggguacggucuggguuccgguauuucucuuuucaucgcuacgaacaucugcgagacgaucauuuggaaggcuuucucuccggcuacugucaacaccgggagaggaaccgaauucgaaggggcuguaaucgccuuguuccacuugcucaccaccagacaggauaagaucagaggguuacgagaggcuuucuaccgccagaaccuucccaauuugaugaaccucuuggcuacaguuuuaguguuugcuauaguaauauacuuccaagguuuuagagucgauuugcccauaaagagcgccagguaccguggccagcauucgagcuaccccaucaagcuuuucuacacuuccaacauucccaucauccugcaauccgcucugguguccaaccuguacgucauaucccagauguuggccguuaaauuucaaggcaacuucuucauuaaucuccugggggugugggcugacguugggggcggcggcccggcuaggucguacccgauaggcgguuugugcuauuacuuguccccgcccgaaagcgugagccacauuuuggaagaucccguccacgcuguuauguacauuauauucauguuggguuccugcgcuuucuucucgaaaacguggaucgaaguguccggcaguucggcuaaggauguugccaagcagcuuaaggagcaacagauggugaugaggggucacagggacaauucuaugauacacgaacugaacagguacauucccacggccgcugcuuucggcgguuuguguaucggggcgcugucuguucucgccgauuucaugggagcuaucgguucuggaaccgguauuuuacucgcuguuacaaucauuuaucaauauuucgaaauauuugucaaggaacaaagcgaaaugggcggcaugggcgcuuuacuuuuuuaa

SEQ ID NO: 6112 - RNA, 486 nt, Phyllotreta nemorum
augucgaugguuucaucuucagccguugaauuaaguucauacagggaucagcauuucaaggguagucgagcagagcaggacaaguuauuaaggcuuucuacgacguuguauguaggaaaucuaucauuuuacaccacagaagaacaaauauaugaauuauuuucgaaaugcggcgacauuaggcgaaucguuaugggucuggacaaguacaagaaaacaccuuguggguuuuguuucaucgaguauuacaaccgcgaagaugcggaaaauugcuuaagguacaucaacgguaccagauuggacgauagaauaguacguacagauugggaugcggguuucauagaaggcagacaauacggaaggggaaaaaccggugggcagguaagggaugaauacaggacugauuucgauuccggcagaggaggguaugguaaaauaacccaacaaagaauuggaccuauggacacgccuaguuauuucagaaaa

SEQ ID NO: 6113 - RNA, 921 nt, Phyllotreta nemorum
auggcugccaccguagggcgaauuugugguguugggcuauuaaagccgaauaauuuagccaccaucggucagaucggcucuuauucgacggccaaagaauggacuagagguaaaaaggcucuuuuaggaacauuagggauguuagcaggcggcacgggagccguauuaguagcucucgaccaauccgucaaagcaucggauuuagaauugcacccgcccaagaacaucuggagccacagcggaauauucagcucguuggaccacgccagcguucgaaggggcuacgaaguguacaaacaagucugcgccgccugccacucguugcguuucgucgccuaucgcaaccugaucggcgugucccacacggaggccgaagcgaaggccgaagccgaagagcagaugauccgagacgggccgaacgacguaggcgaaauguucacgcgccccggaaagcuauccgacuacuuccccagcccguaccccaacgaggaggcggcgcgcgccgccaacaacggggcauacccgcccgauuugagcuacauuacggccgccaggcacggagccgaggauuacauauucgcgcuguugacggguuacugcgaggccccggcgggcguggugcugagagaagggcaauauuacaauccguacuuccccggcggggccauuucgauggcucaggcucuguauaacgagacgaucgaguacggagacgguacgccggcgacggcgagccagcuggccaaagacgugucgacuuucuugaaguggaccgccgagccggagcacgacgacagaaaaaggaugcugauuaaaguuauuggaauauucucguuccuguuaggguugacuugguauauuaaaaaggugaaauucgcuucgcucaagucgcgcaagaucgaauuuaggccgaaaaauuga

SEQ ID NO: 6114 - RNA, 1734 nt, Phyllotreta nemorum
auguuggccuugcaacaauacucaggaaguagcgacgaagaagaggauaaacaaaaaucgaccgcuaauaacgagcccucaacuccuucugaauuuucuuuaaaaagccagcucgcaauuugcgcagcaccagaaguccuucccaccggacuagaggaagaucaaaugcacaucgacguagacacaaaagagcuagcguuuaaucccaaguacgacguacuauucgcaccgucccugggcccugccaauccauuuaaaacgcagcaacaguugguagaacgaaacaugcucucgggccacauagaaagagcccacgucagcgaauuucaauucgaaaaccagaggagaacguucgccaguuacgguuacgcuuuggacccuuccguaacuaacgacgggcaaauaaaaguggucggauccucggaagccgacgauagcagcauuaagacuguguucgaagcuuccaaaacgagaccguuagauaaacgaaaaaggaagaaaaacgacgaucccagugauguggacggguucuuaggcccaugggguggguucauagacgaacaaaaaauaucuaaaccgaccgaggaggagcaaaucgaacuggacgagauaucguccaaaaagaauaaaaaggguaaacccaacgaagauaaaccccucgaagaaaaaucaguccugcacaucaaagacgccguggauuaccaaggacguucguuccuccacgcgccccaagaugucggcgucaaccucagaucggacacaccgccugauaaauguuuccuaccaaaggcucacauucacacuuggacuggccacucgaagggcaucgcugcuauccgauuguuccccaggacggcucaucuucucuuaucagccggaauggacugucgcauuaaaaucugggaggucuacaacgaaagacgguguguaaggaccuacuaugggcaccgacaagcuguuagggauauuaauuucaauaauuccgggaagcauuuucuuucugcugguuaugacagguauauaaaauugugggauacggagacgggucagguucugucucguuuuacuagcagaaaaauacccuauugcguuaaauucaauccggauaagaacaaacaacauuuguuuguggccgguacaucggauaagaagaucauuugcugggauacgaggucaggggauauuguacaagaguacgacaggcauuugggcgcuguuaauaguauuacguuuguggaugaaaaucgacgauucgugacgacaucagacgauaaaucguugagaguaugggagugggacauucccguugauaugaaauacauugcugauccuaccaugcacaguaugccuucaguaacaccagcaccaaacgguaaaugguuagcuugccaaaguauggacaacaaaguggucauauucucuuccaugaacagauuuaagauuaaucguaagaagacauucagcggucauaugguggccgguuacgcaugcuccuuggacuuuucgcccgacaugaguuaccugacguccggagaugccgacgguaaaguuuacauaugggacuggaaauccacuaagcuuuucaagaaguggaaggcucacgauaacguuugcaucagcguccuguggcauccgcacgaaccgagcaaacugauaucggcuggaugggacggccucauaaaauacuggaaauccacuaagcuuuucaagaaguggaaggcucacgauaacguu

SEQ ID NO: 6115 - RNA, 807 nt, Phyllotreta nemorum
auggugcagaaaaagcccaagaagaaggugggaaagaagguagccgcagcuccuuuggcagucaagaaagucgagccgaaaaaagaagucaaucccuuauucgaaaagagacccaggaauuuuggaauaggucaagacauccaacccccuagggacuuaucgagguucgugaaauggcccaaauacauccgcauccaaaggcagaaagccgucuugcagaaacgucugaaagugccgccgccgaucaaccaggucucccagaccaucgacaaacaaacagccacccaauuauucaaaguguuggagaaauaccgaccggaaaccgccuugcagaaaaagaaccgacugaaggccaaagccgaagcuaaaguggccaaaaaggaagaggccccgacuaaaagacccaacaccuuaagagccgguaccaacacggucaccaaguugauugaacagaaaaaagcccaauugguggucaucgcccaugacguagacccuauugaauuggugcucuuccuccccgcccugugcagaaaaaugggaguccccuacugcauagucaagggcaaagccagguuagggcugcuggucaggcguaaaacuugugcgacugucgcccuuacccaagucgauuccggagacaggucgaacuucaacaaacuccuggaggucgucaagaccaacuucaacgaccgcgccgaugaaaucaggaggcacuggggaggcgguauccucgguuccaaauccgcugcccguauugcuaaauuggaaagggccaaggccagggcacucgcccagaagcaggguuaa

SEQ ID NO: 6116 - RNA, 1002 nt, Phyllotreta nemorum
auggcaacaauaauuaaggauauaacacuacaagaaaacauuccgcaaaauauacuuuucaaaaaacacaucgaauucauaaaggaauacggucaaaaggaaaacaacuucgaauacgcaaugaccgauuacuugaggauauccggcauguacuggggccuuacggcucucgaauugaugaaugccucgccuccgcacacaauagaagagauuucagauuacaucaaaaacugucaagaccccgaaagcggcggcauaagcuccugccugaaccacgauccucacauacuccacacccugagcgccguccagauacucugcauguacgacaaucuaaaagccaucgacguggagggcgucgugaaguacguuaaaaaccuacagcuacccgacgguagcuucacgggagacaaauggggcgaaguggacacgagguuuucguuuugcgcuguugccacgcugucgcuuuuaaacagaauggacgcuauugauguuaauaaagcuguggaguucguagcuuccuguaaaaacuucgacggaggcuucggaucgaggccacucuccgaaagccacgccggcuugauuuacugcugcuuaggauucuugucaguuaccaauagauuggauauuguggaucgggacaugcuggcuugguggcugugcgaacggcagcuaccuucgggggguuugaacgggcguccggagaagcugccagacgucuguuacuccuggugggugcugucuucgcugaccauacugggcaagcugcauugcaucgacgccggcgcuuugaagagauucauauuggccugccaggacacggagagcggaggguucgcugauaggccaggggacauuccggauccuuuucauaccguguucgguauaucggcgcuuucuuuguuggggaacgauaccgugcagaagguuaauccuacuuauuguaugccccagcaugucaucgauaggcugcagcugaaaccucaaauuuuagauaguuaa

SEQ ID NO: 6117 - RNA, 2667 nt, Phyllotreta nemorum
augcaccaagaaaccuugcaacuaauccaaauauuagaaaaaacaguuucaccugacaaaaaugaauuggagcaagcuucgagcuuuuuggaacaagcaucccaaacaaaucuauuaggauucauaaagacucugucagauauacugcggcauggcgggaacaguccgguggccagaauggcagcaggucugcaacugaaaaaucaacucacaucgaaagauucaaccaucaaagccaccuaccaacaacgcuggcuucuauuuuccgaagaagucagagacuacaucaaaaagaauguggucggugcccuugggacugaaaccaacagaccaucuucggccgcccaaugugucgcuuacauagccguaaccgaauuaccgcaaggacaauggccugaucucauaucgacgcucgucaguaacauuugcaauggaaauucgacggaaaugcaaaaggaagccacgcuggaagccaucgguuacaucugccaagaaauugaaucugauguuuugguaucccaaucgaaugauauacugacggccauuguucacgguaugagaucgucugaaccgagcaaucacguucgauuagcugcaacccaggcuuuacucaacucguuggaauucaccaaggcuaacuuugauuugaccacagaaagaaauuacauuauggagguuguuugugaagcaacacaaucgccggugucgcaaaucaaaguggccgcuuuacaauguuuggugaaaauaaugucgcuguauuaucaacacauggaacccuacauggcucccgcuuuguuucccauaacguuagaggccaugaaauccgagaacgacgccgucgcccugcaagguauugaauuuuggucaaacguaagcgacgaagaagucgauuuggccauugaagauacggaagccacugaagccggaagaccaccuacgagaguaucgaggcauuacgccaaaggugcacugcaguacaucauaccgauuauucuacaaaaacucacgaaacaagaagaauuggacgaugaagacgauuggaaucccagcaaagcagccggcguuugucucaugcuucuagccacuugcugcgaagacgaaaucguuccgcacgugcugccuuucaucaaagaaaacaucaagucggacaauuggcguuucagagacgcuuccuuaauggcguuugguucuauucugggcggauuggaaccaaacacgcugagaccgcucgucgaacaggcgaugccgacuuugaucgaauuaauguacgacagcagcguuauugugagggauacggcggcuuggacauuuggaaggauaugcgaaauaauaccggaagcggccauuaacgagaauuacuugaaaccgcugcuggaaaguuugauaaccgauuugaaagcggagccccgcguggcggccaacgugugcugggcauucuccggauuggccgaagcugcuuaugaagcggccgcuguuaacgaggaaacggggacgccggauaccuacauuuugucgccuuacuacgaauucauuauacagagauuacucgagacaacugauagagccgacggggcucaggcgaacuugagaccggcagcguacgaggcccugauggagaugguuaaaaauucaccuaaagauugcuacguuacgguucagaaaacuacgaugguuauuuuagaaagacugcaacagguacugcagauggaaacucacauuaccagccacaacgacagaucacaauuuaacgauuugcaaagucuuuugugcgccacauugcagucgguuuugaggaaagucacgccugaggaugccccgcauauuuccgaugccauuaugacggccaugcugaccauguucaauucgaauucuuguaaaaguggaggcguacaagaagacgcucugauggccguuucgacgcucgucgagguucuaggugaaaauuucauaaaauacauggacgccuucaagcccuuccucuauaucggcuugaagaaucaucaggaauaucaagugugcggcaccgcagucgguuugacgggcgacauuuuucgcgcauuaaaacucaaagcgcuucccuauugcgacgaaaucaugaccuuacuguuggaaaaucuccgcgaucaaucuguccaucguagcguaaagccgcaaauucugucuguauucggcgacaucggucucagcaucgguucggaauucaaaaaauaccuagaagucguucugucgacguuggcgcaagccucucaagcccaagucgaucgaaacgauuaugauaugcucgauuaucucaacgaauugagagaaggcguauuggacgcuuacacgggcaucauacaaggcuuaaagggcgacggauugacgcccaauccugacguaaugguacuggaaccacacauuccguuuaucguacaguucauuaccgucguggcgcaagauaaucaacauuccgauggaaccgucgccgucgcggcugguauagucggugauuuguguacggccuuuggcaguccgauggugcaauuguuggauuuggcaucgaucaaugauauguuggcgcaagguagacgcagucgggucagcagaaccaaaacuuuggcuacgugggcaucgaaggaauugagaaaacuuaaaaugccugcacccgcugcggcagcugcuagcuga

SEQ ID NO: 6118 - RNA, 1383 nt, Phyllotreta nemorum
auggaaacgauuuuggaacagcaacggcgauaccacgaggaaaaagagcgacugaucgacgccauggugaaagaaaugcugcacaaaaaaaacaccuacagagaagcgauaaauucggaccacaggcaaaaguaccuucuagacagauacaugacuuccaccgaaagacugauagaacucuacgaagacaaagacgggcagcguaaagccgaaguggccgcucucacgggccccaacgaauucaacgaguucuacagcaggcugaagcaaaucaaggauuucuacaggaggcaccccaacgagauaagcguaccgaugucuguggaguucgaugaauuugcuaaagcgagagagaauccuaacgaagauauggcuaauuuuguagaguuuaccgaugaagagggcuaugggaaguauuuggauuuacacgagugcuacgagaaguacauaaauuuaaaaggcaucgagaaaguggauuauaucacuuaccuggccauguucgaucagcucuacgacauaccgaaagaacgaaagacgggggaauacagaaaauaucuucuauaccuuauugaauaccucacgugguuugugcaacgcauucggccccugauggaccucgacagcgaucugcaggaacaagucgagcaggcuuuggucaauugggauaacggcauggucccgggauggccgaaagaaacaggcucggcuuuggccaacgugggcgcccacuuggaccuaucggccuucuccaguugggaggaauuggcuucguuggguuuggaucgcuuaaaaucagcccuaauggcucuaggauugaaaugcggaggaacguuagaggagcgagcccaaaggcuguuuuccacuaaaggcaaaggcuccuuggauccuucucucaugaccaaaaacagcaagaaucgaauaacuaaagagaaagaagcccugaggcaaagagaacuggcuacucuagaagcucaaauuuacagauuggcugaucuggucucagcccaacgagcagccaccaaagagaacguacaaagaaagcaagcucguacagacggcgaaagagaugauagcgagaacgaagagagcgaggaagagagcccggacgaaggugacgaugacgucccguacaaucccaagaaccucccgcucggcugggacgguaaacccauuccguauuggcuguacaaacuucacggguugaauauaagcuacaauuugagauaugugguaacuacguuuauaaaggccccaaggcuuuucaaaggcauuuugcugaguggaggcacgcgcaugggaugcgguguuuggguauaccgaauacggcucauuucgcuaaugucacucagaucgaggaugcuuuggccuugugggagaagcuga

SEQ ID NO: 6119 - RNA, 639 nt, Phyllotreta nemorum
augacgauaggaaagaauaacaaaaugauccaacacauaaacuauaggguccgaauaacauugcaggacucuaggacguuuaucggcacuuucaaagcuuucgacaagcauaugaacaugauacucggcgacugcgaagaauuccgaaaaauuaaacccaaaaacucgaaagucgaacgagaagaaaaacggguauuaggauuuguauugcucagaggcgagagcauagucucacugacuguagaagggccuccaccaccagaagagggacuuccuaggguaccuauccccggagcagcccaagggccagguauaggaagagcagcagguagaggaaugccucccgguauggcuggaguuccaguaggucuccaaggcccuguaagaggagucggaggaccgucccagcaaguaaugacgccuacggguagaggacaaguuucagcgccaccacaaaugaaccaagcgccuccaagaaugggcggcccaccgccugguaugaugggaccaccgcccggcaugaugggcaugccaccgcaaaugggcauggggcgcggaggaccgccuccgaugggcaugaggggucccccgcccgguaugaugagaggcgggccgcccggacccccgaggccauauuaa

SEQ ID NO: 6120 - RNA, 1173 nt, Phyllotreta nemorum
auguuggaggacauagaaauaguguguauagcguaugcaauacacaagagaaaaaaaaaacaaagaaguuguuguguucauccgcuaaauacacaacguuuaaauuuaggacaauuucacugcuuauucggugaauugcggaaguauccggaaagauuuuucaauuauuacaggaugucgaucacuuccuucgacgaauuaguuuuguuucuucgaccucggcugcaaaagaacaauacucgauuuugcaaaguaauaagcguagaggagagguuaacaauaacucuaagauauuuggcgacggguacgaauuuugcugcaaugcagcacucauucguuaugggaagaacuacaauagcggaaauaguuaaagauacgugcacugcucuauggauaacauuacaacccauugaaaugccugaaccuaccacagaaagaugguugcaauaugcuaacgaauucuggucgcguucuaauuuucccaacuguauuggagcuguugacggaaaacauauucgucuaaugucuccacaacauagcgggucacaauacuuuaauuacaaaaaguauuuuucacuaauguuaauggcaauugcugaugcaaacuacuguuuuauugcugucgauauuggugccuauggcagagaagccgauuguaacguuuuuaagcaaucuaccuugggagugaaaauguauaauaauacuuuaaaucuuccccccccucgagguuugcccggaaccaaugaaccaugucagccauuuguguuuguuggggaugaagcguucggacuccauacuaaucuacugcgaccuuauuccagacguaauuuggaugaaaagacccguauuuuuaauuacagacuuacacgugcuagacgcuuuguugaaugcacuuuugguauacuuagcaacaaauggcgaguauuucacaccccuauauuaguacagccggauuucgcuguuaaaaucguucaagcagcuuguguacuucacaauuucguuagaaggagagauggauaucaguuugaagacacuuuaucuuguaauuuggaggauauccaggugcguggcaccggcggaaggcgaacagagggacauuguguucgagacaauuuugcugacuaccuuguuaguccggagggagcuauuccuuggcaacaacguaugaucuaa

SEQ ID NO: 6121 - RNA, 438 nt, Phyllotreta nemorum
aagcaguacaacgaggacgagccggaggauaaccccgaaucgcccgaggaauucggcgaauccucggauaugauggccgguuacgaucacgaagaaaccgauauaaucaucucagauccaaccaccagcguucccgaagacucaauuuccacuaaggaagacuucgaggagcucauugacgaaggaucgcgcaaaaacaacaucagcaaacaggaagugaccgccaaacacauucaggauuuccacagguacaccgaauuguucgauuacggcaaaccugacgcaguuaagaaaccgggcggcaaaaaauuccaaccgaaagugucucucguuggaggaguagcuuugccgaguaagcccaacgcagagaagauuauaaucacgcaaaauucgaacguguugaauacuucccaagccucgaagguuacuagcaucauu

SEQ ID NO: 6122 - RNA, 1476 nt, Phyllotreta cruciferae
augaagaaagaggcgaaggaaagaaggcgaaaagagaaaaugggcugggauaacgaauacuuacauuacacgaacagcgacaacccauucggagacggcaauuuacuaaccaccuucgucuggaauaaaaaauuguccaaagaaggcaucaaaaacgucggccaugaagaaauagaagccauaaauagauuaaaacaagaagagaauaaaagggaacucgaaaaagugaagaaacgaagauuagagagggaacuggagaggcaaaaaagagaugaagaaacgcaaaugaugcaaagaaguaaagaagcagcccaauucgaggaaugggaaaggcaagaagauaaauuccacuuggaacaagcucgauugagaucucacauuagaauacaagacggacgagccaagccgauugaucuacuagcgaaguacauaagcgccgaagaagaagucgaugccguugaaaugcacgagccuuacacuuaccugaauggcuuacaaaucaaagaccuagaagacuuaguagaagacaucaaagucuacaaggaacuagaaagaggaaaaaaccuagauuacuggaacgauauaacaguaauagucgaagacgagcuucagaaguugagaaaaauugaaaaacaaaacgauuuugacuugggauugaaccgaagggaaggaauacaucagucugucgccacugauguaacaucaguauuuaaaggcaaaacagccgcacaauuagcagcguuagaaaaacaaaucggaagcaaaaucagcagcaaagccgauggaauagacauaggcuauugggaaucuuugcuaucgcaacuuaaggcccacauggcgagggccagacuacgugacagacaucaagauagcuuaagaaggaaacugcaaguacuuaaagcagaacaagccaucacaggaguaggucaaagccauagcgaaacccauucuacugauaacgaagaaaccacuucggaacccaaaccaagcacuucccaggauacuuuggaaacgauggaagaaagcaacgaaaagaccgaagacgcugcucaugaauggcucaacgaaugcuuuucagccuaucaagcaggcggguacaguccuaaguuuuuaacucccgaugacaccgagccugguacgauuguagucucggaggaagacgacguaaauagauuggaauucgcuaggaugcagguucuaggccaaggaaccaaaaucgaaaacgucauuacgaaggaagaauugcugcugcaaaaggaggcgagaaaaggaauggauggggaugaggcucaauuuucggucgagcaagccuuggauaauccaguguaucuuuggucggauaaguaccguccaagaaagcccagguacuuccauagagugcacacaggauucuuauggaucaaaugcgaucaggcccguucucccaucgacaaucccccucugguauuccgacuugugcuugaaaaaaacauauuu

SEQ ID NO: 6123 - RNA, 1266 nt, Phyllotreta cruciferae
auggauaaucucgaagcgaacauaauggacaagucgaugagaucggucuucgugggaaacaucccauacgaagccaccgaagaaaagcuaaaggacauauucggugaaguuggccaaguguugucguucaagcuggucuucgaccgagagaccggcaagcccaaaggcuacggguucugcgaauacagagaccaggagaccgccuugagcgccaugaggaacuugaacggcuacgaaaucggcgggaggaacuugcgcguggacaacgcuuguaccgaaaaaucccgaauggaaaugcaaaaccugcugaaucaaccgcccaucgagaacccguacggggagcccauucaagccgaaaaggccccagaggccaucagcaaggccguggcuucccugccacccgaacagauguucgagcucaugaagcaaaugaagacuaccauacaaaauaaucccacagaggcuagacaaaugcuauugcagaauccccaacuggcuuacgcuuuauuacaagcccaaguggucaugaagauuaucgauccccauacggccgccagccuacugcacccgguuaaccaaguaccggccacuuugcugccgggggacaagaacguggccgugcaaguaccaauaaacaaccaguaccgggagcccccugcccccguacaaccgcccaggcaggaguaccagccgguaccgccgcccuuaguacaucccaaucacguucaacaacccguguuuaccggucaagauguggacuugcgaucgaugggaaaugugacugauccgagaaucaggcccaugauuguggaucaggauaugagacaaaugccggccguuauccagaauccucuaccgccuacuauuagcgaaaguuuuucgagggauccccgaagcggcaccaguuucccaucggauccaaggcaagcuaggauggacccgcgucaaaaaaauauaguaccaccgacgagccaacaaguacccccaacggugaaucccaagauaaugcccccucaagccggcccugucgucagaccggcgcagaacgucaucgcccaaucagcugcagcugcauccguaucagcugcaacagccaacguuagcccgggaauuggaggggcaggagcuacugaucaagaaaaagccgcccugaucaugcaagugcugcaauuauccgacgagcagauugcgauguugccgccugaacagagaaacagcauuuugguguuaaaggagcaaauugcgaagagugcgcacgugcguuga

SEQ ID NO: 6124 - RNA, 1179 nt, Phyllotreta cruciferae
auggcgcaaauggaugcggaacgugagaagagccuccaagaguacagaaaaaaauuguuggagcacaaagaaguggaauccaggcugaaagaaaugcgagagcagcucaaagauuuaaccaagcaguacgauaaaucagaaaacgauuugaaagcccuccaaaguauggggcaaaucguuggugaaguucugaagcaacugacagaagagaaauucauuguaaaggcaacaaacgguccucguuacguagucgguugccgucgucagcuggauaaagccaaguuaaaggccggcacaagaguagcccucgacaugaccaccuuaaccauaaugcgguacuuaccgagagaaguugauccguuaguuuacaacaugagccacgaagauccaggagaugucacuuacucagccaucgguggacuuuccgagcagaucagggaauugagagaagucaucgaauugccucucaugaaucccgaguuguuuaugcgagugggcauuacaccaccaaaggguugucuguuguauggaccgccuggaacugguaaaacucuguuagccagagcaguggcgucucaacuggaugcgaauuucuugaaagucguauccagugcuaucguagacaaauacaucggugaaucugcuaggcuuauuagagaaauguuuaacuacgccaaagaccaccaaccgugcaucauuuuuauggaugaaaucgaugcuauugguggccgaagguucucugaagguacaucggcugauagagaaauccaaaggacgcuuauggaguugcugaaucaaauggauggguucgauucguuaggacaaguaaaaaugauuauggcgaccaauaggccugauacauuggauccugcucugcuccguccgggucguuuggacaggaaaaucgagauuccccugccgaacgaacaagcucgucuugaaauuuugaaaauucacgcacuuccuauugcuaagcacggggaaauugauuaugaagcuaucguuaaauugucagacaccuucaauggggcugauuuaagaaauguguguacugaagcaggacuauucgccauuagagcagaaagagaguauguaauucaggaagauuucaugaaagcuguaaggaaaguugccgauaacaagaaacuggagaguaaauuagacuauaaaccuguauaa

SEQ ID NO: 6125 - RNA, 780 nt, Phyllotreta cruciferae
auggcucgccgguaugauacgagaacgacgauauucucucccgaagggagacuauaucaagucgaguaugccauggaagccauaucacaugcaggaacaugccuaggcauucuggcgaacgacggaauccuucuugccgcugaaagacguaacaccaauaagcugcuggacgaaguuuuuauuucggagaaaauauacaaacucaacgaugauaugguuugcagcguagcaggaauuacuucugacgcaaauguuuuaacaaacgaauugcgucugauaggacaaagauacuuguaucaguacggcgaaucgaucccuugcgaacaguuaguuucuugguugugcgauguaaaacaagcuuauacucaauacggaggaaagcggccuuuugguguaucgaucuuguacaugggcugggauaagcauuaugguuaucaauuguaccaaucagauccgaguggaaauuauucugguuggaaagcgacuugcauaggaaauaacaguucugcugccauuucgaguuugaaacaggaauacaaggaaggcgauaugacuuugaaagaugccaaagguuuggcugugaaaguuuuggcaaaaacguuagauauggcuaaauugacuucagaaaaaguggaaauggcuacucugacacguagaaacgauaagaccaugauaaauauauuaaauagcaaagaaguggaagaacuuauuucugaguaugaaaaauccgaagcugccgcugaagcuaccaagaaacaagaacaaaaauccgcugcuuaa

SEQ ID NO: 6126 - RNA, 2550 nt, Phyllotreta cruciferae
augagugaaucaacaaaagccgaaccuauaaagguggaaucaaaaacaacugaugacaaaaauaagaacgaacuguccgaugaagauaaacaacuccaagaggaauugaacuugugcguugaaaaauuacaagaaaaugacaguaaacuuuacaugcccgcuuugcaagcuuuggguaaccacauucgggccucgacuacuucaaugaccuccguucccaaaccgcugaaguucaugaaaccucauuacgauacaaugaaacagaucuucgagaagauaacugagccuucgguuaagagucugugugcagacaucaucuccguauuagcuaugacuaugggagaaggaagggauugcuuaaaguacaggcuggucuccgauuuggacaaaaucggugaauggggucacgaauaugucagacauuuggcuggagaaauugcuggcgaaugggccgaaacugauuucuuaguaaacacagaaauuagagauaaacucauauuauuaacaaaacagaucguuccuuauaauauggcccacaaugcugaagcagaagcuugugauuuauugauggaaaucgaacgacuagauuugcuagaacaauacguagaugaaaacauuuacccuagaguuugcuuauaucuuacaagcuguguaccuuaugucgcugaucccgaaaauacuacucuucuucaaacugcuuuaaugcuguucaggaaauucaagcaguacccucaagcacuucgguuggcuaugcaacugaacgaucacagucucaucgaggaaauauuccuaaauugccccgauacugacguacaaaaacaguuggcguucauguugggcaggcagcagauuuacaucgaaguucccgacagcacgccggaguacgaagaucucaucgaaauuauggcgaauugucaccugaauaaccacuuuuugaaucuagcacgugaauuggauauuauggaccccaaaaccccagaagauguuuacaaaucccacuuggaaaacagccguccuccauucgguggaagccaagucgauucggccaggcagaacuuggcugcaaguuuugucaacgguuucguaaacgcugccuucgggcaagauaagcucuuaauggaagauggaaacaaauggcuguauaagaacaaagaacauggcaugcuaagcgcuacugccucuuuggguuuaguauuauuaugggauguagaugguggucuuacgccuauugauaaauacuuguacuccucugaagaucacauuaaauccggagcucuauuggcaugugguauugucaauuguggagucagaaaugagugcgauccugccuuggcucuauugagcgacuauguccuucauagcacaaauauaaugaggauaggcgcuaucgugggccucgguuuagcuuacguuggaucuaacagagaagcaguuuuaaguuuacugacucccgucuuuucugauccgaaauccaauauggaagugaucgguauguccgcgcuagcuugcggaaugaucgcagugggaucuggaaaucuucaaguuacuaccacaauuaugcagacauuaauggaaaaaucagaaacugaacugaaagauacguacgcuagauuuuugccuuuaggucucggcuugugcauguuagguaaacaagaaggcaucgauuccauaauagcugcauuggaagucauaccggagccuuuuaaauccauggcaacuacgauggucgacauuugcgcuuacgcugguacuggcaacguacuuaaaguccaacauuuacugcacauuugcucugagcauuacgauggcagcgacagcucagacaagaguuccaaagauaaagacaagaaagaugcuacagagaaggagaaggaucuuuccucgagacaagcaguggcuguacucgguauagcuuugaucaguaugggugaagacauugguagugaaauggccuuccguacuuucgggcauuuguugcgcuacugugaaccaguaauuagaagagcaguaccuuuagcucuaggacucaucucaguaucgaauccuaaauugagcauccucgauacuuugaguaaauucucgcacgacagcgaugcggaaguugcccauaacgccauauuugcuauggguuuggucggagcggguacgaauaaugcgagauuggccgcgaugcugagacaauuggcgcaguaucacgcuaaagauccgaacaaucuguuuaugguucgcauugcucagggucuaacgcauuuagguaaaggaacguugacauugaguccuuaucacagcgaccgucagcucaugagccccguggcaguggcuggauuaauggcuacucuuguuggauuuuuggauguuaaaaauauuauuuugggaaggucgcauuaucuccuauacacuuuagcagcggcuaugcaacccaggaugcuugugacauucgaugaggauuugaauccauuaccaguaccugugagaguggguuugguaaguuugauuauagaaaguuuaaauugcaauuugguuaaaaaaauguuuuauuuuaggcuguag

SEQ ID NO: 6127 - RNA, 1521 nt, Phyllotreta cruciferae
augaccgauagcaacauggauucgaaagaagagaaacaagccucaccggaaaacgcccagcugaaaccagaagcaaccgagcccgaggcucccccagcucaagcaucccccgccgccggcgucauccggaggaauuucaucacccccgccggaaccaucgucgaaaccaacgaagaacaaccgccagaaccgaccacagaagaggucgucaaaacgacaucuucgaauccgaguccggccgaacagaaacccgaauccgagauagucaccuacgcagcggagguccugccgcaggagcaaagagaacaauucgccgaagccaaauccuacgcaguggaaaugccagcugaaaauuuuccuaauaacaacuucacccaggacauuagcuaugugaauauagaaggaacuguuguaccaguuacaauaucagagauggaacauccuggagauuacgccaaucuacaaacugcucaauacaauaauggcuauacggaugguacgcaguacuuaaccaaccaucaguaccagaacauguacauagagagaacuacaguugauaauucuccuucugcuacuguuuuguaucgggaugaucccaauuugggagcuucuagauuccaaggaaauuacgacauauccagcucucaaucgcaagugaaccuucuuccauccgcaccaggagaaaccuacuauacaucaacaccuaacuggacgccgacgagcagcgguacuuaccaacagcaguacccaucugggaccauaaacguccuucaggcggauucgacucaagccuucgggaguccauacauaaacgcgacauggucgucgaauucgauggaggacggacggccgucuagucaagagguacuagugaaagagugcguuaauuguggugcuagcgucacaccacuuuggcguagagacgguacggggcauuaucuauguaacgcgugugguuuauaccacaaaauuaauggggugcacagaccgccgacuaagccaaccaaaaaaccacaggcgacuggaaauagaagaaacggcguaacgugugcaaauugcaaaacuaacaacacaacucuuuggagaagaaacaaccaaggcgagccaguuuguaacgcuuguggacucuauuacaaauuacauaauguuaacaggccgaucaguaugaaaaaggaagguauccaaacgcgcaaaagaaggcccaaaaacucuucugugggaaaccccgccagugcugcaggucaaguaagacuugggauucccucuuauccaucauauucagaaauggauguacagcaagaucaauaccaauuaccaaugaacguuuauucucaaagaccacaaguuucuuauagacaguauggaacggaaaaucuuggaacuuuaaaugcacagccauugcagccaauaauuacucacgaggaugaacaggcaagcgucauuacaucgacuucacaacaggcuagguuuaggacgaagguggaggaggacgaggguagcaauccuucaaugcaauccuga

SEQ ID NO: 6128 - RNA, 4866 nt, Phyllotreta cruciferae
auggcacuaccggggaaugggaucuucgucgucaaaggcgaaauaucgaacuugauggccgccaugaagaggggccccaaauggucgucgcacucuuaucaagacgacgacgucgacgcgcugcugaggaacuuccacgagcugcgggauauucuacacaauguaaacgauuuaggauacguugaacccaacacguuuuuggccccuuuuuuaaacguaauccguucggaagagaccacaggcccuguuacuagcuuagcgcucucagcuguuaacaaguuccucuccuacggucucuuagaucccguacaaacauccauaccgcaaaccauccacaccaucgcagaugccgugacucacgcucgguuugugggcaccgaucaauccuccgaugggguaguccugaugcgcauacugcaaguacugcgaacucucacucuaucccccgagggcgccacguugaccaacgaaagccucugcgagauaaugcugucuugcuuccggauaugcuucgagacgaggcugucggagcugcuccgcaaaacugccgaacauuaucugaaggacauggugcaauugauauucaugcggcugccccaauucuccgaagaucccaagcuguccuacgucaagcgauugcggaugcagcccggggaucucgagcagacgcgaacgaagaggaaaaaguacucgaagaaggagcacaaagagguugcuaaagcgccggcgcaggaaguuaacguugaaaguaccccgcagacugauauaguagauaugcaggguacuauucuucguaauaacgaaguuacuacgccuucuaguccaaaucuaguugauacagauguugcuauagacauuccuacggaugacaguaugaagacuucggaaaccucuacgucuaauuuagaagauagugcugagaaagaaaccgaugaaccguuucaagacuacgucaaucaaagagguauucgguuuacgccucaauuccaacaggaaaccaaucuaucuccuuacggacuagccuguguucgcgaacuauucagauuccugaucagccugugcaauccuuuagacaagcagaacacagacaucaugauacauuuaggacucaguuugcucacaguagcguucgaaauuagcgcagauaacauaggcaaauacagcacauuguugacccuaguggaagacgauuugugcaggaaucuguucgcuuugaugaacaccgaucguuugacgauauucgcugcgaaucugcaagugucguuucugcuguucgaaucgcugagagcccacuugaaguaccaauuggaaugcuauuugaagaaacugauggaaaucuugcguagcgaaucgaacaagguuagcuacgagcacaaggaaaucgcgcuggauaauuugcugcaauuguggagagugcccggguuccaugcggagcuguacgugaacuacgauugugauauguauuguacuaauuuguacgaagagcucaccgaacugcuggccgaacgguccauuuccacuauaguaggugucuaucaugcgcauuuacugucgcucgauggacuucugauuauaaucgauggcauagggaagagauucgacgaagcgaaagaucguacagacaccgaugagauuaguaguuauauaggagagaauacgagaauuaaagguuguguuaaaguucccgauaagaaggugcuggcugccaagaaagggaucaaaaagugguuaccgcaagguacggaguauuucaaucagaagccgaagaaagguauacaguuccugcaggagcacggcguuuugaagcaggagcuggacguggaagagauugcuagauucuugcgggagaaucccgcauugaacaaagcgaugauuggggaguacaucagcaaucgggggaauuugaagauacuugaggcuuucgugagcacguucgauuucacugggauucgaaucgaugaagcgcuuagagcguuuuuggagacguuucgauuaccaggcgaggcucccacgauuucguugauucucgaacauuucgccgagcauuggcacaaaagcaacggagaaccauucgcugauguggacucggcuuuuacgcuagccuaugcuguuauuaugcuaaacgucgaccagcacaaugaaaaugccaaaaaacaaaccauuccgaugucgccuaacgcguucaagaagaaucugaaaggcguaaauggaggcgacgacuucgaggaggacaugcuggacgaaaucuacacuucgaucaaaagcgaggagaucgugaugcccgccgagcggacgggcgucgugcgcgacaacuaccuguggaaggugcugcugcgcaaagggcgcucgcccgaaggcggcguuuacaugcgcgacgacggcggcgccuacgacgccgauuuguuccgcauagccuacgggccgcuggcggcggcguugaacuccgucuacgagcgcgcggaccacgagggcguccagaagaaagucaugcgagguuucgagcgaugcgccuccauagcguccaaucucggcaugacugcgaaccucgacauguuguuggucaguuugucgaaguuuacgguuuuccacaaccaucagaagcagaccgccgucguggugcaauucggcucgaacggcaaggcccaauuggcucugaagacgcucuucaugcugauccaccagcacgggaacuccaccagggaagguuggaagcaccucuucgaucuccugcucgcuuuguacagcaacgauuugcucagcaagagcuucguggaaguggaagauuuuguggagccaucggggaaauuguguuugguguacaaagaugcuccgagcgcagccaaacaggauaccggauuguugagcucuuuguauuccuauaugauaucuguagagaauuuauccaaaauaccaucgcccgaagagcagaguuuaauagauaaagcaagagaauguaucaaagaaugcaauuuagagcaaaugaucacagauucgaaauuccuccaccaacaagcccuauuccaacuggucgauacucuaaucgaauuauccagagguccggacguacaagauggcucaucguacgacuacaacgaaaacguaacggucuuuuuccucgaauuacuggugaaaaucgucauccaaaaccgggacagggugaugaccauaugggaccgcgucagagaccacguguacacccuggugaugaacuccucgcugauggacuaccaguuccuguuggagagguccguggugggucuguugaggauagccgugcgauugaugcgcaacgaggagaugagccacgugguguugcagucgcugcgcaugcugcuguuucuguugaagggcggcgugcuggccgggauauccaggcaaauggcguucgguuuguacgagauguugaagacgucggcgcagaauauccacacgacggccgauuggacggugguguucgcguuguuggagugcgugggagcgggggcgaagccucccagacccguuuugaccgucgaagaaaacgacgcgaaacccaaacccgacgaagaacauccccagacgaaagaccacaaaaaagacgaagaaggcgccagcgcguuuuccgacccuaaaacgaacgaaacccccaaaaacccgacccaaagaccccaaaguccaggaacagcccuaacaucucccgucggcaccccgaacaccggcggauggaucaucgucagcgacgaagacgaccuccagccccaccgcggcccccaacacacccugcccguccacuaccaccugcgccucgacgccgaucucucgccccacgacccgcucagcaugcucaagugcugcgagagcuuggccuuccuaguccgcgacgucgcucacaucaccccguacaacuucgacgucugcguacgcugcgugcggacguucguggaggcggcccugaaaccgccucccaacaaccaccccaacaccagaagauccaaccuaaagaaaaccaggaagaagagccccgcuggaagccaagaagaagacagcagcgguggagaugaagacgaagaccuccccagcggcuaccaccagguccccauacagcuacuggauuugaugcauacauugcacacccgcaccgcgcagauauucaaauggugggccgaggaaggcggcgaaauuuccggggaaacuucccuguggacgcaagguuggugucccuugcugcaaggcaucgcgagguccugcugcgauacgcgcaggacggucagaaccagcgccauagccuaccuccaaagagcccugcuggugcacgaucuccaaacgcucacccccaaggaaugggagcagugcuuccgaagagugcuguucccguuaaugaacuaccuacugcaaaccaccggcccucgagacgccgucuccaccgaggaaaccaggauaagagccgccggggugcugucgaagguguuccugcaccaucuggcgccucuuucgucgcugcagggcuucgcggaccuguggucgacggugcuggagcugauggacggguacaugcacgccgacggcagcgagcugcugcuggaggccgugcccgagagccugaagaacaugcugcuggugauggaggcggccggaguguucgacgggcccgacgggaagaagaacgcccugugggcggcgacgugggagcgcaucgggaaguuccugccgggguugaaggacgaguuguuuagggagauggggucgaggaggaaggugguggaagaagcgaaggacguggaggaggcuuuccccaaggagaaggaggccgaguguugggagaagaacgucggggggcgggagcaggauguggaugguagggagaaggaggagcugguugcguguuga

SEQ ID NO: 6129 - RNA, 618 nt, Phyllotreta cruciferae
augucgauuuuggcguacaacgggggagcaaugguagccaugagaggggacaacugcguggccauagcggcggaccgcagguucggcauacaagcccaaaccgucgccacggauuucgagaaagucuucgaaaugggcccccauuuauucgugggccuccccggccucgccaccgacacgcaaacagucauggagaagcucagauuccgcaagaacuuauacgaauugaaagagaaccggcggaucucgcccaaaguguucgcagccaugauaucgaacaugcuguacgagaagagauucgggccguucuucguugaaccgguuguagcaggucuagcuccugacacauucgagccuuauauaugcaacauggauuugaucgguuguauaaacgaacccagugauuucgucguaggaggcacagccuccgcgcaauuauacggaaugugcgaaucuuuaugggaaccuaaucuagcccccgaugauuuauucgagacuauaucgcaggcuuugauuaaugcuuucgauagagaugcuauauccgguuggggcgcuacgguuuauaucguagaaaaggauaagguaaccguaaggaaucuaaagacucgcauggauuaa

SEQ ID NO: 6130 - RNA, 2898 nt, Phyllotreta cruciferae
auggaaggaaaaccggaauuagaaguggucaaaucagccguaucaacucuauacaacaaccccgaugguggagaaaaagaaagagccucccgauggcucuuggaacuacagaaaucgguucacgcauggaccguugcagacgaauuacuccgacguugcacgaacgccgacgaucuccaaacccgcuacuucgcagcucaaacaaugcgaaccaaaauccaccaauccuuccacgaacuaccccgagaagugcacgagucucucagggacucccuucuggaacauaugggagcuugcgccggcgucgacgagggcgcuggggccgccauagugacccaacugucgcuagcacuggcagauuuggcucugcagaugcccgauuggcgaacgccugcguuggaucugaucggcagguucagugcggggagcaauguguggccuuugcuagaaguguugacggugcuaccugaagaauuagagagcagaucagugagauuaggagaaaaucgacgauacgagguauuagaagauaugaaauucugugcucccacuguaaaugaauuucucaagcauuguucgaacuuguaugggagaggaggcucugagagguuagccgcaggugauagacaaaucgauguaaagauacucagauguuucgcuucguggauaucggucggagcgaucggaccaagucaauugagcgaggaucggguaguagucgacauggcguucgacguguugaaagcgggcguacggggagaugaaaaagaaaccuuaacaggacaacuacacgaagccgccacagauugcauuugcaccuuacuacuacgucucgaggauaacaacaaucacguggcauuggagacccacuuauucgaaaauauaguaaaucuagaaguggccuaucaugcaucugucgcccucgaagaucaagcaaagucuacggauuauugucgacuguucaccgaguuggcugaaucguuuuuggggaagauuguagacgaugggggaggcggaggcggcgacgguggcggagcuaaaaggcguaccguguacgcuguuaaaugucuagauuuaguacugaugugugucggccaucaugauuaugagguggccgagauaacguuuaaccuuuggcauaugcuaagugaggaauuauaucagaaaaauaacaaggaauuaacggaauuauucaaaccguauguggaaagauugauaacugccuuauguaggcauugucagauggagccggacauggagggucuacucgaaaaaggagacgaauuuaaagauuuuaggaugaaaguuucagaucuaauaaaggacgucgucuuuauaguagguagcagcaguugcuucaggcaaauguucaucaauuuacaaaccucugguguaacgugggaugccagugaagccgcucucuuuguaaugcaggccguagccaaaaacguucuuccaacugaaaacgaagucguucccaaagucgucgaagccauacuaaacauacccaacagcgcacacguggcagugaaauacaccuccguccuucuacugggcgaauuagccgaauggauagaaaaacacccggacgcccuggaccccguccugaauuuccuaguaugcugucuccgcagcggcgccgaaggaggaggcgucgcgacggcggcggccgcggcgcugcagaacgucugcacgugcugcggcgcucacaugggcaggcacguucccauucuguuacaguuacuucaacagucggauucguucggaaucggcaacacggcgguggugggauuguugaagggcgucgcgucgguggugaguugcggcaugggaggcggcgccgagacggccuccgccgucagggaauuguguucuaugcaauugucgccgcugugcaguuugauggagaacgacguucggccgguuaaagggacucugacggauccggugcugugguuggaucgauugaguucgguuuugcgauacguuaacgucaauauagucgaaggcgaaauccauccuugcaaaccgguaauauuggagauauggccgauacuaucccgcgcauucgacaccuaccacagcgacguucgaauaauggaaaggugcugucgcucggugcguuucauguugcguugcguggcccgacaacuccaggauuugcugcccucuuuggucggacaaaucgugcauauuuacugucucuacgggcauucguguuguuuguacgugggcagcaucuuaguagacgaauacgccggugacgcgucuugcguucaaggucuacucgacauguugaacgccuuuuuggagccuacguuucguuuguugcaagaggagaacggcuugaagaaccauccugauacuguggaugauuucuuuagguugugcgcucgauucguacagagggcgccuaaggcguuucuaagcgguggggcccaucuggcgcccauuaugcaaugugcucuacucgcggccacuuuagaucacaaggaggccaacgugucuguuaugaaguuuuucuacgauuugauaaaccagggauugagcgguagaggagagccugacuucgaugagaggaaagcguugguuagaagccugcuaaaugaauauggucaacaacuggugucuaauuuaauucacucuugcguauuuuacuugcauucguauauguugagcgaagugggugacguuuuuguacaauuguuagauuucgauagacagaucacgagugaaugguuagcgaacgguuuggaauuguugcccaaacaacagaaugguggaauaauggcggcuaagccuaagcaauuaaaugauguucaugcuucuauaacgagaucaaacaguucgaaaucugugacgcacgcccucaaagaccuaacuaggcuauaucguuaa

SEQ ID NO: 6131 - RNA, 1509 nt, Phyllotreta cruciferae
auggcgcaacgauugcccggaccggugucgaaucaagucccaggagggccgccgccgccucaaagguaccaacaacagccgccuaaucaaggaaugaggcaauacggccaacagaguuucccuccuaggccgggcuacaacccuccacccccaaauaugcagucuagcggaggcaccaugauucaaagaccuccuggggcgccguauucgccgaugcguggggggcccaugccgccgcagccaguggguaagaggccuucggauaacaggaacccguuacaacagaagaauagugacuauagucacgguacuaguaagaagaaaaagaaacuugcugauaaaaucuuaccccaaaaaguaagagauuuggugccagaaagccaagccuacauggaccuguuagcuuucgaacguaaauuagauuccaccauuaugcgaaagcgauuagacauccaagaagcccuaaagcgccccaugaagcagaaaagaaaacuacgaaucuucauuucuaacacuuucuacccggcaaaagaaccccaacccgaaggccccgacggcccuugccaagagggcacgguagccucaugggaacugagagucgaaggcaggcuucucgaagauuccaagaacgauccgaacaaagucaaacgcaaauucuccucguucuucaagucuuuagucaucgagcucgacaaagagcuauauggccccgacaaccacuuggucgaguggcacagaaccuuaaccacccaagaaaccgauggauuucaaguuaagagacccggagacaagaacgugagaugcacaauucucuugcuccucgacuaccaaccucugcaauucaagcucgauccgaggcuggcccgauugcuugguguacacacacaaacaaggccagugauuaucuccgcucuguggcaguacaucaaaacgcaccggcuacaagacggccaugaacgcgaguauaucauuugcgacaaguauuuagagcagaucuucaacuguacucgcaugaaguucgcugaaaucccccaacgauugaacccccugcuacacccaccugauccgaucguuauaaaccacguuauaucagucgaaggcggcgcugagagcaaacaaacggcuugcuaugauauagauguggaaguugaugacacucugaagacucaaaugaacaauuucuugcugaguacagcgagucagcaggagauucaagggcuagacgcgaagauucacgagacaguugacacgauaaaucagcugaaaaccaacagggaguuuuuccugagcuucgcgaaggauccgcagcaguuuauacauaaauggaucgugucucagacgagggaucugaagaguaugacggaugugguggggaaucccgaggaggagaggcgaucagauuucuucuaucagccgugggcgcaggaggcugugugccgguacuucuacacgaaggugcagcagaagagggccgaguuggagcaggcccuggguauucguaauaauuag

SEQ ID NO: 6132 - RNA, 414 nt, Phyllotreta cruciferae
augccuaaaguacgaagaaguaagaaaccaccaccagaggguugggaacuuaucgagccaacuuuagaugaauuggaacaaaaaaugagagaggccgagaccgaaucacacgaaggaaagcgaaagaacgaaucauuguggcccauauucaaaauucaccaccaaaaaucccgauacaucuucgaccucuuuuacagaagaaaggcaaucagccgggaauuguacgaauauugcuuacuggaaaacaucgcagacaagaauuuaaucgcaaaauggaagaaacaaggcuaugaaagccuuuguugccugagaugcauccaagcaagagacacuaauuucggaacgaacugcaucugcaggguacccaaaucuaagcuagaagaaggaaggauugucgaauguguacauugcggu

SEQ ID NO: 6133 - RNA, 885 nt, Phyllotreta cruciferae
augccagcagcuacuuuggguagcauuucacauccuaacaaugaagacugcggcauucgggacguuugggcucacaauuuagaagaugaauuucgaacuauaaggcaaauagugcagaaauaccaauaugucgcaauggacacugaauuucccggaguuguggcuaggcccauaggugaauuucgaaguucggccgauuaccaauaccaaauguuaaggugcaacguagacuuacugagaauuauucaacuagguuuaacguucuuagaugauaaugguaaaacaccaggagguguuuauacuaccuggcaauucaauuuuaaauucaaccuucaagaagacauguaugcacaagauagcauugauuuacugcaaaauucaggaauccaauucaagaagcacgaagaugaagguaucgagccguuagaguuugccgaauuacuaaugucaucuggaaucguucucauggaaaauaucaaaugguuaucguuucauuccggcuacgauuuuggcuauuuaauaaaguuacuaaccgacaacaaucucccacaagaugaaacugaauucuucgaucuguugaaauuguauuuuccuacgauauacgacgugaaguauuuaaugaaaucguguaaaaauuuaaaagguggucuucaagaaguugccgaacaauuagaauuggaaaggauugggccucaacaucaagcuggaucggacucgcuuuugaccggaauggccuuuuucaaaaugaaagagauguuuuuugaggauacuauugacgauucgaaguuuucgggccaucuuuacggccucggaacgucuuucacuguuaaugguacaacuaacaauuacggaaacgauaacggcgacacaacaaauuccucauga

SEQ ID NO: 6134 - RNA, 1212 nt, Phyllotreta cruciferae
auggcggaagcucagaaaaggggggccucgguguucgaggaccucucgaacgucgaauucgagaccagcgagaacuuagaugugaucgaaaaguucaaagacaugaagcugaaggaggagcugcuucgcggcaucuucgcauaugguuucgagaagccuucggcuauucagcaaagggccauuauuccugugaugaaaggccgagauguuauagcccaagcacagucagguaccgguaaaaccgcuacauucuccauagcuauucugcaagcucuggauuuaacgaugagagaaacgcagguguuguguuuauccccuacgagagaauuggcuguacagauucaaaaaguuauauuagcucuaggggauuucaugaacguacaaugucaugcuugcaucggggguacgaaccuuggagaagacauuagaaaguuggauuauggacagcauguuguuagugguacaccuggaagaguuuacgacaugauucguagaagagcucugagaacuagaucagugagaaugcuaguacuagaugaagcugaugaaaugcuaaacaaaggcuucaaagaacaaaucuacgauguguacagauuucuuccaccguccacucaagugguucucauaucugcuacguuaccccacgaaauuuuggagauaacauccaaauucaugaccgaucccaucaggauucuaguuaaacgugacgaacugacgcuggagggaaucaagcaguuuuucguggccguggagagggaagaauggaaauucgacacucuaugcgaucucuacgacaccuuaaccaucacccaagccguaauauucugcaauacgaagagaaagguggauugguuaaccgagaagaugcgagagaacaacuucacugugagcucuaugcauggagacaugccucagaaagagcgugacaacauuaugaaagaauucagaucaggccagaguagaguuuugauuacuacugauguaugggcuagagguaucgaugugcaacaaguaucguugguuaucaauuacgauuugccuaauaaucgugaguuguauauucaucgaauuggucgaucuggucgguuuggaaggaaggguguugcuaucaauuucguuaaauccgaugauauuaggauuuugagggauauugaacaauauuauucaacacaaauugaugaaaugccuaugaauguggcugauuuaauuuaa

SEQ ID NO: 6135 - RNA, 1599 nt, Phyllotreta cruciferae
augaccgcuccugcugccgguggagaugcaagaggaagaacucuugccuacaaagacaaaagcaaacccgccgauguccgaacuaguaacauuaacgccgcuaaggcuguuugcgaugcaauucguacuaguuuggggcccagaggaauggauaaaaugauucaagcugguaacggagaaguaacuaucacuaacgauggagcaaccauuuuaaaacaaaucaacguuauccauccugcagcaaaaauguugguggaacugucaagagcucaagauaucgaagccggugaugguacgacuuccguuguaguuauugccggagcccuuuuagaugcugcggaaaaguugcuacaaagaggaauccacccaacggcuauuucggaaucuuuccagagggcugcucauuuagcugucgaaauucuacaagaaauuucaacacccguagaaaucacuaacagggaguuauuaaucaagagugcauccacuucguugaauucuaaaguuguaucucaacagucgagucucuuaggaccuuuggcagucgaugcuguucuuaaaauuguugaaccaggacaagaacaagcauguaacuuauuggaugucaaagugauuaaacaauugggcgguacuguggaagauaccgaguugauugaggguaucguuuucucgcagaaaucugcuaacguaucuggcccgaagagaaucgaaaaggcuaagauuggucucauccaauucugcauuucuccuccgaaaacugacauggaccacaauguuauuguaucagauuacgcugcgauggaucgaguuuugaaggaagaaagagcuuacauuuugaacauuguuaaacagaucaagaaagccgguugcaacguucuuuugguucagaaaucgauucucagagaugcuguaucugaucuagcucuucacuuuuuggauaaaauaaagugcaugguugucaaggauauugagcgagaagauauagaauuuguaugcaaaucguuggguugccgaccaauugcaucacucgaucauuucaccgcagagaaucuaguaacugcugauuuggucgaagaaguuggaguaggcgguaaccgaaugguaaaaauaacagguauucaaaacgccgggcguacuguuacccuacucgugagaggcucgaauaaacuaguauuagaggaggcugagaggucucugcaugacgcucuuugcgucauucguugucuuguucgcaagaaggcgcugaucgcagguggcggggcaccggaaaucgaagucgcccuuaagcuggcugcuauggcuaauaaguuggagggcauugaugcuauuugcaccagagcuuaugcuacugcuuuggaaauuauaccguuuacuuuggcggaaaaugcuggauugaaucccauacagacaguuacagaauugaggaacagacaugcgaaaggugaaacuucugcugguauuaauguucguaagggcaccauuacagacauuuuggaagaaaauguuguacaaccgcuguuaguuagcacaucugcuuugagcuuugccaccgaaaccgucagauccauauuaaaaauugaugauauuguaaguauauucuaa

SEQ ID NO: 6136 - RNA, 1074 nt, Phyllotreta cruciferae
auggaggcuauggauauuguaauaccagagaaagaggaaggcagcccuuccgaagucaagcaaguccugcaagaucuagacauggaggauuuguacacgaaauacaagaaacuacagcaaaccuuggaauuccuugaaguccaggaagaguacaucaaagacgagcagaggaacuugaaaaaggaguaccuacacgcacaagaagaagucaaacguauccaaucaguaccgcugguuaucggccaauuccuagaagcaguagaucagaauaccggcaucguuggaucaacuaccgguucgaauuacuacguucgcauucucuccaccaucgacagggaauuacugaaacccucugcuagcguagcccuacacaagcacagcaaugcuuugguggacgugcuaccccccgaagcggacuccucgauuagcaugcuccaagccgacgagaaaccagacguacaauacagcgacaucggagguauggauaugcaaaagcaggagauucgagaggccguugagcugccguugacccacuucgagcuguacaaacaaaucgguauagaccccccgaggggugugcugauguacggaccacccggguguggcaaaaccaugcuagcuaaagccguagcucaucacaccacagcugcuuucauucgagugguggguucggaguucgugcagaaguaccugggcgaggggccgaggaugguuagagacguguuccgucuggcuaaagagaauuccccugcuauuauauucaucgaugaaaucgaugcgauugcuacuaagagauucgaugcucagacgggagccgaucgggaggugcagaggauucuguuggaguuguugaaucagauggacggguucgaucaaaccaccaacgugaagguaauaauggcuacgaaucgagcugauacauuggauccugcucuacuuaggccgggucguuuggauaggaaaaucgaauucccauugccugauagaaggcaaaagcgauugauuuuuaguacuaucacuucgaaaaugaaucuauccgaagagguugauuuggaggauuauguugccaggccu

SEQ ID NO: 6137 - RNA, 489 nt, Phyllotreta cruciferae
augccaaauauaaagcugcaaucuucggacggcgagaccuucgaaaucgacgucgaaaucgccaagugcucggugacgauaaaaaccaugcuggaggaccucggcauggacgaggaagaggaggaaguggugccguugcccaacguaaacucagccauucuacggaaggucauccaaugggccaccuaccacaaagacgacccacccccgcccgaagacgacgacaacaaagagaagcgaacggacgacauauccucgugggacgcggauuuccugaaagucgaccaaggcacacuauucgaacugauccuagccgcgaacuaucucgauauaaaaggcuugcuggauguuacuuguaagacuguggccaacaugauaaagggcaaagcgccggaggaaauacguaaaacguuuaacaucaaaaacgauuucacgccguccgaggaagagcaagugcgcaaggagaacgaauggugcgaggagaaauag

SEQ ID NO: 6138 - RNA, 930 nt, Phyllotreta cruciferae
auggacgauaaggcuucauguaaggaacuagaucaauggauagaacaguuaaaugacuguaagcaauuaaccgaaaaccaagugaaaacucugugugauaaggcgaaagaaauacuguccaaagaaucaaaugugcaggagguaaaauguccugucaccguuugcggagauguacacggacaauuucacgaucugauggaauuauuuaggauagguggccgaaguccagauacgaauuaccuuuuuaugggugacuaugucgaucguggguauuauuccgucgagacuguuacucuuuugguggcuuugaaagucagguauaaagaaagaauuacgauccugaggggaaaccaugaaucaagacaaaucacucaaguauauggauucuacgacgagugccugcgaaaauacggaaacgcgaacguuuggaaauucuucaccgauuuguucgauuacuugccgcuuacagcgcucgucgauagucaaauauucuguuugcacggagggcucaguccuagcauugauaccuuggaccauauuagagccuuagaucguuuacaagagguuccucaugaagguccgaugugcgaucuucucuggucggaucccgacgaucgcggagguuggggcauuucuccucgcggugcaggauauaccuuuggacaagauauaucggaaacguucaaccacagcaacgguuugacguuggucucucgggcccaucaacuugucauggagggguacaauuggugccaugacagaaacguuguaacaaucuucagugcuccaaacuacugcuauagaugugguaaucaagcugccauuauggaauuagaugaugcgcuuaaauauucauucuuacaauuugauccagcaccgagacguggugagccucacguuacccgcagaacuccggauuauuuccuuuaa

SEQ ID NO: 6139 - RNA, 918 nt, Phyllotreta cruciferae
augcagaucuucguaaaaacgcuuacuggaaagaccaucacccuugaagucgagccauccgacacuauugagaauguuaaagccaagauccaggacaaagaagguaucccaccagaccaacaaagauugaucuucgccggaaagcaauuggaagauggccguacucuuuccgacuacaauauccagaaggaaucuacccuucacuugguacuuagacuucguggugguaugcagaucuucguaaaaacucucacuggcaagaccaucacccuugaagucgagccaucugacaccauugagaauguuaaggcuaaaauucaggacaaagaagguaucccaccagaccaacagagauugaucuucgcaggaaaacaauuagaagauggccguacucuuuccgacuacaauauccagaaggaaucuacucuucacuugguacuuagacuucguggugguaugcagaucuucguaaaaacucuuacuggaaagaccaucacccuugaagucgagccaucugacaccauugagaauguuaaggcuaaaauccaggacaaagaagguaucccaccagaccaacagagauugaucuucgccggaaaacaacuugaagauggccguacucuuuccgacuacaauauccagaaggaaucuacccuccacuugguacuuagacuucguggugguaugcagaucuucguaaaaacucuuacuggcaagaccaucacccuugaagucgaaccauccgacaccaucgagaauguuaaagccaagauccaggacaaagagggaauucccccagaccagcaaagauugaucuucgcaggaaaacaauuagaagauggccguacucuuuccgauuacaacauccagaaagaaucuacauugcauuugguacuccgucuuagaggaggacaguaa

SEQ ID NO: 6140 - RNA, 1623 nt, Phyllotreta cruciferae
augaugcaaccucagauauuacuccucaaagaaggcacugauucgucgcagggcaagccccaauugauaucuaacauaaaugcgugccagaguauaguggacgcuauacgcacaacucugggccccagaggcauggacaaauugaucguuuccaacagaggcucggccaccaucucaaacgacggagcgacaauacuaaauuuacuagacguggugcauccagcagcgaaaacucuaguugacauagcgaagucacaagacgccgaaguaggcgauggcacgaccucgguggugcuguuagccggcgaguuuuugaagcaacucaaguccuacaucgaagaaggcguccacccgaggaucaucaucagagccgugcggaaggccacccagaucugcuuggagaagaucaacgcgcuggccgucaaaaucgacaaauccaacgccgaggaguacagaucgcugcuggacaaaugcgccgccaccgcgaugagcucgaaauuaaucaacaaacagaaaucguucuucuccaaaaugguagucgaugccguguuacuccucgacgaacuucuaccguugaacaugaucgguauaaagaagguccaaggcggugguuuggaggaauccauguugguagccggaguggccuucaagaaaaccuucucguacgccggauucgaaaugcagcccaagaucuacaaagacugcaagaucgcccuguugaacaucgaauuagaacugaaagcggagagggacaacgccgagauccgccugagcagcgucaaggaguaccaaaaaguagucgaugcggaguggaacauccuguacaacaaacucgagaaaaucuacgaauccggugcuaacgucguucuauccaaacuacccaucggcgacguugccacgcaguacuucgcugauagagacauguucugcgccggaaggguccaagaagaagacaugaagaggacuuuaaaagccugcgguggcuccgugaugaccacagccaacgauuugaaagacgaagugcuagguaaaugccagcuguucgaagagaaacaaauaggaggcgaacgauacaacuucuucaaaggcugucccaacgccaaaaccugcaccauuauccuaagaggaggagccgagcaauucuuagaagaaaccgaaagauccuuacacgaugcuauuaugauuguccgcagaacaaucaaaaacgacuccaucguagcaggcggaggagcaauagaaauggagcugucgaaauuacuuagggauuacucucguacuauugcugguaaagaacaacuccugauuggagcuauagcaaaagcgcuagaaauaaucccuagacagcuaugugacaaugcugguuucgaugcuacaaauauacugaacaaacugcgacagaagcacgcucagggcaauucuugguauggaguggaugucaacauggaagauauugcggauaacuacgaaacuugcgugugggagccagccauuauaaaaauuaacgcuuuaacagcagcugcggaggccacuugcuugaucuugucuguggaugagacgaucaagaaccagaaaucugaagcgcccccgcaaaugggaggucguggaauggguagacccauguaa

SEQ ID NO: 6141 - RNA, 2673 nt, Phyllotreta cruciferae
augagucgucagggccccagcaaacguuacgacucggauucggauuccgauagcguggacagcgcggaggaggcccgcaagcgggaccugcaggaacgagacgaauucgccaaucgucucaaaaagcgggaugaggaucguacgagaaacguagugcagaauuucgauaaaagaaccuacgaagaggcggcgaagcgccucaaguuagacaacgcuggaagagauaaggugauaucggagcuucgaaagaccucgagauggaaguaccuggagaagaggaaggacgacaagcugcaggaauuggaggcugauauuguggaugaugaguacuuguucgaagaggaaauauuaacggagagggagaagaaggagcgccagcacaagaaggaauuguuacagcuagcccaggagcaugagaaggcgcgggaacuggagcgcauucaacgcuaccacaugccgagggacuuggguaaagacucgacugcggauuacaucgaaguggacgagcucgagaaaguaccgcaauccgagcagaagaaaugggagaaagaccaaauggcuucggcuguguucaaguuuggagcgaaagaugucaagaaaaccgacgauuacgaacuacuacuggaggaucaaaucgauuucauacaagcgcuacaaaugccgggaagcagcgagaagaaaguacccgaacuauccgauguacaaaagaagaaacuuaccaucgaagaaacgaaaaaaagccuaccgauuuacccuuucagagacgaucuaauacaagccguuaaagaguaccaagugcugauuauaaaaggugaaaccgguucugguaaaaccacacaaauaccgcaauaucuccacgaagccgguuucacugcugaugguaaaaaaaucgguuguacacagccuagaagagucgcagcuaugucaguagcagccagaguagcccaagaaauggacguaaagcuaggcaacgaagucggauacgccaucagauucgaagauugcacuuccgaacgaaccguuauaaaauacaugaccgaugguacauuacacagggaguuucuaucagaaccagacuugcaaucuuacaguguaaugauuauagaugaggcucacgaacgaacacugcacacugauauauuauucgguuuggugaaagauauagccagauuuagaccagauuugaagcuguuaauauccagugcuacguuagauguuaccaaguuuucggaguucuucgaugaugcuccgguguaucaaaucccaggcaggagauuuccaguggauaucuacuacacgaaagccccugaagccgauuacguagacgcuugcguugucucuauacuacaaauacacguaacucaaccauugggugauauuuuaguauucuugaccggucaagaugagaucgaaacuugccacgaacuccugcaggaucgaguacgacguuuggguucaaaaguuaaagaacugauuauacuuccuuuauaugcuaaccuuccgagugaucugcaagcuaaaauauucgaaccgacuccaccaggugcuagaaagguuauucuugcuacuaauaucgcagaaacuucacuaacaaucgauaacauuaucuauguaauugauccagguuuugccaagcaaaaccacuucaauuccagaacgggcauggagaguuugaugguggugccuauaucuaaagcuucggcuaaccagcgagcuggaagggcuggaagaguggcugccgguaaaugcuuuaggcuguacacggccugguccuauaagcacgaauuggaggaaacuaccguuccggagauacagaggaucaauuuggggaacgcuguguugauguugaaggcguuggggauuaacgauuuggugcauuucgauuuucuggaucccccaccgcacgaaacgcugguguuggcuuuggagcaguuguacgcuuuaggggcuuugaaucaucacggcgaauugacuaaauugggaagaagaauggcugaauuaccgguggauccgaugauggccaaaaugauauuggcaucagagaaauacaaguguuccgaagaaaucguuacuauaggagcaauguugucagugaacggggccauuuucuacagaccgaaagauaagauuauccaugcggauacggcuaggaagaauuucaaucacuuggcuggcgaucacuugagucuuuugaacguuuauaaucaauggagagacuccgauuacucguugcaaugguguuacgaaaacuucauucaacacagaucuaugaagcgagccagagacgucagagaacaacuagucaacuuaaugaccagaguagaaaucgaaauaguauccggaaucgaugaaaccgauaacguccgcaaggcuaucacauccggauacuucuaucauaucgccagguuuuccaaaggugguaguuacaaaacugugaagcauaaucaaagcguuacuauacacccgaacagugcuuuguucgaaacguugccaagguggguuuuguaccacgaguuaguguucacgacuaaagaauucaugaggcaagucaucgaaaucgagaguaaguggcuguuggaaguggcgccgcauuacuacaaggccaaggaauuggaagauuccaccaauaagaaaaugccuaaaacugucggaagaaguaaaaugacugauuaa

SEQ ID NO: 6142 - RNA, 1371 nt, Phyllotreta cruciferae
augaagguagaagaggugaaaagcaccgugaaaacucaacgaauaagcgcccauacucacauaaaggguuugggauuagaugaagcggguuucgcaaucccuucggcggccggccuggucggucaggagcaggcaagagaggcugcaggagucgucguggacaugauaaaaagcaagaaaauggcugguagggcuguucuucuagccggcccuccagguacggguaaaacagccauugcacuagcaauugcccaagaauuggguaacaaagugccauuuugucccauggugggcucggaaguuuacagcacggaaauaaagaaaaccgaaguccuuauggaaaauuucagacgagcuauugggcuuagaauuagagaaacaaaggaagucuacgaaggagaaguuagcgaacugacaccugucgaaacagaaaacccagcaggagguuacgggaaaacugucagucauguuguaaucgguuugcgaacagccaaggggagcaagcaauugaaacuggaucccagcauauacgaagcccugcaaaaagagaagguugaggugggggaugucauuuacauugaagccaccaguggggcugugaaaagacagggaagguccgaugcuuaugcuacggaauucgauuuggaagccgaagaauacguaccucuuccgaagggagaugugcacaagaagaaggaaguuguacaggauguuacuuuacaugauuuggaugcugcuaaugcgaagccacaggguggucaagacguguuauccaugauggggcaacucuuaaaaccaaagaaaaccgaaauuacagauaaacucagaaaagaaaucaauaaaauuguugacaaauacauugaucaagguauugcugaauugguaccagguguuuuauucaucgacgaaguucauauguuggauauagaaacauucacuuaucuccauagagcuuuggaaagcgcuauagccccgauuguuauuuuugcuacuaauagaggucguugucuuauuagaggaaccgaugauguauuuucuccgcauggaauuccauuagaucuucuagauaggcugcugauuauccguacgauuccuuacaacaaauccgaaauggagcaaauuauuaaauugcgagccguuacagaagguuuggaaauugagccggaagcaaucucaagcuugggagaaguugggacaaaggccacccugagauacgcaguucaacuauuaacgccaucauuuuuaacagcuaaaauuaauggaaggaguaacauucuccaaagcgacguugaagagauugguugucuauuccuugaugccaaaucuucugcuaaaauacuuaccgagcacaaagauaaauuuaugacguaa

SEQ ID NO: 6143 - RNA, 1977 nt, Phyllotreta cruciferae
augacuucaauaauuaaaguacaagccuuauccggcgccaaagaugaaucucccccuuguuaccuauugcaggucgacgacguuagaauucuauuagauugugguugggaugaaaaauuugauauggaauucauaaaagagcuuaagaggcauguacauacaauugaugcaguguuaauaucuuacccggauaacuaucauuuaggagcucugccuuacgcaguugguaaauuagguuuaaauuguccaauauacgccacuauaccaguguacaaaaugggucagauguuuauguacgaucuguaucaaucucaguacaacaugaaggaauuuuguauauuuucucuugaugaugucgaugccacuuucgaaaagguuauucaguuaaaauauaaucaaacuguucccuuaaaaggcaaaggauauggcauaacugugacaccuuuacccgccggucauaugaucggaggaaccauauggaagguaaauaaaguaggcgaagaagauauuguuuacugcaacgauuuuaaucacaaaaaagaaaggcauuugaacgguugugaacugaagaaacuucaaaggccaucguuacucauaacagaugcauuuaaugcuacauaucagcaggcuagacgaagggcgagagaugaaaaauuaaugacaaauauucuccagacuuuacgaaaccacgggaacguccuuauagccguagacacugcugguagaguacuggaauuggcucacauguuagaucaacuguggagaaacaaggaauccggacuuuuggcuuauucauuggcuuuuuugaacaauguuaguuauaaugucgucgaauuugccaaaucacaaauagaauggaugagcgauaauuuaaugaggaguuucgagggagccagaaauaauccauuccaguucaaauauuugcagcuaugccacaguuuaggggaguuaagcaaagugcccaguccgaaggucguauuggcuaguucgccugauuuggaaaguggauuuucuagggaacuguuuuuacaaugguguucuaauccuaauaacaguauuauauuaacuacaaggaccucaccuggaacuuuagccagggauuuaauugacaauggaggaggaagaaccauagacuugauaguagagcgaagaguuaaauuggaaggccaagaacucgacgauuaugaaaggcgacaaaggucuaaauaugacaaauuagaagaagaugaagccgauucugauucggauuccgauauugaaaugucagucaccuccaaaggcaaacaugacauuguuaucaaacaagaaggcaaaauauccacgggauuuuuuaaagucaccaaaaaaauguaccccauguauccuuucaaggaagauaaaauaaaauccgacgaauauggcgaaauugugaaagcagaagauuacaaauuagcggaaauuucagcugaaggcgaagauaacaaagagaacauagugauuaaaaaagaggaagaggaaauaacugaaauuacugagcaaccaaccaaauguauaauucuucaacgaacaguucaaguaaguugucaaguucaauacaucgauuucgaagguagaucagauggagaaucguugaugaagauuuuaacgcaauugaaaccgagacgagugauuguuguacaugggacugaagaaaauacaucuguuauagaaaagcauugcuuggauaauuuagaagcuagaguuuucacuccguccagaggugaaauaaucgaugccaccagcgaaacucacauuuaccaggugagguugacggacgcuuugguuucacaauugaguuuucagaaagccaaggaagcugaaguugcuuggcugggagcucacauaguacuaagagaaagccaagcugacgcuaaaaggaugaauuuggauaaugaagaaauggaagguaauucuugcagcuucuaucagcagcucuucuugcagcucucuaaaguuuaa

SEQ ID NO: 6144 - RNA, 2274 nt, Phyllotreta cruciferae
augccuccguuggagguaacagcaaacaccaacaacgaggaaucagcgcccauaaacccgguagugggcauaaucuacccucccccggagguuagaaacaucgucgacaaaaccgccaguuucguggcgcgaaacggccccgaauucgaagcccgcaucagacagaacgagcucgguaaccccaaguucaacuuccucaauggcggcgaucccuaccacgccuacuaccaacauaaagucaaagauuucagggaagggaaaggucaagagcccacuccgggcuugagccaagccguagccaaacuaucggugagcgccucagcgcagcaaaaacaacaagagauauugaagcaagucgagcagccguucguaccgaaagauccuccgucugaguucgaguuuauagccgaucccccuucgauuucugcuuuagauuuggauaucgugaagcuuacugcucaauucguagcuagaaauggucgagcuuuuuuaacccaauugaugaauagagagcagaggaacuuccaguucgauuucuugaggccgcagcauuccuuguuccaauauuucaccaagcuguuggaacaguacacuaaaguacuaauaccuccgaagagcauggagcagaggcucagagacgaagccaaaagcgccaaagccguccuagagcaagucaaguacagggccgaaugguugcgguaucaggaacagcaaaaggccaaggaagaggagauacucgagagagaacggguggcguacgcgcaaauagauuggcacgauuucguggugguggaaacugucgauuaccaaccguucgaaauagggaauuucccgccgccuacuacccccgaagaagugggugcuaggauacucauacaggagaggaucgaagaaggcgaagauaucgaaaugcaguuggagagcgaugaagaugacgauacgaacgcugaugacgguuugaguuccaugcaggauaagacgaagcgcaaaggaggcgaugauaaucguuugcaggacauggaagaggauacuucugaugaagauaaugaugaugauagcgguaaaacgggagcggcuucaucgcucauucaaccgccauugccgccuauaccggauaaagugcuggugaagaaauacgauccuaaacaagccguaaaagucuccagaccgacaguaggcgacgacuaucuaguaucccccaucacaggcgaaaaaaucccggccagcaaaguccaagagcacaugcgcaucggccuacuagacccccgaugggucgaacaacgagacaagcaaauguccgauaaaaugaaccaagacacgguguacgcggccggcagcgccaucgacgcuucgcugaagcuucuagccgaacgacguacggauauuuucggaguaggcgacgaagagacugcuaucgguaagaaaaucggcgaagaagacgugagaaaggacgaaaaggugacgugggacgggcacacgagcagcguggaggcggcgacgagggcggccagggccaacaucacguuggaggagcaaauucaucagauacacaaaguaaaaggccuguugccugacgaagagaaggagaagaucgggccgaagaauaucggcucgaagaagaucaauauacagagcguuaucacuacgaagccggcgaaucaagccacgcagcaacccaaaccgccugucucgauaauccaaaccagcgcccagccgauaaugccgguuccaacgcaaccuacgaugcuggccccgcaaccuuccaucaugaugaugccagcgccgccuaugcccacuauucgaccgccgccguugaugaugcccggagguguagcgaugggugguuaucccguaggccccaugcccccggggcccggcaugaacauggcccccaugaagcauccgaacgaaggucccagcgaagaggagccgagcaauaagaaguugcgaaacgaggauucguuggugcccgagaacguguucuuguccaggaauccgagucaagugucuaucaagauuucgauaccggugaugccggagaagagcgaauggagguugaagggacagauggugucguggacguuggcuuugaccgagagcgugucgaauuugaaggcuaaaauacaggaggaaacuaacaugccgccggcgaaacagaaguuguucuucgaugggauguucuucaaggauuccaacacguuggccuacuauaauguaacgcaaggagccgucauucaauugcagaucaaagagagaggcggaaggaagaaauga

SEQ ID NO: 6145 - RNA, 1005 nt, Phyllotreta cruciferae
  misc_feature (971)..(971): n is a, c, g, or u
augccgaguacagagguuacaacgacuaaggugauagugcacccgcuggugcuucucagcguaguggaccauuucaaucgaaugggcaaaaucggcaaucaaaagcguguugucgguguucuacucgguugcuggagggccaaaggagucuuagauguauccaacaguuucgcagucccuuucgaugaggacgacaaagacaaaucuguaugguuuuuggaccaugacuaccuggaaaacauguacggcauguuuaagaaagucaacgcuagagaacgcgucguugguugguaccacaccgguccuaaauuacaccaaaacgacaucgcuaucaacgaauuaauucgaagauacugccccaauucagucuuggugauuauagaugcgaaaccuaaagaucuggggcuuccuacugaagcauaccaagcgguagaagagguccaugaugauggcucuccuacaucuaaaacguuugaacacgucccgagcgaaauaggcgcagaagaagcugaggaagucggaguagaacauuuacuaagagauauuaaagacacuacagugggaacuuuaucucaaaggauuacuaaucaguuauuaggccuuaaaggguugcauuugcaauugagagauauaagagacuauuugaugcaagugugcgauaacaaacugcccaucaaucaucagaucaucuaucaauugcaggauauuuucaauuuguugcccgauauaaaucaagaugcguucaacaauucguuuuauguuaaaaauaacgaucaaaugcuuguaguuuauuuaggggcucucguucgaucuaucguugcauugcacaaccuaaucaacaacaaacucaccaacagagacgcagaagaaggcaaaaaggaagagaaaaaggacaacaaggauaaagauagcaaagacaaggauaaggaaaaaacggacaaagagaaggaagcgaagaaggacgagaagangaaaaaggacaacaaggauaaagauagcaaagac

SEQ ID NO: 6146 - RNA, 1653 nt, Phyllotreta cruciferae
auguuuggaggaggacgcgccccgauuuuaguguugagccagaauacaaagcgcgagucgggccgaaaaguucaguuggagaacaucaaugccggcaagcaaaucgcagaugucauuagaacaugucuugguccgcaagccauguuaaaaauguugauggaccccauggggggcaucgugaugaccaacgacggcaacgccauucugcgagagaucaccgugcagcauccugccgcuaaaaguaugauagaaauagccagaacccaagacgaagagguaggagaugguacuacuucuguaauuguauuagcuggagaaauguuggccgcugcugaacaguuccucgaacagcaaauucacccuacgaucaucaucagacaauacaggcaggcccucgaagauauggugcaauuucuggaaggacccuuaagcgugcccuuagaucgaaacgacaaaaacgccguagcccaaguggucaaaggcugcauaggaacgaaauucuugagcaaguggucggauuuggccgucaauaucgcuuuagaugcgguaaauaccgucuuauuagaagaaaauggucgaacggagguggacaucaaaagguacgccaaagucgaaaagauucccggugguucgguggaggaauccaggauauugagaggcguaauguugaacaaagacguuacccauccuaaaaugaagcgacacaucaagaauccgagaaucauccuuuuggauugcgcuuuggaauacaagaaaggagaaucucaaaccaacguugaaauuagcaccgaaacugauuuuaccaaacuccucgaauuggaagaagagcacgucaagcggcaaugcgacgagauaaucgcccucaagccggacguaguguucaccgaaaagggaguauccgauauagcccagcacuuccugcucaaggccggcaucaccgccaucaggcgugucagaaagucggauaacaaccgaaucgcucgagcuuguggcgcugucaucgucaacagaacagaggaacuccaggaguccgacgucggcaccggagccggcguauucgaaaucaagaaauucggcgacgaguacuucuguuucaucgacgaaugcaaaaauccuaaggccuguacgauccuucugcgaggagccagcaaggauauucugaacgagaucgagcggaaccuccaagaugcccugcaaguggccaggaacauagugcugucuccgcguuuggugcccggcgguggggccauugaaauggccguagcccaacgguugaugcaaaaggccacgcacggccccuaccgggcgcucgcccacgcuuuggaaaucauuccgagaacguuagcgcaaaauugcggagccaauaccaucagaacguugacggcucugagggccaagcacgccaaccacacugacaccgagaaaccgugcacuuggggaaucgauggcgaaaguggggaauuggucgauaugaaaaucaaaggcuugugggagccguugucugugaaacuucaaaccuacaaaacagccguugagaccgccauucuccuguuacguaucgacgauauuguaucgggauccaaaaagaagggugacaaggaggucccgacgcccagucaaaugcaacagcaggaagcccaaggaggggacuaa

SEQ ID NO: 6147 - RNA, 702 nt, Phyllotreta cruciferae
augaugcaaacaggaguacgucccuauuauccagacuauucuacaauucccguugaacgccagauuaauccguacgcugauaauggaggaagcguaguagcaauugcaggaaaagauuuugugguuauuggcgcagauacgcgucuuaguuccggcuuuuccauauacacuaggaaccagaacaagcuguuuccucuaucugagacaacuguuuuaggauguucagguuguuggugcgauacuuuaacguugacucguauuauaaagucucguaugcaaauguacuaucaagagcacaacaagaacaugucuacaacagcggcugcucaaaugcugucgaccauguuguacuauaagcgauuuuucccuuauuacauaucaaacauucuuguuggauuggauaaugagggaaaagguugugucuacagcuacgaucccguugggcauugugaaaaagcuaccuaucgagcgggugguucugcaggggcuuugcuucagcccuuauuggacaaucaaauugggcaaaaaaaucuacagaagccuucgcaagaagaucuuacucaggaaaaggccauuucuacacugaaagauguuuucauuucggcugcagaaagggauauuuacacuggugauaguguacuuauuaaaaucauuacaaaagauggaaugaaagaagaaacguuugauuugagaaaagauuag

SEQ ID NO: 6148 - RNA, 900 nt, Phyllotreta cruciferae
auguuccaauucggcuucaacauguucccggacaucccgaggcccuucaacaugaccuacaagugcuacucgguggccauguucccgggaaacgaaagacaggacgucgaacgugguggaaaaauaaucaugccgccuucggcacuggaacagcuuacucgauuaaacauuaacuaccccauguuguuuaaacuaguuaauaagaagacaaaucguacgacucauugcgguguauuggaguucguagcggacgaaggaaaggucuaccuaccauuauggaugaugcacaauuugguacuaaccgaaggcgauuuggugcaaauggaaagcguuucguugccagugggaacguuuuccaaauuccagccguugaauccggauuuccucgacaucaccaacccgaaagccguacuggagaauugcuugcggucuuuugcuugucugaccaacggcgacgugauagccgugagguacaaucaaaaggccuaugaauugugcguguuggaaaccaagcccgguaacgccaucaguauaaucgaaugcgauaugaauguggaauucgcggcuccuguuggcuacaaggaacccgaacaugcuaaaaaagaagaagaaaugucgguggaucccgcagauuuaaugcccgaaccgucgggauucguggcuuuuaggggggccgggaaucgauuggaugguaaaaaacgcaaagauucuuccucuaaugauacuccuucgguuaaaccggcuuacguuaggggaauucccgacuacgauuaucaaauuggcacucuagauuucaucaggcguacgauagcgaagccuaaagagaaggagaauagugaagauggggacgauuucaaggcuuuuagugguacuggguucaguuugagaaauaggaauuag

SEQ ID NO: 6149 - RNA, 1623 nt, Phyllotreta cruciferae
augucggccuuaccaggagcuaucgcuuucgacgaauaugggagaccauuuauaauucuaagagaccaagacaagcaaaaacgauugaccggaaucgaugcccugaagucgcacauuuuagccgcaagucaaauugcucacacuguucgcaccucuuuggggcccaagggcuuggacaagaugauggucuccucugauggggaaguuacuguaacgaacgauggggcuacuauuuugaagaugauggauguugaacaugaaguagcuaaauuguuaguucaacuaucucaaucacaggaugaugaaauaggagacggaaccacugguguaguaguauuagcgggggcucuucuggaacaagccggcgcccuccuggaccguggaauucauccgauaagaauagcggaugguuucgaauuggcaugccaaacggcaguggaucauuuggagaaaaucgccgaacuguuuccaauuuccgcugaaaacaccgagccccuuguaaaaguugcgaugacuacauuagguucgaaaaucauuaacaagugucacaggcaaauggccgaaauugccguaaauggcguguuagcaguagccgaucuccaacaaaaggaugucaacuuugaacucauuaaaguagaaggaaagguuggugguaaauuggaagacacgacauuaguaaaaggcgucgucauagauaaaacaaugucucauccucaaaugccgaaggaacuuaagaauguuaaauuggccauccucaccugcccguuugaaccucccaaacccaagaccaagcauaaguuggacgucaccagcgucgaugacuacaaagaacuaagauuguacgaacaagaaaaauucaaggaaauuguuggcuuagucaaaaaagcuggagcuaccuuggcuauuugccaauggggauuugacgaugaggccaaccauuugcuguugcagcaggaguuaccugcuauaagauggguuggcgguccagaaauagaacucauagcuauugcgaccgguggaagaauaguuccacgauucgaggaacucagccccgagaaacuugguucugccgguuugguacgugaaauaucguuuggaacuaccaaagauaagaugauggugauugaagaaugcucgaauucccgugccguuaccauucucgucagaggcgguaaucaaauguugguugaugaagccaagaggaguuuacacgaugcuuugugcguagugaggagcuugauucaggaaccaagagucguguauggaggaggugcagcugaaauagcuugcaguuuagcuguggcugcucaagccgaucaguuagcuucuuuggaacaauacgcuuaucgggcauuugccgaggcauuagaaagcauuccgcuggcucuagcugagaauucggguuucuccgccauucauacuuugggagaaaucaaggcaaagcaagcugcaucuggggauccggcacuuggcguggauugcaugaauauuggcaacauaaacaugagagaacagcauguuacagaaucucugcgaucuaagaggcaacaauuguuguuggccacgcaauuagugaaaaugauucugaaaauugacgauguacgucagcccggcuccggcuaa

SEQ ID NO: 6150 - RNA, 342 nt, Phyllotreta cruciferae
auggccacugcuauggacgucgauuccgaagaaauugaauuaccaacuucaagcaguucgaagggcgagaaaaaacgauuugaaguaaaaaaguggaaugcuguagcacuuugggcuugggauauuguuguugauaacugcgcuauaugccgaaaccacauaauggacuugugcauugagugccaggcaaaucaggccucugcaacuagugaagaaugcacuguagcuuggggaguaugcaaccacgcuuuccacuuucacuguauuucaagaugguuaaaaacuaggcagguaugcccuuuggacaauagagaaugggaauuccaaaaauauggucacuag

SEQ ID NO: 6151 - RNA, 1605 nt, Phyllotreta cruciferae
auggugucacuaaacccggugaggauucucaaacaugacgccgaggaugaaagagcggaaauugcgcguuugagcaguuucgucggcgcgauugccauuggagauuugguuagaaguaccuugggccccaaagguauggacaaaauccuuguaucaagcggcagaaacuccggaaugguagaagucaccaacgacggagccacuauauuaaaauccgugggugucgauaacccugcugcgaaaauccucgucaacaugucgaaaguacaagacgacgaaguaggcgauggaacuacgucaguaacuguauuagcaucagaauuauuaaaagaagcugaacgucuaaucgagcaaaagauccauccgcagacuaucauagcagguuggagaaaagccguggauaucgcgagaaaagcccuuuuggacgcuucgaacgacaacagcgccaacuuggaagccuuccgagaagaucugaugaacauugcuagaacgaccuugagcucgaaaauucuaucucaacacaaagaacacuucgcgaagcucgcugucgaugccgugcugagguugaagggcuccggcgauuugcaagccauucaauugaucaaaaaaaccggaggaacuuugcaagaaucguuccucgacgaagguuuccugcucgauaagagacccggcgugcaccagcccaagcgagucgagaacgcuaagauccugaucgccaauacuccgauggacaccgauaaaaucaagguauucggcucgcacaucaaagucgauuccauggcuaaaaucgcggaauuggaauccgccgagaaagauaaaaugaaagacaaagucaacaaaauccucaagcacaacgccaauguauucaucaaccggcaacucauuuacaacuaucccgaacaacuguucgcagaugcuggcgugauggccauugaacacgcugauuucgaugguaucgaaagacuggcgcuggucaccggaggagaaauagucucaacuuucgaucacccagagcucgugaagcugggaacuugcgaucuaaucgaacaaaucaugauaggagaagauacucuccugcguuucagcggaguggccuuaggugaagccugcacgauagucauucgaggggcuacccagcaaaucauagacgaggcagaucguucgcuacacgaugcgcugugcguauuagccgcaacagugaaagaaagcagaaucguauucggaggcggaugcagcgagacucuaauggcuacagcaguagccagagcuuccauuaauacagcaggaaaggaagcucucgcuauggacgccuucgcuagagcucuguuacaguuaccgaccaucaucgcugauaaugccgguuacgauucggcucaauugauuagcgaacugaaagccgcccacaacagcggccucaacacuaugggcuugaacauggagaagggcgaguugggcgacaugcgagcauugggcauuaccgaaucguucguuguuaaacggcaaguauuaauaucggccggcgaagcagcugagaugauucuucguguugauaauaucaucaaagcggcgcccagacagcgaaccgaagacagaggaauguguuaa

SEQ ID NO: 6152 - RNA, 840 nt, Phyllotreta cruciferae
auguucagaaaucaauacgacagcgacguaaccguauggaguccgcaaggacgccuccaucaagucgaauaugccauggaagcggucaaucucgguucggcuacgguaggccuaaaaagcaacagucaugcuguuauaauagcauugaaaagggcuucaucugaauuguccgcuuaccagaagaagaucauucaaaucgacgaucacaucggcaucaccauuuccgggcuaacggcugaugcgaggauucuaagcagauacaugagaaacgaauguuugaauuacaaguacuccuuggacgcuuacaugccuuugaauagauuaauuaacauuuuagguaucaaaaugcaacauuguacucaaagauacgaucguagaccguucggugugggucuacuaguggccgguugcgaugacaacggggcccacauuuaccaaaccuguccgucggcgaauuucuacaauugcaaggccaugucgaucggugcgagaucccaaagcgcccgaacguauuuggagaagaagcucgacgaguugucuucguguucgcuggaagauuugaucaagcacgguuugagagcucugagggacacucuuccucccgaggucgauuugaacacgaagaacguuuccauugguuacgucgguaaagggauuaccuuuaagauuuuggaggaagaggagacugcuccuuaucuggcucuaaucgagggcgaggaacguagaggaggagccggaggaggcgguaguucggaaggacaagccgauccuuugagagaaucgggggacgauggucccaaagaucccguaccggcuguagcgauggauacuacggaauaa

SEQ ID NO: 6153 - RNA, 2550 nt, Phyllotreta cruciferae
auggguuuaaagccaggaaauaaccaagaaccgauggaaauaaccuuccacgacgaugauuugcccuacgaggaagaaauucuacgaaaccccuacucggugaagcauuggcuucgauauauagaccacaagaaaacggcuccaaacaacgaaaugaauauaauauucgaaagggcccucaaggaacuaccggguucguacaaauugugguacaauuaccuacgaaccagaagaaaucaaaucaaaagcaaaugcaucaccgauccgggcuuugaagagguaaauaacgccuucgagcguucguugguguucaugcacaagaugccucgaauuuggauggacuauugcacguuucucaccgaucaaugcaaaauaacgagaacacgaaagguguucgacagggcucuucgagccuugcccguuacgcagcacaacaggauauggccuuuguaucucauguucguacagaaacaugauauaucagaaacugcuguuagaguauucagaagguacaugaaauugugucccgaaaacgccgaagaguacauagauuaucuaacgaaaguggaaagauuagacgaagccgcuauaauuacagcuaaaauaguaaacgacgauaauuucguaucgcaacagggcaaaucgaagcaucaauuauggaacgaacugugcgaauugauuuccaaaaacccggaaaaaguucgcucucuaaacgucgacgccaucaucagaggcggccugcgcagauacaccgaccaauugggccacuuguggaacucuuuggccaauuacuacguucgcagcgguuuguucgaacgggcuagggacaucuacgaagaggccauucaaaccguuaccaccguuagagauuucacgcaaguguucgaugcuuaugcgcaauucgaagaguuaaguuugagcaaacgaauggaagaaguggccacuaagcagaaccccagcgaagacgaugauaccgaauuggaacuacguuuggcucgauucgaauaucuuauggaaaggagauuguuacuuuuaaauucgguuuuguugcgacagaacccgcacaaugugcaagaguggcacaaacgagugcaacuuuacgaagguaaaccacacgaaaucaucaauacauauaccgaagcggugcaaacuguggacccuaaacuggccguaggaaagcugcacacguuguggguugaauuugccaaguucuacgaaagcaacgagcaaaucgaagaggcccgauugauauucgaaaaagccucccaagugccuuacgugaaagucgacgauuuggcuaccguuuggugcgaauggaccgaaauggagauucgcaacgagaacuacgacgaagcuuugaagcucaugcaaagggcaacuguaaugccuagccguaaaguggcuuaccacgaugauacagaaacaguucaaaguagacuuuacaagucgcugaaaguguggucgauguacgcagauuuagaggaaagcuucggcagcuucaaauccugcaaagccaucuacgacaggaucauugaacugaaaaucgccacgccgcaaauuaucaucaauuacggcguauuucuagaggaaaacaauuacuucgaagaagccuucagagccuacgagaaggguauuucguuguucagauggccuaauguauacgacauauggaacaccuauuuaaccaaguuuuugaaacguuacgguggcaguaaauuggaaagagcucgugauuuguucgagcaauguuuagacgguugucccccucaauucgccaaacaucucuauuuguuauacgcuaaauuggaggaggaacacggaauggccaggcaugcgauggcuguauacgaaagaucaacaaaagcaguaccggagaacgagauguucgacauuuucaacauauacaucaaaagagccgccgagauauacggcauaccgaaaacuagacaaauuuacgagagagccaucgaaguccugccggaggacaagaccagggagaugugcuugagauucgccgauauggaaaccaaauuaggcgagaucgaucgagcuagagccaucuaugcucacugcagccaaauuugcgauccacgcguaacggccgaguucuggcaaauuuggaaggaauucgaggugagacacggcaacgaggacaccaugagagagauguugaggaucaaacguagcguacaagcuguauacaacacucaggugaauaugaugucugcucagaugcugagcucugcagguagcucgagcggcaccauagcggauuuagcgccgggaguuaaggaugguaugaggcucuuggaggcuaaggcggccgagauggcugguucgguggcgcagaagcccaauauuauguucguuagaggggagacucaaggggauaaaaaggauaaaguggugaauccugaugaaauugauauaggaagcgaggaugaggaggaggaagaggaggaagagauuucgguggagaagcaaaacgugccaucugagguguuugggagucuuaagaagaagggaacugaugaggaugaggaugauuaa

SEQ ID NO: 6154 - RNA, 1116 nt, Phyllotreta cruciferae
auggcaaacggaccgauagcugaaagaaauagagacgcuacgauauacguuggugguuuggacgauaaaguaucagaaucucugcuaugggaacucuucguacaagcagggccauuagugaacguacauaugcccaaagaucgcgucaccaugaugcaccagggcuaugguuucgucgaauucaugggcgaagaggacgccgauuacgcuauaaaaauaaugaacaugauaaaauuguaugggaaacccauacgagucaauaaggcuuccgcucaucagaagaauuuggacgucggagcgaacauauuuauaggaaauuuggauccagaagucgaugagaaacucuuguacgauacguuuucggccuuugguguaauauuacaaacgcccaagauaaugagagaucccgagacuggaaauuccaaaggcuuugcguucauaaacuucgccaguuucgaggccucugacgcuuccaucgaggcgaugaacggccaauaucuuugcaaucgaccaauaucugugucguaugcauucaagaaggauuccaaaggcgagagacacgguucggcggccgagcgauuacuggccgcacagaauccauuaucacaggccgauaggccccaucaauuguucgcagacgcaccgccgauaggaaugaugccgaugaguauggcgccuccaccuccgccuuuaaucaccggcaugaugcccccuccuccgccaacgccgggcggaaugccgccuccuccuccgccaguaccgccgccgaguucauucccagcugguauaccgccgccgccauuaccgccaucucaaccgccguugccgcccggcgcuccgcccgcuauggcaccggugccggguagcgcgacuaggccgccaccgccaccuccguggucaggagcggcagcuaacguuccgaugccgcccggcccgccaucgucgaacgcugguggcggauuuggggggaugcuaccaccuccuccgccgccgggcggcaggccgcuaccgucuaauuggaggcccccgccuccgccgccgccgaauuucggcagcgcuagacccccguuuccgccacguggaccaccuccaccaccuccuacuuucgaaggguaa

SEQ ID NO: 6155 - RNA, 774 nt, Phyllotreta cruciferae
augggucguguuauucgagcacaacguaaaggugcgggauccguauucaaaucccacacuaaaaggaggaaaggggcacccaagcuccguuacuuagauuucuccgaaaggcauggcuacaucaaggguguagugaaagacaucauccacgaccccggucgcggcgcccccuuggcucuaguucacuucagggaccccuacaaguuccaaacuaggaaggaaauauucaucgcucccgagggaauguacacagggcaauucuuguacuguggaaagaaagcuaaccuccaaauuggaaauguguugccuguaggaacuaugccugaagguacaauugucuguaauuuggaagagaagacuggugaccguggccgauuggcucgagcaucugguaacuacgcaaccgugauugcccacaaucacgauacaaagaaaacuaggguuaaauugccaucaggagcuaagaaaguuauccccaguaacaacagagcuaugguugguauuguugcuggagguggucguaucgacaagcccauccugaaagccggucgugccuaccacaaauacaaggugaagcguaacugcuggccgaaggugcgugguguugccaugaaccccgucgagcauccucacggaggugguaaccaucaacacauugguaaagcuuccacuguuaagagaggaacuuccgcuggucguaaggugggucuuauugcugcgcguaggaccggucguaucagaggagguaaggucgaaacuaagaaggacgauuaa

SEQ ID NO: 6156 - RNA, 522 nt, Phyllotreta cruciferae
augaaacccaugccuaugaacuaccaccgcccaucaacgccaugccaggccagugaggucgagguggagcccaaguuugugaauguuguugaagcgagacgcuuaagaacgcucaccgcggagacggcgggcgagcuggauguccuugcucuggauggugacacgcuuggcguggauggcgcagagguugguguccucgaagagggagacgagguaggccucgacggacuccugaagagcaccgauggcggaggacuggaagcggagaucggacuugaaguccugggcaaucucacgaacaagacgcuggaagggcagcuugcggaugaggagcucagucgacuucugguagcgacggaucucacggagagcgacaguaccgggcuuguagcggugaggcuucuugacaccaccgguagacggggcggacuugcgagcggccuuggaggcgagcugcuuacggggagccuugccaccaguggacuuacgggcagucugcuuggugcgagccaugacgacuga

SEQ ID NO: 6157 - RNA, 1593 nt, Phyllotreta cruciferae
auggcaauaaguuuguugaaucccaaagccgaaguggcgagagccgcccaagcgcuggccguuaacauaaccgcagccaaagguauuucagaagugaugaaaacgaauuugggacccaaggguaccaugaaaauguugguguccggugccggcgacauuaaaauaaccaaagacggcaacguucuccuccacgaaaugcaaauccagcaucccacugcuucguuaauagcuagagccucuacagcacaagaugauaugaccggugacggaacgaccucuacuguuuuaguaaucggugaacuccugaaacaagcugacauauacaucgcagaaggcuugcaccccagaacacucacagaaggcuucgacaaagcgagagcaaaggcccucgaaguauuggagaagcugaaaguacccaucgaagucaacaaagaaucguuaaccgauguuugucgaacgagcuugagaacaaaauugcaucaaaauuuggcugaucuccuuaccgaugucugcgucgaggccauucucgcuaucaaacaguccgacaaaccggucgauuugcacaugguggagcucauggagaugcagcacaaaaccgagacggacacucaacugguuaaaggaauagugauggaucacggugcucgacaccccgauaugcccaagagcuugaagaauuguuacauccucaccugcaaugugagcauggaguacgaaaagagcgaagucaauuccgguuucuucuacaaaacugccgaagaaagggagaaauugguguuggcugaaagggauuucaucgagcaaagaguuaagaaaguugucgaguugaagaaggcccuuugcaauggcacaaacaagucguuuguuguuauaaaccaaaaagguauugacccgaugagcuuggacaugcuggccaaagagggaaucguugcucugcgaagggccaagagacguaacauggaacguuuggcuuuggcaugcggcggaauagccgugaacaguuucgacgauuuacaggaaucucaccuugguuacgccgggcauguauacgagcauguauugggcgaaaacaaauauacguuuguugaagauugcaaaguuccccaaucggugacgaucuuaauaaaaggacccaacaagcacacuuugaugcagaucaaagacgccguuagagauggcuugagagcuaucaauaacgcuaucgaugacaaagcacuuauacccggugguggcgcuuuggaaguggccguaaacaaggaauugcuggcuuacaaagacgaaauaaaggguaaaucucgcuugggcguagccgcuuacgccgaagcucuguuggucauucccaaaacgcuggcuguaaacuccggauucgacgcccaggauaccaucgugaagcugcaagaagaagcucgacugagcaccgaaccgaucggccucgacuuaaccucuggagaacccaucaauccuaaagaugcgggcaucuacgacaacuacguggucaagaagcagauucucaauucgugcucgauaaucgccagcaacuuguugcucgucgacgagauuaugagagcugguaugagcagcuugaaaggauaa

SEQ ID NO: 6158 - RNA, 3126 nt, Phyllotreta cruciferae
augucuagugcuggaaucgcagacagccccaucgauccuccagcaaagaagcgaaagcucgacucgaaaaauugcggccccgacauggcgaauaacgaagcuucgggauccucgaacgccggcgaaaucgacgagggacucuacucgaggcagcuguacguguugggacacgaugccaugcgccgcauggccaccagugaugugcucguaucggguuuaggcgguuugggugucgaaauagcuaagaacgugauccuaggcggcgucaaaucagugacucuucacgacgaugccguuugcaccguucgagacuuguccucgcaauucuaccucaccgaggccgauguggggaagaaccgcgccgaggccugcugcaagcaccucuccgaacucaacaccuacguccccaccagggccuacgcgggcccccucgacgagaagaucauccagaaguacagggugguaguucuaacuaacagcacucgagccgagcagcugcguaucggcgagauaacgcacaacaacgauguagcuuuaaucguagccgauacuaaaggucuguucgcacagguguucugcgacuucggcaaggccuucucuguuguggacgucaacggggaaccacccguguccaccaugauagcggauauauccaacgauacggagagcguagucaccugcauugaugacacuaggcacggcauggaggaaggagauuacguuaccuucuccgagauauuaggcaugaccgaauugaacaacugcaagcccauuaaaaucaaaguauugggucccuacacguucagcaucggagacaccacuaaauucucgaaauacguucgaggggguauagucacucaaguuaaaaugcccaaggaggugcacuuuaagucguugaaagagucuuugcagaaucccgaauucguggugaccgauuucgccaaguucgaucaccccauucaauugcaucucgcuuucuccacucuacacaaguucguggagaagacgggucgauugccgaaacccuggagcaaagaugacgccaccgaguucaucgcucuggcgaaaucguuggcuguaaacgguucuacggauaccgaagucaacaccgauauccucaacauuuucuccaaguguuguucgggcgaucugaaccccaucaacgcuacgaucggaggaaucguggcgcaagaggucaugaaagcuugcucggggaaguucuaccccauuuaccaaugguuguacuucgaugccaucgaaugccugccccaggacaaggaggagaucaccgaggaacucgcugcacccguugauaguagauacgauggacagaucgcuguguucggaaaagacuuccaaaagcgauuaggcgaacugaaauauuucaucguuggugccggagcgaucgguugcgaguugcugaagaacuucgccaugaugggacugggcacgcaaggcggucaagucaccguaaccgacauggauuugauugaaaagucgaauuugaauaggcaauuuuuguucaggccccacaacguccagcaacccaaauccgcuaccgcugcuaagguaaucaagaagaugaaucccgacguuaacauaguggcccacgaaaaccgagugggccccgaaacugagaacgucuacaacgacgaguucuucgagguuuuagacgggguagccaacgcccuggauaacguagacgcgagaauauacauggacagacguugcguuuacuaucgcaagccucuccucgaguccgguacauugggaacgaaaggcaacacucaaguagugguaccguuccucucugaaucguacagcucaucgcaggacccucccgaaaagagcauaccgauuuguacguugaagaauuuccccaacgccaucgagcacacuuugcaaugggccagggacaauuucgaggggcuguucaggcagaacgccgagaacgcuucgcaguaccucagagauccggacuucaucgaacgaacugucaagcugccuggcguacagccgcuggaagugcuggaauccguaaaggcugcuauaaucgacgaaagaccaaaggauuacgacgauugucuggccugggcgcgucugcauugggaggaccaauacgccaaucagaucaagcaacugcuguuuaauuucccgccggaucaacucaccaguaccggccagcuguucuggucugggccgaagagguguccggaaccgcucguguucgauaucaaugaagauuugcacguggauuacguuauagcggccgcuaauuugaaggcucaaguuuacgguauucccacgaauaggaauagaugcuacgccaaacaagucgucacuagcaucgaggugccggaguuugugcccaaaucgggcgugaaaaucgccgugaccgacucccagauggccaugaacggcaacaacgucgacuuggaucgcaucaaucaaaucaaacaggagcugccuucgaugcaggagcucagcgggcugacgcucacucccuuggaauucgaaaaggacgacgauaguaauuuccacauggacuucaucguggcggccucgaauuugagggccgccaauuacaagauuccuauggccgaucgacacaaaucuaagcucaucgcugguaaaauuauuccggcuauagcuacaacuacaucggugguggccgguuugguuuguuuggaauuguacaaacuggcuaggagcaucaagaguuuaacgccguuuaagaaugguuuuguaaacuuggcguugccguuuuucggauucucugaaccgauagcagcccccaaaauggaguacugcgguaaccaguggacguugugggauagauucgaggugcaaggugaaaugacucucgcugaguuucuggaguacuucaaggagaagcacgguuuggaaaucacgauguugucccaaggggugugcaugcucuauucguucuucaugccuaaagccaaagcucaagaaagauuaggacuaacgaugucugaaguggugaggagagugucgaagaagaagauagagccgcacguuagagcauugguguuugaguugugcugcaaugaugcugauggagaggacguggagguuccuuauguuaaauacaacuuguauuga

SEQ ID NO: 6159 - RNA, 1350 nt, Phyllotreta cruciferae
auggccgacgcugaugccgcugacgaucuauuagauuacgaagaugaggagaacccagagcagaccgcaaaugaaaauaauucaacagaaguucagaaaaaagggguuaaaggaaccuacgucucgauacacaguuccgguuuucgggauuuccuuuuaaaaccagaaauccuccgagcuauugcagauugcgguuucgaacacccuucagaagugcaacacgaaugcauuccacaagcaguaaucggcauggacauccuuugccaagcuaaaagcgguauggguaaaacagcggucuuuguauuagccacacuacagcaacucgaacccaccgaaaacgucguuuauguucuugugaugugccauacgcgcgaauuggccuuccaaaucagcaaagaauaugaacgguucagcaaguacauguccaacaucaaagucggcguguucuucggcgggcugcccauccaaaaagacgaagaaguauuaaaaaacagcuguccgcacaucgucgucggaacgcccggucgcaucuuggcucucgucagaucaaagaaacucaaucucaagcacauaaaacacuuuauucucgacgaaugcgauaaaauguuggagcuucuagacaugagacgcgacguucaagaaauauacagaaauacgccgcacgaaaaacaaguaaugauguucagugcgacgcucagcaaagaaauucggccaguuugcaagaaauucaugcaagaucccauggaaguauaugucgacgaugaagcgaaauugacguuacacggucuacaacaacauuauguuaaacuuaaagagaacgaaaagaauaaaaaauuauuugaguuacuugauguguuggaguuuaaucagguggugauauuugucaaaucggugcaaagauguguagcauuggcacaacuuuugacugaacaaaauuucccugcaauuggaauacacagaggaauggagcaaaaagaacgauuauccagauacgaacaauucaaagauuuccaaaagagaauauuaguggcuacuaaucuauuuggucgugguauggauaucgagagagucaauaucguuuucaacuaugacaugccggaagauucggacacuuaccuucacagaguggcgagagcaggucguuucgguacgaaagguuuggccauuacuuucguuuccgaagaaggugacgccaagauuuugaaugaaguacaagacagauucgauguuaacauuaccgaauuaccugaugaaauugauuugaguucguacaguaaguuuaucaaguuugauuacgauuuauggaaguauuacauguucaccguuuuuguuucaguugagggacgauag

SEQ ID NO: 6160 - RNA, 1500 nt, Phyllotreta cruciferae
gcguuaguuuucacuaguaaacaaaacaugggagucgucgagacagacguggagaugaaaaacgccgacagccccacggggcuggaggccggagacaacaagagagacaaagauuugaacaguuucacggagauucgagaacaggccaagcaaaucgaaaagggcauaaucaacaaagaaaaccgcuucauucuccgagugcuccgcugcaugccgaacaccagacgaaagcucaacggcaucguccucagaagucucaucaaccaaauuuacccgguggucgaacgagauguacuccucagcuucaucgaagaauccgccggugagcucgacaacacucaaacuaaagccagaccggccaccaaguccccuguggcagaaaucgacaccuacaucaacuugcuauguuuaguccauuuaaucgacaccaauaaacuagcagaagccgaacgcugcucgcagauccucaugaacaaaaucaccagccagaacagacgaacacuggaccuugucgcagcuaaaugcuacuucuacuacuccagaguagccgagcucaccgacaagcuggacucgaucagaggcuucuugcauucccgccugcguacagccacacucagaaacgauuucgaaggacaagccguacuaauuaacugcuuauugaggaauuauuuacacuauucgcuguaugaucaagccgauaaguuggugaacaaaugcguuuuuccggagacagccagcaacaacgaaugggcgagauucuuguacuacuugggcaggaucaaagcggcucgauuggaguacaguguagcucauaagcaucucauacaagcgaugcguaaagcgccccagaacacugcgaucggcuuccggcaaaccguccagaaacuaacagucguaguggaguugcuguugggggauauuccggagaggcagauauuccggcaggcgagcaugcggcauucgcuugccccguauuuccaguuaacgcaggcugugagaauggggaacuugcaacgguucggggagguguuggagaauuuugggccgcaauuuaggguagaucauacguuuacuuugauccugcggcuucggcauaauguuaucaagacagcuauuaggucgauugguuugucguauuccaggauaucuccgcaggauauagcuaagaaauugggccuggauucagcggaggaugcggaauucaucguagcgaaggccauucgagaugguguuaucgaagcuacuuuggacccacaagggggcuacaugaggaguaaagagaguacugauaucuacuguacuaaagagccucaauuggccuuucaucagaggauaucauuuuguuuggauuugcacaaucagagcgugaaagccaugagauacccgccgaaugcguacggaaaggaacuggaaucggcugaggaaagacgggagagggagcagcaggauuuggaauuggccaaggaaauggcugaagaugaugaugauaguuuuccuuaa

SEQ ID NO: 6161 - RNA, 1683 nt, Phyllotreta cruciferae
auggccuccagccaucaagcccuuccagugucggccauccuaaaaucgaaaagcgaagucgaggaugagcccaagaagaaguccagggaggacuggcgcaaggccaaggagcuagaggaggcccggaaggccgguacagcuccggcggcagucgacgaagaagguaaagauaucaauccccacauuccgcaauacauaucuucggcuccuugguauuacggaaccucuggacccacguugaagcaucaaaggccccaggaugauaaacagaaagaguauucagauuugaacgauugguauaagagaggcguugauacuucgaagauuguaacaaaguaucguaaaggggcuugugaaaacugcggagcgcuaacucacaaaaagagagauuguauggacaggccacguaaagucggagcgaaauuuucaggugcuaauauagcccccgaugaguuuauccaaaagaacuuaucacuaaguuuugacgguaaaagagauagguggagugguuacgauccuuccgaacauaaaacaguaauagaagaauuccagaaaguggaggaagccaaacggcaacuaaaauccgacaaauugaaugccaacgaagaguccgaagacgaagaaaaagaugaggauaaauacgucgaugaaguggacaugccugguacgaaagucgacagcaaacaaagaauaacagugaggaauuugcguauacgagaagauacggccaaauacuugagaaauuuggaucccaacucggcauauuaugaccccaaaaccagaucgaugagagaagauccgaaugcuggaauggacgcuacauaccauggggaaaauuuuguucgcuucuccggagauacuacgaaucacgccagagcccaacuguucgcuugggaggcacacgguaaaggagucgacguucaucuacuagcagaaccuacaaaauuggaauuacucaagaaggaauaugagaagaagaaagaugaaguuaagucgaauauucaggguacaguauuagagaaauacggaggugaagaauaccucgaagcgccaccgaagaguuuguuguuagcucaaacugaaaacuacguagaauauucgagaucggguaaaguuauuaaaggugcugaaaaagaaguuauuagaucaaaauaugaagaagauguuuauauuaauaaccauacaucaguuugggguucuuauuggaguggaggacacugggguuaucgcuguugccauucuuuuauuaagaauucuuauuguuugggagaaucaggaaaauuaguaaacgcucaaccuacggcagaauuaguaacuaaugaugagccuaaagaagaacagagucaagaggaugaugagaaagauacgguugaagcauuagaaaaagaaagcgaagaaucugaaucuaguaguucaucagaagaggaaaaauccaaagcgaaaucgaagaaaaaacuaaaaaagaaaaugaagaagcagaagaagaagcaaaagaaaaaagauaaggacaaggagguuaaaacgucuucauucaugaaugaugaagaugaagaagugguuuuagacgauagaaagcggccuuacaacagcauguucgaagcgaagaaacccacagaagaacaaauggaggaauacuacaagaagcggcgaagagacgaagauccgaugaaccaauucauguag

SEQ ID NO: 6162 - RNA, 627 nt, Phyllotreta cruciferae
auggguauaagccgagaucauuggcauaaacgaagggccaccggaggcaagaggaagccucuucgcaagaagaggaaguucgaauuaggucguccggcggccaacacgaaacuaggaaccagaaggauccauuauguucguacaagggguggcaacuugaaguaccgugcccuaagauuagacacuggaaacuucucuuggggaagcgaaggaacugcccgucaaacacguauuaucgaugucguuuacaacgcuaguaauaacgaauugguucguaccaagacauugguaaagaaugcuaucguugucguugacgcuaccccguucagacaaugguacgaaaaccacuacaucuuaccauugggacgcaagaagggugcuaagaugacuccugaagaggaggagauuuucaauaagaaacguagcaaaaaaguacagaagaaguacgaaacuaggcaaaaaaccgcuaaaguagagccugcaauugaagaacaauuccacaccggaagauuguuggcaugccuagcaucaagaccuggacaaugcggcagggccgaugguuacguccucgaaggaaaggaacuugaauucuacaugcguaaaauuaagucuaagaaagcuaaauaa

SEQ ID NO: 6163 - RNA, 960 nt, Phyllotreta cruciferae
auggauagauugcuucgacuugggggcgggaugccgggcuuaacccaagcaccgccgccuuccgacgcccccgucguggacaccgccgagcaagucuacauuucaucccuagcccuacuaaaaaugcugaagcacggcagggccggcguccccauggaagucaugggucuuauguuaggugaauucgucgacgauuacacagugagggucauagacguguucgccaugccccagacggguacuggagugagcguagaagccguggaucccguuuuccaggcuaaaauguuagauaugcuacgucaaaccggccggccggagaugguggucgguugguaccauucccauccagguuucggcugcugguugucgggaggcgauaucaacacucaacagagcuuugaagcccucuccgagagggcuguggcuguagucguagauccaauucaauccguuaaaggaaaagucgucaucgaugccuuuagguuaaucaauccuaauaugaugguguugggacaggagcccaggcaaacgacuucgaauuuggggcauuugcagaaaccgucuguacaggcucugauccacgguuuaaaucgccacuacuacuccauaaguauuaacuauaggaagaacgaguuggagcagaagauguugcucaauuugcacaagaaauccuggauggaugggcuaacguuggcugauuauucggagaauugcagcguuaacgagaaaaccgucgccgauauguuggaauuggcuaagaauuacaacaaagcguuggaagaagaggagaaaaugaccccggaacaacucgcuauuaagaacgugggcaaacaggaccccaagaggcauuuggaggagaaaguggauauauugaugaacaacaauaucguccacuguuugggagccauguuagauacucucguguuuaaauacuucaaaguguaucgaacgguuuuu

SEQ ID NO: 6164 - RNA, 1260 nt, Phyllotreta cruciferae
augacuguuauuaauaagauggaggucgaugggccccucaagggggaaggguucagguccuacuauauuaccaaaaucgaggaauugcaacuaaucguugccgaaaagagccagaaccuccggagauugcaagcccaaagaaaugaacuuaacgccaaaguucguaugcuuagagaagaacuaaugcuccuucaagaacaaggaagcuacgucggggaaguagucaaacccauggauaagaagaaaguacucgugaaaguccacccggagggcaaauuugucguugauaucgacaaaaauaucgacauuaaugacguuacaccaaauuguagagucgcucuacgaaaugaaucguacacuuugcauaagauuuugccgaacaagguggacccauuaguaucucuuaugaugguagaaaaagugccagauucaacuuacgaaauggugggugguuuggauaagcaaaucaaagagaucaaagagguuaucgaauugccggugaaacauccugagcucuuugaugcuuuagguauugcucagcccaaggguguguuguuguauggaccuccaggaacuggcaaaacucuucuggcuagagcuguagcucaccacacagaaugcacguuuauuagaguaucaggaucggaguuggugcaaaaauucauuggggaagguucuaggaugguaagggaacuguucguaauggcuagggagcaugccccuucgaucauuuucauggaugaaaucgauucuauuggauccucucguaucgaaucagguucugguggcgauuccgaaguucaaagaacuaugcuggaguugcugaaucaacucgauggauuugaggcuacgaagaacauuaaaguuauaauggcuacaaacagaaucgacauuuuggaucccgcuuuacucaggcccggcagaauugacaggaagaucgaguucccuccaccgaacgaggaagcccgauuggacaucuugaaaauucacucgagaaaaaugaauuugaccagagggaucaauuugaggaaaaucgccgaauugaugccaggugccagcggugccgaagugaagggaguguguacugaggcaggcauguacgcccuaagggagagaaggguacacguaacccaagaagauuucgaaauggcuguggccaaggucaugcagaaggauucagagaagaauaugucgauuaaaaaguuauggaaauacguuugccaaauuuauauucuuuuguauuuauguuauaagaaauaa

SEQ ID NO: 6165 - RNA, 639 nt, Phyllotreta cruciferae
augguaaaauuauauugcaucaguauacucuacaaagauacuacauacgcuacgugguugaagucugcuuucgauuuacaaaguuucaguuuuuuccaaagaggauccguacaggaguuuaugucauucuuuuguaagacuaucguggaaaggacuauaccaucauccaggcaauccgucaaagaaggagaguacaugugucauguuuauguaagacaugauaacuuagccgguguuguaauaucagaucacgaauacccgucuagagugucacauacgcuuaucacaaaaauucuggaugaauuugcugguaaaauaccagcuguuaauuggccuaccuugcaagagagagacguagcguuuccacaauugaacacauaccuugccaaauaccagaacccuaaagaagccgaugcgaugacuaaaauacaagaggaccuugacgaaaccaagauuauucuggugagaaaaauguuaauuaucuugcguuauuuaucuaagcauaacacgauucaagcuguccuggagagaggggaaaaguuggacgacuugguaaauaaaucagagggcuuaaguauacaguccaaagcuuuuuacaagacugcaaggaaaacgaacaguugcugcaguuucacuuaa

SEQ ID NO: 6166 - RNA, 729 nt, Phyllotreta cruciferae
auguuucuaacaagaagcgaauacgauagagguguuaacacauuuucgccugaaggaagauuauuucaaguggaauaugccauugaagcuauuaaauugggaucuacagcuaucggaauaugcacuagcgaagggguugugcuagcagucgaaaagcguauuacuucuccauuaauggaacccacaacgauugaaaagaucguagaaguugauaaacacaucggcugugcuguuucggggcucauggcagauucacguacaaugaucgaucgggcaagaguugaaugccaaaaucauugguucguuuacaacgaaaacaucaccaucgaaucaugugcucagggaguaucgaaccuagcuauucaguucggagauucggaugaugauggugcugcuaugucgaggccauuugguguggccaucuuguuugcuggcauagacgaaaaagggccucaacucuaccacauggacccaucagguacauuuguucaguucgaugcaaaagccauaggaucuggaucagagggcgcacaacaaagcuuacaggaaguauaucaucguagcaugacuuuagaggaagcuaccacagcagcguugacuauucucaagcaggucauggaggagaaauugaacucuucuaauguagaagucaugacaaugacgccaaaggauauguuccacauguucacuaaggaacaaguggaggagguaauuacuaaauuaucuuaa

SEQ ID NO: 6167 - RNA, 1158 nt, Phyllotreta cruciferae
augacagaauauuggcugauuuccgccccaggugacaagaccugucaacaaacaugggauacaaugaauaaucugacuaguaaacagaacaauuugucugcaaauuacaaguucucaauacccgauuugaagguuggaacucuugaccaauuaguugggcuauccgacgauuugggaaagcuggaugguuucguggagcagguuacccggaagguggcucaguaccucggugagguucuugaagaccagagggacaaguugcaggagaauuugcaggcgaacaacaccgauuugccaaguuauuuaaccagauuccaaugggacaucgccaaauaccccaucaagcaaucgcugcgcaacaucgccgauauaaucagcaagcaaguuggacaaaucgacgccgaucuuaagaccaagucgucagcguacaauaacuuaaaaggcagucuucaaaauuuggagaaaaaacaaacagggaguuuguuaacccguaacuuggcagaucuggucaagaaggaacacuuuauuuuagauucugaguacuugcaaacgcugcucgucaucguucccaaagcucaguuuaaugaguggaacgccacuuacgaaaagaucacggacaugaucgucccucguucgucggaguugaucauucaagaccacgacuacggccuguucaccgugucgcucuucaagaaggucgucgaggaguucaagcugcacgccagagagaagaaguuuaucgugcgagauuucacguacaacgaggaggaacuggcggccggcaaaaacgaaaucaccaagcucgucaccgacaagaagaagcaauacgguccguuagugagaugguugaaaguuaacuucagcgaaugcuuuugugcuuggauacacguuaaagcgcugagaguguucguggaguccguguugagauacggguuaccagucaauuuucaggcuauucugauccauccaaauaagaagcaagccaaacguuuaagagauguuuugaaucaacuguacggucaucuagauaguagugcagcucuuuccggaccuaacguugauagcguagacauuccaggauuagguuucggccaaucagaauauuaccccuacguguacuacaaaauaaauguugauaugauagaaucgaaggucuaa

SEQ ID NO: 6168 - RNA, 1674 nt, Phyllotreta cruciferae
augucgauauuagcaaguccucuaucaguagccgguucgcgaaccacaggcgccucaguucgcacccaaaauguuauggccgcuucuaccauagccaacguagugaagagcucauuaggcccgguggggcucgacaagaugcucguugaugacaucggagacgucaccguaaccaacgauggggccaccauuuugcgccuacuggagguugagcaccccgccgccagggugcugguggaauuggcgcaauugcaggacgaggaaguaggcgauggaaccaccucugucgucaucauagccgcagaacuacuuaaaaaugcagaugaacuuguaaaacaaaaaauccacccuacaucgauuauaagcggauacaggcuggcuuguaaagaagcuugccgauacauacaagaccauuugacuauacccguggaggaauuaggcaaggagucuaucguaaacguugcgaagacuuccaugagcucgaaaauuauaggagcugaugcggauuucuuuucgcaaaugguagucgaugcugccaccgcagugaaagucacggacuccaagggcaacucgauguaccccauuaaggcggugaacguguugaaagcccacggcaaaagcgcccgggagagcuuccugguggccggcuacgccuugaacugcaccgucgccagccaggccaugcccaagaagaucgucaacgccaaaaucgcgugucuggauuucucguugcaaaaggccaaaaugaagaugggcgugcaagugcugaucacggaccccaaucaacuggaaggcgucagagccagggagcuggacaucaccaaggagcgcauccagaagauccuggccaccggcgucaacguggugcugcuguccggcggcaucgacgacgucuguuugaaguacuucguggagcgcggcgccauggccgugcggcgcgucaagaaggccgauuugaaacgaaucgccaaggccaccggggccgccuucgucaccuccuugagcaacauggagggcgaggagaccuucgauucuaauauggucggcgaagccgccgagguagugcaagagaggauuuccgaugaugaauugaucgucauuaaaggccccaaggcucgcacggccgccucgaucauccugcgaggccccaacgauuucuacugcgacgagauggagcgcuccguccacgacgcccucucgguggugaaacgcguacuggaaucgaagagcgugguggcgggaggcgguagcguggaggcggcgcucucuauauaccuggagaacuucgccacgacguugagcuccagggagcagcuggccaucgccgaguucgccaggagucugcuggucauaccgaagacguuggcuguuaaugcugcgcaggacgcgaccgauuugguggcgaagcugagggccuaucagaacucgagucagaccaagaaggaucaugcgcauuugaaguacgugggauuggaucugcuggaagguacugugagagauaacaggaaagcuggcgugcuggagccgacuaugucuaaagugaaaucguugaaauucgcuacagaggcggcgauuacuauacucagaaucgacgauaugauuaaauuggaugcugagcagaagggcgggaaaaacuaccaggaugcuaugucuaguggugaauuguacgauuag

SEQ ID NO: 6169 - RNA, 768 nt, Phyllotreta cruciferae
auguuuaauucuucccaauuaaacccuccaccguuuuggaguaacgguccagcucccggggccuucuauaacuucccaggaacagaauggaaaccuguaacaaacccaauaacucauacccaaucuccaguaacgacuucaaccucaauuguaucuauaaccuacgauaagggaguacuaauugccggagacuugcuggccucuuacgggucuuuagccagauacaaaaauugcccgaggguaaucgaaauuaacccaaacaucaucuuaggcgcuggaggagacuacgcugauuuccaauauguaaaaagcuuuaucgagcagaaaauaaucgacgaagauugcuuagaugaugguuugaaaaugaaaccgaagucucuuuauugcuggcucacuagaauuauguaccaacgaagaaguaaacucgacccguucuggaacaauuuaguaguaggagggauccaagauggaguaccuuuccuaggaacagucgauaaacugggcacugcguacacagauaaaguaaucuguacugguuacggggcucauauugcccuuccugucuugagggaugcccucgacaagaagccgaauuugaaucuaaacgaagcuaaggcgcucauuaaaaagugcauggaaguuuuguucuacagagacgcgagaaguuacccgaaauaucaguuaggcauaaucgauguggacgaagguguuaagauugaggggccgauugcuguugaggagaauuggaacauugcuuauaugacauaa

SEQ ID NO: 6170 - RNA, 2106 nt, Phyllotreta cruciferae
auggaauuuucgaaagaacccaacuuugaauuacuaacagccaaagauuuuucaccagaaaaauaugugaaaaaauugucccaaaauuauguggguggauccgaauugcaaaaucuucgcagaaaaauccaagggcucuccgaagaaacuagcucuaauuugaagaaaaauguuuacgaaaacuacauucaauuuaucgaaaccgcgaaagagauuucacaucucgaaagugaaauguaccagcuuucccacuuacuuucagagcaaaaggccuuacucaauuguuuaucagccaccucgauacuagaagauguccaacccguuaacaucgauagagauaauaagguaaacgaaaaggauaucgaagaagaaaauaaacaaaaaauagcugcuauauuagaaaaaguagaagguugucaggaauuguuaaaagugccgggaagaauuuuuuuguacgaaggagauuuauuagaaaucgaacccaccgaaaacacugcuuuaaaaauaguucauguuuauuuauucacugauaguuucaugauaaccacaagaaauucaaacagucgaggccucaugaaauacaucuacgaaagcauauacgacuuaagcagccuagcagucgugaauguaagagauuugggaaacguuaaacacgccuuuaagcuucucauuuuccccgacaccagaguuuuccaaugcucuucgaacuccaauaaaaaagaaugguuagacaaguucgaucaagccaagaagaccaggcuagcccaagaacaacaaaaaagggaauccauaucggaaaaaucccccacccgcguuuccuucgagucccccagcuacaaucccuucgaugaaguggaagaagaaacgagcgcguugcauccggaaugguucguggacauuccggaagagcuggacguuugcguagcccaaaggcauuucgaagacgcucuaucuuuacuacaaaaagccaaagaauacuugaaucaagcguccuccgcgucuggugacaagcgggacaccgucuucacggacauccagcgaaaaguagagcaaagacagaacaauuuaacggagguguugaugaaggaacuggaggugaacccggauaaauccuugcaggggggacugagagcagcucgcagggcugugagauuguugaaucaauuaggaagggaaacacaaucuuguacguuguuccugaaguuaugcagcagcauguuaagaacgcaaugcaaacgaguuaaaagagaaggcuccacuacuacuuacauaaagcaucuuucgaguguaguuuucacuaauaugugucacaugucugaugaauuucuaagggcuuuccccgacucuccggcuugcgcuucagcguaugugguuugggcgagcaaugaacuacugcaauuuacuacccauuuuaucaagcaggucuuuaugccgcagacuuccuuaucaacggugaccgagugcauaguuuuaguuagacaacagugugaaagacuguacguuuacggauuggaccuuuguuaucaauuggacggggcuuugagaucgucgcugaugaaggcguugaaagacgcucgagauaaacucaucgauucgauuaaauugagaguguuagaugauaaauggauaccgauuaauuugcauuccaaaucggcguugagccguugcgugcaagaguauucgcaaaugggacucacuaacguaggaaauuacguuucuggcgauacuugguugcaauuaacagcuaguacuuugucguuuacgaaaauguaucugaacuuguuaaacgauugcaugaaauugaaaacuaccgaauuaauguauacgaucgaugagacuuuguauaacguguucgaagcucaaguuaggcacaaugaaaaugcucuuagaagcgaauugaaucaagaucaaaggaacuuucuuacgaaaaaugcagaguuuuuguugguuaguuuaaugcaaguggugcagaaacaguacgaggaaaacgucgguuacgaauguccuacgcuagcgaaauugcaaaaggaauacauagcauugcagaaaggcguuacgcccgcgucaagaaguacaaaagccaaguauucaucagaguuuauuuaa

SEQ ID NO: 6171 - RNA, 3705 nt, Phyllotreta cruciferae
augaacgaauuagagaaacuagaauaccucucuuuggucucaaaaauauguacagaauuggagaaucaucugggaaugaacgauaaggauuuagcugaauauauaauacaucuuuccgaaaaaaacaacacauuggaguccuuuaagaagguccuuuuagaaaauggcgccgaauucucggacucuuuuauuucuaaccuguugcgaauuauccaacacaugaaacccaagaaaucaucaaauaaagaagacaccgauaaagucgaaaaagaaggauuggcuuuuaaauuccccggucuagcaauacccaaugagaaacaaaaaccuuuaaauuuagaagaauuuaguaaggaaaaugaaaaugaugaaauagacguuguagccgauaugaugaaacagcucgaggccgaugcaccuucucaaaaacaaacaaaagaaaaauccagaagcccgagcauugaaaggaaaucaagaauaagaucuagaagucgaucaaaggaaagaagaagauccagaagcagaucaaaagauagaagaagaucuagaagcaggucgagagacaggagaagaucuagaucuaaagauagacauucuagaagagacaaaaggcauagaaguaggucaaaugaagacuacaagaggagaagaagagacaacaguuacucgagagauagaagagaaagagguagguccaaagaaucggaaagaagggacagaaauagauccagagaugauagaaaaagagauagaagucgaucaagaacgagaaggagagaaaggaguuacgaaaagaaauucaaaagugaaaaggauaauccugaauucgaggaugaccccacuccaggaaagauuuauaauggaaaaguaucaaaugugguaccauuuggauguuuugugcaacuagaaggccuaaaaagaagaugggaggguuuagugcacaucucucaacuaagagccgaagguagagucaccaacguuuccgaaguagucucuagaggaagcaaaguuaaaguaaagguguuaacuauaacuggucagaaaguaucccuuucgaugaaagaugucugccaaacgacaggaaaggauuugaauccucuaucacacgccacuacggaacgagaagauaaagaucguaacccugacaggccuacuaauaauagcacaucagugcugaggcuaccgguuaguaucgaugaaggugaagaagauuccaggaaaagaguaaccagaauauccaguccggaaagaugggaaauuaagcaaaugauuucuuccggauguauagacaaaagcgaauuacccgaauucgaugaugaaacugguuugcugcccaaagaugaagauggugaagcugauauugaaauugaauuggucgaagaugagccaccauuuuuacaaggucaugguagagcucuucaugaucuaagcccagugagaaucguuaagaauccggacgguucgcuagcccaagcugccaugaugcaaucggccuuggccaaagagagacgcgagcaaaaaaugcugcaaagagaacaggaaguggauucccagccaucuggaaagaacaaaaacuggauagauccccuucccgaagaggaaucuaaaucgauggcaagaggaaucggucugcaaagucaagauuuacccgaauggaaaaaacauguuaucggugguaaaaagucaucuuuugguaaaaaaacuaacuuaacaaucaucgaacaaaggcagucucuuccuauauacaaacucaaagaagaguuacgaaaagcuguaacggauaaucaaauacugaucguuaucggugaaaccggcucuggaaaaaccacacaaaucacccaguacuuagccgaagccgguuucacagccagaggaaaaauuggcuguacacaacccagacgaguugcagccaugucgguugcuaaacgaguggccgaagaguuugguugcagauuaggccaagaaguuggauauaccauucgauucgaagauugcaccagucccgaaacgaugaucaaauacaugacagacgguauguugcugcgugaaugccucauggauuuggaucuuaagcaguacuccguaauaauguuggacgaagcucacgaacguacaauccacacugacguacuauuuggauuguuaaaacaagccguuaugaagcgggaugaacugaaauugauuguaacuucagcuacuuuagacgcugugaaguuuucgcaguauuucuucaaagcucccauauucacgauuccugguaggacguuuccuguagaaguuuuguacaccaaggagccggagacugauuacuuagaugcuaguuuaauaacaguuaugcaaauacaucucagggaaccuccgggugauauauuacuguuucugacgggucaggaagaaaucgauacggcuugcgaaauauuauacgaaagaaugaaaaguuuaggucccgauguacccgaauuaaucauucuaccgguauacucggcuuuaccaucagaaaugcaaacuagaauauucgaaccggcgccuccugguaguagaaaaguuguaauagcuacuaauauagcagaaacuucauuaacaaucgaugggauauauuacguaguagauccgggauucgucaaacagaaaguuuauaacuccaaaacuggaauggauucauuaguaguuacaccaauuucgcaggcacaagcgaaacaacgagcugguagagcuggcagaaccgguccugguaaauguuacaggcuuuacacggagagagccuaccgagaugaaaugcuuccuacaccuguuccagaaauccagaggacuaauuuggcaacgacgguacuucaacugaaaacuauggguauaaaugauuugcuacauuucgauuuuauggacgccccuccgguggaaucgcuuauaauggcccucgagcaguuacauucucuaucugcuuuagacgacgaaggucuauuaacuagauuaggaagaagaauggcugaauucccgcuggagccgaauuuguguaaaauguugaucaugucaguggcucuucaaugcuccgaugaaauauugacuauagugagcauguuguccguucagaacguguuuuaccguccgaaggauaagcaggcguuggcugaucagaaaaaggccaaguucaaucaacccgaaggcgaucauuugacgcuguuggccguuuauaauaguuggaagaacaauaaauuuucgaaugcuugguguuacgagaauuucguacagaucaggacguugaaaagagcgcaggaugugagaaaacagcugcuggguauuauggacaggcacaaauuggacguggugucagcugaaaggaauacggugagagugcagaaagccauuuguuccggauuuuucaggaaugcggggaagaaggauccgcaggagggcuacaggacuuugguugauagucaggugguguacauucacccguccagcgcguuguuuaaucggcagccagaauggguuaucuaucacgaauugguucaaacuacaaaggaauacaugagagaagugacaacaauagauccgaaauggcugguggaauuugcgccugcauucuucaaguuuucugauccuacgaaauugagcaaauucaagaaaaaucaaagauuggagccuuuguauaauaaauaugaagaacccaacgcguggagaauuucuagaguuaggagaagacgaaauuaa

SEQ ID NO: 6172 - RNA, 1248 nt, Phyllotreta cruciferae
auggccucaaaaagaaagaacaaaaaaaacauacuggcaaaagugaauuucccucuguacaccguccagaugguaacgucacggcacguuaucguaggaggcggcgguggaacuucgaagacugggguugaaaacgguuucgaaauauacgaaaucuaucaugacgguagcaaauucucagcgaaagaaguuacaagacacgaaaccggaggaaacguagucaugaacugcuguguguuuagugauaggaaacauucauuuuuaguagcaggucaagagaacuacucucaacuuuauggagucaauacgaaauuaaucgaacaugaacaaguagaaacaauuggagacacggcaaguguucgacauagaaauaccaagcccaaagcgcacguagacaauaacaaaaacauuaaaaaggagcugguuuucgacaugaauccucuagauagcauacaaaccgacuuuaagggaucugaaccccuauguagaguaguucgaauuaaucacucgggaaaaauauuagcuacuggaggaacugacggcgauguaagacuuuggaaauucccuacgaugcagccauuguccauucucaagggacauacgaaggaaauagacgauauagauuucaguaaauucgauaaccucaucauaacuuuagcgaaggacgguuuggcuauuuugugggacgcccaaacggguaaauugaaaucgaaacugacauggaacacuccagagggaucgaaauauuuguacaagagguguagauuuggcguaaucgaagaucaaaaaaauaagugcaugcuauacaugauagcgaaugcgacuaauucgaagcaaaaaucguuucuucagcaauggauaccugaagagaauacuuuaaaaaaguucucugaauucaaugaaacacuguccgcacuugcaguuagagaugauggacgauuuguagcugucgggacaauguuuagcgguucuguuucgauucacauugcauuuaguuuacagaaaauauuaguagucguuggugcucauucgauguuuguaacuggucuggaauuccuaucucaugaaaauacuaaucauuccauaaguaguguggcagaggccgcuguauugucuauuucgguggauaaucagcuuuguauacacucagugccauacagacgaaguauaccuuuauggauuggaauuaugguguuaauuuuaguauuauuuuuuacauuuauguuaugugcauacauggguuuguga

SEQ ID NO: 6173 - RNA, 1242 nt, Phyllotreta cruciferae
auggcgggugcaaggguauucgaaagagcucaggccguuccuucccaacaugacaaguuguuaaaauuaaauccggcagacgaagaugacgaggagaauauuguuaauaaagaacaggacauccucaacuugggcgagaaguacaaaaaggagggcaaggcuaaagaacuagcggagcugauaaaggcuaccaggccauuuuugagucuuauuagcaaagcaaaagcagcaaaauuaguuagaucacugguugauuacuuucuggacuuggaggcagguaucggcaucgaggugcaacuguguaaagaauguauagaaugggcgaaagaggagagaagaacguuuuugcgccaaucgcuggaagcgcgucucaucgcccuguauuucgacaccggcauguacaccgacgcccugcaacuggaauccaccuuguugaaagaguugaagaaacuggacgacaaaaaccugcuggucgaagugcaacugcucgaaagcaaaacauaucacgcucuaagcaauuuacccaaagcccgggccgcccugacguccgccagaacgaccgcgaaugccaucuauugcccuccgaagaugcaggccgcccucgaucugcagucgggcguacugcaugcagccgacgaaaaggacuucaagaccgcuuacuccuauuucuacgaagccuucgaggguuuugacagcgucgagucccccaaagcucugaccgcucugaaguacaugcuuuuguccaaaauuaugaucaauaguccugaagauguacagcaaauuguuaguggaaaauuagccauaaaguaugcagguaaagauaucgaggccaugaaagcagucgcacaagcagcccacaaaagaucucuugcagauuuucaacuggcuguaaaacaauucaaacacgagcuggaagaugacguuauuguaagagcacauuuaggaacacucuacgacaauauguuagaacaaaauuuaugcaggaucauugaaccuuacucacguguccaaguagaauauaucgcaaagacgauuaagcuucccguguuacaaguagagaagaaacuaucgcagaugauuuuagaugccaaguuucauggaauuuuagaccagggugaugguguccugauaguguuugaagaaaccccgguagacaaaaccuaugaaauggcucuagaaaccauccagaguaugaguaaaguaguagauacucucuaucaaaaagcgaaaaaguugucauag

SEQ ID NO: 6174 - RNA, 1737 nt, Phyllotreta cruciferae
auggcuucgcggucgaaaaagagcucaacgccgucggcccagcagcggccggcuagcccgcucagccccaccaggcauuccagguugcaggagaaagcggaccugcaaaauuuaaacgaccgccuggccggcuacaucgacaaagugcgguuucuggaagcggaaaacaacaaacuauccagagaaauccaaaccacccaggaaacgguuacacgcgaaguguccaacaucaagucuauguacgaucacgaacuaucggacgcuaggaaacugcuggacgacacccaccgcgagaaggcccgccuggagaucgacgugaagcggcucauugaagagaacgaggagcucaaagccgagcuagccaagaagagcaaggaccucgucauagccgagaaccaugccaggauauacgagaccaggugcaaugaguaccagcucaaagccaaccaagccuccgccgacgccaagaaggccaucgcugacgccaaggagcuggaaaaggaaagggacaagcugaagaagcuccucgaugcagcucguaaacaauuggaagaggagucucuggccagagucgaggucgagaaucacaaucagaguuuaagggaagagaucggcuucaaagaucagauucaucagcaagaacucacagagacccgcacucgccggcaagucgagaucagcgaaaucgauggccgccuggcgcagaaguacgaggccaagcuccaagaggcccugcaggaccugcgagaccaguacgaaucgcagauggccaacaaucgccaggagaucgaauugcuguacgaacagaaaaucaaaaaccugcaggccgccgccgacaggcaucaaucgaccgccuccggcgcucucgacgaguugagacaaguucgaacgaggaucgacaccuucucgucgaggauccaggaucuggagaaccagaaccagggccuggcagcuagaacuagggauuuggagaaguugcucgagaacgaacgcauucgucacgccgaagaccuagcgcuagucgagagggaauugcacaggcugcgagaggaaauggcgacucaacugcaagaguaccaagacuugauggacaucaaagugucccucgauuuggaaaucgccgccuaccguaagcuucucgaagcggaagaagcucgauugaacaucacaccaacagguguugagcacgaggugcaccaaaggagcuccucucagcgccggacgccggugagaaugggggccaagaggaaacgggcccugcucgaggagacgcaggagucgagcaugucggauuacagcgugaauaguucgucuaaaggggacauugaaguggccgcggccgauccggacggucaguuugugagauugcacaacaaaaguaaccaggaggugccgcucagcggauggcaagucaucaggcgggcgggcgaugaggagaccuucuacaaauuccacagaaccguuaaaguagagggaaaugguacaguaaccauuuggaguucugauuuaaauaaagaucaugaacccccuaguaaccugguuaugaaaagccaaaaauggguuacuggagacaacaugauuacgauaguauugaacagcaauggagaagaaguagcgucaucugaaagggugaaaaggcagauuucaacgucgcauuuaagacacagggaauuaggggaugaagaacuuuuucaccagcagggggaccugcaaggugaaaagugcggacugauguga

SEQ ID NO: 6175 - RNA, 2412 nt, Phyllotreta cruciferae
auggcugauagcaaaagcccugacgaucuagcgacugcgauucuucgcaaaaaggaccguccgaacaggcuuuuggucgaagaagccguuaacgaugauaauuccgugguggcccugucccaggcgaaaauggacgaacugcagcucuuuagaggagacacuguacuacuuaagggcaagcgucgaaaagaaacugucugcauaguucucucugacgauaguuguagugacgaaaagauccgcaugaacagaaacguucggaauaacuuaagagucagguugucugacgucguuucuauucagcccugcccugauguuaaguacgguaaaagaauccacguucuucccauagaugauacagucgaagggcuuacaggaaaucuguuugaaguguaucugaaaccguauuuccuggaggcguaucggcccauacauaaggacgacguuuuuaucguaaggggcgguaugagagcuguagaauuuaagguaguggaaacugauccggcuccuuacugcauagucgcucccgauacggucauccauugcgacggggauccgaucaaacgcgaagaagaagaggaggcucuuaacgcuguuggcuacgaugacaucggagguugcagaaaacagcuggcucagauuaaagagauggucgaguugccguugagacauccgagucuguuuaaggcuauugguguuaagccgccucgagguauccucuuguaugguccaccggguacuggaaaaacccugauagccagagccgucgccaacgaaaccggagcuuucuucuuuuugauuaacggcccggaaaucaugagcaaacuugccggagagucggagaguaaccugcgcaaggcuuucgaagaagccgacaagaacuccccggcuaucaucuucaucgaugaauuggaugccaucgcuccgaagagagagaaaacucacggagagguggagcgucguaucguuucgcaauugcuuacucuaauggacggcaugaagaagagcucccacgucaucguuauggccgcuacgaacaggccgaacuccaucgaucccgcucugcgucgauucggaagauucgacagggaaaucgacaucggcauuccggacgcuaccgguagacuggaagugcugagaauccacacuaagaacaugaagcuggccgaugacgucgauuuggagcaaaucgcggccgagacucacggucacgugggcgccgauuuggcuucgcucuguucggaagcggcgcuucaacagauuagggagaagauggaccugauugaucucgaagacgaucaaauagacgccgagguucucaacucgcuggccgugaccauggagaacuuccgcuacgcuaugacgaagagcagcccgagcgcucugcgcgaaacugucgucgaaguuccgaacgucacuugggacgauaucggcgguuuggcgaacgucaagaaggaauugcaggaguuggugcaauacccggucgagcaucccgauaaguuccugaaguucggcaugcagccguccaggggagugcuguuuuacggaccgcccgguugcgguaaaacccuauuggccaaggccaucgcuaacgaaugucaggccaacuucauauccgucaaaggaccggaauuguuaaccaugugguucggugaaucugaagcuaauguuagagacauuuucgauaaggccaggucagcagcuccuugugugcuuuucuucgaugaguuagauucgaucgcuaagucgagagguggaaaugugggagaugccggcggugcagccgauagggugauuaaucaaauuuuaacugaaauggauggcaugggagcuaaaaagaacguuuucauaauuggugcuacaaauagaccagauauuauugaucccgcaauauuacgucccggucgucuggaucaguugaucuacaucccguuaccagacgaaaagucuagagaagcaaucuuuaaggcgaaccuaaggaaaucaccuguagcuaaagacguagaucuuacauauauugccaaaguuacacacggcuuuucgggcgccgauuuaacagaaauaugucaaagagcuugcaaacucgcuauaagacaaagcaucgaaacggagaucagacgagaacgagagagagcauugaaucccaacguagcaauggaucuggaugacgacgauccggucccagaaauaaccagggcucacuuugaagaggcgaugcguuucgccagacgcucggucuccgauaacgacaucagaaaauacgaaauguuugcacaaacuuuacaacaaucucgaggauucggaacaaacuuccguuucccgacggcccagggagggccgcaagccccgggaggcaccggcggggaucaggccaacuuccaagaugcuccugaagacgaccuauauagcuaa

SEQ ID NO: 6176 - RNA, 825 nt, Phyllotreta cruciferae
augagugaccaauuugacugugcacucgauuuaaugaggcgcuugccuccgcaacaaaucgaaaaaaauuugagcgacuuaauagauuuagugccaagucucugugaggaucuucuaucgucuguggaucaaccuuuaaaaaucgcuaaagacaaggauucgggcaaggauuuucuuuuaugugauuacaauagagacggagauucuuacaggucaccauggucgaauaccuacuauccuccauuagaagacgguucgaugcccuccgagaggcuaaggaaauuagaauuagacgccaauuuagcguucgaucaauauagagaaauguauuucgaagguggcguaucuucuguuuauuuuugggacuuggaucacgguuucgcagguguaauuuuaauuaaaaaaacuggcgaugguaguagaaaaauuaaagguuguugggauucccugcacgugguggagguacaagagaagaguuccggaaggaauucccacuacaaaaugacguccacugcuaugcuguggcugcaaaccaauaaacaaggcucgggaaccaugaauuugggcgguaguuuaacccgacagaucgagagugaugcagccguaaacgacaucaauccccacaucgccaacaucggucgaaugguugaagacauggaaaacaaaauucggaacacguuaaacgaaaucuacuuuagcaaaaccaaggacauagucaauagcuugaggucggugcaaccguuaacggagagccgucaacagcaagcgcuuaaacaagacuuggcugccgcccuucagcguaggcaaaauaaauccgaaaauuga

SEQ ID NO: 6177 - RNA, 2106 nt, Phyllotreta cruciferae
auggaacguccaccccgcaaugaaccgcccguggagccugucaacggugugguacaaccgccggugcacccgcccccggacaguccaggacgcguaacgaaccaacugcaauuccugcagaaaaccguacuaaaggcuguauggaaggacaaauucgccuggccuuuucaacaacccgucgacgcuaagaaacucaaccugcccgacuaucauagaauaaucaaacaaccgauggaccugggaacgauaaagaagcguuuagagaacaacuacuauuggucggguaaagagugcauucaagauuucaacacgauguucacgaauugcuacgucuacaaccagcccggcgaagaugugguggucauggcccaaacauuagaaaaaguauuuuuaaccaaaguggccgacaugccuaaacaagaauuugucguugauaugccgaugaaaggcgccaaaggcaagaaagggcgaguuagcgucgguggcggcggcggcagcacgccauccuccagcggaccgguaccagcagcuauaguaccaggaggugucagaggcaggccgcccgcgaccguuuccucuaccaguaccacaccaauugcgaccacuaccgguucguccgguuugccguuggguacccaagcuccugcgacgcugccgggaaguaccgccaccacgacgauagcgccggccaacaacaacaacagcucucugacgccgcagcagcucggcacgcccgucaguucgaugcacggcaccccgggggccccccuaucgaauucccucgaucccagcggagugcugcccuccaacgucaugccgccggcgcaaccagccaagguaaaaaaaggcgugaagagaaaggccgacacgacgacgccggcgacggccuacgauuauccgacgguauuggaaucgaagucggcgaagauuucgacgcgcagagaaucgggcaggcagauaaagaagccggcgcggcgggaaaucgaccuucauguaccucaaccggcgauccacaaacccaacgauaaguugucggagucgcugaaagcuugcaaugaaauccuuauggaacuguucuccaagaaacauucgaauuacgcuuggccuuucuaucaaccggucgaugcagaauuauugggccugcacgacuaccacgacaucauaaagagaccgauggacuuugguacggucaaagagaagauggacaacagggaguaccgcaccccgcaggacuuugccgccgacguuagacugauuuuuaguaauuguuacaaguacaaucccucugaccacgauguggucgccauggcgcggaagcugcaggacguguucgaagucaaguucgcaaagauccccgaugaacccguaaaccggauaggaggagcuguaaauaaucuacccauaaaauccgaaucgaguaguuccgguucgaguuccgauucguccagcgaauccgaggauucggaggaggaacgacguaauaaacaauuaaaaguacuggaaaaagagcugacggcguugcaagagaagaugcgcaagcuuguggaggagagcucgcgccggaaaaaggagaaaaagaagaacaagaugaaaaagaagccgagcggcggcggcaugaccgccgccggggcgggagcgcugccgaacagcagcagcggucucgguaagccaucggggcacggcgcccuaaagucaaacaacaauucgaucgcggacagcguugacgacagcaucgccaguguuguguccggcgccgauaugaagauguccggcgccggggcgaccgucgccggggaaucgcaccaucacgcggucggggcgcagggcgcgggggcgcuccaucccgccggcaagucgaucaacaugcaucacaacauggcggcagcuggcgccaacgcuuccgcccagccuaaaacaccuaagagcaaaggugagauucuauuuaaucguuuuuuauucauuuauuucuaucuacuacguuauuaugcucugcugcaaauucuucaacgcauguucguaucucguuuugggucugccguauacgcaauaguuuguauuuuuuuugcuguauucgauucaauaauuuugucuggcauuguauuguaa

SEQ ID NO: 6178 - RNA, 1227 nt, Phyllotreta cruciferae
augucuuuauccacugcucgcccuuuagugagcguuuacaaugagaaaucggaagaaguaaaaggcaacgggguagcucuacccgcugucuuuaaggccccaauuagaccagaugucgucaauuucguucaucagcaggucucaaugaaccaucgccagccuuacagcguuagcgacaaagcuggucaccagaccuccgccgagucguggggaacaggucgcgccguggcccguauaccucguguucgggguggcgguacccaccgaucgggccagggagccuucgguaacaugugucgcggcggucgcauguucgcgcccaccaagccguggcgccgcuggcacagacgcgucaacaucaaccagcgucgcuacgcccuggcgucggccguggccgccagcggcgugcccgcucuggucaugagcaaggggcacguggucgaucagauucccgagcugccguuggucgucagcgauaaggugcaggagaugcacaagaccaaggaggccgugcaguuucugaggaggaucaaggcuugggcugacauccagaagguuuacaagagccaacgguuccgugccgguaaaggaaaaaugcguaauaggagacguauccaacguaaaggaccacucaucguuuacuacaaagaucaaggucuucgucaagcuuuccguaacaucccgggcauugaccucaucaguguccaaaaguugaacuuguugaagcucgcuccugguggucacguuggucgauuugucaucuggaccgaaucggcauuccaacguuuagacaaauuauucgguacauggaaaaacccaucgaccgaaaagaaggguuacaacuuaccucaacccaagauguccaacaccgauuugucuagguuguugaaagcugacgagauuaaagcuguucuuaggacuccucagaagaaggugguacgucguguucgucgucuuaauccuuugaccaacacuaaagcuaugcugaaauugaacccguaugcugcuguacucaagagagaagcaaucuugaagaaccaaaaaaggcaguugcaaagagacgaagcuuuggcuaagaaacgaggaaucacucugaccccugacaacgcuguaaucaggaccaggaaauugcaggaaagaaggagagcucaaauuuugaaagauaagaaaucaaaacccaagaaggccgcuaaagcgccggccaagaagccugcuggaaagaaauaa

SEQ ID NO: 6179 - RNA, 5394 nt, Phyllotreta cruciferae
auggcagauuaucuuaauucagaagccgaggaaucuagcgaggaggaagaauuagaccauagggaucgaaagaaggcacaaaaagcaaaacucguagauagcucugacgaggaagaggaagaagaugacgaagaaaaaauucgagaagaauuaaaagaucuaaucgacgauaauccaaucgaagaaagcgaugcugaauccgaugcuucaggucgugagaaaagaaaaaagucugacgaugaagaccucgaugaucgauuggaagacgaagauuacgaucuguuggaggaaaauuugggucauaaaguagaacgaaggaaauucaaacguuuacgccgguuugaagaugaagaaagcgaaggggaagaagaacaugaucccgagcaggaucgugagcaaauugcuauggacauauuuuccgaugaugaaaaagacgaucgucacaagaaggaugaagaaagaaggucggagagaagucaaagacccgucgucgagcaagaaucuuucggagugggcgaggaggaagaagaaggcgauuauucggacgccgaugauuuuauuguagacgaugacgguagaccguuaauugagaagaagaggaaaaagaaaccgauuuucaccgacgccgcgcugcaagaggcccaagaaacguucggcguugauuucgauuaugacgaguucaccaaauacgaucaagacgaauacgaagacgaggaggacgaagaagaggacgaauacgaagaagaugacaacgaacgaaggaaacauccgaagaaagcggcgcggaagaagcugacgaaaaaguccauuuucgagguguacgagccgagcgaauugaaaagggguuucuucaccgaucucgauaaugaaguucguaacacugacauacccgaaaggaugcaacuucgugacguucccauuacgccuguaacugacgauucgacugagcuggaagacgaggcagaguggauuuacagacaagcuuuuuguaauaaggcuguguccaauguugaugcgcaccuuucggccgaagcgagagagaaaaugaagaaaggcucccaaacgguggggaaaauaaagaaggcguuggauuuuaugaggaaccaacagcucgaggugcccuuuaucgcuuuuuacaggaaggaauauguacaaccugaacugaauauuaacgauuuauggaaaguuuauaaauacgaugcaaaguggugucaacuaaaaucucgaaaggaaaaucuccuuaaacucuuugauaaaaugaggcauuaucaacuggaucagcucguaaaaaauccggacgcuccuauuccagacaacgugcgagugaugaaagauucggauaucgaaaggcugaaaaacguccaaacugcagaagaacucaaugauguucacaaucauuucauauuguauuauuccggagacuugccugccaugcaugcagcuuggagaaucaaagaaaaagagcagaggaaauucgagaagcgacagaaaagacucaagcaaauugccgaagcggaggaaggugcugacauuccugaugaaccagaggaugacgaugaugaugaaccagaaacagaaacuuugaaauaugcuaaucgaucgggcaguuaugcauuguguucgaaagcuggauuagauccuuuggcaaagaaauucgguuuaucacccgagcaauuugcugaaaauuuacgagauaauuaucaaagacacgaaguugaucaagagccugucgaaccuuccgauguugccaaagacuuuauuucuccuaaauuuucaacugccgaugaaguauuacaagcggcuaaauauauggucgccuugcaaauagcuagagaaccguuagugagaaaauguguuagagaaguuuauuuugaaagagccaggauuaauguauauccgacaaaaaaaggacaaaaagucauugaugagucucacaauuguuacagcaugaaauauuuaaaaaacaaaccugugagagauuugaauggagaucaguuuuuaaaauugugcuuggccgaagaagagaaccuucuaacuauuacaauuaacgauaauaucgaaggaaauacaucaaacucuuacauagaggaaguuaaacagcucuacaucaaggacgaauuuaguaaaaauguacaagauuggaaugcuuuaagaauggagugcguagaaagggcgcuaacgaagaguguuuugcccgauuugcgaacagaauugaagaggaccuuguuaucagaagccaaagaauucguccuuaaggcguguugcaggaaacucuacaacagcauuaaaguugcuccauacucuauuacauuucccgaugaagacgaagacgagugggauacaucgaaaggcguuagaguuauggguuuagcuuacguuccagaauauacaguuuccgcauuugcuugcauagcagcucccgauggagauaucacggauuauuugcguuuaccgcacauauuaaaacgaaaaaacaguuucagaaccgaagaaaaauuaaugaaggaagcugauuuacaagccuugaagaacuuuauuuucuugaaaaaaccccacgugaucgcgaucggcggugaauccagagaagcgcugaugauagccgaugauuugaaggccuugauuaacgaauugguugaauccgaucaauuucccgaaaucaaagucgaaauuaucgacaacgaauuggccaaacuguacgcaaacuccaauaaaggccaggcggacuuuagggacuaucccgaguugcugagacaggccauuuccuuggcuaggaaaaugcaagauccucucaucgaguacucgcaguuauguaacggggacgaagaaauauugaguuugagauuccauccauuacaagaacaaauaggcaaagaggagcucaucgaagcucucugccucgaauucgucaacagaacuaacgaaguuggcguugauauuaauuuggcuguacaacaggcgcauaaaaguagucucguucaauucgugugcgggcuaggcccucgcaagggucaagccuugcugaaaguccuuaagcagaccaaccaaaggcuggaaaauagaacacaguugguuacggcgugccacauggguccgaagguguucauuaauuguucugguuucaucaaaaucgauacuaacagcuugggagauaguacugaagcguauguggaaauauuggaugguucucguguacauccggagacuuacgaaugggcuagaaaaauggcuguagacgcuuuggaauacgacgaugaugaaggcgcuaauccugccggugcacuggaagaaauccuggaaacgcccgagagauugaaagaucuggauuuggaugcuuuugccgaagaauuggaaagacaaggauucggcaacaagaguaucacauuguacgauauaagagccgaauugaacuguagauacaaagauuugaggcaaccuuuccauucggcuaauccugaggaguuguuugauauguuaacgaaagaaacgccggagacguucuauauaggaaaauugguuacugcuucaguuauagguaucgcgagaaagaagccuaaaccagaccaacucgaucaggccaauccugucagaaaugacgaaacggggcuuuggcaauguccguuuuguuugaaaaaugauuuuccggaauuauccgaugucuggaaucauuucgacgccggugcauguccaggucaagcuacuggagucaaacuuagauuagacaauggaauaauggguuauauuuauauaaagaauauuagugauaaaccggugucgaauccggaggaaaggguaggaguuggucaauuaauuaguugucguauaauaaaaaucgacguugaaagauucagcguugacuguacgucgaaaucuagcgauuuguuggauaaaaaucacgaauggaggccaccaagagauccucauuaugauacagaacgcgaagaaaaagacaacagaacugaggcugaaaagaaaaaggaaaagcaacguuugacauacauaaagagaguaauaguucacccggcuuuucacaacauuucuuaugccgaagcugaaaaaugcauggucaauauggaucaaggcgaagucaucaucagaccauccaguaaaggagccgaucacuugaccauuacauggaaagucgccgauaaaauuuaucaacacauugauauuagggaagaaggaaaaacuaacgcguuuucuuuggguaaaucguuguugauaggcaacgaagaguucgaagauuuagaugaaauaauagcgagacaugucacuccgauggcggcgcacgcucgugauuugcucuacuucagguauuuuaaagaauucgagggcggucacaaagacaaggccgaggaguaccuaaaagacgagaagaagaagaacgccucgaaaauacauuacgucguuagugcugcaaagcacuuaccugguaaauuccuacuuucguauuuaccgagaaauaaaguuagacacgaauacauaacggugacucccgaaggauuuagauucagacagcaaauguucgauucgauaacgucgcuauucaagugguuuaaggagcacuuuagagaaccaccgcccggcggaaugacaccuggaacaccaagaauguccaccggaagaacaccuuaugauaugaguaccgaagcuauucaaagaguugcgcaaaaucuuccuagcgacaugguccaagcuuuauccgcugcaacgaaccaaacuccucacuacccgcacacuccuggcgguuauggugguaauuacaucaauacaccguacaccccgagcggccaaacgcccuacaugacuccauuccaaaccccucacgcucaacaaacgccgcgguacggccaacagacgccgucccagccgucucugagcaacccguuccuccaucccggcgccgugacgccgucgcaacggacgcccaguuacaggaaccuaucgagccaaaguccgaugauaccgcaaaguccggugccgaguccgggaucgcagaguucguacagcagccacaugagccaccacacgagggcgagcuacggggauucgaugagguuccagccgccggagucgccgaggaauuacccgagcagcaggggcuccuaucccgaugggagguacgguggcagcgaaucgauggauuggcagaaggcagcugaagcuugggcuucuaggucaagaucaacgccacgaagcgaaggucgggggacucccaggucgucuggccacagaacuccucguaauuaugauaauaugucugaaagugaucggucuaggaugaagcauaugagcaguaagagcccgaaaucgguacggucgacuccucguacuaauucuucgccuagaucaauguccuugggcgacgcuacuccuuuauacgacgaaaauauuuaa

SEQ ID NO: 6180 - RNA, 2592 nt, Phyllotreta cruciferae
augccagaaguggacgacagcgaaacgcguuccccucgccgcaaacggcgcagguccaaauccgccgaucgcaaggaagaaaaaucgucuaaaaggaaaucgucgagaaaacguucaucagacgacgauuacaaugagcgagacuauccacgcuauuauggcgaagaucggcccaacagcgacagcuacuggaacaaauaucccagaagagaaaacaugaaagucggucguagguauuacgaucacccugagcacgagaagaauagggauagggauagggaugccucgaaugagaggagcagagauagagaaagcgccagaggaaaggaauacuccaagaaagaggagaaugaggacaaauccauaauuaaacccagagaacguaaagucguugauaugcuaacuuccagaacaggaggagcuuacauaccaccagcaaagcuucguuugaugcaagagaguauaacagacaaaucuucagcggcuuaccaacguaucgccugggaggcccuuaaaaaaucaguacaugguuacaucaauaaaaucaauacaucuaacaucgguauaaucgccagagaaauccugcacgaaaacauaguaagaggcagaggucugcuuugcaaaucgauaauccaagcccaagcugccucuccuacuuucaccaacguuuaugcugccuuaguggccguaaucaauuccaaauuucccaauaucggagaauuauuauugaaaagacuggugcuucaguucaaaaggggcuacaagcagaacaacaagucuauuugcauuucagcuacuacauucguagcucacuugguaaaccaacggguggcucacgagauucuggcgcuugaaauucugacuuugcuugucgaaacuccuacugacgauuccguagaaguggcuauuucuuuucucaaagagugcggacagaagcucacagaagugucgaguaaaggaauuacugccauauucgagaugcuuaggaacauccugcacgaaggccagcucgagaaaagaauacaguacaugaucgaggugauguuccaaauuagaaaggacggcuuuaaggaccacgccgcuguaacggaggaauuagauuuaguagaagaagaggaucaauucacccaccuaaucaugcuugaugauguaaaggagguuaaugcugaagauauucuaaauguauucaaguuugaugaacauuacgaagaaaacgaaggcaaauacaaaacucugaguaaagaaaucuugggaagcgauagcgagucggaaucaggaucggagggaucugaagaggaaucagauggcgaaggcgaggacgaagaaaucaaagaugccgggaaaaucaucgacaauacugaaacaaaucuaauagcucuuagaaggacaauauauuugacuauacaauccaguuuggauuucgaggaaugcgcucacaagcuuuugaaaauggaguuaaaaccuggucaagaaaucgaauuaugccauauguuuuuagauuguugugcugagcaaaggacauaugaaaaauucuacggacugcuagcucaaagguuuugccagauaaauaaaauauacaucgagccuuuucagcaaauauucaaagacacuuucgcgacuacccaucgcuuggacaccaauagauugaggaacguuagcaaauuuuucgcccauuugcucuuuacggacgccauagguugggagguguucgagauuaugaaacucaacgaagaagacacuaacagcucgaguaggauuuuuauuaaaauuuuguuucaagaauuagccgaauauaugggcuuaggaaaguugaaugcgagauugaaagaugaaacgcuucaacaacauuuugcgggauuauuuccuagagacaauccuaaaaauaccagauuuuccauuaauuucuucacguccaucgguuuaggagguuuaacagacgaacuuagagagcauuuaaaaaacgucccuaaaauuauggaaauuaaaacgaccgccgugagggaaaaaagcgaaaguagcaguagcagcagcagcaguagcaguaguucaagugaagaagauagcagugaugauaguucuggggauucgaguucagaggaugaaaaacaaagggaaaaaucgaaaaagaagaaaaagaaacgcgagucggaaagcaaaucuucaaaaucagauucgaaaauuaaucgcaaagccgaaaugcgcgauagagguaagcacaagaagaauaaggacaaggaagaucguaaagaaacccauaaaaauaaagaaaauagaagcgauucggacaagcacgugucaagggagaaacaaaacucgaggcaagauaaaagaaaagaugacggugacauuaaagaaaaacacagaaaagaugauagggaggacagggagaggcaacggaggaacgaagaaaagagugggaggaaaaaggacuaugaaugggugaaaaguagacacgaggauaacauacaucaauuaaaaacaucuaaaaaaguguuugaaaaaccaucgaagcacaggucgaggucgagagacaaaauuaguaguaaagaaaaggacagaaagcauagaaguaaagaaaggcgaaaaaguuga

SEQ ID NO: 6181 - RNA, 1788 nt, Phyllotreta cruciferae
auggcguugaaaaaccaagucggucaaaaaauaaugaacgaggugauaaaacauaaagccuccaagaagaacggaccugcaguuacacagccccacaacgcuagugguguugacuggagaauccugguggucgaucaacuggcaaugagaaugguaucggcuugcuguaaaaugcaugauauaucagcugaggguauuacauuggucgaagauauaaugaagaagagagaaccgcuugcuacaauggaagcuguguacuugaucacaccuucugaaaagucuguucaugcucucaugaacgauuucgaaucuccgagaccuauguacagaggagcacauguauuuuucacagaagcaugcccagacgaauuauuuaacaaauuaaguaagagucaugcagcaaaauauauaaaaacguuaaaagaaaucaacauagcauuuauacccacagagucacagguauuuucuuuagauuccccagacacuuuccaauguaguuacgauccuuccuuugcugccgcacgaaaugcgaauauggaaagaauggccgaacagauugcaacauugugcgccacuuugggggaauacccgcacguccgauauaggagcgauugggaacguaacguagaguuggcgcaauugauccagcagaaauuggaugcuuacaaagccgacgagccgaccaugggagaagggccggagaaggcccgaucgcaauugcugaucuuagaccgaggcuucgauugcguuucgccuuuacuucacgaacugacguuucaagcuauggccuacgauuuacuuccaaucgaaaacgacguguacaaauacgaggcuuccgcugggguacaaaaggagguucucuuggaugaaaacgacgagcuguggguggaguugcgccaucaacacaucgccgugguaucccaaagcguuacuaagaauuugaaaaaguucaccgauucgaagcgcaugacucaaagcgauaaacaguccaugaaggauuuguccacuaugauuaagaagaugccgcaauaucagaaagaauuaucgaaauacgcuacucacuugcaucuugccgaagacugcaugaaggccuaccaaggguauaucgacaaguugugcaaaguugaacaggauuuggcaaugggaacugacgccgaaggggagaaaauuaaagaucauaugcgcaacaucguuccgauucuuuuagauaccaaaauaacgaacgaauacgauaagaugcgcaucauagcuuuguacgcuaugaccaaaaauggaauaaccgaggaaaaucuuacaaagcuagcaacgcacgcccaaauuaaagauaaacaaacuauugcuaaccuucagcucuugggaguuaaugucauuaaugaugguggcccuagaaaaaagaucuacaccguaccgcgcaaagagcgaauuacagaacaaacuuaucagaugucgagauggacaccuguuauuaaagauaucauggaggauugcaucgaagacaaauuggaucaaaaacauuuccccuaucuaaguggacgagcgcaaaccacaggauaucacgcagcaccguccagcgcucgauauggacaauggcacaaagauagaggucagcaggccgugaagaacgucccgcgucugcuggucuucgucguuggaggcauaaguuucucggaaauucgcugcgcguacgagguaacaaacgcccagaagaauugggaagucauaaucggaucgucgcauauccuuacaccagaagguuuccucagugauuuagcgacguuagccggcuag

SEQ ID NO: 6182 - RNA, 2139 nt, Phyllotreta cruciferae
augaugcaacaauauaugaaagaauuagaacaagagccuuucgaugccgaagaauuuguagaacguuuagccuggagaacuuuagcugaaucaaaaagcgagggagaggaaaaugaaauuaauccggcacuucuucacgagucguuuguucaagccauaaaggaccuuaauuuauugcacgaaaggcaacagaaaaaaugcgaaaaauuagaaguugccguuagagaagacgaagcgacguuuuuucaagaaguuuacaauuuauuggaacaaaauaagcaagcuauggauacauuucaagaacuggacggcaaaauuaaucauguagcaaccaaaguucuucacuugggugaucaauuagacagugucaauggucccagaucuagaguugucgaugcauuaagcuuaaugacucauuuaagagaauuuuuaucgaacgagccaguuucauccacaauauuuaccaaugaagaauacauugaugaagcagcugaugugauucaaaaguuguauuuaauaucgcaagauuugccacccaaguuugaaucgauaaaaagaaaaauagaaaggaaguauucggauauugaaaaaacgcuaauagaagaguuuguuggggccauggauaaugagaauuuaacaagaaugaaggagauagcauugguacugucccaauuuaaaggcuacucucaaugcauugacuccuauauagaucacagccaaguggguuguuuaucuaguaaagaugucuucuauaacuuuuugaauuuguguaaauacaaugaugaaauaauucgaaaaguuuucaagaauccagagcaagugauggcgaaauucguuuuaaauauauaucagcuaaaauuaguggaauauauagaucaaaaacuaaauucuaaauuggguacauacagcuauuuacaaacauuauaugaacuguauucaaagacuaaucaucuaucaagcgaauuaaccguuuuucauaugggaaacgacaaaaacuaucucacuaaacuaacgacaaauauuuuuaauaaguauauuaacgauuacauuucuauggaacucaagugucucaaagacagauguucaacuaacuugcaaaaauauuaugauucgaaaaaucaucaaaagaaacagauucagucugggggcuuucaagaucuuagaagagauuuacaagcaguaauaggcacaagggcaaacauuaacauagcacaaauagaaaauuauggcggugagacuuucuuaucggaggaauuggcaaucaugauucuucaagauacuaaacaagcuuuucaacguugcuuauuguuaucaaaagguagugaaagagcuuccaacgccacucaaauuuuagacaggcuuauuaauaguuugcugauagaacauguagacuaugcaguugaguugggucuacacgcuguacccguugucgaaggcguuagaaaucccccuguuuuguauuuuuuuaauaucgugcaucagagcaauaauauaacccaucucgucgagaaacaguuuauggauuuggugguuccauuaguagaaaauacuucaaaauauagcgauugcauacagaagaaaaaauuuguuuuggaggauauagaaagaaaaauuaauacgggauuggauagauguuugagugcgauauuaaauugggugaaguuguauuuacaaucugaacaaaagaaaucggauuucaagccagagucugaugauuuugauacaguggccucgccagcuugcaagaacguacuuaauuauguuaauaguauuaucaaagaaauuaaaacuaauuuggauggcaauaauguaacagcuauccuucaggaauuagggauuagacugcauagaguuguuuacgagcacuugcugcaguaucaauauaacacugcaggugcaaugguggcaauuugcgauuuaaacgaauauagaucuuguacuaaacaauuagguccuuuaguugcggagcuuuucgauacuuuacaugcuuugugcaaucuuuugcugguuaaaccagaaaaccuucaacaagugugcucugaagauucuuugguuaaguuagacagagcgauccuccauaguuuuauacaacugcgaagugauuuuaaaguucaaaagcagacuauuuugaaaguuuag

SEQ ID NO: 6183 - RNA, 813 nt, Phyllotreta cruciferae
auggauuuucaaaacagaccuggugggaaaacgggcgggggcggcgucgccuccuggucggaaaccaaccgagaccgaagagagcgucugaggcaacuggccuuagaaaccaucgaucugcagaaagaccccuauuuuaugaaaaaccaccuggggucuuacgaauguaagcuuuguuugacgcugcacaacaacgaggguaguuacuuggcccauacgcaaggcaaaaagcaucaagccaauuuggccaggagggcggccaaggaagccaaagaugcccccacguugcuccaaccggagaaaccucgaguggagcccaagaaggucgugaaaaucgguaggcccgguuaucggguaaccaaacaaagagaccccgaaaccggucaacagaguuuacuguuccaaaucgauuauccagaaauaagcgauuugguuuugccccgacaccgcuucaugucugcguacgaacagaaaaucgaaccccccgaccguaaauggcaauacuuacucuucgcugccgaaccguacgagaccauuggcuucaaaguaccgagcagagagguagaaaaaaccgauacuaaauuuuggacacacuggaacagggacaccaaacaguuuuuccuacaauucgccuucaagaacgagaacaaacgcaacguuaacucuguaguacaaaggcauucgauuguugguggcguuccaccgccucccaugcugccgguaccgccgccacccaggccuccuauguuuaaucccauuccaccgccaccgccgaugaugagggcuguuuugccaguacccccuccgaauuaa

SEQ ID NO: 6184 - RNA, 402 nt, Phyllotreta cruciferae
augucuaucgguguaccuauuaagguucuccacgaagccgaaggccacauuauaaccugcgaaacgauaaccggcgaaguuuacagggguaaacuuauagaagccgaggauaauaugaauugccaaaugacccaaauaacuguaacuuacagagauggacgaguggcgcaauuagaaaacguuuacauuagagguuccaagauaagguucuugauauuaccggauauguuaaagaaugcuccgauguuuaaaaaacaaaccaaagcuggaacugcuggcagagggaagucugcaauucuacgagcucaagcucggggaagaggucgagggcaaccgccuguucgaggaggcagaggggcuuggcagaaucagcaaaacgcuccugcaggucgagcaaaauaa

SEQ ID NO: 6185 - RNA, 1329 nt, Phyllotreta cruciferae
auggcuacaaaucuaucccgaacaucgcuccugcgaaucauuaacgcuaggggcuacgcagccuguccccauccacuuuccgggguuccaaacgcagaaguaaaaagcaccauacuccccaacaaaacgguuguagcugcuguugacaacaacgccucccucaccagaguuucaaucguauucagggcuggaagucguaacgaagaucccgacaauuuagguguagcucacguguugagaaccgcugcuggucugaguacgaagaacuguucgcaauucgcuauuauucgcaacauucagcaacugggggccaauuuaacggccacuuccgauagagaaacuaucugcuacacuuuagaagguaccccagaagccguggaaugugcuauaccuuucuugaccgaaguagccacccaacaggaauucagaccuugggagauuuccgaauugucugguagauugcaguuggauauugcuacaagaccguugcaguugagagccaucgauuugcugcacaacgcugccuuuagaggacgcggcuuggguaauucucuguuuauuccgaaaacucaaaucgguaaaauuucguccgaaacccuacaacacuacguugccucgaacuucgugagcggccguauggcuguaguaggcucagguaucagucaaaaggaacugacaucuuucgcaaacuccuugaaaauugaaaauggcgaaggcaacaacgcuccuucaccuuacguaggaggugaacuaagaucaaacaaagguggucaacuugcauucguugcuguagcaggagagggugcugcuaucacgaacaccaaggaagcucuggcuuucgcugugcuacaaggagccuuaggaggaggcccacagguugcacacggaguuuccgacaauggugucuucaggaaggcucuuggaagcaaccccaaugucaguucaguagccauaaacgccaguuacucagacaccggucucuuugggcuucuacuggcugugccaacgaagucugcaggaggugcucuagaaaccgcuguuaaagugcuuaagaguggaacgguuucugaugaagauguccgcagagguaaaaaucaauugaaaacaucgauucucuuuggggcugaaagcggagcugauauuguaagaagaauuggacaggaagcuguuuugacacaaaaagcuaccaguguugaugcacuuguagcugauguagauucuguuucuaccagugauguugcaaaugcucuuaagaaagcaggcaagaaauugucauuagcgucuguuggaaacuuagccggaguaccauuuuuagaugaacuaaaguaa

SEQ ID NO: 6186 - RNA, 333 nt, Phyllotreta cruciferae
augagaagagcccaugcagguaacuacuacgagccauugccgcagaauucgaacgaaauugaagacgaaaaugaucggaugacuaacgaacuacaagagaaaaucggagcccuaaaaucccucacuauagauauaggaaaugagguuaaauaccaggacagaaugcucagggaugucgaugaugauuuagagaaaaccggaggguuccugggaaccaccaugaacaaagucuugaggcugucgaaagggggccacaauuacaucauuguguauuuguuuuuauuuucgauuguuguauuuuuuauacuuuacuguguuauuaaauuuagguag

SEQ ID NO: 6187 - RNA, 1491 nt, Phyllotreta cruciferae
augucuuacccaucgacguuaaacgcaaaacaggccgcacaggaacacguuuuagccguguccagagacuucguaucccagccaaggcucacuuacaaaacagugucuggugucaacggaccguugguaauccucgaagaugucaaauuuccgaaauucaacgaaaucguccagcucaaacuggccgauggcagucuacgauccggucaaguauuggaggugagcggcucgaaagccguaguacaaguguucgaagguacuucgggaaucgacgccaaaaacaccgugugcgaauucaccggcgacauucucagaacgcccguauccgaagacauguugggcaggguguucaacggcucaggaaaaccaaucgauaaaggaccuccaauuuuggcugaggacuucuuggacauccaaggucaaccgaucaauccuuggucgcguaucuacccggaggaaaugauccaaaccgguaucuccgccaucgaugugaugaacucgaucgcucguggucagaagauucccauuuucucggcggcuggucugccccacaacgaaaucgccgcccaaauuuguagacaagccggucuugucaaggugcccggcaagucggcuuuggacgaucacgaagacaacuucgccaucguguucgccgcuaugggagucaacauggaaacugcucguuucuucaaacaagauuucgaagagaacgguucgauggagaacguuuguuuguucuugaauuuggcgaacgauccuacuauugagagaaucaucacgccucguuuggcucuaacagcagccgaauuuuuggccuaucaaugcgagaaacacgucuuggucauauugacugauaugucuucguacgcugaagcuuugcgugagguauccgccgccagggaagaagugcccgguagacgugguuuccccgguuacauguacaccgauuuggccaccauuuacgaacgagccggacguguggagggccgcaacggcuccaucacccaaauccccaucuugacuaugcccaacgacgauauuacucacccgauucccgauuugaccgguuauauuaccgaaggacagaucuacgucgaccgucagcugcacaacaggcaaauuuaccccccgauuaacgucuuaccaucacugucucgucucaugaaguccgccaucggcgagggaaugaccaggaaagaucacucugacguuucuaaccaguuguacgcuugcuacgccauugguaaggacguucaggcgaugaaggccguggugggagaggaggcccugacgcccgacgauuugcucuaccuggaguuccugaccaaguucgagaagaacuucaucucgcagggcagcuacgagaaucguacaguguucgaaucgcuggacaucggcuggcaguuguugcguaucuuccccaaggaaauguugaaacguaucccggccgccacguuggccgaauucuacccgagggacucgcgucauuag

SEQ ID NO: 6188 - RNA, 2421 nt, Phyllotreta cruciferae
augaguuacaugcagacuaaccaaaauagaccaaugucucaaggcuaucaucagggugccaacgaucucccaaugcagucguccaaagagcagacccugcuauggcagcagaacuccuacaugggagacucaggcauccagucaggcgcugccacucaagugccaucgcucucuggcaaagaagaggaagagauggaccucuucgaucucgaccaacccuaccaaggauucacgcaagagcaaguagacgaaaugaacaaccagcugaaccacaccagaucgcaaagagugagggcagcuauguucccugaaaccuuggacgaagggaucgagauuccuucgacccaguucgauccgaaccaucaaacugcuguucaacguuuggccgagccaagccagaugcucaaacacgcugugguuaauuuaaucaacuaucaagacgacgcugauuuggcgaccagggcuauaccagaauugaucaagcugcucaacgaugaagaucaaguggugguaucgcaagccgcuaugauggugcaccagcucucgaagaaagaagcuucucgacaugccaucaugaacagcccccagaugguggccgcuuugguucgagccaucuccaauuccaacgauuuggaaaccaccaaaggugcuguuggcacguugcacaaauuaucgcaccacaggcaggguuugcuggccauuuucaagagcggugggaucccagcgcucgugaaauuguugaguucuccgguugaaaguguauuauucuacgcuauaaccacgcuucacaacuuguugcuccaucaagaugguucgaaaauggcgguuagauuggccggaggauugcagaagaugguagcuuugcuccagagaaaucaugucaaguucuuggcuauucucaccgacuguuugcaaaucuuggcuuacggcaaucaagagaguaagcucaucauacucgccucucaagggcccaucgaauuggucagaauuaugagaucauacgauuacgagaagcuguuguggacuacuucgagaguauuaaaaguguugucgguguguuccagcaauaaaccggcuauaguagaagcuggcgguaugcaagcccucgccaugcauuugggcaaccccagcacgagauugguucaaaacugccuuuggacccucagaaaucuaucagacgcagcuacuaaagucgacggauuggagaguuuguugcaaucauugguacaagugcugcaaucauccgacguaaacguggugacuugcgccgccggcauccugucgaauuugacgugcaacaaucaacgcaacaaagugacggugugccaggugggcggcgucgacgcccuggugcgcaccaucgucagcgccggcgaucgcgaggagaucaccgagccggcggugugcgcccuacgccaccucaccucccggcacguggaguccgagauggcccagaacgccgugcggcugaacuacggcauacaagugauugucaagcuguugaacccgccgucgcguuggccgcuggugaaggccgucaucggguugauuaggaaccuugcucuguguccggccaaucacgcuccguugagagaacacggcgccauucaucacuuggugcaguugcugaugagagcuuuccaagacacucaaagacaacggaguagcgucgcuagcggaggcagccaaccgcccggaacguacgcggacgguguucgcauggaggagauuguagagggaacggugggagcguugcauauauuagcgagagaaucgcauaaucgggccaucauuagacagcaaauggugauuccgaucuucgugcaauugcuguucaacgauaucgagaacauacagcgcgucgccgccgguguucuuugcgaacuggccgccgauaaagagggggcugaaaugaucgaaaacgagggcgccacugccccuuugacugaguuguugcauucgagaaacgaagguguugcuacauaugcagcugcgguguuguuuagaaugagcgaagacaaaccacaagauuauaaaaaacgacugucuauggaguugacuaauucuuuauuuagagaagaaaaucuuuggaaucccgaucuaggcauggguccggauuugcaggauauuuuaagucccgaccaggcauacgacaacauguaugcucagggucccccaaguguucauaguagccauggcggccgaccauaucaacaacaaggguaugaccagauacccauagacaugcaggguuuagagaucgguucucacggaggggggaauggguccacuuacagugcaauagacgcaauggacguuaccagcggggaaccugaucucaauuucgauaccauugaucaacucccuaccccuccucaagauaauaaccaugcugcugcuugguaugauaccgauuuauaa

SEQ ID NO: 6189 - RNA, 801 nt, Phyllotreta cruciferae
auggcccggaacgcugagaaggcaaugacaacauuggccagauggagggcagcccaacugggugaaaucgacaagcacaagaaacgccggccauauuuagcaucagaaugcaaaagccuguacgccugcgagaaauggcgcaugcaaaucaucagggaaauagcgaaaaaaguggcccaaauacagaacgcagggcucggggaauuccgcauucgcgaccuaaacgacgaaaucaacaaacuccugcgcgagaaacgccauugggaggaccaaaucaaggagcuaggcggcccugauuaccagcgcgucggccccaggaugcuagaucacgaaggcaaagaaguccccggcaacagaggcuauaaauacuucggagccgcuaaggaacuaccaggcgugcgagagcuguucgaacaggaaccgccgcccccgccuaggaagagccgugcagaacugaugaaggacaucgaugccgauuacuacggcuacauggacgacgacgacgggauacugaucccuuuggaaaucaaagcugaaaaaauagccguacaaaacgcgauagccgaaugggugaacaacaaggaaaagaaccuagaccccgccaaaggaaucgaagagaguaucuacgugguggaggauucagaugaagaagauguuguucaacaguucgaugguucgcaacagagauucguggcacacguaccggugccaucgcaacaagauaucgagcaggcuuugcugaggcgaaggaagcaagaguugauggagaaauacggcguacaagaugaacaggaucuauga

SEQ ID NO: 6190 - RNA, 2409 nt, Phyllotreta cruciferae
augccaagaauaaugauaaagggugguguuuggagaaacacggaggaugaaauucuuaaggccgccgugaugaaauacggcaaaaaucaauggucuagaauagcaucucugcuucacaggaagucugcgaagcaauguaaagcccguugguucgaaugguuagacccuagcaucaaaaaaaccgaaugguccagagaagaagaugaaaaguuguugcacuuagcuaaacuaaugcccacucaauggagaaccaucgcgccuauaauaggcaggaccgcagcccaaugucuagaaagauacgaauauuuacuggaucaagcgcaaaaaaaggaagaaggcgaagaugccguggaugauccgaggaagcuaaaaccuggagaaaucgaccccaauccagaaaccaaaccagccagacccgauccuaaagacauggacgaagacgaauuagaaaugcuuuccgaagccagagccagacuggccaacacccaaggcaaaaaagccaagcguaaagcucgugaaaagcaguuagaggaagcccggcguuuggcggcuuugcagaaacggcgagaacugagagcagccgguaucgaagucaccucgaggcgcaagaaaaaacgagguguagauuacaaugcggaaauuccguucgaaaaacaaccagcaaucgguuucuacgacacuucuaacgaagcccucgacuugauggccccugauuucucuaaaaugagacaacagcauuuagacggcgaacucagaagcgaaagagaagagagggaacggaagaaggauaagcaaaaguugaagcaacgcaaggaaaacgacauuccucaagcgaugcugcaaaacgaggaaccagcuaagaaacgaucgaaacuggagcaaaaguugaagcaacgcaaggaaaacgacauuccccaagcgaugcugcaaaacgaggaaccagcuaagaaacgaucaaaacugguauugccggaaccucagauauccgaucaagagaugcaucagguaguuaaguuaggcaaagcgagcgaaacggccagagaaaucgcaacagaaagcggugucgaaaccacugauacucuucuuaacgauuacauguucacaccgcaagcugcugcuacuccaagaacucccgcuccccaaacugacaggauacuccaagaagcucagaauaugauggcucuuacacacguagauacgccucuuaaaggggguuugaauacgccucugcauaacucagauuucagcgggguucugccgcaaucgcaagcgauuaccacuccuaauacgguacucgcuacgccauucagaucuacuagaagcgacgggggagcuacaccaggaaguacugccggauucaugacuccuaaaagcggagcccugacuccuguugguaaaaacgcgacgccuucuaucagagauaagcugaauauuaacgcugaagaaaguuuagaugugggaaguacuccggccgaacauagaauguuucagaugucgaugaaagaccaguugaaacuuggauugagcagcuuaccacaaccaagaaacgauuacgagauuguugugccugaaaaugaagcacaagaugaaccagaagaagcccaagcucaauuggucgaagaccaagcugaugucgaugcuagaaaacaagaggaacugagagccaaagcggcucaagaauuagcaucgcguucgcaaguuauccaaagggaauugccaaggccgcaagaggugaauuugaccgugcugcgaccgcccaacgaaagcuacuccuuaaccgaccuucaacgagccgaagaguugauuaaaugcgaaaugguuacuauguugcaauacgacaaccugaagaacccucugccagcgcaaaguaagcgauccaacaugucgcaagcccagcaauuggccuuucucgagcaacauccuuacgauucguucaaaaaggaagacuuagacguggcuaaaacgcuguugagaagcgaaauggacguagugaagaacggcaugaaucacggagaauugccguuggagguguacaaucaaguaugggaagagugucugagucaagugcuguauuuaccgaaucagacgagguacacucgcgcucauuuggcgaguaaaaaagauagauuagaauccgcggagaagcggcuggagcagaaucgaucgcacauggccaaggaggcgaagcgugccgccaagauggagaagaaauugaagauauuaacgggcgguuaucaguccagggcgcagguguugauuaaacaguugcaggaucaguacgagagcaucgaucaaucgacguuggaguugaacacguucaaauuccuggcagagcaggagaagaacgcuuugccgaugcgaauacagucucuuacugaggacguuaauaggcagauggaaagagagaag

SEQ ID NO: 6191 - RNA, 456 nt, Phyllotreta cruciferae
augaugcaauuuauguuauuguucaguaggcaaggaaaguugcgauugcaaaagugguauguggcucauccugauaagcugaagaaaaaaauuacuagggaauuaauuacuaccauucuugccagaaaaccaaaaaugugcaguuuuuuggaauggagagauuugaaaaucguuuauaaaagguaugccagcuuguauuuuugcugcgcgauagaacaaugcgacaaugaacugcuaacuuuggaaaucauucaucguuacguugaacuuuuggauaaguacuucggaagcguaugcgaauuggauauaauuuucaacuuugaaaaagcguauuuuauucuggacgagcugaugcuugguggcgaggugcaggaaaccaguaagaaaaauguucugaaggcaauugcugcacaggaucuccuacaagagguuagucaugggaauauugaauuauag

SEQ ID NO: 6192 - RNA, 1371 nt, Phyllotreta cruciferae
auguauggauuacaacgauacucguuuucuuauacucucaaaaaugcggugcguuauuacucgagagaacccgccaagagaucgucguuucucagccgccuauacgacaauuucaaagaugaaaugaacaaaaacaaagaaaugaaagaaucccuaaaaaaauuccgcgaagaagcccaaaaacucgagcagagcgacgcucuaaaagcugcccgacagaaguucgaaaccguagagaaagaggccaguaaaagcggcgaagucuucaaagagaguuuagguucuauuaaagagagaguuaaaggugugauagacgaggccaguaaaucggaucuggccaaaaaagcugguaaauucaccgaagaaguaggaaaaacuacgcacaaaaucagcgaaacggcacaagaaaucagcaaaaccggagccuuucaaagcauaucggaggccaccaaagccguuaaacaagaaaucgacaacaccagcauggaaggucgaguguacgugagcccuaagaagcuucgaaaacgaaccgaaaccagcgcaguaguccaacaaaaguacuacgaaccgaacacagacgccaccggcguagagcuacacaaagacuccaaauucuacgaguccuggcagaacuucaaaaacaacaaccccuacgugcacaaagucauggacuggaaacucaaauucgacgaaagcgagaaccccaucaucagagccuccagggcgcucacggaaaaagugggagacauaaugggaggguuguuucaaaaaaccgaacucuccgaaacccuuacagaaaucugcaaaaucgaccccgacuucgauacgaaacgcuuccuaaaacaaugcgaaaccgacaucauccccaacauccuagaagccaugaccagaggcgacuuggauguuuuaaaggacuggugucacgaaggcccuuucaauuuauucgcuguaccgaucaaggaggccuauaaaaaaggcuacaaaaucgaguccaagauccucgauguagaccauguggaucuagugauggguaaagugauggaucaaggccccguguugauuauuucguuuacgucgcagcaagugauggccgugcggguccccaacauccuggaagccaugaccagaggcgacuuggauguuuuaaaggacuggugucacgaagggcccuucaauuuauucgcuguaccgaucaaggaggccuauaaaaaaggcuacaaaaucgagucgaagauccucgauguagaccacguggaucuagugauggguaaagugauggaucaaggccccguguugauuauuucguuuacgucgcagcaagugauggccgugcgggauccgucgggggcuguuguagaaggggauccggac

SEQ ID NO: 6193 - RNA, 924 nt, Phyllotreta cruciferae
cuuaaauuuauaaaaaugaguagcagugauucagaauuaagcgauagugacgcugaguugcaacaagcauuauuagaugguaagcugaaaccugguuuaaauaaaaucgaacaggcuccuaagcaauucguaaacaacauaagugguuuaaaucagaaaaucgaagaauucaaauugaaucuaccauggaucgaaaggcuggauuguacgaaugcccaagcccccuuagcgcccgaguuagcggaggagauguuagcucacgaagaaaagagaaguaaucaacugcgaaacaacaaaaaacuuccccaauuccaaccgucggaagauccaguucugaacgauuucaaacgagaacuaauauuccauaggcaagcucaagcuacaauucuggacgcaauuccgaaaaucaaagaauuagggauaucuacuaaaagaccggacgauuauuuugcugaaauggcaaaauccgaugagcaaaugcacaaaaucagagagaacuuaaagcagaagcaggagcagcagaagcggagugaacgggugaagcaauugaggcagcaaaggaaagagggaaaaucgcugcaggugcagcucaaguugcaacgcucuaaggagaagaaagagaugauggaucaagugaagaaagcgagaaaaaauuucgauuuucuggaugagaaaaauaagcccaugggaaagaauaagguggcagaaaggcguaagaugaaggauaaaaaauucgguuuuggugguaagaaaaaggggaugaagaaaaauacaaaggacagugcgggcgauauuagcgaguauagaaauccuggaaaagccaagaaacagaugggaaacaaauucgucaauaaaaacaaaccgaaaaaucaaagaauggguaaaaauaggagaauuaaaacuaaggcuaaaggaaaaaaauaa

SEQ ID NO: 6194 - RNA, 1752 nt, Phyllotreta cruciferae
augaaucccagcgccccaaauuauccuauggcgucucuguacgucggggauuugcauuccgauauuacugaggccaugcuuuuugaaaaguuuucaucggcuggcccaguuuuauccauccgcgucugcagggaucugauaacccgcagaucuuuggguuaugccuacguuaacuuccaacaaccugcugacgcugaacgugcccucgacacuaugaauuucgacuugaucaaaggcaggcccauucguaucauguggucucaacgugacccuucucuacgaaaaucuggaguugguaacguuuucaucaagaacuuggaccgauccaucgauaacaaggccauguacgauacuuuuuccgcguucggcaacauucucagcugcaaaguagcucaagacgagagcggagucagcaagggauacgguuucguucacuucgaaaccgaagaagccgccaauaaguccauugaaaagguaaauggcaugcuguugaacggcaaaaaggucuacguuggccguuucaucccgcgcaaagaaagggaaaaggaauugggcgagaaagccaagcucuucacgaacguuuaugugaaaaauuucggagaggacuuguccgaggaacagcuaagaacgauguucgagaaauacggcaagauaacuagcuacaaaauaaugagcaaggacgaugggaaaucgaaaggguucggauucgucgcauucgagagucccgaggcagccgaaucagcugucgaagcccuaaauggcaaagaaauauuggaaggcaaaccucuguacgucggaagagcccagaagaaggccgaacgccaacaggaauugaagcgucgcuucgaggcucuaaaaauggaaaggcucaaccguuaccaaggcguaaaucuauacgucaaaaacuuggaugauaccauagacgaugaacgccuucgcaaagaauucucaccguucggcaccaucacauccgccaaaguaaugauggaagaaggccgaagcaaaggcuucggcuucguuugcuucuccucgccagaggaggccaccaaggcagugaccgaaaugaacggcagaaucgucggcacgaaaccacucuacgucgcccuggcccaacgcaaggaagaccgcaaggcucacuuaacaucgcaauacaugcaacgcauggccaacaugcgcaugcaccagaugggccaguucauccagccgggcggcuccagcggcuacuucgugcccaccauucaagcgacggcgccccgauucuacgggccggcucagaugccgauucgcacgagcccgagauggccggcgcagacgcccgugcgccccggcgcccaagggagcaccgccaccuacaccggcaugccgaacagcuacagggccgccgccagaccgccgggucaguccacgaugcgcagcaacaucagcgugccgcgacccaucaccggacaacaaccaccaaguaugcacggucguccacuuguuggacaaguguggcugcugccggaaaucgugcagccaacuucaaauacaccgccaacaugcguaauccaccgcaagcguuguuacccggagcucaagcucaaguacagcaagcaguccauauucaagggcaggaaccccuuacugcuaccaugcuggccgcugcuccuccgcaggagcagaaacaaauguugggagaacgauuguucccucucauucaaagaauguauucagauuuggcugguaaaaucaccgguauguugcuggaaauag

SEQ ID NO: 6195 - RNA, 2568 nt, Phyllotreta cruciferae
augaccgacucaaaguauuuuacaaccaccaaaaagggagaaauauucgaauuaaagucagaacucaacaaugauaagaaggagaagaagaaggaagccguuaaaaaggucauugcuuccaugacuguaggcaaagaugucucagcauuauuucccgaugucgugaauugcaugcaaacugacaauuuggagcuuaaaaaauugguuuacuuguauuugaugaacuacgcuaaaucgcagccugauauggcuauuauggcagucaauaccuucguuaaagauugugaagaucccaauccacugauuagagcacuugcuguuagaacaaugggcugcauucgugucgauaaaaucacugaauauuuaugugaaccucuaaggaaaugucugaaagaugaagauccuuaugucagaaaaacugcugcuguuuguguugcuaaauuguaugauauuucgucaggguuaguugaagaucagggauuccucgaacaguuaaaggaauuauuaagcgauucuaauccgaugguaguugcaaaugcuguugcugcuuugucugaaaucaaugaaaguaguccuacaggucaaccccucguugaauuaagcaccaacacaauaaauaagcuucucacugcucuaaacgaaugcaccgaauggggccaaguuuucauacucgauucccugucaaacuacacuccucgagacgagcgggaagcccaaaguauaugcgaaaggaucacuccacgucuagcccacgcuaacgcugcugucguacuaucggccguuaaaguauugaucaaaaugauggagauuuuggcgggcgacacugaauucuguaacacgcuuagcaaaaaauuagcgccacccuuagugacucugcuaagcucagaacccgaggugcaauauguugcauugagaaacauuaacuugaucguccagaaaaagccggacaucuugaaacaugaaaugaagguauuuuuugugaaauacaaugacccgauuuacgucaaacuggagaaacuugacauaaugauucgauuggcuucucaagucaauauagcucaaguucucagcgaacucaaagaauaugcuacugaaguagauguugacuuuguuagaaaagcugugagagcaaucggucguugugccaucaaaguggagccuucugcagaaagaugcgucgcuacgcuguuagacuugauucagaccaaaguuaauuacgucguacaggaggccaucgucgucaucaaagacauauuuagaaaauacccaaauaaauacgaaaguauuauuagcaccuugugcgaaaauuuggauacucuggacgagccagaagccagagcuaguauggucuggauuauaggagaauacgccgagagaaucgauaacgcagaugaguuacuggauaguuucuuggaagguuuuggugacgagaacgcucaaguacaacuacaauugcuaacagccguugugaagcuauucuuaaaacguccacaacauacccaaggcuuaguccaacauguacugaguuuagccacucaagacuccgacaaucccgauuugagagacagagguuucauauauuggagauuguugaguaccgauccggccgcugccaaggaggugguucucgcugauaaaccucuuauuuccgaagaaacggaucucuuagagccgacucuucucgacgagcucaucugccacauaucaucccuggccagcgucuaucacaaaccacccacggcguucguagaaggccgaagugcagguaucagaaagacauugccggcuagacaaggcucugaugacacagccgccgcucccgaaaccacuguuauuccgaaccaagaaagccucauuggugauuugcuuucuauggauauuaacgcuccugcuccagcugcugcugcuccugccgccccucagacuaguaacguugauuuacucggcgguggauuggauguuuuguugggaggagguaaugauauuggggcagcaccugcuagugcugcugcucccaccacuacuggucuucucggggacauauucggcauaccuacugcaccuaccauguacacaccgccgaaaguuaucuggcugccggccgaaaaaggcaagggaauggagaucuacgguacuuucuccagacgaucuggccaaauggccauggaaaugacuauaaccaauaaggcuaugcaggcuaugucggguuucgcgauucaauucaacaagaacaguuucgggaucacgccgagugcgccuaugaacauucccacuuugcaaccgggccaaaaucucgaauacagccugccguugaacacuacggggcccguacaacgcauggauccguuaaugacgcuccagauugccauaaaaaacaacgucgacguguuuuacuaugcuugucaaauacccauucagauauuguucggggaggacgguacucuggauaagaggguguuccuuaccacuuggagggacauuccgggagcuaaugaggucaguauguugguaaauauaaacguuguuugguacggaguuuauaauuuucgagguauuaaaaauguuuaa

SEQ ID NO: 6196 - RNA, 498 nt, Phyllotreta cruciferae
augccgccuaaauucgaucccacugaaguaaaauacguuuacuuaagauguguuggaggagaaguaggagcuacaucaucuuuggcuccgaaaaucgguccccuugguuugucucccaaaaaaauuggugacgauauugccaaaggcacagccgacuggaaagguuugaaaauuacgguccaauugaaaauucaaaaccgucaagccaccaucuccgucguuccaucggcugcuuccuuaaucauuaaggcuuugaaagaaccuccucgugacagaaagaagcagaaaaacauuaaacacaguggaaacauuacauucgaugauguaauuucuauugccaagcaaaugaggcauagaucaauggccaagagccuuucuggaacuauuaaggaagugcugggcacugcucaaucuguagguuguacaauugacggcaaagccccccacgacgucauagaugaagucaaugaggguacuguagaaguuccagaugaguaa

SEQ ID NO: 6197 - RNA, 1095 nt, Phyllotreta cruciferae
augagcgaagaagggaaaagagcguuaauuuuagucgggggcuacggcacaagacugaggccucuaacuuugagccggcccaaaccucuagucgaauucgcgaacaaaccaauccuguuacaucaaauagaagcccuaguagacgccggaguaacggaagucauauuggccgugucguaucgagccaagcaaauggaggaagagcuuacagucgaagcggcuaaacugggcauuucuauaguauuuucgcacgagacugagccuuugggcaccgcaggaccaauagccuuagcuagagaacaccuuucgaaaagcacaaaaccguuuuucguacugaauucggacauaauaugcgacuucccguucagagagcuagagaaguuccacgaaggccacggcaaagaaggcaccauagucgucacaaagguagaagaacccuccaaauacggaguuguaguguacgaucaaaacaacugcaucgagaguuucguggagaaaccccaggaguucauuucgaauaaaaucaacgcuggucuguacauucuaaaccccagcgugauuaacagaauagaacuccggccgacuuccauugaaaaggaaguguucccuuacauggccucugaccagcagcuguacgcuuucgaguugaaaggauucuggauggacgucgggcaaccgaaagauuucuugacuggaaugugcuuguaucuaaaccauuugcgggaaaccaacagccagaaguuguacaaagguccuggaguggucgggagcgugcuggucgaucccacagccaaaauuggcaguaauugccaaauuggacccaauguuacaaucggaccagguguuguaauagaaaaugguguuugcauaaaacgcucgacgauacuaaggggugcaacgguuugcuccaacucuugguuagaaaguugcauugugggguggaagugucacauagguaaaugggugagaauggaaggaaguacuguacuuggagaggauguuauugugaaagaugagacguacauaaacggaggacagguucuuccucauaaaaguaucgcuacgucuguuccagaaccacagauuauuauguag

SEQ ID NO: 6198 - RNA, 867 nt, Phyllotreta cruciferae
auggcgucggaaggugaagaagugauaagugaccaagaaaaaguuaaaauaguuucggauuucauccuccauucgccgccgggcgaguucaacgaagucuucaaugauguaaggaagcuucugaauaacgaugaccuucugaaagaaggaguaaccggggcguucgcccaauacaauaaagaccaacucacccccguuaggauagaaaacgccgaucaaauggugcugauuacagaauacaacgauuuagguaacaauagauucuucgacccccguaguaagcaaaguuucaaauaugaacauuuaagaaaggaagcuucugauuaccagccuuauaguguugauaccgcggcggagcccuggcgggccgcucuagauaacgaguuuauacaauacacgagaaaccauuauaaagacggcguuuguagcguguucgcucgcagccaaaacggcgccaucacccucaccgcuugcaucgaagaccaccaauuccagcccaagaacuucuggaacggucgauggagaucccaguggucuguuaguuuaaccgaugaagccaccgcagaaguacggggaguucucaaagugcaaguccauuauuacgaagaagguaacguucaacuggugagcacuaaagaaaucaaggaaucgauuccgguuucgaacgaagcgcaaacggcuaaggaaaucauccacguaauagaacaggcugagaaucuguaucaaacggcgauuucugagaauuaccagacgaugucugauacgacguuuaaggcucugcgaagacuccugcccgucaccaggacaaaaauggauuggaauaagauuguaucuuauaguaucggaaaagaacuaaaaacacaauga

SEQ ID NO: 6199 - RNA, 3558 nt, Phyllotreta cruciferae
augaacuuucuacuaguuuuaauaaucagugcgguggccgugggggcucaagagggcgucgcgccggacgccgcgggccaggauaacacgggagacguggagagcaucgacgugggugcgucaggaggcgacgaaggggucgauuccaagcccauucccgucgaagaaaacggcgggaguguuacuacuaacauuaauuacgaccccaugacaucagauacagccccccaggacacggaccaaagggguggaggcuugccuuacuccauuaccgaaacuagguuagccgagauuaggaaaaacuuuauguauccguucuucgacaaagggggcaacguggauaacgagggggacuaucagaaggaaauccaauccuccacgccccagguccacaagaaucugaacuuccaauugccuuucuucggauucagguacaauuacacgagaguguccauuaaugguuacuuggaauucagcgauccaccucccaacuuggauuacccauuaguuuuuccuguaaaggacuggccuaaggagaaugauccuucguuuauugguauuuucuacaguaaaugcaaaaucgguaaucuucgcgacgaagacucggacaaaaggaagccagguguguacuucagaauggaaagagaccucagggacaggcaagacaggaugggaguggaaauaagggaaagguugaaaugggacauaagagaaggaguuaucgguucggagaccuucaaucccaaacacgccauaaucguaacguggaagaacguauccuucaauggaggauacgccaacgcaguuuaucagaccaacacauuccaaaugguccucgccacugacgagguauucaccuacgccauguucaacuaccuaaauuuggacuggaccagucacaccgaagccggaggagacacuagaaaaggcgaaggcgguacgccggcauucguuggauucaacgccgguaacggcaccagaagcuuccaguacgcucccuacagucaagcaucggucauucgggacuuaacauccaccggcugggguaacaacaaacccggcaggcacauuuuccgaaucgacgagaacauccugcuggguucuuguaacaaagauaucgauggagcuaacuugccucuucaauuugcuccggagagcggcaauaugcugggaggaacggucgugaacaucacagguccuugcuuccaacccaacgacaggaucagauguaaauucgacguguacgaugaaguuguuggauucgugguggacaggaaucgugcuauuugcauccaaccucgccuuuacuccgaggguugggugaggcugcaaaucgccaucaauucggacgccuucaaauggaagggaaaauacuacgucgaaucgccggccagugccucgcagaagaucuucuucaaagacaugaaguaccacgagaagucgcccagcgagauucgcaucacguggcagaagcagaacuugaccaccaacgaaaaugccaacaucagaauuuccuugugggguuacagggaaaccaccaugaggcccacguucguuuacaucacagaaauagccgauaauguccaaaacaccggggaguacacgaucguaccgucgcaguacagaggcaaaaucaaccaguuccucaccgacauuaaguuuggauuccuccaaauaaauuugaccgaaucgauaaaggucaacauuuacucuaccaacaaccaaaacaucgacaucacaccgauaauauggagcaggccgauuccucuagguugguauuuccaauuccaaugggagaaccaauacggcaaaaauuggcccaaacaacucugcgacgauuggcucagaaccgauagauaucugaaaaacuucgcucacgaauuaccccaauguccuugcacgguccaacaggcucuggcugauaaggggaaauucaugccagacuuugauugcgacaaagauucgaaucccguuuguuauuacaacaaccaagcuuugcauugcgucaaaaccggugcucccacaauggaaggcuccgagcaacaauguugcuacgacaaaaacggcuaccuaaugcuguccuacgaucaacaaugggguuccagcccccgucgaugccacaaccuuggaaaaaugccuuacaacgaagccaccaagguccccacacuaucccaaugguucaacgacaucguacccaaguaccucugcugucuuuggcaggaagagcaagccgugggcugcgaaacgcugcgauucgaaagaaggccuucgcaggacugcgucgccuaucaagcgccggcuguggcaggaguguacggugauccgcacauugucaccuucgaugacguagaguacacguucaacggcaaaggagaguacgccuuggugaaauccuugaagguggacgauaauuuggaaauacaggcuagauucgagcaaauggacaucaaugcuuauggagaggucagagccacgcaacuuacggcaaucguagccaaaggaaacaagaccauuccuauugaagugagaagaagaccguuggaagccagguggagguauagauuagauguuauagccgagaacaggagauuguucuuugauaggccuucguugaaauuccaacauuuccaaggggucacuguuuauacaccaaccuacauucugaaucaaucugaaguacuaauaauguucgacaauggagccggcgucgaagugcuggacaaucaaggguacaugagcgccaggguguacuuaccuuggucguuuauuaacaaaacgguagggcuguucggcaauuggagcuucaacaaagaagacgacuucacgcugccggacggauccaaggcggccguggugagcaacaucaacgacauggagagaguguacaacgauuucgguucaaaauggaugcuggacgacguaggcgacgcgcacaaaggccagucgcuguucuacagggaauucggccgcacgucggccaccuacaacaacaagaccuucaagccgcaguuccugaugcugcccgaggacauccugccgcccaacagguccgagcaaauacagcgcacguacgacgugugcucgaccaagauguacgagugcuacuacgacuacgccaugacgcugaacagggaccuggcgcacuucacgcagaacuacaaggcuaccauuuacgagcugaagcaaaccaccagggagaagaucacguccugcggcgugcuggaaacgccgcgguucggcaggaagaguacguuccuguucgugcccggcacgaaggugaccuacgaaugcauacaagauuucgugcucgucggugauccuagaagagagugcgggggugauggaaaauggaacauaccggauuauggauacacauauuguuugcgucagcaggaauauucccaacgacaagcaggaaucacguccgggauaauaauguuagugcucauaccacucauccugcuauucguguauuuggcguacagguucuuaaagaagaaacagaaagaacgggaggagaacaggcuggagcaagaacaauacagagaacaaucuagg

SEQ ID NO: 6200 - RNA, 342 nt, Phyllotreta cruciferae
augcguuacguggcugcuuacuuauuggccguuuugggcggaaacgcuucccccagcuccgcugaugucgaaaaaauccucggcuccguaggaguagaagcugaagcugaaaaggucaagaaaguccuaggcgaacuuaaaggcaaauccaucgaagaacucaucacuaaaggucgugagaaauugaguucuaugccaguagguggcgcagccccuguagcugccgcugcaguugccgcugccccggcugccgccgaggaaaagaaagaauccaagaaggaagaaaagaaaguugaaucugaaucagaagacgaugacaugggcuuuggucuuuucgacuaa

SEQ ID NO: 6201 - RNA, 2721 nt, Phyllotreta cruciferae
augacugaccguuuuggauuaaaaugggaccccaaaaauuuagaaauaagaaccaugucaguggagaaaacuuuggagccccuuguguugcaaguaacuacccuuguuaacacgaaggggcccagcaaaaagaaaaagggcaagucaaaacgugcuaaugcucuuguuaguacaguagagaaggccacugagaauuucaucgagaaaggugagcaaauugcuuacgagaauccugauauaacggaugagaugauagcugcugucgaagaagucaggaaaacuggcaaugcaaugagcauagcugccagggaauuuucagaagauccuuguuccucuuugaagaggggaaauaugguacgcgcagcuagaaaucuuuugucugcuguaacaagacuucugauucucgcugauaugguugauguucaucuucuauuacaaucgcugcauguagucgaagaugauuuggagaaacuaaaaaaugcuucaagccaaggggaacuucuugacaauauuaaggccuuuggucaaaaugcaaacgaacuuaugaaucaggcugcuaaaagacaacaggaacuaaaagauccucagcuacgugaugauuuggcugccgcuagagcaguacuuaagaaacauuccacaaugcuucuaacagcuucuaaaguuuacguucgucauccggaauuagcugcagcuaaggcuaacagagauuaugugcuaaaacaaguuugcgaagcuguuaauacaauaaacgauguugcgcagggaagaacaccucagcccgcuucugguccuuacgaugguccaggagaacuugcagcugcuuuagaugauuuugaugaucacaugguaauggagccucuggcauacaaugagguucacacgagaccaucguuggaggaacguuuggaaagcauuauuagcggugcugcuuuaauggcugauucgaguugcacuagagaugaaagaagagaacguauuguugcugaauguaaugcugucaggcaagcauugcaggauuuguuaucugaauacaugacaaacaugggcaagaaggauaagagcgaaaaucuuaacagagcuauugacaauaugggaagaaagacccgcgaccuuagaaggcagcucagaaaggccguggucgaccacguuucagauagcuucuuggaaaccaacgugccccucuugguccugaucaaagcagcucaaaacggcaacgaaaaggaaguggaagaauacgccguuguguuuaccgaacauuccaauaagcucguagaaguagccaaccucgucugcagcaugucgaacaacgaagacggcgucaaaaugguucgauacgcugccgcucaaaucgacaaucuauguccugaaguaauaaacgccgcuaggauccuagcggccagaucucgcaguaaaguugcucaagaaaauauggaagcuuucaaacaaucaugggaaaaccaagugcgcaucuugaccgaagccguugacgauaucacaacuaucgacgacuuuuuggccguguccgaaaaucacauucuggaagacguuaacaaaugcguacuagcucuucaagaaggcgaugcugauacauuggaucguacugcuagcggcauaaagggcagaucaaacagaguaugcaauguuguaacagccgaaauggauaauuacgagccuugcauuuacacuaaacgcguuuuggaggccgugaaaguuuugaacgaucaagugaugcccaaguuuacccaaagaguacagguggcuguacaggcuuugggcaacaguccgccuaaagaaguggacgaaaacgauuucaucgacgcaucgagauugguuuacgacggugucagagaaauaagaagagcuguacucaugaacagagccgacgaagauuuggaucccgaagacgucgaacucgaugaaaauuauuugauugagaccagaagcaaaucgagugcucauacuggugaacauggcguugaugaauauccugacaucaguggaauuacaaccgcucgggaagcuauggguaagaugccugaagaggauaagcaaaaaauauugcagcaaguggaguuuuucaagagcgagaagcucaaguucgaucgcgaagucgccaaaugggaugauaccggcaacgauaucaucguauuggcuaaacacaugugcaugauuaugauggaaaugacagauuuuacuaggggaaaagguccucugaaaacuaccauggacgucauaaaugcagccaagaaaauuucagaagcgggcacuaaauuagacaaguuaaccagacaaauugccgaacaguguccggaaaguucaacgaagaaagacuuacucgccuauuuacagcguaucgcucuuuacugccaucagaugaauaucacuucuaagguuaaagcggacguccagaauaucagcggagaauugauuguuucuggucucgacagugcuacaucuuugauacaagcugccaaaaauuugaugaacgcuguuguucugacggugaaagcuucauacgucgcgucuacuaaguauccuagacaaggaacuguagcuucuccgauuguuguauggaagaugaaggcuccagaaaagaaaccucuuguaagacccgagaaaccugaagaaguucgugccaaagugcgcaaaggcucacaaaagaaagugcaaaauccaauacacgcuuuaucugaauuucaaagccccacggagucuguguaa

SEQ ID NO: 6202 - RNA, 1221 nt, Phyllotreta cruciferae
augucguucaauuucggaaauacuggcacuccaaaaacagccgcuacaggcuuuacauuaccgccaaauccggccacuacuagugcaacaggauuacaguuuaauuuuggaggaggagacacuaaaacugaaguuaaaccaucaucuacauuauuuccugcagccacaaguacaccaccagcuuucgggauuaccccaaaaccugcaacaccugcgucagcugcaccaucguuuaauuuugguacaccuacaacccaacagacaacagcauccgcuuuuggaacugcaacaccagccucauucaguacuccaacaucuucucuccaauuuggacuaaccacuacuaaaccagaaacaucagcaggauuauuuggaucaacugcagcugcaacgccuauuucagcaucaacuggacuuaguuuuggaacagcgguuucuacaacaucuucagccaccacagcugcuacuggaacuccccuuuuuggaguugcuccaaccucaagcacuacuacaauagccaguguaccugcuuuagguuuaucgacuacaguuucugccgcugcuucaacaacuccuucgacuucauuaaguacuacaacagcacccccagcuuacucaacaucgacacuuccuucuagugguucauuaacauuuagucaacuagaagauucuauuaacaaauggaccauugauuuggaagaacagggcaaguuuuucauuaaucaagcgaaacagcuuaaugcuugggauucguuacuuauuucaaauggcgagaaaauucucaaucugaaugguaguaucgagagaguuaagcagcagcaacagcaauuggaucaagaacucgauuuugucuuggcgcagcagaaggaauuagaagaguuaauaacaccucuggaaaaggaauuauuggaaauucccguaacagacauagaucgaaaucaaauguaucaauuuucggaaauaaucgauucgcaauuaaagcaaaugucugaugauuugaaagaaauuauugagcauauuaaugaaucuaauaaaagcgaagaaauuucaaauccuuugacccaaauuagccgcauaaugaaugcccacaugaauucccuucagugguuagacagaaauacagcacaaauuguuucucaucuggaacaaaucaguaaaaugcaggacuccaacagaagaaauuuuccucugaaucauucauucaauaauucacuccuuuaa

SEQ ID NO: 6203 - RNA, 582 nt, Phyllotreta cruciferae
auguucauaugggauugguucacgggagugcugggcuaccuaggauuauggaagaaguccgggaaauugcuguuuuuagggcuggauaacgcugguaaaaccaccuuauuacacaugcuuaaagacgauagauuagcccagcacuugcccacguuacaucccacuucugaagaacuguccaucgggaacaugagguuuaccacguucgaucuaggaggccauucgcaggcucgaagaguauggaaggacuacuucccagccguagacgccauuguauuccuuaucgacgcuaacgacagaucucgauucggagaaagcaaacgggagcucgacgcgcuguugacagacgaaacccuggccaacugccccgugcugauucuaggcaauaaaaucgauuuacccgacgcggcgucugaggaugaguugagaaacguuuacucguuguacggccaaacgaccgguaaagguaaagucgcucgaucggaucugccggggagaccguuggagcuguuuaugugcucgauucugaagaggcagggcuacggggaggguuuucguuggcuggcgcaguacauugauuag

SEQ ID NO: 6204 - RNA, 564 nt, Phyllotreta cruciferae
auggacccgaucgccgugcuggagaagcgcaucgaagcccucgagcugcagguguucccccucggggacuacgcucaaaucuccaacaaaacgcaaaccaucaccaaccugcugguggagacgcaaaccaugaucaacucggcgcugaccugccgcgaguccaucacuuccaugcugcagcaccugguggucaucaacgacuaccucaacccggccagcgaggccgacgagcuggagguggaggccaagcggcaguaccugcucgagcucuaccccgaauugaaggacaccauacagacggugagcacgcuggagucgcuguugccguucaucgauucgaucaacauaucgaaggugguggaguucucugggaagcuggaggagguggccguggggaaucuuaaguuguacggggagugcagggauaucaccaagaagguguugguggcguugcagcaguacaacgacauauccaauucgauuaaguuguuguuuucgcagcuggauacggccguuacgaauuuagaguacgcuuugcagcugcgagacgcgaacgaggaauag

SEQ ID NO: 6205 - RNA, 1752 nt, Phyllotreta cruciferae
augaacaacgcuaaauuccaagaaguguacagugaccuaacgcucuacaccacuccagacaaauucuucaucgagccgaaggcuggcgaggaauuaaugguaauagagcgaaauuccgaaaauauaauaugcuucaaaagcgaccacagacaccugauaccagcagcgaacagccggaaggauuucuguggguuaauagguauaauccaacuguuagcuugucccuaucuaguaguagcaguucaaagggaauuggucgguuacauagcaggcugcgccgucuggcgucucgccaaagccgaauuaauucccuauagaagcuccgcgcacuuaacgcccgaaaaacaagccgacaacgaugucuauuuguccauggucuacuccguacuauccacuccauuucuauacuuuucguacgacuacgaucuuacgcauuccuugcagcgccugcacggcauaagccccgauuucuggaagcaauccuuguucgagcgggccgaucagcgguucgucuggaacggaaaccuguuguauucguucaaaggauucuccauacaccgguucugcuugccgcucaugcacggauucguuucgauaaacuucugcguggugaacggccacaguuugaacuggucgauugucaguagaagaagcgugcaaagagcaggcacccgauugcaccgaagaggguuggauaaggaaggaaacgucgccaauuucguggaaaccgagcagaucaucgaauaccaaggggauagggcgagcuucgugcaaauacgaggcagcauuccgcuguucuggcaacaagacccugacuuacgauacaaaccaccgccuacucugcucgaugucgauccgcaggaucagcacucgaugugccugaagcacaugaacgaucuaaugacuuucuacgggaagaucguuugcguuaaucuagucgaucagaaaggagccgaagggaacauggaaguggcguucaagaaugcgauaaacaacguaucgucgccaucggugaaguacgaaucguucgauuuccacgccgagugcagcaaaaugagaugggacagacugucgauucucaucgaucgauuggcgcacgaucaagacgagaugaguuucuuucuguugcugagagacggcucguugaguucccuucaagacggcguauuuagaacgaauugcaucgauugcuuggaccgcacgaacgucgugcaaagcaugcuggcccaucggaaucuggaaagcgugcucagaaaauugcagauucuccaucagaaccaaacguuggaguuccaguauucguuugagguguuguuuaagaacguuugggcggauaaugcggauauaauaaguacccaguauucggguacuggugcuuugaagacggauuucacgaggacugggaaacguacgcgguacgguuuacuucaggaugguaugaauucgaugacgagguacuacaagaauaauuucgcugaugggaugcgacaggacgccaucgaucuguuuuuagguaacgguaaaccccuuucgccauugcauaucgauaaaggauggaaguacgugacguauccgucgauucugcugaucgcgguggcuauguuuguggcuugugcugucacuccuucugaguauucgacagauucauugcuguuucucuuguucugggguuccauggucuaugcgacuuugcacacuauuuugaaguacgguucggaguuugucgauaaaccuagacucacccauucuuag

SEQ ID NO: 6206 - RNA, 783 nt, Phyllotreta cruciferae
guauuaacagaacacgauuuaggcguaagcauagaccucaucaacaaagauauauacgcaaucggagcaggcgccgccuuggacccggccgacgagaaacuccuagaagaagacauccucacuccucaagacucuaagagaucccgccaccaugccaaauccgucucguggcuucgacgaaccgaauacaucuccacggaacagaccagauuccagccccaaacuauggacaaagucgaagccaaagugggcuacagcaucaagaagucccugaacaacgaaacccuuuacauggacagggacucgcaaaucaaggcuaucgagaaaacguucgaagauaccaaaacgaucaucgauaagcauuacagcaagccuaauguagucccuguggauguuuugccaguuuauccagauuucaguuuguggaaauauccuugugcccaggucauuuucgauucggauccggcuccaguuggcaaacaaguaccggcucaaaucgaggagaugucucaagcuaugauucgggguguaauggacgaaagcggugaacaauucguagccuacuuccuccccacggaggaaacccuccaaaaacgcagggaagacguggccaaucaaguccaauaucaagacgaagaggaguacgaauacaaaauggccagagaguacaauuggaacguuaagagcaaggcuaguaaaggcuacgaggaaaauuacuuuaccggcucaaaucgaggagaugucucaagcuaugauucgggguguaauggacgaaagcgguga

SEQ ID NO: 6207 - RNA, 1170 nt, Phyllotreta cruciferae
augccgauugaaaauuuggaagaucaagguuuagaaaagaacccagaccuagagcuagcucacuacaaauuucuccugacgcuccccgaauaucgcagcgaccgcaauguccauucgaagaucacagaagccaucaagaaggacgauauggcuccaugguacgaacuccucugcaaagaagucggcuggaaguuagacgcugccuugcugaaggcccucaaagccaagaacuccgaaaaggucaagcuucuggacgaagccaucgaagacgcggagaagaacuugggggagauggaggugcgggaggcuuauuugcguaaagcggaguuuuacagcagaaucggcgacaaagaaaacgccgugaccacuuucaggcagacuuacgauaaaacaguaucuuugggccaccguuuggacaucauuuuccacuuaauuagaauaggcuuguucuucauggaccacgaccuuaucacuagaaauaucgacaaagcgaagacccuaaucgaagagggaggcgauugggacaggagaaaccgauuaaaagucuaccaaggugcuuauuguauguccgugagagacuucaaaaccgccgcuaaccuguuuuuggacaccgugagcaccuucacauccuacgagcucauggacuacaaggcuuucgucagauacaccgucuacacuuccauaaucagccugccgagaaaccaacuuagagauaaaguaauaaaaggcucugagauacuggaggugcuucauucugaaccguucguuaaagauuaccuguuuucuuuauauaacugccaguacgcggaguucuucucgaauuuggcugaggucgagacgaucuugaggaaagauuacuuccugaauccccauuaccgguauuacguuagggagaugaagauuucggcuuacacgcaacugcuggaguccuaucgaucucuuacguugcaauauauggccgaagcuuucgggguuacuaucgaguacaucgaugaggaguugucgacuuucaucgccgcuggaaggcugcauuguaaaaucgaucgggugggaggaaucguggcgacgaacagaccggauuugaaaaaugcucaguucaauuccguggugaaacaaggggauuuguugcuuaaucgaguucagaaacucuccagaguuauuaauauuuag

SEQ ID NO: 6208 - RNA, 14307 nt, Phyllotreta cruciferae
augcucaccacugcaucuccauguuuaacuugcggcucuauuggagauauagcgaauuugauguuuuguucggguugcggugcgcauuaccauggaauuugcgugggauuagcucaguugccagguguuagauccggauggcaauguaggaaaugccgguguugccaagugugccgagucgucggagacgaaucuaagcugaugacuugcgaacaaugcgauaaaauuuaccacgcuaguugucaaagaccuguagugacuucgauaccgaaauacgguuggaaguguagauguuguagggugugcggggauugcggugcaaggacucccggggcugguuuaucuucaagauggcacgcucacuauacaguaugcgauucuugcuaccaacaaaggaauaaaggguuuucuugcccuauuugccauaaagccuaccgcgcucacgcucauagagaaaugguucaguguucgagcugcaaaaaguuuguucauggaaccugugauccagaagcagacguuguuaccuacaaucaaaagaaagaaauaagcauagacuaugaauacguuugcuugcauugcaaaaauagcacagcuagacaaauaacagcaaaaagagcaaguauugaugauccuuccgauguauccgcuucacacgauucucuauacgaugauacguccgaauucgaucuuccuucgcccgacgaguuugccaggaacauggguuuggguaaagggaaaccguacagcgcgaauaaaauagccaagaagcgccuuaguuucacagugaauccggugggcaggccgaaagguaccggaaaagugccgcccgggaaaaugggguacaugaaacgcuaccgacuaacugaguucaauagaaaacguggcccgaaagccaaaaugaggggcauuuucggcgugcccggcgucggucugcaaagaccgauuucggaugggaaaaccgacgaagaaccgggcguugaaaaucgauugguauuguguucagcuaaagacaaauucacccuaacucaagauaucugcguaaugugcggggccuucggcaccgaucaagagggauguuugaucagcugcguacaaugcggacaauguuaccaccccuauugcaucaacguuaaaguuacuaaagugauuuuacagaaaggauggagaugcuuagacugcacgguuugcgaaggcugcggccaacgcaacgacgaaggccgucucauauuaugcgacgauugcgacguaucguuucacaucuacugcauggacccgccgcucgacuacgugccgcacggcaacuggaagugcaaauggugcgccaucugccaauccugcggcaccaccgauccggguuucaauugcacguggaugaacagcucgacgcaaugcggcccgugcgccucgcacgugaacugccccagcugcaacgagcccuacggcgagggcgaucugaucauacagugcgugcagugcgagcgcuggcugcacggcgccugcgauuucaucaagugcgaagaggacgccgagaagugcgccgaagaggguuacaauuguauacugugcaggccgagggacgugccgccgccgcauauggugccggcggcggucacgccgaagccgcccacucccacgaagagucccgaguuggggaagaguacgagcuauuacauggacggcgugugucucagcgaauucgguagcaacuugaucaaaucguuggcucucgaguaccacgggucgaggaagaagcggaaaaagauacccacuguucaagauaaggaagccgguauuauggcuacgauugaaucggugguugccggugguaauguuauuccuacuaauauggaagacagcgcuaaauuggagcuagucgacaucaaagacgaaccucaagaauuauauaaggaaggcaugauguggacuaaagaagacgguccaccacccgaagguuuuacgauaaucacgauggagaacgguuugaacgugcugcgaaggaagaggcaacgcaaucugcagaagcucgguauuggaggauucguggucaggaugagagguaucagaacaggucaggauaaugaugauguugauucguccauuggucaaagugggcucaacgccaacgacauugucccaucgccugcggacggggacaaaccuagaaggaaaacuauucgucgaaagccgaagaguaaauuagcagaaacguuuccagcuuaucuccaggaggcuuuuuucgggaaagaccuuauggauacggucgauuguaaaaaggaagaagucgauuguuauaguagcgacgaugagaaaacugacaagcauuuuaaauccauuaauuuaucucaagacgaaauaauagcaaucguggcaucagguaaaaccgagaaauuggaaaacaauaacaaagauucgaccaaagaagucaaaccgacuguauugaaggaggaagaagaagauaauccggaggauuugaaagauguucuugccuugccgggcgacuuacucgauacugauuuggucaauaguauuauggaagaugaggaggaacugagcaaaacuacagccucucuuguugcauuagauucgaauuuacagcacgauacggaacugacggacacuuugaguaguucaggaaauucaaaagaaaccaaagaugaauugagcgacauuuuaggcccucauuucaaccucgauuccauaccgaacauaaacagcaaggaugucgaagacauauuuaagggcguauuaacagacgaaucgcaagaaucccaagagagcaguagcuuuuccuugcaaggaaauaauauguuuucgaguaauaaugcgcaacagaacguugcccaacaccccauuauuaaucaagcggugagaccgaaaacuuugccuacuguuaaucacaauuugaauuccccuguuaguuuuccaccacccucaccauaccacucggaauacagcaacaguccucaguuuaguccugcguucaccgauucguccuguucguggguaggaggaaacgaaacgccggaaaucgauaguaccaacgugacggucacaucaacguacaaucagagaucaucugauaaaaugaaagcugaugagaguuugggcaaaagcgcuacgauuucggccguuuuguaugcgaacaucaaccaucccgaauggaagaaggaguauccgaauuggcccgauagguauaagcaaauaauaaagaaauggagaacguugagccaagaacagaaagcgccguuuuugcaacacgcuagagauaauaggagucaguugaggaugaagaaagcgcagcagucacagaccgucaaggaaaccgccucaaccgccacgucccccaaugcgaccaagccucugcaccaagccgguccagccuuagugacaacucuccaggcgguaacgcaacagccggcgggggcggccgcggcccccgcgccgcccguuucagaggaccaagaaaagaucgcccugcaacagaaauccgccagggaagccgaacaggagagacaauggaagcaauugcaggcccucaggcagcagcaaacccaacaaacgcagaacauucuacacgaacagcgcguucaagcgaucgcacguguacaacgucagauuucaacugauccagcgcagcaguucauaaacgagcaacagagcccucugcaggugaacacgccucaggaauugagcccgucaaccacgccggcucccaguccuaggccauuccugggcauuaaaucgcccacguuccccguaccuucgcccguuccgcaaacgggcgucagggccaacacgcccucgcaaucgccccacgauaucucccaacccagcacgcccgacgguaacgaucacuuuauccacucccccacgaauccuaaaccuaauuuccaaccuagauugcccaaugauccguucgccgcgcaacccgccacgccgcgaccgcaauucggaauggcccggccacccuugcagaauuucggcgguacgguucgcaacgagcaacaggacaucaacaucaaucgccaauugagggagcuguugcagcggcagcagguuaaaaaacuggacgaauuguugccuggaaaagcgccaccucaaaggcuguggcacgcgaaugaucagcaagaggccggcgacgccucgaugacgucggcugugcagggcgccggugcccaaggaaccgacgccaccuucaggcagccucuaccgccugguguagugaaaccuagguuggcgauuucgucggugaauaggccgauauugggcacgguuagagucaaccaauuggaucccaggauacaaaauuuggauccgaggaugagguugauuuugcaacaucagcaacaaagacuggccaccgguauucagcagcaauucauccguuucacaucgaacgugcgcccgacgacgguggagcaguacgagcaauuguugcaacgucaggguaauaaucagaaucaaauucacgcggaggaacaacagcagggcguugcucgaauacccauagcccaggccagcguuauacaaaggccgcacguggcucaagcggugguuacuggcgccgccgcugugacaaccaguaccacagaaaguaauuccagcgaggagggaauccccgauaauguaacugccgaauuggagaaacuugaacaggaaacaggcacuaugguggagcuucaaggcguaagcgauauuuuaggagguuuggacgaugacgaugagcuuuuggccgaaaugggcgcugauuuuaacauacucgaauacgcggaucccgaauuggaggcccuaacgggcgguaaaacgaauauuuuggaccuggagcucgaggaggaaccggucaaaaaagaaaaacuagccucuaacgcgaacacuugcgcuccuucucagaaaccgacuccuaacguugcuacuacagcuauuagcaacaguaccucugugacuacaccgaccgaagcuaaugcagaaccuaaaaucgagaauacaauucagcagagcauuccgaaaucgacgccacaacagcuacaacaucccguuucucuuccacagcagcagaacauuccccagcacggagcccaaguucaagugcaaucgcagcaaucccagccgcauccgccgcagcaaaugcccauccaaucgacgcugcauauucagcaaauucaccagcaaauggugcaucaaguucagcaagccgcagcacaaggaaggccgaugccuccggguucgaagaugcaaaccacagauggauucguugguguugugauggcgaacaacgccguacaauuacagauaccuccgaauuaucaacaacgguugcuucuguugcaacaacugcaaaaucaaaaauugaugcgagugggaagcacacagccuagagcugcuuugcaaguggccccuaaucaaaugcccguagguaugaauccgggagcuaggaugccgguaucggcgccgccgccgccuccgccgccuuaucccgggccgcccccgcccuauccgggcaacgcgaaucaacaucagcaggaacaaccgcugcuguuggaagaucugcucgagcaggagaaacgcgaacaggagaagcugcaaaaccagccgcccaaccacgaagucaccucguccaccggcaacgaaacggaaucagcuuugcugagcgaccaggacuucgagcgccucaaagccgauguguuuaacagcgccccagugaguaacauaucuucuacgaaucaagggaacgccgcccaaacgccgcaagcguggccccagcugcagaauaggcaagcggugguuccggccgccgcuucgcagcacacgauggaagugacuacuagaguucaaauguauaauccuaauuugauaccggcgccgccgcucccgcccgagaauaucgcuacggagcaggacaagcaggcgcagcuguuguacgagcaguggcugaaccaccagaacaacucgcucgugcagcaauugcgcuauuaugagaccgaagugcagaagcuucguaagaguaaaaagucgcuaaauaguaagcaacggcaauugaggaaagcugguaaccaguuaaccgacgcagaugcgacugagcuucaaagaauuacugcggaacaggcuauauuacagaaacauuuggaaucgagcaggaaacaaaaucggcaacauggaauguugauacaggaauaucgaaacaagcaucccgccaucaagcagagaaccguaacggaccagauccaaucgccguugggccauccggccucgucgcccauacagcaaucgagcgccucguugucgcccaugcugucgcccuccgugucgccgaugacccagaacagcucgccuuugaacagccccgggccgauggugccuucgucgcccggccacagcgccgugcagaauauuuugcaaagccccaacggcgccaaugcggcucaaaugucgcccaugcaggcguccccgaugcaaucuucgccgagaaucgguacuccucauucucaaagugaugaaagucccggaucggcgcaaucgccgucgcaggucugccugccgccgccuaugccuagaaugacgucgccucagcacagacgagucgucaccaguccggugggaaugucgcaaaugcguuuuauaaacaacaacauguugcagcaacgcguucgcaugcagucuccuauacagaauuuccaacagaaacccggcacgccuucgccguugaacagcccgacgucgcagcaaaugaacgucaaccagcaacaucaaauccagaaacagcuacaacaacagcagcagcagcagcaacaacagacguuguugcagcaaaauuuggaaggcgauccaaacgccauucacucgcagaggaccacgcaauuguugcagcaccggaauuucaucaggcagcaggugucccagcagcaaauaucgccucaaacguuaaccccgcaacagcaucaguugaugcugcaacagcaaaagcagcuggcccagcaacaacaacagcagaucgcccaaaugaacgccgcgagauugcaacaacaacagcaacagcagcagcagcaacaacaacagaauaacccgccgcauucgccgaugccgcccaaaagucccaugaucaaccagcagaucaugucgccgcauucgaugccccaaucgcccaugcagaugccgccgaagagucccauggugccguucaaucccaaccaaacgaaucccaauucgccugcggcuaggagcccggcuuuccaucaggguaugaaccaaccgacgagucccaucacacacggccaucaaccucccaguucaccgaugccuaggagucccaugaucaaucaaacgcacucuccgcauaacguucgaaggccucccagcgccaacagcagcccggccaugccugauaggccgcacagcguagagaauucaucgccuaggauguacucgauagaucaauuggugcaggagaguuuggccaaucaaaauguaaacgcgcaguauaacaguuacaauucggauaugaucaacgaaagcgguggagggaauucgaauaaccccauaccauguccaccggaaauaccgagauuucgcuauuuuaagcucgguuugagaggcggagcgccuauguggagcuuuggaagaggcgccaaaagaaucccagcgccuccgaacgccaaaccggacgaacccaaggcgaagaaggagucgcauuugagcaaaguuucgauacuaaaaaggaaacccccgaucgcuucuaucgguaaagugggcucguugguuaguucggauuacaacgauuuggacgacaguucaacaacgccuccuguaacaccaccguuggcuucgaccagcagaggaagucugucgaagaagaagaaucucgaacugcaagcccagaaggauucggugaucgucaugcacagucccgaggauaauaacaaacagcucgaaauaauggauuacgaugacgauaauaacacgguucuaucaucagaagugucguugaguucuguagcaagaaacgacgacgacuugguggagaucgaaacgauaucgcaagaccucgccgaagggcuauccagcccguuggaauccgaucaaauaggcgacgaauuccuguuguuucccggcaauauggugguggauauguccggugaagagcauuacucggaaaaggaggaagaggaaaccguugaugaggaguauaccgaucagaauaugcacauagugauacgcagcccgaccaccagcgacgacgaguucauaaugccuugcaaagugaagcaguacaacgaggacgagcaggaggauaaccccgaaucgcccgaucaggaggaauucggcgaauccuccgauaugauggcgaguuacgauaacgaagacacggauauaaucauuucagaucaaaccaccggcguucccgaggacucgaucuccacuaaggaagacuucgaggagcucaucgacgaggggucgcggaaaaacaacaucagcaagcaagaggugaccgcgaaacacauucaagauuuccacagguacaccgaauuguucgauuacggcaaaccugaugcccaaccgguuaagaaaccagucgccaaaaaauuccaaccgaaagucucucuaguuagaggaguagcuuugcccaguaagcccaacaccgagaagauuaucaucacgcaaaauucgaacguguugaauacuucacaggcuucgaaagucaccagcaucauuuuaacccacaacgcaaauguuagaaggaacauuauaagcguaccgaaaauagugaguaccguuucaccggcuauaacuauagugagcgccaguaccucgcaaauggccucuauauuaccaucuaaauucaccgugccgguuauaagcgccagugcgguacgccagcuauccaacgucaaagucaucgacaaaccauccacuucuucguugucgauuucuaccagagacaacguccugccgaagaagauauucgaggacgauucggugucgccggacaguucgaauugcgacgacgagaaauccaaagauucauucgacgauaaagucaagucggagucuccgccgcgggaggucaaacaguucgugaaaucggaucagcaggucauaucgcugaaaucgaagaacuacuccgaucaaucgaagaagaucgagcaucugcaaauagugaauauaucugcgaaggaugugguucaaaggcagaggauaccgaguccuuugauaucgaaagcuucuccgguuaucauucacaauacgccagaguugaaaaugacugcgcaaguuauucaagagagccaaacccgcaugaaaauuacuacuacuacugauacagaacauuacgaugagucugcggaugauacgaagucaguugugauuucaauuccgucuccuacaccuucgcaagaacagaugcuugauaguauagcuuuccaggcgcuugaaaauagaaggagagaauacgauucuaucgaagauguauuagauaugauugagaauauagaaaacaucaccgccgaaccgcccgagauauuagaagaaaacacguugcaaaauuccgauuccaacagcaacaucgaaaccaaaaccaccgaaaccaaggaguugaaauugccuaccagcgaaagcgaagcgcccgcuaccaaaucauccaucguaccgcaauuaucgccucuuucccaacccacggaauugacuacaaacauggccaacgccucgcagcagcucagaacucugcuauccucgcugcaaaccaccucgacgucguccccgaccaacguggaguccauagccaagggcuucggccagaaaaugagcaccuccucgucggcuaaccagcccauagucgccucgcgggugaucggccaacaagccggcaggcaaucgccaguuaucaccagcgucuccaccgucauaguuccgaauuucaagcaaaaaaucaccgccgcaacgaccgccgccucccggagcagccccgugaagguggucagcaccucgcagcaauuaaccggauccauaauaaccucgacuuugaauuacauaccgaacagaacgaucgguauacagaugguggcggaucaaucgaaacugccgccggccagcaucgugacgacgaugcagcaaaucaacucgaucaccuccagccaggagucgaagaagccuucguugacucucacggcgaugcugcaaaaccagcccgcugcgaauaugaugacuaaaucaucagccgauacuaucacggcugcuaguuugcuaggcucgcccaucagccugcccaaaaccggguucaccacgucuuuggugcaagcccaaccgagcguggugcugucuaacacaccgccagcgccuagccaaacuuccacggcgacaucuucuacgaaaaccaccgcggauucgaucacggccgcuaguuuauugggcaguucuauuaaaacuagcuuugcaaugcaaccgaguagcaccguaggaguggugacgagcugcgucaacaagacgccuacuuccacuacuaaucugcuccacacgcaguugacgaaagucgugagaagcaaauccgucgacgauguuaaagaauuggccaaaaucgacgagaacaaacaaagcguuagcagcgaaauuguagaugauaguaacagcggguguaaaucaucaacgauaacuacgguagccuguaacaaaacugaagauucgcagaauguguuacucaagaaauugcugcagaauacagcuugcgccagcgcccaauccuccccgccggcuucuacuaguacuguuacaaccagcgcugcuaauacuauaucuaaagugguuaacacgcaguguaguacuagcgcuagcguggagcaaccgccgguaagcgcuccuucgaacguuacaguccaaagaagcgccagcagagacgagcuacuaucaccgccacaagacguccaaacuaugguagugauuaaaaaagaaccgccguuaguaccgcugucccaaccgagcccagugcugaacucgaacuccaacgcucacacgcccgaagugaagaaagaauucaucgacgaaucgucgcagcacuccgaaguauccgaucacagcagaucggacgccccuauuaaagaggaacuggaaaccauggagagcgccgccgagaagaugaugcucgacaaggaggagcugaagaagcagaagcgccgcauguaccagcagaagcgccgccagaaccagauccucaacaaggagcuggcgcagcagcagccgaagaagcggccgcgcaagaauucgaagaucgacgaggacuacgacacguacaucgacggcgugcuggcgcagcugcgccagcugccgcccaucgccgucuccgagccggugcugaaccgcaacuucggcguggugccgcuguucgggugcggcgaucuggccaagaucggcgccaaggauuacucgacgcaccugggggaguugacggggaacuacggcuacggcgagcugcccggcuucaccgauuucuacucgacgaagcccuacggggauauggauccgcugccggagaagccgccgucgucgacgcagcgcggcuucuacgaccaggaguucccgcugauuagauucgaugcggacgagcacaagaaguuugacguguuuugcagggaggauucgcccgauucgauauugagcagcucgucgccggaauguacgcgcgaacccgaaggcaaauucgucggguugaagcucaucagcgacagcgaagaggacgaagaagaugaugccaaagauucugucucgaaaggaagaaugucaccagugguacccgucaucaagccuguuccuauuagacugaaacccgccggcgaauuguacuucaaagagaaccucaacgagaacaaggagaacaucaacagcgacucggugcacguaaugacgaaauccaaauucgacaacaagcagucuccaccgucgaacguuuccggccacguuacaguaaccuuaacucuaacaucaucugcggcugaagauauaaugggaguguugcgggauuuggcgaauauucugcacauacccgcuccgacuaguuaccaaaucguggagagaacggcgucuccgcccagccagaaauugggcuuguaccgcaccaaaggcaaggacggcaaagaaggggcucccaucgacauacagagcauccucaacggcgccaccaaguucugcaagcacugcgacgugaucaucuugagcaacaucaucaggcggaagguguccgauuuaccguuccucgcuaaagauucggauuugcucagcgacggggaagaauuguucuuuugcaguuccgcuuguuacaugcaguucgcuuugaugcaccggucgccuucgauauccgaagauaaggcugcugaaauuauaaaucaccuaucgcagaaagacaauuuggauucgaagcagaaauugcccgcagacgcguuagauagcaauaaaucgauagcgcagaaguuaucguuuaacaucaaagaugcgaaacgggaauucgagccgauggagacgaacgaugcguuugcguuuuucgcucguaccaccgccaauaaacaagggaacaacuucuacgauggggcgccauucaaaucggucccugcuaggguacacaggaacgauagguacaaacucuggacgcccgguugccuccaacccacccagaaacacaaaacucccaccgacaaggagaucauggagcugcucuacaggaugcagaucaccguuacaccucccguuaugcccgaagauacgaggaaguguuuguucugccacgguauuggugauggcguggccgacggaccggcgagacugcucaacuucgacguggauaaaugggugcaccugaacugcggccuguggucggacgguguauacgaaaccgugaacggggcuuuaaugaacgucgaaagcgcccuacaguccggguuguuagccacuugcgugcauugccaaagcaucggggccaccaucaagugcuucaagacgagaugcucgagcauauaccacuugaauugcgccgucaaagacaauugcguguuuuacaaaaacaagacgguguuuugcaaaguccacgcgccgaagaacgaaaaagacaacgaacucaccacccucuccgugucucguagagucuacaucgaacgagacgagaacaaacaaguagccgcuguuaugcaccauuccgauucuacagauuuacugagaguaggcaguuugauauuccugagcgugggucaacugcucccgcaccagcugcagaauuuccauacaccgaaccacaucuaucccaucggcuacaagaucaucagguucuacuggagcaugaggaacuugaacaagcgcugcaaguacauuugcaccauucgagaagugucgggcaaaccggaguuucgggugauggugcaagagccacccgaagcggacguggaguucuccgauugcacuccgaaaggcgccuggcagaagauucuggacaacgucgcuagcauccguaaagagaauaauuguuugcacauguucccgaaauucgcuacaggugaagauuuguuugguuuaacggaacccgcuauaguuagaguguuagaaagcaugccgggcaucgaaacguugucggauuauaaauucaaauacggccggaacccuuuguuggagcuaccgcucgcuauaaacccuucaggaucagccaggacugagccgagauugaggagccaguugcauuggaagaaagcgcauacacagagaacuacuggugguacuucguccauucgaccaauguucgggccgucuuuaacaggaucuauuaguacuccagcucaaggggagaucgccuguccuuauagcaagcaauuugugcauucgaagaguucgcaguacaagaaaaugaagcaggaauggaggaauaacguuuauuuggcgaggucgaaaauacaagggcuggguuuguacgcugcuagggauuuggagaaacacaccaugguuaucgaguacauaggagaaauuauuagauccgaacuggcugagugcagagagaagcaauacgaagcgagaaaucgaggaauauacauguuuagacuggaugaagaacgcgugguugaugcuacuuuauguggcgguuuggcuagauauaucaaucacucguguaauccgaauugcguggccgagaccguggaaguugauagggauauucgaauaauuauauuuuccaaacggagaauuuuacgaggagaagaguuggcauacgauuacaaauucgauauagaagacgaucagaacaaaauauccuguaugugcggagcuccgaauugucgcaaguggaugaauuaa

SEQ ID NO: 6209 - RNA, 4044 nt, Phyllotreta cruciferae
auguuuucaaccaugccggcuaaacagaaaacagcagcgaaaguugaugaugaugaaaugcuaucggaaauauuaggugaaaucgauucugauacagcaaauacaucggcuaucaagaaaccuaaaauuagcaauuacucugcucuggccacuaacuugucgguuaagaauuacaugagaaauuugucccaaccgguuaaaaaacgggcuaucgaaaaaaaaguacaacccaguguacccaaaccaguaaucaauuuaaauaaaaaacuaccugaaccaauucaaauucaagauaccaaaaacgaaacgauugagccucaugagcauaucgauaaagaaaaggcugaugcagauacaucauauuuugaugaugauuuggaugaaacucuacuagaagaauucagcgaagaucuagauaaaaccgccacugaaucccaaauaacggaauccgaaacgaaaguagacgauuucccagaugauuucgauacaacagaaauagaggaaaucgaagaacgaauuaaugcugccagcgaacaacuaaucaacgauauucaagcggaagucgagacggaauggcaguauaucaacaauacuaaugaaagcuucaaauuagcaacagaagauucuauucccgauucuccugcugucaauaccgcugauacuccguuuguaaaagucgaagggaauauuguguuuagguucuuuuggugggaugcuuacguggacccacuauaucaacaagggacuguuuuucucuuugguaaaacguacugcgaaacuucuaagaaauacgaaaguugcugcguggcugugaagaacauagaaagaacaauauuugucuuaccuaggccguuugaacuagaugagaacgggaagcccacagauaaaccgguuacauuuaaaacaauccacgaugaauuuaacaauaagauuuugaagcgauugggcaucggcucuuuuaaauccagauugaucaaaaagaaauacguauucggugguagcgugccagccgaauccgacuauuuagaagucagauacccugcaacauucccacgcauucgaugcagccaagacggugaccuauacaaugacgaugaauacauugaagaugaucucggcuauaaaacuuuuucgaagaucuucggcauaaaaacgaacuucuuggaguugcuuuuucucgagcguaaaaucaaagggccuuguuggaucgauauaaccgaucccgaaauggccgcuaacccgaugagcuucuguaaguucgaaguaaauugccucaagcccgccaauuuacgaauaacugcguucgagaaaccgcuuccuccaccaccucucguaguggcuacuauaaauaugagaaauugcuuuaaucgagcaacgucuaaucacgaaaucguuaugcuaucuugucuggugcaaaauugcuacgaugugaacaaaccgccuccggaacccgcauuucaacagcauuucugcguauucagcugcccccgaggacaggugcuaccuccaaauguguucgaaucuuuacagaauuacaaaauaacgaaagcgcugaaaaccgacaacgaaaaggccaugcugaguugcuucaucaacaacuucgcgccaaucgaucccgaucuaaucguagggcacaacuuacaaggguaucaagccacuauauuggcagauaggcuggugaaauugaacugcguuuauucuaauagacuaggcaggcucaagaagaagacuacucaagccaaacaauuagagaaaacuuuguucuuggggcgauuaguuugcgauauaaaaacaucagcgaaggagcugauuaaauccaaaucguacgauuuugauacgcugugucaggucguguugaaauuaaaggagaaccaacgcguugaucuagagccugaggauguguucaaaauguucaaaacgucgcaggauuuguugaaauuaauuuccuucacuaugcaagauuccggguauauuaugaaaaugauguacaauuugaauguaguuccucuggcguugcaaauuacgaauauagcaggcaacgucaugucuaagacguugaugggaggaagaucagagaggaacgaguuuuugcuguugcaugcuuuccacgagaaaggguauauuuuaccggauaagguuuauagaaaaauugaaagcgaaucgaagaaaaagcccacauauucuggagguuugguguuggagccuaaaguagguuucuacgacaagcugauacuccugauggauuucaauucccuauaccccagcaucauccaggaauacaacauuugcuucaccacccuccccguaauggauucagacgaaaaucuaguacuaccggacagcaaucuaccggccggaauacuuccaacagaaaucagaaaauuaguagagagccgucgacaggugaaaucguuaaugaagaaaccggaccucccgaaagacuugaaauugcaauacgacauucgccagauggcguugaaauuaaccgccaacucgauguacgguugcuugggcuucggacauuccagauucuacgcgagaaaucuagccgcuuugaucacccaaaagggccgagagauucucgugaauaccaaagauuugaucgagaagaugugcuuggacgucguguacggugauacagacagucuuaugauuaacacuaauauuuuagaauacgaucaaguguucaaaguaggcguuaaaaucaaacaagaagucaacaaguuguacaagcaagucgagcuugauaucgauggcguuuuuaaauauuuguuguuguuaaaaaagaagaaauacgccgcaguuacgcuuuccaaaaguccaacaggcgaauuaauaaccacuaaagaguacaaaggauuagauauagugcguagggauuggucgcaauugucuucggaaacuggaaaauugguccucgagcaccuccucagcgaucaauccuccgaugaaaaaguacagaacaucuacgacuacuuggcuaaaaucaaaucugauuugguugaggguaaaauaccaauaccacuauuagcgaucacgaagcagcugaacaaggccccucaccuguacaccgauaaaaacucuaugccucacguucagguggccuugcgauacaacaagaagagccgcgaucacuucagaaugggcgacacagugcccuacguaauaugcauagacaacacgaguaacaaccccaugcagcgagccuaucacguggacgaauugaaggguaaccccgaguugaaaaucgacuacgauuacuaucuggagcagcagauucauccggugauaucgagaauuugcgagcccauagagggcuuggacuccuaccaguuagccgaauuucugggcgccaaucugaagcgaaugaagaggcccaaaccgaaagggggcaacgagaacauucaaggggagaacgucguuaaagccgaggugaaguucaagaacgccgagaaauuuucguucguuugcuacauuugcaaacaccagaaugucguuagcgaaccauuggugaauaacauuccuuuuuuggaaacgugucaaaacuccgauugcaaaucgaagcccaucgauuacuuaccgagcguucaaaaucaacucuacuuaacuauucguucgcauauaacuaaauauuacaagaagguuuuaacgugugaagacccaaguugccccagcgcuccgagaagauugccccugcaauuucugaagaaacgccccauaugcaacaagugcggcaacgcuguaauguacaggguuuacaccgaauuccacuuguauaaucaacuagccuacuaucgguacauguucgauuugagcaaacucaaaaacaagccuuugauggauggugaaaccgaaucggguuacagagcgcuucuagauacaguugagaaauucaugaaucaaucagaguacucgcucauaaaucugagugagguguucagccagcucgguugggcugcgacuguugaggaacguguuuuggaagagucuggaaaugguauccauuuuaacgaagaaggcagugaggaugucuacgaugaauga

SEQ ID NO: 6210 - RNA, 1467 nt, Phyllotreta cruciferae
auggcggcugccgcagcggcaaaaauugccgaaguacgcgagacaacacgcguagaaagaaucggugcccauucucacaucagaggccuaggauuagacgacagucuugaagcuagacauguaucucaagguaugguugggcaaguaucagcuagaagagcaguugggauuguucugcaaaugguacgcgaugguagaaucgcaggaagagcuguuuuauuagccggacagccugguacuggaaagacugcuauagcaacugcuuuagcucaugcuuuaggacaagacacgccguucacuagcauggcugggucugagauauauucguuagagaugaguaaaacugaggcauugacgcaggcuauuagaaagaguauuggaguaaggauaaaggaagagagugaaauuaucgaaggugaaguugucgaucugaguauugaacguccagcuacaggaguugguacuaaagucgguaaauugauucucaaaacuacagauauggagacuguauacgauuugggcgguaaaaugauugauaguauucuaaaagaaaaaguucagucuggugauguuaucacuauagauaaagcuacaggaaaaauuacgagauuggguagaucuuuugcuagagcuagagauuaugaugcuacuggccaacaaacgagguucguucaaugcccagaaggugaacuacaaaaacguaaagaaguuguccacacagugacuuugcaugaaauugauguaaucaauagucgcacucacggauucuuggcacuauuuuccggugacacgggagaaauuaaaucagaaguaagagagcagauuaauggcaaaguagcugaauggcgugaagaaggcaaggcugaaauuauuccugguguacuguucauugaugagguucauauguuggauauagaaugcuucucauuuuuaaacagagcuuuagaaaaugaaaugucuccaaucgucauaauggccaccaauagagguauaacaaaaauucgagguaccacuuacaaaucuccgcacggcauuccuuuggauuuacuggaucgaacaauuauuguuccuacucagccauaugacgagaaggaauuaaaagaaauauuaaauauucggugugaagaagaggacugucagaugucugauaaugcuuuggugguuuuaacuagaaucugcaaggagacuucucugcguuacggcaugcagcucaucaugacaucuaguuuaauugcuagaaagcguaaagcccacgaagucgauguagaggauauaaaacgagccuaucaauuauucuuugaugaaggucgcucugugcaauuucucaaggaauaccagcaagaauuuauguuuaacgagauugaugaaaaggaugauauacuugauguaagcauccguugugaagcuugcguccgcccuauuuuuucugagacgcacuacaaguguaugcaaugcgacgacuuuuuc

SEQ ID NO: 6211 - RNA, 1116 nt, Phyllotreta cruciferae
auggcguuaagaacuuacggagauaaaccgaucaguuuccaguuggaggaaaauggagaguacuacuguguuggaucugaagugggaaauuaucuucgacucuucagaggaucccuguacaaaaaauauccuggaauguucaggaggucuauaaccaacgaagaaagaaggagguugauugagcucgguuugagccagcauguuuuagcgagcaguguaucacugcuuagagcagaagaaguugaagauauaauugaaggaaaugaugagaaguauaaagcuguaucuguacacacuucggaaccuccuaugccaagagaggguaaauccaagaaaaacaugcaauggguaccaucguuaccuaauuccagucauuuagaugccguuccacaagcuacgcccauuaauaggaacagaguagcugcuaaaaaggugagaacauuuccacuauguuuugaugacaccgauccccaaauaaacauagaaaaugcuugucaacaagaauugcuaguuccuauuagacuggauauggaaaucgaaggacagaagcucagagauacauucacuuggaauaaaaaugagaguuuaauaacgccugaacaauuugcugaaguucucugugacgaucuugauuuaaauccuuuaacauuuguaccagcgauugcucaagcaauuagacaacaacucgaugcauucccgacugaaccuccugcuauuauagaggaaaccugcgaucaaagagucauuauuaaguuaaauauucacgugggaaauacaucuuuagucgaucaaguugaaugggauaugagugaaaaacagaauaaucccgaagaauuugcguugaaacuuugugcagaauugggucuugguggugaguuugucacugcgauugcuuauucuauuagaggucaacucucuuggcaccagaggacuuaugcuuucagugaagcuccucuuccuguuguagagguaccauucagaaaucccagugaaucggaucagugggcuccguucuuggaaaccuugacugaugcugaaauggaaaagaaaauucgcgaccaagacagaaauacucguagaauuagaagauuggcuaacacuacgccggguugguag

SEQ ID NO: 6212 - RNA, 624 nt, Phyllotreta cruciferae
auguuguguuguuguucggacaaagaggacuacggcaaggguccgauggcugcaauaagaaaaaaauuagugaucgucggcgacggagccugcgguaaaacgugucuuuugauaguauuuaguaaggaucaauucccggaaguguacgugcccaccguauucgagaauuauguggccgacaucgagguggacggcaagcaaguggaacucgccuuaugggauacugcaggccaggaggacuacgaucgccugcggccccuuucauauccagacaccgacgugaucuuaaugugcuucucgguggauucgccggacucccucgaaaacaucccggaaaaguggacgccggagguaaaacauuuuuguccgaaugugccaauuauccugguaggcaauaaaaaggaucugcguaacgauccgacuaccauuaaugaacuuaaaaaaaugaagcaggagccuguuaagccgcaggacggucguucgauggccgagaaaauaaacgccuuugcguauuuagaauguucggcuaaaaguaaggagggcgucagggaaguauucgagaaugccacucgugcugcgcugcaggucaaaaagaagaagaagcaucguugcguaauguuuuga

SEQ ID NO: 6213 - RNA, 4155 nt, Phyllotreta cruciferae
augaaugcauccacuuucaauccaagaauggaugccgcucaaaauccggugcaaaaaauggaauuggcguccaggaauguggaaaauucguuguuaaucgacaacaaugcgccgagauugaucgauuuuaugaauaucaauccgcaaagcgguuccacugcgagcgguuucgcagaccacgauuauccaacuuuaaguggauugucgcauauuaucaacagcaugacccaaaucaaaugcgugagcaauguucccauaccuucggaaaucguugaccacuuugcccgugugcaaugccacuguaugauggguuuauuuucugaaauaaacagagcuuggcuaacuguugauagugauauuuacguauggaccuaugaggaaaauaccgacuuggcuuauuucgaugggauaagugaaacgauuguuugugugggccuagugaaaccuaaaccaggaguauuucacgccuuuauaaaauaucuccugauuuuagcgacuucugucgauauuguuguauuagggguuacuuucacugaacgacccggugacaacgcugaugaaauucaacucauaccugauccuguguucauauugccuaccgaugguuccacuguuacgauaaucaacaguacugaugaugggaggauuuuuuauggcacaaaagaagggaauuuauuugaaauugcauaucaagcugagagugguugguucggcaaaagaugcaaaaaaauuaauuuaucgaccagcacuuugucguuucugguucccucguuuauuaaugcugcauuaagugaagaggaugggauaacgcaaauuucaauugacgauagcagacauauucucuacauucuuacggagaaaggauccauugaaguuugcgaccuaggagacaaagggaauucguuuuccagaauuaguaaaauaucucaaaacacguugguuaaccaagcaaugaauacuguuaaaacucuugacagucaaaauuuccgaccaauagugagcauauccgccaucgaagcgucugaaucgguuaauuuaaauuuaguagcuguaucucaaacuggaguaagauuuuauaugaguguuacgaguuugucgaaccaaaauccuaaucaaagaccauauacacuaacccuggcucauguaagacuuccguccgaaucgguuaauuuaaauuuaguagcuguaucucaaacuggaguaagauuuuauaugucuguuacgaguuugucgaaccaaaauccuaaucaaagaccauauacgcuaacccuggcucauguaagacuuccaccugguuauucagcuaacauuacuguaagacccagggcgguacacgugucccaauauagggacagaaacuugauauugauauccacuguuaacgagaaagauguguugugguguaugagcucagacuuauuuccauucggccgaggacugacagaagcuuacacggccauuaauuuagacgggccagcuuuagcuaucucugaggugaggaaugguaguccccuucaaauaaaagauuuacaugaagcgcccccuuuagucguccggcaacaugccgaaccuccgaaaaaguacauuguucuuacuucgcacagcauucagauuuucauuaaguuaagaccaguggauguauugaaacaaauuuugaaagacagccaugggcaagacaccgaggcauugaaagccuucuuuacaauucaaaaagaggaccaagcgugcgcuacugcuuugauacuagcuucauuggaaaacgaagauaacauggauauagccgaguuugcaaccagagcuuucuucuuauucggaggcgagccaaaauuggcagcuccaaugaauacauuuuccgggccguccguauuuugcccgcccgucaugucuacuccaaauauacaccaauaucaacagcaacagcaauuucaagcuucaccgcaauaccaacacaauuuuccccaugccaucucgcccggggcaaaugcauacgaauugaccaguccauucguuuucucucccaagcacaacggccucuauuuauauuuaaguagaauauuaagaccuauuuggcaucgaaggacaguggauaagcuuugcuuagauggaaaaauuguuacaaaucacaguacagugacuagugaagacugcauauuuauuuugaacuacauaacgucccugcauaauuuccuaaugcgcaauacucagcuuucaaccuuaagcgccgguccuggucccggucaaaauccucaaaccuucaauaauacuacaauuaauaugaccagauugaaccauaccauucaagauguucaauuggaggaaagggcaucucuggaugcuuugaaaacauucguuugccacuguugucaaauauuaggucuauggagaauucuuugcgagcaucaauuccacacauuaauagcuucuuugccugaaacugagcagcagauuuugcaaaauacgacuuucaaggaucuacuuuuauaucgacaugauaucuguucguuguugauugcgacauuagucgauaguuacuuaggugauaacgccucagucgauucgauuagcagcaaauugagagaagucuguccgcuguuuuacaagacggaagaugcagcuuuuucaaaagcugucgaaauauuaaagaugacccggacaauucaaaacaacgacgaaaaggaagagaugauccaauccgccuuacagauuugcaaaucaauaggucccacuauuaauaucacugauauaugcaaggaguucgcuaauuugaaagcuuacaaagcuguuacggaauugugcgcgcauuucgguaagaaaauagauccggauaaaauagcagaaaguuacuauaacgccgaagacaacaguggugaccaagagggguacaauuauuaccaaagaagguuggaaauuuaccgucauauauuaaacauguuggaucaacuauacaacgaacaaaaucaaacgcuggucacuaguagagaugccucguacucaguuaaucagaccauauuacuggauggcguggaacaaucucaagugggauacgugaugaagcaaguaauaaaagacguuauggaaacgcccgaugagaucaugcacuucgcccuuuacgauuggcugguguucaaaaauaugacuggagauuuaauaaacauccaaaacccgucuuuggaaacguauuugaaacgaaccuccacccagaaucccaacaacauugaggccaugaauuuguuauggaaauacuacgaaaguuguaacaaucacgcagccgcugccaaaauuuugaacaaccucgccucgagaacuggcauaaacguuccuuugaaagagagacugucuuaccuagcgagagcuaucaugugcaugcgaagcgauaaaauaggcuaugcgccauaucuugguguauuuuugagggaucuugaagauaaaauggagguagcgaaggugcaagagcaaauuuuggaugccauuguaaauuugcaaggacaaauuccuaacgcucaggaagcaauaagugcacuuaauucuggcuuguacgaaauuucgcaguuguaugaaaauuucgcugaacccuucaaacuauuagaaugccaauuggcaaucauagaaugcgccggauacacugaucaaguuuugaucgaauccauuuggcagcaaauuuugacugaagaacuaaggaaaaccuacggaacugguacagauaaagucugucaacuuuugaacaaagugaagcaguugucgaagcaauacgcucaaucagcaaacuguuuuccauugaguuacauuguuuacgaauuggaaauagugaaugcaaaacuucgaggagacaaacaacucguuccuugugccuuggaaagcaugaauauuccuuucgaaaauuuaaucaacguuuacaauaguuuaaauacgauuucuauaaaugaucacuuuuggcaauuagaggagaacgaauuucaucuuucugaagcuacugcugcauuaauaaauugcuuccuaagccaucuggaacaguacagcagcguugaaaagagaaaaauaacuucgcucugucaagaugcagugguugcuuuacuauccaacuuguauagcaagccuaacacugagguguuaguuaauaaguuaagaaauauacaagccaaguugucaagaauuuag

SEQ ID NO: 6214 - RNA, 4143 nt, Phyllotreta cruciferae
augagcgaauucacuuugagcuauagggaagucacuccggagcaaauagauuucgaaaauuggaaagaaauaacccucacuacaggaggaacccaaagcacccuucaagauauaaaaguagccgagaaagccaauggauacuguuacaaagacuccacuaaacacugcacgaggaauagauucaucuacuggagaauuaaucacaauguauuggagcuaguagagcacaguuuagauauaaaucuuacaggaaaucguaucagauacaaguucgauacuccaauuuuagaugguguuucgauacacgaaguacucgauaauauuguuauuuugguuccuacaguuuguaguguacacaggcugauuuucccccauccaaauguuuuccacgcacaggacgauuuacugggaauauauccggauuuaacagccuuaucgauauucucgaaagcuucgauuguagacaccagaaacccgaacagcuuuuacguguucaacaaucccagcacugccaacgaucaauuaccgaaccuagccaauucguacuucguaccggaaaccggggaagcuuauuucguuuuggccuuuccuucgacugaacucuuacuaaucaggcaaagucccgaucaagucacuugcacagaacucaaaggggaaucuuuggugcccagauuuuucgccgguuuagcagauaaauucaggcaaaggaauucggauagcgaaaaugugguuaguuugcuauuuuacgauuuggacgaagaaacuuacguguugucauuaacacaagaugcucauuugaaauucuggucaugcaguaaaggccaaugcguagcaguaauagauguucgugaaaaaauaagaacuaacuugaaauauagaguacaaucagccauucuaaagaaagcagaagauggcaacaguucugaaaacauucugguucuauuccuaaguuucggaaauaaaugccaguuccauauuuugaaacccucgauuagagaacaagagaucacucuaaauagauuagccacucucgaaucgccauugaacgauuugauagauuucgcagcacaaauagacugcuuauggucaguauggcgaucagaagagggcgaaacgguuguguacaaugcaucguucaaauccaaccgauggacccaaguaauacuggaaaccgaaccgugcgaauuuaaauauugcccuauaaaauacaaugaugucaagacgcuuuacuuacagcacauuuuccauccaggcagauuuccucugcacguuauuaacaaaacccuuucgauauauaaaaugccuacgauugccucagacgcccaucuuuccguuucugcucuaaagcaaagagugugcuuggcugucgaaaaugauauacaaaaucucuuuaauaaugggagcgauaucgauagcguugaaguugaugaguauguagagugcgcugaauggaguuggcaaaaauucuacaccuauuguguccaauaccacacagcuaguagaaaaccguuggguuugaugcuacuaccguccguaucaggagcuaugcuguugaagaaaucuguauuuucguuucuacggccuguggauucguuggaacacaugacguuguguacagauuuguacagagagcaguucuucaauuuuuccauguuguccgaagauuuggauacuguagaugacguaaucaacguguuuaaagugaucguuuacaucgaacaacaacuaaaggacguuuucaugcaaucguucgaaacagaacuucucaaucuccaaucaccugacguugugacagaggagcuguugaaaagaauuuacguugaaauggauuccgauuuuuucucgcauauuuugcaccuaaucaaagacgucaacgauuuguacaaagccauacacaaaauccuggagcuguugagauaugaaaacaccuuggccaaccccgauaacgacauuaacccauccgcuauguacuauuucaauucacuguuaggcacuucauugguggcccaaaguuuccgacaacaagccgaaaucagauuucaaauuugccgcaauuuguugcuauuaugcaacuucuuggugauggacaggacgcuagauuggggcguuuuggaaggcguucgaucagucuguaugccagacauugucguucuaacccaagccaguuucguuguucuguggcuaagcggguugacaauguucgaaagcgacucgauucgugauucuucgaugagcauccugaacccguuaaaacuaacuccaguuuacaauuugcuaccguucacucguugcacgucuuuguuggaaguauucauaucaucaucaggcguucaagaugccaggaaaucguucgcaaggguuuccugcaaggacgaggccuuggugcauuggcauuggucguuguugccuuacguaaaccacaucaggcaucuuauauggcccauaagcgguuguacgguguuagaagaguggcuguuguccaguggacaacacguguggcuacaacaguacguucgccuacuuagcaauuggugcgaauggaacgcuuguacacguaacuucuuauuggccucgucguuucugacuaccggcgaauuuuauaaagccgaagagcuguucgaaacugcagcgaaagggguuuuuaccgacgcguuuuugaagaaccgaaucaaaagugucgaugauaguaauuuuagaacgacuauucauuauuauuuaaagguuauccagcuauucgaguuauguaaugcaagaaaccaugugauuuacguagccaauacggccuuauguguugucaaacgagacgauccuuuagcugcuacguuguuuucgaucaaauucaagcaccauuuggcuuugaagcacuaccaacuggccuucgauucguugaauucgaaccccgauggugaaaggaggaaagauaaucucagggaucuaguaaaaacguugcuggacgagaaaaaacucaacguauuguugaauuuuacuuacggcagcauggaugaguucuuugcgaacauuauuuuaacucgagcuagagcugcugauguuacuaauaacguguucuacgauuuuuuguauucguaccaaauuaagaaaggaccaccuucuuucagauuagcugccucagcuauguacgaacaagccuuucgauuaagccagaaaacuaccaucgaagcuuuagaaaagcaagugaaaugcuacuuagcagcuaaaaauguucuacauuugugcccaccucaacacgcuuggguugugagaccugcagaucccgaugaagaagacgaacaaguuauauuccagccuuuagccggcuccaacggggaaauucguacguucaaaaucaaaaaacaaaucgaaguaguagacaucgaaaccauaggcaaagaacugacguucgccagcgcuaaauugaaacuacuccaauucaaucccacugucuccaugaacauguacgauccucuggagcuggugauaucguugaacaacuccgggauguucaaaguggcuuucgagauuuguucgaccuucgauuugccuuauucguugguguuugaggcucuaacgaaacgcugcguuuugcucacagaagccgaggaucccaacgcuuggaauuggcugguggagaacgaucugcaagauuuaccgguuaauagagagucagcagccgauguaguuuggaaguucuugcaggauuguuuggagaaauacgaagagccuaacaugucguguuugcauaaugugguuugcaagaaaauuaucaacaugcaaauuuacuugccucauugguugaaagcuucuuauaagucucgaaauccguccgaauugcuaagauuacugcacgccucggggcguuuggaggaagccguggaauuggccaaagauuacauuuuaucagcgaugggauacgguaaagaggaauucggauucaagcagccuuuggcgccaacgucaccggccuuuugucuuccugucuacgccauacaaaggcugguagacgaauugaacauacagaauuccaugaacaucgagaagccuuacguacacgaguaugaugauuugaacguguuguuuucuaaguaucucgaaacagcaauuagaguuucuaaucagaugugccagguuaaguguaaagcuuuuuaa

SEQ ID NO: 6215 - RNA, 2970 nt, Phyllotreta cruciferae
auggaagucuccgacaagaaucuggaaacccugagcagauauuugcaggaaacgcucaacccggaccccaacgugcgcaggccagccgaaaaauuccuggaaggagucgaagucaaccagaacuauccccuauugcugcucaaucuagugcacaagcccgaggcggacaugaccaucaggguggccggcucgguggccuucaaaaacuacauaaaaaggaacuggguagucgaagaggaccagaccgaucguauacacgaauccgaucgauuggccaucaaaaaucucauuguaacuuuaaugcugagcucaccggagucaauucaaaagcaacucagcgaugcuaucagcaucaucggaaaaacugauuuuccuuugaaauggccggagcucaucaccgagauggucgagaaauuuucuaccggcgauuuuaacgugauuaacggcgugcugagaacggcccauucgcuauuuaagaaguaucgauacgaguucaaguccaacgaauuguggacggagauuaaauauguacucgagaagcuagcgaagccucuuacugaucuguuaguugcuacgauaaaucuaucgcaaacccacgcgaacgacguagcagcauugaaaaucaucuacaguucgcucgugcucaucugcaaaguguucuauucguugaauuuccaagauuugccggaguucuucgaggauaacauacaaaucuggaugaccaauuuccauacgcuucucuccguugauguuaaaucguuacaaagccaagaagacagcgaggcagggguacuagagcagcugaagucucaaguaugcgauaauguggccuuguacgcgcagaaguacgaugaagaauuccagccguacuuaccgcaguuuguaacagauguuuggaguuuauuaguggcuacuaauuuacaaccgaaauacgauuugcugguuucgaacgccuugcaguuccuuucguccguagccgaacguucccaauaccggaaccucuucgaggacgacaacgugcugagcagcaucugcgagaaagucaucauacccaacauggaauucagaacuuccgaugaggaauuguucgaagacaaucccgaagaguacacgagaagggacauagaaggcuccgacaucgacacgcgcaggcgagccgccugcgauuuggucaacacuuugagccagaacuucgagcaaaggaucgucgagauauucggaagauaucuacaagugaugcuugcgaaguacacggagaacccgaaggaguucuggcgcagcaaagacgcggccuuguacuugguaacgucgcuggugagcagggggucuacucagaagcacggcguuacgcagacuagccaguuaguggacauuacccaguucugucagcagcacauuuugcccgaauuggaacggccggacgugaacgauuugccgguguugaaagccgaugcuauaaaguacgugaugacguucagaucgguacuucccagcgauuuaguggugucuacguuaccgcaauugaucaggcauaugccgagcgaaaguugugugguucacacguacgccgcgugcacuuuggagaagauucuuauguugaaauccaacaaucaagccauaguaaccggggaucaauuggagccguuggccuccgaguuauugaccaauuuguucgccguauuacaaaaaccagugucggaggagaacgaguacauaaugaaggcuuugaugagaacguucgcaacgcuacaagauaggaucauaccguacuugaacguggcuuugccgaagaugaccgagaaauugcaaaugguggccaagaauccuucgaaaccucucuuuaaccauuaccuguuugagugcuuuucguuggcuauaaagauuaucuguaaggugaaucccacagcugugacuucguucgaagacauauuguuucccauauuucaaggaauuuuacaacaggauauacaagaguuuauuccguacguguuccaaauuuuauccuugcucauggagcacaccccgcagggcuccuuauccgaccccuacaugcagcuguugccuugcuuguuggcccccauauuaugggaacgaccggccaacauuagcccguuggugagauuguuggcugcauucgcuacucaggccgccccgcagauuguacugcaagauaaaguggguggauuuuuggggguauuccagaaauugcuggcuucgaaaucgaacgaucacgaaggcuuucgauugaugcaaaguuuaauacaaaaucuaccuacugaagcucuuacgccguaucacaagcagauauucuuccugcuauuccagcgauuaucgucuagcaaaaccaccaaauacgugauuaauuugaucguguucuuuugcuuguacauggugaaguauucgcccaacgauuugguggcuuugaucgaugaaauucaaggccagauguucgguaugguauuagagaagcuucuaauugcugaauugcaaaaaauagcuggcgauguugagaggaaaaucguagcuugcgggauuacuaaauugcugugcgauuguccugcgauguauacggggacuuaccaaaaauauuggccgcaguuacugcaggcucuauuagcauucuucgagaugccuagagaugagacaaccuuccccgaugaccauuucaucgaaguagaugacaccccagccuaccaagccacuagcgcuaaauugaauuucgcggacgguaccaaaaacgauccucuacaagguguuagcgagccacggcaguuucugguucagagcuuggccagccugggggcuacgcagcccggccggcugccuacuuauauaaaccaacguaaaucagcagucgcagacgauacugcaggguuauuuggccaaguucggcguucaauuggcguaaauucgagucgacugaguucaaauauuauuuaucgaaaaaugaugaucugcgaaacgaucuaa

SEQ ID NO: 6216 - RNA, 600 nt, Phyllotreta cruciferae
auggcaaaaguacaauuaugcaauaucacaguuauggacaauccuaguccuuucuugaacccauuucaauuugaaaucacguucgaaugcauagaggaauuaaaagaagacuuagaauggaagaugauuuacguugguucggccgaaacugaagaacacgaucaaaucuuagacucuguauuuguaggaccuaucccagaaggcaaacacauguucgucuuucaagcagauccuccgaacgucucccguauaccugaaaaugacgccaucgguguaacaguuguucuccucacuugcuccuacaagagccaagaauuuauucguguagguuauuuuauaaauaaugaauacagcgauccugaaaugagggaaaauuugccuaguccaccucaguucgauaagguaauuagaaauauauuggcguccgaaccgagggugacgagguuuaaaaucaacugggaagaaucgaguggcacucaggaaaacggaacuacaauugccgaaacccccgcuaaccaaacaaccgaaacuuccacuuccguagagguaccugcuuucaacgagaacucuaauucgugggccaccauggaguguucauaa

SEQ ID NO: 6217 - RNA, 939 nt, Phyllotreta cruciferae
auggaucaaaugcuaccgagcccugguuuuaguauaccuagcauagguacaccucuucaucaacccgaggaagaccagcuaauuuuaccaaacgccauucaacaacaacaaagucuaccuacuacuaacucacaagugccuccucuagcuccaaugggagguucuacuccaacgcuuggucuagguuuaggccaugcgauguccaugccacauacuaaguauguaaccggauuuucacugccuaucaguucuauggcaccucaaacaccacaacauacaaugaugaguccuaugguaaauguugguggaacugguaccacuaguucugguguaacgcccacguuaggucccucuacaccuucaccaaugacuccuaugacaccacauucagcagauccuggaaucguuccacaauuacaaaacauugugucaacuguaaacuugagcuguaaauuagauuuaaagaaaauugccuugcaugcgagaaaugccgaauauaauccuaaacguuuugccgcugugauuaugaggauacgagagccaaggacgacagcuuugauauuuucgucggguaaaaugguguguacaggugcgaaaagugaagaagacucgagacuagcugcaagaaaguaugcucgaauuauacaaaaacuggguuucccugccaaauuuuuggauuucaaaauacagaauauggugggaaguugugauguuaaauuuccaauaagauuagaaggauugguucuaacucacaguucuuucagcaguuaugagcccgaauuguuuccuggucuuauauaucguauggugaaaccaagaauuguucuguuaauauuugucuccgguaaaguuguucugacuggugcuaaaguuagacaggaaauuuacgaagcguuugauaauauuuauccaauuuuaaagaguuuuaagaaacaauga

SEQ ID NO: 6218 - RNA, 477 nt, Phyllotreta cruciferae
auggcugcaaugcguuccaugucucgccuguuauucuccagaucauuacaaacuacuguaaaaagggguuacgcugaucaaaugagcuucacuuuugcugcuggaaaccaggucuucuacgaugcgaaaucgauaaaacaaguagauguuccuucuuucuccgguagcuucgguauccuaccagcccauguucccacucuugcuguucuaaagccuggaguaguuacuguuuacgaagacgcugguaaugucaagaaaaucuucguauccagcgguacagugacuguuaaugacgauucaucuguucaaaucuuagcugaagaggcccaucccguagaaaauuuagacguuagugcagccagagaucuucuuaacaaagcacaaagucaauugucaucggccacuacagaucaggccagagcugaagcugccauugccauugaagugggagaagcacuuguaaaagcugcugaauag

SEQ ID NO: 6219 - RNA, 972 nt, Phyllotreta cruciferae
augagcggcgauggcaaccaaaacgagcacuucgacacguuauuccuaucaaucgcccagcaucauccccaggggcccacgcaacuccuagacacuuuugugaacuuccugagcagaaaaacggauuucuucacaggcgggaaggaaggcgaaugggaaaaguugguguugaauacguucaagaaguacgagaaguccagcagggagcagcacgcggcagaauugaaggagaagcaggaacaggaggcccgcaggaaggcuaagaaagaggccgaaucggccaagcaagcucaaauuacugaauuaacagaagagcaggcugagaaauugcaagccgagcucgaugcuaagaaguccccagcuucgguuaccccuucgaauagcucgaguggcccuucgaccuccacgacgaagaucgaagaagacgaagacgaguccgagaaggguaaauugcuacccaauaaaggcaacggaugugauuuagacaaguauaauuggacccagacucuuagugauauagagcugcgagugccgcuccagugcaauuuccgagccaagcaaaaggaucucacggugaauuugaccaaaaaacgccucacuugcggccucaaaggccauccccccaucaucgaugacgauuuccagcacgaaaucaaacuggaagagaccaauugggugauugaagacgggaaaucguugcuguuuuccauagaaaaagugaauaaaaugaauugguggaguaaaaucgugaagaaugauccggagaucagcacuaaaaagauuaauccggagccuucgaaguugagcgauuuggauggggagacgaggggcaugguggagaagaugauguacgaucagaggcagaaagagaugggauuacccacuagugaugaaagaaagaaacaggacguguugaagaaguuuauggagcaacaucccgagauggauuucuccaaaugcaaauucaauuga

SEQ ID NO: 6220 - RNA, 477 nt, Phyllotreta cruciferae
augcagucuccuagcggaauggugcacggccauccaggugccucaauacugcaauggagcccugauaaaaaauacagcgauagagaaagguggauuugcguuuauccagcauacauuaauuccaaaaaaaccauugcccaaggcaggaaaauaaacaaagaaaaaugcguggagaaucccacucaucaagaaaucagagacguuuugcucgcagcagguuugaagguuggcguagaaaacaaauuguacagcagagaacgaagcaaagaauugcucuaucgagggcgaauuagaguccaauugaaaaacgacgacgguacgcugugcaauccaaauuucccuaccagagacagcuuaaugcuccauuugggagacaugauucccaaauugaagagcagacaaaacaagggcaguggagauccacaaccaaccaccaccagcucgaagggaaagggcaaaggcaaaggaaggcguuaa

SEQ ID NO: 6221 - RNA, 2202 nt, Phyllotreta cruciferae
auggaggaaccggagccuacuaaacgccagaagaugcccaaaguggccaaagugaaaaacaaagccccagcugagauccagaucacagcugaacagcuacugagagaggcgaaagaaagagacuuggaaauccucccgccgccgccgaaacagaaaauuucugauccggcugaguuggcggacuaucaguuaaggcgcagaaaacaguucgaggauaacaucagaaaaaacagggcggucauuucgaacuggaucaaguacgcccaaugggaggaaucgcaaaaggagauacaacgguccaggucgauaugggagagagcccucgauguggaccacaggaacauuaccauuugguugaaauacaccgaaauggaaaugcggaacagacaaguaaaucaugccaggaacuuaugggacagagcuacaguucuucuaccaaggguaaaccaguuuugguacaaguacaccuacauggaagaaaugcuggaaaacguagccggagcaagagcgguauucgaaagauggauggauuggcaaccugacgaacaagcuuggcaaacuuacauaaauuucgaacugagauacaaggaaauugauagagccaggcaaauauacgaaagauuuguuauaacgcacccggaagugaaacauuggaucaaauaugcccguuucgaagaaaaucacgguuucauucauucagcuaggcagauuuaugaaagagcuguccaauuuuacggagacgaucauuuggaugagaagcuuuacauagcuuucgccaaauucgaagaaaaccagaaggagcacgauagagcuagaguuaucuacaaguacgccuuagaccacaucccuaaggaugaaacgaaagaacuguauaaggcguacaccauccaugaaaagaaauauggagacagaagcgguaucgaggaaguuauaaugucuaaaagaaagcugcaguacgaacaagaaauacuccaaaaucccaccaauuacgaugcuugguucgauuaucuucgacugguagaaggagaagcagauuuggaaauaacucgagaaaccuacgagagagcuauugcaaauauacccccaucgaaaaacaaacaauacuggagaagauacauuuauuuguggaucaauuacgcuuuauucgaagaacuggaagcuaaggauuacgaacgaaccagacagguauauaaagccugccuggaaauccugccgcauaaaacauucacguucuccaaaaucuggcugcucuacgcacaguucgaagugcgacagaagcauuuaaaagcagcccguaaaguucuaggcauguccauaggaaugugcccuagagauaaauuguuccgggguuacauagaacuggagauacagcuccgggaguucgauagaugucggaaauuguacgagaaauuccuggaauucgguccggaaaauugcguuacuuggaugaaauucgcggaauuggaaacucuuuugggggauaccgacagagcgagaggcauuuacgaauuggccauaaaccaaccgagauuagacaugccggaguuacuguggaaagcuuacauagauuucgaaauaucucaagaggaacccaacaaugccaggcaaauuuacgaaagauugcuagagaggacaucucacguuaaaguguggcuuuccuacgccaaauucgaauugaacaauccgagugaagaagauuucaacauccguuuagccaggaggaucuucgagagagccaacgaaaaucugaaaaacguccccgaaaaagaauccagaguauuauugcuugaaaacuggagagaauucgaaaacaaucacggcgaugaggcgcacaaagaaaaaguuaacgcuaaaaugcccaagagaauuaagaagaggcagaagguuaucgaugaggauggugucgaacaaggcugggaagaaguauuugauuauauauucccugaagacgaagccagcaggccgaacuugaaauuacuggccgcugcuaagaacuggaagaagaacacugacgagccggaggaagauacggaaaauagaacaacccuuuccagcaguagccaaaggaugaaagaaaaguuauuagccuccgugaagaauuggaaaaacaaugacaaagaaaauagugauucuaauaacgaugaaugcucuaaugaagauguaguucaaauuacugauucaaacaaugcaguagaaaauuga

SEQ ID NO: 6222 - RNA, 1431 nt, Phyllotreta cruciferae
augggaauuaaauuuuuggaaguuaucaagccuuuuugcaguauccugccggaaauugcaaaaccagaacgaaagauacaauuuagagagaaagugcuauggacagcgauaacucuauucaucuuucuaguauguugccagauuccccuauucgggaucaugaguucggacucugcggaucccuuuuacuggauccguguaauccucgccuccaacagaggcacccucauggaauuggguauuucuccgaucguaacaucuggauugaucaugcaacucuuagccggagcgaagaucaucgaaguuggcgacacuccgaaagacagagcuuuguuuaacggagcccagaaacuguuugguaugguuauaacggucggucaagccaucguguauguaaugaccggaauguacggagacccagcugaaauaggagcuggagucugccugcuuaucaucauccaacuguucguagcaggucuuaucgugcuccuucucgaugaacuguugcagaaaggauacgguuuggguucugguauuucccuguucaucgcuacgaacaucugcgagacgaucauauggaaggcuuucucuccggcuacugucaacacuggaagaggaaccgaauucgaaggagcuguaaucgcuuuguuccacuugcucaccaccagacaagacaagauuagaggacuacgagaggcauucuaccgccagaaucuuccuaauuugaugaaccuccuagccacaguuuuaguguuugcuauaguaauauacuuccaagguuuuagaguugauuuacccauaaagagcgccagauaccguggccagcacucgagcuaccccaucaaacuuuucuacacuucuaacauuccgaucauuuugcaaucugcguugguguccaauuuguacguuauaucccagauguuggcgguuaaauuucaagggaacuucuucaucaaucuguuggggguuugggcugauguugggggcggcggcccggcuaggucuuaccccaucggcgguuugugcuauuacuuaucgccgccugaaagcguuagccacauucuggaagaucccguccacgcuguuauguacauuauuuucaugcuggguuccugcgcuuucuucucgaaaacguggaucgaaguauccggcaguucggcuaaggaugucgccaaacaacuuaaggaacagcagauggucaugagaggucacagagacaauuccaugauacaugaacucaacagguacauucccacugcugcugcauuuggggguuuguguaucggagcccugaguguucuggcugauuucaugggagccaucgguucugguacugguauuuugcucgcuguuacaaucauuuaucaauauuucgaaauauuugucaaggaacaaagcgagaugggcggcaugggcgcuuuacuuuuuuaa

SEQ ID NO: 6223 - RNA, 921 nt, Phyllotreta cruciferae
auggcugccaccguagggcgaauuugugguguagggcuauuaaagccgaauaauuuaaccaccaucggucagaucagcucuuauuccaccgccaaagaauggaguagagguaaaaaggcacuuuuaggaacauuaggguuauuagccggaggcacuggggccgugcugguggcccucgaccagucgguuaaagcgucggaucuagaacugcacccgccgaagaacaucuggagccacagcgggauauucagcucgcucgaucacgccagcguccggagggguuacgaagucuacaaacaaguaugcgcugcaugccacuccaugcguuucguggccuaccgcaaucuaauaggcguuacgcacaccgaggccgaagccaaagccgaagccgaagaccagaugaucgaagauggccccaacgaugagggcaacauguucaaacgccccgggaaauuauccgauuacuuccccagcccuuaccccaacgaggaggcggccagggcugccaacaacggggccuacccgcccgauuugagcuacauuacgucugcuagacacggaggugaggauuacauuuuugcgcuguugacugguuacugcgaggccccggccggcgugauuguuagagaagggcaguacuacaauccguacuuccccgguggggcuauuucgauggcucaggcuuuguacaaugaaacgaucgaguacgaugaugguacuccggcuacggcuagucaauuggcuaaggaugugucgacguuuuugaaguggacagcggagcccgagcacgacgauaggaaacgaaugcugaucaaagucauagggauauucucguucuuguuagggaucacuugguauaucaagaaggugaaguucuccucgcugaagucccgaaagaucgaguucaggccgaagaaauga

SEQ ID NO: 6224 - RNA, 1695 nt, Phyllotreta cruciferae
auguuggcauuacaacaauacucaggaaguagcgacgaugaggaagacaaagaaaaguccacuauuaauaacgauccaucaacuccugcugaauauucgucaaaaagcaagcucgcgguuugcgcagcaccagaaguccuucccacaggacuagaggaggaccaaaugcacaucgauguagacacaaaagagcuagcguuuaaccccaaguucgauguccuguucgcaccugcccuagguccugcuaauccuuuuaaaacgcaacaacaguugguugaacgaaacaugcucucaggccacaucgagagagcccacgucagcgaauuccaauucgaaaaccaaaggaggacuuucaccaguuacgguuacgcuuuggacccgucuguaaccaaugacgggaaaaucaaagugguaggaucuucggaagccgaugauaguagcaucaagacuguauucgaagccucuaaaacgaggccuuuggauaaacgaaaaaggaagaagaaugaugaccccagcgauguugaagguuucuuaggcccuuggggugguuucguagacgagcaaaaaguuuccaaaccuaccgaggaagaacaaaucgaauuggaugagauauccuccaagaagaauaaaaaggguaaacccaacgaagauaaaccccucgaagaaaaaucagucuugcacaucaaagacgccguggauuaccaagggcgcucauuccuccaugcgccacaagaugucggggucaaucucagaucggacaccccuccggaaaaauguuuccugccaaaagcucauauacacacauggacuggacacucgaagggcaucgcugcuauccgauuguuccccaggacggcucaucuucuauuaucggccggaauggacugucguauuaaaauuugggagguuuacaacgaaagacgguguguuaggacauacuauggacaucgacaagccguuagggacaucaauuucaacaauuccggaaagcauuuucuuucagccgguuaugacagguauauaaaauugugggauacggaaaccgggcagguucugucgcguuucaccagcaggaagauacccuauugcguuaaauucaauccggauaaaaacaagcaacauuuguuuguggccgguacuucggauaagaagauaauuuguugggauacgaggucaggggauaucgugcaagaguacgacaggcauuugggugcuguuaauaguauuacguuuguggaugaaaaucgacgauucgugacgacuucggaugauaaaucguugagaguaugggaaugggauauuccuguugauaugaaguacauugcugauccuacuaugcacaguaugccuucaguaacuccagcaccaaacgguaaaugguuagcuugccaaagcauggacaacaaaguagucauauucucuuccaugaauagauuuaagauuaaucguaagaagacauucaguggucauaugguggccggauacgcuugcucguuggacuuuucacccgacaugaguuacuuaucauccggagaugccgaugguaaaguuuauauaugggacuggaaguccacuaagcuuuucaagaaguggaaggcucaugauaacguuugcaucagcguccuguggcauccgcaugaaccgaguaaacugauaucugcuggaugggacggccuaauaaaguacugggauuga

SEQ ID NO: 6225 - RNA, 603 nt, Phyllotreta cruciferae
auggugcagaaaaagcccaagaagaaggugggcaagaagguagccgcggcuccuuuggcagucaaaaaagucgagccaaagaaagaagucaaccccuuauucgaaaagcggcccaggaauuucggaauaggccaagacauccaacccccgagggaucuauccagguucguaaaguggcccaaauacauccgcauccagcggcagaaggccgucuuacagaagcgcuugaaagugccgccgccaaucaaccaauucucccaaaccaucgacaaacaaacggccacccaauuauucaaaguuuuggagaaauaccggccggagaccgccuugcagaaaaagaaccgacugaaggccaaggccgaggccaagguggccaaaaaggaagaggcccccgccaagagaccuaauacuuuaagagcugguacuaacacuguuaccaaauuagucgagcagaagaaagcccaauugguggucaucgcacaugauguagacccuaucgaauugguacuauuccuucccgcccuguguaggaaaaugggaguccccuacugcauagugaaggguaaagcuagguuagggcugcucguuaggcguaaaacuugc

SEQ ID NO: 6226 - RNA, 1002 nt, Phyllotreta cruciferae
auggcaacaauaauuaaggacauaacacuacaagaaaacauuccacaaaacauacuauucgaaaaacauaucgacuucauaaaggaauacggccaaaaggaaaacaacuuugaauaugcaaugaccgauuauuuaaggauauccggcauguauuggggccucacagcccucgaauuaaugaacgccucaccaccacacucaauagacgagauuucagauuacaucaaacagugccaagaccccgaaagcgguggaaucagcucuugccugaaccacgauccucacauacuccacacuuuaagcgccguucaaauacuuugcauguacgauaacuuaaaagcuauagacguagaaggcguugugaaguauguaaaaaaccuacaacuacccgacgguagcuucacaggagacaaauggggcgaaguagacaccagguucucauucugcgccgucgcgacgcucucgcuuuuagacagaauggacgccaucgacgugaauaaagcaguagacuuuguagcuucuuguaaaaacuucgauggugguuucggcucgaggccccucuccgagagccacgccggguuaauauacugcugcuuaggauuccugucuguuaccaaucgauuggauauuguggaucgagauaugcuggcuugguggcucugcgaaaggcaauuaccuucgggcgguuugaaugggcguccggagaagcugccugauguuugcuacuccuggugggugcugucuucuuuaacuauauuaggaaaacugcauuguauagacgccaaugcguugaagaaauucauacuagcaugccaggauaccgagagcgggggcuucgcugauaggccuggggacauuccagauccuuuccacacaguguuuggaauaucagcgcugucuuuacucggaaacgacacgguccagaaaguuaauccuacuuauuguaugccccagcauguuaucgauaggcuucaguugaaaccucaaauuuuagauguuuag

SEQ ID NO: 6227 - RNA, 2667 nt, Phyllotreta cruciferae
augcaccaagaaacauugcaacuaauccaaauauuagaaaaaacaguuucacccgacaagaaugaauuggagcaagcuucgagcuuuuuggaacaagcgucccaaacgaauuuauuaggauucauaaagacccucucggauauacugcggcauggcggcaacagcccgguggcccgaauggccgccgguuuacaacugaaaaaccagcucacuucgaaagacccgaccaucaaagucggcuaccaacagcgcuggcugcucuucgccgaagaagucagagacuacaucaagaagaacgugguuggcgcccucgggaccgagaccaacaggccgucgucggccgcccaaugcgucgccuacauagcagugaccgaauuaccgcaaggacaauggccggaucucauaucgacgcuggugagcaacauuugccaggggaacuccacggaaaugcagaaggaggccacgcucgaagccaucgguuacaucugccaggaaaucgaauccgauguguuagucuuacaaucuaacgauauacuaacagccaucgugcacggcaugagauccuccgagcccagcaaucacguucgauuagccgccacgcaggcuuuacuaaacucauuggaauucacuaaagcuaacuucgauuugaccaccgaaagaaauuacauuauggagguuguuugcgaagccacgcagucgccggugucgcaaaucaaaguggccgcuuugcaaugucuagugaaaauaaugucgcuguauuaucaacacauggagcccuacauggcgcccgcucuguuucccauaacguuagaggccaugaaguccgagaacgaugccguagcccugcaggguauagaauuuuggucgaacguaagcgacgaagaaguggauuuguccaucgaagauacugaagcaaccgaagcugguagaccgccuacaagggugucgaggcauuaugcgaaaggagcucugcaguacaucauaccgaucauccugcagaaacucacgaaacaagaagaguuggaugacgaggacgauuggaaucccaguaaagcugccggggugugccugaugcuucuagccacuugcugcgaagacgaaauagucccucacguguugccguuuaucaaagaaaacaucaaaucagacaacuggcguuuccgggacgccucccugauggccuucgguuccauuuuagguggcuuggagccgaauacucugagaccgcucgucgaacaggcaaugccgacuuugauagaauuaauguacgauagcagcguaauuguaagggauacggccgcuuggacguuugguaggauaugcgaaauaauaccggaggcggccaucaacgagaauuacuugaaaccucugcuagagagucuuauaacugacuugaaagcggagccccguguggccgccaacgugugcugggccuucuccggauuggccgaugcggccuacgaagcugcugcuguuaacgaggaaaccggagcuccagauacuuacauuuugucgccguauuaugaauuuauuauacagagguuauuggagacaaccgacagagcggacggugcacaagcuaacuugagaccggcagcguacgaggcccugauggagaugguuaagaauucgccgaaagacuguuacguuacgguucagaaaaccacgaugguuauuuuagaaagacugcaacagguacugcagauggagaaucacauuaccagccacaacgacagaucgcaauucaacgauuugcagagucucuugugcgccacauugcaaucgguuuugaggaaaguuacucccgaagaugccccgcauauuuccgaugcuaucaugacggccauguugaccauguucaauuccaauucuugcaaaaacggaggcguacaagaagacgcccucauggcuguaucaacccucguagaagucuugggagagaauuucauuaaauacauggacgcuuuuaagccguucuuauacauagguuugaagaaccaccaggaguaucaagugugcgguaccgcuguaggcuugacaggcgacaucuuccgcgcuuugaagcucaaagccaugcccuacugcgaugaaaucaugacucuuuuauuggaaaaucucagcgaucaaucgguacaccguagcgucaagccccaaauucucucuguauucggcgacauaggucucagcaucggcucggaguucaagaaauacuuggacguggugcucuccacguuggcgcaggcgucccaagcgcaagucgaccgcaacgauuucgauaugauagauuaucugaacgaguugagagagggcguauuggacgcuuacaccggcauuauacagggguugaagggggacggaccgucgcccaauccggaaguaaugguccucgagccgcacauuccguuuaucguacaguuuaucaucgugguggcgcaggaugccgaucauuccgauggcacuguggccguggccgcuggaaucguaggggauuuguguacggcguucggcaguucgauggugccguuguuggauuuggcuucgaucaaugauauguuggcgcaaggcagacgcagccgcgucagcaggaccaaaacguuagcgacgugggcuucgaaggaacugaggaaacuuaagaugccgccauccgcagcagcugcuagcugguga

SEQ ID NO: 6228 - RNA, 1503 nt, Phyllotreta cruciferae
auggaaacgauuuuggaacaacaacgucgauaucacgaggaaaaagagcggcugaucgacgccauggugaaagaaaugcugcacaaaaaaaacaccuauagagaagcgauaaauucggaccaccggcaaaaguaccuccuagacagauacaugaccuccaccgaaagacuaaucgauuuguacgaagacaaagacggccaacgcaaggccgagguggccgcccugacgggccccaacgaauucaacgaguucuacagcagacugaaacaaaucaaagacuucuacagaaggcaccccaacgagaucagcguaccgauguccguggaguucgacgaauucgccaaagcuagagagaaccccaacgaagauauggccaauuucguggaauucaccgacgaagaaggcuacgggaaguaccuagauuugcacgagugcuacgagaaguacauaaacuuaaaaggcaucgagaaagucgauuauaucacauauuuggcaauguucgaucagcuguacgauauaccgaaagaacgcaagaccggcgaguaccgcaaauaccugcuguaccucaucgaguaccucacgugguucgugcagcgcaucaggccgcugauggaccucgauggcgauuugcuagagcaggccgagcaggcugcggccggaugggagaacggaucggugcccggguggccgaaagaaaccggcucggcuuuggcgaacgugggcgcucauuuggaccuaucggcuuucuccaguugggaggaauuggcuucguugggccucgaucgauugaaauccgcucuuauggcguugggauugaaaugcggaggaacuuuagaggagcgagcccagcgguuguuuuccacaaaaggcaaaggcuccuuggauccgucguugaugacgaaaaacaccaagaaucgcgucacuaaagagaaggaggcgcugcggcagaaggagcuggcuacauuagaagcgcaaaucuacagauuggccgaucuggugucagcccaacgagcagccaccaaagagaacguacaaagaaaacaagcccgcacagacggcgaaagagacgacagcgagaacgaagaaagcgaagaagagagccccgaugaagccgaugaugacgugccguacaaucccaagaaccuuccgcucgguugggacgguaaacccauuccguauuggcuguacaaauugcacggcuuaaacaucagcuacaauugcgagauaugcgguaacuacguguauaaaggccccaaagcguuucaaaggcacuucgcugaguggaggcacgcgcacggaaugcgcugcuugggcauaccgaacacggcccauuucgcuaauguuacgcagaucgaggacgcuuuggcucugugggagaagcugaaggugcagaagcagagcgagcgguggcagccggagaccgaagaagaguaugaggauucgcaaggaaaugucguuaauaggaagacuuacgaggauuugaaacggcaggguuuauuguga

SEQ ID NO: 6229 - RNA, 639 nt, Phyllotreta cruciferae
augacgauaggaaagaauaauaaaaugauccaacacauaaacuauagaguccgaauaacauugcaggacucuaggacguuuaucggcaccuuuaaagcuuucgacaaacauaugaacaugauacucggcgauugcgaagaauuccgcaaaauuaaacccaaaaacucaaaagucgaacgagaagagaagcggguauuaggauuuguacugcugagaggcgagagcauagucucacuaacuguggaagggccuccaccaccagaagagggacuucccaggguaccuauccccggagcagcccaagggccagguauaggaagagcagcagguaggggaaugccucccgguauggcugguguaccaguuggucuccaagguccugugagaggagucggaggaccgucucagcaaguaaugacuccuacggguagaggacagguuucagcgccgccacaaaugaaccaagcaccuccaaggauggguggcccuccgccugguaugaugggaccuccgccgggaaugaugggcaugccgccgcaaaugggaauggggcgcggaggaccgccuccgauggguaugaggggucccccgcccgguaugaugagaggugggccacccggaccgccaaggccuuacuaa

SEQ ID NO: 6230 - RNA, 876 nt, Phyllotreta cruciferae
augaacuuuggagacuuggaguuugguuuuaaaauuucaaggaaaacaauaccauuaauuguaagagaaacuuguuuggccauauggaauguuauucaaccucaagaaauuccauuuccuacgaaggagcugugguuagagaaguccaaggaauuuuaugagauuacacaguuucccaauuguauuggaaguaucgacgggaaacauaucaggauaauuugucccccuaacucuggcucagaguauuucaauuacaagaaauacuucucgauuguccuuuuggcgguugcugacgcaaauuauuacuucacagcugucgauauuggaucuuuuggacgcgaaggagacucuacgaucuucaaaaagucaaauuuuggacuaagacucaaaaauaacgaacuagaccugccugcagauaauccccuaccaguaccugacaauguggagcaagguuccgagguacccuauguuuugcucggggaugaggcuuuuggguugucaaagcaugugaugcggccauacccguccaagggauuaucgcaagaaaagaggaucuacaacuacagacacugccgagcucggcgugucguagaaugcucuuucggaauucucucuaacaaauggcgugugcuacauucuucuauguuaauacauccugaauuugcugucaucguagugcaggcuuguuguguuuugcauaguuuugugcgaagaggagauggcuaccuuuuugaggauacucugaccugcccacugcaggaugugcaagaguccgcuguuguagggggcaugucaagagggaucgauguaagagaaguguucugucaauauuucaaugguucuggagcacuuucuuggcaaaacaaauauguguaa

SEQ ID NO: 6231 - RNA, 14418 nt, Phyllotreta cruciferae
augcucaccacugcaucuccauguuuaacuugcggcucuauuggagauauagcgaauuugauguuuuguucggguugcggugcgcauuaccauggaauuugcgugggauuagcucaguugccagguguuagauccggauggcaauguaggaaaugccgguguugccaagugugccgagucgucggagacgaaucuaagcugaugacuugcgaacaaugcgauaaaauuuaccacgcuaguugucaaagaccuguagugacuucgauaccgaaauacgguuggaaguguagauguuguagggugugcggggauugcggugcaaggacucccggggcugguuuaucuucaagauggcacgcucacuauacaguaugcgauucuugcuaccaacaaaggaauaaaggguuuucuugcccuauuugccauaaagccuaccgcgcucacgcucauagagaaaugguucaguguucgagcugcaaaaaguuuguucauggaaccugugauccagaagcagacguuguuaccuacaaucaaaagaaagaaauaagcauagacuaugaauacguuugcuugcauugcaaaaauagcacagcuagacaaauaacagcaaaaagagcaaguauugaugauccuuccgauguauccgcuucacacgauucucuauacgaugauacguccgaauucgaucuuccuucgcccgacgaguuugccaggaacauggguuuggguaaagggaaaccguacagcgcgaauaaaauagccaagaagcgccuuaguuucacagugaauccggugggcaggccgaaagguaccggaaaagugccgcccgggaaaaugggguacaugaaacgcuaccgacuaacugaguucaauagaaaacguggcccgaaagccaaaaugaggggcauuuucggcgugcccggcgucggucugcaaagaccgauuucggaugggaaaaccgacgaagaaccgggcguugaaaaucgauugguauuguguucagcuaaagacaaauucacccuaacucaagauaucugcguaaugugcggggccuucggcaccgaucaagagggauguuugaucagcugcguacaaugcggacaauguuaccaccccuauugcaucaacguuaaaguuacuaaagugauuuuacagaaaggauggagaugcuuagacugcacgguuugcgaaggcugcggccaacgcaacgacgaaggccgucucauauuaugcgacgauugcgacguaucguuucacaucuacugcauggacccgccgcucgacuacgugccgcacggcaacuggaagugcaaauggugcgccaucugccaauccugcggcaccaccgauccggguuucaauugcacguggaugaacagcucgacgcaaugcggcccgugcgccucgcacgugaacugccccagcugcaacgagcccuacggcgagggcgaucugaucauacagugcgugcagugcgagcgcuggcugcacggcgccugcgauuucaucaagugcgaagaggacgccgagaagugcgccgaagaggguuacaauuguauacugugcaggccgagggacgugccgccgccgcauauggugccggcggcggucacgccgaagccgcccacucccacgaagagucccgaguuggggaagaguacgagcuauuacauggacggcgugugucucagcgaauucgguagcaacuugaucaaaucguuggcucucgaguaccacgggucgaggaagaagcggaaaaagauacccacuguucaagauaaggaagccgguauuauggcuacgauugaaucggugguugccggugguaauguuauuccuacuaauauggaagacagcgcuaaauuggagcuagucgacaucaaagacgaaccucaagaauuauauaaggaaggcaugauguggacuaaagaagacgguccaccacccgaagguuuuacgauaaucacgauggagaacgguuugaacgugcugcgaaggaagaggcaacgcaaucugcagaagcucgguauuggaggauucguggucaggaugagagguaucagaacaggucaggauaaugaugauguugauucguccauuggucaaagugggcucaacgccaacgacauugucccaucgccugcggacggggacaaaccuagaaggaaaacuauucgucgaaagccgaagaguaaauuagcagaaacguuuccagcuuaucuccaggaggcuuuuuucgggaaagaccuuauggauacggucgauuguaaaaaggaagaagucgauuguuauaguagcgacgaugagaaaacugacaagcauuuuaaauccauuaauuuaucucaagacgaaauaauagcaaucguggcaucagguaaaaccgagaaauuggaaaacaauaacaaagauucgaccaaagaagucaaaccgacuguauugaaggaggaagaagaagauaauccggaggauuugaaagauguucuugccuugccgggcgacuuacucgauacugauuuggucaauaguauuauggaagaugaggaggaacugagcaaaacuacagccucucuuguugcauuagauucgaauuuacagcacgauacggaacugacggacacuuugaguaguucaggaaauucaaaagaaaccaaagaugaauugagcgacauuuuaggcccucauuucaaccucgauuccauaccgaacauaaacagcaaggaugucgaagacauauuuaagggcguauuaacagacgaaucgcaagaaucccaagagagcaguagcuuuuccuugcaaggaaauaauauguuuucgaguaauaaugcgcaacagaacguugcccaacaccccauuauuaaucaagcggugagaccgaaaacuuugccuacuguuaaucacaauuugaauuccccuguuaguuuuccaccacccucaccauaccacucggaauacagcaacaguccucaguuuaguccugcguucaccgauucguccuguucguggguaggaggaaacgaaacgccggaaaucgauaguaccaacgugacggucacaucaacguacaaucagagaucaucugauaaaaugaaagcugaugagaguuugggcaaaagcgcuacgauuucggccguuuuguaugcgaacaucaaccaucccgaauggaagaaggaguauccgaauuggcccgauagguauaagcaaauaauaaagaaauggagaacguugagccaagaacagaaagcgccguuuuugcaacacgcuagagauaauaggagucaguugaggaugaagaaagcgcagcagucacagaccgucaaggaaaccgccucaaccgccacgucccccaaugcgaccaagccucugcaccaagccgguccagccuuagugacaacucuccaggcgguaacgcaacagccggcgggggcggccgcggcccccgcgccgcccguuucagaggaccaagaaaagaucgcccugcaacagaaauccgccagggaagccgaacaggagagacaauggaagcaauugcaggcccucaggcagcagcaaacccaacaaacgcagaacauucuacacgaacagcgcguucaagcgaucgcacguguacaacgucagauuucaacugauccagcgcagcaguucauaaacgagcaacagagcccucugcaggugaacacgccucaggaauugagcccgucaaccacgccggcucccaguccuaggccauuccugggcauuaaaucgcccacguuccccguaccuucgcccguuccgcaaacgggcgucagggccaacacgcccucgcaaucgccccacgauaucucccaacccagcacgcccgacgguaacgaucacuuuauccacucccccacgaauccuaaaccuaauuuccaaccuagauugcccaaugauccguucgccgcgcaacccgccacgccgcgaccgcaauucggaauggcccggccacccuugcagaauuucggcgguacgguucgcaacgagcaacaggacaucaacaucaaucgccaauugagggagcuguugcagcggcagcagguuaaaaaacuggacgaauuguugccuggaaaagcgccaccucaaaggcuguggcacgcgaaugaucagcaagaggccggcgacgccucgaugacgucggcugugcagggcgccggugcccaaggaaccgacgccaccuucaggcagccucuaccgccugguguagugaaaccuagguuggcgauuucgucggugaauaggccgauauugggcacgguuagagucaaccaauuggaucccaggauacaaaauuuggauccgaggaugagguugauuuugcaacaucagcaacaaagacuggccaccgguauucagcagcaauucauccguuucacaucgaacgugcgcccgacgacgguggagcaguacgagcaauuguugcaacgucaggguaauaaucagaaucaaauucacgcggaggaacaacagcagggcguugcucgaauacccauagcccaggccagcguuauacaaaggccgcacguggcucaagcggugguuacuggcgccgccgcugugacaaccaguaccacagaaaguaauuccagcgaggagggaauccccgauaauguaacugccgaauuggagaaacuugaacaggaaacaggcacuaugguggagcuucaaggcguaagcgauauuuuaggagguuuggacgaugacgaugagcuuuuggccgaaaugggcgcugauuuuaacauacucgaauacgcggaucccgaauuggaggcccuaacgggcgguaaaacgaauauuuuggaccuggagcucgaggaggaaccggucaaaaaagaaaaacuagccucuaacgcgaacacuugcgcuccuucucagaaaccgacuccuaacguugcuacuacagcuauuagcaacaguaccucugugacuacaccgaccgaagcuaaugcagaaccuaaaaucgagaauacaauucagcagagcauuccgaaaucgacgccacaacagcuacaacaucccguuucucuuccacagcagcagaacauuccccagcacggagcccaaguucaagugcaaucgcagcaaucccagccgcauccgccgcagcaaaugcccauccaaucgacgcugcauauucagcaaauucaccagcaaauggugcaucaaguucagcaagccgcagcacaaggaaggccgaugccuccggguucgaagaugcaaaccacagauggauucguugguguugugauggcgaacaacgccguacaauuacagauaccuccgaauuaucaacaacgguugcuucuguugcaacaacugcaaaaucaaaaauugaugcgagugggaagcacacagccuagagcugcuuugcaaguggccccuaaucaaaugcccguagguaugaauccgggagcuaggaugccgguaucggcgccgccgccgccuccgccgccuuaucccgggccgcccccgcccuauccgggcaacgcgaaucaacaucagcagacgggauugagaauggggccuggucuucucccaaugggacauuuucaucccaguacacugcaggguuuucccaugcauccacacuugcagcggagaccucuucuccuggaggaacaaccgcugcuguuggaagaucugcucgagcaggagaaacgcgaacaggagaagcugcaaaaccagccgcccaaccacgaagucaccucguccaccggcaacgaaacggaaucagcuuugcugagcgaccaggacuucgagcgccucaaagccgauguguuuaacagcgccccagugaguaacauaucuucuacgaaucaagggaacgccgcccaaacgccgcaagcguggccccagcugcagaauaggcaagcggugguuccggccgccgcuucgcagcacacgauggaagugacuacuagaguucaaauguauaauccuaauuugauaccggcgccgccgcucccgcccgagaauaucgcuacggagcaggacaagcaggcgcagcuguuguacgagcaguggcugaaccaccagaacaacucgcucgugcagcaauugcgcuauuaugagaccgaagugcagaagcuucguaagaguaaaaagucgcuaaauaguaagcaacggcaauugaggaaagcugguaaccaguuaaccgacgcagaugcgacugagcuucaaagaauuacugcggaacaggcuauauuacagaaacauuuggaaucgagcaggaaacaaaaucggcaacauggaauguugauacaggaauaucgaaacaagcaucccgccaucaagcagagaaccguaacggaccagauccaaucgccguugggccauccggccucgucgcccauacagcaaucgagcgccucguugucgcccaugcugucgcccuccgugucgccgaugacccagaacagcucgccuuugaacagccccgggccgauggugccuucgucgcccggccacagcgccgugcagaauauuuugcaaagccccaacggcgccaaugcggcucaaaugucgcccaugcaggcguccccgaugcaaucuucgccgagaaucgguacuccucauucucaaagugaugaaagucccggaucggcgcaaucgccgucgcaggucugccugccgccgccuaugccuagaaugacgucgccucagcacagacgagucgucaccaguccggugggaaugucgcaaaugcguuuuauaaacaacaacauguugcagcaacgcguucgcaugcagucuccuauacagaauuuccaacagaaacccggcacgccuucgccguugaacagcccgacgucgcagcaaaugaacgucaaccagcaacaucaaauccagaaacagcuacaacaacagcagcagcagcagcaacaacagacguuguugcagcaaaauuuggaaggcgauccaaacgccauucacucgcagaggaccacgcaauuguugcagcaccggaauuucaucaggcagcaggugucccagcagcaaauaucgccucaaacguuaaccccgcaacagcaucaguugaugcugcaacagcaaaagcagcuggcccagcaacaacaacagcagaucgcccaaaugaacgccgcgagauugcaacaacaacagcaacagcagcagcagcaacaacaacagaauaacccgccgcauucgccgaugccgcccaaaagucccaugaucaaccagcagaucaugucgccgcauucgaugccccaaucgcccaugcagaugccgccgaagagucccauggugccguucaaucccaaccaaacgaaucccaauucgccugcggcuaggagcccggcuuuccaucaggguaugaaccaaccgacgagucccaucacacacggccaucaaccucccaguucaccgaugccuaggagucccaugaucaaucaaacgcacucuccgcauaacguucgaaggccucccagcgccaacagcagcccggccaugccugauaggccgcacagcguagagaauucaucgccuaggauguacucgauagaucaauuggugcaggagaguuuggccaaucaaaauguaaacgcgcaguauaacaguuacaauucggauaugaucaacgaaagcgguggagggaauucgaauaaccccauaccauguccaccggaaauaccgagauuucgcuauuuuaagcucgguuugagaggcggagcgccuauguggagcuuuggaagaggcgccaaaagaaucccagcgccuccgaacgccaaaccggacgaacccaaggcgaagaaggagucgcauuugagcaaaguuucgauacuaaaaaggaaacccccgaucgcuucuaucgguaaagugggcucguugguuaguucggauuacaacgauuuggacgacaguucaacaacgccuccuguaacaccaccguuggcuucgaccagcagaggaagucugucgaagaagaagaaucucgaacugcaagcccagaaggauucggugaucgucaugcacagucccgaggauaauaacaaacagcucgaaauaauggauuacgaugacgauaauaacacgguucuaucaucagaagugucguugaguucuguagcaagaaacgacgacgacuugguggagaucgaaacgauaucgcaagaccucgccgaagggcuauccagcccguuggaauccgaucaaauaggcgacgaauuccuguuguuucccggcaauauggugguggauauguccggugaagagcauuacucggaaaaggaggaagaggaaaccguugaugaggaguauaccgaucagaauaugcacauagugauacgcagcccgaccaccagcgacgacgaguucauaaugccuugcaaagugaagcaguacaacgaggacgagcaggaggauaaccccgaaucgcccgaucaggaggaauucggcgaauccuccgauaugauggcgaguuacgauaacgaagacacggauauaaucauuucagaucaaaccaccggcguucccgaggacucgaucuccacuaaggaagacuucgaggagcucaucgacgaggggucgcggaaaaacaacaucagcaagcaagaggugaccgcgaaacacauucaagauuuccacagguacaccgaauuguucgauuacggcaaaccugaugcccaaccgguuaagaaaccagucgccaaaaaauuccaaccgaaagucucucuaguuagaggaguagcuuugcccaguaagcccaacaccgagaagauuaucaucacgcaaaauucgaacguguugaauacuucacaggcuucgaaagucaccagcaucauuuuaacccacaacgcaaauguuagaaggaacauuauaagcguaccgaaaauagugaguaccguuucaccggcuauaacuauagugagcgccaguaccucgcaaauggccucuauauuaccaucuaaauucaccgugccgguuauaagcgccagugcgguacgccagcuauccaacgucaaagucaucgacaaaccauccacuucuucguugucgauuucuaccagagacaacguccugccgaagaagauauucgaggacgauucggugucgccggacaguucgaauugcgacgacgagaaauccaaagauucauucgacgauaaagucaagucggagucuccgccgcgggaggucaaacaguucgugaaaucggaucagcaggucauaucgcugaaaucgaagaacuacuccgaucaaucgaagaagaucgagcaucugcaaauagugaauauaucugcgaaggaugugguucaaaggcagaggauaccgaguccuuugauaucgaaagcuucuccgguuaucauucacaauacgccagaguugaaaaugacugcgcaaguuauucaagagagccaaacccgcaugaaaauuacuacuacuacugauacagaacauuacgaugagucugcggaugauacgaagucaguugugauuucaauuccgucuccuacaccuucgcaagaacagaugcuugauaguauagcuuuccaggcgcuugaaaauagaaggagagaauacgauucuaucgaagauguauuagauaugauugagaauauagaaaacaucaccgccgaaccgcccgagauauuagaagaaaacacguugcaaaauuccgauuccaacagcaacaucgaaaccaaaaccaccgaaaccaaggaguugaaauugccuaccagcgaaagcgaagcgcccgcuaccaaaucauccaucguaccgcaauuaucgccucuuucccaacccacggaauugacuacaaacauggccaacgccucgcagcagcucagaacucugcuauccucgcugcaaaccaccucgacgucguccccgaccaacguggaguccauagccaagggcuucggccagaaaaugagcaccuccucgucggcuaaccagcccauagucgccucgcgggugaucggccaacaagccggcaggcaaucgccaguuaucaccagcgucuccaccgucauaguuccgaauuucaagcaaaaaaucaccgccgcaacgaccgccgcgucccggagcagccccgugaagguggucagcaccucgcagcaauuaaccggauccauaauaaccucgacuuugaauuacauaccgaacagaacgaucgguauacagaugguggcggaucaaucgaaacugccgccggccagcaucgugacgacgaugcagcaaaucaacucgaucaccuccagccaggagucgaagaagccuucguugacucucacggcgaugcugcaaaaccagcccgcugcgaauaugaugacuaaaucaucagccgauacuaucacggcugcuaguuugcuaggcucgcccaucagccugcccaaaaccggguucaccacgucuuuggugcaagcccaaccgagcguggugcugucuaacacaccgccagcgccuagccaaacuuccacggcgacaucuucuacgaaaaccaccgcggauucgaucacggccgcuaguuuauugggcaguucuauuaaaacuagcuuugcaaugcaaccgaguagcaccguaggaguggugacgagcugcgucaacaagacgccuacuuccacuacuaaucugcuccacacgcaguugacgaaagucgugagaagcaaauccgucgacgauguuaaagaauuggccaaaaucgacgagaacaaacaaagcguuagcagcgaaauuguagaugauaguaacagcggguguaaaucaucaacgauaacuacgguagccuguaacaaaacugaagauucgcagaauguguuacucaagaaauugcugcagaauacagcuugcgccagcgcccaauccuccccgccggcuucuacuaguacuguuacaaccagcgcugcuaauacuauaucuaaagugguuaacacgcaguguaguacuagcgcuagcguggagcaaccgccgguaagcgcuccuucgaacguuacaguccaaagaagcgccagcagagacgagcuacuaucaccgccacaagacguccaaacuaugguagugauuaaaaaagaaccgccguuaguaccgcugucccaaccgagcccagugcugaacucgaacuccaacgcucacacgcccgaagugaagaaagaauucaucgacgaaucgucgcagcacuccgaaguauccgaucacagcagaucggacgccccuauuaaagaggaacuggaaaccauggagagcgccgccgagaagaugaugcucgacaaggaggagcugaagaagcagaagcgccgcauguaccagcagaagcgccgccagaaccagauccucaacaaggagcuggcgcagcagcagccgaagaagcggccgcgcaagaauucgaagaucgacgaggacuacgacacguacaucgacggcgugcuggcgcagcugcgccagcugccgcccaucgccgucuccgagccggugcugaaccgcaacuucggcguggugccgcuguucgggugcggcgaucuggccaagaucggcgccaaggauuacucgacgcaccugggggaguugacggggaacuacggcuacggcgagcugcccggcuucaccgauuucuacucgacgaagcccuacggggauauggauccgcugccggagaagccgccgucgucgacgcagcgcggcuucuacgaccaggaguucccgcugauuagauucgaugcggacgagcacaagaaguuugacguguuuugcagggaggauucgcccgauucgauauugagcagcucgucgccggaauguacgcgcgaacccgaaggcaaauucgucggguugaagcucaucagcgacagcgaagaggacgaagaagaugaugccaaagauucugucucgaaaggaagaaugucaccagugguacccgucaucaagccuguuccuauuagacugaaacccgccggcgaauuguacuucaaagagaaccucaacgagaacaaggagaacaucaacagcgacucggugcacguaaugacgaaauccaaauucgacaacaagcagucuccaccgucgaacguuuccggccacguuacaguaaccuuaacucuaacaucaucugcggcugaagauauaaugggaguguugcgggauuuggcgaauauucugcacauacccgcuccgacuaguuaccaaaucguggagagaacggcgucuccgcccagccagaaauugggcuuguaccgcaccaaaggcaaggacggcaaagaaggggcucccaucgacauacagagcauccucaacggcgccaccaaguucugcaagcacugcgacgugaucaucuugagcaacaucaucaggcggaagguguccgauuuaccguuccucgcuaaagauucggauuugcucagcgacggggaagaauuguucuuuugcaguuccgcuuguuacaugcaguucgcuuugaugcaccggucgccuucgauauccgaagauaaggcugcugaaauuauaaaucaccuaucgcagaaagacaauuuggauucgaagcagaaauugcccgcagacgcguuagauagcaauaaaucgauagcgcagaaguuaucguuuaacaucaaagaugcgaaacgggaauucgagccgauggagacgaacgaugcguuugcguuuuucgcucguaccaccgccaauaaacaagggaacaacuucuacgauggggcgccauucaaaucggucccugcuaggguacacaggaacgauagguacaaacucuggacgcccgguugccuccaacccacccagaaacacaaaacucccaccgacaaggagaucauggagcugcucuacaggaugcagaucaccguuacaccucccguuaugcccgaagauacgaggaaguguuuguucugccacgguauuggugauggcguggccgacggaccggcgagacugcucaacuucgacguggauaaaugggugcaccugaacugcggccuguggucggacgguguauacgaaaccgugaacggggcuuuaaugaacgucgaaagcgcccuacaguccggguuguuagccacuugcgugcauugccaaagcaucggggccaccaucaagugcuucaagacgagaugcucgagcauauaccacuugaauugcgccgucaaagacaauugcguguuuuacaaaaacaagacgguguuuugcaaaguccacgcgccgaagaacgaaaaagacaacgaacucaccacccucuccgugucucguagagucuacaucgaacgagacgagaacaaacaaguagccgcuguuaugcaccauuccgauucuacagauuuacugagaguaggcaguuugauauuccugagcgugggucaacugcucccgcaccagcugcagaauuuccauacaccgaaccacaucuaucccaucggcuacaagaucaucagguucuacuggagcaugaggaacuugaacaagcgcugcaaguacauuugcaccauucgagaagugucgggcaaaccggaguuucgggugauggugcaagagccacccgaagcggacguggaguucuccgauugcacuccgaaaggcgccuggcagaagauucuggacaacgucgcuagcauccguaaagagaauaauuguuugcacauguucccgaaauucgcuacaggugaagauuuguuugguuuaacggaacccgcuauaguuagaguguuagaaagcaugccgggcaucgaaacguugucggauuauaaauucaaauacggccggaacccuuuguuggagcuaccgcucgcuauaaacccuucaggaucagccaggacugagccgagauugaggagccaguugcauuggaagaaagcgcauacacagagaacuacuggugguacuucguccauucgaccaauguucgggccgucuuuaacaggaucuauuaguacuccagcucaaggggagaucgccuguccuuauagcaagcaauuugugcauucgaagaguucgcaguacaagaaaaugaagcaggaauggaggaauaacguuuauuuggcgaggucgaaaauacaagggcuggguuuguacgcugcuagggauuuggagaaacacaccaugguuaucgaguacauaggagaaauuauuagauccgaacuggcugagugcagagagaagcaauacgaagcgagaaaucgaggaauauacauguuuagacuggaugaagaacgcgugguugaugcuacuuuauguggcgguuuggcuagauauaucaaucacucguguaauccgaauugcguggccgagaccguggaaguugauagggauauucgaauaauuauauuuuccaaacggagaauuuuacgaggagaagaguuggcauacgauuacaaauucgauauagaagacgaucagaacaaaauauccuguaugugcggagcuccgaauugucgcaaguggaugaauuaa

SEQ ID NO: 6232 - RNA, 2055 nt, Phyllotreta striolata
augccuagagaagauauacuugaagggcacaaacacaaaagccacaaaaguaaaaaaagccgguccaguagccguuccgagcguacucaagaaaagcacaagcauucaucaagcucaaagaaaaagaguaguuuccacgaagaugccgaucgaaagaaaaagaaaaagcgaucuaagagcuccuccagugaauccgaaucgaccagcagcgaaaguucggguaauucgguggagcuauuaaaaaaacuagaaaacgaaagauugcgaucagccgaacaaaaaaagaaggaaaaggagcuucucaaagcugcugaaaccgccgaggagaagagauugagaagauugaugaagaaagaggcgaaggaaagaaggcgaaaagagaaaaugggcugggacaacgaauacuuacauuacacgaacagcgacaauccauucggagauggaaauuuacugaccacauucguuuggaacaaaaaauuguccaaagaaggcaucaaaaacgucggucacgcagaaaucgaagcaauaaaccgguuaaaacaagaggagaauaagagggaacucgaaaaagucaagaaacguaggcuagagagggaauuggagaggcaaaaaagagaggaagaaacccaaaugaugcaaagaaguaaagaagcugcccaauucgaggaaugggaaaggcaagaagauaaauuccacuuggagcaggcccgacugagaucucacaucagaauucaagauggucgagccaagccgaucgaucuacuagcaaaguacauaagcgcagaagaagaagucgaugccgucgaaaugcacgagccuuacacuuaccucaacggcuugcaaaucaaagaccuagaagaccuagucgaagacaucaaagucuacaaggaacuagaaagaggaaagaaccuagauuacuggaacgacauaacagucauaguagaagacgagcuucaaaaguugagaaaaauugaaaaacaaaacgauuucgacuugggauugaaccgaagagaagggauacaucaaucuguugccacugauguaacaucaguguuuaaaggcaaaacggccgcacaauuagcggcguuagaaaggcaaauuggaagcaaaauuagcagcaaagccgaugguauagacauaggcuauugggagucuuugcuaucgcaacuuaaagcccacauggcaagggccagacuacgugacagacaucaagauagcuugagaaggaagcugcaaguacuaaaagcagaacaagccauuacaggaguaggucaaagccacagcgaaacucauucuacugauaacgaagaaaccacuucggaacccaaaccaagcacuucccaggauucguuggaaacgauggaagaaagcaaugaaaagagcgaagacgcugcucaugcguggcugaacgaaugcuuuucggccuaccaagcaggcggauacaguccaaaguuuuuaacuccggacgauaccgagcccgguacgaucguagucucggaggaagacgauuuaaaacgauuggaauucgcuaggaugcaggugacgggccaaggaaccaaaaucgaaaacgucguuacaaaagaagaguuacugcuacaaaaggaagcgagaaagggaauggacggggacgaggcucaauuuucagucgagcaagccuuggauaauccaguguauuuauggucggauaaguaccgcccacggaagcccagguacuucaaucgagugcacacaggauucgaauggaacaaauauaaucagacccauuaugacauggacaacccgccgccaaaaaucguacaaggguacaaauucaacauauuuuacccugauuugaucgacaaaagcagcacgcccgaguauuaucuaacgcccagccccgagaauagggaauuugcuauacuacgauuccaugccggaccgccuuacgaggacaucgcuuuuaaaaucgucaacagggaaugggaauauucauacaaaaggggauuuaggugccaguuucauaacaacauauuccaauuaugguuccauuucaagagauauagguaucgaagauga

SEQ ID NO: 6233 - RNA, 1323 nt, Phyllotreta striolata
auggacaauuuagaagccaacauaauggacaaguccaugcgauccgucuucgugggaaacauccccuacgaggccaccgaagagaaacugaaggacauuuucggggaaguggggcaagugcugucguucaaacuggucuucgaccgugaaacgggcaaacccaaaggcuacggcuucugcgaguaccgagaccaggaaaccgccuugagcgccaugaggaaccuaaacggauacgaaauuggcgggcggaauuuacgcguggacaacgccuguacggagaagucucgaauggagaugcagaauuugcucaaucagccgcccgucgagaaucccuacggggagcccauccaggcggagaaggcuccggaggcgaucagcaaagcgguggcuucgcugccuccggagcagauguucgagcugaugagacagaugaagaguaccauacagaauaacccaaccgaagcgagacagaugcuuuugcaaaauccccaauuggccuacgcccuucuacaagcccaagucgucaugaaaaucaucgauccucauacggcagccaguuuacugcaccccgucaaucaaguaccggccacuuugcuggcgggcgauaagaacguaggccugcaaguacccaucgggaaccaauacagggagcccccgggacccgugcaggcccccaggcaggaguaccaacccguaccgcccccgacugcagucguacauccgggucacgugcaacaacagccaguuuuuaccggucaagacgucgauuugagaucaaugggaaacgugacugauccgagaaucagaccgaugauggucgaucaggauaugagacaaaugccgaacgucauccagaauccacugccgccuacgaucagugaaagcuuuucgagggauccccgaagcgccaccggcggcuucccgucggauccgaggcaagccaggauggacccgagacaaaaaaauaucguaccucccgccauccaacaaccaccaucaucggugaauccaaaauugaaucaagcgggccccguccugccgccgcccguccgaccugcgcagaacgucaucgcgcaaucaacgccuaccgcgucugccauaucuucaucguugucgucgggaucggcaggagugggaucggcgggugccaaugugaugaguccggguaucggaggagcgggugcuacugaucaggaaaaagccgccuugauuaugcaaguccuccaauuauccgaugagcaaauugcgauguugccgccugaacagagaaauagcauuuugguguugaaagaacaaauugcgaaaagugcgcauguccguuga

SEQ ID NO: 6234 - RNA, 1179 nt, Phyllotreta striolata
auggcacaaauggaugcagaacgugagaagagccuccaagaguacagaaaaaaauuguuggagcacaaagaaguggaauccaggcuaaaagaaaugcgagaacagcucaaagauuuaacuaagcaguacgauaagucagaaaaugauuugaaagcccugcagaguauggggcaaauuguaggugaaguuuugaagcaacugacagaagagaaauucaucguaaaggcaacaaacgguccucguuauguaguuggcugccgucgucaguuggauaaggccaaauuaaaggccggcacuagaguagcucucgacaugaccaccuuaaccauaaugcgguauuuaccgagagaagucgacccguuaguuuacaacaugagccacgaagauccaggagacgucacuuacuccgccauaggaggacuuuccgagcagauuagggaguugcgagaagucauugaacugccucucaugaaccccgaauuguuuaugcgagugggcauuacacccccgaaagguugucuguuguacgggccgccugguaccgguaaaacucuguuagcuagagcuguggcaucucaacuggacgcgaacuuuuuaaaagucguaucgagugcuauuguagacaaauacaucggcgaaucggccaggcuuauuagagaaauguucaacuacgccaaagaccaucaaccgugcaucaucuucauggaugaaaucgacgcuaucgguggucguagguucuccgaagguacaucggccgauagagaaauccaaaggacgcuuauggaguugcugaaucaaauggacggauucgauucguuaggacaaguaaaaaugauuauggcgaccaauaggccugauacuuuggauccugccuugcuccggccgggucguuuggacaggaaaaucgagauuccucugcccaacgaacaggcucgacuugaaauucugaaaauucacgcgcuuccuauugcuaagcacggggaaauugauuaugaagcuaucguuaaauugucggacaccuucaauggggcugauuuaagaaauguguguacugaggcaggacuuuucgccauuagagcagaaagagaguacgugauucaggaagauuucaugaaagcuguaagaaaaguugccgaaaacaagaaacuggagaguaaauuagacuacaaaccuguguaa

SEQ ID NO: 6235 - RNA, 780 nt, Phyllotreta striolata
auggcucgccgguaugauacgagaacgacgauauucucacccgaagguagauuguaccaagucgaguacgccauggaggccauaucccaugccggaacguguuuaggcauccuggcuaacgacggaauccuucuugccgccgaaagacggaacaccaacaaguugcuggacgaaguuuucauuucggagaaaauauacaaacuaaacgaggauaugguuugcagcguggcgggaauuacgucggacgcuaauguucuaacuaacgaauugcguuugaucgggcaaagguauuuguaucaguacggagagucgaucccaugcgagcaguugguuucgugguugugugauguuaagcaagcuuauacucaauacggagguaagaggccauucgguguaucgaucuuguacaugggcugggacaagcauuacgguuaucaauuguaccaguccgauccgaguggaaauuauuccgguuggaaagcgacuugcauaggaaauaacaguuccgcugcuauuucgaguuugaagcaggaauacaaagaaggcgauaugaccuuaaaagaugcgaaagguuuggcugugaaaguucuggcgaaaacuuuggauauggcuaaauugacgucggaaaaaguggaaauggcuacacugacgcguagaaacgauaaaaccaucauaaauauauuaaauagcaaagaaguggaagaacuuauuuccgaguacgaaaaauccgaagcggccgccgaagcuaccaagaaacaagaacaaaaauccgccgcuuga

SEQ ID NO: 6236 - RNA, 2664 nt, Phyllotreta striolata
augagugaaucaaaagccgaaccuauaaagguggaaucaaaagcaaaugaugacaaaaauaagaacgaacuuucggaugaggauaagcaacuucaagaggaauugaacuugugcguggaaaaguuacaagaaaaugacaguaaacuuuauaugcccgcauugcaagcuuugggcaaccauauucgggccucgacuacuucuaugacguccgugcccaaaccacugaaguucaugaaaccucauuacgauacgaugaaaacgaucuucgagaaaauuaccgaggccccaguuaaaugucucugcgcagauauuauuuccguacuagcuaugacuaugggagaaggaagggacugcuuaaaguacaggcuacucuccgauuuggacaaaaucggugaauggggccacgaauaugucagacauuuggcuggagaaauugcuggugaauggggcgaaaccgauuucuuaauaaacacagaaguuagagauaagcucauauuguuaacgaaacagaucguuccuuauaauauggcccauaaugcugaagcugaagcuugugauuuguugauggaaaucgaaagacuagacuugcucgaacaguauguggaugaaaacauuuacccuaggguuugcuuguaucuuacaagcuguguaccuuacguagcugauccggaaaauaccacucuucuucaaacugcuuugaugcuauucaggaaauucaagcaguacccucaagcucuucgauuggcuaugcaacugaacgaucacagucucauugaagaaauauuccuaaacugucccgauacugaugugcagaaacaguuggcauucauguuggguaggcagcagauuuacaucgaaguacccgacaccacaccggaguaugaagaccucauugaaauaauggcgaauugucaucuaaacaaccacuuuuugaaucuugcacgcgaauuggauauaauggacccgaagaccccagaagaugucuacaaaucccacuuggaaaacagccgucccccauucgguggaagccaaguugauucugccagacagaacuuggcugcgaguuuuguaaacgguuucguaaaugccgcuuucgggcaagacaaacucuugauggaagauggaaauaaauggcucuacaagaacaaagagcacgguaugcugagcgcuacugccucauuggguuuaguacuauuaugggacguugauggaggucuuacgccuauugauaaauacuuauauuccucugaagaucacauuaaauccggagcucuguuggcuugcgguaucgucaauuguggagucaggaaugagugugaucccgcauuggcucuguugagugacuauguccuucauagcacaaauauaaugaggauaggugcuaucgugggccuugguuuagcuuauguuggaucuaacagagaagcaguuuuaagcuuacugacuccugucuucuccgauccgaaauccaauauggagguuaucgguaugucagcacuagcuugcggaaugaucgcagugggaucuggaaaucuucaagucaccaccacaauuaugcagacguuaauggaaaaaucggaaucugaacugaaagauacauacgcuagauucuugccuuugggucucggucuuuguauguugggcaaacaagaagguaucgauuccauaauugccgcguuggaaguuauaccggagccuuuuaaauccauggcaacuacuauggucgacauuugcgcuuacgcugguacuggcaacgugcuuaaaguucaacauuuacuucacauuugcuccgaacauuacgauggcagugacagcacagacaagagcucuaaagauaaggacaaaaaagacgccgcggagaaggagaaagaccuuuccucgagacaagcaguggccguacucgguauagcuuugaucaguaugggcgaagauauugguagcgaaauggccuuccgcaccuucgggcauuuguugcgcuacugcgaaccagugauuagaagagcaguaccguuagcuuuaggacuuauuucaguaucgaauccuaaauugagcauccucgauacuuugaguaaauucucgcacgacagugacgcggaaguagcccacaaugccauauuugccauggguuuaguuggagcggguacgaauaacgcaagauuggccgcgaugcugaggcaauuggcgcaguaucacgcuaaagauccgaacaaccuguuuaugguucgcauugcucagggucuaacacauuuagguaaaggaacguugacguugaguccuuaucacagcgaccgucaacucaugaguccuguagcaguugcaggauuaauggcuacacucguuggguuuuuggauguuaaaaauauuauuuugggaagaucgcauuaucuccuauacacuuuagcagcggcuaugcaaccuaggaugcuugugacauucgaugaagauuugaauccauugccgguaccugugagagugggauuggcuguugauguaguuggucaagcugguaaaccaaaaacuauaacagguuuucaaacacauaccacucccguucuucuugcuuauggugaaagagcugaacuggcuacugaagaauaccuagcccucacuccgauuauggaagguuucguuauauugagaaaaaaucccgacuucaaugcauaa

SEQ ID NO: 6237 - RNA, 1410 nt, Phyllotreta striolata
uuucaaacuacgaagucaagacacauuuuuuugauuuuaccugugccaauuuggaaaaucuguaauauggacucgaaagaagagaaacaagcaucaccggaaaacgugaaacugaaaacagaagcauccgagccugaggcuccuccagcucaagcgaccgcaaccggcgugauccgaagaaacuucaucaccccggccggaacaauaguggaaaccaacgaagagcaaccaccagaaccaacgacagaagaaguagucaaaacgacaucgucaaauccaagcccggccgaacagaaaaccgaacccgcagaaauagucuauacggcggagguccugccgcaggagcaaagagagcaauucgcugacgcuaaaucuuacgccguagaaaugcccgccgagaauuuuccuaauccgagcuuuacgcaggacauuaguuacgugaacauagaaggaacuguugugcccguuacaauaucggaaauggaacauccuggggacuaugccaaucuacaaacugcucaauacaacaacggcuauacggauggcacacaauauuuaaccaaucaucaguaccagaacauguauauagagagaaguacuguugauaauucuccuucugcuacaguucuauaccguggcgaugauccgaauuugggagcuucuagauuccaagcaaauuacgacauauccaguacucaaucgcaagugaaccuucuucccgcuuccggagaaaccuacuauacaucaacaucuaacuggacgccgaccagcagcgguucuuacccacaacaauauccaucagggaccauaaacguccuucaagcugauucgacccaagcuuucggaacuccuuacauaaacgcgaccuggucgucgaauucgauggaggacggacggcaaucuagucaagagacuggaaauagaagaaacggcguaacgugugcaaauugcaaaacuaacaacacaacacuuuggagaagaaacaaccaaggcgagccaguuuguaacgcuugcgggcuuuacuauaaauuacauaauguuaacaggccgaucaguaugaaaaaggaagguauccaaacgcgcaaaagaaggccaaaaaacucuucggucggaagcccugcgagugcugcaggucaaguaagaauggggcuucccacuuaucaauauucagacauggauguacagcaagaucaauaccaauuaccagugaaccuuuauucucaaagaccacaaguuucuuaucgacauuacggaaccgaaaauauuggaacauuaaaugcacaaccacugcagccaauaauuacucacgaugaugaacaggcaagcgucauuacaucgacuucacaacaggcuagguuuaggacaaauguagaagaggacgaaggaagcaauccuucuaugcaaucuuaa

SEQ ID NO: 6238 - RNA, 2193 nt, Phyllotreta striolata
augaauacgauggcacuaccggggaaugggauauucgucgucaaaggcgaaauaucgaacuugauggcggccaugaagaggggccccaaauggucgucgcauucuuaucaggacgacgacgucgacgcgcugcugaggaacuuccaagagcugcgggacauucuacacaacguaaacgauuuaggauacguugaacccaacacguuuuuggccccuuuuuugaacgucauccguucggaagagacuacggguccuguuacuaguuuagcgcugucagcuguuaacaaguuccucucuuacggucuuuuggaucccguacaaacauccauuccgcagaccauccacaccaucgcagaugcuguuacucacgcccgguucgugggcaccgaucaauccuccgacgggguaguccugaugcgcauccugcaaguacugcgaacucucacacucuccccugagggcuccacguugacaaacgaaagucucugcgagauaaugcuguccugcuuucggauaugcuucgaaacgagacugucggagcugcuucguaaaacugccgaacauuaccugaaggacauggugcaauugauauucaugagacugccccaauucuccgaggacccgaagcucuccuacgucaagcgauugcggaugcagcccggugaccucgaccagacgagaacgaagaggaaaaaguacucgaagaaggagaacaaagaggccguuaaaguacaaccgcaagaaacuaacgucgaaacuaccccgcaggccgacauaguagacaugcaagguacuauucuucguaauaacgaaacugcuaguguuacaacgccuucuaguccaaauccaaauguugauacagacguuacuauagacauuccaacagacgacaguaugaagaauucagaaacuucuaauuuagaugauaguggggagaaagaaacggacgaaccuuuucaagacuaugucaaucaaagggguauucgguuuacgccucaauuccaacaggaaaccaaucuaucuccuuacgguuuagccugcguacgcgaacuauucagauuccuaaucagucucuguaauccuuuggacaagcaaaacacggacgucaugauacauuuaggacucgguuugcucacaguagcguucgaaauuagugcagacaacauaggcaaauacagcacccuguuggcucuagucgaagacgauuuaugcaggaaucuauucgcuuuaaugaacaccgaucgucugacgauauucgcagcgaacuugcaagugucguuucugcuguucgaaucgcuacgcgcccacuugaaguaccaauuggaaugcuacuugaagaaacucauggagaucaugcgcagcgaaucgaacaaagugagcuacgagcacaaggagaucgccuuggacaaucuguugcaauuguggcgggugcccggcuuccacgccgagcucuacgugaacuaugauugcgacauguauugcgcgaauuuguacgaagagcucaccgagcuacuggccgaacgaucaauuuccaccgucgugggaguguaccaccagcauuugcugucgcucgacgggcuucugaucauaaucgauggcauaggaaagagauucgacgaagcgaaagaucgcacugauaccgacgagauuaguaguuacauaggagagaauacgaggauuaaagguuguguuaaaguacccgauaagaagguguuggccgcgaagaaggcgaucaaaaagugguuaccucaagguacggaguauuucaaucagaagccgaagaagggcgugcaguuccugcaggagcacggcguuuugaagcaggagcucgacguggaggagaucgcgagauuccugcgggagaauccggcguugaacaaggcgaugaucggcgaguacaucagcaaucggggcaaccugaagauccucgaggcuuuugugagcacguucgauuucaccgggauccgaaucgacgaggcgcugcgagcguuuuuggagacguuucgauugccaggcgaggcucccaccauuucguugauccucgaacauuucgccgagcauuggcacaaaagcaauggggaacccuucgccgacguggauuccgcuuucacccuagcguacgcugugauuaugcuaaacgucgaccagcacaacgaaaacgccaaaaaaacaaacaacucccaugucgccuaa

SEQ ID NO: 6239 - RNA, 618 nt, Phyllotreta striolata
augucgauuuuggcguacaacgggggcgcgaugguagcaaugaaaggcgaaaacugcgucgcgauagccgccgaccgccgguucggcauccaagcccaaaccgucgccacgaacuucgagaaggucuucgaaaugggcccccaccuguucgucggccugcccggccuggccaccgacacgcaaaccgucauggagaagcuccgguuccgcaagaaccucuacgagcugaaggagaaccggcgcaucucgcccaagguguucgccgccaugauaucuaacaugcuguacgagaagagguucgggccguucuucguggaacccgugguggccggucuggcgcccgauacguucgaaccuuacauuugcaacauggauuugaucgguugccuuaacgaacccagcgauuucguuguaggggguaccgcuucggcgcaauuguauggaaugugcgaauccuuaugggagccuaauuuagcacccgaugaucuguucgaaaccauuucgcaggcucuaauaaacgccuucgauagggacgcuauauccgguuggggagcuacgguuuauauuguagaaaaggauaaaguaacuauaagaaaccuaaaaacucguauggauuaa

SEQ ID NO: 6240 - RNA, 2904 nt, Phyllotreta striolata
auggacggaaaaccggauuuggaaguggugaaaucagccguaucaacauuauacaacaacccggauggcggugaaaaagaaagggccucccgauggcuauuggaauuacaaaaaucgguucacgcauggaccguugccgacgaauugcugcgccguugcacgaacgccgacgaucuccaaacccgcuauuucgccgcucaaacgaugcgaaccaaaauccaccaauccuuccacgagcugcccagagagguccacgagucucucagggacucgcuucuggagcacaugggggcuugcgcuggcgucgaugagggcgcaggugccgccauagugacgcaacuaucgcuagcacuugcggauuuggcgcugcagaugcccgauuggcgaacgccugcgcuggauuugaucggccgauucagcgcggggaauaacguguggcccuuauuggagguguugacugugcucccugaagaauuagagagcagaucagugagauuaggagaaaaucgacgauacgagguauuagaagauaugaaauucugcgcucccaccgugaaugaauuucugaagcauuguucgaauuuguacggaagaggaggaucggaaagguuagcggcaggcgauagaccgaucgaugugaaaauccucagauguuucgcuucuuggauaucagucggagcaauuggaccgagucaauuaagcgaggaucggguggugguugacauggcguucgacguguugaaaacggacauaaggccagaugaaaaagaaagcguaacaggccaacuucacgaagccgccacggauuguauuugcaccuuacuguuacgucucgaggauaauaacaaccacgucgcauuggaaacgcacuuauucgaaaauauaguaaauuuagaaguggccuaucaugcaucugucgcccucgaagaucaagcaaagucgacggacuauugucggcuauucaccgaauuggcggaaucauuuuuggggaagauuguagacgauggaggaggcgguggcggcggcgacggcggcggcggagccaagaggcguaccguguacgccguuaaaugucuagauuugguacugaugugcgucggccaucaugauuacgagguggccgaaauaacauuuaaccuuuggcauaugcuaagugaggaauuauaucagaaaaauaauaaggaauuaacugaauuauucaaaccauacguggaaagauugaucacggcccuauguaggcauugccagauggagccagacauggagggucuacucgaaaaaggagaugaauuuaaagauuuuaggaugaaagucucugaucuaauaaaggacguggucuuuauaguagguagcagcaguugcuucaggcaaauguucaucaauuuacaaaccucagguguuacgugggaugccagcgaagccgcucucuuuguaaugcaggcuguagccaaaaacguucuacccacggaaaacgaaguuguuccuaaagucgucgaagcaauauugaacauaccaaucagcgcacacgucgcugugaaguacaccucuguccuucuacugggcgaacuggccgaauggauagaaaaacacccggacgcucuggaucccguccugaauuuccuaguuugcugccuucggagcggcgccgaagggggaggcgucgcgacggcggcggcguccgcgcugcagaacgugugcacgugcugcggcgcucacaugggcaggcacguucccauucuguuacaguuacuucaacagucggauucguucggcgucggcaacgcggcgguggugggauuauugaaaggcgucgcgucgguggugaguugcggcaugggaagcggcgccgaaacggcgucggccguacgggaauuguguucgaugcaauugucgccguuaugcaguuugaucgaaaacgacguucgaccuguuaaagggacucuaacggauccggugcugugguuggaucgauugaguucgguucugagauacguuaaugucaauauugucgaaggugaaauccauccuugcaaaccgguaauaauggaaauguggccgauauuaucccgagcauucgacgcauaccacagcgacguucggauaauggaaagauguugccguucggugcguuucauguugcguugcguggcccgacaacuucaagauuugcugccuucguuggucggacagaucguaaacauuuacugucucuacggacauucguguuguuuguacgucggcagcauuuuaguggacgaauacgccggugacgugacuugcguuagaggucuccucgacauguugaacgcuuuuuuggagccgacguuucgucuguugcaagaagagaauggcuugaagaaccauccggauaccgucgaugauuucuuuagguugugcgcucgguucguccagagggccccgaaggcguuucuaagcggaggcucccauuuggcgcccauuauacaaugcgcucuucucgccgccaccuuagaucacaaggaagccaacgugucuguuaugaaauuuuucuacgauuuaauaaaccagggacugagcggccgaggugaacccgauuucgacgaaagaaaagccuugguuaggagucuacugaacgaauacggucaacaacucgugucuaauuuaauucacucuugcguauuuuacuugcauucguacaugcugagcgaagugggcgacguuuuuguacaauuguuggauuucgauagacagaucacgagugaaugguuagcgaacgguuuggaauuguuaccgaaacaacagaaugguggcauaauggcggccaagccuaaacaauuaaaugauguucaugcuucuauaacgagaucaaacaguucaaaaucugugacgcacgcucugaaagaccuaacuaggcuauaucguuaa

SEQ ID NO: 6241 - RNA, 1458 nt, Phyllotreta striolata
ccgcccccucaaagguaccaacaaccgccgccgaaucaaggaaugaggcaauacggucaacagaccuuuccacccaggccgggcuacaauccuccaccuccaaauaugcagucgagcgggggcacuaugauucaaagaccacccggggcccccuauucgccgaugcgcggagggcccaugccuccccaaccggugggcaagaggccuucggauaacaggaauccauuacaacagaagaccggcgauuacagccacgguacgagcaagaaaaaaaagaaacuggccgauaaaauuuuaccccaaaaagugagagauuuggugcccgagagccaagccuacauggaccugcuagcuuucgaaagaaaacucgauuccaccauuaugagaaagcgauuagacauacaagaagcuuuaaagcgcccgaugaagcagaaaagaaaauugcgaauuuucaucuccaacaccuucuacccagcgaaagagccccaacccgaaggccccgacggucccggccaagaaggcaccguagccuccugggaacuccgagucgaaggcagacuacuagaagacucuaaaaacgaccccaacaagguaaagcgaaaauucuccucguucuucaagucccuggucaucgagcucgacaaagagcucuacggccccgacaaucaccuagucgaauggcaccgaacccucaccacccaagagaccgacggcuuccaagugaaacggcccggcgacaagaacgugcgcugcaccauucuguugcuccucgacuaccagccguugcaguucaagcucgacccgaggcuggcccgauugcucggcguccacacgcaaaccagaccggugaucauauccgcccuguggcaguacaucaagacgcaccggcugcaggacggccacgagcgcgaguacaucaucugcgacaaguauuuggagcagaucuucaacuguacucgcaugaaguucgccgagaucccgcaacgguugaauccccugcugcauccgcccgauccgaucgucauaaaccacguuauauccgucgaaggcggcgccgagagcaagcaaacggcuugcuacgauauagauguugagguugacgauacgcugaagacucaaaugaauaauuuccuguugaguacggccagucagcaggaaauucagggauuggacgcgaagauucacgagacuguugauacuauaaaucagcugaagacuaacagggaguuuuuccugaguuuugcuaaggauccucagcaguuuauacacaaauggaucgugucucaaacgagagaucuuaagucgaugaccgaugugguggggaauccggaggaggagaggcgaucggauuucuucuaccaaccuugggcucaggaggcuguaugucgguacuucuauacuaaggugcagcagaaaagggcagaguuggagcaggcccuugguauucguaauaauuag

SEQ ID NO: 6242 - RNA, 435 nt, Phyllotreta striolata
augccuaaaguacgaagaaguaagaaaccaccaccagaagguugggaacuuaucgagccaacauuggacgaauuagaacaaaaaaugcgagaagccgagaccgaaucccacgaaggaaaacgaaaaaaugaaucauuguggcccauauucaaaauucaccaucaaaaaucucgauacaucuucgacuuauuuuaccgaagaaaggcgauuagccgagaauuguacgaguauugcuuacuggaaaacaucgccgacaagaauuuaauugcaaaguggaagaaacagggcuacgaaagccuuuguugccugagaugcauccaagccagagacaccaauuucggaacgaauugcauuugcaggguacccaaauccaagcuggaagaaggaaggauugucgaauguguacauugcgguuguaggggauguuccgguuaa

SEQ ID NO: 6243 - RNA, 885 nt, Phyllotreta striolata
augccagcagcuacuuuggguagcaauuuacauccuaacaaugaagacugcggcauucgggacguuugggcucacaauuuggaagaugaauuccgaacuauaagacaaauagugcagaaauaccaauaugucgcaauggacacugaauuucccggcgucguggcccgacccauaggagaauuucgaagcuccgccgauuaucaauaccaaauguugaggugcaacguagacuuacugagaauuauccaacuagguuuaacguucuuagacgauaauggcaaaacaccaggaggaguuuacacuaccuggcaguucaauuuuaaauucaaccuucaagaagacauguacgcacaagauagcaucgauuuacugcaaaauuccgggauacaauucaagaagcacgaagacgaagguaucgaaccguuagaauuugccgaacuacuaauguccuccgggaucguucuaauggaaaauaucaaauggcugucguuucauuccggcuacgauuuuggcuauuuaauaaaguuacucaccgacaacaaucuaccgcaagaugaaaaugaauuuuucgaucugcugaaauuguauuuucccaccauauacgacguaaaguauuuaaugaaaucguguaaaaauuuaaaagguggccuucaagaaguugcggaacaguuagaauuggagaggaucgggccccaacaucaagccggauccgacucgcuguugaccggaauggccuuuuucaaaaugaaagaaauguuuuuugaggauacuauugacgauucgaaguucucaggccaucuuuacgggcucggaacaucuuucacuguuaaugguacaacuaacaauuacggaaacgauaacggcgacaccacaaacuccucauga

SEQ ID NO: 6244 - RNA, 1212 nt, Phyllotreta striolata
auggcggaagcucagaaaaggggcgcuucgguguucgaggaccucucgaauguagaauucgagaccagcgagaacuuagauguaaucgaaaaguucaaagauaugaagcugaaggaggaacugcuucgcggcaucuucgcauaugguuucgagaagccuucagcuauucagcaaagagcuauuauucccgugaugaaaggccgagauguuauagcccaagcacagucggguaccgguaaaaccgcuacauuuuccauagcuauucuucaagcucuggauuuaacgaugagagaaacgcaagugcuguguuuauccccuacgagagaauuggcuguacaaauucagaaaguuauauuagcucuaggugauuucaugaauguacaaugucacgcuuguaucggggguacaaaucuuggagaagacaucaggaaguuagauuacggacagcacguuguuagugguacaccuggaaggguuuacgauaugauucguagaagagcuuugagaacuagauccgugaaaaugcuaguacuagaugaagccgacgaaaugcuaaacaaaggcuucaaagaacaaaucuacgauguguacagauuucuucccccauccacucaagugguguuaauaucugcuacauuaccacacgaaauccuggaaauaacauccaaauuuaugaccgaucccaucaggauuuuagucaaacgugaugaacugacgcuggagggaaucaaacaguuuuucgucgccguggagagggaagaauggaaauucgacacucuaugugaccuguacgacaccuuaaccaucacgcaagccguaauuuucugcaacaccaaaagaaaggucgauugguugaccgaaaagaugcgagaaaacaacuucaccgugagcucaaugcacggagacaugccucagaaagagcgcgacaacauuaugaaggaauuccggucgggccaaagcagaguuuugaucacuaccgacguuugggccagagguauugacgugcaacaaguaucguugguuaucaauuacgauuugcccaacaaucgugaauuguauauucaucgaaucggucgauccggucgguucggcaggaagggugucgcuaucaauuucguuaaauccgacgacauuaggauucugagagauaucgaacaauauuauuccacgcagaucgaugagaugccuaugaauguagcugauuuaauuuaa

SEQ ID NO: 6245 - RNA, 1602 nt, Phyllotreta striolata
augaccgcuccugcugccgguggagaugcaagaggaagaacucucgcuuacaaagacaaaagcaaacccgccgauguccgaacaaguaacauuaacgccgcuaaggcugucugcgaugcaauucguacuaguuuggggccaagaggaauggauaaaaugauacaagcugguaacggagaagugacuauuaccaacgauggggcaacgauuuuaaaacaaaucaacguuauccacccugcagcaaaaauguugguagaacugucgagagcucaagauaucgaagcuggugacgguacaaccuccguuguggucauugccggagcccuuuuagacgccgcagaaaaguugcuacaaaggggaauccacccaacggcuauuucggagucuuuccagagggcugcccauuuggcugucgagauucuacaagaaauuucuacaccgguagaaaucacuaacagggaguuguuaaucaagagugcguccaccucuuugaauuccaaaguuguaucucaacagucgagucucuuagggccuuuggcaguugaugcuguucuuaaaauugucgaaccaggacaggaacaagcguguaacuugguagaugugaaaguuauuaagcaauugggcgguaccguggaagauaccgaguugauugaggguaucguuuucucucagagauccgccaauguaucugguccgaagagaaucgaaaaagccaagauugguuuuauacaauucugcauuucuccuccgaaaaccgacauggaccacaauguuaucguauccgauuacgcugcgauggaucgaguguugaaggaggaaagagcguacauuuugaacauuguuaaacagauuaagaaagccggcuguaacguacuuuugguucagaaaucgauucucagagaugccguauccgauuuggcccuucacuuuuuggauaaaauaaagugcaugguuauuaaggaugucgaacgagaagacguggaguuugugugcaaaucguuggcuugcagaccgaucgcuucucucgaucacuucaccgcugagaauuuaguaacugcagauuuagucgaagaaguuggacuaggcgguaaccgaauggugaaagucacagguauucaaaauggcggacgcacggugacccuacuagugagaggcucgaauaaauuaguauuagaggaggcggaacggucucugcaugaugcucugugcgucauccguugucucguucguaagaaggcgcucaucgccggcgguggagcaccggaaaucgagguggcucuuaaacuggcugcuauggcuaauaaguuggagggcaucgaugcuauuugcaccagagcuuaugcaaccgcuuuggaaauuauaccguuuacuuuggcggagaaugcuggauugaauccuauacagacgguuacugaauugaggaauagacaugcuaaaggugaaacuucggcugguauuaauguucguaagggcaccauuacagacauuuuggaagaaaauguuguacaaccgcuguuaguuagcacaucugcuuugagcuucgccaccgaaaccgucagguccauauuaaaaauugaugacauugugaacacaguaacauaa

SEQ ID NO: 6246 - RNA, 1230 nt, Phyllotreta striolata
auggaggcuauggauauuguaauaccagagaaagaggaaggcaguccuuccgaagcgaaacaggucuugcaagauuuagacauggaggauuuguacacgaaauacaagaaauuacagcagacguuggaauucuuagaaguccaagaagaguacaucaaagacgagcagaggaacuugaaaaaggaguaccugcacgcccaagaagaagucaaacgcauccaaucaguaccguugguuaucggucaauucuuagaagccgucgaucagaauaccggcauugucgguucaacuaccgguucuaauuacuacguucgaauucucucuaccaucgauagggaauuacugaaaccguccgcuagcguagcccuacacaagcacagcaaugcuuugguggacgugcuaccgcccgaagcggacuccuccauuagcaugcuacaagccgaugagaaaccggacguacaauacagcgauaucggagguauggauaugcaaaagcaggagauucgagaggccguagaacuuccguugacccacuuugagcuguacaaacaaaucgguauagacccuccgagaggugugcugauguacggcccgcccgguugcgguaaaaccaugcucgcaaaagccguagcucaucacaccacagcggcuuucauucgaguggucgguucggaguucgugcaaaaauaccugggcgaggggcccaggauggugcgagacguguuccgccuggccaaggagaauuccccagccaucaucuucaucgacgagaucgacgccaucgcgacgaagcguuucgacgcccaaacgggcgccgaucgcgaggugcagaggauccuguuggagcuguugaaccagauggacggguucgaucagaccaccaacgugaaggugaucauggcgacgaaucgggcggauacguuggauccggcuuugcugcgacccggucguuuggauaggaagaucgaauuuccguugcccgauaggaggcagaagcgguugauauucagcacuaucacguccaaaaugaaucugucugaagagguugauuuggaggauuacguugccaggccugauagaauaucgggggcggauauuaacgccauuugccaggaagccgggaugcacgcugugagagagaaucguuacaucguguugccgaaggauuucgaaaagggcuacaagaauaacaucaagaaggaugaaagcgaacacgaauuuuacaaauga

SEQ ID NO: 6247 - RNA, 489 nt, Phyllotreta striolata
augccaaauauaaagcugcaaucuucggacggcgagaccuucgagaucgacgucgaaaucgccaagugcucggugaccauaaaaaccaugcuggaggaccugggcauggacgaggaagaggaggaggucgugcccuugcccaacguaaacucagcuauccuacggaaggucauccaaugggccacauaccacaaagacgacccgcccccgcccgaagacgacgacaacaaggagaagagaaccgacgacauauccucgugggacgcggacuuucucaaagucgaccaaggcacucuguucgaacugauccuagccgcgaacuaucucgauaucaaaggccugcucgacgucacuugcaagaccguggccaacaugauaaagggcaaagcgccggaggaaauacggaaaacguuuaacaucaagaacgauuucacgccguccgaagaagagcaagugcgcaaggagaacgaauggugcgaggagaaauag

SEQ ID NO: 6248 - RNA, 1038 nt, Phyllotreta striolata
augaaggcagcaaauaacacuaaauccguuaaaaugacaucgcaaaaauugaauaaugucgaaagcguugauaaaucggagaaaggaaagauaaaaaccguaguaauaauggacgauaaggcuucauguaaggaacuagaucaauggauagaacaguuaaaugacuguaagcaauuaaccgaaaaccaagugaaaacucugugugauaaggcgaaagaaauacuguccaaagaaucaaaugugcaggagguaaaauguccugucaccguuugcggagauguacacggacaguuucacgaucugauggaauuauuuaggauagguggucgaaguccagauacgaauuaccuuuuuaugggugacuaugucgaucguggguauuauuccgucgagacuguuacucuuuugguggcuuugaaagucagguauaaagaaagaauuacgauccugagaggaaaccaugaaucgagacaaaucacucaaguauauggauucuacgacgagugccugcgaaaauacgggaacgcgaacguuuggaaauucuucaccgauuuguuugauuacuugccgcuuacagcgcucgucgauagccagauauucuguuugcacggagggcucagucccagcauugauacuuuggaccauauuagagccuuggaucguuuacaagagguaccucacgaagguccgaugugcgaucuucucuggucggaucccgacgaucgcggagguuggggcauuucuccucgcggugcggguuauaccuuuggacaagauauaucggaaacguucaaccacagcaacggcuugacauuggucucucgggcccaucaacucgucauggagggguacaauuggugccaugacagaaacguuguaacgaucuucagugcuccaaacuacugcuauagaugugguaaucaagcugccauuauggaauuagaugaugcgcuuaaauauucauucuuacaauuugauccagcaccgagacguggcgaaccucacguuacccgcagaacuccggauuauuuccuuuaa

SEQ ID NO: 6249 - RNA, 648 nt, Phyllotreta striolata
aucuucguaaaaacucucacuggaaagaccauuacucuugaaguugaaccuucugacacuaucgagaauguuaaagcuaaaauccaggacaaggaagguaucccaccagaccaacaacguuugaucuucgcuggaaagcaacuagaagauggucguacucuuucugauuacaacauacagaaagaauccacccuucacuugguacuuagacuucguggugguaugcaaaucuucguuaaaacauuaacuggaaaaacuaucacucuugaaguugaaccaucugauaccauugaaaaugucaaggcuaaaauccaggacaaggagggaauucccccagaccaacaaagauugaucuucgccggaaaacaacuggaagauggucgcacucuuucugauuacaacauccagaaagaaucuacucuucacuugguuuugagacuucgugguggaaugcagaucuuuguaaaaacuuuaacuggaaagaccaucaccuuggaagucgagccauccgacaccauugagaauguaaaagcuaaaauccaggacaaggaagguaucccaccagaccagcagagauugaucuucgcaggaaaacaacuagaagauggucguacucuuucugauuacaacauccaaaaggaaucuacu

SEQ ID NO: 6250 - RNA, 1623 nt, Phyllotreta striolata
augaugcaaccgcagauauugcuccucaaggaaggcacugauucgucacaaggcaagccucaguugauauccaauauaaaugcgugccagaauauaguggacgcuauacgaaccacccuggggccccgagguauggacaaauugaucgucuccaacagaggcucugcgaccaucucaaacgacggagcgacaauauuaaauuuacuagacguggugcauccagcggcgaaaacucuaguugacauagcgaagucacaagacgccgaaguaggcgauggcacgaccuccguuguuuugcuagcaggcgaguuuuugaagcaacugaaguccuacaucgaagaaggcgugcauccgaggaucaucaucaaagccgugcggaaggcgacccagauuugccuggagaaaaucaacgcccucgccguuaaaaucaacaaagccaaccccgaggaguacaggucguugcuggagaaaugcgccgcgacggcgaugagcucgaaguugaucaacaaacagaaaucguucuucuccaaaaugguggucgaugccgugcuacugcucgacgaacuccugccguugaacaugaucggcaucaagaaggugcaaggcggcggucuggaggacuccauguuagucgccggaguggccuucaagaagaccuucucguacgccggguucgagaugcagcccaagauuuacaaagacugcaagaucgcccuguugaauauagaauuggaacugaaagcggagagagacaacgccgagauccgccugagcagcgucaaggaguaccaaaaagucgucgaugcggaguggaacauuuuguacaacaaacuccagaaaauuuacgaauccggagcgaacguuguucuaucgaaauuacccauuggugacgucgccacgcaauacuucgccgacagagacauguucugcgccggaaggguccaagaggaagacaugaagagaaccuugaaagccugcgguggcuccauaaugaccacagucaacgauuugaaagacgaagugcuagguaacugccagcuguucgaagagaagcaaauuggaggcgacagauacaacuucuucaaaggcugucccaacgccaaaaccugcaccaucauccuaagaggaggagccgagcaauuuuuagaagaaaccgagaggucccuacacgaugccaucaugaucguccgcagaacaaucaaaaacgacuccgucguagcaggcggaggagccaucgaaauggagcuaucgaaguuacucagggauuacucucgcaccauugccggcaaagaacaacuccugauuggagcuaucgcgaaagcacucgaaauaaucccuaggcaacuaugcgacaaugccgguuucgacgccacuaauauacugaacaaauugcgacagaaacacgcucagggcaacuccugguacgggguggacgucaacauggaggauaucgccgauaacuacgaaacuugcguaugggagccggcuauuauaaaaauuaacgcuuugaccgccgcugcggaggccacgugcuugauccuguccguugaugagacgaucaaaaaccagaaauccgaagcgcccccgcaaaugggcggacgcggaauggguagacccauguaa

SEQ ID NO: 6251 - RNA, 13947 nt, Phyllotreta striolata
augggggacucccuagaagccucggaaacggcucacgaaacucaaaauguggcguuaguggauuuuacugcguuuacaaauuuuauuuugaaagcggcuacuguacuuuugccagaagaugauagccaagcggaaccggcgaaccucauagcagcaauagaugacaaaaccaaucaggaauguauaaaaaaauucauaagcgauccccaaauugugauauuguacguccaaaggaacucuucaaaagaugacgacaauguccagccuccggaaggagaagaagaaaaagaaccaguuacauacuacauuagcaacgaagugcacuauuccaacucgaaaauguccagcuuggugugcaucaaaaggggcccggugauagaggccgauaaaagcauuagggcucagguucguuugaugaacuucagcgaggguuccccuuaugaaauucugcacgauuacgucagcagaaccgucgccccuuacuuuaaauccuacguaaaagagucgggcagagcugaccgcgacggugauaaaauggcgccugcuguugaaaaaacaaucgccgaauuagaaauggggcuucugcauuuacaacaaaauaucgauauuccggaaauuacgcuucaagugcauccguacgucgccagucuuauaaagcaaugcgccgaugaaggaaggaagccgaaagucgccgauuucagugacaaaguggacgacucgaacuuucucaaccaacuccaacacggaguaaaucguuggaucaaagaaauucaaaaaguaacaaaauuagacagagaccccucuucuggcacggcccuucaagaaauuaguuuuuggcucaaucuggaaagggcccuucaccgcauccaggaaaaacgcgaaagcauggaggucgcucuaacauuggacauucucaagcacgguaaacguuuucacgccacggugucguucgauaccgauaccggccuaaagcaagccauagcuacgguuaacgauuacaauccgcugaugaaggauuuccccauuaacgauuuguuagcugcaacggagcuggagagaauucgcgcggcgguucaauugauuuuuucccaucuaaggaagguccgaucgaccaaauaucccauuacgaggugccuaagacuagucgaggccauuucgagagacuuaggcaugcagcuguugaaaguacuggguacccgccguuuaaugcacauuccauucgacgaauucgagaaagucaugacccaauguuucgaaguguuuucgauuugggaugacgaauacgagaaauugcaaggucuucucagagauaucaugaagaagaagcgagacgaacacaugaaaauggucuggcggauuucgccgcaacauaaaaaacuccaaagccguauggaucagaugcgcaaauuucgcaggcagcacgaacagcugcgcacggucauagugcgcguauugagaccgagugucaaagagagcgcagcgcccgucgaaggaagcgauaucgaaccuccuaaaccgacguuuucccuugaugcugcagaugccaacgcuauugaggaaguaaauuuggcuuacgagaacguaaaagaagucgacugucuggacauuaccaaggaaggccaagacgcuugggaugccgcuguacagagauaugaagagcgaaucgauagagucgaaacgaggaucaccgcacaucuacgcgaucaauugggaacggccaaaaacgcgaacgagauguuuaggauuuucucgcguuuuaacgcccuauucgucagaccucacauuagaggggcuauaagggaauaccaaacgcaucugauucaaagagugaaagacgauaucgaagcccuacaugaaaaauuuaaaguucaauauccgcaaaguaacagcgcuaaaauuagcaaagugagagauuugccgccuguagccgguucuauagugugggccaagcaaaucgaucaucaacuaacgacauauuuaaggcgugucgaagaugugcuaggaaaaggaugggagaaccacaucgaaggacaaaaacucaaagccgacggggacaguuuccguuugaagcuaaauacccaggaaauauucgaugauugggcgcgaaacgugcaacaacguaaucucggcguguccggcagaauauuuaccaucgaagccgugagaucgaggagcggucgcgguaacguucucaaauugaaagucaacuuucuaccggagaucauuacgcuggccaaggaaguacguaauuuaaagugccugggauucagaguaccuuuggcuaucgucaauaaggcacaccaagcgaaucaacuuuauccguucgccauaucgcuuaucgaaagcauucgaacauacgagaugacuuuggaaaagaucgaggacaaggccagcaucauuccgcucgucgcuggcaugagaaaagaaguccaacugguccuggccgaaggaauccaacugguaugggaaagcuacaaacuggaccucuacguacagcgacucucagaccuagugguggguuuccaagagcgagucgaagagcucguauucgucggcgagcaauuagaaguagacgucagaucguuggaaaccugcccuuacucggccaacaccuucgccgacauccugucgaagauccaacacgccgucgacgaucugucgcugaagcaauucucgaaccugcacauuuggguguugcgauuggacgaggaggucgagaagaaccucgccaggcggcugcaagccggcaucgaagccuggacggagacgcugagcggccagaagaaggaaaucgaucacagcauggacaccgacgcgccggcccagcccacccacaaacccggcggcgauccgcaaauccaaacgaugauacacgaagugcgcauaaccaaucagacaauguacuuguuuccgagcaucgaagaggccagguuccugauuaugcagcaacuguucgcuuggcaggcgaucgugacgugccagcaacgccuucaaagcagucgcuaucaagucggcguggauaagccggucguggagacuuaccggaauauuuugacuagacuaccggcuggcgcgcaaccguugaucaacgcuuacagcgcuauuucuucuaaaauuaaggagguucaaaauuauguaaacgagugguuaacuuaccaaucucugugggaucugcaagcagauaaucuuuacgggaaacugggugaagauauuaguaaauggauggaaugucugaacgacauaaagaaaacucgaacuacauucgacacgucggacacccgucgcgaauuuggcccaauagucauagacuucgccaaaguccagagcaaaguuucccuuaaauacgacucuuggcacaaagaaaccuugagcaaauucggaagucucuugagcaacgaaaugaccucguuccacgccaacguauccaaauccagauccgaucuggaguugcaaagcaucgaggcggccagcacauccgacgccgucagcuuuauaacguacguccagcaauugaaacggaacaugaaagcuugggagaagcagguggacaucuacaaagaaggccaaagaauccuggagcgccagcgauuccaguucccgacgaacugguugcacguggaaaaccuggagggcgaauggggagcauucaacgaaaucaucaagaggaaggauucgagcauccaaacucaagucgcuagucuucagcagaagaucguuucggaagauaaggcggucgaaagucgcacgaacgauuucuugguagacugggagaggagcaagccggucgaaggccaucucagaccggacgacgcccucucucagcugcaauuauucgaaagcaaauuuucgcgucucaaggaagaacgcgacaacgucgccaaagccaaagaagcuuuggacuugcaagacccgggcggcauaaguaccagcgaagauaaaaugcaagucguuuacgaggaauugcaagaucugagaggcgucugguccgaacuguccagaaucuggcagcaaaucgacgaaacccgagagaaaccuuggcucuccauccaaccgaggaagcugcggcaacaauuagaccaacucucgacgcaacucagagaauuaccggcccgucugaggcaauacgcuucguacgaauacgucaagaagacccuacaaaccuacaccaaagucaacaugcugauagucgaauuaaaauccgacgcccucaaggaacgccacuggaagcagcucaugaagcaacugcgagucaacugggugcucuccgaucuaacgcucggccaagucugggacgucaaucuccagaaaaacgaggccaucgucaaagacgucauacugguagcccaaggcgaaauggcgcucgaagaguuccugaagcaagugcgcgaauccuggcaaaacuacgaacucgaccugaucaacuaccaaaacaaaugcaaacugaucagaggaugggacgaucuguucaacaaagucaaagaacacaucaauuccgucgccgccaugaagcugucgccguacuacaaggucuucgaagaggaagccucgacuugggaggaaaaguugaaucgcaucaacgcgcuguucgacguguggaucgacgugcaaaggcgcuggguguauuuagaagggauauucuccggcagcgcggacaucaaaacgcuccugccgguggaaacgucgcguuuccaaagcaucagcuccgacuucuuggggcugaugaagaaggugagcaagagcccgauggugauggacaucgugaauauucuaggcgugcaacgcguacuggaacgacuggccgauuuauuggguaaaauccagaaagcgcucggcgaauaucuggaaagagaacguacgucuuucccucgauucuacuucgugggcgacgaagaucuccuggagauaaucggcaacagcaaaaacguggcgagguugcaaaagcauuucaagaaaauguucgccggcguggcuuccauauuacucaacgaaaacaauacuaucaucaccgguauagcuucgcgagaaggcgaagaagucguguucaaaucgccgguuuccaccguagagcaucccaagaucaacgaguggcugaguuuggucgaaaaggaaaugcgcgugacgcuggccucgaaucuaacgcaagccgugcaggacaucaagcaauucaaagacgaaaucgacucgaaauccuacauggaauggguggacaaauaccaagcgcagaucgugguguuggcggcccagauucucuggagcgaggacgucgaagcggcgcuggugaaaaugaacagcgaaccgcagaagggcgugcuggaaaagguucugcaacaggucgagaacacccucaacgugcuggcggauuccguuuugcaggagcaaccgcaguugagaaggaagaagcuggagcacuugaucaacgaguuugugcacaagagaacggugaccaggagacugaucgccaacgggguuuguaguaacaaggcguucgaauggcugugcgaaaugagguucuacuucgauccgagacaaaccgaagugcucaaacaauuaacgauucacauggcgaacgcgagguucuauuacggauuugaauacuugggcgugcaggauagauuagugcaaacuccucuaacugacagauguuacuugacuaugacucaagcuuuggaagcccgucucggaggaucgccuuucggacccgccggaacugguaagaccgaaucggucaaagcgcucggaaaccagcugggucguuucgugcucguguucaauugcgacgaaacguucgauuuccaagccaugggcaggauauucguggguuugugucaagugggcgcuugggguuguuucgacgaauucaacagauuagaagaaagaaugcugucggccguuucgcagcaaauacaaacuauacaagaagcucugaagucgcagaaggaagcugccgccgaaggagucgccaccggcaguauaagcgucgaacuggugggaaaacaaguaaaagugucgcccgauauggccaucuuuauuacgaugaaucccggcuacgcgggucguucgaauuugccggauaauuugaagaaauuguucagaucguuagccaugacuacgcccgacagacaacugaucgcugaagucauguuguucucucaaggauucaggcaggccgagaaauuggcaucgaaaaucguaccguucuuuagauuaugcgacgaacaacuguccaaucaaucccauuacgacuucgguuugagagcuuugaaauccguacugauaucggcgggaaaugugaaaagagauagaauccaaaggauaaaagaagguaugacccaacgaggcgaaacuaacauagacgaagcaaacauagccgagaauuugcccgaacaagaaauauugauucaaucgguuugcgagacuaugguucccaaauuggucgcugaagauaucccauugcuguucagcuuguugaacgacguguuucccaacgugcaauacaccagagccgaaauggaaggucuuaaggacgaaauuagaaaagugugcacggaagaauaccucguuugcggagaaggcgaugaaagagguucggcuuggauggaaaaaguauuacaauuauaccaaauuucgaaccucaaccacggucuaaugauggucggcccgagugguucgggcaagaguucagcauggcgaguucugcuuaaagcccucgaacgauucgaagggauagaaggcguagcccauguaaucgauccgaaagcgaucagcaaagagacuuuauacgguguguuggaucccaauaccagagaauggaccgauggucuguucacccauauucuaagaaaaauuauagacaacgugagaggugaaauuaacaaacgccaauggauuaucuucgacggugacgucgauccagaauggguggaaaacuugaacucuguucucgacgauaacaaauuguugacucuucccaacggagaacgucuaucccuaccgccuaacauuagagucauguuugagguacaagaucuaaaauaugccacguuagcuacagugucgcguugugguauggugugguucucugaagacguacuauccaccgaaaugauauucgaaaauuacauucuccgauugaagaacauuccgcucgaagaaagcgaagagggcuucgggaagaaaucagaccucaaagacgacauguugucuccgacccuccaacugcaagucgacgucgugaaucuacuccagccguuuuugggacccgacggucucgucguacgcuguuuggaguacgccauggaacaggaacacauaauggacuucacgcgacucagagcccucagcucucucuucuccaugcugaaucaagccgugagaaacgucuugcaguucaaucacaugcaucccgauuuuccucucuccagcgaagcccucgauaaauacauaccgaaauguuugauauauucgaucuuguggagcuucgccggcgaugccaagcuuaaaguucgaucggaauugggcgauuuuaucagauccgucaccaccguaccccugccuuccgaucgcaauuugccuauuaucgauuacgaaguuaccaucgaaggagaauggucgcuuuggucgaacaaagugccgcaaaucgaggucgaaacucacaaagucgccacgcccgacauuguggugcccacguuggacacagucaggcacgaaucguuguuguacaccugguuggcggaacacaaaccgauaguguugugugguccaccugguuccgguaaaacgaugacauuauucuccgcauugagagcauuaccugacauggaagucgucggguugaacuucucaucggcuacaacuccagaguugcuguuaaaaaccuuugaucauuacugcgaauacagaaaaacaccgaauggcgucauucuaucgcccauacaguuaggcaaauggcucguccucuucugcgacgaaaucaacuuaccggacauggacaauuacggcacccagcgcgucaucauguucuugcgucaaauagucgaacaaaaaggcuucuaucgcgcuucggaccaaaccuggguaucguuggagcgcauucaauucgugggcgcuugcaaucccccgacggaccccggaaggaagccccuuucucaccguuuccucagacacgugcccgucguuuacgucgacuacccgggagagacgucgcucaagcaaauuuacggcaccuucaccagagcgaugcugcgacuggccccgggacugaagggcuacgccgagccgcuaaccaacuccaugguggaauucuacuugucgucgcaggacagguucacucaagacaugcaaccucacuacguguauuccccucgcgagaugacgagaugggugagaggcauaugcgaagccaucagaccucuggacaaucuguccguggaagguuuggucagguugugggcgcacgaagcgcuucgacuguuccaagacagguuaguggaggacgccgaaaggcgauggacgaacgaaaacaucgaugccgucgcuuugaagcacuucccgucggcgaauugcgaaaaggccuuggaacggcccauccuauacaguaacugguuguccaaggauuacguaccgguaggcagggagcagcugagagaauacgucaaggcuagguugaaaguguucuacgaagaggaacucgacguuccuuuggugcucuucgaugagguacuggaucacgugcucaggaucgacaggauuuucaggcaaccgcaaggucauuugcuccugauaggcguguccggagcggggaaaacuacccugucgagguucguggcuuggaugaacggauuguccauuuuccaaauuaaaguucacaacaaauacaccgccgaugauuucgacgaagacuugcgaucgguucugagaaggagcgguugcaaacacgaaaagaucgccuucauuuuggacgagucgaacaugcuggacucgaguuucuuggaaagaaugaauacucuucuagccaacggcgaaguucccggauuguucgaaggagacgaauacaccacucuaaugacgcagugcaaagaaggagcucaaagagaaggauuaauguuggauucgaacgaugaacucuacaagugguucacgcaacaagucaugcgaaauuugcacguaguuuuuacgaugaauccuucgacggaugguuugaaggauagggccgcuacuucuccugcuuuauucaacagaugcguguugaauugguucggagauugguccgauggagcucuauuccaggugggaaaagaauucacgaaucgcuuggaucucgacaaacaaaguuggaaaugccccgauuucuuccccgcuucuugcaaccgcauuuccgcgacgcccaaucacagagaggccgucaucaacgccugcguuuacguccaucagacccuucacaaagccaacggcagauugacaaagagaggaagucgcacgauggccaucaccccuagacacuacuuggauuucauacaccaucucgucaaauuguacaacgaaaaacgguccgauuuagaagagcaacagcuccaucuuaacgucgguuugaacaagaucgcagaaaccguugaacagguggaagagaugcaaaagaguuuggccguaaaaucgcaagaauugcaagcgaaaaacgacgccgccaacgccaagcucaggcaaauggugaaagaucagcaggaggccgaaaagaagaaaguucaaagucaagaaauccaacagcagcucgcccagcaaacggugcacaucaagcagaaaaaauccgaaguaauggccgauuuggaacaaguagaaccggccgucaucgaagcucagcaagcugugaaauccaucaagaaacaacaauuaguagaaauccguaccaugucgaauccuccggcccugguaaaacuggcgcuggaaucgauuugcuugcuacuaggagaaaacgccagcgauuggaaauccauucgagcugugauuaugagagacaauuucaucaacagcguggucaauuucaacaccgaagauaucggcgacgacgucagagaaaaaaugaaaagccgcuauuugagcaaccccgacuacaacaucgacaaaaucuaccacgccagcaacgccugcgguccgcuggugaagugggccugcgcccaagucgaguacgccgacaugcugaagaaggucgagccgcugcgcgaggagcucaacucucuggaaacucaagccgaaacgaaccagaagcgcggcgaagacgugaaaguucucaucggccagcuggagcaaagcaucgccuccuacaaggaggaauacgcgcagcugaucgcccaagcgcaagccaucaaaaccgauuuggagaacguccaagccaaggucgaucgaucgauagcccuucucaaaucgcucgucaucgaaagggaacgaugggaggccagcagcgagacguucagaucgcaaauguccaccaucaucggggacguucuguuaucggccgcguucaucgcguacggagguuacuucgaccaacauuaccgucaaaaucucuucagcacuuggugucaacauuuaacgcuagcuaacauccaauacagggccgauauagcccgaacggaguacuugucgaaucccgacgaacggcucagauggcaagccaacgcuuugccuucggacgaucugugcacggaaaacgccaucaugcugaagagauucaacagauacccgcucauuaucgacccgucgggccaagccaccgaauucauaaugaacgaauucaaagacaagaagaucaccaagacgagcuucuuggacgauucguucaggaagaaccuggaaucggcgcugcguuucggcaauccccuucucguccaagacgucgagaacuacgacgccauauugaaccccgugcucaaccgggagcugcgaaggaccggcgggcgcguguugauaacgcucggcgaccaagacaucgauuugucgccgucguucgugauauuccuauccacgcgagacccgaccguggaauucccgccggacauuugcucgagagucacauucgucaacuucacggugaccaggagcucguugcagagccaaugcuugaaucaagugcucaaggccgagcggcccgacaucgacgccaagcgauccgaucugcugaagcugcagggcgaguuccaccugcgauugaggcagcucgagaagucgcuguugcaagcccucaacgacgccaaggguaagauucucgacgacgacagcgucauuacgacguuggaaacgcugaagcaggaggccgccgaaaucggacagaaagucgaagagaccgauaaggucauuucggaaaucgagacggugucgcagcaguacuugccguuaucgcaggcgugcaguaacacuuacuuuacuauggauaguuugaaccaaguacacuuccucuaccaauacucuuugaagauguuuuuggacguauuugcuacgguguugcacaauaacgugaaguuagauggaaucaccgauuaucaagcuagauugaacgucaucaccaguaauuuguuuucgguuguuuaugagcgaguagcuagaggaaugcuucacaacgaccgcaugacguucgcuauacuacugugcaggauucaccugaaaggacgaccgacggaacccaaucuagaccaagaguucaacuucuuccucagaggcaaagagggcgucuucagcagcaccaauucggccaucgucgacgguuugaacagcgaucaacaggaagccaucacgagacugucgaccaaacuaccggcguucaagaaacuaccggaacaaaucaaagacaugccggaguucggcgcgugguugcagcagagcagccccgagcaggcggugccgcagcuguggaucgaagagaagcagcugagcgccgucggcaggggcauguaccagaugcuggugauccaggccuuuaggcccgaucgcgugaucgcggcggcgcagaacuucgucgccgccgugcucggcgccgauuucauguaccuggccgagaaggagcuggacuuugcgacgugcgucgaaaaggagaucagaucgaacgugccggcgcuguugugcucggugcccggcuucgacgcuuccggucgcgucgacgaucuggccgccgagcucaacaagcagauauccagcaucgccaucgguuccgcugaagguuucaaccaggccgauagggcuauuaacauggccugcaaaacuggaagaugggugaugcuuaaaaacguccaucuggcgccucaguggcuggugcaacucgaaaagaaacuucacucgcuucagccgcacgccaauuuccggcuguuccucacgauggagaucaaucccaaguugccguucaacuugcugagagcgggaagaauauucguguucgaaccgccgccggguauccgagcgaacuuauugagaacauucagcacuguuccggcgagcagaaugaugaaagcgcccaacgaaagagcgagauuguacuuccuguuagcuugguuccaugcgaucgugcaggaaagacugcgguacuguccguuagguugggccaaauacuacgaauucagcgaaucggauuugcgcgucgccugcgauacuuuagacacguggaucgacgcaacggcgaugggaaggaccaauuugccgccggagaaaguaccgugggacgcgcucgucacgcuucucucucaaucgaucuacggcgguaagaucgacaacgauuucgaucagaggcuguugcauucguucuugaacaaauuguucacgccgaagagcuucgacagcgauuucgcguugguggcgaacauagacaaugggcccggcggcaaucgacacauaaccaugccggacgguacucgaagggaucacuucuugaaguggaucgaaagucucgccgacagacaaacgccagcuugguugggacuaccuaauaacgcggaaaagguacuuuuaaccacaagagguaccgaccucauagcgaagcuacucaaaaugcagcaauuggaagacgacgacgaauuggcguauucgcucgacgacagcucgccguccgauccggccgcucaaaucgacgggcguccgucguggaugaaaacucugcacaacagcgccgccaccugggucaauuuguugcccacgucguugcagacacuuagaagaacggucgauaacaucaaggauccucuguacagauauuucgagcgagaagucaauuccgcgucuaaauugcugacggacguuuugcacgaucuucacgauguacuuuuuaucugucaaggagaaaagaaacaaacgaacuaccaucguacgauguugucugaauuaguuagaggaauuauuccgaagaacuggcaucgguacacaauacccaaagguuguacaguuaugcaauggaucaccgacuuuagucagcgcguuaagcaauugcagaacguaucgcaaguggucucgucugcgggugcuaaagaauuacagaguuuuccgguuugguugggaggacuccugaacccggaagcuuacauaacggcuacgagacagugcguggcacaagcuaacagcuggccucucgaagaacuccacuuagacgugacuauuacugauuccaaugauagaaauuccauuccucacgacugcuucgcugucgucggaaucaaauugcaaggagcccaaugcagaaacaaucaacuccuccuaaccucgagcaucaugauugaacuucccaucacacucuuccguugggugagaguaacgggcgaugagaaauuaaaggaagggaaauuaucuuuaccgcuuuauuugaauucaacuagaaccgagcuucuguacacuaucgaacuuaauauugcagcagggcaagacccucacagcuucuaugaacgugguguagcuguuuuaacuucuacuucuuuaaacuaa

SEQ ID NO: 6252 - RNA, 2673 nt, Phyllotreta striolata
augagucgucagggccccagcaaacguuacgaaucggauucggauuccgauagcguggacagcgcggaggaggcccgacggcgcgacuugcaggagcgagacgaguucgccaaucggcugaagaagcgcgacgaagaccgcacgcgaaacgucgugcagaacuucgacaagaggaccuacgaggaggcggcgaagcggcugaagcucgaccacgccggcagggacaaggugauaucggagcuucgcaagaccucgagauggaaguauuuggagaagaggaaggacgauaaauugcaggaguuagaggcggauaucgucgacgaugaguacuuguucgaagaggaaauauuaacggagagggagaagaaggaacgccagcacaaaaaggaguuguugcaacuggcccaggagcaugagaaggcgcgagaauuggagcgcauccagcgcuaccacaugccgagggacuugggcaaggacucgacggccgauuacaucgaaguggacgagcucgaaaaagucccccaauccgagcagaagaaaugggagaaggaccaaauggccucggccgucuucaaauucggcgccaaagaugucaagaagaccgacgacuacgagcuguugcucgaggaucaaaucgauuucauacaagcuuuacaaaugccgggcagcaacgagaagaaagucccgaaaauguccgaugugcaaaugaagaaacucacaaucgaagaaacgaagaagagccugccgauuuauccguucaaagacgauuugaucgcagccguuaaggaguaccaaguguugauuauaaaaggugaaaccgguucggggaagaccacgcaaauaccucaguaccuccacgaggccgguuucacugcagacgguaagaaaaucgguugcacgcagccucguagagucgccgcuaugucgguagcagccagaguagcacaagaaauggacguaaaacuaggcaacgaggucgguuacgccaucagauucgaagauugcaccuccgaaagaaccgucaucaaauacaugaccgaugguaccuugcacagggaauuccuaucggaaccggacuugcaauccuacagcgugaugauuauagacgaagcucacgaacgaacgcuucacaccgauauccucuucggauuggugaaagacauagcgagguucaggcccgauuugaagcuacugauaucgagcgccacguuggacguuaccaaguuuucggaguucuucgacgacgcgccgguguaccaaaucccgggccggagguuucccguggauauuuacuacacgaaagcccccgaagccgauuacguggacgccugcgucgugucgauacugcaaauucacgucacccagccguugggcgacauuuugguguuccugacgggucaggacgaaaucgaaaccugccacgagcuccugcaggaucgcguacgacgauuggguucgaaagucaaagaacugauuauacucccguuguacgcuaacuuaccgagugauaugcaagcuaagauauucgagccgaccccgccgggagcgaggaaggugauucuagcuacaaacaucgcggagaccucgcuaacgaucgauaauauuaucuacguuaucgauccggguuucgccaagcagaaccacuucaauuccagaaccggcauggagagucugauggucgugccuauaucuaaagcuucggcuaaccagcgagcuggaagggccgguagaguggcggccgguaagugcuuuaggcuguacacggccugguccuauaagcacgaguuagaggaauguaccguucccgagauacagaggaucaauuugggaaacgcuguguugauguugaaggcguuggguauuaacgauuuggugcauuucgauuuuuuggauccaccuccgcacgaaacgcugguguuagcuuuggaacaguuguacgcuuuaggugcuuugaaucaccacggggaauugacuaaauuaggaagaagaauggcugaauuaccgguagauccgaugauggccaaaaugguauuggcaucugagaaauacaaguguuccgaggaaaucgucacuauaggcgcaauguugucggugaacggggccauauuuuacaggccgaaagauaagauuauccacgcagauacugccaggaagaauuucuaucacauggcuggcgaucacuugagucuucugaacguuuauaaucaauggagagacucugauuacucguugcaaugguguuacgaaaauuucauucaacacagaucgaugaaacgagccagagacgucagagaacagcuagucaauuuaaugcagagaguagaaaucgaaauggugucaggaaucgaugaaacugacaacauucgcaaggcuauuacuuccggauauuucuaucacauagccagguuuucgaaaggaggcaguuacaaaacggugaagcacaaucaaaguguuacuauacacccgaacagugcuuuguucgaaacguugccacgguggguguuguaccacgaauuaguguucacgacgaaagaguuuaugaggcaagugaucgaaaucgagaguaaguggcuguuggagguggcgccucauuacuacaaggccaaggaauuggaagauucuacuaauaaaaaaaugcccaaaaccgucgggagaaguaaaaugacugauuaa

SEQ ID NO: 6253 - RNA, 1371 nt, Phyllotreta striolata
augaagguagaagagguaaaaagcaccgugaaaacucaaagaauaagcgcccauacucacauaaaggguuugggauuagaugaagcggguuuugcaaucccuucggcagccggccuggucggucaggagcaggcuagagaggcugcaggagucgucguggacaugauaaagagcaagaaaauggccggcagggcugugcuucuagcuggcccuccagguaccgguaaaacagccauugcucuagcgauugcacaagaacuggguaauaaaguaccauuuugcccaaugguuggcucagaaguguacagcacagaaauaaagaaaacugaagugcucauggagaauuuccggcgagcuauuggucuuagaauuagagaaacaaaggaagucuacgaaggagaaguuagcgaacugacacccgucgaaacagaaaacccagcaggagguuaugguaaaacuguuagccauguuguaaucgguuugcgaacagccaagggcagcaagcaauugaaacuagaucccagcauauacgaagcccugcaaaaggagaagguggaagugggagaugucauuuacauugaagcuacaaguggagcuguuaaaagacagggaagguccgaugcuuaugccacggaauucgauuuggaagccgaggaauauguaccucuuccgaagggagaugugcacaagaagaaggaaguuguacaggacguuacuuugcacgauuuggaugcugcuaaugcgaaaccgcaggguggucaagacguguuauccaugauggggcaacuguugaaaccaaagaaaacugaaauuacggauaaacucaggaaagaaaucaauaaaaucguugacaaauacauugaucaagguaucgcggaauugguaccuggaguuuuauucaucgacgaaguucauauguuggauauagaaacauucacuuaucuccacagagcuuuggaaagcgcuauagcaccuauuguuauuuuugcuacuaauagaggucguugucucauuagaggaaccgaugauguguuuucuccacacggaauaccauuagaucugcuagauagacugcugauuauacgcacaauuccuuacaacaaauccgaaauggaacaaauuauuaaauugagagcuguuacagaagguuuagaaauugagcaggaagcaaucucgaguuugggggaaguugggacaaaggccaccuugagauaugcaguucagcuuuugacgccgucauuuuuaacggcuaaaauuaacggaaggagcaacauucuccaaagcgacguggaagaaauugguacucuauuccucgaugcgaagucuucagcuaaaauacuuaccgagcagaaagauaaauuuaugacguag

SEQ ID NO: 6254 - RNA, 2202 nt, Phyllotreta striolata
augacuucgauaauaaaaguacaagccuuauccggcgccaaagaugaaucucccccuuguuaccuguuacagguugacgauguuagaauucuuuuagauugugguugggaugaaaaauuugauauggaauucauaaaagaacuaaagaggcauguacauacaauagaugcaguguuaauuucuuacccggauaacaaucauuuaggagcucuaccuuaugccguggguaaauuagguuuaaauuguccaauauacgcuacuauaccaguauacaaaaugggucagauguuuauguacgaucucuaccaaucccaguacaauaugaaagaauuuugcauauuuucccuugaugaugucgaugcuacguucgaaaagguuguucaauuaaaauauaaccaaacaguucccuuaaaagguaaaggauauggcauaaccguuacaccauuaccugccggucacaugaucggaggaaccauuuggaagauaaugaaaguaggcgaagaagauauuguauacugcaacgauuuuaaucacaaaaaagaaaggcauuugaacgguugcgaacuaaagaaacuucaaaggccaucguuacucauaacagaugcauucaaugcuacauaucaacaggccagacgaagggcgagagaugaaaaauuaaugacaaauauucuccagacuuuacgaaaccacgggaacguucugauagcuguagacacugcugguagagugcuggaauuggcucacauguuagaucaacuguggagaaacaaggaaucaggacuuuuggcuuauucauuggcuuuuuugaacaaugucaguuauaauguagucgaauuugccaagucacaaauagaauggaugagcgauaaucuaaugagaaguuuugaaggagccagaaauaauccauuccaguucaaauauuugcagcuaugccacaguuugggggaacuaagcaaaguacccaguccgaaaguggugcuggccaguucgccagauuuggagaguggauuuucaagggaauuguucuugcagugguguucuaauccaaauaacaguauuauauuaacuacaaggaccucaccuggaacuuuagccagggauuuaauugacaacggaggaggaagaaacauagacuugauaguagagcgaaggguuaaauuagaaggagcagaacuugaugauuaugaaaggcgucaacgaucuaaauaugacaaauuagaagaugaggaggccgauucugauucagauuccgauauugaaaugucagucaccucuaaaggcaaacaugacauuguuaucaaacaagaaggcaaaauaucaacaggauuuuuuaaagucaccaaaaagauguaccccauguauccuuucaaggaagauaaaauaaaguccgaugaauacggcgaaauuguaaaagcagaggauuacaaauuagcugaaauuucagccgaaaccgaagauaauaaagaaaauauagugauuaaaaaagaagaagaggaaauaacugaaauuacugaacaaccaaccaaauguauaauucuucaacgcaccguucaagugaguugucaaguucaguacaucgauuucgaagguagaucagacggggaaucguugaugaagauuuuaacgcaacugaaaccgagaagagugauuguggugcacggaaccgaagaaaauacguccguuauagaaaaacauugcuuggauaauuuggaagcuagaguuuucacaccauccagaggcgaaauaaucgaugccacuagcgaaacgcacauuuaucaggugaggcugacggacgccuugguuucacaacugaguuuucagaaagcuaaagaagcugaaguugcuuggcugggagcucauauagugcucagagaaagccaagcugaugcuaaaaggaugaauuuggacaaugaagaaauggaaguggaagaagaagauacgagaauccuaacgcuugagccauugccggaaaguauuccgcacgauccuguuuucauaaaugaaguuaaacuugccgaguucaaacaaguuuuagggagaaauaauauaaauucugaauucuccggcggcaccuugugguguuccaauggcucaauagcagugagaaagguugagaacggcaaaauaauguuggaggguuguauauccgaagauuauuauaagguuaaagaauuguuguacgaacaguacgcuauuuuauag

SEQ ID NO: 6255 - RNA, 2289 nt, Phyllotreta striolata
augccuccguuggagguaacagcgaauaccaacaacgaugaaucggcgcccauaaacccagucgucggaauaaucuauccuccgccggagguuagaaauaucgucgacaaaaccgccaguuucgucgcgagaaauggacccgaauucgaagcacguaucagacaaaacgagcucggcaaucccaaauucaacuuccucaauggcggugaucccuaucacgccuacuaccaacacaaagugaaggauuucagagagggaaaaggccacgaaccgacuccgggcuugaaccaagccauugcgaaacuaucggugagcgcuuccgcacagcaaaagcaacaggagauauugaagcaagucgagcagccuuucguuccgaaagauccgccggccgaauucgaguuuauagcggaccccccgucgauuucagcuuuagauuuggauaucguuaagcuuacggcccaauuuguagcgagaaacggucgagcuuuucuaacgcaacugaugaacagagaacagagaaacuuccaauucgauuuuuugagaccgcaacauucgcuuuuccaauauuucaccaagcuuuuggaacaguacaccaaggugcucauuccgccgaagagcauggaacaaaggcucagagacgaggcgaaaagcgccaaagccguacucgagcaggucaaauacagggccgaaugguugcgguaucaagaacagcaaaaggccaaagaggaggagauacucgaaagagaaagaguggcuuacgcgcaaauagacuggcacgauuucgucguugucgaaaccgucgauuaucaaccguucgaaaucggcaauuucccgccgccuacgacccccgaagaggucggcgcgcgcauucucauccaagagaggaucgaagagggcgaagacaucgaaaugcaauuggaaagcgacgaagacgacgaucccuccaacgcggacgacgguuugagcgccaugcaggauaagacgaaacgcaagggaggcggcgacgacaaccgucugcaggacauggaagaggacaccuccgaugaagacaacgacgacgaauccgguaaaacuucgacuucaucuucgcucauccagccgccguugccgcccgugcccgauaaaguacucgucaaaaaauacgaucccaaacaagccgugaaaguaucgaggccgacaguaggcgacgauuaucuaguaucgcccaucaccggcgagaagauaccggccaguaaaguacaggagcacaugcgcaucgggcuguuggacccgcgaugggucgagcaacgcgacaaacaaauguccgacaagaugaaccaagacaugguguacgccgcagggagcgccaucgacgcuucguugaaguugcuggccgaaaggcguacggauauauucggcgugggcgacgaggagacggcgaucgguaagaaaaucggcgaggaggacgugcgcaaggacgagaaagugacgugggacgggcacacgagcagcguggaggcggcgacgagggcggcgcgcgccaacaucaccuuggaggagcagauacaucagauacauaaagugaaaggucuccuucccgacgaagagaaggagaagaucgguccgaagaauaucgguucgaagaagauuaacauccaaagcguuaucacuacgaaaccgccgaaucccucuacgcagcaauccaaacagucgauuucgaugaugcaaacgagcgcccagccgaucaugccgguuccggcgcaaccgacgaugauggcgccgcaaccguccauuaugaugaugccggccccuccgaugcccgccauacgaccgccgccgcucaugauggccggugguguggcgaugggcggcuauccggugggaccgaugcccggcgggccgccgggucccggcaugaacauggcccccaugaagcaucccagcgacgggcccagcgaggacgagccgagcaacaagaaauugagaaacgaggauucguuggugccggagaacguguuuuuguccagaaauccgagucaagugucuaucaaaauuucggugccucugaugccggagaaaucggaauggaggcugaagggccaaaugguaucguggacguuggcguugacggagucgguggugaaucugaaggccaaaauccaggaggaaacgaacaugccgccggccaaacagaaguuauucuucgacgggauguucuucaaggauuccaacacguuggcuuacuacaaugugacgcaaggagcggucauucaguugcaaaucaaagaaagagguggaaggaagaaauga

SEQ ID NO: 6256 - RNA, 975 nt, Phyllotreta striolata
augccgaguacagagguaacaacgacuaagguaauagugcacccgcuggugcuccucagcguaguggaccauuucaaucgaauggggaaaaucggcaaucaaaagcgcguugucgguguucuacucgguugcuggagggcuaaaggagucuuggaugugucuaacaguuuugcagucccuuuugaugaggacgacaaagauaaaucuguaugguucuuggaccacgacuacuuggaaaacauguacggcauguuuaagaaagucaacgcuagagaacgcgucguugguugguaccacacugguccuaaauugcaccaaaaugacaucgcuauuaacgaauuaauucgaagauacugcccuaauuccguguuggugauuaucgaugcgaaaccuaaagaucuggggcuuccuacugaagcguaccaagcggucgaagaaguccacgaugauggcucucccacguccaaaacauuugaacacguuccgagcgaaauaggcgcagaagaagccgaggaagucggcguagaacauuuauuaagagauaucaaagacacuacagugggcacuuuaucucagaggaucaccaaucaguuauuaggccugaaaggguugcauuugcaauugagagacauaagagacuauuugaugcaagugggcgauaccaaacugcccauuaaucaucagaucaucuaucaauugcaagacauuuucaauuugcugcccgauauaaaccaagaugcauucaacaauucguuuuauguuaaaaacaacgaucaaaugcuuguaguuuauuuagcagcucucguucgaucuaucgucgcauugcacaaucuaaucaacaacaaacucaccaacagagacgcagaagaaggcaaaaaggaagagaagaaggacaaggauaaggauagcaaagacaaagauaaggaaaaaacugacaaagaaaaggaggcgaagaaggacgagaagaaaaaauaa

SEQ ID NO: 6257 - RNA, 1653 nt, Phyllotreta striolata
auguuuggaggaggacgcgccccgauuuuaguguugagccagaauacaaagcgcgagucgggccgaaaaguucaguuggagaacaucaaugccggcaagcaaaucgcagaugucaucagaacaugucucggcccacaagccauguuaaaaauguugauggaccccauggggggcaucguaaugaccaacgacggcaacgcuauucugcgagagaucaccgugcagcauccugcugcuaaaaguaugauagaaauagccagaacccaagacgaagaggugggagaugguaccacuucuguaauaguauuagcuggagaaauguuggcagcugcugaacaguuccucgagcagcaaauccacccgacgaucaucaucagacaauacaggcaggcccucgaagauauggugcaguuccuagaaggaccuuugagcguaccucuagaucgaagcgacaaaaacgcuauugccgaagugguuaaagguuguauaggaacgaaauucuugagcaaguggucggauuuggccgucaauaucgcuuuagaugcgguaaauaccguucuauuagaagaaaauggccgaacugagguggauaucaagagauacgccaaaguggaaaagauucccggugguucgguggaggaaucgaggauuuugagaggagucauguugaacaaagacguuacccauccuaaaaugaagcgacacauuaagaauccgagaaucauccuuuuggacugcgcuuuggaauacaagaagggagaaucucaaaccaacguugaaauuaguaccgaaacugauuuuaccaaacuccucgaauuggaagaagagcacgugaagcgccaaugcgacgagaucaucgcccucaagccggacgucguguucaccgaaaagggaguauccgauauagcccagcacuuccugcugaaggccggcaucaccgccaucaggcgugugagaaaguccgacaacaaccgaaucgccagagcuugcggcgccgucaucgucaacagaaccgaggaacuccaagaguccgacgugggcaccggggcugguguguucgaaaucaaaaaauucggcgacgaguacuucuguuucgucgacgaaugcaaaaauccaaaggccuguacgauccuccugcgaggagccagcaaggauauccugaacgaaaucgaaaggaaccuccaagacgcccugcaagucgccaggaacaucauacugucgccgcguuuggugcccggcgguggggccaucgaaauggccguggcccaacgguugaugcagaaggccacgcacggucccuacagggcgcucgcucacgcuuuggaaaucauuccgaggacguuggcgcaaaauugcggcgcuaauaccaucagaacguugacggcuuugagggcuaagcacgccaaucacacugacgccgacaaaccgugcacuugggguaucgacggugaaaccggggaauuggucgauaugaaagucaaaggcuugugggagccguugucugugaaacuucagaccuacaaaacggccgucgagaccgcuauucuccuguuacguaucgacgauauuguaucgggaucgaaaaagaagggcgacaaggaggucccgacucccagccaaaugcaacaacaggaagcccaaggagcggauuaa

SEQ ID NO: 6258 - RNA, 702 nt, Phyllotreta striolata
augaugcaaacaggaauacgucccuauuauccugacuauuccacaauucccgucgaacgccagauuaauccguacgcugauaauggagggagcguaguagcaauugcaggaaaagauuucgugguuauuggugccgacacgcgucucaguuccggcuuuuccauuuacacuagaaaccagaacaagcuguuuccucuuucugagacaaccguuuuaggauguucgggcuguuggugcgauacuuuaacguugacucgcauuuuaaagucucgcaugcaaauguaccaucaagagcacaacaagaacaugucuacaacggcggcugcucaaaugcuuuccaccauguuguacuacaagcgauuuuucccuuauuacauaucgaacauucucguuggauuggauaacgagggaaaagguugcguguacagcuacgauccuguaggacauugcgaaaaagccacuuacagagcaggcgguucugcaggggcuuugcuucaacccuuauuggacaaucaaaucgggcagaagaaucuacagaagccuucacaagaagaucuuacucaggaaaaagcccuuucuacacugaaagauguuuucauauccgccgcagaaagggauauuuacacuggugauaguguacuuauuaaaaucauaacaaaggauggaacuaaagaggaaacuuuugauuugaggagagauuga

SEQ ID NO: 6259 - RNA, 900 nt, Phyllotreta striolata
auguuccaauucggcuucaacauguucccggacaucccgaggcccuucaacaugaccuacaaauguuacucaguggccauguuuccggggaacgaaagacaggacgucgaacguggaggaaaaauaaucaugccacccucugcacuggaacagcucacucgauuaaacaucaacuaccccauguuauuuaaacuagucaauaagaagacgagucgcacgacucauugcggcguguuggaauucguggcggacgaaggaaaggucuaccuuccguuauggaugaugcacaauuugguacuaaccgaaggcgauuugguucaaauggaaagcgucucguugccggugggcaccuuuuccaaauuccaaccguuaaacccggacuuccucgacauaaccaacccgaaggccgugcuggagaauugccugcgguccuuugcuugucugacgaccggcgacgugauagccgugcgauacaaucaaaaggcguacgaauugugcgugcuggaaacgaaacccggcaacgccaucaguauaaucgaaugcgauaugaacguggaauucgccgcucccgugggcuacaaggaacccgagcaugcgaagaaagaagaggaaaugucgguggaucccgccgacuugaugccggaaccgucgggauucguggcuuuuagaggggccgguaaccgauuggacgggaaaaaacgcaaagauucuucgucuaacgacgcuccuucgguuaaaccggcuuacguccggggaauucccgauuacgauuaucaaaucggcacgcuggacuucaucaggcguacggugaugaagccgaaggagaaggauaguagcgaugauggggaugauuucaaggcuuucagcgguacuggguucaguuugagaaauaggaauuag

SEQ ID NO: 6260 - RNA, 1623 nt, Phyllotreta striolata
augucggccuuaccaggagccaucgcuuucgacgaauaugggagaccauuuauuauuuuaagagaccaagacaagcaaaaacgauugaccggaaucgaugcccugaagucgcacauuuuagccgcgagucaaauugcucacacuguucgcaccucuuuggggcccaaaggccuagacaagaugauggucuccucugauggagaaguuacuguaacuaaugacggagcuacuauuuugaagaugauggauguugaacaugaaguagcuaaauuguuaguucaacuaucucaaucacaggaugaugaaauaggggauggaacuacuggaguaguaguacuagcaggggcucugcuggaacaagccggcgcccucuuggaccguggaauccauccgauaagaauagccgauggcuucgaauuggcaugccaaacggcuguggaucaucuggagaaaaucgcugaacuguuuccaguuuccgcugaaaacaccgagccccuugugaaaguugcgaugaccacuuuaggcucgaaaauaauuaacaagugucacaggcaaauggccgaaaucgccgucaauggcguauuagcuguggcggaucuugaacaaaaggaugucaacuuugaacucauuaaaguagaaggaaagguuggugguaaauuggaagacacgacauuagugaaaggugucguuauagauaaaacaaugucucauccucaaaugccgaaggaacuuaagaauguuaaauuggcaauccucaccugcccguuugaaccucccaaacccaagaccaagcauaaguuggaugucaccagcguagaagacuacaaagaacuaagauuguacgaacaagaaaaauucaaggaaauuguuggcuuagucaaaaaagcuggagcuaccuuggccauuugccaauggggauucgacgaugaagcuaaccauuugcuguugcagcaggaguugccugcuauacgauggguuggugguccagaaauagagcugauagccaucgcaaccggaggaagaauaguuccacgauucgaggaacuuagcccugaaaaacucggcucugccgguuuggugcgcgagauaucguuuggaacuaccaaagauaagaugauggugauugaagaaugcucgaauucccgugccguuaccauucuugucagaggcgguaaucaaauguugguugaugaagcuaagaggaguuuacacgaugcuuugugcguugugaggagucucauucaggaaccaagagucguguacggaggaggugcagcugaaauagcuugcaguuuagcuguggcagcucaagcugaucaguuggcuucuuuggaacaauacgcuuaucgggcauuugcugaagcguuggaaagcauuccgcuggcucuagcugagaauuccgguuucuccgccauccauacuuugggagaaaucaaggcaaagcaagcugcaucgggagauccggcacuuggcgucgauugcaugaauauuggcaacauaaacaugagagaacagcauguuacagaaucucugcgaucuaagaggcaacaauuguuguuggcuacgcaauuagugaaaaugauucugaagauugacgauguacgucaacccggcucuggcuaa

SEQ ID NO: 6261 - RNA, 342 nt, Phyllotreta striolata
auggccacugcuauggacgucgauuccgaagaaauugaauuaccaacuucaagcaguucgaaaggcgagaaaaaacguuuugaaguaaaaaaguggaaugcuguagcucuuugggcuugggauauuguuguugauaacugcgcuauaugucgaaaccacauaauggacuugugcauugagugccaggcaaaucaggccucugcaacuagugaggaaugcacuguagcuuggggaguaugcaaccacgcauuucacuuucacuguauuucaagaugguuaaaaacuaggcaaguaugcccuuuggacaauagagaaugggaauuccaaaaauauggucacuaa

SEQ ID NO: 6262 - RNA, 1605 nt, Phyllotreta striolata
auggugucauuaaacccggugaggauucucaaacaggaggccgaggaggaacgggcggaacuagcgcguuugagcagcuucgucggcgccauugccaucggagauuugguuaggaguaccuuggggcccaaagguauggauaaaauucuagugucgagcggcagaaacagcggaaugguagaagucaccaacgacggagcuacuauauuaaaauccgugggcgucgauaacccugcugcgaaaauccucgucaacaugucaaagguacaagaugacgaaguaggcgaugguaccacaucaguaacuguauuagcuucggaauuguuaaaagaagccgaacgccuaauugagcaaaagauucacccgcagacuauuauagcggguuggagaaaauccguggauaucgcgagaaaggcgcuuuuggacgcaucgaaagacaacagcgccaacuuagaaacguucagagaagaucugaugaacaucgcccgaaccacauugagcucgaaaauucuaucucaacacaaagagcacuuugcgaagcucgcagucgacgccgugcugagauugaagggauccggcgauuugcaagccauucaacugaucaaaaaaaccggcgguacguugcaggauucguuccucgacgaaggauuccugcuggacaagaaacccggcgugcaccagcccaagcgagucgagaacgcuaaaauccugaucgccaacaccccgauggacacagauaaaaucaaaguguuuggcucgcacaucaaagucgacucgauggccaaaaucgccgaauuggaguccgccgagaaggauaaaaugaaagacaaagucaacaagauccucaagcacaacgccaacguguucaucaaccggcaacucaucuacaacuacccggaacaguuguucgccgaugccggcgugauggccauugaacacgccgauuucgauggcaucgaaagacuggcgcuggucaccggaggagaaauagucucgacguucgaucacccggagcucgucaaacugggaacuugcgacgugauugaacaaaugaugauaggagaagauacgcugcugcguuucagcggaguagcuuugggggaggcuugcacgauagucauucgaggggccacccagcagaucaucgacgaagcggaucgcucccugcacgacgcucuuugcguacuagccgcaacggugaaagaaagcagaaucguauucggaggcgguugcagcgaaacccuuauggcuacggccguggccaaagcggccguuaauaccgcuggaaaggaagcacucgccauggacgccuucgcuagagcuuuguuacagcuaccaaccaucaucgcugauaaugccgguuaugauuccgcucaauuaaucagcgaacucaaggcagcccacaacagcggccucaacacuauggguuugaacauggagaagggcgaguugggcgauaugcgagcgcugggcaucaccgaaucauucguugucaaacgacagguguugauaucggccggcgaagcugcugaaaugauucuucgggucgauaauaucaucagggcugcgccgagaaagcguaccgaagacaggggaauguguuag

SEQ ID NO: 6263 - RNA, 858 nt, Phyllotreta striolata
accauguuucgcaaccaauacgacagcgacgugaccgucuggagcccccaagggcgccuccaccaagucgaguacgccauggaggccgucaaucucggcucggccaccgucgggcugaaaagcgccagucacgccguuauaauagcguugaaaagggccucguccgaacuguccgccuaucagaagaagaucauccagaucgacgaucacaucggcaucaccaucuccgguuugacggcggacgcgagaauacugagcagauauaugaggaacgaauguuugaauuacaaguacucgauggauucguacaugccuuugaacaggcugaucaacaucuuaggcauaaaaaugcaacauugcacccaacgcuacgaccguagaccguucggcgucggucuacucgucgccggcuacgacgacgacaccggcgcccacgucuaccagaccugucccucggcgaauuucuacgauugcaaggccaugucgaucggcgcgcgaucgcaaagcgcccgaaccuacuuggagaaaaagcucgacgagcugcccuccauggcuuuggaggaucucaucaagcacggcuugagagcuuugagagauacucucccacccgaaguggauuugaccacgaaaaacguuucgaucgguuacgugggaaaagggacgagcuucaagauauuggaggaggaggagacggcgccguuuuuggcguugaucgaaggggaggaacguagaggggguagcggugguggugggggugcuguggagggggcggcugauccuuugagggaaucgggggacgaggggggaccccccaacagggauccugucccacagguagcgauggauacaacggaguag

SEQ ID NO: 6264 - RNA, 2547 nt, Phyllotreta striolata
augguuuuaaagccaggaaauaaccaagaaccuauggaaauaaccuucaaugacgaugaucugccuuaugaggaagaaauuuuacggaaucccuacucggugaagcacuggcuucgauauauagaccacaaaaaagcggcucccaauaacgaaaugaacauaaucuucgaaagggcgcucaaggaguuaccggguucguacaaauugugguacaauuaccugcggaccaggaggaaucaaauuaaaagcaaaugcaucaccgauccggguuucgaagagguaaacaacgccuucgagcguucguugguguucaugcacaagaugccccgaauuuggauggauuauugcaccuuccucaccgaccaguguaaaauaacgagaacccgaaaggucuucgacagggcccuucgagccuuacccguuacgcagcacaacagaauauggccuuuguauuugaaguucguacagaaacacgauauauccgaaacugccguucgaguuuucagaagguacaugaaauuguguccggaaaacgccgaagaguacaucgauuacuuagcgucgguggaacgauuagacgaagccgcuauaaucacggcuaaaauaguaaacgacgauaacuucgugucgcaacagggcaaaucgaagcaccaacuuuggaacgagcucugcgaguugaucuccaaaaauccggaaaaaguccgcucgcuaaacgucgacgccaucaucagaggcggccugcgccgguacaccgaccaauugggccaccuguggaacuccuuggccaauuacuacguucgcagcgguuuauucgagcgggcuagggacaucuacgaagaggccauucaaaccguuacgaccgucagagauuucacacaaguguucgaugcuuaugcgcaauucgaagaguuaagucugagcaaacggauggaagaaguggccggaaaacaaaaccccagcgaggacgacgauacggaauuagagcugcguuuggcgcgauucgaguaccucauggaacgccgauuguugcucuuaaacucuguauugcuccgccagaauccgcacaacgugcaagaguggcacaagcgcguacagcucuacgaaggcaaaccgcacgagaucaucaacacguacaccgaagccgugcaaacgguggaucccaaacuggccgugggcaagcugcacacgcuguggguggaauucgccaaguucuacgagggcaacgaucaaaucgaagaggcccggcugauauucgagaaggccucgcaggugcccuacgugaaagucgacgaucucgcgaccguguggugcgaauggaccgaaauggaaauccgcaacgaaaacuacgacgaagcuuugaagcucaugcaaagggcgacggugaugccgagccggaaaguggccuaucacgacgacacggaaaccguccaaagcaggcuguacaagucccucaaaguguggucgauguacgccgauuuggaggagagcuucggcagcuucaaauccugcaaggccaucuacgaucgaaucgucgagcugaagaucgccacgccgcagauaaucaucaacuacggcguguuccucgaggagaacaauuacuucgaggaggcguucagggcguacgagaagggcauaucgcuguucaaguggcccaacgucuacgacauauggaacaccuauuugaccaaguuuuugaaacgcuacggcggcgguaaauuggagagggcgcgcgaucuguucgagcaaugccucgacgguuguccgccgcaauucgccaaacaccucuauuuguuguacgccaaauuggaagaggagcacggaauggcccggcacgccauggcuguauacgaaagauccacgaaggcuguaccggagaacgagauguucgacauuuucaacauauacaucaaacgagccgccgagauauacgggauaccgaaaacgaggcagaucuacgagaaagccaucgaggugcuuccggaggauaaaacgagggagaugugccugagauucgccgauauggaaacgaaauuaggcgagaucgaucgagcgagggcgauauacgcgcacugcagccaaaucugcgauccgcgcgucaccgccgaauucuggcaaaucuggaaggaguucgaggugcggcacggcaacgaggacaccaugagggagauguugcggaucaagcgcagcguccaggcggucuacaacacacaggugaacaugaugucggcgcagaugcugagcucggcgggcagcucgagcggcaccguggccgauuuggcgccgggcgugaaggacgggaugcggcuguuggaggcgaaggcggccgagauggcgggcucggcggcucaaaagggcaauaucauguucgucagaggggagacccaaggggauaauaaggauaagguggugaauccugaugaaaucgauauaggaagcgaugaugaggaggaagaggacgaggaggagauaccguuggagaaacagaacgugccgucugagguguuugggagucucaagaaaaaagggaacgaugaagaugaggauuaa

SEQ ID NO: 6265 - RNA, 1116 nt, Phyllotreta striolata
auggcgaacggaccgauagcugaaagaaauagagacgcuacgauauacgucggugguuuagacgauaaaguaucagaauccuuacuaugggaacucuucguacaagcggggccauuagugaacguacauaugcccaaagaucgcgucaccaugaugcaccagggcuacgguuucgucgaauucaugggcgaagaggacgccgacuacgcuauaaaaauaaugaacaugauaaaauuguacgggaaacccauaagagucaacaaggcuuccgcucaccaaaagaacuuggacgucggcgcgaacauuuucauagggaacuuggauccagaagucgaugagaaacucuuguacgauacguuuucggccuucgguguaauauuacaaacgcccaagauaaugagagauccggagacuggaaauuccaaagguuucgcguucauaaacuucgccaguuucgaagccuccgaugccuccaucgaggcgaugaacggccaguaccuuugcaaucgaccgauauccgucucuuacgcguucaagaaggauuccaagggcgagagacacggcucggcggccgagcgauuauuggccgcccagaauccauuaucgcaggccgacaggccccaucaguuguucgcagacgccccaccgauaggaaugaugccgaugagcauggcgccgccaccuccgccucuaaucaccggcaugaugccucccccaccgccuacgccgggcggaaugccgccgccuccuccgccgguuccgccgccgaguuccuuccccgcgggcaucccgccgccgccguuaccgcccucucaaccgccgcugccgccgggcgcgccgcccgcgauggcgccggugccgggcggcgccgccagaccgccgccgccgccuccgugggccggugcggcggccaacgugccgaugccgccgggaccgccugcggcgaacgcgggcggcggcuucgggggaaugcugccgccuccgccgccgcccggcgggaggccuuuaccgccuaauuggagaccgccgccuccgccgccgccgaauuucggcggugccaggccgccuuucccgccgcgggggccgccuccuccgccgccgacguucgaaggguaa

SEQ ID NO: 6266 - RNA, 774 nt, Phyllotreta striolata
augggucguguuauucgagcgcaacguaaaggugcgggauccguauucaaaucccacacuaagaggaggaaaggggcacccaagcuccguuacuuagauuucuccgaaaggcauggguacaucaagggugucgugaaagacaucauccacgaccccggucguggcgcccccuuggcucuggugcacuucagggaccccuacaaguuccaaacuaggaaggaaauauucauugcucccgagggaauguacacagggcaauuuuuguacuguggaaagaaagcuaaccuccaaauuggaaauguguugccuguaggaacuaugcccgaagguacaaucgucuguaauuuggaagaaaaaacuggugaccguggccgauuggcucgagcuuccgguaacuacgccaccgugauugcccacaaucacgacacaaagaaaacuaggguuaaauugccaucgggagccaagaaaguuaucccgagcaacaacagagcuauggucgguaucguugccggagguggucguaucgacaagcccauccugaaggccggucgcgccuaccacaaguacaaggugaagcguaacugcuggccgaaggugcgugguguugccaugaaccccgucgagcauccucacggaggugguaaccaucaacacauugguaaggccuccaccguuaagagaggaacguccgcuggucguaaggucggucuuauugcugcgcguaggaccggucguaucagaggagguaaggucgaaaauaagaaggaagauuaa

SEQ ID NO: 6267 - RNA, 411 nt, Phyllotreta striolata
auggcucguacgaagcagacagcgcguaaaucgacgggagguaaagcgccccguaaacaacuggccaccaaagccgcgaggaaauccgccccaucgaccggaggugugaaaaaaccccaucguuaccgucccgguacagucgcccugagagaaaucaggagauaccagaaauccaccgaauugcucaucagaaaacugccuuuccaacgauuagucagagaaaucgcccaggacuucaagacagaucuccguuuccagucugcggcuaucggugcucuacaagaagcgagcgaagcauacuuggugggucuguucgaagacacgaacuugugcgccauucacgccaagagagucacaaucaugccuaaagacauccaguuagcucgccggaucagaggagagcgagcuuag

SEQ ID NO: 6268 - RNA, 1593 nt, Phyllotreta striolata
auggcaauaaguuuauugaauccgaaagccgaaguggcgagagccgcucaagcguuggccguuaacauaacagccgccaaagguauuuccgaagugaugaaaacgaauuugggaccgaaggguacaaugaaaauguuggucuccggcgccggcgacauuaaaauaacgaaagacggcaacguccuuuugcacgaaaugcaaauccaacacccuacggccucguugauagcaagagccucgacagcccaagacgauaugaccggagacggaaccacaucgacaguccuaguaaucggggagcuccucaaacaagccgacauuuacaucgccgaaggucugcaccccagaacccucaccgaaggcuucgacaaagccagagccaaagcccucgaaguacuggagaagcugaaaauacccaucgaaaucaacaaggaaucguuaaccgacguuugucgaacgagcuuaagaacgaaacugcaccaaaauuuggcugacuuacugaccgacgugugcgucgaggccauccucgccaucaagcaaucggacaagccggucgauuugcacaugguggagcugauggagaugcagcacaagaccgaaaccgauacgcaacuggucaaagggcuggugcucgaccacggcgcccgccaucccgacaugcccaagagccugcggaacugcuacauucucaccugcaacgucagcauggaguacgagaagagcgaagucaauucgggcuucuucuacaaaaccgccgaggaaagggagaagcucgugcuggccgagcgcgauuucaucgagcagcgcgucaagaaggugaucgaauugaagaagacccuuugcaagggcaacgacaagucguuugucgugauaaaccagaaggguaucgaucccaugagcuuggacaugcuggccaaagagggcaucguggcccugcgaagggccaagaggcguaacauggaacgauuggcucuggccugcgguggaauagccgugaacaguuucgaugauuuacaagaaucucaucucgguuacgccgggcacguguacgagcacguauugggcgagaacaaauacacguucgucgaggacugcaaagugccccaaucggugacgauucuaaugaagggccccaacaagcacacucuguugcagaucaaagacgccgucagagacgguuuaagggcuaucaauaacgccaucgacgacaaggcucuuguuccgggcggcggggcuuuggaaguggccguaaacaagucgcugcuggcguacaaggacgagaucaagggcaaagcccgauugggcgucgccgccuacgccgaagccaugcuggugauucccaaaacgcuggccguuaauuccgguuucgaugcgcaggauaccaucgugaagcugcaggaggaggcucggcucaguucggaaccgaucgggcucgauuugacgucgggcgaaccgaucaauccuaaagacgcgggaaucuacgacaacuacguggugaagaagcagauuaucaauucguguucgauaaucgccagcaacuuguugcucguagacgagauuaugagggccgguaugagcagcuugaagggcuaa

SEQ ID NO: 6269 - RNA, 3126 nt, Phyllotreta striolata
augucuagugcuggaaucgcagacagccccaucgauccuccagcaaaaaagcguaagcuugacucgaaaaucugcagccucgacauggcgaauaacgaagcuucgggauccucgaacgccggcgaaaucgacgagggacucuacucgagacagcuguacguguugggacacgaugccaugcgacgcauggccaccagugaugugcucgucuccggucugggcgguuugggugucgaaauagcuaaaaaugugaucuuaggcggcgucaaaucagugacucuccacgacgaugcucugugcaccgugcgggauuugucaucgcaguucuaccucaccgacgccgacguggggaaaaaucgcgcggaggccugcugcaagcaccucuccgagcucaacaccuacgucccgacgaagcccuacacgggcccccucgacgagaagaucauccucaaguaccggguggugguguugacuaauagcacucgugccgagcagcuccguaucagcgagauaacucacaacaacgauaucgcuuugauaaucgccgauaccaaaggucuguucgcucaagucuucugcgacuucggcaaggccuucuccgugguggacgucaacggggaaccccccgucuccaccaugauagccgauauaucgaacgauacagagagcgugguaacuugcaucgacgacaccaggcauggaauggaggaaggcgacuacgucaccuucuccgagaucuuaggcaugaccgaauugaacaacugcaagcccaucaaaaucaaaguguugggcccguacacguucagcaucggcgacaccaccaaauucuccaaguacguccgaggcgguaucguaacgcaagugaagaugcccaaggaggugcacuucaagccgcugaaggagucgcugcagaaucccgaauucguggugaccgauuucgccaaguucgaucaccccauccaauugcaccucgccuucuccacgcugcacaaguucguggagaagaccggccgguugccgaagcccuggaacaaggacgacgccgccgaguuuaucgccuuggcgaaauccuuggcggugaacgguuccaccgacaacgaggucaacaccgauauacucaacguuuucuccaaguguugcucgggcgauuugaaucccaucaacgccacgaucggaggcaucguggcgcaggaggucaugaaagccugcucggggaaguucuaucccaucuaccaaugguuguauuucgaugccaucgaaugccugccccaagacaaggacgagaucacagaggaacuggccgcucccguugauagucgauacgacggacagaucgcuguguucgguaaagauuuccagaagcgauuaggugaauugaaauauuucauugugggcgccggagcgaucgguugcgaauuauugaagaacuucgccaugaugggauugggaacgcaaggcggucaaaucaccguaaccgauauggauuugaucgaaaagucgaauuuaaacaggcaauuuuuauucagaccccacaacguucaacaacccaaauccgcuaccgcugcuaagguaauuaagaagaugaaucccgacguuaacauaguggcccacgagaaccgagugggccccgaaacggaaaacgucuacaacgacgaguucuucgagguccucgacggcguggccaacgcccuggacaacgucgacgcgcgaauauacauggacagacggugcgucuacuaucgcaagccucuccucgaaucgggcacuuugggcaccaaaggcaacacccaaguagugguaccguuccugucggagucguacagcucgucgcaggacccgcccgagaagagcauaccgauuugcacgcugaagaacuuccccaacgccaucgagcacacguugcaaugggcccgggacaacuucgaggguuuguucaggcagaacgccgagaacgcgucgcaguaccuccgagauccggauuucaucgagcgcaccgucaaacugccgggcguccagccgcuggaggugcuggaaucggugaaggcggcguugaucgacgaaagaccgaaggauuacgacgauugccuggcgugggcgcgccugcauugggaggaccaauacgccaaucagaucaagcagcuguuguucaauuucccgcccgaucaacucaccagcaccggccaguuguucuggucggggccgaagagguguccggauccgcucguguucgacaucaacgaggauuugcacguggauuacgucauagccgcggcuaauuugaaagcucaaguuuacgguauacccaccaauaggaauagauguuaugccaaacaagucgucaccggcaucgaggugccggcguuugugcccaaaucgggcgugaaaaucgccgugaccgacucgcagauggccaugaacgguaacaacgucgacuuggaucggaucaaucaaaucaagcaggaauugccuucgauggaggagcugagcgaucugaagcugacgccguuggaauucgaaaaggacgacgaugccaauuuccacauggacuucaucguggcggccucgaauuugcgagcggccaacuacaagauuccucuggccgaucgacacaaaucuaaguuaaucgcugguaaaaucaucccggcgauagcuacuacuacuucggugguggccgguuugguuuguuuggaauuguacaaacuggcgaggaguaucaagaguuugacgccguuuaagaacggcuucgugaauuuagcguugccguuuuucggauucuccgagcccaucgcggcgccuaaaauggaguacugcgguaaccaguggaccuugugggauagauucgaggugcaaggagagaugacgcucgccgaguuucuggaguauuucaaggagaagcacgguuuggagauuacgaugcugucccaaggggugugcaugcuguacucguucuucaugccuaaagccaaagcucaagaaagguuaggacugacgaugucugagguggugaggagagugucgaagaagaagauugagccucacguuagagcguugguuuuugaguugugcugcaacgacgccgacggcgaggacguggagguuccuuacguuaaauacaacuuguauuga

SEQ ID NO: 6270 - RNA, 1029 nt, Phyllotreta striolata
cuuugccaagcgaaaagugguauggguaaaacggcgguguuugugcuagccacccuacagcaacuagaacccaccgaaaacgucguuuacguucucgucaugugccauacgcgagaauuggccuuccaaaucagcaaagaauacgaacguuucagcaaguacauguccaacaucaaggucggcguguucuucgggggccugcccauccaaaaagacgaagaaguauuaaaaaacagcuguccgcacaucgucgucggaacgcccggccgcaucuuggcccucgucagaucgaagaaacucaaucucaagcacaucaaacacuuuauucucgacgaaugcgauaaaauguuggagcuacuagacaugagacgcgacguucaagaaauauacagaaauacaccgcacgaaaaacaaguaaugauguucagugcgacgcucagcaaagaaauucggccaguuugcaagaaauucaugcaagaucccauggaaguguauguugacgaugaggcgaaauugacguuacacggucuacaacaacauuauguuaagcuuaaagagaacgaaaagaauaaaaaauuauuugaguuacuugauguguuggaguuuaaucagguggugauauuuguaaaauccgugcagagauguguagcguuggcgcaacuuuugacggaacaaaauuucccagcaauuggaauacaccgaggaauggagcaaaaagaacgauuauccagauacgaacaauucaaagauuuucaaaagagaauauugguagccacuaaucuuuucggucgugguauggauaucgagagagugaauauuguuuucaacuaugauaugccggaagauucggacacuuaccuucaccgaguggcucgagcaggucguuucgguacaaaggguuuggccauuaccuucguuuccgaagaaggagaugccaagauauugaacgaaguacaagacagauucgauguuaacauuaccgaauuaccugaugaaauugauuugaguucauacauugagggacgauag

SEQ ID NO: 6271 - RNA, 1572 nt, Phyllotreta striolata
cccgcagguauggaagccggagugaaugucauuugucaucauuacacagcgaaaaacaauuuuucaacaaccaauucuuguuuuccaaauauucgaaugaaaaugggcguagaaaccgacguugaaaugaaaaaugcagacagucccgcagguauggaagccggagacagcaaacgggacaucgacuugcaaagcguccuggaaauucgcgaacaugccaggcagaucgagaaggcagugagcagcaaagaaaaccgcuucauauugagaguuuuacgcugcuuaccuaacaccagaaggaaacuaaacggaacaguccucagaagccuuaucaaucaaauguaccccgucgccgaaagggacgugcuguucggccucagcgaggaaucuaccagugacguagacgcuacacagucgagggccagaucagccacuaaaacgccucuucccgaaguagaugcuuacauucacuuacuacuuuuaguucgacugaucgauaccaauaaacuagcugaagccgagcgguguucgaacauaaucaugaacaaaaucaccagccagaaccgacgaaccaucgaccacauagcagcuaaauguuacuucuaccauucgagaguggccgagcucaccgacaagcucgauucuauccggaguuuccuccacucccgucuacgaacagccacccugcgaaacgacuucgaaggccaagccgugcugauuaacugcuugcugaggaauuaccugcacuacucgcuguacgaucaagccgauaaauuggugaacaaaugcgucuaucccgaaacggccaguaacaacgaaugggcgagguauuuguacuacuugggccggaucaaagccgcccgguuggaguacagcguugcgcacaaacaccuaauucaagcgaugagaaaagcgccucaaaacgcugcgauggguuuucgucaaacggugcagaaacugaccaucguuguggaguuacugcugggggauauaccagaaaggcaggucuucaggcaggccaauaugaggcacucauuggcuccuuacuuccaauuaacccaggcgguuagaauggggaacuugcaccgguucggagaaguguuggagaacuuugggccccaguuuagacaggaucauacguucacuuuaauacuaaggcuucgucauaacguuauaaaaacagcuauaagaucaaucggguugucuuauucgaggauauccccgcaagauauagccaagaaacucggccuggauucggcggaagaugcggaauuuaucguugcuaaagcuauucgggauggcguaaucgaggcuaucuuggacccucaagggggguacaugcgaagcaaggagagcaccgauauuuauugcacuaaggaaccgcaacucgccuuccaucagaggauaucguuuugcuuggaccugcacaaucaaagcgugaaggccaugagguauccuccgaaagcguacgggaaagaauuggaaucugccgaagagagaagagaaagggagcagcaagauuuggagcuggcgaaagaaauggccgaagaagaugacgaugguuuuccuuaa

SEQ ID NO: 6272 - RNA, 1689 nt, Phyllotreta striolata
auggcuuccagccaucaagcccuuccaguaucggccauccugaaauccaaaagcgaagucgaggaugagcccaagaagaaguccagggaggauuggcguaaggccaaagagcuagaggaggcucgaaaagccgguacagcuccggcggcgguagacgaggaagguaaagacaucaauccgcacauuccgcaguacauaucuacagcucccugguacuacggaacguccggccccacguugaagcaucagagaccccaggaugagaaacauaaggaguauucggauuugaacgauugguacaagcgaggcguggauacuucgaagaucguaacaaaguaucgaaaaggcgcuugcgaaaacugcggagcccugacucacguaaggagggauugcauggacagaccccguaaagucggagcuaaauauuccggcgcgaauauagcgccugaugaguauauccaaaaaaauuuaucacugaguuucgacgguaaaagggauagauggagugguuacgaucccucugagcacaagacgguuaucgaggaauuccagaaaguggaggaagccaaacggcaacugaaaucggauaaauugaaugcgaacgaggaguccgacgacgaagaaaaagacgaggacaaauacguggaugaaguggacaugcccggaacgaaaguagacagcaaacaaagaauaacggucaggaauuugcguauacgagaagauacggcuaaauaccugagaaauuuggauccuaacucggcguacuacgaccccaaaaccagaucgaugagggaagauccgaaucccggaaacgacgccacauaccacggggagaauuuuguucgguuuuccggagacacuacgaaccacgcgagagcucagcuguuugcaugggaagcgcacgguaaaggaguagacguucauuugcucgcagaacccacgaaauuggaauuguugaagaaagaauacgagaaaaagaaagacgagguuaagucgaacauucagggaacgguuuuagagaaauauggaggugaggaguaccucgaagcgccuccgaagaguuuacuguuggcucaaaccgaaaacuacguugaauauucgagaucggguaaaguuauuaaaggcgcugaaaaagaaguuauuagaucgaaauacgaagaagauguguauauuaauaaucauacgucuguaugggguucuuauuggcgcggaggacaaugggguuaucgauguugcuauucguuuauuaagaauucuuauuguuugggagaagcaggaaaaucaguuaacgcucaaccuauggcagauauaaaaacuaaugaugagccuaaagaggaacaacaucaugaagaugaaguuaaagaaaagaacgaagcaguggauaaagaaagcgaagaaucagauucuaguaguucgucagaagaggaaaaaucuaaagcgaaaucgaagaaaaaauuaaaaaagaagaugaagaagcagaagaagaagcaaaagaaaaaggacaaggaaaaggaaaaggagguuaaaaugucggcgucgauuaaagauauagacgaagacgugauuauagacgauagaaagcggccuuacaacagcauguucgaggcgaagaaacccacagaagaacaaauggaggaguacuacaagaagaggcgaagggacgaagauccgaugagccaauucauguga

SEQ ID NO: 6273 - RNA, 627 nt, Phyllotreta striolata
auggguauuagccgagaucauuggcauaaacgaagggccaccggaggcaagaggaagccucuucguaagaagaggaaguucgaauuaggucgcccggcggcuaacaccaaacuaggaaccagaaggauccacuauguucguacaagggguggcaacuugaaguaccgcgcccuaagauuagacaccggaaacuucucuuggggaagcgaaggaacugcccgucaaacgcguauuaucgaugucguuuacaacgcuaguaauaacgaauugguccguaccaagacauugguaaagaaugcuauuguugucguugacgcuaccccguucaggcaaugguacgaaaaccacuacaucuuaccauugggacgcaagaagggugccaaaaugacgcccgaagaggaggagauauucaauaagaaacguagcaaaaaaguacagaagaaguacgaaacuaggcaaaaaaccgcuaaaguagagccugcgauugaagaacaguuccacacuggaagauuguuggcaugccuagcaucuagaccuggacaaugcggcagggccgacgguuauguccucgaaggaaaggaacuugaauucuacaugcguaaaauuaagucuaagaaagcuaaauaa

SEQ ID NO: 6274 - RNA, 936 nt, Phyllotreta striolata
auggauagauugcuucgucuuggaggcgguaugccggguuuaacccaagcaccgccgccuuccgacgccccggugguggacacagccgagcaggucuacauuuccucccuagcccuacuaaaaaugcugaaacacggcagggccggcguacccauggaagucauggggcuuauguuaggugaguucguggaugauuacacugugagagucauagacguguucgcuaugccccagacggguaccggagugagcguagaagcuguggaucccguauuccaagcgaaaauguuagauaugcuacgacagaccgggcgaccagaaaugguugucgguugguaccauucccauccggguuucggcuguugguugucgggcgucgacauaaacacccaacagagcuucgaggcgcucuccgagagggcgguagccguagucguagauccgauucaauccguuaaaggaaaggucgucaucgaugccuuuagguuaaucaaucccaauaugaugguauugggacaggaaccccgucagacgaccucgaauuuggggcauuugcagaaaccguccgugcaggcgcugauucacgguuuaaaucgccacuacuacuccauaagcaucaauuacaggaagaacgagcuggagcagaagaugcugcucaauuugcacaagaaaucguggauggacgguuugacucuggcggauuauucggagaauugcagcgugaacgagaagaccguggccgauaugcuggaacuggccaagaauuacaacaaggccuuggaggaagaggagaaaaugacuccggaacaacucgcuaucaagaacguggguaaacaagaucccaagaggcauuuagaggagaaagucgauauauugaugaccaacaauaucguacaauguuugggcgccauguuagauacuauuguguuuaaauaa

SEQ ID NO: 6275 - RNA, 1158 nt, Phyllotreta striolata
augacuguaauuaauaagauggaggucgauggaccucucaagggugaaggguucagguccuacuacauuaccaaaauagaagaauugcaacuaaucguugcugaaaaaagccagaaccuuagaagauuacaagcccaaaggaacgaacucaaugccaaaguucgcaugcuuagagaggaacuaaugcuccuucaagaacaaggaagcuacguaggagaaguagucaagcccauggacaagaagaaagugcucgugaaaguccacccggagggaaaauucguggucgacaucgacaaaaacaucgacaucaacgacgucacgccgaauugucgagucgcccuucgaaaugaauccuacacuuugcacaagauccuacccaacaagguggauccuuuggugucccuuaugauggucgaaaaaguaccggauuccacuuacgaaauggucggcggucuggauaagcaaaucaaagagaucaaagaggugauugaauugcccgugaagcaucccgagcuguucgaugccuugggcaucgcccagcccaagggcguguuguuguacgggccgccgggaaccgguaaaacucuucuggccagagccguggcucaccacacggaauguaccuuuaucagaguaucggguucggaguuggugcaaaaauucaucggugaagguucucgaauggucagagaacuguucgugauggccagagagcacgccccgucgaucauuuucauggaugaaaucgauucuaucggauccucgcgaaucgaaucagguuccgguggcgacucggagguucaaaggacuauguuggaguugcugaaccagcucgacggguucgaggccacgaagaacauuaaggugauaauggcaacgaacagaaucgacauuuuggauccggcuuugcugaggcccggcagaaucgacaggaaaaucgaguucccgccaccgaacgaggaagcucgauuggacauccugaagauucacucgaggaaaaugaauuugaccagagggauuaauuugaggaagaucgcggaauugaugccgggcgcuagcggugcagaagugaagggaguguguacugaggcugguauguacgcccuaagggagagaagggugcauguaacacaagaggauuucgaaauggcuguugcc

SEQ ID NO: 6276 - RNA, 600 nt, Phyllotreta striolata
augguaaaauuauauugcaucaguauucucuacaaagauacuacauacgcuacgugguugaaguccgcuuucgauuuacaaaguuucaguuuuuuccaaagagggucuguacaggaguuuaugucauucuuuuguaagacuauuguggaaaggaccauaccaucaucgagacaauccgucaaagaaggagaauacaugugucauguuuauguaagacaugauaacuuagcugguguuguaauaucagaccacgaauaucccuccaggguaucgcauacgcugauuacgaaaauuuuggacgaauucgcugcuaaaauacccgcugugaauuggccuaccuugcaggagagagaugucacguuuccacagcuaaacacuuaccuuaccaaauaccagaaccccaaggaagccgaugcaaugacuaaaauacaggaggaccuugacgaaaccaagauuauucugcauaacacgauucaagcaguccuggaaagaggcgagaaacuggacgacuugguaaauaaaucagagggcuuaaguauacaguccaaagcuuuuuauaagacugcaagaaaaacaaacaguugcugcaguuucacuuaa

SEQ ID NO: 6277 - RNA, 729 nt, Phyllotreta striolata
auguuucuaacgcgaagcgaauacgacagagguguuaacacauuuucgcccgaaggcagauuauuucaaguggaauaugccaucgaagccaucaaauugggauccacagcuaucggaauaugcacgagcgaaggggucgugcuagcagucgaaaagcguauuacuucuccuuuaauggagccuacaacgauugaaaagaucguagaaguagacaaacacaucggcugugcuguuucggggcucauggcagauucacgcacgaugaucgauagggcaagaguagaaugccaaaaucauugguucguuuacaaugaaaacaucaccaucgaaucgugcgcucagggaguaucgaaccuagcuauucaauucggagauuccgaugaugauggugcugcuaugucgaggccauucgguguggcaaucuuguuugcuggcaucgacgaaaaagggccucaacuuuaccacauggauccuucagguacauuuguucaguucgaugcgaaagcuauaggauccgguucagagggggcgcagcagagcuugcaggaaguguaccaucguagcaugacucuagaggaggcuaccacagcggcauugaccauucucaagcaggucauggaggagaaauugaacucuuccaauguagaagucaugacaaugacgccaaaggauuuguuccacauguucacuaaggaacaaguggaggagguaauuacuaaauuaucuuaa

SEQ ID NO: 6278 - RNA, 1158 nt, Phyllotreta striolata
augucagaauacugguugauuuccgccccaggugacaagacuugucaacaaacaugggauacuaugaauaauaugacuaguaaacagaacaauuugucugcaaauuacaaguuccaaauacccgauuugaagguuggaacacucgaccaauugguugggcuauccgaugauuugggaaagcuggauggauucguggagcagguuacccggaagguggcccaguaccucggagagguucucgaggaccagagggacaaguugcaggagaauuugcaggcgaacaacaccgauuugccaaguuauuuaaccagauuccaaugggacaucgccaaauaccccaucaagcaaucgcugcgcaacaucgccgauauaaucagcaagcaaguuggucaaaucgaugccgaucuuaagaccaaguccucggccuacaauaauuuaaaaggcagucuucaaaacuuggagaaaaaacaaacagggaguuugcuaacccguaacuuggcagaucuggucaagaaggaacacuuuauuuuagauuccgaguacuugcaaacgcugcucgucaucguucccaaggcucaguucaacgaguggaacgccacuuacgagaaaaucacggacaugaucgucccucgaucgucggagcugaucauccaagacggcgacuacggccuguucaccgugucgcucuucaagaaggucgucgaggaguucaagcugcacgccagagagaagaaguucaucgugcgagauuucacguacaacgaggaggaauuggcggccggcaaaaacgaaaucaccaagcucguuaccgacaagaagaagcaauacgguccguuagugagaugguugaaaguuaacuucagcgaaugcuuuugugcuuggauacacguuaaagcguugagagucuucgucgaguccguguugagauacggguuaccagucaauuuccaggcuauucugauccauccaaauaagaaacaagccaaacguuuaagggauguuuugaaucaacuauacggccaucuagacaguagugcagcucuuuccggaccuaauguugauagcguagacauuccaggauuagguuucggccaaucagaauauuacccauacguguacuacaaaauaaauguggauaugauagaaucgaaggucuaa

SEQ ID NO: 6279 - RNA, 1674 nt, Phyllotreta striolata
augucgauauuagcaaguccucuauccguagcggguuccagaaccaccggcgccucaguucgcacucaaaacgugauggccgccuccaccauagccaacguggugaagagcucccugggccccgucggccucgacaagaugcucguagacgacaucggcgacgucacggugaccaacgacggcgccaccauuuugcggcugcucgaagucgaacaucccgccgccagggugcuggucgaacuggcccaauugcaggacgaggaagucggcgacggcaccaccuccgucgucaucauugccgcggaacuacucaaaaacgccgaugaacuaguaaaacaaaaaauccacccuacgucgauuauaagcggauacagguuggcuuguaaggaagcuugccgauacauacaagaccacuugacuauacccguggaggaauugggcaaggaauccaucgugaacgucgccaagacaucgaugagcuccaaaaucauaggagcugacgcggauuucuucucgcaaaugguugucgacgcggcgaccgccgucaaagugacggacgccaaaggcaacucgauguaccccauuaaggcggugaacguguuaaaagcgcacggcaaaagcgcccgcgagagcuuccugguggccggauacgccuugaacugcaccgucgccagccaggccaugcccaagaggaucgucaacgccaaaaucgccugucuggauuucucgcugcaaaaggccaaaaugaagaugggcgugcaagugcugaucaccgauccgggucaauuggagggcgugcgcgcccgcgagcucgacaucaccaaggagcgcauccagaagauccucgccaccggcgucaacguggugcugcucuccggcggcaucgacgacgucugucugaaguacuucgucgaacgcggcgccauggccgugcgucgcgucaagaaggccgaucugaagcgcaucgccaaggcgacgggggcgucguucgugacgucguugagcaacauggagggcgacgagacguucgacgccaauauggugggcgaggcggcggagguggugcaggagaggauauccgacgaugaguugaucguuaucaaagguccgaaagcccgaacggccgccucgauaauccugcgcggcccgaacgauuucuacugcgacgagauggagcgcuccguccacgacgcccucucgguggugaagcgcgugcucgaaucgaagagcgucguggcgggcggcggcagcgucgaggccgcccucucgaucuaccucgagaacuucgcgacgacguugagcucgcgcgagcaacucgccaucgccgaauucgcccgcagccugcuggucauaccgaagacguuggccgugaacgccgcccaggacgccaccgauuugguggcgaagcugagggcuuaccagaauuccagccagaccaagaaggaucacgcgcauuugaaguacgucggauuggaucugcucgaagguacugugagagauaauaggaaggcgggcgugcuggagccgacuaugucuaaggugaaaucguugaaauucgcgacggaggcggcgauaacuauacucagaaucgacgauaugaucaaauuggacgcggagcagaagggcggaaagagcuaccacgaugcuauggauagcggugaauuguacgauuag

SEQ ID NO: 6280 - RNA, 765 nt, Phyllotreta striolata
auguuuaauucuacccauucggcgccuccaccguuuuggaguaacgguccggcccccggggcuuucuauaacuucccaggaacaguagcaccuguaacuaauccaauaacucauacucagucuccaguaacgacuucaacuucaauugugucuauaaccuacgauaaggggguacuaauugccggagacuugcuggccuccuacgggucauuagccagauauaaaaauugcccuagggugaucgaaauuaacccgaacaucaucaugggugcuggaggagauuacgcugauuuucaauacguaaaaagcuucauugagcagaaaauaaucgaugaggacugcuuagaugaugguuugaaaaugaaaccaaaaucucuuuauugcuggcugacuagaauuauguaccaacgaaggaguaaacucgaccccuucuggaacaaccuaguaguaggagggauacaggaugguguaccuuuccugggaacagucgauaaacucggcacugcuuacacagauaaaguaaucuguacuggguauggugcucauauugcccuucccgucuugagagaugcccucgacaagaaaccgaacuugaaucuaaacgaagcuaagcaacucauuaaaaagugcauggaaguuuuguucuacagagacgcgagaaguuacccgaaauaucaguugggaaugauagauguggaugaagguguuaagaucgagggaccaauuucagucgaggaaaauuggaacauugcuuauaugacauaa

SEQ ID NO: 6281 - RNA, 2106 nt, Phyllotreta striolata
auggaauuuucaaaagaacccaacuuugaauugcuaacagcugaagauuuuucgccggaaaaauauguaaaaaaauugucccagaauuauguggguggaucagaauugcaaagucuucgaagaaaaauacaggggcucuccgaagaaaccagcucuaauuuaaagaaaaauguuuacgaaaacuacauucaauuuaucgaaacugcuaaagaaauuucacaucuugaaagugagauguaccagcuuucccacuuacuuucagagcaaaaggcauuacuuaauuguuuaucggccaccucgauauuggaagauguacagccagucaauauugauagggauaauaaaguaaacgagaaggaucucgaggaagaaaauaaacaaaaaauagcugcuauuuuagaaaaaguagaagguugucaggaauuguuaaaaguaccaggaagaauuuuuuuguacgaaggagauuuauuagaaauugaacccaccgaaaacaccgccuuaaaaauaguucacguuuauuuauuuacagauaguuuuaugauaacuacaagaaauucaaacagucgaggucucaugaaauacaucuaugaaaguauauaugaccuaagcagccuagcaguuguaaacguaagagauuugggaaacgucaaacacgccuuuaagcuucucauuuuccccgauaccagaguguuccaaugcucuucaaacuccaauaaaaaagaguggcuagacaaguucgaucaagccaagaagaccaggcuggcucaagaacagcaaaaaagagaauccauaucggaaaaaucucccacccguguauccuucgagucaccuagcuacaauccuuucgaugaaguggaagaagaaacgagcgccuugcauccggaaugguuccuggagauucccgaagagcuggacguuuguguagcccaaaggcauuucgaggaggcucugucucuauugcaaaaagccaaagaauacuugaaucaagcaucauccgcguccggugacaagcgggacaccguuuucacggauauucaaaggaaaguagagcaaagacagaacaauuuaacugagguguuaaugaaggaauuggaaguaaacccggacaaaucguugcaggggggauugagagcggcucgcagggcugugagacugcugaaucaauuaggaagagaaacacagucuuguacguuguuucugaagcugugcagcaguaugcuaaggacgcagugcaaacgaguuaaaagagaaggcucuacuaccacauauauaaagcaucuuucgagcgugguuuucaccaauaugugucacaugucugaugaguuucuaagagcuuuccccgacucuccggcaugugcuucagcguauguaguuugggcgagcaaugaacugcugcaguuuacuacccauuuuauuaaacagguuuuuaugccacagacuucuuugucaacggugaccgagugcauaguuuuaguuagacaucagugugaaaggcuguauguuuaugguuuagaccuuuguuaucaauuagacggugcuuugagaucuucgcugaugaaagcguuaaaagacgcuagagauaaauuaaucgauucgauaaaauugcgaguuuuagaugauaaauggauaccgauuaacuugcauuccaaaucggcuuuaagucguugcgugcaagaguauucucaaauggggcucacuaacguagggaguuacguuucuggugauacuugguugcaauuaacugcuaguacuuuaucguucacgaaaauguuucugaacuuguuaaacgauugcaugaaauugaaaacuacggaauuaauguauacgaucgaugagacuuuguauaacguguucgaagcucaagucaggcacaacgagaacgcucugaggagcgaauugaaucaagaucaaaggaacuuccucacgaaaaaugcagaguuuuuguugguuaguuugaugcaggugguacagaaaaaguacgaggaaaaggucgguuacgaauguccuacgcuagcgaaauugcaaaaggaauacguagcacugcagaaaggcguuuccccagcgucgagaaguacaaaagccaaauaugcaucagaguuuauuuaa

SEQ ID NO: 6282 - RNA, 3243 nt, Phyllotreta striolata
ucgaaagauagacgaagaucuagaagcagaucgaaagauagacgaagaucuagaagcagaucgaaagauagacgaagaucuaggagcaggucuagggacagaaggcgaucuagaucuaaagauagauauucucgaagggaaaaaaggcauagaaguaggucgaaugaagacuacaagaggagaagaggagacgacaguuacucgagagauagaagggaaagagguagguccaaagaaucggaaagaagagacaggaauagaucgagagaugauagaaaaagggaacgaagcagaucgagaacgagaaggcgagaaaggagcuacgagaaaaaauucaaaagcgaaaaggauaauccugaauucgaagaugauccuacuccaggaaagauuuauaauggaaaaguaucgaaugucguuccguuugguuguuuuguacaauuagaaagucuaaaaagaagaugggaggguuuagugcacauuucucagcuaagagcagaagguagaguuaccaacguuuccgacguugucuccagaggaagcaaaguuaaaguaaagguauuaacgauaaccggccagaaaguaucccuuucgaugaaagaugucugccaaacgacgggaaaagauuugaauccucugucccaugccacugcggaacgagaagauaaagaccguaaccccgacaggcccacgaacaacagcacgucaguguugaggcuaccggucaguaucgaugaaggugaagaaaauuccaggaaaagaguaacccggauuuccaguccggaaagaugggaaauuaagcaaaugauuuccuccgguugcauagacaaaagcgaauugccggaauuugacgacgaaacugguuuacugcccaaagacgaagacggugaagcugauauagaaaucgaacuggucgaagaugagccgccauuuuuacaaggucacgguagagcuguucacgaccuaaguccuguaaggauaguuaaaaauccagaugguucgcuagcacaggcggccaugaugcaaucggccuuagccaaagaaaggcgcgaacaaaaaaugcugcaaagagaacaagaaguggacucucagccgucuggaaagaacaaaaacuggauagauccucucccagaggacgaaucuaaaucgauggcgagaggaauaggccuucagagucaagauuugccggaauggaaaaagcacguuauuggugguaaaaagucgucuuucggcaaaaaaacuaacuugacgaucaucgaacaaaggcagucgcuucccauuuacaagcuuaaagaggaauuacggaaagccguaacagagaaucaaauauugaucgucaucggugaaacgggcuccggaaaaaccacacaaaucacccaguaucuagccgaagcuggcuucacggccagagggaaaaucgguugcacgcagcccagaagaguagccgccaugucaguugccaaaagaguagccgaggaguuuggaugcagauuaggccaggaaguuggauacaccauuagauucgaagauugcaccagccccgaaacgaugaucaaauacaugacagacgguauguugcuacgcgaaugccucauggauuuggaucuuaagcaauacucuguaauaauguuggacgaagcccacgaacguacaauucacaccgacguacuauuuggacuauugaagcaagcuguuaugaaacgcgacgaguugaaguuaaucguaacuuccgcgacguuagacgccguuaaguuuucgcaguauuucuucaaagcuccgauauucacgauacccgguaggacguuuccagucgaaguuuuauacaccaaggaaccggagaccgauuauuuagacgcuaguuuaauaacggugaugcaaauacaucucagagaaccacccggcgauauuuuacuguuucugacgggccaagaagaaaucgauacagcuugcgaaauauuguacgaaagaaugaaaaguuuaggucccgauguacccgaacugaucauucuacccguauacuccgcucugccgucggagaugcaaacuagaauauucgaaccggcgccuccuggcagcaggaaaguuguaauugccacgaacaucgcagagacuucguuaacaaucgaugggauuuauuacguggucgauccgggauucgucaagcaaaaaguuuacaauuccaagaccggaauggauucauuagugguuacgccaauuucgcaggcgcaagcgaaacaacgagcaggccgagcgggcaggaccgguccugguaaauguuacagacuuuacacagagagagcguacagggacgaaaugcuuccgacgccggugcccgaaauccagcgaacuaauuuggcaacgacaguacuucaacugaaaacuauggguauaaaugauuugcugcauuucgauuuuauggacgccccuccgguggaaucgcucauaauggcacucgagcaguugcauucucuaucagcuuuagaugaugaagguuuauuaaccagacuaggaagaagaauggcugaauucccgcuggagccgaauuugugcaagauguugaucaugucgguagcccuccaaugcuccgacgaaauauugacuauagugagcauguugucuguucaaaacguguuuuaccguccgaaagacaagcaagcgcuggcugaccagaaaaaggccaaguuuaaucaacccgaaggcgaucacuugacgcuauuggcggucuacaacaguuggaagaacaacaaauuuucgaacgcaugguguuacgaaaauuucguacagaucaggacuuugaaaagggcgcaagacgugaggaaacaguuguuggguauuauggacaggcacaaauuggacgugguaucagcggaaaggaacacggugagagugcaaaaggccauuuguuccggguuuuuccggaaugcggggaaaaaggacccgcaggaaggcuacaggacuuugguugauagucagguuguguacauucacccuucgagcgcuuuguucaaucgacaaccggaauggguuaucuaucacgaauuggugcaaacuacaaaggaauacaugagagaagugacgacgauugauccaaaauggcugguggaauuugcgccugcuuucuucaaguuuucugauccuacgaaguugagcaaauucaagaaaaaucaaagauuggaaccguuguauaacaaauaugaagaacccaaugcguggagaauuucuagaguuaggagaagacgaaauuaa

SEQ ID NO: 6283 - RNA, 1248 nt, Phyllotreta striolata
auggccucaaaaaggaaaaacaaaaaaaacauacuggcaaaagugaauuuuccucuguacaccguccagaugcuaacgucacggcacguuaucguaggaggcggcgguggaacuuccaagacugggguugaaaacgguuucgaaauauacgaaaucuuucaugacggucacaaauucucagccaaagaaguuacgagacacgaaaccggaggaaauguagucaugaauuguugugcguuuagugauaggaaaaauucguuuuuaguagccggucaagaaaacuacucgcaacuuuacaaagucaauacaaaauuaaucgagcaugaacaaguagaaacaguuggugacaccgcaagcguucggcauagaaauaccaagcccaaagaacacguagauaauaauaaaaacauuaaaaaggagcuggcuuuugaccugaauccuuuagauuguauacaaacugauuuuaaaggaaccgaaccucuauguagaguaguuagaauuaaucacucaggaaaaauuuuagcuacugggggaacugauggggauguaagacuuuggaaauuucccacaaugcagccaaugucgauucuaaagggacauacaaaggaaauagacgauauagauuucaguaaauucgauaaccucaucauaacuuuagcuaaagacgguuuggcuauuuugugggacgcccaaacgggaaagcagaaaucgaaacugacauggaaaacuccagagggaucaaaauauuuguacaagagaugcagauuuggcguuauugaagaucaaaaaaacaagugcaugcuauacaugauagcgaaugcgacuaauucgaagcaagcaucguuucuucaacaauggauacccgaggagaauacuuuaaaaaaguucucggaauuuaaugaaacccugucugcacuugcagugagagacgaugggcgauuuguagcugucgggacaauguucagcgguuccguuuccauucacauagccuuuaguuuacagaaauuauuaguaguugucggugcucacucgauguuuguaacuggucuggaauuccuaucucacgaaaauacuaaucauuccauaaguaguguugcugagacugcuguguugucuauuucgguggauaaucagcuuuguauacauucagugccauacagacgaaguauaccuuuauggauuggaauuaugguguuaguuuuaguauuauuuauuacauuuauguuaugugcauacauggguuuguga

SEQ ID NO: 6284 - RNA, 1242 nt, Phyllotreta striolata
auggcuggugcaauguuauucgaaagagcucaguccguuccuucucaacaugacaaguuguuaaaauuaaauccggcagacgaagaugacgaggagaauauuguuaauaaagagcaggacauccucaacuugggcgagaaguacaaaaaggagggcaaggcuaaagaacuagccgagcugauaaaggcuaccagaccauuucugagucuuauuagcaaagcaaaagcagcaaaauuaguuagaucacugguugauuacuuuuuggacuuggaggcagguaucggcauugagguacaacuguguaaagaauguauagaaugggcgaaagaggagagaagaacguuuuugcgccaaucgcuggaagcgcgccugaucgcccuguauuucgauaccggaauguacaccgaugcccuacaacuggaauccacccuguuaaaagagcugaagaaacuggacgacaaaaaucugcuggucgaagugcaacugcucgaaagcaaaacauaucacgcucucagcaauuuacccaaagcucgagccgcucuaacguccgcuagaacgaccgcuaacgcuauuuauugcccuccgaagaugcaggccgcccucgaucugcaaucgggcgugcugcacgcagccgacgaaaaggauuucaagacagcuuacuccuauuuuuacgaagccuucgaaggguucgauagcgucgaaucccccaaagcucugacugcucuuaaguacaugcuucuguccaaaauuaugauuaauagucccgaagacguacagcaaauugugaguggaaaauuagccauaaaguaugcagguaaagauaucgaggccaugaaagcagucgcacaagcagcccauaaaagaucucuugcagauuuucaacuugccguaaaacaauucaaacaugagcuggaagaugacguuaucguacgagcacauuuaggaacccucuacgacaauauguuagaacaaaauuugugcagaaucauugaaccuuacucgcguguccaaguagaauauauagcaaaaacgauuaagcuuccuguuuuacaaguagagaagaaacuaucgcagaugauuuuagaugccaaguuucauggaauuuuagaccagggugaugguguccugauaguguuugaagaaacuccgguagacaaaaccuaugaaauggcucucgaaaccauccagaguaugaguaaagucguagacacucucuaucaaaaagcgaaaaaguugucauag

SEQ ID NO: 6285 - RNA, 1737 nt, Phyllotreta striolata
auggcuucgcgcucgaaaaaaagcucgacgccgucggcccagcagcggccggcuagcccgcucagcccgacgaggcauuccagguugcaggagaaagcggaacuccaaggucugaacgaccgccuggccgguuacauagacaaagugagauuccuggaagcggaaaacaacaaacuauccagagaaauccagacgacccaggaaacuguuacacgcgaagugaccaacaucaagucuauguacgaucacgaacuaucggacgcuagaaaacugcuggacgacacgcaucgcgagaaagcccgccuggaaaucgacgugaaacgccucauagaagagaacgaggagcucaaagccgagcuggccaagaagagcaaggacuuaguugucgccgagaaccaugccaggauauacgaagcccgguguaacgaguaccagcucaaauccaaccaagcugccgccgaugcaaagaaggccaucgccgacgcuaaggaguuggagaaggaaagggacaagcucaagaaacuccucgaugcagcucguaaacaacuggaagaggaaucccuggccagaguagaggucgagaaucacaaucagagucuuagggaagagcuaaccuucaaagaucagauucaccagcaagagcucaccgagacccguacgcgccgacaggucgagaucagcgaaaucgacggccgccuggcgcagaaguacgaggccaagcugcaggaggcgcuccaggaccugcgcgaccaguacgaaucgcagauggccaacaaucgacaggagaucgagcuguuguacgagcagaaaaucaaaaaccugcaggcggccgccgacaggcaccaaucgaccgccuccggcgcucucgacgagcugagacagguccggacgaggaucgacaccuucacgucgcgcauccaagaccuggagaaccagaacaacggccugucggcuaggacuagggauuuggagaaguugcucgagaacgagcgcauucgucaugccgaagaucuggcgauggucgagagggaauugcacaggaugcgagaggaaauggccacgcaacuacaggaauaccaagaccugauggauaucaaaguaucgcucgauuuggaaaucgccgccuacaggaaacuucucgaagcugaagaagcucgauugaacaucacaccaacaggcguugagcacgaggugcaccagaggaguuccucucaacgucggacgccggugagggugggagcgaagaggaaacgggcccugcucgaggagacgcaggagucgagcaugucggauuacagcgugaacaguucuucgaaaggggacaucgaaguggccgcagucgauccggagggucaguuugugagauugcacaacaagaguaaccaagaggugccgcucagcggauggcaagucaucaggcgggcgggcgaugaggagacuuucuacaaauuccacagaacuguuaaaguagagggaaaugguacaguaaccauuuggaguucggauuuaaauaaagaucacgaaccuccuagcaaccugguuaugaaaggucaaaaauggguuaccggagacaacaugauuacgguaguauugaacaacaauggagaagaaguagcgucaucugaaagggugaaaaggcagauuucaacgucgcauuuaagacacagggaguugggggaugaagaacuuuaccaccaacagggggacuugcaaggugaaaagugcggacugauguga

SEQ ID NO: 6286 - RNA, 2412 nt, Phyllotreta striolata
auggcugauagcaaaagcccagacgaucuagcgacugcgauccuccgcaaaaaggaccguccgaacaggcuuuuagucgaagaagccguuaacgaugauaauuccguuguggcccugucccaggcgaaaauggaugaacugcagcucuucagaggcgacaccguucuacuuaagggcaagcgucgaaaagaaacugucugcauaguccucuccgacgauaguuguagugacgaaaagauccgcaugaacagaaacguucggaauaacuuaagagucaggcugucugacgucguuucuauucagcccugccccgauguuaaguacggcaaaagaauccacguucuucccauagaugacacaguagaaggacuuacaggaaaucuguuugaaguguaucugaagccguauuuccuggaggccuaucgucccauucauaaggacgacguuuuuaucguaaggggcggcaugagagccguugaauuuaagguaguggaaaccgauccggccccuuacugcauagucgcgcccgauacggucauccauugcgacggggauccgaucaagcgcgaagaagaagaggaggcccucaacgcugucggcuacgaugacaucggagguugcagaaaacagcuggcccagaucaaagagauggucgaguugccguugagacaucccagucuguuuaaggcuauugguguuaagccgccucgagguauccucuuguacgguccaccggguacuggaaaaacucugauagccagagccgucgcuaacgaaaccggagcuuucuucuuuuugauuaacgguccggaaaucaugagcaagcuugcaggagaaucggagaguaaccugcgcaaagcuuucgaagaggccgacaagaacuccccggccaucaucuucaucgaugaauuggaugccaucgcaccgaagagagagaaaacgcacggagagguggagcgucgcaucguuucgcaauugcuuacucuaauggacggcaugaagaagagcucgcacgucaucguuauggccgccacgaacaggccgaacuccaucgaucccgcgcuacgucguuucggaagguucgacagggaaaucgacaucggcauuccggacgcaaccgguagauuagaagugcugagaauccacaccaagaacaugaaguuggccgacgacgucgauuuggagcaaaucgcggccgagacucacggucacgugggcgccgauuuggcuucgcucuguucggaagcggcgcuucaacagaucagagaaaagauggaccuaaucgaucucgaagacgaucaaauagacgcggaggugcucaauucguuggccgugaccauggagaacuuccguuacgcuaugacgaagagcagcccgagcgcccugcgcgaaaccguggucgaggugccgaacgucacaugggaagauaucggcgguuuggcgaacgucaagaaggaauugcaggagcuggugcaauauccgguggagcaucccgauaaguuccucaaguucggcaugcagccgucuaggggugugcuguuuuacgggccgcccgguugcgguaaaacccuauuggccaaggccaucgcuaacgaaugucaggcaaacuucauuuccgucaaaggaccggaauuguuaacgaugugguucggugaaucugaagcuaauguuagagacauuuucgauaaggccaggucagcagcuccuuguguacuuuucuucgaugaguuagauucgaucgccaagucaagagguggaaaugugggagaugccggcggugccgccgauagggugauuaaucaaauuuuaaccgaaauggaugguaugggagcgaaaaagaacguuuucauaaucggugcuacaaauagaccagauaucauugaucccgcuauauuacgucccggccguuuggaucaguugaucuacaucccguuaccggacgaaaaguccagagaagcaaucuuuaaagcaaacuuaaggaaaucaccuguagcuaaagacgucgaucuuacguauauugccaaaguuacacacgguuuuucgggugccgauuuaacagaaauaugucaaagagcuugcaaacucgcuauaagacaaagcaucgaaacugagauuagacgagaacgugagagagcauugaaucccaacguagcaauggaccuggaugacgacgauccgguuccggaaauaaccagggcccacuuugaggaggcgaugcguuucgccagacgcucgguuuccgauaacgacaucagaaaauacgaaauguuugcacaaacgcuacaacaaucucgaggguucgggacgaacuuccguuucccgacggcccagggcgggccgcaagccccgggaggcaccggcggggaucaggccaacuuccaagaugaucccgaagacgaucuauauagcuaa

SEQ ID NO: 6287 - RNA, 825 nt, Phyllotreta striolata
augagugaccaauuugacugugcacucgauuuaaugaggcgccugccuccgcaacaaaucgaaaaaaauuugagcgauuuaauugauuuagugccaagucuuugugaggaucuucuuucgucugucgaucaaccuuuaaaaaucgcuaaagacaaggauucgggcaaggauuuucuuuuaugugauuacaauagagacggggauucuuacaggucaccauggucgaauaccuauuacccuccguuagaagacgguucgaugcccuccgagaggcuaaggaaauuagaauuagacgccaauuuagcguucgaucaauauagagaaauguauuucgaagguggcgugucuucuguuuauuuuugggacuuagaucacgguuuugcaggaguaauuuuaauuaaaaaaaccggcgaugguaguagaaaaauuaaagguuguugggauucccugcacguaguggagguacaagaaaaggguucaggaaggaauucccacuacaaaaugaccuccaccgcaaugcuguggcugcaaaccaauaaacaaggcucggguaccaugaauuugggcgguaguuuaacccgacagaucgagcuggaugcggccguaaacgacaucaacccccacaucgccaacaucggucgaaugguggaagacauggaaaacaaaauucggaacacguuaaacgaaaucuacuuuagcaaaaccaaggacauagucaauagcuugagaucggugcaaccguuaacggaaagccgucaacagcaagcgcuuaaacaagacuuggccgccgcccuucagcguagacaaaacaaauccgagaacuga

SEQ ID NO: 6288 - RNA, 2652 nt, Phyllotreta striolata
auggaacguccaccccgcaaugagccgcccguggagccugucaacgguguggugcaaccgcuggugcauccgccgcccgacagucccggucgcguaacgaaccaacugcaauuccugcagaaaaccguacugaaggccguauggaaggacaaauucgcuuggccuuuucaacaacccgucgacgccaagaaacucaaccugcccgacuaccauagaauaaucaaacaaccgauggaccugggaacgauaaagaagcguuuagagaacaacuacuauuggucggguaaagagugcauacaagauuucaacacgauguucacgaauugcuacgucuacaaccagcccggcgaagacguggucgucauggcccaaacauuagaaaaaguauuuuuaaccaaaguggccgacaugcccaaacaagaauuugucguugauaugccgaugaaaggcgccaaaggcaagaaagggcgaguuagcgucggcgguggaagcaccccaucgucgagcggaccgguaccgggggcggcggcuauaccaggagcugucagaggcagaccgcccgcgaccguuucuucuaccaguaccacgccaauugccaccacuacugguucgucgggccugccguuggguacccaagcgccggccacgcugccgggcaguaccgccacgacgacgauagcgccggccaacaacaacaacagcucucugacgccgcaacagcucgucggcacgcccgucgguucgaugcacggcacgcccggaggagcgccacuguccaauucccucgaucccggcggcgugaugcccggcaacgucaugccgccggcgcaaccggccaagguaaaaaaaggcgugaagagaaaggccgacacgacgacgccggcgacggccuacgacuauccgacgguguuggaaucgaaaucggcgaagauuucgacgcgccgagaaucgggcaggcagaucaagaaaccggcgcggcgggaaaucgaccuucauguaccucaaccggcgauccacaaacccaacgagaaguugucggaaucgcugaaggcuugcaaugaaauccucauggaauuguucuccaagaaacauucgaauuacgcauggccguucuaucaaccggucgaugcggaauuauugggccugcacgacuaccacgacaucaucaagagacccauggacuuugguacugucaaagagaaaauggacaacagggaguaccgcacgccgcaggauuucgccgccgacguuagacugauuuuuaguaauuguuacaaguacaaucccucugaccacgauguggucgccauggcgcggaagcugcaggacguguucgaagucaaauucgcaaagauccccgacgaacccgucaaccggauaggaggcgguguaaauaauuuacccauuaaaucggaaucgagcaguuccgguucgaguuccgauucguccagcgaauccgaggauucggaggaggagcgacguaauaaacaauuaaaaguacuggaaaaagaguugacggcguugcaagagaagaugcgcaagcuggucgaggagaguucgcgccggaaaaaggagaaaaagaaaaacaaaaugaaaaagaaaccgagcggcggcggcggcggcggugggucgucugccgccgcggcgggcgcucugccgaacagcagcagcggcggcggcggcggucucgguuugcgcgccaacaaaccggccgccgcuucgaacgccgccgccaagcgggugaaggccaauaacaagaccggcgccggcaggaagaagaacgccgcccaaccgccccccaugccguucgauuccgaggacgaagacaacgccaagccgauguccuacgacgagaagcggcaacuuucguuagauauuaacaaauuacccggcgacaaauugggucgaguuguacauauaauccaaucgagggagccgucguugagggauucgaaucccgaugagaucgagaucgauuucgagacguugaaaccgucgacguugagagaauuggagaguuacgucgcgucgugucugcguaaaaagccacguaagccuuacuauaaaaaagucgccggcaaaucuaaagacgaacaaauggcggagaagaagcaggagcuagaaaaaagacuaaucgaugugaacgauaaaaucggcaauuccaaaaaagcaccuaaaaaagaugaagcgaacaagguggacccgacgggcgcgggcggucccuccggucgccugucgucgagcucgagcagcucggauucggacagcagcagcagcagccugucgucgaguucgagcgauuccagcgacagcgaagcaggugguacgaccaacagaucgacuaaaaagaaagugaacaaaaagagccccaacccuucggucgauaauacugcaauaacgaaaccacagcaaccaacaacagcaccaccaaugucacaaacacccgccaacguuaacgcuaacguaaacguaaccguaucggcuaaugcgaacgcaccgccacaaucaguaccugcgacgacguuaacgacgaccgccgccguuaacagcaauuucccggcgccgccgccgccgccgccgcaacaacaacaggcgauggcucccaacaagcagcaacacaacgucaacguaaaugcgaacgcaccgccacaa

SEQ ID NO: 6289 - RNA, 1224 nt, Phyllotreta striolata
augucuuuauccacugcucgcccuuuagugagcguuuacaaugagaagucagaagaaguaaaaggcagcggugucgcucugcccgcugucuucaaggccccaaucagaccagaugucgucaauuucguucaucagcaggucuccaugaaccaucgccagcccuacagcgucagcgacaaagcuggucaccaaaccuccgccgagucuuggggaaccggucgcgccguggcccguauaccucguguacgaggcggcgguacccaccgaucgggccagggagccuucgguaacaugugucgcggcggucgcauguucgccccgaccaagccguggcgccgcuggcaucgacgcgucaacaucaaccagcgucgcuacgcccuggcgucggccgucgccgccagcggcgugcccgcuuuggucaugagcaaggggcacguggucgaucagauacccgaguugccguuggucgucagcgacaaggugcaggagaugcacaagaccaaggaggcggugcaauuccugaggaggaucaaggccugggccgacauccagaaggucuacaagagccaacgguuccgugccgguaaaggaaaaaugcguaacaggagacguauccaacguaaagggccacuuaucguuuacuacaaagaucaaggucuucgucaagcuuuccguaacaucccgggcaucgaucucaucaguguccaaaaguugaacuuguugaaguuggcuccuggaggucacgugggucgauuugucaucuggaccgaaucggcguuccaacguuuagacaaauuauucgguacauggaagaacccaucgaccgagaagaaggguuacaauuuaccucaacccaagauguccaauaccgauuugucuagauuguugaaagccgacgagauuaaagccgugcuuaagacuccucagaagaaggugguacgccguguucgucgucuuaauccuuugaccaacacuaaagcuaugcuuaaauugaacccguaugcugcuguacucaagagggaagcuaucuugaagaaccaaaaaaggcaguugcaaagggacgaggcuuuggcuaaaaaacgcggaaucacccugaccccugacaacgcuguaaucaggaccaggaaauugcaggaaagaagaagagcucaaauuuugaaagauaagaaaucaaaacccaagaaggcggcuaaggcgccggccaagccugcuggaaagaaauaa

SEQ ID NO: 6290 - RNA, 4497 nt, Phyllotreta striolata
augcaacuucgugacguucccauuacgcccguaacggacgauuccaccgagcuggaagaugaagcagaguggauuuacagacaagcguuuuguaacaaagcgauaucgaauguagaugcgcaccuuucggccgaagcgagagagaaaaugaagaaaggcucccaaaccguugggaaaauaaagaaagcgcuggauuucaugaggaaucaacagcucgaggugcccuucaucgccuuuuacagaaaggaguacguucaaccugaacucaacauuaacgauuuguggaaaguuuacaaauacgaugcuaaguggugucaacugaagucucggaaggaaaaccuccuuaaacuguucgacaaaaugaggcauuaucaauuggaucaacucauaaaaaauccggaugcuccuauuccggacaacgugcgagugaugaaagauucggacaucgaacgacuaaaaaacguccaaacugcugaagaacucaaugauguucacaaucauuucauauuguauuauuccggggauuuaccggcuaugcacgccgcuuggagaaucaaggaaaaagaacagaggagauacgagaagcgacaaaaaagacucaaacaaauagcugaagcggaagacggugcugagauacccgaugaaccugaggaugacgaugacgaugaaccagagaccgaaacuuugaaguacgccaaucguucgggcaguuacgcuuuaugcucuaaagcuggauuagauccuuuggcgaagaaguuugguuuauccccggagcaauuugcugagaauuugagagauaauuaucaaagacacgaagucgaucaagagcccgucgaacccucugaaguugccagagaguuuauuucuccuaaauuuucaacggucgaugaaguauuacaagcgucuaaauauaugguugccuugcaaauagcuagagaaccauuaguaagaaaaugcguuagagaaguauauuucgaaagagccagaauuaauguauauccgacuaagaaaggacaaaaagucaucgaugaaucucacaauuguuacagcaugaaauauuuaaaaaacaaaccggugagggauuugaacggagaucaguuuuuaaaauugugcuuagcugaagaagaaaaccuccuuacuaucacaauuaaugauaauaucgaagggaauacaucaaacucuuacauagaggaagucaaacagcucuacaucaaggacgaauuuaguaaaaaugugcaagauuggaacgcgcugagaauggagugcguggaaagggcgcuaacgaaaagcguuuugcccgauuugagaacggaauugaagaggacauuguuaucagaagccaaagaauucguccuuaaggcguguugcaggaaacucuacaacagcauuaaaauugccccauacucaauuacauuucccgaugaagacgaagacgaaugggacacaucgaaaggcguuagaguuauggguuuagcuuauguuccagaauacacaguuucagcauucgcuugcauagcagcucccgauggggauaucacugauuauuugcguuuaccucacauauuaaaaagaaaaaacaguuucagaacagaagaaaaguuaaugaaggaaggcgauuugcaaguucuaaagaacuucaucuucucgaaaaaaccucacgugauagcgaucggcggggaauccagggaggcgcugaugauagcggacgauuugaaagcgcugauuaacgaauuggucgaguccgaucaauuucccgaaaucaaagucgaaauuaucgacaacgaauuggccaaaauuuacgcaaacuccaacaagggccagucggacuuuagagacuaucccgagcugcugaggcaggccauuuccuuggccaggaaaaugcaagauccccucaucgaguacucgcaguugugcaacggagacgaggaaauauuaaguuugagguuccacccguuacaagaacaaauaggcaaagaggaacucaucgaagcccugugccucgaauucgucaacagaaccaacgaagucgguguugauauuaauuuggcuguacaacaggcgcacaaaagcagucucgugcaauucguuugcgggcucggcccucgcaaagggcaagcucugcuaaaaguccucaagcagaccaaccaaaggcuagaaaaucgaacgcaguugguaacagcaugucacaugggccccaaaguguucauuaauuguuccgguuucaucaaaaucgauacuaacaguuugggagauaguacugaagcguacguggaaauauuggaugguucucguguucauccggagacguacgaaugggcuagaaagauggcuguagacgcuuuggaguacgaugacgacgaaggggcuaauccagcgggugcuuuggaagagauucuggaaacucccgagagauugaaagaucuggauuuggaugcuuucgccgaagaauuggaaagacaaggauucggcaacaagagcauaacauuguacgacauaagagccgaauugaacuguagauacaaagauuugagacaaccuuuucauucggcgaauccugaagagauguuugauauguuaacgaaagaaacgccggaaacguucuauauaggaaaauugguuacugcuucaguuauagguauugcgaggaagaaaccuaaaccugaccaacucgaucaggccaauccuguuagaaaugacgaaacgggccuuuggcaauguccguuuuguuugaaaaacgauuuucccgaauuauccgauguguggaaucauuuugaugcaggugcaugucccggucaagcaacgggugucaaacuuagauuagacaauggaauaauggguuauauuuauauaaaaaauauuagugauaaaccgguaucgaauccggaggaaagaguaggggucggucaauuaauuaguugucguauaauaaaaaucgauguugagagauucagcgucgauuguacgucgaaaucuagcgauuuguuggauaaaaaucacgaauggaggccaccgagagauccucauuacgacacggaacgcgaagaaaaagacaacagaaccgaggcggaaaagaagaaagaaaaacaacguuugaccuacauaaagagaguuauaguucacccggcauuccacaacauuucuuaugcggaagcugaaaaaugcauggucaacauggaucaaggcgaagucaucaucagaccguccagcaaaggagccgaucauuugaccauuacguggaaagucgccgauaaaaucuaucaacacaucgauauuagggaagaagggaaaacuaaugcguuuucauuggguaaaucguuguugauaggcaacgaggaauucgaagauuuggacgaaauaauagcgagacaugucacuccgauggcagcgcacgcucgcgauuugcucuacuucagauacuacaaagacuucgagggcggucacaaagacaaggccgacgaguaccuaaaagacgagaaaaagaagaacgccucgaagauacauuacgucguuagugccgcaaagcacauaccugguaaauuccuacugucuuaucuaccaagaaacaaaguaagacacgaguacauaacggugacuccugaaggauuuagauucagacagcaaauguucgauucgauaacgucgcuauucaagugguuuaaggagcauuuuagagaaccaccgccgggcggaaugacaccugguaccccaagaauguccacuggaagaacgccauacgauaugaguaccgaagcuauucaaagagucgcgcaaaaucuccccagcgacaugguccaagcccuaucagcugcaaccaaucaaacuccucacuacccgcacaccccuggcgguuacggugguaauuacaucaacacaccguauacaccuagcggucaaacgcccuacaugacuccauuccaaacgccucacgcucaacagacgccgcgguacggccaacagacgccuucgcagccgucucugagcaauccguuccuccauccgggcgccgugacgccgucgcaacggacgcccagcuacaggaaccugccgacgcagaguccgaugauaccgcagagcccggugccgagcccgggaucgcagagcucguacagcagccacaugagccaccauacgcgagcgaguuacggggauucguugagguuccagccgccggagucgccgaggaauuacccgagcagcaggggauccuaccccgaugggagguacggugguagcgagucgauggauuggcagaaggcagcugaagcuugggcuucuagguccaaaucgacaccacgaagcgaaggucgcgggacucccagaucgucuggucacagaacuccacguaauuaugauaauauguccgaaagugaccggucgaggaugaagcauaugagcagcaaaagcccgaaaucgguacgaucgacuccucguacgaauucuucgccuagaucaauguccuugggcgaugcuacuccuuuauacgacgaaaauauuuaa

SEQ ID NO: 6291 - RNA, 2193 nt, Phyllotreta striolata
augccagaaguggacaacagcgaaacgcgcuccccucgucgcaagcgccgcagguccaaauccggcgagcgcaaggaagagaaaucguccaaaaggaaaucaucgaggaaacguucaucggacgacgauuacaaugagcgagauuauccgcgcuauuacggcgaagaucggccgaacagcgacagcuacuggaacaaguaccccagaagagacaacaugaaaguggggcguagguauuacgaucacccagaucacgagaagaauagggauagggaugcuucgaacgagaagagcagagauagagauagggaaagcaccagagggaaggaguauuccaggaaagaggagaacgaggauaaauccguaauuaaacccagagaacguaaagucgucgauaugcugacuuccagaacaggaggagcuuacauaccaccagcgaagcuccgucugaugcaagagagcauaacagacaaaucaucagcugcuuaccaacguaucgccugggaggcccucaagaaaucuguacacgguuacaucaacaaaaucaacacguccaacaucggaauaaucgccagagaaauccugcacgaaaacauaguaaggggcagagguuugcuuugcaaauccauaauccaagcccaagccgccucuccuacuuucaccaacguauacgccgccuuaguggcuguaaucaauucaaaauuucccaauauuggggaguuauuauugaaaagacuggugcuucaguucaaaaggggcuacaagcagaacaacaagucuauuugcauuucggcuaccacguucguagcucacuuggugaaucaacggguggcucacgagauucuugcccuugaaauucugacauugcuugucgagacuccuacugaugauuccguagagguggcgauuucuuuucugaaagagugcggacagaagcucacagaagucucgaguaaaggaauaacugccauauucgagauguugcguaacauccugcacgagggccagcucgagaaaagaauacaguacaugaucgaggugauguuccaaauuagaaaggacgguuuuaaagaccacgcugcuguaacagaggaauuggauuugguagaagaagaggaucaauucacccaucuaaucaugcucgaugauguuaaggagguuaaugcugaagauauucuaaauguguucaaguucgaugaacauuaugaagaaaacgaagggaaauacaaaacucugagcaaagaaaucuuggggagcgacagcgagucagauucgggaucggagggaucuggagaggaauccgaaggcgaagacgaggaagaagaggucaaagaugccggaaaaaucaucgacaauacugaaacaaaucuaauagcucucagaaggacaauauauuugacuauacaauccaguuuggauuucgaggaaugcgcucacaagcuuuugaaaauggaguugaaacccggccaagagaucgaauuaugccacauguuuuuagauugcugugcugagcaaagaacauacgaaaaauucuauggacuguuggcucaaagguuuugccaaauaaacaaaauauacaucgagccuuuccagcagauauuccaagacaccuacucuaccacccaucgguuggacaccaacagauugaggaacguuagcaaauucuucgcucacuugcucuucaccgacgccauaggcugggagguguucgagaucaugaagcucaacgaagaagacaccaacagcucgaguaggauuuucauuaaaauuuuguuccaagaauuggccgaguauaugggcuugggaaaguugaacgcuagauugaaagaugaaacgcuucagcaacauuuugcaggguuauuuccuagagacaauccgaaaaauaccagguuuuccauuaauuucuucacguccaucgguuugggcggucuaacagacgaacuuagagagcauuuaaagaacgucccuaaaauuauggaaacuaaaacggccgcugugaaggaagaaagcgauaguagcaguaguagcagcagcagcagcaguaguagcagcaguaguucgagcgaagaagaaagcagcgaugauagcucuggagauucgaguucugaggaugagaaacaaaaauccaaaaagaagaaaaagaaacgcgacucggaaacuaaaccuucaaaaucggaugcuaaaaguaaucgu

SEQ ID NO: 6292 - RNA, 1788 nt, Phyllotreta striolata
auggcguugaaaaaccaagucgggcaaaaaauaaugaacgaggugauaaaacauaaacccucgaagaagaacggaccugcuguuacgcagccacauaaugcggccgguguugacuggagaauccugguggucgaucaacuggcaaugagaaugguaucggcuugcuguaaaaugcacgacauaucugccgaggguauuacauugguugaagauauaaugaagaagagggagccucucgcuacgauggaagcuguguacuugaucacaccuuccgaaaagucuguucaugcucucaugaacgacuuugagucuccgaggccuauguauagaggagcacacguauuuuucacagaagcaugcccagacgaauuauuuaacaaauuaaguaagagucaugcagcaaaauauauaaaaacguuaaaagaaaucaacauagcauuuauuccgacagagucacagguauuuucuuuagauuccccugacacuuuccaauguaguuacgauccuuccuuugcugccgcacgaaacgcgaauauggaaagaauggccgaacagauugcaacguugugcgccacuuugggggaauacccgcacguccgauauaggagcgauugggaacguaacguagaguuggcgcaauugauucagcagaaauuggacgcuuacaaagccgacgagccgaccaugggcgaagggccggagaaagccagaucgcaauugcugaucuuagaucgaggcuucgauugcguuucaccgcuacugcacgaacugacguuucaagcgauggccuacgacuugcuuccgaucgaaaacgacguguacaaauacgaagcuuccgccggggugcagaaggaggugcucuuggacgaaaacgacgagcuguggguggaauugcgccaucaacacaucgccgucgugucucaaagcgucaccaagaauuugaaaaaguucaccgauuccaaacguaugacccaaagugauaaacaauccaugaaggauuuguccacuaugaucaaaaagaugccgcaauaccagaaggaauuaucgaaauacgccacucacuuacaucucgccgaagacugcaugaaggccuaccaaggguauaucgauaaguugugcaaaguugaacaggauuuggcaaugggaacugaugcagaaggggagaaaauuaaggaucacaugcgcaacaucguuccgauucuucuagacaccaaaauaacgaacgaauacgauaagaugcgcaucauagcuuuauacgcuaugaccaaaaacgguauaaccgaggaaaaucuuacgaagcuagcuacacacgcgcagauuaaagacaaacaaacuaucgcuaaccugcagcucuugggaguuaacgucauuaacgauggugguccuagaaaaaagcuguacaccguaccgcgcaaagagcgaauuacagaacaaacuuaccagaugucgagauggacaccgguuauuaaagacaucauggaggauugcaucgaggacaaauuggaucagaagcauuuccccuaucuaagcggacgggcgcaaaccaccggauaccaugcggcacccuccagugcucgauauggccaauggcacaaagauagaggccagcaggccgugaagaacgucccgcgucugcuggucuucgucgucggagggauaaguuucucggaaauucgcugcgcguacgaggugacaaacgcccagaagaauugggaggucauaaucggaucgucgcauauccuuacaccagaagguuuccucagcgauuuagcgacguuagccggcuag

SEQ ID NO: 6293 - RNA, 2139 nt, Phyllotreta striolata
augaugcaacaauauaugaaagaauuggaacaagagccuuuugaugccgaagaauucguagaacguuuggccuggagaacuuuagcugaaucgaaaagcgaaggagaggaaaaugaaauuaauccgguacuucuucacgaauccuucguucaagccauaaaggaccuuaauuuauugcacgaaaggcaacagaaaaaaugcgaaaaauuagaaguagccguuagagaagacgaagcgacguuuuuucaagaaguuuauaauuuauuggaacaaaauaagcaagcaauggaaacauuucaagaacuggauggcaaaauuaaucauguagcuacuaaaguucuucacuugggagaucagcuagacagugucaaugguccucgaucuagaguuguugaugccuuaagcuuaaugacucauuugagagaauuucuaucgaacgaaccaguuucauccacaauauuuaccaaucaagaauacauugaugaagcagcugaugugauucaaaagcuguauuuaauaucgcaagaauugccaccaaaguuugaaucgauaaaaaggaaaauagaacggaaauauuccgauaucgagaaagcgcuaauagaagaguuuguuggggcuauggauaaugagaauuuaacaagaaugaaggagauagcuuuggucuugucucaguuuaagggcuacucucaaugcguugaugcguauauagaucacagccaaguggguuguuuaucuaguaaagaugucuucuauaacuuuuugaaauuguguaaauacaacgacgaaauuauucgaaaaguuuucaagaauccagagcaagugauggcgaaauucguuuuaaacauauaucaguugaaauuaguggaauacauagaucaaaaacuaaauuccaaauuggguacauacaguuauuuacaaacauuauaugaguuguauucaaaaacuaauaaucuaucaagcgaauuaaccguuuuucauaugggaaacgacaagaacuaucucacuaaauuaacaacgaacauuuuuaauaaauauaucaaugauuauauuucuauggagcuaaagugucucaaagacagauguucgacuagcuugcaaaaauauuaugauucgaagagccaucaaaagaaacagauucaauccgggggcuuucaagaucuuaggagagauuuacaagcaguaauagguacgagggcaaauauuaacauagcacaaauugaaaauuacggaggugaaacuuucguaucggaggaauuggcuaucaugauucuucaggauacuaaacaagcuuuucaacguugcuuauuguugucgaaaggcagugaaagagccucuaacgccacucaaauuuuagacagacuuauuaauaguuugcuaauagagcauguagacuaugcaguugaauugggucuacaagccguaccaguugucgaaggcguuagaaaucccccuguuuuguauuuuuuuaaugucgugcaucaaagcaauaauauaacccaucucgucgagaaacaguuuauggauuuggugguucccuuaguagaaaauacuccaaaauauagcgauuguguucagaagaaaaaauuuguuuuggaggauauagaaagaaaaauuaauacgggauuagauaggugcuugagugcgauauuaaauugggugaaguuguauuugcaaucugagcaaaagaaauccgauuuuaagccggagucugaugauuuugauacaguggcaucaccugcaugcaagaacguacuuaacuauguuaauagcauuaucaaagaaauuaaaacaaauuuggauggcaauaauguaacggcuauccuucaagaauuaggaauuagacugcauagaguuguuuacgagcacauguugcaguaucaauauaacacugcaggugcaaugguggcaauuugcgauuuaaacgaauauagaucuuguacuaaacaauuagguccuuugguugcggagcuuuucgauacuuuacaugcuuuaugcaaucuuuuacuggucaaaccagaaaaccuucaacaaguuugcucugaagauuccuuggcaaaguuagacggagcaauucuccauaguuuuauacaauuacgaagugacuuuaaaguucaaaagcaaacaauuuuaaaaguuuag

SEQ ID NO: 6294 - RNA, 741 nt, Phyllotreta striolata
gaccgaagagaacgacugaggcaacuggccuuagaaaccaucgaucugcagaaggacccguauuuuaugaaaaaucaccuggggucuuacgaauguaagcuuugcuugacccuacacaacaacgaggggagcuacuuggcgcauacacaagguaaaaagcaccaggccaauuuggccaggagggcagccaaggaagccaaagaugcucccacgucgcugcaaccggagaagccccgaguggagcccaagaaguucgugaaaaucgguagacccgguuaucgggugacuaaacagagagauccagaaaccggucaacagaguuuacuguuccaaaucgauuauccagaaauaagcgaucugguuuugccccgacaccgcuucaugucugcguacgagcaaaaaaucgagcccccagaccguaaauggcaguacuuacuguuugcugcggaaccguaugaaaccauugcuuuuaaaguaccgagcagagaagucgagaaaacggauaauaaguucuggacacacuggaacagggacaccaaacaauuuuuccugcaauucgcuuucaagaacgagaacaaacgcuccguuaacucuguaauucaaaggcauucgauuguuggcggaguuccaccgccucccaugcugccgguaccgccgccgcccaggccuccuauguuuaauccuauuccaccgccaccgccgaugaugagggccguuuugccaguaccgccuccgaauuaa

SEQ ID NO: 6295 - RNA, 402 nt, Phyllotreta striolata
augucuaucggcguaccuauuaagguucuccacgaagccgaaggccauauaauaaccugcgaaacuauaaccggcgaaguuuacagggguaaacuuauagaagccgaggauaacaugaauugccaaaugacucaaauaacgguaacguacagagaugggcggguggcgcaauuagaaaacguuuacauuagagguuccaaaauaagguuuuugauauuaccggauauguuaaagaacgcuccgauguuuaaaaaacaaaccaaagccgggacugcugguagagggaagucugcuauucuacgagcucaagcacggggaagaggccgagggcaaccuccuguacgaggaggcagaggugcuuggcagaaucagcagaaugccccugcaggucgagcaaaauaa

SEQ ID NO: 6296 - RNA, 1329 nt, Phyllotreta striolata
auggcuacaaauuuaucucgaacaucgcuccuaagaaucaucaacgcaaggggcuaugcagcccuuccgcauccacuuucuggcuuuccgaacgcagaaguaaaaagugcaguucuccccaacaaaacuguuaucgcugcuguugauaacaaugcgucccucacuagaguuucaauuguauucagggcuggaagucguaacgaagaucccgagaauuuaggcguagcucacguuuugaggacggccgcuggucugaguacgaaaaacuguucgcaauucgccauuauccgcaacauccagcaagucggagccaauuuaacggccacauccgauagagaaacuaucugcuacacgcuggaagguaccccugaggcuguggaaugcgcuuuaccauucuuaaccgaaguagccacccagcaagaauuuagaccuugggaaguuuccgauuuguccaguagauugcaguuggauauugcuacaagaccauugcaguugagagcuaucgauuuacugcacaaugcugcuuuuagaggacgcgguuuggguaauucucuguuuauuccgaaaacucaaauugguaaaauuucgucugaaacucugcaacauuacguuugcucgaacuucaaaagcggacguauggcggucguagguucaggaaucagucaaaaggaguugacgucuuuugcuaacucuuugaaaauagaaaauggugauggcgauaacaccccaucuccuuacaaaggaggcgaacuaagaucgaacaaagguggucaacuagcauuuauugcuguagcaggagaaggugcugcucucaaaaacagcaaggaagcucucgcuuuugcuguacuacaaggagcccuuggaggagguccccagguuaaacacggaauuacagacagcggugucuucaggaaggcucuuggaaauagcccugacguuaguuccguagccauaaaugcgaguuacucugacacaggucucuuugggcuucuacuggccguuccgacgaagucggcaagaagugcucuagaaaccgcuguuaaaguacucaagaguggaaccgucuccgaugaagaugucaccagagguaaaaaucaauugaaagcaucgauccucuucagugcugaaaguggggcagauauuguaagaacuauuggacaagaagcuauuuugacgcaaaaaguuacaaguacuagugcacuuuuggcucaaguagauucuguuucuaccagugaugucacaaaugcucuuaagaaagcaggccagaaacuaucauuagcaucgguuggaaacuuagcuggaguacccuuuuuagaugaacuaaaguaa

SEQ ID NO: 6297 - RNA, 333 nt, Phyllotreta striolata
augagaagggcccaugcagguaacuacuacgagccauugccgcagaauucgaacgaaauugaagacgaaaaugaucggaugacuaacgaauugcaagagaaaauuggagcgcugaagucccuaacuauugauaucggaaaugaaguuaaauaucaggauagaaugcucagggauguugacgacgauuuagaaaaaacuggaggguuucuaggaacaaccaugaacaaaguacugaggcugucgaaagggggccacaacuacaucauuguguauuuguuuuuauuuucuaucguuguauuuuuuauacuuuacuuuguuauuaaauuuagguag

SEQ ID NO: 6298 - RNA, 1491 nt, Phyllotreta striolata
augucuuacccaucgacuuugaacgcaaaacaggccgcacaggaacacguuuuagccguguccagagacuucgugucccagccaaggcucaccuacaaaacgguguccgguguaaauggaccguugguuauccucgaagaugucaaauuuccgaaauucaacgaaaucguccagcucaaacuggccgauggcagucuacgauccggucaaguacuggaaguaagcggcucgaaagccguaguacaaguguucgaagguacuucgggaaucgaugccaaaaacaccaugugcgaauucaccggcgacauccuccgaacgcccguauccgaagacauguugggcagaguguucaacggcucuggaaaaccgaucgauaaaggucccccaauuuuggccgaggacuucuuggacauccaaggucaaccgaucaauccguggucgcguaucuacccggaggagaugauccaaaccgguaucuccgccaucgaugugaugaacucgaucgcucguggucagaagauucccauuuucucggcggccggucugccccacaacgaaaucgccgcccagauuuguaggcaagccggucucgucaaggugcccggcaagucggcguuggacgaucacgaggacaacuucgccaucguguucgccgcuaugggugucaacauggaaaccgcucguuucuucaaacaagauuucgaagagaacgguucgauggagaacguauguuuguucuugaauuuggccaacgauccuaccaucgagagaaucaucacgccucguuuggcucuaacagcggccgaauucuuggccuaucaaugcgagaaacacguguuggucauauugacugauaugucuucguacgcugaagccuugcgugagguauccgccgccagggaagaaguacccgguagacgugguuuccccgguuacauguacaccgauuuggccaccauuuacgaacgagccggacguguggagggccgcaacggcuccaucacccaaauucccaucuugacuaugcccaacgacgauauuacucacccgauucccgauuugaccgguuacauuaccgaaggacagaucuacgucgaucgucagcugcacaacaggcaaauuuacccgcccauuaacgucuuaccgucgcugucgcgucucaugaaguccgccauuggcgagggcaugaccaggaaagaucacucugacguuucuaaccaauuguacgcuugcuacgccaucgguaaggacguccaggcgaugaaggccguggugggagaggaggcccugacgcccgacgaucugcucuacuuggaguuccugaccaaguucgagaagaacuucaucacgcagggcagcuacgagaaccguacgguguucgaaucgcuggacaucggcuggcaguuguugcguaucuuccccaaggaaauguugaaacguaucccggccgccacguuggccgaauucuacccgagggacucgcgucacuag

SEQ ID NO: 6299 - RNA, 357 nt, Phyllotreta striolata
gggauugccccuggagucgaaaauuuggcgagccaaaacgguuuugauacccaucguuucgggaucguacauauccuggucguagaucaacgcggugccucugcuuucuuuaaauuuagugaaguauuccugcgcguacgauacuacgucuucgggcuguucgagcaaguagcugcaagugaauucgagcaacauggcucgcaauucgucagggacucugauuccugcccuuucgcguucgcguauuucguucauuuucgauuguuuaauaacuuuuacuguucaauguacuuagaauuugacuuaagugauugcgauaagcuucacuucuccauaaucaaacgggaaacuugcuaa

SEQ ID NO: 6300 - RNA, 2421 nt, Phyllotreta striolata
augaguuacaugcagacuaaccaaaauagaccaaugucucaagguuaucaucaggguggcaacgaucugccaaugcagucguccaaagagcagacccugcuauggcagcagaacuccuauuuaggagacucuggcauccagucgggggcugccacucaagucccaucgcuaucgggcaaagaagaggaagagauggaccucuucgaucucgaccagcccuaccaaggguucacgcaagagcaaguggaugaaaugaauaaccagcugaaccacaccagaucccaaagagugagggcugcuauguucccugaaacauuggaugaagguaucgagauuccuucuacgcaguucgauccgaaccaucaaacggcuguucaacguuuggcugagcccagccagaugcucaaacacgccgugguuaauuuaaucaauuaccaagacgacgccgauuuggcgaccagggcuauaccagaauugaucaagcugcucaacgacgaagaccaaguggugguaucgcaagccgccaugauggugcaccagcucucgaagaaagaagcuucucgacacgccaucaugaacagcccccaaaugguggccgcuuugguucgggccauuuccaauuccaacgauuuggaaaccaccaaaggugcuguugguacuuugcacaaauuaucgcaccacaggcaggguuugcuggccauuuucaagagcggugggauaccggcgcucgugaaauuacugaguucgccggucgaaagcguguuguucuacgccauaaccacccuucacaacuuguugcugcaucaagacgguucgaaaauggcggucagauuggccggaggauugcagaagaugguagcguugcuccagagaaaccacgucaaguucuuggccauucucaccgacuguuugcaaaucuuggccuauggcaaccaagagagcaagcucaucauacucgccucccaagggcccaucgaauuggucagaauaaugagaucguacgacuacgagaagcucuuguggacuacuucgagaguauugaaaguguugucgguguguuccagcaauaaaccggcuaucgucgaggcuggcgguaugcaagcccucgccaugcauuugggcaaccccagcacccgguugguucaaaacugccuuuggacccucagaaauuuaucggacgcggcuacuaaagucgacggguuggagaguuuguugcaaucuuuggugcaagugcuccaaucguccgacguaaacguggugacuugcgccgccggcauccugucgaauuugacgugcaacaaucaacgcaacaaggugacggugugccaggugggcggcgucgacgcgcuggugcgcaccaucgugagcgccggcgaucgcgaggagaucaccgagccggcggugugcgcccuacgccaccugacguccaggcacguggaguccgagauggcgcagaacgcggugcggcugaacuacggcauacaagugaucgucaagcuguugaauccgccgucgcguuggccgcuggugaaggcggucaucggucugaucaggaaccuggcacuguguccggccaaucacgcuccguugagagagcacggcgccauucaucauuuggugcaguugcugaugagggccuuccaagacacucaaagacaacgggguagcguggcuagcggaggcagccaaccgccgggaacguacgcggacggggugcgcauggaggagauugucgaggguacggugggagcguugcauauauuggcgagagaaucgcacaaucgggccaucauuagacagcaaauggugauuccgaucuucgugcaauugcuguucaacgauaucgagaacauacaacgcgucgccgccggcguucuuugcgaauuggcggccgacaaagagggggcggaaaugauugaaaacgagggcgccacggccccauugacugaguuguugcauucgagaaacgaagguguugcuacguacgcagcugcgguuuuguuuagaaugagcgaagacaaaccacaagauuauaaaaaacggcugucgauggaguugacuaauucuuuguuuagagaagaaaaucuuuggaaucccgaucuaggcauggguccggauuugcaggauauuuuaagucccgaccaagcauaugacaacauguaugcucaggguccccccaguguucauaguagucauggcggccgaccauaucaacaacaaggguaugaccagauacccauagacaugcaggguuuagagaucgguucucacggaggggggaauggguccacuuacagugcaauagacgcaauggacguuaccagcggugaaccugaucucaauuucgauaccauugaucaacucccuaccccuccucaagauaauaaccaugcugcugcuugguaugauaccgauuuauaa

SEQ ID NO: 6301 - RNA, 801 nt, Phyllotreta striolata
auggcccgaaacgcggaaaaggcaaugacaacauuggccagauggagggcggcccaauugggggaaaucgacaagcacaagaagcgccguccguauuuggccuccgaaugcaagagccuguacgccugcgagaaauggcgcaugcagauaaucagagaaauagcgaaaaaagucgcucaaauccagaacgccggacugggcgaguuccgcauacgcgaucuaaacgacgaaauuaacaaacugcugcgcgagaagcgccauugggaggaccagaucaaggaauugggggggcccgauuaccagcgcgucgggccccggaugcucgaccacgagggcaaagaggugcccggcaacaggggcuacaaauacuucggagccgccaaggaauugccaggcguccgagagcuguucgaacaggaacccccgccuccgccucgaaagagccgagccgaauugaugaaggacaucgaugccgauuacuacgguuacauggacgacgacgacgggauuuugauaccguuggagaucaaagcugaaaaaaucgccguccaaaacgccaucaccgaaugggugaacaacaaagagaagaaccucgacucgagcaaaaccaucgaagagagcaucuacgcgguggaggauuccgacgaggaggagaccgucgaacgauucgacgguucccaacagcgguucgucgcccacguaccgguacccucucaacaggacaucgaacaggcccuguugaggcgcaggaagcaggaauugauggagaaauacggcguacaagacgaacaagaugucuaa

SEQ ID NO: 6302 - RNA, 645 nt, Phyllotreta striolata
auggcagcgaaagacaugcccacauucaaaugcguccuagucggcgacggugguaccggcaaaacgaccuucgucaagcgccacaugaccggcgaauucgagaaaaaguacgucgccacauugggcgucgaagugcacccuuuaguguucacaacgaacagagguaaaaucuguuucaacgugugggauacggcgggccaggagaaauucggcggucucagagacgguuauuacauucagggacaaugugccauuauuauguucgacgucacguccaggguuaccuacaaaaacguccccaauuggcacagggacauugucagggugugcgaaaacauaccgaucguacugugcggaaacaaggucgacaucaaggauaggaagguuaaggcuaaaaguaucguguuccauagaaagaagaaucuucaguauuacgacauaucugcaaaaucgaacuacaacuucgagaagcccuucuuguggcuggcgaggaaacugaucggcgaucccaauuuagauuucguggcggaaucggcccuguugccuccggaagugcaaauggacccgcaguggcaacaacaguuggagaaggauuugaaagaggcuucggaaacggcccugcccgaugacgaugaggauuuguaa

SEQ ID NO: 6303 - RNA, 480 nt, Phyllotreta striolata
augacaaguauagagacaguggguaccaucgugcuuaaaauauugaaguugguaauaaauuugauaugcauaauacuauacaggaccgguuaccagggcuacuucuuaggaguaggaggaacauggaacuuaaacgaagaaaaaaauccugauucggaaauuguggcaucuggaaucuuugucggcuacaugaucuacacuaucguaucucuuauaagccuguguuucgccagcggugaucacaaaacaucuuucaccgauauuuuaaugaauauagucgguguauucauguggguggccguuggagcaacagcacuucacuacuggcucgguuauuugucagaauauaaauacucgagcguugauuccgagcgacaggugggcuuggcguuaggagccuugugcguuauaaacggugcagucuaucuaguggacaguguguugucugucguauuuauaauuaaaucgaagaugcaauaa

SEQ ID NO: 6304 - RNA, 2505 nt, Phyllotreta striolata
augccuagaauaaugauaaagggugguguuuggagaaacacagaggaugaaauucuuaaggccgccgugaugaaauacggcaaaaaccaauggucuagaauugccucucuccuucacagaaaaucugcgaagcaauguaaagcccguugguucgaaugguuagaccccagcaucaaaaaaaccgaaugguccagagaagaggaugaaaaguuguugcacuuagcuaaacuaaugcccacacaauggagaaccaucgcaccuauuauaggcaggaccgcagcccaaugucuagaaagauacgaauauuuacuggaucaagcucaaaaaaaggaagaaggcgaggacgccgucgacgauccgaggaagcuaaaacccggagaaaucgaucccaauccggaaaccaaaccggcccgacccgauccuaaagauauggacgaagacgaguuagagaugcuuucugaagccagagcuagacuggccaacacccaaggcaaaaaagccaagcguaaagcucgcgaaaagcaauuagaggaagcccggcguuuggcggcuuugcagaagcgccgagaacugagagcagccggcaucgaggucacuucgaggcgcaagaagaaacgaggcguagauuacaauucggaaauuccauucgaaaaacaaccagccaucgguuucuacgacacuucuaacgaagcccucgacuugauggcuccagauuucucuaaaaugagacaacaacauuuagacggugaacucagaagugaaagagaagagagagaacgcaagaaggauaagcaaaaguugaagcaacgcaaagagaacgauaucccucaagcgaugcugcaaaacgaggaaccggcuaagaaacgaucgaaacugguguugcccgaaccgcagauauccgaucaagagaugcaccaaguggucaaguugggcaaagcgagcgaaacggcccgagaaaucgcgacggaaagcggcgucgaaaccaccgauacucuucucaacgauuacauguucacaccgcaggccgccgcuacuccuagaacuccagcaccgcaaaccgacaggauacuucaagaggcccagaacaugauggcccuuacgcacgucgauacgccucucaaaggcgguuugaauacgccccugcacaauucggacuucagcgggguucugccgcaaucgcaagcgaucaccacaccuaauacagugcucgccacgccguucagaucgacgcgaagcgauggcggggcgacucccggaagcacggcaggauucaugacacccaaaagcggagcccugacuccugucggcaaaaacgcgacgccuuccaucagagauaagcugaauauuaacgcugaagaaacuuuagacgugggaaguacuccggccgaacaccgaauguaucaaaugucgaugaaagaccaauugaaacuaggacugagcagcuugccgcagcccaggaacgauuacgagaucgucgugcccgaaaacgaggcgcaggaugaacccgaagaagcccaaucgcaauuggucgaagaccaagcggacgucgaugccagaaaacaagaggaacugagagccaaggcggcucaagaauuagcgucgcguucgcaagucauccaaagggaauugccgaggccgcaagacgugaaucucacggugcuccggccgcccaacgagagcuacuccuugacggaccuucagcgcgccgaggaauugaucaaaugcgaaaugguuacgauguugcaauacgacaaucugaagaacccucugccggcgcaaaguaagcgaucgaacaugucgcaggcucagcaauuggccuuucucgagcaacauccguacgauucguucaaaacggaggauuuggacguggcuaaaucgcuguugaggagcgaaauggaugugguaaaaagcggcaugaaucacggagaauugccguuggacguguacaaucagguaugggaagagugccugggccaaguguuguaucuuccgaaucagacgagguacacccgcgcgcauuuggcgagcaaaaaagauagauuagaaucggcggaaaagcggcuggaacagaaccgaucgcacauggccaaggaggccaaacgcgccgccaagauggagaagaaauugaagauauuaacgggcgguuaccaauccagggcgcaggugcugauuaaacaguuacaggaucaauacgagagcaucgaucaaucgacguuggaguugaacacguucaaauuccuggccgagcaggagaagaacgcuuugccgaugcgaauacagucucuuacugaggacgugaauaggcagauggaaagagagaagguacuucaaaugaaauacgcugauuaccagaaucagauuaaagaguuacaagaggaguauuuaggucaaaugcaaaauguuccaaaugaagaaucaaauaaauaugacgaggucacuucgaccaccaaugaagagaaugguauggacacgucggaaaaugaaacaguuacugcugaaaauuaa

SEQ ID NO: 6305 - RNA, 474 nt, Phyllotreta striolata
augaugcaauuuauguuacuguucaguaggcaaggaaaguugcgauugcaaaagugguauguggcucauccugauaagcugaagaaaaaaauuacuagggaauuaauuaccacuauucuugccagaaaaccaaaaaugugcaguuucuuagaauggagagauuugaaaaucguuuauaaaagguaugcuagcuuguauuuuugcugcgcgauagaacaaugcgacaaugaacuguuaacauuggaaaucauucaucguuacguugaacuauuggauaaguacuucggaaguguaugcgaguuggauauaauuuucaacuuugagaaggccuauuucauucuggacgagcuaaugcuugguggagaggugcaggaaaccaguaagaagaauguucugaaggcaaucgcugcacaggaucuccuacaagaggaggaaacaccgcaaggauucuucgacgaucacggacugggcuaa

SEQ ID NO: 6306 - RNA, 1251 nt, Phyllotreta striolata
auguauggauuacaacgauauucguuugguuauacccucaaaaaugcggugcguuauuacucgagagaaccagccaagagaucgucguuucucagccgauuguacgacaauuucaaggacgaaaugaacaaaaacaaagaaaugaaagagucgcugaagaaauuccgcgaagaagcgcaaaaauuagagcaaagcgacgcuuugaaagcugcccggcagaaguucgaaaccguagagaaagaggccagcaaaggcggcgaaguguucaaagagaguuuagguucuaucaaagaucgagucaaaggcgucauagacgaggccaguaaaucggauuuagccaagaaggccgguaaguuuaccgaagaaguaggaaaaacuacgcacaaaaucagcgaaaccgcacaagaaaucagcaaaaccggagcguuucagagcauaucggaagccaccaaagccgucaaacaagaaaucgacaacaccagcauggaaggucgaguguaugucaguccuaaaaagcuacgaaaacgaaccgaaaccagcgccguaguccaacagaaauacuacgaacccaacacggacgccacaggcguggaacuccacaaagacuccaaauucuacgaauccuggcagaacuucaaaaacaacaaccccuacguacacaaagucauggacuggaaacucaaauucgacgaaagcgagaaccccaucauccgagccuccagggcgcucacggaaaaagucggagacaucaugggcggcuuauuccaaaaaaccgaacucuccgaaacccuaacggaaaucuguaaaaucgacccggacuucgauacaaaacgcuuccugaaacaaugcgaaaccgacaucaucccuaacguacucgaagcuaugacgcgaggagaccucgagguucugaaggacuggugucacgaaggacccuucaaucuauucgccauacccaucaaggaggccuacaagaaaggcuauaaaaucgaaucgaaaauccuggauguagaccacguggauuugaugaugggcaaagugauggaucaagggccuguguugauuauuucuuuuacaucgcaacaggugauggccgugcgggacgcgucgggggcggucgucgaaggcgacccagacaaaguuaugagggugaauuauguguggguguugugcagggacgugguggagccggauccgagggcggcuuggagacugcucgaucugucugcgagcagcaacgagcaauuaguauaa

SEQ ID NO: 6307 - RNA, 906 nt, Phyllotreta striolata
augaauagcagcgauucagaauuaagcgauagugaugcugaguugcaacaagcguuguuagaugguaaacugaaacccggauuaaauaaaaucgaagaagcucccaagcaauucguaaacaacauaaguggccuaaaccagaaaauagaagaauucaaauugaaacugccauggaucgagagguuggacuguacaaacgcccaagccccccuggcgcccgaauuggcugcggaaauguuaguucacgaagaaaagaggaguaaucaacugagaaacaacaaaaaacuuccccaauuccaaccauccgaagacccgguucugaacgauuucaaacgagagcuaauauuccacaggcaagcacaagcuacaauucuagaagccaucccgaaaaucaaagaauuagggauauccacuaaaagaccagaagauuauuuugcugaaauggccaaauccgaugagcaaaugcacaaaaucagggagaaccugaagcagaagcaggagcaacagaagcggauugaacgggugaagcaauugaggcagcaaaggaaagaaggaaaaucgcugcaggugcagcugaaacugcaacgcucuaaggagaagaaagaaaugauggaucaaguaaagaaagcgaagaaaaauuucgauuuucucgacgauaaaaauaagcccauggguaagagggcggcggagaagcguaagaugaaggauaagaaauucgguuucggcgguaagaagaaagggaugaagaagaauacaaaggacagugcaggcgauauaagcgaguauagaaauccugggaagccggcuaagaagcaggcagggaaaaaauuugucaauaaaaacaaaccaaagcaacgauugggcaaaacuagacgcauuaaaacuaaggcuaagggaaaaaaauaa

SEQ ID NO: 6308 - RNA, 663 nt, Phyllotreta striolata
gaauuuuguaugcuuuuagcuuuaucaauuuuaaauauuaaaauaaaaucauauauaaaauucaacaagaugaacgaauuagagaagcuagaauaccuuucuuuggucucaaaaauuugcacagaauuggacaaucaucuuggaaugaacgauaaggauuuagcugaauuuauuauacaucucuccgagaaaaacaacacauuggagucuuucaagaaggugcucucagaaaauggcgccgaauucucggauucauuuguuucuaacuugcugcgaauuauccagcacaugaagccgaagaaauccuccaauaaggaagaguucgauaaaguggaaaaagagggacuagcuuuuaaauuucccggucuagcaauaccuaaugagaaacaaaaaccuuuacaauuagaagaauuugauaaugaaaaugaaaaugaugaaauagacguuguagcugauaugaugaaacagcucgaggccgaugcaccuucucaaaaacaaaccaaagaaagguccagaagccccagcaucgaaaagaaaccgagaguaagaucuggaaguagaucgaaggaacgaagaagauccagaagcagaucgaaagauagacgaagaucuagaagcagaucgaaagauagacgaagaucuagaagcagaucgaaagauaga

SEQ ID NO: 6309 - RNA, 1869 nt, Phyllotreta striolata
augaauccaggcgccccaaauuacccuauggcgucucuguaugucggugauuugcauuccgauaucaccgaggccaugcucuuugaaaaguuuucaucggcuggccccguucuauccauccgcgucugcagggauuugauaacccgcagaucuuuggguuaugcuuacguuaauuuccaacaaccugcugacgcugaacgugcccuagacacuaugaauuucgacuugaucaaaggcaggcccauucguauuauguggucccaacgugacccgucccugcgaaaauccggcguugguaauguuuucaucaagaacuuggaccgauccaucgauaacaaggcuauguacgacacuuucuccgccuucgguaacauucucagcugcaaaguggcccaagacgagagcggagucagcaagggcuacgguuucguccacuucgaaaccgaagaagccgccaauaaauccauugaaaagguaaacgguaugcuguugaacggcaaaaaggucuacguuggucguuucaucccgcgcaaagagagggaaaaggaauugggcgagaaagccaagcucuucacgaacguuuaugugaaaaauuucggagaggacuuguccgaggaacagcugagaaccauguucgagaaguacggcaagaucaccagcuacaaaauaaugagcaaggacgaugggaaaucuaaaggguucgguuucgucgcuuucgagagucccgaggcugccgaaucagcugucgaagccuuaaauggcaaggaaauauuggaaggcaagccucuguacgugggaagggcccagaagaaggccgagcgccaacaggaauugaagcgucgcuucgaggcccugaaaauggaaaggcugaaccgcuaccaaggcgugaaucuauacgugaaaaacuuggaugauaccauagacgacgagcgccuccgcaaggaauucucgccguucggcaccaucacguccgccaaaguaaugauggaagaaggcaggagcaagggcuucggcuucgugugcuucuccucgccggaggaggccaccaaggccguaaccgaaaugaacggcagaaucgucggcacgaaaccgcuguacgucgcccuggcccaacgcaaggaggaccgcaaggcccaucugacgucccaauacaugcaacgcauggcgaacaugcgcaugcaccagaugggccaguucauccagccgggcggcucgagcggcuacuucgugcccaccauccaggcgacggcgccgcguuucuacgggccggcccagaugccgauucgcacgagcccgagauggccggcgcaaacgcccgugcggcccggcgcccaagggagcaccgccaccuacaccgguaugcagaacagcuacagggccgccgcccgaccgccgggccaauccacgaugcgcagcaacaucagcguuccgcgaccuaucaccggacaacaaccaccaaguaugcacggucguccacuuguuggacaagguguggcugcugcuggaaaucgugccaacuucaaauacaccgccaacaugcguaauccaccacaagcaauguuguccggagcucaagcucaaguacaacaagcaguccacauucaagggcaggaaccccuuacugcuaccauguuggccgccgcuccuccgcaggagcagaagcagauguugggagagagauuguucccucucauccaaaggauguacuccgauuuggcugguaaaaucaccgguauguuguuggagaucgacaacacggaguuguuacacauguuggaacaucaagaaucgcuuaagaacaaaguugaagaagccguggcuguacuccaagcccaucaagcuaaacaagcugcuauaaaaaaagauuaa

SEQ ID NO: 6310 - RNA, 2781 nt, Phyllotreta striolata
augaccgacucgaaguauuuuacaaccaccaaaaagggagaaauauucgaauugaagucagaacucaacaaugauaagaaggagaaaaagaaggaagccguuaaaaaggucauugcuucuaugacuguaggcaaagaugucucagcauuauuccccgaugucgugaauugcaugcaaacugacaauuuggaacuuaaaaaauugguuuacuuguauuugaugaacuacgccaaaucacagcccgauauggcuauuauggcagucaauaccuucguuaaagauugcgaagaucccaauccucugauuagagcgcuagcuguuagaacaauggguugcauucgagucgauaaaaucacugaauauuuaugcgaaccucuaaggaaaugucucaaagacgaagauccuuauguuagaaaaacugccgccguuugugucgcuaaacuguacgauauuucaucaggauuagucgaagaccagggauuccucgaacagcuaaaagaguuauuaagcgauucuaauccgaugguagucgccaacgccguugccgcuuugucagaaaucaacgaaagcagcccuacaggacaaccccucguugaauugagcaccaacacgaucaacaagcuccuaaccgcucugaacgaaugcaccgaauggggccaaguguucauacucgauucccuaucgaacuacacgccucgugaugaacgagaagcccaaagcaucugcgaaaggaucacuccucguuuggcccacgccaacgcggcuguuguauuaucggccguuaaaguauugaucaaaaugauggagauuuuggcgggugacaccgaauuuugcaacacgcucagcaagaaacuggcgcccccuuugguuacccugcugagcuccgagcccgaggugcaauacguugccuuaaggaacaucaauuugaucgugcagaagaagcccgacauauugaagcacgaaaugaagguguuuuuugugaaauacaacgacccgauuuacgugaaacuggagaaauuggacauaaugauucgauuggcaucgcaagugaacaucgcucagguucugagcgagcugaaggaauacgcgacggagguggauguggauuucgugaggaaagccgugagagcgaucggucgaugcgccaucaaaguggaaccgucggcggaaaggugcgucgcgacgcuguuggauuugauccagaccaaaguuaauuacgucguacaggaggcgaucgucguuaucaaagauauuuucagaaaauaucccaacaaauacgaaagcaucauuagcacguugugcgaaaauuuggacacccuggacgaaccggaagcccgagccagcauggucuggaucaucggagaauacgccgagcgaaucgacaacgccgacgaauugcuggacaguuucuuggaagguuucggcgacgagaacgcccaaguccaacugcaacugcucacggccgucgugaagcuguuccugaagcggccccaacacacgcagggccucguccagcacgugcucagccuggccacgcaggacuccgacaaucccgauuugagagacaggggauucauuuacuggagguuguugagcaccgauccggccgccgccaaggagguggugcucgccgauaagccgcucauuuccgaagaaacggaccucuuggagccgacucuucucgacgagcucaucugccauauuucaucgcucgcuagcguuuaucacaaaccgccuacugcguucguagaaggccgaagugccgguaucagaaaaacguugccggccaggcaagguuccgaugaaggcgucggugccggcgccgccgccgccgaaacgacggucaucccgaaccaagagagccucaucggagauuugcuuucuauggauaucaacgcgcccgcucccucggccgccgccgcucccgccgccccauuggcuagcaacgucgauuugcucggcgguggauuggacguuuugcucggaggcgguagugauaucggcggugguggcgccguuagcgccgccgcucccaccaccaccggucuucugggggauauauucggaauaccuuccgcuccuaccauguacacaccuccgaagguuaucugguugcccgccgaaaagggcaaggguauggaaaucuacgguacuuucuccagacgguccgggcagauggccauggaaaugacuauuaccaauaaggcuaugcaggccauguccgguuucgccauucaauucaacaagaacagcuucgggaucacgccgugcgcgcccaugaacgugccggcccugcagccgggccaaaaucucgaauacaguuuaccguugaacacgacggggccuguucaacggauggauccauugaugacgcuccagaucgccauuaaaaacaacguugacguguuuuacuacgccugccagauaccuauccagauauuguucggcgaggacgguacucuggauaagaggguguuccuuaccacuuggagggacauuccgggagcuaaugagguccaguacacguugaacgacaucaaaggcaacaccgacaccguuucgaacaaaaugacguugaacaacaucuucaccauagcgaagaggaacgucgaagggcaggauauguuguaccaaucgcugaaauugacgaacaacauuuggguguuguuggaauugaaauugcagccgggcgucccgacggcgacgcucagcuugaaaucgagaucggucgagguggcgcccuacguuuuccaagcguacgaauccauuuugaagaguuaa

SEQ ID NO: 6311 - RNA, 498 nt, Phyllotreta striolata
augccgccuaaauucgaucccaccgaaguaaaguacguuuacuugagauguguaggaggagaaguaggagcuacaucaucuuuggcuccgaaaaucgguccccuuggucugucucccaaaaaaguuggugacgauauugccaaggguacugcugacuggaaagguuuaaaaauuacgguacaauugaaaauucaaaaccgucaagccaccaucuccguuguaccaucggcugcuuccuuaauuaucaaggcauugaaagaaccuccucgugacagaaagaagcagaaaaacauuaaacacaguggaaacauuacauucgaugaagugcuugccauugcgaagcaaaugaggccuagaucaauggccaagagccuuucuggaacuguuaaggaagugcuagguacagcucaaucuguagguuguacaauugacgggaaagccccucacgacgucauagaugaagucaaugaggguacuguagaaguuccagaugaguaa

SEQ ID NO: 6312 - RNA, 1095 nt, Phyllotreta striolata
augagcgaagaagggaaaagagcguuaauuuuaguaggaggcuauggcacaagacugaggccucuaacuuugagccggccgaaaccucucguggaguucgcaaacaaaccgauccuauugcaucaaauagaagcguuaguagacgcaggaguaacggaagucauauuggccgugucguaccgugccaagcaaauggaggaggaacuuacaguugaagcggccaaacugggcauuacuauaguauuuucgcaugagacugagccuaugggcaccgcaggaccaauagcauuagcgagagaacaccucucgaaaagcaccaagccguuuuucguauugaacuccgacauaauaugcgacuucccguucagggagcuggccaaguuccacgaaggccacggaaaagaaggcacgauagucgucacgaaggucgaggaacccuccaaauacggcguggugguguacgaucaaaacaacugcaucgagagcuucgucgagaaaccccaggaguucauuucgaauaaaaucaacgccgguuuguacauucugaauccgagcgugaucgaucggauagagcuccggccgacuuccaucgaaaaggaaguguucccuuacauggcgaccgacaagcagcucuacgccuucgaguugcaaggguucuggauggacgucgggcaacccaaggacuuccucaccgggaugugcuuguauuugaaccauuugcgggaaacuaacagccagaagcuguacaaaggucccgguguuguggggaauguacuggucgauccuacagccaaaauuggcaguaauugccagauugggccuaacguuacgaucgggccgggcguuguaauagaaaacgguguuuguauaaagcggucgacgauacugagaggugcgguuguuugcucgaauucuugguuggagagcugcaucgugggauggaagugucacguugguaaauggguuagaauggaaggcagcaccguacucggagaggauguuauuguuaaagaugagacguauauaaauggagggcagguucuuccucauaaaagcaucgcuacgucgguuccagaaccccagauuaucauguag

SEQ ID NO: 6313 - RNA, 867 nt, Phyllotreta striolata
auggcgucggacggugaagaagugauaagugaucaagaaaaaguaaaaauaguuucggauuucauccuccauucgccgcccggugaauucaacgaagucuucaaugauguaaggaagcuuuuaaauaacgaugaccuucuaaaagaaggaguaacuggggcguucgcccaauacaauaaagaccaacucacccccguuaggauagaaaacgccgaucaaauggugcugauuacagaauacaacgauuuagguaacaauagauucuucgacccccguaguaagcaaaguuucaaauaugaacauuuaagaaaggaagcuucugauuaccagccuuauagucuugauacgacggcggagccuuggcgggccgcccuagauaacgaguuuauacaauacacaagaaaccauuauaaagacggcguuuguagcguauucggucgcagucaaaacggugcgaucacccuuacagcuugcaucgaagaccaccaauuucaacccaagaacuuuuggaacggucgauggagaucccaauggucuguuaguuuaaccgaugauucaaccgcagaaguacggggcguccucaaagugcaagugcauuauuaugaagaaggaaauguucaacuggugaguacuaaagagaucaaggaauccauucugguuucuaacgaagcucaaacggcuaaggaaaucauccauguaauagagaacgcugagaaucuguaucaaacggcuauuucggaaaauuaucagacgaugucggacacgacauuuaaggcucugcgaagacuccugcccgucaccaggacaaaaauggauuggaauaagaucguaucuuauaguauuggaaaagaacuaaaaacacaauga

SEQ ID NO: 6314 - RNA, 3774 nt, Phyllotreta striolata
augcaugugaaaaugaacuuucugcuaguguuaauaaucagugcgguggccgucggggcucaagaggaugccgccggggcucaagaggaugccguagcgcccgaugcagcgggccaggauaauacggaagacguggaaagcaucgacgucggugcagcaagaggcgacgucggcgacgucgaucccaagcccguucccgucgaggaaaacaacggcggggcgguuacgaauaaccucaauuacgacgcucccguagaacaacgcucccguaaauuaacaaauaccgauagcgaaauaauugauacuaacaguuccaaacccaauuggacuuuccagaaaaaaacuaaaucuggaaaauacguuacuuauuauggggccaauuaugaccccaugacaucagccaccgccccuccggacaccgaucaaagagguggaggcaucccuuaccucauuaccgaaaccagguuagcggacauuaggaaacacuuuauguauccguucuucgauaaagggggcaacguggacaacgagggggauuaucagaaggaaauccaauccuccacgccccaaguccacaagaauaugaacuuccaauugccguucuucggauucagguauaauuacacgagagucuccaucaacgguuauuuggaauucagcgauccaccuccgaauuacgauuacccauuaguuuuuccgguuaaagacuggccuaagcgaaacgauccagcuuuuauugguauuuucuucaguaaaugcaaaaucgguaaccuucgcgacgaagacgucgacaaacguaaacccgguguauacuuccgaauggaaagagaccucagggacagacaagacagaaugggaguggaaauaagggaaagauugaaaugggacaucagagagggcgugaucgguucggaaaccuucaaucccaaacacgccauaaucgucacauggaaaaacguaucguucaauggaggauucggccccgcaguuuuucaaaccaauacauuccaaaugguccucgcuacugacgaaguauucacguacgcaauauucaacuaccuaaacuuggaauggaccagucacacggaagccgguggagacaccagaaacggggaaggcgguguaccggcauucguuggauucaacgccgguaacgguacaagaagcuaccaguacaugcccuacagucaagcauccgucauucgagauuugacagcgaccgguugggguaacggcaaaccgggaagacacauuuuccgaaucgacgagaacauccugcuagguucuuguaacaaagauaucgauggggcuaauuuaccccuucaauuugcgccggagagcgguaauauguugggaggaaccgucgucaacaucacaggucccuguuucaaucccaacgauaggaucagguguaaauucgacguguucgaugaaguugucggauacgucgucgacaggaacagagccauuugcauucaaccuccucuuuacacagaagguugggucagacugcaaaucgccgucaauucggaagcguucaaauggaagggaaaauacuacgucgaaucgcccgccaccgccucccagaagaucuucuucaaagacaugaaguaccacgagaagucgcccagcgaguuucgcaucacguggcagaagcagaauuugaccaccaacgaaaaugcuaacaucagaaucuccuuguggggcuacagggaaacuaccaugagaccuacguucguuuacauaacugaaauagccaguacccagaacgccggggaguuccugaucucgccgucgcaguacaggggcaaagucaaccaauucuuaagugacaucaaguuuggauucuugcaaauaaauuugacugaaucgguaaaggucaacauuuacucgacgaccaaucaaaacgucgagauuacaccgguuauuuggagccggccgauuccgcuugcuugguauuuccaauuccaaugggagagucaauacgggaagaacuggcccaaacaccucugcgacgauuggcucagaacggacagauaucugaagaauuucgcacacgaauuaccccaaugcccuugcacaguccaacaggcuuuggcggacaagggaaaauucaugcccgacuuugauugcgacaaagauucgaauccuguuuguuacuacaauaaucaagcuuugcauugcgucaaaacuggugcacccacaauggaagguuccgagcaacaauguugcuacgacaaaaacgguuaccugaugcuauccuacgaucaacaaugggguucgaguccucgucgaugccacaacuugggaaaaaugccuuacaaugaagccaccaaaguccccacgcugucucaaugguucaacgacauagugcccaaauaccucugcugucucuggcaggaagagcaagccgugggcugcgaaacccugcgauucgaacgaaggccuucgcaggauugcgucgccuaucaagcaccagguguagcaggaguguacggugacccgcacauagucaccuucgacgaugucgaauacacauucaacgguaaaggggaguacuccuuagugaaaucggucaagguggacgauaauuuagaaauacaggcgagauucgagcaaaugagccccaaugcuuauggagaggugagagcgacgcaacuaacggcgaucguggcuaaaggaaacaagacuauucccauugaaguuagaaguagaccgauagaauccagauggagguauagauuagauguuauagccgagaacaggagguuguacuuugauagaccuucguugaaauuccaacauuuccaaggcgugacuguuuauacaccaaccuacauucuaaaucaaucugaaguacugauaauguucgacaacggcgccgguguugaaguacuggacaaucaaggguacaugagcgccagaguauacuuaccuuggucguuuauaaauaaaacgguuggauuguucggaaauuggaguuucaacaaagaagacgacuucacccugccggacgguuccaaggcggccgucgugucaaacaucaacgacauggagagaguguacaacgacuucgguucgaaauggaugcucgacgacgucggcgacgagcgcaaaggccaguccuuguucuacagggaauucggccgcaccucggccaccuacaacaacaagaccuucaggccgcaguuccugaugcugcccgaagacauccuaccgccgaacagaucggagcaaauacagcgcaccuacgaggugugcuccacgaagauguacgaauguuacuacgacuacgccaugacgcucaacagagauuuagcgcacuacacgcaaaacuacaaggcgaccauuuacgaacugaagcaaaccaccagggagaagaucacguccugcggcgugcuggaaacgcccagguucggcaggaagagcacuuucuuauucguacccggcacgaaggugacuuacgaauguauacaagauuucgugcuagucggugauccuagaagagagugcggggcugauggaaaauggaauauuccagaauauggauacacguauuguuuacgucagcaggaauauucccaacgacaagcaggaaucacguccgggauaauaauguuagugcucauaccgcucauccugcuguucguguauuuggcguacagguucuugaagaagaaacagaaagaacgggaugagagcaggaugcagcaggaccaauacagagagcaaucuaggaaagcucaagaggcagcgacgaggaaauuaaccgag

SEQ ID NO: 6315 - RNA, 303 nt, Phyllotreta striolata
augucaucgucuucggauucugauucaacuuucuuuucuuccuucuuggauucuuucuuuucuucugcggcagcaggagcagcggcaacugcagcagcagcuacgggugcugcaccaccuacuggcauggaacucaacuucucgcgaccuuuaguaaugagcucuucgauggauuugccguugaguucacccaagaccuucuugaccuuuucggcuucagcuucuacuccaacggagccgaggauuuuuucaacaucggcagcgcuuggggaagcguuuccgcccaaagcggcuaauaaguaa

SEQ ID NO: 6316 - RNA, 2457 nt, Phyllotreta striolata
augacugaccguuuuggauuaaaaugggaccccaaaaauuuagaaauuagaaccaugucaguggagaaaacccucgagccccuugugcugcagguaacaacccucgucaacacgaaggggcccaguaaaaagaaaaagggcaagucaaaacgugccaaugcucucgucagcacaguggaaaaggccacugagaauuucaucgagaaaggcgagcaaaucgccuacgaaaaucccgauauaaccgaugagaugauagcugcuguugaagaagucagaaaaacuggcaacgcaaugagcauagcugcaagggaauucucagaggauccuugcucgucuuugaaaaggggcaauaugguacgcgcagccagaaaucuucuaucagcagucacgagacuucucauccucgcugauauggucgauguucaucuucuacuacaaucgcuccacguagucgaagacgauuuggaaaaacuaaaaaacgccucgagccacggcgaacuccucgacaauaucaagaacuucggucacaacgcaaacgaacuuaugaaucaggcugcuaaaagacaacaggaacuaaaagacccgcagcuucgcgacgauuuggccgccgcccgagcgguacucaagaaacauuccacgaugcuucuaacggcuuccaaagucuacguccgucaccccgaacuagccgccgccaaagccaacagagacuacgucuugaagcaagucugcgaagccguuaauacgaucaacgacgucgcgcagggccggacgccccagcccgcuucgggccccuacgacggaccuggcgaacuggcggccgcuuuggacgauuucgaugaucacauggugauggagccucuggcuuacaacgagguccacacgagaccaucgcucgaggagcguuuggagagcaucaucagcggugccgcucuaauggcugauuccaguugcaccagggacgagagaagggaacguaucguugccgaaugcaacgcuguaaggcaggcguugcaggauuuguuguccgaguacaugacgaauauggguaagaaggauaagagcgacaaccucaacagggccaucgacaacaugggcaggaagacccgcgaccucagaaggcagcucagaaaggccgucgucgaucacguuucagacagcuucuuggagaccaacguaccccugcuggugcucauaaaagcggcucaaaacggcaacgaaaaagagguggaggaauacgccgucguauucaccgaacauuccaacaaacuggucgaaguagccaaucucgucugcagcaugucgaacaacgaagacggcgugaagaugguucgauacgccgccgcucaaaucgacaaucucugcccugaaguaauaaacgcagcuagaauauuagcggcgagaucucgcagcaaagucgcccaagaaaacauggaggcuuucaagcaaucgugggagaaccaaguccgcauuuugaccgaagcagucgacgauaucacuacaaucgacgacuucuuggcagucuccgaaaaccacauacuggaagacgucaacaaaugcguacuagcacuccaagaaggcgaugcugauacauuggaccgcacagccagcggcaucaaaggccgaucgaacagggugugcaacguggugacggccgaaauggacaacuacgagccgugcaucuacaccaagcgcgugcuggaggcggugaaggugcucaacgaucaggugaugccgaaguucacccaaagagugcagguggccgugcaggcguugggcaacagcccgcccaaggaggucgacgagaacgauuucaucgacgccucgcgauuggucuacgacggcgugagggagaucagaagggcggugcucaugaauagggccgaugaggauuuggaucccgaagacguggaacucgacgagaauuaccucaucgagacuaggaguaaaucgagcgcucauaccggugaacacggcgucgaugaguaucccgauaucagcggaaucaccacugcuagggaagcuauggguaagaugcccgaagaggauaagcagaagauauugcagcaaguggaguucuucaagagcgagaagcugaaguucgaucgcgagguggccaaaugggacgauaccggcaacgauaucaucguauuggccaaacacaugugcaugauuaugauggaaaugaccgauuuuaccaggggaaaggguccucugaaaaccaccauggacgucauaaacgccgccaagaaaauauccgaagcgggcacgaaauuggacaaguugaccaggcaaauagccgaucaguguccggaaaguucaacgaagaaagauuuacucgccuauuuacagcgcauugcccuuuacugccaucagaugaacauuacuucuaaagucaaagcggacguccagaacaucagcggggaauugaucgugucugguguacguuauacacucuaa

SEQ ID NO: 6317 - RNA, 1224 nt, Phyllotreta striolata
augucuuucaacuucggaaauacuagcacuccaaaaacagcugcuaccggcuuuacauuaccgucaaauccggcaacuacuagugcuacuggauuacaguuuaauuucggaggaggagacaccaaaaccgaaguuaaaccaucaucuacauuauuuucuacggccacaaguggcgcaccagcuuucgggauugccccacaaccggcaucauccgcgucugcugcaccaucguuuaauuuugguacgccuacaacccaacagccgacagcauccgcuuucgguacagcagcccuagccucauugaguacuccaacaucuucuucccaauuuggacuaaccuccagggccccuaaggacacaucaggguuauauggaucaaccacagcugcagcgccuacuccagcaucaaccggacuugguuuuggaccagcaguuucaacaacgucuucagcagccccagcuacuacaggaacuaccccccuuuuuggagucgcaucuaccccgagcaccacuacauuagccagugccccugcuuuagguuuaucgaccacaauuucuuccgcugcuucaacaacuccaucgacuucauuaaguacuacaacagcacccccggcuuacucaacaucgacacuuacuucuacugguucguuaacuuucagucaacuggaagauucuauuaacaaauggaccauugauuuggaagagcaaggaaaauuuuucauuaaucaagcgaagcagcuuaaugcuugggauucguugcuuauuucaaauggugaaaagauucucaaccugaacgguaguaucgagagagucaagcagcagcaacagcaauuggaucaagaacucgauuuugucuuagcacagcagaaggaauuggaagaguugauaacaccgcuggaaaaggaauuauuggaaauucccgugacggacauagaucgaaaucaaauguaucaauuuucggaaauaaucgauucgcaauugaagcaaauguccgaugauuugaaagaaauuaucgagcacauuaacgaauccaauaaaagcgaagaaguuucgaauccauugacgcaaauuagccgcauaaugaacgcccacaugaauucacuccagugguuagacagaaauacggcgcaaauuguuucucaucucgaacaaaucaauaaaaugcaggacucuaaccgaaggaauuuuccucucaaucauucuuuuaauaauucacuacuuuaa

SEQ ID NO: 6318 - RNA, 582 nt, Phyllotreta striolata
auguucauaugggauugguucacgggaguguugggguacuuaggacuauggaagaaguccggaaaauugcuguuuuuaggacuggauaaugcugguaaaacgaccuuauugcacaugcuuaaagaugauagacuggcccagcacuugccuacauugcauccgacuucagaggaauuauccaucgguaacaugagauucaccacguucgaucucggagggcauucgcaggcuagaagaguguggaaggauuacuucccagcuguagacgccauuguauuccucauugaugcuaacgacagaucgagauucguagagagcaaacaggaauuggaugcuuuacuaacagacgaaacccuagcgaauugccccgugcugauucuaggcaauaaaaucgaucuaccggacgccgccucugaggaugaguugcgaaacguuuacucguuguauggccaaacgaccgguaaagguaaagucgcucgaucggauuugcccggaaggccuuucgagcuguuuaugugcuccauauugaagaggcagggauacggggaaggguuucguugguuggcgcaguacauugauuag

SEQ ID NO: 6319 - RNA, 564 nt, Phyllotreta striolata
auggacccgaucgccguacuagaaaaacgcaucgaagcccucgagcugcagguguucccuuugggcgacuacaagcaaauauccaacaaaacgcaaaccauaacgaauuugcugguggaaacgcaaaccaugaucaauucggcguugaccugucgcgaaucgaucacgucgaugcugcaacaccuggucgucaucaacgacuaccugaaucccacgagcgaggcggacgagcucgagguggaagcgaaacgccaguauuuacucgaauuguaucccgaauugaaggauacgauacagacggugagcacguuggagucccuguugccauucaucgauuccauuaacauauccaaagugguggaguucucggggaaguuggaagagguggccgugggcaaucucaaauuguacggggaaugcagggacaucaccaagaaagugcuggucgcguuacagcaauacaacgacauauccaauuccauuaaguuauuguucucgcaauuggauauggccgucacgaauuuagaauacgccuugcagcuucgagacgccaacgaggaauga

SEQ ID NO: 6320 - RNA, 1752 nt, Phyllotreta striolata
augaacaacgccaaauuccaagaaguguacagugaccuaacgcucuacaccacuccagauaaauucuucaucgagccgaaagcuggcgaggaauugaugguaauagagcgaaauuccgaaaauauaauauguuucaaaagcgaccacagacaccugauaccugcagcgaacagccggaaggauuucugcggguuaauagguauaauccaacuguuagcuugucccuacuuaguaguagcaguucaaagggaauuggucgguuacauagcagguugcgcugucuggcgucucgccaaagccgaacuaauuccauacaggagcugcgcgcacuuaucgccugaaaaacaagcagacaacgaugucuauuuguccaugguguauucuguacuauccacuccauuucuauacuuuucguacgacuacgaucuaacgcauuccuugcaacgcuugcacgguauaagcccugauuuuuggaaacaauccuuguucgagcgagccgaucaaagguuugucuggaacggaaaccuguuauacucguucaaaggauuuucgauacacagauuuugcuugccucucaugcacggauucguuucgauaaauuucugcguggugaacgggcauaguuuaaacuggucgauuguuaguagaagaagcauucaacgagcgggaaccagauugcaccgaagaggguuagauaaagaaggaaacguggcuaauuucguugaaaccgagcaaauagucgaauaccaaggcgaccgggcgaguuucgugcaaauacgagggagcauuccccuguuuuggcaacaagaucccgacuugagauacaaaccgccgccuacucuacucgaugucgauccgcaagaucagcacucgaugugucugaagcacaugaacgauuugaugacuuucuacggaaagaucgucugcgugaaucuaguggaucaaaaaggagcugaaggaaacauggaagucgcauuuaagaacgccauuaccaacguaucgucuccaucggugaaguacgaaucguucgauuuccacgccgagugcagcaaaaugcgaugggacagacugucgauucucaucgaucgauuggcgcacgaucaagacgaaaugaguuucuucuuauugcuaagagacggcucguugaguucguugcaggacgguguauucagaacgaacugcaucgauugcuuggaccgcacaaacgucgugcaaagcaugcuggcccaucggaaucucgaaagcgugcucagaaaauugcagauccuccaucagaaucaaacguuggaguuccaguauucguucgagguguuguucaagaacguuugggcggacaaugcggauauaaucaguacccaauauucggguaccggcgcuuugaagacggauuucacgaggaccgggaaacguacgcgcuacggauugcuucaggacgguaugaauucccugacgagguacuacaagaauaauuucgcggacgggcuccggcaggacggcaucgaucuguuuuuaggcaacgguaaacccguuucgccuuugcauauugauaagggauggaaauacgugacuuauccgucgauucuauugauagcuguggcuauguucguagcuugugcuguaacucccuccgaguacucgacggauuccuugcuguuucucuuguucugggguuccauggucuaugcaacuuugcacacuauuuugaaguacgguucggaguuuguagauaaaccuaggcucacucauucuuaa

SEQ ID NO: 6321 - RNA, 1506 nt, Phyllotreta striolata
augccuccuacgauccaacagaauaaucagaacgcagcaaaugggguggaaaaaagacaaguuaagacugucgagaaaagguccgauuuauuauguaaaguaaaauauugcaacacacugcccgauauaccguucgauuugaaguuuauaacguacccuuucgaaucuauuagauucauccaguauaaucccacauccuuggagcguaauuacaaauacgaaguauuaacugaacacgacuuaggcguaagcauagaccuuauuaacaaagauauauacgcaaucggagcgggcgccuccuuggauccggccgaugagaaacuccuagaagaagacauccucaccccgcaagacuccaagaggucccgucaccaugccaaguccgucucguggcuucgacgaaccgaauacaucuccacggaacagaccagauuccagccccaaaccauggacaaagucgaagcuaaagugggcuacagcaucaagaaaucccugaacaacgagacccuuuacauggacagagauucgcagaucaaggccaucgagaaaacguucgaagacaccaagacgaucaucgauaagcauuacagcaagcccaacgugguccccguggacguccugccgguuuauccagauuucaguuuguggaaauauccuugugcgcagguuaucuucgauucagauccggcuccagugggcaaacaaguacccgcccaaaucgaggagaugucucaagcuaugaucagagguguaauggacgaaagcggugagcaauucguggccuacuuccuucccaccgaggaaacacuccagaaacgcagggaagacgucgcgaaccaaguccaauaucaagacgaagaggaauacgaauacaaaauggccagagaguacaauuggaacguuaaaagcaaggcgagcaaaggcuacgaggagaauuauuucuuuguuguacgaucgagugguauuuauuacaacgaauuagaaacccggguuagguugagcaagcgaaggcagaaaguaggccaacccccgagcaauacgaggcuuaucguuaaacauaggccuauggaugcgaacgaauucagaaugcaaagguacagagaaaagcaacuggagccuacaggcgaggaugacgaagagauggaaauggacgagccucaagacgaggaaaacgugcuugagccggauaacgaaagucgcgacaaagaaaccgagagcgacaacgagaagaaacgauccagagcuuccucagugucuucccaaaggagaucgagauccaggucgcauucgucggcuaaaucaaauuccaggucgaguucaaggucguugucgaaguccaggucucguucgagaucgaagucgucgucgagaucucgguccaggacgccgucgaagucucccacuaggucuagguccgcgucaaaguccccuucuaggucuagaucgccgucgagcgccagauccaagucggcuuccaguucuggcucgaauuccgaaagcgaguga

SEQ ID NO: 6322 - RNA, 1170 nt, Phyllotreta striolata
augccgauugaaaauuuggaagaucaagguuuagaaaagaacccagaccuagagcugccucacuacaaguuucuccuaacgcucccggaauaccgcagcgaccggaauguccauucgaagaucacagaggccaucaagaaggaugauauggccccaugguaugagcuccuuugcaaagaaguaggcuggaaguuagacgcggccuugcugaagacccucaaagccaagaacgccgaaaaggucaagcuucuggacgaggccaucgaagaugcggagaagaacuugggagagauggaggugcgggaggcuuauuugcguaaagcggaguuuuacagcagaaucggcgacaaagagaacgccgugagcacuuucaggcagaccuacgauaaaacagugucuuugggccaccguuuggacaucauuuuccacuuaaucagaauaggcuuguucuucauggaccacgaccuuaucacgaggaacaucgacaaagcgaagacccuuaucgaagaaggaggcgauugggaccggaggaaccgauuaaaagucuaccaaggugcuuacugcaugucggugagagacuucaaaacugccgcuaaccuauuuuuggacaccgugagcaccuucaccuccuacgagcucauggacuacaaggcuuuugucagauacgccgucuacaccuccauaaucagccugccgcggaaccaacuuagagauaaaguaauaaagggcucggagauacuggagguccuucauuccgagccguucguuaaagacuaccuguucucguuguacaacugccaguacgccgaguucuucucgaauuuggcagaggucgagacgauccugaggaaggacuacuucaugaauccccauuaccgguauuacgucagggaaaugaagauuucggccuacacgcagcugcuggaguccuaucgaucgcucacguugcaauacauggcggaagcuuucgggguuaccaucgaguacaucgauaaggaguugucgacuuucaucgccgcuggaaggcugcauugcaaaaucgaucggguuggaggcaucguggagacuaacaggccggauuugaagaaugcccaguucaauuccgucgugaaacaaggggauuuguugcuuaaucgaguucagaaacucuccagaguuauuaauauuuag

SEQ ID NO: 6323 - RNA, 5958 nt, Phyllotreta striolata
auggaggaauuaaccucggguuuggaucccgacgauuugauggaucuggacgagcccgaaggcuccgauuuggacgaggacgacgacgaucucaucgacgaucacgucucgucgccuuucaucucguccucggccccggaguccacagccaacuccgucgccucuucaccgauccaugaagacuucccuccgcccuucaauuucaccgggaaaccucugcacguuaaacgcggaagaggcaggccccgaagagaaggaggaaagccuucggcgccgagaacgacuagaggcgguggaacuggaguaucgagaguacguaggccgaggccuccggguuuuucgagaagaggaucgcuagggggaaguaggagcguuagacaaguggauagaucggauuacgagaugucacuuuucgccggcucgccgguggacgacgguuuguuggaucccgaaaccggaucgaugaucuuucccgagaaguuugugcccgcgaucgaggagccuccguacuuuccggaacauuggccggggaaaguuugugccuuguguaauuuaggcgaaaggagccaguuagggcaaggugaaaugcugagauugaauugucccgaaggguucuccccggagaaaguuauuagcgaacaaauauuagaaagggcuuugcaggcuccggauaaggaaugcggggauaagaguccgaaagggccugugacguguagaaggcaaaagaguuucaacaaaugcagacauccuucgauaaccagugaauacguugaugaguuaacuauaaucggauauaaugaaguaccugauguaucuaguuuguucgaaccaaacggacaguuuuacgugcaccgcaauugcgcguuguggucuaacgguguaacgaaagcagaaaauucggcuuuguugaacgucgggccgguaguuucgcaaaguucuuccaaaaaauguuccuucuguaaccauuacggugccagccugaccugugacgucgacaaauguaccaaaacguaucacuuuccuugcgcuacugcugccggugccuuucaggauguuucgucguuaacgacuuugugcaacgaccauuacgggcaaguggccaugcucacugacgcaucuccguguuugacuugcgcgucgaugggagauauugcgaauuugauguuuuguucggguugcggcgcgcauuaucacgggauuugcgugggauuagcucaguugccgggcguaagauccgguuggcaguguaggaaaugccguuguugccaagucugucgaguagucggagacgagucuaagcugaugacuugcgaacaaugcgauaagauuuaccacgcuaguugucaaagaccuauagugacuucgauaccgaaauacgguuggaaguguagauguuguagagugugcggcgauugcggggcucgaacgcccggagccgguuugucuucgagauggcacgcucacuauacggugugcgauucgugcuaccaacaaaggaacaaaggguuuucuuguccuguaugccauaaggcuuaccgcgcucacgcucacagagaaauggugcaguguucgaguugcaagaaguucguucacggaacgugcgaucccgaggcggacguuguuaccuacagccaaaagaaggaaauaagcguggaguacgaauacguuugcuugcauugcaaaaauagcacggcuagacaaauaacagcgaaacgagcgaguaucgaugauccuuccgacguaucagcuucacacgauucccuauacgacgauacaucggaauucgaucuuccaucgcccgacgaguucgccagaaacauggguuugggcaaagggaaaccguacagcgcgaauaaaauagccaagaaacgccucaguuucaccguaaaucccgucggcaggccgaaaggcaccggaaaagucccgcccggcaaaaugggcuacaugaagagguaccgacuaacggaguucaacagaaagcgcggccccaaagccaaaaugcgaggcaucuucggcgugcccggcgucggccugcaacggcccauuuccgacgguaaaaccgacgaagagccgggcgucgaaaaccgauuggucuugugcucggccaaagacaaauucacuuugacccaagacaucugcgucaugugcggagcguucggaaccgaucaagagggaugucugaucaguugcguacaaugcggacaauguuaccaucccuauugcauuaacguuaaagucacuaaagugauuuuacagaaaggauggagaugccuggacuguacggugugcgaagguugcggccaacgcaacgacgagggccgccugauccucugcgacgacugcgacguguccuuucacaucuacugcauggacccgccgcucgacuacgugccgcacggcaacuggaagugcaaauggugcgccgucugccauucgugcggcgccaccgaucccggcuucaauugcacguggaugaacagcucgacgcagugcggcccgugcgcgucgcacgucaacugcgccggcugcaacgagccguacgccgagggcgaucugaucauccagugcguccagugcgaccggugguugcacggcgccugcgauucgaucaagugcgaagaggacgccgagaagugcgccgaggacgguuacaauugcguguugugccggcccagggacgugccgccgccgcauuuggcgccggcggcggcggcgccgaagccgccgacgccgacgaagagucccgaguuggggaagagcaccagcuacuacauggacggcgucugucugagcgaguucgguagcaauuugaucaaaucguuggcgcucgaguaccacgggucgcggaagaaacggaagaagauacccaccgugcaggauaaggaagccgguauuauggcuacgaucgaaucggucguugccggcgguaacguuauuccuacuaauauggaagacagcgcgaaauuggagcuggucgacaucaaagacgaaccacaagaguuguacaaggaaggcaugauguggacgaaagaggacgggccgccucccgaagguuucacgaucaucacgauggagaacgguuugaacgugcugcgaaggaagaggcagcggaaccugcagaagcucggcaucggcggguucgucgucaggaugagagguaucaggacgggucaggauaacgacgauguggauucgacuguaggucaaagcgggcucaauccuaaugauaucgucccgucuccagcggacggggauaaacccagaaggaaagccauccggaggaagccgaagaguaaauuggccgaaacguuuccggccuaucuccaggaggcuuucuucggaaaggaccuuauggauacggucgauuguaagaaggaagaagucgauuguuauagcagcgaugacgagaaaacugacaagcauuauaaauccauuaauuugucucaagaugaaauuauagcgauuguggcaucggguaaaaccgaaaaguuggaaaacgauaacaaagauucgaccaaagaauucgguucgaaccaaccgaagaaucccuucaaaccaacgguauugaaggaagaggaagaagauaauccggaggauuugaaagacguucucgccuuaccaggagauuugcucgauaccgauuugguuaacaguauuauggaggacgaggaggaacugagcaaaacuacggcuucucucgucgcucuagauucgaauuuacaacacgacgcggagcugacggauacguugagcaguucggggaauucgaaagaaaccaaagacgaauugagcgauauuuuagggccgcauuucaaccucgauuccauaucgaacauaaacagcaaagacgucgaagauauauuuaagggcguacuaacggacgagucucaggaaucccaagaaaguaguaacuucaccuuacaaggaaauaguauguucucgaauaacaacucccagcaaaacguagcacaacaucccauuaucaaucaaccgguuagaccgaaaacguugccuacggucaaucacaauuugaacucgccugucggguuuccaccaccaucgccuuaucacucggaauacagcaacaguccucaauucaguccggcuuucgccgaaucgucguguucgugggugagcggaagcgacgcgccggaaaucgacaguaccaacgugacggugacgucgacguacaaccagcgaucguccgauaagaugaaggcggacgagaguuugggcaagagcgcgacgauuucggccguuuuguacgcgaacaucaaccaucccgaauggaagaaggaguacccgaauuggcccgauagguacaagcaaauaauaaaaaaauggagaacguugagccaagagcaaaaagcgccguuuuugcagcacgcgagagauaacaggagccaauugaggaugaagaaagcucagcagucacagaccgucaaggaaacagccaccucuaccggcacgucccccaacgcgagcaagccucuucaccaagccgguccagccuuagcgacaacccuccaggcggcggcgcaacagccggcugcggugguacccgcggcggcggcggcggcggcgccaccggcggcagcggccgccgcggcgccccuuucagaggaccaagagaaaaucgcgcugcagcaaaaauccgccagggaggccgaacaggagcgacaauggaagcaacugcaggcccucaggcagcagcagacccaacaaacgcagaacauccugcacgaacagcgcguccaagccaucgcccgcguacaacgccagauauccgccgauccggcgcagcaguucaucaacgagcaacagggcgccaugcaggcgaacgcgccgcaggaaucgagcccgucgacgacgccggcgcccggcccgcggcaauuccucggcaucaaaucccccacguuccccgucccgccggccggcgucagggccaacgcgcccucgcaaucgccccaugacgucgcccaaccgcccacgcccgaugguaacgaucacuuuauccacucucccacgaauccuaaaccuaauuucccgccuagauugcccaacgauccguucgccgcgcaacccgccgcgccgcgacccccguucggaauggcccggccgcccuugcagaauuucggugguaccguucgcaacgagcagcaggacaucaacaucaaucgccagcugagggagcuguugcagcggcagcaggucaagaagcuggacgaguuguugccgggcaaagcgccgccgccgccgccgcagagguuguggcacgcgaacgaucagcaggagggcggcggcgacgccucgaugacuucgggcggcgcccagggcgccgacgccaccuuucggcaaccucugccgccgggcguggucaaaccuagguuggccaucgcggccguuaacaggccgauauugaacgccguuagagugaaucaauuggaucccaggauucagaauuuggauccgaggaugagguugauuuugcaacaucagcaacaaagacuagcgacgggcauucaacagcaauucauccguuucacgucgaacgugcgaccgacgacgguggagcaguacgagcaacuguugcagcgucagggcaacaaucagaaucaaaugcacgccgaggaccagcagcagggcgucgcgcgaaugcccguagcccaaucgggcgucgugcaaagaccgcacgucgcccaggcgucggugacgggcgccgucgcgacggcuucuacggagagcaaucccagcgaggaagguauccccgauaacgugacugcggaauuggaaaaacuggaacaggaaaccggcacuaugguggagcuucaaggcgucagcgacauuuugggcgguuuggacgacgacgacgagcuucuggccgaaaugggcgccgauuucaacauacucgaauacgccgaucccgaauuggaggcccugacgggcggcaaaacgaac

SEQ ID NO: 6324 - RNA, 4452 nt, Phyllotreta striolata
auggaagauucuccucuggaaggaaggaguagcaagagaaguaagacauucaaagcuaaggcuucggaaaaguucaagcaguucaagagaggcgugaaaaauaaguaugaggugggcgaaguggaaaauguguacgaaguugucgaggaaaagcaguauauuaaagaaguuaugucuagaugugaugaugauuggauuguuggugauuccaguggguauaucgaagacgguagagauauauuugaugaugacuuggacguggaauccauagcucaagcuucgacuaaaggcaaagguguuaaaagaaaacacaagaacguaucggaaaaugcugguaagggaaaauugcagcaaauguucucaaccaugccagcuaaacagaaaacggcagcuaaagucgaugaugacgaaaugcuaucggaaaucuugggcgaaaucgguacuggcacagcaaauaagccuacugucgagaaaccuaaaauagaccaguacucuacacuagcgauuaacauaucagcuaagaauuacaugaaaaauuuaucgcaacccguuaaaaaacgagcuguugagaaaaagguacagaaaauacaacccaguguacccaaacgauuugaaaauuuaaaagaaaaacuacccgaaccaguuaaaauucaagcuaaagaaaaugagaagauuaauccugauaaagucaucgaaaaggaaacaauggaucuugauaaaaacaccgaagaagaaaagcuagaucuugauacaucacacuuugaugaugguuuagaugaaacauuacuugaagaauucaacgaagaucuaaauaacaccgccagugaaucccaaauaacagaaucggaaaugaucggagacgauuucgcaggcgauuucgauacaacacaaauagacgaaaucgaagaacaaauuaaccuugcuagcgaacaacuaaucaacgauauucaagcggaagucgagacugaauggcaauauuucaacaacgccaacgaaagcuucaaaauagcgacggguuccgaagacgcugaaucuucuucagcaauuccgguugauacuccguuugugaaagucgacgggaaaaauguguuuagguucuucuggugggacgccuacguggauccgcaacaccaacaaggaaccgucuuccucuucggcaaaaccuacugcgaaaccuccaagaaauacgaaaguugcugcguagccguaaagaacauagaaagaacgcuauuuguuuuacccaggccuuuugaacuagaugagaacgguaaacccaccgauaaaccgguuacauucaaaacaguccacgaugaauucaacaaucguauauuaaagcgaacaggcauuacaucuuucaaaucgagauugaucacgaaaaaauacgccuucgacgcgaacauaccggccgaaucggaauauuuagaagucagauaccccgcgucauuuccgcggauccuuugcaacgaagaccgccaacacgacgacgacgaauccaccgacaacgacgaucucggcuacagcacuuucucgaagauauucggcaucaaaacgaacuucuuggagucccuuuuccucgaacguaagaucaaagggcccuguuggaucgacguguccgaucccgaaacggccgccaauccgaugaguuucugcaaguucgaagugaacugccugaagcccaacaaccugaaaaucaccccguucgagaaaccaguuccaccgccaccccucguagucgccaccauaaacaugaggaacugcaucaaucgagcaucuuccaaccacgaaaucgucauguuaucuugcuuggugcaaaaucgguacgcuguaaacaaaccgccuccggaacccgcuuuucaacaccacuuuugcguauuuagcugcccgggaggacaagucuugccccucaacuuguacgauacucuacaaaacuacaagauaacgaaagugcugaaaaccgacaacgaaaaggccaugcugaauugcuucaucaacaacaucgugcaaaucgacccggaucuaauaguaggccacaaccugcaaggauaccaaaccgccaucuuagcagacagauugcugaaauugaacugccgcgcuuucaacaggcugggcaggcugaagaaaagggcgacgcaagccaagcaauuggagagaacuuuguucuugggucgguugguuugcgacauaaaaauaucggcgaaagagcugaucaaauccagaucguacgauuuggacacgcucugucaggucguguugaaguugaaggagaaccagcgggucgaucuggagcccgaggauguguucaagauguucaaaacgucgcaggauuugaucaaguugauaucguucaccaugcaagauucgggcuauauuaugaaaaugauguacaaucugaacaucguaccgcuggcuuugcaaauuacgaauauagcggguaacgugauguccaggacuuugaugggaggaagaucggagaggaacgaguuccugcuguugcacgcuuuccacgagaaaggguauauucuaccugauaaaguuuauaggaguaaugaaaacgaaucgaaagggaguucuaagaagaaaccuacuuacuccggagguuugguauuggagccgaaaguaggcuucuacgacaagcugauacuccugauggauuucaauucuuuauaccccagcauaauccaagaauacaacauuugcuucaccacgcuccccguaauggacuccgacgaaaauuuaguacugcccgacaguaaucuaccggccgguauacuccccacggaaauucgaaaacuggucgaaagccgucgccaggugaaaucccuaaugaaaaaaccggacaucuccaaagaacugaaauugcaauacgacauccgccagauggcguugaaauuaaccgcuaacucgauguacgguugcuugggcuucggacauuccagauucuacgcgagaaaucuagccgccuugaucacccaaaagggccgagagauccucgucaauaccaaagauuugaucgaaaagaugugccuggacgucgucuacggcgauacugacagucuuaugaucaacacuaacguuuuagauuacgaucaaguauuuaaaguaggaguuaaaaucaaacaagaagugaacaaauuguacaagcaagucgagcucgacaucgacggcgucuucaaguaccuguugcuguugaaaaagaagaaauacgccgcgguuacgcucaccaaaaguuuauccggcgaauugguagccaccaaagaguacaagggauuggacauagugcgcagggacuggucgcaauuguccucggaaaccggcaaauugguccucgaacaccuccucagcgaccagucuucggacgaaaaaaucaaaaacaucuacgaucacuuggcuacgaucaaaucggaccugaucgaagggaagauaccgauaccuuuguuggugaucacgaagcagcugaacaaggcgccucacauguacaccgacaagaacuccaugccgcacguccagguggcgcugcgcuacaaccagaagagccgcgaucacuucagaaugggcgauacaguaccauauguaaucugcaccgauaacaccggcaacggccccaugcagcgcgccuaucacuuggacgaauugaagggcaauccggaccugaaaaucgacuacgacuauuaccuggagcagcagauucauccggugaucgcgaggauuugcgaaccuaucgaggguuuggaugcuuaccaguuggcggaauguuugggggcgaauuugaagcgagugaagaggccuaagccucaaggggguaacgagaacauucaaggagagaacgucguuaaagccgaagugaaauucaagaacgcugagaaauuuacguuuguuuguuacauuuguaaacaccagaaugucaucagcgagccauugaugaacaacaucccuuuccuggagacuugucaaaaccccgaaugccaaucgaagccgaucgauuaccuaccgagcguucaaaaucaacucuaccggucgauccguucgcacauaacuaaauacuacaagaaaguguugacgugcgaagacccgaguugcccgaacgcccccagacggcugccguugaaguuccugaagaaacgucccgugugcaacaugugcugcaacgcuguaauguacaagguuuacacugaauuccacuuguacaaccagcuggccuacuaucgguacauguucgauuugagcaaacucaaacauaagccucugauggauggugagaccgagucggguuaucggacgcuucaagauacuguggauaaguucaugaaucaaucggaguacucgcuuauuaaucugagugagguguucggccagcucgguugguccggggcgagugaaaagguuacuguagaacagccgaguaaugguguacauuuuaacgaagaaggcaucgaggacgccuaugaugaauga

SEQ ID NO: 6325 - RNA, 1398 nt, Phyllotreta striolata
auggcggcugcugcagcggcaaaaauugccgaaguacgcgagacaacccgcguagaaagaauuggagcccauucucacauucgaggccuaggauuagacgacagccuugaagcuagacaugugucucaagguauggucgggcaagucucagcuagaagagcaguuggcauaguucugcaaaugguacgcgaugguagaaucgcaggaagagcuguuuuauuagccggacagccugguacuggaaagacugcuauagcaacugcuuuagcucaugcuuuaggacaagauacgccauucacuaguauggcuggaucagagauauauucauuagagaugaguaaaacugaagcauugacgcaagcuauuagaaagaguauuggagucaggauaaaggaagagagugaaauuauugaaggugaaguugucgaucugagcauugaacguccagcaacaggaguugguacuaaaguggguaaauugauucucaaaacuacagauauggagacuguguaugauuugggcgggaaaaugaucgauaguauucugaaagagaaaguucagucuggugauguuauaaccauagauaaagcuacaggaaaaauuacgagauugggucgaucuuucgcuagagcuagagauuaugaugcuacuggucaacaaacgagguucguucaaugucccgaaggugaacugcaaaagcgcaaagaaguuguccacaccgugacuuugcaugaaauugauguaauuaacagucgcacccauggauucuuggcacuguuuucaggugauacgggagaaauuaaaccagaaguaagagagcagauuaauggcaaaguagcugaauggcgugaagaaggaaaggcugaaauuauuccugguguacuguuuauugaugagguucacauguuggauauagaaugcuucuccuuuuuaaacagagccuuagaaaaugaaaugucuccaauugucauaauggccaccaauagaggaaucacaaaaauucgagguacuacuuacaaaucuccacacggcauaccauuggacuugcuggaucgaacaauuaucguuccuacucagccauacgacgaaaaggaauugaaagagauauugaauauucggugugaagaagaggacugucagaugucugauaaugcuuuggugguucuaacgagaaucuguaaggagacuucccugcguuacggcaugcagcucauuaugacaucgaguuuaaucgcuagaaagcguaaagcccacgaagucgauguagaggacauaaaacgagccuaucaauuauucuuugaugaaggucgcucugugcaauuucucaaggaauaccaacaagaauuuauguuuaacgaaauugaugagaaagaugauauggaaauggaaacgauuuaa

SEQ ID NO: 6326 - RNA, 1116 nt, Phyllotreta striolata
augacguugagaacuuacggagauaaaccgaucaguuuccaguuggaagaaaauggagaguacuacuguguuggaucugaggugggaaauuaucuucgccucuuuagaggaucccuguacaaaaaauauccuggaauguucaggagguccauaaccaaugaagaaagacgaagguugauugaacucgguuugagccagcauguucuagccaguagcguaucauugcuuagagcagaagaaguugaagauauaauugaaggaaaugaugaaaaguauaaagcuguaucuguacacacuuccgaaccuccuaugccaagagagggaaaauccaagaaaaacaugcaguggguaccuucguuacccaauuccagucacuuagaugccguuccacaagcuacaucuauuaauagaaacagaguagcugcuaaaaaggugagaacauuuccacuauguuuugaugacaccgauccccaaauaaacauagaaaaugcuugucaacaagaacugcuaguuccuauuagacucgacauggaaaucgaaggacagaagcucagagauacauuuacuuggaauaaaaacgagaguuuaauaacgccggaacaauuugcugaaguccucugcgacgaucuugauuuaaauccuuuaacauuuguaccagcgauugcucaagcgauuagacagcaacucgaugcauuccccacggaaccuccuaguauuauagaggaaaccugcgaucaaagagucauuauuaaguuaaacauucacgugggaaauacaucuuuagucgaucaagucgaaugggauaugagcgaaaagcaaaauaaucccgaagaauuugcguugaaacuuugcgcagaauugggucuugguggugaauuugucacugcgauugcuuauucuauuagaggucagcucucuuggcaccagaggacuuaugcuuucagugaagcaccucuuccgacuguagagguaccauucagaaaucccagugaaucggaucagugggcuccguuuuuggaaaccuugacugacgcggaaauggagaagaaaauucgcgaccaagacaggaauacucguagaauuagaagauuggcuaacacuacgccggguugguag

SEQ ID NO: 6327 - RNA, 579 nt, Phyllotreta striolata
auggcugcaauaagaaaaaaauuagugaucgucggcgacggagccugcgguaaaacgugucuucuaauaguauuuaguaaagaucaauucccggaaguguacgugcccaccguauucgaaaauuauguggcggacaucgagguggaugguaagcaaguggaacucgccuuaugggauaccgcaggccaagaagacuacgaucgccugcguccccuuucauauccagacaccgacgugauuuuaauguguuucucggucgauucgccggauuccuuagaaaacaucccggaaaaguggacgccggagguaaaacauuuuuguccgaaugugccaauuauccugguaggcaauaaaaaggaucugcguaacgauccgacuaccauuaaugaacuuaaaaaaaugaagcaagagccugucaagccgcaagacggucgaucuauggcugaaaaaauaaacgccuuugcguauuuagaauguucggcuaaaaguaaggagggcgucagagaaguauucgagaaugccacccgugcugcacugcaagucaaaaagaagaagaagcaucguugcguaauguuuuga

SEQ ID NO: 6328 - RNA, 4014 nt, Phyllotreta striolata
augaauacauccacuuuuaauccgagaauggaugccgcucaaaauccggcgcaaaaaauggaauuggcguccaggaacguggaaaauucguugcuaaucgacaacaaugcuccgagauugaucgauuuuaugaauauuaauccgcaaagcggcuccaccgccagcggcuuugcagaccaugauuauccaacuuuaaguggauuaucucacauuaucaacaguaugacccaaaucaagugcguuagcaacguuccuauaccuucggaaauugucgaccacuucgcccgugugcaaugccacuguaugauggguuuauuuuccgaaauaaacagagcuugguuaacugucgauagugauauuuacguuuggacuuacgaggaaaauaccgacuuggcuuauuucgaugggauaagcgaaacgaucguuugugugggcuuagugaaaccuaaagcaggaguuuuucacgcuuuuauaaaauaccuccugauuuuagcgacauccguugauauuguuguauuagggguuacuuucacugaacgacccggagacaacgcugaugaaauucaacucauaccugauccuguauucauuuuaccuaccgaugguuccaccgucacgauaaucaacaguaccgaugaugguaggauuuuuuacggcacaaaagaagggaauuuauucgaaauugcauaucaagcugaaagugguugguucggcaagagaugcaaaaaaauuaauuuauccaccagcacuuugucauuucugguucccucguuuauuaaugcagcguugagcgaagaggaugggauaacgcaaauuucaauugacgauagcagacauauucucuauauucucacugaaaaaggauccauagaaguuugcgaucuaggagagaaagggaauucguuuuccagaauuaguaaaaugucucaaagcacguugguuaaccaagcgaugaauacuguuaaaacccucgacaguaaaaauuuucgaccgaucgugagcauauccgccaucgaaacaucagaaucgguuaauuugaauuugguagccguaucucaaacgggaguacgauuuuauaugacuguuacgaguuuaucaaaccaaaauccuaaucaaagaccguauacgcuaacccuagcucacguaagacuuccacccgguuauucagcuaacauuaccguaagacccagggcgguacaugugucacaguauagggacagaaacuugguuuuaauaucuacuguuaacgaaaaagauguguuauggugcaugagcucagacuuauuuccuuucgggcaaggacugacagaagcuuacacggcuauuaauuuagauggacccgcucuagcuauuucugaggcaaggagcgcuaguccucuucaaauaaaggauguacaugaagcgcccccuuuagucguacggcaacacgcugaaccgcccaaaaaguacauugugcucacaucgcauagcauucagaucuucauuaaguuaagaccaguagauguguugaagcaaauuuugaaagacagccacgggcaagacaccgaagcuuugaaagccuucuuuacuauucaaaaggaggaucaagcgugcgcuaccgcuuugauauuggcuucauuggagaacgaagauaacauggaaauagccgaguuugcgaccagagcuuucuucuuguucggaggcgaaccgaaauuagcugcuccuaugaauacuuuuucggggccgucaguguuuugcccacccgucaugucuacuccgaauauacaccaauaucaacagcagcagcaauaucaaacuucaccgcaauaccagcccaacuuuccgcauggcaucucgccugcugcgaaugcauacgaauugaccagccccuucguuuuuucaccuaagcacaacgggcucuauuuguauuuaagcagaauauugcgaccuauuuggcaucgaaggacaguggauaaacuuugcuuagauggaaaaauugucacaaaucacaguacggugaccagcgaagacugcauauuuaucuugaacuacgugacgucccugcauaauuuccugaugcguaauacucagcuuucgucguugagcgccgcucccggucacaauacucaaaacuucaauaauaccacgaugaacgugacuagauugaaccauaccauucaagacguccaguuggaggaaagagcgucucuggaugcuuugaaaacguuuguuugccacuguugucaaauauuagguuuauggagaauucuuugugaacaucaauuccacacguuaauagcaucuuuaccugaaacugagcagcagauauugcaaaauacgaccuucaaagaucuacuuuuauacagacacgauaucuguacguuguuaauagcuacauuaguggauaguuauuuaggcgauaacgccucgguggauucgauuagcagcaaauugagagaagucuguccgcuguuuuauaaaaccgaagaugcggcauuuucaaaagccguggaaauauuaaagaugacgcgggcgauucaaaacaacgacgaaaaggaggagaugauccaaucggcccugcagauuugcaaaucaaucgggcccacuaucaauaucaccgauauaugcaaggaauucgcuaaucucaaagcguacaaagcuguuacggaauugugcgcgcauuucgguaagaaaauagaucccgauaaaauagcggagaguuacuauaacgccgaagauaacagcggugaccaagagggguacaauuauuaucaaagacgguuggaaauuuaccgucacauauugaacauguuggaucaauuauacaacgaacaaaaucaaacgcaagucauuaguagagauuccgcguacucgguuaaucagaccauauugcucgauggugucgaacaaucccaaguaggauacgugaugaagcaaguaauaaaagacgucauggaaacgcccgacgaaaucaugcauuucgcacuuuacgauuggcugguguucaaaaauaugacuggagauuugauaaacauccaaaaucccucgcuggaaacauauuugaagcgaacguccacccagaaucccaacaacaucgagaccaugaauuugcuguggaaauacuacgaaaguugcaacaaucacgcggcugcugcgaaaauauugaacaaccucgccucgagaacugguacaaacguuccguugaaagagagacugucuuaccuagcgagggcuaucaugugcaugcgaagcgauaaaaucgguuacgcgcccuaucuggguguauuuuugagagaucuugaagauaaaauggagguagcgaaggugcaggagcaaauuuuggaugcuaucguaaauuugcaaggacaaauaccuaacgcucaggaagcaauaagugcacuuaauuccggauuguucgaaauuucucaguuguaugaaaauuucgcugagccuuucaaacuguuagaaugccaauuggcaaucauagaaugcgccggauacaccgaucaaguauugaucgaguccauuuggcagcaaauuuugacugaagaacugaggaagaccuacggaacagggacagauaaagucugucagcuuuugaacaaagugaagcagcucucgaagcaauacgcucaaucugcaaacuguuuucccuugaguuacauuguuuaugaauuggaaaucgugaacgcaaaacuucgaggagacaaacaacucguuccuugugccuuggaaaguaugaauauuccuuucgaaaauuuaaucaacguuuacaauaguuuaaauacgauuuccauaaacgaucacuuuuggcaauuagaggagaacgaauuucaucuuucugaagcuacugcugcguuaauaaauugcuuccugggccaucuugaacaguacagcaguguugagaaacgaaaaauaacuucgcucugucaagacgcagugguugcuuuauuauccaacuuguauagcaagcccaacaccgagguauugguuaauaaguugagaaauauacaagccaaguugucgagaauuuag

SEQ ID NO: 6329 - RNA, 4143 nt, Phyllotreta striolata
augagcgaauucacuuugggcuacagagaagugacuccggaacaaauagauuaugaaaauuggaaagaaauaacccuuacuacaggaggaacgcaaaguacucuucaagauauaaaaguagccgagagagccaauggauacuguuacaaagacuccacuaaacacugcacgaggaauagauuuaucuacuggaggaucaaucacaacguauuagaauuagucgagcauaguuuagauauaaaucuuacaggaaaucggaucagauacaaguuugauacuccgauuuuagacgguguuucgauacacgagauacucgauaauguuguuauuuuagucccuacagucugcaguguacacagacugauauuuccccauccaaauauauuccacgcacaggacgacuuacuggggauauauccggauuuaacagcuguaucgauauuuucgaaagcaucgaucgucgauaccagaaacccgaacagcuuuuacguuuucaacaaucccagcacugccaaugaucaauuaccgaaccuagccaauucguacuuuguaccggaaaccggugaagccuacuucguuuuggccuuuccuucgacugaacuuuuacugaucaggcaaagucccgaucaagucacuuguguggaacucaaaggggaaucccugguucccagauuuuucgccgguauagcagacaaauucaggcaaaggaauucggauagcgaaaauauuguuaguuugcuauuuuacgauuuggacgaagaaaccuacguguuaucccuaacgcaagaugcccaucugaaauguugguccugcaguaaaggccaaugcguagcaguaauagauguucgcgaaaaaauaucaaccaacuugaaauacagaguucaaucagcaauucuaaagaaagccgaagauggaaacagcucggauaauauucugguucuauuccugaguuucggaaauaaaugccaguuccauauuuuaaaacccuccauucgagaacaagaaaucucucugcauagauuggcugcucucgaaucgccauugaacgauuugauagacuucgcagcgcaauuagacugcuuguggucaguauggcgaucggacgugggcgaaacacugguguacaaggcaucguucaaauccaaccaauggacucaagucauacuggaacccgaaccgugcgaaaaacaguucccuaucaaauucaacgaugucaagaccauguacuuacagcacauuuuccacccgggcagguucccccugcacguuaucaacaaaacccuuucgauuuauaaaaugccuacgaucgccucggacucgcaucuuuccaucucggcgcuaaaacaaagaguaugcauggccguggaaaacgacauacaaaaucuguucaacagagacgggacugauauuaacagcguugaagucgaugaauacauagaaugcgccgaguggugcuggcagaaauucgacucccgcugcguacaauaccagauagccagcaggaaaccgcuggguuugaugcuccugccguccgucucgggcgccaugcuguugaagaaaucggcguuuucguuccugcggcccgucgauucgcucgaacacaugacguugugcaccgauuuguacagggagcaguucuucaauuuuuccauguuggccgacgauuuggacgcuguggaugaugucauaaacguguucaaagugaucguguacaucgaacaacaauugaaagacgauuucaugcaaucguucgaaaccgaacugcucaaucuccaaucgcccgauguagugauagaagaucuguugaagaaaaucuacgucgaaauggauuccgauuuuuuuucgcauauauugcaucuaaucaaagacgugaacgauuuguacaaagccauacacaaaauccucgaauuguugagauacgaaaacacuuuagcuaaucccgacaacgacaucaacccggccgcuauguacuauuucaauucgcucuuaggcacuucguugguggcccaaaguuuccgacaacaagcagaaaucagauuucaaauuugccgcaaucuguugcuccucugcaacuuccuggugauggacaggacguuaaauuggggcgucuuggaaggcguucgauccguuuguaugccggacauuguuguuuugacccaagccaguuucgucgugcugugguugagcggccugacaauguucgaaagcgacucgauucgcgauuccucgaugagcacacugaacccguuaaaacugacgcccguuuacaaucugcugccguuuacccguugcacguccuuguuggaaguguuuauaucgucgucgggcgugcaggacgccaggaaaucguucgcgagaguuuccugcaaggacgaggccuuggugcgcuggcauuggucucuguugcccuacgugaaucacaucagacaucucauauggcccauaagcgguugcacgguguucgaggaauggcuguuaucgagcggacaacacgugugguugcagcaauauguucgauugcucagcaauuggugcgaauggaaugcuuguacacgaaacuuccucuuggccucgucguuucugaccaccggagaauuuuacaaagccgaagagcucuucgaaaccgcugcgaagggcguuuucacugacgcguuuuugaaaaaccgaaucaaaagcguagacgaaaguaauuccagaaccaccauucauuauuauuuaaaggugauccaacuguucgaguuguguaacgcucgaagucacgugauuaauguggccaauacggcccugugcgucgucaaacgggacgauccuuuagcggcgacguuguuuucgaucaaauucaagcaccacuuggccuugaagcacuaccggcuggccuucgacucguugaauucgaaccccgacggcgaacggcggaaggacaaucucagggauuuggugaagacguugcucgacgagaagaaacucaacguuuuguugaauuucacguacgacagcauggacgaguucuucgcgaacaucguucugaccagagcucgagcggccgacguuacagauaacgcguucuacgauuuucucuacucguaccaaaucaagaaagguccaccuucguuccgauuagccgcuucggcuauguacgagcaagcguuccgauugagccagaagaccaccgucgaagcguuggagaagcaagugaaaugcuauuuggcggccaaaaacguccugcacuugugccccucgcagcacgcuugggucgucaggccggcggaucccgacgaggaagacgaacaagucauuuuccaaccucuggccggcucuaacggagaaauccguacguucaaaaucaagaaacaaaucgaagugguggacaucgaaaccaucggaaaagaacugacguucgccagcgccaaauugaaauugcugcaauucaacccggcgguuuccauuagcguuugcgauccguuggagcuggugauuucgcugaacaacucgggcauguucaaagcggccuucgagauuugcucgaccuucgauuugcccuauuccuugguguucgaggcccucacgaagcgcugcgugaugcucaccgaagccgaggaucccaacgcuuggaacugguugguggagaacgaucugcaagauuuaccggugaauagagagucggcugccgaugugguuuggaaguuccugcaggauuguuuggagaaauacgaagagccuaggaugucguguuugcauaacgucguuugcaagaaaaucaucaacaugcagauuuacuugccucauugguugaaggcuucguauaaggcucgaaauccguccgaguuguugagguuauugcacgccuccgggcgguuggaggaagccguggaauuggcuaaagacuacauuuuaucggcaaugggauacgguaaagaagaauucggauucucgcagccuuuggcuccgacaucgccggccuuuugucuucccguuuacgccauucaaaggcucgucgacgaauuggacguacaaaauucaaugaacguagaaaagccuuacacucacgaguacgaugauuugaagguguuguuuuccaaguaucucgaaacggcgauuagaguuuccaaucagaugugccagguuaaggguagagcuuuuuaa

SEQ ID NO: 6330 - RNA, 2349 nt, Phyllotreta striolata
gaucuucuaguugcgaccauaaaucuaucucaaacccacgcaaacgacguggccgcuuugaaaauaaucuacaguucacuagugcucauuugcaaaguauucuacucguugaacuuccaagauuugccggaauucuuugaagauaacauccaaguguggaugaccaauuuccacacguugcucucagucgaugugaagucauugcaaagccaagaagacagcgaagccgguguuuuagaacaacuaaaaucccaagugugcgauaauguggcucuguacgcucaaaaguacgacgaggaguuccaacccuaccugccacaauucguaacagauguuuggagucuauuagucgcuacgaaucuacaaccaaaauacgauuuguugguuuccaacgcccugcaauuccucucgucgguggccgaacguucgcaguauaggaaccucuucgaggacgauaauguacuaagcagcauuugcgaaaagguuauuauacccaacauggaauucagaacuuccgaugaggaauuguucgaagacaaucccgaagaguacacgagaagggacaucgaagguuccgauaucgacacccgucgacgggccgccugcgauuuggucaacacacucagccagaacuucgagcagaggaucguggagauauucggacgguauuuacaagugaugcuggcgaaguauucggaaaauccgaaggaguuuuggcgcagcaaagacgccgccuuguacuuggugaccucucuagugagcagggguucgacucagaagcauggggucacucaaaccagccaauugguggacauuacucaguucugucagcagcauguuuugcccgaauuggaacgacccgacguuaacgauuugccgguguugaaagcggacgcuauaaaauauguaaugacauucagaucgguacuuccaagcgaucuggucguaucgacuuuaccacaauugaucaggcacaugccgagcgaaaguugugugguacacacguacgcagccugcacguuggagaagauccucauguugaaauccaacaaucaaaccauaguaacgggagcccagcuggagccucuggccucagaauuguugacgaaucuguucgcuguacuccaaaaaccggucuccgaggagaacgaguacaucaugaaggcucugaugaggacguucgcgaccuuacaggaccggaucauacccuauuugaacguggccuugcccaagaugacggaaaagcugcagauggucgccaagaauccaucgaagccgcucuucaaucauuaccuguuugagugcuuuucguuggcuauaaagauuauuugcaaggugaaucccacggcggugacuucguucgaggacauauuguuuccgauauuucaaggaauuuugcagcaagauauacaagaguuuauuccguacguguuccaaauuuugucguuguugauggaacacacgccgcagggcgcucuauccgauccuuacaugcaacuguugcccuguuuauuggcuccgauauugugggaacguccggcgaauaucagcccguuggugagauuguuggccgcguucgcuacgcaggcagccccucaaaucgugcuacaggacaaagugggcggauuuuuggggguguuccagaaguuguuggcaucgaaaucgaacgaucacgaagguuuccggcugaugcaaagccucauucagaaucuaccuaccgaagcucucacgcccuaucacaaacagauauucuuccuguuguuccaacgauugucguccaguaaaacgaccaaauacguuauuaauuugaucguguucuuuugcuuguauauggugaaguauucgcccaacgauuugguggcuuugaucgaugaaauccaagcucagauguuugguaugguucuggagaagcuucuaaucgcggaauugcagaaaaucgccggcgaugucgagaggaaaaucgucgcuuguggcguuacuaaauuacugugcgaaugcccggggauguauacggggucuuaccaaaaauauuggccgcaauuguugcaggcguuauuggcguucuucgagaugcccagagacgagacgacguuccccgaugaucauuucaucgaaguggacgauacgccggccuaucaagcgaccagcgcuaaauugaauuucgccgaugguaccaaaaacgauccccugcaaggugucagcgagccacggcaguuucugguucaaaguuuggccacuuugggcgcuucgcagcccggucgccugccgaccuacauaaacaacaugaacgcccaaucgcagacgauacugcagggcuauuuggccaaguucggaguucaauugguguaa

SEQ ID NO: 6331 - RNA, 600 nt, Phyllotreta striolata
auggcaaaaguacaauuaugcaauaucacaguuauggacaauccuaguccuuucuugaacccauuucaauucgaaaucacguucgagugcauagaggaauuaaaagaagauuuagaauggaagaugauuuacguuggcuccgcugaaacugaagaacacgaucaaauuuuagacuccguauucgucggacccauuccagaagguaaacacauguucgucuuccaggcagauccuccgaacgucucccgcauaccugaaaacgaugccaucggugucacagucguucuacucacuugcuccuauaaaagccaagaguuuauucguguagguuauuuuauaaacaacgaauacagcgauccggagaugagagaaaacuugcccaguccaccucaguucgauaagguaauuagaaauauauuggcguccgaaccgagggugacgagguuuaaaaucaacugggaagaaucgagugguacgcaggaaaacgguacuacaaucgcagaagcacccgccaaccaaacauccgagacugccgcuuccguagaaguaccugcuuucaacgagaauuccaauucgugggccaccauggaguguucauaa

SEQ ID NO: 6332 - RNA, 939 nt, Phyllotreta striolata
auggaucaaaugcuaccgagcccugguuuuaguauaccuaguauagguacaccucuucaucaacccgaggaagaccagcuaauuuuaccgaacgccauacaacaacaacaaagucuaccuacuacuaacucacaagugccuccucuagcuccaaugggagguucuacuccaacgcuuggucuagguuuaggccaugcuaugucuaugccacauacaaaguauguaacuggauuuucacugccuaucaguucuauggcuccucaaacaccacaacauacaaugaugaguccuaugguaaacguugguggaacugguaccacuaguucugguguaaccccuacauugggucccucuacaccuucaccaaugacuccuaugacaccgcauucagcagaucccggaaucguuccacaauuacaaaacaucgucucaacuguaaacuugagcuguaaauuagauuuaaagaaaauugccuugcacgcgagaaaugccgaauacaauccuaagcgauuugcugccgugauuaugaggauaagagaaccgaggacgacggcuuugauauuuucgucggggaaaaugguguguacaggugcgaaaagugaagaagacucgagacuagcggcgagaaaguacgcucgaauuauacaaaaguugggguucccugcgaaguuuuuagauuuuaaaauacagaauauggugggaaguugugauguuaaauuuccgauacgauuggaagguuugguuuuaacucacaguucuuucaguaguuacgagccggaauuguuuccuggucuuauauaucguauggugaaaccaagaauuguucuguuaauauuuguuuccggcaagguuguucugacuggugcuaaaguuagacaggaaauuuacgaagcauuugauaauauuuauccaauuuuaaaaaguuuuaagaagcaauga

SEQ ID NO: 6333 - RNA, 603 nt, Phyllotreta striolata
guuccaugucucgccuguuauuccccagggucagugcugucauuuuugucaguuuugggguuauugaagauuuuugaagaaucuuuuauauuuuauccaacaaaauccccuuucaaagcucagaaaauggcugcaaugcguuccaugucucgccuguuauucuccagaucauuucaaacuacuguaaaaagggguuaugcugaucaaaugagcuucacuuuugcuucuggaaaccaggucuucuacgaugcgaaaucaauaaaacaaguagacguuccuucuuucucugguagcuucgguauccuaccagcccacguucccacucuugcuguccucaaaccuggaguaguuacuguuuaugaagacggcgguucaguccagaaaauuuuuguauccagugguacagucacuguuaaugacgauucaucuguucaaaucuuagcugaagaggcccauccaguagaaaauuuagauauuagugcagccagggaucuucuuaccaaagcacaaagucaauugucaucggccacuacagaucaggcuagagcugaagcugccauugccauugaagugggagaagcacuuguaaaagcugccgaauag

SEQ ID NO: 6334 - RNA, 969 nt, Phyllotreta striolata
augagcggcgauggcaaucaaaacgagcauuucgacacguuauuucuaucaaucgcccagcaucauccacagggacccacgcaacuucuggacacuuucgucaacuuccucagcagaaaaacggacuucuucacgggcggcaaagaaggagaaugggaaaagcuaguguugaacacauucaagaaauacgagaaguccagcagggagcagcacgcggccgaauugaaggagaaacucgaacaagaagcgcgccggaaggcgaaaaaagaggccgaacgggcccgaauaaccgagcuaacggacgagcaagcggagaaacuccaagccgagcucgacgccaagaaggccccuucgagcgcccccgacgccccuucgagcaccuccggcgccccuucgacuuccaccgcuaagaucgaagaggacgaggacgaguccgagaaggguaaauuguuaccgaacaaaggcaacgggugcgauuuggacaaguacaguuggacucaaacccuuagugauauagagcugcgcgugccgcucgaaugcgauuuccgagccaagcaaaaggaucucacggugaacaucaccaaaaagcggcucguuugcggccucaaaaaccaccggcccaucaucgacgacgauuuccagcacgagaucaagcuggaggagaccaauugggugaucgaggacgggaaaucguugcuauucuccaucgaaaaagugaacaagaugaauugguggagcaaauuggugaaauccgauccggagaucagcaccaagaagaucaauccggagccgucgaagcugagcgaucuggacggcgagacccgaggcauggucgagaagaugauguacgaucagcgacagaaagagauggguuugcccaccagcgacgagcgcaagaaacaggacguccucaagaaauucauggaacaacaucccgagauggauuucuccaaauguaaguucaacuga

SEQ ID NO: 6335 - RNA, 477 nt, Phyllotreta striolata
augcagucucccaguggaauggcgcacgguuauccuggcgccucaauccuacaauggagcccugauaaaaaguacagcgauagagagagguggauuugcguuuauccagcguacauuaacugcaaaaaaaccauagcccaaggcaggaaauuaaacaaggaaaaaugcguggagaaucccacucaucaagagaucagagacguauuagucgcagcagguuugaaggucggcguggaaaacaaauuauacagcagggaacgaagcaaagaauuguuguaucgaggacgaauuagaguucaauugaaaaacgacgacgguacgcugugcaauccaaguuuucccacuagagacagcuuaaugcuccaucugggagacaugauuccuaaauugaagagcaggcaaaauaagggcagcggagacccucaaccgcagaccaccagcucgaaaggaaagggaaaaggcaaaggaaggcgcuaa

SEQ ID NO: 6336 - RNA, 2196 nt, Phyllotreta striolata
auggaagaaccggagccuacuaaacgccagaagaugcccaaaguggcuaaagugaaaaacaaagccccagcugaaauccagaucacagccgaacagcuauugagagaggcgaaagaaagagacuuggaaauccucccgccgccgccgaagcagaaaauuucugauccggcggaguuggccgacuaccaauugaggcgcagaaaacaguucgaagauaacaucagaaaaaauaggacggucauuucgaacuggaucaaauaugcccaaugggaggaaucgcagaaggaaauacaaaggugcaggucgauaugggaaagagcucucgauguggaccacagaaacauuaccauuugguugaaauacacggaaauggaaaugcggaacagacaaguaaaucacgccagaaacuuaugggacagagccacaguucuuuuacccagaguaaaucaguuuugguacaaguacaccuauauggaggaaaugcuggaaaauguagccggagcaagagcaguauucgaaagauggauggauuggcaacccgaugagcaagcuuggcaaacuuacauuaauuuugaacugagauacaaagaaauugacagagccaggcaaauauacgaaagauuuguuauaacgcauccggaagugaaacauuggauuaaauacgcccgguuugaagaaaaucacgguuuuauccauuccgcuaggcagauuuaugaaagagcuguccaguuuuauggagacgaucacuuggaugagaagcuuuacauagcuuuugccagauucgaagaaaaccaaaaggaacacgauagagcuagaguuaucuacaaauacgcuuuagaucacauuccuaaggaugaaacgaaggaacucuauaaagcauauaccauccacgagaagaaauauggagacagaagcgguaucgaggaaguuauaaugucuaaaagaaaacugcaguacgaacaagaaauacuccaaaaucccaccaauuaugaugcuugguucgauuaccugagacucguagaaggagaggcugauuuggaaauaacccgagaaaccuacgagagagccauugcaaauauaccuccaucgaaaaacaaacaauacuggagaagauacauuuauuuguggaucaauuacgcuuuauuugaagaacuggaagcgaaggauuacgaacgaaccagacagguguauaaagccugccuggaaauccugccgcauaaaacguuuacguuuucgaaaaucuggcugcucuaugcgcaguucgaagugcgccagaaauguuuaaaagcggcccggaaaauucuaggcauguccauuggaaugugcccucgggauaaauuguuccgggguuacauagagcuggagauacagcuccgggaguucgauagaugucgaaagcuguacgagaaauuccuggaguucgguccggaaaauugcgucacuuggaugaaauucgcggaacuugagacccuauugggcgauaccgacagagcgagaggcaucuaugaauuggcuauaaaccaaccgagauuagacaugccggaauuacucuggaaagcuuacauagacuucgagauaucucaagaggagcccaauaacgccaggcaaaucuacgaaagauuguuagagagaacuucccacgucaaaguguggcuuucguacgcuaaauucgaauugaauaauccuagcgaggaagauuucaacguacgauuggccagaaggauuuucgagagagccaacgagaauuugaaaaacguccccgaaaaggaagccagaguguuacuguuggaaaacuggaaggaauucgaaaacaaucacggcgacgacgagcacaaagaaaaggucaacgcuaagaugcccaagagaaucaaaaagaggcagaagguuaucgaugaggauggcguggagcaaggcugggaagagguguuugauuauauauuccccgaagaugaagccagcagaccuaacuugaagcuacuagcagcugcuaaaaacuggaagaagaauacugacgaaccggaugaggauucagaaaaucgaccgagccuuuccagcaguagccaaaggaugaaagaaaaguuauuagccuccguuaaaaauuggaagaauaacgacaaagaaaacagcgauucuaauaaagaugacggcucaaaugaagaggaaguucaaaucgauaacaaugaaguagaaaauuaa

SEQ ID NO: 6337 - RNA, 1431 nt, Phyllotreta striolata
augggaauuaaauuuuuggaaguuaucaagccuuuuugcaguauccugccagaaauugcaaaaccagagcgaaagauacaauucagggagaaagugcuauggacagcgauaacgcuauuuaucuuucuaguauguugccagauuccucuauucgggaucaugagcucggauuccgcggaucccuuuuacuggauccgugucauccucgccuccaacagaggcacccucauggaacucgguauuuccccgaucguaacgucuggcuugaucaugcaacucuuagccggagcgaagaucaucgaaguuggcgacacccccaaggacagggcucuguuuaacggcgcccagaaacuguuugguaugguuauaacggugggucaagccaucguguacguaaugaccggaauguauggagauccagcugaaauaggagccggagucugccuucugaucaucauccaacuguucguggcgggucucaucgugcuccugcucgaugaauuguugcagaaaggauacgguuuggguucggguauuucucuuuucaucgcuacaaacaucugcgagacgaucaucuggaaggcuuucucgccggcuacugucaacacuggaagaggaacggaguucgaaggagccgucaucgccuuguuccacuugcucaccaccagacaggacaagauucgaggauugcgcgaggcuuucuaccgccagaaccuuccuaauuugaugaaucuacuagcuacaguucuaguguuugcuauaguaauauacuuccaagguuucagagucgauuugcccauaaagagcgccagauaccguggccagcauucgagcuaucccauuaaacuuuucuacacuuccaacauuccgaucauuuugcaauccgcuuuggugucgaauuuguacguuauaucccagauguuggccguuaaauuccaaggcaacuucuucauuaaucucuuggggguuugggccgauguuggaggcggcggcccggcuaggucuuacccgaucggcgguuugugcuauuacuuaucgccgcccgagagcgugagccacaucuuggaagaucccguccacgccguuauguacauuauauucauguuggguuccugcgcuuucuucucgaaaacguggaucgaaguguccggcaguucggcuaaagaugucgcgaaacagcuuaaagagcaacagauggucaugagaggucacagggaccauuccaugauacacgaacucaaccgguacauucccaccgcugccgcuuucggcgguuuguguaucggagcccuguccguucucgccgauuucaugggagcuaucgguuccggaaccgguauuuugcucgcuguuacaaucaucuaucaauauuucgaaauauuugucaaggaacaaagcgaaaugggcggcaugggcgcuuuacuuuuuuaa

SEQ ID NO: 6338 - RNA, 486 nt, Phyllotreta striolata
augucgacgguuucaucuucggcuguugaauuaaguucauacagggaccagcauuucaaggguagucgagcagagcaggacaaguuauuacggcuuucuacgacguuguacguaggaaaccuaucauuuuacacuacagaagaacaaauuuacgaauuauuuucgaaaugcggcgacauuaggcgaaucgugaugggucuggacaaguauaagaaaacaccguguggauuuuguuucaucgaguauuacaaccgcgaagaugcagaaaauugcuuaagguauaucaaugggacaagauuggacgauagaauaguaagaacagacugggaugcggguuuuauagaaggcagacaauacggaagggggaaaaccgguggacagguuagggaugaguauagaacugauuaugauuccggucgaggaggauacgguaaaauaguucaacaaaaaguaggcggaauagauucacaaggauuuauucguuag

SEQ ID NO: 6339 - RNA, 957 nt, Phyllotreta striolata
ucaaauaugguuuuaauuuuaagcaggaguuuugguguuaaacucuucaaauauaagacgaauuucacgcaaacucgucuuaacucgaccggaaaauuaugguucggaaguaaaaaaguguuuuacagaaccuuagguuuauuagccacagguacgggcaucguuauuuauacuuuagaccaagcagugaaggcaggagaaauggaacuucauccucccagauuuccuugggccuacaaaggcauaauuacagcacuagaccaugcgaguuuacgacgugguuacgaagucuaccggcaaguuugcgccuccugccauucgcuuaaacacguaaccuuucgagaacugguuggaguuacgcacacugaagcagaggcgaaagccgaagcugagcagcaaauggucgaagacgggcccaaugaagaaggcaauauguuccagcguccugggaaauuauccgauaaauuuccgccuccauaucccaacgaagaagcugcucguuucgccaacgguggauccuacccacucgacuuaacuuacauaauauuagccagagaagguggcgauaauuauauuuucucgcuauugacuggcuacugugaaccaccugcagguguaacauuaaaagaaggauuguacuauaauccuuauuuucuuggagguucuauagcuauggccccaccgcuauuuucagaaucugcuacauauucugaugguacucaagcucaugccagucaacuggccaaggaugucguuacuuuucucaaaugggcuggagagccggaauuugacgauaggaaagugaugauggucaaaugcuuagguugguuuauagucgguucaguaauaucgugguauugguacaaaaugagguuuaugucuaacaaaacgcguaaauuuguuuauacggggaaaucaagcaccaagaagccagaguguucugauaagugcgaguaa

SEQ ID NO: 6340 - RNA, 1698 nt, Phyllotreta striolata
auguuggcauuacaacaauacucagguagcagcgacgaagaagaagacaaacaaacauccuccguuaaucaagagccuucgaauccuucggaguauucguuaaaaacccagcucgcaauuugcgcagcaccagaaguccuccccacugggcuagaggaggaccaaaugcacauagacguagacacaaaagagcuagcguucaaucccaaguacgauguacuguucgcaccggcccugggccccgcuaaucccuuuaaaacccagcaacaguugguggaacgcaacaugcucucgggccacaucgaaagggcccacgucagcgaauuccaauucgaaaaccaaaggcgcaccuucgccaguuacggcuacgcccuggacccuuccguaaccaaugacgggcagaucaaaguggucgggucuucggaggacgccgacgagagcagcauuaaaacuguguucgaagccuccaaaacgagaccuuuggauaaacggaaaaggaagaaaaacgacgaucccagcgacguggagggguuccuaggccccuggggugguuucguggacgagcaaaaaauauccaaacccaccgaggaagaacaaaucgaacucgacgagauauccuccaaaaagaauaaaaaagguaaacccagcgaagauaaaccgcucgaagaaaagucggucuugcacaucaaagacgccguggauuaccaaggucguucguuccuccacgcgccccaagacgugggggucaaucucaaaucggacacuccaccggacaaauguuuccugcccaaggcccacauucacacuuggacgggccacucgaagggcaucgccgccauacgguuguuccccaggacggcgcaucuucugcuaucggccggaauggacugucgcauuaaaauuugggaggucuacaacgaaaggcgcugcgugagaaccuauuauggacaccgacaggccguuagagauaucaauuucaacaauuccggaaagcauuucuuaucugcggguuacgacagguauauaaaauugugggauacggaaacgggucagguuuugucgcguuucaccagcaggaaaauacccuacugcguuaaauucaauccggauaggaacaaacagcauuuguucguggccgguacaucggauaagaagaucaucuguugggauacgagaucgggggauaucgugcaagaguacgacaggcauuugggcgcugugaauaguauuacauucgucgacgaaaaccgacgguucgugacgacuucggacgauaaaucguugagagugugggaaugggacauuccggucgauaugaaauacauugcagaucccacgaugcacagcaugccuucgguaacaccggcaccgaacgguaaaugguuggcuugccaaagcauggacaacaaagucgucauauucucuuccaugaaucgguuuaagauuaaucguaagaagacguucagcggucacaugguggccgguuacgccugcuccuuggacuuuucuccugacaugagcuaccugacgucaggggaugccgaugguaaaguguauauuugggacuggaaguccacuaagcuguucaagaaguggaaggcgcacgauaacgugugcaucagcguccucuggcauccgcacgagccgagcaaacugauuucugccggaugggauggccugauaaaguacugggauuga

SEQ ID NO: 6341 - RNA, 807 nt, Phyllotreta striolata
auggugcagaaaaagcccaagaagaagguaggaaagaagguagcagccgcuccuuuggcagugaaaaaggucgagcagaaaaaagaagugaauccccuauucgaaaagcgacccaggaacuucggaauaggccaagacauccaaaucccccgggaucuaucgagguucgugaaauggcccaaauacauccgcauccaaaggcagaaggccgucuugcagaagcgccugaaagucccgccgcccaucaaccaauucucccagaccaucgacaaacaaacagccacccaauuguucaaaguauuggagaaauaccggccggaaaccgcucuccagaaaaggaaccgauugaaggccaaagcugaagcuaaaguggccaagaaggaagagaccccuucgaaaagacccaauacuuuaagggcugguacuaacaccgucaccaaauugguugaacagaaaaaggcccaauugguggugaucgcccacgauguagacccuauugagcuuguacuauuccuccccgcgcucugcaggaaaaugggagucccuuacugcauaguaaagggcaaagcaagguuagggcugcucguuaggcguaaaacuugcgcggcugucgcccuuacgcaagucgauucaggugacaggucuaacuucaacaagcuuuuggagguuaucaagacgaacuucaacgaucgcgccgaugagaucaggaggcacuggggaggcgguauccucggaucgaaauccgcugcccguauugcuaaauuggaaagggccaaggccagggaacucgcccagaaacaggguuaa

SEQ ID NO: 6342 - RNA, 1002 nt, Phyllotreta striolata
auggcaacaauaauuaaggauauaacauuacaagaaaacauuccccaaaauauacuuuucgaaaaacauaucgacuucauaaaggaauacggccagaaggaaaacaacuuugaauaugcaaugaccgauuauuugaggauauccggcauguauuggggccuuacggcccucgaauugaugaacgccucgcccccgcacacgauagaagagauuucagauuacauuaaacauugucaagaccccgaaagcggcggaauaagcucgugccucaaucacgacccucacauacugcacacacugagcgccgugcagauacucugcauguacgacaauuuaaaagccaucgauguggagggcgucgugaaguacgugaaaaaccuacaguuacccaacgguagcuucacgggggacaaauggggcgaaguggacacgagguucuccuucugcgccgucgccacguugucucuuuuaaacagaauggacgcuauugacgugaauaaagcagucgacuuuguagcuucguguaaaaacuucgauggcggguucggcucgaggccucuuuccgaaagccacgccgguuuaauauacugcugcuuaggauuuuuaucuguuaccaauagguuggauauaguggaucgagacaagcucgcuugguggcugugcgaacgacaacuaccuucgggggguuugaacggacgcccggagaagcugcccgacgugugcuacuccuggugggugcuguccucuuuaacgauacuaggcaaguugcauugcaucgaugccaacgcuuugaagaaauucauauuggccugccaggacacggagagcggaggcuucgccgauagacccggagacauuccagacccuuuccacaccguguucggaauaucggcgcuuuccuuacugggaaacgacacgguccagaaaguuaaucccacuuacugcaugccccagcaugucaucgacaggcuccaauugaagccucaaauuuuagauaauuag

SEQ ID NO: 6343 - RNA, 2664 nt, Phyllotreta striolata
augcaccaagaaacauugcaacuaauccaaauauuagaaaaaacaguuucacccgacaagaaugaauuggagcaagcgucgagcuuuuuggaacaagcgucccaaacgaauuuauuaggauucauaaagacccucucggauauacugcggcauggcgggaacagcccgguggcccgaauggccgccgguuugcaacugaaaaaccaacucacuucgaaagacacaaccaucaaggccaccuaccaacagcgcuggcugcuauucuccgaagaaguccgggacuacaucaagaagaacguggucggugcccuugggaccgagaccaacaggccgucgucggccgcccaaugugucgcuuacauagccguaaccgaauuaccgcaaggacaauggccggaucucauaucgacgcucguaagcaacauuugccaagggaauuccaccgaaaugcaaaaggaggccacgcuggaggccaucgguuacaucugccaagaaaucgaguccgacguguuggugucccaaucgaacgauauauugacggccaucgugcacggcaugagauccuccgaaccgagcaaucacguacgauuagccgccacgcaggcuuuacugaacucauuggaauucaccaaggcuaacuucgaucucaccaccgaaagaaacuacauuauggaggugguuugcgaagccacgcagucgccggugucgcaaaucaagguggccgcuuugcaaugucuagugaagauaaugucgcuguauuaccaacacauggagcccuacauggcgcccgcgcuguuucccaucacguuggaggccaugaaauccgagaacgacgccgucgcccugcaggguauagaauuuuggucgaacgucagcgacgaagaagucgauuuggccaucgaggauacggaagcggccgaagcgggacggccuccuacaagaguaucgaggcauuaugcaaaaggagcucugcaguauauaauaccaaucauucuucaaaaacucacgaaacaagaggaguuagaugaugaggacgauuggaauccgaguaaagcggccggcguuugucucaugcuacuagccacuuguugcgaagacgaaaucgugccgcacguucuaccguuuaucaaagaaaacaucaaaucagacaacuggcguuuccgcgacgcuucucugauggccuucggcuccauucuaggcgguuuggaacccaacacucuucgaccucucgucgaacaagcgaugccgacucugaucgaauugauguacgauaacagcguaaucgugagggacacggcggccuggacguucggcaggauaugcgaaaucaucccggaggccgccaucaacgagaacuaccugaagccgcugcuggagagucugauaaccgauuugaaagcggagccccgcguggcagccaacguguguugggcguucuccggauuggccgaagcggccuacgaacaugccgccgucaacgaggagaccgguacaccggacacguacauucugucgccguacuacgaauuuaucauacagagguuacucgagacgaccgauagagcggacggggcucaggcgaacuugagacccgcggcguacgaggccuugauggagaugguuaaaaauucgccgaaggacuguuacguuacgguacagaaaacuacgaugguuauuuuggaaagacugcaacagguacugcagauggaaacucacauuaccagccauaacgacagaucgcaauucaacgauuugcaaagccuuuugugcgccacauugcaaucgguuuugaggaaagucacgccggaggaugccccgcauauuuccgaugccauaaugacggccauguugaccauguuuaauuccaauucuuguaaaagcggaggcguacaggaggacgcucucauggccguuucgacgcucguagagguacuaggagaaaauuucaucaaauacauggacgcuuucaaacccuuccuguacaucggcuugaaaaaccaccaggaguaccaagugugcggcaccgccgucggccucaccggcgacauuuuccgcgcuuugaagcucaaagcucucccguacugcgacgaaaucaugacccuacucuuggaaaaucuccgcgaucaauccguucaccguagcgucaagccgcaaauacucuccgucuucggcgacaucggucucagcaucgguucggaauucaagaaauaccuggacgucguuuugucgacgcuggcgcaggcgucccaagcgcaagucgaccgcagcgacuucgacaugauggaguaccucaacgagcuaagagagggcgugcuggacgccuacacgggcaucauacagggcuugaagggcgacgggcugacgcccaauccggacguuaugguccucgaaccgcacauuccguuuaucguacaguuuaucaccgucguggcgcaggacgacgagcauuccgacgggacgguggccgucgccgccggcaucgucggcgauuugugcaccgccuucggcaguccgauggugcaauuguuggauuuggcuucgaucaacgagaugcuggcccaagguagacgcagccgcgucggcaggaccaagacguuggcgacgugggcuucgaaggaguugaggaaacuuaagaugccggcucccgcggcagccgcuagcuga

SEQ ID NO: 6344 - RNA, 1497 nt, Phyllotreta striolata
auggaaacgauuuuagaacaacaacgucgauaucacgaagaaaaagagcggcuaaucgacggcauggugaaagagaugcuucauaaaaaaaacaccuacagagaagcgauaaacucggaccaccgacagaaguaccuucuagacagguacaugacuuccacggaaagacugaucgaauuguacgaggacaaagacgggcaacgaaaggccgagguugccgcccugacgggccccaaugaauucaacgaguucuacagcagauugaagcaaaucaaagauuucuacagaaggcacccgaacgagauaagcguaccgauguccguagaguucgaugaauucgccaaggcgagggaaaaccccaacgaagacauggcuaauuucgucgaguucaccgacgaagaaggcuacggcaaauacuuggauuugcacgagugcuacgagaaguacaucaaucuaaaaggcaucgagaaagucgauuacaucaccuacuuggccauguucgaccaacucuacgacauaccgaaagaacgaaagaccggcgaauacaggaaauaccugcucuaccucaucgaauaccucacgugguucgugcaacgcaucagaccgcugauggaccucgacagcgaucuccaggaccaggucgaacagguguuggccaauugggauaacgggauggugcccggguggccgaaagaaaccgguucggcuuuggccaacgucggcgcccauuuggaccugucggccuucuccagcugggaggaauuggccucguugggucuggaucguuugaaauccgcccucauggcguugggauugaaaugcggaggaacguuggaggaacgagcccagagauuguucucgacgaaaggaaaaggcucuuuagaucccucucucaugacgaaaaacagcaagaaccgcgugacgaaggagaaggaggcgcucaggcaacgggaacuggccacguuagaggcccaaauuuacagauuggccgaucuggugucagcccaacgggcggcgaccaaagagaacgugcaaaggaaacaggcccguacugacggcgaacgggacgacagcgagaacgaagagagcgaggaggagagccccgacgaggccgacgacgauguacccuacaaucccaaaaaccuaccgcucgguugggacggaaaacccauuccguauuggcuguacaaauugcacggcuugaacaucagcuacaauugcgagauaugcgguaacuacguguacaagggccccaaggcguuucaaaggcauuucgccgaguggaggcaugcgcacgggaugcguuguuugggcauaccgaauacggcccauuucgcuaaugucacgcagaucgaggacgcuuuggcucugugggaaaagcugaaggugcagaagcaaagcgagagguggcagccggagacugaggaggaauacgaggauucaccacguucccuugcgaaucuucguauuccucuucagucuccggcugccaccucu

SEQ ID NO: 6345 - RNA, 639 nt, Phyllotreta striolata
augacgauaggaaagaauaauaaaaugauccaacacauaaacuauaggguccgaauaacacugcaggacucuaggacguuuaucggcaccuuuaaagcuuucgacaagcauaugaacaugauacucggcgacugcgaagaauuccguaaaauuaaacccaaaaacucgaaagucgaacgagaagagaaacggguauuaggauuuguacugcugagaggcgagagcauagucucacuaacuguagaagggccuccaccaccagaagagggacuuccucgggugccuauucccggagcagcccaaggaccagguaucggaagagcagcagguaggggaaugccaccggguauggcuggagucccaguaggucugcaaggucccgugagaggagucggaggaccaucccagcaaguaaugacgccuacggguagaggacagguuucggcgccgccacaaaugaaccaagcgccuccgaggauggguggcccuccgccugguaugauggggccuccgcccggaaugaugggcaugccgccgcaaaugggcauggggcgcgguggaccgccuccgauggguaugaggggucccccgcccgguaugaugagagguggcccgcccggaccgccaaggccuuauuaa

SEQ ID NO: 6346 - RNA, 1200 nt, Phyllotreta striolata
augcaaacguuucguaaaauggacgugaauaguuuaauaauuuuauauugguaucgccgucguuuucgccggaauaaaacuagaagauacugggugcauccacuuguuaaacaacguucucauguaggagccuuucgcuugcuaaugagccaguuacgacaagacgaaucaaaauuuuuuaauuauuuucggauguccaucucuacuuuucacgaucuucuacaaagacugcaagauaaauugagaaaacaggauacaaacaugagaaaagccgucagcccugaagagaaauuagcgauauguauaagguauuuggccucaggauguuccuucagagacauacauuauaguuaccgaauagguauaucgaccaucagcaacauaauagaagaagugacagaaugcauuuggaauaauuuacaccaugaauuuaugccuauaaucgauaaaguguccgaaugggaaaaaauaucggaugcauuugaugaaaaagccaauuuuccccacugucuuggcgcaguugacggaaagcauaucaggcuuaaaaagccaucaaauagugguucaauguauaugaacuauaaagacuuuuuuucgauaguauuauuagcagugguagaugccgauuaucguuuuauuuacguuaguguaggcuccuauggaaaagagugcgauucgucgauauuuaaggaauccaauuuuuggaaaaaauuaacggaaggcagcuuaaauauuccucaaccaagaccucuaaccaccgacucaacaacugcgguuccuuauguaauaauaggcgaugagggauuuggauuacaugacaauuuauugagaccuuuugguggaacacacuuagauaaagaaaaaagaauauuuaacuacagguuaaccagagcccgacgguauguagagugugcuuuugggauuuuugcaaauaaguggaggauuuuucaucgacccuuggacguaaaaaaagaaacugcgguaucgauagugaaagcguguacagucaaccacaauuucaucagagaaaaagagggguuaaauauugaacgaaaccaagaagaagaauauaaucuugaaaacgugaacaacgaacaacaaacacgaggugguaggacugcuaauucagugcgaucugaauucgugaaauauuuuauuucugaagaaggaucaguacccuggcaagaagauucuaucuaa

SEQ ID NO: 6347 - RNA, 7263 nt, Phyllotreta striolata
cagcaacagcagcagaucgcccagaugaacgccgcgagauuacagcaacagcagcagcagcagcagcaacaacagcagaacaauccgccgcacucgccgaugccgcccaaaaguccgaugaucaaccagcagaucaugucgccgcauucgaugccccaaucgcccaugcagaugccgccgaagagcccgauggugccguucaacucgaaccagccgaauccgaauucgcccgccgccagaagcccggcguuccaucaggguaucaaccaaccgcccagucccgucacgcacggccaccaaccgcccaguucgcccaugcccaggagcccgaugaucaaucagacgcacucuccgcacaacguucgacgaccgcccagcgccaacagcagcccggcgaugcccgaccggccgcacagcgucgaaaauuccucgcccagaauguacucgaucgaucaacuugugcaggagaguuuggccaaucaaaacgucaacgcgcaguacaacuaccaaucggacaugaucaacgaaagcggcggcgggaauucgaacaacccgauacccuguccgccggaagugcccagauuccgguacuuuaaauuggguuugagaggcggcgcgcccauguggagcuucggcagaggcgccaaaaggauaccggcgccgccuaacgucaaaccggacgaacccaaagccaagaaggagucgcauuugagcaaagugucgauacugaagaggaaaaccucgaucgcuuccaucgguaaagugggcucguuggucaguucggauuacaacgauuuagacgacaguucuaccacgccacccguaacaccgccucuagcuucuaccagcagagguaucguaucgaagaagaagaaccucgaacugcacgcccaaaaggauuccgucaucgucaugcacagccccgacgaugacaacaaacagcuggaacugauggauuacgacgacgauaauaacaccguucuaucgucggaggugucguugaguucggcggcgcgcaacgacgacgauuugguggagaucgagacgauaucgcaggaccucgccgaaggccuguccaguccgcuggaacccgaccagaucggcgacgaguuccugcuguuccccggcaacauggugguggacauguccggcgaggagcacuacucggagaaggaggaagagggcgaguacgccgaucagaacaugcacaucgugauacgcagcccgacgaccagcgacgacgaguucaucgugccgugcaaggugaagcaauacgacgaggacgagccggacgagaauccggagucgccugaucaggaggaguucggcgaaucguccgguuacgauaacgaggaggcggauauaauuauuucggaucagacuagcggcguggccgaagacucgauuucgacuaaagaggacuucgaggagcucaucgaugagggaucgaggaagaacaacguagggaaacaggaggugaccgcaaagcacauacaggacuuccaccgguacaccgaacuguucgauuacgguaaacccgauguuaagaaaccggccgcuaaaaaauuccaaccgaagguaucacucguuagaggagugacuuugcccagcaaacccaacgccgagaagauuauuaucacgcaaaauucgaacacuucgcaagcuuccaaaguuaccagcaucauucucacgcacaacgcuaacgugaggaggaacauuauaggcguaccgaagauagucaguaccguuucgccggcuauaacuauagugagcgcuaguaccucgcaaauggccucgauauuacccucuaaauucacggugccugucauaagcgcgagcgccguucgccagcuauccaacguaaaagucaucgauaaaccgucgucaucgucgcuaucgauuucgacgagagacaacguccugcccaagaagauauucgaggacgauucggugucucccgacagcaguucgaauugcgacgacgagaaaucgaaggauucguucgacgacaaggcgaaaugcgagucgccgccgcgcgaucucaaacagcccaacucgcagaucgucucguugaaaucgaaaaccuacgcggagcaaucgaagaagaucgaacaccuccaaaucgugaacguaucgucgaaggacgucguucaaaggcagcgaaugccgaguccuuugaucgcgaaagccucgcccgucaucauacacaacacgcccgaguugaagaugaccgcgcaagucauccaggagagccagacucgcaugaacaucacgacuacuacggauaccgagcacuacgacgagucuaacgacgauacgaaguccguggugauuucgauuccuucaccuacgccaucgcaagaacagauguuggacaauauagccuuccaggcgcuggagaauaggaggcgagaguacgauucgaucgaagacguguuggauaugaucgagaauaucgagaacaucacggccgaaccgcccgagauauuagaggaaaacacguugcaaaguucggaauccgguaguaacaucgaaacgaaaaacgccgauacgaaagaaucgcaauugcccgucagcgaaagcgauuccuccgcgacuaaaucaucuaccguaccgcaauuaucgccucucucccagcccacugaauugacuacaaacauggcgaacgccucgcagcaacucagaacucugcugucgucgcugcaaaccaccucgacgucgucucccaccaacguggagucgguagcgaagggcuugggccagaaaaucgucacuuccucgucggccaaucagcccauagucgcuucgagggugaugggccaacagcaacaggccggcaggcaaucgccggucaucgccggcgucuccacggugaucgugccgaauuucaagcaaaaaaucgccgcgacggccaccagcacguccagaaguagccccguaaagguggugaccaccucgcaacaacucgccggauccaucauaacguccgcuuugaauuauuuaccgaacagaacgaucgguauacaacuagcgcccgagcaaucgaaacuugcgcccgcuagugucgcugcgaugcaacaaaucaacucgauuacgucgagccaggaagcgaagaagccuucguugacgcucaccgcgaugcugcagaaccaaccggcggcgaauacgauuucgaaaucuucagcugauacuauuacagcggcuaguuugcuggguucgccuaucagucuaccgaaaaccggguucaccacgucuuuggugcaagcgcaaccgagcguggugcucucuagcacgccuccagcgcccggccaagcuuccucuucgaccaaaaccaccgccgauucgaucacagccgcuaguuuauugaguagcaucgcuaagaguacguucgcgagcacgaguagcgccaacaagacgccuacuucuacaacgaauuugcuccacacgcaacugacgaaaguggcgagaagcaaauccgucgaugacguuaaagauuuggcuaaaaucgacgagauuaaacagaguaucaguagcgaaaacguugaugacgguaguaacggcggguguaaauuaucgacgaucgcuacgagcguuuguaacaaaacugaagauucgcagaacguguugcugaagaaauugcugcaaaacacggcuugcgcuagcgcccaauccuccccgccagcuuccaccagcaccgucaccacgagcgccgcuagcgcuauagcuaaagcggccaauucgcaggcuaguauuagcgcuagcguggaucccccgccgguggugagcgcuccaccgaacguugcuauccaaaggagcgccagcagagacgaauuacugucgccgccgcaagaccuccaaucgaugguggugaucaagaaagaaccgccgcucgugccgcucucccaaccgagcccucuaaccaacucgaacuccaacgccgccacgcccgaggugaagaaggaauucaucgacgaauccucgcagcacucggaggucuccgaccacagccgcuccgacgcgcccaucaaagaggaacucgaaacgauggagacggccgccgagaagacgaugcucgacaaggaggagcugaagaagcagaagcgccgcauguaccagcagaagcgccgccagaaccagauacucaacaaggagcuggcgcagcagcagcagccgaagaagcgcgcccgcaagaauucgaagcucgacgaggacuacgacacguacaucgacggcgugcuggcccagcugcggcagcugccgccgaucgccgucuccgagccgguguugggccgcaacuucggcgccgugccgcuguucgggugcggcgaucucgccaagaucggcgccaaggauuacucgacgcacuugggcgaguugacggggagcuacggguacgcggaggcgcccgguuucacggauuucuacucgacgaaacccuacggggauuuggauccguugccggagaaaccgccggcgucgacgcaacgcgguuucuacgaucaggaguuuccgcugauucgguucgacgucgacgagcagcggaaguucgacguguucugcagggaggauucgcccgauucgauauugagcagcucgucgcccgaauguacgcgucgaucggagagcaaauucgucggguugaggcucaucagcgacagcgaagacgacgaagaagacgaugccaaagaugccguuucgaacggaagaaugucgccgguugugcccguuaucaaacccguaccuauuagacuaaaacccgcuggggaguuguacuuuaaagaaaaccugaacgagaacaaggagaacaucaacagcgauucguugcacguaaugacgaaauccaaauucgacaauaaacagucuccgccugcgaacgucuccggccacgucaccgugacucugacucucaccucgucggcggccgaagacauaaugggagugcugcgggauuuggccaauauucugcacauaccggcgccuaccaguuaccaaaucgucgagcggacggcgucgccgccgagccagaaauugggcguguaccgcaccaaaggcaaggacggcaaagagggagcgccgaucgacauacagagcauccucaacggcgccaccaaguucugcaagcauugcgacgugaucauuuugagcaacaugaucagaaggaaggcguccgauuugccguucuuggccaaagauucggauuugcucggcgacggggaggaauuguucuuuugcgguuccgccuguuacaugcaauucgcccucaugcaccggucgccuucgauauccgaagacaaggccgccgagaucauaaaccaccuaucgcagaaagacaauuuggacgcgaaucaaaaauuaccggcggccgauucguuagacaacaccaaauccauagcgcagaaauuaucguucaacgugaaagauucgaaacgggaauucgagccgauggagacgaacgacgcguucgcguucuucgcccguacggccuccgccaaacaaggaaacaacuucuacgacggcgcuccguucaaacaggcucccgccagggugcacaggaacgacagguacaaacuuuggacgcccgguugucugcaacccacccaaaaacacaaaacgcccaccgacaaggagaucauggagcugcucuacaggaugcagaucaccgucacgccgcccgucaugcccgaagauaccagaaaguguuuguucugucacgguaucggcgacggcguggccgacggaccggcgagacugcucaacuucgacgucgacaaauggguccacuugaacugcggccugugguccgauggaguauacgaaacgguaaacggggcccuaaugaacguagaaaacgcccuacaaaccggacuaucggccacuugcgugcauugccaaagcgucggagccacgaucaagugcuucaaaacgcgaugcucgagcaucuaccaccugaacugcgccgucaaggacaacugcguguucuacaagaacaaaacgguguuuugcaaggcgcacgcgccgaaaagcgagaaagacaacgaacucaccacgcuguccgucucgcgacgggucuacaucgaacgcgacgaaaacaaacaaguggccgcugucaugcaucacuccgacucggccgaucugcugcgcgucggcagccugauauuccugaacgugggccagcuguugccgcaccaauugcagaacuuccacacgcccaaccacaucuacccgaucggcuacaagaucauccgguucuacuggagcaugcgcaacuugaacaagcgcugcaaguacauuugcgcgauucgcgacgcguccggcaagccggaguuucgcgugacgauccaggagccgcccgaagcggacgucgaauacgccgacgccacccccaaaggcgccuggcagaagauccucgacaacguggccggcauacggaaggcgaacaauugccugcacauguucccgaaauucgcgaccggcgaggaucuguucggacuaaccgaacccgcuauaguucgaguguuggaaagcaugccgggcaucgaaacgcugucggacuacaaguucaaauacggacggaauccgcuguuggagcugccgcucgccaucaacccgucgggggcggcgcggacggagccgaggcugcgcagccaguugcauuggaagaaggcggcgcacacgcagaggaccaccggcggcgcgucgucgauucgaccgauguucggaccgucguuggccgguucuaucggcgcgccggcccaaggcgagcucgccuguccuuacagcaagcaguucgugcacucgaagaguucgcaguacaagaaaaugaagcaggaauggaggaauaacguuuauuuggcgagaucgaaaauucaagggcucgguuuguacgccgcuagggauuuggagaaacacacgaugguuaucgaauauaucggggaaauuaucagauccgaacuggccgaguguagagaaaaacaauacgaagcuagaaaucgagggauauacauguucagauuggacgaggaacgcgugguggaugccacuuugugcggcgguuuggccagguacaucaaucauucgugcaauccgaauugcguggccgaaaccgucgaagucgaucgagacguucggauaauuauauuuuccaaacggaggauuuugcgaggagaagaguuggcguacgauuacaaguucgauaucgaagaugaucaaaacaaaauauccugcaugugcggggcaccgaauugucgcaaauggaugaauuaa

SEQ ID NO: 6348 - RNA, 2100 nt, Phyllotreta atra
augccgaccgaaagaaaaagaaaaagcuuuauaacuacaaugccgagggaagauguacuugaaagauacaaacacaaaagucacaaaagaaaaaaaagccgguccacuagccguuccgaacguaaucaagacgaacgcaaacauucaucuagcucuagcucaaagaaaaagaguaguuuucgcgaagaugccgaccgaaagaaaaagaaaaagcgaucuaagagcucuuccagcgauuccgaaucgaccagcagcgaaaguucggguaauucggugaaguuacuaaaaaaacucgagaccgaaaggcugcgauuagcugaacagaagaugaaggaaaaggagcuucucaaagcuacggaaacagccgaggagaagagauugagaagauugaugaagaaagaggcgaaggaaagaaggcgaaaagagaaaaugggcugggauaacgaauacuuacauuacacgaacagcgacaauccauucggagacggcaauuuacugaccacguucguuuggaauaaaaaauuguccaaagaaggcaucaaaaacgucggccaugaagaaauagaagcgauaaacagauuaaaacaagaagagaauaaaagggaacucgaaaaagugaagaaacgaagauuagagagggaauuggagaggcaaaagagagaggaagaaacgcaaaugaugcaacgaacuaaagaagcagcccaauucgaggaaugggagaggcaagaagauaaauuccacuuggaacaagcucgauugagaucucacauaagaauacaagacggacgagccaagccgauugaucugcuagcgaaguacauaagcgccgaagaagaagucgaugccgucgaaaugcacgagccuuacacuuaccugaauggcuugcaaaucaaagaccuagaagacuuagucgaagacaucaaagucuacaaagaacuagaaagaggaaaaaaccuagauuacuggaacgauauaacagucauagucgaagacgagcuucaaaaguugcgaaaaauagaaaaacaaaacgauuucgacuugggauugaaccgaagggaaggaauacaucaaucugucgccaccgaugugacaucaguauuuaaaggcaaaacagccgcacaauuagcagcuuuagaaaaacaaaucggaaguaaaaucagcagcaaagccgauggaauagacauaggcuauugggaaucuuugcuaucgcaacuuaaggcccacauggcgagggcgagacuacgcgacagacaccaagauagcuuaagaaggaagcugcaaguacuaaaagcagaacaagccaucacaggaguaggucaaagucacagcgaaacccauucuacugauaacgaagagaccacuucggaacccaaaccaagcaccucccaggaugcuuuggaaacgauggaagaaagcaacgaaaggaccgaagacgcugcucaugcauggcucaacgaaugcuuuucggccuaccaagcaggcggauacagucccaaguuuuuaacuccagaugauaccgagccugguacgauuguagucucggaggaagacgacguaaauagauuggaauucgcuaggaugcacguucuuggucaaggaaccaaaaucgagaacgucauuacgaaggaagaauugcugcugcaaaaggaggcgagaaaaggcauggacggggacgaggcucaauuuucggucgagcaagccuuggauaauccaguguaucuuuggucggauaaguaccgaccaagaaaacccagguacuucaacagagugcacacaggauucgaguggaacaaauacaaucagacccauuaugacauggacaauccaccgccgaaaauugugcaaggguauaaauucaacauauuuuacccggauuugaucgacaaaagcagcacgcccgaguacuauuuaacgccuagccccgagaacaaggaauuugcuauacugcgauuccaugccggaccgccuuaugaggauaucgcuuuuaaaauugucaacagggaaugggaauauucauacaaaaggggauuuagaugccaguuucauaacaacauauuucaguugugguuccauuucaaaagauauagguaucgaagauga

SEQ ID NO: 6349 - RNA, 1299 nt, Phyllotreta atra
auggauaaucuagaagcgaacauaauggacaagucgaugagaucggucuucgugggaaacauccccuacgaagccaccgaagaaaagcuaaaggacauauucggugaaguuggccaaguguugucguucaagcuggucuucgaccgagagaccggcaagcccaaaggcuacggguucugcgaauacagagaccaggagaccgccuugagcgccaugaggaacuuaaacggcuacgaaaucggcggcaggaacuugcgaguagacaacgcuuguacggaaaaaucccgcauggaaaugcaaaaccugcucaaccaaccgcccaucgagaaccccuacggcgagcccauccaagccgaaaaggccccggaggccaucagcaaggccguggccucccugccgcccgaacagauguucgagcucaugaagcaaaugaagacuaccauacaaaauaaccccacagaagcgagacaaaugcuauugcagaauccccaauuggcguacgcuuuacuacaagcccaagugguuaugaagauuaucgauccccauacggccgccagccuacugcacccgguuaaccaaguaccagccacuuugcugccgggggacaagaacguggcaguacaaguaccgaucaacaaccaguaccgggaacccccugcgcccguacaaccgcccaggcaggaguaccaacccguaccgccgccccugguacaucccaaucacguucaacagcccguuuuuaccggucaagauguggacuugcgaucgauggggaaugugaccgauccgagaaucaggcccaugauuguggaucaggauaugagacaaaugccggccguuauccagaauccccuaccgccuacuauuagcgaaagucuugccaaagcgggagauucgaaaccggauaacuuuucgagggauccccgaagcggcaccgguuucccgucggacccaaggcaagcuaggauggacccgcgacaaaaaaauauaguaccuccgacgagccaacaaguaccgccaacggugaaucccaagauaaugccgccucaagccggcccugucgucagaccggcucaaaacgucaucgcucagucagcugcagcugcuucaguuucagcugcaacagccaacgucagcccgggaauuggaggggcaggagcuacugaucaagaaaaagccgcccugaucaugcaagugcugcaauuguccgacgagcagauugcgauguugccgcccgagcagaggaacagcauuuugguguugaaggagcaaaucgcgaagagugcgcacgugcguuga

SEQ ID NO: 6350 - RNA, 783 nt, Phyllotreta atra
auggaugcggaacgugagaagagccuccaagaguacaggaaaaaauuguuggagcacaaagaaguggaauccagacugaaagaaaugcgagaacaacucaaagauuuaaccaagcaguacgauaaaucagaaaacgauuugaaagcccuccaaaguaugggccaaaucguaggugaaguucugaagcaacugacagaagagaaauucauuguaaaggcaacaaacgguccccguuacguaguaggcugccgucgucagcuggauaaagccaaguuaaaggccggcacaagaguagcccucgacaugaccaccuuaaccauaaugcgguacuugccgagagaagucgauccguuaguuuacaacaugagccacgaagauccaggagacgucacuuacucagccauuggaggacuuuccgaacagauuagggaauugagagaagucaucgaauugccucucaugaaucccgaguuguuuaugcgagugggcauuacaccaccaaaagguugucuauuguacggaccgccuggaacugguaaaacucuguuagccagagcuguggcaucccaacuggacgcgaauuucuugaaggucguauccagugcuaucguagauaaauacaucggcgaaucugccaggcuuauuagagaaauguuuaacuacgccaagaccaccaaccgugcaucaucuucauggaugaaaucgacgcuauugguggccgaagguucuccgaagguacaucggccgauagagaaauccaaaggacgcuuauggaguugcuga

SEQ ID NO: 6351 - RNA, 780 nt, Phyllotreta atra
auggcucgccgguacgauaccagaacgaccauauucucgcccgaaggacgguuguaccaagucgaguacgccauggaagccauaucucacgcgggcacaugucugggcauccuggcgaacgauggaauccuucucgcugcagaaagacgcaacaccaacaagcuacuagaugagguuuucgucucggagaaaaucuacaaacucaacgacgauauggugugcagcguagcuggaauuacgucugacgcuaacguauugacaaacgaauugcguuugauuggacaaagauauuuauaccaguauggggaaucgaucccuugcgaacagcugguuucguggcugugcgauguuaaacaagcguauacucaauacggagguaagaggccguuuggcguauccaucuuguacaugggcugggacaagcauuacgguuaccaauuguaccaaucggauccgagcgggaauuauuccgguuggaaggcgacuugcauaggaaauaacaguuccgccgccauuucgaguuugaaacaggaauauaaagaaggcgauauggcuuugaaggaugccaaagguuuggccgugaagguuuuggcuaaaacguuagauauggcuaaauugacuucagaaaaaguggaaauggcuacucuuacacguagaaacgacaagaccaugauaaauauauuaaauagcaaagaaguggaagaacuuauuuccgaguaugagaaauccgaggcggccgccgaggcuaccaagaaacaagaacaaaaaucagcugcuuaa

SEQ ID NO: 6352 - RNA, 2667 nt, Phyllotreta atra
augagugaaucaacaaaagccgaaccuauaaagguggaaucaaaaacaacugacgacaaaaauaagaacgaacuguccgaugaagauaaacaacuccaagaggaauugaacuugugcguugaaaaauuacaagaaaaugacaguaaacuuuacaugccagcuuugcaagcuuugggcaaccacauucgggccucgaccacuucaaugacuuccguucccaaaccgcugaaguucaugaaaccucauuaugauacgaugaaacagaucuucgagaaaauaacugagccuucgguuaagagucugugcgcagacaucaucuccguguuagccaugacuaugggagaaggaagggauugcuugaaguacaggcugguguccgauuuggacaaaaucggcgaauggggccacgaauacgucagacauuuggcuggagaaauagcuggcgaaugggccgaaacugauuucuuaguaaacacugaaauuagagauaaacucauauuauuaacaaaacagaucguuccuuauaauauggcccauaaugccgaagcggaagcuugcgauuuguugauggaaaucgaacgacuagauuugcuagaacaauacguggaugaaaacauuuacccuagaguuugcuuauaucuuacaagcuguguaccuuacguagcugaucccgaaaacaccacacuucuucaaaccgcuuuaaugcuguucaggaaauucaagcaguacccccaagcacuucgguuggcuaugcaacugaacgaucacagucucaucgaggaaauauuccuaaauugccccgauacugauguacaaaaacaguuggcguucauguugggcaggcagcagauuuacaucgaaguccccgacagcacgccggaguacgaagaccucaucgaaauaauggcgaacugucaccugaauaaccacuuuuugaaucuugcgcgcgaauuggacauuauggauccaaaaaccccggaagauguuuacaaaucccacuuggaaaacagccguccuccauucgguggcagccaaguugauucggccaggcagaacuuggcugcaaguuuugucaacgguuucguaaacgcugccuucggccaagauaagcucuuaauggaagauggaaacaaguggcuguauaagaacaaagaacacggcaugcugagcgccacugccucauuggguuuaguauuauuaugggacgucgauggaggucuuacgccuaucgauaaauacuuguacucuucugaagaucacauuaaauccggagcucuauuagccugugguauugucaauugcggagucagaaaugagugugauccugccuuggcucuauugagcgacuauguccuacauaacacgaauauaaugaggauaggcgcuaucgugggccucgguuuagcuuacguuggauccaacagagaagcaguuuuaaguuuacugacucccgucuuuuccgauccgaaauccaacauggaagugaucgguaugucggcgcuagcuugcggaaugaucgcagugggaucuggaaaucuccaaguuaccaccacaaucaugcagacgcuaauggaaaaaucagaaaccgaacugaaagauacguacgcuagauuuuugccucuaggucucggcuugugcauguuaggcaaacaagaaggcaucgauuccauaauagccgcauuggaagucauaccggagccuuuuaaauccauggcaacuacgauggucgacauuugcgcuuacgcugguaccggcaacguacuuaaaguccaacauuuacugcacauuugcuccgagcauuacgacggcagcgacagcucagacaagaguuccaaagauaaggacaagaaagaugcuacggagaaggagaaggaccuuuccucgagacaagcaguggcuguacucgguauagcuuugaucagcaugggugaagacauuggcagugaaauggccuuccguaccuucgggcauuuguugcgcuacugcgaaccgguaauuagaagagcaguaccuuuagcucugggacucaucucgguaucgaauccuaaauugagcauucuggauacuuugaguaaauucucgcacgacagcgaugcggaaguagcccauaacgccauauuugccauggguuuggucggagcgggcacgaauaaugcgagguuggccgcgaugcugagacaauuggcgcaguaucacgcuaaagauccgaacaaucuguuuaugguucgcauugcucagggucugacgcauuuagguaaaggaacguugacguugaguccuuaucacagcgaccgucagcucaugagccccguggcaguggcuggauuaauggcuacccuuguuggauuuuuggauguuaaaaauauuauuuugggaagaucgcauuaucuccuguacacuuuagcagcggcuaugcaaccgaggaugcuugugacguucgaugaggauuugaauccauuaccaguaccugugagaguggguuuggcuguagauguaguuggucaagcugguaaaccaaaaacuauaaccgguuuucaaacgcauaccacucccguucuucuugcguauggugaaagagcugagcuggcuacugaagaauacuuagcccuuacuccaauuauggaagguuuuguuauauugaggaaaaauccugacuucaaugcauaa

SEQ ID NO: 6353 - RNA, 1518 nt, Phyllotreta atra
augaccgauaguaacauggauucgaaagaagagaaacaagccucaccggacaacgcccacuugaaaccagaagcaaccgagcccgaggcucccccagcucaagccucccccgccgccggcgucauccgaaggaauuucaucacccccgccggaaccauagucgaaaccaacgaggaacaaccgccggaaccaacgacagaagaggucgucaaaacgacaucguccaacccgaguccagccgaacagaaacccgaacccgagauagucaccuacgcagcggagguccugccgcaggagcaaagagaacaauucgccgaagccaaauccuacgcaguggaaaugccagcugagaauuuuccuaacaacaacuucacccaggacauuagcuacgugaauauagaaggaacuguuguuccagucacaauaucggagauggaacauccuggagacuacgccaaucuacaaacugcucaauacaauaacggcuauacggacgguacgcaguauuuaaccaaccaucaguaccagaacauguacauagagagaacuacaguugauaauucuccuucugcuacuguuuuguaucgggacgaucccaauuugggagcuucuagauuccaaggaaauuacgacauauccaguucccaaucgcaagugaaccuucuuccagcugcgucaggagaaaccuacuauacaucgaccccuaacuggacgccgacgagcagcgguacuuaccaacaacaauacccauccgggaccauaaacguccuucaggcggauucgacucaagccuucgggaguccauacauaaacgcgacauggucgucgaauucgauggaggacggacggccgucuagucaagagguacuagugaaagagugcguuaauuguggugcuagcgucacaccacuuuggcguagagacgguacggggcauuaucuauguaacgcgugugguuuauaccacaaaauuaauggggugcacagaccgccgacaaagccaaccaaaaaaccacaggcgacuggaaauagaagaaacggcguaacgugcgcaaauugcaaaacuaacaacacaacucuuuggagaagaaacaaccaaggcgagccaguuuguaacgcuuguggacucuacuacaaauuacauaauguuaacaggccuaucaguaugaaaaaggaagguauccagacucgcaaaagaaggcccaaaaacuccucugugggaaaccccgccagugcugcaggucaaguaagacuugggauucccuccuauccauauucagaaauagauguacagcaagaucaauaccaauuaccaaugaacguuuauucucaaaggccacaagugucuuaucgacaguacggaacagaaaauauuggaacuuuaaaugcacaaccauugcagccaauaauuacucacgaggacgaacaggcaagcgucauuacaucgacuucacaacaggcuagguuuaggacgaagguggaggaggacgaggguagcaauccuucaaugcaauccuga

SEQ ID NO: 6354 - RNA, 4869 nt, Phyllotreta atra
augaucacgauggcacuaccggggaaugggaucuucgucgucaaaggcgaaauaucgaacuugauggccgccaugaagaggggccccaaauggucgucacacucuuaucaggacgacgacgucgacgcgcugcugaggaacuuccaagagcugcgggauauucuacacaauguaaacgauuuaggauacguugaacccaauacguuuuuggccccuuuuuugaacguaauccguucagaggagaccacaggcccuguuacuaguuuagcgcugucagcuguuaacaaguuccucuccuacggucucuuagaucccguacaaacauccauaccacaaaccauccacaccaucgcagacgcuguuacucacgcucgguuugugggcaccgaucaauccuccgaugggguaguccuaaugcgcauccugcaaguacugcgaacucucacucuaucccccgaaggcgccacauugaccaacgaaagccucugcgagauaaugcugucgugcuuucggauaugcuucgaaacgaggcuaucggagcugcuucgcaaaacugccgaacauuaccugaaggacauggugcaauugauauucaugagacugccccaauucuccgaagaucccaagcucuccuacgucaaacgauugaggaugcagcccggcgaucucgagcagacgcgaacgaagaggaaaaaguacucgaagaaggagaacaaagagguugcuaaaguaccgccacaagaaauuaacguugaaaguaucccgcagacugauauaguagauaugcaagguacuauucuucguaauaacgaaguuacuacgccuucuaguccaaauccaaauguugauacagauguugcuauagacauuccuacagaugacaguaugaagaauucggaaacuucgacaucuaauuuagacgauagugcugagaaggaaaccgaugaaccguuucaagacuacgucaaucaaagagguauucgguucacgccucaguuccaacaggaaaccaaccuaucuccuuacggauuagccuguguucgcgaacuauucagauuccugauuagccugugcaauccuuuagauaagcagaacacagacgucaugauacauuuaggacucaguuugcucacaguagcauucgaaauuagcgcagacaacauaggcaaauacagcacauuguugacucuaguggaagacgauuugugcaggaaucuguucgcuuugaugaacaccgaucguuugacgauauucgcugcgaauuugcaagugucguuucugcuguucgaaucguuaagggcccacuugaaguaccaauuggaauguuauuugaagaaacuuauggagaucuuacguagcgaaucgaauaaagugagcuacgagcacaaagaaaucgcguuggauaauuugcugcaauuguggagggugccugguuuccaugcggagcuguacgugaacuacgauugugauauguauuguacuaauuuguacgaagagcugacagaacuacuggccgaacgguccauuuccaccauuguaggaguguaccaugcgcauuuacugucgcucgauggacuucuaaucauaaucgaugguauagggaagagauucgacgaagcgaaagaucguacugauaccgaugagauuaguaguuauauaggagagaauacgagaauuaaagguuguguuaaaguucccgauaagaagguguuggcugcgaagaaagggaucaaaaagugguuaccgcaagguacagaguauuucaaucagaagccgaagaaagguauacaguuccugcaggaacacggcguuuugaagcaggagcucgacguggaagagaucgcuagauucuugcgggagaaucccgcauugaacaaagcgaugauuggugaguacaucagcaaucgggggaauuugaagauccucgaggcuuucgugagcacguucgauuucacugggauccgaaucgacgaagcgcuuagagcguuuuuggagacguuucgauuaccaggcgaggcuccuacgauuucguugauucucgaacauuucgccgagcauuggcacaaaagcaacggagaaccauucgcugauguggacucggcuuuuacauuagccuaugcuguuauuaugcuaaacgucgaccagcacaacgaaaacgccaaaaaacaaacaauuccgaugucaccuaacgcguuuaagaagaaucugaaaggcguaaauggaggcgacgacuucgaggaggacaugcucgacgaaauauacacuucaaucaaaagcgaggagaucgugaugcccgccgagcggacgggcgucgugcgcgacaacuaccuguggaaggugcugcugcgcaaagggcgcucgcccgagggcggcguuuacaugcgcgacgacggcggcgccuacgacgccgaauuguuccgcauagcguacgggccgcuggcggcggcguugaacuccgucuacgagcgagcggaccacgaaggcguccagaagaaagucaugcgagguuucgagcgaugcgccuccauagcguccaaucucggcaugacuucgaaucucgacauguuguuggucaguuugucgaaauuuacgguuuuccacaaccaucagaagcagaccgccguuguggugcaauucggcucgaacggcaaggcucaauuggcucugaagacgcucuucaugcugauccaccagcacgguaacuccaccagggaagguuggaagcaccucuucgaucuccugcucgcuuuguacagcaacgauuugcucagcaagagcuuuguggaaguagaagauuuuguagagccauccgguaaauuguguuugguguacaaagaugcuccgagcgcggccaaacaggauaccggauuguuaagcucuuuguauuccuauaugauaucuguagagaauuuauccaaaauaccaucgccagaagaacagaguuuaauagauaaagcaagagagugcaucaaagagugcaauuuagagcaaaugaucacagauucgaaauuccuccaccaacaagcccuuuuccaacuggucgauacucuaaucgaauuauccagagguccagauguacaagauggcucaucguaugacuacaacgaaaacguaacggucuuuuuccuugaauuacuggugaaaaucgucauccaaaacagggacagggugaugaccauaugggaccgcgucagagaccacgucuacacccuggucaugaacuccucgcugauggacuaccaguuccuguuggagagauccguuguggguuuguugaggauagccgugcgauugaugcgcaacgaggagaugagccacgugguguugcagucgcugcgcaugcugcuguugcuguugaagggcggcgugcuggcgaggauauccaggcaaauggcguucgguuuguacgagauguugaagacgucugcgcaaaauauucacacgacggccgauuggacggugguguucgcguuguuggaaugcgugggagcgggggcgaagccucccagacccguuuugaccgucgaagaaaacgacgcaaaacccaaacccgacgaagaaaauccuccgacgaaagaccacaaaaaagacgaggaaggcgccugcgcguuuuccgacccgaaaacgaacgaaaccgccaaacacccgacccaaagaccccaaaguccgguaacagcccucacgucucccgucggcacgccgaacaccggcggauggaucaucgucagcgacgaggacgaccuccaaccccaccgaggcccccagcaaacccuacccguccacuaccaccugcgccucgacgccgaucucucgccccacgacccgcucagcaugcugaaaugcugcgagagcuuggccuuccuaguccgcgacgucgcucacaucaccccguauaacuucgacgucugcguacguugcguccggacguucgucgaggcggcccugaaaccgccuaccaacaaccacccgaacaccagaagauccaacguaaagaaaagcaggaagaaaagccccgcuggaagccaagaggaagacagcagcggcggcgaugaggacgaagaccuccccagcggcuaccaccaaguccccauacaauuacuggauuugaugcauacguugcacacucgcaccgcgcagauauucaaauggugggcugaggaagguggugaaauuuccggggaaacuuccuugugggcgcaaggaugguguccuuuacuacaaggcaucgcgagauccugcugcgauauccgcaggacggucagaaccagcgcuauagccuaccuccaaagagcucuacuagugcacgaucuccaaacgcuaacccccaaggaaugggagcagugcuuccgaagaguacuauucccauuaaugaacuaccuacugcaauccaccaguccuagagacgccguuuccaccgaagaaaccaggauaagagccgccggggugcuaucgaagguguuccuucaccaucuagcgccucuuucgucgcuggcgggcuucgcggaucuguggucgacggugcuggagcugauggacggguacaugcacgccgacggcagcgaguugcugcuggaggccgugcccgagagccugaagaacaugcugcuggugauggaggcggcuggaguguucgacgggcccgaugggaagaagaacgccuugugggcggcgacgugggagcgcaucgggaaguuccugccgggguugaaggacgaguuguuuagggagauggggucgaggaggaagguuguggaagaagugaaagacguggaggucggggagaaggagacggaguguugggagaagaacguuggggagcgggagcaggauguggaugguagggagaaggaggagcugguugcguguuga

SEQ ID NO: 6355 - RNA, 618 nt, Phyllotreta atra
augucgauuuuggcguacaacgggggcgcaaugguagcaaugaaaggggacaacugcguagccauagcggccgaccgcagguucggcauacaagcccaaacgguggccacgaauuucgagaaagucuucgaaaugggcccccaccuguucguggggcuccccggccucgccaccgacacgcaaacggucauggagaagcucagauuccgcaagaacuuguacgaauugaaagaaaacaggcgaaucucccccaaaguguucgcggcgaugauaucgaacauguuguacgagaagagguucggaccguucuucgucgaaccggucguggccgguuuagcucccgauacauucgagccuuacauaugcaacauggauuugaucgguugcaucaacgaaccuagugauuuugucguagggggcacagccucugcgcaauuguauggaaugugcgaaucuuuaugggaaccuaaucuagcccccgaugauuuauucgaaaccauaucgcaggcuuugauuaaugcuuucgauagagacgcuauauccgguuggggugcuacgguuuauauuguagaaaaggauaagguaaccguaagaaaucuaaagacucgcauggauuaa

SEQ ID NO: 6356 - RNA, 2907 nt, Phyllotreta atra
auggaaggaaaaccggaauuagaaguggugaaaucggccguaucaacuuuauacaacaaccccgaugguggugaaaaagaaagagccucccgauggcuacuggaacuacagaaaucgguucacgcuuggacaguggcggacgaauugcugcgucguugcacgaacgccgacgaucuccaaacccgcuacuuugcggcucaaacgaugcgcaccaaaauccaccaauccuuccacgagcuaccccgcgaagugcacgagucucucagggacucccuucuggagcacaugggagcuugcgccggcgucgacgagggcgcgggggccgccauagugacgcaacuaucccuagcccuggcggauuuggcucugcagaugcccgauuggcgaacgcccgcguuggauuugaucggcagguucagugcggggaacaacguguggcccuugcucgaagugcugacggugcuccccgaggaauuggagagcagaucagugagauuaggagaaaaucgucgauacgagguguuggaagauaugaaauucugcgcucccaccgucaaugaauuucucaagcauuguucgaacuuguacgggcgaggcggcgccgagaggcuagcggcgggcgauagacaaaucgacgugaaaauccugagauguuucgcuucguggauaucggucggggcgaucgggccgagccaauugagcgaggaucgcgugguggucgacauggcuuucgacguguugaaagcggccguacggggagacgaaaaagaaacccuaacaggucaacuucacgaagccgccacggauugcauuugcacacugcugcuacgucucgaggacaacaacaaccacguggcguuggagacccacuuauuugaaaauauaguaaaucuggaaguggccuaucaugcgucugucgcccucgaagaucaagcaaagucgacggauuauugucggcuguucaccgaguuggccgaaucguuuuugggaaagauuguggacgacgggggaggcggcggcggcggcgacggcgggggagcuaagaggcguaccguguacgccguuaaaugucuagauuuaguacugaugugcgucggccaucaugauuaugagguggccgagauaacguuuaaccuuuggcauaugcuaagcgaggaauuauaucagaaaaauaacaaggaauuaacggaauuguucaaaccguauguggaaagauugaucacggccuuauguaggcauugccagauggagccggacauggagggucuacucgaaaaaggagacgaauuuaaagauuuuaggaugaaaguuucggaucuaauaaaggacgucgucuuuauaguagguagcagcaguugcuucaggcaaauguucaucaauuuacaaaccacugguguaacgugggacgccagcgaagccgcucucuuuguaaugcaggccguagccaaaaacguucuuccaacugaaaacgaagucguucccaaaguggucgaagccauacugaacauacccaacagcgcgcacguggcggugaaguacaccuccguccuucuacugggcgaauuggccgaauggauagaaaaacacccggacgcucucgaucccguccugaauuuccuagugugcugucuacgcggcggcagcggcgccgaagggggaggcgucgcgacggcggcauccgcggcgcugcagaacgugugcacgugcugcggcgcccacaugggcaggcacgugcccauucuguuacaguuacuucaacagucggauacguucggcaucggcaacacggcgguggugggauugcugaagggcgucgcgucgguggugaguugcggcaugggcggcggcgccgagacggccuccgccguccgggaauuguguucgaugcaauugucgccgcugugcaguuugauggagaacgacguucggccggugaaagggacccugacggauccggugcugugguuggaucgauugaguucgguuuugcgauacguuaacgucaauauagucgaaggcgaaauccauccuugcaagccgguaauauuggagauauggccgauacugucccgagcauucgacaccuaccacagcgacgugcgaauaauggaaaggugcugucguucggugcguuucauguugcgcugcguggcccgccagcugcaggauuugcugcccucuuuggucgggcaaaucgugcacauuuacugucgcuacgggcauucguguugcuuguacgugggcagcaucuugguggacgaguacgccggcgacgcgacuugcgugcaaggucugcucgacauguugaacgccuuuuuggagccgacguuucgcuuguugcaagaggagaacggcuugaagaaccauccggauaccguggacgauuucuuuagguuaugcgcucgauucguacagagggcgccuaaggcguuucuaagcggcggggcccaucuggcgcccauuaugcaaugugcucuucucgccgccaccuuagaucacaaggaggccaacgugucgguuaugaaguuuuucuacgauuugauaaaccagggauugagcgguagaggugagcccgacuucgacgagagaaaagccuuaguuagaagccuacuaaacgaauacggucaacaacuggugucuaauuuaauucacucgugcguauuuuacuugcauucguacauguugagcgaagugggugacguuuuuguacaauuguuggauuucgauagacagaucacgagugaaugguuagcgaacgguuuggaauuauugcccaaacaacaaaaugguggaauaauggcggcuaagccuaagcaauuaaaugauguucaugcuucuauaacgagaucaaacaguucgaaaucugugacgcacgcccucaaagaccuaacuaggcuauaucguuaa

SEQ ID NO: 6357 - RNA, 1509 nt, Phyllotreta atra
auggcgcaacguuuucccggcccggugucgaaucaagucccagggggaccgccgccgccucaaagguaccaacaacagccgccuaaucaaggaaugaggcaauacggccaacagaguuucccuccuaggcccggcuacaacccuccacccccaaauaugcagucuagcggaggcacuaugauacaaagaccuccuggggcaccguauucgccgaugcguggggggcccaugccaccgcagccaguggguaagaggccuucggauaacaggaacccguuacaacagaagaacagcgacuauagucauggcacuaguaagaaaaaaaagaaacucgccgauaaaauucuaccccaaaaaguaagagauuuggugccagaaagccaagccuacauggaccuguuagcuuucgaacguaaacuggauuccaccauuaugcgaaagcgauuagacauccaagaagcccuaaagcgccccaugaagcaaaaaagaaaacugcgaaucuucauuucuaacaccuucuacccagcgaaagaaccccaacccgaaggccccgacggcccuugccaagaaggcacaguagccucaugggaacugagagucgaaggcagacuucuggaagauuccaagaacgauccgaacaaaguaaaacgcaaauucuccucguucuucaagucuuuggucaucgagcucgacaaagaacuauacggacccgacaaccacuuggucgaguggcacagaaccuuaaccacccaagaaaccgauggguuccaggugaagagacccggagacaagaacgugagaugcacgauucuccuacuccucgacuaccaaccucugcaauucaagcucgauccgagacuggcccgauugcuuggcguacacacgcaaacaaggccagugauuauaucggcucuguggcaguauauuaaaacccaccggcuacaagacggccaugaacgcgaguacaucauuugcgacaaguauuuagagcagauuuuuaacuguacucgcaugaaguucgcugaaaucccccaacgauugaacccccugcuacacccaccugauccaaucguuauaaaccacgucauauccguugaagggggcgcugagagcaaacaaacagcuugcuaugauauagauguggaaguugacgacacucugaagacucaaaugaauaauuucuugcugaguacagcgagucagcaggagauucaaggguuagaugcgaagauucacgagacaguggauacgauaaaccaguugaaaaccaacagggaguuuuuccugagcuucgcgaaggauccgcagcaguuuauacauaaguggaucgugucucagacgagggaucugaagaguaugacggaugugguggggaaucccgaggaggagaggcgaucagauuucuucuaucagccgugggcgcaggaggcugugugccgguacuucuacacgaaggugcagcagaagagggccgaguuggagcaggcccucgguauucguaauaauuag

SEQ ID NO: 6358 - RNA, 435 nt, Phyllotreta atra
augccuaaaguacgacgaaguaagaaaccaccgccagaggguugggaacuuaucgagcccacauuggaugaauuagaacaaaaaaugagagaggccgagaccgaaucccacgaaggaaaacgaaagaacgaaucucuguggcccauauucaaaauucaccaccaaaaaucccgauacaucuucgaccucuuuuacagaagaaaggcaaucagccgcgaacuguacgaauauugcuuacuggaaaacaucgcugacaagaauuuaaucgcaaaauggaagaaacaaggcuacgagagccuuuguugccugagaugcauccaagcaagagacaccaauuucggaacgaacugcaucugcaggguccccaaaucuaagcuggaagaaggaaggauugucgaauguguacauugcgguugcagaggauguuccggauaa

SEQ ID NO: 6359 - RNA, 885 nt, Phyllotreta atra
augccagcagcuacucuggguagcauuucacauccuaacaacgaagacugcggcauucgggacguuugggcccacaauuuagaagaugaauuucgaacuauaaggcaaauagugcagaaauaccaauaugucgccauggacacugaauuucccggagucguggccaggcccauaggugaauuccgaaguucggccgauuaccaauaccaaauguuaaggugcaacguagacuuacugagaaucauucaacuagguuuaacguucuuagaugauaaugguaaaacaccaggagguguuuauaccaccuggcaguucaauuuuaaauucaaccuucaagaagacauguaugcacaagauagcaucgauuuacugcaaaauucaggaauccaauucaagaagcacgaagaugaagguaucgagccguuggaguucgccgaauugcuaaugucgucuggaaucguucucauggaaaauaucaaaugguuaucguuucauuccggcuacgauuucggcuauuuaauaaaguuacuaaccgacaacaaucucccacaagaugaaacugaauucuucgaucuguugaaauuguauuuuccuacgauauacgacgugaaguauuuaaugaaaucguguaaaaauuuaaaagguggucuucaagaaguugccgaacaguuagaauuggaaaggauugggccucaacaucaagcuggaucggacucgcuuuugaccggaauggccuuuuucaaaaugaaagagauguuuuuugaggauacuauugacgauucgaaguuuucggggcaccuuuacggacucggcacgucuuucacaguuaaugguacaacuaacaauuacggaaacgauaacggcgacacaacaaauuccucauga

SEQ ID NO: 6360 - RNA, 1212 nt, Phyllotreta atra
auggcggaagcucagaaaaggggcgccucgguguucgaggaccucucgaacgucgaauucgagaccagcgagaacuuagacgugaucgaaaaguucaaagacaugaagcugaaggaggaacugcuucgcggcaucuucgcauaugguuucgagaagccuucggcuauucagcaaagagcuauuauuccugugaugaaaggccgagauguuauagcccaagcacagucagguaccgguaaaaccgcuacauucuccauagcuauucuacaagcccuggauuuaacgaugagagaaacgcagguguuguguuuauccccaacgagagaauuggcuguacagauucaaaaaguuauauuagcucugggcgauuucaugaacguacaaugucaugcuugcaucggggguaccaaccuuggagaagacauuagaaaguuggauuauggacagcacguuguuagugguacaccuggaagaguuuacgacaugauucguagacgagcucugagaaccagaucagugagaaugcuaguccuggaugaagccgacgaaaugcuaaacaaaggcuucaaagaacaaaucuacgauguguacagauuccuuccaccguccacucaagugguucucauaucugcuacguuaccccacgaaaucuuggagauaacguccaaauucaugaccgaucccaucaggauucuagucaaacgugaugaacugacgcuggagggaaucaagcaguuuuucguggccguggagagggaagaauggaaauucgacacccuaugcgaucuguacgacaccuuaaccaucacgcaagccguaauauucugcaacacgaagagaaagguggauugguuaaccgaaaagaugcgagagaauaacuucaccgugaguuccaugcauggagacaugccucagaaggagcgugacaacauuaugaaagaauucagaucaggacagaguagaguuuugaucacuacugacguaugggcuagagguaucgaugugcaacaaguaucguugguuaucaauuacgauuugccaaauaaucgugaguuguauauucaucgaaucggucgaucuggaagguuuggaaggaaggguguugcuaucaauuucguuaaauccgaugauaucaggauuuugagggauauugaacaauauuauucgacgcagauugaugaaaugccuaugaauguggccgauuuaauuuaa

SEQ ID NO: 6361 - RNA, 1602 nt, Phyllotreta atra
augaccgcuccugcugccgguggagaugcaagaggaagaacucuugccuacaaagacaaaagcaaacccgccgauguccgaacuagcaacauuaacgccgcuaaggcuguuugcgaugcaauucguacuaguuuggggcccagaggaauggauaaaaugauacaagcugguaacggagaaguaacuaucacuaacgauggagcaaccauuuuaaaacaaaucaacguuauccauccugcagcaaaaauguugguggaacugucaagagcucaagauaucgaagccggugaugguacgacuuccguugugguuauugccggagcccuuuuagacgcugcggagaaguugcuacaaagaggaauccacccgacggcuauuucggaaucuuuccagagggccgcccauuuggcugucgagauucuacaagaaauuucaacacccguagaaaucacuaacagggaguuauuaaucaaaagugcauccacuucguugaauucuaaagucguaucucaacagucgagucucuuagguccuuuggcagucgaugcuguucuuaaaauuguugaaccagggcaagaacaagcauguaacuuauuggacgucaaagugauuaaacaauugggugguacuguagaagauaccgaguugauugaggguaucguuuucucgcagaaaucugcuaacguaucuggccccaagagaaucgaaaaggcuaagauugguuuaauccaauucugcauuucuccuccgaaaaccgacauggaccacaauguuauuguaucagauuaugcugccauggaucgaguuuugaaggaagaaagagcuuacauuuugaacauuguuaaacagaucaagaaagccgguuguaacguacuuuugguucagaaaucgauucucagagaugcugucuccgaucuggcccuucacuuuuuggauaaaauaaagugcaugguugucaaggauauugagcgagaagauguagaauucguaugcaaaucguuggguugucggccaaucgcaucacucgaucauuucaccgcagagaaucuaguaacugcugauuuggucgaagaaguuggaguaggcgguaaccgaauggugaaaauaacagguauucaaaacgccgggcguacuguuacccugcuugugagaggcucgaauaaacuaguauuagaggaggcugagaggucucugcacgacgcucuuugcgucauucguugucuuguucgcaagaaggcgcugaucgcagguggcggggcaccggaaauugaagucgcucuuaagcuggcugcuauggcuaauaaguuggagggcauugaugcuauuugcaccagagcuuacgcuacugcuuuggaaaucauaccguuuacuuuggcggaaaaugcuggauugaauccuauacagacaguuacugaacugaggaacagacaugcuaaaggugaaacuucagcugguauuaauguucguaagggaaccauuacggacauuuuggaagagaauguuguacaaccgcuguuaguuagcacaucugcuuugagcuuugccaccgaaaccgucagauccauauuaaaaauugaugauauugugaacacaauaacauaa

SEQ ID NO: 6362 - RNA, 1230 nt, Phyllotreta atra
auggaggcuauggagauuguaauaccagagaaagaggaaggcagcccugccgaagucaagcaaggccggcaagagcuagacauggaggauuuguacacgaaauacaagaaacuacaacaaacccuggaauuccuagaaguccaggaggaguacaucaaagacgagcagaggaacuugaaaaaggaguaccugcacgcacaagaagaagucaaacguauccaaucaguaccgcuggucaucggccaauuuuuagaagcgguagaucagaauaccggcaucguuggcucaacuaccggcucgaauuacuacguucgcauucucuccaccaucgacagggagcuacugaaacccucugccagcguagcccugcacaagcacagcaacgcuuugguggacguguuaccccccgaagccgauuccuccauuagcaugcuccaagccgacgagaaaccggacgugcaauacagcgacaucggagguauggauaugcaaaagcaggagauucgcgaggccguggagcugccguugacccacuucgagcuguacaaacaaaucgguauagacccgccgaggggcgugcugauguacgggccccccggcugcggcaaaaccaugcuggcuaaagcuguagcucaucacaccacagccgcuuucauucgagugguggguucggaguucgugcagaaguaccugggcgaggggccuaggaugguuagagauguguuucguuuagcuaaggagaauucgccggcuauuauauucaucgaugaaaucgaugcgauagcuacuaagagauucgaugcucagaccggagccgaucgggaggugcagaggauccuguuggaauuguugaaucaaauggacggguucgaucaaaccaccaacgugaagguaauaauggcuacgaaucgagcugauacguuggauccugcucugcuuaggccgggucguuuggauaggaaaaucgaauucccguugcccgauagaaggcaaaagcgguugauuuuuaguacuaucacuucgaaaaugaaucuauccgaagagguugauuuggaggauuacguugccaggccugauagaauauccggggcggauauuaaugccauuugccaggaagcggggaugcaugcuguaagggagaaucguuacaucguguugccgcaagauuucgaaaaggguuacaagaauuauaucaagaacgaugaaagcgagcaugaguuuuaccaauaa

SEQ ID NO: 6363 - RNA, 489 nt, Phyllotreta atra
augccaaauauaaagcugcaaucuucggacggcgagaccuucgaaaucgacgucgaaaucgccaagugcucggugacgauaaaaaccaugcuggaggaccucggcauggacgaggaagaggaggaaguggugccguugcccaacguaaacucagccauucuacggaaggucauccaaugggccaccuaccacaaagacgacccacccccgcccgaagacgacgacaacaaggagaagcgaacggacgacauauccucgugggacgcggauuucuugaaagucgaucaaggaacgcuguucgaacugauccuagccgcgaacuaucucgauauaaaaggcuugcucgauguuacuuguaagacuguggccaacaugauaaagggcaaagcgccggaggagauacguaaaacguuuaacaucaaaaacgauuucacgccguccgaggaagagcaagugcgcaaggagaacgaauggugcgaggagaaauag

SEQ ID NO: 6364 - RNA, 930 nt, Phyllotreta atra
auggacgauaaggcuucauguaaggaacuagaucaauggauagaacaguuaaaugacuguaagcaauuaaccgaaaaccaagugaaaacucugugugauaaggcgaaagaaauacuguccaaagaaucaaaugugcaggagguaaaauguccugucaccgucugcggagaugugcacgggcaauuucacgaucugauggaauuauuuaggauagguggccgaaguccagauacgaauuaccuuuuuaugggugacuaugucgaccguggguauuauuccgucgagacuguuacucuuuugguggcuuugaaagucagguauaaagaaagaaucacgauccugaggggaaaccaugaaucaagacaaaucacucaaguauauggauucuacgacgagugccugcgaaaauacggaaacgcgaacguuuggaaauucuucaccgaucuguucgauuacuugccgcuuacggcgcucgucgauagucaaauauucuguuugcacggagggcucaguccuagcaucgauaccuuggaccauauuagagccuuagaucguuuacaagagguuccucacgaaggcccgaugugcgaucugcucuggucggaucccgacgaucgcggagguuggggcauuucuccucgcggcgcaggauauaccuuuggacaggauauaucggaaacguucaaccacagcaacgguuugacgcuggucucucgggcccaucagcucgucauggagggguacaauuggugccacgacagaaacguuguaacaaucuucagugcuccgaacuacugcuauagaugugguaaucaagcugccauuauggaauuagaugaugcgcuuaaauauucauucuuacaauuugauccagcaccgagacguggugagccucacguuacccgcagaacuccggauuauuuccuuuaa

SEQ ID NO: 6365 - RNA, 1602 nt, Phyllotreta atra
augcaaauauucguuaaaacucuuacugguaaaacuauaacccucgaaguugaaccaucugauacuaucgagaacguuaaggcuaaaauccaagacaaagaggggauuccuccagaucagcaacgucuaaucuucgccggaaagcaacuggaagacggaagaaccuuguccgacuacaacauucagaaagaguccacacugcauuuaguucuucgucuacguggaggaaugcaaauauucgucaaaacucuuacugguaaaacuauaacccucgaaguugaaccaucugauacuaucgagaacguuaaggcgaaaauccaagacaaagaggggauuccuccagaucagcaacguuuaaucuucgccgguaaacaacuggaagauggaagaaccuuauccgacuacaauauucaaaaagaaucuacucuacauuuaguacuucgucuccguggagggaugcaaauauucguuaaaacucuuacugguaaaacuauaacccucgaaguugaaccaucugauacuauugagaacgugaaggccaaaauccaagacaaagaggggaucccaccagaucagcaacgucuaaucuucgccgguaaacaacuggaagauggaagaacauugucugacuacaacauucagaaagaguccacauugcauuuaguucuucgucuacguggaggaaugcaaauauucguuaaaacucuuacugguaaaacuauaacccucgaaguugaaccaucugauucuauugagaacguuaaggccaaaauccaagacaaagagggaaucccgccagaucagcaacgucuaaucuucgccgguaaacaacuggaagauggcagaacauugucugacuacaauauucaaaaagaguccacacugcauuuaguucuucgucuacguggaggaaugcaaauauucguuaaaacucuuacugguaaaacaauuacucuugaaguugaaccgucugauacuaucgaaaauguuaaggccaaaauccaagacaaagaggguauuccuccagaucaacaacguuuaaucuucgcuggcaaacaacuggaagacggaagaaccuugucugacuacaacauucagaaagaguccacucugcauuuaguucuucgucuacguggaggaaugcaaauauucgucaaaacucuuacugguaaaacaauuacucuugaaguugagccgucugauacuaucgagaacguuaaggccaaaauccaagacaaagaaggaauuccuccagaucaacaacguuugaucuuugccggcaagcaacuggaagauggaagaaccuuguccgacuacaacauucagaaagaguccacacugcauuuaguucuucgucuacguggagggaugcaaauauucguuaaaacucuuacugguaaaacuaucacucuugaaguugaaucaucugauacuaucgaaaauguuaaagccaaaauccaagacaaagaggguauuccuccagaucaacaacguuuaaucuucgcuggaaagcaacuggaagacggaagaaccuuaucugacuacaauauucaaaaagaaucuacucuacauuuaguacuucgucuccguggagggauguga

SEQ ID NO: 6366 - RNA, 1623 nt, Phyllotreta atra
augaugcaaccacagauauuacuccucaaagaaggcacugauucgucgcagggcaagccccaguugauaucuaacauaaaugcgugccagaguauaguggacgcuauacgcacaacucugggccccaggggcauggacaaacugauaguuuccaacagaggcucggccaccaucucaaacgacggagcgacaauacuaaaucuacuagacguagugcacccagcagcgaaaacucuaguugacauagcgaagucacaagacgccgaaguaggcgauggcacgaccucagucgugcuguuagccggcgaguuucugaagcaacucaaguccuacaucgaagaaggcguccacccgaggaucaucaucagagccgugcggaaggccacccagaucugcuuggagaagaucaacgcgcuggccgucaaaaucgacaaauccaacgccgaggaauacagaucguugcuggacaaaugcgccgccaccgcgaugagcucgaagcugaucaacaaacagaaaucguucuucuccaaaaugguagucgacgccguguugcuccucgaugagcuccugccguugaacaugaucgguauaaagaagguccaaggcggcgguuuggaggaauccaugcugguggcuggaguggccuucaagaaaaccuucucguacgccggguucgaaaugcagcccaagaucuacaaagacugcaagaucgcccuguugaacaucgaauuagaacugaaagcggagagggacaacgccgagauccguuugagcagcgucaaggaauaccaaaaaguagucgaugccgaguggaacauccuguacaacaaacucgagaaaaucuacgaauccggugcuaacgucguacuauccaaacuacccaucggcgacguugccacgcaguacuucgccgacagggacauguucugcgcuggcagaguccaagaagaagacaugaagaggacuuugaaagccugcgguggcuccgugaugaccacagccaacgauuugaaagaugaagugcuagguaaaugccagcuguucgaagagaaacaaauaggaggcgaacgguacaacuucuucaaaggcugucccaacgccaaaaccugcaccaucauccuacgagguggagccgagcaauucuuagaagaaaccgaaagaucccuacacgaugcuaucaugauuguacgcagaacaaucaaaaacgacucgaucguagcaggcgguggagcaauagaaauggagcugucgaaauuacuuagggauuacucucguacuaucgccgguaaagaacaacuccugaucggagcuauagcaaaagcgcuagaaauaaucccuagacagcuaugugacaaugcuggauucgaugcuacaaauauacugaacaaacugcgacagaagcacgcucagggcaauucuugguacggaguggacgucaacauggaagauauugcggauaacuacgaaacuugcgugugggaaccagccauuauaaaaauuaacgcuuuaacagcggcugcggaggccacuugcuugaucuugucuguggaugagacgaucaagaaccagaaaucugaagcgcccccgcaaaugggaggacguggaaugggcagacccauguaa

SEQ ID NO: 6367 - RNA, 10845 nt, Phyllotreta atra
augggggacuccuuagaagccucggaaacggcucaugaaacucaaaauguggcauuaguggauuucacugcguuuucaaauuuuauuuugaaagcggcuacuguacuguugcccgaagaugauagccaagcggaaccggcuaaccuuauagcagcuauagaugacaaaaccaaucaggaauguauaaagaaauucauaagcgauccccaaauugugauacuguauguccaaaggaacucuucaaaagaugaugacaauguccagccucccgaaggagaagaagaaaaagaaccuguuacuuacuacaucagcaaugaagugcauuauucuaauucgaaaauguccaguuuggugugcaucaaaagggguccggugauagaagcugauaaaagcauuagagcucagguucgcuugaugaacuucagcgaaggguccccuuaugaaauucugcacgauuaugucaguagaaccguugccccuuacuucaaaucuuacguaaaagaaucagguagagcugaucgugauggugauaaaauggcgccugcaguugaaaaaaccaucgccgaauuagagaugggacuucugcaucugcaacaaaauauagauauuccggaaauaacgcuucaaguacauccguacguugccagccuuauaaagcaaugcgccgaugaaggaaggaagccgaaagucgccgauuuuagugacaaaguggacgacucgaacuuucucaaccaacuucaacauggaguaaaucguuggaucaaagaaauucaaaaaguaacaaaauuagacagagaccccucuucuggcacagcccuccaagaaauuaguuuuuggcucaaucuggaaagggcccuucaccgcauccaagaaaaacgcgaaagcauggaaguagcucuaacauuagacauccucaagcacgguaaacguuuucacgccacaguaucuuucgauaccgauacagggcugaaacaagccauagcuacagucaacgauuacaauccgcucaugaaggauuucccaauuaacgaucuuuuggcugcgaccgaguuggagcgaauucgcgccgcuguucagaugauuuuuucccaucuaaggaaggucagaucuacuaaauaucccaucacgaggugcuuaagacuggucgaagccauuucgagagaucugggcaugcaguuauugaaaguauuggguacccgccguuuaaugcacauuccauucgacgaauucgaaaaagucaugacccaauguuuugaaguguucucgauuugggaugacgaauacgagaaauuacaaggacuccucagagauaucaugaagaagaaacgagacgaacauaugaaaauggucuggcgcauuucgccgcaacauaaaaaacugcaaagccgaauggaucaaaugcgcaaauuucgcagacagcacgaacagcugcguacgguuauaguacguguauugagaccaaguguaaaagagagcgcagugcccguugaaggaagugauaucgaaccuccaaaaccaacauuuucccuugaugcugcagaugcaaaugcuauugaggaaguaaauuuggcguaugagaacguaaaagaagucgacugucucgacauuacuaaggaagggcaagaugcuugggaugcugcuguacaacgauacgaagagcggaucgauagagucgaaaccaggaucaccgcacaucuucgcgaucaauugggaacggccaaaaacgccaaugagauguuuagaauuuucucgcguuuuaacgcccuguucgucagaccucacauuaggggagcuauaagggaauaccaaacccaucuaauucaaagagugaaagacgauauugaagcacugcaugaaaaauucaaaguucaauauccgcaaaguaacagugcuaaaauuaguaaagugagagauuugccgccuguagcugguucuauagucugggccaagcaaauugaucaucaacuaacaacauauuugaggcggguugaagaugugcuagggaaagguugggagaaccacaucgaaggacagaaacucaaagccgacggagacagcuuucguuugaagcuaaacacccaagaaauauucgaugauugggcgcgaaacgugcagcaacguaaucucggcgugucuggaaggauauuuaccaucgaagccgugagauccaggaguggucgcgguaacguucuuaaauugaaggucaacuuccuaccggagaucauuacacuggcuaaggaagugcguaauuugaagugccugggauucagaguaccguuggccauaguuaauaaggcucaucaagcgaaucaacuuuauccauucgccauaucgcucaucgaaagcauccgaaccuaugaaaugacuuuggagaagaucgaagacaaagccagcauuauuccgcucgucgcuggcaugcgaaaagaaguccaacuaguccuagccgaaggaauacaacuaguaugggaaagcuacaaacuggaccucuacguacagagacuuucagaccuaguuguggguuuccaagagcgagucgaagagcugguuuucgucggcgagcaauuagaaguagacgucagaucguuggaaacguguccuuacuccgccaacaccuucgccgacauauuaucgaagauccaacacgcugucgacgaucuaucccugaagcaguucucgaaccugcacauuuggguguugcgauuggacgaggaagucgagaagaaccucgccaggcgacuccaagcgggcgucgaagccuggacggaagccuuaagcggccagaagaaagaaaucgaucauagcauggacacggacgccccggcccaacccacccacaaacccggaggcgauccccaaauccaaaccaugauacacgaagugcgaaucaccaaucaaaccauguacuuguuuccgagcaucgaagaggcccgguuccugauuaugcagcaauuguucgcuuggcaggcgaucgugacgugccagcaacgucuucaaagcagccgcuaccaagugggcguggauaagccggucguugaaacuuacaggaauauuuugacuagauuaccggccggcgcucaaccguugaucaacgcuuacagugcuauuucuucuaaaauuaaagagguucaaaauuauguaaaugaaugguuaacuuaccagucucugugggaucugcaagcugauaaucuuuacgggaaacugggagaagauauuagcaaauggauggaaugucugaaugacauaaagaaaacucgaacuacauucgauacaucagacacucgccgcgaauucggcccuauagucauagacuucgcuaaaguccagagcaaaguuucucucaaguacgacucuuggcacaaagaaaccuuaagcaaauucggaagccucuugagcaacgaaaugaccuccuuccacucuaacguauccaaauccagauccgaucuagaauugcaaagcaucgaggcagccagcacuucagacgcugucagcuuuauaacguacguucaacaauugaaacgaaacaugaaagcuugggagaagcagguagacaucuacaaagaaggucagaggauccuggaacgccagcgauuccaguucccaacgaacugguugcacguggagaacuuggagggcgaauggggagcauucaacgaaaucaucaagaggaaagauucgagcauucaaacccaagucgcuagucuucagcaaaagauuguuucagaagacaaagcaguggaaagccgcaccaacgauuucuugguagacugggaaaggagcaagccgguggaaggccaucuuagaccggacgacgcccucucgcagcuacaacuauucgagaguaaauuuucgcgacucaaggaagaacgcgacaaugucgcuaaagcuaaagaagcuuuggacuugcaagacccaggcggcauaagcacuagcgaagauaaaaugcaagucguuuacgaggaauugcaagauuugcgaggcguuugguccgaauuguccagaauuuggcagcaaaucgacgaaaccagagagaaaccuuggcuuuccauucaaccgagaaaacucaggcaacaauuggaccaacucucaacgcaacuccgagaauuaccggcccggcugagacaauacgccuccuacgaauacgugaagaaaacucuucaaaccuacaccaaagucaacaugcuaauaguggaauuaaaauccgacgcccucaaggaacgccacuggaagcaacucaugaagcaacugagagucaacuggguccucuccgauuuaacgcucggccaaguaugggacgucaaucuccaaaaaaacgaaaugaucguuaaagaugucauucugguagcccaaggggaaauggcccucgaagaguuccugaagcaagugcgagaauccuggcaaaacuacgaacuggacuugaucaauuaccaaaacaagugcaaacugaucagaggaugggacgaucucuucaacaaagucaaagaacacaucaacuccgucgccgccaugaagcuguccccguacuacaaggucuucgaagaggaagcaucgacuugggaagaaaaauuaaaucgcaucaacgcuuuauucgauguauggauagacguucaaaggcgcuggguguauuuagaaggaauauucuccgguagcgcggacaucaagacgcuccuaccgguggaaacgucgcguuuccagagcaucagcuccgauuucuugggauugaugaagaaggucagcaagaguccgauggugauggauauuguaaauauucuaggcguacaacgcgugcuggaaagacucgccgauuuauuaggaaaaauccaaaaagcguugggcgaauacuuggaaagagaacguacaucuuucccucgauucuacuucgugggugacgaagaucuccuggaaaucaucggcaacagcaaaaacgucgcgagauuacaaaagcauuucaaaaaaauguucgccggcguagcuuccauauuauuaaacgacaacaacacuguuauuaccgguauagcuucaagagaaggcgaagaagugguauucaaaacgccaguuuccaccguagagcauccaaaaaucaacgaauggcugaguuuggucgaaaaagaaaugcgcgucacauuagccucgaaucuaacgcaagccguacaagauauuaaacaauucaaagaugaaaucgacucgaaauccuacauggaauggguagacaaauaucaagcgcagauugugguguuagcugcgcagauucucuggagcgaagacgucgaagcugcgcucgucaaaaugaacagcgaaccucaaagaggcguguuggaaaaaguccugcaacaagucgagaauacucucaacguacuagcggauuccguuuugcaagagcaaccccaguugagaaggaagaaacuggagcacuugaucaacgaguuugugcacaaaagaacugugaccaggaggcucaucgcuaacggggugugcagcaacaaggcguucgaauggcugugcgaaaugagguucuacuucgaucccagacaaaccgaaguucuuaaacaauuaacgauucauauggcgaacgcuagguucuacuacggauuugaauaccucggcgugcaagauagauuagugcaaacuccucuaacggauagguguuacuugacuaugacacaagcuuuggaagcccggcugggaggaucuccuuucggacccgcuggaacugguaagacugaauccgucaaggcgcuaggaaaccagcuaggucguuucgugcucguguuuaauugcgacgagacguucgacuuccaagccaugggcagaauauucguggguuuaugucaagugggcgcuugggguuguuucgacgaauucaacagauuagaagaaagaauguuguccgccguuucgcaacaaauacaaacuauacaggaagcuuugaaaucccagauggaagcugccgccgaaggagucgccaccggcaguauaagcgucgagcucgugggaaaacaaguaaaaguguccccugauauggcuaucuucauuacgaugaauccuggcuaugcgggucguucgaauuugccagauaauuugaagaaauuguucagaucguuggccaugacuacgcccgacagacaacuuaucgccgaagugaugcuguucucucaaggauucagacaggccgaaaaauuggcuucgaaaauuguacccuucuuuagauuaugcgaugaacaauuguccaaucaaucucauuacgauuuugguuugagagcuuuaaaauccguacuaauaucggcgggaaacguaaaaagagauagaauucaaagaauaaaagaagguaugacccaacgaggcgaaacuaacauagaugaagcaaacauagccgagaauuuaccagagcaagaaauauuaauucaaucaguuugugagacuaugguccccaaauuagucgcugaagauauuccauugcuguucagcuuguugaaugacguguuucccaacguacaauacaccagagccgaaauggaaggucuuaaggaugaaauuagaaaaguguguaacgaagaguaccucgucugcggagaaggcgacgaaagggguucagcuuggauggaaaaaguacuacaauuauaccaaauuucgaaucuuaaccacggucucaugauggucggcccgagcgguucggguaaaaguucagcguggcgaguucugcucaaagcucuagaacgauuugaaggaacagaaggaguugcccauguaauugauccgaaagcgaucagcaaagagacuuuauaugguguuuuggaucccaauaccagagaauggacagauggucuguucacccauauucuaagaaaaauuauagacaacgugagaggugaaauuaacaaacgccaauggauuaucuucgauggugacgucgaucccgaauggguggaaaauuugaacucuguucucgacgacaacaaauuguugacucuucccaacggagaacgucuuucucugccaccuaacguuagaguuauguuugagguacaagauuuaaaguaugccacuuuagcuacaguuucgcguuguggcauggugugguucucagaagacguauuauccacagaaaugauauucgaaaauuacauucuucgacugaggaacauuccacucgaagaaagcgaagagggcuucggcaagaaaucggacaugaaagacgacauguugucuccgacacuucaauugcaacucgacguuguaaaucuacuucaaccguuuuugggacccgauggccuuguaguacgcuguuuggaguacgccauggaacaagaacacauaauggacuucacgcgacucagagcucugagcuccuuguucuccaugcucaaucaagcagugagaaaugucuugcaguacaaucacaugcaucccgauuuuccucugucuagcgaagcccucgacaaauacauacccaaauguuugauauauucgaucuuguggagcuuugccggcgaugcgaaacucaaaguuagaucggaauugggcgauuucauuagauccgucaccacuguacccuuaccguccgaucgcaacuugccuauuaucgauuacgaaguuacuaucgaaggagaauggucgcuuuggucuaacaaagugccgcaaaucgagguugaaacucacaaagucgccucaccugauaucguggugccuacguuggacacaguuagacacgaaucuuugcuguacacuugguuggcggaacacaaaccgauaguauugugcgguccacccgguucugguaaaacgaugaccuuauucuccgcauugagagcucuaccagauauggaagucguugguuugaauuucucuucagcaacaacuccggaguugcuguuaaaaaccuuugaucauuacugugaauacagaaaaacgccaaauggcguuauccuaucgccaauacaguuaggcaaauggcuuguacucuucugcgacgaaaucaaccuaccggacauggacaauuacggcacccaacgcgucaucauguuucuccgucaaauaguggagcaaaaaggcuucuaccgcgcuucagaccaaaccugggugucauuggaacgcauacaauucguaggcgcuugcaaucccccaacggaccccggacgaaaaccccucucucaccguuuccucaggcacguacccgucguuuacguggacuacccaggcgaaacgucgcucaaacaaauuuacggcaccuucacgagagcaaugcugagacuagccccgggacugaagggcuacgcggaaccguuaacuaacuccaugguggaguucuacuuguccucgcaggauagguucacucaagacaugcaaccucacuacguguacuccccucgugaaaugacgagaugggugagaggcauaugcgaagccaucagaccuuuagacaaucuuuccguggaagguuuggugagauugugggcccacgaagcgcuucgacuguuccaagacagguuaguggaagacaccgaaaggcgauggacgaacgaaaacaucgaugcugucgcuuugaagcauuucccaucggcggauugcgaaaaagccuuagaacggccuauucuauacagcaauuggcuauccaaggauuacguaccgguaggaagagagcaacuaagagaauacgucaaggcuagguugaaaguguucuacgaagaagaacuggacguuccuuugguacucuucgaugaggugcuagaucacguucucaggaucgacaggauuuucagacaaccgcaaggucauuugcucuugauuggugugucuggagccgggaaaaccacucugucgagguucguggcuuggaugaacggauuguccauauuccaaaucaagguucacaacaaauauaccgcugacgauuucgaugaagacuugagaucgguuuugagaagaagcggaugcaaacacgaaaagaucgcguucauuuuagacgagucuaauauguuggauucgaguuucuuggaaagaaugaauacucuucuagcuaacggcgagguuccuggauuauucgaaggagacgaauauacaacucuaaugacacagugcaaagaaggagcccaaagagaaggauuaauguuggauucgaacgaugaacuauacaagugguucacgcagcaaguuaugagaaauuugcacguaguuuuuacgaugaauccuucaacugauggauugaaggacagggcugcuaccucuccugcuuuauucaacagauguguuuugaauugguuuggagauugguccgauggagcucuuuuccaggucggaaaagaauuuacgaaucguuuggaucucgagaaacaaaguuggaaaugucccgauuucuucccugcuucuugcaacaacauuucugcuucgcccaaucacagagaagccgucaucaaugccugcguauacguucaucagacccuucauaaggcgaacagcagauuagugaagagaggaagucgaaccauggcgaucacuccuaggcacuacuuggauuucauucaccaucucgucaaauuguacaaugaaaagcgguccgauuuagaggagcaacaacuccaucuuaacgucgguuugaacaagaucgccgaaaccguggaacagguggaagagaugcaaaagaguuuggcuguaaaaucucaagaauugcaagcgaaaaacgaugccgccaacgcuaagcugagacaaaugguaaaggaucagcaagaagccgaaaagaagaaaguucaaagucaagaaauucaacagcaacucgcucagcaaacugugcacaucaagcagaagaaaucugaaguaauggccgauuuggaacaaguagaaccggccguuaucgaagcucagcaagcuguaaaauccaucaaaaaacaacaauuaguagaaauccguaccauggcgaauccuccagcucuaguaaaacuggcgcuagaaucaauuugccugcuauugggagagaacgccagcgacuggaaauccauucgagccgugauuaugagagacaauuucaucaacagcguuguuaauuucaacaccgaagauaucagugacgaugucagagaaaaaaugaaaggccgcuauuugagcaaccccgauuaccagaucgacaaaaucuaucacgccaguaacgccugcggcccgcuggugaagugggcgugcgcccaagucgaguacgccgacaugcugaagaaggucgagccgcugcgagaagaguugcagucucuggaaacgcaagccgaaaccaaccagaagcgcggcgaagacgucaaaguucucaucggccaacucgagcaaaguaucgccucuuacaaggaggaauacgcccagcugaucgcccaagcucaggccaucaaaaccgauuuggagaacguccaagcuaaaguugaccgaucgauagcccuucucaaaucgcuggucaucgaaagggagagaugggaggccagcagcgagacguucaggucgcaaaugucuacuaucaucggggacguucuguuauccgccgcguucauugcauacggaggcuacuuugaccaacauuaccgucaaaaucucuucagcacuuggugucaacauuuaacucuagcuaacauccaauacagagccgacaucgcuagaacggaauaccuaucgaaucccgacgaaaggcucagauggcaagccaacgcuuuaccaucggacgaucugugcacggaaaacgccaucaugcuaaagagauucaacagauacccgcucaucaucgacccgucgggucaagccaccgaauucauaaugaacgaauucaaagacaaaaagaucacgaagaccagcuucuuggacgacuccuucaggaagaaccuggaa

SEQ ID NO: 6368 - RNA, 2673 nt, Phyllotreta atra
augagucgucagggccccagcaaacguuacgacucggauucggacuccgauagcguggacagcgcggaggaggcccgaaagcgggacuugcaggaacgagaugaauuugccaaucgucucaaaaagcgggaugaggaucguacgaggaacguagugcagaauuucgauaaaagaaccuacgaggaggcggcgaagcgccugaaguuggacaacgccggcagagauaaggugauaucggagcuucgaaagaccucgagauggaaguaccuggagaagaggaaggacgacaagcugcaggaauuggaggccgauauuguggaugaugaguacuuguucgaagaggaaauauuaacggagagggaaaagaaggagcgccagcacaagaaggaauuguuacagcuagcccaggagcaugagaaggcgcgggaacuggaacgcauucaacgcuaccacaugccgagggacuuggguaaagauucgacagcggauuacaucgaaguggacgaacuggaaaaaguaccgcaauccgaacagaagaaaugggagaaagaccaaauggcuucggcugucuucaaauucggggcuaaagaugucaagaaaaccgacgauuacgaacuacuauuagaagaucaaaucgauuucauacaagccuuacaaaugccuggaagcagcgagaagaaaguaccggaacuauccgacguacaaaagaagaaacucaccaucgaagaaacgaaaaaaagccuaccgauuuacccuuucagagacgaucuaauccaagccguuaaagaguaccaagugcugauuauaaaaggugaaaccgguucgggaaaaaccacacaaauaccgcaguaccuccacgaagccgguuucacugcugaugguaaaaaaaucgguugcacccagccuagaagagucgcugcuaugucaguagcagccagaguagcccaagaaauggacguaaagcuaggcaacgaagucggauacgccaucagauucgaagauugcacauccgaacgaaccguuauaaaauacaugaccgaugguacuuuacacagagaguuucuaucagaaccggacuugcaauccuacagugugaugauuauagacgaagcucacgaacgaacgcuucacacugauauauuauucgguuuggugaaagacauagcuagauuuagaccagauuugaagcuguuaauauccagugcuacguuagauguuaccaaguuuucggaauucuucgacgaugcuccgguguaccaaaucccaggcaggagauucccaguggauauuuacuacacgaaagcccccgaagcagauuacguagacgcuugcguuguuucaauacuacaaauacauguaacucaaccauugggcgauauuuuaguauucuugacgggucaagaugaaaucgaaacuugccaugaacuccugcaggaucgaguaagauguuuggguucaaaaguuaaagaacugauuauacuuccguuguaugcgaaccuuccgagugaucugcaagcuaaaauauucgagccuacuccaccgggggcuagaaagguuauccuugcuacuaauaucgcagaaacuucacuaacaaucgauaauaucaucuacguuauugauccagguuuugccaagcaaaaccacuucaauuccagaaccggaauggagaguuugaugguggugccuauaucuaaagcuucggcuaaccagcgagcuggaagggcuggaagaguagcugccggaaagugcuuuagguuguacacggccugguccuauaagcacgaauuggaggaaacuaccguuccugagauacagagaaucaacuuggggaacgcuguguugauguugaaggcguuggggauuaacgauuuggugcauuucgauuuucuggauccaccaccgcacgagacgcugguguuggcuuuggagcaguuguacgcuuuaggggcuuugaaucaucacggcgaauugacuaaauugggaagaagaauggcugaauuaccgguggauccgaugauggcgaaaaugauauuggcaucugagaaauacaaguguuccgaagaaauagucacuauaggagcuauguugucaguaaauggggcaauauuuuacagaccgaaagauaagauuauccaugcggauacggcuaggaagaacuucaaucacuuggcuggcgaucauuugagucuucugaacguuuauaaucaauggagagacuccgauuacucguugcaaugguguuaugaaaacuucauucaacacagaucgaugaaacgagccagagacgucagagaacaacuagucaacuuaaugaccagaguagaaaucgaaauaguauccggaaucgaugaaaccgacaacguccgcaaggcuauuacaucuggauacuucuaucauauugccagguuuuccaaaggugguaguuacaaaacggugaagcacaaucaaagcguuacuauacacccgaacagugcuuuguucgaaacguugccgcgguggauuuuguaccacgaguuaguguuuacgacuaaggaauucaugaggcaagucaucgaaaucgagaguaaguggcuguuggaaguggcgccgcauuacuacaaggccaaggaauuggaagauuccaccaauaagaaaaugcccaaaacugucggaagaaguaaaaugacugauuaa

SEQ ID NO: 6369 - RNA, 1371 nt, Phyllotreta atra
augaagguagaagaggugaaaagcacggugaaaacucaacgaauaagcgcccauacucacauaaagggcuugggauuagaugaaggggguuucgcaaucccuucggcggccggccucgucggucaggagcaggcuagagaggcugcaggagucgucguggacaugauaaggagcaagaaaauggcugguagggcuguccuucuagccgguccuccagguacggguaaaacagccauugcccuggcaauugcccaagaauugggcaacaaagugccauuuugccccauggugggcucugaagucuacagcacggaaauaaagaaaaccgaaguacucauggaaaauuucagacgagccaucgggcuuagaauuagagaaacgaaggaagucuacgaaggagaagucagcgaacuaacuccugucgaaacagaaaacccagcaggagguuacgguaaaaccgucagucacguuguaaucgguuugcggacggccaagggcagcaagcaauugaagcuggaucccagcauauacgaggcccugcaaaaggagaaggucgaggugggagaugucauuuacaucgaggccaccagcggggcugugaaacgacagggaagguccgaugcuuaugccacggaauucgauuuggaagccgaggaauacgugccccuuccgaagggggaugugcacaagaagaaggaaguuguacaggauguuacuuuacaugauuuggacgcugcuaaugcgaaaccgcaggguggucaagacguguuguccaugauggggcaacuguuaaaaccaaagaaaaccgaaauaacagauaaacucagaaaggaaaucaauaaaauuguugacaaauacauugaucaagguauugcugaauugguaccggguguauuauucaucgacgaaguucauauguuggauauagaaacguuuacuuaucuccauagagcuuuggaaagcgccauagccccgauuguuauuuuugcuacuaauagaggucguugucuuauuagaggaaccgaugauguauuuucuccgcauggaauuccauuagaucuucuagauaggcugcugauuauccguacgauuccuuacaacaaauccgaaauggagcaaauuauuaaauugcgagcaguuacggaagguuuggaaauugaucaggaagcaaucucaaguuugggagaaguugggacaaaggccacucugagauacgcaguucaacuauuaacaccgucauuuuuaacggcuaaaauuaauggaaggaguaacauucugcaaagugauguugaagagauugguugucuauuccucgaugccaaaucuucugcuaaaauacuuaccgagcauaaagauaaauuuaugacguaa

SEQ ID NO: 6370 - RNA, 1557 nt, Phyllotreta atra
augaccucaauaauuaaaguacaagccuuauccggcgccaaagaugaaucucccccuuguuaccucuugcaggucgacgacguuagaauucuauuagauugcgguugggaugaaaaauuugauauggaauucauaaaagagcuuaagaggcauguacauacaauagaugcaguguuaauaucuuacccggauaacuaccauuuaggagcucugccuuacgcaguugguaaauuagguuuaaauuguccaauauacgccacuauaccaguguacaaaaugggucagauguuuauguacgaucuguaccaaucucaguacaacaugaaagaauuuuguauauuuucucucgaugaugucgaugccacuuucgaaaagguuauucaauugaaauauaaucaaacgguucccuuaaaaggcaaaggauauggcauaacugugacuccucuaccagccggucauaugaucggaggaaccauauggaagguaaauaaaguaggcgaagaagauauuguauacugcaacgauuuuaaucacaaaaaagaaaggcauuugaacgguugcgaacugaagaaacuucaaaggccaucguuacucauaacggaugcauuuaacgcuacauaucaacaggccagacgaagggcgagggaugaaaaauuaaugacuaauauucuccagacuuuacgaaaccacgggaacguccuuauagccguagacacugcugguagaguacuggaauuggcucacauguuagaucaacuguggaggaacaaggaauccggacuuuuggcuuauucguuggcuuuuuugaacaacguuaguuacaaugucgucgaauuugccaaaucacaaauagaauggaugagcgauaaucuaaugaggaguuucgaaggagccagaaacaaucccuuccaguucaaauauuugcagcuaugccacaguuuaggggaguugagcaaagugcccaguccgaaggucguacuggcuaguucgccugauuuggaaaguggauuuucuagggaacuguuuuuacaaugguguucuaauccuaauaacaguauuauauuaacuacaaggaccucaccaggaacuuuagccagggauuuaauagacaauggaggaggaagaaccauagacuugauaguagagcgaagaguuaaauuggaaggccaagaacucgacgauuaugaaaggcgacaaaggucuaaauaugacaaauuagaagaagaugaagccgauuccgauucggauuccgauauugaaaugucagucaccucuaaaggcaaacaugacauuguuaucaaacaagaaggcaaaauauccacaggguuuuuuaaagucaccaaaaaaauguaccccauguauccuuucaaggaagauaaaauaaaguccgacgaauacggcgaaauugugaaagcggaagauuacaaauuagcggaaauuucagccgaaggcgaagauaacaaagagaacauagugauuaaaaaagaggaagaggaaauaaguaaguauuauucauuuaugaacgaucuaaucguuacacuaauuauuuuuagcuga

SEQ ID NO: 6371 - RNA, 2268 nt, Phyllotreta atra
augccuccguuggagguaacgggcaacaccaacaacgacgaaucggcgcccaucaacccaguggugggcauaaucuacccucccccggagguuagaaacaucgucgacaaaaccgccaguuucguggcgagaaacggccccgaauucgaagcccgcaucaggcagaacgaacucgggaaccccaaauucaacuuccucaauggcggcgaucccuaccacgccuacuaccaacacaaagucaaagauuucagagaagggaaaggucaagagcccacuccggguuugagccaagccguagccaaauuaucggugagcgccuccgcgcagcaaaaacaacaggaaauauugaagcaagucgagcagccguuugugccgaaagauccuccguccgaauucgaauucauagccgaucccccuucgauuucggcuuuagauuuggauaucgugaagcuuacugcucaauuuguagcucgaaacggucgagcuuuccucacacaauugaugaauagagaacaaaggaacuuccaguucgauuuccugaggccgcagcauucguuguuucaauauuucaccaagcuguuggagcaguacacuaaagugcuaauacccccgaagagcauggagcagaggcuccgagacgaggccaaaagcgccaaagcugucuuagagcaagucaaguacagggccgaaugguugcgguaucaagaacagcaaaaggccaaggaagaggagauacucgagagagaacggguggcuuacgcgcaaauagauuggcacgauuucguggugguggaaacgguggauuaccaaccguucgaaauugggaauuucccgccgccuacuacccccgaagaagugggcgccaggauacucauacaggagcggaucgaagaaggcgaagacaucgagaugcagcuggagagcgacgaagacgacgauacgaacgcugaugacgguuugaguucgaugcaggauaagacgaagcguaagggcggcgaugacaaucgcuugcaggacauggaagaggauacgucugaugaggauaaugaugaugauggcgguaaaacggggccgucuucgucgcuuauucagccgccuuugccgccuauacccgauaaagugcuggugaagaaauaugauccgaaacaagccguaaaagucuccagaccgacaguaggcgacgacuaccuaguaucccccaucacgggcgaaaaaaucccggccagcaaaguacaagaacacaugcgcauaggccugcuggacccccgaugggucgaacaacgggacaaacaaauguccgauaaaaugaaccaagacacgguguacgcggccgguagcgccaucgacgcuucgcugaaguugcuagccgaaagacguacggauauuuucggcgugggcgacgaagaaacggcuaucggcaagaaaaucggcgaagaggacgugaggaaggacgaaaaggugacgugggacgggcacacgagcagcguggaggcggccacgagggcggccagggccaacaucacgcuggaggagcagauccaucagauacauaaagugaaggggcuguugccugaugaggagaaggagaagaucgggccgaagaauaucgguucgaagaagauuaauauacagagcguuauuacuacgaagccggcgaaucaagcugcgcagcaacccaaaccgccggucucgaugauccaaaccggcgcccaaccaauaauuccaacgcaacccgcgaugcuggccccgcaaccguccaucaugaugaugccagcgccgccuaugcccaccauucgaccgccgccauugaugaugcccggaggcguggcgaugggcgguuaucccguaggccccaugcccccggggcccggcaugaacauggcccccaugaagcaccccaacgaggggcccagcgaggacgagccgagcaacaagaaguugcgaaacgaggauucguuggugcccgagaacguguuccuguccaggaauccgagucaagugucuaucaagauuucgauaccggugaugccggagaagagcgaauggcgauugaagggacagauggugucguggacguuggcuuugaccgagagcgugucgaauuugaaggcuaaaauacaggaggaaacuaacaugccgccggccaaacagaaguuguucuucgaugguauguucuucaaggacucgaacacguuggccuacuauaauguaacgcaaggagccgucauucaauugcagaucaaagagagaggaggaaggaagaaguga

SEQ ID NO: 6372 - RNA, 978 nt, Phyllotreta atra
augccgaguacagagguuacaacgacuaaggugauagugcacccgcuggugcuucucagcguaguggaccauuucaaucggaugggcaaaaucggcaaucaaaagcguguugucgguguucuacucgguugcuggagggccaaaggagucuuagauguguccaacaguuucgcagucccuuucgaugaggacgacaaagacaaaucuguaugguucuuggaccacgacuaccuggaaaacauguacggcauguuuaagaaagucaacgcuagagaacgagucguugguugguaccacaccgguccuaaauuacaccaaaacgacaucgcuaucaacgaauuaguucgaagauacugccccaauucagucuuggugauuauagaugcgaaaccuaaagaucuggggcuuccuacugaagcauaccaagcgguagaagaaguccacgaugauggcucacccacaucuaaaacguuugaacacgucccgagcgaaauaggcgcagaagaagcugaagaagucggaguagaacauuuacuaagagauaucaaagacacuacagugggaacuuuaucucagaggauuacuaaucaguuauuaggccuuaaaggguugcauuugcaauugaaagauauaagagacuauuugaugcaagugugcgauaacaaacugcccaucaaccaucagaucaucuaucaauugcaggauauuuucaauuuguugcccgauauaaaucaggaugcguucaacaauucguuuuacguuaaaaauaacgaucaaaugcuuguaguuuauuuaggggcucucguucgaucuaucgucgcauugcacaaccuaaucaacaacaaacucaccaacagagacgcagaagaaggcaaaaaggaggagaaaaaggacaacaaggauaaagauagcaaagacaaggauaaggaaaaaacggacaaagagaaggaagcgaagaaggacgagaagaaaaaauaa

SEQ ID NO: 6373 - RNA, 1560 nt, Phyllotreta atra
augcugaaaauguugauggaccccauggggggcaucgugaugaccaacgacggcaacgccauucugcgagagaucaccgugcagcaucccgcugcuaaaaguaugauagaaauagccagaacccaagacgaagagguaggagacgguacuacuucuguaauaguauuagcuggagaaauguuggccgcugccgaacaguuccucgaacagcaaauucacccuacgaucaucauccgacaauacaggcaggcccucgaagauauggugcaauuucuggaaggaccccuaagcgugcccuuggaucgaaacgacaaaaacgccguagcccaaguggucaagggcugcauaggaacgaaauucuugagcaaguggucggauuuggccgucaauaucgcuuuagaugcggugaauaccgucuuauuggaagagaauggucgaacggagguggauaucaaacgguacgccaaaguggaaaagauucccggcgguucgguggaggaauccaggauuuugagaggcguaauguugaacaaagacguuacccauccuaaaaugaagcgacacauuaagaauccgagaaucguccuuuuggauugcgcuuuggaauacaagaagggagaaucucaaaccaacguugaaauuagcaccgaaacugauuuuaccaaacuccucgaauuggaagaagagcacgucaagcgccaaugcgacgagauaaucgcccucaagccggacgucguguucaccgaaaagggaguauccgauauagcccagcacuuccugcucaaggccggcaucaccgccaucaggcgcgucagaaaaucugacaacaaccgaaucgccagagccuguggcgccgucaucgucaacagaaccgaggaacuccaggaguccgacgucggcaccggagccggcguauucgaaaucaagaaauucggcgacgaguacuucuguuucaucgacgaaugcaaaaauccuaaggccuguacgauccuucugcgaggagccagcaaggauauucugaacgaaaucgagcgaaaccuccaagaugcccugcaagucgccaggaacaucgugcugucgccgcguuuggugcccggcggcggggccauugaaauggccguggcccaacgguugaugcaaaaggccacgcacgggcccuaccgggcgcucgcccacgcguuggaaaucauuccgagaacguuggcgcaaaauugcggcgccaauaccaucagaacguugacggcgcugagggccaagcacgccaaccacgcugaagccgacaaaccgugcacuugggguaucgauggcgaaagcggggaauuggucgauaugaaaaucaaaggcuugugggagccguugucugugaaacugcaaaccuacaaaacagccguugagaccgccauucuccuguuacguaucgacgauauuguaucgggauccaaaaagaagggcgacaaggaggucccgacgcccagucaaaugcaacaacaggaaacccaaggaggcgacucgacauuugguuuuaguaauuuauucucguuucuuucguuaguuauuuaa

SEQ ID NO: 6374 - RNA, 702 nt, Phyllotreta atra
augaugcaaacuggaauacgucccuauuauccagacuauucuacaauucccguugaacgccagauuaauccguacgcugauaauggaggaagcguaguagcaauugcaggaaaagauuuugugguuauuggcgcagauacgcgucuuaguuccggcuuuuccauuuacacgaggaaccagaacaagcuguuuccucugucugagacaacuguuuuaggauguucagguuguuggugcgauacuuuaacguugacucguauuauaaagucucguaugcaaauguacuaucaagagcacaacaagaacaugucuacaacagcggcugcucaaauguugucgaccauguuguacuauaagcgauuuuucccuuauuacauaucaaacauucuuguuggauuggauaaugagggaaaagguugcgucuacagcuacgaucccguugggcauugugaaaaagcuaccuaccgagcaggugguucugcaggagcuuugcuucagcccuuauuggacaaucaaauugggcagaaaaauccacagaagccuucgcaagaagaucuuacucaggaaaaagccaucucuacacugaaggaugucuucauuucggcugcagaaagggauauuuacacuggugauagugugcuuauuaaaaucauuacaaaagauggaaugaaagaagaaacguuugaauugagaaaagauuag

SEQ ID NO: 6375 - RNA, 900 nt, Phyllotreta atra
auguuccaauucggcuucaacauguucccggacaucccgaggcccuucaacaugaccuacaagugcuacucgguggccauguucccgggaaacgaaagacaggacgucgaacgugguggaaaaauaaucaugccaccuucggcacuggaacagcuuacucgauuaaacauuaacuaccccauguuguuuaaacuaguuaauaagaaaacaaaucguacgacucauuguggcguauuggaguucguagcggacgaaggaaaggucuaccuaccauuauggaugaugcacaauuugguacuaaccgaaggcgauuuggugcaaauggaaagcgucucguugccagugggaacguuuuccaaauuccaaccguugaauccggauuuccucgacauaaccaacccgaaagccguacuggagaauugcuugcggucuuuugcuugucugaccaccggcgacguaauagcugugagguacaaucaaaaggccuacgaauugugcguauuggaaaccaagccugguaacgccaucaguauaaucgaaugcgauaugaacguggaauucgccgcuccuguuggcuacaaggaacccgaacaagcuaaaaaagaagaagaaaugucuguggaucccgcagacuugaugcccgaaccgucgggauucguggcuuuuaggggggcugguguucgauuggaugggaaaaaacgcaaagauucuucaucuaaugacacuccuucgguuaaaccgguuuacguuaggggaauucccgacuacgauuaucaaauuggcacucuagauuucaucaggcguaccguggcgaagccuaaagagaaggagaauagugaagauggggacgauuucaaggcuuuuagugguacuggguucaguuugagaaguaggaauuag

SEQ ID NO: 6376 - RNA, 1623 nt, Phyllotreta atra
augucggccuuaccaggagcuaucgcuuucgacgaauaugggagaccauuuauaauucuaagagaccaagacaagcaaaaacgauugaccggaaucgaugcccugaagucgcacauuuuagccgcaagucaaauugcucacacuguucgcaccucuuuggggcccaaaggcuuggacaagaugauggucuccucugauggggaagucacuguaacgaacgauggggcuacuauuuugaagaugauggauguugaacaugaaguagcuaaauuguuaguucaacuaucucaaucacaggaugaugaaauaggagacggaaccacugguguaguaguauuagcgggggcucuucuggaacaagccggcgcccuccuggaccguggaauccauccgauaagaauagcugaugguuucgaauuggcaugccaaacggcaguggaucauuuggagaaaaucgccgaacuguuuccaguuuccgcugaaaacacugagccccuuguaaaaguugcgaugacuacacuggguucgaaaauaauuaacaagugucacaggcaaauggccgaaauugccguaaauggcguguuagcaguugcggaucuccaacaaaaggaugucaacuuugaacucauuaaaguagaaggaaagguuggcgguaaauuggaggacacgacauuagugaaaggugucgucauagauaaaacaaugucucauccacaaaugccgaaggaacuuaagaauguuaaauuggccauccucaccuguccguuugaaccucccaaacccaagaccaagcauaaguuggacgucaccagcgucgaagacuacaaagaacuaagauuguacgagcaagaaaaauucaaggaaauuguuggcuuagucaaaaaagcuggagcuaccuuggcuauuugccaauggggauuugacgaugaggccaaccauuugcuguugcagcaggaguuaccugcuauaagauggguuggcgguccagaaauagaacuaauagcuauugcgaccgguggaagaauaguaccaagauucgaggaacucagcccugagaaacuugguucugccgguuugguacgugaaauaucguuuggaacuaccaaagauaagaugauggugauugaagaaugcucgaauucccgugccguuaccauucucgucagaggcgguaaucaaauguugguugaugaagccaagaggaguuuacacgaugcuuugugcguugugaggagcuugauucaggaaccaagagucguguauggaggaggcgcagcugaaauagcuugcaguuuagcuguggcugcucaagccgaucaguuagcuucuuuggaacaauacgcuuaucgugcguuugcugaggcauuagaaagcauuccgcuggcucuagcugagaauucggguuucuccgccauucauacuuugggagaaaucaaggcaaagcaagcugcaucuggggauccggcacuuggcguggauugcaugaauauuggcaacauaaacaugagagaacagcauguuacagaaucucugcgaucuaagaggcaacaauuguuguuggcuacgcaauuagugaaaaugauucugaaaauugacgauguacgucagcccggcuccggcuaa

SEQ ID NO: 6377 - RNA, 351 nt, Phyllotreta atra
auggcagcagcuucagcuauggacguggacgaugaugaugaggucgaauugccaacaucgaguagcagcaaaggugagaagaaacgguucgaggugaagaaguggaacgcuguugccuugugggcgugggacauugucgucgacaacugugccaucugucguaaccacaucauggaucuuugcaucgaaugccaagccaaucaagcugccgccaccagugaagaaugcacagucgccugggguguguguaaccacgcuuuucauuuucacugcauuucccgauggcucaaaacgcgacagguguguccucucgauaaucgggagugggaguuccagaaguauggucacuag

SEQ ID NO: 6378 - RNA, 1605 nt, Phyllotreta atra
auggugucacuaaacccggugaggauucucaaacacgaugccgaggaugaaagggcggaaauugcgcguuugagcagcuucgucggcgcgauugccauuggagauuuggucagaaguaccuuggggcccaaagguauggacaaaauccucguaucaagcggcagaaacuccggaaugguagaagugaccaacgacggagccacuauauuaaaauccgugggugucgauaaccccgcugcgaaaauccucgucaacaugucgaaaguacaagacgacgaaguaggcgauggaacuacgucaguaaccguauuagcgucagaauuauuaaaagaagcugaacgucuaaucgagcaaaagauccauccgcagacuaucauagcggguuggagaaaagccguggauaucgcgagaaaagcccuuuuggacgcuucgaccgacaacagcgccaacuuggaagcguuccgagaagaucugaugaacaucgccaggacgaccuugagcucgaaaauucuaucgcagcacaaagaacacuucgcgaagcucgccguggacgccgugcugagauugaagggcucuggugauuugcaagccauucaauugaucaaaaaaaccggaggaacuuugcaagaaucguuccuugaugaugguuuccugcucgauaagagaccuggcguacaccagcccaagcgagucgagaacgcuaagauccugaucgccaacacuccgauggacaccgauaaaaucaagguauucggcucgcacaucaaagucgacucgauggcuaaaaucgccgaauuggaauccgccgagaaagauaaaaugaaggacaaagucaacaaaauccucaagcacaacgccaacguauucaucaaccggcaacucaucuacaacuaucccgaacaauuguucgcagaugccgguguaauggccauugaacacgccgauuucgaugggaucgaaagacuggcgcuggucaccggaggagaaauagucucaacuuucgaucacccggagcucgugaaacugggaacuugcgaucugaucgaacaaaucaugauaggagaagauacucuccugcguuucagcgguguggccuuaggugaagccugcacgauagucauucgaggagccacccagcaaaucauagacgaggcagaucguucgcuacacgaugcccugugcguacuagccgcuacagugaaagaaagcagaaucguauucggaggcgguugcagcgagacucuaauggcuacagcuguagccagagcaucuguaaauacagccgguaaggaagcccucgcuauggacgccuucgcuagagcucuauuacagcuaccgaccaucaucgcugauaaugccgguuacgauucggcucaauugauuagcgagcugaaagccgcccacaacagcggccucaacaccaugggcuugaacauggagaagggcgaguugggcgacaugcgagcauugggcauuaccgaaucguucguuguuaaacggcaaguauugauaucggccggcgaagcagccgagaugauucuucgcguugauaauaucaucaaggcggcgcccagacagcgaaccgaagacagaggaauguguuaa

SEQ ID NO: 6379 - RNA, 843 nt, Phyllotreta atra
auguuccgaaaccaauacgacagcgacgugaccgucuggagcccccagggccgccuccaccaagucgaguacgccauggaagcggugaaccucgguucagccacgguaggccugaaaagcgccagucacgccgucauaauagcccuaaaacgggccucguccgaacuauccgcuuaccaaaagaagaucauucaaaucgacgaucacaucggcaucaccaucucgggccuaacggcggacgcgagaaucuugagcagauauaugcgcaacgaauguuugaacuacaaguacucuuuagacgcuuacaugccuuugaauagauuaauuaacaucuuagguaucaaaaugcagcacuguacucaacgauacgaucgcagaccguucggcgugggucugcuaguagccggcugcgacgacaacggggcccacauauaccaaacgugccccucggcgaauuucuacaauugcaaggccaugucgaucggggcgcggucccaaagcgcucgcaccuaucuggagaagaagcucgacgaguugccgucguguucgcuggaagauuugaucaagcacggcuugagggcucuaagagacacucugccgccggagguggauuugaauacgaagaacgugucgaucgguuacgugggcaaagggauuacguuuaagauauuggaggaggaggagacggcucccuauuuggcuuugaucgagggcgaggagcguagaggaggcgcuggugguggcggcgguaguuccgaaggacaggccgauccuuugagggaaucgggggacgacgggcccaaggaucccgugccggcuguagcgauggauacuacggaauaa

SEQ ID NO: 6380 - RNA, 2544 nt, Phyllotreta atra
augggguuaaagccaggaaauaaccaagaaccaauggaaauaacauuccacgacgaugauuugcccuacgaggaagaaauucuacgaaaccccuacucggugaagcacuggcugcgauauauagaccacaagaaaacggcuccgaacaacgaaaugaacauaauauucgaaagggcccucaaggagcuaccggguucguacaaauugugguacaauuaccuacgaacccgaaggaaucaaaucaaaagcaaaugcaucaccgauccgggcuucgaagaaguaaauaaugccuucgagcguucguugguguucaugcacaagaugccucgaauuuggauggacuauugcacguuucucacagaucaaugcaaaauaacgagaacacgaaagguguuugacagggcucugcgagcccugccuguuacgcagcacaacaggauauggccuuuguaucugaaguucgugcagaaacacgauauaucagaaacugcuguucgaguauucagaagguacaugaaauugugucccgaaaacgccgaagaauacauagauuacuuaacaaaaguagaaagauuagacgaagccgcuauaauuacagcuaaaauaguaaacgacgauaacuucguaucgcaacagggcaaaucgaagcaucaacuauggaacgaacugugcgaauugauuuccaaaaaccccgaaaaaguucgcucucuaaacgucgacgccaucaucagaggcggccugcgcagauacaccgaccaauugggccacuuguggaacucuuuggccaauuacuacguucgcagcggcuuguucgaacgggcuagagacaucuacgaagaggccauacaaaccguuacaaccguuagagauuucacacaaguguuugaugcuuaugcgcaauucgaagaguuaaguuugagcaaacgaauggaagaaguggccacuaagcagaaccccagcgaagaugaugauaccgaauuggaacugcgguuagcucgguucgaauaucuuauggaaaggcgauuguugcuguuaaauucaguauugcuaaggcaaaacccgcacaaugugcaagaguggcacaaacguguacaacuuuacgaagguaaaccacacgaaaucaucaauaccuacaccgaagcugugcaaacuguggauccaaaacuggcuguaggaaagcugcauacguuguggguugaauuugccaaguucuacgaaagcaacgaucaaaucgaagaggccagauugauauucgaaaaagccucccaggugccuuacgugaaagucgacgauuuggcaacaguguggugcgaauggaccgaaauggagauucgcaacgagaacuacgacgaagcuuugaagcucaugcaaagggcuacuguaaugccuagccguaaaguagcauaccacgaugauaccgaaacaguucaaaguagacuguacaagucgcuuaaaguguggucgauguacgcagauuuggaagaaagcuucggcagcuucaaauccugcaaagccaucuacgacaggaucaucgaacugaaaaucgccacgccgcaaaucaucaucaacuacgguguauuucucgaggaaaacaauuacuucgaagaagccuucagagccuacgagaagggcaucucguuguucagauggcccaauguauacgacauauggaacaccuauuuaaccaaguuuuugaaacgcuacggcggcaguaaauuggagagagcucgcgauuuguuugagcaauguuuagacgguugccccccucaauucgccaaacaucucuaucuguuauacgccaaauuggaggaggaacacggcauggccaggcaugcgauggcuguauacgaaagaucaacaaaagcaguaccagagaacgagauguuugauauuuucaauauuuauauuaaaagagccgcugagauauauggcauaccgaaaacuagacaaaucuacgagaaggccaucgagguacuuccggaggacaagacaagggaaaugugcuugagauucgccgauauggagacgaaauuaggugagaucgaucgagcuagagccaucuacgcucacugcagccaaaucugcgauccacguguaacagccgaauucuggcaaauauggaaggaguuugaaguuaggcacgguaaugaggacaccaugagggagauguugaggaucaaacgcaguguacaagcuguauacaacacucaggugaauaugauguccgcucagaugcugagcucugcagguagcucgagcgguaccauagccgauuuagcuccggggguuaaggacgguaugaggcuguuggaggccaaggcggccgagauggcugguucgguggcgcagaagcccaauauuauguucguuagaggggagacucaaggggauaagaaggauaaaguggugaauccugaugagauugauauaggaagcgaggacgaggaggaagaggaggaggagauuucgguggagaagcaaaacgugccaucggagguguucgggagucuuaagaagaagggagcugaugaugaggaugauuaa

SEQ ID NO: 6381 - RNA, 1113 nt, Phyllotreta atra
auggcaaacggaccgauagccgaaagaaacagagacgcuacgaucuacgucggcgguuuagacgacaaaguaucggaaucucugcuaugggaacucuucgugcaagcggggccguuagugaacguacauaugcccaaagaucgcgucacgaugaugcaccagggcuacggcuucgucgaauucaugggcgaagaggacgccgauuacgccauaaaaauaaugaacaugauaaaauuguacgggaaacccauacgggucaacaaggcguccgcucaccagaagaauuuggacgucggagcgaacauuuucauaggcaauuuggacccggaagucgacgagaaacucuuguacgacacguuuucggccuuuggcgucauauuacaaacgcccaagauaaugagagaucccgagacugguaauuccaaaggcuucgcguucauaaacuucgccagcuucgaggccucggacgcuuccaucgaggcgaugaacggccaauaucucugcaaucgacccauauccguaucguacgcguucaaaaaggauuccaaaggcgaacgacacggcucggcggccgagcgauuguuggccgcacagaauccgcuaucgcaggccgacaggccccaucaauuguucgcagacgccccuccgauuggaaugaugccgaugagcauggcgccgccaccgccgccucuaaucaccggcaugaugccuccucccccgccgacgccgggcggcaugccgccgccuccgccgccgguaccgccgcccaguucguuccccgccgguauaccgccgccgccgcuaccgcccucucaaccgccguugccgcccggcgcuccacccgccauggcagcggugcagggcggcgcggccaggccgccgccgccuccuccguggucggcggcggcggccaacgugccgaugccgcccggcccgcccgcuuccaacgccggcggcgguuuugggggaaugcugccgccaccgccgccgccuggcggcaggccgaugccgccuaauuggaggccgccgccaccgccgccgaauuuuggcggugccagaccgccguuuccgccgcgcgggccgccuccgccgccgcccaccuucgaaggguaa

SEQ ID NO: 6382 - RNA, 774 nt, Phyllotreta atra
augggucguguuauucgagcgcaacguaaaggugcgggauccguauucaaaucccacaccaaaaggaggaaaggggcccccaagcuccguuacuuagauuucuccgaaaggcauggcuacaucaaggguguugugaaagacaucauccacgaccccggucgcggcgcccccuuggcucuagugcacuucagggaccccuacaaguuccaaacuaggaaggaaauauucaucgcucccgagggcauguacacagggcaauucuuguacuguggaaagaaagcuaaccuccaaauuggaaauguguugccuguaggaacgaugccugaagguacaaucgucuguaauuuggaagaaaagacuggugaccguggccgauuggcucgagcauccgguaacuacgcaaccgugauugcccacaaucacgauacaaagaaaacuagaguuaaauugccaucaggagcuaagaaaguuauccccagcaacaacagagcuaugguugguaucguugcuggugguggucguaucgacaagcccauccugaaagccggucgugccuaccacaaguacaaggugaagcguaacugcuggccgaaggugcgugguguugccaugaaccccgucgagcauccucacggaggugguaaccaccagcacauugguaaagcguccacgguuaagaggggaacguccgcuggucguaaggugggucuuauugcugcgcguaggaccggucguaucagaggagguaaggucgagacuaagaaggacgauuaa

SEQ ID NO: 6383 - RNA, 411 nt, Phyllotreta atra
auggcucguacgaagcaaacggcucguaagucuaccgguggcaaggcuccgcggaagcaacuugcuacgaaggcugcgcguaaguccgcaccggcgaccggcggugugaagaagccucaucgcuaccguccugguaccguggcuuuacgcgagauucgucgcuaccaaaagucgacugaacugcuuauucguaaggcuccguuccagcgccuuguucgagagaucgcucaggacuucaagacggauuugcguuuccagucgucggccgugucugccuugcaggaggcaucggaagcauacuuggucggucuuuuugaagacacgaacuugugcgcuauacaugccaagcguguuaccauaaugccgaaagacauucaacuggcucgucguauccgcggcgagcgcgcuuga

SEQ ID NO: 6384 - RNA, 1593 nt, Phyllotreta atra
auggcaauaaguuuguugaauccgaaagccgaaguggcgagagccgcccaagcguuggccguuaacauaaccgcagccaaagguauuucagaagugaugaaaaccaauuugggacccaaggguaccaugaaaauguugguguccggugccggcgacauuaaaauaaccaaagacggcaacguucuccugcacgaaaugcaaauccaacaucccacugcuucguuaauagccagagcuucgacagcacaagaugauaugacaggagacggaacgaccucuacuguuuuaguaaucggugaacuccugaaacaagccgacauauacaucgcagaaggccugcaccccagaacacucacagaaggcuucgacaaagcgagagcgaaggcccucgaaguauuggagaagcugaaaguacccaucgaagucaacaaagaaucguuaaccgauguuugucgaacgagcuugagaacaaaauugcaucaaaaauuggcugaucuccuuacugaugucugcgucgaggccauucucgcuaucaaacaguccgacaaaccggucgauuugcacaugguggagcucauggagaugcagcacaagaccgagacggacacucaacuggucaaagggauagugauggaucauggugcucgacacccugauaugccgaagagcuugaagaauugcuacauccuuacaugcaacgugagcauggaguaugaaaagagcgaaguuaauuccgguuucuucuacaaaaccgccgaagaaagggagaaauugguguuggccgagagagauuucaucgaacagcgagucaagaagguggucgaguugaagaaggcccuuugcaacggcacaaacaaaucguuugucguuauaaaccaaaaagguauugacccgaugagcuuggacaugcuggccaaagagggaaucguggcucugcgaagggccaagagacguaacauggaacguuuggcuuuggcaugcgguggaauagccgugaacaguuucgacgauuuacaggaaucucaccucgguuacgccgggcauguauacgagcacguccugggcgaaagcaaauauacguuuguugaagauugcaaaguuccccaaucugugacgaucuuaauaaaaggacccaacaagcacacuuugaugcagaucaaagacgccguuagagauggcuugagagcuaucaauaacgcaaucgaugacaaagcgcuuauacccggugguggugcuuuggaaguggcaguaaacaaggaauuacuggcuuacaaggacgaaaucaaggguaaaucucgcuugggcguagccgcuuacgccgaagcucuguuggucauucccaaaacgcuggcuguaaacuccggauucgaugcccaggauaccaucgugaagcugcaagaggaagcucgacugagcaccgaaccgaucggccucgacuuaaccucaggagagcccaucaaucccaaagaugccggcaucuacgacaacuacguggucaagaagcagauucuuaacucgugcucgauaaucgccagcaacuuguugcucgucgacgagauuaugagggcuggcaugagcagcuugaaaggauaa

SEQ ID NO: 6385 - RNA, 3126 nt, Phyllotreta atra
augucuagugcuggaaucgcagacagccccaucgauccuccagcaaagaagcgaaagcucgacucgaaaaauugcagccccgacauggcgaacaacgaagcuucaggauccucgaacgccggcgaaaucgacgagggacucuacucgcggcagcuguacguguugggacacgaugccaugcgccgcauggccaccagugaugugcucguaucggguuugggcgguuugggugucgaaauagcuaagaaugugauccuaggcggcgucaaaucagugacucuacaugacgaugccguuugcaccguucgagacuugucgucgcaguuuuaccucaccgaagccgaugugggcaagaaccgcgccgaggccugcugcaagcaccucuccgaacucaacaccuacguccccaccagagccuacacgggcccccucgacgagaaggucauccagaaguacagggugguaguucugacgaacagcacucgagccgaacagcugcguaucagcgagauaacacacaacaacgauguggcucuaaucguagcugauacuaaaggucuguuugcacagguauucugcgacuucggcaaggccuucuccguuguggacaucaacggggaaccacccguauccaccaugauagccgauauauccaacgauacggagagcguaguaacuugcauagaugauacuaggcacgguauggaagaaggagauuacguuaccuucuccgagauuuuaggcaugaccgaauugaacaacugcaagcccauuaaaaucaaaguuuuggggccguacacguucagcaucggcgacaccacuaaauucuccaaguacguucgaggggguauagucacucaaguuaaaaugccuaaagaagugcacuuuaagccguugaaagagucuuuacagaaucccgaauucguggugaccgauuucgccaaguucgaucaccccauucaauugcaucucgcuuucuccacccuacacaaguucguggagaagaccggucgauugccgaaacccuggaacaaagacgacgccaccgaguucaucgcuuuggcgaaaucguuggccguaaacggaucuacggauaccgaagucaacaccgauauccucaacauuuucuccaaguguugcucaggcgaucuuaaccccaucaaugcuacgaucggagguaucguggcgcaagaggucaugaaagccuguucggggaaauucuaccccaucuaccaaugguuguacuucgaugccaucgaaugccugccccaggacaaggaggagaucacugaggaacucgcugcccccguugauaguagauacgauggacagaucgcuguguucggaaaagacuuccaaaagcgauuaggugaacugaaauauuucaucguuggugccggagcgaucgguugcgaguugcugaagaacuucgccaugaugggaauaggcacgcaaggcggucaagucaccguuaccgacauggauuugaucgaaaagucgaauuugaauaggcaauuuuuguucaggccccacaacguccagcaacccaaauccgcuaccgcugcuaagguaauuaagaagaugaaucccgacguuaacauaguggcccacgaaaaccgagugggccccgaaacugaaaacgucuacaacgacgaguucuucgagguuuuagacgggguagccaacgcccuggauaacguagacgcgagaauauacauggacagacguugcguuuacuaucgcaagccucuccuagaguccgguacauugggaacgaaaggcaacacucaaguagugguaccauuccucucugaguccuacagcucaucgcaggacccucccgagaagagcauaccgauuugcacguugaagaauuuccccaacgccaucgagcacacucugcaaugggccagggacaauuucgaggggcuguucaaacagaacgccgagaacgcuucgcaguaccucagagauccggauuucaucgaacgaaccgucaagcugccgggcguacagccgcuggaagugcuggaauccgucaaagcugcuauaaucgacgaaagaccaaaggauuacgacgauugucuggccugggcgcgucugcauugggaggaccaauacgccaaucagaucaagcaacuguuguucaauuucccgccggaucaacucaccaguaccggccagcuguucuggucugggccgaagagguguccggaaccgcucguauucgauaucaaugaagauuugcacguggauuacguuauagcagccgcuaauuugaaggcucaaguuuacgguauucccacgaauaggaacagaugcuacgccaaacaagucgucacuagcaucgagguaccggaguuugugcccaaaucgggcgugaaaaucgccgugaccgacucgcagauggccaugaacggcaacaacgucgacuuggaucgcaucaaucaaaucaaacaggagcugccuucgaugcaggagcucagcgggcugacgcucacgccgcuggaauucgaaaaggacgacgauaguaauuuccacauggacuucaucguggcggccucgaauuugagggccgccaacuacaagauucccauggccgaucgacacaaaucuaagcucaucgcugguaaaaucaucccggcuauagcuacaacuacaucggugguggccgguuugguugguuuggaauuguacaagcuggcuaggagcaucaagagucuaacgccguuuaagaaugguuuugugaauuuggcguugccguuuuucggguucucugaaccgaucgcagcccccaaaauggaguacugcggcaaccaguggacguugugggauagauucgaggugcaaggagaaaugacccucgcugaguuucuagaguauuucaaggagaagcacgguuuggaaaucacgaugcugucccaaggggugugcaugcuguauucguucuucaugcccaaagccaaagcucaagaaagauuaggauuaacgaugucugaaguggugaggagagugucgaagaagaagauugagccgcacguuagagcauugguguuugaguugugcugcaaugaugcugauggagaggacguggagguuccuuacguuaaauacaacuuguauuga

SEQ ID NO: 6386 - RNA, 1221 nt, Phyllotreta atra
gcaaaugagaauaauucaacagaaguucagaaaaaagggguuaaaggaacuuaugucucuauacacaguucagguuuuagagauuuccuuuuaaaaccagaaauccuucgagcuauagcugauugugguuucgaacacccuucagaagugcaacacgaaugcauuccccaagcaguaaucggcauggacauccucugccaagcgaaaagcgguauggguaaaacggcggucuucguccuagccacacuacagcaacucgaacccaccgaaaacgucgucuacgugcuggugaugugccauacgcgcgaacuggccuuccaaaucagcaaagaauacgagcgguucagcaaguacauguccaacaucaaagucggcguguucuucggcgggcugcccauccaaaaagacgaagaaguauuaaaaaacagcuguccgcacaucgucgucggaacgcccggccgcaucuuggcccucgucagaucgaagaaacucaaucucaagcacaucaaacacuuuauucucgacgaaugcgauaaaauguuggagcuacuugacaugagacgcgacguucaagaaauauacagaaauacgccgcacgagaaacaaguaaugauguucagugcgacgcucagcaaagaaauucggccaguuugcaagaaauucaugcaagaucccauggaaguguauguugacgaugaagcgaaauugacguuacacggucuacaacaacauuacguuaagcuuaaagagaacgaaaagaauaaaaaauuauuugaguuacuugauguguuggaguuuaaucagguggugauauuuguuaaaucggugcaaagauguguagcauuggcgcaacuuuugacugaacaaaauuucccugcuauuggaauacaccgaggaauggagcaaaaagagcgauuauccagauacgaacaauucaaagauuuccaaaagagaauauuaguggcuacuaaucucuuuggucgugguauggauaucgagagaguuaauaucguuuuuaacuacgacaugccggaagauucggacacuuaccuucaccgaguggcuagagcuggucguuucgguacgaaagguuuggccauuacuuucguuucugaagaaggagaugccaagauuuugaacgaaguacaagacagauucgauguuaacauuaccgaauuaccugaugaaauugauuugaguucauacauugagggacgauag

SEQ ID NO: 6387 - RNA, 1458 nt, Phyllotreta atra
aacaguuucaccgagauucgagaacaggccaagcaaaucgaaaagggcauaaucaacaagagagacaaagaucuaaacaguuucaccgagauucgagaacaggccaagcaaaucgaaaagggcauaaucaacaaggaaaaccgcuuuauucuccgagugcugcgcugcaugcccaacaccagacgaaagcucaacggcaucguccucagaagucucaucaaccaaauuuacccgguggucgagcgagacgugcuccucagcuucaucgaagaauccgccggcgaacucgaccaaacucaaaccaaagccaggccggccaccaagucccccguagcagaaaucgacaccuacaucaaccugcuauguuuaguccauuuaaucgacaccaacaaacuagcagaagccgaacgcugcucgcaaauccucaugaacaagaucaccagccagaacagacgaacgcuggaccuagucgcugcgaaaugcuacuucuacuacuccaggguagcggagcucaccgacaagcuggacucgaucagaggcuuccugcauucccgccugcguacggccacccucagaaacgauuucgaaggacaagccguacuaauuaacugcuuauugaggaacuaucuacacuauucccuguacgaucaagccgauaaguuggugaacaaaugcguguuuccggagacggccagcaacaacgaaugggcgagguucuuguacuacuugggcaggaucaaagcggcgcgauuggaguacagcguggcgcauaagcaucugauacaagcgaugcgcaaagcgccccagaacacggcgaucggcuuccggcaaaccguacaaaaacuaacggucgugguggaguugcuguugggggauauuccggagaggcagauauuccggcaggcgagcaugcggcauucgcucgccccguauuuccaguuaacgcaggccgugagaauggggaacuugcaacgguucggggagguguuggagaauuucgggccgcaauuuaggcuggaucauacguuuacucuaauccugcggcuucggcauaauguuauaaagacagcuaucagaucgauugggcugucguauuccaggauauccccacaggauauagcuaagaagcuggggcuggauucagccgaggaugcggaauucaucguagcgaaggcuauucgagaugggguuaucgaagcuacuuuggacccacaagggggguacaugaggaguaaagagaguacugauaucuacuguacuaaagagccccaacuggcuuuucaucagaggauaucauuuuguuuggauuugcauaaucagagcguuaaggcuaugagauacccgccgaaugcguauggaaaggaacuggaaucggcugaggaaagacgggagagggagcagcaggauuuggaauuggccaaggaaauggcugaagaugaugaugauaguuuuccuuaa

SEQ ID NO: 6388 - RNA, 1668 nt, Phyllotreta atra
auggccgcuagccaucaagcccuuccagugucggccauccugaaauccaaaagcgaagucgaggaugagcccaagaagaaguccagggaggacuggcgcaaggccaaagagcuggaggaggcccggaaggccggcacagccccggcagccgucgacgaagaagguaaagacaucaauccccacauaccgcaauacauaucuucggcuccuugguauuacggaaccucuggccccacguugaagcaccaaaggccccaggaugauaagcagaaagaguauucagauuugaacgauugguauaaaagaggcguugauacuucgaagaucguaacaaaguaucguaaaggcgcuugcgaaaacugcggggcgcugacucacauaaagagagauugcauggacaggccgcguaaagucggcgcuaaauucucaggcgcuaauauagcccccgaugaguuuauccaaaagaauuuaucacugaguuucgacgguaaaagagauagguggagugguuacgauccauccgaacauaaaacgguaauagaagaauuccagaaaguggaggaagccaaacggcaacuaaaauccgacaaauugaacgcgaacgaagaguccgaagacgaagaaaaagacgaggauaaauacgucgaugaaguggacaugcccgguacgaaaguggacagcaaacaaagaauaacggugaggaauuugcguauacgagaagauacggccaaauauuugagaaauuuggaucccaacucggcguacuacgaccccaaaaccagaucgaugagagaagauccgaacgcuggaauggacgcuacauaccauggggaaaacuucguucguuucuccggagauacuacgaaucacgccagagcccagcuguucgcuugggaagcgcacgguaaaggagucgacguucaucuacuagcagaaccuacgaaauuggaauuacugaagaaggaauacgagaagaagaaggacgaagugaagucgaauauucaggguacaguauuagagaaauacggaggugaagaauaccucgaagcgccgccgaagaguuuguuguuagcucaaacugaaaacuacguggaauauucgagaucggguaaaguuaucaaaggugccgaaaaagaaguuauuagaucgaaauacgaagaagauguuuacauuaauaaucacacgucaguuugggguucuuauuggagugggggacauugggguuaucgcuguugccauucuuucauuaagaauucuuauuguuugggagaaucgggaaaauuagugaacgcucaaccuacggcagaauuaauaacuaaugaugagccuaaagaggaacagagucaagaagaugauaagguugaagcauuagaaaaagaaagcgaagaaucugaaucuagcaguucaucggacgaugaaaaauccaaagcgaaaucgaagaaaaaacucaaaaagaaaaugaagaagcagaagaagaagcaaaagaaaaaggacaaggagguuaaaaugucuucguugaugaaagacgaagacgaagaagugguuuuggacgacagaaagcggccuuacaacagcauguucgaagcgaagaaacccaccgaagaacaaauggaggaauacuucaagaagcggcgaagggacgaagacccgaugaaccaauucauguag

SEQ ID NO: 6389 - RNA, 621 nt, Phyllotreta atra
auaagccgagaucauuggcauaaacgaagggccaccggaggcaagaggaagccucuucgcaagaagaggaaguucgaauuaggucguccggcggccaacacgaaacuaggaaccagaaggauccacuauguucguacaagggguggcaacuugaaguaccgugcgcuaagauuagacacuggaaacuucucuuggggaagcgaaggaacugcccgucaaacacguauuaucgaugucguuuacaacgcuaguaauaacgaauuggugcguaccaagacguugguaaagaacgcuauugucgucgucgacgcuaccccguucagacaaugguacgagagccacuacaucuuaccguugggacgcaagaagggugcuaagaugacgccugaggaggaggagauuuucaauaagaaacguagcaaaaaaguacagaagaaguacgaaacuaggcaaaaaaccgcuaaaguagagccugcgauugaagaacaauuccacacuggaagauuguuggcaugccuagcaucaagaccuggacaaugcggcagggccgaugguuacguccucgaaggaaaggaacuugaauucuacaugcguaaaauuaagucuaagaaagcuaaauaa

SEQ ID NO: 6390 - RNA, 936 nt, Phyllotreta atra
auggauagauugcuucgucuuggaggcgguaugccggguuuaacccaagcaccgccgccuuccgacgcccccgugguggacaccgccgagcaggucuacauuucaucccuagcccuacugaaaaugcugaaacacggcagggccggcguccccauggaagucaugggucuuaugcuaggugaauucgucgacgauuacacagugagggucauagacguguucgccaugccccagacggguacuggagugagcguagaagccguggaucccguuuuccaagcgaaaauguuagauaugcuacggcaaaccggccggccggagaugguggucgguugguaccauucccauccggguuucggcugcugguugucgggagucgauaucaacacucagcagagcuucgaggcccucuccgagagggcgguggcuguagucgucgauccgauucaauccguuaaaggaaaagucgucaucgaugccuuuagguuaaucaauccuaauaugaugguguuggggcaggaaccccgacaaacgacuucgaauuuggggcauuugcagaaaccguccguacaggcucugauccacgguuuaaaucgccacuacuacuccauaaguauuaacuacaggaagaacgagcuggagcagaagauguugcucaauuugcacaagaaauccuggauggauggguuaacguuggcugauuauucggagaauugcagcguuaacgagaaaaccgucgccgauauguuggaauuggcuaagaauuacaacaaagcguuggaggaagaggagaaaaugacaccggaacaacucgcuauuaagaacgugggcaaacaggcuaccaagaggcauuuggaggagaaaguggauauauugaugaccaacaacaucguacaauguuugggagccauguuagauacugucguguuuaaauaa

SEQ ID NO: 6391 - RNA, 1215 nt, Phyllotreta atra
augacuguuauuaauaagauggaggucgaugggccccucaagggggaaggguucagguccuacuauauuaccaaaaucgaggaauugcaacuaaucguugccgaaaagagccagaaccucagaagauugcaagcccaaagaaaugaacuuaacgccaaaguucguaugcuuagagaagaacuaaugcuccuucaagaacaaggaagcuacgucggugaaguggucaaacccauggauaagaagaaaguacuggugaaaguucacccggagggaaaauuuguuguugauaucgacaaaaauaucgacauuaaugacguuacgccaaauuguagagucgcucugcgaaaugaaucguacacuuugcauaagauuuuaccgaauaagguggacccguuagugucucuuaugaugguagaaaaaguaccagauucgacuuacgaaauggugggugguuuggauaagcaaaucaaagagaucaaagagguuaucgaauugccggugaaacauccugagcucuuugaugcuuuagguauugcucagcccaaggguguguuguuguauggaccuccaggaacuggaaaaacucuucuggcuagagcuguagcucaccacacagaauguacguuuauuagaguaucaggaucggaguuggugcaaaaauucaucggggaagguuccaggaugguaagggaacuguucguaauggcuagggagcaugccccuucgaucauuuucauggaugaaaucgauucuauuggauccucucguaucgaaucagguucugguggcgauuccgaaguucaaagaacuaugcuggaguugcugaaucaacucgauggauuugaagcuacgaagaacauuaaaguuauaauggcuacgaacagaaucgacauuuuggaucccgcuuuacucaggcccgguagaauugacaggaagaucgaguucccuccaccgaacgaggaagcccgauuggacaucuugaaaauucacucgagaaaaaugaauuugaccagagggaucaauuugaggaaaaucgccgaauugaugccaggugccagcggugcugaagugaagggaguguguacugaggcaggcauguacgcccuaagggagagaaggguacacguaacccaagaagauuucgaaauggcuguggccaaggucaugcagaaggauucagagaagaauaugucgauuaaaaaauuauggaaauaa

SEQ ID NO: 6392 - RNA, 600 nt, Phyllotreta atra
augguaaaauuauauugcaucaguauacucuacaaagauacuacauacgcuacgugguugaagucugcuuucgauuuacaaaguuucaguuuuuuccaaaggggaucuguacaggaguuuaugucauucuuuuguaagacuaucguggaaaggacuauaccaucguccaggcaauccgucaaagaaggagaauacaugugucauguuuauguaagacaugauaacuuggccgguguuguaauaucagaucacgaauacccgucuagggugucgcauacgcugaucacaaaaauuuuggacgaauuugccgcuaaaauaccagcugugaauuggccuaccuugcaagagagagacguggcguuuccacaguugaacacauaccuggccaaauaccaaaacccuaaggaagccgaugcgaugacuaaaauacaagaggaccuugacgaaaccaagauuauucugcauaauacgauucaagcuguccuggaaagaggggaaaaguuggaugacuugguaaauaaaucagagggcuuaaguauacaguccaaagcuuuuuacaagacugcaaggaaaacgaacaguugcugcaguuucacuuaa

SEQ ID NO: 6393 - RNA, 729 nt, Phyllotreta atra
auguuucuaacaagaagcgaauacgauagagguguuaacacauuuucgcccgaagggagauuauuccaaguggaauaugccauugaagcuauuaaauugggaucuacagcuaucggaauaugcacuagcgaagggguugugcuagcagucgaaaagcguauuacuucuccauuaauggaacccacuacgauugaaaagaucguagaaguugauaaacacaucggcugugcuguuucggggcucauggcagauucacguacaaugaucgauagagcaagaguugagugccaaaaucauugguucguuuacaacgaaaacaucaccaucgaaucgugugcucagggaguaucgaaccuagccauucaguucggagauucggaugaugauggugcugcuaugucgaggccauucgguguggccaucuuguuugcuggcauagacgaaaaagggccucaacucuaccacauggacccaucagguacauuuguucaguucgaugcgaaagccauaggaucugguucagagggcgcacaacaaagcuuacaagaaguauaucaucguagcaugacuuuagaggaagcuaccacagcagcguugacuauucucaagcaggucauggaggagaaauugaacucuucuaauguagaagucaugacaaugacgccaaaggauauguuccacauguucacuaaggagcaaguggaggagguaauuacuaaauuaucuuaa

SEQ ID NO: 6394 - RNA, 1158 nt, Phyllotreta atra
augacagaauauugguugauuuccgccccaggugacaagaccugucaacaaacaugggauaccaugaauaauaugacuaguaaacagaacaauuugucugcaaauuacaaguucucaauacccgauuugaagguuggaacucuugaccaauugguugggcuauccgacgauuugggaaagcuggaugguuucguggagcagguuacccggaagguggcucaguaccucggcgagguucuugaagaccagagggacaaguugcaggagaauuugcaggcgaacaacaccgauuugccaaguuauuuaaccagauuccaaugggacaucgccaaauaccccaucaagcaaucgcugcgcaacaucgccgauauaaucagcaagcaaguuggacaaaucgaugccgaucuuaagaccaagucgucagcguacaauaacuuaaaaggcagucuucagaauuuggagaaaaaacaaacagggaguuuguuaacccguaacuuggcagaucuggucaagaaggaacacuuuauuuuagauucugaguacuugcaaacgcugcucgucaucguucccaaagcucaguucaaugaguggaacgccacuuacgaaaagaucacggacaugaucgucccucguucgucggaguugaucauucaagaccacgacuacggccuguucaccgugucgcucuucaagaagguggucgaggaguucaagcugcacgccagagagaagaaguuuaucgugcgagauuucacguacaacgaggaggaacuggcggccggcaaaaacgaaaucaccaagcucguuaccgacaagaagaagcaauacgguccguuggugagaugguugaaagucaacuucagcgaaugcuuuugcgcuuggauacacguuaaagcgcugagaguguucguggaguccguguugagauacggguuaccagucaauuuucaggcuauucugauccauccaaauaagaagcaagccaaacguuuaagagauguuuugaaucaacucuacggucaucuagauaguagugcagcucuuuccggaccuaacguugauagcguagacauuccaggauuagguuucggccaaucagaauauuaccccuacguguacuacaaaauaaauguugauaugauagaaucgaaggucuaa

SEQ ID NO: 6395 - RNA, 1674 nt, Phyllotreta atra
augucgauauuagcaaguccucuaucaguagccgguucgcgaaccacaggcgccucaguucgcacccaaaauguuauggccgcuucuaccauagccaacgucgugaagagcucauugggacccguggggcucgacaagaugcucgucgacgacaucggagacgucaccguaaccaacgacggggccaccauuuugcgccugcuggaaguagagcaccccgccgccagggugcugguggaauuagcgcaauuacaagaugaggaaguaggcgauggaaccacuucaguugucaucauagcugcagaauuacugaaaaacgcagaugaacugguaaaacaaaaaauccacccuacaucgauuauaagcggauacaggcuggcuuguaaagaagcuugccgauacauacaagaccauuugacuauucccguggaggaauugggcaaggagucuauagugaacguugcgaagacuucuaugagcucgaaaauuauaggagcugaugcggauuucuuuucgcaaaugguagucgaugcugccaccgcagugaaagugacagacucgaaggggaacucgauguaccccauuaaggcggugaacguguuaaaggcucacgggaaaagcgccagggagaguuuccuaguggccggcuacgccuugaacugcacugucgccagccaagccaugcccaagaagaucgucaacgccaaaaucgccugucuggauuucucauugcaaaaggccaaaaugaagaugggcgugcaagugcugaucacggaccccaaucaacuggagggcgucagagccagggagcuggacaucaccaaggagcgcauccagaagauccuggccaccggcgucaacguggugcugcuguccggcggcaucgacgacgucuguuugaaguacuucguggagcgcggcgccauggccgugcgccgcgucaagaaggccgauuugaagcgcaucgccaaggcgacgggggcggcguucgucacauccuugagcaacauggagggcgacgagaccuucgauuccaauaugguuggugaagccgccgagguagugcaagagaggauuuccgaugaugaauugaucgucauuaaaggccccaaggcucgcacggccgccucgaucauccugcgaggccccaacgauuucuacugcgacgagauggagcgcuccguccacgacgcccucuccguggugaaacgcguacuggaaucgaagagcgugguggcgggaggcgguagcguggaggcggcgcucuccaucuaccuggagaacuucgccacgacguugagcuccagggagcagcuggccaucgccgaguucgcuaggagucugcuggugauaccgaagacguuggccguuaaugcugcgcaggacgcgaccgauuugguggcgaagcugagggccuaucagaacuccagccagacuaagaaggaucaugcgcauuugaaguacgugggauuggaucugcuugaagguaccgugagagauaacaggaaagcuggcguguuggagccgacuaugucuaaagugaaaucguugaaauucgcuacggaggcggcgauaacuauacucagaaucgacgauaugauuaaauuggaugcugagcagaagggugggaaaaacuaccaggaugcuaugucuaguggugaauuguacgauuag

SEQ ID NO: 6396 - RNA, 822 nt, Phyllotreta atra
auguuuaauucuucucaauuaaacccuccaccguuuuggaguaacgguccagcuccuggggccuucuauaacuucccaggaacagaauggaaaccuguaucacauccaauaacucauacccaaucuccaguaacaacuucaaccucaauuguaucuauaaccuacgauaagggaguacuaauagccggagacuugcuggccucuuacgggucuuuagccagauacaaaaacugcccuaggguaaucgaaauuaacccaaacaucauccuaggcgcuggaggagacuacgcugauuuccaauacgucaaaagcuuuaucgagcagaaaauaaucgaugaagauugccuagaugauggcuggaaaaugaaaccgaaaucucuuuauugcuggcuaacuaggauuagguaccaacgaaggaguaaacucgacccguucuggaacaaucuaguagucggaggaauccaagauggaguaccuuuccuaggaacagucgauaaacuuggcacugcguacacagauaaaguaaucuguacugguuacggggcucauauugcccuuccugucuugcgggaugcccucgacaagaagccgaauuuacaucuaaaugaggcuaaggcucuaauuaaaaagugcauggaaguuuuguucuacagagacgcgagaaguuacccgacauaucaguuggguauaaucgauauggaugaugguguuaagaucgagggaccgauuucugucgaggagaauuggaacauugcuuauaugacauauuuuuuguauuuuauucuugaaaaaaugauauuauuuaauaaaggauggaacuga

SEQ ID NO: 6397 - RNA, 2106 nt, Phyllotreta atra
auggaauuuucgaaagaacccaacuuugaauuacuaacagccaaagauuuuucgccagaaaaauaugugaaaaaauugucccaaaauuauguggguggauccgaauugcaaaaucuucgcagaaaaauccaagggcucuccgaagaaacuagcucuaauuugaagaaaaauguuuacgaaaacuacauucaauuuaucgaaaccgcgaaagagauuucacaucucgaaagugaaauguaccagcuuucccacuuacuuucagagcaaaaggccuuacuuaauugucuaucagccaccucgauacuagaagauguccaaccuguuaacaucgagagagauaauaaaguaaacgaaaaggauauugaagaagaaaauaaacaaaaaauagcugcuauauuagaaaaaguagaagguugucaggaauuguuaaaagugccagggagaauuuuuuuguacgaaggagauuuauuagaaaucgaacccaccgaaaacacugcuuuaaaaauaguucauguuuauuuauucaccgauagcuuuaugauaaccacuagaaauucaaacagucgaggccucaugaaauacaucuacgaaagcauauacgaccuaagcagccuagcagucgugaacguaagagauuugggaaacguuaaacacgccuuuaaacuucucauuuuccccgauaccagaguuuuccaaugcucuuccaacuccaauaaaaaagaaugguuagacaaguucgaucaagccaagaagacccggcuagcccaagaacaacaaaaaagggaauccauaucggaaaaaucccccacccgcguuuccuucgagucccccagcuacaaucccuuugaugaaguggaagaagaaacgagcgcguugcauccggagugguucguggacauuccggaagagcuggacguuugcguagcccaaaggcacuucgaagacgcuuuaucuuuacuacaaaaagccaaagaauacuugaaucaagcgaccucugcaucaggugacaaacgggacaccgucuuuacggacauccagcgaaaaguagagcaaagacagaacaaucuaacggaggugcugaugaaggaacuggaagugaacccggauaaaucgcugcaggguggacugagagcagcucgcagggcugugagauuguuaaaucaauuaggaagggaaacacaaucuuguacguuguuccugaaguuaugcagcagcauguuaagaacgcaguguaaacgaguuaaaagagaaggcucuaccacuacuuauauaaaacaucuuucgagugugguuuucacuaauaugugucacauguccgaugaauuucuaagggcuuuccccgacucuccggccugugcuucagcguauguggugugggcgagcaaugaacuacugcaauuuacuacccauuuuauuaagcaggucuuuaugccgcagacuuccuuaucaacggugaccgagugcauaguuuuaguuagacaacagugcgaaagguuguacguuuacggauuggaccuuuguuaucaauuggacggggcuuugagaucgucgcugaugaaggcguugaaagaugcucgagauaaacucaucgauucgauuaaauugagaguauuagaugauaaauggauaccgauuaauuugcauucuaaaucggcuuugagccguugcgugcaagaguauucucaaaugggacucacuaacguaggaaguuacguuucuggcgauacuugguugcaauuaacagcuaguacuuuaucguuuacgaaaauguaucugaacuuguuaaacgauugcaugaaauugaaaacuacggaguuaauguauacgaucgaugagacuuuguauaacguguucgaagcucaaguuaggcauaaugaaaaugcacuuagaagcgaauugaaucaagaucaaaggaacuuucuuacgaaaaaugcagaguuuuuguugguuaguuuaaugcaaguggugcagaaacaguacgaggaaaaugucggauacgaauguccuacgcuagcgaaauugcaaaaggaauacauagcauugcagaaaggcguuacgcccgcgucaagaaguacaaaagccaaguauucaucagaguuuauuuaa

SEQ ID NO: 6398 - RNA, 3762 nt, Phyllotreta atra
augaacgaauuagagaaacuagaguaccucucuuuggucucaaaaauuuguacagaauuggagaaucaucuuggaaugaacgacaaagauuuagcugaauauauaauacaucuuuccgaaaaaaacaacacauuggagucuuuuaagaaaguccuguuagaaaauggcgccgaauucucagacucuuuuauuucuaaccuguugcgaauuauccaacacaugaaacccaagaaaucaucaaauaaggaagacaccgauaaagucgaaaaagaaggauuggcuuuuaaauuccccgguuuagcaauacccaaugagaaacaaaaaccuuuacaauuagaagaauuuggcaaggaaaaugaaaaugacgaaauagauguuguagccgauaugaugaaacagcucgaggcugaugcaccuucucaaaaacagaccaaagaaaaguccagaagcccaagcaucgaaagaaaauccagaauaagaucuagaagucgaucaaaagaaagaagaagaucaagaagcagauccaaagauagaagaagaucuagaagccggucgagagacaggagaagaucuagaaguaaagauaggcauucuagaagagacaaaaggcauagaaguaggucaaaugaagacuacaagaggagaagaagagacaacaguuacucgagagauagaagggaaagagguagguccaaagaaucggaaagaagagacagaaauagauccagagaugauagaaaaagggauagaaguagaucaagaacgagaaggcgagaaaggaguuacgaaaaaaaauucaaaagugaaaaggauaaucccgaauucgaggaugauccuaccccaggaaagauuuacaauggaaaaguaucaaaugugguuccauuuggauguuucguacaacuagaaggucuaaaaagaagaugggaggguuuagugcacauuucucaacuaagagcagaagguagagucaccaaugugaccgaaguggucucuagaggaagcaaaguuaaaguaaagguguuaacuauaaccggucagaaaguaucccuuucgaugaaagaugucugccaaacgacaggaaaagauuugaauccucuaucccacgcuaguacggaacgagaagauaaagaucguaacccugacaggccuacuaauaauagcacaucaguguugaggcuaccgguuaguaucgaugaaggugaagaagauuccaggaaaaggguaaccagaauauccaguccggaaagaugggaaauuaagcaaaugauuucuuccggauguauagacaaaagcgaauuaccagaauucgacgaugaaacugguuugcugcccaaagaugaagauggugaagcugauauugaaauugaauuggucgaagaugagccaccauuuuuacagggucaugguagagcucuucaugauuuaagcccagugagaauaguuaaaaacccggacgguucgcuagcccaagcugccaugaugcaaucggccuuggccaaagagagacgcgagcaaaaaaugcugcaaagagaacaggaaguggauucccagccgucuggaaagaacaaaaacuggauagauccccuuccggaagaggaaucuaaaucgauggcaagaggaaucggucugcaaagucaagauuuacccgaauggaaaaaacacguuaucgguaauuauuucucgaucacacaauuaauuucgaaguuuguacuaaacaacauuuuaggugguaaaaagucuucuuuugguaaaaaaaccaacuuaacgaucaucgaacaaaggcagucucuuccuauauacaaacucaaagaggaguuacgaaaagccguaacggauaaucaaauacugaucguuaucggugaaaccgguucaggaaaaaccacacaaaucacccaguacuuagccgaagccgguuucacagccagagggaaaauuggcuguacacaacccagaagaguugcagccaugucgguugcuaaaagaguggccgaagaguuugguuguagauuaggccaagaaguuggauauaccauucgauucgaagauugcaccagucccgaaacgaugaucaaauacaugacagacgguauguugcuucgugaaugccugauggauuuggaucuuaagcaguacucuguaauaauguuggacgaagcucacgaacguacaauccacacugacgugcuauuuggauuauuaaaacaagcuguaaugaagcgggaugaauugaaauugauuguaacuuccgcuacuuuggacgcugugaaguuuucgcaguauuucuuuaaggcuccgauauucacgauuccugguaggacguuuccuguagaaguuuuguacaccaaggagccggagacugauuacuuagaugcuaguuuaaucacaguuaugcaaauacaucucagagaaccuccgggugauauauuacuguuuuugacgggucaagaagaaauugauacagcuugcgaaauauuguacgaaagaaugaaaaguuuagguccugauguacccgaacuaaucauucuaccgguauacucagcuuuaccaucggaaaugcaaacuagaauauucgaaccggcaccuccagguaguagaaaaguuguaauagcuacuaauauagcagaaacuucguuaacaaucgaugggauauauuacguaguagauccaggauucgucaagcaaaagguuuauaacuccaaaacuggaauggauucguugguaguuacaccaauuucgcaggcacaagcgaaacaacgagcugguagagcuggcagaacugguccuggaaaauguuacaggcuuuacacggagagagccuaucgggacgaaaugcuuccuacaccuguuccagaaauccagaggacuaauuuggcgacaacgguacuucaacugaaaacuauggguauaaaugauuugcugcauuucgauuuuauggacgccccuccgguggaaucacuuauaauggcucucgagcaguugcauucucuauccgcuuuagacgacgaagguuuauuaacuagauuaggaagaagaauggcugaauucccgcuggagccgaauuuguguaaaauguugauuaugucaguggcucuucaaugcuccgaugaaauauugaccauagugagcauguuaucaguucaaaacguguuuuaccguccgaaggauaagcaagcauuggcugaucagaaaaaggccaaguucaaucaacccgaaggugaccauuugacgcuuuuggcuguuuauaauaguuggaagaacaauaaauuuucgaaugcuugguguuaugagaauuucguacagaucaggacuuugaaaagagcgcaggaugugaggaaacaguuguuggguaucauggauaggcacaaauuggacguggugucggcugaaaggaacacggugagagugcaaaaggccauuuguucaggguuuuucaggaaugcugggaagaaggauccgcaggaaggcuacaggacuuugguugauagucaggugguguacauucauccuuccagcgcguuguuuaaucggcagccagaauggguuaucuaucacgaauugguucaaacuacaaaggaauacaugagagaagugacaacgauagauccgaaauggcugguggaauuugcgccugcauucuucaaguuuucugauccuacaaaguugagcaaauucaagaaaaaucaaagauuggagccuuuguauaauaaauaugaagaacccaacgcguggagaauuucuagaguuaggagaagacgaaauuaa

SEQ ID NO: 6399 - RNA, 1254 nt, Phyllotreta atra
augaacgauggccuccaaagaaaaaacaaaaaaaacauacuggcaaaagugaauuucccucuguacaccguccagaugguaacgucgcggcacguuaucguaggaggcggcgguggaacuucgaagacugggguugaaaacgguuucgaaauauacgaaaucuaucaugacgguagcaaauucucagcgaaagaaguuacaagacacgaaaccggaggaaacguagucaugaacugcuguguguuuagugauaggaaacauucguuuuuaguagcaggucaagagaacuacucucaacuuuauagagucaauacgaaauuaaucgaacaugaacaaguagaaacaauuggagacucugcaagcguucgacauagaaauaccaagcccaaagaacacguagacaauaacaaaaacauuaaaaaggagcugguuuucgacaugaguccuuuagauagcauacaaaccgacuuuaagggauccgaaccccuaugcagaguaguucgaauuaaucacucgggaaaaauauuagcuacuggaggaacugacggcgacguaagacuuuggaaauucccuacgaugcagccauuguccauucucaagggacauacgaaggaaauagacgauauagauuucaguaaauucgauaaucucaucauaacuuuagcgaaggacgguuuggcuauuuugugggacgcccaaacggguaaauugaaaucgaaacugacauggaacacuccagagggaucgaaauauuuguacaagagaugcagguuuggcguuaucgaagaucaaaagaauaagugcaugcuauacaugauagcgaaugcgacuaauucgaagcaaaaaucguuucuacaacaauggauaccugaggagaauacuuuaaaaaaguucucggaauuuaaugaaacacuguccgcacuugcaguuagagacgauggacgauuuguugcugucgggacaauguucagcgguucuguuucgauucacauugcauuuaguuuacagaaaauauuaguaguugucggugcucauucgauguuuguaacuggucuggaauuccuaucucaugaaaauacuaaucauuccauaaguagugucgcagaggccgcuguauugucuauuucgguggauaaucagcuuuguauacacucggugccauacagacgaaguauaccguuauggauuggaauuaugguguuaauuuuaguauuauuuauuacauuuauguuaugugcauacauggguuuguga

SEQ ID NO: 6400 - RNA, 1242 nt, Phyllotreta atra
auggcuggugcaauguuauucgaaagagcucaguccguuccuucccaacaugacaaguuguuaaaauuaaauccggcagacgaagaugacgaggagaauauuguuaauaaagagcaggacauccucaacuugggcgagaaguacaaaaaggagggcaaggcuaaagaacuagcggagcugauaaaggccaccaggccauuuuugagucuuauuagcaaagcaaaagcagcaaaauuaguuagaucacugguugauuacuuucuggacuuggaggcaggcaucgguaucgaggugcaacuguguaaagaauguauagaaugggcgaaagaggagagaagaacguuuuugcgccaaucgcuggaagcgcgucucaucgcccuguauuucgacaccggcauguacaccgacgcccugcagcuggaauccaccuuguuaaaagagcugcagaaacuggacgacaaaaaccugcuggucgaagugcagcugcucgaaagcaaaacauaucacgcuuuaagcaauuuaccgaaagcccgggccgcucugacguccgccagaacgaccgccaaugccaucuauugcccuccgaagaugcaggccgcccucgaccugcagucgggcgugcugcaugcagccgacgaaaaggauuucaagaccgcuuacuccuauuucuacgaggccuucgaggguuucgacagcgucgagucccccaaagcucggaccgcucugaaguacaugcuuuuguccaaaauuaugaucaauaguccugaagauguacagcaaauuguuaguggaaaauuagccauaaaguaugcagguaaagauaucgaggccaugaaagcagucgcacaagcagcccacaaaagaucucuugcagauuuucaacuggcuguaaaacaauucaaacacgagcuggaagacgacguuauuguaagagcacauuuaggaacacucuacgacaauauguuagaacaaaauuuaugcaggaucauggaaccuuacucacguguccaaguagaauauaucgcaaagacgauuaagcuucccguguuacaaguagagaagaaacugucgcagaugauuuuagaugccaaguuucauggaauuuuagaccagggugaugguguccugauaguguuugaagaaaccccgguagacaaaaccuaugaaauggcgcuagaaacgauccagaguaugaguaaaguaguaguuacucucuaucaaaaagcgaaaaaguugucauag

SEQ ID NO: 6401 - RNA, 1824 nt, Phyllotreta atra
augaagaagacuaugcgugugcuauucgugagguuuguauccgaguguuuguguugugcuaagcaucgaagcaaguuucucaaaaaaauggcuucgcggucgaaaaagagcucaacgccgucggcccagcagcggccggcuagcccgcucagccccaccaggcauuccaggcugcaggagaaagcggaccugcaaaaucugaacgaccgccuggccggcuacaucgacaaagugcgguuucuggaagcggaaaacaacaaacuauccagagaaauccaaaccacccaggagacgguuacacgcgaaguguccaacaucaagucuauguacgaucacgaacuaucggacgcuaggaaacugcuggacgacacccaccgcgagaaggcccgccuggagaucgacgugaagcgucucaucgaagagaacgaggagcugaaagccgagcuagccaagaagagcaaggaccucgucauagccgagaaccaugccaggauauacgagaccaggugcaacgaguaccagcucaaagccaaccaagccgccgccgacgccaagaaggccaucgccgacgccaaggaacuggaaaaggaaagggacaagcugaagaagcuccucgaugcagcucguaaacaauuggaagaggaguccuuggccagagucgaggucgagaaucacaaucagaguuugagggaagagaucgucuucaaagaucagauucaucagcaggaacucacagagacccgcacucgccggcaagucgagaucagcgaaaucgauggccggcuggcgcagaaguacgaggccaagcuccaagaggcccuccaggaccugcgggaccaguacgaaucgcagauggccaacaaucgccaggagaucgaguugcuguacgagcagaaaaucaagaaccugcaggccgccgccgaccggcaucaauccaccgccuccggcgcucucgacgagcugagacagguucgaacgaggaucgacaccuucucgucgaggauccaggaccuggagaaccagaaccagggucuggcagcuagaacuagggauuuggagaaguugcucgagaacgagcgcauucgucacgccgaagaccuagcguuaguagagagggaauugcacaggaugcgcgaggaaauggcgacucaacugcaagaguaccaagacuugauggacaucaaagugucccucgauuuggagaucgccgccuaccguaaacugcucgaagcggaagaagcucgauugaacaucacgccaacaggcggugaccacgaggugcaccaaaggagcuccucucaacgccggacgccggugcgacugggggccaagaggaaacgggcccugcucgaggagacgcaggagucgagcaugucggacuacagcgugaauaguucgucuaaaggggacauugaaguggccgcagucgauccggacgggcaguuugugagauugcacaacaaaaguaaccaggaggugccgcucagcggauggcaggucauaaggcgggcgggcgaugaggagacuuucuacaaauuccacagaaccguuaaaguagagggaaaugguaccguaaccauuuggaguucugauuuaaauaaggaucacgaacccccuaguaaccugguuaugaaagggcaaaaaugggugacuggagauaacauguuuacgauaguauugaacagcaacggagaagaaguagcgucauccgaaagggugaaaaggcagauuucgacgucgcauuuaagacacagggaauuaggggacgaagaacuuuuucaccagcagggggaccugcaaggugaaaagugcggacugauguga

SEQ ID NO: 6402 - RNA, 2385 nt, Phyllotreta atra
auggcugauagcaaaagcccugacgaucuagcgacugcgauucuucgcaaaaaggaccguccgaacaggcuuuuggucgaagaagccguuaacgaugauaauuccguuguggcccugucccaggcgaaaauggacgaacuacagcucuuuagaggcgacacuguacuacuuaagggcaagcgucgaaaagaaaccgucugcauaguucucuccgacgauaguuguagugacgaaaagauccgcaugaacaggaacguucggaauaacuuaagagucaggcuguccgacgucguuucuauucagcccugcccugauguuaaguacgguaaaaggaaugauaauuccguuguggcccugucccaggcgaaaauggacgaacuacagcucuuuagaggcgacacuguacuacuuaagggcaagcgucgaaaagaaacggucugcauaguucucuccgacgauaguuguagugacgaaaagauccgcaugaacaggaacguucggaauaacuuaagagucaggcugucugacgucguuucuauucagcccugcccugauguuaaguacgguaaaagaauccacguucuucccauagaugauacaguagaaggacuuacaggaaaucuguuugaaguguaucugaagccguauuuccuggaggcguaucggcccauacacaaggacgacguuuuuaucguaaggggcgguaugagagccguagaauuuaagguaguggaaaccgauccggcuccuuacugcauagucgcucccgauacggucauccauugcgacggggauccgaucaaacgcgaagaagaagaggaggcucuuaacgccgucggcuacgaugacaucggagguugcaggaaacagcuggcucagaucaaagagauggucgaguugccguugagacaucccagucuguuuaaggcuauugguguuaagccgccucgugguauccucuuguacgguccaccggguacuggaaagacucugauagccagagccgucgccaacgaaaccggagcuuucuucuuuuugauuaacgggccggagaucaugagcaaacuugccggagagucggagaguaaccugcgcaaggcguucgaagaagccgacaagaacuccccggccaucaucuucaucgaugaauuggaugcuaucgcuccgaagagagagaaaacccacggagagguggagcgucguaucguuucgcaauugcuuacucuaauggacggcaugaagaagagcucccacgucaucguuauggccgcuacgaaccgaccgaacuccaucgaucccgcucuacgucgauucggcagauucgacagggaaaucgacaucggcauuccggacgccaccgguagacuggaagugcugagaauccacaccaagaacaugaaguuggccgacgacgucgauuuggagcaaaucgcggccgagacucacggucacgugggcgccgauuuggccucgcucuguucggaagcggcgcuucaacagauuagggagaagauggaccugaucgaucucgaagacgaucaaaucgacgccgagguucucaauucgcuggccgugaccauggagaacuuccgcuacgccaugacgaagagcagcccgagcgcucugcgcgaaaccguggucgagguuccgaacgucacuugggacgauaucggcggcuuggcgaacgucaagaaggaguugcaggaguuggugcaauauccggucgagcaucccgauaaguuccugaaauucggcaugcagccguccaggggagugcuguuuuacgggccgcccgguugcgguaaaacccuguuggccaaggccaucgcuaacgaaugucaggccaacuucauauccgucaagggaccggaauuguuaaccaugugguucggugaaucugaagcuaauguuagagacauuuucgauaaggccaggucagcagcuccuuguguacuguucuuugaugaguuagauucgaucgcuaagucgagagguggaaaugugggagaugccggcggcgcagccgauagggugauuaaucaaauuuuaacugaaauggaugguaugggagcuaaaaagaacguuuucauaauuggugcuacaaauagaccagauauuauugaucccgcuauauuacgucccggucgucuggaucaguugaucuacaucccguugccagacgaaaagucuagggaagcaaucuuuaaggcgaaccuaaggaaaucaccuguagcuaaagacguagaucuuauauauauugccaaaguuacacacggcuuuucgggcgccgauuuaacagaaauaugucaaagagcuugcaaacucgcuauaagacaaagcaucgaaaccgagauuagacgagaacgagagagagcauugaauccc

SEQ ID NO: 6403 - RNA, 825 nt, Phyllotreta atra
augagugaccaauucgacugugcacucgauuuaaugaggcgcuugcccccgcaacaaaucgaaaaaaauuugagcgacuugauagauuuagugccaagucucugcgaggaucuccuuucguccguggaucaaccuuuaaaaaucgcuaaagacaaggauucgggcaaggauuuucuuuuaugugauuacaauagagacggggauucuuacaggucaccauggucgaauaccuacuauccuccauuagaagacgguucgaugcccuccgagaggcuaaggaaauuagaauuagacgccaauuuagcguucgaucaauauagagaaauguauuucgaaggcggcguaucuucuguuuauuuuugggacuuggaucacgguuucgcagguguaauuuuaauuaaaaaaaccggcgaugguaguaggaaaauuaaagguuguugggauucccugcacgugguggagguacaagagaagaguuccggaaggaauucccacuacaaaaugacguccaccgccaugcuguggcugcaaaccaauaaacaaggcucggggaccaugaauuugggcggcaguuuaacccgacagaucgagaaugaugcggccgugaacgacaucaauccccacaucgccaacaucggucgaaugguggaagacauggaaaacaaaauucggaacacguuaaacgaaaucuacuuuagcaaaaccaaggacauagucaauagcuugaggucggugcagccguuaacggagagccgucaacagcaggcgcuuaaacaagacuuggccgccgcccuucagcguaggcaaaauaaauccgagaauuga

SEQ ID NO: 6404 - RNA, 3291 nt, Phyllotreta atra
auggaacguccaccccgcaaugagccgcccguggagccugucaacggugugguacaaccgccggugcacccgcccccggacaguccaggacgcguaacgaaccaacugcaauuccugcagaaaaccguacuaaaggcuguauggaaggacaaguucgccuggcccuuucaacaacccgucgacgcuaagaaacucaaccugcccgacuaucauagaauaaucaaacagccgauggaccugggaacgauaaagaagcguuuagagaacaacuacuauuggucggguaaagagugcauucaggauuucaacacgauguucacgaauugcuacgucuacaaccagcccggcgaagaugugguggucauggcccaaacauuagaaaaaguauuuuuaaccaaaguggccgacaugccuaaacaagaauuugucguugauaugccgaugaaaggcgccaaaggcaagaaagggcgaguuagcgucgguggcgucgguggcggcggcggcggcggcagcacgccauccuccagcggcccgguaccagcagcuauaguaccaggaggugucagaggcaggccgcccgcgaccguauccucuaccaguaccacaccgauugcgaccacuaccgguucguccggcuugccguugggcacccaagcgcccgcgacgcugccgggcaguaccgccaccacgacgauagcgccggccaacaacaacaacagcucucugacgccgcagcagcucggcacgcccgucagcucgaugcacggcacgccgggggcgccgcugucgaauucccucgaucccaccggaggagugcuacccucuaacgucaugccgccggcgcaaccagccaagguaaaaaagggcgugaagagaaaggccgacacgacgacgccggcgacggccuacgauuauccgacgguguuggaaucgaagucggcgaagauuucgacgcgccgagaaucgggcaggcagaucaagaagccggcgcggcgggaaaucgaccuucacguaccucagccggcgauccacaagcccaacgacaaguugucggagucgcucaaggccugcaaugaaauccucauggaauuguucuccaagaaacauucgaauuacgcuuggccuuucuaucaaccggucgaugcagaacuauugggccugcacgacuaccacgacaucaucaagcgaccgauggacuuugguacggucaaagagaagauggacaacagggaguaccgcaccccgcaggacuuugccgccgacguuagacugauuuuuaguaauuguuacaaguacaaucccucugaccacgauguggucgccauggcgcggaagcugcaggacguguucgaagucaaguucgcaaagauccccgaugaacccuugaaccggauaggaggagcuguaaauaaucuacccauaaaauccgaaucgaguaguuccgguucgaguuccgauucguccagcgaauccgaggauucggaggaggaacgacguaauaaacaauuaaaaguacuggaaaaagagcugacggcguugcaagagaagaugcgcaagcugguggaggagagcucgcgccggaaaaaggagaaaaagaagaacaagaugaaaaagaagccgagcggcgguggcggcaugucggccgcgggggcgggagcgcugccgaacagcagcagcggucucgguuugcgcggcaacaagcccgccgccgccgccaacgccgcccccaaacgggugaaggccaacaacaagaccggcgccggcaggaagaagaacgccgcccagccgccgcccaugccguucgauuccgaggacgaggacaacgccaagccgauguccuacgacgagaagcgacagcuuucauuagauauuaacaaauuacccggcgacaaauugggucgaguuguacauauaauccaaucgagggagccgucguugagggauucgaaucccgaugagaucgagaucgauuucgagacguugaagccgucgacguugcgggaauuggagagcuacgucgcgucgugucugcguaaaaagccacauaaaaaaguagccggcaaaucuaaagacgaacaaauggcggagaagaagcaggagcuagaaaaaagacuaaucgauguaaacgauaaaaucggcaauuccaaaaaagcaccuaaaaaagaugaagcgaacaagguggacccgacgggcgcuggcggucccuccggucgccugucguccagcucgagcagcucggauucggacagcagcagcagcagccugucgucgaguucgagcgauuccagcgacagcgaagcaggugguacgaccaacagauccacuaaaaagaaagugaacaaaaagagccccaacccaucggucgauaauacuacgauaacgaaaccacagcaaccaacaacagcaccaccaaugccacaaacacccgccaacgcuagcguaaccgccgccgcgccggccaacaccaacgcgccgccgccgcagguacccgccaccgucaacaacaauuucccgccgccgcagcaacaacaacaggcgguagcucccggcaaacaacagcagcacaacgugguuaacguaccgcccgcgcagcuggugccgccgcugaacaucaaacccaucggcaucgagaagcugucggcggugaaucccguaaccccggccagcgugccccaagccccuaaauccgucgcccuacccacacccucgcccgacaaaccuaaacccaacgucaucgcgcacauggacaccuacaccgaccccaucgagcagagccucgccaaccuggagcaggacaccgucaccgugcaacagcucaccaaucccauccccacccaucccguacacaugaaccucaauccuaacgucacgcaucccguuuuacagcccaguuccuugaacauggacaugaaggcgccggugacgauggccaccagcaugcugcaccacaugccgauguccauggacgccggggaucuacccgccuugaugcaaacccaagcuaacuugaugcacgcgcagaacaacggguucggcaucaagcacgaguuugauuuaaccgcgaacaacaacgguaucacgucgaugggguugcccauggagauguccauaucgucgauguucgaccagcugccgcagcacaucagcggccagaugaucaagccggauccgggccaggaucggcucgacgggcuggugggggcgcugaucagcgagaagaaaccgccgccgggcgugccgccggccgccuccaagccgcagacguucggguucaagcaggagaaggccgag

SEQ ID NO: 6405 - RNA, 1218 nt, Phyllotreta atra
augucuuuauccacugcucgcccuuuagugagcguauacaaugagaaaucggaagaaguaaaaggcaacgggguagcccuacccgcugucuuuaaggccccaauuagaccagaugucgucaauuucguucaucagcaggucucaaugaaccaucgccagccuuacagcguuagcgacaaagcuggacaccagaccuccgccgagucguggggaaccggucgcgccguggcccguauaccucguguacgcgguggcgguacccaccgauccggucagggagccuucggcaacaugugucgcggcggucgcauguucgcgcccaccaagccguggcgccgcuggcacagacgcgucaacaucaaccagcgucgcuacgcccuggcgucggccgucgccgccagcggcgucccagcucuggucaugagcaaggggcacguggucgaucagauucccgagcugccguuggucgucagcgacaaggugcaggagaugcacaagaccaaggaggccgugcaguuucugaggaggaucaaggcuugggcugacauccagaagguuuacaagagccagcgguuccgugccgguaaaggaaagaugcguaauaggagacguauccaacguaaaggaccacucaucgucuacuacaaggaucaaggucuucgucaagcuuuccguaacaucccaggcauugaccuuaucaguguccaaaaguugaacuuguugaagcucgcuccuggcggucacguaggucgauucgugaucuggacugaaucggcguuccaacguuuagacaaauuguucgguacauggaaaaacccaucgaccgagaagaaggguuacaacuuaccucaacccaagauguccaacaccgauuugucuagguuguugaaagcugacgagauuaaagcugugcuuaggacuccucagaagaaggugguacgucguguucgucgucuuaauccuuugaccaacacuaaagccaugcuuaaauugaacccguacgcugcuguacucaagagagaagcaaucuugaagaaccaaaaaaggcaguugcaaagagacgaagcuuuggcuaagaaacgaggaaucacccugaccccugacaacgcuguaaucaggaccaggaaauugcaggaaagaaggagagcgcaaauuuugaaagauaagaaaucaaaacccaagaaggccgcuaaagcgccggccaagaagccugcugga

SEQ ID NO: 6406 - RNA, 5274 nt, Phyllotreta atra
auggcagauuuucuuaauucagaagccgaggaaucuagcgaggaggaagaauuagaccauagggaucgaaagaaggcacaaaaagcaaaacucguagauagcucugacgaggaagaggaagaagaugacgaagaaaaaauuagagaagaauuaaaagaucuaaucgacgauaauccaaucgaagaaagugaugcugaauccgaugcuucaggucgugagaaaagaaaaaaaucugaugacgaagaccucgaugaucgauuggaagacgaagauuacgaucuguuggaagaaaauuugggucauaaaguagaacgaaggaaauucaaacguuuacgccgguuugaagaugaagaaagcgaaggggaagaagaacaugaucccgaccaggaucgcgaacaaaucgcuauggacauauuuuccgacgaugacgaagaaagaaggucggaaagaagccaaagaccggucgucgagcaagaaucuuucgguguaggcgaagaagaagaagaaggcgauuauucggacgccgaugauuuuauuguagacgacgacggcagaccguuaaucgagaagaagagaaagaagaaaccgauuuucaccgacgccgcgcugcaagaggcccaagaaacguucggcguugauuucgauuacgacgaguucaccaaauacgaucaagacgaauacgaggacgaggaggacgaagaagaggacgaauacgaagaagaugacaacgaacgaaggaaacauccgaagaaagcugcgaggaagaagcugacgaaaaaguccauuuucgaaguguacgagccgagcgaauugaaaagggguuucuucaccgaucuggauaaugaaguucguaacaccgauauacccgaacggaugcaacuucgugacguucccauuacacccguuacggacgauucgacugagcuggaagacgaggcggaguggauuuacagacaagcguuuuguaauaaggcuguguccaaugucgaugcgcaccuuucggccgaagcgagagagaaaaugaagaaaggcucccaaacgguggggaaaauaaagaaggcguuggauuuuaugaggaaccaacagcucgaggugcccuuuaucgcuuuuuacagaaaggaguacguucaaccugaacugaacauuaacgauuuauggaaaguuuauaaauacgaugcgaaguggugucaacuaaaaucucgcaaggaaaaucuucuuaaacucuucgauaaaaugaggcauuaucaacuggaucaacucguaaaaaauccggacgcuccuauuccagacaacgugcgagugaugaaagauucggauaucgaacggcugaaaaacguccaaacugcggaagaacucaaugauguucacaaucauuucauauuguauuauuccggagacuugccugccaugcaugccgcuuggagaaucaaagaaaaagagcagcggaaauucgagaagcgacaaaaaagacucaagcaaauugccgaagcggaagaaggugcugacauucccgaugaaccagaggaugaugaugaugacgaaccagaaauagaaacuuugaaguaugcuaaucgaucuggcaguuaugcauuaugcucuaaagcuggauuagauccuuuggcaaagaaauucgguuuaucacccgagcaauuugcggaaaauuugcgagauaauuaucaaagacacgaagucgaucaagagcccgucgaacccuccgauguugccaaagacuuuauuucuccuaaauuuucaacugccgaugaaguauuacaagcggccaaauauauggucgccuugcaaauagccagagaaccguuaguaagaaaauguguuagagaaguuuauuuugaaagagccaggcuuaauguauauccgacaaagaaaggacaaaaagucauugaugagucucacaauuguuacagcaugaaauauuuaaaaaacaaaccugugagagauuugaauggagaucaguuuuuaaaguugugcuuggccgaagaagagaaccuucuaacuauuacaauuaacgauaauaucgaaggaaauacaucaaacucuuacauagaggaaguuaaacagcucuacaucaaggacgaauuuaguaaaaaugugcaagauuggaacgcguugagaauggagugcguagaaagggcgcuaacgaagagcguuuugcccgauuugcgaacagaauugaagagaacuuuauuaucugaagccaaagaauucguccuuaaggcguguugcaggaaacucuacaacagcauuaaaguugcuccauacucgauaacauuucccgaugaagacgaagacgagugggauacaucgaaaggcguuagaguuaugggauuagccuacguuccagaauauacaguuucggcauuugcuugcaucgcagcacccgauggagauaucacggauuauuugcguuuaccgcacauauuaaaacgaaaaaacaguuucagaacggaagaaaaauuaaugaaggaaacggauuugcaagcccugaagaacuuuaucuucuugaaaaaaccccacgugaucgcgaucggcggcgaauccagagaagcgcugaugauagccgaugauuugaaggccuugauuaacgaguuaguugaauccgaucaauuucccgaaaucaaagucgaaauuaucgacaacgaauuggccaaacuuuacgcaaacuccaacaaaggccaggcggacuuuagggacuaucccgaguugcugagacaggccauuuccuuggcuaggaaaaugcaagauccucucaucgaguacucgcaguuguguaacggagacgaagaaauauugaguuugagauuccauccauuacaagaacaaauaggcaaagaggagcucaucgaagcccugugccucgaauucgucaacagaacuaacgaaguuggcguugauauuaauuuggcuguacaacaggcgcacaaaagcagucucguucaauucguuugcgggcuaggcccucgcaagggucaagccuugcugaaaguccuuaagcagaccaaccaaaggcuggaaaauagaacacaguuggugacggcaugccacaugggcccgaagguguucauuaauuguucugguuucaucaaaaucgauacuaacagcuugggagauaguacugaagcguauguggaaauauuggaugguucucguguacauccggagacuuacgaaugggcuagaaagauggcuguagacgcuuuggaauacgacgaugaugaaggcgcuaauccugccggugcuuuggaagaaauccuggaaacgcccgagagauugaaagaucuggauuuggaugcuuucgccgaagaauuggaaagacaaggauuuggcaacaagaguaucacguuguacgacauacgagccgaauugaacuguagguacaaagauuugaggcagccuuuccauucggcuaauccugaagaguuguuugauauguuaacgaaagaaacgccggaaacguucuacauaggaaaauugguuacugcuucaguuauagguaucgcgagaaagaagccuaaaccugaccaacucgaucaggccaauccugucagaaaugacgaaacggggcuuuggcaauguccguuuuguuugaaaaaugauuuuccggaauuauccgaugucuggaaucauuucgaugccggugcaugucccggucaagcuacuggagucaaacuuagauuagacaauggaauaauggguuauauuuauauaaagaauauuagugauaaaccggugucgaauccggaggaaaggguaggaguuggucaauuaauuaguugucguauaauaaaaaucgacguugaaagauucagcguugacuguacgucgaaaucuagcgauuuguuggauaaaaaccacgaauggaggccaccgagagauccacauuacgauacagaacgcgaagaaaaagacaacagaacugaggcggaaaagaaaaaggaaaaacaacguuugacauacauaaagagaguaauaguucacccggcuuuucacaacauuucuuacgccgaagccgaaaaaugcauggucaauauggaucaaggugaagucaucaucagaccauccagcaaaggagccgaucacuugaccauuacauggaaagucgccgauaacauuuaucaacacauugauauuagggaagagggaaaaacuaacgcguuuucuuuggguaaaucguuguugauaggcaacgaagaguucgaagauuuagaugaaauaauagcgagacaugucacuccgauggcggcgcacgcucgugauuugcucuacuucagguauuuuaaagaauucgagggcggucacaaagacaaggccgaggaguuccuaaaagacgagaagaagaagaacgccucgaaaauacauuacgucguuagugcagcaaagcacuuaccugguaaauuccugcuuucguauuuaccgagaaauaaaguuagacacgaauacguaacggugacucccgaaggauuuagauucagacagcaaauguucgauucgauuacgucgcuguucaagugguuuaaggagcacuuuagagaaccaccgccgggcggaaugacaccuggaacaccaagaauguccaccggaagaacaccuuaugauaugaguaccgaagcuauucaaagaguugcgcaaaaucuucccagcgacaugguccaagcuuuauccgcugcaacgaaucaaacuccucacuacccgcacacuccuggcgguuacggcgguaauuacaucaauacaccguacacgcccagcggccaaacgcccuacaugacuccauuccaaaccccucacgcccaacaaacgccgcgguacggccaacagacgccgucccagccgucgcugagcaacccguuccuccaucccggcgccgugacgccgucgcaacggacgcccagcuacaggaaccugucgagccaaaguccgaugauaccgcagaguccggugccgaguccgggaucgcagaguucguacagcagccacaugagccaccauacgagggcgagcuacggggauucgaugagguuccagccgccggagucgccgaggaauuacccgagcagcaggggcuccuaucccgaugggcgguacgguggcagcgaaucgauggauuggcagaaggcagcugaagcuugggcuucuaggucgagauguaaguguuuuguggagguuuauagauaucgaaugauuguuuuuuuauuguuuagcaacgccacgaagcgaaggucgggggacucccaggucgucuggucacagaacuccucguaa

SEQ ID NO: 6407 - RNA, 2250 nt, Phyllotreta atra
augcuaacuucccgaacaggaggagcuuacauaccgccagcgaagcuccguuugaugcaagagagcauaacggacaaaucuucggcugcuuaccaacguaucgccugggaggcccuuaagaaaucgguacacgguuacaucaacaaaaucaauacgucuaacaucgguauaaucgccagagaaauccugcacgaaaacauagugagaggcagaggucugcuuugcaaaucgauaauccaagcccaagccgccucuccuacuuucaccaacguuuaugccgccuuaguggccguaaucaauuccaaauuucccaauaucggggaauuguuguugaaaagacuggugcugcaguucaaaaggggcuacaagcagaacaacaaguccauuugcauuucggcuacuacguucguagcucacuugguaaaccaacggguggcucaugagauacuggcgcucgaaauacugacuuugcucgucgaaacuccuacugaugauuccguggaaguggcuauuucuuuucucaaagagugcggacagaagcucacggaagucucgaguaaaggaauuacugccauauucgagaugcuuagaaacauccugcacgaaggccagcucgagaaaagaauacaguacaugaucgaggugauguuccaaauuagaaaggacggcuuuaaagaucacgccgcuguaaccgaggaauuagauuuaguagaagaagaggaucaauucacccaccuaaucaugcuugaugacguaaaggagguuaacgcugaagauauucuaaauguauucaaguucgaugaacauuacgaagaaaacgaaggcaaauacaaaacucugaguaaggaaaucuugggaagcgauagcgaaucggaaucgggaucggagggauccgaagaggaaucggagggcgagggcgaggacgaagaagucaaagaugccgggaaaaucaucgacaauaccgaaacgaaucuaauagcccuuagaaggacgauauauuugacuauacaauccaguuuggauuucgaggaaugcgcucauaagcuuuugaaaauggaguuaaaaccuggacaagaaaucgaauuaugccauauguuuuuagauuguugugccgagcaaaggacauaugagaaauucuacggacugcuagcucaaagguuuugccagauaaauaaaauauacaucgagccuuuucagcaaauauucaaagacacuuucgccacuacccaucgguuggacaccaauagauugaggaacgucagcaaauuuuucgcccacuugcucuuuacggacgccauagguugggagguguucgagauuaugaaacucaacgaagaagacacuaacagcucgaguaggauuuuuauuaaaauuuuguuccaagaauuagccgaguauaugggauugggaaaguugaaugcgagauugaaagaugaaacgcuucaacaacauuuugcgggauuauuuccuagagacaauccgaaaaauaccagguuuuccauuaauuucuucacguccaucgguuuaggagguuuaacagacgaacuuagagagcauuuaaaaaacgucccuaaaauuauggaaauuaaaacgaccgccgugaaggaagaaagcgaaaguagcagcaguagcagcagcagcagcaguaguaguucaagugaagaagauagcagugauuauaguuccgggagcaguagcaguaguucaagugaagaagauagcagugauuauaguuccggggauucgaguucagaggaugaaaaacaaagggaaaaaucgaaaaagaagaaaaagaaacgcgauucggaaagcaaaucuucaaaaucggauucuaaaaguaauccuaaagacgaaaagcgcgauagagguaagcacaagaagaauaaggacaaggaagaucguaaagaaacccauaaaaauaaagaaaauagaagcgauucggacaagcacguuucaagggagaaacaaaacucgaggcaagauaaaagaaaagaugacggugacguuaaggaaaaacccagaaaagaugauagggaugacagggagaggcaacggaggaacgaagaaaagggcgggaggaaaaaggacuaugaaugggugaaaaguagacacgaggauaacauacaucaauuaaaaacaucuaaaaaaguguuugaaaaaccaucaaagcacaggucgaggucgagggagaaaauuaguaguaaagaaaaggacagaaagcauaggaguaaagaaaggcgaaaaaguuga

SEQ ID NO: 6408 - RNA, 1821 nt, Phyllotreta atra
augcauuuuacagcaagcagauaccauucucauugccaguugaaaaaccaagucggucaaaaaauaaugaacgaggugauaaagcauaaagccuccaagaagaacggaccugcaguuacacagccccacaacgcuagugguguugacuggagaauccugguggucgaucaacuggcaaugagaaugguaucggcuugcuguaaaaugcaugacauaucugcugaggguauuacauuggucgaagauauaaugaagaagagagaaccgcuugcuacaauggaagcuguguacuugaucacgccuucugaaaagucuguucaugcucucaugaacgauuucgaaucuccgagacccauguauagaggagcacauguauuuuucacagaagcaugcccagacgaauuauuuaacaaauuaaguaagagucaugcagcaaaauauauaagaacguuaaaagaaaucaacauagcauuuauacccucagagucacagguauuuucuuuagauuccccagacacuuuccaauguaguuacgauccuuccuuugcugccgcacgaaaugcgaauauggaaagaauggccgaacagauugcaacauugugcgccacuuugggggaauacccgcacguccgauauaggagcgacugggaacguaacguagaguuggcgcaauugauucagcagaaauuggaugcuuacaaagcggacgagccgaccaugggagaagggccggagaaggcccgaucgcaauugcugaucuuagaccgaggcuucgauugcgugucaccuuuacuccacgaacugacguuccaagcuauggccuacgauuuacuuccaaucgaaaaugacguguacaaauacgaggcuuccgcugggguacaaaaggagguucucuuggaugaaaaugacgagcuguggguggaguugcgccaucaacacaucgccgugguaucccaaagcguuacuaagaauuugaaaaaguucaccgauucgaagcgcaugacucaaagcgauaaacaauccaugaaggauuuguccacuaugauuaaaaagaugccgcaauaucagaaagaauuaucgaaauacgcuacucacuugcaucuugccgaggacugcaugaaggccuaccaaggguauaucgauaaguuaugcaaaguugaacaggauuuggcaaugggaacugacgccgaaggggagaaaauuaaagaucacaugcgcaacaucguuccgauucuuuuagauaccaaaauaacgaacgaauacgacaagaugcgcaucauagcuuuguacgcuaugaccaaaaauggaauaaccgaggaaaaucuuacgaagcuagcaacacacgcccaaauuaaagacaagcaaacuauugcuaaccuucagcuuuugggaguuaaugucauuaaugaugguggccccagaaaaaagaucuacaccguaccgcgcaaagagcgaauuacagaacaaacuuaucagaugucgagauggacaccuguuauuaaagacaucauggaggauugcaucgaagacaaauuggaucagaaacauuuccccuaucuaaguggacgagcgcaaaccacaggauaucacgcagcaccguccagcgcucgauauggacaauggcacaaagauagaggucagcaggccgucaagaacgucccgcguuugcuggucuucgucguuggaggcauaaguuucucugaaauucgcugcgcguacgagguaacaaacgcccagaagaacugggaagucauaaucggaucgucgcauauccuuacaccagaagguuuccucagugauuuagcgacguuagccggcuag

SEQ ID NO: 6409 - RNA, 2139 nt, Phyllotreta atra
augaugcaacaauauaugaaagaguuagaacaagagccuuucgaugccgaagaauuuguggaacguuuagccuggagaacuuuagcugaaucaaaaagcgagggagaggaaaaugaaauuaauccggcgcuucuucacgaguccuuuguucaagccauaaaggaccuuaauuuauugcacgaaaggcaacagaaaaaaugcgaaaaauuagaagucgccguuagagaagacgaagcgacguuuuuucaagaaguuuacaauuuauuggaacaaaauaagcaagcuauggauacauuucaagaacuggacggcaaaauuaaucauguagcaaccaaaguucuccacuugggugaucaguuagacagugucaauggucccagauccagaguugucgaugcauuaagcuuaaugacucauuuaagagaauuuuuaucgaaugagccaguuucauccacaauauuuaccaaugaagaauacauugaugaagcagcugacgugauucaaaaguuguauuuaauaucgcaagauuugccacccaaguuugaaucgauaaaaagaaaaauagaaaggaaguauucggauauugaaaaaacgcuaauagaagaguuuguuggggccauggauaaugagaauuuaacaagaaugaaggagauagcguugguacugucccaauuuaaaggcuacucucagugcauugacuccuauauagaucacagccaaguggguuguuuaucuaguaaagaugucuucuauaacuuuuugaauuuguguaaauacaaugaugaaauaauucgaaaaguuuucaagaauccagagcaagugauggcgaaauucguuuuaaauauauaucagcuaaaauuaguggaauauauagaucaaaaacuaaauucuaaauuggguacuuacagcuauuuacaaacauuauaugaacuguauuccaagacuaaucaucuaucaagcgaauuaaccguuuuucauaugggaaacgacaaaaacuaucucucuaaacuaacgacaaauauuuuuaauaaguacauuaacgauuacauuucuauggaacuuaagugucugaaagacagauguucaacuaacuuacaaaaauauuacgauucgaaaaaucaucaaaagaaacagauucagucugggggcuuucaagaucuuagaagagacuuacaagcaguaauaggcacaagggcaaacauuaacauagcacaaauagaaaauuauggcggcgagacuuucuuaucugaggaauuggcaaucaugauccuucaagauacuaaacaagcuuuucaacguugcuuauuguuaucaaaagguagugaaagggcuuccaacgccacucaaauuuuagacaggcuuauuaauaguuugcugauagaacauguagacuaugcaguugaauugggucuacacgcuguacccguugucgaaggcguuagaaaucccccuguuuuguauuuuuuuaacaucguucaucagaguaauaauauaacccaucucgucgagaaacaguucauggauuuggugguuccauuaguagaaaauacuucgaaauauagcgauugcguacagaagaaaaaauuuguuuuggaggauauagaaagaaaaauuaauacgggauuggauagaugcuugagugcgauauuaaauugggugaaguuguauuuacaaucugaacaaaagaaaucggauuuuaagccagagucugaugauuuugauacaguggccucaccagccugcaagaacguacuuaauuauguuaauaguauugucaaagaaauuaaaacuaauuuggauggcaauaauguaacagcuauccuucaggaguuagggauuagacugcauagaguuguuuacgagcacuugcugcaguaucaauauaacacugcaggugcaaugguggcaauuugcgauuuaaacgaauauagaucuuguacuaaacaauuagguccuuuaguugcggagcuuuuugauacuuuacaugcuuugugcaaucuuuugcugguuaaaccagaaaaccuucaacaagugugcucugaagauucuuugguuaaguuagacagagcgauccuccauaguuuuauacaacuacgaagugauuuuaaaguucaaaagcagacuauuuugaaaguuuag

SEQ ID NO: 6410 - RNA, 813 nt, Phyllotreta atra
auggauuuccaaaacagaccuggugggaaaacgggcggaggcggcgucgccuccuggucggaaaccaaccgagaccgcagagagcgacugaggcaacuggccuuagaaaccaucgaucugcagaaagaccccuauuucaugaaaaaccaccuggggucuuacgaauguaagcuuuguuugacgcuacacaacaacgagggcagcuacuuggcccauacgcaaggcaaaaagcaccaagccaauuuggccaggagggcggccaaggaagcuaaagacgcccccacguuacuccaaccggagaagccucgaguggagcccaagaaguucgugaaaaucgguagacccgguuaucggguaaccaaacaaagagaccccgaaacuggucaacagaguuuacuguuccaaaucgauuauccagaaauaagcgacuugguucugccccgacaccgcuucaugucugcguacgaacaaaaaaucgaaccccccgaccguaaauggcaauaccuacucuucgcugccgaaccguacgagaccaucggcuucaaagugccgagcagagaaguggaaaaaacugacacuaaauuuuggacgcacuggaacagggacaccaagcaguuuuuccugcaauucgccuuuaagaacgagaacaaacgcaacguuaacucgguaguucaaaggcauucgaucguuggcggcguuccaccgccucccaugcugccgguaccgccgccacccaggccuccuauguuuaaucccauuccaccgccaccgccgaugaugagggccguuuugccaguacccccuccgaauuaa

SEQ ID NO: 6411 - RNA, 402 nt, Phyllotreta atra
augucgaucgguguaccuauuaagguucuccacgaagccgaaggccauauuauaaccugcgaaacgauaaccggcgaaguuuacagggguaaacuuauagaagccgaggauaauaugaauugccaaaugacccaaauaacuguaacuuacagagacggacgaguggcgcaauuagaaaacguuuacauuagagguuccaagauaagguucuugauauuaccggauauguuaaagaacgcuccgauguuuaaaaaacaaaccaaagcuggcacugcuggcagagggaagucugcaauucuacgagcucaagcucggggaagaggccgagggcaaccgccuguucgaggaggcagaggggcuuggcagaaucagcaaaacgccccugcaggucgagcaaaauag

SEQ ID NO: 6412 - RNA, 1329 nt, Phyllotreta atra
auggcuacaaaucuaucacgaacaucgcuccugcgaaucauuaacgcuaggggcuacgcagccuguccccauccacuuucuggcguuccaaacgcagaaguaaaaagcaccguacuccccaacaaaacgguuguagcugcugucgacaacaacgcagcccucaccagaguuucgaucguauucagggcuggaagucguaacgaagaucccgacaauuuaggcguagcccacguguugagaucggccgcaggucugaguacgaagaacuguucgcaauucgcuauuauucgcaacauucagcaacuaggggccaauuuaacggccacuuccgauagagaaacuaucugcuacacguuggaaggcaccccggaagcuguggaaugcgcuauaccauucuuaaccgaaguagccacccaacaggaauucagaccgugggagauuuccgaauuguccgguagauugcaguuggacauugcuacaagaccguugcaguugagagcuaucgauuugcugcacaacgcugccuuuagaggacgcggcuuggguaauucucuauuuauuccgaaaacucaaaucgguaaaauuucguccgaaacccuacaacacuacguugccucgaacuucgugagcggccgcauggccguaguaggcucagguaucugucaaaaggaacugacaucuuucgcaaacuccuugaaaauugaaaauggcgaaggcaacaacgcuccuucaccuuacguaggaggugaacuaagaucgaacaaaggcggucaacuagcauucauugcuguagcaggagagggugcugcuaucacgaacaccaaggaggcucuggcuuucgcugugcugcaaggagccuuaggaggaggcccgcagguuacacauggaguuugugacaacggugucuucaggaaggcucugggaagcaaccccaaugucaguucaguggccauaaacgccaguuacucagacacaggucucuuugggcuucugcuggcuguaccaacgaagucugcaggaggugcucuggaagcagcuguuaaagugcucaagaguggaucggugucugaugaagauguccgcagagguaaaaaucaauugaaaacgucgauucucuuuggggcugaaagcggagcugauauuguaagaagaauuggacaggaagcuguuuugacgcaaaaagcuaccaguguugaugcacuuguggcugauguagauucuguuucuaccagugauguugcaaaugcucuuaagaaagcaggcaagaaauugucauuagcgucuguuggaaacuuggccggaguaccauuuuuagaugaacuaaaguaa

SEQ ID NO: 6413 - RNA, 333 nt, Phyllotreta atra
augaggagagcccacgcugguaacuacuacgagccacugccgcagaauuccaacgaaauugaagaugaaaaugaucggaugacuaacgaacuacaagagaaaaucggagcccuaaaaucccucacuauugauauaggaaaugagguuaaauaccaggacagaaugcucagggaugucgaugacgauuuggagaaaaccggaggcuuccugggaaccaccaugaacaaaguguugaggcugucgaaagggggccacaauuacaucauuguguauuuguuuuuauuuucgauuguuguauuuuuuauacuuuacuguguuauuaaauuuagguag

SEQ ID NO: 6414 - RNA, 1491 nt, Phyllotreta atra
augucuuacccaucgacguuaaacucaaaacaggccgcacaggagcacgguuuggccguguccagagacuuuguaucccagccgaugcucacuuacaaaacagugucuggugucaacggaccguugguaauccucgaagaugucaaauuuccgaaauucaacgaaaucguccagcucaaacuggccgauggcagucuacgauccggucaaguauuggaggugagcggcuccaaagccguaguacaaguguucgaagguacuucgggaaucgacgccaaaaacaccgugugcgaauucaccggcgacauucucagaaccccaguguccgaagacaugcugggcaggguguucaacggcucaggaaaaccaaucgauaaaggacccccgauuuuggccgaggacuucuuggacauccaaggucaaccgaucaauccuuggucgcguaucuacccggaggagaugauccaaaccgguaucuccgccaucgaugugaugaacucgaucgcucguggccagaagauccccaucuucucggcggccggucugccccacaacgaaaucgccgcccaaauuuguagacaagccggucuugucaaggugcccggcaagucggcuuuggacgaucacgaagacaacuucgccaucguguucgccgcuaugggagucaacauggaaacggcucguuucuucaaacaagauuucgaagagaacgguucgauggagaacguauguuuguucuugaauuuggccaacgauccuacuauugagagaaucaucacgccccguuuggcucuaacggcugccgaauuuuuggccuaucaaugcgagaagcacguguuggucauauugacugauaugucuucguacgcugaagcuuugcgugagguauccgccgccagggaagaagugcccgguagacgugguuuccccgguuacauguacaccgauuuggccaccauuuacgaacgagccggucguguggagggccgcaacggcuccaucacccaaauccccaucuugaccaugcccaacgacgauauuacucacccgauucccgauuugaccgguuauauuaccgaaggacagaucuacgucgaccgucagcugcacaacaggcaaauuuacccaccgaucaacgucuuaccgucgcugucucgucucaugaaguccgccaucggcgagggaaugaccaggaaagaucacucugacguuucuaaccaguuguacgcuugcuacgccaucgguaaggacguccaggcgaugaaggccguggugggagaggaggcccugacgcccgacgauuugcucuaccuggaguuccugaccaaguucgagaagaacuucauaucgcagggcagcuacgagaaccguacgguguucgaaucgcuggacaucggcuggcaguuguugcguaucuuccccaaggaaauguugaaacguaucccggccgccacguuggccgaauucuacccgagggacucgcgucacuag

SEQ ID NO: 6415 - RNA, 492 nt, Phyllotreta atra
augaacgaaauacgcgaacgcgaaagggcaggaauacgaguccccgaugaauuacgagccauguuacucgaauucacuugcagcuauuugcuagaacagcccgaagauguaguaucguaugcacaagaauacuucacuaaauuuaaagaaaguagaggcacugcguugauauaugaucaggacauguacgaagaggaaacgauggguaucaaaacagucuuggcucgccaaaucuucgacuccagaggcaacccgaccgucgaagucgacaucaccaccgaguuggggcucuucagagcagccguaccaucaggagccaguacugguaucuacgaagcccucgagcuccgcgacaacaucaaaaccgaauaccauggcaaaggcgugagucaggccaucaaaaacaucaacaccaucaucgcccccgagcugaucaaggccggcuucgaggugacccaacagagggaaaucgaugaguuuaugauuaacuag

SEQ ID NO: 6416 - RNA, 2343 nt, Phyllotreta atra
augaguuacaugcagacuaaccaaaauagaccaaugucucaagguuaucaucagggagccaacgaucucccaaugcagucguccaaagaacagacccugcuguggcagcagaacuccuacaugggagacucaggcauccagucaggcgcugccacucaagugccaucgcucuccggcaaagaagaggaagagauggaccucuucgaucucgaccagcccuaccaaggauucacgcaagagcaaguagacgaaaugaacaaccaguugaaccacaccaggucucaaagagugagggcagcuauguucccugaaaccuuggacgaagggaucgagauuccuucgacccaguucgauccgaaccaucaaacggcgguucaacguuuggcggagccaagccagaugcucaaacacgcuguggugaauuuaaucaauuaucaagacgacgcugacuuggcgaccagggcuauaccggaguugaucaagcugcucaacgaugaggaucaaguggugguaucgcaagccgcuaugauggugcaccagcucucgaagaaagaggcgucucgacacgccaucaugaacagcccccagaugguggccgcuuugguucgagccaucuccaauuccaacgauuuggaaaccaccaaaggcgcggucggcacguugcacaaauuaucgcaccacaggcaggguuugcuggccauuuucaagagcggugggaucccggcgcucgugaaauuguugaguucuccgguugaaaguguguuauucuacgcuauaaccacgcuucacaacuuguugcugcaucaggaugguucgaaaauggcggucagauuggccggaggauugcagaagaugguggcuuugcuccagagaaaccacgucaaauucuuggcuauucucaccgacuguuugcaaaucuuggcuuacggcaaucaagagaguaagcucaucauacucgccucucaagggcccaucgaauuggucagaauaaugagaucauacgauuacgagaagcuguuguggacuacuucgagaguacugaaaguguugucgguguguuccagcaauaaaccggcuauaguagaagcuggggguaugcaagcccucgccaugcaucugggcaaccccagcacaagguugguucaaaacugccuuuggacccucagaaauuuaucagacgcagcuacuaaagucgacggauuggagagcuuguugcagucguuggugcaagugcugcaaucguccgacgugaacguggugaccugcgccgccggcauccugucgaaucugacgugcaacaaucaacgcaacaaagugacggugugccaggugggcggcgucgacgcccuggugcgcaccaucgucagcgccggcgaucgcgaggagaucaccgagccggcggugugcgcccuacggcaccucaccucccgccacguggaguccgagauggcccagaacgccgugcggcugaacuacggcauacaagugauugucaagcuguugaacccgccgucgcguuggccgcuggugaaggccgucaucgguuugauuaggaaccuugcucuguguccggccaaucacgccccgcugcgcgagcacggcgccauucaucacuuggugcaguugcugaugagggcuuuccaagacacucaaagacaacggaguagcgucgcuagugguggcagccaaccgcccggaacguacgcggacgguguucgcauggaggagauuguagagggaacggugggagcguugcauauauuggcgagagaaucgcauaaucgggccaucauuagacagcaaauggugauuccgauauucgugcaauugcuguucaacgauaucgagaacauacagcgcgucgccgccggcguucuuugcgaacuggccgccgauaaagagggggcggagaugauugaaaacgagggcgccacggccccuuugacugaauuguugcauucgcgaaacgaaggcguugcuacguaugcagcugcgguguuguuuagaaugagcgaagacaaaccacaggauuauaaaaaacgacugucuauggaguugacuaauucuuuauuuagagaagaaaaucuuuggaaucccgaucuaggcauggguccggauuugcagguauguuacaaguuuguauuguuugaauaccguuacucgaaaugugagugggguauguauuaucaaaguaucgaauuuggcaugaacgcucuugcuaccguuuuuaguauauuauuuaugauuauuuugaaguauauuuauucgacgguauauuuuuuuauuuucguuuuguuuuguuuuuugcauuuuuuuuuguuugcuauuuuuaggauauuuuaa

SEQ ID NO: 6417 - RNA, 801 nt, Phyllotreta atra
auggcccggaacgcugagaaggcaaugacaacauuggccagguggagggcggcccaacuaggcgaaaucgacaagcacaaaaaacgccggcccuauuuagcuucagaaugcaaaagucuguacgccugcgagaaguggcgcaugcagauaaucagggaaauagcgaaaaaaguggcccaaauacagaacgcaggacucggggaauuccgcauucgcgaccuaaacgacgaaaucaacaaacuccugcgcgagaaacgccauugggaggaccaaaucaaggagcuaggcggccccgauuaccaacgagucggccccaggaugcuggaucacgaaggcaaagaaguccccgggaacagaggcuacaaguacuucggagccgcuaaggaauuaccuggcguucgagagcuguucgaacaggaaccgccgcccccgccgaggaagagucgcgcggaacugaugaaggacaucgaugccgauuacuacggcuacauggacgacgacgacgggauacugauaccuuuggaaaucaaagcugaaaaaacagccguacaaaaugcgauagccgaaugggugaacaacaaggaaaagaaccuagacucuaccaaaggaaucgaagagaguaucuacgugguggaggauucggaugaagaagaugucguucaacaguucgaugguucgcaacagagauucguagcccacguaccggugccaucgcaacaggauaucgaacaggcuuuguugaggagaaggaagcaagaguugauggagaaauauggcguacaggacgagcaggauguauga

SEQ ID NO: 6418 - RNA, 645 nt, Phyllotreta atra
augacacaacaagauaucccaacauucaagugcgugcuuguuggcgacggagguacaggcaaaacaacuuucgucaaacggcacuuaacuggugaauuugaaaagaaguauguugcaacacuaggaguugaaguucauccacugguuuuucacacuaacagaggcccaauccgauucaauguuugggauacagcaggacaagagaaauuuggcggucuucgugaugguuauuacauucagggucagugcgcuaucgucauguuugacgucacaucacgaguaacguacaaaaauguuccaaacuggcauagagaucuuguucguguuugugaaaauaucccaauuguucucugcggaaacaaaguugauauaaaagaccgcaaagucaaggccaaaaguauaguuuuucaucggaagaaaaaucuucaguacuacgacaucagcgccaagagcaauuacaacuuugagaaaccauuuuuauggcuggccagaaaauugaucggggaugcuaaccuugaauuuguagcgaugccugcucuuguaccuccugaaguuguaauggauccucaguggcagacccagauugagaaagaucucagggaagcccaagaaacugcauugccagaugaugaugaagaccuauga

SEQ ID NO: 6419 - RNA, 159 nt, Phyllotreta atra
augaucuacacuaccguaucccuuauaagucucuguuucgccagcggugaucacaaaacaucuuucaccgauauuuuaaugaacauagucgguguguucauguggguggccguuggagcaacagcacuucacuacuggcucgguuauuugucagaauag

SEQ ID NO: 6420 - RNA, 2517 nt, Phyllotreta atra
ucaaucuucaaaaugccaagaauaaugauaaagggugguguuuggagaaacacagaggaugaaauucuuaaggccgccgugaugaaauacggcaaaaaucaauggucuagaauagcaucucugcuucacaggaagucggcgaagcaauguaaagcccguugguucgagugguuagacccuagcauaaaaaaaaccgaaugguccagagaagaagaugaaaaguuguugcacuuggcuaaacuaaugcccacucaauggagaaccaucgcgccuauaauaggcaggaccgcagcccaaugucuagaaagauacgaauauuuacuggaucaagcgcaaaaaaaggaagaaggcgaagaugcaguggaugauccgaggaaacuaaaacccggagaaaucgaccccaaucccgaaaccaaaccagcccgacccgauccuaaagacauggacgaagacgaauuagaaaugcuuuccgaagccagagccagacuggccaacacccaaggcaaaaaagccaagcguaaagcucgcgaaaagcaauuggaggaagcccgccguuuggcggcuuugcagaagcggcgagaacugcgagcagccgguaucgaagucaccucgaggcgcaagaagaaacgaggcguagauuacaacgcggaaauuccguucgaaaaacaaccggcuaucgguuucuacgacacuuccaacgaagcccucgacuugauggccccggauuucuccaaaaugagacaacagcauuuggacggcgaacucagaagcgaaagggaagagagggaacggaagaaggauaagcaaaaguugaagcaacgcaaggaaaacgacauuccucaagccaugcugcaaaacgaggaacccgcuaagaaacgauccaaacugguauugccggaaccgcagauauccgaucaagagaugcaccaggugguuaaguuaggcaaagcgagcgaaacggccagagaaaucgcaacagaaagcggagucgaaaccacugacacucuacuuaacgauuacauguucacaccgcaagcugccgcuacuccaagaacucccgcgccccaaacugacaggauacuucaagaagcucagaacaugauggcucuuacgcacgucgauacgccucuuaaaggggguuugaacacgccccugcauaacucggauuucagcgggguucugccgcaaucgcaagcgauuaccacuccuaauacgguacucgcuaccccguucagaucuacuagaagcgaugggggagcuacaccgggaaguacugccggauucaugacuccuaaaagcggagcccugacuccuguuggcaaaaacgcgacgccuucuaucagagauaagcugaauauuaacgccgaagaaaguuuagaugugggaaguacuccggccgaacaucgaauguuucagaugucgaugaaagaccaguugaaacuuggauugagcagcuuaccacaacccaggaacgauuaugagauugucgugccugaaaaugaagcgcaggaugaaccggaagaagcccaagcucaauuggucgaagaccaagcagaugucgaugcuagaaaacaagaagaacugagagccaaagcggcucaagaauuagcaucgcguucgcaagucauccaaagggaauugccgaggccccaagaggugaauuugaccgugcugcgaccgcccaacgaaagcuacuccuuaaccgaccuucaacgagccgaagaguugauuaaaugcgaaaugguuacuauguugcaauucgacaaccugaagaauccuuuaccagcgcaaaguaagcgauccaacaugucgcaagcccagcaauuggccuuucucgagcaacacccuuacgacucguucaaaaaggaagauuuagagguggccaaaacgcuguugagaagcgaaauggacguggugaaaagcggcaugaaucacggggaauugccguuggagguguacaaucaagugugggaggagugucugagccaagugcuguauuugccgaaccagacgagguacacucgcgcccauuuggcgagcaagaaagauagauuggaauccgcggagaagcggcuggagcagaaucgaucgcacauggccaaggaggcgaagcgcgccgccaagauggagaagaaauugaagauauuaacgggcgguuaucaguccagggcgcagguguugauuaagcaguugcaggaucaguacgagagcaucgaucagucgacguuggaguugaacacguucaaauuccuggccgagcaggagaagaacgcuuugccgaugcgaauacagucucuuacugaggacguuaauaggcagauggaaagagagaagguacuucaaaugaaguaugcagauuaccagggucaaauuaaagaguugcaagaggaguauuuaguucaaaugcaaacuguuccaaaugaagaaacaaguaaauaugacgaagucacuucgaccaccaaugaagaaaaugguauggauacgucggaaaaugauaaaauuacugcugagaacuaa

SEQ ID NO: 6421 - RNA, 474 nt, Phyllotreta atra
augaugcaauuuauguuauuguucaguaggcaaggaaaguugcgauugcaaaagugguauguggcucauccugauaagcugaagaaaaaaauuacaagggaauuaauuacuaccauucuugccagaaaaccaaaaaugugcaguuuuuuggaauggagggauuugaaaaucguuuauaaaagguaugccagcuuguauuuuugcugcgcgauagaacaaugcgacaaugaacugcuaacuuuggaaaucauucaucguuacguugaacuuuuggauaaguacuucggaagcguaugcgaauuggauauaauuuucaacuuugaaaaagcguauuucauucuggacgagcugaugcuugguggcgaggugcaggaaaccaguaagaaaaauguccugaaggcaauugcugcacaggaucuccuacaagaggaggaaacgccgcaaggauucuucgacgaucauggauugggcuaa

SEQ ID NO: 6422 - RNA, 1251 nt, Phyllotreta atra
auguauggauuacaacgauacucguuuuguuauacccucaaaaaugcggugcguuauuacucgagagaacccgccaagagaucgucguuucucagccgccuguacgacaauuucaaagacgaaaugaacaaaaacaaagaaaugaaagaaucccuaaaaaaauuccgcgaagaagcccaaaaacucgagcaaagcgacgcucuaaaagccgcccgacagaaguucgaaaccguagagaaagaggccaguaaaagcggcgaagucuucaaagagaguuuagguuccauuaaagaaagagucaaaggaguaauagacgaggccaguaagucagauuuagccaaaaaggcugggaaguuuaccgaagaaguggggaaaaccacgcacaaaaucagcgaaaccgcacaggaaaucagcaaaaccggagccuuucaaagcauaucggaagccaccaaagccguuaaacaagaaaucgacaacaccagcauggaaggucgaguguacgucagcccuaagaagcuucgaaaacgaaccgaaaccagcgcagugguccaacaaaaguacuacgaaccgaacacagacgccaccggcguagagcuacacaaagacuccaaauucuacgaguccuggcaaaacuucaaaaacaacaaccccuacgugcacaaagucauggacuggaaacucaaauucgacgaaagcgagaaccccaucauccgagccuccagggcgcucacagaaaaaguaggagacauaauggggggacuguuucagaaaaccgaacucuccgaaacccuuacggaaaucugcaaaaucgaccccgacuucgacacgaaacgguuccuaaaacaaugcgaaaccgacaucauccccaacauccuagaagccaugaccaggggcgacuuggacguccuaaaggacuggugccacgaaggccccuucaauuuauucgccgugccgaucaaggaggccuacaagaaaggcuacaaaaucgaaucgaagauccuagauguagaccauguagaucuagugauggguaaagugauggaucagggccccguguugauuauuucguuuacaucgcagcaagugauggccgugcgggauccaucgggggcuguuguagaaggcgauccggacagggugaugagggugaauuacguguggguguuguguagggauguggucgagccugauccgagggcggcuuggagauugcuggaucugucggcgaguaguaacgaacaguuaguguaa

SEQ ID NO: 6423 - RNA, 909 nt, Phyllotreta atra
augaguagcagugauucagaauuaaacgauagugacgcugaguugcaacaagcguuauuagaugguaagcugaaaccuggauuaaauaaaaucgaacaggccccaaagcaauucguaaacaacguaagugguuuaaaucagaaaaucgaagaguucaaauugaaucugccauggaucgaaaggcuggauuguacgaacgcccaagcccccuuagcgcccgaauuagcggaagagauguuagcucacgaagaaaaaagaaguaaucaacugcgaaacaacaaaaagcuuccccaauuccaaccgucggaagauccaguucuaaacgauuuuaaacgagaacuaauauuccacaggcaagcucaagccacaauucuagacgcaauuccgaaaaucaaagaauuagggauaucuacuaaaagaccagacgauuauuuugcugaaauggcgaaauccgaugagcaaaugcacaaaaucagagagaaucugaagcagaagcaggagcagcagaagcggagugaaagggugaagcaauugaggcagcaaaggaaagagggcaaaucgcugcaggugcagcugaagcugcaacgcucuaaggagaagaaggaaaugauggaucaagugaagaaagcgaaaaaaaauuucgauuuucuggaugagaaaaacaagcccaugggaaagaauaagguggcggaaaggcgcaagaugaaggacaagaaauucgguuuuggugguaagaaaaagggaaugaagaaaaauacaaaggacagugcgggcgauauuagugaguauagaaauccuggaaaagccaagaaacagaugggaaacaaauucgucaauaaaaacaaaccgaaaaaucaaagaauggguaaaaauaggagaauuaaaacuaaggcuaaaggaaaaaaauaa

SEQ ID NO: 6424 - RNA, 3762 nt, Phyllotreta atra; identical to SEQ ID NO: 6398

SEQ ID NO: 6425 - RNA, 1872 nt, Phyllotreta atra
augaaucccagcgccccaaauuauccuauggcgucucuguacgucggggauuugcauuccgauauuaccgaggccaugcuuuuugaaaaguuuucaucggcuggccccguucuauccauccgcgucugcagggaucugauaacccgcagaucuuuggguuaugccuacguuaacuuccaacaaccugcugacgccgaacgugcccuggacacuaugaauuucgacuugaucaaaggcaggcccauucgcaucauguggucccaacgcgacccuucucugcgaaaaucuggaguuggcaacguguucaucaagaacuuggaccgauccaucgauaacaaggccauguacgauacuuuuucugcguucggcaacauccucagcugcaaaguggcucaagacgagagcggagucagcaagggauacgguuucguucacuucgaaaccgaagaagccgccaacaaguccauugaaaagguaaacgguaugcuguugaacggcaaaaaggucuacguuggucgcuucaucccgcgcaaagaaagggaaaaggaauugggcgagaaagccaagcucuucacgaacguuuaugugaaaaauuucggagaggacuuguccgaggaacagcugagaacgauguucgagaaauacggcaagauaaccagcuacaaaauaaugagcaaggacgaugggaagucgaaaggauucggauucgucgcauucgagagucccgaggcagccgaaucagcuguugaagcccuaaacggcaaagaaauauuggaaggcaaaccucuguacgucgggcgggcccagaagaaggccgaacgccagcaggaauugaagcgucgcuucgaggcucuaaaaauggaaaggcucaaccguuaccaaggcguaaaucuauacgucaaaaacuuggaugauaccauagacgacgaacgccuucgcaaagaauucucaccguucggcaccaucaccuccgccaaagugaugauggaagaaggccgcagcaaaggcuucggcuucguuugcuucuccucgccggaggaggccaccaaggcggugaccgaaaugaacggcagaaucgucggcacgaagccgcucuacguggcccuggcccaacgcaaggaagaccgcaaggcccacuugaccucgcaguacaugcaacgcauggcgaacaugcgcaugcaccagaugggccaguucauccagccgggcggcuccagcggcuacuucgugcccaccauucaagcgacggcgccgcgauucuacgggccggcucagaugccgauucgcacgagcccgagauggccggcgcagacgcccgugcgccccggcgcccaagggagcaccgccaccuacaccggcaugccgaacagcuacagggccgccgccagaccgccgggccagucgacgaugcgcagcaacaucagcgugccgcgacccaucaccggacaacaaccaccaaguaugcacggucguccacuuguuggacaagguguagcugcugcuggaaaucgcgcagccaacuucaaauacaccgccaacaugcguaauccaccgcaagcguuguuacccggagcucaagcucaaguacagcaagcaguccacauucaagggcaggaaccccuuacugccaccaugcuggccgccgcuccuccgcaggagcagaaacaaauguugggagaacgauuguucccucucauucaaagaauguauucagauuuggcugguaaaaucaccgguauguugcuggaaauagacaacacggagcuguugcacaugcuggaacaucaggaaucgcugaagaacaaaguggaagaagccguggcuguacuccaagcccaucaagcuaaacaagcugcuauaaaaaaagauuaa

SEQ ID NO: 6426 - RNA, 2601 nt, Phyllotreta atra
augaccgacucaaaguauuuuacaaccaccaaaaagggagaaauauucgaauuaaagucagaacucaacaaugauaagaaggagaaaaagaaggaagccguuaaaaaggucauugcuuccaugacuguaggcaaagaugucucagcauuauuucccgaugucgugaauugcaugcaaacugacaauuuggagcuuaaaaaauugguuuacuuguaucugaugaacuacgcuaaaucgcagccagauauggcuauuauggcagucaauaccuuuguuaaggauugugaagauccgaauccacugaucagagcacuugcuguuagaacaaugggaugcauucgaguugauaaaaucacugaauauuuaugugaaccucuaaggaaaugucugaaagaugaagauccuuaugucagaaaaacugcugcuguuuguguugcuaaauuguaugauauuucaucaggcuuaguugaagaucagggauuccucgaacaguuaaaggaauuauuaagcgauucuaacccgaugguaguugcaaacgcuguugcugcuuugucugagaucaaugaaagcaguccuacaggucaaccucuuguugaauuaagcaccaacacaauaaauaagcuucucacugcucuaaacgaaugcaccgaauggggccaaguuuucauacucgauucccugucgaacuacacuccccgagacgagcgagaagcccaaaguauaugcgaaaggaucacuccccgucuagcccacgcuaacgccgcugucguacuaucggccguuaaaguauugaucaaaaugauggagauuuuggcgggcgacacugaauucuguaacacgcuuagcaaaaaauuagcgccgcccuuagugacucugcuaaguucugaacccgaggugcaauauguugcguugagaaacauuaacuugaucguccagaaaaagccggacauuuugaaacaugaaaugaagguauuuuuugugaaauacaaugacccgauuuacgucaaacuggagaaacuugacauaaugauucgauuggcuucucaagucaacauagcucagguucucagcgaacucaaagaauacgcuacagaaguagauguugauuuuguuagaaaagccgugagagcaaucggucguugugccaucaaaguggagccuucugcagaaaggugcgucgcuacgcuguuagacuugauucagaccaaaguuaauuacgugguacaggaggccaucgucgucaucaaagacauauuuagaaaauacccaaauaaauacgaaaguauuauuagcaccuugugcgaaaauuuggauacccuggacgagccggaagcccgagccaguauggucuggauuauaggagaauacgccgagagaaucgauaacgcagaugaguuacuggauaguuucuuggaagguuucggugacgagaacgcucaaguacaacuacaauugcuaacagccguugugaagcuauucuuaaaacguccucaacauacgcaaggcuuaguccaacacguacugaguuuggccacucaagacuccgacaaucccgauuugagagacagagguuucauauauuggagauuguugaguaccgauccggccgcugccaaggaggugguucucgcugauaaaccucuuauuucggaagaaacggaccucuuagagccgacucuucucgacgagcucaucugccacauaucaucccuggccagcguuuaucacaagccacccacagcguucguagaaggccgaagugcagguaucagaaagacauugccggcuagacaaggcuccgaugacacagccgccgcucccgaaacaacgguuauuccgaaccaagaaagccucauuggugauuugcuuucuauggauauuaacgcgcccgccccgucugcugcugcugcuccugccgccccucagacuaguaacguugauuuacucggcgguggauuggauguuuuguugggaggagguaaugauauugcggcggcuccugcuagugcugcugcucccaccaccacuggucuucucggggacauauucggcauaccuacugcaccuaccauguacacaccgccgaaaguuaucuggcugccggccgaaaaaggcaagggaauggagaucuacgguacuuucuccagacgaucuggccaaauggccauggaaaugacuauaaccaauaaggcuaugcaggcuaugucggguuucgcgauucaauucaacaagaacagcuucgggaucacgccgagugcgccuaugaacguuccgacuuugcagccgggccaaaaucucgaauacagccugccguugaacacuacggggcccgugcaacgcauggauccguuaaugacgcuccagauugccauaaaaaacaacgucgacguguuuuacuacgcuugucaaauacccauucagauauuguucggggaggacgguacucuggauaagaggguguuccuuaccacuuggagggacauuccgggagcuaaugagguuaguauguugguaaauuugaacguuguuugguacaguguuuauaauuuucgagguauuaaaaaaauguuugauuucuaugcaaaaauaacgacgggguaa

SEQ ID NO: 6427 - RNA, 498 nt, Phyllotreta atra
auggguccaaaauucgauccaaacgaaauuaaagucguuuaccugcgaugugucggaggugaaguuggagccacaucuucccuugcuccuaaaauugguccacuagguuugucccccaaaaagguuggagaugauaucgccaaggcuacaucugacuggaaaggacuuaaaauaacuguacaguugacaauucaaaacaggguggccacaaucucaguagucccaucugccgcaucuuuaguaauuaaagcccucaaggaacccccuagggaccgaaagaaggucaagaacaucaaacacagugguaauaucacauucgaugauguacucaacauagcaaggaccaugcgaucaagaucaauggccaaagaauucaaaggaaccgucaaagaaauauuaggaaccugccagucugucggaugugucauugauggcaaacaaccccaugauuauauugauaugaucgaugaugaagaacuagaaauaccugacgaauaa

SEQ ID NO: 6428 - RNA, 1095 nt, Phyllotreta atra
augagugaggaagggaaaagagcguuaauuuuagucgggggcuacggcacaagacugaggccucuaacuuugagccgccccaaaccucuagucgaauucgcgaacaaaccaauccugcuacaccaaauagaagcucuaguagacgccggaguaacggaagucauauuggccgugucguaucgagccaagcaaauggaggaagaacuuacagucgaagcggcuaaacugggcauuucuauaguauuuucgcacgagacugagccuuugggcaccgcagggccaauagccuuagcuagagaacaccuuucgaaaagcaccaaaccguuuuucgugcugaauucggacauaauaugcgacuucccguucagagagcuagagaaguuccacgaaggccacggcaaagaaggcaccauagucgucacaaaggucgaagaacccuccaaauacggggugguaguguacgaucaaaacaacugcaucgagagcuucguggagaaaccccaggaguucauuucgaauaaaaucaacgccggccuguacauccugaaucccagcgugaucaaccgaauagaacuccggccgacuuccaucgaaaaggaaguguucccuuacauggccuccgaccagcagcuguacgccuucgaguugaagggauucuggauggacgucgggcaaccgaaggauuuccugaccggaaugugccuguaucugaaccauuugcgggagaccaacagccagaaguuguacaaagguccuggaguggucgggagcgugcuggucgaucccacggccaaaauuggcaguaauugccaaauuggacccaacguuacaaucgggccagguguuguaauagaaaaugguguuuguauaaaacgcucgacgauacuaaggggugcaacgguuuguuccaacucuugguuagaaaguugcauugugggguggaagugucacauagguaaaugggugagaauggaaggaaguacuguacuuggagaggauguuauugugaaagaugagacguacauaaacgggggacagguucuuccacacaaaaguaucgcuacaucuguuccagaaccacagauuauuauguag

SEQ ID NO: 6429 - RNA, 867 nt, Phyllotreta atra
auggcgucggaaggugaagaagugauaagugaccaagaaaaaguuaaaauaguuucggauuucauccuccauucgccgccgggcgaguucaacgaggucuucaacgauguaaggaagcuucugaauaacgaugaccuucugaaagaagggguaaccggggcguucgcccaauacaauaaagaccaacucacccccguuaggauagaaaacgccgaucaaauggugcugauuacagaauacaacgauuuagguaacaauagauucuucgacccccguaguaagcaaaguuucaaauaugaacauuuaagaaaggaagcuucugauuaccagccuuauaguguugauaccgcggcggagcccuggcgggccgcucuagauaacgaguuuauacaguacacgagaaaccauuauaaagacggcguuuguagcguguucggucgcagccaaaacggcgccaucgcccucaccgcuugcaucgaagaccaccaauuccagcccaagaacuucuggaacggucgauggagaucccaguggucuguuaguuuaaccgaugaagccaccgcagaaguacggggaguccucaaagugcaaguucauuauuacgaagaaggaaacguucaacuggugaguacuaaggaaaucaaggaaucgauuccgguuucgaacgaagcgcaaacggccaaggaaaucauccauguaauagagcaggcggagaaucuguaccaaacggcgauuucugaaaacuaccagacgaugucugauacgacguuuaaggcucugcggagacuccugcccgucaccaggacaaaaauggauuggaauaagauuguaucuuauaguauuggaaaagaacuaaaaacacaauga

SEQ ID NO: 6430 - RNA, 3225 nt, Phyllotreta atra
auggaaagagaccucagggacaggcaagacaggaugggaguggaaauaagggaaagguugaaaugggacauaagagaaggaguuaucgguucggagaccuucaaucccaaacacgccauaaucguaacguggaagaacguauccuucaacggaggauacgccaacgcaguuuaucagaccaacacauuccaaaugguccucgccacugacgagguauucaccuacgccauguucaacuaccuaaauuuggacuggaccagucacaccgaagccggaggagacacuagaaaaggcgaaggcgguacaccggcauucguuggauucaacgccgguaacggcaccagaagcuuccaguacgcucccuacagucaagcaucggucauucgggacuuaacagcuaccggcugggguaacaacaaacccggcaggcacauuuuccgaaucgacgagaacauccugcuagguucuuguaacaaagauaucgacggggcuaauuugccucuucaauuugcuccggagagcggcaauaugcugggaggaaccgucgugaacaucacagguccuugcuuccaacccaacgauaggaucagauguaaauucgacguguacgaugaaguuguuggauacgucguggacaggaaucgugcuauuugcauccaaccucgccucuacucagaagguugggugagguugcaaaucgccaucaauuccgacgccuucaaguggaacgugaacaucacaggaccuugcuuccaacccaacgauaggaucagauguaaauucgacguguacgaugaaguuguuggauacgucguagacaggaaucgugcuauuugcauccaaccucgccuuuacuccgaagguugggugagguugcaaaucgccaucaauucggacgccuucaaguggaaaggaaaauacuacgucgaaucgccggccagcgccucgcagaagaucuucuucaaagacaugaaguaccacgagaagucgcccagcgagauucgcaucacguggcagaagcagaacuugaccaccaacgaaaaugccaacaucagaauuuccuugugggguuacagggaaacuaccaugagacccacguucguuuacaucacagaaauagccgauaauguccagaacaccggggaguacaccaucguaccgucgcaguacaggggcaaaaucaaccaguuccucacugacauuaaguuuggauuccuccaaauaaauuugaccgaaucgauaaaggucaacauuuacucuaccaacaaccagaacaucgauaucacaccgauaauauggagcaggccgauuccucuagguugguauuuccaauuccaaugggagaaccaauacggcaaaaauuggccuaaacaccucugcgacgauuggcucaggaccgacagauaucugaaaaacuucgcucacgaauuaccccaauguccuugcacgguccaacaggcucuggcugauaaggggaaauucaugcccgacuuugauugcgacaaagauucgaaucccguuuguuauuacaacaaccaagcuuugcauugcgucaaaacuggugcucccacaauggaaggcuccgagcaacaauguugcuacgacaaaaacggcuaccuaaugcuguccuacgaucaacaaugggguuccagcccucgucgaugccacaaccucggaaaaaugccauacaacgaagccaccaagguucccacguugucucaaugguucaacgacaucgugcccaaguaccucugcugucuuuggcaggaagagcaagccgugggcugcgaaacgcugcgauucgaaagaaggccuucgcaggacugcgucgccuaucaagcgccggcuguggcaggaguguacggugauccacacauugucacauucgaugacguagaguacacguucaacggcaaaggagaguacuccuuggugaaauccgugaagguggacgauaauuuggaaauacaggcuagauucgagcaaauggacaugaaugcuuauggagaggugagagccacgcaacugacggccaucguggccaaaggaaauaagacgauuccuauagaagucagaagaagaccguuggaagccagauggagguauagauuagauguuauagccgagaacagaagauuguucuuugauagaccuucguugaaauuccaacauuuccaaggggucacuguuuauacaccaaccuacauuuugaaucaaucugaaguacuaauaauguucgacaauggagccggcgucgaaguacuggacaaucaaggguacaugagcgccagaguauacuuaccuuggucguuuauuaacaaaacgguaggguuguucgguaacuggagcuucaacaaagaagacgacuucacgcugccggacggauccaaggcggccguggugagcaacaucaacgacauggagaggguguuuaacgauuucgguucgaaguggaugcuggacgacgugagcgacgcgcgcaaaggccagucccuguucuacagggaauucggccgcacgucggccaccuacaacaacaagaccuucaagccgcaguuccugaugcugcccgaggacauccugccgcccaauagguccgagcaaauacagcgcacguacgacgugugcucgaccaagauguacgagugcuacuacgacuacgccaugacguugaacagagaccuggcgcacuucacgcagaacuacaaggcuaccauuuacgagcugaagcaaaccaccagggagaagaucauguccugcggcgugcuggaaacgccgcgguucggcaggaagaguacguuccuguucgugcccggcacgaaggugaccuacgaaugcauacaagauuucgugcucgucggugauccuagaagagagugcgggggugauggaaaauggaauauaccggauuauggauacacauauuguuugcgucagcaggaauauucccaacgacaagcaggaaucacguccgggauaauaauguuagugcucauaccacucauccugcuauucguguauuuggcguaccgguucuuaaagaagaaacagaaagaacgggaagagaacaggcuggagcaagaacaauacagagaacaaucuaggaaagcgcaggaggcggcgacgaugaaauugaccgaacacgaggaagaguucaauucugaggaggaagaugaucacaguaacgugaccagcacgggagcuaaagaaacaaauauuuauuag

SEQ ID NO: 6431 - RNA, 321 nt, Phyllotreta atra
augcguuacguggcugcuuacuuauuggccguuuugggcggaaacgcuucccccagcuccgcugauguggaaaaaauccucggcucuguuggagucgaagcugaagcugaaaaggucaagaaaguccuaggcgaacucaaaggcaaauccaucgaagagcucaucacuaaaggucgugauaaauugaguuccaugccaguagguggcgcagcccccguagcuguugcugcaguugccgcugcaccagcugccgccgagcaaaagaaagguauauuuuuauucuacucgauuacuuauaauaaucacaguaaaaaaaguuaa

SEQ ID NO: 6432 - RNA, 2721 nt, Phyllotreta atra
augacugaccguuuuggauuaaaaugggaccccaaaaauuuagaaauuagaaccaugucaguggagaaaacucuggagccccuugugcugcaaguaacuacccucguuaacacgaaggggcccaguaaaaagaaaaagggcaagucaaaacgugccaaugcucucguuagcacgguagaaaaggccaccgagaauuucaucgagaaaggcgagcaaaucgccuacgagaauccugauauaacggacgagaugauagcugcugucgaagaagucaggaaaacuggcaacgcaaugagcauagcugccagggaguuuuccgaagacccuuguuccucuuugaaaaggggcaacaugguacgcgcagcuagaaaucuauugucugcuguaacaagacuucugauucucgccgauauggucgauguucaucuucugcuacaaucgcugcacguugucgaagacgauuuggagaaacuaaaaaacgcuucgagccaaggggaacuucuugacaauauuaaggccuucggucaaaaugcaaacgaacuuaugaaucaggcugcuaaaagacaacaggaacuaaaagauccccagcuacgcgacgauuuggcugccgcucgagcaguacucaagaaacauuccacaaugcuucuaacagcuucuaaaguuuacguccgucauccggagcuagcugcagcuaaggcuaacagagauuacgugcuaaagcaaguuugcgaagcuguuaauacgauaaacgauguugcgcaggggagaacaccgcagcccgcuuccggcccuuacgaugguccgggagaacucgcggcugcuuuagacgauuucgaugaucacauggugauggagccucuggcguacaacgaggugcacacgagaccaucguuggaagaacguuuggagagcauuaucagcggugcugcuuugauggcugauucgaguugcacuagagacgagagaagagaacguaucguugcugaauguaaugccgucaggcaagcguugcaggauuuguuguccgaauacaugacgaacauggguaaaaaggauaagagcgaaaaucuaaacagggcuauugacaauaugggcagaaagacccgcgaccuuagaaggcagcucagaaaggccguugucgaccacguuucagacagcuucuuggaaaccaacgugccccucuugguccugaucaaagcggcucagaacggcaacgaaaaggaaguggaagaauacgccgucguguucaccgaacauuccaacaagcucguagaaguggccaaccucgucugcagcauguccaacaacgaagacggcgucaaaaugguucgauacgccgccgcucaaaucgacaauuuaugccccgaaguaauaaacgccgcuagaauccuggcggccagaucucgcagcaaaguugcucaagaaaacauggaagcuuucaagcaaucgugggagaaccaagugcgcauauuaaccgaagcgguugacgauaucaccaccaucgacgacuuuuuggcugugucagaaaaccacauucuagaagacgucaacaaaugcgugcuagcccuucaagaaggcgaugcugauacgcuggaucgcaccgcuagcggcauaaagggcagaucgaacagaguaugcaacgugguaacggccgaaauggacaauuacgagccgugcauuuacaccaagcgcgugcuggaggcggugaaaguuuugaacgaucaagugaugcccaaguuuacccagagaguccagguggcugugcaggcuuugggcaacagcccgcccaaggaggucgacgagaacgauuucaucgaugcgucgagauugguuuacgacgguguuagagaaauaagaagagcuguacugaugaacagagccgacgaagauuuggaucccgaagauguagaacucgaugagaauuauuugaucgagaccagaagcaaaucgagugcucauacuggugaacauggcguugaugaguauccugacaucaguggaauuacaacagcucgggaagcuauggguaagaugccggaagaggauaagcagaaaauauugcagcagguggaguuuuucaagagcgagaagcucaaguucgaucgcgaggucgccaaaugggacgauaccggcaacgauaucaucguguuggcuaaacacaugugcaugauuaugauggaaaugacagauuuuacuaggggaaaagguccccugaaaacuaccauggacgucauaaacgcggccaagaaaauaucagaagcgggcacuaaauuggacaaguugaccagacaaauugccgaacaguguccggaaaguucaacgaagaaagacuuacucgccuaucuacagcguaucgcucuuuacugccaucagaugaauaucacuucuaagguuaaagcugacguccagaauaucagcggagaauugaucguuucuggucucgacagugccacaucuuugauucaagcagccaaaaauuugaugaacgcugucguucugacugugaaagcuucauacgucgcuucuaccaaguauccuagacaaggaacuauagcuucuccgauuguuguguggaagaugaaggcuccggaaaagaaaccucucguaagacccgagaaacccgaagaaguucgugccaaagugcgcaaaggcucacaaaagaaagugcaaaauccgauacacgcuuuaucugaauuucaaagccccacagagucuguguaa

SEQ ID NO: 6433 - RNA, 1230 nt, Phyllotreta atra
augucguucaauuucggaaauacugguacuccaaaaacagcugcuacagguuuuacauuaccgucaaauccagccacuaguacuacuagugcaacaggauugcaguuuaauuuuggaggaggagacacuaaaacugaaguuaaaccaucaucuacauuauuuccuacggccacaaguaccccaccagcuuucgggauaaccccaaaaccugcaacaccugcaucagcugcugcaccaucguuuaauuuugguacaccuacaacccaacagacaacagcauccgcuuuuggaacugcaacaccagccucauucaguacuccaaccucugcucuccaauuuggacuaaccacuacuaaaccagaaacauccacaggguuauuuggaucaacugcagcugcaacgccuauuucagcuucaacuggacuuaguuuuggaacagcggugucuacaacaucuucagccaccgcagcugcuacaggaaccccccuuuuuggaguugcuccuaccucgagcacuacuacaauagccaguguaccugcuuuagguuuaucgacuacaguuucugucgcugcuucgacaacuccaucgacuucguuaaguacuacaacagcacccccggcuuacucgacaucgacgcuuccuucuagugguucguuaacuuuuagucaacuagaagauucuauuaacaaauggaccauugauuuggaagaacagggcaaguuuuucauuaaucaagcgaaacagcucaaugcuugggauucguugcuuauuucaaauggcgagaaaauucucaaucugaaugguaguaucgagagaguuaagcagcagcagcagcaauuggaucaagaacucgauuuugucuuggcgcaacagaaggaauuggaagaguuaauaacgccgcuggaaaaggaauuauuggaaauucccguaacagacauagaucgaaaucaaauguaucaauuuucggaaauaaucgauucgcaauuaaagcaaaugucugaugauuugaaagaaauuauugagcacauuaaugaaucuaauaaaagcgaagaaauuucgaauccuuugacccaaauuagccgcauaaugaaugcccacaugaauucccuccagugguuagacagaaauacggcgcaaauuguuucucaucuggaacaaaucaguaaaaugcaggacuccaacagaagaaauuuuccucugaaucauucauucaauaauucacuccuuuaa

SEQ ID NO: 6434 - RNA, 582 nt, Phyllotreta atra
auguucauaugggauugguucacgggcgugcugggcuaccugggacuauggaagaaguccgggaaauugcuguuuuuagggcuggacaacgcugguaaaaccaccuuauuacacaugcuuaaagacgacagauuagcccagcauuuaccuacauuacaucccacaucugaggaauuaucaaucgggaauaugagguuuaccacguucgaucuaggaggccauucgcaggcucgaagaguauggaaagacuacuucccagcuguagacgcuaucguauuccuuguagaugcuaacgacagaucucgauucggcgaaagcaaacgggagcucgaugcgcuguugacggacgaaacccuggccaacugccccgugcugauucuaggcaauaaaaucgaucugcccgacgcggcgucugaggaugaguugcgaaacguuuacucguuguacggccaaacgaccgguaaagguaaagucgcucgaucggaucugccuggcagaccguuggagcuguuuaugugcucgauucugaagaggcagggcuacggggaggguuuucguugguuggcgcaguacauugauuag

SEQ ID NO: 6435 - RNA, 1380 nt, Phyllotreta atra
augguguacuccguacuauccacuccauuucuuuacuuuucguacgacuacgaucuuacgcauuccuugcaacgccugcacggcauaagcccugauuucuggaagcaauccuuauucgagcgggccgaucagcgguucgucuggaacggcaaccuguuguacuccuucaagggauucuccauacaccgauucugcuugccgcucaugcacggauucguuucgauaaacuucugcguggugaacggccacaguuugaacuggucgauuguaaguagaagaagcgugcaaagagcgggcacccgauugcaccgaagaggguuggacaaggaaggaaacgucgccaauuucguggaaaccgagcagaucaucgaauaccaaggggaccgggcgagcuucgugcaaauacgaggcagcauuccacuguucuggcaacaagaccccgauuuacgauacaaaccaccgcccacucugcucgacgucgauccgcaggaucagcacucgaugugccugaagcacaugaacgaucuaaugacuuucuacgggaagaucguuugcguuaaucugguggaucagaaaggagccgaagggaacauggaaauggcaaugaagaaugcgauaaacaacguaucaucaccaucgguuaaguacgaaucguucgauuuccaugccgagugcagcaaaaugagaugggacagacugucgauacucaucgaucgauuggcucacgaucaagacgagaugaguuucuuucuguuguugagagacggcucguugaguucguuacaagacggcguauucagaacgaauugcaucgauugcuuggaccgcacgaacguggugcagagcaugcuggcccaucggaaucuggaaagcgugcucagaaaauugcagauccuccaucagaaucaaacguuggaguuccaguauucguuugagguguuguucaagaacguuugggcggauaacgcggauauaauaaguacccaguauucgggcaccggugcuuugaagacggauuucacgaggaccgggaaacguacgcgguacggguugcuucaggauggcaugaauucgcugacgagguacuacaagaauaauuucgcugacgggaugcggcaggacgccaucgaucuguuuuuagguaacggcaaaccccuuucgccauugcauaucgauaaaggauggaaguacgugacguauccgucgauucugcugaucgcuguggccauguucguggcuugugcugucacuccuucugaguauucgacggauucguugcuguuucucuuguucugggguuccauggucuaugcgacuuugcacacuauuuugaaguacgguucggaguuugucgauaagccuaggcucacccauucuuag

SEQ ID NO: 6436 - RNA, 1506 nt, Phyllotreta atra
augccuccuacgauucagcagaauaaucagaacgccgcaaauggcguugaaaaaagacaaguaaagacugucgagaaaagguccgauuuacuaugcaaaguuaaauacugcaacacacugcccgauauaccauucgauuugaaguucauaacauacccuuucgaauccauucgauucauccaguacaaccccacguccuuggaacgcaacuacaaguacgaaguauuaaccgaacacgauuuaggcguaagcauagaccucaucaacaaagauauauacgccaucggagcgggcgccgccuuggacccggccgacgagaaacuccucgaagaagacauccucacgccccaagacuccaagaggucccgccaccaugccaaguccgucucguggcuucggcgaaccgaguacaucuccaccgagcagaccagauuccagccccaaaccauggacaaggucgaagccaaagugggcuacagcaucaagaagucccugaacaacgaaacccucuacauggacagggacucgcaaaucaaggccaucgagaagacguucgacgauaccaaaacuacaaucgacaagcauuacagcaagccuaacguagucccuguggauguacugccgguguauccagauuucaguuuguggaaauacccuugugcgcagguuauuuucgauucggauccggcuccggugggcaagcaaguaccggcucaaaucgaggagaugucucaagcuaugauucgggguguaauggacgaaagcggugaacaauucguagccuacuuccuccccacggaggaaacucugcaaaaacgcagggaagacguggccaaucaaguccaauaccaagacgaagaagaauacgaauacaaaauggccagagaguacaauuggaacgucaagagcaaggcuaguaaaggcuacgaggagaauuacuucuucgucguacgaucgagugguauuuuuuacaacgaauuggagacuagaguuagguugagcaagcguagacagaagguugggcagccgccgaguaauacuaggcucaucguuaaacacaggccgauggaugcuaaugaauuuaggaugcaacgguacagggaaaagcagcuggagccuacaggugaagaugaugaagagauggaaaucgacgagccccaggaagaggauaacgugcuugagccggauaacgaaagucgggauaaagaaaccgaaagcgacaacgaaaagaaacgauccagagcuuccucaguaucuucccaaaggagguccagauccaggucgaauucgucggcuaaaucgaauuccaggucuaguucuaggucugcgucgaaguccaggucucguucgaggucuaagucgucgucgaggucucggucuaggucgccgucgaagucuccuucuaggucuagguccgugucaaagucuccuucuaggucuaggucgccgucgagugccagauccaagucggcuuccaguucuggcucgaauuccgaaagcgaguga

SEQ ID NO: 6437 - RNA, 1170 nt, Phyllotreta atra
augccgauugaaaauuuggaagaucaagguuuagaaaagaacccagaccuagagcuagcucacuacaaauuucuccugacgcuccccgaauaucgcagcgaccgcaauguccauucgaagaucacagaagccaucaagaaggaugauauggcuccgugguacgaacuccucugcaaggaagucggcuggaaguuggacgcggccuugcugaaggcccucaaagccaagaacgccgaaaaggucaagcuucuggacgaagccaucgaggaugcggagaagaacuugggggagauggaggugcgcgaggccuauuugcguaaagcggaguuuuacagcagaaucggcgacaaggaaaacgccgugagcacuuucaggcagacuuacgauaaaacggugucuuugggccaccguuuggacaucauuuuccacuuaauuagaauaggcuuguucuucauggaccacgaccuuaucacuagaaauaucgacaaagcgaagacccuaaucgaagagggaggcgauugggacaggaggaaccgauuaaaagucuaccaaggcgcuuauuguauguccgugagggacuucaaaaccgccgcuaaccuguuuuuggacaccgugagcaccuucacauccuacgagcucauggacuacaaggcuuucgucagguacaccgucuacacuuccauaaucagccugccgagaaaccaacuuagagauaaaguaauaaaaggcuccgagauacuggaggugcuucauuccgagccguucguuaaagauuaccuguuuucuuuguacaacugccaguacgcggaguucuucucgaauuuggccgaggucgagacgaucuugaggaaagauuacuuccugaauccccauuaccgguauuacguuagggaaaugaagauuucggccuacacgcaacugcuggaguccuaucgaucucuuacguugcaauauauggccgaagcuuucgggguuaccaucgaguacaucgaugaggaguugucgacuuucaucgccgcuggaaggcugcauuguaaaaucgaucgggugggaggcaucguggagacgaacagaccggauuugaaaaaugcucaguucaauuccguggugaaacaaggggauuuguugcuuaaucgaguucagaaacucuccagaguuauuaauauuuag

SEQ ID NO: 6438 - RNA, 15420 nt, Phyllotreta atra
auggaggaauuaaccucugguuuggaucccgacgauuugauggaucuggacgagcccgagggcuccgaucuggaggaggacgacgaggaucucaucgacgaucacgucucgucgccuuucaucucguccucggcgcccgaguccacggccaacuccgucgccuccucgcccauccacgaagacuucccgccgcccuucaacuucacggggaagccucugcacgucaaacgaggaagaggccggccccgaagagaaggagguaagccuucggcgccgcgaacgacaagaggcgguggaacuggaguaucgagaguacgcagaccgagaccuccgggguuuucaagaaggggcucguuaggaggaagucgaaguguuaggcaaguagauagaucggauuaugacauguccuuguucaccgguucaccgguggacgacgguuuguuggaucccgaaacggguucgaugaucuuccccgagaaguuuguucccgcgaucgaggagccuccguacuuuccggagcauuggccggggaaaguuugugccuuguguaauuuaggugaaagaagccagcuaggacaaggugaaauguuaagauuaaauuguccggaaggauucucgccggagaagguuauuagugaacaaauauuagaaagagcguugcaggcuccggauaaagaaugcggggauaagaguccgaaagguccugugacguguagaaggcagaaaaguuucaacaaaugcagacauccuucgauaaccagugaauacguugaugaauuaacuauaauuggauauaaugaaguaccugauguaucuaguuuguuugagucuaacggacaguuuuacguucaucguaauugugcguuguggucuaacggugugacgaaagcagaaaauucugcuuuguugaauguaggaccuguagugucgcaauguucuuccaaaaaguguaccuucuguaaucauuacggagccagccugaccugccacguugacaaauguaccaaaauuuaucacuuucccugugcuacugcugccggugccuuucaggacguuucugcguugacaacuuuaugcaacgaccauuucggacaaguggcuaugcucaccaccgcaucuccguguuuaacuugcggcucuaugggagauauagcgaauuugauguuuuguucggguugcggugcgcauuaccauggaauuugcgugggauuggcucaguugccaggcguuagauccgguuggcaguguaggaaaugccgguguugccaagugugucgagucgucggagacgaaucgaagcugaugacuugcgaacaaugcgauaaaauuuaccacgcuaguugucaaagaccuguagugacuucgauaccgaaauacgguuggaaguguagauguuguagggugugcggcgauugcggugcaaggacucccggggccgguuuaucuucaagauggcacgcucacuauacaguaugcgauucuugcuaccaacaaaggaauaaaggguuuucuugcccuauuugccauaaggccuaccgcgcucacgcucauagagaaaugguucaguguucgaguugcaaaaaguuuguucauggaaccugugauccggaggcagacguuguuaccuacaaucaaaagaaagaaauaagcauggacuaugaauacguuugcuugcauugcaaaaauagcacagcuagacaaauaacagcgaaacgagcaaguauugaugauccuuccgauguauccgcuucacacgauucucuauaugacgauacguccgaauucgaucuuccaucgcccgacgaguucgccaggaacauggguuuggguaaagggaaaccguacagcgcgaauaaaauagccaagaagcgccuuaguuucacagugaauccgguuggcaggccgaaagguaccggaaaagugccacccgggaaaaugggguacaugaaacgcuaccgacugacggaguucaauagaaaacggggccccaaagccaaaaugagggguauuuucggcgugccgggcgucggucugcaaagaccgaucucggaugggaaaaccgacgaagaaccgggcguugagaaucgauugguauuguguucagccaaagauaaauucacccuaacucaagauaucugcguaaugugcggggcguucggcaccgaucaagaggguuguuugaucagcugcguacaaugcggacaauguuaccacccauauugcaucaacguuaaaguuacuaaagugauuuuacagaaaggauggagaugcuuagacugcacgguuugcgaaggcugcggccaacgaaacgacgaaggccgccucauacugugcgacgauugcgacguaucguuccacaucuacugcauggacccgccgcucgacuacgugccgcacggcaacuggaagugcaaauggugcgccaucugccaauccugcggcaccaccgauccggguuucaauugcacguggaugaacagcucgacgcagugcggcccgugcgccucgcacgugaacugccccagcugcaacgagccguacggcgagggcgaucugaucauacagugcgugcagugcgagcgcuggcugcacggcgccugcgauuucaucaagugcgaagaggacgccgagaagugcgccgaagaggguuacaauuguauauugugcaggccgcgggacgugccgccgccgcauauggugccggcggcggucacgccgaagccgcccacucccacgaagagucccgaguuggggaagaguacgagcuauuacauggacggcgugugucucagcgaauucgguagcaacuugaucaaaucguuggcucucgaguaccacgggucgaggaagaaacggaaaaagauacccacugugcaggauaaggaagccgguauuauggcuacuauugaaucggugguugccggcgguaauguuauuccuacuaauauggaagacagcgcuaaauuggagcuagucgacaucaaagacgaaccucaagaacuguacaaggaaggcaugauguggaccaaagaagacgguccaccacccgaaggguuuacgauaauaacgauggagaacgguuugaacgugcugcgaaggaagaggcagcgcaaucugcagaagcucgguauugggggauucgucgucaggaugagagguaucagaacaggucaggauaacgaugauguugauucguccauuggucaaagugggcucaacgccaacgauaucgucccaucgccugcggacggggacaaaccuagaaggaaaacuauucgucgaaaguugaagaguaaauuagcagaaacguuuccagccuaucuucaagaggcuuuuuucgggaaagaucuuauggauacggucgauuguaaaaaggaagaagucgauugcuauagcagcgaugaugagaaaacugacaagcauuuuaaaucgauuaauuuaucacaagacgaaauaauagcaauaguggcaucagguaaaaccgagaaauuggaaaacaauaacaaagauucgaccaaagaagucaaaccgacuguguugaaggaggaagaagaagauaauccggaggauuugaaagauguucuugcccuaccgggcgacuuacucgauaccgauuugguuaauagcauuauggaagaugaggaggaacugagcaaaacuacagcgucucuuguugcuuuagauucgaauuuacagcacgaugcggaacugacggacacuuugaguaguucaggaaauucgaaagaaaccaaagaugaauugagcgacauuuuaggcccucauuucaaccucgauuccauaucgaacauaaacagcaaggacgucgaagacauauuuaagggcguauuaacagacgagucgcaggaaucccaagaaagcaguagcuucucccuacaaggaaauaauauguuuucgaauaauaaugcgcaacaaaacguugcccaacaccccauuauuaaucaagcggugagaccgaaaacauugccuacuguuaaucacaauuugaauuccccuguuaguuucccaccccccucaccguaccacucggaauacagcaacaguccucaguuuaguccugcguucaccgauucguccuguucguggguaggaaguaacgaaacgccggaaaucgauaguaccaacgugacggugacgucgacguacaaucagaggucaucugauaaaaugaaagccgaugaaaguuuggguaaaagcgccacgauuucggccguuuuguaugcgaacaucaaccaucccgaauggaagaaggaguauccgaauuggcccgauagguauaagcaaauaauaaagaaauggagaacguugagucaagaacagaaagcgccguuuuugcaacacgcuagagauaacaggagucaguugaggaugaagaaagcgcagcagucacagaccgucaaggaaaccgccucgaccgccacgucccccaaugcgaccaagccuccgcaccaagccgguccagccuuagugacaacucuccaggcgguaacgcaacagccggcgggggcggccgcggcccccgcgccgcccguuucagaggaccaagaaaagaucgcccugcaacagaaauccgccagggaagccgaacaggagagacaauggaagcaauugcaggcccucaggcagcagcagacccaacaaacgcagaacauucuacacgaacagcgcguucaagcgaucgcccguguacaacgacagauaucgaccgauccagcgcagcaguucauaaacgagcaacagagcccucugcaggugaacacgccucaggaauugagcccgucaaccacgccggcucccaguccucggccauuuuugggcauuaaaucucccacguuccccguaccuucgcccguuccgccaacgggcgucagggccaacacgcccucgcaaucgccccacgauaucucccaacccagcacgcccgacgguaacgaucacuuuauccacucccccaccaauccuaaaccuaauuuccaaccuagauugcccaaugauccguucgccgcgcaacccgccacgccgcgaccgcaauucgggauggcccggccaccucugcagaauuucggcgguacgguucgcaacgagcaacaggacaucaacaucaaccgccaauugagggagcuguugcagcggcagcagguuaaaaaacuggacgaauuguugccuggaaaagcgccaccucaaagauuguggcacgcgaaugaucagcaagaggccggcgacgccucgaugacgucggcugugguccagggcgccggugcccaaggcaccgacgccaccuuccggcagccucuaccgcccgguguggugaaaccuagguuggcgauuucgucggugaauaggccgauauugggcacgguuagagucaaucaauuggaucccaggauacaaaauuuggauccgaggaugagguugauuuugcaacaucagcaacaaagacuggccaccgguauucagcagcaauucauccguuucacaucgaacgugcgaccgacgacgguggagcaguaugagcaauuguugcaacgucaggguaauaaucagaaucaaauucacgcggaggaacaacagcagggcguugcccgaauacccauagcccaggccagcguuauacaaaggccgcacguggcucaagcgguggugacgggcgccacugcuguuaccacgaguaccacagaaaguaaucccagcgaggagggaauccccgauaauguaacugccgaauuggagaaacucgaacaggaaacaggcaccaugguggagcuucaaggcguaagcgauaucuuaggagguuuggacgaugacgaugagcuuuuggccgaaaugggcgccgauuuuaacauacucgaauacgcggaucccgaauuggaggcccuaacgggcggcaaaacgaacauuuuagaccuggagcucgaagaggaaccggucaaaaaagaaaaacuagccucuaacgcgaacacuugcgcuccuucucaaaaaccgacuccuaacgucgcuacuacagccauuagcaacagcaccgcugucacuacaccgaccgaagcuacugcagaaccuaaaaucgagaauacaauucaacagagcauuccgaaaucgacgccacaacagcuacaacaucccgcuucucuuccgcagcagcagaacaugccccagcacggggcccaaguucaagugcaaucgcaacaaucccagccgcauccgccgcagcaaaugcccauccaaucgacgcugcauauccagcaaauucaccagcaaauggugcaucaaguucagcaagccgccgcacaaggaagacccaugccaccggguucgaagaugcaaaccaccgauggauucguugguguugugauggcgaacaacgccguacaauuacagauaccuccgaauuaucaacaacgguugcugcuguugcaacaacugcaaaaucaaaaauugaugcgagugggaagcacgcagcccagggccgcuuugcaaguggcccccaaucaaaugcccguagguaugaauccgggagccaggaugccggugucggcgccgccgccgccuccaccgccuuaucccgggccgccgccgcccuauccgggcaacgcgaaucaacaucaacaggagcaaccgcugcuguuggaagaucugcucgagcaggagaaacgcgaacaggagaagcugcaaaaccaaccgcccaaccacgaagucaccucgucgaccggcaacgagacggaaucggcgcugcugagcgaccaagacuucgagcgacucaaagccgacguauuuaacagcgccccagugaguaauauaucgucuacgaaucaagggaacgccgcccaaacgucgcaagcguggccccagcugcaaaauaggcaggcggcgguaccggccgccgcuucgcagcacacgauggaagugacuacuagaguucaaauguacaauccuaauuugauaccggcgccgccgcucccgccggagaauaucgcuacggagcaggacaagcaggcgcagcuguuguacgagcaguggcugaaccaccagaacaacucgcuggugcagcaauugcgcuauuacgagaccgaagugcagaagcuucguaagaguaaaaagucgcuaaauaguaagcaacggcaauugaggaaagcugguaaccaguugaccgacgcagaugcgacugaacuucagagaauuacagcggaacaggcuauauuacagaaacauuuggaaucgagcaggaaacaaaaucggcaacauggaauguugauacaggaauaucgaaacaagcaucccgccaucaagcagagaaccguaacggaccagauccaaucgccguugggccauccggcgucgucgcccauacaacaaucgagcgccucguugucgcccauguugucgcccuccgugucgccgaugacgcagaacagcucgccguugaacagccccgggccgauggugccuucgucgcccggccacggucccgugcagaacauuuugcaaagccccaacggcgccaacgcggcucaaaugucgcccaugcaggcguccccgaugcaaucuucgccgagaaucgguacgccucauucucaaagugaugaaagucccggaucggcgcaaucgccgucgcagguuugccugccgccgcccaugccucgaaugacgucgccucagcaccgacgagucguuaccaguccggugggaaugucgcaaaugcguuuuaucaacaacaacauguugcagcaacgcguucgcaugcaaucgccuauacagaauuuccaacagaaacccggcacgccuucgccguugaacagcccgacgucgcagcaaaugaacgucaaccaacaacaucaaauccagaaacagcugcaacaacaacaacaacagcagcagcaacagacguuguugcagcaaaauuuggaaggcgauccuaacgccauucacucgcagaggaccacgcaauuguugcagcaccggaauuucaucaggcagcaggugucccagcagcaaauaucgccucagacguugacgccacaacagcaucaguugaugcugcaacagcaaaagcagcuggcgcagcagcaacaacagcagaucgcccaaaugaacgcggcgagauugcaacaacaacagcaacagcagcagcaacaacaacaacagaauaaccccccgcauucgccgaugccacccaaaaguccaaugauuaaccagcagauaaugucgccgcauucgaugccccaaucgcccaugcagaugccgccgaagagucccauggugccguuuaaucccaaccaaacgaaucccaauucgccugcggcuagaaguccggcuuuccaucaggguaugaaccaaccgacgagucccaucacucacggccaucaaccuccgaguucuccgaugcccaggagucccaugaucaaucaaacgcacucuccgcauaacguucgaaggccucccagcgccaacagcagcccggccaugccugauaggccgcacagcguagaaaacucaucgcccaggauguacucuauagaucaauuggugcaggagaguuuggccaaucaaaaugugaacgcgcaauauaacaguuacaauucggauaugaucaacgaaagcgguggagggaauucgaauaacccgauaccuuguccaccggaaauaccgagauuucguuauuuuaagcucggcuugagaggcggagcgccgauguggagcuucggaagaggcgccaaaaggaucccagcgccuccgaacgccaaaccggacgagcccaaggcgaagaaggagucgcaucugagcaaaguuucgauacugaaaaggaaacccccgauggcuucuaucggcaaagugggcucguugguuaguucggauuacaacgauuuagacgacaguucgacaacgccucccguaacgccgccguuggcuucgaccagcagaggaagucugucgaagaagaagaaucucgaacugcaagcccaaaaggauucggugaucgucaugcacagucccgacgacaacaacaaacagcucgaaauaauggauuacgacgacgauaauaacacggugcuaucgucggaagugucguugaguucuguggcaagaaacgacgacgacuugguggagaucgaaacgauaucgcaagaccucgccgaagggcuauccagcccguuggaaucggaucaaauaggcgacgaauuccuguuguuucccggcaauauggugguggacauguccggugaagagcauuacucggaaaaagaggaagaggaaaccgucgacggggaauauacagaucagaauaugcacauagugauacgcagcccgaccaccagcgacgacgaguucauaaugccuugcaaagugaagcaguacaacgcggacgagcaggaggauaaucccgaaucgcccgaucaggaggaauucggcgaauccggcgauaugauggcgaguuucgauaacgaagacacggauauaaucauuucggaucaaaccgccggcguucccgaggacucgauuuccacgaaggaagacuucgaggagcucaucgacgaggggucgcguaaaaacaacaucagcaaacaggaggugaccgccaaacacauucaagauuuccacagguacaccgaauuguucgauuacgguaaaccugaagcucaaccgguuaagaaaccagucgcuaaaaaguuccaaccgaaaguaucucuaguuagaggaguagcuuugcccaguaagcccaacaccgagaagaucaucaucacgcaaaauucgaacguguugaauacuucucaggcuucgaaagucaccagcaucauuuuaacccacaacgccaacguuagaaggaacauuauaagcguaccgaaaauagugaguaccguuucaccugccauaacuauagugagugccaguacaucgcaaauggccucgauauuaccauccaaauucaccgugccgguuauaagcgccagcgcgguacgccagcuauccaacgucaaagucaucgacaagccuuccacuucuucauugucgauuucuaccagagacaacguccugccgaagaagauauucgaggacgauucggugucgccggacaguuccaauugcgacgaugagaaauccaaagauucguucgacgauaaggucaagucggagucgccgccgcaggaggucaaacaguucgugaaaucggauucgcagguuauaucguugaaaucgaagaacuacgccgaucaaucgaagaagaucgaacaucugcaaauagugaauauaucggcgaaggaugugguucaaaggcagaggauaccgaguccuuugauaucgaaagcuucuccaguuaucauccacaauacgccagaguugaaaaugacugcgcaaguuauucaagagagccaaacucgcaugaaaauuacgacuacuacugauaccgaacauuacgaugagucuacggaugauacgaaaucaguuguaauuucaauuccaucuccuacaccuucgcaagaacaaaugcuggauaguauagccuuucaggcguuggaaaacaggagaagagaguacgauucuauugaagacguguuagauaugauugagaauauagaaaacaucaccgccgaaccgcccgagauauuagaagaaaacacguugcaaaauuccgauuccaacagcaacaucgaaaccaaaaccgccgaaacgaaggagcugcaauugccuaccagcgaaagcgaagcgcccgcuaccaaaucguccaucguaccgcaauuaucgccucuuucccaacccacggaauugaccacgaacauggccaacgccucgcagcagcucagaacucugcugucgucgcugcaaaccacgucgacgucguccccgaccaacguggaguccauagccaagggcuucggccagaaaaucagcaccuccucgucggcuaaccagcccauagucgcuucgagggugaucggccaacaagccggcaggcaaucgccgguuaucaccagcgucucuaccguuauaguuccgaauuucaagcaaaaaaucaccgcggcuacuaccgcuaccuccagaagcagccccgugaagguggucagcaccucgcagcaauuaaccggauccauaauaaccucgacuuugaauuauauaccgaacagaacgaucgguauacaaaugguggcggaucaaucgaaacugccgccggccaguaucgugacgacgaugcagcaaaucaacucgaucacuuccagccaggagucgaagaagccuucguugacgcucacggcgaugcugcagaaccaacccgcagcgaauaugaugacuaaaucgucagcugauacuaucacagccgcuaguuugcuaggcucgcccaucagccugccgaagaccggguucaccacgucuuuggugcaagcccaaccgagcguggugcuuucuaacacgccgccaacgccuagccaaacuuccacggcgacaucuucgacuaaaaccaccgcggauucgaucacggccgcuaguuuauuggguaguucuauuaauauaguuaaaacuaguuuugcgaugcaaccgaguagcaccguaggaguggugacgagcugcgucaacaagacgccuacuuccaccacuaauuugcuccacacgcaguugacgaaagucgugagaagcaaauccgucgaugauguuaaagaauuggucaaaaucgacgagaacaagcaaagcguuagcagcgaaaauguagacgauagcaacagcggguguaaauuaucaacgauaacuacgguagccuguaacaaaaccgaagauucgcagaacguguuacugaagaaauugcugcagaacacggcuugcgccagcgcucaauccuccccgcccgcuucuacuaguacuguuacuaccagcgcugcuaauacuaugucuaaaguagcuaauacgcaguguaguacuagcgcuagcgucgagcaaccgccgguaagcgcuccuucgaacguuacaguccaaagaagcgccagcagagacgaguuauuaucaccgccacaagacguccaaacuaugguagugauuaagaaagaaccgccgcugguaccgcugucccaaccgaguccagugcugaacucgaauuccaacgcucacacgcccgaggugaagaaagaauucaucgacgaaucgucgcagcacucugaaguauccgaucacaguagaucggacgcccccaucaaagaggaacuggaaaccauggagaacaccgccgagaagaugaugcucgacaaggaggagcugaagaagcagaagcgcaggauguaccagcagaagcgccgccagaaccagauccucaacaaggagcuggcgcagcagcagccgaagaagcggccgcgcaagaauucgaagaucgacgaggacuacgacacguacaucgacggcgugcuggcgcagcugcgccagcugccgcccaucgccgucuccgagccgguguugaaccgcaacuucggcguggugccgcuguucgggugcggcgaucucgccaagaucggcgccaaggauuacucgacgcaccugggggaguugacggggaacuacggcuacggcgagcugcccgguuucaccgauuucuacucgacgaaacccuacggggauauggauccgcugccggagaagccgccgucgucgacgcagcgcggcuucuacgaccaggaguucccgcugauuagauucgaugcggacgagcacaagaaguuugacguguuuugcagggaggauucgcccgauucgauauugagcagcucgucgcccgaauguacgcgcgaacccgaaggcaaauucgucggguugaagcucaucagcgacagcgaagaggacgaagaagaugaugccaaagacgccguuucgaaaggaagaaugucaccgguggugcccgucaucaaaccuguuccuauuagacugaaacccgccggcgaauuguacuucaaagagaaccuuaacgagaacaaggagaacaucaacagcgacucguugcacguaaugacgaaauccaaauucgacaacaagcagucaccaccgucgaacguuuccggccacguuacgguaacuuuaacucuaacaucaucugcagcugaagauauaaugggaguacugcgggauuuggccaauauucuacacauaccugcuccgacuaguuaccaaaucguggagagaacggcuucuccgccuagccagaaauugggcuuguaccgcaccaaaggcaaggacggcaaagagggggcucccaucgacauacagagcauccucaacggcgccaccaaguucugcaagcacugcgacgugaucaucuugagcaacaucaucaggcggaagguguccgauuuaccguuccucgccaaggauucggauuugcucagcgacggggaggaauuguucuuuugcaguuccgcuuguuacaugcaguucgcuuugaugcaccgcucgccuucgauauccgaagauaaggcugcugaaauuauaaaucaccuaucgcagaaagacaauuuggauucgaaacagaaauuacccgcagacgcguuagacagcaguaaaucgauagcgcagaaguugucguucaacaucaaagauacgaaacgggaauucgagccgauggagacgaacgaugcguuugcguucuucgcucgcaccaccgcuaauaaacaggggaacaacuucuacgauggggcgccguucaaaucgguccccgcuagggugcacaggaacgauagguacaaacucuggacgcccggcugucuccaacccacccagaaacacaaaacgcccaccgacaaggagaucauggagcugcucuacaggaugcagaucaccguuacuccucccgucaugccggaagauacgaggaaguguuuguucugccacgguaucggugacggcguggccgacgggccggcgagacugcucaacuucgacguggacaaaugggugcaccugaacugcggccuguggucggacgguguauacgaaaccguaaacggggcuuuaaugaacgucgaaaacgcccuacaguccggguuguuggccacuugcgugcauugccaaagcaucggggccaccaucaagugcuucaagacgagaugcucgagcauauaccacuugaauugcgccgucaaagacaauugcguguucuacaaaaacaagacgguguucugcaaaguccaugcgccgaagaacgaaaaagacaacgaacucaccacacucuccgugucucgcagagucuacaucgaacgagacgagaacaaacaaguagccgccgucaugcaccauucagauucuacagauuuacugagaguaggcaguuugauauuccugagcguaggucaacugcucccgcaccaacuucagaacuuccacacgcccaaucacaucuaucccaucggcuacaagaucaucagguucuacuggagcaugaggaacuugaacaaacgcugcaaguacauuugcaccauucgagagguguccggcaaaccggaguuucgcgugauggugcaagagccccccgaagcggacguggaguucuccgauuccacaccgaaaggcgccuggcagaagauccucgacagcgucgcuaccauccgcaaagagaacaauuguuugcacauguucccgaaauucgccacaggcgaagauuuguucgguuuaacggaacccgcuauaguucgaguguuggaaagcaugccgggcaucgaaacguugucggauuauaaauucaaauacggccggaaccccuuguuggagcuaccgcucgccauaaacccuucgggcucggccaggaccgagccgaggcugaggagccaguugcauuggaagaaagcgcauacgcagagaacuacuggcgguacuucguccauucgaccgauguucgggccgucucugacgggaucuauuaguacgccagcccaaggggagcuggcuuguccuuacagcaagcaauucgugcauucgaagaguucgcaguacaagaaaaugaagcaggaauggaggaauaacguuuauuuggcgaggucgaaaauacaagggcuggguuuguacgcugcuagggauuuggagaaacacaccaugguuaucgaguauauaggggaaauuauuagauccgaacuggccgaguguagagaaaagcaauacgaagcgagaaaucgaggaauauacauguuuagauuggaugaagaacgcgugguugaugcuacuuuauguggcgguuuggcuagauauaucaaucacucgugcaauccgaauugcguggccgagaccguggaaguugauagggauauucgaauaauuauauuuuccaaacggagaauuuuacgaggagaagaguuggcauacgauuacaaauucgauauagaagacgaucagaacaaaauauccuguaugugcggagcgccgaauugucgcaaguggaugaauuaa

SEQ ID NO: 6439 - RNA, 4107 nt, Phyllotreta atra
auguuuucaaccaugccgacuaaacagaaaacagcagcuaaagucgaugacgacgaaaugcuaucggaaauauuaggcgaaaucgauucugguacagcaaauacaucggcuaucgagaaaccuaaaauuagcaaguacucuacacuggccauuaacuugucagcuaaggauuacaugaggaauuuuucccaaccgguuaaaaaacgcgcuaucgaaaaaaauguacaacccagugugcccaaaccaguaaucaaguuaaacaaaaaacuaacuaaaucaauucaaccaauuaaaauugaagauaccaaaaacgaaacgauugagccugaugagcauaucgauaaagaaaaggcugauccagauacaucacacuuugaugaugauuuggaugaaacuuuacuagaagaaaucagcgaagaucugaauaaaaccgccacugaaucccaaauaaccgaaucagaaaugaacgaagacgauuuuccaggggauuuugauacaacaguaauagaugaaaucgaagaacgaauuaacauugccagcgaacaacuaaucaacgauauucaagcggaagucgagacggaauggcaguauuucaacgaugcuaauaaaagcuuuaaaauagcaacaguagauucuggagauacugauucuauugcuucggaagauaccgauucuauugccgauucuccugcugucacuacugccgauacuccauuuguagaagucgaagggaacaguguguuuagguucuuuuggugggaugcuuacguggauccacuacaucaacaagggacuguuuuucucuuugguaaaacguacugcgaaaccuccaagaaauacgaaaguugcuguguggcugugaagaacauagaaagaacacuauuugucuuacccaggccauuugaaguagaugaggacgggaaucccaccgauaaaccgguuacauuuaaagcaguccacgaugaauuuaacaauaagauuuugaagcgacugggcaucggcucuuuuaaaucgagauugaucacgaagaaauacgcauucgaugccagcauaccagccgaauccgaguauuuggaaaucagauacucugcgucauuuucgcgcauucgaugcggcgaugaggauugcgaccaaaaagaugguuaugacuacauugaaggugaucucggcuauagcacuuuuucgaagauuuucggcacaaaaacgaauuucuuggaguugcuuuuucucgaacguaaaaucaaagggccuuguuggaucgacauaucagaccccgaaccggccacuaacccgaugagcuucuguaaauucgaaguaaauugccucaagcccaccaauuuaaaaauaacuacauucauaaaaccaguuccuccaccaccucucguaguagccacuauaaauaugagaaauugcauuaaucgagcuucaucuaaucacgaaaucguuaugcuaucuugucuggugcaaaauagcuacgcugugaacaaaccgccuccggaacccgcauuucaacagcauuuuugcguauucagcugcccccgaggagaggugcuaccucuaaacuuguacgauacuuuagagaacuacaaaauaacgaaagugcugaaaaccgacaacgaaaaggccaugcugaauugcuucguccacaacaucguacaaaucgaucccgaucuaaucguagggcacaacuugcaaggguaucaggccacuauauuggcagauaggcuggugaaauugaacugccguucuucuaacagacuaggcaggcucaagaagaagacuacucaagccaaacaauuagagaaaacguuguucuuggggcgguuaguuugcgauauaaaaauaucagcgaaggagcugauuaaauccagaucguacgauuuggauacgcucugucaggucguguugaaauuaaaggagaaccaacgagucgaucuagagccugaggauguguucaaaauguucaaaacgucgcaggauuugauuaaauuaauauccuucacuaugcaagauucuggguauauuaugaaaaugauguacaauuugaauauagugccucuggcguugcaaauuacgaauauagcagguaacgucauguccaggacauugaugggaggaagaucagagaggaaugaguuuuuguuguugcaugcuuuccacgagaaaggguacauuuuaccggauaaaguuuauagaagaaucgaaagcgaaucgaaagggaguucuaagaaaaagcccacauauucaggagguuugguguuggagccuaaaguagguuucuacgacaagcuaauacuccugauggauuucaauucccuauaccccagcaucauccaggaguacaacauuugcuucaccacccuccccguaauggauuccgacgaaaaucuaguacuaccagacaguaaucaaccggccggaguacuaccaacagaaaucagaaaauuaguagagagccgucgccaggugaaaucgcuaaugaagaaaccggacgucccgaaagacuugaaauugcaauacgacauucgccagauggcguugaaauuaaccgccaacucgauguacgguugcuugggcuucggacacuccagauucuacgcgaggaaucuagccgcuuugaucacccaaaagggccgggagauucucgugaauaccaaagauuugaucgagaagauguguuuggaugucguguacggugauacggacagucuuaugauuaacacuaauauuuuagaauacgaucaaguguucaaagugggcguuaaaaucaaacaagaagucaacaaguuguacaagcaagucgagcuugauaucgauggcguuuuuaaauauuuguuguuguuaaaaaagaaaaaauaugccgcaguuucgcugucuaaaaguccaucaggugaauuaauagccacuaaagaguacaaaggauuagauauagugcguagggauuggucacaauugucaucagaaaccggcaaauugguucucgaacaccuacuaagcgaucaaucugccgaugaaaaaguacagaacaucuacgacuacuugucuaaaaucaaaucugauuuggucgaggguaaaguaccaauaccacuauuagugaucacgaagcagcugaacaaggcgccucacauguacaccgauaaaaacucaaugccucacguucagguggccuugcgauacaacaagaagagccgggaucacuucagaaugggcgacacagugcccuacgugaucuguguagacaacaccagcaacaaccccaugcagcgagccuaccauuuggacgaauugaagggcaacccggaguugaaaaucgacuacgauuauuaucuggagcagcagauucauccggugauagcgagaauuugcgagcccauagagggcuuggacgccuaccaguuggccgaaugcuugggcgccaaccugaagcgaaugaagaggcccaaaccgcaagggggcaacgagaacauucaaggggagaacgucguuaaagccgaggugaaguucaagaacgccgagaaauuuacguucguuugcuacauuuguaaacaccagaaugucguuagcgaaccauuggugaauaacauuccuuuuuuggaaacgugucaaaacuccgauugcaaaucgaagcccaucgauuacuuaccaagcguucaaaaucaacucuacuuaucuauucguucgcauauaacuaaauauuaccagaaaguguugacgugugaagacccaaguugcccaaacgcuccgagaagauuaccccuaaaauuccugaagaaacggcccauaugcaacacguguggcaacgcuguaauguacaggguuuacaccgaauuccacuuguauaaucaacuagccuacuaucgguacauguucgauuugagcaagcucaaaaacaagccuuugauggauggugaaaccgagucgggguacagaacgcuucuagauacaguugagaaauucaugaaucaaucugaguacucgcucauaaaucugagugagguguucggucagcucgguugggcugcgccuguugagaaacgcguuuuggaagagucuggaaaugguauccauuuuaacgaagaaggcagugaggaugucuaugaugaauga

SEQ ID NO: 6440 - RNA, 1398 nt, Phyllotreta atra
auggcggcugcugcagcggcaaaaauugccgaaguacgcgagacaacucguguagaaagaaucggugcccauucucauaucagaggccuaggauuagacgacagucuugaagcuagacauguaucucaagguaugguugggcaagucucagcuagaagagcaguuggcauuguucugcaaaugguacgcgaugguaggaucgcaggaagagcuguuuuauuagccggacagccugguacuggaaagacugcuauagcaacugcuuuagcucaugcuuuaggacaagacacgcccuucacuagcauggcuggauccgagauauauucguuagagaugaguaaaacugaggcuuugacgcaggcuauuagaaagaguauuggaguaaggauaaaggaagagagugaaauuaucgaaggugaagucgucgaucugagcauugaacguccagcuacaggaguugguacuaaagucgguaaauugauucucaaaacuacagacauggaaacuguauacgauuugggcgguaaaaugauugauaguauucuaaaagaaaaaguucagucuggugauguuaucacuauagauaaagcuacaggaaaaauuacgagauuggguagaucuuuugcuagagcuagagauuacgaugcuacuggccaacaaacgagguucguucaauguccagaaggugaacugcaaaaacguaaagaaguuguccacacagugacuuugcaugaaauugauguaaucaacagucgcacccacggauucuuggcacuauuuuccggugacacuggagaaauuaaaucagaaguaagagagcagauuaacggcaaaguagcugaauggcgugaagaaggcaaggcugaaauuauaccuggcguacuguucauugaugagguucauauguuggauauagaaugcuucucauuuuuaaacagagcuuuagaaaaugaaaugucuccaaucgucauaauggccaccaauagagguauaacaaaaauucgagguaccacuuacaaaucuccgcacggcauuccguuagauuuacuggaucgaacaauuauuguuccuacucagccauacgacgagaaggaauugaaagaaauauuaaauauucgaugugaagaagaggacugucagaugucugauaaugcuuuggugguuuuaacgagaaucugcaaggagacuucacugcguuacggcaugcagcucaucaugacaucgaguuuaauugcuagaaagcguaaagcccacgaagucgauguagaggacauuaaacgagccuaucaauuauucuuugaugaaggucgcucugugcaauuucucaaagaauaccagcaagaauuuauguuuaacgagaucgaugaaaaagaugauauggaaauggaaacgguuuaa

SEQ ID NO: 6441 - RNA, 1116 nt, Phyllotreta atra
auggcguuaagaacuuacggagauaaaccgaucaguuuccaguuggaggaaaauggagaguacuacuguguuggaucugaagugggaaauuaucugcgacuguucagaggaucccuguacaaaaaauauccugggauguucaggaggucuauaaccaacgaagaaagacgaagguugauugaacucgguuugagccagcacguuuuagcgagcaguguaucacugcuuagagcagaagaaguugaagauauaauugaaggaaaugaugagaaguauaaagcuguaucuguacacacuucggagccuccuaugccaagagaggguaaauccaagaaaaacaugcaauggguaccaucguuaccuaauuccagucacuuagaugccguuccacaagcuacccccauuaauaggaacagaguagcugcuaaaaaggugaggacauucccacuauguuuugaugacacagauccccaaauaaacauagaaaaugcuugucaacaagaauugcuaguuccuauuagacuggacauggaaaucgaaggacagaagcucagagauacauucacuuggaauaaaaaugagaguuuaauaacgccugaacaauuugcugaaguucucugcgacgaucuugauuuaaauccuuuaacauuuguaccagcgauugcucaagcgauuagacaacaacucgaugcauucccaacagaaccuccugcuauuauagaggaaaccugcgaucaaagagucauuauuaaguuaaacauucacgugggaaacacuucuuuagucgaucaaguugaaugggauaugagugaaaaacagaauaaucccgaagaauuugcguugaaacuuugcgcagaauugggucuugguggugaguuugucacugcgauugcuuauucuauuagaggucaacucucuuggcaccagaggacuuaugcuuucagugaggcaccucuuccuguuguagagguaccauucagaaaucccagcgaaucggaucagugggcuccguucuuggaaaccuugacugaugcugaaauggaaaagaaaauucgcgaccaggacagaaauacucguagaauuagaagauuggcuaacacuacgccggguugguag

SEQ ID NO: 6442 - RNA, 684 nt, Phyllotreta atra
augcaggcuaucaaauguguagugguuggagacggcgcggugggaaagacgugucugcucaucagcuacaccacuaacgccuuuccgggcgaauacauucccaccguauucgacaauuauucggccaacgugauggucgauggacgacccauuaauuuggggcuuugggauaccgcuggucaagaggauuacgaucggcuucgaccgcucagcuauccgcaaacggauuguuuccuucuuuguuucagccuagugaauccggcaucguuugaaaauguaagagcgaaaugguacccugaaguauugcaucauuguccuagaacgccgaucaucuuaguugguacgaaacuugaucuccgcgacgacccggcaucguuugaaaauguaagagcgaaaugguacccugaaguauugcaucauuguccuagaacgccgaucaucuuaguugguacgaaacuugaucuccgcgacgacccgaaauccauugaaaagcuaaaagagcgaagauuauuuccgaucacguauacacaggguuugcaaauggccaaagaaaucaaagccgucaaauacuuggaauguucagcguugacgcaagucggcuugaagcagguguucgaugaggccauucgagccgugcuuuguccuccgcccguaaagaaaaagaagucuugcucaguguuauaa

SEQ ID NO: 6443 - RNA, 4020 nt, Phyllotreta atra
augaaugcguccacuuuuaaucccagaauggaagccgcucaaaauccggugcaaaaaauggaauuggcguccaggaauguggaaaauucguuguuaaucgacaacaaugcgccgagauugaucgauuucaugaacaucaauccacaaagcggcuccacugcaagcgguuucgcagaccacgauuacccaacuuugaguggauugucgcauauuaucaacagcaugacccaaaucaaaugcgugagcaacguucccauaccuucggaaauuguugaccacuuugcccgugugcaaugccacuguaugauggguuuauuuucugaaauaaacagagcuuggcuaacuguugauagcgauauuuacguauggaccuacgaggaaaauaccgacuuggcuuauuucgaugggauaagugaaacgauuguuugugugggucuagugaaaccuaaaccaggaguauuucacgccuuuauaaaauaccuccugauuuuggcgacaucugucgauauugucguauuagggguuacguucacugaacgacccggugacaacgcugaugaaauucaacucauaccugauccuguguucauauugccuaccgaugguuccacuguuacgauaaucaacaguacugaugaugggaggauuuucuauggcacaaaagaagggaauuuauuugaaauugcauaucaagcugagagugguugguucggcaaaagaugcaaaaaaauuaaucuaucgaccagcacuuugucguuccugguucccucguuuauuaaugcagcguuaagugaagaggauggaauaacgcaaauuucaauugacgauagccgacauauucucuacauucuuacggaaaaaggauccauugaaguuugcgaccuaggagacaaagggaauucguuuuccagaauuaguaaaauaucucaaaacacguugguuaaccaagcaaugaauacuguuaaaacucuugacagucagaauuuucgaccaauagugagcauauccgccaucgaagcguccgaaucgguuaauuuaaauuuaguagcuguaucucaaacuggaguaagauuuuauaugaguguuacgaguuugucaaaccaaaauccuaaucaaagaccauacacgcuaacccuggcucauguaaggcuuccaccgggcuauucagcgaacauuaccguaagacccagggcggugcaugugucccaauauagggacagaaacuugauauugauauccacaguuaaugagaaagauguguugugguguaugagcucagacuuauuuccauucggccgaggacugacagaagcuuacacggccauuaauuuggacggaccagcuuuagcuaucucugaggugaggaacgguaguccccuucaaauaaaagauuuacaugaagcgccaccuuuagucguccggcaacaugccgaaccuccgaaaaaguacauuguucuuacuucgcacagcauucaaauuuucauuaaguuaagaccgguggauguauugaaacaaauuuugaaagacagccacgggcaagacaccgaggcauugaaagccuucuuuacaauucaaaaagaggaccaagcgugcgcuacugcuuugauacuagcuucauuggaaaacgaggacaacauggauauagccgaguuugcaaccagggcuuucuucuuauuuggaggcgagccaaaauugguggcuccaauaaauacuuuuuccgggccguccguauuuugcccacccgucaugucuacuccaaauauacaccaauaucaacagcaacagcaauuucaaccuucgccgcaauaccaacacaacuuuccccaugccaucucgcccggagcuaaugcauacgaauugaccaguccauucguuuuuucucccaagcacaacggccucuauuuauauuuaaguagaauauugagaccuaucuggaaucgaaggacaguggauaagcuuugcuuagaugggaaaauuguuacaaaucacaguacagugacuagugaagacugcauauuuauuuugaacuacauaacgucccugcauaauuuccuaaugcguaauacucagcuuucaaccuuaagcgccgguccaggucccggucaaaauccucaaaccuucaacaauacuacaauuaauaugacuagauugaaccauaccauucaagacguucaauuggaggaaagggcaucucuagacgcuuugaaaacauucguuugccacuguugucaaauauuaggccuauggagaauucuuugugagcaccaauuccacacauuaaucgcuucuuugccugaaacugagcagcagauuuugcaaaauacaaccuucaaggaucuacuuuuauaccgacacgauaucuguucguuguugauugcgacauuagucgauaguuacuugggcgauaacgccucugucgauucgauuagcagcaaauugagagaaguuuguccgcuguuuuacaaaacggaagaugcagcuuuuucaaaagcugucgaaauauuaaagaugacccgggcaauucaaaacaacgacgaaaaggaagagaugauccaauccgcuuugcagauuugcaaaucaaucggucccacuauuaauaucacugacauaugcaaggaauucgcuaauuugaaagcuuacaaagcuguuacggaauugugugcgcauuucgguaagaaaauagauccggauaaaauagcagaaaguuacuacaacgccgaagacaacagcggugaccaagaaggguacaauuauuaccaaagaagguuggaaauuuaucgucacauauuaaacauguuggaucaacuauacaacgaacaaaaucaaacgcagguuacuaguagagauaccucauacucaguuaaucagaccauauuacuggauggcguagaacaaucucaaguaggauacgugaugaagcaaguaauaaaagacguuauggaaacgcccgaugagaucaugcacuucgcccuuuacgauuggcuaguguucaaaaauaugacuggagauuuaauaaacauccaaaacccgucuuuggaaacguauuugaaacgaacguccacccagaaucccaacaacaucgaggccaugaauuuguuguggaaauacuacgaaaguuguaacaaucacgcggccgcugccaaaauuuugaacaaccucgccucgagaacuggcaucaauguuccguugaaagagagacugucuuaccuagcgagagcuaucaugugcaugcggagcgauaaaauaggcuaugcgcccuaucuugguguauuuuugagagaucuugaagauaaaauggagguagcgaaggugcaagagcaaauuuuggaugccauuguaaauuugcaaggacaaauuccuaacgcucaggaagcaauaagugcacuuaaugcuggcuuguacgaaauuucucaguuguaugaaaauuucgcugaacccuucaaacuauuagaaugccaauuggcaaucauagaaugcgccggauacacugaucagguuuugaucgaauccauuuggcagcaaauuuugacugaagaacuaaggaaaaccuacggaacugguacagauaaagucugucaacuuuugaacaaaguaaagcaguugucgaagcaauacgcucaaucugcaaacuguuuuccauugaauuacauuguuuacgaauuggaaauagugaacgcaaaacuucgaggagacaaacaacucguuccuugugccuuggaaagcaugaauauuccuuucgaaaauuuaaucaacguuuacaauaguuuaaauacgauuucuauaaaugaucacuuuuggcaauuagaggagaacgaauuucaucuuucugaagcuacugcugcauuaauaaauugcuuccuaagccaucucgaacaguacagcagcguugaaaagaggaaaauaacuucgcuuugucaagaugcagugguugcuuuacuauccaacuuguauagcaagccuaacacugagguguuaguuaauaaguuaagaaauauacaagccaaguugucaagaauuuag

SEQ ID NO: 6444 - RNA, 4143 nt, Phyllotreta atra
augagcgaauucacuuugagcuacagggaagucacuccggagcaaauagauuucgaaaauuggaaagaaauaacccucaccacaggaggaacccaaagcacccuucaagauauaaaaguagccgagaaagccaauggauacuguuacaaagacuccacuaaacacugcacgaggaauagauucaucuauuggagaauuaaucacaauguauuggagcuaguagagcacaguuuagauauaaaucuuacaggaaaucguaucagauacaaguucgauacuccaauuuuagaugguguuucgauacacgagguacucgauaauauuguuauuuugguuccuacaguuuguaguguacacaggcugauuuuuccccauccaaauguuuuccaugcacaggacgauuuacugggaauauauccggauuuaacagccuuaucgauauuuucgaaagcuucgauuguagacaccagaaacccaaacagcuuuuauguguucaacaaucccagcacugccaacgaucaauuaccgaaccuagccaauucguacuucguaccggaaaccggggaagcuuacuucguauuggccuuuccuucgacugaacucuuacuaaucaggcagagucccgaucaagucacuugcgcagaacucaaaggggaaucuuugguucccagauuuuucgccgguauagcagacaaauucaggcaaaggaauucggauagcgaaaaugugguuaguuugcuauuuuacgauuuggacgaagaaacuuacguguugucauuaacacaagaugcucauuugaaauuuuggucaugcaguaaaggccaaugcguagcaguaauagauguucgugaaaaaauaagaacuaacuugaaauauagaguacaaucagcgauucuaaagaaagcagaagauggaaacaguucagagaauauucuaguucuauuucuaaguuucggaaauaaaugccaguuccauauuuugaaacccucgauuagagaacaagagaucacucuaaacagauuagccacucucgaaucgccauugaacgauuugauagauuucgcagcacaaauagacugcuuauggucaguauggcgaucagaagaaggcgaaacggugguguacaaugcaucguucaaauccaaccgauggacucaaguuauacuggaaaccgaaccgugcgaauuuaaauauaucccuauaaaacacaacgaugucaagacgcuuuacuuacagcacauuuuccauccaggcagauucccuuugcacguuauuaacaaaacucuuucgauauauaaaaugccuacgauugccucagacucccaucuuuccguuucugcucuaaagcaaagagugugcuuggcugucgagaacgacauacaaaaucucuuuaauaaugguagcgauaucgauagcguugaaguugaugaguauguagagugugcugaauggaguuggcaaaaauucuacaccuauuguguccaauaccauacagcuagcagaaaaccguuggguuugaugcuauuaccauccguaucaggagcuauguucuugaaaaaaucuguguuuucguuucuacgcccuguggauucguuggaacauaugacguuguguacagauuuguacagagagcaguuuuacaauuuuuccauguuguccgaagauuuggauacaguagacgacguaaucaacguguuuaaagugauuguuuacaucgaacaacaacuaaaggauguuuucaugcaaucguucgaaacagaacuucucaaucuccaaucccccgauguuguaacagaggaauuguugaagagaauuuacguugaaauggauuccgauuuuuucucgcauauuuugcaucuaaucaaagacgucaacgauuuguacaaagccauacacaaaauccuggagcuguugagauacgaaaacaccuuggccaaucccgauaacgacauuaacccauccgcuauguacuauuucaauucacuguuaggcacuucuuuagucgcccaaagcuuccgacaacaagccgaaauuagguuucaaauuugccgcaauuuguugcuauuaugcaacuucuuggugauggacaggacgcuggauuggggcguuuuggaaggcguucgaucagucuguaugccagacauugucguucuaacccaagccaguuucguuguucuguggcuaagcgguuugacaauguucgaaagcgacucgauucgugauucuucgaugagcauacugaacccguuaaaacuaacuccaguuuacaacuuguuaccguucacucguugcacgucuuuauuggaaguauucauaucaucaucaggcguucaagaugcuaggaaaucguucgcaaggguuuccugcaaggacgaggccuuggugcauuggcauuggucgcuguugcccuacgugaaccacaucaggcaucuuauauggccaauaagcgguuguacgguguuagaagaauggcuguuguccaguggacaacacguguggcugcagcaguacguucggcuacuuagcaauuggugugaauggaacgcuuguacacguaacuucuuauuggccucgucguuucugacuaccggcgaauuuuauaaagccgaagagcuguucgagacugcggcgaaagggguuuuuaccgacgcguuuuugaagaacagaaucaaaagugucgaugauaguaauuuuagaacgacuauucauuauuauuuaaagguuauccagcuguucgaguuguguaaugcaagaaaccacgugauuuacguagccaauacggccuuauguguugucaaaagggacgauccuuuagcugcuacauuguuuucgaucaaauucaagcaccauuuggcuuugaagcacuaccaacuggccuucgauucguugaauucgaaccccgauggugaaaggaggaaagauaaucuuagggauuuaguaaaaacguugcuggacgagaaaaaacucaacguauuguugaauuuuacuuacggaagcauggaugaguucuuugcgaauauuauuuuaacucgagcuagagcggccgauguuaauaauaacguguuuuaugauuuuuuguauucguaccagauuaagaaagggccaccuucuuucagauuagccgcuucagcuauguacgaacaagccuuucgacuaagccagaaaacuaccaucgaagcuuuagaaaagcaagugaaaugcuaccuagcagcuaaaaauguucuacauuugugcccaucccaacacgcuuggguugugagaccugcagaucccgaugaagaagacgaacaaauuauauuccaaccuuuagccggcuccaacggggaaauacgcacguucaaaaucaaaaaacaaaucgaaguaguagacaucgaaaccauaggcaaagaacugacguucgccagcgcuaaauugaaacuacuccaauucaaucccacuguuuccauuaacauguacgauccacuggagcuggugauaucguugaacaacuccgggauguucaaaguggcuuucgagauuuguucgacguucgauuugccuuauucguugguguucgaggcucuuacgaaacgcugcguauugcucacagaagccgaggaucccaacgcuuggaauugguugguggagaacgauuugcaagauuuaccgguuaauagagagucagcggccgauguaguuuggaaguuccugcaggauuguuuggagaaauacgaagagccucacaugucguguuugcauaacgugguuugcaagaaaauuauuaacaugcaaauuuacuugccgcauugguugaaagcuucuuauaagucucgaaauccguccgaauuguuaagauuacugcacgccuccgggcguuuggaggaagccguggaauuggccaaagauuacauuuuaucagcgaugggauacggcaaagaggaauucggauucaagcagccuuuggcgccgacgucaccggccuucugucuuccugucuacgccauacaaaggcuaguagaugaauugaacauacagaauuccaugaacaucgagaagccuuacguucacgaguaugaugauuugaacguguuguuuacuaaguaucucgaaacagcaauuagaguuucuaaucagaugugccagguuaaguguaaagcuuuuuaa

SEQ ID NO: 6445 - RNA, 2262 nt, Phyllotreta atra
auggaagucuccgacaagaauuuggaaacuuugagcagauauuugcaagaaacgcucaacccggaccccaacgugcguaggccagccgaaaaauuccuggaaggagucgaagucaaccagaacuacccgcuauugcugcucaaucuggugcacaagcccgaggcggccaugaccaucaggguggccggcucgguggccuucaagaacuacauaaaaaggaacuggcuagucgaagaugaccaggccgaucguauacacgaauccgaucgauuggccaucaaaaaucucaucguaacucugaugcugagcucgccggaguccauucaaaagcagcucagcgaugccauuagcaucauagggaaaaccgauuuuccuuugaaauggccggagcucauuacggagauggucgagaaauuuuccaccggcgauuuuaacgugauuaacggcguguugagaacggcccauucgcuguuuaagaaguaucgauacgaauucaaauccaacgaguuguggacggagauuaaauacgugcucgagaagcuagcgaagccucuuacugaucuguuagucgcuaccauaagucuaucgcaaacccacgcaaacgauguagcggcauugaaaauaaucuacaguucgcuggugcucaucugcaaaguguuuuauucguugaauuuccaagauuugcccgaguucuuugaagauaacauacaaaucuggaugaccaauuuccauacgcugcucuccgucgaugugaaaucguuacaaagccaagaagacagcgaagcgggcguauuggagcagcucaagucgcaagugugcgauaauguggccuuguaugcgcagaaauacgacgaagaguuccagccguacuuaccgcaguucgucaccgacguuuggaguuuauuagucgcuacuaauuuacaaccgaaauacgauuugcugguuucgaacgccuuacaguuccuuucgucuguggccgaacgcucccaauacagaaaccucuucgaggacgacaacguguugagcagcaucugcgagaaagucaucauacccaacauggaauucagaaccuccgaugaggaauuguucgaagacaaucccgaagaguacacgagaagggacauagaaggcuccgacauugacacgcgcagacgagccgccugcgauuuggucaacacuuugagccagaacuucgagcaacggaucgucgagauauucggcagauaucuacaagugaugcucgcgaaguacgcggagaacccgaaggaguucuggcgcagcaaggacgcggccuuguacuugguaacgucgcugguuagcaggggauccacucagaagcacggcguuacgcagaccagccaauugguggacauuacccaguucugucggcagcacauuuugcccgaauuagagcgaccggacguuaacgauuugccgguguugaaagccgaugcuauaaaguacgugaugacguucagaucgguacugcccagcgauuuggucguaucuacuuuaccgcaacugauaaggcauaugccgagcgaaaguugcgugguucacacguacgccgcgugcacuuuggagaagauucuuauguugaaauccaacaaucaagcuauaguaaccggggcucaguuggagccguuggccuccgaguuguugaccaauuuguucgccguauuacaaaaacccgugucggaggagaacgaguacaucaugaaggcuuugaugagaacguucgccacgcugcaagauagaaucauaccguauuugaacguggcuuugccgaagaugaccgagaaauugcgaaugguggccaagaauccuucgaaaccucuauucaaucauuaucuguuugagugcuuuucguuggccauaaagauuaucuguaaggugaaucccacggcggugacuucguucgaagacauauuguuucccauauuucaaggaauuuuacaacaggauauacaagaguuuauuccguacguguuccaaauuuuaucguugcucauggagcacacgccgcagggcuccuuguccgagcccuacaugcaacuguugccuugucuguuggcccccaucuugugggaacggccggccaacauuagcccguuggugagauuguuggcugcguucgcuacgcaggccgccccgcagaucguacugcaagauaaagugguauuuauuuauuuauuuauuaccagcauaccaacaccuaaacuuaaaacuaaaacuguaugcagauugaauuuacaucgauga

SEQ ID NO: 6446 - RNA, 600 nt, Phyllotreta atra
auggcaaaaguacaauuaugcaauaucacaguuauggacaauccaaguccuuucuugaacccauuucaauuugaaaucacguucgaaugcauagaggaauuaaaagaagacuuagaauggaagaugauuuacguugguucggccgaaacugaagaacacgaucaaaucuuagacuccguauuuguaggaccuaucccagaaggcaaacacauguucgucuuucaggcagauccuccgaacgucucucguauaccugaaaaugaugccaucgguguaacaguugugcuucucacuugcuccuacaagagccaagaauucauucguguagguuauuuuauaaauaaugaauacagcgauccggaaaugagggaaaauuugccuaguccaccucaauucgauaagguaauuagaaauauauuggcuuccgaaccgagggugacgagguuuaaaaucaauugggaagaaucgagcgguacucaggaaaacggaacuacaauugccgaggcccccgcuaaccaaacaaccgaaacuuccacuuccguagagguaccugccuucaacgagaacucuaauucgugggccaccauggaguguucauaa

SEQ ID NO: 6447 - RNA, 939 nt, Phyllotreta atra
auggaucaaaugcuaccgagcccugguuuuaguauaccuagcauagguacaccucuucaucaacccgaggaagaucagcuaauuuuaccaaacgccauucaacaacaacaaagucuaccuacuacuaacucacaagugccuccucuagcuccaaugggagguucuacuccaacgcuuggucuagguuuaggccaugcuauguccaugccacauacuaaguauguaaccggauuuucacugccuaucagcucuauggcaccucaaacaccacaacauacaaugaugagucccaugguaaauguugguggaacugguaccacuaguucugguguaacgccuacguuaggucccucuacaccuucaccaaugacuccuaugacaccacauucagcagauccuggaaucguuccacaauuacaaaacauugugucaacuguaaacuugagcuguaaauuagauuuaaagaaaauugccuugcaugcgagaaaugccgaauauaauccuaaacguuuugccgcugugauuaugaggauacgagagccaaggacgacagcuuugauauuuucgucggguaaaaugguguguacaggugcgaaaagugaagaagacucgagacuagcugcaagaaaguaugcucgaauuauacaaaaacuggguuucccugcgaaauuuuuggauuucaaaauacagaauauggugggaaguugugauguuaaauuuccaauacgauuagagggauugguucuaacucacaguucuuucaguaguuaugagcccgaauuguuuccuggucuuauauaucguauggugaaaccaagaauuguucuguuaauauuugucuccgguaaaguuguucugacuggugcuaaaguuagacaggaaauuuacgaagcguuugauaauauuuauccaauuuuaaagaguuuuaagaaacaauga

SEQ ID NO: 6448 - RNA, 453 nt, Phyllotreta atra
auggcugcaaugcguuccaugucucgccuguuauucuccagaucaaugcaaacuacuguaaaaagggguuacgcagaucaaaugagcuucacuuuugcugcuggaaaccaggucuucuacaacgcaacaucaauaaaacaaguagauguuccuucuuucucagguagcuuugguauccuaccagcccacguucccacucuugcuguucuaaagccuggaguaguuacuguuuaugaagacgcugguaaugucaagaaaaucuucguauccagcgguacagugacuguuaaugacgauucaucuguucaaaucuuagcugaagaggcccauccaguagaaaauuuagacguuagugcagccagagaucuucuuaacaaagcacaaagucaauugucaucggccacuacagaucaggccagagcugaagccgccauugccauugaagugggagaa

SEQ ID NO: 6449 - RNA, 972 nt, Phyllotreta atra
augagcggcgauggcaaccaaaacgagcauuucgacacguuauuccuaucaaucgcacagcaucauccccaggggcccacgcaacuucuagacacuuuugugaacuuccugagcagaaaaacggauuucuucacaggcgggaaggaaggcgaaugggaaaaguuaguguugaauacguucaagaaguacgagaaguccagcagggagcagcacgcggccgaauugaaggagaaacaggaacaggaggcccgcaggaaggccaagaaagaggccgaaucggccaagcaggcucaaauuaccgaacuaacggaagagcaggcugagaaauugcaagccgaacucgaugcuaaaaaguccccagcuucggcagccacuucgaauagcucgaguggcccuucgacuuccacugcgaagaucgaagaagacgaagacgagucggagaaggguaaauuguuacccaauaaaggcaacggaugugauuuagacaaguauaauuggacccagacucuuagugauauagagcugcgagugccgcuccggugcaauuuccgagccaagcaaaaggaucucacggugaauuuaaccaaaaaacaucucacgugcggccucaaaggccauccccccaucaucgacgacgauuuccagcacgagaucaaacuggaagagaccaauugggugauugaggaugggaaaucguugcuguuuuccauagaaaaagugaauaagaugaauugguggaguaaaaucgugaagaaugauccggagauuagcacuaagaaaauaaauccggagccuucgaaguugagcgaucuggauggugagacgagggguaugguggagaagaugauguacgaucaaaggcagaaagagaugggauuacccaccagugaugaaagaaagaaacaggauguguugaagaaguuuauggagcaacaucccgagauggauuucuccaaaugcaaauucaauuga

SEQ ID NO: 6450 - RNA, 501 nt, Phyllotreta atra
augcagucuccuagcggaauggugcacggucaucccggcgccucaauacugcaauggagcccugauaaaaaauacagcgauagagaaagguggauuugcguuuauccagcauacaucaauugcaaaaaaaccauagcccaaggcaggaaaauaaacaaagaaaaaugcguggagaaucccacucaucaagagaucagagacguuuugcucgcugcagguuugaagguuggcguagaaaacaaauuguacagcagggaacgaagcaaagaauuguuguaucgagggcgaauuagaguccaauugaaaaacgacgacgguacgcugugcaauccaaacuucccaaccagagacagccuaaugcuccauuugggagacaugauucccaaauugaagagcagacaaaacaagggcaguggagauccucaaccgaccaccaccagcucgaagggaaagggcaaaggcaaagguuggcguagaaaacaaauuguacagcagagaacg

SEQ ID NO: 6451 - RNA, 2199 nt, Phyllotreta atra
auggaagaaccggagccuacuaaacgccagaagaugcccaaaguggccaaagugaaaaacaaagccccagccgagauccagaucacagcugaacagcuacugagagaggcgaaagaaagagacuuggaaauccucccgccgccgccgaaacagaaaauuucugauccggcugaguuggcggacuaucaguuaaggcgcagaaaacaguucgaggauaacaucagaaaaaacagggcggucauuucgaacuggaucaaauacgcgcaaugggaggaaucgcaaaaggagauacaaagguccaggucgauaugggagagagcccucgauguggaccacaggaacauuaccauuugguugaaauacaccgaaauggaaaugcggaacagacaaguaaaucaugccaggaacuuaugggacagagcuacaguucuuuuaccaaggguaaaccaguuuugguacaaguacaccuauauggaagaaaugcuggaaaacguagccggagcaagagcgguauucgaaagauggauggauuggcaaccugacgaacaagcuuggcaaacuuacauaaauuucgaacugagauacaaggaaauugacagagccaggcaaauauacgaaagauuuguuauaacgcauccggaggugaagcauuggaucaaauaugcccguuucgaagaaaaucacgguuucauucauucagcuagacagauuuacgaaagagcuguccaguuuuacggagacgaucauuuggaugagaagcucuacauagcuuucgccaaauucgaagaaaaccaaaaggagcacgauagagccaggguuaucuacaaguacgccuuagaccacaucccuaaggaugaaacgaaagaacuguauaaggcguacaccauccaugaaaagaaauauggagacagaagcgguaucgaggaaguuauaaugucuaaacgaaagcugcaguacgaacaagaaauacuccaaaaucccaccaauuacgaugcuugguucgauuaucuccgacugguagaaggagaagcagauuuggaaauaacucgagaaaccuacgagagagccauugcaaauauacccccgucgaaaaacaaacaauacuggagaagauacauuuaucuguggaucaauuacgcuuuauucgaagaacuggaagcaaaggauuacgaacgaaccagacagguauauaaagccugccuggaaauccugccgcauaaaacguucacguuuuccaaaaucuggcugcucuacgcacaguucgaagugcgacagaagcauuuaaaagcagcccgcaaaguccuaggcauguccauaggaaugugcccuagggauaaguuguuccgggguuacauagagcuggagauacaacuccgggaguucgauaggugucggaaauuguacgagaaauuccuggaauucgguccggagaauugcguuacuuggaugaaauucgcugaauuggaaacucuuuugggggauaccgacagagcgagaggcauuuacgaauuggccauaaaccaaccgagauuagacaugccggaguuacuguggaaagcuuacauagauuucgaaauaucucaagaggaacccaacaaugccaggcaaauuuacgaaagauugcuagagaggacaucccacgugaaaguguggcugucguacgccaaauucgaauugaacaauccgagugaagaagauuucaacauacguuuagccaggaggaucuucgagagggccaacgaaaaucugaaaaacguccccgaaaaagaauccagaguauuauugcuggaaaacuggagggaauucgaaaacaaucacggcgaugaggcgcacaaagaaaagguuaacgcuaaaaugcccaagagaauuaagaagaggcagaagguuaucgaugaggauggggucgaacaaggcugggaagaaguauuugauuauauauuccccgaagacgaagccagcaggccgaacuugaaguuacuggccgcugcuaagaacuggaagaagaacacugaugagccggaggaagauacggaaaauagaacaacccuuuccagcaguagccaaaggaugaaagaaaagcuauuagccuccgugaagaauuggaagaauaaugacaaagaaaauagugauucuaauaacgaugacuguucgaaugaagaggaaguucaaguuguuucuaacaaugaaguagaaaauuga

SEQ ID NO: 6452 - RNA, 1431 nt, Phyllotreta atra
augggaauuaaauuuuuggaaguuaucaagccuuuuugcaguauccugccggaaaucgcaaaaccagaacgaaagauacaauuuagagagaaaguucuauggacagcgauaacacuauucaucuuucuaguauguugccagauucccuuauucgggaucaugaguucggacucugcggaucccuucuacuggauccgugugauccucgccuccaacagaggcacccucauggaacuggguaucucuccgaucguaacauccggauugaucaugcaacucuuagccggagcgaagaucaucgaaguuggcgacacuccgaaagacagagcccuguuuaacggagcccagaaacuguuugguaugguuauaacggugggucaagccaucguguacguaaugaccggaauguacggagacccagccgaaauaggagcuggagucugccugcuuaucaucauccaacuguucguggcaggucuuaucgugcuccuucucgaugaauuguugcagaaaggauacgguuuggguucugguauuucgcuuuucaucgcuacaaacaucugcgagacgaucauauggaaggcuuucucuccggcuacugucaacacuggaagaggcaccgaauucgaaggagcuguaaucgcucuguuccacuugcucaccaccagacaagacaagauuagaggauuacgagaggcuuucuaccgccagaaucuuccuaacuugaugaaccuccuagccacaguuuuaguguuugcuauaguaauauacuuccaagguuuuagagucgauuuaccgauaaagagcgccagguaccguggccagcacucgagcuaccccaucaaacuuuucuacacuuccaacauuccgaucauuuugcaaucugcuuugguguccaauuuguacguuauaucccagauguuggcgguuaaauuucaagggaacuucuucaucaaucuguuggggguuugggccgauguugggggcggcggcccggcuaggucuuaccccaucggcgguuugugcuauuacuuaucgccgccugagagcguuagccacauucuggaagaucccguccacgcuguuauguacauuauuuucaugcuggguuccugcgcuuucuucucgaaaacguggaucgagguauccggcaguucggcuaaggaugucgccaagcagcugaaggaacagcagauggucaugagaggucacagagacaauuccaugauacaugaacucaacagguacauucccacugccgcugcuuucggggguuuguguaucggagcccugagugugcuggccgauuucaugggggccaucgguucugguacugguauuuugcucgcuguuacaaucauuuaucaauauuucgaaauauuugucaaggaacaaagcgagaugggcggcaugggcgcuuuacuuuuuuaa

SEQ ID NO: 6453 - RNA, 453 nt, Phyllotreta atra
gucgaauuaguguguuuaccaaaaguauuagaauauagccguuuuaaacuauauuuuaaauauaguacaaucaugucgacgguuucaucuucagcuguugaauuaaguucauacagggaucagcauuuuaagggcagucgagcugagcaggacaaguuauuaaggcuuucuacgaccuuauacguaggaaaccuaucauuuuacacaacagaagaacaaauuuaugaauuauuuucgaaaugcggcgacauuaggcgaaucgugaugggccuggacaaguauaagaaaacaccuuguggauuuuguuucaucgaguauuacaaucgcgaagaugcagaaaauugcuuaagguacaucaacgguacaagauuggacgauaggauaguucgaacggauugggaugcggguuuuauagaaggcagacaguacggaaggggaaagaccggugggcag

SEQ ID NO: 6454 - RNA, 921 nt, Phyllotreta atra
auggcugccaccguagggcgaauuugugguguagggcuauuaaagccgaauaauuuaaccaccaucggucagaucaacuccuauucgaccgccaaagaauggaguagagguaaaaaggcacuuuuaggaacauuaggguuauuagccggaggcacuggggccguacuaguggcccucgaccaaucgguuaaagcgucggaucuagaacugcacccgccgaagaacaucuggagccacagcgggauauucagcucacuugaucacgccagcguccggagggguuacgaagucuacaaacaaguaugcgccgcaugucacuccuugcguuucguggccuaccgcaaucuaauaggcguuacucacaccgaagccgaagccaaagccgaagccgaagaccagaugaucgaagacggccccaacgaggagggcaacauguucaaacgccccgggaaauuguccgacuacuuccccagcccuuaccccaacgaggaggcggccagggccgccaacaacggggccuacccgcccgauuugagcuacauuacgucugcuagacacggagccgaggauuauauuuuugcgcuguugacugguuacugcgaggccccagccggggugguuguuagagaagggcaguacuacaauccguacuuccccggcggggcuauuucgauggcucaggcuuuguauaacgagacgauugaguacggugacgguacuccggcuacggcuagucaauuagcuaaggaugugucgacguuuuugaaguggacagcggagcccgagcacgacgauaggaaaagaaugcugaucaaagccauagggauauucucguucuuguuagggaucacuugguacaucaagaaggugaaguucgccucgcugaagucccgaaagaucgaguucaggccgaagaaauga

SEQ ID NO: 6455 - RNA, 1389 nt, Phyllotreta atra
cgagcccacgucagcgaauuccaauucgaaaaccaaagaaggacuuucaccagcuacgguuacgcuuuggacccgucuguaaccaacgacgggaaaauuaaagugguuggaucuucggaagccgaugauaauagcauuaagacuguguucgaagccucuaagacgagaccuuuagauaagcgaaaaaggaagaagaaugaugaccccagcgauguggaagguuucuuagguccuugggguggauucauagacgaacaaaaaguauccaaaccgaccgaggaagaacaaaucgaauuggaugagauauccuccaagaagaauaaaaaggguaaacccaacgaagauaaaccccucgaagaaaaaucagucuugcacaucaaagacgccguggauuaccaagggcgcucauuccuccaugcgccacaagaugucgggguuaaucucagaucggacacuccuccagagaaauguuuccuacccaaagcucauauucacacuuggacuggccauucgaagggcaucgcugcuauccgauuguuccccaggacugcucaucuucuauuaucagccggaauggacugucguauuaaaauuugggagguuuacaacgaaagacggugcguuaggaccuacuauggacaucgacaagccguuagggauauuaauuucaacaauuccggaaagcauuuucuuucggccgguuacgacagguauauaaaauugugggauacggaaacaggacagguuuugucgcguuucaccagcaggaagauacccuauugcguaaaauucaauccggauaaaaacaagcaacauuuguucguggccgguacuucggauaagaagauaauuuguugggauacgaggucgggggauaucgugcaagaguacgacaggcauuugggugcuguuaauaguauuacguuuguggaugaaaaucgacgauucgugacgacuucggaugauaaaucguugagaguaugggaaugggauauuccuguugauaugaaguauauugcugauccuacuaugcacaguaugccuucuguaacuccugcaccaaacgguaaaugguuagcuugccaaagcauggacaacaaaguggucauauucucuuccaugaacagauuuaagauuaaucguaagaagacauucaguggccacaugguggccggauacgcuugcucguuggacuuuucgccagacaugaguuacuuaucauccggcgaugccgaugguaaaguuuauauaugggauuggaaguccacuaagcuuuucaagaaguggaaggcucacgauaacguuugcaucagcguccuguggcauccgcacgaaccgaguaaacugauaucugcuggaugggacggccuaauaaaguacugggauuga

SEQ ID NO: 6456 - RNA, 732 nt, Phyllotreta atra
auggugcagaaaaagcccaagaagaaggugggaaagaagguagccgcggcuccuuuggcagucaaaaaagucgagcaaaagaaagaagucaaucccuuauucgaaaagagaccuaggaauuucggaauaggccaagacauccaacccccgagggaucuauccagguucgugaaauggcccaaauacauccgcauccagaggcagaaggccgucuuacagaaacgcuugaaagugccgccgccaaucaaccaauucucccaaaccaucgacaaacaaacggccacccaauuguucaaaguuuuggagaaguaccgaccggaaaccgccuugcagaaaaagaaccgacugaaggcuaaggccgaggccaagguggccaaaaaggaagaggcccccgccaagagacccaauacuuugagagccgguacuaacaccguuaccaaauuggucgagcaaaagaaagcccaauugguggucaucgcacacgauguagacccuaucgaauugguacuauuccuucccgcccucugcaggaaaaugggaguccccuacugcauagugaaggguaaagcuagguuagggcuacucguuaggcguaaaacuugugcgacuguggcacuaacacaagucgauuccggagacagguccaacuucaacaagcucuuggagguuaucaagaccaacuucaaugaccgugcugaugaaaucaggaggcacuggggaggcgguauccuc

SEQ ID NO: 6457 - RNA, 1002 nt, Phyllotreta atra
auggcaacaauaauuaaggacauaacccuacaagaaaacauuccacaaaacauacuauucgaaaaacauaucgacuucauaaaggaauacggccaaaaggaaaacaacuucgaauaugcaaugaccgacuauuugaggauauccggcauguacuggggccucacggcucucgaauuaaugaacgccucaccaccacacucaauagacgagauuucagauuacaucaaacagugccaagaccccgaaagcggugggaucagcucuugccugaaccacgauccucacauacuccacaccuuaagcgccguucagauacugugcauguacgauaacuuaaaagcuauagauguagagggcguugugaaguacguaaaaaaccuacaauuacccgacgguagcuucacaggagacaaauggggcgaaguggacaccagguucucauucugugccgucgcgacgcucucgcuauuggacagaauggacgucaucgacguuaauaaagcaguagacuucguagauucuuguaaaaacuucgauggcgguuucggcucgaggccccucuccgaaagccacgccggcuuaauauacugcugcuuaggauuccugucuguuaccaaucgauuggauguuguggaucgagauaugcuggcuugguggcucugcgaaaggcaauuaccuucaggcgguuugaacgggcguccggagaagcugcccgacguuugcuacuccuggugggugcugucuucuuuaacuauauuaggaaaacugcauuguaucgacgccaaugcguugaagaaauuuauauuagcaugccaggauaccgagagcgggggcuucgcugauaggccuggagacauuccagauccuuuccacacaguguuuggaauaucagcgcugucucuacucggaaacgacacgguccagaaaguuaauccuacuuauuguaugccccagcauguuaucgauaggcuucaguugaaaccucaaauuuuagaugauuag

SEQ ID NO: 6458 - RNA, 2667 nt, Phyllotreta atra
augcaccaagaaacauugcaacuaauccaaauauuagaaaaaacaguuucacccgacaagaaugaauuggagcaagcuucgagcuuuuuggaacaagcgucccaaacgaauuuacuaggauucauaaagacccucucagauauacugcggcauggcggcaacagcccgguggcccgaauggccgccggcuuacagcugaagaaccaacucacuucgaaagacgcgaccaucaaagccaccuaccaacagcgcuggcuggucuucuccgaagaagucagagacuacaucaagaagaacguggucggcgcccucgggaccgagaccaacaggccgucgucggccgcccaaugcgucgccuacauagcggugaccgaauuaccgcaaggacaauggccggaucucauaucgacgcuggugagcaacauuugccaggggaauuccaccgaaaugcagaaggaggccacgcucgaagccaucggcuacaucugccaggaaaucgaauccgauguccuagugacccaauccaacgauauacuaacagccaucgugcacggcaugagaucuucagaacccagcaaucacguucgauuggccgccacgcaggcuuugcuaaacucguuggaauucaccaaagccaacuucgauuuacccaccgaaaggaauuacaucauggaggucguuugcgaagccacgcagucgccggugucgcaaaucaagguggccgcuuugcaaugucuagugaaaaucaugucgcuguauuaccaacacauggagcccuacauggcgcccgcgcuguuucccauaacguuagaggccaugaagucggagaacgaugccguggcucugcaggguaucgaauuuuggucgaacgugagcgaugaagaaguggauuuggccaucgaagauacagaggcuacugaagcugguagaccgccuacaagggugucgaggcauuaugcgaagggagcccugcaguacaucauaccgauuauccugcagaaacucacgaaacaagaagaguuggacgacgaggacgauuggaaucccaguaaagccgccggggugugccucaugcuucuggccacuugcugcgaagacgaaauagucccgcacguguugccguuuaucaaagaaaacaucaaaucagacaacuggcgguuccgcgacgccucccugauggccuucgguuccauucuggguggcuuggagccgaauacgcugagaccgcucgucgaacaggcgaugcccacuuugauagaauuaauguacgauaacagcguaauuguaagggauacggcggcuuggacguuugguaggauaugcgaaaucauaccggaggcggccaucaacgagaauuacuugaaaccucugcuggagagccucauaaccgauuugaaagcggagccccguguggcugccaacgugugcugggcauucuccggauuggccgaagcggccuacgaagcugcugccguuaacgaggaaacuggagcucccgauacuuacauuuugucgccguauuaugaguuuauuauacagagguuacucgagacuaccgauagagcugacggugcacaagcuaacuugagaccggcggcguacgaggcccugauggagaugguuaagaauucgccgaaggacuguuacguuacggugcagaaaaccacgaugguuauuuuggaaagacugcaacagguacugcagauggagaaucacauugccagccacaacgacagaucgcaauucaacgauuugcagagccuuuugugcgccacauugcaaucgguuuugaggaaagucacgcccgaagaugccccgcacaucuccgaugccaucaugacggccauguugaccauguucaauuccaauucuuguaaaagcggaggcguacaagaagacgcccucauggcuguaucgacccucguagaagucuugggagagaauuucaucaaauauauggacgcuuuuaagcccuucuuauacauugguuuaaagaaccaccaggaguaucaagugugcggcacagccguaggcuugacgggcgacaucuuccgagcuuugaagcucaaaguucugccuuacugcgacgaaaucaugacucuuuuacuggaaaaucucagcgaucaaucgguacaccguagcgucaagccgcagauacucuccguauucggcgacauaggucucagcaucgguucggaauucaagaaguacuuggacguggugcugucgacguuggcgcaggcgucccaagcgcaagucgaccgcaacgacuucgacaugauggauuaccugaacgaauugcgcgagggcguuuuggacgcguacaccggcaucauacaggggcugaagggggacgggccgucgcccaguccggacgugaugguccucgagccgcacauuccguuuaucguacaguuuauuaucgugguggcgcaggaugccgagcauuccgacggcacgguggccguagccgcuggaaucguaggggauuuguguacggcguucgguaguucgauggugccguuguuggauuuggcuucgaucaacgauauguuggcgcaagguagacgcagccgcgucagcaggaccaaaacguuagcgacgugggcuucgaaggagcugaggaaacuuaagaugccgccauccgcggcggcugcuagcugguga

SEQ ID NO: 6459 - RNA, 1221 nt, Phyllotreta atra
auggaaacgauuuuagaacaacaacgucgguaucacgaagaaaaagagcggcucaucgacgccaugguuaaagaaaugcuccauaaaaaaaacaccuauagagaggcgauaaauucggaccaccggcaaaaguaccuucuagacagauacaugacguccaccgaaagacugauagauuuguacgaagacaaagacggacaacguaaggccgagguggccgcccugacgggccccaaugaauucaacgaguucuacagcagacugaagcaaaucaaagauuucuacagaaggcacccgaacgagauaaguguaccgaugucgguggaguucgaugaauucgccaaagccagggagaaucccaacgaagauauggccaauuucguggaauuuaccgacgaagaaggcuacgggaaauauuuagauuuacacgagugcuacgagaaguacauaaaucuaaaaggcaucgagaaagucgauuauaucaccuacuuggccauguucgaucaacuguacgacauaccgaaagaacgaaagaccggcgaguacaggaaauauuugcuguaccucaucgaguaccucacgugguucgugcaacgcaucagaccgcugauggaucucgauagcgauuugcaggagcaggccgaucaggcgucgggcggcugggagaacggaacggugcccggguggccgaaagaaaccgguucggcuuuggcgaacgugggcgcccauuuggaccugucggccuucuccaguugggaggaauuggcuucguugggcuuggaucgcuugaaauccgcccuuauggcguugggauugaaaugcggaggaaccuuggaggagcgcgcccaacgguuguucucgacgaaaggcaagggcuccuuggacccgucgcugaugacgaagaacagcaagaaucgcgugacgaaggagaaggaggcgcugaggcaaagggaacuggccacguuagaagcgcaaauuuaccgauuggccgaucuggugucggcccaacgcgccgccaccaaggagaacguccaaaggaagcaggcucgcacggacggcgaaagggacgacagcgagaacgaagaaagcgaagaggagaguccggacgaggccgaugacgacgugcccuacaaucccaagaaccugccgcucgguugggacgguaaaguaagucgugcgaaacgcgacagggaacuuauaguauuggaaacuaauggcuaa

SEQ ID NO: 6460 - RNA, 639 nt, Phyllotreta atra
augacgauaggaaagaauaauaaaaugauccaacacauaaacuauagaguccgaauaacauugcaggacucuaggacguuuaucggcaccuuuaaagcuuucgacaagcauaugaacaugauacucggcgauugcgaagaauuccguaaaauuaaacccaaaaacucgaaagucgaacgagaagagaagcggguauuaggauuuguacugcugagaggcgagagcauagucucacuaacuguagaagggccuccaccaccagaagaaggacuucccaggguaccuauacccggagcagcucaagggccagguauaggaagagcagcagguaggggaaugccucccgguauggcuggaguaccgguuggucuccaaggucccguuagaggagucggaggaccgucucagcaaguaaugacuccuacggguagaggacaggucucagcgccaccacaaaugaaccaagcgccuccgaggauggguggcccuccgccugguaugauggggccgccgccgggaaugaugggcaugccgccgcaaauggguauggggcgcggaggaccgccuccgauggguaugaggggucccccgcccgguaugaugagaggugggccacccggaccgccaaggccuuacuaa

SEQ ID NO: 6461 - RNA, 876 nt, Phyllotreta atra
augaacuuuggagacuuggaguuugguuuuaaaauuucaaggaaaacaauaccauuaauuguaagagaaacuuguuuggccauauggaauguuauucaaccucaagaaauuccauuuccuacgaaggagcugugguuagagaaguccaaggaauuuuaugagauuacacaguuucccaauuguauuggaaguaucgacgggaaacauaucaggauaauuugucccccuaacucuggcucagaguauuucaauuacaagaaauacuucucgauuguccuuuuggcgguugcugacgcaaauuauuacuucacagcugucgauauuggaucuuuuggacgcgaaggagacucuacgaucuucaaaaagucaaauuuuggacuaagacucaaaaauaacgaacuagaccugccugcagauaauccccuaccaguaccugacaauguggagcaagguuccgagguacccuauguuuugcucggggaugaggcuuuuggguugucaaagcaugugaugcggccauacccguccaagggauuaucgcaagaaaagaggaucuacaacuacagacacugccgagcucggcgugucguagaaugcucuuucggaauucucucuaacaaauggcgugugcuacauucuucuauguuaauacauccugaauuugcugucaucguagugcaggcuuguuguguuuugcauaauuuugugcgaagaagagauggcuaccuuuuugaggauacucuaaccugcccacugcaggaugugcaagaauccgcuguuguagggggcaugucaaaagggaucgauguaagagaaguguucugucaauauuucaaugguucuggagcacuuucuuggcaaaacaaauauguguaa

SEQ ID NO: 6462 - RNA, 15540 nt, Phyllotreta atra
auggaggaauuaaccucugguuuggaucccgacgauuugauggaucuggacgagcccgagggcuccgaucuggaggaggacgacgaggaucucaucgacgaucacgucucgucgccuuucaucucguccucggcgcccgaguccacggccaacuccgucgccuccucgcccauccacgaagacuucccgccgcccuucaacuucacggggaagccucugcacgucaaacgaggaagaggccggccccgaagagaaggagguaagccuucggcgccgcgaacgacaagaggcgguggaacuggaguaucgagaguacgcagaccgagacccccgggguuuucgagaaggggcucguuagggggaagucgaaguguuaggcaaguagauagaucggauuaugacauguccuuguucaccgguucaccgguggaugacgguuuguuggaucccgaaacggguucgaugaucuuccccgagaaguuuguucccgcgaucgaggagccuccguacuuuccggagcauuggccggggaaaguuugugccuuguguaauuuaggugaaagaagccagcuaggacaaggugaaauguuaagauuaaauuguccggaaggauucucgccggagaagguuauuagugaacaaauauuagaaagagcguugcaggcuccggauaaagaaugcggggauaagaguccgaaagguccugugacguguagaaggcagaaaaguuucaacaaaugcagacauccuucgauaaccagugaauacguugaugaauuaacuauaauuggauauaaugaaguaccugauguaucuaguuuguuugagucuaacggacaguuuuacguucaucguaauugugcguuguggucuaacggugugacgaaagcagaaaauucugcuuuguugaauguaggaccuguagugucgcaauguucuuccaaaaaguguaccuucuguaaucauuacggagccagccugaccugccacguugacaaauguaccaaaauuuaucacuuucccugugcuacugcugccggugccuuucaggacguuucugcguugacaacuuuaugcaacgaccauuucggacaaguggcuaugcucaccaccgcaucuccguguuuaacuugcggcucuaugggagauauagcgaauuugauguuuuguucggguugcggugcgcauuaccauggaauuugcgugggauuggcucaguugccaggcguuagauccgguuggcaguguaggaaaugccgguguugccaagugugucgagucgucggagacgaaucgaagcugaugacuugcgaacaaugcgauaaaauuuaccacgcuaguugucaaagaccuguagugacuucgauaccgaaauacgguuggaaguguagauguuguagggugugcggcgauugcggugcaaggacucccggggccgguuuaucuucaagauggcacgcucacuauacaguaugcgauucuugcuaccaacaaaggaauaaaggguuuucuugcccuauuugccauaaggccuaccgcgcucacgcucauagagaaaugguucaguguucgaguugcaaaaaguuuguucauggaaccugugauccggaggcagacguuguuaccuacaaucaaaagaaagaaauaagcauggacuaugaauacguuugcuugcauugcaaaaauagcacagcuagacaaauaacagcgaaacgagcaaguauugaugauccuuccgauguauccgcuucacacgauucucuauaugacgauacguccgaauucgaucuuccaucgcccgacgaguucgccaggaacauggguuuggguaaagggaaaccguacagcgcgaauaaaauagccaagaagcgccuuaguuucacagugaauccgguuggcaggccgaaagguaccggaaaagugccacccgggaaaaugggguacaugaaacgcuaccgacugacggaguucaauagaaaacggggcccgaaagccaaaaugagggguauuuucggcgugccgggcgucggucugcaaagaccgaucucggaugggaaaaccgacgaagaaccgggcguugagaaucgauugguauuguguucagccaaagauaaauucacccuaacucaagauaucugcguaaugugcggggcguucggcaccgaucaagaggguuguuugaucagcugcguacaauguggacaauguuaccacccauauugcaucaacguuaaaguuacuaaagugauuuuacagaaaggauggagaugcuuagacugcacgguuugcgaaggcugcggccaacgaaacgacgaaggccgccucauacugugcgacgauugcgacguaucguuccacaucuacugcauggacccgccgcucgacuacgugccgcacggcaacuggaagugcaaauggugcgccaucugccaauccugcggcaccaccgauccggguuucaauugcacguggaugaacagcucgacgcagugcggcccgugcgccucgcacgugaacugccccagcugcaacgagccguacggcgagggcgaucugaucauacagugcgugcagugcgagcgcuggcugcacggcgccugcgauuucaucaagugcgaagaggacgccgagaagugcgccgaagaggguuacaauuguauauugugcaggccgcgggacgugccgccgccgcauauggugccggcggcggucacgccgaagccgcccacucccacgaagagucccgaguuggggaagaguacgagcuauuacauggacggugugugucucagcgaauucgguagcaacuugaucaaaucguuggcucucgaguaccacgggucgaggaagaaacggaaaaagauacccacugugcaggauaaggaagccgguauuauggcuacgauugaaucggugguugccggugguaauguuauuccuacuaauauggaagacagcgcuaaauuggagcuagucgacaucaaagacgaaccucaagaacuguacaaggaaggcaugauguggaccaaagaagacgguccaccacccgaaggguuuacgauaauaacgauggagaacgguuugaacgugcugcgaaggaagaggcagcgcaaucugcagaagcucgguauugggggauucgucgucaggaugagagguaucagaacaggucaggauaacgaugauguugauucguccauuggucaaagugggcucaacgccaacgauaucgucccaucgccugcggacggggacaaaccuagaaggaaaacuauucgucgaaaguugaagaguaaauuagcagaaacguuuccagccuaucuucaagaggcuuuuuucgggaaagaucuuauggauacggucgauuguaaaaaggaagaagucgauuguuauagcagcgaugaugagaaaacugacaagcauuuuaaaucgauuaauuuaucacaagacgaaauaauagcaaucguggcaucagguaaaaccgagaaauuggaaaacaauaacaaagauucgaccaaagaagucaaaccgacuguguugaaggaggaagaagaagauaauccggaggauuugaaagauguucuugcccuaccgggcgacuuacucgauaccgauuugguuaauagcauuauggaagacgaggaggaacugagcaaaacuacagcgucucuuguugcuuuagauucgaauuuacagcaugaugcggaacugacggacacuuugaguaguucaggaaauucgaaagaaaccaaagaugaauugagcgacauuuuaggcccucauuucaaccucgauuccauaucgaacauaaacagcaaggacgucgaagacauauuuaagggcguauuaacagacgagucgcaggaaucccaagaaagcaguagcuucuccuuacaaggaaauaauauguuuucgaauaauaaugcgcaacaaaacguugcccaacaccccauuauuaaucaagcggugagaccgaaaacauugccuacuguuaaucacaauuugaauuccccuguuaguuucccaccccccucaccuuaccacucggaguacagcaacaguccucaguuuaguccugcguucaccgauucguccuguucguggguaggaaguaacgaaacgccggaaaucgauaguaccaacguaacggugacgucaacguacaaucagaggucaucugauaaaaugaaagccgaugaaaguuugggcaaaagcgccacgauuucggccguuuuguaugcgaacaucaaccaucccgaauggaagaaggaguauccgaauuggcccgauagguauaagcaaauaauaaagaaauggagaacguugagucaagaacagaaagcgccguuuuugcaacacgcuagagauaacaggagucaguugaggaugaagaaagcgcagcagucacagaccgucaaggaaaccgccucgaccgccacgucccccaaugcgaccaagccuccgcaccaagccgguccagccuuagugacaacucuccaggcgguaacgcaacagccggcgggggcggccgcggcccccgcgccgcccguuucagaggaccaagaaaagaucgcccugcaacagaaauccgccagggaagccgaacaggagagacaauggaagcaauugcaggcccucaggcagcagcagacccaacaaacgcagaacauucuacacgaacagcgcguucaagcgaucgcccguguacaacgacagauaucgaccgauccagcgcagcaguucauaaacgagcaacagagcccucugcaggugaacacgccucaggaauugagcccgucaaccacgccggcucccaguccucggccauuuuugggcauuaaaucucccacguuccccguaccuucgcccguuccgccaacgggcgucagggccaacacgcccucgcaaucgccccacgauaucucccaacccagcacgcccgacgguaacgaucacuuuauccacucccccaccaauccuaaaccuaauuuccaaccuagauugcccaaugauccguucgccgcgcaacccgccacgccgcgaccgcaauucgggauggcccggccaccucugcagaauuucggcgguacgguucgcaacgagcaacaggacaucaacaucaaccgccaauugagggagcuguugcagcggcagcagguuaaaaaacuggacgaauuguugccuggaaaagcgccaccucaaagauuguggcacgcgaaugaucagcaagaggccggcgacgccucgaugacgucggcugugguccagggcgccggugcccaaggcaccgacgccaccuuccggcagccucuaccgcccgguguggugaaaccuagguuggcgauuucgucggugaauaggccgauauugggcacgguuagagucaaucaauuggaucccaggauacaaaauuuggauccgaggaugagguugauuuugcaacaucagcaacaaagacuggccaccgguauucagcagcaauucauccguuucacaucgaacgugcgaccgacgacgguggagcaguaugaacaauuguugcaacgucaggguaauaaucagaaucaaauucacgcggaggaacaacagcagggcguugcccgaauacccauagcccaggccagcguuauacaaaggccgcacguggcucaagcgguggugacgggcgccacugcuguuaccacgaguaccacagaaaguaaucccagcgaggagggaauccccgauaauguaacugccgaauuggagaaacucgaacaggaaacaggcaccaugguggagcuucaaggcguaagcgauaucuuaggagguuuggacgaugacgaugagcuuuuggccgaaaugggcgccgauuuuaacauacucgaauacgcggaucccgaauuggaggcccuaacgggcggcaaaacgaacauuuuagaccuggagcucgaagaggaaccggucaaaaaagaaaaacuagccucuaacgcgaacacuugcgcuccuucucagaaaccgacuccuaacgucgcuacuacagccauuagcaacagcaccgcugucacuacaccgaccgaagcuacugcagaaccuaaaaucgagaauacaauucaacagagcauuccgaaaucgacgccacaacagcuacaacaucccgcuucucuuccgcagcagcagaacaugccccagcacggggcccaaguucaagugcaaucgcaacaaucccagccgcauccgccgcagcaaaugcccauccaaucgacgcugcauauccagcaaauucaccagcaaauggugcaucaaguucagcaagccgccgcacaaggaagacccaugccaccggguucgaagaugcaaaccaccgauggauucguugguguugugauggcgaacaacgccguacaauuacagauaccuccgaauuaucaacaacgguugcugcuguugcaacaacugcaaaaucaaaaauugaugcgagugggaagcacgcagcccagggccgcuuugcaaguggcccccaaucaaaugcccguagguaugaauccgggagccaggaugccggugucggcgccgccgccgccuccgccgccuuaucccgggccgccgccgcccuauccgggcaacgcgaaucaacaucaacagacgggauugagaauggggccuggucuucucccaaugggacauuuucaucccaguacacugcaggguuuucccaugcauccacacuugcagcggagaccucuucuccuggaggagcaaccgcugcuguuggaagaucugcucgagcaggagaaacgcgaacaggagaagcugcaaaaccaaccgcccaaccacgaagucaccucgucgaccggcaacgagacggaaucggcgcugcugagcgaccaagacuucgagcgacucaaagccgacguguuuaacagcgccccagugaguaauauaucgucuacgaaucaagggaacgccgcccaaacgucgcaagcguggccccagcugcaaaauaggcaggcggcgguaccggccgccgcuucgcagcacacgauggaagugacuacuagaguucaaauguacaauccuaauuugauaccggcgccgccgcucccgccggagaauaucgcuacggagcaggacaagcaggcgcagcuguuguacgagcaguggcugaaccaccagaacaacucgcuggugcagcaauugcgcuauuacgagaccgaagugcagaaacuucguaagaguaaaaagucgcuaaauagcaagcaacggcaauugaggaaagcugguaaccaguuaaccgacgcagaugcgacugaacuucagagaaucacagcggaacaggcuauauuacagaaacauuuggaaucgagcaggaaacaaaaucggcaacauggaauguugauacaggucuauaugaaggaauaucgaaacaagcaucccgccaucaagcagagaaccguaacggaccagauccaaucgccguugggccauccggcgucgucgcccauacaacaaucgagcgccucguugucgcccauguugucgcccuccgugucgccgaugacgcagaacagcucgccguugaacagccccgggccgauggugccuucgucgcccggccacggucccgugcagaacauuuugcaaagccccaacggcgccaacgcggcucaaaugucgcccaugcaggcguccccgaugcaaucuucgccgagaaucgguacgccucauucucaaagugaugaaagucccggaucggcgcaaucgccgucgcagguuugccugccgccgcccaugccucgaaugacgucgccucagcaccgacgagucgucaccaguccggugggaaugucgcaaaugcguuuuauaaacaacaacauguugcagcaacgcguucgcaugcaaucgcccauacagaauuuccaacagaaacccggcacgccuucgccguugaacagcccgacgucgcagcaaaugaacgucaaccaacaacaucaaauccagaaacagcugcagcagcaacaacagcagcaacagcagacguuguugcagcaaaauuuggaaggcgauccuaacgccauucacucgcagaggaccacgcaauuguugcagcaccggaauuucaucaggcaacaggugucccagcagcaaauaucgccucaaacguugacgccacaacagcaucaguugaugcugcaacagcaaaagcagcuggcgcagcagcaacaacagcagaucgcccaaaugaacgcggcgagauugcaacaacaacagcaacagcagcagcaacaacaacaacagaauaaccccccgcauucgccgaugccgcccaaaaguccuaugauuaaccagcagauaaugucgccgcauucgaugccccaaucgcccaugcagaugccgccgaagagucccauggugccguuuaaucccaaccaaacgaaucccaauucgccugcggcuagaaguccggcuuuccaucaggguaugaaccaaccgacgagucccaucacucacggccaucaaccuccgaguucuccgaugcccaggagucccaugaucaaucaaacgcacucuccgcauaacguucgaaggccucccagcgccaacagcagcccggccaugccugauaggccgcacagcguagaaaacucaucgcccaggauguacucuauagaucaauuggugcaggagaguuuggccaaucaaaaugugaacgcgcaauauaacaguuacaauucggauaugaucaacgaaagcgguggagggaauucgaauaacccgauaccuuguccaccggaaauaccgagauuucguuauuuuaagcucgguuugagaggcggagcgccgauguggagcuucggaagaggcgccaaaaggaucccagcgccuccgaacgccaaaccggacgagcccaaggcgaagaaggagucgcaucugagcaaaguuucgauacugaaaaggaaacccccgauggcuucuaucggcaaagugggcucguugguuaguucggauuacaacgauuuagacgacaguucgacaacgccucccguaacgccgccguuggcuucgaccagcagaggaagucugucgaagaagaagaaucucgaacugcaagcccaaaaggauucggugaucgucaugcacagucccgacgacaacaacaaacagcucgaaauaauggauuacgacgacgauaauaacacggugcuaucgucggaagugucguugaguucuguggcaagaaacgacgacgacuugguggagaucgaaacgauaucgcaagaccucgccgaagggcuauccagccccuuggaaucggaucaaauaggcgacgaauuccuguuguuucccggcaauauggugguggacauguccggugaagagcauuacucggaaaaagaggaagaggaaaccgucgacggggaauauacagaucagaauaugcacauagugauacgcagcccgaccaccagcgacgacgaguucauaaugccuugcaaagugaagcaguacaacgcggacgagcaggaggauaaucccgaaucgcccgaucaggaggaauucggcgaauccggcgauaugauggcgaguuucgauaacgaagacacggauauaaucauuucggaucaaaccgccggcguucccgaggacucgauuuccacgaaggaagacuucgaggagcucaucgacgaggggucgcguaaaaacaacaucagcaaacaggaggugaccgcuaaacacauucaagauuuccacagguacaccgaauuguucgauuacgguaaaccugaagcucaaccgguuaagaaaccagucgcuaaaaaguuccaaccgaaaguaucucuaguuagaggaguagcuuugcccaguaagcccaacaccgagaagaucaucaucacgcaaaauucgaacguguugaauacuucucaggcuucgaaagucaccagcaucauuuuaacccacaacgccaacguuagaaggaacauuauaagcguaccgaaaauagugaguaccguuucaccugccauaacuauagugagugccaguacaucgcaaauggccucgauauuaccauccaaauucaccgugccggucauaagcgccagcgcgguacgccagcuauccaacgucaaagucaucgacaagccuuccacuucuucauugucgauuucuaccagagacaacguccugccgaagaagauauucgaggacgauucggugucgccggacaguuccaauugcgacgaugagaaauccaaagauucguucgacgauaaggucaagucggagucgccgccgcaggaggucaaacaguucgugaaaucggauucgcagguuauaucguugaaaucgaagaacuacgccgaucaaucgaagaagaucgaacaucugcaaauagugaauauaucggcgaaggaugugguucaaaggcagaggauaccgaguccuuugauaucgaaagcuucuccaguuaucauccacaauacgccagaguugaaaaugacugcgcaaguuauucaagagagccaaacucgcaugaaaauuacgacuacuacugauaccgaacauuacgaugagucuacggaugauacgaaaucaguuguaauuucaauuccaucuccuacaccuucgcaagaacaaaugcuggauaguauagccuuucaggcguuggaaaacaggagaagagaguacgauucuauugaagacguguuagauaugauugagaauauagaaaacaucaccgccgaaccgcccgagauauuagaagaaaacacguugcaaaauuccgauuccaacagcaacaucgaaaccaaaaccgccgaaacgaaggagcugcaauugccuaccagcgaaagcgaagcgcccgcuaccaaaucguccaucguaccgcaauuaucgccucuuucccaacccacggaauugaccacgaacauggccaacgccucgcagcagcucagaacucugcugucgucgcugcaaaccacgucgacgucguccccgaccaacguggaguccauagccaagggcuucggccagaaaaucagcaccuccucgucggcuaaccagcccauagucgcuucgagggugaucggccaacaagccggcaggcaaucgcccguuaucaccagcgucucgaccguuauaguuccgaauuucaagcaaaaaaucaccgcggcuacuaccgcuaccuccagaagcagccccgugaagguggucagcaccucgcagcaauuaaccggauccauaauaaccucgacuuugaauuauauaccgaacagaacgaucgguauacaaaugguggcggaucaaucgaaacugccgccggccaguaucgugacgacgaugcagcaaaucaacucgaucacuuccagccaggagucgaagaagccuucguugacgcucacggcgaugcugcagaaccaacccgcagcgaauaugaugacuaaaucaucggcugauacuauuacagccgcuaguuugcuaggcucgcccaucagccugccgaagaccggguucaccacgucuuuggugcaagcccaaccgagcguggugcuuucuaacacgccgccaacgccuagccaaacuuccacggcgacaucuucgacuaaaaccaccgcggauucgaucacggccgcuaguuuauuggguaguucuauuaauauaguuaaaacuaguuuugcgaugcaaccgaguagcaccguaggaguggugacgagcugcgucaacaaaacgccuacuuccaccacuaauuugcuccacacgcaguugacgaaagucgugagaagcaaauccgucgaugauguuaaagaauuggucaaaaucgacgagaacaagcaaagcguuagcagcgaaaauguagacgauagcaacagcggguguaaauuaucaacgauaacuacgguagccuguaacaaaaccgaagauucgcagaacguguuacugaagaaauugcugcagaacacggcuugcgccagcgcucaauccuccccgcccgcuucuacuaguacuguuacuaccagcgcugcuaauacuaugucuaaaguagcuaauacgcaguguaguacuagcgcuagcgucgagcaaccgccgguaagcgcuccuucgaacguuacaguccaaagaagcgccagcagagacgaguuauuaucaccgccacaagacguccaaacuaugguagugauuaagaaagaaccgccgcugguaccgcugucccaaccgaguccagugcugaacucgaauuccaacgcucacacgcccgaggugaagaaagaauucaucgacgaaucgucgcagcacucugaaguauccgaucacaguagaucggacgcccccaucaaagaggaacuggaaaccauggagaacaccgccgagaagaugaugcucgacaaggaggagcugaagaagcagaagcgcaggauguaccagcagaagcgccgccagaaccagauccucaacaaggagcuggcgcagcagcagccgaagaagcggccgcgcaagaauucgaagaucgacgaggacuacgacacguacaucgacggcgugcuggcgcagcugcgccagcugccgcccaucgccgucuccgagccgguguugaaccgcaacuucggcguggugccgcuguucgggugcggcgaucucgccaagaucggcgccaaggauuacucgacgcaccugggggaguugacggggaacuacggcuacggcgagcugcccgguuucaccgauuucuacucgacgaaacccuacggggauauggauccgcugccggagaagccgccgucgucgacgcagcgcggcuucuacgaccaggaguucccgcugauuagauucgaugcggacgagcacaagaaguuugacguguuuugcagggaggauucgcccgauucgauauugagcagcucgucgcccgaauguacgcgcgaacccgaaggcaaauucgucggguugaagcucaucagcgacagcgaagaggacgaagaagaugaugccaaagacgccguuucgaaaggaagaaugucaccgguggugcccgucaucaaaccuguuccuauuagacugaaacccgccggcgaauuguacuucaaagagaaccuuaacgagaacaaggagaacaucaacagcgacucguugcacguaaugacgaaauccaaauucgacaacaagcagucaccaccgucgaacguuuccggccacguuacgguaacuuuaacucuaacaucaucugcagcugaagauauaaugggaguacugcgggauuuggccaauauucuacacauaccugcuccgacuaguuaccaaaucguggagagaacggcuucuccgccuagccagaaauugggcuuguaccgcaccaaaggcaaggacggcaaagagggggcucccaucgacauacagagcauccucaacggcgccaccaaguucugcaagcacugcgacgugaucaucuugagcaacaucaucaggcggaagguguccgauuuaccguuccucgccaaggauucggauuugcucagcgacggggaggaauuguucuuuugcaguuccgcuuguuacaugcaguucgcuuugaugcaccgcucgccuucgauauccgaagauaaggcugcugaaauuauaaaucaccuaucgcagaaagacaauuuggauucgaaacagaaauuacccgcagacgcguuagacagcaguaaaucgauagcgcagaaguugucguucaacaucaaagauacgaaacgggaauucgagccgauggagacgaacgaugcguuugcguucuucgcucguaccaccgcgaauaaacaggggaacaacuucuacgauggggcgccguucaaaucgguccccgcuagggugcacaggaacgauagguacaaacucuggacgcccggcugucuccaacccacccagaaacacaaaacgcccaccgacaaggagaucauggagcugcucuacaggaugcagaucaccguuacuccucccgucaugccggaagauacgaggaaguguuuguucugccacgguauuggugauggcguggccgacgggccggcgagacugcucaacuucgacguggacaaaugggugcaccugaacugcggccuguggucggacgguguauacgaaaccguaaacggggcuuuaaugaacgucgaaaacgcccuacaguccggguuguuggccacuugcgugcauugccaaagcaucggggccaccaucaagugcuucaagacgagaugcucgagcauauaccacuugaauugcgccgucaaagacaauugcguguucuacaaaaacaagacgguguucugcaaaguccaugcgccgaagaacgaaaaagacaacgaacucaccacacucuccgugucucgcagagucuacaucgaacgagacgagaacaaacaaguagccgccgucaugcaccauucagauucuacagauuuacugagaguaggcaguuugauauuccugagcguaggucaacugcucccgcaccaacuucagaacuuccacacgcccaaucacaucuaucccaucggcuacaagaucaucagguucuacuggagcaugaggaacuugaacaaacgcugcaaguacauuugcaccauucgagagguguccggcaaaccggaguuucgcgugauggugcaagagccccccgaagcggacguggaguucuccgauuccacaccgaaaggcgccuggcagaagauccucgacagcgucgcuaccauccgcaaagagaacaauuguuugcacauguucccgaaauucgccacaggcgaagauuuguucgguuuaacggaacccgcuauaguucgaguguuggaaagcaugccgggcaucgaaacguugucggauuauaaauucaaauacggccggaaccccuuguuggagcuaccgcucgccauaaacccuucgggcucggccaggaccgagccgaggcugaggagccaguugcauuggaagaaagcgcauacgcagagaacuacuggcgguacgucguccauucgaccgauguucgggccgucucugacgggaucuauuaguacgccagcccaaggggagcuggcuuguccuuacagcaagcaauucgugcauucgaagaguucgcaguacaagaaaaugaagcaggaauggaggaauaacguuuauuuggcgaggucgaaaauacaagggcuggguuuguacgcugcuagggauuuggagaaacacaccaugguuaucgaguauauaggggaaauuauuagauccgaacuggccgaguguagagaaaagcaauacgaagcgagaaaucgaggaauauacauguuuagauuggaugaagaacgcgugguugaugcuacuuuauguggcgguuuggcuagauauaucaaucacucgugcaauccgaauugcguggccgagaccguggaaguugauagggauauucgaauaauuauauuuuccaaacggagaauuuuacgaggagaagaguuggcauacgauuacaaauucgauauagaagacgaucagaacaaaauauccuguaugugcggagcgccgaauugucgcaaguggaugaauuaa

SEQ ID NO: 6463 - RNA, 2079 nt, Psylliodes chrysocephala
augcccaaagaucacaggucuuucagauuugaauauaaaaaaaagacaacggaaaguucucuuucuucagauucccaagauuaccaucacaaaaaaaugagaaaacauucacgagauagaaguaaagaaaaacguuuagauaaaacauauuuugaugauaaaagacgugaaaaaccaaagaaaucuaagaagaaacgauccaaacauucuucugacgauucuaguucaagcagcagcgaaaguucggauaauucaguaaaguuguuggaaaaacuuaccaaagaacgaauaagacagacggaagaaaaaaagaaagaaaaagagguacuuaaggcuacagaaacagcagaagaaaaaagauuaagaagguuaguuaaaaaagaagcaaaggaacgaagaagaaaagaaaaaauggguugggauaaugaauacuugcacuacacaaacagcgauaauccauuuggagaugguaacuugcuaaguaguuucguuuggaauaaaaaauugucuaaagaagguauuaagaacgucagucaacaagacauagaggcuagaaacagguuaaaacaggaagaaaauaagagagaacuugaaaaagugaagaaaaggagguuggaacgagaauuagaaagacaaaagagagaagaagaaacacaaauguuacaaaggaguaaagaagcugcacaauuugaagaaugggaaaggcaggaagacaaguuucauuuggaacaagcuagauuaaggucucauauaaggauacaagauggucgagcuaaaccuauagauuugcuggcaaaguauauaagugcugaagaagagguagaugcaguggagaugcaugagccauauacauaccucaauggguuacaaauuaaagaccuagaagaucuaguugaggauauuaaaguguacaaagaauuagaaagggguaaaaauuuggauuauuggaaugauauaacagucauaguugaagaugagcuacaaaaauugagaaaaauagagaagcaaaacgauuuugauuuaggauuaaauagaagagaagguauacaucagucaguugcuacugauguuacaucaguguucaaaggaaaaacugcugcucaacuagcagcuuuagaaaagcacauugaaaguaaaauuaguggcaaagcugauggaauagauauaggcuacugggaaucuuuauugucccaacuaaaagcccacauggcgagagcaagauuacgagauaggcaucaagaaaguuuaagaagaaaauuacaaguuuuaaaagcagaacaagcuauuacagcccccagugaaagucaguccagugacuccgaggagccaauuucugaacaaaaugaacccaaaccugguacuucucaagaugcucauaauucagcugaagacaguaaugaggcaacugaagacacugcuaauauuuggauaaaugaauguuuuucagcguaccaagcagguggauacaguccaaaauuuuuaacugcugauguuauugagccugguacaauuauugucacagaagaggaugauguuaagagauuagaauuugcuagaauucaggugguuggacaaggagcuaaaguugaaaauguuauaacaaaggaagaauuguuguuacaaaaggaagcuaggaaagguauggaugcugaugaagcucaguuuucuguugaacaagcuuuggacagucaaguguaucuuuggucugauaaauaccguccacggaaaccuagauacuuuaauaggguacauacugguuuugaauggaacaaauacaaucaaacucauuaugauauggauaauccaccaccaaagauagugcaggguuacaaauuuaauauauuuuauccagauuuaauagacaaaaguaguaccccagaauauuaucuaacaccauguccagaaaauaaagaauuugccauuuuaagauuccaugcuggcccaccuuaugaagacauugcuuuuaaaauuguuaauagagaaugggaauauuccuauaaaagaggauuuaggugucaauuucauaauaacaucuuucaauuaugguuccacuucaagagauacagauauagaagauaa

SEQ ID NO: 6464 - RNA, 1278 nt, Psylliodes chrysocephala
auggacaaccuagaagcaaauauuauggacaaguccaugagaucaguuuucguggguaauauuccuuaugaagcuacagaggagaaauuaaaagauauauuuggggaagucggucaaguauuaucuuuuaagcuuguuuuugaucgcgagacagguaaaccaaaagguuauggauuuugugaauauagagaucaagaaaccgccuugagugcgaugagaaaucuaaauggcuacgaaauuggcggcagaaaccuaagaguagauaaugcuuguacagaaaaaucucgaauggaaaugcaaaauuugcuuaaucaaccuccaguagaaaacccuuauggagagccuauucaagcugagaaagcuccugaagcuauuagcaaggcuguagcuucucugccaccagaacaaauguuugaguugaugaagcaaaugaaaacuacaauacagaacaacccaacagaagcaaggcaaauguuacuucaaaauccacaauuagcuuaugcucuuuugcaggcucaaguaguuaugaaaauaauugauccccauacagcagcuacauuauuacauccuguaaaucaaguuccugcaacuuuaaugccuggugauaagaauguuccagugcaaguaccaauuaauaaccaauauagggaacccccagcaccuguucaaccaccuagacaagaauuccagccugugccuccaccuauuaugauucccaaccauguucaaccaccuguuuuuacugggcaagauguugacuuaaggucccugggaaccgccccagauccaagacucgggccuguggugagggaccaagauaugagacaaauuccaggcccuauucaaaaucccuuaccgccuaccauuggagaaagcuuugcaagggauccacgaggcauaacugcuuuucccaccgauccaagacaaacgcguauggacccucgucaaaaaaauuugguuccuccauuaacucaaggaccuguaccaacuccagcuccaagaccggucccaauugucccucaaccuguaccaguagucagaccggcaccuguaacaacuacacccgguccagugacuccuacgccugcagcugccagucccauaguaggaacggcuggagcgucagaccaggaaaaggcugcucuuauaaugcaaguauuacagcugucggaugaacagauagcaaugcuuccaccagaacagagaaauaguauuuugguauugaaggaccaaauagcaaaaagugcacauucucguggcuccuuuuucuuuuuuuaa

SEQ ID NO: 6465 - RNA, 1179 nt, Psylliodes chrysocephala
augacucaaauagaugcagaucgugaaaaaagucuccaagaguacagaaagaaauuacuggaacacaaagaaguggaauccagguuaaaagaaaugcgagagcagcugaaggaucuaacaaaacaauaugauaaaucagaaaaugaccugaaagcauugcagaguaugggacaaauuguuggagaagucuuaaaacaacuuacagaagaaaaauuuaucgucaaagcuacuaaugguccacguuauguuguugguugucgucggcaauuggauaaaacaaaauuaaaggcaggaacaagaguagcucuagauaugaccacuuuaacuauaaugagguacuugccaagagaaguugaccccuugguuuacaacaugagccaugaagauccuggugauguaacuuauucugcuauugguggucuuucugaacaaauuagagaacuccgagaaguuauugaauuaccauuaaugaacccggaguuauuuaugagaguuggaauuacaccuccaaaagguuguuugcuuuauggaccaccagguacaggaaaaacuuuguuggcaagagcuguggcuucacaacuugaugcaaauuucuugaaaguuguaucuagugcuauuguugacaaauauauuggagagucugccagacuuaucagagaaauguucaacuaugcuaaagaucaucaaccuugcauuauuuuuauggaugaaauugaugcuauagguggucgcagguuuucagaagguacaucagcagacagagaaauucagagaacucucauggaauugcuuaaucaaauggauggauuugacucuuuaggacaaguaaaaaugauaauggccaccaacagaccugacacauuagauccugcuuuacuccguccaggccguuuggauagaaaaauugaaaucccucuaccaaaugaacaggcccgucuugaaauucucaaaauccaugccuucccuauugccaaacauggggaaauugauuaugaggcaauuguuaaacuaucugauacuuucaauggugcagauuuaaggaauguuuguaccgaagcaggacuuuuugcaaucaggucagagagggaauauguuauucaagaagacuucaugaaggcuguaagaaaaguugcagauaauaagaaacuugaaaguaaauuagauuauaaaccuguguaa

SEQ ID NO: 6466 - RNA, 393 nt, Psylliodes chrysocephala
uucggccacacuuucacauuucguguacgaccacacaaccccauucguaguucuucgcgccuucgcgacgccuucaucaugucucgucgcuacgauucaagaacaaccaucuucucgccugagggccgacucuaccagguugaauaugcgcucgaggcuauuucccaugccgguaccgccauugguauccuugccaaggacggcaucguccuugcugccgaacgcaaggucacauccaagcuccucgagcaagacaccucugccgaaaagcucuacguccucaacgauaacaugaucugcgccgucgcugguaugacagccgaugccaacauccucaucaacuacgcccgccaagccgcucagcgauaccucuugaccuacaacgaagacauu

SEQ ID NO: 6467 - RNA, 2673 nt, Psylliodes chrysocephala
augagcgaaacaaaagccgagccagucaagguggaaguaaaggcaaaugguaaaaaugaugacaaaaacaaaaaugaauugucugaugaagacaaacaacugcaagaagaacuaaacuuguguguugaaaaacuacuggaaaacgauaccaaacuuuacuuaccagcucugcaagcuuuggcaaaucacauucgagcuucuacuacuucaaugacuucaguucccaaaccuuugaaauucaugaagccucauuaugauaccaugaaacaaauucaugaaaaaauuacugaugccccugucaaaaaaguuugugccgauauuauuucuguauuggcuaugacuaugggagaaggcagagacugucuuaaguauagauugcugucugauuuagacaaaauuggagaauggggacaugaauauguuaggcauuuggcuggggaaauugcaggagaaugggcagaaacugauuuuauaauaaacacugaaguuagagauaagcuuauuuuguuaacuaagcaaauuguacccuacaauauggcucauaaugcagaggcagaagcuugugaucuuuugauggagauugagagacuugauuuacuugaacaauauguugaugaaaauauauauucuagaguuugcuuauaucuuacaaguuguguaccuuauguagcagauccagaaaacacuacuuuacuucagacugcacuaauguuauucagaaaauuuaaacagcauccucaagcucuuagauuagccaugcaacuaaaugaucacagucuuauagaagaaauauuugugaauuguccagacacugauauucaaaagcaguuggcauucauguuagggaggcaacaaauuuauauugaaauuccagaaagcacuccagaauaugaagaccucauagaaauaauggccaacugucaucugaacaaccacuuccuaaaucucgcccgugaauuggauaucauggauccaaaaacuccugaagauguguacaagucacauuuagaaaacagccgucccccauuuggggguagucaaguugacucugccagacaaaacuuagcugcaagcuuuguaaaugguuuugugaaugcugcuuuuggccaggauaagcucuugauggaagaugguaauaaaugguuguacaaaaacaaagaacauggaaugcucagcgcaacugcuucauugggauugguauuacugugggauguagaugguggucuuacccccauugauaaauauuuguacucuucugaagaucacaucaaaucuggagcucuguuagcaugugguaucguaaauugugguguuaggaaugaaugugacccagcacuagcucuguugagugauuaugugcuacauaauacaaacaucaugaggauaggcgcuauaguaggacugggauuggcuuauguagguuccaauagagaagcaguuuuaagcuugcuaacuccagucuucucugauccuaaauccaacauggaagucauuggaaugucugcucuggcauguggaaugauagcagucgguucuggaaauccucaaguuaccacuaccauuaugcaaacuuuaauggaaaagucugaaucugaauuaaaagacacauaugccagauuuuuaccccuaggacuugguuuaugccacuuggguaaacaagaaggcauugauaccauaauugcagcucuggaaguuaucccagagccauuuaaguccauggcaaccacaaugguugauauuugugcuuaugcugguacugguaauguacuaaaagugcaacaucuacuccauauuugcucugaacacuaugauggagcugacagcucagacaagaguucaaaagauaaggauaaaaaagaaauuacugaaaaagaaaaagaucucucuucaagacaagcuguagcuguucuugguauagcucuaaucaguaugggugaagauauagguagugagauggcuuuccgcaccuuuggacaucuacuucgguacugugaaccaguaauacgucgugcaguaccucuggcucuaggucucauuucaguaucaaauccuaaauugagcauucuggacaccuugaguaaguuuucucacgauagcgaugcugaaguagcucauaacgcuauuuucgccaugggauuaguuggagcugguacuaauaaugcuagauuagcugcaauguugaggcagcuggcacaguaccaugcuaaggauccuaauaacuuguuuaugguacgcaucgcacaaggucuuacacauuuagguaaagguacauuaacuuuaaguccuuaccacagugauaggcagcugaugaguccaguggcuguugcuggcuuaauggcuacucuuauuggauuuuuagauguaaaaaauauaauuuugggaagaucccauuaucuuuuauacacauuagcagcugccaugcaacccagaaugcuuguaacauuugaugaagacuugaacccuuugccaguaccuguaagaguggguuuggcuguggauguaguuggacaagcaggaaaaccgaaaacaauuacagguuuucaaacgcauacaacuccaguauuguuagcauauggagaaagggcugagcucgccacugaagaauauauagcacuuacacccaucauggaagguuuuguuauauuaagaaaaaacccugauuuuaauacuuaa

SEQ ID NO: 6468 - RNA, 1521 nt, Psylliodes chrysocephala
augacugauagcaaaauggaaccaaaagaagaacaacaaccuucgcccgaagaaauaaaaccaaaaguagccgcucuugaaacggauccacagccaacccaaaacaacggaacaggcguuauuagaagaaacuucauuacuccggcuggaacuaucauugaaucaaacgaagaacaaccuccugaaccgacugccgaagaaauuguuaaaacaucagcguccacaccaaguccugucgaacaaaaaguugaacguacagaaacaacuacguauucagaaauauuaacgcaggagcaacgggaacaauuuccagauaccaaaccguacgccauagagaugccagcugagaauuucgaaaaucagaauuucgcacaagacauuaguuacacaacugugaauauugaaggaaacguuguaccgguaacucucucagaaaucgaacauccuggagauuaugccaaccuucagacugcgcaauauaauaacgguuacgcugaugguucucaauaccuagcucaacaucaguaucaaaauuuguucauaaacagaaacgauguugauaauucuucucccacggcgguuuuauacagaggcgaucccaauuuagcagauucuagauaccaaguaaacuuugaaguauccaguacucaaccccaagugaacauccucccuucuuccggagauuccuacaccuacaccaccccaggaaguuggaaugcuaguagcagugguucuuaucaacaacaauaucccggaaacauaaauguucuucaucaagccgacaguacucagucguacucugcuggacaauacgcaaacuccacuuggucaucuaacacgauggaggauggacggccaucuagucaagagguacuagugaaagagugcguuaauuguggcgcuagcguuacaccucuuuggcguagagacgguaccgggcauuaucuauguaacgcgugugguuuauaccacaaaauuaaugggguucacagaccgccgauuagaccaaccaaaaaaccacaggcgacuggaaauaggcgaaacggaguaucgugugcuaacugcaaaacuaauaauacuacccuuuggagaagaaauaaccaaggugaaccuguuuguaacgcuuguggacuauacuucaaauuacauaauguuaacagaccgaucaguaugaaaaaagaagguauccaaacacgcaagaggagaccaaaaagcucuuccgcuggaaauuccggaaaccccggucaaaugagaauuggucuuccucaguaucaguuucaacauacucaagacauagaaauaccccaagaucaguaccagguaccgaugagcguuuaccaacaaccacaaccugcguauagacaauuugcaacagacagucaccgauuaaaugcccaaccuuugcagccuauaagcgccgaagacgagcaagccagugucaucacuucaacgucacagcaagcaagauuuaggacagacguggaagacgaggacggaaguaauccaucaaugcaaacuuag

SEQ ID NO: 6469 - RNA, 4866 nt, Psylliodes chrysocephala
auggcacuuccagggaacgggauuuuugucgucaaaggcgaaauaucaaacuugcuggcggcuaugaaaaggggcacaagauggucaucacauucuuaucaagacgaugauguagaugcccuauuaagaaacuuccaagaguuaagagauauuuuagauaauguagacgacuugagauucguagaaccuaacacguuuuuagcuccuuuuuugaaugucauaaggucugaagagacuacagggccuguaaccaguuuggcacuaucugcaguaaauaaguuuuugucauauggucucuuagaccccguacacgccucuaucccacaaaccauucacagcauagcugacgcaguuacccaugcccgauucgugggcaccgaccagucauccgacgggguagucuugaugcgcauuuuacaaguccuuagaacucugacccuauccccggaaggugccacccuaaccaaugaaagccuuugcgaaauaaugcugucauguuuccggauaugcuucgaaacaagacuggccgaucuucuacgaaaaacugccgaacacuaucucaaagacauggugcaauuaauauucaugagacugccccaauucucugaagaucugaagguuuccuacaucaagcaacucaaaaugaaaccgggagcucuagaccaaacucgaacaaaaagaaaaaaguauuauccgaaaaaagagaguaaagaauuagaaacuccaccaccgcaagaaauuauuguucaaaaucccgcacaaaccggcauaguagauaugcaaggagcaauucuacaaaauaacgauaguaccaccacuacuaacucuguuaauauuccuucuaguccaacucaacgugauaacgauauaaccauagauauaccuacagacgaaaguuugaaaaacucagaaacuacaucgagcuuagaagauaguauggaagugaaaccuguuguggaagaaccuaaaucugaagaauccgaagagcaguaccaucaaacucaagauuaugugaaucggagagguauacgguucacuccucaacuacaacaagaagugaaucuaucgcccuacggucuagcuugcguaagggaacuucuaagguuucugauuagccuuuguaacccuuuggauaagcaaaauaccgauauaaugaugcauuugggccucacucuacuuacaguggcuuuugaaauaagugcugauaauauaggaaaauacagcacauuguuggcguuaguuaaagaugauuuguguagaaauuuauucgcauugaugaacaccgaaagacuaacaauauucgcagcugaucuacaaguaucuuuuuuacuauucgaaucguuaagaacgcauuugaaguaccaauuagaacauuauuuaaagaaauuaauagagauuauuuuaaacgauucuaauaaagugaccuacgaacauaaagagaucgcuuuagacaaucuucuucaauuauggaggauaccgggauuccacacugaacuguacgugaauuaugauugcgacauguacugcgcaaauuuguacgaagaacugaccaaauuauuagcuaaacauucgauuucuucgacuuccggaguauaucacacccacuugcuuucucuggaugcucuguugauuauagcugaagguaucgagaauagauguugcgaggaaaaggguaggauagaaucggaggauaaugaugaaauaacgaaugauauuagcuauuuuauagggaagaguucuaggauaaagauuucggaaaaugugcccaaaaaggaggagcuggcugccaagaagucgaucaaaaaauggcugccgcaaggcacugaauauuuuaaucaaaagccgaaaaagggcauacaauuucuucaagagcacggcguuuugaagcacgagcuggacgucgaugaaguuucgagauuuuuaagagaaaaucccgcuuuaaacaaaggcaugauuggagaauauguuaguaacagaagcaauuuaaaaauacuggaugcuuuugucaaaacuuuuaguuuuaccggaguacgaaucgaugaagcuuuaaggacguuuuuagaaucuuuuagguuaccaggugaagcgccgacgauuucucuaauucuagagcacuucgccgagcauuggcacaagagcaauggugaaccuuuugccgauguugauucggcuuucacacuggcuuacgccauuauuauguugaauguggaccaacacaacgaaaaugccaaaaagcagaccguuccaaugaccccuacugcuuucaagaagaaucugaaagguguuaauggagguaacgauuuugaagaagaaaugcuagacgaaaucuacacaacaaucaaaaacgaagaaaucguaaugcccgcggaacacacgggcuuggucagagaaaauuaucuguggaaaauucucuugcgcaaaggacaaacgaaggaugguuguuauauacacgacaauagcggcacuuaugauucagaguuguuccaaauuguuuacggaccuaucguggcugcauuaucuucugucuacgaaaaaucagagaacgagaguguucauaaaaaagucaugcaagguuucgaacgcugcgcuuucauagcugcaaaccucaacaugaccaaaaacuuggacauguugauacucagcauauccaaauucaccaucuucuacaaccaacaaaagcaaaacaccaucgucguucaauucggcgccaacgccaaagcucaauuagccuuaaaaucggucuuuucucucauccaccagcacggcaacacgaugcgagaaggauggaagcauuuauucgaccuccuguuggccuuguauaguaacggguugcugucgaaaacuuucgucgaagucgaggacuucaucgaacccagcgggaagcucaaucugguauacaaagaagcucccgcggccgccaagcaggauacaggauuguugagcucuuuguacuccuacaugguguccgccgagaaucuaucgaaaaugccuacgccugaagaacagaacuacaucgaagcggcgaaagaaugcaucaaggauugcaacuuggagcagaugaucagcgauucgaaguucuugcacgaagaggccuuguucgaguuggugaagucgcuaauugaacugucaaggggaccagaugugcaagaaagcuuggcguaugauuacaacgagaacgugacgauuuucuuuuuggagguguuaaucaaagugguuauacaaaacagggaucgagucaugacgauuuggaacaacguuagagaucauauuuauacguuggugaugaacgcgucauuguucgauuaucaguucuuguuggagcgaucuguuauagguuuauuacgaaucgccauccgguugaugcgaaacgaagaaaugagccacauuguccuacaauccuuaaggaugcuucuccuauuaaaaucuagcacacuuuccaggauaucucgucaaauaucguucgguuuauacgaacuacuaaaaacguccgcccaaaauauacacaccaacacggacuggaccauuauuuuuacgcuucucgaaugcguuggagcuggcgcccaaccuccgaaaccaguaacuucugcugaagauacugacuuaaaaucgaaaucugacggcgaaacuucggaucaucaugaagaagaaggugcguuaucugauucggagcuuacgaaaaguccgaaacgcggcguucaaaggccucagagucccguuacagucguuacaucgcccgucgguacucccaauacaggugguuggauucucgucggcaacgaaggcgaaauccaaccggucaugggccgaaccgucccgccgacucaauacggcuugucucuugaaaagaaccucggcagccacgauccgcgaagcaugaugaaaugcugcgagagccucgcguuccuuguacgcgacguggcccacaucacuccauacaauuucgacgugugcguucacugcauacgaaccuucgucgaggccagucugcacggcaccagccucagacgaaccagaucgagaaaaaaguccucggacaggcaccggacgagaaagagcccugccagcaguccugaugaggacgacagugaugacgacgacauuccaagcggcuaccaucaaauauccauacaauuauuagauuugaugcacacgcugcauacacgaacggcgcagauuuuuaaauggugggccgaagagggcggcgaaauaucgcaagagacgucgcuguggacucaaggcuggugcccgcuguuacaagggaucgcgcgauugugcugugauaccagaagacccgugcggaugagcgcuauaacguaccugcagagagcguugcuggugcacgaucuucaaacauugagcgggcccgaaugggagcaauguuuccagagaguuuuauucccgcuuuuaaguuaccuacuacaaucgaucaguccuaaagacgccaucgccauggaggaaacuagaauaagagcggcaacggugcuaucgaaaguauuuuuacaucaccucaccccacugcuagcguugccgaguuuuuucaaucuuugguuggucguucuggacuuuauggacaaauauaugcaugcggauaggagcgaacucuuauacgaagcuauuccggaaagucugaagaacaugcugcuaguaauggacucggcuagaguguuugauggucccgacgguaaaaaugugcuuuggaaugcgacuugggaucgaauagggaaauuuuuaccgacgaugaaagacgauuuguucaaggaaaucgaagaucaaauucgaaaaaacgaggaaguggcggugaguguugauguaguugugaauaaggaugaaagucagaugaaugcggaaaaacuuauugccuguuaa

SEQ ID NO: 6470 - RNA, 618 nt, Psylliodes chrysocephala
augucgauucuagccuacaauggaggcgccauggucgcuaugaagggcgaaaacugcguagcuauagccgccgaucgucgauucggcauccaagcucaaaccguagcaacaaauuucgaaaaaguauucgaaaugggcccacaucuauucgucggccuacccgguuuagcuacagacacccaaaccguaauggaaaaguuacgauuucguaaaaaucuuuacgaacucaaagaaaacagacguauuucaccaaaaguauuugcugcaaugauuucaaauauguuauacgaaaagagguuuggccccuuuuucgucgaaccgguaguugcaggauuaaugccuggaacuuuugagccuuauauauguaauauggaucuuauugguuguauuaaucaaccuacugauuuuguuguuggugguacugcuuccgcacaauuguaugguaugugcgaagcacuaugggaaccuaauuugggaccugacgauuuguuugagacuauaucgcaagcgcugaugaaugcuuucgauagagaugcuauuucugguuggggagcuacaguuuauauaauugaaaaggacaaggugacuguuaaaaacuugaagacucguauggauuag

SEQ ID NO: 6471 - RNA, 2808 nt, Psylliodes chrysocephala
auggaucagaaaccugcguuagauuuagugauauccgcaguuucagcucuguauaacaauccuaacagaggcgagaaagaaagagcaucccaauggcuuuuagaacuucaaaaauccguccacgcuuggacaguagcagacgagcuacuucauaugaaaagagaucuagagucuugcuauuuugcagcucagaccaugagaacgaaaauucaccaaucuuuccaugaauuaccacaagaaguucauacaucucuaagagauucuuuguuagaacauauuggucaaauaaaugaagcuaccagcacagcuauugugacacaauuguguguugcauuagcagaucuagcauugcagaugccuagcuggcagaaagcuacucuagauuuaauaaauagguuuucucagacuaauauuuggccuuuauuagaaauucugacuguuuuaccagaggaauuggaaaguagaucuguaaggcuaggugaaaauaggcgaauugagguauuagaagacaugaaauuuugcgcccccacugucaacgaauucuugaaacauugcuccaaucuuuacggcacaaauuggcaagagcacguucaggucaauguaaaaauauugcguuguuucacaucuuggguauccguaggugccauaagucugaacgaucuugcaaauaacguaguaaucaauagggcauuugaaauacugaacuuuaagccucaaaaugacaaacauaccauaucaggugccuuccacgaggcugcuacagacuguauaugcaccuuauuguuauguuuagaagauaacaauaaucaacuagguuuagaaaguuaucuuuuuaauaauauaauuaauuuggauguaccuuaucacuugucagucgccaacgaagaucaaggaaaaucuauggacuauuguagguuauucacagaauuagcagaaucauuuuuggaaaagauuaucaacaauaguaacacggaacagaugcauuaugcuacuaaaauuuuggauuucguuuuaauguguguugggcaucaugauuaugagguugccgaaauaacuuuuaaucugugguauguccuaagcgaagaauuauaucaaaaaaacaacaaagaauugacagaacuuuucaggccuuacguggaaaggcugguaaccgcauuaugcaggcauugucaaauggaaccugacagcgaaggccuacuagaagaaggagaugaauucagagacuuuagguuaaagguaucugacuugauaaaagacguuguauuuauagugggaaguagcagcuguuucagacagauguuuaugaguuuacaagcaccuggagucacgugggacuccagugaagcugcucuauuuauuaugcaagcaguggcaaaaaacguuuuaccaucagaaaaugaaguuguuccgaaggugguagaagcaauauugaacgucccggaaaacacucacguagcaguaaaauacacauccguucugcuauugggugaacuuugcgaauggauagaaaaacauccgaauacuuuggauccaauuuuaaauuuuuuaguuuguuguuugccucaacacgguguaggcgccgccucugccgucgcucuccagaauaucugcgccaguuguagugagcacaugccgcgccauguaccgauccuuuuacagcuccuccaccaaucggaaacguuugcgauaagcaacaccgccacgaucggucugcugaaaggcguggcuucuauaaucggaaggaugccucacggcgauaugacggcggcgcuacgagaauuguguuccaugcaacucaauccgaucugucaacucaucgaacaagacgucacuccgcucaaagguucuaaaacugaucccgugacuugguuggauagacuuaguucggugcugagguacauuaacguuaauguacaugagggcgaauuaaauccaugcaaaccugucauacuggaaguguggccaguacugucgcgaguauuugacaaauaccaaagugacauuaggauaauggagagauguugccgugcagugcguuucaugcugaggugcgugucucaacaaguucgggaacuuuuagauucgcucguaggacaaauagugcgcauuuauagucuauauaaacauucuugcuuccuauacguaggaagcauuuuaguagacgaauaugcaacggacgcgcauugcguccaaggacuuuuggacauguuacaagcauuuuuagagcccaccuuccauuuguugcaagaggagaauggucucaggaaccauccugauaccgucgaugacuuuuuuagguugugcgcgcgguucaugcagagggcgccaguugcuuucuugaagugcgcgucucugguacacauuuugcaaugugcacuguuggcaucgacuuuggaccacaaggaagccaauaugucugugaugaaguucuuuuaugaucuggucaaucaaggacagagcgguagagccgauccugauuaugaaacaaggaaaauguugguucgaaguauauuggacgaauacggucagcaguuagucucaaaucucauccauucuuguguguucuaccuucauuccuauauguugagcgaagugggagaugucuuuguucaacugcuagauuucgauagagagucgacuaguaaaugguuggcggccgguauagaaugcuugccgaaacacagcaacggugguauuguagccgcuacaccucaacaacucacggauauacacauugccauaacuagaucgaauacuuccaagucuguaacgcaugcucugaaagaucuaacgagguuauaucguuaa

SEQ ID NO: 6472 - RNA, 1509 nt, Psylliodes chrysocephala
auggcgcaaagguuucccguacccguaguaaaucaagguccuggcgguccgccuccgccucaaagauaucaacagcagccuccaaaucaaggaaugaggcaguaugggcaacaaaacuuuccacccagaccuggauauaauccuccaccuccaaauaugcaaucaaguggugguacaaugauccaaagaccuccugggaccccauauucuccuaugcguggaggaccuaugcccccacaacaaggaaguaaaagacccacagauaacaggaaccccuuacaacaaaaaacuaaugaauauccucauggaacgagcaagaaaaagaagaaauuagcggacaaaauuuuaccccaaaaaguaagagauuuaguuccagaaagucaggcauauauggauuuguuggcauuugaaagaaaacuugauucaacaauuaugagaaaaagacuagauauucaagaagcauuaaaacguccaaugaaacaaaaacgaaagcuaagaauuuuuauuucuaauacauucuauccugcuaaagaaccucaacccgaggggccagaagggccuugucaggaagguucuguagcaucuugggaacuuagaguagaagguagacuuuuagaagauucuaaaaaugauccaaauaaaguuaaacguaaauuuucaucuuucuuuaagucuuugguaauugaacuugauaaggaacucuauggaccugauaaucauuuaguagaauggcauagaacauugacuacacaagaaacagauggcuuucagguaaagagaccuggugauaaaaauguccgcuguacaauccuguuacuacuugauuaucaaccacuacaguuuaaacuugauccuagacuggcucgucuucuuggugugcauacacagacuaggccagucaucauuucagcuuuauggcaguauauuaaaacacaucgccuucaggauucucaugaacgugaauauauuguaugugauaaauauuuagaacaaauuuucaauuguacucguaugaaauuugcugaaauuccacaacguuugaauccauuauuacacccaccagauccaauuguuauaaaucaugucauaucuguagaaggaggugcugaaaguaaacaaacugcauguuaugauauugacguugaaguagaugauacccugaaaacucaaaugaauaauuucuuauuaaguacugccagucaacaagaaauucaaggucuggaugcaaaaauucaugaaacuguagauacuaucaaccaguuaaaaacgaacagggaauuuuuccuuaguuuugcuaaggauccacaacaguuuauccauaaauggaucguuucucaaaccagagaucuuaaaacaaugacugauguuguuggaaauccagaagaagagagaagaucugacuuuuuuuaucaaccaugggcgcaagaagcuguuugcagauauuucuacacaaaaguucaacagaaaagggcagaauuggaacaagcucuugguauucguaauaauuaa

SEQ ID NO: 6473 - RNA, 435 nt, Psylliodes chrysocephala
augcccaaaguacgaagaagcaaaaaaccucccccggaaggaugggaacuuauugaaccaacuuuagacgagcuugagcaaaaaaugagagaagcugaaacagaaucucaugaagguaaaagaaaaaaugaaucguuguggcccaucuuuaaaauucaccaccaaaaaucaagauauauuuuugaucuguuuuauagaagaaaagcaauuagucgugaacucuaugaauauuguuuaguggaaaauauugcugacaaaaauuugauagccaaguggaagaagcaaggcuaugaaagccuuuguugcuuaagguguauucaaacaagagauacuaauuuuggaacaaauugcauuugucguguaccuaaagcaaaauuggaagaaggcagaauuguagaauguguacacugugguuguagagguuguucugguuag

SEQ ID NO: 6474 - RNA, 885 nt, Psylliodes chrysocephala
augccugcagcuacuuuagguagcauuucacauccuaauaaugaagauuguggcauucgagacguaugggcucauaauuuagaagacgaauuccgaacuauaaggcaaauaguucagaaauaucaauauguugcaauggacaccgaauucccaggcguuguggcaaggcccauaggagaguuuagaaguucugcugauuaccaauaccaaaugcuaaggugcaauguagacuuauugaggauaauucaacuaggccuuacauuuuuggaugacaacggaaagacaccugguggggcuuauacuacauggcaguucaauuuuaaauuuaaucuccaggaagacauguaugcacaagacaguauugacuugcugcaaaauucaggaauucaauucaagaagcaugaggaugaggguauagaaccucuagaauuugcggaauugcugaugucuucugguauuguucuuauggaaaauauaaaaugguugucuuuucauucuggcuacgauuuuggauaucuuauaaaacuauugacugacaacaaccuuccacaagaugaaacugaguuuuucgauuuauuaaaauuauauuuucccacaauauaugauguuaaauaucuaaugaaaucauguaaaaauuuaaaagguggucuucaagaaguagcugaacaacucgaauuagaaaggauuggaccacagcaucaggcaggaucugauucacuuuuaacaggaauggcauuuuuuaaaaugaaagagauguuuuuugaagauacgaucgaugauuccaaauuuuccggccaccuauauggacucggaacaucuuucacggugaacggcaccacaaacaacuaugcaaacgauaauggcgacacgacaaacucuucauga

SEQ ID NO: 6475 - RNA, 1212 nt, Psylliodes chrysocephala
auggaagcagcucaaaaaaggggugcuucgguauuugaggaucucucaaauguagaauucgaaaccagugaagauguggaaguuauugaaaaguucaaaaacaugaaucugaaggaagaauugcuucguggaauuuuugcauaugguuuugaaaagccuucagcuauucaacaaagggcuauuaagccuauuaugaagggcagagauguuaucgcccaagcacagucgggaacugguaaaacugcuacuuuuucaauaucaauuuugcaagcccuugauuugacgaugagagaaacacaaguauugugcuuaucuccaacaagagaauuggcuguucagauucagaaaguuauacuagcuuuaggugacuuuaugaauguacaaugucaugcauguauugguggaacaaaucuuggagaggauauaaggaaacuugauuauggacaacauguuguuaguggaacaccaggaagaguauaugacaugauucgaagaagagcccuuaggacaagaucaguaaaaaugcugguucuagaugaagcugaugaaauguuaaauaaggguuucaaagaacaaaucuaugauguauacagauuucuuccuccuuccacacaagucguucuuauaucagcuacuuugccccaugaaauuuuggaaauuacaucaaaguuuaugacugaucccaucagaaucuuggucaaacgugaugaauugacacuagaaggcaucaaacaauucuucguggcaguagagagagaagaauggaaauuugacacccucugugaucuuuaugauacauugacaauuacucaagccguuauuuucuguaauaccaaaagaaagguagauugguuaacugaaaaaaugagagaaaacaacuucacugucagcucaaugcauggugacaugccucaaaaagaaagagacaauaucaugaaagaguucagaucagggcaaagcagaguauuaauuacuacagauguuugggcaagagggauagauguacaacaaguuucauuaguuauuaauuaugauuuaccaaacaaucgugaauuauauauucaucguauugguagaucugguagauuugguaggaaagguguugccaucaauuuuguuaaaucugaugauauuaggauuuugagagauauugaacaauauuauucuacucaaauagaugaaaugccuaugaauguugcugaucuaauuuaa

SEQ ID NO: 6476 - RNA, 1683 nt, Psylliodes chrysocephala
augacugcuccugcugccgguggagaugccagagguagaacucuugcuuacaaagauaaaaguaaacccgccgauguccgaacuaguaauauuaacgccgcaaaagcuguuugcgaugcuauucguacaagucuuggacccaggggaauggauaaaaugauacaagcugguaacggugaagugacaauaacaaacgauggagcuacuauuuuaaagcaaaucaauguuauacauccugcugcuaaaauguuggucgaacuuucaagagcucaagacauugaagcuggugacgguaccaccucagucguaguaauugccggugcccuuuuggacgcugcugaaaaauuguugcacagaggaauccacccaacugccauuucagaaucuuuccaaagagcagcucuuuuagcaguagaaauauugaaugguauuucuacaccaauagaaauuacaaauagggaauuguuaaucaaaagugcuucuacuuccuuaaauucuaaaguuguaucacagcauucuagucuauugggaccguuggcuguugaugcaguacucaaaauuguugaaccaggccacgaagaagcuugcaacuuagaagacauaaaaguaaucaaacaauuaggaggaacggucgaagacaccgaauuaguugaaggaaucgucuucucgcaaagauccgcaaacguaucuggcccaaaaagaaucgaaaaggccaaaaucgguuugauacaauucugcauuucaccaccaaaaaccgacauggaccauaacgucauaauauccgauuacgccgcgauggauagaguuuugaaagaggagagagcuuacauuuugaauauagucaagcagauuaagaaagcuggauguaauguucuuuugguucaaaagucaauucucagagacgccguuucagaucuagcccuccacuuuuuggacaaaaucaaaugcauggucgucaaggauaucgaacgggaggacaucgaauucguaugcaaaucuuuggguugucgccccaucgcuucuuuggaucauuuuacgaccgaaaauuuggucggcgccgauuuagucgaagagguaggcguaggcgguaacagaaugguuaaaauuacaggugcucagaacgcgggccguacuguaaccuugcugguucgaggcucgaauaaauugguucuggaagaggccgaaagaucuuugcacgacgcucuuugcgucauucguugucucguucgcaagaaagcgcuuaucgcuggcgggggugcuccggagaucgaaguggcgcuuaaauuggcugcuuuggcgaauaaguuggaugguaucgacgcuauauguacuagagcguacgccaaugcuuuggaaauuauuccguuuacguuggcugagaaugcuggguugaauccuauucagacgguuaccgaauugagaaacagacacgccaaaggagagacuucugccggcauuaacguacgcaaaggcgccaucacggacauacucgaagaaaacgucguccaaccgcuuuucguuagcacuucggcacugaguuucgccaccgaaaccgucagauccauauugaagauugaugauauuguaaguauauauauuaaguuuaauuuuucccuagauuuacggaaaacuaaacgacaauauagaaacggcaacgucgcuuuguaucauaaguacaguuag

SEQ ID NO: 6477 - RNA, 1230 nt, Psylliodes chrysocephala
auggaggcuauggacauuguuauaccagaaaaagaggaaggcaguccuuccgaagcaaagcaagcuuuacaagacuuagacacggaagaucuguacacgaaauacaaaaaacuucaacaaauguuggaguuuuuagaaguacaggaagaauauaucaaagaugaacagaggaaucuuaaaaaagaguaucugcacgcucaagaagaagucaaacguauucagucggugccuuuaguuauaggucaauuuuuggaggcugucgaucagaauacagggaucgucggaucuacaacagguuccaacuauuauguucguauucuuucgacuaucgauagagagcuuuuaaagccuucugccaguguagcucuucacaaacauaguaaugcuuuaguagauguuuugcccccugaagcugauucuucaauaaguaugcuacaagcagaugaaaaaccugauguacaauauugcgauauaggagguauggacaugcaaaaacaggaaaucagagaagcuguugaauuaccuuugacucauuuugaguuguauaaacaaauugguauugaucccccacgagguguguugauguauggaccgccugguugugggaaaacuauguuagcaaaggcaguggcacaucauacuacagccgcuuucauucguguagucgguucggaauucguccaaaaauauuuaggagaaggaccgcguauggugcgagacguauuccguuuggccaaagaaaauucgcccgccauuaucuuuauugacgaaaucgacgcuauagcuacgaaacguuucgacgcccaaaccggcgccgaccgcgaaguccaacgaauuuugcucgaacugcuuaaucaaauggacggauuugaucaaacuacaaacguuaagguuauaauggcuacuaacagagcagauacauuggauccugcucuucuaagacccggucguuuggauagaaaaauugaauuuccuuugcccgauagaaggcaaaaacgguugauauucaguacuaucacuucuaaaaugaaccuuucugaagaaguugauuuggaagacuauguggcaagaccugacagaauuucgggggcugauauaaacgccaucugucaagaagcuggaaugcaugcggugagagaaaaccgguacauuguuuugccgaaagauuucgaaaaggguuauaaaaauaauaucaaaaaagaugagagcgaacaugaauuuuauaaauaa

SEQ ID NO: 6478 - RNA, 618 nt, Psylliodes chrysocephala
cuuuucugcaaacaaucacacaucgcuucagcaucagcuaacgaccggcgcgccagaccaucgcacucuucuuaucccauuucugacuacuauucaucucacaaaauggccgacgcuaagccuauguccaagaucuggcugaucuccaacgauucggccaccaucgaaguugaccgugccguugucgagcgcuccaugcucaucaagaacaugcucgaggaugucggcgacgacaccaucagccagaccaaccccauucccauucccaacgugaaugaggccguuuugcgcaaggucaucgaguggugcaaccaccaccgcgacgaccccgcccaggccgccgacgacgagucggaugcucgaaagaagacgacugauaucgacgagugggaccagaaguucaugcaggucgaucaggagaugcucuucgagauuauccucgccuccaacuaccucgauaucaagccccuucucgaugucggcugcaagacugucgccaacaugaucaagggcaagucgcccgaggagauucgcaagacguucaacauuaccaacgacuucacucccgaggaggaggagcagauucgccgcgagaacgagugggccgaggaccgauaa

SEQ ID NO: 6479 - RNA, 930 nt, Psylliodes chrysocephala
auggacgauaaggcuucauguaaggaacuagaucaguggauagaacaguuaaaugacuguaagcaauuaaccgaaaaucaagugaaaacacugugugauaaggcuaaagaaauacugucuaaagaaucaaauguacaggaagugaaaugcccuguuacuguauguggcgauguucauggacaguuccaugacuugauggaguuauucaggauaggcggucguaguccagauacaaauuaucuuuuuaugggugacuaugucgaucgugguuauuacucaguugaaacugucacccucuugguagcacugaaagucagguauaaagaaagaaucacaaucuugagagggaaucacgaaucaaggcaaaucacacaagucuacgguuucuacgaugaaugucuaagaaaauauggaaaugccaauguauggaaauuuuucacugauuuguucgauuacuugccucuaacggcgcucguugauagucaaauauucugucugcaugguggguugaguccuagcauugauacuuuggaccauauuagggcgcuagaucguuuacaagagguaccucacgaaggcccaaugugcgaccuccuuuggucagacccggacgaccgcggagguuggggcaucucuccccguggugccgguuauaccuuuggacaagacaucucagaaacuuucaaucacagcaauggucugacgcugguaucgagggcgcaucaauuggucauggaaggguauaacuggugucacgauagaaacguuguaaccauauucagcgcccccaacuauugcuauagauguggcaaucaagcugccauuauggaauuagacgaugcucuuaaauauucauucuuacaguucgauccggcaccgagacguggcgagccucacgugacccgcagaacuccagacuauuuccuuuaa

SEQ ID NO: 6480 - RNA, 2058 nt, Psylliodes chrysocephala
augcagauauucguuaagacccugacagggaaaacuaucacucucgagguugaaccauccgacacuauugaaaaugucaaagccaagauccaggauaaggaaggaauccccccagaccagcaaagguugaucuuugccgguaaacaauuagaagauggcagaacauuaucugacuauaauauccagaaagagucgacucuccauuugguacuuagacuucguggugguaugcagaucuucgucaaaacucugacuggaaagaccauuacucuggaaguagaaccuucagacacuauugagaauguuaaggcuaaaauacaagacaaagaagguaucccaccagaccaacaaagauugaucuucgcaggaaaacagcuagaagacgggcguacucuaucugauuacaacauccagaaggagucuacccugcauuuggugcuuagacuucguggugguaugcaaaucuucgucaaaacuuugacugguaaaacaaucaccuuagaaguugaggcaucagacaccauugaaaacgucaaagccaagauccaggauaaggaaggcaucccaccagaccaacagagguugaucuuugccgguaaacaauuagaagaugguagaacauuaucugacuacaauauccagaaagagucgacucuccauuugguacuuagacuucguggugguaugcagaucuuugucaaaacacuaacuggaaagaccaucacucuugaaguagagccaucugauacuauugaaaacguuaaagcuaaaauucaagauaaagaagguaucccaccagaccagcaaagauugaucuucgcaggaaaacagcuagaagacgggcguacucuaucugauuacaacauacagaaagagucuacccugcauuuggugcuuagacuucguggugguaugcaaaucuucgucaaaacuuugacugguaaaacaaucacauuagaaguugaggcaucagacaccauugaaaaugucaaagccaagauccaggauaaggaaggcaucccaccagaccaacagagguugaucuuugcugguaaacaguuagaagacggcagaacauuaucugacuauaauauccaaaaagagucuacucuccauuugguacuuagacuucgcggugguaugcaaaucuucgucaaaacucugacuggaaagaccaucacucuagaagucgaaccaucagacaccauugagaacgucaaagccaagauccaggauaaggaaggaauucccccagaccagcaaagauugaucuucgcugguaaacagcuagaagauggacgcacucucucagacuacaauauccagaaagagucuacucuccauuugguacucagacuucguggugguaugcagaucuucgugaaaacucugacuggaaagaccaucacucuugaaguagagccaucugauacuauugaaaacguuaaagcuaagauucaagauaaagaagguaucccaccagaccagcaaagguugauauuugccgguaaacaauuagaagacgguagaacuuuaucugacuacaauauccagaaagaguccacucuccauuugguacuuagacuucguggugguaugcagaucuucgucaaaacuuugacugguaaaacaaucacguuagaagucgaaccgucugauacuauagaaaauguuaaagccaaaauccaagauaaagaagguauucccccagaccagcaaagauugauauuugcaggcaaacaacuagaagaugggcguacucuaucugauuacaauauccagaaggagucuacccuccauuuagugcuuagacuuagaggcgguaugcagauauucgucaaaaccuugacuggaaagaccaucacucuagaagucgaaccaucagacaccauugagaacgucaaagccaaaauucaagauaaggagggcaucccaccagaucagcaaagauugaucuuugcugguaaacaauuggaagauggcagaacauuaucugacuacaacauccaaaaagaaucaacuuuacauuuaguacuccgucuuagaggaggacaauag

SEQ ID NO: 6481 - RNA, 1623 nt, Psylliodes chrysocephala
augaugcaaccacaaauauuauuacucaaagaagguaccgauucaucacaagguaaaccucaacugauuucaaauauaaaugcuugccaaaauguuguggacgccauacgaacaacuuuggggccuagaggaauggauaaacuuauugucggaagcggaggugcagcgacuauuuccaaugauggagcuacuaucuuaaaauuauuggacauaauucacccagcugcaaaaaccuuaguagauauagcaaagucucaagaugcugaaguaggugaugguacaacuucuguaguuuuacuagcuggagaauuuuugagacagaucaaaccauauguugaagaagguguacauccacgaauuaucauaaaagcaguacguaaagcaacucaaauuuguuuagaaaaaauaaguucucuugcuguuaaaauuaauaagucaaaugcugaugaauuuagaucuuuacuagagaaaugugcugcaacagcaaugaguucaaaauugaucaaccaacagagaucuuucuuuucaaagauggugguagaugcugucuuacuucuugaugaguuauuaccauuaaauaugauugguauaaaaaaaguucagggagguggucuugaagagucaguucuaguagcuggaguugcuuucaagaaaacuuuuucuuaugcugguuuugaaaugcagccaaaaauauacaaagauugcaaaauugcuuuauuaaauauugaauuggaacuuaaagcugaaagagauaaugcagaaauucguuuaaccaguguaaaggaguaucaaaaaguuguugaugcagaauggaacauauuguacaacaaacuccaaaaaauccaugaaucuggugcuaaugcuguuuuauccaaacuucccauuggugauguagccacucaauauuuugcugaucgagauauguucugugcugguaggguaggagaagaugauaugaaaagaacccuaaaagcaugugguggugcuguaaugaccacuguuaaugaucuaaaugauucaguacuagguaaaugucagcuuuuugaagaaaaacaaauaggaggugagagauacaauuucuuuaaaggauguccuaaugcuaaaacuuguacauuacucuuaagaggaggaucugaacaauuucucgaagaaacugaaagaucuuuacaugaugccaucaugauuguccguagaacuaucaagaaugacucaguuguagcaggaggaggagcaauugaaauggaauuaucaaaauuauuaagagaucauucaagaacuauagcaggaaaagaacaacuccuuauuggggcuauugcuaaagcuuuggagauaaucccaagacaguuaugugauaaugcagguuuugaugcuacaaacauacuaaauaaguuaagacagaagcaugcccagaauaacccuugguaugguguugauauugccaaagaagacauuauugacaacuuugaagcuuguguuugggaaccagccauugucaagguuaaugcuuuaacggcagcugcagaagcuaccugucuaauacuuucuguggacgagacuaucaagaaucagaaaucugaagcuccaccacaaaugggagggcgugguaugggaagacccauguaa

SEQ ID NO: 6482 - RNA, 12180 nt, Psylliodes chrysocephala
auguuuagaauuuucucccguuuuaaugcucuauuuguuagaccucacaucagaggugcuauucgagaauaucagacacauuuaauucaacgaguaaaagaugauauugaggcucuucaugaaaaguuuaaaguucaauauccccaaaguaauagugcaaaaauaagcaaaguuagagauuuaccuccuguugcuggaucuauugugugggcuaaacaaauugaucaucaacuaacaacauacuuaagacguguugaagauguuuuagguaaagguugggaaaaucacauugaaggccaaaaacuaaaagcagauggagacaguuuccgucuaaaacuaaacacgcaagaaauauucgacgauugggcccguaacguacaacagcgcaaucuuggaguaucuggaagaauuuuuaccauugaagcagugagaucuagaaguggcagaggcaauauuuuaaaauugaaaguuaacuuucuaccagaaauuauuacauuagccaaagaagugcguaauuugaaaugucuaggauuuagaguuccucuggccauuguuaacaaagcacaucaagcgaaccaacuuuauccauuugcuauaucgcuuauagaaagugucagaaccuaugagaugacuuuagaaaagauugaagauaaggcuagcauuaucccccuugucgcugguaugagaaaagaaguucagcaagucauugcagaagguauccaacuaguuugggagagcuacaaacuagaucccuauguccagcgucuaucagaucuugucguuaguuuccaagaaagaguugaagaacuaguuuuuguuggugaacaguuagaaguugauguaaggucgcuagaaacuuguccuuauucagcuaauacauucgcugauauauuauccaagauucaacaugccguggaugaucuuucauuaaaacaguauucaaacuuacauauuuggguuagucgguuagaugaggaaguugaaaaaaaucucgcuaggcgucugcaagcaggugucgaagcuuggacagaaacuuuaaguggacagaaaaaagaaauugaucacagcauggauacagacgcuccagcacaaccaacacacaagccuggaggggauccucagauucaaacaaugauacaugaaguucguauuacaaaucaaacaauguauuuguauccaaguauagaagaggccagauuccuaauuaugcagcaauuauucgcuuggcaagcuauuguuacgucucagcaacgucuucagaguaguagauaucaaguuggcguggauaagccaguuacagaaaccuacagaaauauuuuaaccaaguuaccagcagguccgcaaccucuaacuaacgcuuauagcgccauaucuucaaaaauuaaagagguucaaaguuauguaaaugaaugguuaaccuaccaaucuuuaugggaucuacaagcugacaaucuuuauggaaaguuaggagaagauauuagcaaauggauggaguguuuaaaugauauaaaaaaaacgcguacaacuuuugacacaucagauacucgucgagaauucgggccuaucaucauugauuucgccaaaguucaaagcaaagucucuuuaaaauaugauucuuggcacaaagauaccuuagguaaauucggaagucuuuugagcaacgaaaugacuucauuccacucuaauguuuccaaaucucgaucugacuuagaacugcaaagcauugaagcagcaagcacuucagaugcagucuguuucauaacguauguucagcaauuaaaacguaguaugaaagcuugggagaaacaaguagacauuuacaaagaaggucaaagaauauuggagcgucaacgauuucaguucccuacaaacugguuacauguugaaaauuuagaaggggaauggggagcauucaacgaaaucaucaagagaaaagauucuagcauccaaacacaaguugcuagucuucaacaaaaaauugugucugaagauaaagcuguugaaaguagaaccaaugauuucuugguugauugggaaagaaguaaacccgucgaaggucaucuuagaccagaugacgcucuuucucaacuacaacuauuugaaaguaaauucucccgacuaaaagaagaacgugauaauguugcaaaagcaaaagaagcucuugaauugcaagauccaggcgguauuaguaccagugaagacagaaugcaaguuguuuaugaagagcuacaggauuugagaggaguguggucugaguugucaagaauuuggcagcaaauugaugaaacuagggaaaagccuugguuaucuauucaaccuagaaaauuaaggcagcaauuggaccaauuguccacccaacucaaagaauuaccagccaggcuuagacaauaugcuuccuaugaauauguuaaaaaaacucuccaaacuuacacaaaaguuaauauguuaauuguugaauuaaaaucugaugcucuuaaagaacgucauuggaaacaacuaaugaaacaauugagaguaaacuggguccuuucugauuuaacccucggucaaguaugggauguuaaucuucaaaaaaaugaagcaaucguuaaggauaucauauugguggcacaaggagaaauggcucuugaagaguucuugaaacaaguuagagaaucuuggcagaacuacgaauuggacuuaaucaauuaucaaaauaaaugcaaacugauuagaggaugggaugaucuauuuaauaaaguaaaagaacauauuaauucuguagcagcuaugaaguuaucuccguacuacaagguguuugaggaagaagcuuuaacuugggaagaaaaauuaaaccguauuaacgcucuuuuugauguguggauugaugugcaaagaagauggguauauuuagaaggaauuuucucuggaagugcggacauuaagacacuucugccaguagaaacaucucgauuccaaaguauaaguucugaguucuuaggguugaugaagaagguaagcaaaaguccuauggucauggauguuuuaaauauuccaggaguacaacgggcccuagaaagauuagcagaccuucuaggaaagauucaaaaagcucuaggagaguauuuggaacgagaacguacaucuuuuccacguuucuacuuuguaggagaugaagaucuauuggagaucauugguaacagcaagaauguugcaaggcugcaaaagcauuucaaaaaaauguuugcgggcguagcuuccauacucuuaaaugacaacaauacaauuauaacugguauugcaucuagggaaggagaagaaguaguuuuuaacucaccaguuucuacuguugaucauccaaaaauuaaugaauggcuuaguaugguugagaaagaaaugcgaguuacauuagcuucaaauuuaacacaagcuguacaagacaucaaacaguuuaaagaugaaauugacucaaaggccuacauggaauggguugauaaauaccaagcccaaauuguuguacuugcugcucagauucuauggagugaggauguugaagcagcucuugugaaaaugaacagugaaccacagaaagguguccuagaaaagguacuucaacaaguugaaaguacucuuaauguccuagcagauucuguucuucaagaacaaccucaacuuagaaggaagaaguuagaacacuuaauuaaugaauuuguucauaagagaacgguaacaagaagacuuauugcuaaugguguuuguaguaacaaagcuuuugaaugguuaugugaaaugagauucuacuuugaucccaggcaaacagagguucuuaagcaacugacaauacacauggcuaaugcaagauucuauuauggauuugaauaucuugguguucaagauagacuuguacagacaccucuaacagauagaugcuauuuaaccaugacucaagccuuggaagccagauuaggaggaucaccuuucggucccgcugguacggguaagacagaaucaguuaaagcucucggaaaccaauugggucguuucguucuuguauuuaacugugaugaaacauucgauuuucaagcuaugggcagaauuuucguugguuuaugucagguaggcgcaugggguugcuuugaugaauucaacagauuggaggagagaauguuaucugcaguuucccaacaaauacaaaccauccaagaagcuuugaaaucucagaaagaagcugcagcagaaggaacugcuacugguaguauaagcguugaacuuguuggcaagcaaguaaaaguaucaccagauauggcuauauucauuacaaugaauccugguuaugcagggcguucuaauuuaccagauaaccuuaagaaauuauucagaucucuggcuaugaccacucccgacagacaacuuaucgcugaagucauguuguucucucaaggauuuagacaagcagaaaaauuagccuccaaaauuguaccuuucuucagauugugugaugaacaacuaucaaaccaaucucacuaugacuuuggacugagagcauugaaaucaguacuuauaucagcuggaaauguuaaaagagacagaauacaaagaauuaaagaagguaugacucagagaggcgaaacuaacauagacgaggcuaauauagccgaaaauuuaccugaacaagaaauauuaauacagucuguuugugaaacuaugguaccuaaauuaguugcugaagauauuccacuuuuguuuagcuuauugaacgauguauuuccgaauguucaguauaccagagcggaaaugcaaggccuuaaggaugaaauuagaaaaguuugugcugaagaauaucuuguuugcggcgaaggagaugaaagaggaucagcuuggauggaaaaagugcuccaacuauaccaaauuuccaaucucaaucacgguuuaaugaugguagguccuagugguucugguaagaguucagcuuggcgaguauuacucaaagcucucgaaagauucgaagggaccgaagggguugcucauguaauugacccaaaggcaauaaguaaagaggcuuuguacgguguuuuggacccuaauaccagagaauggaccgauggacuuuuuacacauauauugagaaaaaucauagacaauguuagaggugaaauuaacaaacgccaauggauuaucuuugauggugauguagauccagaauggguagaaaacuuaaauucagugcuugacgacaacaaacuauugacucuucccaauggugaacgucuuucgcuaccucccaauguuagaguuauguuugaggugcaagauuuaaaauacgcaacauuagcuacugucucucguugugguaugguaugguuuucagaagauguucuaucuacugaaaugauauuugaaaacuacguucugcgauugaagaacauuccgcuugaagaaagcgaagaagguuucggcaagaaaucagacaugaaagaagauauguuauccccaacucuucaauuacaacucgauguuguuaauuuguuacaacccuucuuagcaccagauggucuuguggugcguuguuuagaauaugccauggaacaagaacauaucauggauuuuacucgguuaagagcuuuaaguucuuuauuuucuauguugaaccaagcagugaggaacguuuuacaauacaaccauaugcacccagauuuuccucucucuaaugauuaucucgagaaauauauuccgaaaugucuaauuuacuccaucuuauggaguuuugcgggagaugcuaaacuuaaaguuagaucagaauuaggagauuuuacucguucaguauccaccauuccuuuaccaccagacaauagcaugccaauuauugauuaugaaguuaccauugaaggagaauggucauuauggucaaacaaaguuccacaaauugaaguugaaacccauaaaguugcuucccccgauauuguaguaccuaccuuggauacuguaagacaugaaucuuuguuguauacuugguuggccgagcacaaaccaauaguguuaugugguccaccugguucugguaagacaaugacuuuauucucugcuuugagagcacuaccugauauggaaguuguugguuugaacuucucuucugcuacaacuccagaauuauugcuaaaaacuuuugaccacuacugugaauauagaaaaacaccuaacgguguaguuuuaucgccaauucagcuggguaaauggcuaguucuauucugcgaugaaauaaauuuaccagacauggauaccuauggcacucaacguguaaucauguuccugcgccaaauaguugaacaaaagggcuucuaccgugccucagaucaaucuuggguuuccuuagaacgcauucaauuuguaggugcuugcaauccuccuacagacccuggaagaaaaccucuuucucaucguuuccucagacauguaccagucauuuauguggauuauccuggagaaaccucuuuaaagcaaauuuaugguacuuucacuagagccauguugagguuggcuccagguuuaaaagguuaugcgaauccuuugacaaaugcuaugguugaauuuuaccuagcgucucaagacagauuuacucaagauaugcaaccccauuauguuuauuccccucgagagaugacaagauggguaagaggaauaugcgaggcuaucagaccauuagauaaucucucuguagagggauuaguaaggcuuugggcgcaugaagcucuacgucuauuccaagauagacuuguugaagacacagaaagacguuggaccaacgaaaauaucgacgcugucgccuuaaaacauuucccaucagcgaauugugaacgugcauuggaacgaccuauuuuauacaguaauugguugucuaaagauuacguuccuguuggaagagagcaguuaagggaauacguuaaagcaaggcugaaaguauuuuaugaagaagagcuugaugugcccuuaguacuauuugaugaaguauuagaucauguauuaagaauagacagaauuuucagacagccucaagggcauuuacuucugauuggugucucuggagcuggaaaaacuacccucucuagauuuguagcuuggaugaauggauuauccaucuuccagaucaaaguucacaauaaauauacagcugaagauuuugaugaagauuuaagaucaguuuugagaagaagcgguugcaaacacgagaagauuucauucauuuuagaugaaucuaauauguuagauuccaguuucuuggaaaggaugaauacucuuuuagcuaacggugaaguuccuggguuguuugaaggagaugaauacacaacuuuaaugacacaauguaaggaaggagcucaaagagaaggacuaauguuggauucaaaugacgaacuuuauaaaugguuuacucaacaaguaaugcgaaauuugcauguaguuuuuaccaugaauccaucuacugaugguuugaaagacagagccgccacauccccugcuuuauucaacagauguguccuaaacugguuuggugauuggucagauggagcccucuuccagguuggaaaagaauucacgaaucguuuggaccuugacaaacaaagcuggagauguccggacuucuucccugcagcuugcaaucauguuucugcuucacccaaucauagagaagcuguuaucaaugcuugcgucuacguucaucaaacucuucacaaagcuaacaguagacugguuaaaagaggaagucguacuauggcgaucacgccuaggcauuauuuagacuuuauucaucaucuuguaaaauuauauaaugaaaaacgauccgauuuggaagagcaacaacuucaucucaauguugguuuaaauaagauugcagaaacuguggaacagguggaagaaaugcaaaagaguuuggcgguaaaaucgcaagaauugcaagcuaaaaaugaggcagcuaaugccaagcuuagacaaauggucaaagaucagcaagaagccgaaaagaagaagguucaaagucaagaaauccagcaacaacuugcgcaacagacuguucauauccaacagaagagauccgaaguaauggcugauuuagaacaagucgaaccugcuguuauugaagcccaacaagcuguuaaaucuaucaagaaacaacaacugguagaaauucguacaaugucaaauccucccgcccuuguaaaacucgccuuagaaucaauuugucuuuuacucggagaaaaugccagugacuggaaaucaauucgggcugucaucaugagagauaauuuuauuaauaguaucgucaauuucaacacugaagacaucagugaugaaguaagagaaaaaaugaagagccgcuauuugagcaauccagauuacaacaucgauaaaaucuaccaugccaguaacgcuuguggcccacucgucaagugggcaugcgcucaaguucaguacgccgauauguugaagaaaguagaacccuuacgagaggaacuuagaucacuugaacaacaagcugaaaccaaccaaaaacguggugaagacgucaaagcucuuauuagucaauuggagcaaaguauugcaucuuauaaagaagaauaugcacaacuuauugcgcaagcucaagccauuaaaacugauuuggagaauguacaagcuaaaguugacagauccauugcacuucuuaagucgcuuguaauugaaagagagaggugggaagcuagcagugaaacuuuccgaucccaaaugucuacuauuauuggugacgucuuauuaucugccgcuuuuauugcauaugguggauacuucgaucaacauuaccgucagaaucuauucaguacuuggugucaacacuugacgcaagcaaguauucaauacagagcugauauagcaagaacagaauacuugucuaauccugaugaaaggcuuagauggcaagccaaugcuuugccaucugaugauuuguguacugagaaugcuauuauguugaagagauucaacagauauccuuugauuauugauccaucaggacaagccacugaauuuauaaugaaugaauuuaaggauaagaagauaaccaaaacuagcuuuuuagaugauuccuucagaaaaaaucuugaaucagcauuacguuuuggaaauccacugcugguucaagaugucgagaacuaugaugccauauuaaauccagugcucaacagagaguuaaggagaacggguggucguguauugaucacccuuggugaccaagauaucgacuuaucgccuuccuuugucauauucuuaucaacuagagaucccaccguugaauuuccuccagauauuugcucuagaguaacauuuguuaacuucacuguuaccagaaguucuuugcagagucaaugcuuaaaccaaguacuuaaagcagaacgaccagauauugaugcuaaacguucugaucuacuaaaacugcaaggugaauuccaccuuagauuaaggcaacuggaaaaaucucuuuuacaggcauugaacgacgcuaaaggaaaaauuuuggaugaugauagcguuauuacuacuuuagagacucuuaaacaagaagcagcugaaauuggacaaaaaguugaagagacugauaagguuauuucagaaauugagacuguuucucaacaauacuugccauugucucaagcuugcaguaauacguacuuuacuauggacagucucaaucaaauacacuuccucuaucaauacucuuugaagauguuccuugacguuuuugcuucggugcuacauaacaauucgaaacuugaugguaucucagauuaucaagcuagacuuaauguuaucaccaguaaccuauuuucuguuguuuaugaacguguagccaggggaaugcuccacaacgaucgcaugacuuuugccaucuuacucugcagaauucaucugaagggacaacucucugaacccaaccuggaccaagaauuuaauuucuuccuaaggggcaaagaaggcguuuuuaauaguucugguucuacaaucguugacggauuaaauagcgaccaacaagaagcaaucacuagacuaucuaccaagcuacccacauucagaaaacuaccaaacgaccaacaagaagcaaucacuagacuaucuaccaagcuacccacauucagaaaacuaccaaacgaaauaaaagaaaugccagaauuuggggccugguuacaacaaagcagucccgaacaagcuguuccacaauuguggauugaagaaaaacaacuaagugcaaucgguagaggaauguaccaacucuugguaauccaagcguuccgaccagaucgaguaauagcugcagcucaaagcuuuguagcagcuguucuuggaccagacuucauguauuuagcugagaaagaauuggacuuugcuacguguauugaaaaagaaaucaggucaaaugugcccgcucuguuguguucuguaccuggauuugaugcuuccggucguguugaugauuuggcggcugaacuaaacaaacaaauaucaagcauagcuauuggaucugcagaaggauuuaaucaggcugauagagcuauuaauauggcuugcaaaacuggaagauggguaaugcuuaaaaacguacauuuggcaccccaauggcuuguucaacuugagaagaaacuacauucuuuacaaccacaugcgaacuucagauuauuccuuaccauggaaauuaaucccaaacuuccugugaaccuacuuagagcaggaagaauauuuguauuugaaccuccuccggguauuagggccaauuuauugagaacuuucaguacaguuccagcuaguagaaugaugaaagcacccaaugagagagcaagauuauacuuccuauuggcuugguuccaugcuauuguacaagaaagacugcguuacugcccacuagguugggcuaaauauuaugaauuuagugaaucagauuuacguguugccugugauacuuuagauacuuggauugauacgacugcuaugggaagaacuaauuuaccuccagaaaaaguacccugggaugcuuuggucacacuucuuucucaaucaaucuauggugguaaaaucgauaacgacuuugaccagagacuuuuacauuccuuuuugaauaaauuauucacacccaaaagcuuugaaagugauuuugcacugguagcaaauauugacaaugguccuggaggaaauagacacauuacuaugccugauggaaccagaagagaccauuucuugaaauggauugaaagccuugcagaucgucaaacaccagccugguugggguugccuaauaaugcugaaaagguacuucuaacaacaagaggcacugaccuuauagcuaaauuacucaagaugcaacaguuggaagacgaugaugaauuggcauauuccauugaugacagcucaccaacagauccugcucaggucgaugggcguccaucuuggaugaaaacauugcacaauaguggugcuacuuggguuaauuuacugcccacuucauuacagacucugagaagaacuguggagaauaucaaagauccucuuuacagauauuuugaaagagaagucaauucagcuucaaaacuucuuacagauguuuugcaugaucuuaaugacguacuuuugaucugucaaggagacaagaaacaaacgaacuaccaucguacuauguugucugaacuggucagaggaauuauuccuaagaauuggcaucguuauacaauaccuaaagguuguacuguaaugcaauggaucaccgacuuuagucaaagaauuaaacaguuacagaaaguaucgaagguaguuucaucagcaggugcuaaagaauuacagagcuuccccguuuggcugggaggacuucuuaacccagaagcuuacauaacagcuacaagacaauguguugcccaggcuaauagcuggccucuugaagaacuucacuuggauguuaccaucacagauucuaaugauaaagauucuguuccacaugacuguuuugcaguuguuggaauuaaauuacaaggagcccaaugccgaaauaaucaauuguuacucacauccagcaucaugauagaacucccaauaacgcucuuccguuggguuagaauuauuggagaagacaaacuaaaagaaggaaaacucucuuuaccgcuuuacuuaaauucuacuagaacagaacuauua

SEQ ID NO: 6483 - RNA, 2673 nt, Psylliodes chrysocephala
augaguaaccaucggucgaaaaaacaaaucgagucagauuccgauucugauaguguugauagugccgaagaagccagaagacgugaucucaaagaaagagaugaguuugcuacacgucuuaaaaaacgcgaugaagaacguacaagaaauaucguacaaaguucagauaaaaaagcuuaugaagaagcagccaagaggcugaaauuagacaaugcagagaaagagaaacucauuccagaacuccguaagauuucaaggaggaaauauuuggaaaaaagaaaggaugauaaguuacaagaguuggaggcugauauugcugaugaugaauaucuguuugaagaaaaaguauuaacagaaagagaaaagaaagaacgccagcauaaaaaggaacuauuacaacuugcucaggaacaugaaaaagcaagagaacuugaacgaauucagagguaucacaugcccagagauuuggguaaagacucuacagcagauuauauugaaguugaugaacuugaaaaaguaccucaauccgaacagaaaaaaugggaaaaagaccagauggcuucugcuguuuuuaaguuuggugcuaaagaugucaagaaaaaggaugauuaugaguugcuguuggaagaucagauugauuuuauucaagccuugcaaaugccaggggucauugaaaaaaaggaaaaagaguuaacugaaguagagaagaaaaaguugaguauugaagaaacuaagaagaguuuaccaauauuuccauuuaaagaugaucugauucaggcaauuagagaacaucagguauuaaucauugagggagaaacaggaucuggaaaaacuacacaaauuccucaguaucuacaugaagcuggauucacugaagauggaaaaaagauuggcuguacacaaccacgucgaguagcagccaugucuguagcaucaagaguagcacaagaaauggguguaaaauugggcaaugaaguuggauaugccauuagauuugaagauugcacuuccgaaagaacaguuauaaaauauaugacggaugguacacuacaccgagaauuuuuaucagaaccugaucugcagucuuacagugugaugauuauugaugaagcucaugaaagaacuuuacauacugauauauuguucgguuugguaaaagauauugcgagauuuagaccugaauugaagcuguuaauaucuagugcaacauuggauguuaccaaguuuucggaauuuuuugaugaugcaccuguauaccaaauuccaggucguagauuuccuguagauauuuacuauacuaaagcuccagaagcagauuauguagaugccuguguuguuuccguacuucaaauacauguaacucaaccucuuggugacauuuugguuuuuuugacuggucaagaugaaauugaaaccugucacgaacuuuuacaagauagaguaagacguuuagguucuaaaguuaaggaauuauuaauacuucccuuauaugcuaaccuuccgagugauaugcaagcuaaaaucuucgaaccaacucccccuggugcuagaaaggugguacuugcuacuaacauagcugaaacuucauuaacgauugauaacaucauuuaugucaucgauccaggauuugcuaaacagaaccauuucaauuccagaacaggaauggaaaguuugaugauaguucccauaucuaaagcuucagcuaaccagagagcuggacgagcuggcagaguagcagccgguaaauguuuucgguuauacacugcuuggucuuacaaacaugaacuggaagauaauacaguaccggaaauucaaagaauuaacuuaggaaaugcuguuuuaauguugaaagcauugggaaucaaugauuuggugcacuucgauuuuuuggacccaccuccgcaugagacccuaguuuuagcuuuggaacaauuguaugcguuaggggcauuaaaucaucauggagaauugacgaaacuagggaggagaauggcugaauuaccaguugauccaaugauggcaaaaaugguuuuagcaucugaaaaguacaaaugugcagaagaaauaguuucaauaggagcaauguugucaguuaacggagcaauauuuuacagaccgaaagacaaaauaauacaugcagauacugcuaggaaaaauuuuaaucacucgggaggugaccauuuaagccuucucaauguuuauaaccaguggcgcgauucugauuauuccuuacagugguguuaugaaaauuuuauacaguauagaucaaugaaaagagcacgugacguuagagagcaacuggucaaccuaauggcaagaguagaaauugaaauguuguccagcauugaagacauagacaauguucgcaaagcgauaacugcagguuacuuuuaucacauagcuagauuuucaaaaggcggaaguuacaaaacuguuaaacacaaccaaaguguuaccauacauccaaacaguucucucuuugaaucuuugcccagauggguuuuguaucaugaguugguuuuuacuacgaaagaauuuaugaggcaaguuauugaaauugaaaguaaaugguuauuagaaguagcuccucauuauuauaaaucaaaagaacuagaagauacaacaaauagaaaaaugccuaagacuauaggcagaaguaaaaugacugauuag

SEQ ID NO: 6484 - RNA, 1371 nt, Psylliodes chrysocephala
augaagguagaagagguaaaaagcaccguaaaaacucaaagaauaagugcccauagccacauuaaagguuuagguuuggaugacgcugguuucgcaauucaaucugcggccggcuugguuggacaagagcaggccagagaggcugccgggguaguuguagauaugauaaagaguaaaaaaauggcugguagagcuguucuguuagcugguccuccugguacagguaaaacggcuauugcuuuagcuauugcucaagaacuuggaaauaaaguaccauuuugucccaugguugguucagaaguauacagcuccgaaauuaagaagacugaaguacucauggaaaauuuccgaagggcuauuggacuuagaauucgagaaaccaaagaggucuaugaaggggaaguuagugagcucacaccuguagagacagaaaauccagcaggaggguaugguaaaacuguuagucauguuguaauugguuugagaacugcuaaggguaguaaacaauugaagcuggauccuagcaucuaugaagcucuacaaaaagagaaaguugagguuggagauguuauuuacauugaagcuacaaguggagcugucaaaagacaaggaagaucugaugcauaugccacugaauuugacuuggaagcugaagaauauguuccccuuccaaaaggagauguacauaagaagaaagaaguaguucaggauguuacuuuacaugauuuggaugcugcuaaugcuaaaccacaaggaggucaagauguauuauccaugaugggacaacuauuaaaaccaaagaagacugaaauuacagacaaauuaaggaaagaaauuaacaaaauuguugacaaauauauugaucaggguauagcggaauugguaccugguguacuuuuuauugaugaaguucauauguuagaucuagaaacauuuacuuaucuucauagagcuuuagaaagugccauagcaccuauuguaauuuuugcaacaaauagagggcguugucuuauuagaggaacagaugacauuuucucuucacaugguauaccauuagaucuuuuggauagauugcugauuauucgaacaauuccuuaugguagaucugauauggaacaaauuuugaaacuaagggccaccacagaagguuuagaaauugaaucagaugccaucgcaauauuaggagaaauugguacaaaagcuacuuugagauaugcaguacaguuguugacacccucucauuugacagcuaaaaucaauggaagacauaauauaauccaaagcgauauugaagaaguugguucauuauuccuugaugcaaaaucaucugcuaaaauucugacugacaacaaggagaaguucaugacuuaa

SEQ ID NO: 6485 - RNA, 2196 nt, Psylliodes chrysocephala
augacgucaauuaucaaacugcaggucuuaucuggggccaaagacgaaucgcccccauguuaccuacuucaaguagacgauguacgaauauuacuagauugcggcugggaugagaaguuugauauggaauuuauuaaagaaauuaaaagacacauccauacgauagaugcuguauuaauuucuuauccugauaauuaucacuuaggagcuuuaccauacguuguggggaagcucgguuuaaauuguccaauauauucgacaauaccaguguacaaaaugggccaaauguucauguaugaucucuaucagucgcaauauaauaugaaagaguucuguauauuuucacuggaugauguagauguuacuuuugagaaguuuauucaauugaaauacaaccaaacgaugccuuuaaaagguaagggauaugguuuaacagucacaccuuuaccugccggucauaugauuggaggaacaauuuggaaaauccagaaaguaggcgaggaagauauuguauauuguaacgauuuuaaccauaaaaaggagcggcacuuaaacgguugugaauuagaaaaauuacaacgaccaucuuuacuuauaacugaugcauucaaugcuagcuaucaacaagcaagaagaagggcuagagaugaaaaauuaaugacaaacauccuucaaaccuuaaggaaccacgggaacgugcugauagcagucgauacggccggcagaguccuagaacuggcacacauguuggaccagcuuuggagaaacaaagaauccggucuucuagcuuacucucuggcauuccuaaacaaugugagcuacaacguagucgaauucgcuaaaucgcaaaucgaauggaugagugauaaacucaugagaagcuucgagggugcuagaaacaauccauuucaguucaaacauuuacaauugugucacaguuuggucgaguugaacaaagugccgagucccaaggucguguuggccagcucaccugauuuagaaaguggguuuuccagggaguuguucuugcaaugguguucuaaccauaauaacaguauuauauuaacuacaaggacgucaccgggaacucuagcuagagaucuaauagacaacggagguggaagaaacaucgauuuaacaguagaaagacgggugagauuagaaggacaagaacucgacgauuacgaaagaagacaaaggucuagaagugauaaaauugacaaugaggacgcggauucagauucggacucugacaucgagaugucgguaaucucgaaggggaagcacgacaucgugaucaagcaggaagguaaaauaucgacgggauuuuucaagguuaccaaaaaaauguacccgauguauccguuccacgaggaaaagauuaagugcgacgaauacggcgagaucgucaaacccgaggauuacaaauuggccgaaguaauacccgaaggcgaagacaauaaggaaaauaucgugauaaagaaagaagaggaggaaauuacugaaauuacggaacaaccgacgaaaugcaucgugcugcaaaggacgguucaaguuaacugucaaguccaguacaucgauuucgaggguagaucagacggugaaucgcugaugaagauuuugacgcaacugaaacccaggagagugauuguggugcgcggcacggaagaaaauacggccgucaucgagaagcauugcuuggagaacaugcaggggcgaguguuuacgcccucuaggggcgaaauagucgacgcuacgagcgaaacgcacaucuaccaaguuagguugacugacgcucuagugucgcaguugaguuuccaaaaggcgaaagaagcagaaguggcuugguugagcgcucacaucaugcugagggaaagccaggcggacgccagacgaauaaacguugaugacgaagaaauggaagugguagacgaagaaacgagaauucuaacccuugagccuuuacccgaagguucgccgcacgauccuguguucauaaacgaguuaaaacuugccgaguuuaaacaaguuuuaggaaggaauaguauuaauucggaauuuucuggggguacuuuguggugcuguaaugguacuauagcagugagaaagguggagaaugguaaaaugauguuggaaggaauaguauuaauucggaauuuucuggggguacuuuguggugcuguaaugguacuauag

SEQ ID NO: 6486 - RNA, 2286 nt, Psylliodes chrysocephala
augccuccuuuggagguaacauccaacacaaacaaugaagaaccuggcccaauaaauccaguuguggguauaauuuauccaccaccagagguuagaaauaucguugauaaaacagccagcuucguugcuagaaauggaccagaauuugaagcucguaucagacaaaaugaacuuggaaauccuaaguuuaauuucuugaaugguggagauccuuaccaugcauacuaucagcacaaaguuaaggauuuuagggaaggaaaaggucaagagccaucuccugguuuaagucuagcaguuucuaagcuuucuguaagugcuucagcacaacagaagcaacaagaaauauugaaacaaguagaacagccuuuugugccuaaagauccaccacaagauuuugaauuuauugcagacccaccaucuauuucagcucuagauuuggacauuguuaagcucacugcucaguuuguagcuagaaaugguagagcauuuuugacccaguuaaugaacagggaacagagaaauuuucaguuugauuuucugagaccucagcauucuuuguuucaguauuucacuaaacuguuggaacaauauacuaagguucuuauuccuccaaaaaguaugcaacagcgucuuagggaugaagcaaaaagugcuaaagcuguacuggaacagguaaaauaucgugcagagugguugagauaucaggaacaacaaaaagcaaaagaagaggagauucuugaacgagaaagaguggccuaugcucaaauugacuggcacgauuuuguggugguugaaacaguagacuaccaaccauuugaaauugggaacuucccaccuccuaccacaccagaagaggucggcgccaggauauuaauacaagaaagaauugaagauggagaagacauugaaaugcaacuggaaagcgaugaugacgaugauacuccaaaugcugaggaagguuugaguaccaugcaggauaaaacuaagcgcaaaggaggugaugauaaucgcguucaggauauggaggaagaaaguucugaugaagaugaaaaugaaggcaagacaccuagagcaccucccccgccgucaauucaacccccucuaccaccugcuccagauaaagugcuugugaagaaauaugauccuaaacaagccguuaaagucgcaagaccuacaguaggagacgauuaucuagucucucccaucacuggugagaaaauuccagcuagcaagguccaggaacacaugcgcaucgggcuuuuggauccccguuggguggaacagcgggacaaacaaauuacagacaagaugaaccaagauacgguuuaugcagccgguagcgccaucgaugcaucucuuaaacuccucgccgaaagacguaccgauauuuucggugucggagaugaagaaacugcuauugguaaaaagauuggagaagaggaugucagaaaagacgagaaagugacaugggaugggcauacgagcagcguggaagcagcgacaagagccgcgagggcuaauauuacuuuagaggaacaaauucaucaaauacacaaaguaaaaggucuacuuccugacgaagagaaagaaaaaauuggucccaaaaauauuggaucuaagaagauaaacauucagaguauuauuacuacaaaaccuccuaauccaccuguucagcccccaaagccgccaguaucucuuauacaaaccccugcuccacaaaugauuccaguuccaacucaggcugcgaugauggcuccacagccaccuauaaugaugaugccugcuccucccaugccucccauaagaccaccaccucuuaugaugcccggaccaccgccgauggguggcuuuccuguaggaccaaugccuggaccaccgauggguccugguaugaacaugcccccuaugaaacauccuaaugauggaccaucugaggaugaaccuaguaauaagaaguuaagaaacgaggauucacucauucccgaaaauguguucuugucuagaaauccaagccaagugucgauaaaaguuucgauuccacauaugccggaaaagucagaauggagauuaacuggacaaaugaugucuuggacuuuuccuuuaggagaaucuguggcaaacuugaaagccaaauuacaggaagaaacgaauaugccucccgccaaacaaaaguuauucuuugauggaauguuuuucaaggauuccaacacauuggccuauuauaauguuacuccaggcgcuguuauccaauugcagaucaaggaaagagguggaaggaaaaaauaa

SEQ ID NO: 6487 - RNA, 999 nt, Psylliodes chrysocephala
augccuaguucagacguaacgacaacuaaaguuauaguccauccauuggucuuacuuagcguaguggaucauuucaaucguaugggaaaaaucgguaaccaaaaacgcgucgucggugucuuacucgguuguuggagggcuaaaggagucuuggauguuucgaauaguuucgcaguuccuuuugaugaggaugacaaagaucaaucugugugguuuuuggaccaugauuacuuagaaaauauguacggcauguuuaaaaaagucaaugcuagagaacguguagugggcugguaccacaccggacccaaauuacaccaaaacgacauugcuauuaaugaacuaguaagaagauacuguccaaauucaguauugguaauuauugaugccaaaccaaaagacuuaggccuucccacagaagcguaucaagccguugaggaaguacaugaugaugguucaccaacauccaaaacuuuugaacacguaccaagcgaaauuggagcagaagaggcugaagaaguggguguagaacauuuauuacgugauaucaaagauacuacuguuggcacacuuucucaaagaauuacaaaucaauuguugggucugaagggacugcauucacaguugaaagacauuagagacuauuuguuaaauguuugugacaauacgcuaccuauuaaucaucaaauuaucuaucaguuacaagauauuuucaauuuguugccugauauaaaccaagaugcuuuuaacaauucauuuuauguuaaaaacaaugaucagaugcuuguagucuacuuagcagcucugguuagauccauaguggcauugcauaauuuaaucaauaacaaacugacaaacaaagaugcugaggaggguaagaaagaagagaagaaggauaguaaggauaaagauaaggacaguaaggauaaggauaguaaagauaaagauaaggaaaagggagaaaaggauaaggaugcaaagaaggaugagaagaaaaaguag

SEQ ID NO: 6488 - RNA, 1653 nt, Psylliodes chrysocephala
auguuuggaggaggacgugcucccauuuuaguuuugagccagaauacuaaacgagaaucgggccggaaaguucagguggagaacaucaaugccggaaagcaaauugcagaugucauucgaacaugucuggggccucaggccauguuaaaaaugcuuauggacccaauggguggaaucguuaugaccaacgauggaaaugcaauucuucgugaaauuacagugcaacauccagcugcaaagagcaugauagaaauagccagaacccaagaugaagagguaggagaugguacaacaucuguaauaguucuagcuggugaaauguuagcugcagcugaacaauuucuugaacaacaaauacacccuacaguuauaauucgacaauauagacaagcucuugaagacaugguucuauuuuuagaagggccuuuaaguguuccuguugacagaaaugauaaaaaggcccuugcccaaguaguuaaaggauguguugguaccaaauuuuuaugcagauggucugaucuggcaguugguauugcucuagaugcaguaaguacaguauuacuugaagaaaauggcagaacagaaguggauauuaaaagauaugccaaaguagaaaaaaucccaggggguucaguggaagaaucaaaaaucuuaaagggcguuaugcucaacaaagauguuacucauccuaaaaugaaaaggguaguuaagaauccgagaauuauacuuuuggauugugcuuuagaauauaaaaagggcgaaucucaaacuaacguggaaaucagugcagaaacagauuuuacaaaacuccuugagcuugaagaggaacauguuaagcgccaaugugaugaaaucauagcuuuuaagccagacguugucuuuacagaaaaggguguuucagaucuagcccaacacuuuuuauuaaaagcuggaaucagugcugugagacguguuaggaaaucugacaauaacagaauugccagagcauguggugguacaauugugaaucgaacagaagaauuacaagagacagauguugguaccggagcuggucucuuugaaauuaaaaaaauaggcgaugaguacuucuguuuugucgaugaauguaaaaauccaaaggcuugcacuauuuugcuccgaggagcuaguaaagacauccuuaaugaaauugaaagaaaucuccaagaugcccuucaaguugcaagaaacauaguucucucaccccgucuagugccaggagguggugcuauugaaauggccauagcucaacgucuaaugcaaaaagcaacacauggaccuuacagagcucuugcacaugcacuagaaauuauuccuagaacuuuagcucagaacuguggagcuaacacaaucagaaccuugacagcuuugagggcaaaacaugcuaaccauacugaugcugagaaaccuuguacuugggguauagauggagaaacuggcgagauuguugacauggagacuaaaggauugugggaaccacuuucagugaaacuacaaacuuacaaaacggcuauugaaacugcuauucuucuauugcguaucgacgguauugugucuggauccaaaaagaagggugacaaggaaccaccuacaccuagccaaguacaacaacaagacgcaagagaagcagauuga

SEQ ID NO: 6489 - RNA, 705 nt, Psylliodes chrysocephala
augaugaugcaaacagaaaugaaugcuuauuauccugacuauucuacagcuccaauccaacgacaaauuaaccccuaugcugauaauggagggaguguuguagcgauagcaggaaaugauuucguaguugugggagcugauacucgucucaguucagguuuuucaauuuacacaagaaaccaaaauaaauuauuuccuauguccgauacaacuguauuagguugugcaggauguuggugcgacacuuuaacuuuaacccgaauuuugaaaucucguaugcagauguaccagcaggaacauaacaaacaaaugucuacaacagcaugugcacagauguuauccaccaugcuguauuauaagagauuuuucccuuacuauauauccaauauacuuguuggauuggauaaugaaggaaaagguuguguuuauagcuaugauccaauugggcauugugaaaaggccaccuacagagcagguggcucugcaggugcauuacuucaaccucuuuuggacaaccagauuggacaaaaaaaucuggugaaaccaucaucugaagaucuuucucaagagaaagcucuugcuauauugaaagauguauucauugcugcugcagagagagacaucuauacuggagauaguguucuuaucaauauuauuacaaaggauggaacuaaaguagaaacuuuugaauuaagaaaagauuaa

SEQ ID NO: 6490 - RNA, 876 nt, Psylliodes chrysocephala
auguuuccagaaauacccagaccuuuuaauaugacguacaaauguuauuccguugcgauguucccaggaaaugaaagacaagaugucgaacggggaggaaaaauuauuaugccuccaucagcucuagagcaauuaacgaggcuaaacaucaacuauccuauguuauuuaagcuuguaaauaaaaaaacaaaucguacuacacacugugguguguuagaauucgucgcugaugaaggaaaaguauaucuucccuuauggaugaugcauaauuugguccuuucugagggcgauuugguucaaauggaaagcauuucgcuuccaguuggaacuuuuuccaaauuucaaccuuugaauccugauuuuuuggauauuacuaauccgaaagcuguuuuggagaauuguuuaagaucuuaugcuugucuuacgacuggggacguuauagcuguuaaauauaaucaaaaggcuuaugagcuguguguuuuggaaacaaagccugggaaugcuauaaguaucauagaaugcgacaugaauguggaauucgcagccccagugggcuacaaggaaccggaaagauuuaaaaaagaagaagaggaaaugucuaucgauccugcugacuuaaugccagaaccaucagguuuuguagcauucagaggcgccgggaaucgucuggauggcaaaaaacguaaagauucuucuucgagcgacagucacguaucuaaaccaacuuacguuaagggaauccccgauuacgauuacgagaucggcaccuugaauuucaucagaagaacacugaagacgaaagagaaagaaaaugaugauaaugaggaguucaaggcguucaguggaacaggauuuagcuuaagagcuagacaguaa

SEQ ID NO: 6491 - RNA, 1623 nt, Psylliodes chrysocephala
augucgacauuuccaggaucuaucgccuuugaugaauaugggcgccccuuuauaauuuuaagggaccaagacaggcaaaaaagauuaaccggaaucgaugcauugaagucacauauuuuggcugcaagucagauugcucacacaguuaguacuucuuuaggaccaaaggguuuggacaagaugauggugucaccugacggagaaguuacggugaccaaugauggcgcuacuauuuugaaaaugauggauguugagcaucaaguagcuaaauuguugguucaguuaucccagucucaggaugaugaaauuggagauggaacaacgggaguuguaguucuagcaggagcucuucuagaacaagcagguacucuauuagaucgugguauucacccaauuagaaucgcugaugguuuugaacucgccugucagacagcuguagagcauuuggaaaaaauugccgaaguauuuccaguuucugcugaaaauacugagccucuaguuaaaguugcaaugaccacauuaggaucuaaaaucauuaauaaaugucacagacaaauggcagaaaucgcaguuaaugcuguuuuagcuguggcugauuuagaacaaaaagauguuaauuuugaauuaaucaaaguugaaggaaaggucggugguaaauuagaagacacaacaaugguccguggcguagucauagacaaaacaaugucucauccccaaaugccaaaagagcuuagaaaugucaaacuggccauucucaccugccccuuugaaccaccaaagcccaaaaccaaacauaaguuggauguugccaguguagaggauuacaaagaauugaggcaguaugaacaagacaaguucaaagaaaucguuagucugguuaagaacgccggcgccacauuggccaucugucaaugggguuuugaugaugaagccaaccauuugcuuuugcaacaggaguugccggccgucagaugggugggcggucccgaaauagaacuuaucgcuaucgcgaccggcgguaggauugugccgcgauuugaggaacuuaguccugaaaaacuugguuaugcagguuugguaagggaaauauccuuugguaccaccaaagauaagaugauggugauagaagaaugcaagaauucccgugccgugacuauucuaguuagaggcgguaaucaaaugcugguagcugaggcuaagaggagucuacacgaugcguuaugugucguuaggaguuuaguacaggaaccaagaguaguuuaugguggaggugcagcggagaucgccugcaguuuggcaguagcagcccaagcugaucaacuggcaacuuuggagcaauacgcauaccgcggcuucgccgaagcuuuagaaagcaucccguuggcucucgccgacaauagcggucuuucugccauccacaccuuaggagaaaucaaggcuaaacaguccgccaccggagauccagccuugggcguggauugcaugaacaccggcaacaucaacaugcgugagcaacauguuacugaaucuguuaaaucuaagcggcaacaauugcuguuggccacgcaguuggugaagaugauuuugaagaucgaugauguacgucagcccggcucugguuaa

SEQ ID NO: 6492 - RNA, 342 nt, Psylliodes chrysocephala
auggccacugcuauggacgucgauucugaagaaaucgaauuaccaacuucuaguagcucgaagggagagaagaaacgauuugaaguuaaaaaguggaaugccguugcacuuugggcuugggauauuguuguggacaacugugcuauuugccgcaaucauauaauggauuuauguauugaaugucaagcuaaucaagcuucugccacuagcgaagaauguacaguagccuggggaguauguaaucaugccuuucacuuucauugcauaucgagaugguugaagacgagacaaguguguccuuuagacaauagagaaugggaauuccaaaaguauggucacuag

SEQ ID NO: 6493 - RNA, 1605 nt, Psylliodes chrysocephala
auggugucccuaaacccaguaagaauucuuaaacaagaagcagaagaagaaagagcugaaauugcucgcuugagcaguuuuguuggugccauugcuauaggagauuugguuagaaguaccuuggggccgaagggaauggauaaaauuuuaguauccagcggacgaagugcaggacacguagaaguaacuaaugauggagcuacuauauuaaaaucuguugguguagauaauccagcagcgaaaauucuuguugacaugucaaaaguacaggaugaugaaguuggagauggcaccacaucaguuacaguuuuggcaucugaauuguuaaaagaggcagaaagguuaguugaacagaaaauucauccucagacuauaauugcuggauggagaaaagcaguugaugcugcaagaaaggccuuauuagaugcuuccaaagacaauagugcuaaccuggaagcauucaaagaagaucugaugaauauagcaaggaccacauuaaguucaaaaauccucucacaacacaaggaacacuuugccaaacuuacuguagaugcaguauugagauuaaaggguucugcugaacugcaauccauccagcugauuaaaaaaacuggagguacuuugcaagauucuuuuuuggaugaggguuuccuuuuagauaaacggccugguguucaucagcccaagagaguagaaaaugcaagaauuuugauugccaauacacccauggacacugacaaaauuaaaguauuugggucacacauuaaagucgacucuauggcaaaaguagcagagcuggaaucugcagagaaggacaaaaugaaagauaaaguuaacaaaaucuugaaacacaaugcaaauguauucauuaauagacaacuuauuuacaacuauccugaacagcuguuugcugaugcuggaguaauggcuauugagcaugcagauuuugaugguauugaaagauuagcacuuguuacaggaggagaaauagucucaacuuuugaccacccagagcuugucaaauuaggcacuugcaacuuaaucgaacaaauuaugauuggagaagauacucuucuacguuuuaguggaguugcucuaggagaagcuuguaccauagucauucguggagcuaccagacaaaucauugaagaagcagaccguuccauacacgaugcucuuuguguacuugcugcaaccgucaaagaaaguagaaucguuuauggugguggauguagugagacauugauggcuacugcugugacuaaagcugcugccaacacuccaggaaaagaagcaguugccauggaagccuucgccagggcuuuacuucaacuaccuaccauuaucgcugauaaugcagguuaugauucugcacagcugauaagugaacuaaaagcugcucacaacaguggccuuaacacuaugggacucaacauggacaaaggagaggugggagauaugaaaacuuugggaaucacagaaucuuuuguuguaaagaggcaaguguuggugucugcugcagaggcagcugaaaugauucuucguguugaugauauuaucaaggcagcgccuagaaggaggacagaagacagagggaugugcuag

SEQ ID NO: 6494 - RNA, 843 nt, Psylliodes chrysocephala
auguuuaggaaucaauaugacagugaugugacggucuggagcccccagggacgucuccaccaaguagaauaugccauggaagcuguuaaccuagguucagcaacaguaggucucaaaagugauaauuaugccguuauaauugcuuuaaaaagagcuucuucggaacucucggcguaccagaagaaaauuaucaauaucgacgaucauaucgguauaacuauaucuggacuuacagccgaugcuagaauuuugaguagauacaugaggaacgaauguuuaaauuauaaguacucauuggaugcuuauaugccccucaacaggcugauuaguaucuuagguaauaaaaugcaacauugcacccaacgguacgaccguagaccauucggcgucggccuacucgucgcagguuucgaugauacuggugcucauauuuaccaaaccugucccucagcuaacuucuacaacugcaaagccaugucuaucggggcuagaucucaaagugcuaggacuuacuuggagaagaagcucgaugaauuaucuucagccucuuuggaagaguugauuaaacaugguuugagggcuuugagggauacuuuaccuccagagguagaccuaaccaccaaaaacgucucaauaggcuauguaggcaaaggucaaaacuucaagaucuuagaagaggaagaaacugcucccuaccucucgcucauugaaggugaagaacgucgcggcgguggaggcggaggcaucgcugacgcuccugcagauccguugagagagggggaagcgggggacgacggucccagagacccaaucccagcggucgccauggauacgacggaguaa

SEQ ID NO: 6495 - RNA, 2568 nt, Psylliodes chrysocephala
auggguuuaaagccuggagaugaaucggaaccaauggaaauuacuuuuaaugaugaugaccuacccuaugaagaagaaauuuugcgaaauccauauuccgugaaacauugguugcgguauauagaucauaaaaaaucggccccgaauaacggaguuaacauuauuuuugaaagagcuuuaaaacaguuaccaggaucuuauaaacugugguacaacuacuuacgaaccagaagaaaccaaaucaaaagcaaauguauaacggauccggguuaugaagaagucaauaacgcuuucgaacgaucuuuaguguuuaugcauaaaaugccuaggauauggauggauuauugcacauuuuugacggaucaguguaaaauuaccagaacuagaaaaguauucgaccgagcucuuagagcuuuaccuguuacgcagcacaauagaauuuggccuuuguauuugaaauucguacagaaacaugauauucaagaaacggcuguaagaguguuucgaagauauaugaaauugugcccagaaaacgcagaggaauacauagacuaccuaucaaauauagaaagauuagacgaagcugcaaugcucauggcaaaaauagucaacgacgaaaauuucguuucgcaacaaggaaaauccaaacaucagcuguggaacgagcuuugcgaacucaucucuaaaaaccccgagaaaguucauucuuuaaacgucgaugcgaucaucaggggcggcuuaaggcgauauacugaucaguuaggucauuuguggaauucuuuggcuaauuauuacgugagaagcgguuuauucgagagggcuagagauauauaugaagaggcgauucagacugucacgaccguuagagauuucacucagguuuuugacgcuuacgcucaauucgaggagcuuaguuuaaguaaacguauggaggaaguggcgacgaagcaaaauccgucagaagacgaugauacggaacuggaauugagacuggccagauucgaauaucugauggagcgcagauuguugcuuuugaauucgguuuuguugcgccagaauccucauaacguacaggaauggcacaaacgaguacaacuuuaugaaggcaaaccgcacgaaauaauuaacacguacacugaagccguccaaacuguggaaccgaaauuggccgugggcaaauugcacacgcuuuggguggauuucgccaaauuuuacgaaaccaacgggcaaaucgaggaggcucgacucauuuucgaaaaggccucgcaagugucguacgucaaggucgacgauuuggccaccguguggugcgaauggacggaaauggagaucagaaacgagaauuacgacgaagcgcugaggcuaaugcagagggcaacgguaaugcccagucgcaaaguggcauaucacgacgauucagaaacgguccaaagucguuuguacaaaucccuaaaaguuuggucaauguacgccgauuuggaagaaaguuucggcacguucaaauccugcaaagccaucuacgacaggaucaucgaauuaaaaaucgccacgccacaaauaaucaucaauuacggcgucuuuuuggaggaaaacaacuauuucgaggaggcuuucagggcauacgaaaaagguauaucguuguucaaauggccgaacguguacgauauuuggaacacuuacuuaacgaaguuuuugaaacgauacggugguacgaaacuggaacgagcucgggauuuguucgaacaguguuuagauggguguccgccgcaauuugcuaaacaucuguacuugcuguacgccaaauuagaagaggaacacggaauggcccggcacgccauggcuguuuacgaaagaucuacaacagcgguuccggaaaacgagauguucgauauuuucaacauuuauaucaaaagagccgccgaaauuuacgguauaccuaagacgcgacaaauuuaugaaaaggccaucgaaguacugccggaggauaaaacaagagaaaugugccuucgauucgccgauauggaaaccaaauugggcgaaaucgauagagcgcgagcgauauacgcucauugcagucaaauuugcgauccgcgaauaacggcggaguuuuggcagaucuggaaagaauucgaggugaggcacggcaacgaggauaccaugcgagaaauguugaggaucaagcgcagcguccaagcugucuacaauacacaggugaacaugaugucggcacaaauguugagcuccgcgggcagcaugagcggcaccauugccgauuuagcgcccgguguaaaagacgguaugcgauuguuagaggccaaagcugcagaaauggcggggauuccgcagagcucgaccaaacccgggaauauuauguucgucagaggggaaacccagggcgcuaauaaggauagagucguuaaucccgaugaaauugauaucggaagcgaugaugacgaugaugaggaggaagaggaugauauacaggucgaaaagcagaacgugccgucggaaguguucggcaguuugaagaagaaucagcagggaaaugaugaggaugaugaagauuga

SEQ ID NO: 6496 - RNA, 1155 nt, Psylliodes chrysocephala
auggcuaacggacccauagcugagcgaaacagagaugcaacaauauauguugguggucuagacgauaaagucucagaaucuuuauuaugggagcucuuuguccaagcagggccuuuaguaaauguacauaugcccaaggaucguguaaccaugaugcaccaggguuacggcuuuguagaauucaugggcgaagaagaugcggauuacgcuauaaaaauaaugaacaugauaaaguuauauggaaagccaauaaggguuaauaaggcaucugcacaucaaaaaaauuuagaugugggagcuaauaucuucauaggaaauuuagacccugaaguagaugaaaaguugcuauaugauacauuuucagccuuugggguaauauugcagacaccaaagauaaugagagauccugagacuggcaacuccaaaggguuugcuuucauaaacuuugcaaguuuugaagcaucugaugcuucaauugaggccaugaauggucaguaucucuguaacagaccaauuucuguaucauaugcauuuaagaaagacucaaaaggugaaagacauggaucugcagcagaacgucuucuagcagcacaaaauccauugucucaagcugacagaccucaucaauuguuugccgaugcaccacccauaggaaugaugccaaugaccauagcaccuccaccaccaccuuuaaucacaggaaugaugccaccuccuccaccuacuccuggaggcaugccaccaccuccucccccaguuccaccaccaaauucuuucccauccggaauaccuccaccuccuuuaccaccuucucaaccgccacuuccacccggagcuccgcccaaccucgccgcaacaggcggauccgggccaagacccccuaugccuggaggcaugccucgcaugccuccgccaccuccauggacgggaggaccuucuggaaauguaccuaugccuccagggccaccuacuucagcugcaucuggaggauuuggcgggauguuuccaccuccaccgccuccuggaggaaggccaccuccgccuaauuggaggccgcccccuccuccaccuccugguuuugguggggugcgaccaccauucccaccuagaggaccgccuccaccaccauucccaccuagaggaccgccuccacca

SEQ ID NO: 6497 - RNA, 774 nt, Psylliodes chrysocephala
augggucguguaauucgggcacaacguaaaggugcgggauccguauucaaaucccauacaaaaaggaggaaaggagcaccaaaacugcguuauuuagauuucucagaacgacaugguuacaucaaggggguaguuaaagauauccuucaugacccaggucgcggugccccguuggcuguuguacauuucagagacccuuacaaguuccaaacuagaaaggagcuguucauugcucccgaaggaauguacacaggacaauuuuuauacuguggaaagaaagcuaaccuccaaauuggaaauguacuaccuguaggaacuaugccugaagguaccauuguguguaauuuggaagaaaaaacuggugaccguggucgauuggcccgugcaucaggcaacuaugcaacaguaauugcacacaaccaugauacaagaaaaacuaggguuaaguugccaucaggagccaagaaggucauuccauccaacaacagggcuaugguugguaucguugcuggaggcggucguaucgacaaacccauauugaaagccggucgugcuuaccacaaauacaaggugaagcguaacugcuggcccaagguucgugguguugcuaugaaccccgucgagcauccucacggaggugguaaccaucaacacaucgguaaggcuucuacugucaagagaggaacgucggccggucguaaagucggucucaucgccgcccgcaggacaggucguaucaggggaggcaaagucgaugccaagaaagaggauuag

SEQ ID NO: 6498 - RNA, 411 nt, Psylliodes chrysocephala
auggcucguaccaagcaaacggcucguaaaucuacaggagguaaagcaccucgaaaacaauuggccacuaaggcggcucguaagagcgcaccggcuaccggugguguuaaaaaaccacaucguuacaggccugguacgguggcucuucgagaaauucgucguuaccaaaagaguaccgaauuguugauuagaaaauuaccuuuccaacgguuaguacgugaaauugcccaagauuuuaaaacugauuuaagauuucagaguucugcagugauggcgcuucaagaagccagcgaagccuacuugguagguuuauucgaagacacuaacuugugugccauucacgccaaacgaguaacaauuaugcccaaagauauacaauuggcaagaagaauucguggagaacgcgccuaa

SEQ ID NO: 6499 - RNA, 1602 nt, Psylliodes chrysocephala
auggcuauuaguuuauugaauccaaaagccgagguugcuagggcugcccaagcuuuagcuguuaauauuacugcggcaaaagggauuucagauguuaugaaaucgaacuuggguccuaaggguacaaugaaaauguuggucucuggugccggugacaucaaaauuaccaaagauggaaauguacucuuacaugaaaugcagauucaacauccuacugcaucuuuaaucgcccgugcuucuacugcccaagaugauaugacuggugaugggacuacaucuacaguuuuaguuauaggagagcuucucaaacaagcagauauauacauagccgaaggucugcacccaagaauacuuacugaaggauucgacaaagccagaguaaaagcuuuagaaguucuggagaaaauaaagauucccguggagauuaauaaggaaauauuaacugauguuuguaagacaaguuugagaacuaaguugcaucaaaauuuggcugaucuccucacagauguuuguguggaugcaguuuuggcuaucagacagccugacaaacccguugaucuacacaugauugaacugauggaaaugcaacauaagacagaaacagauacccaauugguuaaagguuugguccucgaucacgguucucgucaccccgauaugccgaaaagucugaagaauuguuacauacugacgugcaacguuagcauggaauacgaaaaaagcgaagucaauucggguuucuucuacaaaaccgcagaagagagagaaaaguugguuucggccgaacgagaauuuaucgaacaaaggguuaagaaaguugucgaauugaagaaaucucuuugcaacgguacagauaagacguucguugucauuaaucaaaaaggcauugaccccaugagcuuggacaugcucgccaaggaaggaauaaucgcucuuagaagagcuaaaagacguaacauggggcgcuuggcuuuggcgugcggcgguauagccaugaacaguuucgaugauuuacaggaaucucaucucggacgugccggacacguuuaugaacacguuuugggcgagaacaacuacacguucgucgaggauugcaaagugccccagucgguuacuauuuugaugaaaggacccaacaagcacacacugcugcagaucaaggacgccguuagggacggauugagugccaucaacaauacuaucgaagauaaagcgguuauuccaggugguggugccuucgaagugacugccaacaaggaacuguuggccuacaaagacgagaucaaaggcaaagcucgucugggcguggcagcuuaugccgaagcucuuuuggugauuccaaaaacguuggcuguuaauuccgguuucgaugcacaggacaccaucguuaagcuccaggaagaggcacguuugaauccggaaccgaucgguuuggauuuaacguccggggaacccaucaaccccaaagauucuggcauuuaugacaacuacguggucaagaagcaaauuaugaauucguguucgaucauagccagcaaccuguuacucgucgacgagauuaugagggcgggaaugaguagcuugaaguguucauuuauuuaa

SEQ ID NO: 6500 - RNA, 3126 nt, Psylliodes chrysocephala
augucuagugcuggaaucgcagacagcuccaucgauccaccagcaaaaaagcggaagcuugacucgaaacuagcuacccccgaaauggcgaauugugaagcaucaggauccuccaaugucggagacaucgacgagggauuguacuccagacagcuguacguauugggacacgaugcuaugcgccgcauggccaacagugauguacucguaucaggauuaggagguuugggugucgaaguagcuaaaaaugugauccucgguggugucaaaucagugacucugcaugacgaugcucuuugcaccgugcaggauuuaucgucccaauuuuaucuaacggaauccgauguaggcaaaaaccgcgcugaagcuugcugcaagcagcuuucagaacuuaacacuuacgucccgaccaaagcuuacacggggcccuuagaugagaaaaucauaaagaaauucaggguugugguuuuaacuacgaguacucgugccgaacagauacguaucagcgaaauaacucacgcuaaugauauugcuuuaaucaucgcugauacgaaaggucuuuuugcucagguuuucugcgauuuugguaaaucuuucuccgugguggacguaaacggugaaacaccgguaucuacgaugauagcagacaucuccagugauaaagacagcguuguaacuugcauagacgacacgagacacgguauggaagaaggagacuauguaacuuucucugaaauacaagguaugacugaauuaaaccacuguaaaccaauaaaaaucaaaguauuaggcccuuacacguucagcauuggugauaccacuaauuucacaaaauacguacguggcgguaucguuucucaagucaagaugccgaaagaauugaauuucaaaccuuuaaaagaauccuuacagaauccugaauucguuauaaccgauuaugcuaaguuugaucacccugugcaguuacacuuggcuuauacaacucugcacaaguauguagaaaagacaggcagauugccuaaaccuuggaacaaugaugaugcuucucaguucaucacuuuagcuaaaucuuuggccgugaacgggucuacagaugcagaaguuaauacagauauuuuggaaguguuuucgaaagugugugcuggggaauugaacccuauuaaugcuacgaucgggggcaucguggcucaggagguuaugaaggcuucuucugggaaguuccaucccauuuaucaaugguuguacuucgaugccauugaguguuugccucaagagaaaacugaaauuaccgaggaacuagcggcuccuacugguagcagauaugauggacagauugcuguguuuggaaaggauuuccagaaaagauugggcgaacucaaguauuucguggucggcgcuggagccaucggcugcgaauuauugaaaaacuucgcuauggucggucuggguucuagaggcggucaaauaacugucaccgauauggaucugaucgaaaaaucuaaucugaacagacaauuuuuguuuagacccagcaacguacagcaauccaagucggccacugcugccaagguaauaaaaaaaaugaacccagaagucaacaucauagcucacgagaaccgggugggccccgaaacagaaaacgucuacaaugacgacuuuuucgaggcucuagacggcguagccaacgcuuuagacaacgucgacgccagaauauacauggacagacggugcgucuacuaccgcaaaccccuacuggaauccgguacguuaggcaccaaagguaacacgcaggucgugguaccguuccucuccgagucuuacagcucaucccaagaucccccagagaagagcauuccgauauguacccugaagaacuuccccaacgcuauagaacacacucuacaaugggccagagacaauuucgaaggcuuguucaagcagaacgccgaaaacgcuucgcaauaucucaccgauccggauuucaucgauagaacccucaaauuacccggcguccaaccgcuggaaguauuggaauccgucaaagcggcucuggucgacgaaagaccgaaagauuucgacgauugccuggccugggcucgauugcacugggaagaacaguacgccaaucagaucaaacaguugcuguucaauuucccgccggaucaguugaccagcaccggccaacuguucuggucggggccaaagagauguccagagccguuggaguucgacgucugcacugauuugcauuuggauuacgucuuggcgacggcuaauuugaaggcgcaaguuuacggaauucccaccaguagggauagaugucacgccaagcaugugcucagcaaaguugaugugccgaaguucgugccgaaaucgggcgucaagaucgccgugaccgauucacagauggccaugaacggcaacaacguugaucuagaucgcgugacucaaauaagagaggagcugcccucgguugcggaguugagcggauugcgucugacgccucucgaguucgagaaggacgacgauuccaauuuccacauggauuuuauaguggccgcguccaacuugagagccgccaauuacaagauacccgccgccgauaggcacaagucaaaguugaucgcuggcaagauaauuccggccauagcgaccaccacguccgucguagccggucuggugugccucgaguuauauaaguuggccagaagcacuaagagcuugacgccguucaagaauggcuucguaaacuuggcguugccguucuucgguuucucggagccgaucgccgcgccuaagauggacuauugcggcaaucaguggacgcugugggauagauucgagguacagggcgagaugacguugagcgaguucuuggaguauuucaaggagaagcacgguuuggagauuacgaugcugucgcaaggcgugugcaugcuguacucauuuuucauggccaaagccaaggcucaagaacgguuaggccucacgauguccgaaguggucagaaggguguccaaaaagaagaucgaaccgcacgucaaagcgcucguauucgaguugugcuguaacgacgccgacggcgaagacgucgaaguuccuuacgugaaauacaacuuguguuga

SEQ ID NO: 6501 - RNA, 1305 nt, Psylliodes chrysocephala
auggccgaugcugaugaucuauuagauuacgaagaugaggaaaauccagaacagaccacaacugaaacuaccacaacagagguucaaaagaaaggugugaaagggacguacgucucaauucacagcucagguuuucgagauuuucuuuuaaaaccagaaauccucagagcuaucguagauugugguuuugaacacccuucugaaguucagcaugagugcauuccucaggcuguuauuggcauggacauucuuugccaagcaaaaagugguauggguaaaaccgccguauucguauuagccacucuccaacaacuagacccgaccgaaaaugccgucuacguccucgucaugugccauacgcgugaguuggcuuuccaaauuagcaaagaauacgaacguuucaguaaauacaugcucaacaucaaggucgguguauuuuucggaggucugcccauucaaaaagacgaggaaguauuaaaagccagcuguccccauauugucguuggcacgccuggacguauuuuggcucuugucagaucuaagaaacucaaucucaagcauuuaaagcauuuuauucuugaugagugcgauaaaauguuggaacuauuagauaugagacgcgacguccaagaaauauaccguaacacuccgcacggcaaacaaguaaugauguucagugcgacccucagcaaagaaauccggccaguuugcaagaaauucaugcaagaucccauggaaguguacguugaugacgaagccaaauugacccuucacgguuuacagcagcauuauguaaaacuaaaagagaacgaaaagaauaaaaaguuguuugaguuacuagaugucuuggaauuuaaccaggucguuauauuuguaaagucggugcaaagguguguagccuuagcgcaauuguuaacagagcaaaacuuuccagcaauuggaauucacagaggcauggaccagaaagagagauugucucgguaugagcaguuuaaagauuuccaaaagagaauuuugguagcaaccaaucuuuucggacgcgguauggauauugaaagaguaaauauuguauucaacuacgauaugcccgaagauucggauaccuaccuacacagaguagcuagagcuggucgauucgguaccaaaggauuagccauuacguucguuucugaagaaggagaugcuaaaauucuuaacgaaguacaagacagauuugaugugaauauuacugaacuaccugaugagaucgauuuaaguucauauaguaaguauacaaccauuuauaaagcgggugaaaagaacuaa

SEQ ID NO: 6502 - RNA, 1473 nt, Psylliodes chrysocephala
augggaguuguugaaacagauguugaaaugaaaaacgccgacaguccuggaggauuggaagcuggagauagcaaaaaagacacugacaugcaaaguguaauagaaauucgagaacaugcaagacagauugaaaaagccguaagcagcaaggaaaaucgauuuauuuuaagaguuuugcguuguuugcccaacacuagacgaaagcuuaauggaguaguucucagaagucuuauaaaccaaauauauccuguagccgagagagacguccuacuugguuuuacugaagaggcugcaacugaacuugacacuacgcaaucuagagcuagaucagcuucaaaaacuccuguuccagaaguugaugcuuauauuaacuuguuaauuuugguucguuugauugacacuaauaaacuaccagaagcagaacguuguucucaagcacucaugaauaaaauuacuagucaaaaucgccguuccauagaucuuguagcagcuaagugcuacuuuuaucacucaaggguuucugaacuuacugauaaacuugauucaauuagagguuuucuacauucucgucuucguacugcuacucuuagaaaugauuuugaaggacaagcuguacuuauaaauugcuuauugagaaacuauuugcauuauucauuauaugaucaagcugacaaguuaguaaguaaaugugucuuuccugaaacggcuaguaauaaugaaugggccagauuuuuguauuauuugggucgaauuaaagcugcuagauuagaauacaguguagcccauaagcaccuuguucaagccaugagaaaagcaccucagaaugcugcaauagguuuuagacaaacuguucagaaacuaacuguuguaguugaauuacuauugggagauauaccagagagacaaauauuuaggcaagccagcaugaggcauucccuugcaccuuacuuucaguugacucaggcgguaagaaugggaaauuugcagagauuuggagaaguuuuggaaaacuuuggaccacaauuuagacaagaccauacuuuuacuuuaauucuacgucuccgucacaaugucauaaagacggcuauaagaucuauuggucugucuuauucuagaauuucuccucaagauauagcuaaaaaacuuggucuugauucagcugaagaugcagaauuuauuguggcaaaagccauucgugaugggguaauugaggcuacucuagauccucaaggugguuucaugagaaguaaagagaguacagauauuuacuguacaaaggaaccacaacuugcuuuucaucagagaauaucauuuugcuuagauuugcauaaucaaagugugaaagcuaugagauauccuccaaaagccuauggaaaggaguuagaaucugcugaagaaagaagggaaagggaacaacaagauuuagaauuagcaaaagaaauggcagaagaagaugaugauggcuucccuuaa

SEQ ID NO: 6503 - RNA, 1833 nt, Psylliodes chrysocephala
augcgaaguaaccaucaagcucucccuguuucuaccaucuugaaauccaaaaccgaaauagaagaugaacccaagaaaaaaucuagggaagacuggcguaaggcgaaagaauuggaagaggcucguaaagcugguacagcgccugcagcagucgaugaagaagguaaagacaucaacccucauauuccccaguacauuucaacggcuccuugguacuauggaaccgcugggcccacuuuaaaacaucagagaccccaagaggacaaacagagggaauuuuccggguuagaugauugguauaagagaggaguagauacaucaaaaauaguuacaaaauauagaaaaggugcuugugaaaauuguggagcaaugacucauauaaagaaggauuguauggauagaccuagaaaaguaggugcgaaauuuucaggagcaaauauagcaccggaugaguuuacucaaaaaaauuuggcauugaguuuugaugguaaaagagauagauggaguggauaugauccuucagagcauaaagcugucauagaagaguuucaaauaguagaagaagcgaaacgacaauuaaaggcagacaaauuaaaugcaaaugaaucauccgaagaugaagaaaaggacgaagauaaauauguagacgaaguugacaugccugguacaaaaguagacaguaaacaaagaauuacugucagaaauuuaagaauaagagaagacacugcgaaauauuuaagaaauuuagacccugcuucagcuuauuaugauccaaaaacaagaucaaugagagagaauccgaauccugaaagagaugaaacauaucauggugaaaacuuugugcguuucucuggugacacaacgaaucacgcaagagcucaacuauuugcuugggaagcucacgaaaaagguguagauguucaucuacuagcagagcccacuaaauuggaguuacugcaaaaagaauacgaaaagaaaaaagaugaaguuaaaucuaauauucagaguacgguuuuggagaaauaugggggccaggagcauuuggaagcuccaccuaaaaguuuauuguuagcucagacugaacaguauguggaauauucaagggcuggaagagucauuaaaggagccgaaaaagaaguuauucuaucuaaauaugaagaagauguuuauauaaauaaccacacuucaguuugggguucucauuggagaggaggacaguggggauaucgguguugccauucuuucauuaaaaauucguacuguuugggagaagcaggaaaauccguuaauguacaacccauaguggaaucgauuuccaaugaagaggaaauuggaaaaccuguuggagaugugcaagaaaaggaaaagagcaaagaaaaggacgaggaaagugaagaaagcgauucgagcaguucgucagaagauaauucaaaagugaaagcgcagaaaaaauuaaagaaaaaauugaagaaacagaaaaagaaggaaaggaagcaaaagagaaagggaaaaauaaaagaaaaggaugaagaaagugaagaaagcgauucgagcaguucgucagaugacgacaauucaaaagcgaaagcccagaaaaaacuaaagaaaaaacugaagaaacagaaaaauaaagaaagaaagcagaaaagaaaggaaaaugaaaaggaaaagaaaaaaucuuccguguuacuggacgauccagaaauuauucuggaugauaggaaaagaccuuauaacaguauguuugaggcuaagaaacccacagaagaugauauggaggaauauuuuaaaaagagaagaagagaugaagaucccaugaaccaguuuuuguaa

SEQ ID NO: 6504 - RNA, 615 nt, Psylliodes chrysocephala
cgagaucauuggcauaaacgaagggccaccggaggcaagaggaagccucuucgcaagaagaggaaguucgaauuaggccguccggcggccaacacgaaacuaggaaccagaaggauccauuauguucguacgaggggaggcaacuugaaguaccgcgcccuaagauuagacaccggaaacuuuucuugggguagcgaagguacugcccgucaaacacguauuaucgaugucguuuacaacgcuaguaauaacgaauugguccguaccaagacguugguaaagaaugcuauuguugucauugacgccaccccguucaggcaaugguacgaaaaucacuacaucuuaccauugggacgcaagaagggugccaaaaugacgccugaagaggaggagauuuucaauaaaaagcguagcaaaaaaguacagaagaaguacgagacuaggcaaaaaaccgcuaaaguagaacccgcgaucgaagaacaguuccacaccggaagauuguuggcaugccuugcaucuaggcccggacaaugcggcagggccgaugguuauguccucgaaggaaaggaacuugaauucuacaugcguaaaauuaagucuaagaaagcuaaauaa

SEQ ID NO: 6505 - RNA, 936 nt, Psylliodes chrysocephala
auggauagacuucuucgucucggcggcggaaugccagguuugagucaagcaccgccaccuuccgaugcccccguuguagacacagcggagcaaguauauauuucaucuuuagcuuuacuuaaaauguugaaacauggucgugcugggguaccaauggaaguaaugggacuuauguuaggugaauuuguggaugacuacacaguccguguaauagauguuuuugcaaugccucagacugguacuggggucaguguagaagcaguugauccaguauuucaagcuaaaauguuggauauguugaggcaaacugguaggccagaaaugguagugggaugguaucacucucauccagguuuuggaugcugguugucaggaguugauauuaacacacaacagaguuuugaagcacuuucugagagggcuguugcagugguaguagacccaauacaaucaguuaaaggaaaagucgucauugaugcauuuagguugaucaaucccaacaugaugguuuugggacaagaaccucgccaaacaacaucuaauuuaggacaccugcagaaaccuucagugcaagcacugauccaugguuuaaaucgccauuauuauucuauaaguauuaauuacaggaaaaacgaacuugagcaaaaaaugcugcuuaaucuacauaaaaaguccuggauggacggucuaacuuuagcugacuauucagagaacugcaguguuaaugaaaaaacuguugcugacauguuggaauuagcuaagaacuacaauaaggcauuagaagaugaagaaaaaaugacaccagagcaacuugcaauaaagaauguggguaaacaagauccaaaaaggcauuuagaagaaaaaguugacauauuaaugacuaacaauauuguacaauguuugggagcuauguuagauacgguugucuuuaaauga

SEQ ID NO: 6506 - RNA, 1215 nt, Psylliodes chrysocephala
augacgguaauuaauaagauggagguggauggggcccucaaaggugaaggauuuagaucauauuauaucaccaaaauugaagaguuacagcuuauuguagcugaaaaaagucaaaaucuucgcagguuacaagcucaaaggaaugaacuuaaugcuaaaguucguaugcuuagagaagaacugaugcuucuucaagaacagggaagcuauguuggugaaguuguaaaacccauggacaagaaaaaaguacuugucaaaguacacccugaaggaaaauuuguuguugauaucgauaaaaacauugacauuaaugaugucacaccaaauuguagaguagcccuuagaaaugaaucauacacauugcauaagauuuuacccaauaagguugacccauuaguaucacuuaugaugguagaaaaaguaccugauucuacauacgaaaugguuggagguuuagauaaacaaauuaaagaaaucaaagagguuauugagcugccaguaaagcauccagagcuuuuugaugcuuuggguauugcccaacccaaggguguauuguuguauggcccuccaggaacuggaaaaacucuguuggccagagcaguagcucaucauacagaauguacauucauucgaguaucugguucagaauugguucaaaaauucauuggagagggcuccagaauggucagggagcucuucguuauggccagagagcaugcaccuuccaucauuuucauggacgaaauugauucuauaggaucuucucguauugaaucuggcucugguggugauucugaaguccaaagaaccauguuggaguuguuaaaucagcuugaugguuuugaagcaaccaaaaacauuaaagucaucauggcuaccaacagaauagacauucuugauccugcuuugcuuagaccuggaagaauugacagaaaaauugaguucccuccaccgaacgaagaagccagauuggacauuuugaaaauucauucgagaaaaaugaaucuaacuagagguaucaauuuaaggaaaaucgcugaauuaaugccaggugcuagcggggcugaaguuaaggguguuugcacagaggcggguauguacgcuuugagggagagaaggguucaugugacacaagaagauuuugaaauggccguugcuaaaguuaugcaaaaagauucugaaaagaacaugucuaucaaaaaauuguggaaauaa

SEQ ID NO: 6507 - RNA, 666 nt, Psylliodes chrysocephala
augccuauacuuuacaguguuaucugucgggguaguacugucuuaguuaaauaugcaacaugcgcuggaaauuuuggugaaguuacagaacaaauuauagcaaaaauuccgccucacaaugauaaacuuaccuauucucauggaaacuaucuuuuucacuacguuuuagaaaaucguauucuguacaugugcauaacagaugaugaauuugagagaagucgagcauuuuuauuucucaaugaaauuaaaagacgguuucaagcuacuuauggagcuagugcugauacagcuauugcuuaugcaaugaauucagaauuuuccacaauauuggcuacagaaaugaaacauuauuccgaaucucacgaucuugauacaauauccaggguccacagugaauuagaugaauugaagaauauuaugguuaaaaauauugauaauauugcaaugagaggugaaagacuagaacuucuggucaacaaagcagauaaucuaaauaauggaucgaugacauuuaggaccacaaguagaaaccuagcucguucguuauuuuggaaaaacaucaaacucuacguuauuauuggugucgucguaacugugauuauuuauauuauuauuuccauaucuugugguggguugcuuuggcagggauguuugucacacaaauag

SEQ ID NO: 6508 - RNA, 729 nt, Psylliodes chrysocephala
auguuucuuacgagaagugaauacgauagaggaguaaauacuuuuucuccagaagggcgauuauuucaagucgaauaugccauugaagcgauuaaacugggaucaaccgcuauuggaauaugcacaagcgagggugucguuuuagcaguugaaaaacguauaacuuccccucugauggaacccacuacuaucgagaagauuguagaagucgacaaacauauuggaugugcuguuucaggucuuauggcagauucacguaccaugaucgacagagcuagaauagaaugccaaaaccacugguucguuuacaaugaaaauauuagcauugaaucaugugcacaggguguuucaaauuuagcaauccaguuuggcgauucagaugaugacggugcugcaauguccagaccuuuuggaguggcuauuuuguuugcugguauugacgagaaaggaccucagcuauaccauauggauccaucggguacuuuuguucaguuugaugcaaaagccaucggguccgguucagaaggagcgcaacagagucuacaagaaguauaccaucgcaguaugacuuuggaggaagcgacgacugcagcguugaccauucucaagcagguuauggaagaaaaauugaauucugcgaauguagaagucaugacaaugacuccaaaagacuuuuuccacauguuuacuaaggaucaaguggaagagguaauuucuaaauugucuuaa

SEQ ID NO: 6509 - RNA, 1158 nt, Psylliodes chrysocephala
augacagaguacugguuaauuucugccccaggugacaagacuugucagcaaacaugggacacaaugaauaacuugacuaguaaacagaauagcuugucgacaaauuauaaauuucagaucccagauuuaaagguugguacucucgaucaacuagucggucuuucugaugacuugggcaaauuggauggguucguggagcaaguuacuagaaagguugcucaguaccucggcgagguacucgaagaucagagagacaaguugcaggagaacuugauggcuaauaacaccgauuugccaaguuauuuaaccagauuucaaugggacaucgccaaauacccgaucaagcaaucccugcgaaacauugccgauauaauaaguaaacaaguuggccaaaucgacgcugaucucaagaccaagucgucagcguacaauaauuuaaagggaagucuucagaauuuggagaagaaacaaacuggaaguuugcuaacacguaacuuggcagaccuagucaagaaagaacauuuuauuuuagauucggauuauuugcagacuuugcuggucaucguuccaaagucucaauucaaugaauggaacgcuacuuacgaaaaaauuacagauaugauuguaccgcgcucgucagagcucauuacucaagaucacgaauacggucuauucaccguuucgcucuucaaaaaggucguugaagaauuuaaguugcacgcaagagaaaagaaguuuauugucagagauuucacuuauaacgaggaggaacuggcagcugguaaaaaugaaauuaccaaacucguuacugauaaaaaaaagcaauuuggaccguuggugaggugguugaaagucaacuucagcgaaugcuuuugugcuuggauacauguaaaggcguuaaggguguuuguugaguccguauuaagauaugggcuaccagucaauuuucaagcuauccuaauccauccaaauaagaagacacugaaacguuuacgagauguguuaaaucaacucuauggucaucuagacaguagcgcugcucuuuccggacccaauguugauagcguagacauuccaggcuuagguuuuggccaaucagaauauuacccguacguguacuacaaacugaacgucgauaugauagaaucgaagaucuaa

SEQ ID NO: 6510 - RNA, 1677 nt, Psylliodes chrysocephala
augucgauauuagcuaguccucuaucaguagccgguucaagaaccaccggagccucaguucguacucaaaaugucauggcagcaucuacaauugccaauguaguaaaaagcucauuggguccaguaggauuagauaaaauguugguugaugauauuggagaugugaccguaacaaacgauggagccacuauucugcgacuuuuggaaguagagcauccugcugcuagaguuuuaguugaauuagcccaguuacaagaugaagaagucggugauggcaccacauccguuguaauaauagcugcagaauuacuuaaaaaugcugaugagcuuguuaaacaaaaaauucauccuacuucuaucaucagugguuauagauuggcuuguaaggaggcuugucgguauauucaagaucauuuaaccauaccaguagaggaauuggggaaggaguguauuauaaaugucgccaagacaucuaugagcucaaaaaucauuggagcugaugccgauauuuucucacaaaucgucguugaugccgcuaccgccaucaaaguaacagauucgaaggguaaugccauguaccccaucaaagcugucaacguccuuaaagcgcacgguaagagcgcuagggagagcuuuuugguugccggauacgcucuuaauuguacagucgccagccaggccaugcccaagaagauccuuaacgccaaaaucgccuguuuagauuuuucuuugcagaaggcuaagaugaagauggguguacaagucuugaucaccgaucccaaucaccuggaagggauccgcuccagggagcuggacaucaccaaggagcgcauccagaagauccuggcgacgggagugaacgucauccuauguuccggggguauugacgaucugugucucaaguauuuuguagaaaacggcgccaugggggugcguaggguuaaaaaagcugauuugaaacguaucgcuaaagcuacgggcgccgcuuuugucacuucacucagcaacauggaaggggacgaaacauucgaugccaauauggucggcgaggcagcugaggucguacaagaaagaauauccgaugacgaacuuaucauuauuaaaggccccaaagcccgcacagccgcuucaaucauccuucgcggacccaacgacuuuuacugugacgaaauggagcgcucagugcacgacgcacucugcgucgucaaacgcguccucgaaucaaaaagcgucgucgugggaggcgguagcgucgaagcggcauugucaaucuaucuggagaacuuugcaacaacgcucagcuccagggagcaacuugccaucgcugaauucgccagaagcuugcugguaauucccaagacguuggccguuaacgcugcccaagacgcgacugaucuaguggccaaguugagggcauaccagaacuccagccagaccaaaaaggaccaugcacauuugaaguacgucggauuggaucuuauugaagguaccguacgggauaacagaaaagcuggagucuuggaaccgacuaugucaaagaucaaaucuuugaaauucgcuacugaagccgcgauuaccaucuugagaaucgaugauaugauaaaauuggaugccgaacagaagggcggugguaaaaguuaccaugacgccauggauagcggagaauuauaugauuaa

SEQ ID NO: 6511 - RNA, 765 nt, Psylliodes chrysocephala
auguuuaauccauuagaaagugcaccaccuugguggcauaacgguccaguuccaggugcuuuuuacaauuuuccaggcacucaaagaauuccugcugccaacccgauaacccauacucaaucuccuguaacuacaucaacuucuauaauagcuauuacuuaugauaaagguguauuaauugcuggagauuuagucgccucuuauggaucuuuagccagguacagaaauugucccaggguaauugaaguuaauccuaauauaauauuaggagcugguggagauuaugcagauuuucaguacgugaaaagcuuuauugagcagaaaauaauugaugaagacuguuuagaugaugguuuaaaaaugaaaccaaaaucucuguauuguuggcuuacaagaaucauguaucaacguagaaguaaacuugaccccuucuggaauaaucuuguaguaggaggacugcaggaugguguaccuuucuugggaaccauagauaaacuuggcacagcuuacacagauaaaguuauuuguacuggguauggagcucacauugcucucccuauucuucgggaugcucuugauaagaaaaccaacuugaaucugaaugacgccaaagcucuuauaaagcggugcauggaagugcuuuuuuacagagaugcaagaaguuuuccaaaauaucaguuagguauuauugauaaggaugauggcgugaaaauugagggaccacuuacaguugaagaaaauuggaauauugcuuacaugacguaa

SEQ ID NO: 6512 - RNA, 2124 nt, Psylliodes chrysocephala
auguuauuuguugugucaaaaguaaacaaaauggaauuuucaaaagaacccaauuuugauauguuaacagcuaaggauuuuacaccagaaaaauacguuaagaaacuaucucaaaacuaugugggcgguuccgaguuacaaaaucuucgcagaaaaauuaaaucgcuuuccgaagaaaccaguaguaacuuaaagaaaaauguuuacgaaaauuauguacaguucauugaaaccgcaaaagaaauaucccauuuggagagcgaaauguaucagcuuucuuacuuacuuucagaacagaaaucuuugcuuagugcucuaucuacuacaucaauuuuagaagauaugcaaccgauuaacauugauagagauaauaaagugaaugagaaagauuucgaagaagaaaauaaacaaaaauuagcugccauuuuagaaaaaguagagggauguaaagaauugcuagaaguuccuggaaggacuuuuuuauaugaaggagauuuacuugaaauugaucccacagaaaauacaucuuuaaagacuguucauguguauuuauuuacagaugguuuuaugauaacuaacaggaauucuaacagucgaggucuuaugaaguaugucuaugaaauuauguacgaccuaagcagccuagcuguggugaauguaagagacuugggaaaugucaaacaugccuuuaaacuucuaauuuuuccugacacuagaguguuucaguguucuuccaacucuaauaaaaaagaaugguuggauaaauucgaucaagcuaagaaaacaaggcuagcucaggaacagcaaaaacgagaaucaauuacugaaaaauccccaucucgcucagcaucuauugagucgcccacuuauaacccauuugaagaagauauggguaccauucacccggaaugguuuuuagauauuccugaagaacuugacguuuguguagcccaaagacauuuugaagaagccuugucuuuauuacagaaagccaaagauuauauaaaucagacugcuucuuccagugagaaacaugaucacguucucauugauauucaaagaaagguggaacaaagacagaacagucuaacugaagugcuaaugaaagaacuagaaguuaauccugacaaaucucugcaaggugguuugagagcagcacguagagcuguuagguugcugaaucaauuaggaagggaaacucaaucaugcaaccuguuucugaaauugugcaguaguauguugagaacucaauguaaacgaguaaaacgagaagguucgaccacaacuuauauaagacauuuaucuaguguaguuuuuacuaauaugugucacaugucugaugaguuuuuacgagccuuucccgauucgccagcuugugcuucagcuuauguugugugggccagcaaugaacuguuacaauuuacaacccauuugauuaaacaaguuuuuaugccucagacuucccuggcaacuaucacagaaugcauaauuuuggucagaacacagugugaaagguuauacgguuaugggaucgaccucuguuaucaguuagauggcgcuuugaggucgucgcuaaugaaagcuuuaagagaugcucgagauaaacuuaucgauucuauaaaauugcgagcccuagaugacaaauggauucccaugaacuuacauuccaaaucgucuuuaggacguugcauacaagaacacgcccaaaugggguugaauuuggaaagcuacguuucaggugauacuugguugcaauugacagcaaguacauuaucguuuacaaaaauguuucuaagcuuauugaacgacuguaugaaauuaaaaaccacagaauuaauguauacuaucgaugaaacucuauauaacgucuuugaagcacaaauaagacauaaugaaaaugcucucagaacugaauuaaaucaagaacaacgaacauuucuuacgaaaaacgccgaauuuuuguuggucaauuugauagaaguugcgcaaaagaaauacaaggaaaauguugguuaugaaugccagacucuacaaaaauugcguaaggaauauguugcacugcagaaggguguaucgccuacaucaagaaguacaaagaccaaauauucuucagaauuuauuuaa

SEQ ID NO: 6513 - RNA, 3837 nt, Psylliodes chrysocephala
augaaugaauuagagaaguuagaauaucucucuuugguuuccaagguuuguacagaauuagauaaucaucucggaaugaacgauaaagauuuagcugaauucauuauacaucucucugaaaagaacaauacuuuagaaacauucaagaaggcucucuuagaaaauggagcagaguuuucagacucauuuauuucuaacuugcugcgaauuauucaacacaugaagccaaaaaaggcugccaacaaagaagaggcucuacauauugagaaagaaggacuagcguuuaaauuucccggucuggcaauacccaaugaagcccaaaagccauuauuuuuggaagagaaagaugaaaaaccuuuggaaaaagaaaaaguugaagaaguagauauaguagcugauaugaugaaacaguuugaagccgaugcuccuucucaaaagcaaaccaccaccagagacagaucuagaagcgcaaguguugaaagaaaaccaaagaaaagauccagaagcagaucuagaacaagaagaaggucuagaucaagggaaggaaacucuagaagagauaaaacugauaagaggcaucgaaguagguccagagaugaccguaaaaaacguagaaaagauagaaguaguuccaaaacuagagagaggaguggaucaagggauagaagagagucagggagaucuagagauacagauaaaagggaaagaaauagaucgagagauaggagagauagaaguagaucaagagauaggagagauagaaguagaucaagagauaggagagauagaaguaagucuagagauacagauaaaagggagagaaauagaucaagagauaggagagauagaaguagaucuagagauagaggaagaagagaugggaguagaucuaggacuaacagaagggaaagaaguucugagaagaaauuuaaaagugaaaaagauaauccugaauuugaagaagauccuacuccaggaaagauuuauaauggaaaagugucgaauaucguuccauuuggauguuuuguucaguuggaaggcuugaaaagaagaugggagggucuaguucauauuucucaacugagagcugaaggcagagucacaaauguuucagaaguagucgcuagagggggcaaaguaaagguaaaaguauugacaauaacaggccaaaaaguuucccuuuccaugaaagaugucugccagaugacaggaaaagauuugaacccccacucccaugcaccugacgaaagagaagacaaagacagaaacccugacagaccgaugaacaauagcacaucaguucuaagacugccggucagcauagaugaaggugaagaggacucuaggaagcgaguaacaagaauuuccagcccagaaaggugggaaaucaaacagaugaucucaucuggauguauagauaaaagugagcugccugaauuugaugaagaaacugguuugcugccuaaagaggaagauggagaggcugauauugagauugaauugguugaagaugaaccuccauuuuugcaaggccacgguagagccguccacgaccuuaguccagugaggauagucaaaaauccugauggaucucuagcccaagccgccaugaugcaauccgcucucgccaaagaacgcagggaacaaaaaaugauucaaagagaacaagaagucgauucacaaccauccgguaagaacaaaaauuggauugauccacuucccgaagacgaaaccagacugauggcgaggggaauaggccugcaaagccaggauuugcccgaguggaaaaagcacgucauuggugguaaaaagucgucuuucggcaaaaaaaccaaucugacgauaaucgaacagcgccagucucuuccuaucuacaagcucaaagaagaauuacgaaaagccguuacggacaaucaaauuuugaucgugaucggcgaaacggguucugguaagacgacgcagaucacucaguauuuggcugaagccgguuucacagccaggggaaaaauaggauguacucagccaagaagaguggccgccaugucgguggcuaagcgaguagcggaggaguuuggauguagauugggacaggaagucggauauaccaucagauucgaagauuguacuagcccugagacgaugaucaaguacaugacagacgguauguugcuuagagaaugccuuauggacuuagaucucaaaaauuacucggugauuauguuggacgaggcucacgaacguaccauccacaccgacguccuauucggucuucugaaacaagcugucuugaaacgcgaagaacucaaauugaucgucaccucggcaacgcuggacgccgucaaauucucgcaguacuucuucaaggcgccgauauucacgauacccggcagaacguuuccggucgaaguuuuguacaccaaagaaccggaaacugauuauuuggacgccagcuugaucaccgugaugcagauacaccugagggaaccgccuggcgauauuuuacuguuuuugaccgggcaggaggagaucgauacagccugcgagauucuguaugaaagaaugaagagucuaggucccgauguaccugaacuaaucauccuacccguguauuccgcguuaccaucagaaaugcaaacuaggauauuugaaccggcaccgccggguagccgaaaggucguuauagcuacaaauauugccgaaacgucucuaacaauugacgggauuuauuaugucgucgauccgggauucgucaaacagaaaguuuauaauuccaaaaccggaauggauucgcucguaguuacacccauuucgcaggcgcaagcgaaacaacgcgcaggccgugcagguagaaccgguccuggaaaaugcuacaggcuguacaccgaaagggcguaccgcgacgaaauguugccgacgccggugcccgaaauccaacguacaaauuuagcgacgacggugcuccagcugaaaacuaugggcauaaacgaucugcuucauuucgauuucauggaugcuccgccuguagaaucucuaauaauggcgcuggaacaguugcauucguuaucggcccuagacgaugaaggacuguugacuagauuggguagaaggauggcggaauucccgcuggaacccaaucuaucaaagaugcucauaaugucgguggcgcuucaauguuccgacgaaauuuugaccauagugagcauguuguccguucaaaacguauucuaccggccgaaagacaagcaagcgcuggccgaucaaaagaaggcgaaauucaaucaaccggaaggcgaucauuuaacgcuguuggcgguuuacaacaguuggaagaacaacaaauuuucgaacgcuugguguuacgaaaauuucguacaaaucagaacguugaagagggcacaggaugucaggaaacaguugcucgguaucauggacaggcauaaauuggacguggugucugccgaaagaaauaccgucagggugcagaaggcuauuuguucagguuucuuuaggaacgcugggaaaaaggauccucaggaagguuacaggacuuugguggacagucaagugguauacauucauccuucuagugcuuuauucaaucggcaaccugaaugggugauuuaccacgaauugguccagacgacgaaggaguacaugagagaagugacgacuaucgauccgaaauggcugguugaguucgcgccugcguucuucaaguucuccgauccuacgaaguugaguaaauucaaaaagaaucaacgguuggagccuuuguacaacaaauacgaagagcccaacgcguggaggauaucgagagucaggaggagaaggaauuaa

SEQ ID NO: 6514 - RNA, 1254 nt, Psylliodes chrysocephala
augaccucaaaaagaaaaaaugaaaaaaauauacuugcuaaaguuaauuucccucuuuauaccauuaaaaugcuaucuucaaggcauguaauuguagguggaggugguggaucuucaaagacggggguugaaaacgguuuugaaauauaugaaauuuuucaugacggacaaaaauuuggcgcuaaagaaguuacaagacaugaaacugguggaaauguaguuaugaacugcuguguauuuaaugacaaaaaaaauuccuauuugguagcuggucaagaaagucacugucaauuauauaaaguuaacacaaaauuaguagaacaaguuaaaguggagaacauuggaaaugauauacauauuaaacaaagaaauacaaauuuaaaaccuaaagaacaaguagauaauaauaaaaauguuaaaaaagaauuauacuauacucuuaauccuauggacaguguacagacagauuuuaaugguucugaaccauuaucuagaguaguuagaauuaauuaugauggaaaaguauuagcaacuggaggcacugauggcgauguaagacuguggaaguuucccaguuuacaaccccucuucauucuaaaaggccauaagaaagaaauagaugauguagacuuuaguagacaugacaauuauguuauuucaauugcuaaagaugguuuaggaauauugugggauuguaaaacgggaaaugaaagaucaaaacugacauggaaacauccagaaggaucaaaguaucuguauaaaagauguagguuugguguuauugaagaacaaaaaaauaaaucagcauuauauaugauugcuaacgcagucaauccuaaacacaagucuuuccuucaacaauggauaccugaggagaaugacuugaaaaaauauucagaauuugaugaaacucuugcaaccuuggcagugcgagaugauggcagauuuguugcaguugguaccauguuuaguggaucuauuucuauccauguugccuuuaguuuacagaaaauauuaacuguugcuggugcucauuccauguuugugacuggucuugaauuccuaucgaguauaaauacgaaucauuccauaaguagcguagcggaggcugccguacuaucaauuucuguagauaaucgauugugcauacacacagugccguacagacggacuauaccacuguggauuggaauuauguuauuaguucuuacauuauuucuuacuuuucuguuaugugcauaccuagguuuguga

SEQ ID NO: 6515 - RNA, 1308 nt, Psylliodes chrysocephala
aaagaaugcauagaaugggcaaaagaagaaagaagaacgcucuugcgccagaggaaagggagaaauguagcuggcgcagggcuauucgaaagagcucaaucuguaccuucccaacaugacaaguuguugaaacuaaacagagacgaugaagaagaugaugaaaauaucgucaauaaagaacaagauauccuuaaccugggugagaaguacaaaaaggagggcaaggcuaaggaacuagcggagcucauaaaggcuacuaggccuuuuuugagucuaauuaguaaagcgaaggcugcuaaauuaguuagaucguuaguugacuacuuuuuggaucuagaagcugguauugguaucgagguccaacuuuguaaagaaugcauagaaugggcaaaagaagaaagaagaacguucuugcgccaaucccuggaagcccgacuuauugcccuuuauuucgauacuggaauguacgccgaagcccuacauuuagaauccacauuguuaaaggaauuaaaaaagcuugaugacaaaaauuuguugguggaaguucagcuucucgaaagcaaaacauaucaugcuuugaguaauuuaccgaaagcccgagccgcuuuaaccucggcacgaacaacagccaaugcuauauauugcccuccaaaaaugcaggcugcuuuggacuugcaaucugguguccuacaugcagccgaugagaaagacuucaaaacugcauacucauauuucuaugaggcauucgaagguuucgauagugucgagucccccaaggcucuaacugcucuuaaguacaugcuucuguccaaaauuaugauuaacaguccugaagauguccagcaaauuguuaguggaaaauuggcuauuaaauaugcuggacaagauauugaugcaaugaaagcaguugcacaagcugcccacaaaaggucccucgcagauuuucaacuugccguaaaacaauucaaacacgaacuagaagacgauguuauuguaagagcacacuuagguacccuuuaugacaauauguuggaacaaaauuuauguaggaucaucgagccguacucuagaguccaaguagauuauauagccaaaacuauuaaacuuccagucuugcaaguagagaaaaaauuaucacagaugauuuuagaugccaaguuucacggaauuuuggaucagggugaagguguccugauaguauuugaagaaacucccguagacaagaccuaugaaauggcucuggaaacgauacagagcaugagcaaaguaguagauacucuuuaucaaaaggcgaaaaaauugucauag

SEQ ID NO: 6516 - RNA, 1755 nt, Psylliodes chrysocephala
auggcaucgcgaucgaaaaaaggaucaacgccgucggcuguacaacggccggcgagcccgcugagucccacaagacacuccagauugcaggaaaaagccgaucuacaaaauuugaaugaccgucuggccggguacaucgauagaguaagauuuuuagaaggugaaaauaacagguugacgagggaaauucaauccacccaagaaaccgucaccagggaaguuucuaacaucaaaucuauguacgaucaugaauugucggaugcuagaaaacuccuagacgaaacccaucgugaaaaagcgcguuuggaaauugauguuaagcgacuuuuagaagaaaaugaugaacugaaagcugauuuagguaagaggaacaaggaguugcaauuagccgaaaguucuguuagaaucuaugaaacuagauguaacgaaucgcagcucaaagcuaaucaggcaauugcugaugcuaagaaagcuaucgccgaugcuaaagaacucgaaaaagaacgggacaaguuaaggaaacuucuugaagcaacacguaaacaguuggaacaggaaucuuuggcuagaguagaugucgagaauaaaaaucaaagucuuagggaagaacuauccuucaaugaucaggugcaccagcaagagcugacagaaacccgcacccgccgucaagucgaaaucagcgaaaucgauggcagacucgccgaaaaguacgaagccaagcuccaagaagcccuacaagaucucagggaucaauacgaaucucagauggccaacaaucgccacgaaaucgaguugcucuaugagcagaagaucaaaaacuugcaggcggccaacgauagaaaccagaauuccgcuuccgcugcucucgacgaguugagacaaaccaggacgagaaucgacacgauaucgucgaggaugcaggauuuggagaaccaaaacgccggccuggccgccagagcaagggacuuggagaaguugcuggagaaugaacgaaugcgucaugcugaagaucuagcucuauuggaaagagagcuccaaagacuuagggaagaaacagcaaaccaacuucaagaauaccaagaucuuauggacaucaaaguaucucuugauuuggagauugcggccuaucgcaaacuucuggaauccgaagaagcgcgucuuaauauuacucccagcggucuugaaguagcccagcacagucaacgcagcuccucccagcgccgcacucccaucagggcgggcgcuaaaagaaaacguacucugcuagaagagagccaggaauccagcuuaucggauuucagcauaaacaguucaucgaaaggcgacauugagguagcagacgucgaugccgauggacauuucaucagguuacacaacaagaguaaccaggaaguuccacucgguggcuggcaggugaucaggcgugucggcgaagaggagacuguuuuuaaauuccauaggucgcuuaaauuggaaggcaacgguuacgugacgauuuggaguuccgaucaaaauaaggaccacgaaccacccagcaaucucguuaugaaaggacaaaaauggauugucggcgacaacaugaccacucuaguauugaacaacagcggagaagaaauugcaauuucagaaaggguaaagaggcagauuucgagcgcgcauuuaagacacagagaacgaucggggggcuaccuuuccgaagaacuccaccaccagcagggcgacccacagggugacgaaaagugucggcugauguga

SEQ ID NO: 6517 - RNA, 2412 nt, Psylliodes chrysocephala
auggcugauacuaaaagccccgaugauuuagcuacagcgauucuccguaaaaaggaucguccaaauaggcuuuuaguagaagaggcuguaaaugaugauaacucaguuguugcuuuaucacaagcgaaaauggacgaguugcagcucuucagaggcgauacaguacugcugaaaggcaaacguaggaaagaaacugucuguauaguacuaucagaugaaacuuguagcgaugaaaaaauucgcaugaacagaaauguuagaaauaauuuaagaguuagauuaucugaugucguuucaauucaaccuugcccagauguuaaguaugguaaaagaauccacguucuucccauagaugauacuguugaagggcuuacuggaaauuuguucgaaguauacuuaaaacccuacuuccuggaagcguacagaccaauucacaaggacgacguguuuaucguacgcggcggcaugagagccguugaauuuaagguagucgagacugauccggccccuuauuguauagucgcuccggauacggucauccauugcgauggggauccgauuaagagagaagaggaggaggaggcccucaacgccguagguuacgaugacauuggaggguguagaaagcaauuggcacaaauuaaggagaugguagaguugccuuugaggcaucccaguuuguuuaaggcuaucggugugaaaccaccacgcgguauccuucuguacgguccuccggguaccgguaaaacucugauagcucgagcuguagccaacgaaacgggagccuucuucuuccugaucaacgguccggaaaucaugagcaaacuggccggcgaauccgaaagcaaucuccgcaaagccuucgaggaagcggacaaaaacucgccggcuaucauauucaucgacgaguuggaugcgaucgcgccaaaacgagaaaaaacgcauggagagguggagcgucguaucgugucgcaauuguugacgcugauggacggcaugaagaagaguucgcacguaaucgugauggcggcuacuaauagaccgaauucgauugauccggcuuuacgucguuucgguagauucgauagggaaaucgauaucggaauuccugaugcuacuggucgauuggagguguugagaauucacaccaagaauaugaaguuagcugacgauguggauuuggaacagauugcugcugaaacucacggucauguuggugccgauuuggcaucgcugugcucagaagccgcccuacaacaaauuagagaaaaaauggaccucauagaccuugaagaugaucaaaucgacgccgagguccuaaacucgcucgcuguaacaauggagaacuuccguuacgccaugaccaagagcagcccgagugcuuugcgcgaaacugucgucgaaguaccaaacauuacuugggacgauaucggcgggcuggccaacguuaaaaaggaguuacaggaauuggugcaguacccugucgaacaucccgacaaguuccucaaguucgguaugcagccgucuagaggcgugcuguucuauggcccaccggguugcgguaaaacucuuuuggccaaggccauagcgaacgagugccaggccaauuucauauccguaaagggaccggaauuguugacgaugugguuuggagagucagaagccaaugucagagauauuuucgauaaagcuagaucugcggcgccuugugugcuguucuucgacgaguuggauuccaucgcuaagaguagaggugggaacguuggagaugcaggcggugcugcggauagggugauuaaccaaauuuugacggaaauggacggcaugggagccaaaaagaacguguucauaaucggugcuacuaacagaccagauauuaucgaucccgcaauauuacgucccggccguuuggaucaacugaucuacaucccauugccagaugaaaaauccagggaagcgaucuucaaggcgaacuugaggaaaucgccuguagcuaaagacguggaucucguuuacauugccaaaguuacucacggauucuccggugccgauuugacggagauaugucagagagcaugcaagcucgccauuagacagugcaucgaagcugaaaucaggagggagcgggagagagcauugacucccaacguagcuauggacuuggacgacgacgacccagucccagaaauaacucgggcccacuucgaagaggcgaugcgcuucgccagacgcuccgugucagauaacgacauaaggaaguacgaaauguucgcgcaaacgcuacaacagucucgagguuuuggcacaaacuuccgcuucccgacggcgcagggcgggccccaggcuccgggaggcacgggcggcgaccaggccaacuuccaggacgauccugaagacgaccucuauaguuag

SEQ ID NO: 6518 - RNA, 825 nt, Psylliodes chrysocephala
augggugaccaauucgacugugcacuugauuugaugaggcguuugccuccucaacaaauugaaaagaacuugagugacuuaauagauuuaguaccaaguuuaugugaagaucuccuuucgucuguagaucaaccuuuaaaaauugcuaaagacaaggauucugggaaagauuuccucuuaugcgauuauaauagagauggagauucuuacaggucaccuuggucuaacaccuauuaucccccauuggaggaugguucuaugccauccgaaagguuaagaaaauuagaauuagaugcaaaucaugcauuugaucaauauagagaaauguauuuugaaggugguguaucuucaguuuauuuuugggacuuagaccaugguuuugcagguguaauucuaauaaagaaaacuggggaugguaguaaaaaaauaaaaggauguugggacuccuuacauguaguagaaguucaagaaaaaaguucuggaagaaauucacacuacaaaaugacuucaacugccauguuguggcuacagaccaacaaacaaggaucuggaacaaugaauuuggguggcagucuaaccagacaaauugagcaagaugcagcugucaacgaaaucaauccucacaucgccaacauuggucgcaugguagaagauauggaaaacaaaauucggaacacacuuaacgaaauuuacuuuagcaaaacuaaggauaucgugaacagcuugaggucaguccaaccucugacagaaagucgccagcaacaagcacuuaaacaagauuuagcggcggcccuccagcguagacaaaacaaaucugagaacuga

SEQ ID NO: 6519 - RNA, 4179 nt, Psylliodes chrysocephala
auggaacguccaccucguaacgaacccccuguggaaccuguaaauggggugguacaaccauuaguucauccaccuccagauagcccagggcgcgucacaaaccaacugcaauuuuugcagaaaaccguacuaaaggcuguguggaagcaucaguuugcauggccuuuccagcaaccugucgacgcuagaaaacucaacuugcccgacuaccacagaauaaucaaacaaccaauggaccugggaacaauaaagaagcgcuuagagaacaacuauuauuggucgggcaaagagugcauacaggacuucaacacaauguucacaaauuguuauguguacaacaaaccuggagaagaugugguuguaauggcccaaacauuggagaaaguguuuuugaccaaaguggcugauaugccaaaggaggaauuuguagucgaaaguccuaucaaagggacaaaaggaaagaagggccgaggaaguuccggcggcccagguacccccucgacaccggugguggcggcgguuccgccaccaacaccaacggcaacugguagaggcaggccgccugcuacuguuucaucuacaagugcgacuccaguugccacuaccacaggaucaucagguuuaccauuggguacccaagcuccagcuacaguaccaggcagcacagcaacaaccacgauagcaccugcaacuaccaauaauagcucucuggcuucccagcagcuuacuacuucaguuggauccacacacggagcuggagcuccuuuggccaauuccuuagacucuaguggagugcuaccuggaaauguaauaccuccggcacaaccagcaaagguaaaaaaaggcgugaagagaaaggccgacacaacaacuccugcgaccgccuaugauuauccgaccgcauuagaaucgaaaucugcgaaaauuucaacgcgcagggaaucaggaaggcaaauuaaaaagcccacacgaccagaaauugacugccauguaccccaacccgccucgcacaaaccuaaagacaaauuaccugaguccaucaaagccuguaaugagauccuaauagaauuguuuuccaaaaaacauucgaguuaugcuuggccuuucuaucaaccaguagaugcagaacuacuuggcuugcacgacuaucacgacaucauaaagagaccaauggacuuugguacugucaaacaaaaaauggacaacagagaguaccgcaccccgcaggauuuugccucugauguuagacugauuuuuaguaauuguuacaaguacaauccuucugaccacgacguggucgcuauggcacggaagcugcaggauguguuugaaguuaaauaugcaaaaauucccgaugagccagugaaucggauagggccaagugugaacaauguaccugucaaaucggaaucuaguaguucagggucuaguucagaaucuucuagugaaucugaagauucggaggaagagagaacaaacaaaaaguuaaaacugcuugaaaaagaguuaacgaugaugcaagagaaaaugaaaaaguugguagaagagagcucaaagcggaaaaaggagaaaaagaaaaacaaggugaaaaagaagccggguggcguguccaccgccgcgucggcgagcacguuaccuaacagcagcaguggccucgguaagcccucugggcacggagcccuaaagucaaacaacaauucgaucgcggacagcguugacgacagcaucgccaguguugugucaggggcggaucugaagaugucgggugugggauccaaugccucuguggagucgcaucauccagcggguggcgcgcaggguacgggggcgcaacaucccaccaacaagucccucaacaugcaucacaacauggcggcagcuggcgccaacgcuuccgcccaggcuaaaacaccuaagagcaaaggauuacgcggaaacaaaccgacugcugcaacaaaugcggcgccuaacaagaggguaaaggcaaacaauaaagccggugcugguaggaagaagaacgcgguucagccgccuccaaugcaguuugauucugaagacgaggacaaugcuaaaccgaugucuuaugaugaaaaacgccaacugucauuagauauuaacaaauuaccuggcgacaaacuggggagaguuguacauauaauccaaucaagagagccauccuugagggauucuaacccagaugaaauugaaauagauuuugaaacauugaaaccuuccacuuugagagaauuggaaaguuaugucgcaucgugccuccguaaaaagccacguaagccuuacuacaaaaaaguggcaggcaaauccaaagaugaacaaauagcggaaaaaaagcaggaacuagaaaaaagacuaauugauguuaaugacaaaauuggcaauuccaagaaggcgccuaaaaaagaugaaucaaacaaaguggauccaacaggugccgguggucccucuggucgccucuccucuaguuccagcagcuccgacucggauagcaguagcagcaguuuaucuucgaguucuagugauuccagugacagcgaagcaggugguacgacgaauaggccgccaaagaagaaggggaauaaaaagaguccaaacguaucuguaggaaauaccacaaauacgaguauacagaaaccaccgcaaucaacaacagcagcaccagcaacgacacaagcaucugccaucccaacgguuaaugcuaauguuacuguuacggcuaaugcuaacguuaauauuacgccuaaggcaaagauaccuccaccaacuacaacaaacaacaguaguacuacuguuccaccaaucgugauuccaccagcagcaccacaaccgguaccgccaacaguuaaugccaaugcuaaacaacaacuuguuaauguuacuuccgcaccgccucuagugccgccuaucagcaucaaaccaaccguaaucaauacuguugaaaaauugaccauaguuaauccuuuaccuccuacuauaacacccacagcuguuccgcaaccuccgaaaucgguggcuuuaccaacuccuucaccugauaaaccuaaaauuguaucaccucuugguacuuacacagauccuauagagcaaaguuuagcaaguuuagagcaugauauuaagcagaaugaucccauggaaacuauagcuguaucuacugugcaaauaccuacaacuacucugaguaauccuauuguaucccauccucacuuaaaccuuaauccuaaugucacccauccuauuuuacagccuaguucuaucagcauggauuugaaaacuccagugaccaugagugguuuaggggcuggaaauauguuacaucaugguaugggcaugccaauggauagugauauuccaaguuuaauaccuccucaagcuaguaugcugcaugcgcagaauaaugguuuuggcaugaaacaugauuucgacauguccaugaauaauaauggaauaucuucgauggguuuaccaauggagaugucgauauccucaauguuugauccguuaccucaacauuuaaguaaucagcuacuuauuaaaaacgauccaacacaagaucgccuagaugguuuaggcggucuucuuaaugauaaaaagaauauaccucuaaccuccaaaucuaugagccaaaccuuuggauuuaagacugacaaaacugaucauaauguuaaaaaugccaguucuuggucgagucuagcaaaaggaaagaguccgcaaaauaacacacccggugacaguaguaaacagcaaguaauggauaguuuuaaggcguuccagaauaaggcgaaagaaaaggcagauagggaaaagcagagguuagaaaacuugaaaaugaagagacagcaaagagaacaggccgagagggaaagaaugagaguugaaacugaaagaaggagggaaagagaagaagaagaugcuuuagaaaaagcgaggaaagcuguagcggagcagcaacagccaguaucaaaucagaggguggaagaguugcguucgucuccuggagaagguaguacuucgccggguucuuuaaguucggguucggaaaggauaucggaaagagagaggcagagauugcaggaacaagaacgaagaagaagagaagugauggcaaauaagauagauaugaauaugcaaagugauuuaauggcugcuuucgaggguucguuauga

SEQ ID NO: 6520 - RNA, 1212 nt, Psylliodes chrysocephala
augucuuuauccacagcucgcccuuuagugagcguuuacaaugagaaaucggaagaaguaaaaggcagcggcguagcucugcccgcugucuucaaggccccaaucagaccagaugucgucaauuucguucaucagcaggucucaaugaaccaucgccagcccuacagcgucagcgacaaagcuggucaccaaaccucggccgaguccugggggaccggucgcgccguggcccguauaccccguguacgcggcggcgguacccaccgaucgggccagggagccuucggcaacaugugucgcggcggucgcauguucgcgcccaccaagccguggcgccgcuggcacagacgcgucaacgucaaccagcgucgcuacgcgcuggcgucggccgucgccgccagcggcgugcccgcccuggucaugagcaagggccacguggucgaucagauacccgagcugccguuggucgucagcgauaaggugcaggagaugcgcaagaccaaggaggccgugcaguuccugaggaggaucaaggcuugggcugacauccaaaagguuuacaagagccagcgguuccgugcugguaaaggaaaaaugcguaacaggagacguauccaacguaaaggaccucuaaucguuuacuacaaagaucaaggucuucgucaagcuuuccguaacaucccuggcauugaucuaaucaguguucaaaaguugaacuugcugaaacuggcuccugguggucacguaggucgguuuaucaucuggaccgaauccgcuuuccagcguuuagacaaauuguucgguacauggaagaacccgucgaccgaaaagaaggguuacaauuugccccagcccaagauguccaacaccgauuugucuagguuguugaaagcugacgagauuagagcuguucuuagggcuccucagaagaaggugguacgucguguucgucgucucaauccuuugaccaacacuaaggcuaugcuuaaauugaacccguaugcugcuguacucaagagggaagccaucuugaagaaccaaaaaaggcaguugcaaagggacgaagcuuuggcuaagaaacgaggaaucacuuugacuccugacaacgcuguaaucaggaccaggaaauugcaggaaagacgaagagcucaaauucugaaagauaggaagucgaaacccaagaaggccgcgaaagcgccggccaagccugcc

SEQ ID NO: 6521 - RNA, 5415 nt, Psylliodes chrysocephala
auggcagauuuuaucgaaucggaagccgagguguccagcgaggaagaagaaguagaucaccgagaucgaaaaaaggcucaaaaacccaaaguaguugauaguucugacgaagaugaagaagaugaugaggaacggcuuagagaagaauugaaagaucuuauugaugacaaucccauugaagaaagugaugcagaaucugaugcuucuggaggggaaaaaagaaaaaaaucagaugaugaagauauugaugaccgacuggaagaugaagauuaugaucuucuugaagaaaauuugggagucaaaguucaaagaaggaaauucaaacguuuacgucguuuugaagaugaggaaagugagggugaagaagaacaugacccugaacaagacagagaacaaauugccauggauauauucucugaugaugaugaugaacgaagaucggaacgcagucauagaccugcugccgaaccugaaaauuucggugucggcgaagaagaagaggagggcgaauacucagaugcugaugauuuuauaguagacgacgauggucgaccuauagcagaaaaaaagaagaaaaagaaaccuauuuuuacugacgcagcucugcaggaagcucaagaaacuuucggugucgauuucgauuaugaugaauuuuccaaguaugaccaggaugaguaugaagaugaggaagaugaagaggaagaugaguaugaggaagacgaagagggagagaaaagaaagcgucaaaagaaaacugcaagaaagaagccaacgaaaaaaucuauuuucgaaguguaugagccuagcgaacuuaaaagagguuucuucacagaucuugauaaugaaauucguaacacggauauuccugaaaggaugcaacuucgagauguucccauuacugcaguuccugaugauucuauagagcuggaggacgaggcugaauggauauacagacaagcauucuguaaccgaacaguauccaauguugacgcacaucuuuccucugaagccagagagaaaaugaagaaaggcccccaaacuguaggaaaaaucaaaaaggcucuagauuuuaugagaaaucagcaauuagaaguaccuuucauugcuuuuuauagaaaagaauacguucagccagaguugaauaucaaugaucucuggaaaguuuauaaguaugaugccaaauggugccaacuuaaaacccggaaagaaaaucuucuccagcucuucgaaaagaugaggucuuaucaauuagaucaacucuugaaggacccugaugcccccauucccgaaaauauacgggucaugaaggauauggauauugaaagacuuagaaauguccaaaaugcugaagagcucaaugaugugcacaaccauuucauuuuguauuaugcucacgaucuaccagcaaugcaugcugcuuggagaguuaaagaaagggaacgaaaaaagcacgagaaaagacaagcaagacucagauugauugcugaagcugaagaagguucugagauuccagaagaaccagaagagauugaugaugaugaaccagagguugaaguuuuaaaauaugcuaacagaucuggcaguuaugccuuauguacuagagcaggauuagauccuuuggccaagaaauuugguuugucaccagaacaauuugcugaaaauaugagagacaacuaccaaagacaugaaguugaucaggaacauguugaaccugcggagguagcaaaagauuuuauuucaccuaaguuugcuaauggugaugaagucuugcaagcugccaaauauaugguugccuugcaaauagcuagagaacccuuagugagaaaaugugugagggaaguuuuuuuugaaagagccagaauuaacguuuauccaaccaaaaaaggucaaaaaguaauugacgaaucucacaauuguuauaguaugaaauauguaaaaaauaagccuguaagagaucuagcgggcgaucaguuuuuaaaauugugccuugcugaagaagaaaaccuucuuacuauuacaauuaaugaccacaucgaagguaacacaacuaauucguauauugacgaaguuaaacaacuuuacauaaaagacgaguuuaguaaaaacguacaagacuggaaugcuuugaggauggaauguguggagagagccuuaacgaaaaguguuuuaccugauuuaagaacugaauuaaaaaggacuuuguugacugaagccaaagaauuuguacuuaaagcauguuguaggaaacuuuauaauuggauaaagauugcaccuuacucuaucacguuucccgaugaugacgaggaugauugggauacgucaaaaggcgugagaguuauggguguggcauauguaccagaauacacaguuucugcuuuugcuuguauagcagcuccggauggugauauuacugauuauuugagauugccucacauauuaaaaaggaaaaauaguuuuagaacagaagagaaauuauugaaggaagcagaucugcaagccauaaaaaacuuuaucuaccugaaaaaaccucauguuauaacaauugggggcgaauccagagaagcccuuaugaucgccgacgaucuuagaucaguaaucaaagaacucguugaaucugaucaauuucccguuauuaagguugaaguugucgauaacgaauuggccaaaguguaugccaauuccaauaaaggucagacugauuuuagagauuauccugagcucuugagacaggccauuucauuagcuagaaggaugcaggauccgcuuguugaauauucucaguugugcaauggugaugaagaaauuuugaguuugagauuccauccuuuacaggaacaaauaggaaaagacgaacucauagaagcuuuaugccucgaauuuguuaauagaaccaacgaaguugguguugauaucaaucuagcugugcaacaagcucacaaaaguagccuuguccaauucauuuguggccuugguccucguaaaggacaagcuuugcucaaaguccucaagcagaccaaucaaagauuggaaaacaggacucaauugguuacaacgugucacauggggcccaaaguauuuauuaauuguuccgguuuuauaaaaaucgauacaaauagucugggagauaguacagaggcguauguggaaauauuggauggaucucguguacacccagaaaccuacgaaugggcacggaaaauggcuguagaugccuuggaauaugaugaugacgaaggugcuaauccagcgggagccuuagaggaaauccuugaggcaccugagagauuaaaagaucuggaucuugaugcauuugcugaagaauuagagagacaaggauucgguaauaagagcauuacccuguacgacauuagggcggaauuaaauugcagauacaaagauuugaggcaguccuuccauucggcaaauccagaagaauuauuugauaugcuuaccaaagaaaccccagagacuuucuauauaggaaaauuggucacagccucaguuauaggcaucgcaaggaaaaaaccuaagccugaccaguuagaucaggcuaauccuguacguaacgaugaaacgggucuuuggcaguguccuuucuguuugaaaaacgauuuuccugaauugucggauguguggaaccauuuugaugccggggcguguccaggucaagcuacuggagucaaacuuagauuagacaaugguauauuagguuauauuuacauaaaaaauauuagugauaagccgguggcaaauccagaagaaagaguaggugucggacaacugauucauugucguauaauaaaaauagauguugaaagguucagcgucgauuguacuucgaaaucuagcgaucucuuagacaaaaaacaugaauggagaccuccaagagauccgcauuaugacguggaacgcgaagacaaagacaauagauuggaggccgacaagaaaaaagaaaaacagcgaaugacguacauuaagagggucauagugcauccugcuuuccauaauauuuccuaugcggaagcagaaaaguguauggucaauauggaccaaggugaagucauuguaagaccuucuaguaaaggugcugaucaucugacaauuacuuggaaaguugcggauggaauuuaucaacauauugauaucagggaggaaggaaaagugaaugcuuuuucacuagguaaaucuuuauggauaggaaacgaagaauuugaagacuuagaugaaauaauagccagacacgucacuccgaugucgucgcaugcuagagauuuacucuauuuuagauacuacaaagacuuugaagguggucauaaagauaaggcugaggaauuccugaaagaagaaaaaaagaaaaacucuucaaaaauucauuauguaauuagugcagcuaagaauaucccaggaaaauuccuacucuccuacuuaccuagaacuaaaguuagacacgaauauguaaccgucacuccugaaggauuuagauucaggcaacagauguuugacucuguuacgucgcucuuuaagugguucaaggagcauuucagggaaccucccccagguggucuaaccccuggcacaccuagguugucuuccgguagaacuccuuacggaaguggcacaccaucguucaguaugagcacugaagcuauacaaagaguugcucaaaacuugccgagucacaugguccaagcacugucugcagcaacaaaucaaacuccacacuauccucauacuccuggagguuacggugccaauuacauuaauacaccauauacacccaguggucaaacaccguacaugacuccauuccaaacuccgcauacacaacaaacgccgcgcuacggucaacaaacuccaucgcagcacauucccagcacugcuccuccaaauuugaacaaucccuuccuucacccgggagccgcaacgccuucccaaagaacgccgaguuacagaaacauggccagucaaaguccgaugauaccgcaaagucccguuccgaguccgggaucucaaagcucguacagcagucacaugagucaucauacaagagcaagcuaugcagaaucguugagauuucaaccuccagaaucgccgagaaauuauacaggggguaguagagguucguauccugauggaagauauggcggaaauaauagugaaucuauggauuggcagaaggcggccgaagcuugggcugcuaggucaagaucaacucccagaagcgaaggccguaacacuccgaggucuaugggccaaagaacuccucguuacgacauguccgaaagcgaucgaucuagaaugaagaguauuaguagcaagagucccagauccgcgaggucaacuccacgcacuaacacuucuccgcacucuaugucucuaggcgacgccaccccucuguaugacgaaaguauuuaa

SEQ ID NO: 6522 - RNA, 2415 nt, Psylliodes chrysocephala
  misc_feature (2218)..(2218): n is a, c, g, or u
augccagagacuaaagacaaagacucugcaacacguucuccagaacgaaagagacguagaucgaaaucuccugagcguaaagaaagaaaaucuucaaaaagaaaagaucgcgaugguaaacguucacaagacgaugacuacaauccaaaagacuauccucgauacuauggagaggaucggccaaauagugauaguuacuggaauaaauauccuaggaaggauaacacaaaagucggucaacgauauuaugacccaccugaaaaugauaaaacauucgaaaaagaaaagaacgugcaagaaaaacauguuucaaacaaggaagagacuguugauaaaucaguaauuaaaccgagagaaagaaaaacuguagauauguuaacuucucgaacgggaggugcuuauauuccaccagcaaaacuucgaaugaugcaggcuaguauuacugauaaaucaucagcugcuuaccaacgaauugcuugggaagcacuuaagaaaucuguacaugguuauauuaauaagauuaacaccucuaauaucgguauaauagccagggaaaucuuacaugaaaauauaguuagagguagagguuuacucuguaagucaauaauacaagcucaagcagcuucuccaaccuuuacuaaugucuaugcagcucugguugcuguuauuaauucaaaguuuccuaauauaggagagcuuuuauugaaaaggcuggugcuacaguuuaaaagaggcuacaaacagaacaauaaauccaucuguauaucugcuacaacuuucguagcucauuugguuaaccaaagaguggcccaugagauuuuggcccuugaaauuuuaacuuuauuaguugaaacaccaacagaugauucuguagaaguggccauaucuuuucuaaaagaauguggacaaaaacuuacagaaguuucuaguagagguauaacugccauauuugaaauguugaggaauauuuugcaugaaggacaacuagaaaagagaauacaguacaugauugaaguuauguuucaaauuagaaaggauggauuuaaagaucaugcagcugugacagaagaacuugauuugguugaagaggaagaucaguuuacucaucuuauuauguuggaugaugugaaggaggccaaugcugaagauauauuaaacguuuucaaauuugaugaggauuaugaagaaaacgaagguaaauacaaaacauugaguaaagaaauuuugggaagcgauagugaaucaggaucuggcucugaaggaucagaugaugaaucagacgaagagggggaagaggaaguaaaagauucuggaacuauuauugacaacacagaaacuaaucuaauagcucuuagaaggacgauauauuugacaauacaaucuaguuuagauuuugaggagugugcacauaagcuauugaaaauggaauugaagccuggacaggaaauugaguugugucauauguuccuggauugcugugcagaacaaagaacauacgaaaaauucuauggacuguuagcccaaagauucugucaaaucaacaaaauauacauugaacccuuucaacaaauauuuagagacacauaugcaaccacacacagauuagaugcuaauagguugagaaaugugagcaaauuuuuugcacauuugcuguuuacggaugcuauaaauuggcaaguucuugacauaaugaaauuaaacgaagaagauaccaauaguucuaguaggauuuuuaucaaaaucuuguuucaagaguuggcugaauauaugggauugggaaaauuaaacgcaagacugaaagaugagacucuucaagaacauuuuucugguuuguuuccuagagacaauccuaaaaacaccagauuuuccauuaacuucuuuacauccauugguuugggaggccugacggaugaacuuagagaacauuugaaaaauauuccaaaaauaauggaagcgaagauggcaauaggaaaagaagaaagcgaagacagcaguggcucaaguaguuccaguggugaagaaaguagcggggauagcagugcagaauccaguucagaggaagaggaugaaaaggcgaagaaaaagaaaacgcgugauacuaauguuaaaucucuagaaucuucaaaaucacaaagaacugaaagaauuaauggagggggauacagagaggacaaagaaaaauauagaaauaaggaaaaacaaagauauucugaaaaanaaacgagaaagauaaaaauccuucaaaagcagaucguaguaauaaagaagacagaaggaaagauuacaaugaaaauagagaaaagacaaaaaaauauuaugaaguggacaaagauaaaaggaaaagggauggagauaaaacggaaagaaaaaacaaagacuaugaauggguuaaaaguagauaugaggauaauauaa

SEQ ID NO: 6523 - RNA, 1782 nt, Psylliodes chrysocephala
auggcguugaagaaucaaguuggucuaaaaauuaugaaugaggugauaaaacacaaaccaacuaaaaaaaauggaccugcuguuacacagccucauggugcuguugaauggcguaucuugguuguagaucagcuugcaaugcgaaugguuucugcuuguuguaaaaugcaugauauaucagcugaggguauuacauugguggaagauauuuugaaaaaaagggaaccauugacuacuauggaagcuguuuauuugauuacaccuagugaaaaaucuguucaugcccuuaugaaugauuuugaaucucccaggccuauguacagaggcgcgcaugucuuuuucacagaggcauguccagaugaacuauuuaacaaauuaagccaccacccugcagcuaaauauauaaaaucuuuaaaagaaaucaacauagcuuucauaccagcagagucacagguauuuucacucgauucaccagauacuuuucaaugcaguuacgauccaucauuugcugcugcaagaaacgcgaauauggaaagaauggcggaacaaaucgccacgcuuugcgcgacuuuaggggaauacccacaugucagauauaggaccgauugggaacgaaauguggaacuggcgcaacuuauucaacaaaaauuggaugccuacaaagcagaugagcccaccaugggagaaggacccgaaaaagccagaucucaguuguugauuuuagaucgugguuuugacugcguuucuccauuauugcacgagcucacuuuccaagcuauggccuacgacuugcuucccauugaaaaugacgucuacaaauacgaagcauccgcgggcguucaaaaagaaguccuccuggacgaaaacgacgaacucuggguagaacuccgccaccagcauaucgccgucguuucccaaagcguuaccaaaaacuugaagaaguuuacagauucaaaacgcaugacgcaaagcgacaaacaaucgaugaaggauuugucgaccaugaucaagaaaaugccccaauaucagaaggagcuguccaaauacgcgacccaccuccauuuggccgaagacugcaugaaggcuuaccagggguacaucgacaaguugugcaaaguugaacaggauuuggccaugggcaccgacgcagaaggugaaaaaaucaaagaccacaugcgcaauaucguccccauucuucuagauccaaaaauaacuaaugaauaugacaaaaugcgcaucauugccuuguacgcuaugaccaagaacggaauuacugaagaaaauuuaucgaaacuugcgacucacgcacagauaaaggacaaacaaaccauugccaaccuccaacuguugggcgucaacgucauuaacgauggagggccgagaaagaagcaguacaaugugccgcguaaagaaaggaucacagaacagacuuaucaaaugucaagauggacgccuguuauuaaagacauuauggaagauuguaucgacgauaaguuggaucaaaagcacuacccauacuugagcggccgggcgcagacuacuggauaucacgcagcgcccucuagcgcgcgcuauggacaguggcacaaagauagaggccagcaagccguuaagaacguuccgcgcauuuuggucuuugugguaggaggcaucaguuucucggaaauacgaugcgccuaugaagugacaaacgcucagaaaaauugggaagugaucaucgguucgucgcacauauugaccccagaagguuuccuaagcgaucuggcgacguuagccggcuag

SEQ ID NO: 6524 - RNA, 2139 nt, Psylliodes chrysocephala
augaugcaacaauauaugaaagaauuggaacaagagcccuuugaugcagaagaauuuguagaaagguuagcuuggagaacuuuagcugaaucaaaaaaugauggagaugaaagugagauuaacccggcucucuuauacgaaucguuuguucaagccauaaaagaucucaauuuauuacaugaaagacagcagaaaaagugugaaaaauuagaaguagccguuagagaagaugaagcgacauuuuuucaagaaauauauaauuuauuagaacaaaauaagcaagccauggauacauuucaagaacuagauggcaaaaucaaucauguugcuacaaaaguucuucauuugggugaucaauuggauagugucaauggucccagaucuagaguuguugaugcuuuaaaaauaaugucucauuuaagugaauuuuuaucaaacgaaccugucuccucagcuauuuuuacgaauugcgaauuuaucgaugaagcugcagauaugauucagaaguuguauuugauaucucaagauuuaccuccaaaauuugaagcuacaaaacggaaaauagaacgaaaauauucugauauugaaaaagcccucauagaagaauuuguaguugcuauggacaaugaaaauuuaacaagaaugaaagagauagcuacaguucuuucacaguucaagggauacucucaauguguugaugcuuauauagaucacagucaaaugggcuguuuguccagcaaagacguuuuuauuaguuuucugaaucuguguaaauacaacaaugaaauuauccagaaaguuuuuaauaauccagaacaaguuauggcuaaauuuguauuaaacauauaucaauuaaaauugguggaauacauugaugacaaacugaauucuaaauuaggaacuuauaauuacuuacagacauuauaugaauuguauucaaagacuaaucaguuaucaaaugauuuaaguguguuuaauaugggaaaugauaaaaauuauuugagaaaguuaacaacuaauauuuuuaauaaauauauaaaugacuauauuacaauggaacucaaaugccugaaagacagauguucggcaaauuuacaaaaguacuaugagucaaaaaaucaucaaaagaagcagauucaaucuggcgguuuccaagaccuuagaagagauuuacaagcagugauagguacaagagcaaauauuaauauagcccaaauagaaaauuaugguggcgaaacuuucuugucugaggaauuggcuauaacaauuuuccaagacacuaaacaggcuuuucaacguugucaguuguuaucgaaaaacaaugacagagcaucaaaugcaacucaaaucuuagacagacugauaaauaguuuacuuauagagcaugucgauuaugccguagaacuagguuugcaagcuguaccuguuggggaaggauccaaaaauccuccuguauuauacuuuuuuagugugguacaccaaagcaauaauauuacacaucuucuugaaaaacaauucauggauuuagugguuccauuaguugagaauacgccaaaauauaaugacugcuugcaaaagaaaaaauuuguuuuagaagauauugaaagaaaaauuaauacaggauuagauagaaguuuaaaugccauaucuaauugggucaaauuauaucuccagucagaacaaaaaaaauccgauuuuaaaccggaaucugaugauuuugauacaguugcuucuuccgccugcaaaaauguacuuaacuaugugaacaguauuauaaaagaaauuaaagcaaacuuagaugguaauaacguuacggcgauucuccaagaacuaggcguucgauuacauagaguaguuuacgaacauaugcuacaauuucaguauaauacagcaggugccaugguggcuauuugcgauuuaaaugaauauagaucguguacaaaauuacuagguccuuuaguuauggaacuguuugauacucuacaugcuuugugcaaucuuuuacuagucaaaccugaaaaccuucagcaaguauguucagaggauucguuggccaaguuggaccgaacaauucuucacaacuuuauccagcugagaagcgauuuuaaaguucaaaaacagacaauucucaaagucuag

SEQ ID NO: 6525 - RNA, 813 nt, Psylliodes chrysocephala
auggauuuucaaaauagaccugguggaaaaaccggaggaggugguguugcuuccugguccgaaacaaaccgggaccgaagagaacgguuaagacaacucgcuuuagaaaccaucgauuuacaaaaagaucccuauuuuaugaaaaaccacuuagguucuuaugaaugcaagcuuuguuuaaccuuacacaacaacgaagguaguuauuuagcucauacgcaaggaaaaaagcaucaagcuaauuuagcuagacgagcggccaaagaagcuaaagacgcacccucccuauugcaaccagagaagccucgagucgaaccuaagaaauucgugaaaaucgguagaccugguuauagaguuacgaagcagagggacccagaaaauggccaccagaguuuacuguuucaaauugauuauccagaaaucagugauguaguccuuccucgacaucgcuuuaugucagcuuaugaacaaaaaauagaaccuccagaccgcaaauggcaguaccuuuuguuugcagcugagccauaugaaaccauugccuuuaaaguaccaucaagggaaguggaaaaaacugacaauaaguuuuggacucauuggaauaaggauacaaagcaguuuuuccugcaguuugcguucaaaaaugagaacaaacguacugcuaauacuguugugacaagacaucaguuggucaguggagugccaccuccuccgauguugccagugccuccaccuccuaggccuccuauguuuaauccaauuccuccaccaccaccuaugaugagggcugugaugccgguaccgccuccacguuaa

SEQ ID NO: 6526 - RNA, 402 nt, Psylliodes chrysocephala
augucuauugguguaccuauuaaaguucuacaugaagccgaaggucauauuguaaccugugaaacuauuaccggcgaaguuuacagaggaaaacuuauagaagcugaagauaauaugaauugccaaaugacucaaauuacuguaacuuacagagacggaagaguagcacaauuagagaauguuuacauuagaggaucuaaaauuagguuucuaauauuaccagauauguugaagaaugcuccuauguucaaaaagcaaacuaaagcugggacugcagguagagggaaaucagcaauucuucgagcucaagcucgggggagaggaaggggucagccuccugugcgggguggcagaggugcuuggcaaaaucagcagggcgcuccacaaggcaggggaagauaa

SEQ ID NO: 6527 - RNA, 1329 nt, Psylliodes chrysocephala
auggcuacaaguuuuacacggaccccauucuugagagccauuacggcaagagguuacucuguaucagcucuaccaguuucugguaauccaaacgccgaaguaaaauguacuacucuuccuaacaagguaguaguugcugcuguugauaauaaugcgagccuuacaagaguaucaauuguauuuagaucaggauccagaaaugaagaaacugacaacuuggguguaacgcauguuuugagaacugcagcagguuuaagcacuaaaaaugcuucacaauuugccauuauucguaauauucaacaaguuggugcuaauuuaacagcuacuucugaucgugaaacuauuucuuauacuuuagaagguacuaaagaagcuguugaacgagcuuugccauuuuuaacagaaguagccacucaacaagaauuuaggccaugggaaguuucugaauuaucaaacagacuauuguuggauauugcaaccaggccacuucagcuaagggcaguugauuugcugcacaaugcugcuuucagaggucguggauuaggcaauucccucuuuauuccuaagccacaaauuggaaaaauaucuucugaaaccuugcagcacuauguugccagcaauuuuuugaguggucgcacugcuguuauaggaucaggaaucagugaaagagaguuggcacaguaugcaaacuccuugaaaauuggaaauggugaagguaauacuagucccagcccuuacaaagguggcgaacuuagaucaaacaaagguggaccacuugccuuuguugcuguagcaggagaaggaacugcucuuaaaaacacccaagaagcucuugcuuuugcuguccuacaaagagccauaggugcuggaccacaaauuaaauauugcacagcugacaauggcauauuuagcaaggcuauuggaaguccugcagauguuaguucugcugcuauuaaugucagcuauucugacacuggucuauuugguauauuacuagcugccccuaccaaaucuguuggcaaaguuguugaaacugcugucaagguguugaaaucugguuguguuucagaugaagauguuaacagagguaaaaaucaacuaaagacggcuauacuucuugauaaugagaguggagcagauauuguaaggaauacuggaacacaagcugcuuuaacucaaaguguaucaucugcaaagucccuuguagcugccguagaaucaguuacuaccagugauguucaaaaugcccuuaagaaagcuggaagaaacuugucauuagcaucuauuggaaaucuaucuggaguaccuuacuuagaugaauuaaaauaa

SEQ ID NO: 6528 - RNA, 333 nt, Psylliodes chrysocephala
augagaagagcucaugcugguaauuauuaugagccuuuaccgcaaaauucgaaugaaauugaagacgaaaaugaucgaaugacuaaugaacuccaagaaaaaauugggguucuaaaaucuuugacuauagacauuggaaaugaaguuaaauaucaagauaaacuuuugagagauguggacgaugauuuagauaaaacuggaggcuuuuuaggaacaacgaugaauaaaguauuaaaauuauccaaagguggucagcauuauaucauauuguauuuguucuuguuuucaauaguuguguucuuuauauuguauuuugucauuaaauuuagguaa

SEQ ID NO: 6529 - RNA, 1491 nt, Psylliodes chrysocephala
augucuuacccuucgacguuaaaugcaaaacaggcaucacgggaacauauuauggcuguuuccaaagauuuuguaucuaagcccagacucacuuauaaaacgguaucuggugucaaugguccacugguaauucuggaagauguaaaguuuccaaaauucaacgaaauuguccaacuuagauuggcugauggaacuuuaagaucuggucaaguuuuggaagucagugggaauaaagcuguaguacaaguauuugaaggcaccucaggaauugaugccaaaaacacaguaugugaauucacuggugauauucucagaacuccaguaucugaggauauguuggguagaguguucaacggaucuggaaaaccaauugauaaaggucccccaauuuuggcagaagauuacuuagauauccaaggucaaccuaucaacccauggucacguauuuauccugaagaaaugauccaaacugguaucuccgccaucgacguaaugaacuccauugcccguggccaaaaaauucccauuuucucggccgcuggucugccucacaacgaaauugcugcucaaauuugucgacaagccggucuugucaaaauucccggcaaaucuguauuggaugaccaugaagauaacuuugcuauuguguuugcugcuaugggaguuaacauggaaacugcuagguuuuucaaacaagauuucgaagaaaaugguuccauggaaaauguaugucuguuuuugaacuuggcuaaugaucccacuauugaaagaauuauuacaccacguuuggcucuuacagcagcugaauuuuuggccuaccaaugcgaaaaacacguccuggucauauugacugauaugucuucauaugcugaagcuuugcgugagguauccgccgccagagaagaagugcccggucgucgugguuucccagguuacauguacaccgauuuggccaccauuuacgaacgugccggucgugucgaaggucguaacgguuccauuacgcagauucccaucuugacuaugccuaacgacgauauuacccauccaauucccgauuugacagguuauauuaccgagggacagaucuacguagaccgucaauugcacaauaggcaaaucuauccuccagucaauguauugcccucuuugucucguuugaugaaauccgccauuggugaggguaugaccaggaaagaucacucugacguuucuaaccaacuguaugccuguuacgcuaucgguaaggauguccaagcuaugaaagccguaguaggagaggaagcucuuacaccugacgaucuccuguacuuggaauucuuaacgaaauucgaaaagaacuucaucacucaggguaacuacgaaaaccguaccguuuucgaaucauuggacaucgguuggcaacuacuccguaucuuccccaaggaaauguugaaacguaucccagccaguauauuggccgaauucuaucccagagacucgcgucauuag

SEQ ID NO: 6530 - RNA, 1176 nt, Psylliodes chrysocephala
augaaucguggacaagcaggaccccggauacauguuccagacgaguugcgugaaguacugcucgaauuuacuauaaguuaccuucuagagcagcccggagacgugauuaauuaugccucggaauauuuuacgagauuaagagaggucagaacgacggcuauaauuuuugaucaagcaggcgaugccucacaagaagaacuuuuaucuccggacgagucugucauaucccgggacgaagaaccuuccauaacccgcuuuuccggucgacgcaaaucgguguucgccgaaacguacgaucccgaagaagaugacgacgaggacgccaacaaaaucgucuauccgaaaucggacgagcaacgccaaagacugucguccgccgucggcaauauuuugcucuucagaucgcuggacagcgaacaaaugaacgaaguauuggacgccauguucgagaggaucgucaagaaggacgaauuggucauacggcaaggagacgacggggauaauuuuuacguuauucaaaauggaacuuaccacguuuuggucagcaccgauaacucgccggagccgaaacacauccacaccuacgaagacagcggcagcuucggcgaauuggcguugcuguacaacaugccgcgcgcggcuaccguaaaggccguuucggaaggcucccucugggcgauggacagacacacguuuaggcguaucguucucaaaucggcguucaaaaagaggaagauguacgaaacguugauagagagcguaccgaugcucaagacuuugcagccguacgaacguaugaaucuugccgaugcgcuuguucccagaguguucaaagacggggacagaaucauaaaacagggcgacgcggcggacggaauguauuucguggagcaaggccagaucaucaucagcguuuuagacgauagcggcaaagagguggagauaaaucguaucaucaagggcggcuacuuuggcgaacuagcucugguuacacaucguccgagggcggcgucggcuuuuugcgacggagacguuagaugcgcauuuuuggacguggaagccuucgagagguuauuagguccgugcauggagaucaugaagcgaaacaucaccgauuaugaagaacaaaugcucaagauauucggcucaaagcacaacauccgggauauccgauga

SEQ ID NO: 6531 - RNA, 2427 nt, Psylliodes chrysocephala
augaguuacaugcagucuaaucagaauagaccuaugucucaagguuaucaucaaggucccaacgaccuuccaaugcaauccucaaaggaacaaacauugcuauggcagcagaacucuuaccuaggagauucugguauccagucuggagcugccacacagguuccaucccugacuggcaaagaggaagaagagauggaucuguuugaccuggaucaacccuaucaaggauucacccaagaacaaguggaugaaaugaauaaccagcugaaucauacgagaucucagagagucagagcugcaauguuuccagaaacauuggaugaaggaauagaaaucccuucaacccaguuugauccaaaccaucaaacugcuguccaacgacuugcugaaccaagucagaugcuaaaacaugcaguuguuaauuugauuaacuaccaagaugaugcugauuuagcuaccagagcuaucccugaguugauaaaacucuuaaaugaugaagaccaaguuguggugucccaggcugcuaugaugguucaccaacuuucaaagaaagaagccucuagacaugcuaucaugaacagcccacagaugguagcagcuuuaguuagagccaucucaaauucuaaugauuuagaaacuaccaaaggcgcuguugguaccuugcacaaauuaucacaccacaggcaagguuuacuagcuauauucaagaguggcggaaucccagcucuuguuaaauuguuaaguucuccuguagagaguguauuguuuuaugccauuacuacucuacauaaucuguuguugcaucaggauggaucaaaaauggcagugagacuugcugguggucuccaaaaaaugguagcacuguugcaaaggaacaaugucaaauuuuuggcuaucgugacugauugcuugcaaauuuuggcuuaugguaaucaagaaaguaaacugaucauuuuggcuucacaaggacccaucgaauuggucagaauuaugagaucuuaugauuaugagaaguugcuauggaccacuucaagaguuuugaagguuuuaucaguuuguuccaguaauaaaccagcaauuguagaagcugguggaaugcaagcucuugcuaugcauuugggcaacccaagcaccagacuggugcaaaauugccuuuggacucuaagaaacuuaucagaugcugcuacuaagguugauggucuagaaagcuuguugcaguccuuggugcagguaaauguacuggcuucaucugaugucaauguuguaacaugugcagcugguauucuuucuaacuugaccugcaauaaccaacguaacaaagugacaguuugucaaguaggaggggucgacgcuuugguacgcacuauagucacagcuggagaucgugaagagaucacagaaccggcuguaugugcuuuacgucauuuaacauccagacauguugaaucugaaauggcacagaaugccgucaggcucaacuaugggauacaaguaauuguaaaauuauugaauccaccuucacguuggccauuagugaaagcagugauuggacuuauaaggaauuuggcuuuaugcccagcuaaucaugcuccucuaagagagcauggugcaauucaccacuugguucaguuacuaaugagagcuuuccaagacacacaaaggcaaagggccagcguugcgaguggcggcagccaaccuccaggaaccuaugcggacggagugcgcauggaggaaauaguagagggcaccgucggugcuuuacacauuuuggcucgagaaucucacaaucgagccauuauucggcaacaaaugguuguaccgaucuucgugcaacugcuuuucaaugauauugaaaauauacagcguguugcagcuggaguccuaugugagcucgcugccgauaaggaaggggcggaaaugauagagaaugagggagcgacugcuccauugacggaguuacugcauucgagaaaugaaggggucgcuacauaugcagcggccguuuuguuuagaaugagugaagauaaaccucaagauuauaaaaaacgauugucaauggaguuaaccaacucauuguucagagaggagaaccuuuggaaucccgaccugggcauggggccugacuuacaggauauuuuaaguccagaucaggcuuaugacaacauguaugcccaagguccaccaagcguccauaguagccaugguggcagaccuuaucaacaacaaggguaugaccagauacccauagacaugcaggguuuagagaucggcucucacggaggcggaaaugguucgaccuauagcgcaaucgacgccauggacguuaccagcggagaccaagaucucaauuuugauaccauugaucaacuccccaccccuccccaagauaauaaccacgccgcugcuugguacgauaccgacuuguaa

SEQ ID NO: 6532 - RNA, 804 nt, Psylliodes chrysocephala
auggcucguaaugcugaaaaagcaaugacaacuuuagcucguuggagagcagcccaacuaggagaagcagauaaacauaaaaagcgccgaccauauuuggcuucugaaugcaaaagcuuacacgccugugaaaaauggagaaugcaaaucauaagggagauagcaaaaaaaguggcacaaauacaaaaugcugguuuaggagaauucagaauuagggauuuaaaugaugaaauuaauaaauugcuuagggaaaagagacauugggaagaucaaaucaaagaacugggagguccagauuaucaaagaguuggaccuaggauguuggaucaugaaggaaaagaggugccaggaaauagagguuauaaauauuuuggagcugcuaaagaauugccagguguaagagagcuuuuugagcaagaaccacccccuccucccagaaagagcagagcugaacugaugaaagacauagacgccgauuacuauggguacauggacgaugaugacggcauucuuauuccgcuggaaguaaaagcugaaaaaauagcuauucaaacuucuaucacugaauggguaaauaauaaagagaagaauuugggagauaaugaggaaguggaagaaaauauuuaugcuguagaagguucggaggaugaagaggaaacaguucaacaaauugacggaucccaacaaagauucgucgcgcacguaccggucccaucgcagcaagacauagaacaagcuuuacugagacgacguaaacaagaguugauggaaaaguauggcguacaagaagauccgguuuccuga

SEQ ID NO: 6533 - RNA, 645 nt, Psylliodes chrysocephala
auggcuacagaagauaugcccacauuuaaauguguuuuggucggagauggugguaccggcaaaacuacuuucguuaaacgucauaugacuggagaauuugaaaaaaaauauguagccacuuugggcguggagguucauccccuaguguuccacacaaaccgaggcaaaauccguuuuaacguaugggauaccgcuggucaagaaaaauucggaggccuacgagauggauacuacauucagggacagugugccaucauaauguuugaugugacuuccagaguaacauauaaaaauguaccaaauuggcauagagaccuuguaagagugugcgaaaacauuccuauuguuuuguguggaaacaaaguugacaucaaggauagaaaaguuaaagcaaaaaguaucguuuuccauaggaagaagaauuugcaguauuaugacaucucugcuaaaucaaauuacaauuucgaaaaacccuucuugugguuggcaaggaaacucauuggagaucccaacuuagauuucgucgccgcuccagcucuacugcccccagaaguccagauggauccucaauggcaacaacaaaucgaaaaggaucucaaagaagcaucagaaacugcucucccagaugaugacgaagauuuguaa

SEQ ID NO: 6534 - RNA, 2502 nt, Psylliodes chrysocephala
augccgagaauaaugauaaaagguggugucuggaggaacacagaggaugaaauucuuaaagcugccguaaugaaauauggcaaaaaccaauggucuagaauagccucauugcuucacagaaagucugcgaagcaauguaaagcccguugguuugaaugguuggaccccaguaucaagaaaacggaauggucuagggaggaggaugaaaaauuauuacauuuagccaaacuaaugccgacucaauggagaaccaucgcccccauuaucgguaggacagcagcgcaaugucuagaacgauaugaauauuugcuggaucaagcacaaaagaaagaggaaggugaagaugcaguugacgauccuaggaagcuuaaaccuggggaaauugaucccaacccugaaacuaaaccagcuaggccagauccuaaggauauggaugaggaugaguuagaaaugcugucugaagcuagagcuagauuagcuaacacucaaggcaagaaagccaaacgcaaggcccgcgagaagcagcuggaagaagcccgacguuuggcagccuugcaaaaacguagagaauugagagccgcugguaucgaaguaacaucaagacgcaagaaaaagcggggagucgauuacaacgcggagauuccguucgaaaaacguccggcgaucggauucuaugacacaucgaacgaggcucuagacccgauggcuccggauuucuccaaaaugagacagcaacauuuggacggggagcuccgaagcgaacaagaagagagggagcgcaaaaaagacaagcagaaguugaagcaaaggaaggagaacgauauaccgcaagcgaugcuucaaaaccaggaaccggcgaagaagcggucgaaauugguuuugccugaaccgcaaauuuccgaucaagagaugcaucagguugucaaauuggguaaagcuagugaaacugccagagaaauagccacagaaaguggaauagaaacuacggauacgcuuuugaaugauuacauguuuaccccgcaagcugccgccacuccuaggacuccggcaccccaaacugacaggauucuccaagaagcccaaaacaugauggcgcucacccacguugacacgccccucaagggcggucuaaacacgccucuacacaacucggacuucagcggaguccuuccucaagcgcaaacuaucgcuacucccaacacgguacuagcgacucccuuccgaacgacuagaagcgaaggcggagcuacuccaggcaguaccgcggguuucaugacgcccaaaagcggagcucucacucccgucggcaaggccaacaugacgccuucgguacgcgauaagcucaacauuaaucccgaagaggguuuagacgucggaagcacacccgccgaacacagaauguuccagaugucgaugaaagaccaacugaagaugggacugagcgguuuaccgcaacccaagaacgacuacgagaucgucgugcccgaaaacgaggaccaagaagaaccggaacaagcacaagcacaauugguggaagaucaggcggacauagacgcuaggaaacaggaggaacugaaagcuaaggcugcgaaagagcucgcuucucgcucgcaagugauucagagagaauugccgagaccgcaggauguuaaucugacugugcuucguccuccacacgagaguuacucacugaccgaucuucaaagggccgaggaguugaucaaaugcgaaauggucacgaugcugcaauuugacaaucuaaaaaauccaguuccuaccauaaacaaaagaacgaauaugucgcaggcgcagcaauuggcauuuuuggaacagcauccguacgguucuuaccgaaaggaagauuuagagguagccaaagggauguugaagaaagagauggauuaugucaagaauggcaugagucacggggaguugccuuuagaagucuacacccaaguaugggaagaaugccuaagccaaguucuuuaucuuccgaaucaaaccagauacacuagagcgaauuuggccagcaaaaaagauagauuagaauccgccgaaaagcguuuggaacagaacagaucccauauggcgaaagaggccaagcgcgcggccaaaauggagaagaaauugaagauuuuaacaggcgguuaucagucaagagcgcaaguuuugaucaaacagcugcaggauauguaugagaauaucgaucagucugcauuggaguugaacacuuucaaguucuugcaagagcaggagaagagcgccuuaccuagaaggauacagucucuaacugaagacgugacuagacagauggagcgcgagaaggugcuucaaaagaaauacgcggaguuccagauucaaaucaaacaauugcaagaagaguauuugacacagaugcaaagccuaccaaaugacgaugcuagcaaaggagaagagguuucuucuacgaccaaugaagagacggcgguggacgaggaugaugcggaaauggaugaagauuaa

SEQ ID NO: 6535 - RNA, 576 nt, Psylliodes chrysocephala
augauuaaagcuauuuuaguguucaauaaucauggcaaaccuaggcuaucaaaauuuuaucaauacuuuccagaagauaugcaacaacagauuauuaaagaaacguuucaguuaguuucaaaaagagaugauaacguauguaauuucuuagaagguggaaguuuaaucggaggcagcgauuauaaauuaauauacagacacuacgccacauuauacuuuguauucugcguggauuccucugaaagcgaauuaggcauuuuagaucuaauucaaguuuuuguugaaacauuagacaaauguuucgaaaauguaugugaacucgauuugauuuuccacgucgauaaaguucauuacauacuuaacgaacucguuaugggugggaugguauuagaaacgaauaugaccgaaauuuuaacaaggauagaggaucaaaauaaaauggaaaaacaagaagccgguauagcugcagcuccagcucgagcgguuucagcuguaaaaaauaugaacauuccucaacagauaaaggacauuaagcuuccagauauaccgcaagcuauuaaagauuugaaauucuga

SEQ ID NO: 6536 - RNA, 954 nt, Psylliodes chrysocephala
augaguucugauucugaauuaagcgacagugaugucgaacuucaagaagcucuacuggaaggaagauuaaagccuggguuaaauaaaguagagaaggugccaaaaaaauucauaaauaauguaaguggucuuaaacaaaaaguugaagaauuaaaacuuaaucugccuuggauugaaagacuugacuguacaaguucacaagccccauuagcaccagaauucgcagcucaaauguuaauucaugaagaaaaaaggaguaaccaauugaaaaauaauaagaaacuuccccaauuuaguccaucugaagacccaguacuuaacgauuuuaaaagagaaauuauguuucaaaggcaggcacaggcuacgauucuagaagcuauaccuaaacuaaaagcaaugggaauuucuacgaaacgaccagaugacuacuuugcagaaauggcaaaaacagaugcacauaugcauaaaauucgagaacaacuacagaaaaaacaagaacaacaaaaaagaauugaaagaguaaaacagcuaaggcaacaaagaaaagauggaaagauguuacaaauucaaacaaaauuacaaaggucucaagaaaagaaagaaaugcuugcacaggugaagaaaguccggaaaggcgugagcaaaaaucucgauuuucuugaugguaagaauaaaccuuccaaaaagauuauugaaaaacgcaaaaugaaagauaaaaaauuugguuuuggggguaaaaaaagagguaugaagaaaaauacuagagaaagcgcaggugauauuagugaauauaagaguccaggaaaaccaggcaagaaauuuaaccaaaaucaaccaggacagaaauuuaaucaaaaucaagcaagacagaaauuuaccaauaaaaauaaaggaaagaguaacagaauggggaaaaauagacgaaugaaaaugaagacaaaaagcaaaaaauaa

SEQ ID NO: 6537 - RNA, 3882 nt, Psylliodes chrysocephala
augaaugaauuagagaaguuagaauaucucucuuugguuuccaagguuuguacagaauuagauaaucaucucggaaugaacgauaaagauuuagcugaauucauuauacaucucucugaaaagaacaauacuuuagaaacauucaagaaggcucucuuagaaaauggagcagaguuuucagacucauuuauuucuaacuugcugcgaauuauucaacacaugaagccaaaaaaggcugccaacaaagaagaggcucuacauauugagaaagaaggacuagcguuuaaauuucccggucuggcaauacccaaugaagcccaaaagccauuauuuuuggaagagaaagaugaaaaaccuuuggaaaaagaaaaaguugaagaaguagauauaguagcugauaugaugaaacaguuugaagccgaugcuccuucucaaaagcaaaccaccaccagagacagaucuagaagcgcaaguguugaaagaaaaccaaagaaaagauccagaagcagaucuagaacaagaagaaggucuagaucaagggaaggaaacucuagaagagauaaaacugauaagaggcaucgaaguagguccagagaugaccguaaaaaacguagaaaagauagaaguaguuccaaaacuagagagaggaguggaucaagggauagaagagagucagggagaucuagagauacagauaaaagggaaagaaauagaucgagagauaggagagauagaaguagaucaagagauaggagagauagaaguagaucaagagauaggagagauagaaguaagucuagagauacagauaaaagggagagaaauagaucaagagauaggagagauagaaguagaucuagagauagaggaagaagagaugggaguagaucuaggacuaacagaagggaaagaaguucugagaagaaauuuaaaagugaaaaagauaauccugaauuugaagaagauccuacuccaggaaagauuuauaauggaaaagugucgaauaucguuccauuuggauguuuuguucaguuggaaggcuugaaaagaagaugggagggucuaguucauauuucucaacugagagcugaaggcagagucacaaauguuucagaaguagucgcuagagggggcaaaguaaagguaaaaguauugacaauaacaggccaaaaaguuucccuuuccaugaaagaugucugccagaugacaggaaaagauuugaacccccacucccaugcaccugacgaaagagaagacaaagacagaaacccugacagaccaaugaacaauagcacaucaguucuaagacugccggucagcauagacgaaggugaagaggacucuaggaagcgaguaacaagaauuuccagcccagaaaggugggaaaucaaacaaaugaucucaucuggauguauagauaaaagugagcugccugaauuugaugaagaaaccgguuuguugccuaaagaggaggauggagaggcugauauugagauugaauugguugaagaugaaccuccauuuuugcaaggccacgguagagccguccacgaccuuaguccagugaggauagucaaaaauccugauggaucucuagcccaagccgccaugaugcaauccgcucucgccaaagaacgcagggaacaaaaaaugauucaaagagaacaagaagucgauucacaaccauccgguaagaacaaaaauuggauugauccacuucccgaagacgaaaccagacugauggcgaggggaauaggccugcaaagccaggauuugcccgaguggaaaaagcacgucauuggugguaaaaagucgucuuucggcaaaaaaaccaaucugacgauaaucgaacagcgccagucucuuccuaucuacaagcucaaagaagaauuacgaaaagccguuacggacaaucaaauuuugaucgugaucggcgaaacggguucugguaagacgacgcagaucacucaguauuuggcugaagccgguuucacagccaggggaaaaauaggauguacucagccaagaagaguggccgccaugucgguggcuaagcgaguagcggaggaguuuggauguagauugggacaggaaguuggauauaccaucagauucgaggauuguacuagcccugagacgaugaucaaguacaugacagaugguauguugcuuagagaaugucuuauggacuuagaucucaaaaauuacucggugauuauguuggacgaggcucacgaacguaccauccacaccgacguccuauucggucuucugaaacaagcugucuugaaacgcgaagaacucaaauugaucgucaccucggcaacgcuggacgccgucaaauucucgcaguacuucuucaaggcgccgauauucacgauacccggcagaacguuuccggucgaaguuuuguacaccaaagaaccggaaacugauuauuuggacgccagcuugaucaccgugaugcagauacaccugagggaaccgcccggcgauauuuuacuguuuuugaccgggcaggaggagaucgauacagccugcgagauucuguaugaaagaaugaagagucuaggucccgauguaccugaacuaaucauccuacccguguauuccgcguuaccaucagaaaugcaaacuaggauauuugaaccggcaccgccggguagccgaaaggucguuauagcuacaaauauugccgaaacgucucuaacaauugacgggauuuauuaugucgucgauccgggauucgucaaacagaaaguuuauaauuccaaaaccggaauggauucgcucguaguuacacccauuucgcaggcgcaagcgaaacaacgcgcaggccgugcagguagaaccgguccuggaaaaugcuacaggcuguacaccgaaagggcguaccgcgacgaaauguugccgacgccggugcccgaaauccaacguacaaauuuagcgacgacggugcuccagcugaaaacuaugggcauaaacgaucugcuucauuucgauuucauggaugcuccgccuguagaaucucuaauaauggcgcuggaacaguugcauucguuaucggcccuagacgaugaaggacuguugacuagauuggguagaaggauggcggaauucccgcuggaacccaaucuaucaaagaugcucauaaugucgguggcgcuucaauguuccgacgaaauuuugaccauagugagcaugcuguccguccaaaacguauucuaccggccgaaagacaaacaagcgcuggccgaucaaaagaaggcgaaauucaaucaaccggaaggcgaucauuugacgcuguuggcgguguacaacaguuggaagaacaacaaauuuucgaacgcuugguguuacgaaaauuucguacaaaucagaacguugaagagggcacaggaugucaggaaacaguugcucgguaucauggacaggcauaaauuggacguggugucugccgaaagaaauaccgucagggugcagaaggcuauuuguucagguuucuuuaggaacgcugggaaaaaggauccucaggaagguuacaggacuuugguggacagucaagugguauacauucauccuucuagugcuuuauucaaucggcaaccugaaugggugauuuaccacgaauugguccagacgacgaaggaguacaugagagaagugacgacuaucgauccgaaauggcugguugaguucgcgccugcguucuucaaguucuccgauccuacgaaguugaguaaauucaagaaaaaucaacgcuuggagccauuguacaacaaauacgaagagcccaaugcguggaggauaucgagggcacaggaugucaggaaacaguugcucgguaucauggacaggcauaaauuggacguggugucggcc

SEQ ID NO: 6538 - RNA, 1317 nt, Psylliodes chrysocephala
augaauccaggcgccccgaauuaccccauggcgucucuguacgucggagacuugcauuccgauaucacggaggccaugcuuuuugaaaaguuuucaucggcuggccccguucuauccauucgcgucugcagggauuugauaacccgcagaucuuugggcuaugccuacguuaauuuccaacaaccugcugacgccgaacgugcccuagacacuaugaauuucgacuugaucaaaggcaggcccauucguaucauguggucccaacgcgacccuucucuacgaaaauccggagucggcaacguuuucaucaagaacuuggaccgauccaucgacaacaaggccauguacgacaccuucucggccuucgggaacauucucagcugcaaaguggcucaagacgagagcggagucagcaagggcuacgguuucguccacuuugaaaccgaagaggcugccaauaaauccaucgaaaagguaaaugguaugcuguugaacggcaagaaggucuacguuggucgauucaucccgcgcaaagaaagggaaaaggaacugggcgaaaaggccaagcucuucacgaacguuuacgugaagaauuucggagaggacuuguccgaggagcagcugcgaacgauguucgagaaguacggcaagauaaccagcuacaaaauaaugagcaaggaugacggcaaauccaaaggguucggauucgucgcuuucgagagccccgaggcagccgaaucagcugucgaggcccuaaauggcaaagaguuacuggaaggcaagccuuuguacgugggaagagcccagaagaaggccgagcgccaacaggagcugaagcggcgcuucgaagcccugaaaauggaacggcugaaccgcuaccaaggcguaaaucucuacgugaaaaacuuggaugacaccauagacgacgaacgccugcgcaaagaauuuuccccguucggcaccaucaccucggccaaggugaugauggaagaaggccgaagcaagggcuucggcuucgugugcuucuccuccccggaggaggccaccaaggccgugaccgagaugaacggccggaucgucggcacgaaaccgcucuacgucgcccuggcccaacgcaaagaggaccgcaaggcccaucugacgucgcaguacaugcagcgcauggccaacaugcguaugcaccaaaugggccaguucauccagccgggcggcucgagcggcuacuucgugccgaccauucaagcgacggcgccgcguuucuauugcugcugcuggaaaucgugcagccaacuucaaauacaccgccaacaugcguaa

SEQ ID NO: 6539 - RNA, 2766 nt, Psylliodes chrysocephala
augaccgacucaaaauauuuuacaacuacuaaaaaaggagagaucuuugaauuaaaaucugaacucaauaaugacaaaaaggaaaagaaaaaggaggcuguuaaaaagguuauugcuucuaugacaguuggaaaagauguuucagcauuguuuccugauguuguuaauuguaugcagacagauaauuuggagcucaaaaaguugguuuauuuauauuugaugaauuaugcgaaaucucaaccugacauggcuauuauggcagugaauacauuuguuaaagauugugaagaucccaauccucuuauuagagcacuugcuguuagaaccauggguugcaucagaguagauaaaauaacugaauacuugugugaaccuuuaagaaagugcuugaaagaugaagauccauauguuagaaaaacugcagcuguuuguguagccaaguuauaugauaucuccucagguuuaguugaagaucaaggauuucuggaacaacuaaaagaauuauugagcgauuccaaucccaugguaguagcaaaugcuguugcggcuuuaucugaaauaaaugaaaguaguccuacuggacagccacuuguugaacuaaguacuaacaccauaaauaagcuccuaacugcuuuaaaugaaugcacugaauggggccaaguuuucauucuggauucguuguccaauuauacuccaagagacgaccgugaggcucaaaguauaugugaacgaauuacgccucgucuugcucaugcuaaugcugcuguagucuuaucagcuguaaaaguuuugaucaaaaugauggaaauuuuagcaggcgauacagaauuuugcaauacacugagcaaaaaguuagcgccuccuuuggucacuuuauugaguucagagccugaaguacaguauguagcauugaggaauauuaauuugauugugcaaaagaagcccgauauccuaaagcaugagaugaaaguauuuuuugugaaauacaaugauccaaucuacguaaaacuagaaaaacuugauauaaugauccguuuagcaucccaagucaacauagcucaagugcuuagugaacuuaaagaguaugcuacugaaguugauguggacuuuguaagaaaagcuguuagagccaucgguagaugugcaaucaaaguugaaccuucugcagaaagguguguugccacauuauuggaccuuauucagacaaaagucaacuaugucguucaggaagccauuguggugauuaaggauauuuucaggaaauauccaaacaaauaugaaaguauuaucaguacauuaugcgaaaauuuggauacucuugaugaaccagaagccagggcuagcaugguguggauuauaggagaguacgcagagagaaucgauaaugcugacgaacuuuuggauaguuuucuggaagguuuuggcgaugagaaugcucaaguacaacuucaauuguugacugcuguagugaaauuauucuugaaacgaccucaacacacucagggcuuaguucagcacguacuaaguuuagcaacucaagauucugauaaucccgauuugagagacagagguuuuaucuauuggagauuauuaaguaccgaucccgcugcagcuaaggaaguggugcuugcagacaagccccucauuuccgaagaaacugaucucuuagaaccgacccuucuugaugaacugauuugucacauaucaucacuggcuagcguuuaucacaaaccacccacagcauuuguagaggguagaagugcuggaauacgaaaaacauugccagcuagacaagguucugcagaugauagugcuagcgcuccggagaccacugucauaccgaaccaagaaagucugauuggagauuuacuuucuauggaucuuaacgcuccugcacccuccauggcggcuccggccgcugcgccaaccaguaaugucgaccuucuuggugguggauuagaugucuuguugggaggaggaaaugauaucagugguguucccaccaccgcagcugcgccgacaaccacaggucuccugggcgauaucuucggaauaccuuccgccccuaccauguacacuccucccaaaauucuuugguugccugcugaaaaaggcaagggauuggaaauucaagguacuuucuccagaagaucuggacagaugucgauggauaugacuuuaacaaacaaggccaugcaggcaaugacagguuuugcuauccaguucaacaaaaacagcuucgguaucaugccccacgcuccauuuagcgcuccuccauuacaaccaggacaaagucucgaauauucuaugcccuugaacaccacagguccagugcaacgcauggauccauugaccacucuucaaguggcaauuaagaauaacguugacguuuuuuacuacgccugucaaauuccaauucaaguacuauuuucugaagauggaacauuggauaaaagaguauuccuuaccacuuggagggacauuccuggagccaacgagguccaguauacucuuaaugacguaaaaggcaauacugacacagucuccaacaaaaugacccucaacaacauuuucacuauugccaaacguaacguggaaggccaagauaugcuguaucaaucucuuaaauugacaaauaauauuuggguccugcuugaacucaaauugcaaccaggcguuccaacggccacuuugaguuugaagucgagguccguagaaguugcuccauacguauuucaagcuuaugaaucuaucuuaaagaauuaa

SEQ ID NO: 6540 - RNA, 498 nt, Psylliodes chrysocephala
augccaccuaaauucgaucccacagaaguaaaauacguuuacuuaagauguguaggaggagaagugggcgcuacuucaucuuuggccccuaaaauugguccacuaggguugucuccaaagaaaguuggugacgauaucgcuaaaggaaccgccgacuggaaagguuugaaaauaaccguucaauugaaaauccaaaaucgucaggcuacaauuucugucguaccaucagccgccucucuuauuauuaaggcuguaaaagaaccaccacgugauagaaagaagcaaaagaacauuaaacacaguggcaacauuaccuucgaugaaauaaucacaauugcaaagcaaaugaggccccggucuauggccaaacaacuuucugguugugucaaggaaguauuggguaccgcacaaucuguagguugcaccaucgauggaaaagcaccucaugacguuauagacgacgucaaugaugguucaauagaaguaccagacgaauaa

SEQ ID NO: 6541 - RNA, 1185 nt, Psylliodes chrysocephala
augauaaguauauuacauccuauugaaaaggugaguagguauauuuauacacacuacuggauaacauauuuuuuuauaacuucuaguaaaaaaaugguugaaggcaaaagagcacugauucucguuggaggauaugguacaagacugagaccucucaccuugaguagaccaaaaccucuuguagaauuugccaauaaaccaaucuuguugcaucagauugaagcauuaguagaugcuggagucacagaaguaauucuagcaguaucauaucgugccaaacaaauggaagaagaacuaaccauagaagcuacaaaacuagguguuaacauaaucuauucucaugagacugagccucuagguacugcaggaccaauagccuuagccaaagagcaucuuuccaaaagcacaaagccauuuuuuguacuuaauucagauauaaucugugacuuuccauuuagagaacuagccaaguuccaugaagaucaugguaaagaagguacaauagugguuacaaaggucgaagagccuucuaaauaugguguagugguuuaugauaaaacuaauuguauacaaagcuuuauugaaaagccccaggaauuuaucucgaacaaaauaaaugcuggcuuguacauucuaaaccccaguguaaucaacagaauugaccuuaaaccaacuucuauugaaaaggaaguuuucccaaauauggcuucugacaaacaguuguaugcauuugaauugaaaggguuuuggauggacgugggucaaccaaaagacuuucugacagggaugugcuuguauuuaacucauuuaagagaaacuaacagccaaaaauuguauaaaggcccuggugugguugggaauguaauaguagauccaacagcaacaauuggaaacaacugucaaaguggaccuaauguuacuauuggcccagggguuguaauagaagaugguguguguauaaaacgaucaacaauucugagaggugcaaccauuuguucuaauucauggcuugaaagcugcauaguaggauggaagugccauguagguagguggguacgaauggaaggcagcacaguucuaggcgaagacguaauuguuaaagaugagaccuacauaaauggaggacaaguuuugccccauaaaaauauagccaccucaguuccugaaccccaaauuauuauguag

SEQ ID NO: 6542 - RNA, 867 nt, Psylliodes chrysocephala
auggcgucggacggggaagaagugauaagugaccacgaaaaaguaaaaauagucucagauuucauccuccauucgccuccaggugaauucaacgaagucuucaaugacguccggaagcuuuuaaauaacgaugaccuccugaaagaaggaguaaccggggcauucgcccaguacaauaaagaccaacucaccccaguuaggauagaaaaugccgaucacuuggugcugauuacagaauacaacgauuuagguaacaacagauucuucgauccccguaguaaacaaaguuucaaauacgaacauuuaagaaaagaggcuuccgauuaccagcccuauaccccagauucugcuacggagccuuggcgggcugcccuagaugcggaguuuguccaauacacgaggaaccauuacaaggacggcguuugcagcgucguggggcgcaaccaagguggugcuauuacacuuacagcuugcauagaagaucaccaguuucaaccuaagaauuuuuggaacgguagguggaggucucaguggucuguuagcuuaacggaugagucuacggccgaaguaagagguguguugaagguucaaguccauuauuaugaagaaggaaauguccagcugguaagcacuaaagaaauaaaagaaacuauuccgguuuccaaugaaacucaaacagcaaaagaaaucauccaagugauugagaaugccgaaaaccuguaccagacggccaucucugagaauuaucaaaccaugucugacaccacauucaaggcgcucaggagacuccugccugucaccaggacaaaaaucgauuggaacaaaauuguaucuuacaguauuggcaaagaacuaaaaacgcaauga

SEQ ID NO: 6543 - RNA, 3861 nt, Psylliodes chrysocephala
auggggcgaugugccaaaaaccuagcaaaaaugugccuaaaguacuuuguucuaguuuuaauacuuaguguuagcauacaugcucaagacaauagugauaguacggggagcguugauaauacugacaauaacggacaagauaacacaggugauguagaaaguauaaaugucgauacggggguaguuaaagcaguuccggauggaacugauucaaaaccuauaccgguugaggaagggauaaaugcaauuucgccaacaaacccgaacuaugaagaacccguagaaguuuuaacagauauuguuagcgauacuaacacuucaaagcccaacuggacuuaccagaaaaaaaguaaaagcgggagauauauuacuuauuacggcgcagauuaugaucccaugacauccgacacugccccuccugauagugaccaacgaggagguauuccauauaccauaacugaaacaaggcuagcagaaauccgaaaacauuucauguacccauuuuucgacaaaggcggcaaugcugacaaugaaggagauuaucagaaagagauccagucuucgacgccucaaguccacaagaauuuaaacuuccaacugccauuuuucgguuuuagauauaauuacaccagaguuucuauuaacgguuauuuggaauucagugacccuccaccaaauuuugauuauccauuaguuuuuccugucaaagaauggcccaagaaaaaugauccuucauuuauugguauuuucuucaguaaauguaagaucggaaaccuucgugauggugacauugaucaaagaaaaccagguguuuacuucagauuagaacgagaucuucgaguaagacaagacagaaugggaguagaauuacgggaaagauuaaagugggauauaagagaaggaguaauugguucccauacauuugaucccaaacaugcaauuuuuauaaccuggaagaacauuucguucaacggaggauacgccaacgcuguauaucaaaccaacaccuuucaaaugguccuugccaccgaugaagucuucacuuaugccauuuuuaacuaucucaacuuagacuggacuagucacacugaagcuggaggugauacaagaaaaggagaaggugguguaccagcuuacguugguuuuaaugcuggcaauggaacacgcaguuuugaauauuuaccauacagucaagcaucuguuauuagagauuuaacagcuacugguuggggaaacaacuuccagggaagacauauuuuccguauagaugagaauaucuuacuagguucuuguaauaaagauauugacggugcaaaucuaccucuacaguucgcaccugagagcgguaacaugcugggaggaaccguugugaauauaacaggucccuguuucaaucuuaacgacagaauuagauguaaauuugauguuuccgacgaaguuguuggacaugucguugacagaaauagagcuauuugugugcagccucuauuauacucugaaggauggguuaaucuacaaauugcuguuaacucagaagcuuucaaguggaaaggaaaauauuauguugaaucaccaucuagugcaacucaaaaaauuuucuucaaagacaugaaauaccaugaaaaaucuccgagcgaaauuagaaucacuugggaaagacaaaauuugacuaguaacgauaaugcaaauauucggauuucuuuaugggguuacagagaaacuacaaugagaccgacguuuguuuacaucggagaaauugcugaaaauauucaaaacacuggagaauacacaauaguuccuucucaguacagaacaagggcuaaucaauuuuugacugauauuaaguuugguuuucuacaaauuaauuugacugaauccauaaaggucaauacauacacaacuuccaaccaaaauauagauaucacuccagugguuuggagucgaccaauucccuuggguugguacuucggauuucaaugggaaaauuuguaugguagaaauuggcccaaauaucucugcgacgaaugguuaagaacagacagguaccuuaaaaauuucgcucaugaacuuccucaguguccuuguacaguacaacaggcuuuagcagauaaaggaagauauaugccagauuucgauugcgauaaggauucaaaucccauauguuauuacaauaaucaagcucuacauugugucaaaacuggaucuccaacauuggaaggcucagaacaacaauguugcuacgacaaaaacggauaccuuauguuaucuuacgaccaacaauggggauccaguccucgccguugucauaaucuugguaaaaugccuuauaacgaagcuacgaaagucccaacucuaucccaaugguuuaacgacguaguucccaaauaucuuugcuguuuauggcaagaagaacaagcaguagguugcgaaacuuuaagauuugaaagaagaccaacgcaagauuguguggccuaucaagcaccgggcauagcuggaguuuauggugacccacaugucguuacuuucgaugacguagaguauacuuuuaauggcaaaggagaauuuucuuugguaaaaucaguuacuaaauuagauaauuuagaaguacaagguagauuugaacaaauggacccuaaugcuuacggugaagucagagcuacacaguugacaucaauuguugcuaaaggaaacaacacuaucucuguggagauuagaagaaggccuuuggauucuagguggagauaccgauuggauguaauagcugauaauagaagguuauauuuugacaggccuuccuugaaguuccaacauuuucaagguguaacuauuuauaccccaacuuauauacugaaucagucugaaguguugauuauguuugauaacggagccgguguugaaguauuagauaaucaagguuacaugagugcaagagucuuuuuaccauggucauuuauaaacaaaacaguugguuuauuuggaaacuggaguuucaacaaagaagaugacuuugcuuuaccagacggcacuaaggcugcuguaguaaguaauauuaacgauauggaaagaguguacaaugacuucgguucaaaauggauguuggaugacguauuagauccacaaaaaggacgcgcauuguucuauagagaguucggacgaaguucuucuacauauaauaauaaaacuuucaaaccacaguuuuuaaugaugccggaagacauuauaccugcaaauagaucaguucagauugauagaacauaccaaauauguucaacaaggauguacgaauguuacuaugauuaugcuaugacguuaaauagagauguagcgcacuuuacgcaaaauuauaaaucaacaauuuaucaacuaaaggauauugcccguacuaaagugccaucuugcggaguuuuggaaacaccaagauuuggccggaagaguaccuucuuguuugugccugguaccaaaguaacauaugaauguauucaagauuuuguauugguaggagaucagagaagagaauguacugcugaggguacuuggaauacaccggauuauggauauacauacuguuuacgucagcaggaauauucgcaaaggcaggcaggaauuacaucaggaauaauaaugauaguccuuauaccuuuaauccugcuuuucgucuacuuggcguauagguuuuuaaagaaaaaacagaaggaaaaagaagaaacucagcaucaagcguuaauguaccaagaacaaaaaaggaaagcucaagaagcagcuacacgaaaaauaacugaagcugaggaguauaauucugaagaagacgauaauaacaguaaccucacaaguacaggagcgaaggaaacaaauauuuauuaa

SEQ ID NO: 6544 - RNA, 318 nt, Psylliodes chrysocephala
augcguuacguggcugcuuacuuauuggccguuuugggcggaaaagccucuccaaaugccgcugaucuugaaaaaauucuugguucaguaggaguugaagccgagggugaaaaacuuaaaaaagucaucggcgaacguaauggaaugugcguugaagaacuuaucacucaaggucgugaaaaauugaguucccugcccguugguggaggugcaccugcagcugcuguugcuucagcugccccagcugcugccgcagagcagaagaaagaagccaagguagaagaaaagaaagaugaaucagaaucagaggaugaugau

SEQ ID NO: 6545 - RNA, 2733 nt, Psylliodes chrysocephala
augaugacugaucguuuuggacuaaaaugggaccccaaaaauuuagaaauuagaaccaugucggucgaaaaaacacuggagccccuuguuuugcaaguuacuacucuuguaaauacuaaggggcccaguaaaaagaaaaaggggaaaucuaaacgugccaaugcuuugguuaguacuguagaaaaagccacugaaaauuuuauugagaaaggugaacaaauugcuuaugaaaacccagacauuacagacgaaauguuagcugcuguugaugaggugaagaaaacagguacugcuaugagcauagcugccagggaguuuucugaagauccuugcucauccuuaaaaaggggaaauaugguucgugcagcuagaaaccuuuuaucagcugugacacgucuguuaauucucgcugacaugguagauguucaccucuugcucaaguccuuacauguaguugaagaugauuuagaaaaacugaaaaaugcuucaagccacggggaacuucuugacaauauuaaagccuuuggccaaaaugccaaugaacugaugaaccaggcagcuaaaagacaacaggaauugaaagauccucagcuacgugaugauuuggcagcugcuagagcuguacuuaagaaacauuccacuaugcuuuuaacugcuucuaagguuuaugugcgccacccugaauuggcagcugcuaaggccaauagggauuauguuuuaaagcaaguuugugaggcugucaauacuauuaaugauguugcacaggguagaacaccucaaccugcuucuggaccuuaugaugguccuggagagcuugcagcugcauuagaugauuucgaugaucauaugguaauggaaccucuugcuuacaaugagguucauacaagaccaucacuggaagaacgcuuggagagcauuauuaguggugcugccuuaauggcagacucaaguuguaccagagaugaaagacgagaacguauuguagcugaaugcaaugcuguuaggcaagcucuucaagauuuacuuucagaauacauaacaaauauuggcaauaaagacaaaagugagagucuuaacagggcuauugacaauaugggcagaaagacccgugaccucagaagacagcucagaaaagccguaguugaucauguuucugacaguuucuuggaaaccaacguaccucuauugguucuaauaaaagcagcucaaaacggcaaugaaaaagaaguagaggaauaugcggucgucuuuacugaacauuccaauaaacuuguagaaguagcuaaccucgucugcagcaugucaaacaaugaagauggugucaaaaugguucgauaugcagcugcucagauagacaaucuuugcccggaaguaauaaacgcagcuagaaucuuagcugccagaccucgcaguaaaguugcucaagagaauauggaagcuuuuaaacaaucuugggaacaccaaguacgaauuuugacagaagcuguugaugauaucacuacuauugaugacuuuuuggcuguuuccgagaaccauauucuugaagauguuaauaaaugcguccuagcacuucaagaaggugaggcugauacauuagaucgcacugcuagcggaaucaaggguagaucuaacaggguaugcaauguuguaacagccgaaauggauaacuaugaaccuugcauuuauaccaaacguguucuggaagcaguuaaagugcugaacgaucaaguaaugcccaaguuuacucaaagaguacagguugcaguacaagcgcuugguaacaguccaccaaaggaaguugaugaaaaugacuucauugaugcuucuagauuaguuuaugauggaguuagagagauaagaagagcugugcuuaugaauagggcugaugaggauuuagauccugaagaugucgaacuugaugaaaauuacuugauugaaacuagaaguaaaucgagugcccacacuggugaacauggcguagaugaauauccggauauuaguggcauuacaacugcuagggaagcuauggggaagaugcccgaagaggauaaacagaagauuuuacagcaaguagaauucuuuagaagugaaaaacucaaauuugaccgugaaguugccaaaugggacgauacuggaaaugacauuaucguucuugccaaacauaugugcaugauuaugauggaaaugacagauuuuacaaggggucgagguccucugaaaacaaccauggacguuauaaacgccgcuaaaaagauuucagaagcugguaccaaauuagauaaacuaacucgccaaauugcagaacaaugcccagaaaguucaacuaagaaagaucuucuugcuuaucuacaacguauugcucuuuacugucaucaaaugaacauuacgucuaagguuaaggcugacgugcagaauauuaguggagaacuuauuguuucagggcuugauagugcuacaucauugauucaagcugcuaagaauuuaaugaacgccguaguucuuaccguuaaagcuucauacguugcuucuaccaaauauccacgacaagggacuguagcuguaaguauuucuccuauugucguguggaagaugaaggcuccagagaagaaaccucuagugagacccgaaaaacccgaggaaguccgugccaaagugcgcaaagguucacaaaagaaaguucaaaauccaauacaugcucuauccgaauuccaaagucccacggaauccguguaa

SEQ ID NO: 6546 - RNA, 1014 nt, Psylliodes chrysocephala
acaacuacuacuccucaauuuggacuuccaacgagcaaaccagguacuacaacuuuaucuucacuucuuggaucugcaccagcugcuguugcugcuacuacaguuucuacaggauuagguuuugguucuacuauuggugcaacaacugcaacucuugcuccuacuacaguuucuacaggauuagguuuugguucuacuauuggugcaacaacugcaacucuugcuccuacuacaguuucuacaacaacugcuacuccugcuacaggugcuucucucuucgguaguacgucuacaaguguugcuacaauugcuccagguuuggguuugucaacagcagcaccuacagcuuuuucuacagcagcauccaccgcuuuaaguacuaccacaguagcuccaacuuauucaacuacuacacuuccaucuacugguuccuugacuuucggucaauuggaagacucuauaaacaaauggacgaucgauuuagaagaacaaggcaaauucuucaucaaccaagcaaagcaacuuaaugcaugggacucucugcuuauuaccaacggagagaagauucuuaauuugaauggcaguauugagcggguuaagcaacaacaacagcaguuggaucaagaacuagauuucguauuggcacaacagaaagaauuggaagagcuaauuacaccuuuggaaaaggaauuguuggaaauuccugucacugauauagauaggaaucaaauguaucaauucucagaaauuauugacucucaguugaaacaaaugucagaugauuugaaggaaauuaucgaaaauauuaaugaaucuaacaagaaugaagaaauaucaaauccuauuacccaaaucagucgaauacugaaugcccauaugaauucucuacaaugguuagauagaaauacaucccaaauuagcucacaucucgaacaaauuagcaagauucaggauacaaauagacgaaauuuuacucaaaaucauucauucaauaauaauucauuuaauauguaa

SEQ ID NO: 6547 - RNA, 570 nt, Psylliodes chrysocephala
auguggauugugaacugguucuacgacguccuuucgucucuuggccugcucaacaagcacgccaagcuucuguuccucggucucgacaaugccggaaagacgacccuccugcacaugcuaaagaacgaccgcguugccguuuugcagcccacgcuccacccuaccucugaggagcuugccauuggcaacguccgcuucaccacauucgaucucgguggccauccccaagcccgccgcaucuggagagacuacuuccccgaggucaauggugucguguuccucgucgacgccaaggacgaggagcgauucgccgaggccaaagccgagcucgacgcccugcucgccauggaggagcucgccaagguccccuuugucauccucggaaacaagaucgaucaccccagcgcgguccccgaggacagacuucgucacgagcucggccuuuaccagacgacuggcaagggcaaggugccucuggagggcauccgcccgaucgagguauucaugugcucgguagucaugcgccagggcuacggugacggcauucgcuggcugucccaguacgucuaa

SEQ ID NO: 6548 - RNA, 564 nt, Psylliodes chrysocephala
auggaucccaucgcaguccuagaaaagcguaucgaggcccuagaauuacaaguuuuuccauuaggagaccauucucaaauuucaaauaaaacccaaacuauuaccgacuuauugucggaaacucaaacaaugaucaaaucagcccuacauugucgggaaucgaucacuucaauguugcaacauuuaguaaucauuaaugauuauuugaacccugccggcgaugcugacgaguuagaaguggaagcaaaacgacaauguuugcuugaauuguauccugaauugaaagacacuguacaaaccauuaguacucuagagucucuguugcccuuuauugauucuauuaacaucucuaaaguagucgaauuuucuggaaaauuggaagaaauagcuuuaaguaaccuuaaacuuuauggagaaugucgagauauaacuaaaaaaguacugguagcucuacaaaauuauaaugauauaucuaacucuauaaaauuacuauuuucucaguuggauacugcuauaucaaaucuggagaaugcuuuacaacuuagaguuguuagugaggaauga

SEQ ID NO: 6549 - RNA, 1752 nt, Psylliodes chrysocephala
augaauaacgcaaaauuacaagaaguuuacagugauuuaaccuuguacacuacccccgauaaauuuuuccucgagcccaaaacuggugaugaacuuauggugauagagagagcuucugaaaauauaguauguuucaaaaauaaucauagacauuugaucccugcagcuaauagcagaaaagauuuuuguggucuuauugguauaguacaucuacuagcauguccauaucuaguuguagcuguucaaagagaauuaguggguuauauagcggguugugcaguuuggagacugguuaaagcugaauuaauuccauuuagaagugcauugcauuuaccuccagaaaaacaagcugauaaugaaauauauuuagcuaugguagagucuguauuaucuaccccuuuccuauauuuuuguuaugauuaugaucuuacacauuccuuacaacgauuacauggaauaaguccugauuucuggaaccaaucaauaugggauagagcugaucaaagauuuguuuggaauggaaacuuauuaacuccauuuaagggcuuguauauucaaaaauuuugcuuaccuuuaauucaugguuuuauuuccauaaacuucuguguuauaaauggccacaguuugaacuggucaauuguaucucguagaaguguucagcgugcugguaccagauuacauagaagaggcauagacaaagauggaaauguugcuaauuuuguugaaacugaacagauuguugaauaucaaggggaccaugcaaguuuuguacaaauaagagguucaauuccacuauuuuggcaucaaaauccugauuuacguuacaagccuccucccacccuauuagaaguugauccacaagaucaucauuccacuuguuuaagacauaugaaugauuugaugaccauguauggaaaaguuguuugugugaaucuuguugaucaaaaaggagcugaagggaauauggaaauagcuuuccaaaaugcuauaaacaauaugucgucuccuuccauucguuaugaguauuuugauuuccaugcagaaugcagaaaaaugagaugggauagguuaucaauucuuauagauaggcugucucaugaucaggaugaaauggguuucuucuuauuacuaagagaugguucauuaaguucuuuacaagauggcguuuuuagaacuaauugcauugacugcuuagauagaacuaauguugugcaaaguauguuggcucauagaaaucuugaaagcguucuaaaaaaauuacagauucuucaacaaaaccaaacacuggauuaucaauauuccuuugagcuucuuuuuaagaauguuugggcugauaaugcagauauaauuaguacccaguacucagguacaggugcauuaaaaacugauuuuaccagaacuggaaaacguaccaaaaugggauugcuucaagauggccuaaauucucuuauuagauacuacaaaaauaaucuaacagauggauaccggcaagauucuauugacuuguucuuggguaauggaaaaccaauuucaccgcuacauauagauaaggguuggagauauguaacuuauccaucuguauuguuaauugcuguagccauguuuguagcuugugcagucaccccuucugaguauucaacggauucccuauuguuuuuguuauucuggggauccaugguauaugcuacauugcauacgauucucaaauauggaucggaauuuguggacaaacccagacucacacaguccuag

SEQ ID NO: 6550 - RNA, 1767 nt, Psylliodes chrysocephala
augccuccuacuauucaacagaauaaucaaaaugcuacaaauggaguagaaaaaagaccagugaaaacaauagaaaaaagguccgaucuguugugcaaaguuaaauauuguaauacguuaccagauauuccguuugauuuaaaauuuauaucauauccauucgaaucaauaagguuuauucaauacaauccaacaucauuagaacguaauuacaaauaugagguauuaacugaacacgauuuagguguuaauauagaccuuauuaauaaggauauauaugccauugguucaggaguuacuuuagauccagcagaugaaaaguuauuagaagaagauauuuugacgccucaagauucuaagagaucacgccaccaugcuaaaucaguaucauggcuuagaagaacugaguauaucucuacagaacagaccagauuucaaccucaaaccauggacaaaguggaagcaaaaguugguuacaguauuaaaaagucacuuaacaaugaaacuuuguauauggacagagauucucaaauuaaagccauugaaaaaacauucgaugauacuaaauugguuaucgauaagcauuauagcaaaccgaauguuguaccaguugauauuuugccuguauaugcagauuuuagcuuauggaaauauccuugugcucaaguuauuuucgacucugauccauccccgaguggcaaacaaacgccugcccagauugaggagaugucucaagcuaugaucagaggugugauggacgaaaguggagaacaauucguggcauauuuccuaccuacagaagaaacucuucaaaaacgucgagaagauuucaucaaacaaaucccguaucaagacgacgaggaauacgaauauaaaauggcgagagaauacaauuggaaugucaaaaguaaagccagcaagggauacgaagaaaauuacuucuucgucguucgucccgacggaaucuacuauaacgaauuggagaccagagucagacuuaguaagagaagacagaaaaucggucaagcucccagcaacacuaggcuuaucguuaaacauaggguuauggaugcaaacgaguucaggaugcaaagauacagggagaaacaacuugaaccaccaggugaagaagaugaggaaauggaaauugaugaaccgaaguacgacgauacuguucaagaacaagaaaaugagauugagguugaaucagaucaagaaaagacuaaagauguaagcaauacuggaaacaagcaacguaaagcuuuuucaagauccagauccaauucgucggcuagaucugauaagucaagaucuagaucuaggucaacuucuucuucuaaaucuaauaaguccagaucuagaucaaaguccaggucaaaaucuaggucuagaucaaaauccaggucuaagucuagaucaaaauccaggucaaagucuagaucaaaguccagaucucguucuagaucauccucgaagagcgcaucuagaucuaggucggugucuaaaucuucuucgaacucucgaucaccuucuagaucaaagucgagaucuguggcaagaagucgaucaguuuccaggucuaaaagcaggucgagaucaaaaagcagaucgaggucuaaaagcaggucgaagucuaaaagcagaucgaggucuaagaguaggucgagaucuaaaagcagaucgagaucuaagagcaagucgaggucuaaaagcaggucgaggucuaaaucuggaucuaggucuggcucaucuucugauucugaguaa

SEQ ID NO: 6551 - RNA, 1170 nt, Psylliodes chrysocephala
augccgauugaaaauuuggaagaucaaggacuggagaaaaauccagacuuagggcuugcccauuguaaguuucucuugagccuaccggaauacaggaaugacagaaguguacauucgaaaaucaccgaagcaaucaagaaagaugauauggccccaugguacgaauugauuuguaaagaugcuggauggaaauuagaugcggcuuuguugaagacccugaaagcuaaaaaugacgaaaagaucaagcuuuuggaugaagcuaucgaagaugcugaaaagaauuugggagaaauggaaguaagggaagccuacuugaggaaauccgaauauuauaguagaauuggagauaaagacaacgcuguaauuacauuuagacaaacuuaugauaaaacugugucucucgggcaucgcuuagauaucaucuuucaucucauuagaauugguuuguucuuuauggaucacgaccuuauaacaagaaauaucgauaaagcaaagacuuuaauagaagaggguggagauugggauagaagaaaucguuugaaaguauaucaaggugcuuacugcaugucagugcgagauuuuaaaacugcugccaacuuauucuuggacacugucaguacuuuuaccucauaugagcuuauggauuacaaagcuuuugucagauauaccguuuauacuucaauaauaagccuaccaaggaaucaacuuagagauaaaguggugaaagggucugaaauucuagaagugcuacauucugaaccauuuguuaaagauuacuuauuuucuuuauauaacugccaguaugcugaauuuuucacaaaucucgcugaaguugagaguauauugagaaaagauuauuucuugaauccacauuaccgcuacuaugucagagaaaugaaaauaucagccuacacucaacucuuagaaucauacagaucucuuacuuugcaauacauggcugaggcuuuuggugucaccauggaauauauugaugaagaacugucuaccuucauagcugcugggcgguugcauugcaaaaucgauagagucggagguauuguggagacaaacaggccagacuugaagaaugcucaguuuaccucuguugucaaacaaggcgauuuguuacuuaauagaguucagaacuuguccagaguucuuaauauuuag

SEQ ID NO: 6552 - RNA, 15819 nt, Psylliodes chrysocephala
auggaggaaauaaccucggguuuagaucccgaugaauugauggaucuagaugaaccugaagguucugauuuagaggaugaugaagaagaccuuaucgaugaucauauuucgucaccauuuauuuuaucuucugccccagaaucuacugcaaacucuguugccucaucuccaauuagugaagauugucauccaccuuuuaauuuuacaggaaagccucuuaauguuaaacggggcagaggaagaccuagacgagaaggagguaagccuacugcaccucgaaguucacgaggagguaugucaaguguaucuagagugagaaaaccuagaccuccggguuuuucaagaagaggugcuuugggaaguagaaguauaaggcagguagauaggucggauuaugaguuaucucucuuuacuccaucaccaauugaggauaacggguuucuggacccagaaacggguucaaucaucuauucugauagagaaaaauauauuccaucaauagaagauccgccauauuuuccggaacacuggccaggaaaaguuugugccuuguguaauuuaggagagagaagucaauugggacaaggagaacuguuaagauugaauuguccagauggauucuccccacauaaggucgccgcugaacaaauauuagaaagagccuugcaagcucccgauaaagaagcuggcgacaaaaguccuaaagguccuguaacgugcagaagacaaaaaaguuuuaauaaauguagacacccuuccaugaccagcgaauacauugacgaauugacuauuauuggauauaaugaaguaccugauguaucuagcuuguuugaacuaaaugggcaauuuuauauucaccgaaacugcgcuuuauggucucaaggaguuaccaaagcagaaaauucagcuuuguugaaugucggcccuguuguccugcaaaauucuuccaaaaaguguucguucuguaaccauuacggagcaagccucgcuugcaauaaggacgaauguaauaaaaucuaucacuuuccuugcgcaacugcuucuggugccuuucaagaaauuucaucuucagcgacuuugugcagcgaucacuuugggcaaguugcgcugcuuaauaacgcaucuccauguuugacauguggaagcaugggggacauugcaaauuuaauguuuuguucugguuguggcgcccauuaccauggaauuugugucgguuuggcucaauuaccaggaguacgaucugguuggcaaugucgaaaaugccgauguugucaaguuugccgcguggugggggacgaaucaaaauugaugucgugcgaacagugugauaaaguuuaccacgcuggcugccaaagacccauuguuacuucaauuccaaaauauggcuggaaaugucgguguugcagaguauguggagauuguggugcaaggacucccggggcuggcuuauccucaagauggcaugcccacuauacagucugugauucuugcuaccaacaaagaaacaaaggauuuucuuguccuuugugccacaaagcuuaucgcgcccaugcgcauagagaaaugguucaguguuucaguugcaaaaaguucguccauggcacuugugacgccgaugcagacguuaauaccuacaaucaaaagaaagauaugaauccugaauaugaauauguaugccuucacuguaaacauaguacugcgcgccaaauaacuucuaaaagagcaagcauagaugauucauaugauauuuccguuucccgcgauucucuauacgaugauacuucggaauuugaucucccgucgccagaugaauucgcucgaaauaugggauugggaaaaggaaaaccuuacaaugcuaguaagauagcuaaaaaacgacuuaguuucacuguuaacagcguugguagaccaaaggguacuggaaaaguaccaccgggaaagaugggauuuaugaaacgaucccgauuaacagauuucaaccgaaaacgaggacacaaagcuaaaaugaggggcauuuucggaguucccgguguuggacuucaacgaccgauuucggauggaaagaaugacgaagaaccgggcguagagaaucgauugguacuuuguuccgccaaagauaaguucacuuugacacaggauauaugcguuauguguggagcguucgguacugaucaagaaggguguuugauuggaugcguccaaugugggcaguguuaucacccguauuguauuaauguaaaagucacgaaagugauacuacaaaaagguuggagauguuuggauuguacaguuugcgaagguugcggucaacgcaacgaugaagcccguuugauacuuugcgaugacugugacgucucguuucauauuuauugcauggacccuccuuuagauuacguuccgcacggaaauuggaaauguaaauggugugccauaugccuguccuguggaucuaccgauccagguuuuaacuguacguggaugaauaguaccacucaauguggaccuugcgcuucgcauauuaauugcccgaguugcaaugacccuuacagugaaggugaccucaucauucaguguguucaaugcgaacgauggcuacacgguucgugcgauuacauaaagagcgaagaagaugccgaaaaaugcgcugaagaagguuauaauuguauuuugugucggccaagagacguaccgccuccgcauuuaauaccgccaccaauuacgccuaagccuccgacgccaacgaaaaguccugaaguuggaaggaguacaaguuuuuauauggacggaguuuaucucagcgaauucggaaauaaucuaauaaaaucuuuggcuuuagaauaucauggaucuaggaaaaagcggaagaaaauuccuaccguucaggauaaagaagcugguaucauggcuacaauugagucgguuguugcagguggaaauauugguccuaccaauuuggacgacagugcgaaacucgaguuaguagacauuaaagacgaaccacaggaacuuuacaaggaagguaugacguggaccaaagaagacgguccgccuccagaagguuucgcaguuguuaccauggaaaauggugugaacguccugcgacguaagagacaacguaaucuucaaaagcucggcaucggcgguuucuuaguuagaaugcgcgguauuagaaccggucaagauaacgaugacaucgaucaaucugucggucaaucuggaucaauuaccaaugaaauuucaacaccguuaccuggagacggcgauaagccuagaaggaaagcgauuaggagaaaaccuaaaaauaaauuggccgaaacauuuccgacuuaucuucaagaagcguuuuucggaaaggaucuuauggauguggucgaaugcaaaaaggaaguugacaguuauagcagugaagacgaaaaaucugauaguuauuauaaaucuauuaauuuaucacaggaugaauugauagcagucgcugcugucucaggaaaaaaugaacgacuggaaaauaucaauaaagauuauacaaaagaaaugaaaguuaacgcccuaaaagaagaagaagaugacgacaauacggaggauuugaaagauguucuugcuuuaccaggcgauuuacuggauacagauuuaguuaacaguauuauggaagaugaugaagaacuuacuaaaaauaccgcgucgcuagaagguuuagauucgaacuuacaagaugaaucugaauugacagauacuuugggcaguucuggaaauucaaaggaaaccaaagaugaauugagcgauauucuugguccacauuucaaucuugauucuauuucaaauauuaauaguaaagauguagaagauauuuuuaaggguguacugacugacgagucucaagaaucgcaagagagcagcaauuuuucuuugcaaggcaauaguauuuuuacuaauaauagcagccaacaaagcauugcucagcauuccauuauaaaucaaccaguuagaccgaaaaccuugccuaauguuaaucacguuaaccucaauucgccuguuaguuuuccaccaccaucaccguaccauucagaauauagcaauaguccacaauuuaguccagcauuuacugaaucgcccagcgcuuggguggguguaacugaaacuccggaaauugauaguacgaauguaggaguaccuucgacguauaaucaacguucuucugaaaaaaugaaagcugaugagaguuugggcaauggagccaccauuuccgcuguccuauaugccaacauaaaucacccagaauggaagaaagaguucccgaauuggucagauagguacaaacauauaauaaaaaaauggagaacguuaacucaagaacagaaagcaccuuuucuucaacacgcaagagacaaucguagucagcuaagaaugaaaaaagcucaacagucacagaccuccaaggacucuaccucugcuaccacgccccccaaugugaccaagccgcuucaugccgccccagcccuagugaccacccuccaggcaguaacacagcagaccguggggguuuccauagcccccacggcucccguuucagaggaucaagaaaaaauugcgcuucaacaaaaauccgcuagggaagcugagcaggaaaggcaguggaagcaacuucaggcuuugagacagcagcagacucaacaacagcaaaauauuauacacgaacagcguguacaagacaauuguacagcuauugcaagagugcaacgccagauauccacagauccgacucaacaguuuuugacagaacaacaaaguccucuucaagucaauacuccucaagaacuaaguccgucuaccacuccgacgacuccaaguccaaggcaguuccucggcauuaagucuccaacauuuccuguuccuucccccguaucgcagagcucuguccgaucuaccacuccuuugcaaucuccucaugacauuucacaacccgguaccccagaugguaacgauccuuuuauucaaucacccacuauuccuaaaccuaacuuucaaccuagguuaccuaaugauccauuugcucaacaaccagcuacgccuagaccgcaguucggacuuucaaggccacaauuacagaacuucggaggcgccauccgaacugaccaacaagaccuuaauaucaaucgucaguugagggacuuauuacagcggcaacaagugaagaaguuagaugaaauaccgggaaaacuucaacagcagaggguauggcauccgguggaacagcaacaagaaaacgaggcuucuauaacggcaccuacuucuaccucagcaguuaguacuguggcuuccaugucggaugcaacguuucgucaaccguuaccuccuaguaucgugaaaccgagacuagcacuuucauuagcuggaaggacggcacccagugcugugagaguaagccaguuggauccuagaaugcaaggauuggauccgaggaugagauuaauucugcagcaucaacaacaaagauuagcuaccggaauucaacagcaauucauucguuucaccucuaacgcacgucccacuacgguagaacaauaugaacaacuucuacaaaguaauaauccuggucaaauucauucugacgaacaagucauaccucgaaugccucuuaaucaagcgagcguuauacagagaccacaaaucucucagucugcuccgacaagcacgccaacaaucucuaauacaacugaaaauaaccccagcgaagaaggaauuccggauaauguuacagcggaguuagaaaaauuagagcaagaaacagguaccaugguugaacuucaggguguuagugacauauuagguggacuggacgaugacgacgaacuuuuggcugagaugggugcagauuuuaauaucuuagaguaugccgauccggaauuggaagcucucacgggugguaaaacgaacauccuggauuuggaacuagaagaagaaccaguuaaaaaagaaaaaguaguagcaccaaaugcaaaggaagccccuucuaauucuaucuccgcuaaaagcgaugcgaacguugaaacuaaaauugagaauaaugugcaaaaauccauuccaaaaccaguucaaaauccguuaccuccaucaucgucucaucaaauuauucagcagcaaaauauugcucaacauacuacuucgaugcaggcucaacagcaaccaccacauccacagcaacaagcaccucauccacagcaacaagcgccacauucacaacaacaagcaccucauccacaacaacaaguaccucauccacaacaacaacaacaacaaguaccuguacaaucaacuauacagauucaacagauucaucagcaaaugguccaucaaguacaacaagcugcugcucaagguagaccaaugccuccaggaucaaaaaugcaaacaaccgacggguuuguagguauugucauggcaaauaacaccguacaauugcaaauuccccaaaauuaccaacaaagauuacucguguugcagcaguuacaaaaucagaaauuacaaaugaggauuggaggcaagccaucuagagcggcuuugcagguuggucagaaccaacuuucuguaggucugaauucggguccaccucgaaugacaguaccggcuccaccgcccccaccuccgccauauccugguccaccgccgccuuauccuggaaacgcgaaucagcaccagcaggagcagccucuuuuauuggaagacuuacuugagcaagaaaaacgggaacaggagaaacuucaaaaucagccuucuaaucaagaaguaucaucuuccacgggcaaugaaagcgaaucggcacuauugagcgaucaagauuucgaacgucucaaagcggacguuuucaacagcaccccuguaaacaguauaucauccguaaaucaaggaaaugcuggccaaacgucucaaucuuggcaacagcaguuagcaccaacucgacaagcgccuacaccagcgccgccgccgcagcccacaauggaaauuacuacuagaguucagauguucaauccaaauuuaauaccugcaccuccgcuuccaccugagaauauuauuacugagcaagauaagcagacccaguuguuguacgagcagugguuaaaucaucagcauaacgcuuuggcucaacaacugcauuauuaugaaacugaaguacaaaaacuucgaaaaaguagaaagucuuuaaauaguaaacagcggcaacuuagaaaaucuggaaaucaguuaacggauacggaugcagcggaacuucaaaggauauccgcugaacaagcgauccuccaaaaacauuuggaaucgaguagaaaacagagccgucaacauggaaugcugauccaggaauaucgcaacaagcauccugugauuaagcagaggaccggaucagaccaaauucagucgccguugggaccgccggcgucgucucccauucaacaaccaaguacuucuuugucuccgauguugucgccaucuguaucaccgaugacucaaaauaguucgccucugaauaguccuggaccucugauucccucgucuccaggacacguucaaaaucuuuuacaaaguccuaauaguauauccgcuaccaauaugucuccucuacaaucaaugcaggcuucuccaaugcaaucuucgccuuuacaaucuucgccuaggauagguacaccucauucucaaagugaagaaaguccuggcccaauacaauccccaucacaaguaugucuuccgccaccgaugccaagaaugacuucuccucagcacagaagagugguaacaaguccuguugguaugucacagaugagauuuauaaacaacacaguauugcaacaacgcguucguaugcaaucgccaauuccaaauuuccaacaaaagccuggaacgccgucuccauuaaauaguccaacgucgcaacagauaaauguuaaucaacuacaaauucaaaaacagcuucagcaacaaacgauuuugcagcaacaacaguugcaucaacaaacuuuggauaccaaccuugucgaucccaaugcucuucauucucaaagaacaacgcagcuguuacaacacaggaauuucauuaggcaacaaguuacucagcaacaaauuauaggucagccacaaacuuuaacuccucaacaacaucagauaauguugcagcagcaaaaacaguuagcucaacagcaacaacagcaaaucgcucaaaugaacgcagcuagacuucaacagcagcagcaacaacaacagcagcagcaaaauaaucccccucauucaccgaugcccccaaagaguccaaugauuaugucgccgcauucaaugccucauucuccgaugcaaaugccaccgaaaaguccaaugguaucuuuuaguucuagucaaccgaauccgaauuccccugcugcuagaaguccagcauuucaucaaggaaugaaucaaccgacgagucccauaacccauggacucaaucaaccucccaguucgccuaugccuaggaguccuaugaucaaucaaacacaaucgccgcauaugaggaggccgccuagugcuaguaauaguccggcgaugccugaaagaccucacagcguugaaaaugcuucaccuagaaugucguauucgauagaccauuuaaugcaagacaaucugcacagucaaaaucgauauaccgauucugcaaaucuuuauaauucugacaugaauaaugagaacagcauuagagaaucuuuaucgagugguggaggaaauccaaauaacccuuguaaucccauaccucuuccacccgaaauuccaagauaucguuauuucaaacuugggcuacgaggaggagcgccuaugugggguuuuggaagaggugccaaaagguuaccuacaccucccaacguaccuaacaaaccugaugagaaaguuacaaaucaagaaagcuuaauacagaaauugaaaaaggaaucgcacuuaaguaaaguaucgauucuuaaaagaaaagguucuacgucaucgaugggaaaaauggggucuuuaguaagcuccgauuacaacgacuuagacgacaguucuucaacgccgcccguaacuccuccuuuagcgucgacgaguagagguacgcuaccaaaaauuacuucuaaaaaaacuauggaacaucagggccaaaaagagucuguaaucguuaugcacaguccugauaauaaacaauuagagaugauggacuaugaugacgauacgaauacaguucuaucagcugaaguaucucuaaguucuguugcacaaaaugacgacgauaugguggagauugagacucuuucgcaacaggaccucgccgaaggauuggcuaguccuuuggaauccgaucaaauagcugaagauuuucuucuauuucccgguaauaugguagucgauuuaucaggcggaggacauuauuccgaaaaggaagacgaagaggaacaaaacgaugacgaauuuaaugaagaaaacaugcauaucguuauacgcagucccaccaccagcgacgaugaauuuaucaugcaaaguaaaggaaagaaauacaacguugauguacaucacgaugaacgagaugauaaucucgaaucaccggaacaagaagaauacacagaaccgucugaaauaguaaacgauaugaugacuaauuacgaagaaucugacgugaugcuuacagaucaaaacagcagcacucccgaagauucuauuucgacgaaagaagacuucgaggagcuaaucgaugaagguucgcgcaaaaauaauauaaccaaacaugauaugccgucaaagcauauacaagaauuucauaaauacacagggauguuuaauuaucccaaaaaugauacacacaguaugcggccgcagccgaauaaaauuccgacgacgucuaaaaaacuuccacagaaaauaucuuugguuacuggaccuauuguacauacgcugccucccgucaguaaauccaacgcugauaaaauuauaauuacucaaaauucgaauguguuaaacacuucucaagcuucuaaaguuaccagcaucauuuuaacucacaauucugccaugaggaggaauauucuaaaugugccgaaaauaguuagcuccguuucuccagcaauaacuauuguuagcgccaguacuucccaaauggcuucgauauugccauccaaguuuacuguaccgguuauaagcgcuagcgcaguccgucagcuuuccaacguuaaaguuauagauaaaccaucguccucgucuuuaucgauuucgacuagagauaacgcccuuccaaaaaagauauucgaagaugauucaguuucuccagauaguucaaauuguggcgaugaaaaaucgaaagauucguuugacgauaaaaccaacucucaagaacccaaaucuauguucaugaaaaccgauaauuuaaauacuuuaccuguuaugucaagaaauauggaauuuaagucgaaaaauuacacugaccagccgaaaaaagucgagcaucuucaagucaugaauuuagcgacaaaagauuuugcucaaaagcaaagaauaccuaguccuuuaauaucgaaaacuucuccgccuguaauuauacauaauacaccggagcugaagaugacggcgcaaguaauucaagaaacgcagacgcguaugaaaaucacugcuacuacagaccauuuagaucauuacgacggaucuguugacgaucaaaaauccgucguaauauccauaccaucaccaacgccuucucaagaacaaaugcuagacaauauagcguugcaagcucuggaaaaucguagaagggaauucgauucgauagaagauguguuagauaugauugaaaauauaacugcugaaccaccuucgauucuagaagaaaauacuagaguccgaaacacggacaauaacaguaagauugaaauaaaagauaauaaugauaugaaggagaaaccugucacaaagucggaaacguuaaauuuaucgucgaauuccaaaucuucaauugugccucaauuaucuccacugucccaaccaaccgauuugacuacgaauauggcuaaugcaucacagcaacucagaacucuauuaucaucauuacaaaccacuucaacaucggcuccgacaaacguagaaucugugguaaaaaauuuuggacacaaaauuagcaguaguacaucuucugcuagucaaccgauugucgcaucuagaguuauacaacaagccgguagacauucgccugucauuacgaauguuaguacaguuauaguuccuaauuuuaaacaaaaaaucaccguuacguccgcaaguacgucuagaaguaguccggugaaacaaguaagcaauuccgcuguaauuacgucuacucuaaauuauuugccaagcagaacuguaggugguauacaguugaugccagaucaucccaaauugccaccuguaacgagcguacagcaaauuaauucugugacuucgucucaacaggcuacugcuaugcaaaaaaacgcaccuaaugcugauauuaaaaagccuucauugacccuaacggcgauguuacaaaaucaaccugcugcuaauaugaugacuaaaccuucgucugacacaauaacggcugccagucuucugggaucaccuaucaguuugccgaaaacuggauuuacuacgucuuuaguacaggcucaaccgaguguaguaguuccaaauacaucaacaacaauuguaacauugcagaaccagauauccacgguggguaccgccgcuaaaaccacugacacgaucacagcagcaaguuugcuagguacgucgauaaauauuacgaaaacgggauuuacaacugcuuuacugcaagcccagcccaauccgugcguuacuucucuaucuucuaacguuacaagcucugcagcccuaucgaacuccagcaauaucauaacuaguucgacgcauaaaguuccaacuucuacuacgaauuuauugcauacgcaauuaaccaaaguuguaagaagcaaaucaguugaugauguaaaagacguaauaaugaagcaagaagauguuaaauuaucucauaacgaaaguuuaaauauuuuggaagacaguaaagcaucuguuuuagggaauagugguuguaaauuauccacaauccccacgccuguuauaaauaaaacugaagauucgcaaaacguuuuacugaagaaacuacuucagaauaccgcuugugccagcacucagucuccuccaccuaguucgacuaguacgacuaccacugucgccaacauuccuaaaccuccgauacgagaaacgucuuucguuuccaauccgaaugucgaacaacccguuucccaagcaaauucgucuccgauuguaacuucgcaacaaaugaauuuaaagaaauuuaugccuacuaacaggaguacuaguaaagaugaauuauuauccccgcaaacgccucgaucaguaaauaacaaucaagauuuaaauauacaaaugccggcgauaguuaaaaaagaaguaauaccgccuccgcaaucgaguccccuuuugaugccgcuagaagucaagaaagaauucaucgacgaaucgucucagcacucggaaguuucggaucacagucgaucggauguuccaauuaaagaagaacuagaaucuauagacaauacagucgaaaaaguuuuguuagauaaagaagaaauaaagaagcaaaaacggcgaauguaucaacaaaaaaggagacaaaaccagauucuuaauaaggaauuagcuggucaaccaaagaaacgcccucggaagaauucuaaaaucgaagaagauuacgauacuuauaucgauggggugcuagcgcaauuaagacaguugccuccuauaaccguuucugaaccggugcugaaucguaauuuugguguaguaccucucuucgguucaggugauaugucuaaaauuggaacaaaagacuauucaauucaguucggggaauuagucgguaauuauggauauagcgaauugccgacguucucggacuucuauucgaccaaacccuauggcgauuuggauccgauuccagagaaaucaccgucgucaacucagagagguuucuaugaccaagaauuuccguuaaucagauucgauacugacgaacauaaaaaauucgauauguucugcagagaagauacgccugauuccauacugagcaguucgucgccugaaugcguauuaaacgaaccgcauucuaaauuuaucggauucaaacugaucacugauagugaagaugaggaggaagaaaccggcaaagaaauguuaucucgcgggagauuaucuccggucgugccuaugauuagaccuguucccauuaagcugaaaccuguugguggauuguacguuaaagaaaauccuaaugagaauaaggaaaauauucaagauuccguaaacgucuuaacuaaaucuaaauucgauaauaagcagucaccgccgucgaacgauucuggacaugucacagugacguuaacacugacaucuucggcggcagaagauauaaugggcguuuuaagagauuuggcgaacauuuuacacauuccugcuccaacuaguuaccaaauuguagaaagaacgacuucuccgccuagucaaaaguuaggcuuauauagaacuaaagggaaagauggcaaagaaggagcucccaucgacauccagagcauucuuaauggugcuacgaaauucuguaaacauugugauguaaucaucuuaaguaacauuaucagaaggaaagucucugauuugcccuuccucgcuaaagacuccgaucuccuuagugacggugaagaauuguucuuuugcagcuccacguguuauaugcaauucgcuuugaugcauagaucgccuucaaucuccgaaggcaaggcugccgaaauuauaaaucauuuaucucaaaaggacaauuuggaggcgaaacaaaaguugccgaugauggaaucuuuagacaauaaaucgauaauagcucaaagauugacuuuuggaaugaaggaugugaaacgggaauuugaaccgauggacacgaauaauccguuuagcuauuuugcucguucuggcauuaaacagccuaguuucuuugauggugucucguacaagccggcgccugugaaaauguacaaaaauauuaaauauaaauugugggcucccgguugccuucagccaaaucagaagcauaaaauaccaacugauaaggaaauuauggaauuguuauauagaaugcagauuacuguugcaccuucaguuaugccagaagauuuuagacgauguuuguuuugucaaggaauuggugacggaguugcagacgguccagcaagacuucuuaacuucgacguagacaaguggguucauuugaauugcggccuuuggucggacgguguuuaugaaacggucaacggagcgcuggugaauguagaaaaugcauugcagucggguuccggugcuuauuguauacauuguaauaauuccggugcuacuauaagauguuuuaaaaaccgaugcuccagcgucuaccacuugaauugcgcugucaaagauaauugcguauuuuacaaaaacaaaaccguuuauuguaaaacgcacgcgccgaaaaacgaaaaggacaacgaacucaccacgcugucagugucucgaaggguuuauaucgauagggaugaaaauaaacaaguggcugcggucaugcaucauucagacucuacugaucuauuacgagucgguaguuugauauuuuuaaaugucggucaacuguugccgcaccagcuacagaauuuccacacuccuaauuauauuuauccgauaggauacaagaucaucagauucuauuggagcaugagacaauuaaauaagcguugcaaauacauuuguuccauacacgaauuguguggaagaccugaauuuagaguuaucauucaagagccgucugaagaagaucucgaauucagcgaugcuacaccgaaaggugcguggcaaaaaaucuuggacgaaguuucgaaucuucguaaagaaaauggcuguuuacacauguuuacgaaauucgcaacaggagaggaucuuuucggucuaaccgagccagcgaucguuagaguguuagaaaguaugcccggcauugaaacguugucugauuauaaauuuaaauacggccggaaucccauguuagaguugccguuagcgauuaauccaucuggagcggcuagaaccgaaccgagauugaggagucagcugcauuggaagaggccucauacccaacguaccacggguggauuuucgguuagaccaauguucggaccgucacuaucuguaccuucuuuuagcacacagacuuugggagaguuggccuguccguauagcaagcaauuuguacacucuaagaguucgcaguacaaaaaaaugaagcaagaauggaggaauaauguguauuuggcaagaucaaaaauucaagggcugggucucuaugcugccagagauuuggagaaacauaccaugguuauugaauauauaggagaaauuauaaggucugaguuagcagaaaguagagaaaagcaguaugaagccaagaaucguggaauauauauguuuagacuagacgaagaacgaguaguagacgcuaccuuauguggugguuuggcaagauauauaaaucauuccuguaauccgaauuguguagcagaggcaguagagguugauagagauauucgaaucauuauuuucucgaaacggagaauauuacguggagaagaguuggcauaugauuacaaguucgauaucgaggaugaccaaaacaagauaucuugcauguguggcgcucccaacugucgcaaauggaugaauuaa

SEQ ID NO: 6553 - RNA, 4503 nt, Psylliodes chrysocephala
auggaagauucugcucaagacagaagaucuagcaggcgauccaaaggggauacuucuuacaaagcaaaagcauucgaaaaauucaaacagcugaagaaagggauuaaaaacaaguacgaaguugaugauauugauaauguuuaugaaguuguugaagaaaaagaguacguaaaagaaguuuuaucaagauacgaagaugauuggauugucgaugaugauggcagcggcuauguugaggauggcagggacauuuuugaugaugacauggacuugcaguccaucgcucaagcaucuaauaaaggaaaagguacuaaaagaaaaagcaaaaacuugucugaaaacgcaggaaaagggaaauugcagcaaaugcuguccaguaugccaacaaagaaaaaaacggagacaaaaaucgacgaugaugaugaaauguuaucagaaauucuuggggaaauugauucaccuucaacaagcguugcuaaacccaaaaucaaagaauauucaguucuggcuaaaaaauuagcugcuaaaaauuauaugaaaaacuucucacaaccgauaaaaaaacgugccauagaaagaaaaucauuaccaacaacagagacucccgaaaagaauucaaccccauuaaaagaggugacugcuaauguagaacaaccuacaaaacaaauuuuagagccaguacaugcaaaaauaaaucaagccgcaaguccagugguggacaauaauaaaaaauuugaugaaacucuaucagaucaauucacugaagauauuuccuuugaugauuucaaugaaacuccuacuaaaaucaccgaaacgcaaauaauagacacugaaaugacucaagaggaguuugaugaugauuucgaugucacacugauugaagaagucgaaucuaaguuaucugcugccggugagaagcuugcugacaacauucaggcagauuuugagacugaaugggagaauuucucaaauaccagcguuaaugucgauaguaauaaccaaaauuuguuggacaaaacugauauaccucuggaagaaguugauggacaaaagguauuuagauuuuuuuggugggacgccuacgaagaccccguacaucaaaaaggauccguuuucuuauuugguaggacuuauugcgaaaaaacgaagaguuuuaugaguuguugcguugccguacggaacaucgauaggagaaucuucguccuacccagaccguucgaacucgacaacgauggucaaccaaccgacaacgccguuacgauuaaaaacguuuaugacgaauuuaacaacaccauuuugaaaccauugggagugaaaucguuuagaacaaaaccaacuaugaagaaguacgcuuuuaaucccaauauaccgagcgaauccgaauauauggaaguuagauaugccgcgucagaaccgcgaaucgacguugaaaauuuaccgaaaaaaauccgcacuuuuucgaaaauuuucgguacuaacacgagcuucuuagagacgcucuuuuuggaucgcaaaaucaaagguccuugcugguuggacauaucgaaucccgugccgguauccaacccuguaagcuggugcaaauucgaaguaaacuguaugaaaaucgucgaccuuaaauuaacuccuagcgaaaaaccgcuuccuccaccgccucuugucguggcgaccauuaauaugaggagcugcauuaacaggaggaccgguacgcucgagcugguuaugcuguccuguuuggcgcauaacgaguacgagguggauaaacagccuccagauccgccauuucaacagcauuuuugcguuuuuacccgucccagcaaaaucaaagguccuugcugguuggacauaucgaauccagugccgguauccaacccuguaagcuggugcaaauucgaaguaaacuguaugaaaaucgucgaccuuaaauuaacuccuagcgaaaaaccgcuuucuccaccgccucuugucguggcaacuauuaauaugaggagcugcauuaacaggaggaccggcacgcucgagcugguuaugcuguccuguuuggcgcauaacgaguacgagguggauaaacagccuccagauccgccauuucaacagcauuuuugcguuuuuacccgucccagugaccaaccacuuccauccgacauccacaacgcucucggcaaauacaaagcuaccaaaguccaaaaaauggacuccgagaaaggcaugcucaacuucuucgucaacaaauucacagaaaucgauccugaucucauaguuggccacgauuugcagggcuaccaaaucaacgugcucgucaacagauuguugacguugaacaacgugaguuucaacaaauugggacggcugaagaggaccgauaagaaggcguuggagaagaguuuguuugccggccgauuggugugcgauaugaaaguguccgccaaagaacugaucaaaucucgaucguacgauuuggaaacccucugccaggucgugcugaaauuaaacgacaaccaacgaaucgaauuagagccggaagauauaccgaaaauguucaaaacguccgacgauauuuugaaacugaucucguucacgaugcaggacaccauguacauaauaaagaugauguacggcuugaacgugauaccgcuggcgcugcagaucaccaauauagccgguaacgucaugucgaggacuuugaugggcggucgauccgaaagaaacgaauuccuauugcugcacgcuuucuccgaaaaaggauucauauugcccgauaaggaguacaagaagaaaauuccgggucagaaggguuccaagaagaaaccuacuuacgccggagguuugguccuggaucccaagguagguuucuacgacaagcucauccuccucauggacuucaauuccuuauaucccaguauaauucaggaauacaauauaugcuuuaccacauuaccugucacagaggaagacgauaaucuguacuuaccggacagcagucugccgccuggcauuuuaccgacagaaaucagaaaacuaguagagagucgacgucaagucaaaggucugaugaagagaccggaucuaucuaaugaucugcgagugcaguacgauaucaggcagauggcucugaaguugacagcuaacuccauguacgguuguuuggguuucgcgaauuccagguucuacgccaaaaauuuggccgcuuuggucacgcagaaaggucgagaaaucuugaccaacaccagggauaugaucgagaaaaugagcuacaaugucguguacggagauaccgacaguauuaugauuaauacuaauauuuuggaguaugaacagguauucaaaaucggcgugaaaaucaaacaggaagucaacaaacuguacaaacaagucgaguuggacauagacggcguguucaaauauuugcugcuauugaaaaagaagaaauacgccgcuauaucucuagcgaaagacaaaaauggcggucucgucaccaccaaagaguacaaagguuuggacauaguucgcagggauuggucccaacuguccugcgaggcuggcaaauacguuuuggaucagauauugagcgaucagucuccggaugacagaauagaaaacauucacgaguauuugaggaaaauucgugccgauuuggaagaaggcaaaguaccaauaccucuauuagugauaaccaagcagcuuacuaaagaaccucacauguacccggauaaagcuucuuugccgcacguucagguggcgcugagguauaacaaaaacagcggcggucauuucagaagcggcgacacuguuccuuacguaauuugcgaagaugggacuaggaauaaugcuauacaacgugccuaucacguugacgaaaugaaaaauaaccccguuuugaaaauagacuauaauuauuaucugggacagcagauucauccugucgugacuagaauuugugaaccuauagaggguaccgauucuuaccaaauagccgaauguuuagggauggauuugaagaacuuaaaaaaaccgcagaaacaaucaacagaucagaucgugggagagaauauauguaggccggaaaucaaauuuaggaauguggauacauucaaguucguuuguuacgugugcaaacaggaaaacauuguagacgguccguuggucggcgcgacaccguuuuuagaaaaaugccaaaacgccgauugcaaaucgagacccaucgacuacuuacccuguauccagaaccaagucacuuugucuauucguuccuauauaaagaaguacuacaaaaguguaaugauuugcgaggacccggcuugcaccaacgaaaccaggaaauuaccgcugcgauucguuagaaaguaucccuuauguaaugucugcaaaaagggcguccuguucaagguguacaaugagcagcaauuauacaaccaacucgcuuauuuucagcauauuuucgauuuggggaaacuccucagaaaaccugugauggacagagaaaccgaguccggcuaucacgcu

SEQ ID NO: 6554 - RNA, 1398 nt, Psylliodes chrysocephala
auggcugcugcagcggcugcuaaaaucgccgaaguccgagagacgacacgcguggaaagaauuggggcccacucucauaucagaggauuagguuuagacgacagucuagaagccagacauguuucccaagguauggugggucaaguuucugcuaggagagcagugggaaucguccuucauaugguacgugaaggcagaauugcugguagagcagucuuauuggcaggacagccagggacuggcaaaacggcuauagcaacagcuuuggcgcaugcuuugggacaagacacgccguuuaccaguauggcaggaucugaaauauauucguuggaaaugagcaaaacugaagcuauaacgcaagcuaucagaaaaaguauugguguuagaaucaaagaggaaagcgaaaucaucgaaggagaagucgucgaagugagcaucgacagaccagcuacgggggucggcacgaaaguuggaaaauuaauuuugaaaaccaccgauauggagaccguuuaugaccugggcgguaaaaugaucgauaguauuuuaaaggaaaaaguccaaucgggcgacgucauaaccaucgauaaagccacgggaaaaauuacgcgauuggguagaucuuucgccagagccagagauuacgacgcgacaggucaacagaccagguucguucaaugccccgaaggggaauugcaaaaaaggaaggaagucgugcauacggugacgcuucacgagaucgacgucaucaauagucguacgcacggauuucucgcccuauuuucaggcgacaccggcgaaauuaaaccggaaguaagagaacaaauuaacggaaaaguggcggaauggcgggaagagggcaaagcggaaauaauaccggguguccuuuuuaucgaugagguucacauguuggauaucgaaugcuucucguuucuaaauagagcgcucgaaaaugaaaugucuccgaucgucauaauggcuaccaaucgaggcaucaccaaaaucagagguaccacuuauaaaucuccgcacgguauuccccuagauuuguuggacagaaccaucaucguaccgacucaacccuacgacgagaaggaauugagggaaauuuugagcauccgaugcgaagaagaagacugucaaaugucggacaacgcuuuggccguuuuaacgaggaucugcaaggagacuucguugcgauacgguaugcaauugauuaugacaucuagcuugauagcuagaaaacguaaagcucacgaagucgauguugaagacauaaagagagcuuacacacuguuuuacgacgaaggaagauccgugcaauuccucagagaguaccaacaagaauucauguuuaacgaucuugaugacaaagaugacauggagguggaaacgaauuga

SEQ ID NO: 6555 - RNA, 1125 nt, Psylliodes chrysocephala
auggcucugagaaccuacggagauaagccaauaaguuuccaacuggaggaaaauggggaauacuauuguguuggauccgagguuggaaacuaucugcgacuauucagaggaucucuauauaaaaaauacccuggaauguuuagaagaucuauaacuaaugaagaaagaagaagauuaaucgaacuugguuugagccagcacguauuggccagcaguguaucucuacuuagagcuggugaaguugaagauaucauugauggaaaugaugauaaguguuccagauacaaagcgguaucugugcacacuucagaaccuccgaugccaagagagagcaaaucgaagaagaacaugcaauggguaccgucucuacccaacuccagucaucuggaugccguuccucaagccacgccuaucaacagaaacagaguggccgccaaaaagguuagaacguuuccucuauguuuggacgauacggauccacaauugaacaucgaaaacgcgugccaggcagagguauugguaccuauaaggcucgauauggaaaucgagggacagaaacucagagauacuuuuacuuggaacaaaaaugagaguuugauuacaccugaacaauucgcugaaguacuuugcgaugaucucgauuugaauccauugacguucgugccggcuaucgcccaagcgaucagacaacaacucgaggcuuuucccgccgauccgccgagcauuaucgaagagucuagcgaucaaagggugaucguuaaauugaauauacacgucgguaauacgucgcuugucgaucaggucgaaugggauaugagcgagaagcagaacaaucccgaggauuucgcgcucaaacuuugcgccgaauuggguuugggcggugaguucgugacugcgauugcuuauucuauaagggggcaauugucguggcaucagaggacuuacgcguucagcgaagcgccgcuuccuauggucgaggugccguucaggaauccgagcgaaucggaccaaugggcgccguuuuuggagaccuuaaccgacgccgaaauggagaagaaaaucagagaucaggacaggaauacgcgcagaaucagacgauuggcgaauacuacgccggguugguag

SEQ ID NO: 6556 - RNA, 309 nt, Psylliodes chrysocephala
caaguggaacucgccuuaugggauacggcgggccaggaggacuacgaccgccugcggccccuuuccuacccggacacggacgugauuuuaauguguuucucggucgacucgcccgacucccuagaaaacaucccggaaaaguggacgccggaggugaaacauuuuuguccgaacgugccaauuauccugguaggcaauaagaaggaucugcguaacgaucccacuaccauuaacgaacugaaaaaaaugaagcaggagccugucaagccgcaagacggucggucgauggccgaaaagauaaacgccuuc

SEQ ID NO: 6557 - RNA, 4008 nt, Psylliodes chrysocephala
augaauacaucuuccuacauucaacgaauggacgcaacacaaaaucaaguacaaaaaauggaauuggccucuagaaauaucgauaauucauuauuacucgacaauaauucuccuaggcuacuagauuuuaugaaccuacacccacaaagcgguucuacugcaaguggcuuugcugaccaugauuauccaacuuuaaguggagggccccacauuauuaacaauaugacucaaaucaaauguauuaauagugugccauuaccuucagaaauaguugaucauuuugcacggguccaaugucacuguaugaugggcuuauuuucugaaauaaacagagcuugguuaacuguggauagugauauuuaugucuggacuuaugaagagaauaccgauuuagcuuauuuugauggaauaagugaaacuauugucuguguuggccugguuaaaccuaagguuggaguuuuccaugcuuucauuaaauaucuacuuauuuuggcaacaucuguugauauuguuguauuagguguuacuuucacugaaaauccaggugacaauagugaugaaauucaacugauaccagauccuguauuuacacuaccaacugaugguucuacagucacaauaauaaauagcacugaagauggacguauauuuuauggcacaaaagaaggaaacuuauuugaaaucaccuaucaagcugaaagugguugguuugguaaaagauguaaaaaaauuaauuuaucaacaagcacauuguccuuuuugguuccuucauuuuuaaaugcagcauuaagugacguagauggcauuauccaaauuucgauugaugacaguagacauguucuauauauucuuacagaaaaaggaucaauagaaguuugugauuuaggagaaaaaggaaauucauuuucaagaguuaguaaaaugucucaaggaacuuugguuaaccaagcaaugaauacuguuaaaacuuuagauagucaaaacuuccguccaauugucagcauaucugccauugaagcuucugaaucagccaauuuaaaucugguagcaguuucucaaacgggagugagauuuuaucugacaguuguuaguuugucaaaucaacaacccaaucaaagaccuuauacauuaacacuagcucaugugagacugccuccugguuauucugcaaacauuacugugagaccaaggucggugcaugugucccacuauagagacaggaauuugguguugauaucuacaguaaaugaaaaagauguucugugguguaugaguucugauuuauuuccguuuagucagacauugauggaagcguacucggcuguaaauuuagaugguccagcuuuggcuauaucagaggugcgaaauaucaauccccuacaaauacacgauuuacaugaagccccuccauuggucgucagacaacaugcagaaccuccgaagaaauauguaguacuaacuucgcauaguguucaaauuuucauaaaauugagaccaguugauuugcuuaaacaaauuuuaaaagauagccacggucaagauacuggagcauugaaagcuuucuucaccauucaaaaggaagaucaagcuugugcuaccaguuugauacuggcuucuuuggaaaaugaggacaacauggaaguagcagaauaugcaacgagagcuuucuuuuuguuuggaggcgaaccuaagcuggcacacggaaauauuuauucuggucaaucuguauuugcaccgcccauaauuucuacuccagcuccacaucaauaucagcaacaacaguuucaaucucagcaauaucauaguuuuucacaaacuaugucuccuacaggcucugcauaugauuuauccaguccauuuauuuuuucgccuaaacacaauggucuuuacuuguacuuaagcagaauauugagaccgauuuggaauagaagaacaguugauaaacuuuguuuagauggcaaaacuauaacgaccaacaguacaguaaguagugaagauugcauuuucauuuuaaauaauuugucggcgcuucauaacuucuugaugcgcaauacacaauuaucaacauuaaacaccagucaaagccaaaaucccaauacauucaacaauacuucuuuaaauaugacaagguugaaccacaccauucaagaugcucaauuggaagaaaggaugucauuaaaugcccucaagaucuuuguaugucacuguugccaaauauuaggucuauggagaauucuaugcgaacaucaauuccauucauuaauugcuacuuuaccggagaaugaacagcacauucuucaaaauacgacguuuaaagauuuauuuuuauauaggcaugacauauguucauugcugaucacaacuuugguuaacaguuauuugggagauaacgcuucgguugauucuauuaguaacaaauuaagggaaguuugcccacaauuguauaaaaccgaggaugccgcuuuuucaaaggcaguugaaauauuaaaaaugacucgaacgauacaaaauagugacgagaaagaagaaaugauucacuccgcucuacagauuugcaagucaauugguccaucuaucaauaucacugauauauguagagaguucacaaaucugaaggcuuacaaagccauuacugaauugugcgcgcauuucggaaagaaaauagaucccaauaaaauugccgaaaguuauuacaauucagaagacaacaguggagaucaagaagguuacaauuauuaucaaagaagauuggaaauuuacagacauauauuaaauaugcuagauacucuuuauaacgaacagagccagacucaaucauuaaguccaaauucugaucgcgcuuguucaacuaaucagucaaucuuauuagaugguguagaacaaucccaaauuggauauguggugaagcaaguaauaagcgacauuuuggaaacucccgaugaaauuaugcacauugcacuuuacgauugguuaauauucaaaaauaugacaggagauuuaauaaauauacaaaauacaucguuggagacauauuugaaacgaacgucaguucaaaauccuaauaacgucgaagcuauggaccuuuuguggaaauauuaugaaaguugugacaaucacgcugcugcugcuaaaauauuaaauaaucuugcgucacgaagugguaucaauguuccauuaaaagaaaggcuuuccuaucuagcuagagcuauaauguguaugcgaagcgauaagauaggcuaugcgcccuaucucggaguauucuuaagagacuuagaagauaaaauggaaguagcgaaaguacaagaacaaauucugaacgccauaacgaaucugcaaggucaaauaccuaauucucaagacgcgauuaaugcccuuaacucugguuuauaugaaauuucacagcuuuacgagaacuuugcagaaccuuuuaaacuguuggaaugccagcucgcgauuauagaaugcgcugguuacacagaccaaguguuaguugaaucgauuuggcagcaaauuuuaacugacgaauugaagaaaaccuuuggaaccgguacagauaaaguaugccaacuuuugaacaaagucaaacaauuggcgaaacaguaugcccaguccacaaacugcuuuccauuaaguuacaucguuuaugaguuagaaauuguaaaugcaaaacugaagggggacaaacaacuuguacccacugcacuggagaguaugaauauuccuuuugaaagucugaucaacguuuacaacaguuugaauacgauaucaguaaaugaccacuucuggcaguuagaagagaacgaauuucaucuaucugaagcaacgucugcguugauaaauugcuuccucagcaaucacgaaaguuauaacagcauugaaaagaggagaauaacuucacuaugccaagauacaguaguugcauuacuaucuaauuuauacagcaaaccuaauacugaaaccuuaguuaauaaguuaagaaauauacaagcuagacugucaagaauuuaa

SEQ ID NO: 6558 - RNA, 4218 nt, Psylliodes chrysocephala
augaccgaauuuacuuuaggauaucgagaaguaauuccagaucaaacaguuuucgaaaauuggcgagaaauaacguugacuacaggcgguacacaaaguacucuucaagauauaaaaguagcugaaagagcaaaugguuuuuguuaugaagacuccacaaagcaccauacuaggaacagauucaucuacuggagaauuaauuaugauguacuagaauuaguagaacauaguuuggauguaaaccuuacagccaauagaguuagauacagauucaucgauacgccuauucuagaugguguuucuauucacgaaacguaugaaaacaucauaguuuuagucccuacaguuuguaguguacaucguuugauauuuccucaucccgauagguuucauagacaggaugaauuauuaggcauccauccagauuuagcuucaccuucgauauuuucuaaagcaucgccaguugaugcuagaaauccaaauacuuuuuauguuuucaucaauccaagcacugccaacgaccaacuaccgaacauagccaguucguauuuauugcccgaaacggaagaagccuuuuucauauuggcauauccuucaacggaacuuuuacugaucaaacagaauccagauagcggucaagucguguguaccgagcucaaaggcgaauccuugguuccuagauuuuucgcggguauagcggaaaaauuucgacaaagaaauucggauagugacacuaucguaagucuguuauuuuauauuguugauuacgaaacguacguauugacguuaaccagagaugcccauuugaaauuuugguccuguagcaagggucagugcguugcugucaucgacguucgcgaaaaaaccgcagauaacucaaaagaucguguucaaggcgccauauugaggaaagcaguggauggaaauaguucugaaaguacauuagcaguguuuuuaaacuuugcaagcgguugucaauuccacguuuuaaaucccguuauuaaaggacaagaaauuacaaucgaccgaguggcgacuguuuauucacccgagaacgaccuuauagauuuugcucuucaaaccaaucguuuguggucuuuauggagauccgaagauggcgauagugucguauauacggcuucgcuaccguugugcaagcaaucggguacuuuuaagucgaccaguuggacgccggugauuuuggaaacuaucccugacgccaaucaagcucccgcuaaugauggcgauuccgauucaagacagauuuauuugcaacauauuuuccauccuggaagguuucccuugcauauuaucaguaaagcguuaucgauuuacaaaagaucaacaauuuugucagaugcccaaauaucagcaucggcguuaaaacaaagaauauguuuagcgguugauaacgaaauacagaauaugcugaacggagaaaacgucaacgaugaugaauauaucgauugcgcugauuggugcuggcaaaaauuuuauucuuguugcguucaauaccacaucgcgagucuaaagccguugggauugaugcucuuaccguccguaucuggcgcgguauuuuugaaaaaaucugcuuuuucguuuuuaagaccucuugacggauuagagcacaugacucuuuguaacgaagaauuauacagagaucaguucgucaauuuuucaauguuaucagaaguuuuagauuuagaugcggcagaggauguuaugaauuuguuuaaaguaauaguuuaucuagaccaacaaaucagcgagacguuuaaucaagcuuucgaaaaggaauuauuuaaucuucaagcgccagauguuguaauggaugguuuguuggagaagauucauagcgaaauggauucucaguuuuccucucacauuuuggaaaugauuaacgacauuagcgacuuguacaaggccaugcacaaaguccucgaauuguugagauacgaaagcacuuuagccaaucccgauaacgauauaaauccggcagccauguaccauuucaguucguuacucggaacuucugugguggcugaaagucuuagacagcaaacuaaagucagauuucuaauaugccguaauuugcuguuggugugcaacgucuuauugaaagaaaaaacuuuggauuggggaguucuggaagcgguucguucuguuuguaugcccgauaucguuguacuuacccaagccaguuuugugguacuguggcuaagcgguuugucaacgcuuguaaauaugccagucagcgagucaucauugaacagacugaacccguuaaaauuggcucccguacuuaauuugagaccgaccagcacuuguacgucuuuguuagaguuauuuauuuguucgucugguggacaagaagcuagaaaaucguucgcuagagugucuugcagcgacgaagcucuagcgcauuggcauuuaucgcuguugccguauuugaaccacgucagacacauaaucuggcccauaagcggcgguacgguuuuagcugaauggcucuuggcuagcggccaacauguguggcuccaacaguacguacgacucuuaagcaauuggugcgaauggaacaguuguaccagaaacuucuuauuagcaacagcauuucuuaccacuggggaauuuuacaaagcugaagauuuauucgaaacagccgcaaaggguguuuuuagugacggguuuuugcaagaaaggauacuaaaagguauggaugaaaguccaucuaaggcuuucgugaauuauuacuugaaggucauucaauuguucgaguugcacaaggcuagagauugcguuauaagcguagcuaauacagcgcugaguaucguggaaccugaugauccguuggcggccacgcuguauuccauaaaauucaaacaccacuuggcgcucaaacacuacgaacucgcguucgauucguuguacuccaaucccgacgccgaacggaaaaaagacaauuugagagaccuggucaaaacuuuauuagacgaaaagaaacuagacacucuauugaauuucacuuacggcagcauggacgaguucuucgcuaacauacucuuaaccagagcuagagccaccgauucggucaacaauguuuucuacgauuuucuguauuccuaucagaucaaaaggggaccgcuuuccuaucguuuagccgcgagcgugauguacgaacaagcguuccgacugaaccacgcgaacaacaucgacgcguuggaaaaacaagugaaauguuauuuggcggcuaagaauguuuugcauuugugucaacccgaacaugcuuggguaguuagaccugcggaucccgacgaugaagacgaagaagucguuuugcaaccuuuggccggaucgaaucgagaaaugcgaguauuuaagcuaagaaagcaagucgaagugguggauauugagacuauacaaaaagaacuuaucuucucgagugccaaauugaaauuagcuagauuuaauaccaguacuccgauuaauauaaccaguccuguggaauuaguaacguuauuaaauaccucuggauuauuuaaaacugcuuuugacauuuguacaacguucucuuuggcguauucuccuguguucgaaacgcugaccaaacaaugcguacuguugagcgaggaggauaaccccaacgcuuggaauugguugguagagaaugauuugcaagaucuuccggugaaucgugaauccgcguccgaugucauuuggcaguuccuucaggauuguuuggaaaaauacgaagaacccaaaaugaccacauuacauugcguggucgcuaagaagauaauuaauaugaggauauauuugccucauuggcuuguagcuucguauaagaugcguaauccaucagaauuguugcgauugcugcauacgucuggacgguuagaggaagcaguggaauugacuaacgaauauauucuaucagcgaugggguacgguaaagaauuuuucggauuuacgcaaccucuggcuccgacuucgccagcuuuuugccuuccgguguacgccauccagcggcugauagacgaauuaaacauacaaaaugucaagaauguugaacgaccauuuauucaagaauacaauaauuugaagucgcuguuuacgaaauacuuggaaaccgcaaccagaguguccaaucagaugugccagacuaaauuaaguuccgguucuuuaaaaacuaacgcucccaugauagguauaagauaa

SEQ ID NO: 6559 - RNA, 2718 nt, Psylliodes chrysocephala
auggaaguguccgaugaaaauauacaaacuuuaagcagauaccuacaagagacacuaaauccggacauaaauguuagaagaccagcugaaaaauuccuggaaggaguagaaguaaaucagaauuauccauugcuguuguugaauuugguccacaaaccggaagcagacaugacuauuagaguagccggagcuguggcuuuuaaaaauuauauaaaaagaaauugguuuguggaggaagaucaaacggaucguauacaugcaacugaucguuuagcaaucaagaaucugauuguuacguuaauguugaguucuccagaaucuauucagaagcaguuaagugaugcuauaagcauaaucggaaaaacugauuuuccauuaaaauggccugaacucauaacucaaaugguagaaaaauuuuccacaggugauuuuaauguuauaaacggaguuuuaagaacagcacauucucuguuuaaaaaauauagauacgaauucaagucaaacgaguuauggacggaaauaaaguacguuuugcaaaaaauagcucaaccuuuaacggaucuauuaguggccacuauaaauuuaucgcaaacccacacaaacgaugugaaugcuuugaaaguaaucuauagcucuuugguguugauuugcaaaguauucuauucguugaauuuccaagaucucccggaauuuuucgaggauaauauucagauuuggaugacgaauuuccacacucuucucacugucgaagugccaaguuuacaaaagaaugauagugaugaagcugguguaauagaacaacuaaaaucacaaguuugugauaauguggcucuauacgcucaaaaauaugacgaagaguuccaaccguauuugccgcaguucguuacagacguuuggagccuuuuaguugcaacuggcuugcaacccaaauacgauuugcucguuucgaaugcucuacaauuucuaucaucuguagccgaacgaaaucaauacagacauuuguucgaggaugacaacguuuugagcagcauaugcgaaaaaguuauuauaccaaauauggaauucaggacauccgaugaggaauuauucgaagacaaccccgaagaguauacaagaagagauaucgaagguucugauauugauacacguagacgagccgcuugugacuuaguaaauacgcugagucaaaacuuugaaaagcguauaauugaaauuuucggucaauauuuacaagugauguugggaaaauauacggaaaaucccaagcaguuuuggagaagcaaagaugcugcucuauauuuggugacuucauugguuaguagagggucuacucaaaaacacgguguaacacagaccagccaacucguuaacauuacgcaauuuugucaacagcacauuuuaccagaauuggaacgaccugaugucaacgaacuaccuguacugaaagcggaugccauaaaauacguaaugacauucagaucggucuuacccagcgaucucguggugucuaccuuaccccaguugauaagacauauuccaagcgagagcgcaguaguucacacguacgccgcuugcacucuagagaagauucuuauuuuaagaaccaacaaucaaccgaucguuacaggugcacaauuagagccgcuagcuacugaccuucuacgcaauuuguuuggcguguugcaacagccaguuuccgaagaaaacgaguacauuaugaaagcuaugaugagaacguucgcgaccuuacaggaaagggugauuccguuuuuggguguggcucugccgaaauugacagaaaaauugcagaugguggcaaagaaucccuccaaaccccauuucaaccauuaucuguucgaaagcuucucguuagccaucaaaaucguuugcaaagcaaauccgggcgcuguuacgucuuucgaagauauucuuuuuccgauuuuccaagggauuuugcagcaggacauucaagaguuuaucccguacguauuucaaauacugucuuuauugauggaaaauacgccacagggaacaaucccggagcccuacaugcagcuguugccgugccuguuggcgccgauauugugggacagaccugccaauguuaguccauugguuagacugcugacugcauucgcuacucaagcugcuccacaaauuguggcgcaagauaaauugagcggauuuuugggaguuuuccaaaaacugauagcgucgaaauccaacgaucacgaaggauuuuaccucaugcagggucugauucaacauuuaccgauggaggcucucgcuccguaucauaagcagaucuuuuuccuucuguuccaaaggcugucguccagcaaaacuacuaaauaugugauaaaucugauaguauucuuuuguuuguacaugguuaaauacucaccgaacgaucugguaucguuaauagauggaauucaaacgcaaauguucggcauggugcuggaaaaacuacuuauagccgaacugcaaaaaauugcgggcgaugucgaaaggaaaaucgucgcaaucggcgugaucaaacuguuaugcgaaugucccgaaauguauacaggaacguaccaaaaauacuggccucaacuguuacagguaaaaaaaaaaacaaaauauaauacguuuaaacuuccuuuauuuggcucgcacccuuguuacaauauauuuccuauuggugugacaaauaucuuauuuccacacuuguaa

SEQ ID NO: 6560 - RNA, 948 nt, Psylliodes chrysocephala
auggaucagaugcuuccuaguccggguuucagcauacccaguauuggcacaccucuucaucaaccagaagaagaccaauuaauuuuaccaaaugcucuucaacaacagcaacaacaaaaccaacucccuacuagcaguucgcaagucccuccauuagccccuaugggugguacaacaccuacucucggucuugguaugggccaugcuaugucuaugccucauaccaaauacguaacaggcuuuacuuugccuaugaguucuaugacaccucaaacaccacaacacaccaugaugaguccuaugguuaauuugggugguucuggaccaacagguucuggugugacacccaccaugggacccucgacaccuucgccaaugacucccaugaccccucauucagcagauccaggcauaauuccacaauuacaaaacaucgugucaacuguaaaccucagcugcaaauuggacuugaaaaaaauugcccuacacgcaagaaaugcggaauauaaucccaaacguuucgcugccgucaucaugaggauucgagagccgcguacaacagcucugauuuuuucuucggguaaaauggugugcacgggagcaaaaagugaagaagauuccaggcuggcugcuagaaaauacgcccggaucauccaaaaacugggauuccccgccaaauucuuggauuucaagauacagaacauggucggaaguugugauguuaaguuuccuauaagguuggaaggacucguguugacucauaguucuuucaguaguuacgaaccugaauuguuucccggacuuauuuaucguauggugaaaccaaggauuguacuuuuaauauucgugucugguaaaguaguacugacgggcgcuaaaauaaggcaagaaauauacgaagcguucgauaauauauauccgauuuugaagaguuuuaaaaagcaguga

SEQ ID NO: 6561 - RNA, 477 nt, Psylliodes chrysocephala
auggcugcaauucgucccaugucucgccuccuuuucuccaggucucuacaaaccacugcaagaagaggauaugcagaccaaaugaauuuuaccuuugcugcuggaaaccaggucuuuuacaaugcaaugucuguuaaacaaguagauguuccauccuucucagguaguuuugguaucuuaccugcgcauguuccuacucuugcuguucucaaaccuggaguaguuaccguuuaugaagacaguggcaaaguuaauaaaauauuuguauccaguggaacagucacaaucaaugaugacucaucaguucagauuuuagcagaagaagcucauccuguagaaaauuuagauguuaaugcagccagagauauccgcacuaaagcucaaagucaguuaucaucagcaggcacagaucaggcuagagcugaagccgccauugccauugaaguaggagaagcguugguaaaggcugcugaauag

SEQ ID NO: 6562 - RNA, 984 nt, Psylliodes chrysocephala
augaguggugaugguaaacaacaagaacauuucgauacguuauuccuaucgaucgcgcaacaucauccccaagggccuacgcagcuuuuggauacuuuugugaacuuuuuaaguagaaaaacugacuuuuucacuggagcgaaagaaggagagugggaaaaguugguguugaacacuuucaaaaaauacgaaaaauugagcagggaaaaucacgaggcggaacuaaaagaaaaacgggaacaagaagcccguaaaaaagcggcggcugccaaaaaagcacaagccgaaaccguuaaaccugcucaaauuacagaacugacagaggaagaggcugcuaagcuucaagcugagcuugaugcuaagaauaacgucucuucugcuaguucuucgagcacgccuguaccaacuccuccggccccccaaaagauugaggaagacgaggacgaaucugaaaagggcaaauugcugccuaacaaaggaaauggaugcgaucuagagaaguauaccuggacucaaaauuuaggcgacauugaguuacggguaccuuuaaaugcgagcuucagaguaaaacagaaggaucugauugugaauaugacgaagaaacacuugacuugcggcauuaagggucaaccgccgaucauagacgaugauuuucuacacgaaaucaaguuggaggaguccaguugggugauagaggaugggaaaauguugcuauucacuuuugaaaaggugaacaagaugaacugguggagcaaaauagugaaguccgauccugagauuagcacgaaaaaaaucaacccggaaccgucgaaguugagcgauuuggacggagaaaccagaggcaugguggaaaaaaugauguacgaucaaagacagaaggagcugggucuccccacuagcgacgaacagaagaaacaagacguuuugaagaaguucauggaacagcauccggaaauggacuuuuccaaaugcaaauucaacuaa

SEQ ID NO: 6563 - RNA, 483 nt, Psylliodes chrysocephala
augauacagucuccuaguggaguugugcauggauauccgggaacaucuauucuacaguggagccccgauaagaagcacagugaucgagagagauggauuugcauuuauccugcuuauauuaacaguaaaaaaaccauagcccaaggaaggaaaauuaacaaagaaaaguguguggaaaaucccacccaucaagaaauaagggacguauuagucgcagcugguuuaaagguugguguagaaaauaaauuguacagcagagaaaaaagcaaggagcuguuguaucgcgguagaauacggguucaguugaaaaacgaugauaacaguuugugcaaucccaauuucccuacuagagacagucuuauguuacauuuaggggacaugauucccaaacuuaaaaguagacugaauaagggaaguggagacccccagccgcaagucacuggcagcgccaagggaaagggaaaaggcaaaggaaggcgauga

SEQ ID NO: 6564 - RNA, 2280 nt, Psylliodes chrysocephala
augauggaggacccagaaccuacuaagcgacaaaaaaugcccaaaguggccaaaguuaaaaauaaggcaccugcugaaauccaaaucacagcagaacagcuacucagagaagcaaaagaaagagauuuagaaauccuuccuccgccuccaaagcaaaaaauuucugauccagcagaauuggccgauuaucaauuaagaaggagaaagcaguuugaagacaacaucagaaagaacagagcaguuauuucaaauuggaucaaauaugcccagugggaggaaucgcaaaaggagauacagagggcuaggucaauaugggagagagcccuugauguugaccacagaaauauuaccauuugguugaaauauaccgaaauggaaaugagaaauagacaaguaaaccaugcaagaaauuuaugggacagggcuacugugcuuuugccuaggguaaaucaauuuugguauaaauacacuuauauggaagaaauguuggaaaacguugcaggagcuagggccguauuugaaagauggauggauuggcaaccugaugagcaagcuuggcagaccuauauuaauuucgagcugagauauaaagaaauugauagagcaagacaaauuuaugagagauuugucauaacucauccagaagucaaacacuggaucaaauaugcccguuuugaagaaaaccauggcuucauccauucugcaagacaaauuuacgaacgagcaguacaguuuuauggagaugauuauauggacgaaaagcuguacauagcuuuugcuaaauuugaagaaaaccagaaagaacacgacagagcccgaguuguauacaaauaugccuuggaucacauaccaaaagaucaaacuaaggaacuuuacaagacuuacacgauccacgaaaagaaauauggagacaggaguggcauugaagaggucauaauguccaagaggaaauugcaauaugaacaggaaauuuuacagaauccuacaaacuaugaugccugguuugauuaucuaagauuaguagaaggcgaaggugacauugauguuacuagggagacauaugaaagagccauagcuaauauuccuccaucaaaaaacaaacaauuuuggaggagauacaucuauuuguggaucaacuaugcuuuauuugaagaacuugaagcuaaagauuaugaaagaacacgacagguuuacaaagcuugucuggaaguucuaccucacaaaauauucacuuucucaaagauuuggcugcuuuuugcucaauucgaaauacgccagaaaaauuuaaccuccgccagaaagauccugggcaugucuauaggaaugugucccagagacaagcuauuucgagguuacauagauauagaaauacaacuuagggaauuugacagaugcagaaagcucuaugaaaaauucuuagaauucgguccggaaaauugcgucacuuggaugaaauuugcggaauuagaaacguuguuaggcgaugcagacagagcuagagguauauacgagcuagcuauuaaccaaaccagauuggacaugccagaauuguuguggaaagccuacauagauuucgaaauuucccaggaugaacccaauaaugcgagaagaaucuacgaaaggcugcuagaaagaacuucacaugucaaaguauggcuaucuuaugccaaauuugaauugaacaaucaaaccgacgaugaccugaauauacagcuugcuagaaggauuuucgaaaaaucuaaugaaacccuaaaaaauuucccagaaaaagaaucuagaguguugcuauuagaaaacuggagggaauuugaaaaugcuuauggcgaugaugauaguaaggaaaaaguuaacgccaaaaugccgaggaggaucaaaaagagacagaaagucaucgaugaagaugguguugagcaaggaugggaagagguauucgacuacauauucccagaggacgaggccaguagacccaacuugaaauugcuugcugcagccaagaacuggaagaaaaccgcagaugaaacugaagaaacuaucgaaagcagaccugcgauuucuacuaguagccaaagaguacgggaaaaauugauggcaucugccaaaaacuggaaaaacaagcaaaacgagacugacaauaaggagaacgaaagugaaagggauaaugaggauagccaaguccaccaagaagaugaagcgagcaaagauguagaacagaaagaagauacaagaagcgaagaucgagauaguaaaagugagggugaagauggcgaugaaucaucuuag

SEQ ID NO: 6565 - RNA, 1431 nt, Psylliodes chrysocephala
augggaauuaaauuuuuggaaguuauuaagcccuucugcaguauacugccagaaauagcgaagcccgaaagaaaaauccaauuuagggagaaaguuuuauggacagcaauaacguuauuuaucuucuuaguauguugucagauaccccuuuuuggaaucaugagcucagacucggcggauccuuucuacuggauucgugucauucuggcuucaaacagagguacccuuauggaauuggguauuucaccaauugugacgucugguuugaucaugcagcuucuggcuggagcgaagaucauugaaguuggugauacuccuaaagacagagccuuauuuaauggugcucaaaaauuguuuggcaugguaaucacaguuggucaagccaucguauacguaaugacaggcauguacggagauccugccgaaauuggagccggaguaugccuucucaucaucauccaacucuucguagcgggucuuauuguacuuuugcucgacgaacuccuccaaaaggguuauggucuugguucagguauuucacucuucaucgcuacaaacauuugcgaaaccaucaucuggaaagccuucucgccggcuacggucaacaccggaagaggaacugaauucgaaggagccgucaucgcguuauuccacuuacucacuacuagacaagacaaaaucagaggauuacgugaagcuuucuacagacaaaaucuaccuaaucuuaugaaccucuuauccacuguucucguuuuugcuauagugauauacuuccaaggauuuagaguggauuuaccaaucaagagugcaagauaucguggacagcauuccaguuauccaauuaaacuuuuuuacaccucaaacauuccuauuauccugcagucggcuuuagugucgaauuuguacguuauaucucagauguuggcagugaaauuccaugggaacuuuuugauuaaucuguuaggaguuugggcugauguagguggcggcgguccagcuagauccuaccccauuggcggguuguguuacuauuuaucuccaccagaaaguguuagucacauucucgaagaucccguucacgcaugccuuuauaucguuuucauguugggaucaugugcuuucuucucgaagacguggauugaaguaucuggaaguuccgcuaaagacguagcuaagcaacuuaaggaacaacagauggugaugagaggucacagggauaacucgaugauucacgaguugaaucguuacauucccacugccgccgcguuugguggauuguguauuggagcucuuucggugcucgcugauuuccuuggagccaucggaagugguacugguauuuuauuggcaguaacgaucaucuaccaauacuucgagauauucguuaaagaacaaagcgagaugggaggcaugggagccuuacucuuuuag

SEQ ID NO: 6566 - RNA, 486 nt, Psylliodes chrysocephala
auggcuauggcuacaucuccuucaguggauuuaaguuccuauagagaccaacauuuuaagggcacucgagccgaacaagacaaacuauuaagacuuucaacaacuuuauacguaggaaauuuaucuuuuuauacaacugaagaacagauuuaugaacuguuuaccaaauguggugauauuagacguauugugaugggccuggauaaauacaagaaaacuccauguggauucuguuuuguagaauacuauaauagagaggaugcagaaaauuguuuaagauauauaaaugguaccagacuugaugacagaauuguaaggacagauugggaugcagguuuucuagaggggagacaguauggaagaggcaaaacugggggacaggugagagaugaauacagaacugauuaugauucuggucgaggaggauauggcaaaauaauucaacaaaaaauuggaggauuagauacacaaggauuucugcguuaa

SEQ ID NO: 6567 - RNA, 921 nt, Psylliodes chrysocephala
auggcugccacaguagggcgaauuuguggaguaggucuuuuaaaaccgaguaauuugacgacaauuagccagaaaaguucauauuccacggccaaagacuggacauggggcaaaaaagcgcuuuuagggagcuuagguuugguggcaggugguacaggagccauacuauuugcucucgaccaaucuguuaaggcuucggaucuagaauuacauccaccaaagaauauuuggagucauacagggcuuuucagcgccuuugaucaugccagcauaagacgaggauaugaaguauauaaacaggugugcgcagcaugccacucgaugcguuucaucgccuaccguaauuugguaggcguaucgcacacagaguuggaagcgaaggcugaagccgaggagcaaaugguagaagacggaccagacgaccaaggcaacauguucaaacguccuggaaagcuaucggacuauuucccuaguccuuaucccaacgaggaagccgcccgugcagccaacaauggugcuuacccuccggauuugaguuacaucgucucugcuagacauggaggagaagauuauauuuucgcucuucuaacuggguacugcgacgccccugcuggugucguucuucgagaaggucaauacuacaacccguacuuccccggcggcgccauuuccauggcgcaagcgcuguacaaugaggucauugaguaucaagauggcaccccacccacugccagccaaauagccaaggacguguccacguucuugaaauggaccgccgagcccgagcacgacgacaggaagaaaaugcugaucaaagcuaucggcaucuucaccuuccuuaucgccacguguuacuauaucaaaaaauugaaguucucuucgcugaagacgcgcaagaucgaauucaggcccaaagaauaa

SEQ ID NO: 6568 - RNA, 1716 nt, Psylliodes chrysocephala
auguuaucguuacuacaguacucuggaagcagugaugaggauggcgacacaagccugaacacagcgaaaaaaucaacaagugaucccgaaaccaaaauuaacccaaaauauucuuucaaaucacagcuugcaguaugugcugcuccagaaguaguaccuacuggucuggaugcugaucaaaugcauauuaauuuggacacaacagaguuaucauauaaucccaaauuugauguauuauuugcaccaauacuaggccccguaaauccauuuaagacucaacagcaaucaguggacagaaauauguugucgggccacauugagcaagcucauguuagugaauuucaauuugaaaaucaaagaagaacauuuacuaguuaugguuaugcucuagaucccucuauaacaaaugauggacaaauaaaaguuguugguucuacagaagaggguaaggaugucgauaguguuaaaacuguauuugaaaccuccaaaauaaggccauuagauaaacgaaaacgaaagaaaaaugaugauccuggugauguugaugguuuuuugggaccuuggggugguuuuguagaugaacagaagguugccaaaccuacagaagaagaacaagcugaguuagaugaaauaacauccaagaaaaauaaaaaggguaaaccuaaugaagacaaaccuauugaagaaaaaucagugcugcacauuaaagaugcaguugacuaccaaggucgguccuuucuucacgcuccacaagauguuggggucaaucucaggucagauucuccuccagaaaaguguuuucuaccaaaaucccauauucauaccuggacaggucauucaaaagguauugcugcuauucguuuguuuccaagaacuggucaccucuuauugucugcuggaauggauugccgcauuaaaauuugggagguuuauaaugaaaggcgauguauuagaacuuauuauggacauagacaggcuguuagagauauuaauuuuaauaauucugggaaacaguuucuuucugcuggauaugauagauauaucaaauuaugggacacagaaacuggccagguuguaucacguuuuacaaguagaaaaaucccuuauuguguuaaguuuaauccugacaaaaauaaacaacauuuauuugucgcugguacuucugauaagaaaauuauuugcugggauacaagaucuggugauauuguacaagaguaugauaggcauuuaggagcugugaauaguauuacuuuuguugaugaaaauagaagguuugugacgaccucugaugauaagucauugagagugugggaaugggauauuccuguugacaugaaguauauugcugauccaacuaugcacaguaugccuucaguuacaccugcaccaaauggaaaaugguuggccugucaaaguauggauaacaaaauagugauauuuucggccaugaauagguuuaaaauaaaccgaaaaaaaaccuucacagggcauaugguugcugguuaugcauguucuuuagauuuuucuccugauaugaguuacauaacaucgggagaugcagaugguaaaguguacauaugggacuggaaaucaacuaagcuguuuaaaaaauggaaggcucaugacaaugucugcauugguguuuuguggcauccucaugagcccaguaaauugauaucugcaggaugggacggacuuauuaaguauugggauuaa

SEQ ID NO: 6569 - RNA, 807 nt, Psylliodes chrysocephala
auggugcagaaaaagcccaagaagaaggugggaaagaagguagccgcagcuccuuuggcagucaaaaaagucgagccgaaaaaagaagucaaucccuuauucgaaaagagacccaggaauuuuggaauaggucaagacauccaacccccuagggacuuaucgagguucgugaaauggcccaaauacauccgcauccaaaggcagaaagccgucuugcagaaacguuugaaagugccgccgccgaucaaccaguucucccaaaccaucgacaaacaaacagccacccaauuauucaaaguguuggagaaauaccgaccggaaaccgccuugcagaaaaagaaccgacugaaggccaaagccgaagcuaaaguggccaaaaaggaagaggccccgaccaaaagacccaacaccuuaagagccgguacuaacacagucaccaaguugauugaacagaaaaaagcccaauugguggucaucgcccaugacguagacccuauugaauuggugcucuuccuucccgcccugugcagaaaaaugggaguccccuacugcauagucaagggcaaagccagguuagggcugcuggucaggcguaaaacuugugcgacugucgcccuuacccaagucgauuccggagacaggucgaacuucaacaaacuccuggaggucgucaagaccaacuucaacgaccgcgccgaugagaucaggaggcacuggggaggcgguauccucgguuccaaauccgcugcccguauugcuaaauuggaaagggccaaggccagggaacucgcccagaagcaggguuaa

SEQ ID NO: 6570 - RNA, 1002 nt, Psylliodes chrysocephala
auggcaacccuaauuaaagauguuacuuugcaagaaaacauuccaacaaauauacuuuucgaaaaacauauugauuuuauuaaagaauauggccaaaaagaaaguagcuucgaauaugguaugacugauuauuuaaggguuucugguauguacuggggccuaacagcuuuagaauuaaugaaugccucaccgccacauagcauagaagagauuuuagaguauauaaaaaagugucaagaugccgaaacugguggaauaagugcauguguuaaccacgacccucauauucuucacaccuuaagugcaguucaaauucuuuguaucuacgacagucuaaaagccauugauguggaaggaguugugaaauauauaaaaaaauuacaguugccugaugguaguuuuaugggugauaaauggggcgaaauagauaccagauucucguuuugugcuguugcaacauugucauuauuaaauagaauggaugcuaucgauguuaacaaggcuguugauuuuguagcuucauguaaaaauuuugauggugguuuugguucaagaccacuuucugaaagccaugcaggcuuaauuuauugcuguguuggauuucuaucuguuacaaauagguuagacauuguagaucgugauacccuugcuuggugguuaugugagagacaauuacccucuggugguuugaauggucguccagaaaaauuaccagauguuugcuauucaugguggguguuaucaucucuaacaaucuuaggaagauuacauuggauugauggcaaugcuuugaaaaaauuugucuuggcuugucaggacacugaaacuggggguuuugcugaucgaccuggagauauuccugauccuuuucauacuuuauuugguauuacagcacuuucuuuguuaggccaugauacuguucaaaaaguuaaucccacauauuguaugccacagcaaguuauugauagacuacaacugaagccucaaguauuaggagacuaa

SEQ ID NO: 6571 - RNA, 2676 nt, Psylliodes chrysocephala
augaaccaggaaaccuuacaacuaauccaaauacuagaaaaaacaguuucacccgauaaaaaugaauuggaacaagccucaaguuuucucgagcaagcgucacaaacgaaucuacuagaauuuauaaagaccuuaucagauauacuacgucaugguggaaacaguccagucgccagaauggcggcugguuugcaacuuaaaaaucagcuuacaucaaaagauccagccauuaaauugacauaccaacaacgcuggcuccuuuuuucagaagaagucagaaauuauauaaagaaaaaugucguuggggcacuuggaacugaaaccaaucgaccuucuucagccgcccaguguguugcauacauagccguaacagaacugccccaaagacaauggcccgaccucauagcgacgcuugucagcaaugucugucaaggcaauucuacagaaaugcaaaaagaagccacuuuagaagcaauugguuacauuugucaagaaauugacuccgacguccuaguuacucagucaaacgacauauugacagcgauaguucaugguaugcgaucaucagagccuagcaaucauguacguuuggcggcaacgcaggcuuuacucaauucacuggaguucacuaaggccaauuuugaucagcccucggaaaggaauuauauuauggagguugugugugaagcuacccaaucaccggauucacaaaucaaaguagcggcuuugcaauguuuaguuaaaauuaugucucuguacuaccaacacauggaaccuuacauggcaccggcacuauucccgauuacguuggaggccaugaaaucagaaaaugaugcuguagcuuugcaagguauagaauucuggucgaauguuagugaugaagaagucgauuuggccaucgaagauacggaagcuacugaggcuggcaggccacccacacgaguuuccagacauuacgcaaaaggcgcccuacaguacauuauucccauucuccuucaaaagcuuacuaaacaggaagaguuagacgacgaagacgauuggaauccuagcaaagcugccgguguuugucucaugcuucucgccacauguugcgaagaugaaauaguuccacacgugcugccauuuauuaaagaaaauauuaaauccgacaacuggcguuuccgggaugcuucucuaauggcuuucgguucgauuuuaggcggauuggaaaauaacacuuugagaccucuuguugaacaggcaaugccaacuuuaauagaacuaauguacgacagcagcguaauugugagagacacugcagcguggacguucggaagaauaugcgaaauuauucccgaagcggcgaucaacgaaacuuuccuuaaaccccuucuggagagucuaauaaccggucuuaaggcagaaccucguguugccgcuaacguuuguugggcauucuccgguuugguugaagcagcuuacgaggccgccgaugucaaugaggaaaccggcgcuccggauacuuacguuuugucacaauauuucgaauuuauuauacagagauugcuugaaacuacagauagacccgacggagcacaagcgaacuuaagaccagcagccuacgaggcucugauggagauggugaaaaauucgccuaaagauuguuacgucacugugcaaaaaaccacgaugguuauucucgaaagacugcagcagguauugcagauggagacacauauauccagccacaaugacagaucgcaguuuaacgaucuccagagucuuuugugcgguacgcugcagucgguuuugagaaaagucacaccagaggacgcuccucacaucucugaugccauaaugacugcuauguugaccauguuuaauuccaauucgugcaaaagcggggugauucaagggguccaagaagacgcucuuauggccgucucaacgcugguggaggucuuaggagagaacuucauaaaauacauggacgccuucaaaccauuccuuuacauuggauuaaaaaaccaucaagaguaccaagugugcgguaccgcagucggucuaaccggggacauuuucagagcccugaaacucaaaguacuuccguauugcgacgaaaucaugacgcuacucuuggagaaucuuagagaucaguccguucaucgcagcgucaaaccacaaauacuguccguauucggagauauaggucucagcaucgguuccgaauucaagaaauaccuagacgucgucuuguccacuuuagcgcaagcgucccaggcccaagucgaucgcaacgauuucgauaugguugauuaucucaacgagcucagagagggcguauuagacgcguacaccgguaucauccaaggauuaaaaggagauggaccgacuccgaauccggauguucuaauucucgaaccacacauuccauuuauaguucaguuuaucaccgucguggcgcaagacacugaacauucugauggcaccguagcaguagccgccgguaucguaggagauaugugcaccgcuuucggggcucccaugguucaacuuuuggauuuggaacccaucaaugaaauguuggcacaaggcagacgcagcagagucaacaggacuaagacucuagcaacuugggcuacgaaagaauugaagaaacugaagcuggcgacuaccacugcugccgcugcuagcuga

SEQ ID NO: 6572 - RNA, 1251 nt, Psylliodes chrysocephala
auggaaacuauuuuagaacaacaacgacguuaccaugaagaaaaagaaagacuaauugaugcaauggucaaagaaaugcuucauaaaaagaauacauauagagaagccauaaacucagaccaccgucaaaaauaucuccuggaucgauauaugacuucuacggaaagacuuauagaucucuaugaagacaaagauggucagcguaaagcugagguugcagcucuuacaggaccaaaugaguuuaaugaauuuuacaacaggcugaagcagauuaaagauuuuuacaggagacacccaaaugagauaaguguuccaaugucaguagaauuugaugaauuugcaaaagcuagagaaaauccuaaugaagauauggcuaauuucguagaauucacugaugaagaagguuauggaaaauauuuagaucugcaugaaugcuaugaaaaauauauaaaucugaagggaauagagaaacucgacuacauuacuuacuugggcauguuugaucaacuguaugacauuccuaaagaaagaaaaacuggugaauacagaaaauaccuguuaugucucauugaauaucuaacuugguuuguucaacguauuagaccuuuaauggaucuugaugcugauuuagaagaacaaauugaucagguuuugucuaauugggauacugguacuguuccaggauggccaaaagaaacugguucugcuuuaacaaauguuggggcccauuuggaucuuucugcauuuucaaguugggaagaauuagcuucuuuaggcuuggauagauuaaaaucugcccuuauggcauugggacucaaauguggagggacuuuggaagaaagagcucaaagguuauuuucaaccaaaggaaaggguucacuggaucccucacuuaugacaaagaauaguaaaaauaggauuacuaaagaaaaagaaaucucaagacacagagaauuggguacauuagaagcucaaauuuacagguuggcugaccuagucucagcucagagagcagccacuaaagaaaauguucaaaggaaacaagcucguacagauggugaacgugaugacagugaaaaugaagaaagugaagaugacaguccugaugaaggagaugaugauguaccuuauaauccuaaaaaucuuccacuugguugggauggaaaaguaaguguucacauggguccgacaauauuugugagauuaaucuuauuuuuuuuuauuuuccaucaauauaaauauaaaauguga

SEQ ID NO: 6573 - RNA, 639 nt, Psylliodes chrysocephala
augacgauaggaaaaaauaauaaaaugauccagcacauaaacuauaggguccgaauaacauugcaggacucuaggacguuuauuggcacuuuuaaagcauuugauaaacauaugaauaugauucuuggagauugugaagaauuucguaaaauaaaaccaaaaaauucaaaaguugaaagagaagaaaagcgaguguuaggguuuguuuuauuaagaggagagagcauagugucuuuaacuguagaaggcccuccuccaccagaagaaggacuuccuaggguaccuauucccggagcagcaccagguccagguauuggaagagcuggagguaggggaaugccuccagguaugacaggugucccuguaggucuucaaggaccuguaagaggaguagguggcccaucucaacagguaaugacgccuggagguaggggacaagucucagcaccaccacaaaugaaccaagguccaccuagaaugggugggccaccaccuggcaugauggguccaccuccugguaugaugggaaugccgccucaaaugggaaugggacgugguggaccgccuccaauggguaugagaggaccuccaccugguaugaugagagggggaccaccuggaccuccgagacccuauuaa

SEQ ID NO: 6574 - RNA, 1290 nt, Psylliodes chrysocephala
augcgggauucuguaugcgaaauaccgaaucacagccgcauacuaccccgauacuucugggauacuuuauuacacauuucuaacaagcuucagugcggugcagucguuaucaugaauauugaagaguacguuauguuaugguauauaucuaauaaaaagaaaaaacuuaaaagaagacgaacucuguggguucauccuaugguagaauuaagggaagcuaagggaacauauaauuuacuucaucaagauuuauuacaagacacuacaaaguuuuuuaauuauuaucgaaugucuccacaaucauuugaagaguugcacaacauuuuaaaaagugaauuaaccaagcaagauacuacaaugcguagaaguauucaaucaagagaacgguuaucuauaacauuaagguacauagcgacuggauguucucuaacugauuuacauuacaccuacagagugggaauuucaacagcaagugaaauaauacagcacacaugcaagcuaauuuggaccaaaaugaaagagcaauguaugccaaagcccacaagagaaaacugguuggaaauagcacaugguuuuuuucgaaacgccaauuuuccccauugcguggguacuauugacgguaaacauauucgagugauaaaaccacaacaaaguggaucuuuguauuuuaauuauaaacauuuuuuuucaauucaacucuuggcaaugugcgauucaaacuauuguuuuacguuuguggauauuggggauuacggcaaaaacagugauucaaguauuuuuaaaaauucggaucuuuacaaaaaguuaucgacaaaaaaacuaaaccuuccugaucccgacuuuuuaccagaaaaggaugacuguaaaauccccuauguuauuauuggagacgaagcguuuggcuuaucguuuaauguaaugcguccauaugguggaaaauuuuugccaauacagaaaagaauuuauaauuacagacuaucuagagcacgaagguauauugaauguacuuucgggauuuuugcuaacaaguggagaauauuccaucguccucuuaacgugucuauugaguuugcugaagauauagugaaagccuguacuguacuucacaacuuugugcgaauacgcgauggauacagacacgaggauacguuauccuacgaaggaguuuaugacaaugaagucgcggcuaccgaggcauacccugcuagaccagcaauuguuauccgugacuauuuugcugaguauuuuaugacuacucaugcauuaccuuggcaaaauaacuuuauuuaa

SEQ ID NO: 6575 - RNA, 15819 nt, Psylliodes chrysocephala; identical to SEQ ID NO: 6552

SEQ ID NO: 6576 - RNA, 900 nt, Meligethes aeneus
agcaaauauucagauucgucaaggagaaaagaugaaucaagcaaauauucagauucgucaaggagaaaagaugaaucaagcaaauauucagauucgucaagaagaaaagaugaaaagaggucucgaagcagaucaaggaacagacacaaaaagucuaaaaacagacgcgauucucauagcagcagcagcucggauucauccaacagcaguagcagcaguaguucagauaacaguuuaaaauuauuggagaaauuaaaggaagaacgucuaaagcaaguagaugccaaaaagaagcaaaaagaguugcuuaaagccacagaaacagcaggggaaaaaagauugagacgguuguuaaaaaagcaagcgaaagaaagaagcagaaaggagaaaaugggcugggacaaugaauauuugcacuacaccaacagugauaaccccuuuggagauggcaaucuacucucuacuuuuguguggaacaaaaaauuguccaaagaaggccucacaggggucagucaugaagaauuggagacuagaaauagguucaaacaggaagaaaacaaaagggagcuggaaaagguuaagaagaggagguuggagagggaauuggaaaggcagaaaagggaggaggaaaugggaauguugcagaggagcaaagaggcagcacaauuugaagagugggagaggcaagaggauaacuuucacuuggaacaagccagacuaagaucacauauaagaauacaagauggcagagccaaacccauagaccuccucgccaaauacauaagcgccgaggaggagguggacgcgguggaaaugcacgagccguacaccuaccucaacgggcugcacaucaaggaccuggaggaccucgucgaggacaucaagguguacaaggaacuc

SEQ ID NO: 6577 - RNA, 1224 nt, Meligethes aeneus
auggauaauuuagaagcaaauauuauggacaaguccaugagaucaguguuuguggggaauauuccuuaugaggccacagaagaaaaacuaaaggauauauucggggaagugggucaaguuuuaucauuuaaacuuguauuugaucgugaaacaggcaaacccaagggauaugguuucugugaauacagagaccaagaaaccgccuugagugcaaugagaaaucugaaugguuaugaaaucggcgguagaaaucucaggguugauaaugcuuguacagaaaaauccagaauggaaaugcagaacuuguugaaucaaccuccuguugagaauccuuauggagaaccgauucaagcugaaaaagccccugaggcuauaaguaaagcuguugccaguuuaccuccagaacagauguuugaguugaugaagcaaaugaaacaaaccauacaaaacaauccaacugaagccagacaaaugcuucugcaaaacccucaauuagcuuacgcucuacuccaagcucaagugguaaugaaaauaaucgacccccacucagcagugacucuacugcacccuucaaaccaaguaccgcaaacuuugaugccuggagauaagauaccgcacauucccauaaaccaaaguuacgcgacgccuuuaccgaccccuguacaggcucccaggcaggauuuucaaccuguaccaccuccgauuaugcaucaaaacaaucaaccugucuuuacaggucaagauguggacuugagaucgcuggauccaaggggcgguucagauccaagacuaacaagagggaugggggaucaagacaugaggacuuugccugcuccauuggccaauccauugccuccggugggcgaaggauuuaacagggaucccaggggguccacagccaguuuuccgaacgaccccaggcagcaaucucaaagggucgaccccaggcaaaaaaauauaccacccccacaaaugccaccccaaccaaucagaccgccuccacaggcagugccagcuccgccuccagucccaucaagggcacaaauuucccaugcugccaacaguccaaauauugggccugcuggggcgucagaccaagaaaaggcugcccucaucaugcaaguccuccaauuauccgacgagcaaauugcgauguugccaccugaacagagaaacaguauuuuggugcuuaaagaacagaucgcaaaaagugcacaucgcuaa

SEQ ID NO: 6578 - RNA, 1245 nt, Meligethes aeneus
gccgucuacguugauuugccagucaucgucgguuugcuaauaaauuugucaaauuugauauuaaaaaugucccaaauggagccugaacgugaaaagggccuucaagauuauagaaagaaauuauuggaacauaaagaaguggaaucucgcuuaaaagaaaugagagaacaauuaaaagauuuaacaaaacaguaugauaagucggagaaugauuuaaaggcuuugcagaguaugggccaaauuguaggggaagucuuaaaacaguuaacugaagaaaaauucauuguaaaggcaacaaaugguccucguuaugucguggggugccgcagacaguuggacaaagcuaaauuaaaggcagggacccguguagcuuuggauaugaccacuuuaaccauuaugagauacuugccaagagaaguugauccgcuagucuacaacaugagucacgaagauccaggagauguaacuuauucugcuauuggugguuuaucagaacaaaucagggaauugagagaagucauugaacuuccuuuguugaacccugaauuguuuaugagaguugggauuacuccuccaaaagguuguuuauuauauggaccaccagguacugguaaaacucuuuuggccagggcuguagccucucaauuagaugcaaacuuccuuaaaguuguaucuagugcaauuguugacaaauacauuggagaaucugccaggcuuaucagagaaauguuuaacuaugccaaagaccaucaaccuugcauuauuuucauggaugaaauugaugcuauugguggaagaagauucucugagggaacaucugccgaucgugagauccaacguacccucauggagcuguugaaccagauggaugguuuugauucucuuggucagguuaaaaugaucauggcuacaaauagaccugacacuuuggacccugcucuuuugcguccaggccguuuggacagaaaaauugaaauuccacuucccaaugaacaggcuagauuggaaauucuuaaaauucaugcuggucccauagccaaacauggugaaaucgauuaugaagcaauuguuaaguugucugauucuuucaauggugcagauuuaaggaauguuuguacugaggcagguuuguuugcaaucagaucagaaagggaauauguuguucaagaagauuucaugaaggcuguaaggaagguggcagacaacaagaaguuagaaagcaaguuagauuauaaaccaguauaa

SEQ ID NO: 6579 - RNA, 567 nt, Meligethes aeneus
gauauggugugcaguguggcuggcauaacaucagaugccaaugugcucacaaaugagcuccguuugauaggccaaagguauuuguuucaauauggagaaucgauucccugugagcaauugguaucgugguugugugauguaaaacaagcuuacacucaguaugguggaaaacgcccauuuggagucucaaucuuguacaugggaugggacaaacauuauggauaucaguuguaucagucagaccccaguggaaauuacaguggauggaaagcaacuugcauuggaaauaacagugcugcugccauauccagcuuaaaacaagaauacaaggaaggagaaaugaccuuaaaagaugcuaaaucauuggcuguuaaaguuuuaagcaaaacacuggauaugaccaaacuuacuucagaaaaaguugagaugucaacucuaacaagaaaagauggcaaaacuuuuauuaauauccuagcaggcacagaaguugaggcucuuauaagcgaauucgaaaaaacugaagcugcagcugcugaagcuucuagaaaggaaaaagcaacagcuuag

SEQ ID NO: 6580 - RNA, 2676 nt, Meligethes aeneus
augagugagacaaagucagaaacaccgaaaauagaguccaaaaaggagaccgaggacgauaagaaugauuugucugaagaggacaaacagcuucaggaugaguugaauuugugcguugagaggcuucaggagaauaaugcuggucuuuauauggcggcccuucaggcuuugucuagucauaucaaagccuccacaaccucaaugacuucaguaccaaaaccccuuaaauucaugaagccucacuaugacaccaugaaagcuauuuaugaaaaaauaacugaugcugaaguaaaaaaaguaugugccgauaucauaucagugcuugcuaugacaaugggggagaauagggagugccuuaaauuccgccugaagucagaaaugaauaaaaucggcgaguggggucaugaguaugucagacauuuggcaggagaaauugcuagugaaugggcugaaacugauuuaacuuucgauaaagguuuaagggagaauuuaauuuuacuagcaaagcaaauugugccuuacaauauggcgcauaaugcugaggcugaagcaugugauuugcugauggaaauugaacguuuagaucuucucgacgaauauguugaugauaauaucuauccuagaguuugcuuguauuuaacuaguugugugcccuauguggcugauccagaaaauacaacuuuauuacaaacugcauuguuauuguuccguaaauuuaaacaauauccacaagcuuuaagauuggcuaugcaguuaaaugaucauucuuugauugaagacaucuuuauuaccuguccugauacugcuguccaaaagcaguuggccuacaugcugggcagacagcaaaucuacaucgaaauccccgauaccacucccgaauacgaggaccuuaucgaaauaauggcgaauugucacuugaacaaucauuuccugaaucuggccagagagcuggacauaauggagccgaaaacucccgaggacguguacaagucgcaccuggagaacagccgaccgcaauucggcggcagucaaguggacucggcccggcaaaacuuggcggccaguuucgugaaugguuucgugaacgcugccuucggucaggauaaauuguugauggaggacgguaacaagugguuguacaagaacaaagagcacggcauguugagugccacagccuccuuggguuugguuuuguugugggaugucgauggugguuuaacccccaucgauaaauaccuguacucuuccgaggaccacaucaaauccggugcccuguuggccugcgguaucgucaacugcgggguuagaaaugaaugcgacccggcauuggcucuacuauccgacuauguucuucaccaaacgaacaucaugaggauuggagcuauagucgguuuggguuuggcuuacgucggcucgaaccgcgaggccguuuugaguuugcuguucccaguauucagcgacccgaaauccaacauggaggucaucgguauggcugccuuggcuugcggcaugauagcagucgguucugccaacgcucaagucaccaccaccauaaugcagaccuugauggagaaauccgagacugaauugaaggacacuuacgcgagauuuuugccguuaggccucgguuugugccacuugggcaaacaggagggagucgacaccaucauagccgcuuuggaggugauuccggagccguucagauccauggcgaccaccaugguggauauuugcgcguacgccggcaccggcaacguacugaaagugcagcacuugcugcacauuugcucggagcauuacgaagccggggacaaagaggaagccagagguaaccaggauaagaauaaggauaaaacgaaggagaaggaggagaaggauaaggaucugucguccaggcaggccauagcggugcucgguaucgcuuuaauaagcaugggagaagacaucgggggcgagauggccuaccgcaccuucgggcauuugcucagguacugcgagccugugaucagaagagccguaccgcuagcgcucggccucaucucggucucgaaccccaaguugagcauucuggacacccugucgaaauucucgcacgauuccgacgccgagguugcgcacaacgccaucuucgccaugggcuuggugggcgccggcacuaacaacgcccgcuuggccgccaugcucaggcagcuggcgcaguuccacgccaaggaucccaacaaccuguucauggucaggauugcgcaaggauugacgcacuugggaaaaggcacguugaccuugagcccuuaccacagcgacagacagcugaugagccccguagccguggcuggacuuauggcuacuuuggucggauuuuuggacgucaaaaauauuauauugggacguucccacuaccuuuuguacacauuggcugcugcgaugcaaccuaggaugcuuguuacuuuugaugaagaucucaacccauugccagugccuguaagaguagguuuggcuguggauguaguuggccaggcuggcaaaccuaaaacgauuacaggcuuccaaacucacaccacaccaguuuuacuagcauuuggugagagagcagagcuggcaacugaggaauaccuagcauuaacuccgauuauggaaggauucguuauccuucgaaaaaauccagacuuuaauccuuaa

SEQ ID NO: 6581 - RNA, 990 nt, Meligethes aeneus
gacuuagacaguuacaauucagaaagguucgcuggaaacaccguggugacuuugguuggcaauucugaaaccaucaaugaauuaccaacaaauguuuacgugaauuuggaaagugucaacggaaauauggauuacagugcgaauuacaucauuccaaauaacuacgaugaauacaguauagagaauucuucauccccucaagcuucguacuuguugaauagagauccaaacauggcugcagcuucaaucagauauugcacugaaccugaagguccauaugcagguggugcuguagugcaaaacccagguggccacaucgcgcaauacagcggucagcaaaacuaccacaucagcuacgcucagaacuggacuccucagucgcagucagcuucaguuuacaacgguccgggucagaugcuggcgcaagccgacagcacgcaguucaacgguuacgccaauggcggcggaagcaguggcggccuaaacgagggggcagggacaucgucaaacccacaggaauuaauaucaccaaauagcaacagaagaaguggaguaaauugugcgaauuguaagaccacaaauacaacguuguggagaagaaauaaucaaggggaaccaguauguaacgcauguggacuuuacuucaaacuucacgggguuguaaggccacuaaguaugaagaaggagggcauccaaacaagaaaaaggagaccaaagaauaccuccagcucugggccgagcucuucuauaguucaccauucuucuaggcugggcacacccgcacaacacuacacaucuccauauccuuuaccuacagagauacaagauggauacgaauuaccccauccaaugaauuauuauaauaggguaaauacucaaagcgagucauauuuacguguuacuccgcaugaagaggacucuucuguuauaacuucgacuucucaccaccaaaacuaccaggaucaaauggaugaagaagauggacaauga

SEQ ID NO: 6582 - RNA, 5016 nt, Meligethes aeneus
auugaccaaaccagaaauaaaagaaaaaagucgucauuucggaaaaaagauaauaaaaaugcugaaauagaacaagaaguagcuccaaaauuaaaaccagaaaauccugcauuaaaguccaacccuuuagcaacaaccccaauuacaccaggaggaaauauugucgauaugcaaggcucaauuucacaggaaaccacugaaaaagauccaacuacuauaaauacaaauucagaacaaucaaauuuagaaaacucaucucccguggaucaacaaauugaggaugaagaaagguuaaauucguuaaaaacgucaaccgaagaaauaguugaauaucaauuaaaaucaccaaccaaugaaaaacaagacccugacucucuagaugcuaaacaaauugaggauacuccggaugguuaugcaaccagcgaagcaaaccaagaauacgucaaccaaagaggaaucagauucacgccucaacuucaagaugaaguuacacuucuuccuuauggauuggcuugcguaagggaacuuuuaagguuuuugauuagucuuuguaacccacuagacaaacaaaacagugauauaaugauucauguugguuugacucucuugacuugcgcauuugaagugggaucugauaguauaggaaaguauuccacucuauuggcccuugucaaagaugauuugugcaggaauuuauuuucgcuccuuaacaccgaacgacuaucagucuucgcagccgaccuucaagucucauuucucauguucgaaucgcuacgaacucaccugaaauuccaacuggaaagguaccucacaaaacugauggaaauagugaugagcgacucgcccaaggucaccuacgaacacaaggagaucgccuuggacaacaucuugcagcuguggcgcgugcccggcuucgugaacgagcuguacuugaacuacgacugcgacauguacugcacgaacuuguacgaggaccugacgaaguugcuggcgaaaaacguccugucggccaccgcgggggucuaucagacgcaccuguugucccuggacgcccugcucacggucgucgacgguauagaguugcauugcagacacaaacaggacgacucgagcaacgguagcgacuuuuucaacagcagcgacggcaguuuggcggcuaagagagguagaaucaggguuucggaucgcgugcccaccauagaggagcugcaugcgaaaaagaacaucaaaaaguggcuuccgcaaggcacagaauacuuuaauuccaaaccgaaaaaaggcauccaauuccuucaagaacacaacguccuaaaacacgaucuagacaucaacgaaaucgcgauguuucuucgcgaaaacccugcuuuggacaaaaaaacaaucggcgaguacaucagcaauagaaacaaccucaacauucucgaagccuucgugaacacuuucgauuucaccgacacuagaaucgacgaggcgcugagaaguuaucuggagaccuuuaggcuacccggggaagcaccgacuaucucccugauuuuggagcacuuuucugaacauuggcauaaaagcaauggggagccguuugcggacguggauuccgcauucacuuuggcguacgcggugauaauguuaaacgucgaccagcacaaucaaaacgccaagaaacaaagucuaccgaugagugcugccgccuuuaagaagaaccugaaaggugucaaugguggaaacgauuucgacggcgauaugcucgacgaaauauacaacacuauuaaaaacgacgaaauagugaugccggccgagcaaaccggccuggugaaagaaaacuaccuauggaaaguucuauugaaaaaaggccaaacgaaagacggcgucuacauccacgugaacagcggcaccuacgauuccgaacucuuucaauugcuguacggacccauaguggccgcucuaucguucguuuucgaaaaguccgaaauacccgggucguacaagaggauccugcaagguuucgagaaguguucuuuuauaucggcgcauuauaauuugacgaggaauuuggacauguuguugcugagcuugaguaaauucacgauguuccauaaucagcagagguugaauaauaucacguugcaauucgguaucaauaauaaagcgcaguuggcacugaagagcguguuuucuuugacgcaucaacauggcgauaguauuaggcagggauggaagaauguuuucgacuugauuuugucuuuguauugcaauaauuugcugccuaaaacauacguggaagccgaggauuuuauagagccgagcgggaagaucaacuuaacuuucgaggagguggaaaguuugcagaagcaggauaccggguugcugaguucuuuguacucguacauggugucugcggaaaauuuaucgaaaauucccuccccggaagaacagcaaugcaucgaucuggcuaaagagugcaucaaagauugcaacuuggaacaguuggugaccgauuccaaguuuuugcacgaagaggcuuugcuggaguuggucggagcucugauggagcaauccagaggccccgacgugcaaaaauccuuguacaacagcuacaacgaaaacgucacgguguucuuccuggaacugcucgucaagaucgugauucagaaccgcgaccgcgucgucucgauauggcgaacggugcacgaccaccucuacaccaucgucaugaacgccucggucuucgacuaccaguaucugcucgagcgggccgugaucgggcugcuucgcgucgccauccggcucaugcgcaacgaggagaugucgccgauggugcugcagucgcugcgcaugcugcugcugcucaagagcaccacgaucugccggaucuccaggcagauuuccuucggccucuacgagcugcugaagacguccgcgcagaacauccacaccaaugcggauuggacgaucguuuuuacguugcuggagugcgugggggcgggcgcgcagccgcccaagcccauagccgaagacaaucaaguugaucaaggaacgaaauccgacggcgaaaaccaacuagcaagcgaugaagaagcagcggcaacgucgacagaccgaggcuacaccucggauuccgagcuggcaaaaagcccgaaacacgcggcggcccaaaggucccauagcccacccggcguaauugccgcgucgccagugggaacucccaacacaggcggauggauuuuggucggcaacgagggggagauucagcccguggucggccgaacugugccuccgacgcaguacggccugucguuggagaggaacuuggguccccacgacccgagcagcuugaucaaauguugcgaaaguuuggcguuuuuggucagagaugucgcucacaucacgccguauaauuuugacguuugcguccauugcaucaggacguuugucgaagcuagucuacacggaugcaaacacaacaaaaaaagucgcgagggaagaccgcgacggaaaaacccgaacaggaaacgccaggaccuguacaaaucccggaaaagcccgaccagcaguccggaggaggaggaagaagaggcgagcgacgacgacgcccuacccaccggcuaccaucaaauauccauccagcugcuggaccugaugcacacguugcacacgaggaccgcgcagauuuucaaguggugggccgaggagggcggcgagaucgcccaggagacgucgcuguggacgcagggcuggugccccuuacugcagggcaucgcgcgguugugcugcgacguccggaaaccggucaggaugagcgccaucacguaucugcagagggcgcuguuggugcacgauuugcagacgcugagcgggccggagugggaggcgugcuuccacagggugcuguuuccacuacugagauaucuauugcaaccacucacuccuaaagagcccauggcuauggaggagaccaggaugagagccgcgacuguuuuaucuaaaguuuuucugcaccaccuaacaccacugcuaucccuuccaacauucuucaaucuuuggcugguaaucuuggacuuuauggagaaauacaugcacgcagacaagagcgaucugcucuacgaagccauaccggaauccuugaagaacaugcugcucguaauggacuccgcgaaaguuuucgacgcgccggacggccacaagagucaccuuugggcggccacuugggagaagaucaacaccuucuugccgcguaugaaggacgauuuguucagggagaucaaccagggacuggcccaggaacaaaugcaacugcagcaggaaauccccacagaaaccguagagauuacaaaaccugugcaauacaacauagaaaaugcgaccagaaccaguauaauuuuacagccgcccaccacgggccaacagcaaguuucaucgcauuuauucgcucacuuaggacagauggucucgacgccgaucgguccgucguacgacgcgccggcagcaccguaccgcccucuaccgccgccggucagcaucgcgccgcugguggcgccaccucuggugucgaacucgccuuuacugccgccaaaucaaacgacgccgaucauucagccgcagccgucuuacauguccucguucuacgccggcgccgccaacucgacgucgacggcgggucacacuuucccggugcugugcggcaacgcggcgguguugccgccggcggcggccaccgaggugcaacccgucucgcuguucaccgacuacgucgucaauccguacaacgcggcaucgacggaccugaacgaaaacgccgccgcccaaaucggcggcggcggcguuucgaacaacaacgggucgacgcagaacauuuuccagucggcgaauuacuuucagagcggagguaauaauauuauaccggucgggucggaaauacuguacggcauugaugccaccgcccccacuaacaauaccaauaacauuccaguuguuacagcuacagauaacagggacaccaguagaagcacugaaguuuag

SEQ ID NO: 6583 - RNA, 399 nt, Meligethes aeneus
uacgagcucaaagaaaacaggacgaugacuccagagguguuuggagcaauguugucgaguaugcucuaugagaagcguuucgggcccuucuucgucgagccugugauagcaggguugcauccgacgacuaaugaaccguuuauuugcaacauggauuuaauuggguguauuaaucaaccugaugauuuuguugucggugguacagccucggcacaacuuuacgguaugugugaagcucugugggagccuaauuuaggcccugaagauuuauuugaaacgacugcacaggcuuuaauuaaugcuuuugauagagaugcuauuucugguuggggagcaacaguuuauaucauugaaaaagacaaggugacuguaagagauaucaaaacacguauggauuaa

SEQ ID NO: 6584 - RNA, 2811 nt, Meligethes aeneus
auggaacaaaaaccagccauugauuugguuuuauuggccguaucuucacuauacaacaauccaaauacaacugaaaaagaaagggccucgcaauggcuaggagaucuacaaaaauccguccacgcguggacgguggcggacgaauugcugcaucacaaaagagacuuggagucguguuacuucgcugcccaaacgaugcgcucgaaaauacagcaauccuuucacgagcuacccccggaagcgcacuccucucugcgagacucccuuuuggagcacauugcccaaaucaacgaacaaaccaacacgaucaucguuacgcaguugugcgucgcuuuggccgaucuggcgcugcagaugcccaccuggccgcgggcuucgcuggacuugaucaccaaguucucuuccaccaacauguggccgcuuuuagaaauuuugacuguguuaccugaagaauuagaaaauagaucugugaggcuaggcgagaacaggcgacuagacguccugaacgacuucaaaaguugcucgacaacaauuuuagaguuuuuaaagcauugcgcuaacaccuacacggauaacucgcaagaaaacgugcaggugaacauuaaaauccuacgguguuucacuucguggguuuccgucggcgccuucgagcucuccgaguugggaaacaacaucgugaucaacagagcguucgguauuuuaaccuacaaaccugagggggagaaacagacuguugggggcgcgcugcacagcgccgcuacugauugcauuugcacucuauugcaauguuuggaggauaauaauaaccagcagauacuggagacguacuuguuuaauaacguuauuaauuuagagguggcauaccacaugucuguagccaacgaagaucaggauaaguccauuaauuacuguaggguuuucaccgaguuggccgagucguuucuggaaaaaaucauaaugaauagcaacaauaaaucgcaacauuacgcgaugaaaguucuagauuuagugcuaauuugcguggggcaccacgauuacgagguagcagaaauaacuuucaacuugugguacguuuugagcgaggauuuauaccagaaaaacaacaaggaaauuaccgaaauguuucgaccuuacgucgaacgauuaauaacggcucuaugcagacacugucaaauggagccggaucacgaagguuugcuggaagacggagacgauuuuaaagacuucaggcugaaaguaucugaucuaaucaaggaugugguguucauaguagggucaagcaguuguuucagacaaauguuuaucaaccugcaaacgccuggagucacgugggaguccagcgaagcuagucuauuuguuaugcaggccgucgccaaaaauauaguaccuacugagaacgaggugguucccaaaguggucgaagcuauccucucucugccggaaacaacgcacauuuccgugaaauacaccucgguucugcugcugggcgagcugugcgaguggauagaaaagcacgccaacacguuggaccccauccugaacuuuuugguuugcuguuugccgcagcagggcauuggcgcugcugcugcuauagcccugcaaaacaucugcgcgaccugcaacgaucacaugccucgacauguuccgaucauguugcagcuuuugcaucaaguugauacguuugccauaaccaacaacgcagucauaggauuacuuaaaggugucgccucuauaauagguugcaugaacccgccugaacuaaccaccgcucuuagagaauuauguucgaugcaaaugaacccgaucugucagcuuauagagcaagacgugguuccuguaaaaggcaccaaaaccgacccuguacucugguuggaucgacucagcuccguacuuaggcacaucugcugcaagaacaaccaaagcgaugguccucauccgugcaaagagguaguuuuggagauauggccgauuuuaucgcgcacuuuugauaaguacgacuccgaucugcgcauaauggagcgcuguugccgcagcguucgcuuuaugcugcgcugcgugagccagcaggugcgcgagauauuggagagcuugguggggcaaauagugcgcaucuacucgcacuucaagcauucguguuuuuuguaugucggcagcauuuuggucgaugaguacgccgcugaugccagcugcgugcaagggcuuuuggacauguugcacgcuuuuaucgagccgacuuuucuaguuuugcaggaagagaaugguuuaaggaugcauccagauacuguugaugacuuuuucagacugugcgcccguuuucugcagcgcgcccccguggcguuccugcagugcccuucguuggugcacauccugcagugcgcacuuuuagccuccucuuuggaccacaaagaggccaacaugucggugaugaaguucuucuacgauuugaucaaccaggcgcagaccgaccgguccaaggccgacuacaagcaacgcaaggaccucgugcaucgcguuuuagaagaguacggccagaauuuggucaacaauuugcugcacgcgugcgucuucuaccugcacuccuacaugcuuagcgagguggcugacguguuugugcaauuauuagauuuuaacagagaaacaacuggaaaauggcuggcaaaugguuuagaucaguugccggugcaaaguaacggugguauaguuacggcaacgccgcaacaauugaaagauauacacgcaucuauuacgagaucugacaccucaaaaucgguaacacacgcuuuaaaagaauuaacccgacuguaccguuag

SEQ ID NO: 6585 - RNA, 750 nt, Meligethes aeneus
gacgguuuccaggugaaaagacccggggacaaaaacgugcguugcaccauucucuuguugcucgacuaucagccguugcaguucaagcuggaccccagauuggcccggcuucugggcgugcacacccaaaccagacccgugaucauuuccgccuuguggcaguacaucaaaacgcaccgauugcaggacgcgcacgaaagagaguacaucgugugcgacaaguacuuggagcagauuuucaacugcucgcgcaugaaguucgccgagauuccgucccgcuugaacccgcugcugcacccgccggauccgaucgucaucaaccacgugauuucggucgaaggcggcgccgagagcaagcagaccgccugcuacgacaucgacgucgaggucgacgacacgcucaaaacgcagaugaacaacuucuugcugagcaccgcgagucagcaggagauucaaggguuggauucgaagauucacgagacugucgacaccauaaaucagcucaaaaccaacagggaguucuuccuuaguuuugccaaggauccucagcaauucauacacaaguggaucgucucgcagaccagggaucuuaagaccaugacagacguuguugguaacccugaagaggagcgcagagcagacuucuucuaucaaccuugggcccaagaagcaguuugucguuacuucuacaccaaggugcagcaaaaacgcgcugaacucgaacaggcucucgguuuuagaaacaauuaa

SEQ ID NO: 6586 - RNA, 471 nt, Meligethes aeneus
aucaaucguuuuuguuguuuuuuggaguucauaacgaugccaaaagugagaagaagcaaaaaaucgccuccagaggguugggaguuaauagaaccaacuuuggacgagcuggaacagaaaaugcgcgaagcugagacugaaacucaugagggaaaacguaaaaaugagucgcuguggccgauauucaaaauacaccaucaaaaaucgcguuauauauucgauuuguucuacagaagaaaggcuauaaguagggaguuguacgauuauuguuugaaugaaaauauagcggauaaaaauuugauugcaaaguggaagaagcagggauaugaaaauuuguguugcuugagguguauacaaaccagggauaccaauuucgggacgaauugcaucuguaggguuccgaaagggaagcuugaagagggaaggauuguggaguguguucacuguggaugcaggggcuguuccgguuag

SEQ ID NO: 6587 - RNA, 1065 nt, Meligethes aeneus
augaauuuugugcauucugaugucaaaacacaggggaaaaaaguuagcgaagagaauauuuggaauaccuuagaaauaacuaaggaaaaacggagcccuccauaucacacagacauuauaugggugcagaauccauugcagcaacuuauuaauaacgaauugcagcgagauaugccggcagcuacacuagacauuuuagguagcauacaacaucccaauaaugaggaguguggcaucagggauguuugggcacauaacuuggaggaugaauuucgaaccauuagacagauuguacaaaaauaccaauauguagccauggauacugaauuuccugggguuguagcaagaccuauaggugaauuuagaaguucugccgauuaccaauaucagauguuaagauguaacguugauuugcucagaaucauacaacuggggcucacauuucuugacgauaauggcaaaacgccuggaggcucuuacaccacguggcaguuuaacuuuaaauuuaaccugcaggaagacauguaugcccaagacaguauugaucugcuaacaaacuccgguauccaguucaaaaagcacgaggaugaaggcaucgagccgcuggaauucgccgaacuacucaugacaucggguauaguucugauggacaacauuaaaugguugucguuucauucggguuacgauuuugguuaccugaucaaguuguuaacugauaacacuuugccccaagaugaaaacgaauuuuuugaucucuugaaacuguacuuucccaccauauaugaugugaaguaccugaugaagucuuguaagaauuuaaaaggagguuugcaagaaguugcagagcaacuggaccuugaaagaauaggcccccaacaucaggcuggaucugauucuuuauugacuggaauggccuuuuuuaaaaugaaagagauguucuuugaagacacaaucgaugauucaaaguucucaggucacuuguacggucuaggaacuucguucgccgugaacggaacuucaaauaacuacgcgaccgacaacggagacacgacaaauuccucguga

SEQ ID NO: 6588 - RNA, 1161 nt, Meligethes aeneus
gaaggcaucauugagucgaacugggaagaaguuguugacaacuuugaugacaugaaccugaaagaggaacucuugagagguaucuaugcauacgguuuugaaaaaccuuccgcuauccagcaaagagcuauuauucccugcauuaagggucaugaugucauugcccaagcccagucugguacugguaaaacggccaccuuuuccauuuccauccuccagcaaaucgacaccuaugugagggaaugccaggcucuuaucuuggcccccacaagagaauuggcccaacaaauccaaaagguugucauugcuuugggagacuucauguccgcgcaaugccacgccugcaucggcggcacgaaugucagggaagacaugaggaaauuagagacuggagugcacgugguggugggaacccccggcaggguguucgacaugauaacgcgaagggcgcugcgcacgagccacaucaagauguucguucucgacgaggccgacgagauguuaucgagagguuucaaagaccagauucacgacguuuuuagaacgcuaaacucggacgugcaggugauccugcuguccgccacuaugccgcaggacgugcucgacgucaccaagucguucaugaggaacccgauccguaucuuagucaagaaggaggagcucaccuuggaggguaucaagcaguucuucguguucgucgagcgugaagauuggaaguuggagacuuugugcgauuuauacgacacgcugucgaucacgcaggccgucaucuucugcaacacgcgccgcaagguggacuggcucaccgagaacaugcacaagaaggacuucaccgugucggcgaugcacggagacauggagcagagggagagggacguuauuaugaggcaguucaggacggggucuucgagagugcugaucaccacggauuugcuggccagaggcaucgacgugcagcaaguuucguuaguuauuaauuaugauuugccauccaaccgugaaaacuacauucacaggauuggucgcgguggacguuucgggcguaaaggcguggcgauaaacuuugugaccgaggaggacaagcgcacgcugaaagauaucgaacaauuuuacaacacgaagaucgacgagaugccaaugaacguggccgaucucaucuaa

SEQ ID NO: 6589 - RNA, 669 nt, Meligethes aeneus
augaccgcccccagugccgccggugaugcaagcaaaggaagaaaugucgccuacaaggacaaaagcaaacccggagaugucaggaguucuaauauuaaugccgccaaagcuguuugugaugccaucagaacaaguuugggccccagaggaauggauaaaaugauccaaucagcaaacggcgaaguuacaaucacaaaugauggggcaacaaucuuaaaacaaauaaaugucauucacccugcugcaaaaauguugguagaauuguccagagcccaagauguugaggcuggugacgguaccaccacaguaguuguuaucgcaggagcucuuuuaaaugcagcagaaaaacugcuuagcagggguauucacccuacuguuauuucagauaacuuccagaaagcugcuguucaugcagugaauauccuaaacgaaaucucuaucccggugguacuaaaaaaccgcgaccaacugcugcaaagcgccuccaccucgcuaaacuccaaaguggugucgcaacaauccuccucucuggcgcccauagccgucgacgcggugcuaaaaaucgucgagacgggucgcgagcaggcuugcaaccuguccgacauaaaggugaucaagcagcugggcggcaccaccgaagacaccgagcugguggacggucugguguuc

SEQ ID NO: 6590 - RNA, 1230 nt, Meligethes aeneus
auggaggcaauggaaguuauuuuaccagaaaaagacgaaggaagcccuucagaaacgaaagucagcuuacaagaugcugauguugaagauuuauacacaaaguauaagaaauugcagcaaauguuggaauuuuuggaaguucaagaggaguauauuaaagaugaacaaagaaacuugaaaaaggaguacuugcacgcucaagaagaggucaagagaauccaguccguuccgcugguaaucggacaauuuuuagaggcugucgaucaaaacacagguauuguugguucaaccacuggcuccaauuauuaugugcgcauuuugucgacaaucgacagagaauuguuaaaaccaucagcaaguguugccuugcauaaacauaguaaugcuuuggucgauguuuugccuccugaagcagauuccuccaucagcauguugucggcugaugaaaaaccagauguucaauacagcgacauuggagguauggacaugcaaaaacaagaaaucagagaggcuguugaauugccucugacacacuuugaguuguacaagcagauugguaucgacccacccagagguguguugauguaugggccccccgguugcgguaaaaccauguuggccaaggcaguggcccaccauaccacggcugcuuucauaagaguaguagguucggaauucguacagaaauauuugggcgagggccccagaauggugcgcgacguguucaggcucgccaaagaaaacucgcccgccauuauuuucaucgacgagaucgaugccaucgccaccaaacguuucgacgcucaaacuggagcggauagggaagugcagagaauucugcucgaguuguugaaccaaauggaugguuucgaucagacuaccaacgucaagguuaucauggcuaccaacagggcugacacguuggacccugcucuauugcgucccggccguuuggacagaaagaucgaguuuccauugccugaucguagacagaagagauugguguucacuacuauuacaucuaggaugaacuugucugaagagguugauuuggaagauuauguagcuagaccugacagaaucucuggugcugauauaaaugcuauuugccaggaagccgguaugcaugcuguaagagaaaacagauauaucgugcuaccaaaagauuuugaaaaagguuacaagaauaacaucaaaaaggaugaaagugagcaugaguuuuacaaguaa

SEQ ID NO: 6591 - RNA, 591 nt, Meligethes aeneus
gugggacuuuaucgaucgugucaaugguuuauugaagcuguugucauuuuuacaaauuacguuauuuaucguguguuuuucguauauuuuaacuggaauaagaugucuaaaauaaagcuacagaguuccgauggagaaaccuuugagguugagaucgaaauugcaaaauguucuguaacaauaaaaacuauguuggaagaucuuggaauggaugaagaugaggaggaaguuguuccauuaccaaaugucaacucugcuauauuaagaaaggucauucaaugggccacauaucacaaagaugacccuccaccaccagaagaugacgaaaacaaagaaaaaagaacugaugauauaucuuccugggaugcagacuuuuuaaaagucgaccagggaacuuuauuugaacuaauuuuggcugccaacuaccuagacaucaaagguuuguuggauguaacuugcaaaacuguggccaacaugauaaaaggaaaagccccagaagaaauccgcaaaacuuucaacauaaaaaacgacuuuacugccucugaggaagagcaagucagaaaggagaacgaauggugcgaggaaaaguaa

SEQ ID NO: 6592 - RNA, 702 nt, Meligethes aeneus
auggacgagaaagcaucaugcaaggaacuagaucaguggauugagcaguuaaacgauugcaagcaacuuacagaaaaccaagucaaaacuuuaugcgauaaggccaaggaaauccuuuccaaagaaagcaacguacaggaaguaaaaugccccgugaccguuugcggggacgugcacggccaguuccacgaccugauggagcuguucagaauaggcggacgcagccccgacacaaacuaccuuuucaugggugauuacguugaccgugguuacuauuccguggaaacggucacauuacuggucgcccugaaggugcgguacaaagagagaaucacgauucucagaggcaaccacgaauccagacagaucacacagguuuacgguuuuuacgaugaaugucugaggaaguacgguaacgcgaaugucuggaaguuuuucacggacuuguucgauuauuugccauuaacugcccucgucgauagucagauuuucuguuuacauggaggcuugagccccaguaucgauacuuuagaucacauuagagcuuuggaucgucuacaagaaguuccucacgaggguccuaugugcgaccugcugugguccgauccggacgaccgcggcggcuggggcauaucgccucgcggcgccggcuacaccuucggccaggacaucuccgagacguucaaccacucgaacggccug

SEQ ID NO: 6593 - RNA, 657 nt, Meligethes aeneus
uacaacauccaaaaggaaucuacccuccauuugguacuccgucucagaggugguaugcaaauuuucguuaaaacuuugaccggaaaaaccaucaccuuggaaguugaaccuucugauaccauugaaaaugugaaagccaaaauccaagacaaagaagguauccccccagaucagcaacguuuaaucuucgcaggaaagcaauuggaagauggaagaacccucucagacuauaacauccaaaaggaauccacccuccauuuaguacuccguuugagaggugguaugcaaaucuuugucaaaaccuugacaggaaagaccaucaccuuggaaguagaacccucugacaccaucgaaaacguuaaagcuaaaauccaagauaaggaagguaucccaccagaccagcaacguuuaaucuuugccgguaaacaauuggaagauggucguaccuugucugacuacaacauccagaaagaauccacccuccauuugguacuccguuugagaggugguaugcaaauuuucgucaaaacuuugacuggaaaaacuaucaccuuggaaguugaacccuccgauaccauugagaauguuaaggcuaaaauccaagauaaggaagguaucccaccagaccagcaacguuugauuuucgccggaaaacaa

SEQ ID NO: 6594 - RNA, 1443 nt, Meligethes aeneus
aacgauggggcgacaauaaugaaauuguuggauaucguacacccaggugcuaagacuuugguugacauagcuaaaucgcaagaugcugaaguuggggacgguacaacaagugugguuuugcuagcgggggaguacuuaaagcaaaucaaaccguacgcugaggaaggcgugcaccccagaauaaucauaaaagcugucaggcagucguugcaauugugccuugaaaagauaaaugagcucucgaucaaaauaaacaaggcgaacccggaagaguuccguucuuugcuggagaagugcgccgcgacggcuaugagcucgaaacugaucaaccagcagcgugauuucuucucgaagaugguuguggaugccguucugcuccucgacacacuucuacccuugaacaugauugguauuaagaaaguucagggugggggucuggaagagucccugcucgucgccgggguggcuuucaagaaaaccuucuccuaugccggguuugagaugcaacccaaagucuacaagaacugcaaaaucgccuuguugaacaucgaguuggaacugaaagcugaacgcgacaacgccgaaaucagagucgauaacguucgggaauaccagaaaauugucgacgccgaauggaauauucuguaugaaaaguuaagaaaaguccacgaaucgggcgccaaugugguucuuuccaaacucccuauuggcgacguugcaacgcaguacuucgcagauagggacauguucugcgcgggccgcguccccgacgaagacaugaagcgcacccugaaggcgugcggcggcgccgugaugacgaccgcgcacgaccucaaggacgccgugcucggcaggugcgaccuguucgaggagcgccagaucggcggcgagcgcuucaacuucuucaacggcugcccgaacgccaagacgugcacguugauccugcgcggcggcgccgagcaguuccucgaggagaccgagcgcucgcugcacgacgccaucaugaucguccgaaggacgaucaagaacgacgcgaucgucgcgggcggcggcgccaucgagauggagcugucgaagaugcugcgcgaccacucgcgcaccaucgccggcaaggagcagcugcucauaggggcgaucgccaagucgauggagaucaucccgaggcagcugugcgacaacgccggcuucgacgccaccaacauccugaacaagcugaggcagaagcacgcgcagggccacugcugguacggcgucgacaucagcaaggaggacgucagcgacaaucuggacgcuugcgugugggaaccggccauuaucaagaucaacgcgcucacggcggccaccgaggccaccugccugauucuuuccgucgacgagaccaucaagaaucaaaaggcgggcgacgcaccucagaugggccgcgggaugggaaggcccauguaa

SEQ ID NO: 6595 - RNA, 4725 nt, Meligethes aeneus
gauccuagugcuucgauaaucgauuuugagguuaacauugauggggaauggucuccauggucuaacaagguuccacaaauugaaguggagacucauaaaguugcaucuccagauauugugguaccuacuuuggauacaguaaggcacgaaucccuuuuguauacuugguuggcugaacacaaaccucuuguacugugugguccuccugguucugguaaaacaaugacacuauucuccgcucuaagggcauuacccgauauggaaguaguaggucuuaacuuuucaucagccacaacuccagaguugcuguuaaaaacuuucgaucauuauugcgaauacagaaaaacacccaacgguguuguguuagccccaguacagcucgguaaaugguugguauuauucugcgacgaaaucaacuuaccagauauggacaacuacggaacccaacgcguaauaauguuccuacgucaaauagucgaacaaaaagguuucuaccgcgcuuccgaucaaaccuggguaucucucgaacguauucaauuugugggcgcuuguaauccgccuacagauccaggcagaaagccuuuaucgcacagauuucuucgucauguaccaguaguauacguggauuacccuggugaaacuucuuugaagcagaucuacgguacuuuuacgagagcgauguuaagguuaacaccagguuuaagagguuauucggaaccguugacaaacgccaugguggaguuuuauuuggcgucacaagacagauuuacucaagauaugcagccucacuacguguacucaccucgugagaugacucgauggguuagaggaauuugcgaggcuaucagaccucuggauaauuugccaguugaagguuuggugagguugugggcucaugaagccuuaaggcuuuuccaggacaggcuuguugaagauacugaacgucgauggaccaaugaaaacauagaugcuguggcauuaaaacacuucccauccgcaaacugcgaaaacgccuuggaaagaccaauacuauauaguaauugguugaguaaggauuacauaccgguagauagagaacaauuaagggaguauguaaaggcaagacuuaagguuuucuaugaagaagaauuggauguuccuuugguguuguucgaugaaguucucgaucauguacuaagaauugacaggauuuuuaggcagccacaaggucauuuacuuuugaucggggugucuggagcuggaaaaacgacucuuuccagauucguagccuggaugaacggcuugagcaucuuccagauuaaaguacacaacaaauauaccgcugaagauuucgaugaagauuuaagaucaguauugagaagaagcgguuguaaagacgagaaaaucgcuuuuauccuugaugaaucaaacauguuggauuccaguuuccuggagagaaugaacacuuuguuggccaauggagaaguucccggauuauuugagggagacgaauacacaacuuuaaugacgcagugcaaggaaggcgcccaaagagaagggcuuaugcuggauucuaacgacgagcucuacaagugguuuacacaacaaguuaugcgcaacuuacacguuguuuucacgaugaauccauccacagacgguuugaaagacagagcggccacauccccagccuuguucaacagaugcguauugaauugguuuggagauuggucugauggcgcgcuauuccaagucggaaaagaguucacaaacagacuggacuuggauagacccaacuggaaaucacccgacuuuuucccugcaguuuguacgcacauuucagcuacaccaguacauagggaagcuguuauaaacgcuugcguuuacgugcaucaaacguugcauaaagcuaacgcuagauuggcgaaaagagguggaagaacuauggcuauuacuccuagacauuacuuggacuucauccaucauuuugucaagcuccacaacgagaaacguucggacuuggaagaacaacaacuccacuuaaacguuggucuaagcaagauugcagaaacaguagaacaaguggaagagaugcagaaauccuuagcgguuaaaucgcaagaauugcaagccaaaaaugaagcugccaacgcuaaacucaagcagaugguuaaagaucaacaagaagccgagaagaagaaggugcagagucaggaaauucagcaacaauuggcuggacaaaccauccacauugagcaaaaacgcaccgaaguaauggcggauuuggcacaaguagaaccagcuguuauagacgcucaaacagccguaaagucgaucaaaaagcagcaauuggucgagauccguacgauggcgaacccaccugccguuguaaagcuggccuuagaguccauuugcuuguugcucggugaaaaugcaagcgacuggaagucuaucaggaccgucaucaugcgugauaacuucaucaauacuguagucaacaauuuuaacacugaggacauuagcgaugauguacgcgauaaaaugaggucccguuaccuaaguaacccugauuacaacuucgaaaaaguaaaccacgccaguaacgcuugcggaccguuggugaagugggccuuggcgcaaauucaauacgcagacaugcuaaaaaaaguugaaccucuucgggaggaguugaacucucuggagacgcaagcugaaacaaaucaaaagcgcggcgaugaaguuaagagucuuaucgcgcaauuagagcacaguaucgcuucauacaaggaagaauaugcgcaauuaauugcgcaagcgcaagcuauaaaaacugauuuggaaaaugugcaagccaaaguugacagaucuauagcccuacuaaaauccuugguuauugaaagggaaaggugggaggcuacaagcgaaacauucagaucgcaaauguccacaauuauuggagacguuuuacuauccgccgcauucauugcuuauggugguuacuucgaucaacauuaccgucaaaacuuguucaccacauggugucaacaucugacacaagccaccauacaguacagaccugacauugcuagaacugaguauuuaucaaauccagacgaaagguuaagguggcaagccaacgcuuuaccaacggacgaucuguguacugaaaacgcuauaauguuaaagagguucaauagguauccuuuaauaaucgauccuucagggcaagcaaccgaauauaucaugaacgaauucaaggauaaaaagauuaccaaaacuaguuuucuggaugauucuuuuagaaagaaccuggaaucugcguuacgauucgguaacccucucuugguucaagacgucgaaaacuacgacccaauuuuaaaccccguucuaaacaaagaacuucgcagaacuggcggucguguuuugaucacucucggcgaucaagacauagauuugucaccgucuuucgucauuuucuuguccacgagagauccaaccgucgaguucccgccggauaucugcuccagaguuacauuuguuaacuuuacuguaaccagaagcucgcuacaaagccaauguuugaaucaaguacuaaaagcagaacgaccugauaucgaugccaaacguucagaucuguugaaguugcaaggggaguuccauuugagguugaggcagcuugagaagucucuauugcaagcuuugaaugacgcuaaagguaaaauucuggaugaugauagcguuaucacuacguuggaaacucuuaaacaggaagcagcagaaaucggucaaaaaguugaagaaacugauaagguuauuucggagaucgagaugguaucucaacaguacaugccuuuaucacaggcuugcaguaauacauauuucaccauggauucucuuaaccaagugcauuucuuguaccaguacucccuuaaaauguuuuuggauauguucaguacaguacugcuaaguaauccacaguuagauggaguuucugacuaucaacaaaggcucaacauuaucaccagagaucuuuuacagguuuguuaugaaagaguugcgagaggcaugauacacaacgaucguuuaacauucgcuuuacuauugugucgaauucaucuuaaaggaguuccaagcgaaccaaauuuggaccaagaguucaacuucuuccuuagagguaaagaaggcguauuuacgucauccucaaccgauucuguggacgguuugaacaaugagcaacaagaagccuugacuagguuaucauugagauugccggcguuuaaaaaguuaccggagaaaauccgcgaaaugccagaguuuggaaacugguugcagcaaagcacgccugagcaaugcgugccugguuuguggauugaagagaaacaguugaguccgauuggaacuuccauguaucaacuccugguuauacaagcuuuuagaccugauagaguuauagcugcagcuucguuguuuguuaccgcuguguuggguguugauuucaugcccagcgcugaaaaagaauuggacuuggcugcuugcguugaaaaagaaauaagauccaauguaccagcuuuacuguguuccguaccagguuuugaugcuucaagcaggguugacgaucuagccgccgagauaaacaaacaaauuucaagcaucgcuauugguuccgcugaaggcuuuaaccaagcugauagggcuauaaauauggccuguaaaacuggccguugggguauguugaagaacgugccuuua

SEQ ID NO: 6596 - RNA, 1950 nt, Meligethes aeneus
gaagaaugcaaaaaaagucuaccuauauucccguucagagacgaauucauaaacgcuguucgcgaaaaucaagugcuaaucauagagggcgaaaccgguuccgguaagaccacgcaaauaccacaguaccuccacgaggccgguuuuaccgaagauaguaaaaaaaucgguugcacucagccgagaagaguugcugccaugucaguggcggcucguguagcccaggagaugcggguuaaacugggcaaugagguuggguaugccauacguuuugaagacuguaccucggaaagaaccgucaucaaguacaugacggaugguacguugcauagagaguuuuugucugagccggacuugcagucuuauagcgucaugauuaucgaugaagcucaugagagaacuuuacauaccgacauucuuuuugguuugguuaaagauaucgcccgauucagaccugauuugaagcugcugauauccagugcaacucuggaugcgcagaaguuuuccgaguuuuucgauggagcgccgauauuuagaauacccgguagacgauuuccagucgauaucuauuacacuaaagcucccgaagcugauuacauagacgcuuguguuguuuccguacuucaaauacaugccacacaaccccugggggauauuuugguauuucuuacaggucaagaagaaaucgaaacuugccaagagcugcucaccgaccgugugagacguuugggcucuaaaguuaaagaacucuugauucuaccgguauacgcuaaccuucccagcgauaugcaggcgaaaauuuucgaacccacaccaccaggugcaagaaaagucguuuuggccaccaacauugcggaaacuucgcugaccauagacaacaucaucuacguuaucgauccaggguuugcaaaacaaaaccacuucaauuccagaaccggcauggagaguuugauggugguucccauaucuaaagcgucggcgaaucagagagccggcagggccgguagaguggcagccgguaaauguuuuagacuguacacagccuggucguacaaacacgaguuggaagacaauacuguuccugaaauacagagaaucaacuuggguaaugcuguauugauguugaaagcacuggguauaaacgacuugguacacuucgacuuuuuggacccuccuccacaugaaacucuaguguuggcucuggaacaacuguacgcucuuggagcuuuaaaucaucacggugagcuuacaaagcuagggaggcgcauggcagaauucccaguugauccaaugauggcgaaaaugauuuuggcgucugagaaauauaaauguucagaagaaauaguaucgauuggagcuaugcugucuguuaauggcgccauauucuacagacccaaagauaagaucauacaugcugauacggcuagaaagaacuucaaccauccuggaggagaucauuugaguuugcucaacguuuacaaccaauggaaagauucugauuauuccacgcagugguguuacgagaauuuuauacaguacagauccaugaaaagagcuagggacguuagagaacaacucguaggcuugaugcagagagucgagauagagaugguuucaaauguauccgagaccaucgauauacggaagaguauaacagcuggguauuucuaccacauagcuagacugucgaagggugguaacuacaagacagugaagcacaaucaaagcgugaccauucauccgaacagcgcgcuguucgaagagcuaccacgguggcugcuguaccacgaauugguguucaccacaaaagaauuuaugaggcagguggucgagaucgaaagcaagugguugcuggagguggcgccgcauuauuacaagcaaaaagagcucgaagaucccaccaacaagaagaugccgaaaacggucggaagaagcacgcgcacagaguaa

SEQ ID NO: 6597 - RNA, 1371 nt, Meligethes aeneus
augaagguugaagaaguaaaaaguacggugaaaacccaaaggauaagugcccacagucacauuaagggcuuggguuuggacgaacgcggcuucgcgauacaauucgcagcggguuugguuggacaggagcaaguuagagaggccgcugguaucgucguggacaugauuaaaagcaagaaaauggcagguagggcuauuuuguuggcuggaccgccuggaacaggcaaaaccgcuguggcucuggcaaucgcccaggaauugggcaacaaggugccauucugcccgauggugggcucagaaguguucagcuccgaaaucaaaaagaccgaaguuuuaauggagaacuuucggagagccaucggguuaagaaucagggaaacaaaggaagucuaugaaggugaagugagcgaguugaccccugucgaaacagagaauccugcuggagguuaugguaaaacagugagucauguuauaaucgguuuaagaacugcaaagggcaguaaacaguugaaguuggaucccagcaucuacgaggcucuucagaaggagaaaguugagguuggagauguaauuuauauugaagcaaacaguggggcuguuaaacgacaagguagaucugaugcauaugcaacugaauuugauuuggaggcagaagaauauguuccauuacccaaaggagauguacauaaaaagaaagaaguugugcaggacguaacuuugcacgauuuagacgcagcaaacgcaaaaccgcaaggggggcaggacguguuaucgaugauggggcaauuauugaaacccaaaaaaacggaaaucaccgauaaacugcguaaggaaaucaacaaaaucgucgacaaauacaucgaccaggggaucgcggagcugguuccgggcguuuuguucaucgacgagguccacaugcucgacauugaaaccuucacguaccugcacagggcucuggaaagcacaauagcccccauagugauuuucgcuaccaaucgcggccggugcgugaucaggggcacggacgacauuuacuccccccacggcauuccccuggaucuccucgaccggcugcucaucaucagaacgaagccguaccagaggcaggagauggagcagauccugaagcugcgcgccagcaccgaggggcucgagaucgaagcugaagcucucucgauucucggggagguuggcgucaaggccacuuuaagauuugccguucaacuuuugacgcccgcuuuccucaccgccaaaauuaacggcagagcgaacaucacgaaagcggauguugaggaagucagcacuuuguucuuggacgccaaagcguccgcuguuauuuuaagcgaaaaucaauccaaauuuaugaaguaa

SEQ ID NO: 6598 - RNA, 2196 nt, Meligethes aeneus
augacuuccauaauaaaauuaacugccguuucgggggccauggacgaaucgcccccauguuacauucuacaaguagaugauguuagaauuuuguuagauuguggaugggaugaaaaguucgauauggaguuuauuaaggaaguaaaaaggcauauucauacaaucgaugcagugcuuauuuccuacccugauguauuucauuugggcgccuuaccuuauuugguugguaaauuggguuuaaauugucccauauauuccacaauuccuguguauaagauggggcaaauguuuauguaugauuuguaucagucucauuacaauaugaaggaguuugauauuuuuucccuugacgauguugaugccacauuugaaaagauuauacagcugaaauauaaucagaguguaccacuuaaagguaaaggauaugguuuaacuauaacaccauuaccggcaggucauaugauuggugguacuauuuggaaaauaaugaaaguuggugaagaagacauaauuuacgccaacgauuuuaaucacaagaaggaaaggcauuuaaaugggugugaauuggagaaauugcagagaccuucauugcuuauuacugaugccuauaaugcuuccuaucaacaagcuagaagaagggcgagggaugaaaagcuuaugaccaauauucuucaaacucuacgcaauaauggaaauguucuuauagcuguagauacagcugguagaguauuagaauuggcucacauguuggaccaauuguggagaaauaaggaaucuggacuucuagcuuauucuuuggcuuuguguaauaauguuagcuauaauguuguugaauuugccaagucgcaaauugaauggaugagugacaaacuuaugaggaauuuugaaggggcuagaaauaauccauuucaauuuaaacauuugcaauuaugccacaguuugcaugaguuggcuaaagugucaaguccaaaagugguuuuggccaguucagcugacauggaaagugguuauuccagggaauuauuuuuacagugguguuccaaucccaauaauaguuuaauaauuacuucaaggacuucuccuggaacuuuggcaagggaacuaguugauaauggaggaaauagggaaauugaaaugaauguggaaaaaagaguuaaguuggaaggggcugaguuggaagaauaugaaaaaaagaugaaggaguuaaggaauguuaaaaaagaaagugacaacgaaucagacucugacgacgacaucgagaugagcguuaucuccaagggccgucacgacaucgugaucaaacaggagggcaaagugucgggcgguuuuuucaaggucaccaaaaaacaguaccccauguacccguucagcgaagagaaaaucaagugcgacgaauauggagaaauaaucaagccugaagacuacaagcuggcggauguggugccugaggaggacaacaaggagaacauugugaucaagaaggaggaggaggauauaacugaaaucccggaaauccccacaaaaugcaucauucuaaaccguacaguccaaguaaacugccagguucaguacauagacuuugaaggcagauccgauggugaaucccuaaugaaaauuuugucacaacuaagaccuagaagagugguaaucguacgugguucuccagaaaacacuaaagucauagaaaaccauugcacugauauuuugcacaccaggguuuuugugcccagcaaaggagauaccauugaugccaccagcgaaacgcauaucuaccaaguuaggcuuacggaugcguuaguuucccaacugaacuuccaaaaggcuaaggaugcggaaguugcauggauaaacgcucagauuguuuuaagggagagccaauuggaugcuaaaaggaugacaauugauaaugaacccauggaggaagaggacgacuuuaauguucuaacccuggaaccauacccaggcgaaauuccccaugacccaguguucauaaaugaacuaaaacuaucagacuuuaaacaaguccuuggcaaaaauaguauuccuucagaauucucaggaggcguguuauggugcaguaguggcaccauugcauuaagaaaaguggaaaauggcagaauaaugauagaagguuguauuucagaagauuauuacaaagucagagaacuucuguacgagcaauaugcuguuuuauag

SEQ ID NO: 6599 - RNA, 2343 nt, Meligethes aeneus
agcauugauguugucauuugucaaaaccugcguucgucggaaaguaaacgauuaauauuuuguguagcguuuaaagaaaaacucauaaaaaugccuccuuuggagccaaauggagaaaaaaacgaugaaccgggaccgauaaauucgguggugggaauaauuuacccaccaccugaggugagaaauauuguggauaaaacagcaaguuuuguugcuagaaauggcccagaguuugaggcucguauccgucaaaaugaauugggaaaccccaaguuuaauuucuugaacaguggggaucccuaucaugcguauuaucaacacaaagucaaugauuuccgugaaggaaaaggucaagaaccagcuacaaauuuaccugcagcaauaucaaaacuaucaguuacugcaucagcacaacagaaacaacaagaaauuuuaaaacaaguugagcaaccauuuguuccaaaagauccuccacaagaauuugaguuuauagcugacccaccuuccauuucugcuuuagauuuagauauaguuaaguuaacagcacaauuuguugcccguaauggcagacaauucuuaacccaacucaugaacagggagcaacguaacuuucaguuugauuuuuuaagaccccagcacucuuuguuccaauauuucacaaaauuacuggagcaauacaccaagguacuuauuccaccaaaaaguaugcaacagagauuaagagaugaagccaaaagugccaggucuguuuuggaacaaguuaaauacagagcagaauggcaaagguaccaggagcaacaaaaagcuaaagaggaggaaauauuggaaagagaaagaguugcuuaugcacaaauugauuggcaugacuuuguuguggucgaaacuguagauuaucaaccguuugaaaucgguaauuucccgccgccaacuacuccagaagaagugggagcacguuugcuuauucaagagagaauugaagaaggagaggacauugaaaugcaacuugagagcgaugaugaggaaucugcaccacccacugaugaagguuuaagucauaugcaagacaggacgcacggucgcaaagguagagaugauaaucgcguacaagacauggaagaggauaguuccgaugaggacucucgcggaccaucaaagccuucucagccuucaauucaaccaccaaugccgccaauaccugauaagguugucgucaagaaauaugaucccaaacaagcuguuaaagucaccagaccaaccgugggugaugacuuuuugguaucgccuaucaccggcgagaaaauccccgccagcaaagugcaggagcacaugcgcaucggccugcuggauccaaggugggucgagcaaagagacaagcaggugauggacaagaugaaccaggaaaccgucuacgccgccgguucugcaauugacgcuagucugaaauuguuggccgaaagacguaccgauauuuucggugugggcgacgaagaaaccgccaucgguaagaaaaucggcgaagaggacguucgcaaggacgaaagggucaccugggacggacacacguccagcgucgaggcggccaccagagccgcccgcgccaacaucacuuuggaagagcaaauccaccagauacacaagguuaagggccuguugcccgacgaggagaaggaaaaaaucgggcccaagaauguaaugggucagucuaaaaacgcuaaaggcaauaaaggacagcaaaugcaaaaucaacaaaaacccccgcagaugccucccaugcccacucaacccaccauacagcuacaaguggccccucaaccaauaauagcaccccaaccucaaauuaugaugaugccagcuccucccauggcucaaaugagaccuccaccauugaugauggcugcuccaccaccaaugggcggauuugugacucaauugccaccgcaaauggcucccccuaugaacaugccccacaagcauccaaaugaagggcccuuggaagaagaaccauccaauaagaagaugaggaaugaggauucccuugugccagaggaaguguuuuuggcgcgcaauccgaguccuguguccaucaaaguggcgaucccuguaaucccggacaaacccgaauggaaacucacaggucaaaugguuaguuacacuuugccccugucagagaguguuucaaaucuuaagguuaagauucaagaggaaaccaacauggcuccugccaaacaaaaguuguucuuugauggaauguucuuuaaagauucaaacacguuggcauauuacaauauuacacagggagcaguuauucagcuucaaguaaaaacucgugguggaaagaaguaa

SEQ ID NO: 6600 - RNA, 1011 nt, Meligethes aeneus
gaaguugucaucgucgccauuugucagauuuauuuguuaaaaaugccgagucaagaggugacaacaacuaaaguggugguucacccuuuaguuuuauugagugucguggaccauuuuaaucguaugggcaaaauuggcaaccaaaaacgugugguugguguucuuuuagguugcuggcgggcuaaagguguccuagauguuuccaacaguuuugcaguuccuuuugaugaagaugacaaagauaagucagugugguuucuggaccacgauuaccuagaaaacauguauggaauguucaaaaaggugaacgcacgugaacggguagucgguugguaucacacagggccaaaauugaaccagaaugacauucaaauaaacgaacugaucagaagguauuguccaaauucgguauuaguaauuauugaugcgaaaccuaaggaucucggucuucccacugaagccuaccaggcuguagaagagguacacgaugaugguucaccaacaucgaagacuuuugagcauguuccuagugaaauuggggcagaagaggcugaagaaguugguguugagcauuugcuaagagauauuaaggauaccacaguggguacauugucucaaagaauaacgaaucaauuguugggggugaaggggcugcauugucagcugagagaaauuagagacuaucucauacaaguuagugaagaaaaguugccuauuaaucaucagauuaucuaucagcugcaagauaucuucaaucuuuugccugauauuaaucaggagaacuuuaauaaagcauuuuauguuaaaaacaacgaucagauguugguuguguauuuggcagcaauggugagaucuauuguagcuuuacacaaucuuauuaacaauaaauuaacaaauaaagaugcugaagaaggaaaaaaagaagaagccaaaaaggauaaagauagcaaagacaaagaaaaggaaaaggagaaagauaaggaugcuaagaaggaugaaaagaaaaaauaa

SEQ ID NO: 6601 - RNA, 525 nt, Meligethes aeneus
auguuuggugguggccgugcuccuauuguuguuuuaagcaauaacacaaagcgugagaguggaagaaaaguucagcuggagaauauaaaugccggaaagcaaaucgccgacgugauaaggacauguuuggggccacaagccaugcugaaaauguugauggacccgaugggggguaucgugaugacgaacgacgguaacgccaucuugcgugagauuacuguacaacacccggccgcgaaaaguaugaucgaaaucgcacgcacacaagacgaagaagugggcgacgguaccacuucagucaucguacuggccggggaaauguuaguggccgccgaacaauuuuuagagcaacagaugcaccccacagucaucaucagggaguacaagaaagcuuuagaagacauuguuacguuguuagaggggcccuuaagugugccuguggacaggaacgauaaggcggccguugcgcaggucguuagggguugcaucggcaccaaauucaucuccaaguggggggauuuggcg

SEQ ID NO: 6602 - RNA, 708 nt, Meligethes aeneus
augucuuuaaguauggaagguauucguccucacuacccugauuacucgaaugcgcccaugcagcgucauuucagcccauacgccgacaacggagggagcguuguugcgauagccggagaugacuuuguaguuaucggagccgauacucguuugagugcuggcuucucaauuuacaccagagaucaaaacaaguuguuuccucugucgaaaaccacuguuuuggguugcgcugguuguuggugugacaccuuaacccuaacucgcauucugaccucucgcaugcagauguaccagcaggagcacaacaaaacaauguccacgguggcuugcgcucaaauguuguccaccauguuguacuacaagagguuuuuccccuacuacauuuccaacgucuugguuggguuggauaacgagggaaaaggcugcguuuacagcuacgaucccauuggacauugcgagaaggccaccuacaaagccggagguucugcaggggcucuguugcagccccuuuuggauaaccagauugguuugaagaauauggagauaaucggggauucaaagcugacgauugagaaagcuaccaauaucauuaaggauguuuuuauuucugcagccgagagggacauuuacacuggggauaguguuauuauuaacauaauuaccaaggagggaauuaaggaugauaaguuugaguugaggaaggauuag

SEQ ID NO: 6603 - RNA, 903 nt, Meligethes aeneus
auguuucaguuuggguucaacauguuucccgagcuacccaggcccuuuaacguaacauacaaaugcuauucaguggcuauguuaccuggcaaugaacggcaggaugucgaaagggguggaaaaauuauaaugcccccaucagcuuuagaacagcugacaagguugaauauuaauuacccaauguuguuuaagcuggucaauaagaaaacaaaucguacaacucacugugguguccuugaguuuguggccgaugaaggaaagguuuauuuaccacuauggaugaugcauaauaugguguuggacgaaggagauuuuguacaaauggaaaguguuucuuuaccugugggaacguuuuccaaauuucaacccuuaucuccagaauuuuuggacauuaccaacccaaaagcgguuuuggaaaacuguuuaagaucauuugcgugccuaacgucgggagauaucauagcugugaaauauaauucaaaaguuuaugaauuauguguacuggaaacaaagccuggugaugccauaagcauuauugagugugauaugaauguugaauuugaagccccgguggguuacaaagagcccgaacauguuaaaaaagaggacgaagacaugcaaaucgauccuucggaauuaaugcccgaacccgcagguuucauagcauuuaaaggggcgggcaauagacuugacgguaaaaaaagaaaagauuccacgucaagcgacucgacgauguugccgaccaaaaccgccuauguuaggggaauccccgauuaugauuacgaaauugguacguugaaauuuauaagaaggaauuuuaaaccggccagcaaagagagugcagaaaauaucgauuuuaaagcguucagcggcaacggauucagucucaaagguagaaaguaa

SEQ ID NO: 6604 - RNA, 666 nt, Meligethes aeneus
gaagacaccguccucgucagaggcguggugaucgacaagaccaugucgcacucgcagaugcccaaagaguugaagaacgucaaaauggccaucuugaccugcccguucgagcccccgaaacccaagaccaagcacaaguuggacgucaccagcguggaggaguucaaggaguugcggcaguacgagcaggacaaauucaaggaaaugguugauuuggucaagaaggcuggcgcaaauuuggccauuugucaaugggguuuugacgaugaagccaaucauuuacuguacucgcaagguuuaccagcugucagaugggucggcgguccggagaucgaacugaucgccauagcgacgggcggcaggaucgucccgcgcuucgaggagcucacccccgacaagcuggguucggcggggcucgugcgcgagcuggccuucggcaccaccaaagacaagaugcuggugaucgaggacugcuccaacucucgcgccgucaccauccuggugcgcggcggcaaccagaugcugguggccgaggccaagaggucucugcacgacgccuugugcgucgucaggagccugguucuggaaccgaggguuguuuacggcgggggcgcggcggaaaucgcuugcagcuuggccguggccgccgaagcugaucagcuggcu

SEQ ID NO: 6605 - RNA, 339 nt, Meligethes aeneus
auggcaagugcgauggacguggacguugaugaaguugaaaugcccaccagcagcucaaaaggcgaaaaaaagcguuuugaagucaaaaaguggaaugccguugcuuuaugggcuugggacauuguuguggauaauugcgcuauuugccgcaaucauauaauggauuuguguauagaaugucaggcaaaucaggccucugccacuucagaggaaugcacuguagcuuggggcguuuguaaucacgccuuucauuuucacuguauuucaagaugguuaaagacucggcaaguuugcccguuggauaauagagaaugggaauuucagaaguaugggcauuaa

SEQ ID NO: 6606 - RNA, 681 nt, Meligethes aeneus
auggauacggauaaaauaaagguguuugguagucauauuaagguggauuccauggcuaaaaucgccgaauuagaaucggcugaaaaggagaaaaugaaggagaaggucgauaagauacugaaacacaaaccgacgguguuuauuaaccggcaguugaucuacaacuacccggagcaguuguuugccgaugcggggguuauggccaucgaacaugccgauuuugacgguauugagcgauuagcuuuggugacaggaggcgagauagcuucgauguuugauaaccccggggauaucaaauuggggacuugcgauuugauugagcaaauuaugaucggggaggauauuuugcugcguuuuucggguguugcuuugggggaagcuugcacuguggugauuagaggcgcgacucaacagauuauagacgaagcugaucguaguauccacgaugcacuuugugugcuagcugcaacuguaaaagagagccgcguuguuuacgguggcgguugcagcgagacuuugauggccugcgcggugcgcaaagccgccgccaguacuccgggcaaggaggccguagcuauggaggcuuacgccagggcguugcugcagcugcccaccaucauagccgacaacgcuggcuacgauucggcgcagcuggugucggaguugguggcugcgcacaac

SEQ ID NO: 6607 - RNA, 837 nt, Meligethes aeneus
auguucagaaaccaauacgacagcgaugucacgguguggagcccccagggccgccuccaccaagucgaauacgccauggaggccguaaaucugggcucugcaacaguuggccuuaaaagcaaaacucacgcuguccugauagcccucaaaagggccuccuccgaauugucggccuaccagaaaaaggugaucaacaucgaugaacauauuggaaucaccauuuccgguuuaacugcagaugcaaggauuuugagcagauacaugaggacugaguguuugaauuacaaguauucucaugauacuguguugcccuuaaauaggcuuauuuccacuuuggggaauaagaugcagguuugcacgcagagauaugauagaaggcccuaugggguuggauuguugguugcugguuuugacgauaaaggugcucauaucuaccaaacuugcccaucugcaaacuacuacgauugcaaggccauguccauuggugcuagaucucaaagugccaggacuuacuuggagaaaaaaaucgacgaacuccauaaugcuccucuggaagauuugauuaaacaugguuuaagggcguugagagauacccuucccccagagguggauuugaacaccaaaaauguuucuauuggauuugugggcgacaaacagccguuuaaaauccuggaugaggaugaaaccgcucccuucuuggcuuugauugaaggagaagagagacguggagguggugggggcccaccugaugcagcugcagcuccuuugagggaugaggcgggggaccaggaugccccgagggaaccgguuccacaaguggccauggauacagauuga

SEQ ID NO: 6608 - RNA, 2550 nt, Meligethes aeneus
augccgauuaaaaaugcagaugaaccaauggaaauuguuuuuacugaugaugauuuacccuaugaagaggaaauauuaagaaacccauacucgguuaaacauugguugcguuacauagaucauaagaaaaagucucccaaacauggcguuaauauaauuuaugaaagggcuuuaaaagaauugccagguucuuauaaauuaugguauaacuacuugaggacucguagaaagcagguuaagccucguugccugacagacccuuuguaugaagaaguaaauaaugcauuugaaagagcuuuaguauuuaugcacaaaaugccaagaauauggauggauuauuguacauuuuuaacagaccaaggaaaaauaaguagaacucgaaagguauuugacagagcucuacgugccuuaccagugacccagcaucauaggauuuggccucuuuauuuggguuuuauuaagaaacaugacauuccugaaacugcuguuaggguguuuagaagauauuugaaauuauccccagaaaaugcagaagaauauguagaguauuuaacugagauagggaggcuggaugagucuucauugguauuggccaaaaucguuaaugaugaaaauuuuuuuucucagcaaggaaaauccaaacaucagcuuuggaaugaauuaugugaacuaauuuccaaaaacccugaugaaguaagaucucuuaauguagaugcuauuauaagaggugguuugagaagguacacagaucagcugggacauuuguggaauucccuggcuaauuacuauguuaggaguggauuauuugauagagcacgggauauuuaugaagaagccauucaaacuguaucuacaguacgugauuuuacucagguauuugaugccuaugcacaauuugaagaauuaaguuugaguaaaaggauggaagaaauagccaaacuuucaaguccuucugaaggugaugauauugauuuggaguuaaggcuagcgcgauuugaaaauuuaauggaaagaagguuauuacuuuuaaauucaguuuuauuaaggcagaacccacacaauguucaggaauggcauaaaagagugcaguuguaugaaggaaaaccccaugaaauuauuaauacuuauacugaagcaguacaaacaguugacccaaaauuggcuguugggaaacuacacacauuauggguugaguuugcaaaauuuuaugaaagcaauguccaaauugaugaugcaagauugauuuuugaaaaggggacccaaguucccuauguaaaaguagaugauuuagcaaauguguggugcgaauggacugaaauggaaauucguaaugaaaauuaugaugaugcauuaaaguuaaugcacaaggcaacaguaaugccagcuaaaaaaguagcuuaccaugaugacacagagucugugcaagcaagacuguauaaaucuuuaaaaguuuggucuauguaugcugauuuggaagaaaguuuuggaaccuauaaauccuguaaggcuguuuaugacagaauuauugauuuaaaaauugccacuccacaaaucauuauuaauuaugggguauuuuuggaagaaaauaacuauuuugaggaagcauuucgcgcuuaugaaaaagguauaucauuguuuaaauggccaaauguuuaugauauuuggaauacauauuugacaaaguuuuugaaaagauauggugguaguaaguuggagagagcgcgcgauuuguuugaacaaugccuugaaaauuguccagcacaauuugccaaaacgcuauauuuacuguaugcaaaauuggaagaagaacaugguauggcaaggcaugcuauggcaguuuaugaaagggcaacaaaugcuguccuuccugaagaaauguuugaaguauuuaauauuuauauuaaaagagcagcagaaauuuauggaauacccaaaacaaggcagauuuaugaaaaggcuauugagguuuugccagaagacagaacaagagaaauguguauacgauuuucagauauggaaacaaaguugggcgaaauagauagggcuagagccauuuaugcucauugcagucaaauuugugauccaaggguuaccacugaauucuggcagauauggaaagaauuugagguucgccauggaaaugaagauacaaugagagaaauguuaaggauuaaacgaaguauacaagccauguauaacacgcaagucaauaugaugucagcacaaauguuaagcucuucaaguagugugucuggaacaguugcugauuuagcuccagguguaaaggauggaaugaggcuuuuagaggcaaaggcuguugaaaugacagggucaucugcugguuccagaccuggaaacauaauguuugugaggggugaaacccaaggcaaucacaaagauaagguuaucaauccugaugaaauugauauaggcaaugaagaugaugaagacaaugaugaugaaaaggaagcugaagaaauaccaguugaaaagcaaaguaucccauuagaaguuuuuggaaguuuaaaaaacaaaaguaaagaaaauuag

SEQ ID NO: 6609 - RNA, 1149 nt, Meligethes aeneus
auggcgaaugguccaauugcagaacggaaucgagacgcuacaauuuacguuggggguuuagaugacaaaguuuccgaaucauuauuaugggagcuuuuugugcaagccggacccuuagugaauguucacaugccuaaagacagaguuacaaugaugcaccaggguuacggguuuguagaauuuaugggagaagaagaugcagauuaugcuauaaaaauuaugaacaugauaaagcuguauggaaaaccgauaaggguuaauaaagcaucagcccaucaaaagaaucuggaugugggagcaaacauauuuauaggaaauuuggaugcagaaguggaugaaaaguuauuguaugauacuuuuuccgcguuuggagucauauuacaaacuccaaagauaaugagggauccugaaacgggcaacuccaaagguuuugcuuuuauuaauuuugcaaguuuugaagccucugaugcaucuauagaagcuaugaaugggcaauaucuguguaaccgaccaauuucuguaucauaugcauucaaaaaagauucuaaaggagaacggcaugguucugcugccgagagauuauuggcugcccagaacccauuaucucaagcugauagaccucaucaacuguuugcugaugcuccaccaauggguaugaugccuccuggaaugucaauggcaccaccaccacccccaguauugauaaugccgcccccaccuccaaccccuacaaauaugcaaccuccaccaccaccuccuguucccccuccagcagcguuucccucuggaauacccccaccuccccucccaccaucucaacccccacucccuccaggugcaccuccauuaccgccaauggcaggagcaggcauucccccuucaggccgucccccucucccuccuaugccucccaccucaacucgcgcccuacagccuccauggcaagcggguggaauuccaccuccacccccagguccccccaguggagcaggaccuguuccuccauucccaggaauguuuccaccuccuccuccaccuggaggaaggccaccgccgcccaacuggcgcccuccaccaccgaauuuugucgguagaccaccguuucccccaagagguccaccuccaccuccucccaguuuugaggguuaa

SEQ ID NO: 6610 - RNA, 774 nt, Meligethes aeneus
augggacguguaauucgugcgcaacguaagggugcgggauccgucuucaaaucccacacgaaaaaaaggaagggagcccccaagcuccgcuacuuggauuucagcgaacgucauggauacaucaagggggugguaaaggagaucauccacgaccccggucgcggcgcccccuuggccauggucaacuucagggaccccuacaaguuccagaccaggaaggagcuuuucauugccccagaaggcauguacaccggacaguuuguuuacuguggaaagaaagccaacuugcaaaucgguaacguuuugccaauuggagccaugccugaagguaccaucgugugcaacuuggaagagaaaacuggugaccguggucguuuggcccgugcaucugguaacuaugccaccguaauugcccacaaccacgacacaaaaaaaacuaggguuaaguugccaucuggagcaaaaaaagucauucccuccaacaacagagccaugguugguauuguagcuggugggggucguauugacaagccaaucuugaaggcuggucgugccuaccacaaauacaagguuaagcguaacugcuggccuaaggugagaggugugugcaugaaccccguugagcauccucacggaggugguaaccaucaacauauugguaaggcuucgacggucaagaggggaaccagcgcuggucguaaagucggucucaucgcugcccgcagaaccggucguauucgugguggaaagguugagacaaagaaagaagauuag

SEQ ID NO: 6611 - RNA, 411 nt, Meligethes aeneus
auggcacguaccaagcaaacugcccguaaauccacugguggaaaagcuccacguaaacaguuggcaaccaaagccgcacguaaaagugcaccagccaccggaggugucaagaaaccacaucguuacaggccuggaacaguagcucuucgugagauccgucguuaccagaaaaguaccgaauugcucaucaggaaauugccuuuccaacguuugguucgugaaaucgcucaagauuucaaaacugacuugcguuuccagagcuccgccgucauggcauugcaagaagccagcgaagcauacuuggucggucuuuucgaagauaccaacuugugcgccauccacgccaagcguguaaccaucaugccuaaagacauccaauuggcaagacguauucguggagaacgugcuuaa

SEQ ID NO: 6612 - RNA, 786 nt, Meligethes aeneus
caugaugcccuccuuggccagcauguccaagcucauggggucgaugcccuucugguugaucaccgcgaagcucuugucggugccggcgcagagcuucuucuugagcucgaccaccuugcgcacgcgcugcaugaugaagucgcgcuccgccgucaccaucuucucgcgcuccucggccguuuuguagaagaagcccgaguucacuucgcucuucucguacuccaugcucacguugcaggugaggauguacgcguuuuucagcuguuugggcaugucgggguggcggcacccgugguccaucacgauaccuuugaccaaagaagugucagcuucaguuuugugcugcaucuccaucaacucaaccaugugcaagucgacggguuugucgcccugcuugauggccaaaaucccgucgacgcacaccucggccagaacgucggccaacuuccggugcaccuugguccucaagcuggucuugcacacguccaucaggcucucucuggacgccucgacggggaucuugaucuucuccaagaccuccagcgccuuggcucuggcuuugucgaagcccucggccaggauccucgggugcaaaccuucggauauguagaugucggccugcuugaggagcucgccgaucaccaggacgguggagguggugccgucgccugucaugucguccugcgcgguggaagcccuggcuaucaaggaggcgguagggugcuggauuugcaucucgugcagcaagacguugccguccuuggugauuuugaugucgcccgcgcc

SEQ ID NO: 6613 - RNA, 2736 nt, Meligethes aeneus
augucuagugcugaaaucguagauaguuccgucgaucccccugccaagaagaggaagcuagaauugucaucguuuuccucagacauggcgaauaauggagccgaaggaucgucacaagccggugacauugaugaggggcuauauucucgucaacuuuauguuuugggacacgaugcuaugcgacgcauggcuuccagugauguucuuauauccgguuuggggggauuaggaguagagauugcaaaaaacguuauucuuggagguguaaagucagugacuuuacaugacgaggcaguuuguacuauuucugauuuaucaucacaauuuuauuucaaugaaucggauguugguaaaaacagagccaaagcuuguuguaaaucauuaucugaauuaaacacuuauguuccaacaacagcauacacugguaaauuagaugaaucauacaucuuaaaauuuagaguuauuguuuuaacaacuaguagcuuaaaagaacaguugcuuauuaguaaaauaacacauucuaauaauauagccuugauuauugcugauacucgugggcuauuugcucaaguuuucugugacuuuggagaaucauuuacuguuguggauauaaauggggaaccuccuguauccgccaugguugcugauauaucaucagaaaaagaagcuauuguuacaugcauugaugauacuagacauggcauggaagauggggauuacauuacauuuucagaaguuaaaggaauaacugaauuaaauaacugcaacccuauuaaaauuaaaguguuagguccauacacauuuguaauuggagacacaaccaaauuuucuaaauaugagcaugguggaauugccacucaaguuaaaaugccuaagguuguaaauuuuaaaucacuuacugaauccuuggaaaauccugauuucauaauaagugauuuugcuaaauuugauagcccuacacaguuacaucuugccuuccaggcauugcaugaauuuauugaaacacauucuagaaccccaacaccuuggagcccaagugaugcuucagaauuccuaaauauugcaaagucaauuaauaaacaaaauauugaaauugauuccaaauuacuugaacuauuuucuaaaauuucuucuggagauuuaaacccuaugaaugccacuauugguggaauuguggcccaagaaguaaugaaggcaugcucugggaaguuucauccaauuuaucaaugguuauauuuugaugccauugaauguuuagagucagaugaacccgaagaaauaacugaagaguuagcggagccuauugguuccagauaugaugggcaaauugcuguuuuugguaaaaauuuucagaaagcuauuggugaauuaaaguauuucguagucggagcuggagcaauuggaugugaauuauugaaaaauuuugcaaugguugguuuaggaacccaaggaggagaaauuacugucacugauauggaucuuauugaaaaaucaaaucucaaccgacaauuuuuauuuagaccucaugauguucaacagucaaaaucuguuacagcagcaaaggucaucaaaaaaaugaacccagauguaaacauugcagcucaugagaauagaguuggaguggacacugaaaauguguaugaugauaaguuuuuugaaaguuuagacgguguugcuaaugcauuggacaauguugaugcaagaauguauauggaucguagauguguuuauuaucgcaaaccuuuacuugaaucugguacuuugggcacuaagggaaauacccaagugguuguaccuuucuuaacugaaucauauaguucuucucaagacccaccagaaaaaagcauccccauauguacuuuaaagcauuucccuaaugccauugaacacacuuuacagugggcaagagaaacguuugaaggacuuuuuaaacaaaaugcagaaaacgcaucuuuguaucuaaaagauccugaauuuguugaacgcacucuaaaacuaccuggcguucaaccgcuugacacguugcagucuguuaaggcagcuuugauugaugaacgcccaaaaucuuuugaagauugcauucauugggcuagacuucauuggcaagaacaauauagcaaucaaauaaagcaacuuuuguuuaacuuuccgccaacacaacuuacaagcacuggucaguuauuuuggucugguccuaaaagauguccagauccacuugaauuugauguaaacaauucacuucauuuggacuauauuguagcugcuuccaauuuaaaggcucaaguuuauggcauucaaaccaauagagauaggauguauauaucucaaauuguaacucaaguugagguaccggaauuuguuccaaaaucagguguaaaaauuuccguaaccgauuuucaaaugggaaugagcaaugguucaaauguugauuuggaucggguaagccaaauaagagaagaacuaccgccugcuccagaguuuggaacuuugcgauuaaugccaauagaauuugaaaaggacgacgauucaaacuuccauauggacuucauuguugcugcaucuaaccuucgugccacuaauuacaaaauuguaccagcugauagacacaagucaaaauuaauugcagggaaaauuauuccugccauagcuacuacaacguccguaguggcggggggggggggguuuuuguuauuuuuauuuuuaauaaaaaaaaaaaaaaaaaaaaaaaaaaaaaaa

SEQ ID NO: 6614 - RNA, 1278 nt, Meligethes aeneus
auggcugaugcugaugaucuuuuggauuacgaagaugaggaacaaaccgaacagaccacgaccgaaacggcgggagcaggggacgccaaaaaagccguuaaggguacuuacguauccauccacagcuccgguuuuagagauuuucuucuuaaaccugaaauuuuaagggcuauugucgauugcgguuuugaacauccaucggaaguacagcaugaauguauuccacaagccguucucggcauggacaucuugugccaagcaaaauccgguauggguaaaaccgccguguucguguuggcaacguugcaacaacucgagccuaccgaaaacguggucuacguacugguaaugugccacacgagagaguuggccuuccaaaucagcaaagaauaugaacgauucagcaaguacauguccaacaucaaaguuggcguguucuuugguggguuaccuauucaaaaggaugaagagcuguuaaaaaacaauugcccacacauugugguugguacuccuggcagaauauuggcguugguccguucgaagaaguugaaucucaaacaccucaagcauuuuauucuugacgagugcgacaaaaugcuggaacuauuagauaugagaagggacguucaagaaauauacagaaacacaccucacggaaagcaaguaaugauguucagcgccacucucagcaaagaaauucgucccgucugcaagaaguuuaugcaagauccaauggaaguuuacguugacgacgaagccaaacuuacccuccacggucuccaacaacauuacguuaaacuaaaagagaacgaaaaaaacaaaaaauuauuugaauugcucgauguucuugaauuuaaucaagucgucauuuucguuaaaucaguacaaagaugcguugcacuggcccaauuauugacugaacaaaauuucccagccauuggaauucacagaggaauggaccagaaagaacguuugucaagauaugaacaauuuaaagauuuccaaaagagaauauuaguagccacaaaucucuuugguagagggauggauauugaacguguaaacauuguguucaacuaugacaugccagaagauucugacaccuaccuucacaggguugccagagcagggcguuuugguaccaaaggguuggccauuacguuugugagugaagaaagugaugccaaaauucuaaaugaagugcaggauagguucgauguuaauauuacagaguuaccugaugaaauugaucucagcucuuauauugaaggaagauaa

SEQ ID NO: 6615 - RNA, 777 nt, Meligethes aeneus
ccgccagguuuggagggcggcgacagcaaaagggacacggauauacagggugugauggaaauucgcgagcaagcaagacaaaucgaaaaagcgguggcgaauaaggaaaaccgcuuuauuuugaggguuuugaggugcuugccgaacacgagacguaaauugaacgguauagugcugagaaguuugaucucgcagauauauccuuugucugaacgggaagcuuuguugucuuuuguugaagaggcuguagggucugagauugauucucagacgagggcgagaucagcaacuaaaacccccgugucggaaguugacuuguacauccaucucaucauucugguacguuugauugauacaaacaaacuagaagaagccuuacguugcucccaggcuuuaauggguaaaaucaccagucaaaacagacguacuucggaucauauugccgcuaaaugcuauuucuaccacucccgcgucgccgaauuaaccgacaaacuugauacaauucgugcguuccuacaugcacgguuaagaacagccacacugagaaaugacuuugaagggcaagcuguacuuauaaacugccuauuaagaaacuaucugcauuacucucuauacgaucaaucagauaaauuggugagcaaaugcguuuuuccugaaacagcaaguaacaaugagugggcaagauuucuguacuauuuaggcagaauuaaggcugccagguuggaguacaguguggcccacaaacauuuggugcaagcuaugagaaaaucuccgcaa

SEQ ID NO: 6616 - RNA, 1665 nt, Meligethes aeneus
auggcaagugcuccgcaaaacuuaccuguaucggagauucucaaauccaaagcagaauuugaggaugaaccuaagaaaaagucgagggaagauuggaggaaagcaaaagaguuagaagaagcacguaaagcagguacagccccagcugcugucgaugaagaagguaaagauauuaauccgcauauaccacaguacauuucaucagcaccaugguauuauggaacuagugggccuacgcuaaaacaucagagaccucaggaagagaaacaaaaacaauucaguaagauugaugaaugguauagcagaggagucgauaauaguaaaauagugacaaaauauagaaaaggagcaugugagaacuguggggcuuuaacccacauaagaagagacuguauggaaagacccaggaaagugggugcaaaauauucuggagcaaauauagcugcagacgaguuuguacaaaaaaaucuagccuuaaguuuugaugguaaacgagauagauggaguggauaugacccaucagagcacaaagcuguaauagaagaauuccaaaaaguugaagaagccaaaagacaauuaaaagcugacaaauuggaugcuaaugaagauagugaggaagaaggugaaaaagaugaggauaaauauguggaugaaguugauaugccugguacuaaaguagauaguaagcaaaggauuacuguaagaaauuuaaggauaagggaagauacagccaaauauuuaaggaauuuagauccaaauucagcuuacuaugacccuaaaacaagaucuaugagagaaaauccaaauccaaguaaggaugauccuuacucuggugaaaauuuugugagauucacuggagauacaacgaaacauuuaaaugcacaguuguuugcaugggaugcuuacgaaaaagguguugauguacacuuacuagcagaacccacaaaauuggagcuuuuacaaaaagaauaugaacagaagaaagaacaauuuaaaggcaaaauucaaaacaacauccuggaaaaauauggaggugaagaacacuuggaugcaccuccaaaaacauuacuuuuagcucaaacagaagacuauguugaauacucaagaucaggaaaaauuguuaagggacaggaaaaagaaaucauaaaauccaaauaugaagaggauguuuacauuaacaaccacacaucuguaugggguucauuuuggaaagguggucauugggguuauaaauguugccauuccuucauaaaaaauucauauugccuuggagaaaaugguaaaaauaaaaauucaacagaaucaauaccuuugguugaagaaucaacuaaagaugaagaagaaaaagaagaauccccagaagaaaaggaagcaaguucaaguaaugaagaagauucaaaauuaaagaaagaaaagaggaaaaagaaaaaggacaagaagaagaaacaaaaggagaaaaagcaaaauaaaaaaaaggauuugcuuaaagaggcuguaaaggcugaagaacaaagccaagaaaaugcugauagguuauuggcaauugaugaaagaaagagaccuuauaacaguauguuugaagcuaaaaaaccuacugaggaggaaauugaagcuuacuacuugaaaagaagacgagaggaagauccaaugaaucaauuuauguaa

SEQ ID NO: 6617 - RNA, 525 nt, Meligethes aeneus
accaaacuuggaggaccacguagaauccacccuguucguacucgcggaggaaacuugaaauacagagcauuaagguuagauaccggaaauuucgcaugggguagcgaaggcacagcccgcaaaacccguaucaucgacguuguuuacaaugccaguaacaaugaauugguucguaccaagaccuugguaaagaacgccaucguugucauugaugccacaccauucaggcaaugguaugaaaaucauuacauuuuaccuuugggacgcaagaagggagccaaauugacugccgaugaagaagcuauuuuaagcaaaaaacgcagcaaaaaagugcaaaagaaauacgaaacaagacaaaaaacaucuaaaguugaaccugcuauugaagaacaguuccaaacugguagacuauuagcaugcuuggcuuccaggccuggacaauguggaagggcugauggauauguucuugaaggcaaagaacuugaauucuacaugcguaaaauaaaaucuaagaaagcuaaauaa

SEQ ID NO: 6618 - RNA, 333 nt, Meligethes aeneus
ggguuugguuguugguugucagggguggauauuaacacgcaacaaucauuugaggcucucucugaaagggcuguggcugucguagucgauccuauucagucuguuaaagggaagguugugauugacgcuuuuaggcugauaaauccuaauaugauggucuuagggcaggaacccagacagaccacaucaaauuuggggcauuuacagaaaccuucugugcaagccuugauucauggacuaaacaggcauuacuacucuauaaguauuaacuacagaaagaaugaguuggagcaaaaaaugcuguugaaucuccauaaaaaauccuggauggau

SEQ ID NO: 6619 - RNA, 1215 nt, Meligethes aeneus
augacuguaauaaauaagauggauauugaugggccucccaaaggggaggguuuccgguccuacuauaucaccaaaauugaagaauugcaacucauuguggcugagaaaagucaaaauuugaggcgucugcaagcucaaagaaacgaguuaaaugcuaagguucguauguugagggaggagcugauguuguugcaagaacaagguaguuaugugggugaagugguaaaacccauggacaagaaaaaaguucuuguuaaaguucaucccgaaggaaaauucgucguugauauugauaaaaauauugauauuaacgauguuacacccaacugcagaguggcuuugaggaaugagagcuacacuuugcauaaaauuuuacccaauaaaguugaucccuuaguuucacuuaugaugguugagaaaguuccugauuccacuuaugaaauggugggaggucuggacaaacaaauuaaggaaaucaaagagguuauugaguugccugugaaacaucccgaauuguuugaugcucuuggaauugcacaaccuaaagguguacuguuguacggcccaccugguacugguaaaacucuguuggcucgugcgguggcccaucacacugagugcaccuuuauucgcgucuccgguuccgaguuggugcagaaauucauuggcgaagguucgcgaauggugcgcgaacuguucgucauggcucgcgagcacgcgcccuccaucauuuucauggacgaaaucgauuccaucgguucuucucgcauugagucugguucagguggagacucagaaguacaaagaaccaugcuggaacuuuugaaccaguuggacgguuuugaggcaaccaaaaauaucaaggugaucauggccaccaacagaauagauauuuuggacccugcucucuuaagacccggcagaauugaccguaaaaucgaauuccccccaccaaaugaagaagccagauuggacauccugaaaauucacucgagaaaaaugaacuuaaccagaggaaucaaucuuaggaaaaucgccgagcuaaugccuggagcuagcggagcugaagucaaggguguaugcacugaagcagguauguaugcuuuaagggaaagaagaguucauguuacccaggaagauuuugaaauggcugucgcaaaagucaugcaaaaagauucagagaaaaauauguccaucaaaaaguuauggaaauaa

SEQ ID NO: 6620 - RNA, 600 nt, Meligethes aeneus
augguaaaauuauauuguuuaagcguguugcacaaaggucccacaacagcuacgugguugaaaucggccuucgagcugcaaagcuucagcuucuuucagcgcggcuccgugcaggaguucaugucguuuuucugcaaaaccauaguggaacgaaccauuccagcuuccaggcaaucugucaacgaaggagaguauuugugucacguguacgugagaggcgauaauuuagcuggcguugugauaaccgaucaugaguauccaucgagagugucacacacuuuaauuacaaagauuuuagacgaguuuucuguuaaauuuccuguggagaguuggccccaauugcaagaaagagacguggcguucccacaguuaaauacuuacuuagcgaaauaccaaaaucccagugaggcagaugcaaugacuaaaauacaagaagaucuggaugaaacaaagauuauucuacauaacaccauaacagcuguccuucaacgaggcgaaaaacuggacgauuuaguuuccaaaucggaaggccucagcauacaaucgaaggcuuucuauaaaacggcccgaaaaacaaacaguuguuguucauucaguuaa

SEQ ID NO: 6621 - RNA, 438 nt, Meligethes aeneus
cacauuggaugugcuguuucugggcuuauggcugauucuagaaccaugauugauagggcaagaauagaaugccaaaaccauugguuuguuuacaacgaaaacaugagcguugaaucuugugcccaagcgguuucgaauuuggccauucaguucggcgauuccgacgacgacggggcggccauguccagacccuuuggaguugccauuuuguucgccggaauugacgaaaaggguccccagcuauaccacauggacccuucgggcacuuucguucaauucgacgcgaaagcgauugguuccgguucggagggagcgcagcagagccuucaggagguuuaccaucgcagcaugaccuuggcggaggcuaccacguccgcuuugaccauccucaagcaggucauggaggagaaauugaacucuuccaacguggaagucaug

SEQ ID NO: 6622 - RNA, 1158 nt, Meligethes aeneus
augacagaguacuggcuaauaucggcaccaggggacaaaaccugucagcaaacaugggacaaaaugaacacugcuaccagcaagcaaaacagcuugucucuuaacuauaaauuccacauucccgaucucaagguugguacuuuggaccaauugguugguuuguccgaugaucuggguaaacuggacgcauuuguugaacaaguuaccagaaaaguggccucguacuugggugaaguucuugaggaucaacgggacaaacuucaggagaacuugauggccaacaacaccgacuugccaagcuaucugacccgauuccaaugggacaucgcgaaguacccgaucaagcagucgcuucgcaacaucgccgacaucaucagcaaacaggucggccagaucgacacggacuugaagaccaagucuaccgccuacaauaacuugaagagcagucuucagaacauggagaagaagcaaaccggcagcuuguugacucgcaacuuggccgauuuggugaaaagggagcauuuuauuuuggauucggaguaccucaccacccuuuuggugauuguucccaagagcucuuuuaaugaauggaacgccacauacgaaaagaucaccgauaugaucguacccagguccaccaauuugauuauccaggacgcugaguauggacucuacacgguaucuuuguucaaaaaggucguugaugaguucaaacuucacuccagagaaaagaaguucauuguuagggacuucacuuacaaugaggaagaauuggcugccgguaaaaacgagauuaccaaguugguuacugauaagaagaagcaauuugguccuuuggugagguggcugaaggugaacuucagcgaauguuucugugccuggauucacgugaaagccuugagaguguuuguugaaucuguuuuaagauaugguuuaccugucaauuuccaagcaauuuuaauccauccaaauaaaaagaccaugaagcguuuaagggacguucuccaccagcuuuacggucauuuggacaguagugcagcgcuuucaggcgucaacguagauaguguugacauucccggcuuaggcuuuggucaaucggaguauuacccuuauguuuacuacaaaauaaacgucgacaugaucgacucaaaaguauaa

SEQ ID NO: 6623 - RNA, 804 nt, Meligethes aeneus
caccaccacggauuucgacuccagcacgcgcuucacgacgcacagggcgucgugcaccgaacgcuccaucucgucgcaguagaagucguuggggccgcgcaggauuauagaggccgcggugcgggccuuuggcuuuuuaauaaugaucaacucaucaucgcagauucucuccuggguuacuucggccgcuucaccaaccauacugcugucgaaaguuucaucaccguccauguuggucaaggaugugagauaagcggcuccgguggcuuuggcgaugcgcuugaggucgaccuucuugacccugcgaacggccauggcguucuucucgacgaaauacuugaggcagaggucgucgaugccgccggaaaccaggacgacguucacgcccgucgccaggaucuucucgaugcgcuccuucgucauguccagcucgcgguuccugaugcccuccaacuuguccgggucgcugaucaggaccugcacgcccaacuucaucuuggacuuuugcagcgaaaaguccaggcacgcgaucuucgcguuggcgaucuucuugggcauggccuggcuggcgacggugcaguucagcgcguaacccugcaccaagacgcucucccucgcacuucugccgugcgccuugaggauguugaccgccuugaugggguacauggccuggccuuucggguccuggaucuugaccgccugagcggcguccacgaccauggucgagaacagaucggcaucggagccgaugauuuuagagcucaucgagguuuuggccacguuuaucaggcacucgcgccccaa

SEQ ID NO: 6624 - RNA, 774 nt, Meligethes aeneus
auguucgauccaacaucaaauccaccaccuuuuuggcaaaauggcccugcaccgggggcuuucuauaauuucccaaacacgaaauccggcccaagcgacgaauuucaacauucucaggcucccauaacgacagcaacguccauuguggcuauaaaguacgccaccgggguuauaauugccggugauuugcuggguucguaugggucuuuagcccguuacaggaauugccccagaguuuugcaagucaaugagaauauuauucuuggagcuggcggagauuacggcgauuuccaguacauaaaaaacuuuauugagcaaaaaauuguucaagaagaauguuuggaugaugguuuuaagcuaaaaccaaaauccuuguacuguugguuaacaaggguuauguacaguuguagaagcaaauuugauccccuguggaauaauuugguuauaggaggaauucaagauggugaaccuuucuuggguacaguagacaaacuaggcacugccuucacagauaaaauaaucugcacaggguauggggcucacauugcuguuccuuugcuuagagaggcuauggaaaaaaauccaaacaugucuaaagaugaagcuaaagcucuuguugaaaaauccauggaagucuuguuuuacagagaugccaggaguuucccuaaauaccaaguugcuauaauugaccaaaaugaagguucgguuauugaaggcccauugguggucaaacaaaauuggucuuuggcccauaugauuucuggauauaauuaa

SEQ ID NO: 6625 - RNA, 2076 nt, Meligethes aeneus
ccaacacuuacucugcuggcuucaacagaauuucagcccgaaaaauauguuaaggauuugucccagaacuauguaggugguucagaguugcaagcuauaagaaagaaaauacaggcguugucagaggauacuaauaauaauuuaaagaagaauguauaucaaaauuauggucaauuuauugauacagccaaagaaauaucccauuuggagagugaaauguaucaauuaucccaucuauuaucugaacaaaagucccuuuugaacucucuggcaucaacuuccuuaaugggggauaauagcaauuuaacuagaaacaaggaaagaucugaggagaaaauuauugaggaacaaaaacagaaaacucaaucaauucuagagaaaguggagggaugcaaagauguuuuagauaucccagguagaacguucuugcaugagggagaucuuuuggaauuagauucuuuagaaaauaaaccaauuaaaccagugcauguuuauuuauuuaaugaugguuuuaugauuacuucaagaaauuccaauagucgaggauuaaugaaauauaaguuugaaguuauguaugaauuaggcaguuuagcugugguuaauguuagagauuuaggggauguuaaacaugcuuuuaaguugcuaauauuuccugaaacuagaauauuucaaugcucuucaaauucaaauaagaaagauugguuggauaaauuugaucaagccaagaaaaaccagcuuucacaggauguccaaagacgcgaaucuauaauagaaagaucaccuucaagaaccacuauagaaucaggcauacacagcacuuuaagugaaucugaagaugacuugguuauuauaacacauccagaaugguuuuuggauuugccugaagaacuugauguagguguggcacaaagacauuuugaggaagcuauaacuuuguugcagaaagggaaggauuauaugucucaguuagguuugccaaaugccaagacagaccauguucuaauugauauacaaagaaagcuugacaugcgccagucuaguuuaaccgaaguccuaaugaaagaauuggaaauaaacccugacaaaucuuugcaaggugguuuaagggccgccagacgggcagugagacuauuaaaccaauugggacguucaacacaauccugcgauuuguuccuuaaguuaugcaguagcaugcuaaaaauccaaugcaaaagaguaaaaagggaggggucuacaaccacauacauaaggcacuugucuagugugguuuuuaccaauaugugucauaugacugaugaauuuuuaagggcuuuccccgagucuucaguaugcgcauccgcuuauauuguaugggcuucuagcgaauugucgucauuuuccgcacauuuuaucaaacaaguuuuuguaccucaaacaucuuuggcuacaaucacugaaugcguguuucugguuaaaacacaaugugaaagguuauguaacuauggcauagaucuuugcuaccaacuagauggggcacuuuugacaccucuaacaaaagcuuuaacugauacaagggauaaauuaauagauucuguuaaaguaagagcuuuggaagauaaguggauaccaacgaauuuucauacuaaaaacgguuuaaguagguguuugaaugaacacagagaaaugggacuucaacuugacucauauguaacuggggacauuuggcuacaacuaacucaaaacacaauagcuuucacaaaaguuuuccuagcguuauuagaaugcugcuugagacuuaaaacuacagaauuacuuuacacuguggauacaguucucuaugaaauauauggugcacaacuaaaacauuaugagcuuacauuaaaaaaggauuuacaaaaagaggaaaggcaguucauaauuaaaaauacggaauuucucuugguaacccucuacaauuuaauucaaagaaaauacacaaaaucaaacgguuuugaguguaaaacuuuugccaaaguacaaauugauuaugcugcuuuaaugaaaauuuguuuagggaauagaaauauaaaaacuaaauacucaucugaguuuuuguaa

SEQ ID NO: 6626 - RNA, 3609 nt, Meligethes aeneus
augaaugaaguugagaagcuagaauauuuaucuuugguuuccaaaguauguacggagcuggaaaaccauuugggaaugaaugauaaagacuuggccgaguuuaucauacaucuaucagaaacacacgauaccguaucaaguuuuaagaaaguucuaauugaaaauggggcggaauuuucggauucuuuugucagcaacuugcugagaauaauccagcauaugagaccaagaaaaucuggucaaaacaguucaaaggcaaguucccaaccugacgcugauaaaaaugacuuggcguuuaaguuucccggucuggccuugcccaaugaaucccaaaaacccauggaagaagaaaaaaagccugcugacaagccaaaagaaaaaaaagaagauaacgauguuguagcugauuuaauggcacaauuugaagcucaagccccuucaaguaauaaagagggugauagaaaaagggaaagaagcagaaguaaagaaagagauagacauagagaaggggacagaagcaaaagaaacagaucaagauccaggucaagagagcaccauagagauagaagaaacagaucuagagauagagaucgaagcaggagacauaggucaagaucuagggaaagaagaaggucaagggacagaagaagcagaucaagagaaagaaagcacgauaaacaugauagaguuaauaauaagaauaagcaugaacgaaguccagaauuggaugaugauccgguuccaggaaaaauauacaguggcaaaguagccaauauagugccauuuggauguuuugugcaaauugagggguugaaaaggagaugggagggguuggugcauauaucccaauuaagggcugaggguagaguuacuaauguuucugaggucacugcuagaggcaacaaaguaaaaguaaaaauccucucaguaacuggccagaaaguaucuuugucgaugaaggauguuugccagaugagugguaaggauuuaaauccacugucacaugcuccuucugaaagggaagauagggauagaaauccggauaggcccacaaguagcuccacuaguguguucagauugccuguagguacugaugaaggagaagaggauuccaggaagaaaaucaccaaaaugucuaguccagaaagaugggaaaucaagcagaugauuucguccgguugcauagauaaaagugaacucccagaauucgacgaugaaaccggacuuuuaccaaaagacgaagacggcgaagcagacauugaaauagaacuggucgaagaugaagcaccauuuuugcacgggcacgguagagcaaugcacgacuuaagcccaguaagaauugucaaaaauccagacggcuccuuagcgcaagccgccaugaugcagucugcuuuagcuaaggaaagaagggaacagaaaaugcuucagagagaagcggaagucgacucucaacccucggggaaaaacaaaaacuggauugauccgcuuccagaagaggaagauaaaccuucucaagcaagggguauuggcuugcaaacucaggaucuucccgaauggaaaaaacacguuauuggcgguaaaaagucuucuuuugguaagaagaccaauuugacuauagucgaacaaaggcaaucuuuacccaucuacaagcuuaaggaagaauuaagaaaagccgugaccgauaaccagauccucaucgucaucggcgagaccgguuccggcaaaacgacucaaauaacucaguaccucgccgaagcuggcuuuauagcgcgcggcaaaaucgguugcacgcagccgcgucguguugccgccauguccgucgccaaacgcgucgccgaagaguucgguugccgccugggccaggaagucggcuacacgauacguuucgaagauugcaccaguccagaaacgauuauaaaauacaugacggacgguauguugcucagagagugucucauggacuuggaccucaaagguuacucggucauuaugcucgacgaggcccacgaacgcacaauacacaccgacguucuguucggucugcucaagcaagccgugcaaaagcgccccgagcucaagcucauagugacaucggcaacgcuggacgccgucaaguucucgcaguacuucuucgaggcgccgauuuucacgauacccggcagaacguuucccgucgaggugcucuacaccaaggagccggaaaccgacuaccuggacgccagccugaucaccgugaugcagauccaccugcgggaacccccgggagacguccugaucuuucugacgggccaagaggaaaucgacacggccugcgaaauauuguacgaaagaaugaagucucuaggccccgauguucccgaacucaucauucuucccguguauucggccuugcccucggaaaugcagacgagaauauucgauccggcuccgccuggcagcagaaaagucgucauugcuaccaacauugccgaaacuucccucaccauugacggcauuuuuuacgugguagaucccgguuucgucaaacagaaaguuuacaacuccaaaacuggaauggauucgcugguugucaccccgauuucacaggcucaagccaaacaaagagcgggacgagcagggcgcacuggucccggcaaauguuaccgccuguacaccgaaagggcguaccgggacgagauguugccaaccccgguacccgagauacagcgaaccaaucuggcgaccaccguucuucaauuaaaaaccaugggcaucaacgacuugcuccacuucgauuucauggacgccccgccuguggagucccuuauuauggccuuggagcaguugcauucccuuucugcccuggacgacgagggucucuugacgagacucgguagaaggauggccgaguuucccuuggaaccaaauuuaucgaagauguugauaaugucgguggcacugcaauguuccgacgaaauucugacaauagucagcaugcuuucggugcagaacguguucuaccgaccgaaagacaaacaagcgcuggccgaucagaaaaaggccaaauucaaucagcccgaaggcgaccaccugacgcuucuggccguuuacaacagcuggaagaacaauaaguucuccaacgcuuggugcuacgaaaauuucgugcaaauuaggacucuuaagagagcgcaggacguuagaaagcaacuguuggggaucauggacaggcacaaguuggacguugugucagcagauagaaauacaguuagaguucaaaaagcuauauguucaggguucuuuagaaaugccgccaaaaaagauccucaagaagguuauaggacucugguggacagccagguuguuuauauacauccuuccagugcccuguucaacagacaaccugaguggguaauauaucacgaguuggugcaaaccacaaaagaauacaugagggagguaacaacaauagaucccaaauggcugguagaguuugcacccgcauucuuuaaauucucagauccuacaaaguugagcaaguuuaagaaaaaccaacguuuggaaccguuauacaacaaauacgaagaaccaaaugccuggagaauaucgcguguuagaaggcgaagaaauuag

SEQ ID NO: 6627 - RNA, 1263 nt, Meligethes aeneus
auggcuccuacaagaaagcauauagaugauauauuagcuaggguuaauuuuccuuuguacacaauacaaaugcugucaaacagacauguucuagucggaggcggaggagguucuucgaaaacuggcguagcaaauggauuugaaauauuugaaauagcccaugaugggaaaaaauuuauugcugaagaggugaccagacacgaaacaggacccaguguuguuaugaauugcucaucguacaguaacaguaaacauuccuacuuaguggcaggccaagaaagucauugucaguuauacaguguugauaguguucuagucagagaugaagauaauguggaaaauguuggugaaaaucacacggaagugaggcaacguaaagcaaaaccuaaagaacaaacagacaauaacagaaaugugaaaaagagauuaaaguuuaauaucaagccuauggacagugugcagacugauuuuaauggacaggaaccuuuguugagaguuaugcggauagggcacaauggaaaaaugcuggcaacuggugguacagauaauacaauuaaacuauggaaauucccuaacuuagagccccuagcaacauuaaaagcccacgaaaaagaaauugaugacauagauuuuagccaucaugguaauuuuuuaauaacuguugcaaaagacgguuuggcaguauuaugggauaguuuaaaggguaaagaacuuaacaggcuggaauggaaacaaccugagggaucaaaauauuuauacaaaagaugcagguuuggccuuaucgaggggcuggacgagaaaaggucugcucuguacaugcuggcaaaucccacaggcguggccagaaagcaaaaauccuaccugcaacaaugguuggccgaagguggccaccugaaaaauuccaucgaguucgaugaaaguuugagcgcguuggcugugagagacgacggcagauucguagccgucgguacgauguucagcgggucuguguccauacacgcugcauuuagcuugcagaaaguuuuaaacauuucuggggcacauuccauguucguuacggguuuagaauuuuuaccgguaucgcaagauaaucauacagcuacaaguguagcugaagcugcaguuuuaucaauuucuguugauaaccauguuugcauacacacauugccauuuagaaaaacaaugccagccuggauuggaauacucauuuuaguuuguacauuauuuaugacuuuuguauuuuguuccuauuuacguauauaa

SEQ ID NO: 6628 - RNA, 1317 nt, Meligethes aeneus
uuucaaaauuuucguugucuuuucaaauccaaaucagacguucacaaugaugugugguuaaccaauauggcgggcgcgauguuguuugaaagagcgcaaucuguuucuucgcaccacgauaaacuucuggaaaaccugaaacgcgaacaagaagaacgcgacgaugaagaaaacaucaaaaauaaggagcaggacauccugaauuugggcgagaaguauaaaaaagaggguaaggcuaaggaacucgcggaacuaauaaaggccacaagaccguuuuugggggaaauaagcaaggccaaagcugcuaaacugguuagaucuuugguugacuucuucuuggacuuggaggcuggcauugguauagaagugcaacuguguaaagaaugcauagaaugggcaaaggaggaacgaaggacuuuccuucgucagucacuugaggcgagguuaauagcccuauauuucgauaccgguauguuugcagaggcucugcuguuaggaucaacucuacuuaaagaacucaaaaagcuagaugacaagaauuuguuaguugaagugcaacuguuagaaagcaaaaccuaucaugcuuuaagcaauuuaccuaaagcccgugccgcuuuaacuuccgcucguaccaccgccaacgcaaucuauugcccccccaaaaugcaagccgcccuugauuugcaaucaggaauuuugcaugcugccgacgagaaggauuuuaaaacugccuauucauacuuuuacgaagcguucgaggguuuugacagugucgaaucaccgaaagcucuaacagccuugaaauacaugcugcucucaaaaauaaugcucaacaacccggaagacgugcaacaaauugucagcgggaaauuagcaauaaaguaugccggucgugauauugaugccaugaaagcuguggcacaagcaucucacaaaaggucucuggcugauuuucagcagggugucaagcaguuuaagcaugaguuggaagacgauguuauugugagagcacaucuggguacauuguaugauaacaugcuugaacagaaucuguguaggauuaucgagccuuauucaagaguucagguugauuauguugcuaaaacuauuaagcuuccaaugccacaaguugaaaagaaguugucacagaugauuuuagaugcuaaauuucauggaauuuuggaucaaggagaaggugugcuuauuguauuugaagaaacuccaguagauaaaacauaugaaauggcuuuagaaacaauacagaguaugaguaaagugguagauacacuuuaucagaaggcuaaaaaguugucuuag

SEQ ID NO: 6629 - RNA, 699 nt, Meligethes aeneus
augucuucgaaaucgaaaaaaaccucgacgccggcuucgcagaugccgcagcgcccggcgagcccucucagcccaacaagacacucccgucugcaggaaaaacacgacuugcagaaccucaacgaucguuuggccagcuacauagauaaagugcgguauuuggagcaggaaaacucgcguuugaccagggaagugcaaacuucgcaggaaugcacuacgcgggagaucaccaacaucaaauccauguacgauguggaacucagcgacgcccggaagcuucuggacgagacgcacagggaaaaagcucgccuggaaaucgacgugaaacgucugcuggaagaaaacgacgaguuaagggacgauuuggcgcgcaaaagcaaagaucugaugaucgcugacaacucugcacguaucaacgaaaccaaagccaacgagaugcagcugaaguacacccaggccaaccaggacgccaaaaaggccaucaacgaugcccgaaacuuggagaaggagcgcgacaagcugcggaagcuucuggacgagcaccgcaaacaucuggaagaagagaguuuggcacgcgucgaaauugaaaacgcaaaccaaaguuugagggaagagcucuccuucaaagaucagauccaccagcagauccugacggagacgaggacgcgccggcaggucgagcugagcgagaucgacggc

SEQ ID NO: 6630 - RNA, 1869 nt, Meligethes aeneus
gagggagcccccaccaagcgcgaaggggaggaggaagccuugaccgcggucggcuacgacgacaucggcggcugccgcaagcagcucgcgcagaucaaagagauggucgagcugccucugaggcaucccagccuguucaaggccaucggcgucaagccgccgagaggaauuuugcuguacggcccccccggcaccggcaagacucugauugcucgcgccguugccaacgaaaccggugcguucuucuuuuugaucaacggucccgagauuaugagcaaguuggccggcgaguccgagagcaacuugcgcaaggcguucgaggaggcggacaaaaauucgccggcuauuauuuuuaucgacgaguuggacgccaucgcgccgaagagggagaaaacucauggagaggucgaacgucguaucgucucccaacucuuaacucucauggacggcaugaaaaagagcucgcacguaaucgugauggccgccaccaaucguccgaauucgaucgaucccgcucuacgucguuucggacgcuucgaucgcgaaaucgacaucggcauccccgacgccaccggccgucuggaaguuuuacgcauccacaccaaaaacaugaagcucgccgacgacgucgauuuggagcagaucgcugccgagacgcacggccacgugggcgccgauuuggccucgcuaugcuccgagagugcucugcaacagaucagagagaagauggauuugaucgaccuggaggacgaucaaaucgacgcggaaguacuaaacucgcucgccgucacgauggagaacuuccgcuacgcgaugacaaagagcagcccguccgcucuccgcgaaaccguggucgaaguacccaacgucagcugggaagacaucggcggccugcaaaacgucaagaaggaacugcaggaguuggugcaauaccccguggaacaccccgacaaguuccugaaguucgggaugcagccgucgcgcggaguucucuucuacggcccgcccgguugcgguaaaacacuccuggccaaggccaucgccaacgagugccaggccaacuucauaucgaucaaagggcccgaguugcugaccaugugguucggcgaguccgaagccaacgucagggauauuuucgauaaggcgcguucggccgcuccuugcgugcucuucuucgacgagcuggauuccaucgcuaaauccagggguggaaaugucggggaugccgguggggcggcugacagaguuaucaaccagauuuugacggagauggacggcaugggcgccaaaaagaacguuuucaucaucggugcuaccaacagaccagauaucauugaucccgcaauuuugagaccuggccgucucgaccagcugauuuacaucccauugccggacgacaaguccagggaggcgaucuucaaggccaaccugagaaaaucuccgguggccaaggacguagacaugaacuacaucgccaaaguaacgcacgguuucucuggugccgaucugacggaaaucugccaacgcgcuugcaaacuggccaucaggcagugcauagagucggaaauaagacgcgagcgcgaaagggccaccaaccccaacguggcuucgauggagguagaagaagacgauccaguuccagagauaacaaaagcgcacuuugaagaggcgaugcgauucgccaggaggucgguuuccgauaacgacauucgcaaauacgagauguucgcgcaaacuuugcaacagucgagagguuucgguaccaauuuccguuuccccaacgcugguacagggccacaggcaccagguggcacugccggagaccaggguaacuuccaggacgacccugaagaugaccuauacagcuag

SEQ ID NO: 6631 - RNA, 825 nt, Meligethes aeneus
augggagaucaauucgauugcgcucuagacuuaaugcguagacuuccuccacaacaaauagaaaaaaacuuaugugauuuaauagauuugguuccuaguuuaugugaagauuuacugucaucugucgaccagcccuugaaaguggcuaaagauaaggauucaggcaaagauuauuuguugugugauuauaauagagauggcgacucauauaggucuccgugguccaacacauacuacccaccucuagaugauggcuccaugccuucugaacgccuacguaaauuagaacucgacgccaaccaugcuuucgaucaauauagggaaauguacuucgaaggcggcguaucgucgguguacuuuugggauuuggaccacggauucgccggcguuauucuaauaaaaaaaaccggcgacggcaguaaaaagaucaaggggugcugggacucccugcauguggucgaagugcaagaaaaaaguuccggcaggaauucacacuauaaaaugacuucuacugcuauguuguggcugcagaccaacaaacaggaauccgguacaaugaauuugggcggcagucuuacccgacagauggaacaagacagcguagugagcgaguccaacccacacaucgcgaauauagggcgcauggucgaggauauggaaaauaaaauucgcaacacucuaaacgaaaucuacuuuagcaaaacuaaggacaucgugaacaguuuaaggucggugcagccguugaacgagagucgucaacagcaggccuugaagcaggaccuugcggcagcccugcagcgccgccacaacaaaucagacaacuga

SEQ ID NO: 6632 - RNA, 4119 nt, Meligethes aeneus
augcagcaaguuauggcucccacucuaaauaauaugggcgcaaacaugaaugauacaagagaagcaccaccccguaaugauacuccaguggauccaaucaauggggugguucagccucuuguuaacccagcuccggaaaggccaggucgugucacuaaucagcuccaauuucuacaaaaaacugugcuuaaggcugucagcaaacaucaauuugcauggccuuuugcagcaccuguugaugcuaaaaaacucaauuugccugacuaccauaaaauaauuaaacaaccuauggaccugggaacaauaaaaaagagacuggauaacaacuacuauuggucaggcaaagaaugcauacaagauuuuaacacaauguuuucaaacuguuauguguacaauaaaccaggugaagauguggugguuauggcacaaacuuuggagaaaguauuucuuaccaaaguagcagauauacccaaggaugaaguaguuguggaaccaccagcaaaagguggcaagggcaaaaagggaagaacaaguagugggucaggaaccgguggagcuacacccacagcagggagaggaagaccuccaggugcugucucuucaacuagcgcgacuccaguggcaacaacaacaggaucaucaggucuaccacuaggcacacaagcucccaccacaguuccuggcaguacugccacaacaacaaucacaccugcaucgacacacagcucucuuccuccccaaccaauaucacagaauuaccacucaaauuccuuagaccccuuaucaacaucuguuuuaccaggcaguguuguacccccuucacaaccugcaaagucaaaaaaaggaguuaaaagaaaggcugauacuacaacgccgacggcuaacgcuuacgacuacaacccaccguuggaaucaaaaucggccaaaauaauaaacaggagggagucaggaagacagauuaaaaaaccgaucaggccugaacuggacggucuaguaccauacaaccaggccaccauuuccccaaugaccaauaugaauaccgccacaccucagcaugcugcguugaagacgaaagagaaacucagcgaagccuuaaaagcgugcaaugaaauuuuaaaggaacucuucuccaaaaaacauucaagcuacggauggccauuuuaucagccaguggaugcccagcuauugggcuugcacgauuaucacgacauuauccgaaagccuauggacuugggcacuguuaaacaaaaaauggacaaccgcgaguaccguaccgcgcaagaguuugccggcgacgugagacugauauucacaaacuguuacaaguacaaccccucggaucacgaugucguggccauggcacgaaagcugcaggauguauuugaagucaaauucgccaaaauuccagaagaaccaguuaauaggauagguggcccacccgucaaguccgaguccaguucgucuggcuccagcucggaaucuucgagcgaaacagaggauuccgaggaagaaaggcggaacaaacagcucaagucucuggaaaaagagcugauaaugaugcaagagaaaaugcgcaaauugguagaggagaguucaaagcgaaagaaggaaaagaaaaagcaaaaggagaaggaaaaaccaaagaagacgguagcgaacaacaacagcagcagcggcaacaguaacaacagcauugguaagggggcacacggaggaaugauuaauaagucuaacagcguuguagacagcguugacgacagcauugccagugugguaucgggggcagaucucaagauaguugguggugacgcgcaucaugcaacaucaggaaagucccucgcugcgcaccacaacgcuggcgccaacgcugcugccgccccaacgacuaaaucggccaagaguaaaggagugcgcggucccaaacccagcucgguggcuuccgguuucccugcugcgaaucgcagcaaccgggcggccaaaccugcgagcaaagccggcagaaagaagcaacaagcggcuccggccccgcuggcguucgauuccgaggaugaagacaacgcuaaaccgaugucguacgacgagaagcgacagcucucguuggauaucaauaagcugccuggcgacaaauuaggaaaaguuguacauauaauccagucucgcgagccaucucugagggauucgaauccggaugagaucgaaaucgauuucgaaacguugaagccuucgacguugcgugagcucgagagcuaugucgcaucgugccuacguaaaaagccacauaagaaagugcaagguaaaucaaaagaugaacaaauggcggaaaaaaaacaggagcuagagaaaagacuauuggaugucaaugauaaaauaggaacuaaaaaggcacccaaaaaagaagaggcaaacaagguggacccgacaggcgcgggcgggccuuccggccgguuaucguccaguucgagcaguuccgauucugacagcagcaguucgagccugucgagcagcaguagugacuccagcgacagcgaagcagguacaggcaaaggucaaccuaaaaagaaagccaaaaaaucacccaacccugcaggaaauacaacgaguauacagaaaccaccuauauuaccaccacaaccagcacaaccaaccgccgcaccaccaacaaacaauacaacaaaucuaccuguggcgagcaacaacagugagguaccaccuccaucuuccacuuccagcuccauauccuccacucaaucacaaaacagcaaccaugcagcauccaacaacaaauuuauuaccaacccuaguccgaugcccucaguugccagucguaaaccuuccgucgaaaagccgcccgucucguuggcgucgcaaaacauugcaccucccaccgcuccucaggugccaaaaccggucgcccuuccuaccccgucacccgacaaaccuaaaccuaauaucuugucaccguugucuagugcguacacggacccgcucgaacagucccuggcuagguuagagcaugacauagcaaaauccgaaccaauggaagucaaguccgaggcccucgacuugcccggcaaucuauuaccaaugccgccuguccuuagcaaucccaugcuaaaucccaacaucaacucuaauccuaaccuacaccaugcuuugcagccaaauuugggcauggacaugaaacagcccauugggaugaugccaaugaugccgccgaacuugcaaaugcuagguaugcacaaucccuuggaaaaugacauugcaucgcugaugcaaaacagccacccgcccuacaugaugcauucccaaaacaacggaaucgguaugaagaacgaauacgacaugcacacaaacaacaacggcauuucuuccaugggucugcccauggaacucucuaucccgaccauguucgacucgcuuccgcuacagaugaacaacagcgggaugagaaaagaucaaaauccgcccaaaauggaugaaagaauggaccuggggcacauggguaugagcaacgacaaaaaaucucacaacauggacucccauaagcagcauucucaauccuucgccgcuggguacaaaccuaacaaaccagaccacaacguaaagaaugccaguuccuggucuagccuuggauccaaccuuggaaaaggcaguucgccucagaguaacagccaaggcggcagcaguaaacaaacagucauggagagcuucaaggcguuccagaacaaggcaaaagagaaggccgaucgcgagaaacagcgcuuggagaauuuggaaaugaagcgguugcaaagagaacaggcugaaaaggaaagaauacgcgcggaaaacgaaagaagaagggaacgugaagaagaagaugcacuggagaaagcaaggaaagcgguggcugaacaacaacagcaacaaccuauaccuguacaacgaguugaagaacuuagaucgucaccuggugaaggaagcaucucuccugguucacagaguucagguuccgaaaagacggaaagggaaagacagcgauuacaagaacaagaaagaagacgaaaagaagcgauggccaauaaaauugacuugaauaugcaaagugaucuuauggcugcauuugaagguucauuauaa

SEQ ID NO: 6633 - RNA, 555 nt, Meligethes aeneus
gaaaugaccaagaccaagcaagcugugcaauucuugaggagaaucaaggccuggucugacauccaaaagguguacaaaagccagcgcuuccgcgcugguaaagguaagaugcguaacaggaggcgcauccagcguaaaggaccauuggucguguaccaucaagaccaaggauugcgucgcgcuuuccgcaacauccccggcaucgaccucaucagcgucggcaagcuuaacuuguuaaaauuggcuccugguggucacguuggacguuucgucaucuggaccgaauccgcuuuccagagauuggacaaauuguucggcaccuggaaaacuccauccggcgaaaagaagggauacaacuugccgcaacccaagauggccaauacagaccuuuccagguuguugaaggccgacgaaauuaaacaaguucucagagcuccacagaagaagauuguacgucgccagcgucgucucaauccaaucagcaacacuagggcuaugcuucgucuuaacccguacgcugccguucuaaaacgccaagccauucucagcggacaa

SEQ ID NO: 6634 - RNA, 3264 nt, Meligethes aeneus
auguccgauuuuauccaaucugaggccgaggagagcgaggaugaagacuugacaacucaugagcguaaaaagcucaagaaagucaaggcaauggauaguuccgaggaggaggacgaugaugaugaucgacucagagaagacuugaaagaucugaucgaugauagaccaauagaagaaagcgauggcgaagagucggacgguuccaacggcgaaaaacgcaaaaaauccgacgaugaggaguuugaugacagauuggaagacgacgacuaugauuugaucgaggaaaauuugggugucaaagucgaaagaaagaaauucaagcguuugaggaggauacaagaugaggagagugauaaugaagaagagcaaggggaaggacaggaccgagaccaaauagcccuaaaguuguucgaugaugaugaugaugagcguagaucggaaagaucgcaucgaacaaccguggagcccgaccaguucggggaagaagaagacgagggugaauacagcgacgccgacgacuucaucgucgacgacgacggaagacccauagccgaaaagaagaagaagaagaagcccauauucagcgacgcagccuugcaagaagcccaggaaacguucggaguggacuucgacuacgacgaguucuccaaauacgaacaggacgaguaugaagaugaugaagacgaagaagacgacgauuacgaggaggacgacgauggcgaacgcagacgaccuccgaagaaagaaagacgcaaaaagcccacgaaaaaauccauauucgaaguguacgaacccagcgaguuaaaaagagguuucuucaccgauuuggacaacgaaauucguaacaaggacguucccgagcgcaugcagcuccgcgacguucccauaaccccggucgcggacgauuccaccgagcuggacgacgaggccgaauggauuuacaaacacgcauuuugcaaaccaaguguuuccaauauggaagcgaauuugacgucugaacagagggaaaaauugaaaaaggguccgcaaacugugacgaaaauucgcaaagcucuggauuuuaugcgaaaucagcaguuggaaguuccuuuuaucgcuuuuuacagaaaggaauacguccaacccgaauugaacaucaacgauuuguggaaaguuuauaaauucgacuccaaguggugccaacugaaaucucgcaaggagaaccugaugaaacuguucgacaaaaugcgcucguaccagcuggacgagcugaugaaaaacccggacgcgcccauccccgacacggugcgcgucaugaaggacagcgacauggagcgccugaaaaacgugcagucggccgaagagcugaacgacgugcacaaccacuucgcucuguacuacgcgggagaucuggcagcgaugcacgcggccuggcggcucaaggagaaggagaggcggcgccaggagcgcaacgaggagaggaugcgucgaauagccgagagcgaagacggcgccgauauaccggaagaaccggaagaggaaguggacgacgagccggaagaacaccuaaaguacgcgaaucguucggggucuuacaaguugugcagcagggccggacuggacacgcuggccaaaaaauucgggcugacucccgaacauuuugcggaaaacaugcgcgacaacuaucagaggcacgaggucgagcaggaguucaccgaacccacggaaguggccaaagaguuuauuucugccaaauucucgaccauugaagaaguaauucaggccgcaaaauacaugguggcccuucaaauagccagagagccguuggugcgcaaaugcgugcgcgaaguuuucuucgagcgcgccaaaauuuccaucaaacccaccaaaaaaggucaaaaggucaucgacgaggcccacaauuguuacaguuuaaaauacgucaaaaacaaaccaguucgcgaccuagccggcgaccaauuccuaaaacucacaauggcagaagaggaaaaccuucucaccauuacgauaaacgaaaccauugaaggcaacaccagcaacucuuacauagacgaaguuaaacagcuuuacauaagagacgaguucaguaagaacgugcaggauuggaacgcucugagagucgagugcgucgaaagagccuuaaccaggugcauagucccggacuugagggucgaacugaagaggauuuugcuggcggaagccaaggaguucgugcugaaggccugcugcaggaaguuguacaacuacaucaaggugucucccuacgagaucgaguucccggacgaggacgaggacgaguggaacacgaacaaaggcauccggacgaugggauuggccuacgugcccgacuacggccagucggcguucgcgugcaucagcucccccgacggcgagaucacggacuaccuccggcugccgcaccuccucaaacgcaagaacagcuaccggcaggaggagaagaugaugaaggaggcggauuugaccgcgaugcgaaacuucauuuucacgaaaaaaccgcacgugauuugcguuggaggggagagcagggaggccuugaugaucgcagaggauuuacgcggaguuauauccgaucuaauagaaagcgagcaguuuccuugcaucaagguggaaauuauugauaacgagcucgccaaagucuacgccaacucaaacaaagguacagccgacuuuagggacuacccugaguuacucagacaggcuauaucuuuagcgagaaaaaugcaagacccuuugaucgaauacucucaacuuugcaacggggaugaggaaauuuugucgcucagguuucauccuuugcaagaacaaauaccgaaagaagaguuacuggaagcucugugucuggaguucgucaacagaaccaacgaagucggcgucgacauaaacuuggcggugcaacagaaccacaaagugaaucuggugcaguucauaugcgguuuggggccgagaaaggggcaagcucugauucgcgugcugaagcagacgaaucagaggcuggagaaccgcacgcaacuggugacggcgugccacaugggccccaaagucuucauaaacuguucgggguucauaaagaucgacaccaacagucugggagauuccaccgaggcauacgucgagauucuggacgguagcagggugcacccggagacuuacgagugggcccgcaagauggcgguggacgcguuggaguacgacgacgacgagggcgccaauccggcgggggggggggggggggggggggggggg

SEQ ID NO: 6635 - RNA, 2397 nt, Meligethes aeneus
augacgacggauuccgagagagguuccccuacagcugcggcuccacgcagaagcgccucgaaaucgccagaaccaaaaaaagcaaaguacgauaagaaagagaagggcgauaaagaucgcaagaggagaucccacagauccagaucuagauccagggauagagaccauagggacaaacaugguggaaaaaaacguuaccacgaccuggacgacccuucugaagacuacccaagauauuauggcgaggauagaaaacagaacagugacagauauugguccaaguacccaaagaaagacagggacgaauauguuauugguagccgguauuaugauguugaggaaaagaaggagaaaaaggaaaaagaggaugaaaauaaggauaaauccgucauuacuccaagggaaaggaaaacaguggacuuacuaacaucucgaacagguggggcuuauauaccuccagcuaaauuacguaugaugcaggcugagauaacugauaaaucaucagcugcauaucaaagaauugccugggaagcuuuaaaaaaguccauucaugguuacaucaacaaaauuaacacuuccaauauuggucuuauugcuagagaauuacugcaugaaaacauuguaagagguagagguuugcuguguaaaucuauaauacaagcacaggcagcuuccccgacguucaccaauguuuaugcagcuuuaguugcagucauaaauucaaaauuccccaacauuggagaacuguuacugaaaagguugguuuugcaguuuaaaagggguuucaagcagaacaacaagucuaucuguauaucggcugcuaccuuugucgcgcauuuaguaaaccaaagaguggcccacgaaauuuuagcauuggaaauucuuacuuuacuuguugagucccccacagaugauucaguggaaguagcaauuucguuuuugaaggaaaguggucaaaaacucacugaggugucgaguaaagguaucaaugccauauuugagauguugaggaauauucugcaugaaggacaguuggagaagagaauacaguacaugauugaagucauguuccaaguucggaaagaugguuucaaggaucaugcugcuguuacugaagaacuagauauuguugaagaggaagaucaguuuacucaccuaaucacauuggaugauguuaaacaagcuaacucagaggauauauugaauguguuuaaauuugaugauaaauaugaggaaaaugaggguaaauacaaaacuuuaaguaaggaaauucuccagucagacagugaaucaggcgaaucugguucagaggggucugaagaagacucggaagaugaagaaggugaagaagaugaaaccaaaaaucaaaccauuauugauaacacagaaacuaauuuaaucaccuuaaggagaaccaucuaucucacaauacaauccaguuuggauuuugaggaaugugcccauaaauugaugaaaauggagaucaaaccuggacaagagauugaauugugucacauguuccuugauuguugcgcugaacagcguaccuacgaaaaauucuucggccuccucucgcagcgcuucugccaaauaaacaagacuuucaucgaaccguuccaacaaauuuucaaagauaccuauuccacaacucacagacuugacgccaaucgauugagaaacguuagcaaauucuucgcgcauuuauuguucaccgacgccaucggcugggaagugcucgauaucaugaaauuaaacgaggaagacaccaacaguuccagcaggauuuucaucaagauuuuguuccaggaguuguccgaauauaugggauuagcgaaguugaauaaaaggcuaaaggaugaaacuuuacaggaauauuucgcggggcuauuuccgagggauaacccgaagaacacgcguuucgccaucaauuuuuucacgucgaucgguuuaggaggucuaacggacgaguugagggagcacuugaaaaacgugccaaaacaucuggaagugauggcuuugaaagcagauucgagcagcucuagcagcaguagcagcaguuccaguaacgauuccagcagcaguucagauucuuccgaugacgaggguuccaggaagaagaaaacaaaaaaauugaaaaccccggacaaaaagaagaaacagaaagaagaugaaaaacccaaaaagaaaagcgaggauaaaccgaggaacaaaccagacuauagagauagaagaaacgacgacagggaaaaguuuaaaaaauacagaaacaacgacgaagaaagccacagaagaagcagagaagaugcaagagaaaaauacagaggucacgaggaaagaagaagcgaccacagagaagaauaccggccgagggaacauagagguagagauagacguuag

SEQ ID NO: 6636 - RNA, 1761 nt, Meligethes aeneus
auggcguuaaaaggacaaguugggcaaaaaauuaugaacgagguaauaaagcauaaaccaaagaaaaauggacccgcucauggaguggaauggagaguuuugguuguggaucaacuugccaugagaaugguuucagccuguuguaaaaugcacgauauuucagcugagggcaucacauugguugaagauauaaacaagaaaagagaacccuuaaacaccauggaagcaauauaucuaauaacaccaucugaaaaaucuguucacucacugaugaacgauuuugaaucgccaagacuuauguacaaaggggcacauguauuuuuuacugaagcaugcccugauaauuuauuucaaaaauugucucaacauccaguagugaaauauauuaaaacuuguaaagaaaucaacauugcauuuauaccaaaugaaucacagguguuuucuuuggacugcccagaaacauuccaaugcaguuaugauccugcuauggaagcagccagaaaugcaaacauggagagaauggcagaacaaauugcuacauugugugcaacucugggagaauacccuucaguaagauaccgaagugauugggaacgcaacguggaacuagcgcagaugauucagcaaaaguuggaugccuauaaagcggaugagcccacaaugggagaggggccugaaaaagcgagaucgcaacuuuugauucuugaccgcggcuucgacugcguaucacccaugcugcacgaacuuacauuccaggcaauggccuacgauuugcugccaaucgaaaacgacguguacaaauaugaagcuucagcgggaguauuuaaggaaguguugcucgacgaaaacgacgaguuauggguagaauuacgacaucagcauaucgcuguagugucgcagagugugacgaaaaacuugaagaaauuuaccgauucaaaacgaaugacccaaagugauaaacaaucaaugaaagaucugucacaaaugauuaagaaaaugccccaauaucaaaaggaguuaucuaaauaugcuacacacuugcaucuugcugaagacugcaugaaaucuuaccaaggauauguugacaaauuauguaaaguugaacaagaccuagcaauggguacagaugcagaaggagaaaaaauuaaagaccauaugcguaacaucguaccgauuuuacuugauccaaaaauaacaaacgaauaugacaaaaugagaauaauugcucuauaugcaaugauuaaaaauggcauaaccgacgaaaauuuaucaaaacuugcuacucaugcccaaauaaaagacaaacaaacuauugcuaauuugcaauucuugggaguuaauguuaucaaugauggugggaaccggaaaaaaccguauucggugccaagaaaagagcguauuacugaacaaacguaucaaaugucuagauggacgccuguaauuaaggauauuauggaagacgcuauugaagauaaauuagaucaaaaacacuuuccauuuuuagcuggccgagcgcaaaccagugcuuaccacgccccaacaagugcucgauauggucauuggcauaaagacaaggcccagcagacagugaaaaaugugcccagaauaauugucuucauuguuggaggcaugaguuuuucagaaaucagaugugcguaugagguaacaaacgcccaaaaaaauugggaggucauuauuggauccuccaacauuuugacuccccaaaguuuucuuaaggauuuaaacacucuuacagucuag

SEQ ID NO: 6637 - RNA, 2139 nt, Meligethes aeneus
augaugcaacaauacaugaaagaguuggaacaggaaccuuuugauccagaugaauuuauugaaagauuggcuuggagaacgaugucugaaguuaaaucugacggggaggauuuuaacccgaauauauugcaugacucuuuuguacaggcaaucaaggacuugacuuugcuucaggaacaccagcaaaagaaaugcaagaaauuggaggcuauagugcgagaaaaugaggcucaauuuuucggcgauguugccaaguugacgacggauaacaagcaaucgauggagacuuuucaagaguuggaugguaaaauaacgcauguagcaucaaaaguuuugcauuugggcgaucaacucgacaguguuaauggccccagggccagaguuguggaggcacaaaaauuaaugacacacuuaaacgaguuuuuuaccacuggcccucuaacgucaucuuuauucacagauccuaaacgaguagaugaggcugcagauguaauacagaaacuauuuguuauuucucaagauuuacccaaugaaaaauuuagcggcguacuugaaaaaauaaaaagaaaauaugcggauauugaaagaucuuuaauugaagaauuuacugaugaauuaaaaagggauaaugucgauagaaugaaggaaauugcuaguguuauguaccaguuuaagggauauucucgcuuaauuaaugaauauaucgaauauagucaagcugggugucuccacacaaaagaaauuuucuacagucaacucuuggaguuguguagaaaaaacuacgaaagaauaaaggaaguuuucauaaauccugaccagguuauguccaaauuuguucuaaacauuuaucaacucaaaauccaggaacacauuagauuaaggcucucugauaaguuggaaacauauaauuauuugaagacucucuaugaacuauuaucaaagacuaaccaacugucaaaugauuuagcuauggugcauguuagcagugacaagaauuuuuugaauaaguuaacaucaaauauuuuuagcaaauauauugacaauuauauacaauuggaauuaaaauguuugagagguagauguucgacgaaccuacaaagauauuacgacucuaaaaaucaccaaaagaaacaaauacaaucaggaggauuucaggauuuaagaagagacauacaggcuguuauagguacaagagcgaacauaaauauugcgcaaauagaaaauuauggcggugaaacuuuuuugucagaggaauuggcuauaacuguacugcaagauacaaaacaugccuuucaaaggugucaauugcuuucaaaaccugaagacagggcgucaaaugcaacgcaaaucuuggacuauuuaauuaacugucuacuuacggaacacguagacuaugcucuggaauuaggucuacaggccauuccagugguggaggcggcuagaacuccgcccgucauuuauuuuuucagcgucgucuaucaaagcaacaauauaacgcaucugcucgaaaaacaguucagcgauuuggugguuccccuaguuauaaauuccguaaaauacaacgauugccugcaaaaaaagaaauuugugcuugaagauaucgaaaaaaaagucaacaacggaauagacaggucguugaacgccauagccgccuggauuaaaauguacuugcaggcggaacaaaagaagagcgacuuuaagcccgaaacggacgauuuugacacaguggcgucuccugcguguaaauuggugucgcaauacaucacaagcaugauuaaggaaauaaaaucgaauuuggacgguaauaaugucaccauaauuuugcaagaguuggggauaagauugcacaggguuguguaugaccauuuauugcaauuucaguacaacacugcaggggcuauggucgcaaucugcgauuuaaacgaguauagauccuguacuaaaccgcuuggacucuuaguacaagaacuguuugaaacuuuacaugcccuuuguaauuuauuguugguaaaaccugaaaaucucgcccaaguuuguucggaagacucauugguaaauuuggauaaaucaguauuaaacaauuucauccagcuaagaagugauuuuaaagcccaaaagcagaauauuuuaaaaguuuaa

SEQ ID NO: 6638 - RNA, 813 nt, Meligethes aeneus
auggauuuucaaaaucgucccgguggaaaaaccggcggcggcgguguggcgucauggucggaaaccaacagagaccgcagagaacguuuaagacaacuugcguuggaaacuauagaucuucagaaggaccccuauuuuaugaaaaaccauuuggggucauaugaguguaaguugugcuugacgcugcauaauaacgagggcaguuacuuggcgcauacucaggguaaaaagcaucaagccaauuuggcuagacgugcugccaaggaggcaaaagaugcaccuucgcuaauccagccugaaaagccaagaguugaacccaagaaguuugugaagauugguaggccugguuacagggucaccaagcagagggauauugagaaugggcagcagagcuugcuauuucagauugauuauccagaaauuggugacauggugauaccacgucaucguuucaugucagccuaugagcaaaaaauugagccgccagaccgcaaauggcaauaccugcuauucgcagccgaaccauacgaaacgauuggcuucaaaguaccgagucgcgagguggaaaaaaccgacacgaaauucuggacgcacuggaacagagacacaaagcaauuuuucuugcaguuugcauuuaaaaacgaagcaaaaaagagcaccaccauaauaacccgaccagggcacauuauugcuggagugccaccuccuccaaugaugccaguaccaccaccaccaaggccccccauguucaacccccuccccccuccuccuccuaugaugggaggagucaugccuguacccccuccacauuag

SEQ ID NO: 6639 - RNA, 405 nt, Meligethes aeneus
augucgaucggcgucccaauuaaaguucuacaugaagccgaagggcacauagugaccugcgagacgauuaccggcgaaguuuacagaggaaaauugauugaagccgaagacaacaugaauugccagaugacgcagaucaccgucacuuauagagacggcagagucgcucagcuagaaaauguuuacauuagaggcucgaaaaucagauuccuaauucugcccgauaugcugaaaaacgccccaauguucaagaaacagaccaaagcggguacugcggggcgaggaaaaagcgccauacugcgagcacaagcucggggcagagggcggggucagccuccuauucgagggagagguggggcuccuuggcaagcuccgcaagguggcgcuccaggcaggggaagauaa

SEQ ID NO: 6640 - RNA, 1392 nt, Meligethes aeneus
ggggaguuugguuggcaucccugcaaauuuaccacuggaauuuugacgacuggauugaagguaucaacgaagauggcaacaaaucuaacaaaagccccacuucuucguaaagccgcgacaaggggauacucaaaacuugccccaguuagcggaauucccaacuaugaagucaaaacauccacccuucccaauaaaacuguaguuguugcugccgauaaugauucccaaauugccaggguuucuauaauuuuaagagcugggucaagaaacgaaaccgccgaaaauuuggguauuacccauuuauugagaaauugugcaggacuauccaccaaaaaugccagccaauuuaucauuacucgcaacauucaacaaguuggcgccaguuugaccgcaaccucggaccgcgaaaccauuuccuacacccuugaagguaccagaucggcugucgaaaaaguuauaccauacuuuacugaaguugccacacaacaaguuuucaagccaugggaagucgccgagaauaccggacguuugcaccucgacauugccacccgcccauugcagguuagagcaauugauuuguugcacaaagccgcuuuccguaccggucuugguaacucgauguucauuccgaaauuccacauuggcaaaauuucuucggaaucuuugcaacacuacgugugcgagaacuucaccagcggccgcgccgcugucguugguuugggaauggacgaagccgaaguaaccaagaucgcucaaucuuugcacuugggaucuggggaaggucaaacaagaccaucuccauacaaaggcggugaaguaagauccgauaagggaggagauuuggccuuugucgccaucgccggcgagggugcgucucuugccaacgccaaggaagcgcucgcuuucgccguccuucagagggccaucggaaccgguccucaagugaaauggagcgcgagagauaacggucugcucucgaaggcagucggcaacgccgaauucgccagcagcgccaucaacgcgaacuacucugacaccggauuguucggcguguuggucgccguucccgccaagaacgccuccagcgucgugcagagcaccuacaaguucaugaagugcaucaacguguccgaggaagacgucuccagaggcaagaaucaauugaagaccgcucuucucuuggaaggagaaaauggugccaacgcuaucgaaaaucuugcaacccaagccguacucaccggaacagcccacucugcuaccagccuggcugcucuaguggauuccaucucugcuucagauguucaacaagcagccaacaaaguacgaucaggaaaauugucaguugcuucuguaggaaaucuaacuggaguaccauacauggacgagcuuuaa

SEQ ID NO: 6641 - RNA, 333 nt, Meligethes aeneus
augagacgagcucaugcuggcuaugguuaugagccguuaucgcaaaauucuaacgagauagaggacgaaaaugaucgaaugacuaaugaguuaaaagacaaaauuggcguuuugaaaucucuaucgauagacaucggcaaugaggugagguaccaagauaaacugcuuaacgaugucgacgacgacuuggaaaggacugggggguuccuugggaauaccaugaaucgagugaugcgacuaacaagggggggacauaacuauuacauuauuuacauguuuuuguucucuauauuuguguucuuuguuuuauaucuaguacuuaaguuuagauaa

SEQ ID NO: 6642 - RNA, 684 nt, Meligethes aeneus
uugguuaaaaugacgacuuuaucacccagacaggcucaaagggaacauguuuuggcgguaucccgugacuucgugucccagcccagauuaacuuacaagacaguuucugggguaaacgggccuuugguaauuuuggaagacguaaaauucccuaaauucuacgaaauugugcaacugaaguuggcugauggcagcauucguucgggacaaguuuuagaaguaagcgguucuaaagccguaguacaaguuuuugaggguacaucuggaauugaugccaagcacacgguaugcgaguucaccggagauauuuugcguaccuccgugucagaagacauguugggacguguuuucaacggaucuggaaaacccauugacaaaggacccccaaucuuggcggaggacuucuuggacauccaaggucagccgaucaacccguggucgcgcaucuaccccgaggagaugauccagaccggcaucacggccaucgacgugaugaacucgaucgcucgcggccaaaagauccccaucuucucugccgcgggguugccgcacaacgagaucgccgcgcagaucugccgucaggccgggcucgucaaggugcccggaaaaucggugcucgacgaccacgaggacaacuucgccauaguguucgccgccaugggcgucaacauggagacggcgcgc

SEQ ID NO: 6643 - RNA, 684 nt, Meligethes aeneus
augagucgaaaccaaaguggaaaucgcuuacaaguucccaaugauuuaagagaaguuuuauuggaauucacuauaaguuaccuccuagaacaaccaggagauguuguggcuuaugcagcugauuauuuucaaagauuacgggaaaccagaacuacuuccuuaaucuaugggggcucagggacacaggauuugaugucuccugaugagucuacaauaucaggagaagaagaaccaccaauagaacguuucacguccagacguaaaucaguauucgccgagacuuacgaucccgaagaggaugacgacgaugaugacggcauuaagacgguguuucccaaauccgacgagcagaggcaaagauugucagaagcuguucguaacauauuguuauuuagaucguuggacaaagagcagaugagcgagguuuuggacgccauguucgagagaaaaguucagcaagaugaauugguuauuaagcagggagaugauggggacaacuuuuauguuauacaaagcggaauauuucaugcuuugguggcuagcgaaccagcccagguuccgacacacauccacacguacgauaacgccggcaguuuuggcgagcuggcuuuguuguacaacaugccacgugccgcuacaauuaaagccgucaccaccgguuccuugugggccauggaucgucaa

SEQ ID NO: 6644 - RNA, 2424 nt, Meligethes aeneus
augaguuacaugcaggcaaaccaaaaucggccaaugggccaacaaggacacuaucaacaggguccuaacgaccuuccaaugccuucgucaaaagaacaaacccucauguggcagcagaacuccuacaugggugacucaggcauccauucuggagccgccacucaggucccgucgcucaccggcaaggaggacgaagagauggaucuguuugaucucgaccaagguuauggucaggguuucacccaagaccaaguggacgagaugaacaaccagcucaaccagacucgcucgcaaagggugcgcgccgccauguuuccggaaacccuggaagaaggcaucgagauccccucgacccaauucgaucccggucaccagaccgcgguucaacgucuggccgagcccagucaaauguugaagcaugccgucgucaaucugaucaacuaucaggacgaugccgaucuggccacacgggcuauucccgaguugaucaaacuuuugaacgacgaggaucaaguggucgugucccaggcagccaugaugguucaccaacugucgaagaaggaagcuuccagacaugccaucaugaacagcccgcaaaugguugcugcguugguacgcgccaucucuaacucuaacgauuuggaaaccacuaaaggcgccguaggcacucugcacaaauugucgcaccacaggcaaggucuacucgccaucuucaagagcggcggcaucccagccuuggugaaacuccuuucauccccaguggaaagcguucucuucuacgccaucaccacccugcacaaccugcugcuucaccaggacggauccaaaauggccgugcgucuggcaggcggucugcagaagauggucgccuuguugcaacguaacaacgucaaguuuuuggccaucgugaccgauugccugcaaauuuuggcuuacggcaaccaggagagcaagcugaucauccucgcuucgcagggaccgaucgaguuggucaggaucaugagguccuaugauuaugagaaguugcuguggaccacauccagaguuuugaagguucuuucgguauguucgagcaacaaacccgcgaucguggaggccggagguaugcaagcccucgcgaugcacuugaccaacgcgagcgcccgucuggugcaaaacugccuguggacguugaggaacuuguccgaugccgccacgaaaguggacgguuuggaggcccucuugcaaucguuggugaccguuuugggaucgcaagacgucaauguggugaccugcgcggccggcauuuuguccaacuuaacgugcaauaaucaacggaacaaaguuaccgucugucaaguuggaggcgucgacgcccucguaagaacaaucgugaacgccggcgaccgggaggagaucaccgagccggcagugugcgcccugcgucaccucacuucgcgucacguggaaucggagauggcgcagaacgcuguucgucugaacuacggcguccaggugaucgucaagcugcugaacccgccuuccagauggccgcugaugaaggccgugaucgguuugaucaggaaccuggcgcucugcccggcgaaccacgcgccgcuccgggagcacggcgccauccaccauuugguucaguuguugaugcgggccuuccaagacacucagaggcgugccagcguggcaaguggugguagcaaucaaccggguacuuaugcugacggaguucgcauggaggaaaucauagagggcacugugggugcuuugcauauccuugccagagagucgcauaaucgugccaucauucgacagcaaaugguugucccaauauucguuggacuucuguucaacgacaucgaaaacauacagcgcgucgcagccggcguucuuugcgaacuugccgccgauaaagaaggcgccgaaaugaucgagcaagagggcgccaccuccccacuaaccgaacugcugcauucaagaaacgaagguguugccaccuaugcggcagcgguguuguucagaaugagcgaagacaagccgcaagacuacaaaaagagacuguccauggagcugaccaacuccuuguuccgcgaagagaaccucuggaaccccgaucuuggaaucgguuccgaacuacaggaaauuuugagucccgagcacuacgauaaccuguauccacaagaucccccaaguguacacagcagccauggcaguagaccauaccaacagcaaggguaugaccagauaccaauagacaugcaagguuuggagaucgguucccacggaggcggcaacggcuccaccuacagugcaauagaugcgauggaagucaccagcggugaaccggaucucaacuuugacgguaucgaucaguugccuaccccgccacaagacaacaaucaaguggccgcgugguacgacacugacuuguaa

SEQ ID NO: 6645 - RNA, 807 nt, Meligethes aeneus
auggcgcgaaacgcagaaaaagcaaugacaacuuuggcacguuggagagccgcccaguugggagaaagcgaaaaacacaaaaaacgucgccccuauuuagccucugaauguaaaagccucuaugcuugugaaaaauggaggaugcagauuauucgggagauugccaaaaaaguggcgcaaauucagaaugcugguuugggggaauucaggaucagggauuuaaaugaugagauaaauaaguuguugagggagaaacggcauugggaggaucagauuaaggaguuggguggcccugauuaucaacguguuggaccacguauguuggaucaugaagggaaagaaguuccagggaauaggggguauaaauauuuuggggcugcuaaagaguugccaggaguucgagaguuguuugagcaagaaccuccgccucccccaagaaaaacuagagcugaacucaugaaggacauugaugcugacuauuauggguacauggaugacgacgauggcauccuacuuccauuggaaacaaaagcugaaaaaacaucaauucagaagaaaguggcagaauggaaagagaaaaaggagaacaggcuaaacaaagcuucagaugaugaagaugacgaagaggaugaaaauauuuaugcgguggaagaaucugaugaggaagagcaaccccaaguaauagacgggucccagcaaagauuuguugcucauguuccagugccgucccagcaagaagucgaacaggcuuuguugagaagaaggaagcaagaauuguuggacaaauauggggcacacgaagauuag

SEQ ID NO: 6646 - RNA, 648 nt, Meligethes aeneus
auggcucaagaacaggaaaugccuucauucaaaugcguuuuggucggagacgguggcacuggcaaaaccacguucguaaaacgucacuugaccggugaauucgagaagaaguacguggccacacuggguguugaagugcacccgcugguguuucacaccaacaggggggcuauuagguucaacgugugggacaccgcgggccaagagaaguucgguggccugcgagacggcuacuacauucagggacagugugccauaaucauguucgaugucacaucucgugucaccuacaagaaugugcccaacuggcacagggaucucgugaggguuugcgaaaacaucccaaucgugcugugcggcaauaaagucgacauaaaagauagaaaagucaaagccaaaagcaucguuuuccacagaaagaagaaucuacaguacuaugacaucucugccaagucgaauuacaacuuugaaaagccguucuugugguuggcuagaaaacugauuggcgaccccaacuuggaguugguugccgccccugcuuuggugcccccagaagugcaaauggacccccauuggcagcaacaaauugaaaaggaucucaaagaggcgcaagaaacggcucugccggaagaugaugaagauuuguaa

SEQ ID NO: 6647 - RNA, 480 nt, Meligethes aeneus
augacgagugcuauaacuguugguacuuuaauaauaaaacuggugaaguugguucuuaacuucauuauuauuauuauguacaggguggguuuucaagguuacuucuuaggaguugguggaaccuggaauuuaaaugaagaaaaaaaugcagaugcugaaauuguggcaucgggaauuuuuguuggguacaucauauacacugugguuucucugauuagcuuuuguuuugcugcaggugaucauaaaacaaccuuuacugauguuuuaaugaacguuguugggguuuucauguggguagcaguuggugcaacugcuuuacauuacuggcaugguuaucuggcugaacauaaauauaccgcuauaaacucagaaagacagguugguuuagucauggguucucuauguauuauaaacggggcagcguauuugguagacagugcacuuucaauuauauuccuucugcagacaaaauuggcauaa

SEQ ID NO: 6648 - RNA, 2472 nt, Meligethes aeneus
augccacgaauuaugauaaaggguggcguuuggcgcaauaccgaggaugaaauccuuaaagcggcuguaaugaaauauggcaaaaaccaguggucucgaauugcuucauuacuacauagaaaauccgcuaaacaguguaaagcacguugguuugagugguuagauccuagcaucaaaaaaacugaauggucacgagaggaagaugaaaaauuguuacauuuggcuaaacuuaugccaacucaauggagaacuauagccccaauaauuggcagaacugcagcccaguguuuagaaagauaugaauauuugcuugaucaagcucaaaaaaaggaagagggugaagauggagcugacgaucccaggaaacuuaaaccuggugaaauugauccaaauccagaaacuaaaccugccagaccugaucccaaagacauggacgaagaugaacuugagauguugucugaagcuagagccagguuagccaacacucaagguaaaaaagcgaaaagaaaggccagagaaaagcaacuugaggaagccagaagguuggcagcacugcagaaacguagagaauuaagggcggccgguaucgaggucaauucucgaagaaaaaagaaaagagguguggauuauaaugcagagauacccuuugaaaaacgcccggccauuggauuuuaugauacuucuucagaagcuuuggauccaauggccccagauuucuccaaaaugagacagcaacaucuugauggagaguuaagaagugaacaagaagaaagagaacguaaaaaggacaaggcaaaacuuaaacagagaaaagaaaacgacaucccgcaggcuauguuacaaaaucaagaacccgccaagaaaaggucgaaauuaguuuuacccgaaccgcaaauuuccgaccaggaacugcaccaaguggucaaauugggucgugcuagcgaggucgcaaaagagguagcugccgaaaguggcguggaaaccacagaugcccuauuaaacgacuacacaguaaccccacaagcugcagcuacuccaaggacaccagccccacagacagacagaauucuucaagaagcccagaacaugauggcgcuuacucacguagacacuccacuaaaagguggucuaaacaccccccuucacaaccccgauuuuagugguucauuaccucaagcucuggccguugccacgcccaacacaguccuggccacgcccuuccggucgacgagaagcgacgguggugccacucccggaaguacaggcuucaugacgccaaagagcggagccgugguaccuguugggggaaccauaccaggcaauuucacucccucaguaagagauaagcucaacauaaacgcugaagaagguauugaaguuggcggaacucccgcuaagaauagaauguuccagacaucuuuaaaagaacaauuaaaaaugggucuuagcaguuuaccacaaccgaaaaaugacuacgaaauuguuguuccugaacaggaagacgaaaaaaugccugaacaugcucaggagcauauggucgaagaucaagcagacguugaucaacguuaccaagaagaacuaaaagcgaaggcagaacgcgaauuggcccugcguucgcaagucauccagagagaauuucccagaccgcacgacguuaacuuggcaguguugcggccgccgcacgaguccuacucucuaacggaccuccagaaggccgaggaacuaaucaaaaccgaaauggucaccaugcugcacuacgacaaccuaaaaaacccgauaccgaccaccaccaccaagcgaucaaacuuaucgcaagcgcagcaacuggcguuccucgagcaacauccauacgaaaauuauaagcccgaggauuuggacguugccaagguucugcuuaagcgagaaauggacgucgugaagcacggcaugaaccacggggagcuuccguuggaugccuacacccaggugugggaagagugccuuggacaaguguuguucuuaccaaaucagaauagguacacucgugcaaauuuggcaagcaaaaaagacaggcuugaaucggcagaaaaaagauuggagcaaaaucgaucacacauggcuaaagaagcaaaaaaagccgcuaaaauggagaaaaaacuuaagaucuuaacuggugguuaucagucuagagcucaggucuuaauaaaacaguugcaugaucuuuuugauaauauagaucaagcaaauuuggagcuaaauacauuuaaguuuuugcaagaacaagaaaagagugcuuugcccagaaggauacagucucuaacugaggauguaaauagacaaauggaaagagaaaaagcccuccaacauaaauauggggaacuacaguuucaaaugaaagaaauucaagaucaauacucucaaauucauuuagaaguuaauggaauucaagaaaaucaagaaaauaugguugaagaaaguacagaaguugaauaa

SEQ ID NO: 6649 - RNA, 471 nt, Meligethes aeneus
augcaauuuauguuguuauuuagccgacaaggcaaauuacguuuacaaaaaugguacaaugcucauccagacaaacuaaagaaaaaaauuacgagggaguuaaucacaacgauuuuggcuagaaaaccaaaaaugugcagcuuuuuggaauggagggaccuaaaaauugucuacaaaagauaugccaguuuguauuucuguugugcaauugagcaagaugauaaugagcuccuaacauuggaaauuauacaucgauauguugaacuguuggauaaauauuuuggaagugugugugaguuggauaucauuuuuaacuuugaaaaggccuauuuuauacuugaugagcuacugcuuggaggugagauacaagaaaccaguaagaagaaugucuuaaaggcaauagcugcucaggauuuguuacaagaggaggaaaccccccaaggauuuuuugaugaccacgggcucggcuaa

SEQ ID NO: 6650 - RNA, 813 nt, Meligethes aeneus
augcaccgacuaaacuacgcguuacugcguugcucaauaacaaaaucucacaauggguugcgcuuguauucgaaagagcagcggcggcagacuuucauaucgcguuuguacgacaauuuccgcgacgaaauggcgaagaacaaggaaaugaaagagucgcugaagaaauuucgagaggaggcccaaaaauuggagcaaagugaugcguugaaagcugccaggcacaaauuugagacuguagagaaggaagcuagugagggaaguaaaguguuuaaggagaaguuugauaguauuaaagaaaaagugcaagggguuguugacgaaguggguaaaucagauauugcaaaaaaagcugguaaaaucucugaagguauugguaaaacaaccaccucauucacggaaaaagcacaagaaaucggcaaaacaagcgcauuucaaagcauaucgcagacagccgaagcaguuaaaaaagagauugacacuacaaguauggagggcagaguuuaugugagucccacaaaguuaaggaagagaacagagacaucugcagugcaaaacgugaaguucuaugaacccaaugaggaagcaacaggcauagaacuacacaaagacucaaaauucuaccagucguggcaaaguuucaaagacaacaaccccuacguucacaaaguaauggauuggaaauuaaaguaugaugaaagugauaacccccuuaucagagcuucaagaguucuaacggaaaaagucucagacguugugggggguuuguucucgaaaacggaacucucagaaacccucacagaaaucugcaaa

SEQ ID NO: 6651 - RNA, 780 nt, Meligethes aeneus
agcgauagugaugucgaguuacaagaggcacuugcagaugguagauuaaaaccaggucuaaacauuguagaucaaaagccuaaacaguuuguaaacaacacaacugguuuaaaccagaaacuggaagaaauaaagucaucuuugccauggauugaauuacuugauuguguuaacaaacaagcuccacuugcaccugaaauggcagcacagauguuggaacaagagcaaaaaagagagaaucaauuaaaaaacaacaaaaaguugcaacaauuugcucccacagaugauccuguauugaacgauuucaaaagagaaaugauguuucacagacaagcacaagcugcagugcaagaggcuauaccaaaauuaaaagcaauggauauugcuacuaaaagaccagacgauuauuuugcggaaauggcuaaaacugaugcucauaugcaaaaaauuagagagcauuuaaugcaaaaacaacagcagcaacaaaggagugaacgggugaagcaguugagaacacaaaggaaagaagggaaaaugauacaaauccagacgaaacuucaaagacaacaggagaaaaaggaaaugauggaucaaguaaagaagguaagaaaagggcuuuccaaagauuuggacuuuuuggaugguaagaaaaauaaggccauaucuagaaagucgcuggaaaaaagaaaaaugagggauaagaaguuuggcuuugguggaaaaaagaaagguaugaaaaugaauacuaaggaaagugcugcugauauaagugaguauaag

SEQ ID NO: 6652 - RNA, 3609 nt, Meligethes aeneus; identical to SEQ ID NO: 6626

SEQ ID NO: 6653 - RNA, 1506 nt, Meligethes aeneus
augaaucccagugccccaaauuaccccauggcgucuuuguacgucggggauuuacacucagauauaacugaagcuaugcuguuugagaaauuuuccacugcuggaccugugcuguccauucgcguaugcagagauuugauuacucgucguucuuugggauaugcauacguuaauuuccagcaaccuguugacgccgaacgugcuuuggauacaaugaauuuugauguuaucaagggacgcccgauccguauuauguggucccaacgcgauccuucgcugagaaaaucuggcguaggcaaugucuucaucaagaaccucgaucgcuccaucgauaacaaagcuauguacgauacauucucugccuuugguacuauucucaguugcaaaguagcucaagacgagaauggcaccagcaaagguuacgguuuuguccacuuugaaaccgaagaggcagcuaacaaauccauugaaaaaguaaaugguauguugcucaauuccaaaaagguauacguaggcagauuuaucccacgcaaagaacgcgaaaaggaacuuggagaaaaagccaaauuguucaccaacguguaugucaagaacuuuggugaagaucuaacugaagaacagcugagaauaauguucgagaaauauggugucaucaccagcuacaagaucaugagcaaagacgacggcaaauccaaagguuuugguuuuguugccuuugagagcccugaagcugccgaaacugccguugaggcgcuaaaugcagguaaagaauugguggagggcaagccuuuguacguuggccgcgcucagaagaaagcagaacgucaacaggaauugaaacgucguuuugaggcauugaaaauggagagguugaaccguuaccagggcgucaacuuguacgugaagaaccucgacgacaccaucgacgacgaacguuugagaaaggaauucuccccauucggaacaaucaccucggccaaggugaugauggaagaaggcagaagcaaaggauucgguuucguuugcuuuucuucuccggaggaggccaccaaggccgugacggaaaugaacgggcgcaucgugggcacgaagccgcucuacgucgcuuuggcucaaaggaaagaggaccgaaaagcgcauuuaacgucgcaguacaugcaacgcauggccaacaugcgcaugcaccagaugggccaguucauccagcccggcucuagcggcuacuucgugccgacgaucccugcgccgcagcgcuucuacgccgccgcgcaaaugaaccagauccgcacuagcccgcgcuggccugcgcagacgcaggugcgcgccggcggcggccagggcggcgccgcagcguacgccggcggccaaggccaaggcggcaugcccagcggcggcggcggcggcuacagggccgccgccaggccgcccaacaaccagucggcggccaugcgcggcaacaugaacgugccucggcccaucacgggcggacagcagcagcccggcggc

SEQ ID NO: 6654 - RNA, 2841 nt, Meligethes aeneus
uucgugugucaaaaacaagaggcguuugcaaauauuacaaguauuacuaagaaaauaaaggauuuuagauaucacggcaaaaugaccgacucaaaguauuuuacaacaacuaaaaagggugaaauuuucgaguuaaaauccgaguugaacaaugauaagaaggagaagaagaaggaggcagucaaaaaagugauugcaucaaugacugugggcaaagauguuucagcuuuauuuccagacguuguaaacugcaugcaaaccgauaaucuugaauuaaagaaacugguuuauuuauauuuaaugaauuaugcaaaaucucaaccugauauggccauaauggcuguaaauacuuuugucaaggauugugaagauccaaacccuuuaauaagggcgcucgcagugcguacuauggguugcauaagagucgacaaaauaaccgaauauuugugcgaaccuuuaagaaaaugccuaaaagacgaagauccguacguacgaaaaacagcugcaguuugugucgccaaacuguacgacauuucaucggguuugguugaagaccaggguuucuuggagcaacuuaaagaguugcuaagugauucuaaccccaugguugucgccaaugcgguagcagcucuuucugaaauaaaugaaaguaguccaacuggacaaccauugguugagcucaguacaaguacaauaaacaaacuuuugacugcuuugaacgaauguacggaauggggacaaguuuucauccuugauucuuugucaaauuacacucccagagaugaaagggaagcucaaagcauuugcgaaagaauuaccccacgauuggcccaugcaaaugcugcuguaguccugucagcugucaagguuuuaauaaaaaugauggagauauuggccggugauguugaguuuuguaauacucugagcaaaaaauuggccccaccuuugguuacacugcucaguucugagccugaaguucaguauguugcuuugagaaauauuaacuugauugugcaaaagaaaccugacauuuugaaacaugaaaugaagguuuucuucgucaaauacaacgacccaaucuacguaaaacucgaaaaacucgacaucaugauccgcuuggcgucucaagccaacaucgcucaaguuuugagcgagcucaaagaguacgcaaccgaggucgaugucgauuucgugcgcaaagccgugcgcgcaaucggaagaugcgcuauaaaaguugaaccuucagccgaaagaugcguaucgacuuugcuggauuuaauucaaaccaagguuaauuacguugugcaagaagccauuguggugauuaaggauauauucagaaaauauccaaauaaauacgaaagcauaauauccacauuaugugaaaaccuggacacucuagaugagccagaggcgagagcuuccaugguuuggauuauaggcgaauaugccgaaagaauugacaacgccgacgaguuauuggacagcuuuuuggaagguuuugccgacgaaaacgcucagguucaacugcaacugcuuaccgcuguugucaaguuguucuugaagcguccacagcacacccaagguuuaguucagcacgugcuaagucuggccacacaggacucagacaacccugauuuaagggaccgcgguuuuaucuacuggagauuguuaaguacagacccggcagcagcuaaagaggucguuuuggccgauaaaccucuuauuuccgaagaaaccgauuuauuagaaccaacacuguuggacgagcugauuugccacauuucuucuuuggccagcguuuaccauaaaccgccgaccgcguuuguagagggaagaagcgcagguauacgaaagacgcuaccggccagacaagguucagcugaugaaaucggccaagaagcaaccguuauucccaaccaggaaagcauugugggcgaccuacucuccauggaucuuggcgcuaccgccccagcugcgccccugggcggcccugcggcaaccaguaacauugaccuuuugggcggaggauuggacgucuugcuuggaggcgguaguucagacauaucaacggcaggcggugccgcuccuucaaccacaggucucuuaggcgacauuuucggcaucuccuccucccccuccauguacaccccaccaaaaacguguuggcuaccggcggagaaaggaaaaggcauggaaauacacgguacauucucccgcaaaaacggacaaauguccauggacaugaccuucaccaacaaggcuaugcaagcuaugagugguuuugcgguacaguucaauaaaaacaguuuuggcgugucucccucagggcccauaacuaugacccccuugcaaccagggcaaucuuuagaguauucuuuaccuuuaaauacuacagggccuguacaaagaauggauccucuaacaacguuacaaguugccauuaaaaauaauguugacguuuucuauuuugccugucaaaugccgauacaaauuuuguucacugaggaugguacucuagauaaaagggucuuuuugacaacauggcgcgauauaccaucagccaaugaaguccaguauacaauaaacgauuuaaauggaaacacugauacagucuccaauaagaugguuaugaauaauaucuucaccaucgcaaaaagaaacguggagggccaggauaugcuguaucagucccugaaguugaccaacaacauuugggugcuauuggagcucaaauugaccccaggggucacuacugcaacuuugagcuugaaguccagaucuguugaaguugcuccauauguauuccaagcuuuugaagccguuuuaaagaauuguuag

SEQ ID NO: 6655 - RNA, 498 nt, Meligethes aeneus
augccaccaaaguuugauccuacugaaguuaaauacguuuaccuaagauguguuggaggagaaguaggugcaacaucaucuuuggcaccuaaaauugguccacuugguuugucuccaaaaaaaauuggugaugauauugccaaaggaacugcugauuggaaaggucucaaaaucaccguucagcugaaaauucaaaaucgucaagcagccauuuccgucgugccuuccgcagcaucucuuaucauaagagcucuuaaagaaccaccacgugauaggaaaaagcaaaaaaauauuaagcacaguggaaacauuacauuggaugauaucauuucuaucgcaagacaaaugaaaccacguuccauggcuaaacaauugucuggcacaguuaaagaaguucuugggaccgcucagucuguugggugcacaauugauggaaagccaccucaugaccucauagacgaaauaaacaaugguaguuuggaaauaccagaagaauaa

SEQ ID NO: 6656 - RNA, 1080 nt, Meligethes aeneus
augagggcuuuaauuuugguugguggcuacggcacaagacugagaccuuuaacgcuaagcaggccaaaaccuuugguggaauucgcaaacaagcccauuuuguugcaucaaauugaagcuuuggucgaagcugguguaacugagguaauauuggcuguaucauacagagccgagcaaauggaagaagaacuaacugcagaagccaccaaauuagguauaucaauaguauuuucccaugagacugaaccguuagguacugcuggaccaauugcucuagcuaagaacauuuugcagaaaagugccaagccuuucuuuguacuaaacucugauauuaucugcgauuuuccauuuaaagaacuggcugcuuuucacaacagccaugguaaagaggguaccauuguugugaccaaaguugaagagcccuccaaauaugguguaguuguauacgaugacgguaacugcauugaaaguuuuguggagaaaccccaagaauuuauuuccaacaaaauuaaugccggcuuguauauuuugaauccaaguauuuuaaauagaauugaacuccgucccacuucuauagagaaagagguuuucccuggaauggccucugauaaggaauuguaugccuuugaauugcaaggauucuggauggauguaggccagcccaaggauuuccuaacugguaugugcuuguaucugaagcauuuaagaucccagaacucugaaaaauuguacaagggaccagguguuguugggaacguccuaguucacccuucagcuaaaauuggcucaaacugccaaauugggccuaaugucacuauaggaccggggguagucauugaagaugguguuuguguuaagaggugcacaauccuaagagaugccaccauaaaauccaacacuuggauggaaagcuguauuguggguuggaaaugcagugugggaagauggguaaggauggaaggaacuacagucuuaggugaagauguuauugucaaagacgaaacauauauuaaugguggucaaguguugccucacaagaacauugccaauucaguuccugaaccacaaauuauaauguaa

SEQ ID NO: 6657 - RNA, 894 nt, Meligethes aeneus
ggggaguuagacgaacccaaccuaaaaauggccgacggggacgauauuguaacggaucaagaaaaaguccguauaguuacggacuuuauauugcauucgccgcccggcgaauucaaugagguguucaacgaugugcgaaaguuguugaguaacgaugauuuguuaaaagacggggccggcggagcuuucucgcaguacaacaaagaucaacuuaccccaguuaggaucgagaacgcugaccauuugguuuuaauaaccgaauacaacgaucuaggaggcugcagauucuucgauccaagaucaaaacagagcuucagauacgaccauuugcgcaaagaagcgucugauuaccaggcauucaguccggacagugcggcggaaccuuggcgcgccgcacuagaugccgaauuuauccauuacacaagaaaccacuacaaagauggaguauccaguguuguuucaaggaaccagggagguguuauaacccuuacugccugcauugaagaccaucaguuucagcccaagaacuucuggaauggcagguggagaucgcaauggucuauuuugaucaauucgggggcugccacugcugaagucaggggcauacuuaaaguccaggugcauuauuaugaagaaggcaacguccagcuggugagcacgaaggagaucaaggaaucgauuucuguaacgagugaggcgcagacagccaaagagaucgugcaauuaauugagacagcagaaaacacuuaucaaacugcgauuucugagaauuaccagaccaugucggacaccacuuucaaggcuuugaggaggcuguugccuguaacucguaccaaaauugauuggaacaaaauaguaucguacaguauuggaaaagaauuaaagacucaauaa

SEQ ID NO: 6658 - RNA, 1743 nt, Meligethes aeneus
ccuacguugucucaauggcaauacgauguaaugccaaaguacauguguuguuuguggcaggaagaacaggcugucgguugcgagacuuugcguuuugaacgaagacccacgcaagauugcguagcauaucaagcuccagguauagcugguaucuauggcgacccccacaucaucacuuucgaugauuacccuuacacuuuuaacggcaaaggagaauucguaauucuaaaaacaguuucgaagacgaacaaccuggaaauccaaggccguuucgaagaaaugccaaugaacgcauacggugacgucaaagccacccaacuuuccuccgugguugccaaagguaacucuucaaccaucaucgaaauccgcuccagaccucgagaagccagauggcgcuaccgucuggacguucuggccaacggcaaacaaauuuacuucgacagaccaucguugaaauuccagcacuucuccggagucaccguauacacacccacuuacaucuacaaccaauccgaaguuguuguuauguuugauaacggagccggucuggaggucaucgaaaaugauggauuuuuguccgccagagucuaucuacccuggaguuuuauuaacaagacuagaggccugcugggaaacuggucauucaaucagcucgacgauuuagccuuaccggacggcaggauagucuccuuaccguccaaagaugaggaucaaaaaaggcuguacgacgauuuuggucugaaauggaugcuggacgauagcgacguccccgaugucggacgcgccauguuuuaccgcgaauucggcaggacuucuuccaccuacaacaacaaaacuuucguacccgaguacaaguuuaagccugaagauaucauaccggcgaaucgguccaaguuuaucgaagaugcuuaccaaauaugcuucacggacaacagagagugccucuaugauuauucggugacguugaauagagacguggcucauuucacgaguaacuacaaggcgacuauauuaaaaaugaaggagauaagucgggacaaaauuauaucuugcgguguccuggaaacgccccgguucgguagaaaaaauacuuaccucuuuacuccggguacgaagguuacuuaugaauguaauaccgacuuuauuuuggugggagacccgagaagaacuugcuugccgaaugguagaugggacauaccgaauuacggauacacugaguguuuacgucagcaggaguacuccucuaggaacgcagcuacgacuuggggaauaauucuggcgauucucauaccauuaauuuuguuguugcuauacggggcguggagaguuuaccaaaacuacaucgacaccgacgauacuacguggaaguacgacccugcgucucguagggccucuagcgugcaaaaacugaacacuaaggcgccuguggaagaaucggaggaguacgaaaccgauuaugacgaugccgaugacgaggaagucaaaccgagauuaagaagcaacucgcagacguccaaguccagcaauaaacguaggagcuacgaaaaaagcuacaaaaccaacgagcccauaaagggucuuccagagacugauuuugaggagaaaccaugggaccccgaggucgacggcagcguuuugucgagccccaugucaucacccauacaaagaccgccaccuuugacuuuaccgcagaaaaaacccaccagauauagcagucaaaguaguacuguaacagacguguag

SEQ ID NO: 6659 - RNA, 2715 nt, Meligethes aeneus
augacugaacaccuaggguuaaaaugggacccgaaaaacuuagaaauaaggacaaugucuguggaaaggacauuggaaccuuugguuuugcaaguaaccacacuggucaacaccaaagggcccagcaagaagaaaaaaggcaaaucuaagagggcaaaugcuuuggucagcacugucgaaaaagccacagaaaauuucauugaaaagggugaacugauugcauaugaaaauccugauauaaccagggaaaugcugaaugcuguagaagaagucaagaaaacagguacucaaaugagcauagccgcucgcgaauuuuccgaagacccuugcucaucccugaaacgcggcaacaugguccgcgcagcuaggaaccugcuaucagccguaaccagacuauuaauucucgccgacauggucgacgugcacuuauugcucaagucgguccaccucgccgaagacaaccucgaaaaagugaaaaacgcuucgagcaacaccgaacuaaucgacaacaucaaaaacuucggccaaaacgugaacgaccuaaugaaccaagcugccaaacgucaacaggaacugaaagacccgcagcugcgcgacgauuuagccgccgcaagggcagugcucaaaaaacauuccaccaugcugcugacagcuucgaagguguacgugcggcacccggagcuggcggccgcaaaagccaacagggacuacgugcucaagcaagugugcgaagcugucaacacgaucaacgacguuugccaaggacggccgcagcagcccacgucggggcccuacgacgggcccggcgagcucgcagcugcgcucgacgacuucgacgaucacacuguuauggagccgcuggccuacaacgagguccacacgagaccuucuuuggaagaaagacuggaaaguauuaucagcggggccgccuugauggcggauuccagcugcaccagagaugagaggcgugaaaaaauuguggccgaguguaacgcgguccgucaggcucugcaggaucuucuuucggaguacaugucuaauaugggaaacaaugagaagagugaagguuuaggcagagccauugaaaauaugggaagaaaaaccagggauuuaagaaggcagcugagaaaggcaguuguugaucauauuucugacagcuuuuuagagacgaacgcuccgcuuuugaucuugauaaaagccgcgcagaacggcaacgaaaaagagguugaagaguacgcucugguauuccaagaacauuccaauaaguugguagagguggcaaaucugguuugcagcaugucgaacaacgaggacggcgugaagauggugcgcuacgccgcagcucaaaucgacaaucuuugcccggaagugauaaacgcggcgcgcauccuggcggcgaggccgcgcagcaaagucgcucaagagaacauggacgcguucaagcaaucgugggagaaccaggugaggauccucaccgaagcaguggacgacauaaccacgaucgacgacuucuuggccgugucagagaaccacaucuuggaggacgugaacaagugcgugcuggcgcugcaagagggcgacgcugagacuuuggacaggaccgccggcggcaucagagggcgcucgagucgcgucugcaacgucgucaccgccgagauggacaacuacgagcccugcaucuacaccaagcgcgugcucgaagccguuaaaguucucaacgaucaagugaugcccaaguuuacgcagagaguucaaguggccgugcacgcgcuaagcucgaauccuucgaaggaaguggacgagaacgauuucaucgacgccuccagguugguguacgacggggugagggaaauuaggagggccguuuugaugaacagggccgacgaggauuuggauccugaagaggucgagcuggaugaucccacuuuggagaccagaagcaaaucgagugcgcauacuggagaacauggcguggacgaguauccagacaucagcgguauaaccacagcucgcgaggcgaugggaaaaaugcccgaggaagacaagcaaaaaauccuccagcaagucgaguucuuccgcagcgagaagcgcaaguucgacauggagguggccaaaugggacgacaccggcaacgacauaaucgugcucgcaaaacacaugugcaugauuaugauggagaugacggauuucacgcgcggcagagguccguugaaaaccaccauggacguuaucaaugccgccaagaaaauuuccgaggccggcaccaaguuggacaagcugacacggcaaaucgccgaucagugccccgaaucgucgaccaaaaaggaucuguuggccuauuugcaacgcaucgccuuguauugccaucaaaugaacaucacaucgaaagucaaggcugaugugcagaauaucaguggagagcucaucguuucugggcuugacagugccacaucccuuauccaagcagcgaaaaacuuaaugaacgcugugguacuaacagugaaagcuucauacguggcuucaacgaaauauccaaggcagggacccguuacuuuaccgauaguguggaagaugaaggcgccagagaagaagccuuuggugagaccggagaagcccgaggaaguucgugccaaaguacgcaaagguucgcagaaaaaaguacaaaauccaauucacgcucugucggaguuccagagucccaccgagucaguuuag

SEQ ID NO: 6660 - RNA, 1077 nt, Meligethes aeneus
auguuuucguucggcaacagcaccaguacgccaaaaacagcgacagguuuuaccuugcccacgucgacuacagccacaacuucagccggcggcuuccagcugaauaucggggcgggggauaacaaaaccucucaaaguaaacccggggucacuuuauucgcagcccccgcagcuaaaacuacagcucccggagugguuuugccuaguuuuggggcuacaacugccacaucaacaacagguacuagugaggcuccgccggcuuuugauauaggugccaguacagcuacauugucuacaacuuucacaccaauuguagggaguucggcuccaaguacaguugguuuguuguuuacugggucugcacagagcacuacauccccuaaguuuuccaguuuggcuacaacaacuucagcagcaccuagccuaacacuagggggcacuacauccacugcaggaacugcuguuuccauaucagcugcagcugcaacuagugccccagcaggaucucucacauuuggccagcuggaagauucuauuaacaaauggacaauugauuuagaagaacaagguaaauuuuucaucaaucaagcuaaacaauuaaaugcuugggauucccuauugauuucaaauggugagaaaauuuugaauuuaaauggaagcauugaaagaguuaaacagcaacaaacucagcugaaucaagaguuggauuuuguuuuggcacaacaaaaagaguuggaagaguuaauugcucccuuggaaaaggauuuaauggauauaccuguuacagauauugaccgcaaucaaauguaccaaaugucagaaaugauagauucacagcuaaaacaaaugucagaugacuuaaaagaaaucauagaacauauaaaugagucccacaaagaugaagaaacaucaaacccuauuacacaaaucagucgcauauuaaaugcccauaugaauucuuugcaauggauugacacuaacacagcacaaauuucaacacauuuggaacaaauuaauaaaaugcaagauuuaaauagaagaaauaugucauuaaauaauucuuuuaaagguuuuuaa

SEQ ID NO: 6661 - RNA, 582 nt, Meligethes aeneus
auguuuauaugggacugguuuacugguguuuugggauauuugggcuuguggaagaaaucuggcaagcuacucuuucuggggcucgacaaugcuggcaaaacuacgcuguugcacaugcucaaggacgauagacuagcacagcaucuuccuacauuacaucccacuucugaggaacugucaauaggaaauaugagguuuacaacuuuugauuugggcggucacucgcaagccaggaggguauggaaggauuauuuuccagcgguggacgcuauuguguucuugauugacgccaacgacagaucgagauucgucgagagcaaacaagaacuugacucgcuacuuacagacgaaaccuuguccaacugccccgugcugauccucggcaacaaaaucgauuugcccggugcggcguccgaagacgagcucagaaauuucuacgccuuguuuggacaaaccacaggaaaagguaaaguagccaggucagauuuggcaggucggccacuggaacuuuuuauguguuccauuuuaaaaaggcaagguuauggugaaggcuuccguugguuagcacaauacaucgauuga

SEQ ID NO: 6662 - RNA, 492 nt, Meligethes aeneus
cuggggugucagaacugucaaaaccaagaacugucaguguuuuguauauuaauuaaauuuacauugaauaaaaacaaaauuaaacacacaaacauggauccuuuggauauccuagaaaaacguauuacagcucuggaacugcaaguauuaccgaaaaauggcgaaauuaauagcgcccaagcuauuacagaacuauuacuacaaacccacaacauguuaacaucagccuugagcugcagagaggcuauaucauccauauuacaacacuuaucgacaauuaacaacuaccuggacccaaacaacggagaaacagaacuugaaacugaagccaagcgacaauaucuacucgaaugcuacccugagauaaaagaaacagugcaagcuauagccacaauaggaagucuaaccucauucacugacucagcgaauaucaaaaaaguuaccgagcuaucucaaaaacuggaagaauuaucagucucaaaccuuggcauc

SEQ ID NO: 6663 - RNA, 1743 nt, Meligethes aeneus
auguccaauucagauguauacaacgauuugacgcuguuuuuuacgacagaaaaguuuuauuuacaaccaaaagccagcgaugaguugauagugauugauagggcgucugaugaggugucuguggccaaaaacugcgggcaaauaccgccgaauucgugcagccaggauuucugcggauuacucggaguaauaaaguugguugcuggccguuaccucaucauagccacccaaagagaguuaguggguaauauagcaggacacgcaguauggcguuuaguucagauaaaauugauuccguacagcagaagcaugcuucauuuaaacacagaacaagcugccgauaaucaagcuuacauaagcauggucgagcaaauucuagcgaccccaaaccauuacuucagcuacaccuacgauuuaacccacaccuugcaaagauugcacgauuuugguccugauuucuggcagcaaucucuacuugaaagggcugaccaaagguuuguuuggaauggcuauuugcucagagaguucaaaggucuagcuggugcuaaaaaauucugccuucccauagugcaugguuucauuuccauuaaccagugcguucugaacggcgcgaauuugucguggauuuugauuuccaggaggaguguucaaagggcuggcacuagauugcacagaaggggaaucgauaaggacgguaauguagccaacuuugucgagacagagcaauugguggauuaucagggcgauaaagcuaguuuugugcagguuagggguucuauaccgcuguuuuggcaucagaaucccgauuuacguuacaaaccacccccaacuuuguuggaaaucgauccccaagaacacaaugccgccugucagaagcacuuggaagcuuuggcgguuuuguacgguaaacaggucaugguugauuugguugaccaaaaaggaucugaggguagauuggagaaggcuuucaaagacaccauacacacuuuggcuuacccuucgguuaaauaugaaccauuugauuuucacgcugagugcaggaagaugcggugggauagauuguccauuuuaauugauagguuggcuuuggaccaggaugagaugggauauuuucuguuguuaagagaugguucguuguccuuacuucaggagggcauuuuuaggacuaacuguauagauugccuggacagaaccaauguuguccaaagcaugcuggcacauagaaaccuggaaauaguccugaaaaaauuaaauguaauccagacaaaucaacggcuggaagagcaguacacuuucgagcauuuauucaaaaacgugugggcagauaaugcagacguuauaagcacucaauauucgggcacuggugcccugaaaaccgauuuuacccguaccggaaaacgcacaaaguuugguuugauucaagacggaauaaacucgaugacgcguuauuacaaaaacaacuuaucugauggcgugcgccaagaugccauagauuuguuucauggaaaugcugaaguuauuucgccucuuagaaucgacagggguuggcguuacaugacauuccccucuguauuacuaguagcuguggcaauguuuguugcuucggcuguacugccugcagaauauuccaccgagucucuguuguacuugcuguuuuggggguccauggugggagcuucaggccuaaauauacucaaguaugguaucgaguuuguggauaaaccuagacuaacucaguccuaa

SEQ ID NO: 6664 - RNA, 1632 nt, Meligethes aeneus
augccaccuacaauucaaaacgggucaaaugccgcugaaaagcgaccugugaaaccagcagaaaaaaggucugauuuaauuugcaaaguaaaauauuguaauacacuucccgauauaccguucgauuuaaaauucaucucguacccguuugaaccgaccagauuuauucaauauaaucccacaucccuggaaagaaauuauagauaugaaguauuaacagaacaugacuuggguguaggaauugaccuuauuaauaaggagauauauucuguugaauuuggugcacagcuggauccugcugacgaaaaacuuuuggaagaagacauucuaacaccacaagauucuaaaagauccagacaucaugcuaaauguguguccugguuacgucguacagaguacauuuccacagaacagacaagauuucagccacaaacaauggacaaaguggaagccaaaguugguuauaguauuaaaaagaaccuuaaaaaugagacuuuguacauggaucaugacucucagauaagagccauugagaaaacguuugaugauacuaaaauucccauugaaaagcauuacagcaaaccaaaugugguaccaguugaaguuuuaccgcuauauccagauuucaguuuguggaaauauccuugugcacagguuauuuuugauucugauccagcuccuguaggcaaacagguuccagcucaaauugaagaaaugucucaagcuaugauucguggugucauggaugaaaguggugaacaauuuguugccuacuuccuuccaacugaagauacccuagagaaacguagacaagauuucaucaacaauguugcauaucaagaugaugaagaguaugaguacaaaauggccagggaguacaacuggaaugucaagaguaaggcuagcaagggcuaugaggagaacuacuucuuuguggugcgucaggaugguauuuacuacaaugaguuggagacaaggguuagguuaaguaaaagaagacaaaagguuggucaaccugcaagcaauaccagacuaauugugaaacacagaaccauggauggcaacgaauuuagaaugcagagauacagggaaagacaacuagaaccaccuggugaggaugaagaagaauucgagccggaaccagaagaaauacaacagcaagaugaagaaagucaagcgggauccgaccaagagaaagaagaugacaaagaggaaaaaggaagcagugauggggaaagaucaagggccucgucaagggcaucaucaaaaagauccucuucaagauccagauccaggucuaaauccaaguccaggucaaaaucuagaucgcggucacggucacguucacgaucaaaauccaagucaaaauccagaucaagaucaagauccaaaucgucgucuagaucccguucgcgcucuaaaucaagauccaggucaaggagugccucuaaauccccaucccguuccagauccagaucaaaauccaaaagcaaaucuagaucgagauccaggagcaagucgcaaagcagaucgcgcucaagauccaaaucaaagucucgcucgagauccagaucuggaucggcgucuggaucugauucuggaucggguucuggcaagucugacagugaguag

SEQ ID NO: 6665 - RNA, 1170 nt, Meligethes aeneus
augccgaucgaaaaccucgaagaucagggucuagagaaaaacccggacuuggaguuaacgaauuucaaguuccugcucacuuugccggaauuccgaagcgaucgaaguguacaccaaaaaaucagcgaugcuauaaagaaagacgacauggcgccaugguacgagcuggucugcaaagacgcggguuggaaacuagaugcgaaccuccuaaaacaacuaaaaacaaagaaugaggaacaaauuaagaaacuugaugaggcuaucgaagaugcagagaaaaaccuuggcgagggugagguaagggaggcuuauuugaggaaagccgaguauuacagucguauuggugauaaagacaacugugugagcacauuuagacagaccuaugacaaaacuguuucacugggucaucguuuggacauuaucuuucauuuaauucguauuggguuguuuuuuauggaucacgauauuauugugcgcaacaucgauaaggcuaaaaccuuaaucgaagaagggggcgauugggauaggcguaaucguuuaaaaguguaccagggggcuuacugcauggcugugagggacuucaaaacggccgccacuuuauuuuuggacacuguaagcacuuucaccucguacgaguugauggauuacaagcaauuugugagguauaccguguacacuucgauaaucaguuugcccaggaaucagcugagagauaagguugugaaggguucugagauuuuggagguuuugcauucugagccuuuugugaaggauuauuuguuuucccuguauaauugucaauaugcugaguuuuucacuaauuuggcugaagucgaaagcguucuacguaaagacuacuuccuaaacccucacuaccgcuauuacgugagggaaaugcgaauuuuagcuuacacacaacuucuagaaucguacagaucucuaacauugcaauacauggccgaagccuucggaguuuccaagcaauuuaucgaccaggaauuaucgacuuucaucgccucagguaggcugcacugcaaaauugacagaguuggcgguauaguagagacaaacaggcccgauuugaaaaaugcgcaguucaacucugugguuaagcaaggcgauuugcuuuuaaccaggguucagaaauuaucgagaguaaucaacauuuaa

SEQ ID NO: 6666 - RNA, 627 nt, Meligethes aeneus
aaagauaccaaagaugaauuaagugauauauugggaccgcauuuuaaucuggaggcaauucccaauaugaauaguaaagauguugaagacaucuucaagggcguuuugacugacgaaucucaagagucccaagagagcaaccuauuuccaauacaaucgaauccaguuuucccgccgacuccagcgccucaaaauccaaugccuaauccgauuucuauguugaacccugucguucggccgaccacuuugccgaacguaaaucaaagugcgcugaacucgccucacagcuuuccuccacaaucgccguaucauucugaauauagcaacaguccgcaguuuaguccugcguucucugaaccaccacccaguccauggguuggaagcgauaacucggaaauggacucuucauccggacagucgacuuacaaucagcguucuucggaaaagaugaaggcggacgaaaguuugugugauaaggcgacaauuucugcaguucuuuacgcgaauguuaaacauccugaauggaaaucugaauaucccauuuggacugauagauacaagcagauacugaaaaaguggaggacacugagucaggaucagaaagcuccauucuugcaacaagccagg

SEQ ID NO: 6667 - RNA, 855 nt, Meligethes aeneus
uggcuggacgugaagaacccgcagccggucgccaaccccgucagcuggugccaguucgagauaaacugcucgaacccgggcgacaugggcgcugcgcagagccccaagcccauuccgccgcccccucuggcggucgccgccgucaacaugcgcugcgccaucaaccccaagacccugcagaacgagaucgucaugauuuccugccucacgcacaccagauacgcccuggacaagcagccucccaagccgccuuuugaacaccauuuuugcguguugacuuguccgaaaaguuccaugaugccucuggacuuucacaagcaacugggcaacuacaaggccaccaaaguccaaaaaauggacucggaaaaggcccuauuaaacuacuucaucaaccaauucagccgcauagaccccgacuuggucgugggucacgauuugcagggcuaccaaaucaacgugcucuucgacagauugaaagcgaacggcaacgccgcggccgacaaaaucggcagaaugcgccgggccgacaaguugaagaacgagcgcguucuuuuugucgguagauuaguuugcgacuuaaaaagaucggcuaaagaguugaucaaaucgcggucguacgacuuggacgcccucugcucggcgguguuaagaguuaaggaggguuuaaggguggaguuggagcccgaggaugugcccaagauguaccaaaccucggagaauauccucaaguugguaucuuucacgaugcaggauacuucguauauacuucaaauuauguacgacuugaacgucauaccucuggcgcuucagauaacuaauaucgccgggaauguuaugucgaggacuuugaugggg

SEQ ID NO: 6668 - RNA, 768 nt, Meligethes aeneus
ucauucgccagagcucgcgauuacgacgccacuggacagcaaacgcguuucguccagugcccggaaggugaacugcagaaacggaaggaaguaguucauaccgugacguugcacgaaaucgacgucaucaacuccagaacgcacggauuuuuggcuuuauucuccggggacaccggagaaaucaaaucugagguuagggagcaaaucaacggaaaaguggccgaauggcgcgaagaaggcaaggccgaaauuauaccggguguucuauuuauagacgagguccacauguuggacaucgaguguuuuucguuuuuaaauagggcguuggagaacgauaugucccccauuguuaucauggcuaccaacagaggaauaaccaagauaagagguacuaauuauacuuccccucaugguauaccgcuggauuuguuggauagaaugauuauuguucccacuucuccauacaaugagaaggagaucagggagauuuugagcauccguugcgaagaagaagacugucagaugucggagaacgcgcugggcgugcugacgcgcauagccaaagaaacaucuuugcgguacggcaugcaacugaucaugacguccagccugauaucgcgcaagcgcaaggcgcaagaaaucgacgucgaagacaucaaacgggccuaccaacuguucagcgacgauuccaggucggugcaguuccugagggaguaccagcaagaguucauguucaacgaacuuggugaagacacaauggauaccaac

SEQ ID NO: 6669 - RNA, 1116 nt, Meligethes aeneus
auggcucuaagaacuuacggagauaagccuauaaguuuccagcuggaagauaauggagaguauuacuguguuggaucugagguugguaauuaccucagauuauucagggggucuuuauacaagaaauacccugguauguacaggaggagcauuacgaaugaagaaagaaagagguuaauugauuugggguuaucccaacauguuuuggcgaguaguguuucuuuacuaagagccacagaaguugaggauauaauugagggaaaugaugauaaguauaaagcugucucggugcacaccagcgauccgccgcugguaagggagggcaaaacaaaaaaaaacaugcagugggugccaucguugcccaauuccagccaucuggaugcgguaccgcaagcaacacccauuaaccgcaaccgcguggcugcaaaaaaaguacgaacuuuuccgcuuuguuucgacgacacugacccugaaauuaacgcugaaaacgcuugucagggggagcuacuggugccgauuagguuggacauggaaaucgagggucaaaaauugcgcgacacuuucacguggaauaaaaacgagagucugauauccccagagcaguuugcugaaguauuaugugaugacuuagauuugaauccucuuacuuucguuccugccauagcccaggcuauuagacagcaacuggaggcuuucccccccgaacccccugccauuauggaggagucuugcgaucagaggguuauaauaaagcugaacauccacguggguaauacuucuuugguagaccaaaucgaaugggacaugagcgagaaaaaaaacaaccccgaggaguuugcuuugaaguugugcgccgaauugggguuggggggggaguuugucaccgcgauugcuuauucuguucgcggucaaauaucauggcacgccagaaccuacgcuuuuuccgaggccccauuaccaacaguggagguuccguuuagaucgaccagcgaaagcgacgcaugggcgccauuuuuagagacgcuaaccgacgccgaaauggagaaaaaaauccgcgaccaggaccgcaacacgcggcgcauccggcgcuuggcaaacaccaccacugcgugguaa

SEQ ID NO: 6670 - RNA, 624 nt, Meligethes aeneus
auguuuugcuguuguucuuauagggaggacagaggcaaagguccgauggcugcuauaaggaaaaaauuggugauuguuggugacggggcauguggaaaaacgugccuuuugauuguguuuagcaaggaccaguuuccugagguguacgugccgaccguguucgaaaauuauguugcggacaucgaaguggacggcaagcaggucgaguuggcguugugggauacggccggacaggaggacuacgaccguuugaggccccuuuccuacccggacacugacgucauccuuaugugcuuuuccgucgauucucccgacuccuuagagaacauaccggaaaaauggacaccggaaguuaagcacuucugcccaaaugugccaauaaucuugguaggcaacaagaaagaucugcgcagcgauccgucaaccauuaacgaguuaaaaaagaugaaacaggaaccuguaaaaccacaggacggccgcuccauggccgaaaaaauuaacgcguucgcuuacuuggaguguucggccaaaagcaaggagggcguccgagaaguuuucgagaacgccacgcgcgccgcauuacaggugaaaaagaagaagaaacaucguugcguuuuguuuuga

SEQ ID NO: 6671 - RNA, 3963 nt, Meligethes aeneus
augaacguuaguucaauuauagaccaaacaauggauaauacucgaaugccucuucaaaaaauggagauugcggcgagaaacguugauagaucuuugaacauagauuguucggcaccaagauuaauugaucaauugaauguaaaugcacaaacagggucuacagccaguggucuuauugauaaugauuacccuuuguuaaacgggaucccuuuuacuuugaauaauaugacacaaaucaagacugugaacaauauuccucuuccaccugaaauugucgaucauuuuacucauauucaaugccacugcaugaugggcuuguucccagaaauaaacagagcuugguuaacaguggacagugauauuuauguuuggaccuaugaagaaaacucugauuuagcuuauuucgaugggaucaacgaaaccauuuugugugugggauuaguaaaacccaaaccaggaguuuuucauaauuucauaaaauauuuguugguucuuacgacgucaguggauauuguuguguugggaguuacuuuuacugaaggggcugagggggauaaugaugagauacagcuuauaccugauccuguguucacaauuucaacagauggcgccacaauauccaccauuucuggcacugacucuggaagauuguuuuuggguuccaaggaagggaaucuauuugaaaucuccuaccaggcugaaagugguugguuuggaaaaagaugcaaaaaagucaacuuaucgaccaguucucuuucauuucugguaccuucauuuuuaaaugcagcccuuagcgaggaggauggcaucgcucaaauugcaaucgauaacaccagaaauauacuuuacauuuuaacugaaaaaggauccauugaaguuugcgacuugggagaaaaaggaaauacguuuucuagaguuaccaaguuaucgcaggcucaacuuguaucucaagccaugaccacugucaaaacguuggacagccaaaauuuccgccccaucgugagcauauccgccguggaggcaugcgacucggccaacguuaaccugguggccguuucucaaacuggcgugcgauuuuacauguccguggugagcuuguccaaccagcugcccaaucagcggccguacacguuggcgcuuuugcacgugcggcugccgcccggcuacucggccaacaucgcgguucgcccgaggugcgugcacaugagccacuacagagacaggaacugcguacugguguccaccgugaaggauaaggacguguuguggugcaucaguucggauuuguucccguucaauuccacccuuauggaagcuuacacgacugucaacuuggaugggccuguuuuggccauugcugaggugcgucacgacagcccgcugcaagacccgaacuucgaagcgcccccucucgccgugcgccagcacuucgaggcgcaaaaaaaauacgucguuuuaacgucgcacggcguucagauccucgucaagcuccgcccggucgacuugcugcggcagauucugcgggacagccgcggccacgacagcgaaacccugaaagccuucuucaugauccugaaggaggaucaagcgugcgccgccagccucauccucgccucauuggagaacgacgagaacacggagaucgccgauugcgccaccaggugcuucuucacuuucggcggcgaaccgaagguggcgcuucugaaccaaaccagugcacuaucugguucuacaauguuuucaccaaacauaauauccaccccagcccacaauuaccaacaaaacauguacaacaugcaaagccccaaucugucucaaacucaacaauccccaaauuuugaaguggugugccccuuuguguuuuccuccaaacacaacgguuuguauuuguaccugggaagaauauuacgacccguuuggaacagaagaugcgucaauaagguuugcaucgauggaaaaaccuucacaaaugugagcaccaucucaaucaacgauugcaucuggauacugaacaaccugaccgcccugcacaacuucauaacgcaaaacacgcagcucuccuccguuugcaauaccucgucgaacgcgaacgccaacggcucguucgcgaaccaaacgacgaacgcgacgcggucgaccgugacggucagggaggcgcaacucgaggaaaggcgaucgcuggacgcccugaagaucuucgcgaaccagugcugccagcugcugggcuucuggaggauccugugcgagcaccgcuuccacgagcugaucggcucguugcccgagaaccagcagcaggugcugcagaacaccacguucaaggaguuguuucucuaccggcacgauaucugcucguuuuugaucgccacgcuggugaacagcuaucucggcgacaacgccucggucgauucgaucagcaacaaguugcgggaggucugcccucaguuguacaagucugaagaugccgcguuuucgaaggccaacgaaauccugaaaaugaucagaaccgugcaaaacacggacgaaaaggaggaaaugcugaucucggcccugcaacucugcaaauccaucggggccaacauaaagcugcgggaaaucucccgccaauuuaccgcgcugaaagccuacaaggccgucaucgagcugugccacuacuacgcgcaaaaggucgacccagaaaacaucgccgagcauuuuuacaacaacgacgacaacgccgcugaucacgagggcuacggcuacuacaggaagagaauggagguuuacacagaaguuuuggccaugcuggacacgauuuacuucgagcagaacgaaaaucgccaggccaccuucgcagacgauugcgccgucgauucagugacccgucaagugauaucgcaaguuuuggacuaccccgacgaaauaaugcacauagcguuguacgaguggauggucaguaaaaacaugaccagcgaccucaucaaaaucagucagccgucguuggagguguuccucaagcgcagcucgaacaaagacaacggcaacaucgccgucauggaccucuuguggaaguacuacgagagcaacaacaaccacgccuccgccgccaagauccucaacgggcucgccucgcagucggggggcgccgucagccugaaggaaagacugucguauuuggcgagggccauaaugugcaugagaagcgacaaagugggcuaugcgccuuguuuggguguguuuuugagggaucuggaagacaaaauggagguagccaaggugcaggaacaaauccucgaugccaucacaaauaugcaaaauuccguuccgaaugcccaagaaguuauuaccauucugaauucuggauuauuugaaauaucgcagcuguaugaaaauuucgcggagcccuucaaacuacuagagugccaauuggcaaucaucgacugugccggcuacacagacaaugugcugaucgagcacauuuggcgucaaauucugacgaacgagcugagaaaaagcagcggcucuggcaacgacagaauggcgcaagugcucaccaaggucaagcaucuggccagguauuaugccucaucuuugaacugcuuuccuuuagauaauauuguguaugaauuggaaaugcuuaauucgagguugaggggggacaaaaauuuaguaccacaaacuuuggucacguuaaaugugccguuugaaaaacuugucgcuguuuauaauaaccucauaacauuaucagcaaaugaccaagaauggcaaaaggaagaaaaugaauuccaucuaucggaagccacaucauuuuuaauauauuauuuccuugauaauaaugauuccuuuaauagcauugaaaagagaaaaauuacgucacuaugccaagaugcuguagcaacauuguuuuccauacuuuacagcaaaccaaacacagaacauuuagugaaucaacuuagaagcauaaaagcgcaacucucaagaauuuaa

SEQ ID NO: 6672 - RNA, 4173 nt, Meligethes aeneus
augagcgaguuuacguuaaguuauagagaaguuauaccggaucaaaccguuuuagauucauggaaagauauaacacuuaguacagguggcacucaaaguacuuugcaagauauuaaaguagccgaaaaggcaaauggcuauugcuacgaggauuccacuaaaacacauacuagaaauagauuuauucacuggcguauuaacaaugauguguuggaguuggucgagcacaguuuggauauaaauuuaacaggaaauagaaucagauacaaaauaguugauacuccuauauuagauggaguuucuauucaugaaaguauugauaauguuaucguacuugugccuacuguuuguagcauccauaggcuuguuuuuccacauccagauagauuucauagacaggaugauuugggcuccuacccugauuuggcugcuccuucaauauucucaaaagcaacagcuauggaagccaaaaaccccaauacuuuccauguuuuuaauaacccccacagugcaaaugaucaguugccaaauuuggcuuguuccuauuuaucggcugauacagaggaagcuguguuuguccuugccuaucccuccacagagaugcuguuaauuaaacaaaacagggaaggucagugcauuucuauggaaaugaaaggagagucucuuaugcccagguuuuuaucuggacuggcagaaaaauucaggcaaaaaaauagugaagcugacaacauagucagccuuuuaauuauccuguuagauaaugaaauguaugcagucacacuguguagagaugggcauuugaaguucuggucaugcagcaggggacacuguguggcuguuauugauguuuuaacugaaacaggggacacuaacagggaucuggugcaaggugcuucucuaagaaaggcguugaauggauaccauacaucagaaaauacuuugguaguauuuaugagcuuuuccacuggaugccaguuucacaucuuaaaaccaguacugagcggccaacagaucagaaucgugagguuaaacacgcuacauucgccugagaacgauuugauagacuucgcgcuccaaccgaaccggcuguggucggcguggagaugugaggacggcgacugcgcagcuuuuucugcgucgcucuacgcuaacggcgacgagagcagcagcuggacgccggugauucuggagacgcuacccgacgccaaccaauacccggccgucgacgacgagauagauccuaagcaggcuuauuugcagcacaucuuucaucccggcagauuucccuugcacaucaucagcaaggcuuuaugcauuuauaguagauccaacgcucuagcugauacuaauuuaucggcaacagcucuuaaacagcgcauuugcauggcgguggaauccgaaauucgaacaguauuaaaugaacaaaccgucaacgaucaggaauauuuagaaugugcccaauggugcuggcaaaaguuuuauucgugcuguguccaauaucacguggccggacuaaaaccgcuaggucugcuacuacuuccugcuguuucgggagcuguuuuccugaaaaaauccacuuuuucguucuugcggccuuuagaaccuuuggagcacaugaccuuguguggcgauuacauguacaaagaccaauucguggaauauccacuauuaggcgaugauuuggacaacaugggcgacguuaugagccuauuucagguuaucguuuacuuggaacagcaaaugagcgacauuuuccugacaacguuugaaaaagaaauggccacucuucaaucccccgauguuauaaugucaaaguuacuagaaaaaauucacacggaaauggacagugaguucacaaaucaaguguccgguauguugggucaauguugcgaccucuacaaggcgguucacaaaguucucgaacuucuccgcuaugaaaaucucaacacaugcgauucugauguuaauccuuucgcgcuucaucacuucaguucucacuugggggugucgguuguggccgguugcauacgucagcaagcugucacccgguucucgauuugccggaauuuauuguugauuugcaacauucuuuuguacagaaaagaauuggaauggggcauuuuggaagccauacgaucaguuugcaugccugaaauaguuguuuuuacacaagcuagcuacguuaugauguggcuuagcagucugcaaggguuggugaacuuaccucacgauucaaguuugcaaagacuugcuccgauuaaauugaacccaguuuauaacuugcgcaacaacagcuuccaaucgguuucgcuucuggauauguucauuucgucguccggcggccaagaagcgcgaaaaaccuucugucgcaucaaguauugcgacgaggauuuggcacacuggcaucuuucgcuguugcccuacuugaaucaucucaggcacauuauauggccggucgguggcagcacuguucuggcugagugguugcugagcagcggccaacaccuguggcugcaacaguacguaagacucuugagcaauuggugcgaauggaacagcugcacaaggagcuucuugcuggccgcauccuaucuaacaagcggggaaaacuacaaggcccaagaguuguucgagacggcugcuaaaggaauauuuuuagauaaauuuuuaagcgagcgcauucuuaaaaaucguucugccgacgauagccaaacaaaggcauacguuaccuacuacauaaaaguuauucaacucuuugaacuccacaaagcuaaagauugugccauaaggguugccaauacugcgcucagcauaguggacaaagacgacccccucauggcaaccuuauauuccauuaaguucaagcaucauuuaucauuaaaacauuaugaaaaagcauucgauucguuaaauucuaauccggacguugaaaggcguaaagauaacuuaagagauuugguaaagugcuuguuagaugaaaaaaaacuggauacauuguugaacuucacauauggaagcauggacgaauuuuucaccaauauauugcugacaagagcuagagcuacugaugcuguuaacaauauuuacuacgauuuucuuuauuccuaucaaauuaaaagaggcccuuuaugucacaggcuagcugccucugucauguacgaacaagccuucaggcugacacaauuuaacaccacugaagcuuuagaaaaacagguaaaauguuacuuggcugcaaagaauauucuacagcuuugcgauccuaaacacgcuuggauagcuagaccuaccgaugcggaugagagcgaugaugagauuguuauagaaccaauggcuggaacuggaacuguagaaaaucuccagaaaauuaaauugcaaaggcagguggaaguggugaauauaaacauaauuaaaaaagaucuuauuuucgcuugugccaaauuaaaguugcucagauuuaguucuggaucaucuuugaauauuaccacuccccacgaauuaguaucguugcugaauaaugcgggacuuuuuaaaaccgcacugaaaauaugcauuaacuuuaaaguuccauaugaaagcguuuucgauacucucacaaaacacugcguucuucuuacggagcaagaccauccaaaugcuugggauugguugguugagaaugaucuucaagaucuuccaguaaauagagacugcauugccgacguugucuggcaauuacuucaagagugucucagaaccuaugaggaaccaaacaugacaacauugcacaguguuguuuuaaggaaaauuaucgggaugaaaauguuuguuccguucugguuaauggaaucauacaagaaaagaaauccuggagagcuccuuaagauucuucauucuuccgguaggcuggaggaagcggcaacaauggcgcgcgacuacuuaucggcagcuauggguuaugguaaagaguuguauggauuuucagccccguuagcucacacuucaaaacccuuuugcaugccgguauacgcaauucaaaauuugaucaaggaguuggagauacaaaacaaagugaauuuggaacaacccuuuaaaauggaauacacuucucuacaaaaucucuuuauggaauaucuacaaacuuccucaagaauuuccuucgaaauguguaauuuuaagcguuugucaguuaaauaa

SEQ ID NO: 6673 - RNA, 2910 nt, Meligethes aeneus
auggaaaucucagacgauaauuuacaaacucuugcgcguuauuugcaagaaacguuaaauccugacguaaaugucagaagaccagccgaaaaguuuuuggaggguguugaagugaaccaaaauuacccgcuguuaaugcuucauuugguacauaagccugaaauugauaugacaauucguauugcugggucaguggcuuuuaaaaacuauauaaaaagaaauuggaauguggaggaagaucaagcagauagaauucaucaagcugacagagcagcuauaaaaaauuugauuguaacauuaauguuaacuucaccagaauccauacaaaaacaguuaagugaugcuauuaguaucauuggaaaaacugauuuuccacuuaaauggccggaguugaucacucaaaugguugagaaguuugcaacaggagauuuuaauaucauuaaugguguucuacaaacuggccauucuuuauuuaaaaaauacagauacgaauuuaagucaaaugaauuguggacugagaucaaauauguguuggagaaguuagcaaagccccuaacugauuuauuaguggcuacugugaaucuugcgcaaacucaugcuagugauccaaaugcgcuuaaaauaauuuaucauucuuuaauguuaauuuguaaaguauuuuacucauugaauuuccaagauuugccugaauuuuuugaagacaacaugcaaacuuggaugucaaauuuucauaauuuguuguguguugauguaaauaguuuaagaacagagagugaggaggaggcaggggucauugagcaauuaaaaucgcaaguuugcgauaauauugcgcuuuacgcgcaaaaauaugaugaagaguuucagcccuauuugccacaguuugugacugauguuuggggguuauugguaggaacaggacuccaaccaaaguaugauuugcugguuucaaaugcacuucaguuuuuguccacuguggcugaaagaaaucacuauagaaacuuguuugaggacaauacaguucuaaguagcauuugugaaaaaguuauuauuccaaauauggaguuuagaguuucugacgaagaacucuucgaagacaaccccgaagaguacacgcgccgcgacaucgaaggcucagacguggacacgcgucgccgcgccgccugcgaccucgucaacacccugagcgugcacuucgagcaacgcaucauggaaauauucggccaguacuugcaaggcaugaugggcaaguacucggaaaauccgaagcaaaacuggcgcagcaaagaugccgcucucuaucuuguuaccucguuggucagcaggggguccacgcagaagcacggggucacgcagaccagccaccucguuuccauaccgcaguucugucagcagcaaauuuugcccgaacucgaacgccaagacguuaaugaguugccuguacuaaaagcugacgcgauaaaauacguaaugacguucagaaguguuuuaccaaacgaaaugguaguguccacccuaccucaguuaauaagacauaugacgucagaaagcgcggugguucacacauacgcgucaugcgcacuagaaaaaauacucauacuuaaggacgccggcaauaaaccucuuguuacaggagcucaauuagagccucuauccaacgaguuacugucaaaucuuuuugguguuuuaacacguccaguuucugaagaaaaugaauaugucaugaaagcaaugaugagaacuuucucaacauuacaagaaagggugguuccauuuuugagcguugcuuugcccaaauuaacagaaaaacuacaaaugguugccaaaaacccuucuagaccgcauuuuaaucauuauuuguuugaaacuuuuucucuagcuaucagaauugugugcaagcaaaaccaaucagcuguuaaauccuuugaggauauuuuguucccgauauuccaaggaauccuacaagcugacauucaagaguuuauucccuacguuuuccaacuacuaucucugcucauggaaaacacgcccccuggugccgugccugaaacguacaugcagcuguugccauguuugcuggcuccaguguugugggaaagaccagcaaauauuucccccuuggugcgguuauuaagcgcuuuugcaacucaggccgcgccucaaauugucgggcaagauaaauuggguggauuuuugggaguuuuucagaagcugauagcuucaaaauccaaugaucaugaagguuuccauuugaugagguguauaauacaaaauguuccaacugaagcuuuacaagccuacaugaaacaaguauucuuucuacuuuuccaaagguuaucaucaagcaaaaccacaaaguuuguuauaaauuuaauuguuuucuucuguuuguaugcuguuaaauauucagcaaacgauuuggucguuacuauugacggaauucaggcacagauguuugguaugguucuggaaaaaauccuuaucccagauuugcaaaaaguugcuggcaacguugacagaaaaauugucgcuugugguaucacaaaguugcugugugaguguccagaaauguacacagggacguaucaaaaauucuggccccaauuauuacaggcauuaaucgcauucuuugaaaugccaguagaugaaacaagucucccagacgaucauuucauugaaaucgaugacacuccaacauuccaaacagcuagugccaaauuaaacuuugcaaauacacaaaaaaccgaccccuuacaagcuguuggugagccuagacaauuuuuggcgcaaaguuuagcaucuuuaggcaguucgcaaccaggucgccuaccaaguuauauuucaaacacaaaucaacaaucccaaaccacuuugcaaggauauuugucaaaauucggaguucaacucuccuaa

SEQ ID NO: 6674 - RNA, 603 nt, Meligethes aeneus
auggcaaaaguucagcuaugcaacaucacuguuauggacaaccccagccaguuuuugaacccuuuucaguucgaaaucacguucgagugcauugaggaacugaaagaagauuuggaauggaaaaugauuuacguugguucggcagaaagcgaggaguacgaucaagucuuagauuccguauucguaggccccauaccugaaggaaaacacauguuuguguuucaagcugacccaccaaauguaucaagaauucccgaaaacgaugcuauugggguuacaguuguucuauuaacuuguuccuacagaagccaagaguucauacgagugggauauuuuauuaauaacgaauauagcgacccagaguugaaagaaaauuccccgagccccccucaguuugauaaagugaugaggaacauauuggcuucugagccgaggguuacaagguuuaaaauuaacugggaggagccgaaucagcaggaaaauggucaggguucgggggaaaaucaggcacaaacaucuagugucgaggauaauagugcaucaggacaaauaccuaguuuuaacgagaauucuaacucaugggccacaauggaguguucauag

SEQ ID NO: 6675 - RNA, 921 nt, Meligethes aeneus
auggaucaaaugcuaccaaguccaggguuuaguauaccaaguauaggaaccccacuucaucagccugaagaagaucaauuaauucuuccaaaugcuuuacaacagcaacaacaacaaaauuugucacaaguccccccauuggccccuauggggggacuaaccccaacuuuaggccuaggaauggguaugucgaugccaacucgauauguuccagguuauggcagcaguuugcagucucaaacgccgcaacauacgaugaugucgccuaugauaaacuuaggugguaccaguggagguccaggggccacaccuaguaguaauauggggccugcgacaccugcaaccccugcuacaccucagaccccacauucccaggauccagggauuguuccccaguuacaaaacauuguuucuacaguaaaccuaaacugcaaacuggaccugaaaaaaaucgcgcugcacgccagaaacgccgaauacaaccccaagcguuucgcggccgucauaaugcgaauccgggaaccucgaacgacagcccugaucuucuccuccggcaagauggugugcaccggggccaaaagugaggaagacucgcgguuggccgcgcgaaaguacgcgcguaucauccaaaaguuggguuuuaacgccaaguuuuuggauuuuaaaauacagaacauggugggcaguugugacguuaaguuccccauaagacuggaggguuugguguugacgcacggcucuuuuagcuccuacgagccggaguuguuccccggauugauuuaccguauggugaaacccaggauugugcuguuaauuuucguguccgggaaagucgugcuaaccggcgccaaagugagacaggaaaucuacgaagcauuugauaauauuuauccuauuuugaagaguuucaaaaaacaauaa

SEQ ID NO: 6676 - RNA, 474 nt, Meligethes aeneus
auggcuuuaagauccguaaccaggcuuuucucucgccgugcuuuaagcacuaccacuguucgcgguuauuccgacgaaaugagcuucacuuuggccuccggcaaccagguguucuacgaugccaaaucaguuaagcaagucgacgugccgucuuucuccggcaguuuugguauuuuacccaaacauguacccacucuggcuguauugaaaccaggaguaguuucuguuaucgaagauagugguaauguuaaaaaaauauucguuuccagugguacagucacaaucaacgaagauucguccguacaaauuuuggcggaagaagcccauccuguggaaaguuuggaccguucugcugcccaggagguuuuaaguaaagcucagagcucuaugucgucugccuccacagaacaagcucgugcugaagcugccauugcuauugaaguaggugaagcucuugucaaagcuguugaauaa

SEQ ID NO: 6677 - RNA, 972 nt, Meligethes aeneus
augaguggugacggaaaucaaauggaaacuuucgauuccuuauuuuugucgauugcacaacaucauccccaaggagccucgcagcuucucgacacguuugugaauuucuugggaagaaaaaccgauuuuuuuaucggcggacaggaaggagcauggcaaucgcuggugaugagcacauuuaaaaaauacgagaaaauaagcagggaugcucacgaggcugaacuuaaacuaaaaaaggaaaaagaggcaguuaaaaaagcugcaucugccaaaaaacaagaagcugaaguuguuaaaccagcugaaauuaaggaauugacugaugcugaagcugaacagcugcaggcugaguuaaacgcuaaaaagggagggucugaagcugcaccugcuaaagcugaagaagggaaaggcaaugaugaagaagaggaggaugaagcugaaaaaggaaaauugaaaccaaaugguggaaaugguugugaucuggaaaaauauaaauggacacagacucuacaggauguugagguuaggauuccauuaaacgucaacuuuagggcgaaacaaaaagaucuggucguuaaccuaacgaaaaaacauuuaaccgucggugucaaaggucaaccucccauaguggacgaugauuuucccuacgaaaucaagcuggaggaguccacaugggugauagaagacgguaaaaguuugcuaaucaauuuagaaaagauaaacaaaaugaacugguggaauaaauuggucaagucugauccggaaauaagcacgaaaaaaaucaacccggaaccgucgaaacugagugauuuggauggggaaacccguggacugguugagaagaugauguacgaucaaaggcaaaaagaacgaggacuucccacuagcgaugaucaaaagaaacaggacguuauuaauaaauuuaugcagcaacacccagaaauggacuucucaaaauguaaauuuaauuag

SEQ ID NO: 6678 - RNA, 456 nt, Meligethes aeneus
augcagggccacucugcaaugccuccaccccuucaauggagcccugauaagaaacacagcgaucgcgaaagauggguauguauuuauccagcauacaucaacaguaaaaaaacuuuagcucaaggcagaagaauaucaaaagaaaaaugcgucgaaaacccaacacaucaagaaauaagagauguguugcuggcagcaaacuugaaaguuggaguggaaaauaaaauuuacucaagagaaagaaguaaggagcuuuuguaccgugguagaauaagagugcaauuaaagaaugacgaugguucuuuauucaauccaaguuuucccuccagagagaguauuaugcuucauuuaggagacaugauuccuaagcugaagacacgacagacaaagagugguggugaacaacagcaaucaacggguaauaagggaaagggcaaaggaaaaggaagacguuaa

SEQ ID NO: 6679 - RNA, 1356 nt, Meligethes aeneus
caaauuuucgaaagggcuguucaguuuuauggagaugaucauuuggaugagaaauuguucauugcuuuugcuaaauuugaggagaaucagaaagaacaugauagagccaggguuauuuauaaguuugcuuuagaucacauucccaaggagcaguccaaagaauuguacaaacaguacacuauacaugaaaagaaauauggggauagaagugggauugaagaaguuauuguuucuaaaaggaaauuucaguaugaacaagaaauauugcaaaauccuacaaacuaugaugccugguuugauuauauuagauuaauugaaggugaaggagaaguagaaauuacaagagaaaccuacgaaagagcaauagcaaacaucccucccuccaaaaacaaacaauuuuggaggagauauauauaccuauggauaaacuacgcuauuuuugaggaacucgaagcccaagacuaugaaaggacaagacaaguauacaaagcuuguuuagacuuacuaccucacaaaguauucacauuuucaaaagucugguuauuauaugcaaaauucgaaauaagacaaaagaauuuaaccacugcuagaaaaguauuggggauguccauuggcaugugcccaagagauaaacuguuuagaggauacauugaguuggaaauucaguugagagaguuugauagauguagaagauuguaugagaaguuuuuggaauuuggaccugaaaauuguguuacauggaugaaauuugcugaacuagaaacauuguugggugauguggauagagcuagagcuauuuaugaguuagcaauuaaccaaccuagguuggauaugccagagcucuuauggaaagcuuauauugacuuugaaauaucacaggaagaaccugaucaugccaggcgauuguaugagagauuacuugaacgaacaaaccaugugaaagucugguuaucuuaugccaaauuugaauucaacaaccauucagaagaugagauaaauauaggucuagcaagaaggguguuugaaagagccaaugaaacacuaaaaucuuguguagauaaagaauccagagugcuucuuuuagaaaacuggaaggaguuugaaaacacccauggugauaauguuaauaaagaaaaaguuaauuccaaaaugccaaggagaaucaagaaaagacagaagguuauugaugaagauggauuugagcaagguugggaggaaguguuugauuacaucuuuccagaagaugaagcuagcaggccuaauuugaaacugcuugcugcugccaaaaacuggaagaaaaaagcugcugaugaugaaccuucagaaagugauaaaucagcagaaagagagucauga

SEQ ID NO: 6680 - RNA, 762 nt, Meligethes aeneus
augggcaucaaauuccucgagguuauuaagccuuuuugcagcauuuuacccgaaauugccaagccagaaagaaagauccaauucagagagaaaguacuguggacugcaaucacccuauucaucuuuuuaguauguugucagaucccacuuuuuggaauuaugaguucagacucagccgauccauucuacuggauucgugugauucuggcuucaaacagagguacccuuauggaguuggguauuucacccauuguaacaucuggccugauaaugcaacuuuuggcuggugccaaaauaauugaggucggugauacaccaaaagacagggcuuuguuuaauggagcacagaaauuguuuggaauggugaucacagugggucaagcaaucgucuacgugaugaccggcauguacggcgacccggccgaaaucggcgccggagugugucucuugauuaucauacaacuuuucgucgccggucuuaucgugcuccuccucgacgagcuccuccaaaaagguuacgguuugggguccggcaucucucucuucaucgccacgaacaucugcgaaaccauaaucuggaaagcguucucucccgccacggugaacaccggaagaggcacugaguuugaaggcgcggucaucgcucuauuccaccucuugaccaccagacaagacaaaaucagagcuuugcgugaagcguucuaccgccaaaaucugcccaacuugaugaacuugcucgccaccguauucgucuuugcuaua

SEQ ID NO: 6681 - RNA, 486 nt, Meligethes aeneus
augucuucaauaacauccccguccguagaauuaagcuccuaccgugaucagcauuucaagggcuccagagccgaacaagaccguuuauuaagggguacaacuacuuuauauauugguaauuuaucguucuuuacaacagaagagcaaauuuaugaguuguuuucgaaaugcggcgauauucggcguguuauaauggggcuggacaaauacaaaaaaacgcccuguggguucuguuuuguugaguauuauaacagagcugaugcugaaaauugccuaagauacauuaacggaacccgauuggacgauagaaucgugagaaccgauugggaugccgguuuuauugagggaaggcaauauggaagagguaaaacuggaggacaaguuagagaugaauauagaacugauuucgauggcggacgaggcgguuauggcaaaauaauccaacaaaaaauaggcagcggucccgaaaccacuuuuccccgauga

SEQ ID NO: 6682 - RNA, 921 nt, Meligethes aeneus
auggcugcuacaguaggacggauuugcggagcuggccucuuaaaaucggcuaauggggccucuguaacccaaauaucuucguucucuacaaguagagaauggaccagaggaaggaaagcacuuauggguacauuggggauguuagcugguggaacaggugcuuuguuguuugcccuggauagaucaguuaaagcuucugauuuagaauugcauccaccaaaaaacccauggagucaugauggaauucuuaguucgcuugaucaugcagguauaagaagaggcuacgaaguauacaaacaagugugcgcugcgugccacuccaugcgcuucaucgccuaccguaacuugaucggcgugucgcacaccgaggccgaggccaaagccgaagccgaagaaaucauggucacggacggacccgaugagcuuggcaacauguucaaacgcccaggaaaacuuuccgacuacuucccgagccccuaccccaacgaagaggcugcgcgcgcagccaacaacggcgccuauccacccgaucuuagcuacauuguugaugcacgucacggaggugaagauuauaucuuugcccuguugacuggauacugcgaucccccggccggcgcaguuaucagagagggucaauacuucaaccccuacuucccggguggcgccauuuccauggcucaagcgcucuacaaugaagccauggaguacaccgacgguacuccagccacugccagucaauuggccaaggauguguccacuuuccuuaaauggacauccgagccagacuuugacgaccgcaagaggauguucauuaaagccguaggaauauucuccauccuuauugcacuuacauacuacuugaagcgacacaaguggucaucgaucaagacccguaagauugaauuuaaaccaagaaauuaa

SEQ ID NO: 6683 - RNA, 1788 nt, Meligethes aeneus
ucuagguuaacuaucguaaacaauccgucuuuuccacuaaaacaauuaaaaaugcuuucuauccagcaauauucagacaguagugaugacgauucacccaaagaacccuuggaagacaaaacaacggcaguaauaaaccaagauuaccuaaaaccuuuaccaccagaaaaggccaaauucucagugcaaaaacaguuacaaauuugugcugcaccgauuguuuuacccacaggcgucgacgaagauaaaauacaucugcacccugauacaaaggagguggaguuuaaucccaaguaugaagaauuauuugcucccgaguuggggccucauaacccauauaaaacgcaacagcgagcguuuucgaaaaauaugcuguccgggcaugucgaggccgcucaugugagcgauuuucaauuugagaaucagagaagaacguuugcuaguuuuggguaugcauuggauccuucagugaguggcgaaggagagaaacuuaagguugugggugcuaaagagguuaauagcgagucaacggaaauaacaacuguguuugagacuaccaaagugagaccuuuagauaagcgaaagcgcaagaaaaacaccgacgcaggcgacauagaaggguuccuuggcccguggggcggcuucauagacgagcaacgcaucaugaaaccgaccgaagaggaagccaucgagcucgaagaacucguaucgaagaaaacgaaacgcggcaaagucgucgaagagaagccgaucgaggaaaaaucgguguugcacaucaaggacgcgcuggauuaccagggccgcucguuccugcacgcgccgcaagaugucggggucaaccugcgcucggacucgccgcccgagaagugcuuccugcccaagucgcacauacacaccugguccgggcacuccaagggcaucgcggcccucagaugguuccccaggacggcgcaucuauuccuaucggcuuccauggauugcaggauuaaguugugggagguguacaacgaacgcagaugcaucagaaccuacuacggccaucggcaagcggugagggacauaaauuucaacaacuccgguaagcacuuccucuccgccgguuacgacagauacaucaaguugugggacaccgaaacgggacaaguuuugucccgcuucacggcccgcaaaauucccuacugcgugaaauucaauccggacaaaaacaagcagcaccuguucguggccgggacuuccgacaaaaaaauuauuugcugggacaccaggucgggggauaucgugcaggaguacgauaggcauuugggagcugucaauaguaucacuuuugucgacgagaauaggagguucgugacuacuucggacgauaagaguuugaggguuugggagugggacauucccguugauaugaaguauaucgccgaucccaccaugcacaguaugccgucuguuacaccugcaccaaaugguaaguggcuggcaugccaaaguauggacaacaaaaucguuauauucucagccuuaaaccgguuuaaaauuaaccggaaaaaaguauucaccggacacaugguugccgguuacgccugcagucuugacuucucaccggauaugucguaucuaguuuccggagaugccgacgguaaauguuacauuugggacuggaaaaccacaaaacuguacaaaaaauggaaagcccacgauaacguuuguauaagcaccuuguggcacccccaugaagcuagcaaacuauugacugcuggaugggauggacuuauuaaguauugggauuaa

SEQ ID NO: 6684 - RNA, 339 nt, Meligethes aeneus
guguuuccugaucucgucagcgcggucguugaaguuggucuugaucgucucgaccagcuuguugagguuagaucuguccccagaguccaccugcgucagcgcgacggccgagcaagucuuacgucucaccagcaaucccaagcgggcuuugccuuucacgaugcaguacgguacccccaucuuccugcagagggcaggcaagaacaaaaccagcucaauugggucgacaucgugggcgaugaccaccaauugggcuuuuuucugcucaaucagcuuugugaccguguugguaccggcgcggagcacguuuggcuucuuggcuggcgccucuucuuucuu

SEQ ID NO: 6685 - RNA, 990 nt, Meligethes aeneus
auggccacauuaauuaaagauguuaaauuggaaaacguucccacagaaguacucuucgauaaacacaaagaauuccugcaaaguuaugaaaaagacgaaaacaauuaugaauacgguaugacggacuauuuacgaauaucggggauguacuggggccuuacggcgcuagaauugaugaguauuaacacuaaaaaucaaaaagugauagacuuuauaguaaaaugucaggacccugagucuggagguaucagugggugcaucgaucacgacccccauaugcuacacacguuaagugcggugcaaaucuugguuacaauggaugaaguaaaugccauagacguagaggggguuguaaaguacguugugaguaaccaacaggaagacgggaguuuuacaggggauaaauggggggaaguugauacacgguuuucuuuuaccgcuguggcaacacuggcuuuauuaaaucguuuggaugccauugauguuaaaaaagcuguugaguuuguacagucguguaugaauuuugauggcgguuuuggcuccaggccuuuaucggagagucaugcaggacuuauuuauugcuguuugggguuuuuguccauuacaaauagucuucauauuguugaacaagacacucuggcauggugguuaugugagaggcagcuuucaucgggugggcuaaauggcagaccagaaaaacucccagacguauguuacucuugguggguguuaucaucucuaucaaucuugggaagaauacacuggauaaaucacucugcaauccaaaauuacauaaaagcaugucaagauguugaaacugggggcuuuuccgacagaccuggaaaugucacugauccuuaucacacauuauuuggccuggcaggguuagguuuauuaggcgacgaaagaaucauaaaaguuaaucccacauuuuguaugccucaggcuguuauagauaaguuaggauuaaaaccacaaauauuaucuuaa

SEQ ID NO: 6686 - RNA, 2652 nt, Meligethes aeneus
augcaucaagaaacacugcaacucauccaaauucuagaaaagaccguuucaccagacaaaaccgaauuagagcaggcuucacauuuucuggagcaagcggcaacaacuaaccuauuggaauuuaucaggacccucucugauauauuaagacaugggggaaauagucauguugcccgaauggcugccgguuugcagcucaaaaaccaacuuacaucaaaagaugccaccaacaagguugucuaucagcagcgcuggcuugcuuuccccgaagaagugaggaguuacaucaaaaagaauguggugggugcccucggaaccgaaacaaaucguccaucuucggcggcgcagugcgucgcguacaucgccgucgcggaacuuccgcagaaacaauggccggauuuaauucaaacguuggucaacaacgugugccaugcaaauucuaccgaaaugcagaaagaggccacccucgaggccaucggcuacaucugccaggaaaucgauucggacgugcucgugacgcaagcgaacgauauucucaccgcuauuauacacgguaugcggguauccgagcagaguaaccacgucagauuggccgccacgcaggcucuauuaaauucguuggaguucacgaaaggcaacuuugaucaacccacugaaagaaauuucauuauggagguugugugcgaagccacgcaaucgcccgauucgcagaucaaaguugccgccuugcagugucucgucaagauuaugucucucuacuaccaguauauggagccuuacauggcgcaggcucuuuuucccaucacucuagaagcaaugaaaucggagaaugaugccguuucguugcaagguaucgaauucuggucgaauguuagcgacgaagaggucgauuuggcgauugaggauacggaagccaccgaagccggucgaccuccuucgagaguaucaaggcacuacgccaaaggcgccuugcaguuuaucguaccgauuuugcugcagaaguuaaccaagcaggaagaauuggacgaugaggacgacuggaaccccagcaaagccgcgggagugugucucaugcuucuggccacuugcugcgaggacgaaauuguaccgcacguacugccguucaucaaagagcacauaaaauccgagaacuggcgauuccgggacgccucuuuaauggcguucgguucuauucucggcggucuggagacaaccacgcuaaaaccacucgucgagcaggcaaugcccacgcuaaucgaacuuauguacgacagcagcgucaucgugagagacacggcugcguggacuuuuggaagaauaugcgagauuauacccgaagccgccauacacgagacuuuuuugaaaccgcugcucgagaguuuggugacgggguuaaaagcggagccucgcguugccgcgaaugucugcugggccuuuucuggcuuggccgaggccgccuacgaggcggccgagccgaacgaggagaccggaaauccggacacguacgugcugucgcaguacuuugauuucaucgucgagaggcugcuggagacuacggacaggccggacggcgcgcacgccaaccucaggcccgccgcguacgaggcgcucauggagauggucaagaacucgcccaaggacugcuacgugaccguccagaagaccaccauggucauuuuggagcgccugcagcaagugcuucucauggacacgcacauuacgagccacuacgaccguucgcaauucaacgacuugcagucgcugcucugcggcacccugcaguccguguugagaaaggugacgccagaggacgcccccaggauauccgacgccaucaugaccgccaugcugaccauguucagcuccaauucgugcgugcaagaggacgcccucauggccgucucgacgcucgucgaaguucucggcgagaacuuccucaaguacauggacgcguucaagccguuucuguacaucggucugcgaaaccaccaggaguaccaggugugcgguaccgcggucggucugaccggggacauuuuccgcgcgcugaaacacaaagcucuuccguacugcgacgagaucauggcgcucuugcuggaaaaccugggcgaccagacggugcaccgcaccgucaagccgcagauuuuguccgucuucggggacaucggccugaguaucggcgccgaguucaagaaguaccuggagaucgugcugucgacuuugucgcaagcuucgcaggcucaagucgacaggaacgauuacgauaugaucgauuauuugaacgagcugagggaaggcguuuuggacgcuuacacugggauuuuacagggcuugaagggcgacggggcgagccccaauccggaagugaacauccucgagccgcacauaccguucauagugcaguucaucacggugguggcgcaggaccaggagcacucugacggcaccgucgcaguggcggcgggcaucgucggcgaccugugcgccgccuucggcgcucccauggugcagcuguuggaucucgagccgaucaacgagaugcuggcgcaaggucgcagaagccgcgucaacagaacgaaaaccuuggccacgugggccaccaaggagcucaggaaacucaagucgcagagcacagccguugcggccagcuga

SEQ ID NO: 6687 - RNA, 1503 nt, Meligethes aeneus
auggagacuauauuggaacagcaaaggcgauaccaugaagaaaaagaaagguuaauugaugcuauggucaaagaaauguugcacaagaaaaauucuuacagagaaaccauaaauucagaucaaaggcaaaaauauuugcuugaucguuauaugaauggaacggaaaaguugauagaguuguaugaagauaaagauggucaacgaaaagcugaaguugcagcuuugacuggacccaaugaguuuaaugaauuuuauaaucguuuaaaacagauaaaggauuuuuacagaaagcauccaaaugagauaaguguaccaaugucaguugaguuugaugaauuugcuaaagcuagagaaaaucccucugaagaaauguccaacuugguugaguuuacugaugaggaagguuauggaaaauuuuuggauuuacaugaauguuaugagaaauuuauaaaucuuaaaggaauugauaaaguggacuauauuaguuauuuauccacauuugaucagcuuuaugaaauuccaaaggaaagaaaaucuggugaauauagaaaauaucuauuaacuuuaauugaauacuugagcugguuugugcaaagaauaagaccuuugauggacuuggacaaagacuuacaagaagaagccgacaguauuauaaauauuugggagagcgguacuguuccaggauggccaaaagagacugguucagcauuggcaaauguuggugcacauuuggaucuuucagcauuuucaaguugggaggaauuggcuucuuugggucuggaucguuugaagucggcuuuauuggcuuuaggguuaaaauguggaggaaccuuggaggagagggcacaaagauuguuuucaacaaagggaaaagguucuuuggauccaucauugaugacuaaaaauaauaagggaaaagccaauaaggaaaaagaacaacugagacauagggaccuugcuauguuggaagcucagauuuauagacuggccgauuuaguguccacucaaaggggagcaacaaaagaaaauguucaaaggaaacaagccagaacugacggagaaagaaacgacagugaaaaugaggaaagugaagaggauagucccgaugaaggugacgaugaugucccauauaaccccaaaaauuugccauuggggugggauggaaaaccuauuccuuauuggcuguauaaauugcaugguuuaaauaucagcuacaacugcgaaauuugugguaauuuuguuuauaaggguccuaaagcuuuucaacggcauuucgcggaauggagacaugcucaugguaugaggugucuugguauuccaaacacggcucauuuugccaauguuacgcaaauugaggaugcuauugcuuugugggaaaaauugaaaguacagaagcaaaaugaacgcuggcaaccagaaaccgaggaagaauaugaagauucucaaggaaacgugguaaacagaaaaacauaugaagaucuuaaaagacaaggauugcuauaa

SEQ ID NO: 6688 - RNA, 645 nt, Meligethes aeneus
aaaaugacgauaggcaagaauaacaagaugauccaacacauaaacuacagagugagggucacucugcaagacucgcgaacguucauaggaacuuucaaagcguucgacaagcacaugaacaugauucucggcgauugcgaggaguuccgcaagauaaaagcgaaaaacuccaaaguggagcgggaggaaaaaagaguuuuagguuuuguuuugcugagaggggaaaguaucgucucucugacaguggaaggccccccacccccggaagaaggccucccgcgcguccccauaccuggagcagccccagggcccggaauuggcaaagcagccggccgugguaugccagcgggcauggcuggagucccgguggggcuccagggacccgugaggggcguuggaggucccucucagcaggugaugacgccuggaggcagggggcagguggcggcaccuccacaaaugaaucagggaccuccgagaauggggggaccaccuccaggcaugauggggcccccuccugguaugauggguaugcccccaaauauggggauggggcgugggggacccccaccaccaauggggaugaggggacccccaccugguaugaugagagggggcccaccuggaccuccaagaccauacuag

SEQ ID NO: 6689 - RNA, 1104 nt, Meligethes aeneus
augcgucuuaaagaugaaaaaaaauuuagaaauuaucauagaauggccauugaagauuuugauaauuuaguggaaaaaguuucaccuuuuuuacgaaaaacauuuauuucccgugaaccaauaucgccuggggaaauguugucuguuacacuuagauauuuggcaucuggugaaaguaugcgaagcauuucauauagcuauagauuaggacuaagcacuguuucuaauauuauuaaaagcacaugcucugcuauuuggaaagcuuuaagugaagaauauuuaccauaucccacagaacaaaguuggaaaaaaauugcuguugauuuugaaucaaaguggaauuuucccaauugugugggugcaauugauggaaaacaugugagaauacaagcaccucaacauucugguucagauuuuuuuaauuauaaagaauucuuuagcaugauauugcuagcaguuugugaugcaaauuaucgauuuacugugguugacauuggugcaaaagggagacaaagugauggaggaguuuuucgcaacaguacuuuuggaaaacaauuuuucucaaacuccauuaauuuaccugcuccaagaaaacuugcagaugaugaagaaccaacuccauacuguuuuguaggugaugcagcauuucccuuuggaguuaauuuaaugcgaccauacccuggaaacuuucuuccacagaaugaaagaauuuucaauuauagauuaagucgugcaagaagaacaauugaaaauacauuuggcauucuuguugccagauggagaauauuagaaaaaccaauuauugcaaagcuugaaacuauugaaaaaaugauaagugcacuuguaugucugcauaacuuuuugaggaaaucagacucagauaagguugacagcaacagguacuguccuucuaauuuuguggauagagaaacagaaacaggugaacuuaucgagggagaauggaggaauuuagugcauaauggguuaccuaaugcuggaagaauggguggaaaugcauauucccaaggagccagugcuaugcgcaauucauuagcugauuauuuuauccauguggauccaauugcaucacaauuguuaaaauaa

SEQ ID NO: 6690 - RNA, 3786 nt, Meligethes aeneus
cagcaauuaaauaugaaccaacaacaguugcugcaaaauaaguugcaacaacaggcauugcuacagcagcagcaacagcaacaagggaaucuugaugguaauggcaguaaugauccaaacuugaugcaaagagcacaauuauugcauagacaaaaccugguaaggcagcaacagcagacacagcaacaagcgauaggccaaccacagccucuaacaccgcaacagcaucaaaauauguugcaucagcaaaagcuuuugcagcaacagcaauuggcucagauacaagcuagacuucagcaacaacagcaggcgcaacaacagcagcuaaauaauccaccucagucgccguuaucaaugcccccgaaaaguccaaugauuaaccaacaaauaaugucaccucacucuaugccugccucaccuaugccuccacaaaguccaauguccguaagaaguccagcuuuuucucagagcgucggacagccgcccagcaguccuaugagaaguucgccuaugccaagaagcccaaugguaaaccaaauccaaucaccgaugaguaugcguaguccagcaaugccggaaagaccaacuagcguggagaauccuggaacaccaagaaccccuuauaacccccaaaacguggagaacaugcaggaaaauaacgucuccaacaccacuacagaugguggcggcgguaacccgcgcaaccccguaaauccaauaccguuucccuuuggaagguuugggucauuuaaguuggguuugagggguggaucuccaaugugggguggcuuuggccggggggcuaaaagagucccaacgccaccugugacuucuaccggcgugggugcuugcguaucuaaaccgauugcugcaacgaaugcguugguagauucggcaacuucccaggugccgccuaaaccaaagaaagaaucccauuauagcaaaguaucgauucuuaagaaaaaaucugcacccacaauaaccaacaggcaaucuuuuguggccaauaaagugagcucacuuguuaguucagauuauaacgaauucgaugacaguucgucuacuccaccaguaacuccuccaccuucaucuucgaccagcaggaaugucguucagaaaacgauacauaaaaaaauugccgaagaaaccaaagaaaaagcaaaagagagacuaaugauuuuacaaaguccugaacccaaacaaauccacgaaauaauagauuacgaugacgauaacaauacuguucuaucgggugaaguuucguugaguucuguggcucagcaaaacgauggugacgauaucgaaauagaaacccuuucgcaaaacgaucuuacagaagaucuguccagucccuuggaagcggaucagaucaccgacgaguauuuacuguuuccuggcaacauggucguggaagaagaagucgaugacuaugcaagcgaaaacaugcacuuugugauacguagucccaccacaagcgacgacgaguauauaaugcaggguaaaaccaaaaaauacaauauuguaucuucagaacaguugauggcgauaaaugauacgcccgaaucgccggaacaagaggaaaugaacguggauccgucaccggaaccgacggaagaugaagaaaacgaagucgaagaaucgaucucuacgaaggaggauuucgaggagcucauagaugaaggcucucgaaaggaaaaacuuaaaaacgacggcaauguuaccgccaaacauauuaacgaguuucauaaauacgcugccaccaccguuuauaguuucccaccgaaagccuccggcucgcaacaaaccacggcccguaucgcaaacauaaacaaaaugccgcaaaaaauaucccugaucacuccacuuguuuccaaaaaugacgccgccaaagaacuaauaauugccccaaacgcuaaaauagucaaccacacucaaccgacuuccaaagugacgaguauuauuuuaacuccgcauccagugcgcaguaacgugcuuacgccgaaaauugugucggcuggcggucaaccuaucacaauagugagugcgaacuccaaguccaaauuuacuguuccuaucaucagugccagugcaguuagacaauuaagcaacauuaaagugaucgauaaauccauuucguugaccacacacgacaguucuuugccaaagaagauuuucgaggacgauucaguuucaccagacaguuccaauugcgaagaagacgcaaaaucuaaagacuauuccgaugaaaaauuaaaggauucaccgauuaccgacgaaacaaaaucacagguguuugcgaaaaaugagucauuuaaaauuauaaaaacaguaaaaucugauaauauggugguguuaaacaaacaaccagaaaacguuaaaauugagaaaaaggaacaaaauaaaccaaagguuuuggagaaaaaggaacuucauccaauacauacaauugaaaacgugaaaauaacuaacauaauaacuaaacagaggauuccaaguccaauaauugcaaaaucgucuucuccagucaucauucguagcacucccgaauuaaaaaugaccgcucaaguguuucaggagacuucgcaaaauagaauucaaauaucaacugauacagauugcaauuccaccgacgauacuaaaucagugguuauuucaauaccgucuccaacgccaucucaagagcaaauguuggacgauaucgcuaugcgagcguacgaaacucgaagacacggaacagcaauuccugguacguucgacuccuuugaagacguuuuggauauguuugaaaauauaacugccgaaccugguacaauucuggacgaaaaagaaaaaguuaaacaauccaaugagacuuucgacucugcaaagaaggccgagccggaaaagaaacacaccgcaaacaaugccacgauaucgaaaccggcaaugacucaaaugccagugacaguaaccacaacauccaccaagucuucgguuguuccacaauuaucaccucuuucgcaaccgaccgaauugacuacaaacauggcaacugcaucccaacaacuaagaaacuugcugucccugcagacgacaacggguucuucgcccaccaacguggaaacguugguaaaaacacagcaaaagaacguggugacuacugcaagcacccuaggaguucuaccacaacaaccugcuguaaccguaacuaguguaggcacuguuguaucaaguauaaagcaguugccuguaaguacaaaaaccaacacgguaaaaacacaauuuacuacaaacguagucucuuccucuacuacgccaacauuuaccacacaccguaacguaggaggcauacaauugaugccugaucacucgaaacuuccaccugucacucaacaacaaccgagcacuuccguugucacaacaccgcauucgaauacaguagugguucauagagcuccucuuguaaacaccacaccaacgaccacuccgaacggcgaacaaaggaaaccuucguugacuuugacagccaugcuacagaaucagccggccgcuacuccaacuacaaaaaccacaccggauucuaucacggcagccagucuuuuggccacuccaguauccauuuccaggggauuuaauacagcauuaguucaggcucaaccaaaugugucgguuucguccauuguagcaacaaccaacaacguuacuucggaguccguuacugcuuuuagaucgguuacaaccaccacuaaccucuuacacacucaacuuacuaaggugcgaaacaagucggucgaagaaccgaaagag

SEQ ID NO: 6691 - RNA, 2097 nt, Ceutorhynchus assimilis
augccuagagacaguaucagacaccgauaccguuaugacgaccacaguucaagcuccagacaccgucggaaauccagaucuucaagugaagaauuucgaaaauccaccaaaaagucuggcaaaaguggcucggaaagacgccgaucuaccucuucaaaacgaucaaaaaguaaccacaaccguagaaaaucuccucacaaauccaaaaaacaugauuccgacagugauucuucuaguagcagugacucuagugacucaaauaaauccauaaaauuacucaagaaacucgaaaagaagcguuugcaggaaaucgaagagaggcgcaaacaaaaggagcuaaugaaagcuacagaaacugcagaagaaaaacguuuaagacgccuaaagaaaaaagaagaaaaagagaggaaacgcaaagaaagaaugggcugggacaaugaauaucuccacuacacaaacagcgauaauccguuuggagaugguaacuuacuaagcacauuuguuuggaacaaaaaacuagcaaaagaagguuuaacaaaugcaucccgugcagaacuugaagccagaaauagauuuaagcaagacgaaagcaaaagagaacuagaaaaaguaaaaaaaagacgucuggaaagggaauuagaaaaacagcgccgagaugacgacaaucaauuacuucaaagaagcaaggaggcagcacaguuugaggaaugggagagacaagaggauaauuuccauuuagaacaagcaagguugagaagccacauaagaauucaggaugguagagccaagccuauugaucuacuagcaaaguauaucagugcagaagaagaaguagaugcuguagaaaugcacgaaccuuacacuuaucuuaauggacugcaaauaaaagauuuagaagaucuuguagaagauaucaaaguauauaaagaguuagagaggggcaagaauuuagacuacuggaacgauauuacuguaauuguagaagaugagcuucaaaaauuaagaaaacugcaaagagaacaagauuuugaugcuggaauugguagacgcgaaggcauaaaucaagcaguagcccaagacguuacagcaguauucaaaggcaaaacagccauacaacuugaggaucuucaaaagcaaauugaaagcaaaaucaguggcaaaucugaugguauugacauaggcuauugggagucgcuuuugucucaauugaaagcucacauggcuagagccagacuuagagacagacaucaacuuaguuugaagagaaaacuucaaguauuaaaagcugaacaagcuguaacugugccugaaauaaaugcugaaaauaguaaucagucuucacaaaguccacaagaauccaaaccaggaacuucacaagaaucagcagacaaugaaagucaaagcgaugaggaaggugaaaauaaugaagaagcagccagugauauacucaaugaaugcuuuguugcuuaccaaaauggcaacuacaguccuaaacuauuaaauucugagcaaauugagccuggcaccauagugguuucagaagaagaugauauaaaacguuuagaauuugccagauugcaagugacaaauaaaggcaagaaaguggaaaauguuaucacaaaagaggagcuuuuacuucagaaagaagcucgaaguggcaugggugaagaugaagcccaauucaguguggaacaagcauuggauagucaaguuuauuuauggucugauaaauauagaccgaggaaaccaagauacuucaacagaguccauacaggguuugaauggaacaaauauaaucaaacucauuaugacauggauaauccuccacccaaaauaguccaaggguauaaguuuaauauauuuuauccagauuuaauugauaagaauugcacuccugaauauuuccucacuccuuguccagaaaacagagaauuugcuauacuuagauuccaugcaggaccuccauaugaagauauagccuucaaaauuguuaauagagagugggaguauucauauaaaagaggauuuaggugucaguuucacaauaauauuuuucaauugugguuacauuucaagagguauaguucuaggagauga

SEQ ID NO: 6692 - RNA, 1251 nt, Ceutorhynchus assimilis
auggacaauuuagaagcuaacauaauggauaaguccaugcgaucugucuuugugggaaacauuccauacgaggccacagaggaaaaacuaaaggauauauucggggaagugggucaaguauugucuuucaaacucgucuaugaucgugaaaccgggaaaccaaaagguuauggauucugugaauaccgugaccaagaaaccgcccugagcgcaaugagaaaucuaaauagcuacgaaaucggaggucguaacuugcgaguggacaaugcuuguacugaaaaaucucgaauggaaaugcaaaauuuacucaaccaaccacccauagagaaucccuauggagaaccgguucaaucagaaaaagcuccugaggcuaucaguaaagcaguugccucuuugccaccagaacaaauguuugaauugaugaagcaaaugaaagaaacuauucaaaacaaucccacugaagcuagacaaauguuauugcaaaauccacaauuugcuuaugcuuugcuucaagcacaaguaguuaugaaaaucaucgaugguuauacagcugcaucacuucuucauccuguaaaucaaguuccagcaacgcuuaugccuggagacaaaaacguuccuguucaagugccuauaaauagagaguuucaagcugcuccagcuccaguugcuccacccaggcaagaguuucaaccuguuccagcuccaauuauuauuccaaacaccaaucauagugcaccaguguuuacuaguaugaaugauguugauuucagagcuauggauccaagaguaccaacuguugacccuagauugaaccgcauggcugaucaggaucugaggaugccgcccgcagugcaaauuucaaauccuuugccaccagucgagagcuuuucuucagcagcaucuacagaaccuaacgcuagcuuuccuagggauccaagagaaguuagaaacggcccuggugccuuuuccaaugauccucgacaguugggaagaguugauccuaggcaaaaagcugcugcugcaccaguuccagucucucaaccccccagaccgucacaagcagcugcagcagcuucuauggcuucaguaaauggagcaaugccaccuggugcuucugaucaagaaaaggcugcucuuauaaugcaagucuugcaauugucugaugaacaaaucgccaugcugccuccagagcaaaggaauaguauuuugguauugaaggagcagauagcuaagagugcucagggacguuga

SEQ ID NO: 6693 - RNA, 1179 nt, Ceutorhynchus assimilis
augacugcaauggagccggaacgugagaaaguccugcaggacuaccgaaaaaaacuaauggaacacaaagaagucgagucucgacugaaagaaaugcgagagcaauugaaagaccucacaaaacaguacgacaaaucggaaaaugaccugaaagccuugcagagcaugggccagauugucggugaaguccuaaagcagcucacugaagaaaaguuuauugucaaagccacaaacgguccacguuauguuguaggaugccgcaggcaacuagauaagcuaaaauuaaaagcugguacucguguagccuuagauaugacaacucuaaccauaaugagguauuugccaagagaagucgauccuuuaguuuacaauaugagccacgaagacccuggcgaugucacuuauucggcuauugguggucuuucugagcaaauucgggaauuacgugaaguaauugaauugccucuaaugaauccugaauuguuuaugagaguaggcauuaccccaccuaaagguugucuuuuauaugggccuccugguacugguaagacuuuacuagcuagagcugucgccucucaguuggaugcaaacuuuuuaaaaguagucuccagcgcuauuguugacaaguacauuggagagucggcaagauuaaucagagaaauguucaauuaugccaaagaccaucagccuuguauaauuuucauggacgaaaucgaugcuauugguggacgaagauuuucagaagguacuucugcugaucgugaaauucagcguacccuaauggaacugcuaaaccaaauggauggauucgacucucugggacaaguuaaaaugauuauggcaacuaaccgucccgauacuuuagauccagcucuauugaggccuggucguuuggacaggaaaauugaaauuccuuugcccaacgaacaagccaggcuugaaauuuuaaaaauccaugcagggcccauugcuaagcauggagagauugauuaugaggcaauuguaaagcuuucagauaauuuuaauggggcugauuugaggaacguuugcacugaagcuggucucuuugcuaucagaucugaacgggaguauguuauucaagaggauuucaugaaggcagugaggaaaguggcugauaacaagaaauuggagagcaaauuggauuauaaaccaauauaa

SEQ ID NO: 6694 - RNA, 780 nt, Ceutorhynchus assimilis
auggcucgccgauaugauacaagaacuacuauuuucuccccugaaggccgacuguaccaggucgaauacgcuauggaagccauuuccuuggccgguaccugcuugggaauauuagccaacgauggcauuuuauuggcugcagaaaggcguaauaccaauaagcuuuuggaugaaguuuucacuucagagaagauuuauaagcuaaacgaagauauggucuguaguguagcugguauaacuucagacgccaaugucuuaaccaaugagcugcgccucauuggccaaagauaucuguuccaauacggacagucaaucccuugugaacaauuaguuucuuggcugugcgacgucaaacaagcuuacacccaauaugguggcaagaggccuuuuggaguaucaauuuuguacaugggcugggacaaacauuauggcuaccaauuguaccaaucugacccuaguggcaacuacagcgguuggaaggccacuugcauuggcaacaauaguucugcagcaauuuccagucucaagcaggaauacaaagaaggcggcaugacauuaaaagaugccaaaacuuuggccaucaaaguuuugaguaaaacuuuggacaugaccaagcugacaucggagaaaguugaaauggccacuuugaccaggagcaacgauaaaacagucacuaguauucugacuggcaaagaaguugaagcauugauuaaggaguaugaaacaacugaggccagcaaugaggcaaugaagagggaacaaucaaaagcugcugcuuaa

SEQ ID NO: 6695 - RNA, 2670 nt, Ceutorhynchus assimilis
augucgcaaaccacagcugaaauucccaccaaagugaaaaccaagaaagaugcggaggaagauaaaaacgaauugucugaggaagacaagcaacuucaggaugagcuaaaucuuuguguggaaagauuaacagaaaaugaugaaaaucuauauuuauccgcucuuaauguucucucaaugaaaauuaaagcuuccacaacuucuaugacuucggugccaaaaccauugaaguuuaugaaaccccauuaugauaccaugaagcaaguuuaugauaaaaucaaaaacccagaaguccaaagggugugcgcugauauuauuucaguuuuggccaugacuuugggagacgggcgugaauguuugaaauauagacuuuugucagauuuggauaagauuggagaauggggucaugaauaugucaggcaucuuucuggugaaauugcugcugaauggggagaaaaagaugaagacgacaaagacauggaagcaaaagucauucaguuggccaaacaaauuguuccuuacaauauggcucacaaugcagaagcugaagcuugcgacuugcucauggaaauagaaagacuugaucucuuggaaagauauguggaugaaaauauuuacaccagaguuugcuuauaucuuacaaguuguguggaguauguugcugauccagaaaacacgacucuuuugcaaacugcucuaaugcuauuuaaaaaguuuggccaguauccucaagcucuacguuugggaaugaaguugaaugaacaaaaacuuauugaagaaauauuuuuguccuguccagauaccauuguccaaaaacaacuggccuuuauguuaggucgucaacaaaucuacauagaagucccugaaaccacuccagaauaugaagaucuaacagaaauaauggccaauugucauuugaauaaucauuucuuaaacuuggcaagagaauuagauaucauggaaccaaaaaccccugaagauguuuacaaaucucauuuggaaaauaccagaccuucuuuuggagguagucaaguagauuccgcaaaacaaaaucuugcugcuaguuuugucaaugguuucguaaaugcugcuuuuggccaagacaaacuucucauggaagaugguaauaaguggcucuacaaaaacaaagaucauggcauguugagugcaacagcuucacuuggauuaguacuuuuaugggauguugauggggguuugacuccaauugacaaguacuuauacucuucagaagaucauauuaaaucuggagcacuucuagcaugugguauagucaacuguggugucagaaaugaaugugacccugcucuugccuuauuaagugacuauguuaugcauagcgcuccgaucauaagaauuggugcaauauuaggucugggauuagcguaugugggcucuaacagggaagcaguacucggccuacuguacccaguauuuuccgauaaaaguucuaauauggaaguuauuggaauggcugcuuuggcuuguggaaugauuucaguugguucugaaaauucccaaguaacuacgauccucaugcagacauugauggacagaucugaagaugacuugaaggauacuuaugcuagauuuauaccuuugggaguuggcuuaugucauuuggggaaacaagauaguguugaugcaauuguugcugcuuuggcaguucuuccugaaccauuuggaucuauggcaacaacuaugguggauauuugugccuaugcggguacaggaaacguacuaaaaguccaacaauugcuccacaucuguucugaacacuaugauacugauacaucugaaaaagacaaaaaagacaaagauaaggauaaaaaagaaaaaucagaagauaaggaaaaagaucauucagcaaggcaagcuauugcuguccuuggcauugcccuuauaaguaugggagaggauauuggcagugaaauggcuuuuagaaccuuuggaaaucuauuaagauauugugagccuguuauuagaagggccguaccuuuagcuuuaggucuuaucucugucucaaacccaaaauugaguauucuggauacuuuaaguaaauuuucccaugacagugacucagaaguugcucauaaugcuauauuugcaaugggcuuagugggcgcuggcacuaacaaugcaagauuagcugcuaugcuacgucaacuagcacaauaucaugcuaaagaucccaauaaucuuuucauggucaggauugcacaaggguuaacucauuuaggaaaaggaacuuugacgcuuugcccuuaucauagugacaggcagcuaaugaguccuguagcaguugcuggccuaauggcuacuuuaguugguuuucuagauguuaaaaacauuauccugggaaaaucacacuauuuacuguacacauuagcagcggccaugcagccuagaauguuggucaccuuugaugaagaucucaauccauuaccuguacccguucguguugguuuggcuguggaugugguagggcaagcuggcaaaccgaaaacgauaacugguuuccaaacucacacaacgccaguacuauuagcacacggagaaagagccgagcuggcaacagaagaauaccuuucgcuuacacccauaauggaaggauuugugauacugaggaaaaauccugacuuuaguccauaa

SEQ ID NO: 6696 - RNA, 1530 nt, Ceutorhynchus assimilis
auggcugacgauggaagagagaaaaauccagcuucuggugccagcgaagaaaacgacauugaagaaggcacuuauuuaaugaaaauggaaccgaaagaagagccccaagcuucuccgcaagacguucagccucccaaagaaagcgaacaagaugcugcagaaguaaaauuagaaaaacaagaagaaaauaacauuaaagaugaggcgaaaguguuggaagaaccgccaauaacggaagugauuguugaaagucaaccgaauauuacuccuccgccuucagugauuaaaaaaaauguucucaccacggcagguaaaauagaaagugcagaccaucuugaagcccacaacgaagaacucguggaagcccaagaaagcucugauacagaagacaaacacagagugccgcaagaagugguaccuuacgaaauaaucagucaagauuccucuacgcauucggagcaccaguuuacuguuaccagcaaaaguuucaacgcaggaaacuuccagcagcaccugcaccaacaccauccacaucagcaccaucagccggaaauuuucacauugcaaauaaccaauuccgaagguacuaccgugccggucaccauugaaaguaccauagacacuucggcugauuacgcuaaucuugaaacugcacaguacucgaauaacggacaguauccaccggaugguucucaguauuugcagcaacaucaguacaguaccaugcaguaucaguuggaacggaauagcggggaaaguccuccgauuuugaauaauaauguguuagugaggaauaaugaucccacuuuggcgucuuccagauaucaucaggaucuccgguuuucagcaagcaacuacgaacaacaauuaaaccaaaucacccugacagcaccccaaacgggccaaacguaccaaaucaguccagcgagcgcuggaucagauuccuggucgacguccaguaccgccacaacgcaguaccagcaaaccuaucaaggugcugccaacgugagcguccaccaagcugacagcaguacagcucaucaguacuacuugaacagcaacuggccagcgggcgcuuuggaggauggaggcaacaacguuucggcgcagaggucgccguccucagaggcuaacaauagaaggaaugggguggcaugugccaacuguaaaacuuugaacaccacucuauggagaaggaacaaccaaggagaaccuguuugcaaugcuugcgggcuuuauuucaaauugcaugggguaaaucggccaauaaguaugaaaaaagaaggaauccagacuaggaagagacgaccgaaaaacaauucuucuguucauaauggagcuggaguuucuggcaugccucaacgauuaagcaacacccaagccaucuacuaccaaaacaucucccaagaccaagaaaucccgaucgaccaguaccaauugccgcacaccgccguguaccaaacccaguaccacagaccgccgcaaauucaaaacgccgcugaccauuugggcagacaaauggcaaaguaa

SEQ ID NO: 6697 - RNA, 4983 nt, Ceutorhynchus assimilis
auggcacugcccagcaaugggauuuucgucgucaaaggagagaugaccauccugaugacugccaucaaaagaggaauucguuggccaucgcauucagacgaagacaccgacaauuuauugaaaaacauccaagauuugaaagaucuccugaugaaaaucgaugaucuaagacucguagaacccgacgucuuccuggcuccguuucucgaaguuaucagaagcgaagacaccagcggaccagucacaagcuuagcccuggcagcagucaacaaauuccuaucuuacggccuaaucgauccuacacacccuaguguuccuaauacaguuuacaacauugcggacgcagucacucaugccagauuugucggaaccgaucaaucuucagauggaguaguucugaugagaauacuucaaguucugagaacauugaccuuagcuccagaaggagccaugcucacaaaugagagccuaugcgaaauaaugcugaguuguuucaggauauguuuugaagcucgcauucaugagcuccuaaaaaaaaccgccgaacaauauuuaaaggauaugguacagcugguguuuaugcguuugccucaauuuucagaugaccucaggucuagcgugaagcaauugaaaaugagagcgggcauggaacauagcagaaccaaaaaacggagcaggcauucguuuaggaaaaaaagugcugagguuaucgaagagaaauccaaagaagcuccaacaaauguaguugauaugcaaggccaaauuuuacaaauagaugagaguccuacuacaacaguuaucgaggauaauauugaugcugaggaaaaagaagguucauuggaaaauaauagugaaccaauuauucaaaaaccaccaucuagcgagguauuagauacaaaugaaacuucaaaagauuaugugaaucaaagaggcauacgguuuacuccacaacuucaagaugauuuagucuuguuaccuuauggccuugcuugcgucagagaacuauucagauuucuaauaaguuuauguaacccaaacgacaaacaaaacaccgaagucaugauucauuuagguuuaacucuauuaacuguagcuuuugaagugggugcugacaguauaggaaaacacgccaccuuauuggcuuuagucaaagaugauuuggcucgcaacuuauuuucauuauugacaaacgaaagaauuucgauauuugcugcugacuugcaagugucuuuucuaauguuugaaucacucagaauccacuugaaauuucaaauggaaaaauacuuaacaaaacuaauugauauuauuguaagcgauaaucaaaaaauuaacaauuacgagcauaaagaaguugcuuuagauaacauauuacaauuauggagaauaccugguuuuguaaaugaacuuuaucuuaauuacgauugcgacauguacuguacuaauuuauaugaggauuuaacuaaauugcuggcuaaaaaugcuacuaauggaauuuggcacacacaccuaaugucuuuggaugcuuuauuaacugucauugaaggcauagaaaugcauuguuuugaaucuaaaacaaaaaacauaauaggcaaaacuauaagacaaaauuacagugacaauuugccugcacuagaugaucuauuggccagaaaaaauauuaaaaaguggcuaccucaagguaccgagcacuucaacacaaaacccaaaaaagguauucaauuuuuccaagaacaugguguucucaaaccugaauuagacccacaugaaguugcaauguuucuacgagaaaauccagcuuuagacaaaaaaaugauuggcgaauacauaagcaacagaagcaaccuaaacauccuugaagccuuuguaaaaaccuuuaauuucaacggaguaagaauugaugaagccuugagaagcuuucuagaaucguuuagauuaccaggcgaagccccaacuauuucauuaauccuggaacaauuugcugagcauuggcaccaaagcaacaaugaaccauuugcugacguagacucagcauuuacucuggcuuaugcuguaauuaugcucaauguggaucaacauaaucagaaugccaaaaaacaaucaaauccaaugucggauucugcauucaaaaaaaaccugcaaggaguuaaugguggagacaauuuugaagaaucaauguugaaugaaauuuaucaugccauuaagggagaugaaauuguaaugccuucggaacaugguggcuugauucgugagaauuauuuguggaagguuuuguugaggaaaggggcuucaaauaaaggagauuauuuucauauaccuccagguacuuaugauucugagcuauuucguuuaauuuacgauccgauugugucugcauugugcuucauuuacgaacauacagaagaggauucgguguacaaacacguugugagcggauuugaaaagugcgccuugguagccgcccauuuugguaugacagcgaauuuggauacuuugauuuugucuuugugcaaguucaccguuuuuuauaaucagaggagacagaauaauauuaugauauuauucgguucgaauagaaaagcucaacuagcccuaaaaacaguauucaguuuggugcaucuaaacggcgacaauauaagacaaggcuggaaauauauauucgaucuaauccuagccuuauacagcaacaacuuacuaccaaaauccuacauugaaccggaagauuuuauaaaucaaagcggccauauaguccuagucuaugaagaaacugaaaauuuacaaaaacaagaaucagguuuauuuaguucuaucuacuccuacaugguuucggcagaaaacuugucuaaaaucccuucaccugaagagcaacaauuuauggauuuggccaaagaaugcaucaaagacugcaauuuggaucaacuaauaacagacucaaaauuccugcaugaagaggcuuuaguggaguuaguaaaaugucuuauagagcuaucaagaggcccagauguucaaaaaagcuuaggauacaauuacaaugaaaauguuacuguguuuuucauggaacuauuauuuaaaauuguuauucaaaacagggaucgugugauaacaauauggcaaccaguaugugaucacauuuacacuuuaguaaugaacgcuucaguuuucgacuaccaauuccuucuagaacgcucuguuauuggccuauugagaauagccauaagauuaaugcgaaaugaagaaaugugccccauagucauacaaucucuaagaauguuguugcuauuaaaaaguaccacucuauguagaaucuccaaacaaauuuccuacgggcuuuacgagcuacuaaaaacuucagcucaaaauauucacaccacaacagauuggacuauaauuuucacuuuauuagagugcguaggggcaggcgcucagccuccaaaaccuguagcagacgauggcagcacuugcgcagaccaaucaaagucagauggcgaaaaucaaauaaacagcgacgaagaaaguguaguaucagacagaggcuacaccucagauucugaacuaacaaaaaaacaaaaagcaauucuggcaacuucucccuguggcacuccaaacacaggaggcuggauuuuggugggcaacgaaggcgaaauuguuggucgaacagugccuccgacacaauacggcauugcuuuggaaagaaauuuaggcccacacgauucaaugaguuugauaaaaugcugcgaaagcuuggcauuuuuaguuagagacguggcccacauaacaccguacaauuucgacauuugcguacaauguauaaggacuuuuguugaggcaagccuacaaacugacaacaaaaaacgcaaaagaaaagucgccucucguaggaaauccgaauuaagaaguccugcggcuaguaguccaagcuguagugaagaugacgauuuuccuagugguuaucaucacuugcuuuuagacuugaugcauacguugcacacgaggacugcccaaauuuucaaauggugggcggaggaaggcggcgaaaucgcucaagaaaugucacuguggacucaagguuggugccccuuauuacaaggcauugccaggaugugcugcgaucgccgugaagaaguccggaucagugcgauugcuuucuugcagagggcguuguuggugcacgauuugcaaacuuugaacgguuuggagugggaacaauguuuucaucggguguuguuuccguuacucaauuacuuguugcaaccgagcgguucuaagggacccauugcgauggcugaguucaggaauagggcugccacuguauuaucuaagguauucuuacaucauuuaacaccccuacuaucucugccaacauuccccaaucuuuggacaaacauucuggacuacauggacagguacaugcacgcugacaaaagcgacaucuuauccgaagcgauuccugaacucuugaaaaacaugcugcugguaaugaacucggccaaaguauucgacaaugccgaaggcaaaaaucaacuguggcaccacacuugggagaaaaucggacgguuuuuacccaaucucaaagaggaacuauucaaggaaccuguaaaacucaaaccuauuauacaagaugagaugguuucaacaccaauugguucuacacaaacaccuucuacaucuauacuacaaccuacucuacaaccuggaaugccuuauaugccuaauuuauuaacuagugcaaaucagcaacaaggucaacaacacgcauuuccaguuuuauauaacagucccacaguuauaccaaguaccaccacaaccgaaauucaaccauuaucauuguaugccgaauuuuuaggaaauccuuauaauuuggacaagaauuuagaagccguagacaaugcugaaucaaacuuuuuccagucuucaaacuauuucaacaauacaauuaugccagccggaagugaaauuuuguuuggcauggauaaagauuguaauaau

SEQ ID NO: 6698 - RNA, 618 nt, Ceutorhynchus assimilis
augucgauccuagcauauaacggaggcgcuaugguagcaaugaaaggagaaaauugcgucgcuauagcugccgauagaagauucgguauccaagcucaaacccuagcaacaaauuucgaaaaagucuucgaaauggggccccaucucuacgucggucugcccggcuuagccaccgauacccaaacagucagagaaaaacugcgguucagaaaaaacuuguacgaacucaaagaaaacaggcugaugucgcccaaaguauucagcgcuaugcugucucauaugcuguacgaaaaacgcuuugggccguucuuuguagaaccuguaguagcugguuuagacccgaaaaccuacgagccauuuauuugcaauauggaucuuauugguugcaucaaucagccuaaagauuuuguuguaggagguaccgcuucugcacaauuguacgguaugugcgaggcuuugugggaacccaaucuagggccugaggauuuauucgagacuauuucgcaagcuuugauuaaugcuuuugauagggaugcuguuucugguuggggugcaacuguauacauaauugaaaaggauaaagucaccaucaagaacuugaagacccgaauggauuaa

SEQ ID NO: 6699 - RNA, 2811 nt, Ceutorhynchus assimilis
auggaggaaaaaccuaaccuagacauuguaauuuuggccguguccacuuuguacaagaacccggagagaacagaaaaggaaagggcuucggaauggcuguugaacuuacaaaaaucgguccaugcauggucaauagcagacgaauuguuacacaaaaaaccagacuuggaaucuugcuacuuugcagcccaaacaaugagaacaaaaauccaccaauccuuccacgaauugccaguagaaguucacgcagcauugagagauucucuuuuagagcauauuagucaaauuaaugaaggaacuaauaccguaauaaccacccagcuaugccucgcucuaucagauuugauauugcaaaugcccucuuggccuugugcuucuuuagauuuaauuaaucguuuuucuaaucacucuuacauguggccuuugguggagauuuugacuguuuugccugaagaauuggaggguagaucuguaagauugggcgaaaaucgcagacuagaaguacuagaagacuuaaaacaaugcgcaccaacaguacuagaauuccuaaagcauugcugucacacuuacgguaccaacguaaacgaaaacacccauauuguagccagaauguugcgcuguuucaacuccuggauuuccguaggcgcaauaacuuugcacggucuuucggacaauaucguuuugaauuuggcuuuugacauuuuggacuuuaggccucacgauggaaaagaaucuucuggggcauuaugugacgcggccaccgaaugcauuugcacauugcuucaguguuuagaggacaauaacaaucagcaagacuuggaaaauuaccuuuucacaaacauauuaaaacuagaagugucuuaucacauuucgguugccaaugaagaucaaaguaaaucuauagauuauuguagauuguuuacugaauuggcugagucguuuuuggaaaaaaucgucucgaauaguacggcaucgaauuugcauuacgcuaucaaaguuuuagauaugguuuuaaugugcguagggcaucaugauuaugaaguugcugaaauaacuuuuaacuugugguacguccucagugaggaauuguaucagaaaaauaauaaggaauuaacugagcuguuuaggccuuauguugaaaggcugauaacugcuuuguguaggcauugccaaauggaaccugauggagaugguauuuuagaugaaggugacgaauuuaaagauuucagaaagaaaucuucagacuugauaaaagaugugguuuuuauugugggcagcuguagcuguuucagacaaauguuuuuaaauuuacagacuccuaauguuacuugggaucaaacugaagcugcuuuauucguaaugcaggcuguugccaaaaaugucuuaccauccgaaaacgaagugguaccaaaaguggucgaggccaucuugaccaugccucaaaccacccauuuagcgguacgucacacuucgguacuccuauugggcgaacuaugcgaauggauccaaaaacacucucacguuuuggauccgguacucaacuuucucguauccagucuuucagcacgaggauuaggagccgcagcugcuucagcacuacaaaacauaugcauugcuuguaauaagugcauuuccaggcauaugccgauuuuguuacaauugcuacaccaaguugauaguuucucuauuacaaauaaugccauuauugguuuguuaaaagguguugccucaauuguaucagugaugccccauucagaaauaacaguuguguugcgugaauuauguuuuaugcaauugacuccuuugguacaaguuauggaacaaaccacucucccuguaaaagguaccacaaaugauccaauuuuguggcuggacaggcucagugcuauuuuaaggcauguuauuauuguggggguuaaugaaaaugagguccauccgugcaaaccuguaguacuggaaauauggcccauuuuauugaaagcuacagauaaguaccaaaaggauacuagaaccauggaaagguguuguaggaguauuagguuuaugcuuagaugugcuagucaacaaguaugugaaauauuggaaaguuuaguuagacaaauaauaaggcuuuauaacgagcacaaacauucuugccugcucuauguuggcaguauucuaguggacgaauaugcuccaaauucccaaugugugaacgggcuuuuagauauguuacagguauuuauugaacccacauuucacauguugcaacaagaagacggucuucgaaaucauccggauacuguugaugacuuuuucagauugugugcucguuucauccaacgagcuccaguuccacuacuccguugcaacgucuugguucccauaauccagugugcaauguuagcugccucguuggaccauaaagaggccaacauguccguaaugaaguuuuuuaacgaccucauuaaccaagguuugacuggacauucuuugcccgauuuugccgagagacaccagcuggucaaagcgauuuuggaccaauuaggacagcaauugguuaacgcuuuagugcaggcuugcguguuuuauuugcacacuuauaugcuaagcgaaguuggagauguuuuugugcaauugcuggauuucaauagggagaauacgaguaaauggauagcgggggcuuuggauaaucuuccuaagcaaagcaauggaggcuugaugacugcaacuccugagcaauuaaaugaaauucauauuaauuuaauuaggucaaguacuucaaaauccguaacgcacucuuugaaagaccuaacacgacuguaccgauag

SEQ ID NO: 6700 - RNA, 1347 nt, Ceutorhynchus assimilis
augaauacuaguggcgguaccaugauccaaagaccuucaggagcucaauauucgccaaugagaggccagaugcaaagucaaccuggagggaaacgaccaucugauaaccguaauucuaugcaacaaaaaagugacuauggucacauaaccaguaaaaagaaaaagaaacuagcugacaaaauucucccacaaaaaguucgagacuugguuccugagagucaagcauacauggacuuacuagcuuuugaacgaaaacuugacgccacaauaaugcguaaacgucuagacauacaagaagcuuugaaaaggcccaugaaacaaaaacgcaaauuaaggauauuuauuuccaacacguuuuauccugccaaagaacccuguccugauggaccagacgggccuggagcagaaggacugguugcuucuugggaacuaagaguugagggaaggcuacuggaugauucaaaaaaugacccgaauaaaguaaaaaggaaauuuucgucauucuucaaaucauuggucauugaauuggauaaggagcucuacggcccugauaaccauuuaguugaauggcaccgaacacuuacaacacaagaaacagaugguuuccaggucaagaggccaggugauaaaaauguccgauguacgauacuucugcuuuuggauuaccagccuuugcaguuuaaacucgauccuaggcuugccaggcuacuuggaguacauacgcaaacccggccaguuauuauuucugcuuuguggcaguauaucaaaacccacaaguugcaggauacucacgagcgggaauauaucauuugcgacaaauauuuggaacagauuuuuaauuguuccaaaaugaaauucgcugaaauuccacaaagauuaaauccuuuauuacauccaccggauccaauuguaauaaaucacguaauuucaguggagggaggagccgaaaguaagcaaacugcuuguuaugauauugauguggaaguugaugauacauuaaaaacgcaaaugaauaauuucuuguugagcacugcgagucagcaagaaauucaaggauuagauucgaaaauucaugaaacuguugacacaaucaaucaguugaaaacaaauagagaauucuucuugaguuuugcuaaggauccgcaacaauuuauucauaaguggaucguuucgcaaacuagagaccuaaaaacuaugacggauguuguuggaaauccugaagaagaaagaagaucugauuucuuucaucaaccuugggcacaagaagcaguuugucgcuauuuuuacacuaaaguucagcagaaaugugcugaauuggagcaagccuuagcuauucguaauaauuaa

SEQ ID NO: 6701 - RNA, 882 nt, Ceutorhynchus assimilis
augccaucggccaccaucaguacacuacaacuucccaacaaugaggauugugguaucagagauguuugggcucauaaucuggaagaugaauuccgaacuauuagacagauuguccagaaguaccauuacguggcuauggacacugaguuuccugguguaguggcucgucccauaggagaauuucguaguucagcugauuaucaguaccaaauguugcguuguaacguugacuuauuacgcaucauucaguugggacugacauucuuggacgauaauggaaaaacgccugggggcaguuauacuacauggcaauucaauuucaaguucaacuugcaggaagauauguaugcccaagacaguaucgaccugcucacaaauuccgguauacaguucaagaagcaugaagaugaugguauucaaccuuuggaauuugcagaacuccuuaugucaucuggcauuguacuaauggacaauauuaaauggcugagcuuucacucuggauaugauuucggauaccugaucaaacuccuaacagauaguaaccuacccccugacgagaaugacuuuuucgauuugcugaaacuguauuuucccgcgauuuaugauguuaaauaccuaaugaaaucaugcaaaacacuuaaagguggccuucaagaaguggcggaacaauuagaacuagaaagagugggaccccaacaucaggcugguucagacucgcuuuuaacuggaauggccuuuuucaaaaugaaagaaauguucuuugaagauacuauugacgacucaaaauuuucuggacaucuauauggcuugggcaccucuuuugcugucaauggaucgaauaauuacggacaggauaauggagaaaacacaaacucuacauaa

SEQ ID NO: 6702 - RNA, 1206 nt, Ceutorhynchus assimilis
auggcagcgaaaacucaaaaugcccccuuugaggaccucucgaacguugaguucgaaaccagugaagaugucgaaguuauugauacauucuccaguaugcaccucaaagaggaacuuacaaggggaaucuaugcauaugguuuugaaaagccuucagcaauccaacagagagccaucaaacccaucaugaaaggcagagacguaaucgcacaagcccaauccggaacugguaaaacggccacauucuccauuucgauucugcagucuauagauuuaaccaugcgggaaacgcaaguacuuugccugucgcccacaagagaauuggcuguacaaauucaaaaagucauucuggcucucggcgauuuuaugaacgugcagugccaugcuuguaucggugguacuaaucuuggugaagauaucaggaaauuggauuauggacaacauguuguuagugggacuccaggaagagucuaugauaugauucguagaagagcuuuacguacaagagggguaaaaauguuaguccuugacgaagcagaugaaauguugaauaaaggcuucaaagaacaaauuuacgauguguaccgauuuuuaccaccauccacacaaguuguacuuauuucugcuacccuaccucacgaaauucuggaaaucacaucaaaauucaugacagauccaauucguauuuuaguaaaacgugaugaauugacauuggaaggaaucaaacaauucuuuguggcuguagaaagagaagaauggaaauuugacacauugugugacuuguaugauacuuugacuauaacacaagcuguuauuuuuugcaauaccaaaaggaaggucgauuggcugacugaaaaaaugagggaaaacaauuuuacuguuagugcuaugcacggugacaugccucaaaaagagagagauaauauuaugaaggaguuuagaucaggacagagucguguuuugauuacuacugauguaugggcaagagguauugauguacagcaagucaguuugguaaucaacuacgauuugccaaacaaucgugaguuguacauucacaggaucgguaggucuggucguuuuggacguaaagguguugcaauuaauuuuguaaagucugacgauaucagaauucucagggauaucgaacaauauuauucgacgcagauugacgagaugcccaugaauguugcugaucuuaucuaa

SEQ ID NO: 6703 - RNA, 1605 nt, Ceutorhynchus assimilis
augacggcacccaaagccuccggagacgcgacccgcaaccggaauuuagcuuacaaagacaaaaguaaacccacagauguaaggacuaguaauauaaaugcagcaaaagcuguuugcgaugcuauucguaccaguuuggggcccaggggaauggauaaaaugauccaagcaggaaauggccaagugaccauuaccaaugacggggccacaauuuugaagcaaauaaauguuauucauccagcagcaaaaauguugguagaauuauccagagcucaagacguugaagcuggagacgguaccaccucaguaguagucauugccggagcucuccuagaugccgcugaaagauuacugaaccguggcauucaucccacagcgauuucugaaucuuuccagcgagcagccgugcaugcuuugcagauuuuaaacaacauugccaccccaguggaacuaaacaaccgagaacaacuaaucaaaacugcagcaacuuccuuaaauucaaaaguagucucucaacaaucuagccagcuugcuccauuagcuguagaugcuguacuaagaauuguugaaccaggucgugaagcugccuguaaucucagugacauaaaaguccucaaacaacuuggcgguacaguggaagacaccgaacuuaucaacgguuuaguguuuccgcaaaaguuggccaacguuucugguccaaaaaggauggaaaaggccaaaauuggucuuauccaauuuuguauuucaccuccuaaaaccgauauggaccauaacauuguuguuucggauuauuccgccauggauagaguucugaaggaggaacgugcuuacauuuugaauauuguuaagcaaauuaaaaaggcuggauguaauguuuuauugguccaaaaauccauccucagagaugcagucucugacuuggccauccacuuuuuggacaaaaucaagugcauggucaucaaggacauugaaagggaagacauugaauucguuugcaaaaccuugaguugccgucccauugcuucucuugaucauuuugucgccgaaaauuuaguauccgcugaacucguagaagagguuggauuuggaggaaacaggauggucaaaguuacagguauucaaaauccuggcccuacaaucacccuucuaguacgagguuccaauaaauugguccuagaagaggcagaaaggucucuucaugaugcccuaugugugguucguugucuuguacguaagaaggcagucauagcuggaggaggagcuccagaaauugagcuggcuuuaagauuggccgcucuagcugauaaacuggaagguguagaugcuauuugccucagagcuuaugcuaaugcuuuggagauuauuccauuuacuuuagcugagaaugcuggauuaaauccuauccagacuguuacagaguugaggaauagacaugcuaaaaacgagguaucugcugguauaaauguccguaaagggugcauuucagauauccuagaggaaaaugucauucagccucuuuugguaaccacuucugcuuugucuuuugcuacagaaacugugagaucgauuuugaaaauugacgauauugucaacacaaugaccuaa

SEQ ID NO: 6704 - RNA, 1233 nt, Ceutorhynchus assimilis
auggaagcuauggauguaguucuaccagaaaaggaggaagguaguccuucugacaacaccaaacagucucuccaagaugcagacacugaagaccucuacacaaaauacaaaaaacugcaacaaaugcucgaguuccucgaaguucaagaagaauacaucaaagacgaacagagaaacuugaaaaaagaauaccugcacgcucaggaagaggugaaaagaauccaaucagucccucuggucaucggccaauuuuuagaggcuguagaccaaaacacuggcauagugggauccacuacaggcucaaacuauuacgucagaauucuaucgacuauugacagggaauugcugaaacccagcgccagcguggcucugcauaaacacagcaaugcgcuggucgacgucuuaccaccugaagcugauucuuccauaagcaugcuucaagccgacgaaaaacccgaugucagcuacggugauaucgguggcauggacaugcagaaacaagaaaucagagaagcuguagaacugccuuugacgcacuuugaacuuuacaagcagauuggaauugauccuccaagagguguuuugauguacgggccaccuggauguggaaagacuauguuggcuaaagcuguagcucaucauacaacugcugcuuuuaucagaguaguaggaucugaauucguccaaaaauacuugggagaaggaccuagaauggucagagacguauuuagguuagcuaaggaaaacucuccagcaauuauauucauugacgaaaucgacgcuaucgcuacaaaacguuucgaugcucaaaccggugcugaucgugaaguacagagaauccugcuggaauuguugaaucaaauggaugguuuugaucaaaccaccaacguuaaggucaucauggcaacuaaccgugccgauacauuggauccagcuuuacuaagaccuggacguuuggacaggaaaaucgaauuuccgcuuccagacagaagacaaaagcguuuaguuuucagcacuauuacuuccaaaaugaauuuaucugaagaaguugauuuggaagauuacguugcaaggccugauaaaauaucuggcgcugacaucaaugcaauuugccaggaagccgguaugcacgcugugcgugaaaaucgcuacauuguuuugcccaaggacuuugaaaaagguuacaaaaacaacauuaagaaggaugaaagcgaacaugaauucuacaaauaa

SEQ ID NO: 6705 - RNA, 423 nt, Ceutorhynchus assimilis
augccaagaaucaaacuccaaucauccgauaaugaaauuuucgauaucgaagucgaaaucgccaaaugcucagugaccauuaagacaauguuggaggauuugggcauggacgacgaagaagaagaagcugugccucugcccaacgucaacucugcuauuuugcguaaagugcugcaaugggccacuuuccacaaggacgauccaccaccgccagaggaugaugaaaacaaagagaagcguaccgaugacauuucuucuugggacgcugauuuucugaaaguugaccaaggaacguuguucgaauugauuuuggcagcuaauuauuuggacauaaaagguuuguuggaugucaccugcaaaacuguggccaacaugauuaauaggaaaagcccccgaggagauaagaaagacuuuccacauuaa

SEQ ID NO: 6706 - RNA, 993 nt, Ceutorhynchus assimilis
auggaaaaucaacagcuagaaauugauguccagcaaucgaacuccgagcugcccacgauggcgguggacgacaaggcgucgaguaaggagcuggaccaguggaucgaacagcuaaaugacugcaagcaauuaacggaaaaucaagugaaaacuuuaugugauaaggcaaaggagauucugucaaaagaauccaaugugcaagaagucaaauguccagucacaguaugcggugauguacacggucaguuccaugaccucauggaacuguucaggauagggggucguagcccggacacaaauuaccuauuuaugggcgauuaugucgaccgugguuacuacucaguugaaacaguaacacuauuaguugcccucaaaguccgcuacaaggaaagaauuaccaucuugaggggcaaccacgaaucaaggcaaauuacacaaguuuacggcuucuaugaugaaugcuugagaaaauacggaaaugcuaauguuuggaaauucuuuaccgauuuauuugacuauuuaccacuaacugcucuaguugauagucaaauuuucuguuugcacggaggauugagcccuagcauugauaccuuggaucauaucagagcuuuagaucgucuacaagaggugccucaugaaggcccaaugugugaccuguuauggucggauccggaugaucgagguggauggggaauuaguccuagaggugcugguuacacuuuuggacaagacaucucggaaacguuuaaucauucuaauggacugacacuaguuuccagagcucaucagcugguuauggagggcuauaauuggugucacgauagaaacguuguuaccaucuuuagcgcacccaauuacugcuacagauguggaaaucaagcugccauuauggaauuggaugaugcacuuaaauauucuuucuuacaauuugauccagcuccuagacgcggugagccucaugugacucgucgaacuccugauuauuucuuguaa

SEQ ID NO: 6707 - RNA, 2514 nt, Ceutorhynchus assimilis
augcagauuuuugugaagaccuugacaggcaaaaccaucaccuuggagguugaacccucugacaccaucgagaaugucaaagccaagauccaggacaaggaggguauccccccagaccagcaacgucugaucuuugcugguaaacaacuagaagauggucgcacccuuucugacuacaacauccagaaagagucuacccuucauuugguguugagauugagaggaggcaugcaaaucuucgucaagacuuuaacuggcaagaccaucaccuuggaaguugagccaucugacaccauugaaaaugucaaggcuaaaauccaggacaaggaagguauccccccagaccagcaaagauugaucuuugcuggaaagcaauuagaagaugguagaacuuugucagacuacaacauccagaaagaguccacccuucacuugguguugagauugagaggaggcaugcaaaucuuugucaaaacuuuaacuggcaagaccauuaccuuagaaguugagccuucugauaccauugaaaacguuaaagccaagauccaagacaaggaaggcaucccaccagaccagcaaagguugauuuuugcuggaaagcaauuagaagauggcaggacuuugucagacuacaacauucagaaagaguccacccuucauuugguguugagauugagaggugguaugcaaauuuuugucaaaaccuugacuggcaagacuaucacauuggaaguugaaccaucugacaccauugaaaaugucaaggcuaaaauccaagacaaggaagguauuccuccagaccagcaaagguugaucuuugcuggaaagcaauuagaggauggacgcacuuugucugacuacaacauccaaaaggaauccacccuucacuugguacugagguugagaggugguaugcaaauuuuugucaagaccuugacugguaaaaccaucacacuugaaguugaaccaucugauaccauugaaaacgucaaagcuaaaauccaagacaaagaagguauuccuccagaccaacaacgucuuaucuuugcuggcaagcaacuugaagauggaagaacucuuucugauuauaacauccagaaagaauccacccuucacuugguucugagauugagaggugguaugcaaauuuuugucaaaacuuugacuggcaagaccaucacccuugaaguagaaccaucugacaccauugagaaugucaaagcuaaaauccaagacaaggaaggaaucccuccagaucaacaaagauugaucuuugcuggcaaacaauuggaagauggcagaacuuugucugacuacaacauccaaaaggaauccacucuucacuugguacuaagauugagaggugguaugcaaaucuuugugaaaaccuugacuggaaaaaccaucacccuugaaguugaaccaucugauaccauugaaaauguaaaagccaaaauucaagacaaggaagguaucccuccagaccagcagagguugaucuuugcuggaaaacaacuugaagauggcagaacuuugucagacuacaacauccaaaaagaauccacccuucacuugguacugagguugagaggugguaugcagauuuuugucaaaaccuugacuggaaaaaccaucacccuugaaguggaaccuucagacaccauugaaaauguuaaagcuaaaauccaagacaaggaaggcaucccaccagaccaacagcgucuuauuuuugcuggcaaacagcuugaagauggcagaaccuuaucugacuacaacauucaaaaggaauccacucugcauuugguacucagacugagaggugguaugcaaaucuuuguaaaaaccuugacugguaagaccaucacccuugaaguagagccauccgauaccauugaaaacgucaaagcuaaaauccaggacaaagaagguaucccaccagaccagcaacgucuuauuuuugcuggcaaacaacuugaagauggccgcacccucucagauuacaacauccaaaaagaauccacgcuucacuugguauuaagauugagagguggcaugcaaauuuuugucaaaacuuugacuggaaagacuaucacccuugaaguugaaccuucugauaccauugagaaugucaaggccaaaauccaagauaaagaagguaucccgccagaccaacaacgucuuaucuuugcuggcaaacaacuugaagauggccgcacccucucagauuacaacauccaaaaagaauccacccuccauuugguauuaagacugagaggugguaugcaaauuuucgugaaaaccuuaacugguaagaccaucacucuugaagucgaaccaucugauaccauugagaaugucaaggccaaaauccaagacaaagaaggaaucccaccagaucaacaaagguugauuuuugcuggcaaacaacuagaagauggaagaacuuugucagacuacaacauucaaaaagaaucuacucuccacuugguacucagacuucgugguggaaacuag

SEQ ID NO: 6708 - RNA, 1620 nt, Ceutorhynchus assimilis
augcaaccccaaauuuuacuacucaaagaagguacugacacaucucagggaaaaccucaauuaaucuccaacauaaaugccugccaaucaaucguagaugcuguucgcaccacauuaggcccaagaggcauggacaaauuaauugucgugagaaaugguaaagcaacaauaucgaaugauggggcuacuauaaugaaauuguuggauguuguucauccugcagcaaagacuuugguugacaucgcuaggucacaagacgcugaaguaggcgauggcaccacuagugugguuuuacuugcuggagaguuuuuaaaacauauuaaaccauauguugaggaagguguucauccuagaauuauuauuagaucuguccggaaaugcuuacaacuaugccuggccaaaauuaaugagauuucugugaaaaucaacaaagcaaaugugucagaauuucguucauuauuagaaaaaugugcugcaacugcaaugaguucaaagcuaaucaaucagcaacgaguauuuuucucuaaaaugguuguagaugcaguucuacuacuugaugaacuuuuaccacugaauaugauuggaauuaaaaaaguacagggugguggccuagaagauucuauguugguugcagguguagcuuucaaaaaaacuuuuucauaugcuggcuuugaaaugcagccaaagauuuauaaaaacugcaaaauugcuuuauugaauauugaauuggaguugaaagcugaaagagacaaugcugaagugcguguugauaaugucaaagaauaucaaaagauugucgacgcugaauggaauauacuuuacaagaaacugcaaaaaauccacgaauccggagcuaauguugugcuuuccaaguuaccaauuggagauguugccacucaauuuuucgccgacagggauauguuuugcgcuggucgcgucccagacgaugaccuuagaagaacucucaaagcuuguggaggagcaguaaugacuacuguuaacgauaucaaugauucaguacugggaaaaugugaucuuuuugaagagcgucaaauugguggagagagguucaacuuuuucaaaggaugccccaaugcuaaaacuuguacguugauucuaagaggaggugccgaacaguuuuuggaagaaacugaacgaucuuugcaugaugccauuaugauuguucguaggacaauucaaaaugaugcuguuguugcugguggaggugcaaucgaaauggaacucuccaaaaugcugcgagacuauucaagaacaauugcuggcaaagaacaacuuuuaauugccgcaaucgccaaggccuuggaaauaauuccaagacaacuaugcgacaaugcugguuucgacgccaccaauguuuugaauaaacuucgucaaaaacaugcccagggccauugcugguauggcguagacaucaauaaagaagacaucagcgauaauuucgaaucuugcguuugggagccagcuauaaucaagaucaaugccuuaucugccgcuagcgaagcugcuuguuugauuuugucugucgaugagacuauuaagaaugaaaagagcggcggggaccaaccucaaaugggucgugguauggguagaccaauguaa

SEQ ID NO: 6709 - RNA, 2679 nt, Ceutorhynchus assimilis
augaguaaaacaaaaaaauucaaaaagcgcuacgaaacagacucgucguccagugucgacucagaagaagagcagcgcagaaaagaucugaaagaacgugacgaauuugccgacagacucaagaaacgcgauggcgagaaaacuagaaacauuauucaagccucagacagaagagcguacgaggaagcggcuaaaaggcuucagcuggaaagugccgcgagagaaaaaaucguucccaagcucagaguugaauccagacggaaauaucuagaaaaacguaaagaugacaaguuacaggaacuggaagccgauauuguagacgacgaauaucuauucgaagaaggcauuuuaacagaacgcgaaaaaaaggaaaggcaacacaaaaaagaacuccuaaaauuagcucaggaacaugaaaaagccagagaguuggaaagaguacaaagguaucacaugcccagagauuugggcaaagauucgacaucagacuacauugaaguggacgaacuugaaaaaguaccacaaucagagcagaaaaaaugggaaaaagaccaaauggcaucagccguuuucaaauuuggagccaaagaugcuacaaaaaaagaugacuacgaauuaguacuggaagaccaaaucgauuucauucaagccuugcaaaugccaggcucuagagacaaaauaaaaaaagaaccagaacugucugaacacgaaaagaaaaaguuaaccauugaggaaaccaaaaaaagcuuaccuauauucccuuuuaaagaugacuuaaugcaagcagugcgggaacaucaagugcuuauaauugaaggagaaacuggcucugguaaaaccacucaaauuccucaauacuuacaugaagcuggguuuacagaggauggaaaaaaaauugguugcacccagccacguaggguagcagcuaugucuguagcagcucguguagcucaagaaauggguguaaaauuaggcaaugaaguuggauacgcuauaagauuugaagacugcacgucagaaagaaccauaauaaaauacaugacugaugguacuuugcauagggaauucuuaucagaaccugauuugcaguccuacagcgucaugauuauugaugaagcucacgaaaggacuuugcacacagacauuuuauucggacuaguaaaggauauugccagguuuaggccugacuugaaauuacuaauaucaagugcaacauuagaugcccaaaaauucucggaauuuuucgaugaggcucccauuuuuagaaucccugguagaagauuuccuguggauauuuauuacaccaaagccccugaagcugacuauguagacgcuuguguaauuucugugcuacaaauucauguaacccaacccuugggggacguuuuaguauuuuuaacuggucaagaagaaauugaaacuugccaagagucacugcaagaccguuugagacguuugggcuccaaaguaagggaacucauaauauugccuguauaugcuaauuuaccuagugauaugcaagcuaaaauauuugacccgacuccaccuggagccagaaaaguaguauuggccacaaauauugcagaaacuucuuugacaauugacaacauaauuuacguaauugauccaggauuugcaaagcaaaaucacuuuaacuccagaacaagcauggagaguuugauggugguaccaauuucaaaagcuucagcuaaucagagagcugguagagcuggccgaguggcugcaggaaaguguuuuagauuguacacugcguggucuuauaaacaugaauuggaagagaauacagugccagaaauucaacgcauuaauuuaggaaaugcuguuuuaaugcuuaaagcuuuaggcauuaaugacuuggugcauuuugacuuuuuggacccgcccccucaugagacauuaguguuagcucuugagcaacuguaugcuuugggugcuuugaaucaucauggagaauuaacuaaaauggguaggagaauggcugaauuuccuguagauccuaugauggcuaaaauguugcuugccucagaaaaauacaagugcucagaagaaguugucacgaucacugcaauguugucuguaaauagcucaguguuuuauagaccuaaagacaaaauaauucaugcagauacugcuagaaagaauuucuaucacuuggcaggagaccauuugaguuuauugaaugucuacaaccaguggaaagauacugauuauucuuuacaaugguguuaugagaauuucauucaguauagaucuaugaaacgagcuagagaugucagagagcaacuaguaggcuuaaugcaaagagucgaaauagaaauggucucuaauguaucagaaacuguugauauaagaaaagcuauuacagcaggauauuuuuaucauaucgcucggcucucaaaaggugguagcuacaaaacagugaaacacaaucagaguguaacaguucaucccaacagcgcucuauuugaagaauugccaagauggauuuuguaucacgaacuaguuuuuacuacaaaggaauucaugcggcaaguaauugaaauugagagcaaguggcuguuggagguggcaccgcacuauuauaaacccaaggaacuugaggauucuaccaauaagaaaaugccaaaaacuguugggagaagcacucgaacugaauaa

SEQ ID NO: 6710 - RNA, 1371 nt, Ceutorhynchus assimilis
augaagguggaggaagugaaaaguaccauaaaaacucaacgaauuagugcccauagucacguuaaaggccugggucuggacgaaaauggauuugcuauugcccaggcggccggcuuggucgggcaagaacaggccagagaggcugcagguaucguggucgauaugaucagaagcaaaaaaauggcaggccgagccguauuacuagccgguccuccagguacuggcaaaacugccauagcucuugcaauagcacaggaacuggguaauaaaguaccuuucuguccgauggucggaucggaaguguacagcucugaaauaaaaaagacagaaguacugauggaaaacuuucgaagggcuauugguuugagaguaagagaaacuaaagaaauuuaugagggagaaguuugcgaacucucuccuguggaaacggaacaucccguuggaggucaagguaaaucugucagucauguaguaaucggccuaagaacagcaaaaggcaccaaacaacuaaaacuugauccgaacauuuaugaggcucuacaaaaagaacgagucgaaguaggagacguaauuuacauagaagcccucaguggggcuauaaaaagacaaggaagaucugaugcuuucgccacugaauuugauuuggaagcugaagaguacgugccucuacccaaaggagauguacacaaaaagaaggaaguuguucaggauguuacauuacacgacuuggaugcagcaaaugccaagccacaagguggucaagauguucuuucaaugauggggcaauuauugagauccaaaaaaaccgaaauaacugauaaauugagaaaagaaguuaauaaaauugucgacaaauacauugaccaagggauugcugaauugguccccggaguacuuuucaucgaugaaguucauaugcuggauauugaaacuuuuacuuauuugcacaaggcuuuagaaagugccauugcuccuaucguuauuuuugcuacaaaucgaggcagaugucuuauuagagguacugaugauauuuauucuccgcacggcauuccauuagauuuacuugauagacucuugauuaucaggacugugccauacgaucguccagauauggaacaaauuuugaaauugagagcuaaaacugaagguuuagaaauugaugauaaugcucuaacagcucuaggagcuguaggcacaaaggcuacuuuaagguaugcagugcaacuuuuaacuccggcucauuuaacagccaaaggcaacaagcgaaccaacauuacagucgccgauguugaagaaguuucauuuuuguuuuuggacgccaaacagucggcaaagauucugucggaaaauagugcuaaguuuaugcaauaa

SEQ ID NO: 6711 - RNA, 2208 nt, Ceutorhynchus assimilis
augacuucaauaauaaaacuacaaguccucucgggggcuauggacgagucuccgccagcuuaccuuuugcaaaucgacgacguaaaaauccuauuggauugcggcugggaugaaaaguucaauauggaauucauuaaagaagucaaaagacacauucaccaaauagaugcuguccugaucucguacccugacacaaugcauuugggggcuuugcccuauuuagugggcaaacuagggcugaauuguccgauuuauucaacgauuccuauuuauaagaugggucaaauguucauguacgaauuguaucagucacaaaugaacaugaagucuuuuauguuguuuaauuuggacgauguugaugcuacauuugagaaaauuauacaguugaaguauaaucagagugugccuuugaaaggaaaagguuacggucucacgauaacuccuuuaccagcaggccacaugauuggcggaacaauauggaaaauaaugaaagcaggcgaagaagauaucauauacgcuaacucauucaaccacaaaaaagagaggcacuugaacgguugcgaauuggaaaaauugcaaaggccuucuuuguuuauuacugaugcuuucaaugccaguuaucaacaggccagacguagagccagagaugagaaauugaugacaaacauuuuacaaacucuuagaaauagcgguaacguucuaauagcaguagacacugccggcaggguauuggaauuggcccacauguuggaucaguuguggagaaauaaggaaucagggcuuuuaacauauucucuagcacuuauaagcaauguagcuuacaauguugucgaguuugccaaaucgcaaauagaguggaugagcgacaagcuaaugagaaguuuugagggugcgaggaacaauccguuucaauuuaaacauuuaaauuugugccacagcuuacaggaauuaaauaaaguucccagcccaaagguaguuuuggcuacuagcccugacuuggaaauggguuuugcuagggaacuauuuuugcaaugguguucgaauucaaauaauaguguaauuauuaguacaagaacaucuccaggaacuuuggccagggauuuaauugauaacaacgaaccgggacgaucaauugauuuaauugucgaaagaagagugaaacucgaaggccaagaauuagaagaguacgagaaaagacagcaaaugacuaaaguugaaaaaacaaccaaagaagacgacucugacucugaaagcgacauagaaaugucgguaauauccaaaggcaggcacgauauuguugugaaacaagaaggcaaaguggguggagguuuuuuuaaagugaccaaaaagcaucauccaauguauccuuuuaaagaagaaaaaaucaaaugugacgaauauggugaaaucauaagaguagaagacuacaaauuggcugacauuacuccagaaguugaagacaauaaagaaaaucuucaaauuaaaguggaagauguugaugaaaucauugaaguuaccgaucuuccuucaaaauguauagcccuagagcguacaguccaagucaauugccaagugcaguauauagauuucgaaggccgaucagauggagagucuuuaaucaagauuuugucacaauugaaaccuagaagaguaauaguuguccauggaacaccagaaaacacugaaauaauugcaaaacauugccgagaaaacauuggagcuagaguguuuacaccgcaaagaggcgaaauuguugaugcuacaagugaaacacauauuuaucagguucgauuaacugaugcuuuaguaucccaauuacaauuccaaaaagccaaagaagcagaaguggcuuuuguuaaugcuaauuuacaaauuagagagucccaagcugaugcuagaagauuggaugcugaugaugaaccaauggaaguuauagaagaagaugcccaucagcuuacauuggaaccgugcaacgaagauuauucaagggaaccaguuuucauuaccgaauugaaauugucagauuucaagaagguuuuggccaaagcuaaugugccuucggaauuuuccggugggguuuugugcuguugcaaugguacaauugcuguaagaaagcuugauacuggcaaaauuguuuuggaagguugcauuucugaagacuauuauaagauuaaaggucuuuuguaugaacaauuugcuauuuuauaa

SEQ ID NO: 6712 - RNA, 2226 nt, Ceutorhynchus assimilis
augucuucuucgggggaaguagguaguaguaccaguacccaagaugcggcaccggcuaaucccauugugggcaucauuuacccgccuccugagguuagaaacauugucgacaaaacagccaguuucguggcaagaaauggucccgaauucgaagcuaggauucgucaaaacgaauugggaaacccgaaauuuaacuuuuugaauucgggagacccuuaccaugcuuauuaucagcauaagguuaaugaauuuagagaagggaaagcucaagaaccuucccuugcucaaggaauaucuaagcugacaguaucugcaagucagcaacagaaacaacaugacauucuuaaacaaguugagcaaccguuuguaccaaaggauccacccagugauuuugaguuuauugcugauccaccuuccauaucugcuuuggauuuggacauuguaaaacuaacggcccaauuuguagcaagaaaugguagaacuuucuugacccaacucaugaacagggaacagagaaacuuucaauucgauuuccuacgcccucaacauucucuauuccaauauuucaccaaauugcuugaacaauauacaaagauuuuaauuccuccaaaaacccuccagcaaaaguuaagagacgaaaucguaagccaccaaaccauucuagaugaagucaaguacagggccgaguaucaaaaauaccaagaagcccaaaaagccagagaagaagagauacuagaacgcgaacgaguugccuaugcucaaauugacuggcacgacuuuguagugguagaagcggucgauuaccaagcauucgaaaucgguaauuucccaccuccaaccaccccagaagaaguaggcgccagaauucugauccaagaacguauagaagacggcgaagacaucgaaaugcaacuugaaagugacgacgaugaaccuacaaauguagauucaggccucagucauauggaagacagaacaggcccuacaagccguaaagauaacaaucaagugcaagauauggacgaggagaguucagaggaggaauaugaaagagaacagccacaacccauacaaccaccuaugccuccggcuuuggauaaagugguuguuaaaaaauaugauccuaaaaaacaaacaccaaaaguuacuagaccaacuccaggggaugauuauuuggugucgccaauuacaggagagaaaauuccugcuaguaaagugcaggagcauaugcggauugguuuguuggauccuagauggguggaacaacgugauaaacauguuacagacaaaaugaaucaagauacaguuuaugcucaagguccagccauagaggccaguuuaaaauuguuggcugaacgucguacugauauuuucggugugggagaugaggaaacugcuauugguaaaaaaauuggagaagaagaaagaagagaugaaaaggucacuugggacggacacacuucuaguguggaggcggccacuagggcugcaagggcuaauaucaccuuggaagaucaaauacaucaaauucacaagguuaaagguuuacuuccugacgaagaaaaagaaaaaaucgguccuaagaacuugcaaggcucaaacaaaaugaaaaugccaccggcuccgaucauuaaaccuccaccaccaguuuugacagcgccuucuacaacaucgauagguauuccuguaccuccucaaccucagauuaugguacaaccaccuauaaugaugaugccggcaccaccaauggcaccaaugagaccaccacuuaugaugcccacccauccacccauggcagguuuuguuacuccaaugccuccgcccauggguuuaccgccaaugccaguaaaacacccaaacgaugguccuucagaggaagagccuuccaauaagaaauugagaaacgaagauucacuggugccagaagaaauauuuucggcaagaaauccgaacccgguuaauauaaaaguggcgauuccgaugaugccugauaaacccgaauggaaacugaccggacaaauguugucguucacguugccuauaggcgaaaaugugggaaauuugaaagucaagauacaagaggaagucaguaugccuccaacgaaacagaaauuguuguuugaugguauguuuuucaaagaucagaacacuuuggcuuauuacaauaucacuccgggcgcuguuauucaguugcaauugaaggagagagguggcaggaagaaauaa

SEQ ID NO: 6713 - RNA, 966 nt, Ceutorhynchus assimilis
augcccagccaagaagugaguaccaccaaaguggugguccacccuuugguacuacuaagcguggucgaccauuucaaucguaugggcaaaaucggcaacuccaaaagaguaguagggguuuuguuggguuguuggcgggccaaaggaguuuuagauguuuccaacaguuuugcagucccauuugaugaagacgacaaagacaaaucuguuugguuuuuggaccacgacuacuuggaaaacauguaugggauguuuaaaaaagucaacgccagagaacguguuguggguugguaccacacuggacccaaauugaaccaaaacgacauugcuauuaacgaauugguaaggcgguacuguccaaauucuguauugguaaucauugaugcggaaccaaaagauuugggcuuaccaacugaagcuuaccaagcaguagaagaaguucaugaugaugguucaccuacuucuagaacuuuugagcaugugccaagugaaauuggagcagaagaagcugaagaaguagggguggagcauuuacuaagagacauuaaagauacaacuguugguacuuugucucagagaauuaccaaucaguuauugggccucaaaggccuucacucgcaacugagagaaaucagagacuauuugauacaagucagcgaaucaaaauugcccauuaaucaucagauaaucuaucaguuacaagacauuuucaacuuauuacccgauaucaaucaauuggaauucaauaagucguuuuaugugagaaacaaugaucaaauguugguuguuuacuugucuacucuuguccgguccauuguggcuuugcacaauuugaucaacaauaaauugaccaacaaagaugccgaagaaggcaaaaaggaagagaaaaaagauaaagaugccaaggagaaggaaaaggaaaaagauaaagacaaagacagcaagaaggaugaaaagaaaaaauaa

SEQ ID NO: 6714 - RNA, 1650 nt, Ceutorhynchus assimilis
auguuuggcggcggacgugcaccgauuuuaguuuuaagucaaaacacuaaacgugaauccggccgaaaggugcaguuggagaauaucaaugcaggaaagcaaaucgccgauguaauccgaacaugccugggaccccaagcuaugcuaaaaaugcugauggaccccaugggggguaucgucaugaccaacgacggcaaugcgauuuugagagaaaucacugugcaacauccggcagcuaaaaguaugaucgagauagcuaggacacaagaugaagagguuggugaugguaccaccucagucauaguucuugccggagaaauguuagcugcagcugaacaauuucuagaacaacaaauucauccgacaguaaucaucagacaauaccgucaagcccucgaagacauaauuucccuuaucgaaggaccuuugaguguacccauugacaaaaacgacaaagccgcucuuagcaauguugucagagguugcguuggcaccaaauucauuggcaaaugguccgauuuggcagugaaaaucgcuuuggacgccguccauacugugaugcuggaggaaaaugguagaacugagguggacauuaaacgauaugccaaaguugagaaaauucccggugggucuauugaagaaucagaaguuuuaacuggaguuaugcucaauaaagaugucacucaucccaaaaugagacguuauauugagaauccuagaauuauuuugcucgauuguucuuuggaguauaaaaaaggagaaucucaaacuaauguugaaauuacuucugauggugauuuuacuagaauguugcaauuggaggaagagcacgucaggaggcaaugcgacgaaguuauagcccucaaaccggauuugguguuuaccgaaaaggggguuucagauuuggcucagcacuuuuuguugaaagcaggaaucagugcuauucguagaguaagaaaauccgacaacaacaggaucgcucgcgccuguggcgccaccauaguaaauagaaccgaagaauugcaagaauccgacgucggaacuggagcgggucucuuugaaaucaaaaaaaugggcgacgaauacuuuugcuacaucaccaagugcaaaaacccgaaagcuugcacaaucauuuugcguggugccagcaaagauaucuuaaacgagaccgaaaggaauuuacaagacgccuugcaaguagccagaaauauugugcuuucgccucgucugguaccagguggaggcgcaaucgaaauggcuauagcccaaaaauuguugcagaaagcuacucacggaccuuacagaucuuuggcacacgcuuuagaaaucauuccucguacacuggcucagaacuguggcgccaacacgaucaaaacucucacugcgcucagagcgaaacacgccaaucacaccgacguaaacucucccugcacuuggggcauugacggcgaaucuggcgaacucguagagcaaaaagaaagaggccucugggaaccucuggcggucaaacuucaaacuuacaagacggccaucgaaacugccauuuuguugcugcguauugacgauauuguuucuggaucuaagaagaaggacagggaaccagcagggccugcucagacucaagaaacugccgcuaugaugcaagauuga

SEQ ID NO: 6715 - RNA, 699 nt, Ceutorhynchus assimilis
augucucucgucgugaaaccaaacuuuccugauuaucaaacugcucccguacaacgcggauuuaaucccuacgcugacaauggcgggaguguuguggcaauagcaggcgacgacuucguuauaaucggagccgacacgcgucugagugccggguuuucgauuuacacucgcgaacaaaacaaauuguucccauuguccaguaccacggucuugggcuguucugggugcuggugcgacacccucacuuugaccaggauuuugaagucucgcaugcaaauguaccagcaggagcacaacaaaacaaugucuacuacugccugcgcccaaaugcucuccacuaugcucuauuacaaaagguucuuucccuauuacauuuccaauguauuaguugguuuggauaaugauggaaaaggggugguuuacaguuacgauccuauuggucauugcgaaaaaagaacucacagagcuggaggaucugcgggugcucuauugcaaccacuuuuggauaaucaaauuggcaagaagaacauguugaaugugaaagaagaaccgguuucgcaacagagagcuuuguccaucauuaaagauguguuuauuucagcugcugaaagagauauuuacacuggggauaguauuuuaauaaauaucauuacuaaagauggaauuaaggaagaaacuuuccaauuaaggaaggauuaa

SEQ ID NO: 6716 - RNA, 990 nt, Ceutorhynchus assimilis
auguccuccaggcguaaucgauuuguuucaagaagaauuaacauucagaaugcggcugccagagaguuccaauuuggauuuaacauguucccggacauuccgaggcccuucaauguuacuuaccaaugcuauucgguagcuaugcuuccuggaaaugagagacaggauguagaaagagguggaaaaauuauuaugccuccaagugcucuagaacaacuuaccagacucaauauaaauuacccaauguuauuuaaacugacaaauaaaaauucuggaagagaaacacacugugguguuuuggaauuuguugcugaugaaggaaaaguuuauuugccauuauggaugaugcacaauaugaaccuagaagaaggcgagcugguacaaauggaaagugucucucuaccugucgguacauuuuccaaauuccagccauuaucuccagaguuucucgacauuacuaacccgaaagcuguauuagaaaauugccucagaucguuugcuugccucacuaaaggagauguaauugccgugcaauacaaccaaaaaaucuaugagcuuuguguauuggaaaccaaaccagguaaugccauaagcauuauugaaugugauaugaauguagaguuugcugcgccugugggauacaaggaaccugaaauagugaggaaaccugaagaggaaauggcuguagauccugcugaauugaugccggagccuacuggauuuauagcauuuaaaggagccgguaauagauuggauggaaagaaacggaaggauucuacaucuacugauguuucgccacauaaaccaauauacgucagaggaauuccagacuaugacuaugaaauuggaaguuugagauucauuagagcaauagcaaaaccaaaaaauaaugauaauaaugaaagugaugaguuuaaaccguucucuggugaagguuucaguuuaaaagacagcgcuuauuuauuguuuguuauuauuauuauuuuuuuu

SEQ ID NO: 6717 - RNA, 1629 nt, Ceutorhynchus assimilis
auggcggguuuuccgggcaguauugccuucgacgaguacggcaggcccuuuaucauccugcgggaucaggacaagcaaaaaagacugaccggaaucgacgcccuaaagagucauauuuuggccgcuagacaaauugcaaacacuguuaggacuucuuuggggcccaaagggcucgauaaaaugauggugucuccugacggugauguuaccguaaccaacgacggcgccacgauucuaaaaaugauggacaucgaacacgaaauuggcaaacuccuaguagaacuaucccaaucucaagacgacgaaaucggcgacgguacuacuggagucgugguacucgcuggggcuuugcuagaacaagcagccaguuuaguagaccgcggcauucaccccauaagaauagccgacgguuucgaaauggccugccaaacugccguagcucauuuggaaaaaaucgccgaacuuuucccgguuuccgccaccaaccccgagccucuuauacaagucgccaugaccacuuuagguucaaaaaucaucaacaagugucacagacaaauggccgaaaucgcagucaacgcugugcuagcuguggccgauuuggaacagaaagaugucaauuuugagcugauuaaagucgaaggcaaaguggguggcaaauuggaagacacuguauuaguuaagggagugguuaucgacaagacaaugucgcacucgcaaaugcccaaggagcugaaagauguuaaauuggccauuuuaacuugcgcguuugaaccaccaaaaccuaaaaccaagcauaaguuggauguuggugauguugccgcuuauaaagaguugagacaauaugaacaggaaaaauucaaagaaaugguuaauuuggugaaaaaugcuggagcuacguuggcaauuugccaguggggcuuugacgaugaagccaaccaucuucuuuugcagcaacaauuaccggcuguccguuggguaggagguccggaaaucgaauugaucgccaucgccacuggugggcgcaucgugccacgauucgaagaauugagcccggaaaaauugggaacggccggauuaguacgcgaauugucuuucgguaccacaagcgacaaaauguuggucaucgaagaaugcgcaaauucaagggcaguaacaauucuaguacguggaggcaacaaaauguuaaucgaagaagccaagcguagcuuacacgacgccuuguguguaguucguagucuggugcaagaacccaacaucguuuacggaggaggugccgccgaaaucgcuugcaguuuagcuguagcggcucaagcugaccaauuagcuucuuuggaacaauacgcuuacagagguuuugccgaagcuuuagaagccauuccuuuggcucuagcggaaaacagcgggcuuucagcaauucacacuuugggugaauugaaagccaagcaaucggcuaguggagauccggcuuuagguaucgauuguauguuuacuggaaauaugaauaugagggagcagcacguuauugaaucuuugaaguccaagaggcaacagcuguuguuggcuacgcagcuuguuaaaaugauuuugaaaauugaugaugugaggucacccagcgaucaacaaggauaa

SEQ ID NO: 6718 - RNA, 348 nt, Ceutorhynchus assimilis
auggcaucagcauccgcaauggacguggacacugacgaaguagaaaugcccacaucgagcagcucaaagggggaaaaaaagcgguucgaagugaaaaaguggaaugcaguagcccuaugggccugggauaucguuguugacaauugcgcuaucugcagaaaucacauaauggauuuguguauagaaugccaggcuaaucaggccuccgcuaccagcgaagaaugcacugucgcuuggggcguuuguaaucacgcuuuccauuuucauuguaucucgagaugguugaagaccaggcagguuuguccauuggacaacagggagugggaauuccaaaaguauggacacuaa

SEQ ID NO: 6719 - RNA, 1605 nt, Ceutorhynchus assimilis
augguuucccucaauccaguuagaguacuaaaucaaaaugccgaagaagaaagggcagagauugcucguaugagcaguuuuauaggagccaucgccauuggugauuuggucaagagcacucuaggaccaaaagguauggacaaaaucuugguaucaaguggccgaaacgcugguuccguagaagucacaaacgacggcgccaccauccucaaaucaguaggaauugauaacccagccgcuaaaguccuuguagacauguccaaagugcaagacgaugagguuggagauggcacaacuucuguaacaguuuuggcagcggaacuguugagagaagcugaaaagcuugucgaucaaaaacuucauccucaaaucauuauugcaggauggaggaaggcuucugauauugccagaaaggcuuuggaagacgcuucagaggauaacagugcuaguucagagaaauuccgcgaggauuugaugaauauugcucguacaacuuugagcucgaaaauucuuucccaacacaaagagcauuuugcuaacuuggcaguggaugcuauucuuagauuaaaaggaucuggcaacuuacaagcuguucaaauuauuaaaaagucuggcgguacuuuagaagaaucguuuuuggaagaaggcuuccucuuggacaaaaaaccagguguucaucaaccaaaaagaguagagaaugcuaaaauuuuaauugcaaauacaccuauggauacugauaagauuaaaguguuuggcucgacaauuaagguugacucuauggccaaaauugcagaacuagaauuagcagaaaaggagaaaaugaaagacaaaguaaauaagauucucaaacacaacgcuaacguuuuuaucaaucgucaauugauuuacaauuacccagaacaauuguuugcugaugcuggcguuauggcaauugaacaugcugauuuugauggcauugaaagauuagcauuaguuacugguggugaaauagucuccacuuuugaucaaccagaaucuguaaaauuaggaacuugugaucucauugaacaaaucaugaucggugaagacauuuuguugagauuuagugguguugccuugggagaggcuugcucuauaguuauucguggugcaacgcaucaaauuauugaagaagcugacagaucccuccaugaugcuuuaugugucuuggccgccacaguuaaagaacaucguguaguguauggaggagguugcagugaaacuuuaauggcuguugcuguuaguaaagcugcuuugaauacgcccgggaaagaagcuguugcuauggaagcuuuugccagagcucuucuacaacugccaacgauuauugcugacaaugcugguuacgauucugcgcagcuuguagcggaauuaagagcaucccacaacaaugguaauuccuuugauggucuaaauauggaaaaaggcgaaauuggugauaugcgugcccuaggcaucacagaaucguuugcagucaaaaggcaggugcuucuuucagcaucagaagcagcugaaaugauucuucguguagacaauauuauacgugcagccccaagaaggagagucgaagauagaggacacuguuaa

SEQ ID NO: 6720 - RNA, 840 nt, Ceutorhynchus assimilis
auguucaggaaccaguacgacagcgacgugacgguguggagcccccaggggcgucugcaccaagucgaauacgccauggaagcggugaaccuggguucagcuacuguggggcucaaaaguaacucgcaugcggucauuauagcccuaaaaagagccuccucugaauugucugccuaccagaaaaagaucaucaacaucgacgaucauauugguauuacuauaucagggcuuacugcagaugcaaggauuuugagcagauacaugagaacagaguguuugaauuauaaguacucucacgauacuuauaugccaaugaauagacuuauuacaacuuuaggcaacaaaaugcaaguuuguacucaacguuacgaucgucgucccuacgguguaggccuuuuaguugcugguuuugacgauaagggcagccacauuuaccaaacuugcccuucggccaacuuuuacgauugcaaagccaugucuauuggguccagaucucaaagcgccaggacuuacuuggaaaagcauuuggaucaauuauuaaacagcagcuuagaagaacuuauuaaacacgguuugagggcuuugagagacacccuuccuccagaaauagauuugucuaccaaaaauguuucuauugguuuuguuggcaaggaaaggcaauuuaagauuuuagaagaagaggagauugcaccuuauuuaggacuuauugaaggugaggagagaagaggacagggugcugauaaagcuccagggccucuuagggaagaucagggggaagcaccgagggacccccaagcagcuacagccacagaagcugcagacagaauggauacagauuaa

SEQ ID NO: 6721 - RNA, 2550 nt, Ceutorhynchus assimilis
augaaaaugccaguuagaaaccaaauauccgaauuuaugccuaugguuaucguauuuucagacgaugagcuaccuuaugaagaagaaauacugcgcaaccccuauucggucaaacacuggcuacguuacauugaccacaaaaaacaaucgccgaaccucaucuacgaacgugccuuaaaacagcuaccuggcagcuacaagcugugguacaacuacuugcucauaagacgucaacaagucaaaagcaaaugccuacuggauccagauuuugaggccguuaacaauuguuuugaacgcucccugguguucaugcacaaaaugccccgcaucuggauggauuacugucaauuuuuaacagaucaaaacaagaucacgcgcacgcgcaaaguauuugauagggcgcugagagcgcuaccaguaacacagcaccaucggauauggccuuuguauuugaaguuugucucuaaacaugacauuccggaaacuucuguaagaguuuuuaggagauacuugaaguuguucccagaaaauagagaagaauuuguggaauuuuugcaaaaaauugauagguuagaugaagcaaguguuauuuuagcuaaauguguaaauaaugacaacuuuauuagucgaaauggcaagucuaagcaucaauuauggaacgaacugugcgaauuaaugucaaauaacccacaaaaaauucuaacuuuaaauguggacgccauuaucaggggcggcuuaagacguuacacggaccagcuaggucaucuauggaccagcuuggcaaauuauuacgucaggagcggccuguucgaucgcgccagagacauuuuugaggaagccauacaaacuguuacaaccgucagagauuuuacacaaguuuuugaugcauaugcucaauuugaagaguuaagcuugagcaagcaaauggaagaaguggcuaaaauugcugagccaacugacgacgacaauguugaccuugaauuaagguuggcgcgguuugaacacuugauggagaggcggcuacugcuuuugaacucgguuuuguugaggcaaaauccgcauaauguacaggaauggcauaaaagaguccaacuguaugauggacaaccucacgaaauuaucaauacuuauacagaagcuguucaaacgguucagccaaaguuggccguugguaagcuucacucccucuggaucgccuuugccaaauucuaugaacaaaacucacagugugaagaugccagacugauuuucgaaaaagccacugaaguagaguacaucaaaguagacgauuuggcaacaguguggugcgaacgaguugaauuagagauccgucaggagaacuacgaggaagcuuuaaaacugauguaccgugcuacagcaaugcccaaacguaaaguggccuacuuugacgagaaagaaucagugcaggcccggcuuuauaaaucuuuaaaaauaugggcaauguacgcagacuuggaggaaaguuucgguacauucaaaucuugcaaagcugucuacgauaggauuuuggauuuaaaaauugcaacgccgcagauuauuauuaacuauggaauguuuuuggaagagaacaacuauuuugaggaggcuuuuagagcguaugaaaaagggauaucguuguucaaauggccgaauguuuacgauauuuggaauacguauuugaccaaauuucuaaagagauacaagggggacaaaaucgagagggcgagggaccuguucgaacaaugccuggaaacuuguccagaagccuacugcaaaaaccucuacuuacucuaugccaaacuugaggaagauuacggaauggcccaucaugcaauggcaguuuacgaacgugccacacaagcugucucacaagauuccaugcuggaaauuuuuaauauuuacaucaaaaaggcaucgagcauuuacgggauaccaaaaaccaggcagauauaugaaaaggcuauuucugucuuaccagagaaggacauacgggauguuugucuaagauucgccgauauggaaacuaaauugggagagauugacagggccagggguguuuauucgcacuguagccagauuugcgauccuaggauuacaggggaauuuuggcaaacuuggaaggaguuugaaguuaaacaugggaaugaggagacuaugagagaaauguugagaauuaagaggagcgugcaggcaaccuauaauacucagguuaauaugaugucaguccaaauguugggaucauccucaccucuaggaacuacagccgauuuagcaccaggcgaaaaggauggaaugcgacuguuggaagucagagcugccgaaauggcuucuucuucaggugcucaaaaaucggcgaccagcgguauaauguuuguuagaggcgaaacucaaggagguaaaaaggauaaagugguuaauccagacgaaaucgauaucgaugccgacgggggugaagacgaagauggggaagaugaugaggauccugaaccuuuauuggaacaaauagaggugccucaggaaguguuuggcaguuugaaaaagccugauuaa

SEQ ID NO: 6722 - RNA, 1089 nt, Ceutorhynchus assimilis
auggcuaacggacccauagcugaaagaaauagagaugccacuaucuauguuggaggccuggaugaaaagguuguagacuccuuguuaugggaacuguuuguacaaaguggaccauuggugaauguccauaugccuaaagacaggguuaccaugaugcaccagggcuauggauuuguggaguucaugggcgaagaagaugcagauuaugcaauaaaaauaaugaacaugauaaaacuauauggaaaacccauuagaguaaauaaagccucugcccaucagaaaaaucuugauguuggugccaauauauuuauugguaauuuagaucuagaaguugaugaaaaauuacuuuacgacacuuucucugcuuuuggaguaauacuucaaacgccaaagauuaugagggauccagaaucuggaaauuccaaagguuuugcuuucgucaauuucgccaacuuugaaucuucggaugcuuccauagaagccaugaauggacaauacuugugcaacaggccaauuuccguaucuuacgcuuucaagaaagauucaaaaggagaaaggcacggaucagcugcugaacguauuuuggcugcacaaaauccguuaucacaggcugacagaccccaucaacuguuugcagauucuccaccaaucggcaugaugccaccaggaaugacgacugcuccuccaccaccaccaggaauguugggucuaccgccacccucugugacacccaacacuacgauuccacccccaccgccugcuguucccccaccagcaucauuuccugcaggaauuccgccgccuccguuaccgcccucucaaccaccuuugccgccaauugcacccccaccgccuccagcuucuaagccaggugugaugaacccaccagcaccauggaaagggggguuggguaaucccccaccaccaccuguaccaccaguaucugauccaaacuucuccaaauugcuucugccuccuccaccgccaaguggaccaccacaaaaaugggaaggaccgccgcccucggccauuucuggaaggccguccuuuccaccuagaagaccaccacccccgccgcccacaaauuaa

SEQ ID NO: 6723 - RNA, 693 nt, Ceutorhynchus assimilis
augggucguguaauccgagcacagagaaaaggugcugggucuguauucaagucccacacgaaaaagaggaaaggggcgcccaaauugcguuacuuggacuuuuccgaaagacauggcuacaucaagggugucguuaaggacauuguucacgaucccggcagaggagcaccuuuggcuuucguacauuuccgugacccuuacaaauucaagacacguaaagaauuguucaucgcccccgaaggaauguacacuggacaauuugucuacuguggcaagaaagccaauuugcaaauuggaaauguauugccaguaggaaccaugcccgaagguaccauuguguguaaccuugaagaaaaaacuggugacagaggccguuuggcucgugccucugguaacuacgccacuguaauugcccacaaccacgacacgaaaaaaaccagagucaaguugccuucaggcgccaaaaaaguaaucccauccaacaacagagccaugguugguaucguagcugguggagguaggaucgacaaacccauccugaaagccgguagggcuuaucacaaguacaaggugaagaggaacugcuggccuaagguuagagguguugccaugaaccccgucgagcauccucacggaggugguaaccaucaacacauugguaaagcuucuacuguuaagagggguacauccgcu

SEQ ID NO: 6724 - RNA, 411 nt, Ceutorhynchus assimilis
auggcucguaccaagcagaccgcucguaaauccacuggaggaaaagcaccuaggaagcaguuagcuacgaaagcugcacguaaaagugccccggcuaccggaggagucaagaaaccucaucgcuacaggccuggaaccguugcucuccgggaaauucgccguuaucagaaaaguacugaauugcugaucagaaaacuuccauuccagcgcuuaguucgugaaaucgcucaggauuucaagaccgauuugcguuuccaaaguucagcaguaauggcuuugcaagaagccagugaggccuaccuggugggucuuuucgaggacacuaaccuuugcgccauccaugccaagcgagugaccaucaugcccaaagacauccaauuggccagacguaucagaggcgaacgugcuuaa

SEQ ID NO: 6725 - RNA, 1596 nt, Ceutorhynchus assimilis
auggcuauuagcuuguuaaauccuaaggccgaagucgccagggcugcccaggcauuggccguuaacauuucggccgcaaaagguauccaggaggugaugaaauccaaccugggacccaaggggaccaugaaaauguugguaucgggagcuggcgacaucaaaaucaccaaagacggcaacaucuuacuucacgaaaugcaaauucaacaccccacugcauccuuaauugccagagcuucaacugcccaagaugauaugacuggugaugguacuacauccacuguucuccugauuggugaacucuugaagcaggcagacaucuacauugcagaaggccuccauccgagacuucuugcugagggcuuugauaaagcuaagaccaaagcuuuagaaguccuggacaaaaucaagauccccauugaaaucaauagagaaaauuuauuggauguuugcaggacuagucuaaggacaaagguucaucaaacuuuggcugauguccuuacagaaguuugugucgaagcagucuuagcgauaagacccaaagacaacaaaccuguugauuugcauaugguugaauuaaugcaaaugcaacacaaaaccgagacugauucaucauuaaucaaagguuugguacuugaucauggaucccgucauccagacaugccaaaacgucuggaaaauugcuacauuuuaacuugcaaugugaguuuggaauaugaaaagagugaagucaauucuggcuuuuucuacaaaacugcugaggagagagacaagaugguucuugcugaacgugaguuuauugaucagagagucaagaaagucauugaguugaagaaaaaaauuugcacugguaccaauaagacuuuuguuaucaucaaccagaaaggaauugauccuaugagcuuggaucaauuagcaaaggaagguauuauagccuuaagaagagccaaaaggcgaaacauggaacguuuaucuuuggcuuguggugguacugccaugaauacuuuugaugauuugagugagucgugccuuggauaugcuggucuaguuuacgagcacguucucggugaaacuaaguucacuuuuguugaggagugcaagaacccucaaucuguuacuauuuuauugaaaggccccaacaaacauucuuugcagcaaaucaaagaugcuauuagagaugguuugagagcuauuaauaaugcuauugaagauaaagcuguaauuccaggugcuggcgccuucgaaauugcugccaacaaagaacuucuucaguggaaagacacuguuaaaggcaagacuagguuggggguaguugcguaugcugaagcucugcugguuauucccaagauucuggcuacaaauucuggauuugauguccaagaaaccauugucaaacuucaagaagaaagccacacaagucccgagccaauuggcuuagaucugaccuccggagagccaauuucuccaaaagaugcuggaauuuuugacaacuacauuguuaaaaaacaaauaauuaauucuuguucagucauugccaguaauuuauuguugguggaugaaauuaugcgggcuggaaugaguagucuaaagggcuag

SEQ ID NO: 6726 - RNA, 3141 nt, Ceutorhynchus assimilis
augucuagugcugaaaacgcagacagcuccgucgaucccccaacuaaaaaacggaagcucgaggcaagaaaaaguaccaacacggacagggaaauggcgaacaacggcacagcuucgaguucucaggcucagggucaaacuagugaaauugaugaaggauuauacuccagacaacucuauguauugggccaugaugcuaugcguaggauggcuacaagugauguacuuauauccggcuugggaggauuagguguugaaguugccaagaaugucauuuugagugguguaaagucaguaacuguccaugacgacaaagaagcaacaauaacugacuugagcucccaguuuuuuuugucagaagaggacguuggcagcaaccgugccgaggucguuugcaaaaaacuagcugagcuuaacaguuaugucccaacucguucuuacacuggaucccuugaugaagauuucauuaaaaaauucagaguagucguucugaccaacucuacuagcagugaacaacugagaaucagugaaaucacucaugcuaauaauauugcuuugaucauagcagacacuagaggguuauuugcccaaguguuuugugauuuuggagaaucuuucacugugguugaugcaacuggagagccuacuguuucugcuaugauugcugauauuaguaaugauacagaagguguuguuaccuguauugaugauaccagacauggaauggaagauggcgauuuuguuguauuuucagagguucaagguaugacugaauuaaaugggugcucaccuaucaaaaucaagguuuugggaccauacacauucagcaucggugacacuacagccuucucaaaauaccaaagaggagguauugcgacacaaguaaaaaugccuaaggaauugcauuucaaaucgcucaaggaauccuugggaaauccugaguuucucaugacggacuuugccaaauucgauuacccaccucaauuacacuuggcauuuaguacgcuucacgcauuugaagaaaaaaacgggcgggucccuaaaccguggagcaacgaugaugcagcugaauuuguggcacuugccaaaacuaaugccaguagcggcgauacugaaauaaaugccggcuuauuggaaacuuuugcaaagguuugugcuggaaaucuaaacccaaucaaugcaacaauuggagguauaguggcucaagaaguaaugaaagcuucuucuggaaaauuccauccaauuguacaaugguuauacuuugaugccauugaaacuuugccuucugauaggucugaaauuacagaagaaucagcugcaccucaaggcaccagauaugauggacaaauugcuguguuuggaaaagaauuccagaacaaaauagcugcucagaaauauuuugugguaggcgcgggcgccauugguugugagcuauuaaagaacuuugcgaugaugggccuggguacugaaggcugcaucauugucaccgauauggaccuuauugaaaaaucaaauuugaacaggcaguuuuuguuuagaccacaugauguucaaaaagcaaaaucugacacugcagcauuggcaauucugaaaaugaauccucaaaucaacauuguugcucaccagaauagggucggcccugacacugaaaguguuuaugaugaugaauuuuucgaaaauuuagauggaguugcgaaugcuuuggauaauguagaugcaaggauuuacauggauagaagauguguuuacuaccgcaaaccucuucuagaaucaggcacuuugggcacaaaaggaaacacucagguggugguaccauuccugacagaaucguacaguucaucucaggauccuccagaaaaaagcaucccgauuuguacuuugaaaaacuuccccaaugccauugagcacacauuacaaugggccagggaugcauuugaaggauuauucaaccaaaauauagaaaaggcauaccaguuucucagcgauccugauuucuuggaaagaacucuuaaacugccaggaguucagccuuuagaaacucuugaacaaguaaaggcagcucuaguugaugaaaggcccaaaucauuugaucaauguauugcuugggcuagacuuuauugggaggaucaauacaacaaccaaauccgucaacuauuguucaacuucccaccagaucagcuaacaucaacaggucagcucuucuggucaggaccuaaacguuguccucagcccuuaaccuuugacaucaacgacccucugcauauugauuauauugcagcugcugcucgauugaaagcagacugcuaugguauuccacaugcucaugccaauagagaucauauugcccaaguagcugcuagcauugagguuccuguauuuguuccaagaucuggggugaaaauugcgguuacugauucacaaauggccgccaacgguaacaaugucgaccuggaucguauuacucaacuuacucaagaaauaccaaccagggauaaaauugauggugucauguugaaacccuuggacuucgagaaggaugaugacaccaauuuccauauggauuucauuguagcggcaucaaaucugagagcccucaacuacaaaauuccuccugcggauagacacaaguccaaacuuauugcugguaaaauuauuccagccauugcuacaaccacgucuguggucgccgguuuaguuugucuggaacuuuacaaauugauucgaucucaaagaagucuggaaccauuuaaaaaugguuucgucaauuuggcucuaccauucuuuggauucagcgaaccuauugcugccccacaaaaggaauauggcgaaaacaaauggacauuaugggacagauuugagauugauggagaaaugacuuuagcugaauuuuugcaauauuucaaagauaaacauaauuuggaaaucacaaugcuuucgcaaggcguuugcaugcuuuacucauucuucaugcaaaaagccaaagcucaagaacguuugggccuuucaauguccgaaguggugaggagaguguccaaaaaaaagaucgaaccucacguuaaagcucuggucuuugaauuguggugcaacgacacugaaggugaagacgucgaaguaccauaugucaaauauaaucuuccauaa

SEQ ID NO: 6727 - RNA, 1272 nt, Ceutorhynchus assimilis
auggcggaugcagaagaucuucucgauuacgaagacgaagaacaaaaugagcaaacuccggccgaagcagcggccgaaccuaaaaaggcgguaaaagguaccuacgucuccauucacaguuccggauucagagauuuccuuuugaaaccggaaauuuuacgugccaucgucgauugcgguuucgaacauccuucagaaguucagcacgaauguauuccccaagcgguccuuggcauggacauccuaugccaagcaaaauccgguauggguaaaacugccguuuucguccuggccacucuccagcaacuggaacccacagaaaaccaggucuacguacuggugaugugucacaccagagagcuggcauuccagaucagcaaagaguacgaacgguucagcaaauacaugcccacaaucaaaguggguguguuuuucgguggcaugcccauccaaaaggaugaggaugugcugaaaaauaguuguccgcauauuguugucgggacaccuggcaggauuuuggcgcuuguuagguccaagaaguugaacuugaagaauuugaagcauuuuguuuuggacgagugcgacaaaaugcuggaguuguuagauaugagaagagacgugcaagaaaucuacagaaacacaccacacggcaaacaagugaugauguucagcgccacccuaagcaaagacauccgcccggucugcaagaaguuuaugcaagaucccauggaaguguauguggacgacgaggccaaauugacucuucacgguuugcagcagcacuacguuaaauugaaggaaaaugaaaaaaauaaaaaauuguucgagcuuuuggauauucuagaauuuaaucagguugucauuuuugucaaaucaguccaaagauguguggcuuuggcccaacuauugaccgagcaaaauuuccccgccaucggaauccacaggggaauggaccaaaaagaaagauuguccagauaugaacaauucaaagauuuccaaaagagaauauugguagcaacaaaucuuuuuggcagaggcauggacauugaaagagucaacauuguauucaacuaugauaugccugaagauucagacacuuaccugcacagaguugccagagcgggacguuuugguaccaaaggccuugcaaucacuuuuguuucagaagagagugacgcaaaaauuuugaacgaaguucaagacagguuugaugucaauauuacggaacuuccggaugaaauugaucucaguucauauauugaaggacgauaa

SEQ ID NO: 6728 - RNA, 1473 nt, Ceutorhynchus assimilis
augguuucaguggaaaacgacguggaaaugaaaaacgccgacagccccccgggucccgaggccggcgacagcaaacgagacgccgauuugcaaagucugcaagagauccgagaacacaccaggcaaauugaaaaggcgauuuccaacaaagaaagccgcuuuauuuuaaggguuuuaaggugcuuaccaaauacaagacguaaacucaacgguguaguacuuagaagucucauaacgcaaauuuauccugcagcagaucgugaagcucugcuggucuuuguugaggaggcuguaggugaaauugaaagcucucaaaccaggauucguucagcuacuaaagcugccuugccagagguggauucuuauauuaacuuguugauuuugguaagacuaauugacaccaacaagcuggaggaggcucaaaggugcucccaggcuuugaugaacaaaaucgucagucaaaacaggagaacuauugacuugauugcugcuaagugcuacuuuuaucauucuagaguagcugaauugucuaauaaguuggacacaauucgugcuuucuugcaugccagauugcguacagcaacuuugaggaaugacuuugaaggacaagcaguucuuaucaauugucuguugaggaauuauuugcacuauucacucuaugaucaagcagacaaguugguuuccaaguguguuuuuccugaaacugcuagcaacaaugaaugggccagguuuuuguauuauuugggaagaauuaaggcugcuagguuagaauacaguguugcucacaaacacuuggugcaagcuaugagaaaggccccccaaaacacugcuguaggcuucaggcaaacuguucaaaaacuuuuagugguaguagagcuucuucugggugauauuccugaaagacagauuuucaggcaaccugccaugcgucacucguugagcuccuacuuccaacucacucaagcaguacguaugggcaacuugcaacgauuuggagaaguuuuggaaaacuuugggccccaauucaggcaggaccauacuuauacauuaaucuugcgcuugcgccauaacgucaucaaaacugcucuuagaaguauuggccuagcuuauucgagaaucucuuugcaagauauugcacaaaaguuaggcuuggauucagcugaagaugcugaauucauuguggcaaaagccauaagggaugggguuauugaggccacauuagacgcugaggguggcuauaugagaagcaaggaaacuacggauauuuauuguacuaaagaaccacagauggcguuccaucaaagaauaucuuuuugcuuggauuugcauaaucagaguguuaaggccaugagguauccaccuaaagcuuacgguaaagaguuggaaagugccgaagaaagacgcgaacgugaagcgcaagaucuugaauuggcaaaggaaauggcggaagaagacgaugauggauuuccuuga

SEQ ID NO: 6729 - RNA, 1638 nt, Ceutorhynchus assimilis
auggcccacaccagucaaaguuugccagucucccaaauccucaaaacaaaaaccaacgauaucgaggacgaugacgaacccaagaaaaaauccagagaagauuggaggaaagcgaaagaacuggaagaagcucguaaagcugguaccgcccccgccgcagucgacgaagaaggcaaagauaucaauccucauauuccccaguacauuuccaaugcuccuugguacuaugguacuagugggccuacgcucaagcaucaaagaccucaagaggagcaccagaagcaguuuucuggacuagacgagugguaccagagaggauuggacacaucaaaaauugucaccaaauuccgaaaaggugccugugaaaauuguggugcaaugacccacaaaaaaaaagauuguauggaucgacccagaaaaauuggugccaaauauuccaaauccaacauucugccagaugaauauguucagaaaaacuuggcguugaguuuugauggcaagcgggauagauggagcggauacgauccaagugaacacaaaacuguuauagaagaguuccaaaaaguugaggaagccaaacgccaacuaaaagcugagaaacuagaugcugagaacucagaugaagaggaaaaggaugaggacaaauauguagaugaaguugauaugccuggcaccaaaguggacagcaaacaaagaauuacugugaggaauuugcguauaagagaagacacugcaaaauauuugaggaauuuagauccaaauucugccuauuaugaucccaagacaagaucuaugagagaaaaucccaauccuggaguggaugagacacaccaaggagaaaacuuuauucgauucacuggugauacuaaaaaccaugcaaaagcucaacuuuucgcuugggaagcuuaugaaaaagguguugacguacauuuacuugcugagccuacaaaacuagaacugcucaagaaggaauaugagaaaaagaaagaacaauuuaaagauacuguuucuucaaguguauuggacaaauauggaggggaggagcauuuaaaagccccaccuaaaacacuuuuauuggcucaaacugaggauuauguugaguauucacguucaggcaaaauuaucaaaggccaagaaaaagaggaaaucaaaucaaaguaugaggaaaauguuuacauuaauaaucauacaaguguauggggguccuauuggaaagguggucauuggggguauaaaugcugucauucuuuuauaaaaagcuccuauugcuuaucagaagcuggcaaaaguauagaacaaccaaugccugaaacuguuccgaaugaggucuuggagaaaguugcaagugaaaaaucugaaaguucuucuucaagugaagaagauguuagaacugcuucagaaaagucuagcaagaaaaagaagacuaaaaaaauuaagaagaaagauaaagauaaguuggcagaagcucuaaaagcagaagagcaacaacaacaacaggcagaucauuuguugucgauagaugaaagaaaacgcccuuauaauaguauguuugaggcuaaaaaacccacagaagaagaaauugaagcuuauuaccuaaaaaggcgcagggaagaugacccaaugaaccaauucauguga

SEQ ID NO: 6730 - RNA, 627 nt, Ceutorhynchus assimilis
auggguaucagucgugaucauuggcauaaaagacgugccaccgguggcaaaaggaagccccugcguaagaagaggaaguucgaauuaggacguccagcugccaauacgaaauugggagcccgcagaauccauuauguccguaccagagggggcaacaucaaguaccgugcccucagaauugacacuggcaauuucgcuugggcuagcgaagguacugccaggaaaacucguauuaucgacguuguauacaaugcuagcaacaaugaauugguucguaccaagacuuuggugaaaaaugcuauuguuguuguugacgccacuccguucaggcaaugguaugagacgcacuauauuuugccuuuggguagaaagaagggagcuaaacugacagcagaagaagaggcaauuuugacaaaaaagaggagcaaaaaaguccaaaagaaauacgaaaacagacagaaaaucgccaagguugaaccugcgauagaagaacaauuucagacugguagauuguuggcuugucuagccucaagaccaggacagugcggucgagccgacgguuacaucuuggaaggcaaagaauuagaauucuauaugagaaaaauuaagucuaagaaagcaaaauga

SEQ ID NO: 6731 - RNA, 936 nt, Ceutorhynchus assimilis
auggauagacuauuaagauugggcggcgguaugccgggauugagccaggcacccccuccgaaugaugccccugugguagacacagcagaacaaguuuacauuuccucguuggcccuuuuaaaaaugcucaaacacggucgagcaggugugccuauggaaguuaugggucucaugcugggcgaauuuguagaugacuacacuguaaggguuauagauguguuugcuaugccccaaaccgguaccggugucaguguagaagccguagauccaguauuucaagcaaaaauguuggacaugcugcgccaaacuggaaggccugaaaugguggugggcugguaccacucgcaucccgguuuugguuguuggcuuucaggagucgacaucaacacucaacagucuuuugaggcuuugucugaaagagcuguugcuguuguagucgaucccauucagucuguuaaagggaaaguuguuauugaugcuuucagguugauuaacccaaauaugaugguuuugggccaagaaccucgccaaacgaccuccaauuugggacaccuucaaaaaccuucagugcaagcucucauucacggccugaacaggcauuacuacucgauuagcauaaacuacaggaaaaacgagcuggaacaaaaaaugcugcucaauuugcacaaaaaaucuuggauggacggccucauguuggcugacuauucagaaaacuguaguaccaaugaaaaaacuguugcugaaauguuggaauuagccaagaauuauaacaaagcucuugaagaugaagagaaaaugacuccggaacaguuggccaucaaaaaugugggcaaacaagauccaaagaggcauuuggaagaaaaagucgaugugcugaugaccaacaauauuguacaguguuugggugcuaugcuagauacuguggucuuuaaauaa

SEQ ID NO: 6732 - RNA, 1215 nt, Ceutorhynchus assimilis
augacgguuauaaauaagauggagauugauggugguucaaaaggcgaagguuuccgauccuacuacaucaccaaaaucgaagaacuacagcuuguuguagcugaaaaaagucaaaauuugaggcgucuacaagcucaaagaaacgaacuaaaugccaaaguccguaugcuuagagaagaacucaugcuguugcaagaacaaggcagcuacgugggcgaaguagucaaaccaauggacaagaaaaaaguccuggucaaaguccacccugaaggaaaauucguagucgauauugacaaaaacaucgacaucaaugacgucacuccuaauugcagaguggcuuugagaaacgaaaguuacacucuacauaaaauacuucccaacaagguugauccauuggucucucuuaugaugguggaaaaagugccagauuccacuuacgaaauggugggugguuuggacaaacaaaucaaggaaaucaaagagguuauugaauugccuguuaaacauccagaauuguuugaugcucuugguauugcucaaccaaaaggcguuuugcuuuaugguccaccuggaacugguaaaacucuucuagcaagagcuguagcccaucacacugaaugcacuuuuauucgugugucugguucugagcugguacaaaaauucauuggagaaggauccagaauggugcgagaauuguucguuauggcucgagaacacgcccccucuaucauuuuuauggacgaaaucgauucuauuggaucgucucguaucgagucugguucaggaggugacucagaaguccaaagaacuauguuggaauugcugaaucaacuggacgguuuugaggcaacuaaaaacaucaaagucauuauggcgacuaaucguaucgauauucuggauccggccuuguugagacccggucguauugauaggaaaaucgaauuuccaccaccgaaugaagaagcccguuuggacauuuuaaaaauucauucacgcaagaugaauuugacaagagguauuaaucugaggaaaauugcugagcuaaugccaggggcuaguggagcugaagucaaggguguuuguacugaagcuggaauguacgcucugagagaaagaagaguccacgugacccaagaagauuuugaaauggcaguagccaaaguuaugcaaaaagauucagagaaaaacauguccaucaaaaaguuguggaaauaa

SEQ ID NO: 6733 - RNA, 600 nt, Ceutorhynchus assimilis
auggugaaacucuauugcauuagcauucuuuacaaaggcccuacaucggcgacaugguuaaaaucagccuaugaccuacaaaguuuuagcuacuuucaaagaggcucugugcaagaauucauguuguuuugugcuaaaaccauugcugaaaggacaauaccagcuucgaggcaaucuguaaaagaaggcgaauacuuuugucauguguauguaagagcugacaacuuagcaggaguuauuauuucagaccaagaguauccuucaagaguaucucauacguugcucaccaaaauccucgaugauuuugcugauaaaaucccuucuaccaguuggccuaauuuacaagaaagagauguggcuuuuccgcaaauaaauaccuauuuagcaaaauaccagaagccagccgaggcagauauauugacaaaaauccaaggagaauuggaugaaacuaaaauuauauugcacaauaacauugcagcuguuuuggauaggggcgaaaaguuggacgaccuaguuuccaagucugaagguuugaguauacaaucgaaagcuuuuuauaaaacugcaaggaaaacuaaugcuugcuguaguuuuucuuaa

SEQ ID NO: 6734 - RNA, 771 nt, Ceutorhynchus assimilis
auguuucucacaagaagcgaauacgaccguggagugaacaccuuuuccccagaaggacgcuuauuucaaguagaauaugccauugaagcuauuaaauuagguuccacugcuauaggaauaucuacaagccaagggguaguacuugcuguugaaaaacguaucacuucacagcuuauggaaccaacgacuauugaaaagauuguagaagucgauaagcauaucgguugugcuguaucuggccucauugccgauuccagaacuaugauugauagggcucgcaucgaaugccagaaccacugguuugucuacaaugaaaauaugacugucgagucaugugcucaagcaguauccaacuuggccauucaguuuggagauucggaugaugauggggcagcuaugucuaggccuuuugguguagcaauuuuauuugcugguaucgaugaaaaagguccccaacuuuaucauauggauccaucugguacuuuuguucaauuugaugccaaagcuauugguucuggcucagaaggugcccaacagagucugcaagaagucuaccauaagaguaugacgcuagaagaagccaccacuucggcacugacaaucuuaaaacaaguuauggaagaaaaauugaacucgucaaauguugaagugaugacuaugacuccugauaagcuguuccauauguuuucuaaagaucaaguagaagaggcucugacucguggacuucuuguagaacauccuguaaccuuaacuguuggacagaaagccuaa

SEQ ID NO: 6735 - RNA, 1161 nt, Ceutorhynchus assimilis
augacggaauacuggcugauaucugcuccgggugacaaaaccugccagcaaacaugggaaacuaugaacaauaugaccuccaagcaaaacuccuugugcaccaauuacaaguuccacauuccagaucuuaagguugguacccuggaucaacugguaggucuaucugaugauuugggcaagcuggacggguuuguugagcaagucacucgcaaaguggcuucuuaccucggugaaguacuggaagaccagcgggacaagcuacaagaaaacuugauggccaauaacacugaucuuccgaguuauuugaccagguuccagugggauaucgccaaguauccuaucaagcaaucgcugaggaacauugcugacauuaucagcaagcaagucggucaaaucgaugccgauuugaagaccaagucgacggccuacaauaauuugaagggcagcuugcagaguuuggagaaaaaacaaacuggaaguuuguuaacaagaaaucuggccgaucuugugaaaaaggagcauuucaucuuggacucugacuacuugcaaacauugcuuguaauuguucccaaggcucagguccaugaauggaacgcgaccuacgaaaaaaucacugacaugaucgugccaagaucgucucagaugguuacucaggauaacgaauacggccuauucacuguuacacuguucaaaaaagucauggacgaauucaagcaucaugccagagaaaagcgauucauuguaagagacuucacuuaugaugaagagcaauuggccgcgggcaaaaacgaaauuaccaaauuggccacggacaaaaagaagcaguucggaccguuggucagaugguugaaagucaauuucagugagugcuucugcgcauggauccaugucaaagcccuuagaguauuuguugaauccguauugagauacgguuugccagucaauuuccaagcaauccucauucaucccaauaagaagucaaugaaacgucuuagagauguuuugaaccagcuuuauggacauuuggaugguagugugggacaucaagguuccaauguugauaacguugacauuccuggucuugguuucggccaauccgaauacuacccguacgucuccuacaaaauaaacguggagaugauugaaagcaaaacccucuaa

SEQ ID NO: 6736 - RNA, 1674 nt, Ceutorhynchus assimilis
augucgauuuuagcgagccccuuaucuguggcgggccagagaacauccggggccccaguccgaacccaaaacguuauggcugcugcugcaauugccaacauagugaaaagcucgcuagguccuguaggacuggacaaaauguugguagacgauaucggcgaugugacagucaccaacgauggagccaccaucuugaaacuguuagaagucgaacaucccgcugccaggaucuugguugagcuggcucaacuucaagacgaagaagucggagauggaaccacaucuguuguuauuaucgcugcugaauuacuaaagaaugccgaugaauuggugaagcaaaaaauucauccaacuucuauuaucagcgguuacagguuggcuuguaaagaagccugcagauauauucaagaucauuuaacuauuccuguagaggauuugggaaaggaauauauuaucaauguugccaagacuucuaugaguucuaagauuauuggagcugaugcagauuuauucucugcaaugguuguugaugcagcauaugcaguuaaaguuacagauguuaaagguaacccucuauauccaauuaaggcugugaacguacuuaaagcccauggacgaagugcuagagaaaguaccuuaauccaagguuacgcccuaaacuguacaguagccagccaggcgaugcccaaaaaaauuguuggcgccaaaaucgccugucucgauuuuucuuugcaaaaagcuaaaaugaagaugggaguccaaguacucaucaacgacccugacaagcucgaagcuguccgugcucgcgaacuagacauaaccaaagagagaauccaaaaagucuuguccaccgggguuaaugugauuuugugcucgggagguaucgaugauuuguguuugaaauauuucgucgaggcuggagcuaugggagugaggagagucaagagggucgacuugaagcguaucgcuaaagcuacuggggccacguuuuugacuucucugucaaacauggauggugaggaaucauuugaugccaauaugguuggagaggcagcugaaguuuugcaagaaagaaucucagaugaugaauugauuauuauuaaaaacccaaaacaacguacugcagcuucaauaauccuacguggaccaaaugauuuuuauugugacgaaauggaacguuccguacaugaugcucugagugucgucaaacgagucuuggagucaaaaagcguuguaguaggagguggcgcuguugaagcagcucugucaauauacuuggaaaacuuugcaacaacucucagcagcagagaacaauuggccauagccgaauucgcuaggacucuuuuaguaauucccaaaacuuuagcuguaaaugcugcuaaagaugccacagauuuaguggcuaagcuuagggcuuaucacaauucaagccagacuaaguuggaacacgcagaucuuaaauuugucggcuuagaucuuauugaagguacaguaaaagacaaccggaaagcuggaguuuuggaacccacaguuucgaaaauuaaaucuuugaaguuugcuacggaagcugcaauuacuauucugaggauagacgauaugauuaaauuggaugcucaggaaaaaggaggcaggagcuaccaagaagccuaucagucaggacaacucuaugauuga

SEQ ID NO: 6737 - RNA, 765 nt, Ceutorhynchus assimilis
auguuuagugcaccaccguucuggcaaaacggccccgcuccgggcaguuuuuacgauuucccuaacaugcagccccaaguacaacccaacgauuucaggcaacacacucaaucuccagugacaacaucuacuucucuaguagcugucacuuacgauaaaggcaucauuaucgcuggugaucuuuuagcuucauacgguucacuagccagauacagaaauugcccaagaaucguuaaagugaacaacaacauaauuuugggcuccaguggcgauuaugccgauuuccaauacguucaaaauuuuauugaacaaaaagugauaagugaugaauguuuggaugacgguaucacccucaaaccgaaaucucucuacugcugguugaccagaauccuauacaacagaagaagcaaaauggauccacuuuggaauaauuuuauuguugccggaauucaagacggagagccuuucuuaggcacggucgacaaacaaggcacugcguacucugacaaaauuauuugcacuggcuacggugcucauauugccacuccuaugcucagagacgcucuggauaauaaaccucaacucacgcaagcugaagcuagagcucaaguugaaagaugcauggaaguuuuguacuaucgugaugcuagaaguuuuccuaaguaucaauuggggauuauugaugcugaucaagguguuaguauugaagggccuuugcaaguggcacagaauugguccguggcucauucuauuaaaggauauuaa

SEQ ID NO: 6738 - RNA, 2049 nt, Ceutorhynchus assimilis
auggauauuccuaaagaaccaaauuucucauuacuaaguucccaggacuucgccccugaaaaauacgugcgagacauuucccaaaacuacgugggcggucuggaacugcaaaacaucaaaaagaaaauccaggcguuggcugacgaaaccagcaacaacuugaagaaaaacgucuaccaaaauuacgugcaauucaucgaaacugccaaagaaauaucgcacuuagaaagugaaauguaucaacuuucucacuuguugucagagcaaaaaggguugcuuacagcucugaguacuucgucuauuuuagaagacaacagggcucauuuugauguuagaaaugaaaaauuagacgaacaagagcuugaggaggaaaacaagcaaaaacuggcaacaauuuuggauaagguugagaacuguaaagaaguaguugaagcuccggauagauuuuuauuguucgaaggagauuugcuugaaauagacgcaacagagaauacagcaaucaaauuuguacauguuuauuuguuuaaugacaguuuaaugcuaacaaacagaaauucuaauaguagaggcuugaugcgauacgccuuugaaagcuuauacgaacuuaguagcuuggcugugguuaauguacgagauuuaggcaacauuaaacacgcauucaaguugcuuauauuuccagauacacgaguauuccaauguucaucuaaugcuaguaaaaaagaguggcuggauaagauugaucaagccaaaaaaacccgcuuggugcaagagcaacaaaaacgcgaauccucuuuggaaaaaaucuccccugcccguuccauuucaguugacuuaaacaucaacagccagccugaagaaauauucacccaucccgauugguuuuuggacaucccugacgaacuagacguuugcaucgcccaaagacaauucgaagacgcugucaaccacauaaacaaaucaaaaaccuacauaaacaaacacccagaauaugugggagcaauucagaaaaaaaucgaccaaaaacaaaacacccuaguugaaaugcuaaugaaagagcuugaaguuaauccugaaaaauccuugcaaggugguuuaagagcuacuagaacagcugucagauuguugaaccaauuaggucgcuccacccaaucaugugacuuauuuuuaaagcuuugcucuagcauguuaaaaauccaaugcaaacgagugaaaagagagggcuccacuagcacauacgugcgucaucuaucaagcguagucuucaccaacaugugucacaugucagaagaguuucuaagggccuuuccagacucuugugcaaacugcgcaucugcuuauguagucugggcaaguggggaauuaucuuuauuuacuacucauuuugccaagcaaguuuuuaugccgcaaacaucuuugucuaccauuacggagugugugguuuuggugaggucgcagugcgagcguuuaugcacuuauggaguagauuuucgauaucaauuggacggggcccuuagggcuccgcuaaguaaagcccuuaaugacgcaagagauaaguuugucgauucgauuaaguugagagcgauagaugaaaaguggauuccugucaauuugaauacgagaaguggauuagcaaggugucuucaagaauaugcaguuuuaggccugaaacucgacaccuacgucaccggagauguuuggcuccaauuaaccucaagcaauuuggcuuuuaccaaauccuuccuaauucuauuggacgauugccucaaacuaaaaaccacagaacuuuuacacucuauugaugaaacucuagcaaaauguuuugaggcccaauuacgguacaacgagcaaggccucaaaaacgaagaccaaaaacaguuuauuuugaagaauuucgaauuuuuacuggugguuuuggugcagcuuacgcaaacuaaauacaaggaggcaacuggguaugagugugacaacuuaaacaaauugguuaaugauuauuugaguuuauugaaggcgagaagcacuaaaacaaaauauucuucugaauuuuuguaa

SEQ ID NO: 6739 - RNA, 3675 nt, Ceutorhynchus assimilis
auggauaaaauggaugaaguagagaaguuggaauauuuaucuuuagugucaaaaauauguacagaauuggaaaaucauuugggggccagugacaaagauuuagcugaauuuaucauacauuuaucagagaaaaacaacaccaaugauucauucaagaaagcccucauugaagcuggugcagaauucgcagauucauuuauauccaauuuguugagaauaauacagcauaugagaccuagaaaagaccagucaaaggaugaaauuguucaagaggaaaaaagugaacuugcacagaaauuuccagguuuagcuauaccaaaugagccucagaaaccuuugggugaugaugaaaauauugauucaaaauuagaaaauucuaauaaagcuaaaaaacaggauaaugauguuguagcagaucuuauggcacaauuugaagcugaggcaccaucugcuaguaccaauuccaaaacugaaaaaucaagaaaaaggucuagaucaagaaaccgauccagaucaaagaacagauccagaucuagggaacguaggcgcgacagaucucgugaugacaaaaaagguagauacagggacaggucaagggaucgucaucgagaaagagaucgugaccgugagcgugauacugaaagaagaagagaaaggcacagaagcagaucuagggagagacgaagaucaagagacagaagggacagaagucggucuagaaguagaaccaggagaggcagagaggaugauuuugauaaaaaaaauaaauuugauaaggguaguguggaacuugacgaagaucccgugguaggcaaaguuuacaacgcuaaaguagcaaauauugucccuuuugguuguuuugugcaacuugaaggcuugaaacguagaugggaaggacuaguucacauuucccaauugaggggugaaggucgagucacgcaggugucagaaguuguuucucgggggaauaaagugaagguaaaaguuuuaucaguuacuggacaaaagguaucuuugucuaugaaagauguugaucaauugacuggaaaagaucuaaauccguugcacgcuccacaagaaagagaagacaaagacagaaauccagaccggccaacuuauaauagcacaucaguucucaaacuugcucugccuuuggaggaaaaugaagacgguacuagaaagaggguuacacgaauaucgaguccagaaagaugggaaaucaaucagaugauugccucuggaaguaucgacaaaagcgaacugccagacuuugaugaugaaaccggucuuuuaccgaaagaugaagaggauggggaagcagauauugaaauugaacuuguagaagaugagccuccuuuucuucacggccacggacgggccuuaaaugauuuaaguccugugagaauugugaaaaauccugauggaucguuagcucaggcugcaaugaugcagucggcuuuggcgaaagaacgaagagaacacaagaugcuucaaagggaggccgaaguggauucacagccgucuggaaaaagcaaaucauggauugauccacuaccugaugaggaaaauaaaccagcagcaccuagagguauagguuuacaaucucaagacuuacccgaauggaagaagcauguaauuggugguaaaaaaucuucauuugguaaaaagacaaaucucacuauucuagaacaaagaaaaucgcugccuaucuauaaacuaaaagaagaauuacgcaaggccgucacagauaaccaaauucuaaucguuaucggagaaacggguucaggaaaaaccacccaaauuacacaauauuuggccgaggaggguuucacagcuagaggaagaaucggauguacucaaccucgucguguagccgcuaugucaguggcuaaaagaguugcagaagaauacgguugcagguuaggacaagaaguuggauauaccauucgauucgaagauuguaccaguccugaaacuauuauaaaguacaugacugacgguauguuacuccgugaaugucugauggauuuagaccucaaaggauauucagucauuauguuggaugaagcucacgaaagaacuauucacacugacguucuauucggccuucuaaaacaagcaguuaccaaacgguccgaacucaaacuuauagucacuucugcuacuuuggaugcuguaaaguuuucucaauauuucuuugaagcuccuauuuuuacaauaccaggaaggacguuuccugucgaaguuuuauauacaaaagagccugagacugacuauuuagaugccaguuugauaacaguaaugcaaauacaucuuagagaaccuccaggagauauuuugcucuuuuuaacuggucaagaagaaaucgauacugcuugugagaucuuauaugaaagaaugaaguccuuaggucccgaaguuccugaacuuauuauucugccuguuuacucugcacuaccaucagaaaugcagacccguauuuuugagccagcgccaccugguagccgaaaagucguaauagcaacaaauauugcagaaaccucuuugacaauugacggaauuuuuuauguaguagacccuggauuuguuaagcaaaaaguuuauaauucaaagacggguauggauucguugguaguuacuccuauaucucaggcacaggcaaaacagcgagcuggcagagcaggucguacaggucccggaaaaacuuacagacuguauacagagcgcgcauauagagaugaaauguugccuacuccagugccagaaauucaacgaacaaauuuggcaacgacggugcuucaguugaaaacuauggguauaaaugauuuacuucacuucgauuucauggaugcuccaccuguagaaucacuuaucauggcauuggagcaauugcauucacuuucagcacuugaugacgaagguuuacuuacaagacuugggagaaggauggcagaauuuccucuagaaccaaacuugucuaaaaugcuaaucaugucaguagcucuucaauguuccgacgaaauccuaacuauugucagcaugcuaucaguacaaaacguguucuacaggcccaaagacaaacaagcagucgccgaucagaaaaaggcgaaauuuaaccaaccagaaggugaccauuugacuuuauuagcugucuacaauagcuggaaaaauaauaaauucucaaaugccuggugcuacgaaaacuucguucaaauuagaacucuaaaaagggcgcaggauguuagaaaacaauuacuugguaucauggacaggcauaaauuggacguaguuucugccgagaaaaacacgguccgaguucagaaggcgguauguucgggauuuuucagaaacgcugguaaaaaggauccgcaagaaggauaucguacuuugguugacagucaaguuguuuauauucauccgucuagugcucucuucaaucgacaaccagaguggguuauuuaccaugaacugguauguaccacuaaagaauacaugagagaagugacuacaaucgauccuaaaugguuaguggaauuugcuccugcguucuucaaauuuucggauccuacgaaacugagcaaauucaaaaagaaccaacguuuggaaccgcuuuauaauaaauaugaagaaccaaacgcuuggaggauuuccagagucagaagacgacggaauuag

SEQ ID NO: 6740 - RNA, 1266 nt, Ceutorhynchus assimilis
auggccccacaucgaagaaauaucgacgauguguuggcucguaucaauuucccguuguuuacauuacaaaugcucacaaauagacauguuuuaguuggagguggcggagguucuucaaaaacaggggucgcaaauggcuuugaaauauuugaauuaucacaugauggcaaaaaguuccacguugaagaaguaacuagacaugaaacagguccuaacguaguaaugaacuguucaguuucaaguucgccugauaaaaaacauacuuauuuaguugcuggccaagaaagccacugccaauuguaucauguuaauacagauuuugccgcucaacuaaauggaaguguagaaacgauagguaacaaucaugaagauacuggagagcuuaggcaaagaaaaaacaagacuaauaauaacaaaaacacgaaaaaaaggcuaaaguuuguccucaguccuggcgauaguguucaaacugauuuuaaugguacugaaccuuuaugcaggguuguaaggcugcauccaaauggaaaacuuauggcgagugguggaacagauggugauauucguauguggaaauucccuggccucgaaccauuagcaaaacuaaaggcccacacuaaagaaauagacgauauagacuuuaguucuuuuggcaaccuucucaucacaauagcuaaagauggccuggcaguuuugugggauuguguuaaagguacugaaauuaaaaggcucaagugggagcagccucaaggaucaaaguauuuauacaaaagaugcagauuuggaucaauugaaggccaacaaaaaucggcuuuguauauguuagcuaaucccacaggaguggcuaaaaggcagaaauccuaucugcaacaaugguauccagaggaagguauucuaaaaagaguaacagaauuugaugaaaguuuaucugccuuggcagucagagaugaugguagauucauagcuguagguacaauguuuagcggaucuguaucuauacauguagcauuuaguuugcagcgcguuuuaaauguagcgggugcacauuccauguuuguaacaggccuagaauuucucccaguguccaauccagaaaaccacacaguguguaguguggcagaagcggccguacucucaauaucaguagauaaucaaguuuguauacacaccuugcccuacagaaaaucuauuccccuaugguuggcuauaguaauuuuaauauuugccauguucuugacauuuguauuuugcucauauauagguuuguag

SEQ ID NO: 6741 - RNA, 1224 nt, Ceutorhynchus assimilis
auguccggggcuaccuuauucgaacgaccaggguccgaguuguuuaaacacaaagaaaacgacgagaaugacgaaagaaacauccagaacaaggagcaggacauccucaaccucggcgaaaaguacaagaacgagggcaaggccaaagaacuggccgauuugaucaaacaaacgcgccccuuucugagcgaaaucagcaaagcgaaagcggcaaaacucguccgaucucucaucgauuucuauuuggaucuugaagcuggcaccggucuagaaguacaacucuguaaagaaugcaucgagugggccaaagaagaaaaacgaaccuuucuucgccagucuuuggaagccagguuaguugcacuguauuucgacacuggcauguucagugaagcccuacagcuugguucuacuuuacugugggagcugaagaaguuggacgacaaaaauuuacuuguagaagugcagcuacuagaaaguaaaauuuaucaugcauugaguaaucuuccuaaagccagagccgcuuugacuucagcccguacaacugccaacacaauuuauugucccccaaaaauccaagccucuuuagaucuucaaucaggcauauuacacgcagcagaugagaaagauuucaaaacagcuuauucauacuuuuaugaggcauuugaagguuucgacaguguagaaucaucaaaagcacuaacagcuuugaaauauaugcuuuuaucaaaaauuaugcuaaaucauucugaagauguucagcaaauugucagcgaaaaauuggccaucaaauacgcaggcagggauauugaugcaaugaaagcuguggcucaagcuucccauaaaagaucuuuggcugauuuccaaguggcacucaaacaauacaaagcagaacucgaagacgacgucauaguuagggcucauuuggacacuuuauaugauaacauguuggaacaaaaccuacugagaauuauagagccuuacaguagaguccaaguugauuauauagcaaaggcuauaaaacuguccauggcacaaguugaacaaaaauugucacaaauuaucuuagaugggaaauuugaugggauuuuggaucaaggcgaagguguucuaauuguguuugacgaagccccaguagauaaaucauaugaaauggcauuagaaacuauucacaauaugagcaaaguuguagauacgcuuuaucaaaaagcuaaaaagcuauuauag

SEQ ID NO: 6742 - RNA, 1770 nt, Ceutorhynchus assimilis
auggcuaccagagcgaaaaagucggcgacgccggguucgcagccuccgccgcgggcucagaguccuuugagccccaccagacauuccagauugcaggaaaaacacgauuuacaaaaccugaacgaucgguuggcuacuuacauugaaaaagucagguuucuggagaaugaaaaccuaaaacuaacaaaagaaguccaaugucaccaggaaacaagccaacgcgaagugucccauaucaaguccauguacgaucaugaacugggcgaggcucgcagauuacuggacgcuacucacagugaaaaauccagacucgaaaucgacuugaaacgagugcuggaggaaaacgacgaccuuaaagcugacuuggccaaaaaaacaaaagaccuuguaguugcugaaaaugcugccaggguuuacgagacccggugcaacgauuugcaguugaaauacacccaggccaaugcugacgccaagaaggcuaucggggaucuuaaggauuuggaaaaggagagggacaaguugaagaagaugcuggaugagcacagaaaacaguuggaggaggaaaguuuggcuagggucgauguugaaaaugcuaaucagacuuugagagaggaauugucguucaaggaucagguauuccaacaacaacugacggaaacccgcacucgucgucaagucgagaucaccgaaaucgauggacaauuggccgaacaauaugaggccaagcuccaacaggcucuacaagaucucagagaccaauaugaagcucaaauaaccaacaacagagccgagaucgaaaauauguaugauagcaagauuaagagucuucaaacggccgcuaauagacacucugcagccgcugccaaugcuuuggacgaagcucgucaaguucguaccagaaucgacacucuauccagccgagucacacaguuggaaaaugaaaacggcgcauuaguggccagaucaagagaucuugaaaaaauauuggagcacgaacguuugagacacgccgaagaacuggcagccuuggaaggcgaacuguccaggaugagagaagagaugaacguucaacugcaagaguaccaagaccuuauggacauuaaggugucucuagauuuggaaauugcggccuacaggaaacuauuggaaucugaagaggacagauugaaaaucacuccagcaggacaagaacgcgauguuucucacucgagcagucgcaguuuggcacaacguuacacuccaagccgucacaacacgaaacggaagcgcuuucugauggaagaaagucaagauuccagccuaucagacuucagcguuaccacuucuugcaagggcgacauugaaauucuggaagccgacccugaggguagauuugugaaauuaguuaacaagagcaaucaagaaguuucacuuggugguuggcaauuacuucguaaagcuggcacugaggagaccaaguucaaauucaaccgaucuuugaaacuugaaggcaaaggcaccguaacuguuuggucggcugauuugaauaaagaccaugaaccaccacauaaucuuguaaugaaaggccaaaaauggcugguuggagauaauaugacuacugugcuggugaauuuggauggggaggaaguugcaacaucagaaaggaucaaaacucaaguguccacuucucacuugagacacagagaaucggcggggggguuuauagaaggugaagaucuccaucagcacgugggugacccccaaggcgacgaaaagugucgacugauguga

SEQ ID NO: 6743 - RNA, 2427 nt, Ceutorhynchus assimilis
auggcugaucagcagaaugaugauuuggcaacugccauccuccgcaaaaaagacaggccaaacagacucaucgucgaggaagccgucaacgaugacaacuccguugucgcucuaucucaagccaaaauggacgagcugcagcuuuuccguggcgacacuguucuuuugaaagguaaaagacgcaaagagacugucuguauugucuuaucugaugacacaugcagcgacgaaaaaauuaggaugaaucgaaacguuagaaacaacuugcgggucagguugucugacguagucucaauucaaccuuguccugauguuaaauauggcaaaagaauucacguucuccccauagaugauucuguugaaggucucaccggcaaccucuuugaaguguauuugaaaccauacuuccuugaagcuuacagaccaauucacaaagacgacguuuuuaucgucagaggaggcaugcgugcuguggaauuuaaaguuguagagacggauccugcuccauuuuguauaguugcuccugacacuguuauucauugugauggagauccuauuaaacgugaagaagaggaggaagcuuugaaugcuguggguuaugaugauaucggaggcugcagaaagcaacuggcacaaaucaaggagaugguugaguugccuuugaggcauccaucauuguucaaagcuauuggaguuaagccuccaagaggaaucuuguuguaugggcccccagguacaggaaagacauugauugcuagggcuguggcuaaugaaacuggugccuuuuucuuuuugauuaacggucccgaaauuaugagcaaauuggcuggcgaaucugaaaguaauuugcguaaggccuucgaagaggcagauaaaaauucuccugcuauuauauuuauugaugaauuggaugccauugccccaaaaagagaaaaaacccauggagaaguggagagacguaucguuucucaacuuuuaacuuugauggacggcaugaaaaaauccucucacguaauuguaauggcugcuaccaacagacccaacucaauagacgcugcucuacgucguuucggacguuucgacagggaaaucgacauuggcaucccagacgccacuggccguuuggaaauccuccguauccacacaaaaaacaugaaauuggccgacgacguugauuuggaacagauugcugcugaaacucacggacauguuggugccgaucucgcuucgcuuugcucugaagccgcucugcaacagauccgugaaaagauggauuugauugauuuggaagaugaccaaaucgaugcugagguucucaauaguuuggcuguuacgauggagaacuuccguuaugcuaugacaaagaguaguccaagugcucuaagagaaacuguuguugaaguucccaacgucacaugggaagauauuggagguuuggccaaugucaaaaacgaauugcaagaauugguacaguacccaguggagcaucccgacaaguuucucaaauuugguaugcaacccucaagaggaguacucuucuacgguccgccugguugcgguaaaacucucuuggccaaagcuaucgccaacgaaugucaagcgaacuucauuucugucaaagguccugaacuauugaccaugugguuuggugaaucugaagcuaauguuagggauauauucgauaaggcuagaucagcagcuccuuguguccuauucuuugacgaauuggauuccaucgcaaagucaagagguggcaacgucggugacgcagguggcgccgcagaccguguuaucaaucaaauucuaaccgaaauggacgguaugggcgccaaaaagaacguuuucaucaucggugcuaccaacagaccugauauuaucgauccugcaaucuuacguccuggccgucuggaucagcugaucuacauccccuugcccgacgaaaaaucacgcgaacagaucuucaaagcuaacuugcgcaaaucgccaguagccaaagauguugauaugguuuauauugcuaaaguuacucacggauuuucuggagccgauuugacggaaauuugccagagggcuugcaaguuggcuauuagacaaucuaucgaagcugagauaagaagagaaagggagcgcgcugcuaauccugcugccgcugcugcuauggacuuggacgaagacgauccaguucccgaaaucacuagagcucacuuugaagaagccaugcgauucgcacgucguucagugucugauaaugacauucgcaaauacgaaauguuugcccaaacuuugcaacaaucuagagguuuugguacuaacuucagguucccaucgagucaaggugcgccugcucaagguggucagguaccaccuccugucgcgccaggcgaucaggccaacuuugacgauccugaagacgauuuauauaguuag

SEQ ID NO: 6744 - RNA, 825 nt, Ceutorhynchus assimilis
augggagaucaauuugauugcgcccuggauuugaugaggcgguugccuccucagcaaaucgagaaaaaucugagcgaccucaucgauuugguacccaguuugugcgaggaucucuugucuucggucgaucagccuuugaaaaucgccaaagacaaggaaacuggcaaggauuacguuuugugcgacuacaaucgagauggugacucguacagaucuccuugguccaacaccuacuaccccccacuggacgacggccagaugccuucagaaagacuacgcaaguuagaacuggacgcaaaccacgccuuugaccaauacagagaaauguacuuugaaggaggcgugagcucagucuacuuuugggacuuggaucacggauuugcugguguaauucugauuaaaaaaaucggggaugguucuagaaaaaucaaagguugcugggacucuuuacaugugguugaggugcaagagaaaagcucgggcaggaacucgcacuacaaaaugacuuccacugccaugcuguggcugcaaaccaaugaaacagguucaggcacuaugaauuugggugguaguuugaccaggcaaauugagcaggacucugcagucaacgagaauaauccucauauugcuaauauuggcaggaugguugaagauauggagaauaaaauaagaaauacgcucaaugagauuuauuuuagcaaaacuaaggacauuguuaauaguuuaagaucgguccagccuuuaacugagaguagacaaaaggaaauuuuaaagcaagacuuggcugcagcuuuacaaaaaaggcacaacaagucggauaauuga

SEQ ID NO: 6745 - RNA, 3996 nt, Ceutorhynchus assimilis
augcaacaaguugaggcugcagcucagaauaauaauacugguaaaaugaacgagcaagccucggcaggcaacggggcggccgcggugcccgcccaguccgccaccccauccaaugcuaucgcccgggacaaucgcgaaccuccgcccagaaacgaaccgccaguugaaccugucgauggggugguucaaccuaacgucauaccacaagcagauaggccugguaggguaacaaaucaguugcaguucuugcaaaaaacaguacugaaagcuguuuggaagcaucaauuugcuuggcccuuucaacaaccuguagaugcuaaaaaauuaaauuuaccagacuaccauaaaauaauuaaacaacccauggaccuaggaacgauaaaaaaacgccuggauaauauuuacuauuggucaggaaaagaauguauucaagacuucaauacaauguuuacaaauuguuauguguauaauaaacccggugaagauguaguaguaauggcacaaacucuagaaaagguauuccugaccaaaguggcagacaugccaaaagaagaaauaauuguagagucccaaaugaaaagugcaaaagguaaaaaaggccgggccaguucaguaggugcuaccaccccaaccgcuaccauuauuggaacaccuucaagagguagaccuccagugacuguaucaucaacaguaucaaauccauuugcuacaacuacaggcucuauggguuuaccucucggcacugccgccccugcuacaguuccaggcaguaccgccacaacgacgauagcgcccccuaucaauguuaacucccaagcgacacccauaauuccagcuccaaccuacgccccuccaccucuugacccgacgcccguaacggcgcugggugucguaccuccugcgcaaccugccaaaaguaaaaagggcguuaaaagaaaggccgauacuaccacaccugcgacagcuuaugauuauuuaccuucaggugccgauucaaauucauccucguccgcuaguaagaucucuaagaggcgggaaucgggacgacaaauuaagaagccucuucguagucaagaauuagauggauuagguccauauagugguggaccggcagguauacccucaccagguagccaagcggcgcucgcccuaaaguccaaagaaaaacugaacgacacuuuaaaagccugcaacgagauacuaaaagaacuauuuucgaaaaaacacugcaguuaugcguggcccuuuuacaaaccgguggacgcggacuuguugggcuugcacgacuaccacgacauuaucaagaaacccauggauuugggcacggugaaacggaaaauggacagucgcgaguaccggucggcgcaagaguuugccgaagacguccggcugauuuucaccaauuguuacaaguacaauccuucggaucaugaugugguugcgauggcgcgcaaauuacaggacguauuugaagucaaauuugcaaaaaucccugacgaacccuuaaauaggauaagugguaugguuccuaaugagucgaguucguccgguucaaguucagaaaguucgagcgaaacggaagauucugaagaggaacgacgaaacaagcaauugaaacaacuugaaaaagaacuaacagcaaugcaagagagaaugcgaaaauugguggaagaaaguacgaaacguaaaaaagaaaagaaaaaacaaaaaaugaaagacaaaccgaaaaagaauucaguacaagcgcuggcccuucccaacaguacugguccccgagguccaaaaccgggagcaggggcgccaggagugaacgcgggcgggccggcgggcaaacgcgcgaaagcgggcagaggagcgggagcgggcggggcggguccgggucgcaaaaaagcgcagccaguguccgugguaccggcguucgauucagaggacgaggacagcgccaagccgauguccuacgacgagaaacgucaacugucgcuggacaucaacaaacuaccaggcgacaaacuaggucgagucgugcacauaauccaguccagggagccgucguugagggacucgaauccggacgagaucgagauagacuucgaaacguugaaaccgucaacguugagagaacuggaaaguuacgucgcgucgugucucagaaaaaagccacguaagcccuacuacaaaaaguuaccgggcaaaucaaaagaggaacaaaucgcagagaaaaaaaaggaacucgaggaccgacuacucgacguaaaucauaaaaucggacccaccaaaaaggcgccuaaaaaagaugcaaaaucugauccuacaggagcaggugcaggacacaugucaucguccagcuccaguucggacagugacaguucgacgucguccaugagcagcagcucgagcgauuccagcgacagcgaagcaggugccucggcagccaggcaggcgaaaaagccuaaaaucgcgaaucccaaaaagucgcccaacccuucggugaaucacaacaaugguggugcaccucucacagugccuccaacaaucauccaagugccacaacuacaacaaaaacaaucgccccaaccaccagucguggccacgcccauaccgacaacggccacgcccacugucaacucgguaguaccgacgccgccgaucacucccguuaacggcccuucgccgccaauaaaaccuguggcggcgccacguaagccuucgacuagugauaagccaccaacgauaccuucgcccguaccggcccagccgccaaauaccggcgggggugugacuaaaaugggggugggcguggcugcgucgccagacaagcccaaaguaccaucucccuuguugacuaccgcuguucaacagcaguauaccgauccuauugaggagaguuuggccaauuuggaacaggaaaugaagauagagccuauugauaacguuauugcuaugacuacuaguauagcucagccaaaacaacaacagaugccggccauuaacgcgauggucccucaacaucacuugucaaugccacccaauccucuggcaagucuggaacuuaaacagcccuuaggauugccgccuacgaucggcggcaugccgccaaauccuuuggcagugccgcaacaucauaauuugcacauggaucaggacaugcaaagccugaugcaucagggucacucucauccaggaauucacacucaaaacaacggcuacagcauaaaacacgaguucgacucuucaaugggcacaaacaauaaugguauggcuacuuuaggccuacccauggaaaugucuauaccgucaauguuugaccccuugccucagcacgucaacaacaugcaaaugcucaaaaaagaaaugccucuaaugaaaaacgaaccccaagauguguacgauaaaaaggcucaaaugcacgagcaacauaaaucuaugggggcguuuccuggguauaacaaggccaaaccggacgugaaaaaugccaguucguggaguagcuuggcaaaggccaguucaccuccaaacagcaauuccggaaauaguagcaaacaacaaaacaugaugcaagucauggacaguuuuaaggcauuccaaaauaaggcaaaagaaaaggccgauagggaaaagcaaaggcuggaaacguuagaauuaaagaggcaacaaaaagagcaagcagaacgagagaggaugaggcaagaaauugaacgaaggagagagguggaagagcaagaagcauuagaaaaagcuaggcaagcgguugcggaacgagaaaaaccaguacaagcacaacgaguugaagaguugaggucuucaccgggugagggcagcacuucgccagguucccucaguucggguucggacaggauaucagacagagagaggcagaggcugcaggaacaagagagacgcaggagggaagugauggcgaauaaaauagacaugaacaugcaaagugauuuaauggcagcauucgaagguucguuacagugucucagucgcgauuag

SEQ ID NO: 6746 - RNA, 1143 nt, Ceutorhynchus assimilis
augucguuaucgacaacgcguccacucgugagcgucuacaaugaaaagucugaagaagucaaagggucgagcaucgcucuucccauugucuucaaggccccaaucaggccugauguggucaacuuuguccaucagcaaguuuccaugaaccgucgucaaccuuacagcguaagcgacacagcaggacaucaaacuucugcugaauccugggguacuggacgugccgucgcccguauuccccguguucgugguggugguacccaucguuccggacagggugcuuucggcaacaugugucgcgguggucguauguuugcucccaccaaaccuuggcgccguuggcaaagacguguaaacaucaaucagcgucguuacgcuuuggcuucagcuaucgcugcuaguggcguaccagcuuuagucauguccaaaggacauguuguugaucaaaucccagaauugccuuugguagucuccgacaaaguccaggaauugaccaagaccaaacaggcuguucaguuuuugaggcggaucaaggcuuggccagacauccaaaagguauacaaaagucaacguuuccgcgcugguaaagguaagaugcguaacaggaggagaauccaacguaaaggaccuuugguugucuaccaucaagaucaaggucuucguagggcuuuccguaacauuccuggaaucgaccuaaucaguguugaaaaacucaaucuuuugaaauuggcuccugguggucauguuggacguuucaucaucuggacugaaucagcuuuuggaaaauuggacaaaguuuuuggcagcagcucagcucagaaaggcaacuugccucaaaccaaaauggccaacaccgaucuuucaagauuguugaaaucugaugaaaucaaggcuguauugaggaaaccacagaaaaagauuguucgucguguacgucgucucaauccguugaccaauaccaaggcuuuggucaggcucaauccauucgccgcuguauugaaaagggaggcaauuuugucgcaacaaaagagggcaaaauuggcugcagcaccugcagucaagaaggcgccuguagccaagaaagcgccuguagccaagaaagcgccugcagccaagaaagcgccugcagccaagaaggcauaa

SEQ ID NO: 6747 - RNA, 5316 nt, Ceutorhynchus assimilis
auggcugauuucaucgauucugaagcggaaguaagcagcgaggaggaggaauuggagccucaugaacguaaaaaacucaaaaaagucaaggcaauggacgauaguucugaagaggaagaagaugaugaugauagacugagagaagauuugaaagaccucaucgaugauaauccaauagaugaaagugauggggaagauucugaugcuucugggcgucagaaaaggaagaaaucugaugaugaagaagauuuggaugacagacuggaagaugaagauuaugacuuguuggaagaaaacuuggggguuaaaguggaaagaagaaaauucaaaagacugagaagaauucaagacgaagaaagcgaaggagaagacgaaaacgacgcugaacaagacagagaacaaaucgcuaacgauuuauuuucugaagaugaaagagauggaggaaguagaaaggaugaugaaagacauucugaacgcagucacagaccaacaguugucgauccagaucaauuugcugaagaagaagacgaaggcgaauacucagacgcagaugauuucaucguugacgacgacgguaaaccaauagcccgaaaaaagaagaagcccaucuuuacugaugcugcuuugcaagaggcccaagaaaccuuuggagucgauuucgauuaugaugaauuuucgaaauaugaugaauacgaugaugaagaggaagaugaagaagaugaauaugaggaggacgaagaaggcgaaagaagacgccgccagaaaaaggcagccaaaaaacgcccaaccaaaaagucaauauuugaaaucuaugaaccgucugagcuuaaacgaggcuucuuuacugauuuagauaacgaaauccguaguacagacaucccagaaagaaugcaacuuagagaugucccauuaacaacagugccugaugauucaacugaauuagacgaugaagccgaauggaucuacaaacaagccuuuugcaaaagcacuguauccaauauggacguaaaucugacucaagaggcucgcgaaaaacaacgcaaaggcccccuagcuauaggcaaaauaagaaaagcuuuagaauucaugcgcaaccaacaucuugaaguaccuuucauagccuucuacagaaaagaauacguacagccugaacuaaacauaaacgauuuauggaaaguuuacaaauuugacgccaaauggugccagcuaaaaaccagaaaggaaaacuuguugaaucuguuugaaaaaaugcgcuccuaccaaauggaucagguuaugaaagacccugacgcacccuuacccgauaacuuacgcauaauaaaagacaacgacaucgagcgccuaaaaaacguccaaacagucgaggaauuaaacgauguccauaaucauuuuauuuuauauuacgcaaacgauuugccugcaaugcacgcugccuggcgucuaaaagaaaaagaacgcaaaaagcaacugagacgugaagccagacuaaaagcuauugcugaagcugaagacggugcagacaucccagaagaaaucccagacgaagaccaagacgaugaacccgaaccugaaacaaucaaauacgcaaacagaucagguucguauucauuaugcagccgggcagguuuggaaaguuuagccaaaagauuugggcuuucgccugaacauuuugccgaaaacuuacgggacaauuaccaaagacacgacgucgaucaagaagcaggugaaccaaacgaaguugcucgacaauauguuugucccaaauuucaaacuguugaagaaguuaugcaggcugcaaaauauaugguugcuuugcaaauugcacgggaaccacuaguacgcaaguguguuagagagguauuuuacgaacgugcuaaaauuacuguuaauccaaccaagaaaggacaaaaaguaauugaugaagcccauaauuguuuuucgaugaaguauuugaaaaauaaaccaguaagagauuuggcaggggaucaauuccuuaagcuaacuuuagcugaagaggaucaacuaguuacaauucaaauaaguaguacuauugaaggacauacaucuaguucuuuuauagaugaagucaagcaauuauauauuagagaugaguuuaguaaaaauguacaagaguggaauaaaguuagaucagaguguguugagcgggcuuugacucguugcgucauuccagacuuacaagcugagcuuagaagagugcuuuuagcugaagccaaagaauuugugcucaaggcuugcuguaggaaauuguacaauuggaucaagauugcuccguaucaaguugaauuuccugaagaagaugaagacgaaugggauacuaguaaagguauaagaguaaugggcuuggcuuaugugccagauuauucucagucggcuuuuacuuguauaucgacugcagauggugauauuacugauuauuugagguugccgcauauuuugaagcggaaaaacagcuggaaacaggaagaaaagcugaugaaggaagcggauuugacggcuuugaggaacuucauuuacaccaaaaaaccucacguuaucgcaauaggaggcgaaucccgagaagcccuaaugauugccgaagaccugcgcggaaucgugaaagacuuaaucgaauccgaccaauuuccggcaaucaaaguggaaaucgucgauaacgagcuggcaaaagucuacgcaauuuccaacaaaggaaucgccgauuuccgagauuaccccgaacuauuacgccaagcgauuucauuggcccgucuaaugcaagauccacuaauugaauauucgcaaaugugcaacagugacgaggaaauuuugaguuuaagauuccacaaauugcaagaccaauugacaaaagaggaacuuuuagaagcuuuauguuuggaguuuguuaauaggacaaacgaaguugggguggauguuaauuuggcuguacaacaagcgcauaaaagucauuugauacaguuuauaugugguuuggggccuagaaagggacaggcuuuguugagaaucuugaaacaaaccaaucagcgcuuggaaaaucguacccaacuuguuacagcuugucauaugggaccuaaaguuuucauuaauuguucuggauuuauuaaaauugauaccaacaguuugggcgauaguacugaagcuuaugucgaaauucuagaugguucuagagugcauccagaaacuuaugagugggccaggaaaauggcuguagaugcuuuggaguaugaugaugaugaaggugcuaauccugcaggggcuuuggaggagauucuagaaacucccgagaggcuaaaggauuuggauuuggaugcuuucgcugaggaauuggagagacaaggauuugguaacaaaaguaucacccucuaugacaucagagccgaacuaaacucccgauacaaagacuuaagauccccauuuagaucugccaauccugaagaauuauucgauauguuaaccaaagaaaccccugaaacguuuuacauagggaaacuaguccaaguuucagugguuggaauugcucguaggaaaccgcaaggugaacaguuagauucagccaauccugugcguaaugaugaaaccggucuauggcaguguccguuuuguuugaaaaacgauuucccugaauuauccgauguguggaaucauuuugaugcugguucuuguccuggacaagccacaggaguaaaauugaggcuagauaauggaauuucuggcuauauuuauauuaaaaauuuaagcgacaaaccuguuaauaauccugaagaacguguaggaauugggcaacuaauacauuguagaauaaucaaaaucgauguagaaagguuuucaguugauugcacuucaaaguccagugauuugguugauaagaaucacgaauggcggccacccaaagauccuuuuuacaaucaagaacaagaggauaaagauuugagaauugaggcugaaaagagacaagaaaagcaaaagcaaaccuacauuaaacguguaauagugcauccagcuuuucacaauauuuccuauaaggaagcugaaaaauguauggucaacauggaucaaggugaagucauuauuaggccuucgaguaaaggggcugaucaucuuacaaucacuuggaaggugggggauggcauuuaucaacacauugaugucaaagaagaaggcaaaauuaaugccuuuucuuuagggaagucuuuauggauugguaaugaagaauuugaagauuuagaugaaauacuugcaagauauguuacgccuauggcuucaaaugcuagagaucuuuuguauuuuagauauuauaaagauacuaauggugguaugaaggacaaagcagaagaagcuauaagagaagaaaaaaagaaaaaccccaacaaaauccauuacguagugagcgcggcuaaaaauuucccaggcaaauuccuccuuuccuacaugccaaggaauaaaaucaggcacgaauacauuacagugacccacgaagguuucagauugagacaacaaauguuugacucaguaggcucacuauuuaaaugguucaaagagcacuuuagagaccccauuccugguggaacgccuaguacuccuagauugggcaguacuucuaguagaacaccuuuucaaggaggcgguacaccuuauaacaaugucaacucugaagcaauucaaaggguggcucagaauuugcccagucacauguugcaaaguuuaucggcuguggccaaucaaacaccgcauuauccucacaccccuggaggagcuuauggggcuaauuacgugacuacuccuuauacuccuagcagucagacaccuuuuaugacuccuuaugcuacaccucauacucaaacaccaaguuuuucucccucucaacaaucacaaucuggauugccucaagggcaaagcacguuuuugcacccaggcucagugacuccuucaaaucauagugugagcaguuccuacucuagagccagucaacguagucauaugucuucuagaaauccuccuaacaauagugcuggguaccaucacaggucugguagugcuuacgguaguacugcugaucaaauggauuggcaaaaggcugcugaagcuugggcagcaaaaaguaaagguacuccaagaagugaaggucguauuacuucuagaggaucaacaggucaaagaacgccucgguaugaugacauacaugcugauuuggagcguaccagaaugaaaaauguaggcaagaguccuaggucuaugagaagcacgacgccccuuaguaugucgaugggugaugcuaccccucuuuaugaugagaauauuuaa

SEQ ID NO: 6748 - RNA, 2571 nt, Ceutorhynchus assimilis
auggcuucugacaaagaaacagaccccagaguccuuguacaagaggacacugagggcaaagcaucgaaagaaaaagguaaugauaauaaaaagaagucgcaagauaaaagaaggcauaguagaucucgguccaaaucuccagacagggaacagcgacgugaaaaaaggcgaaaacgaaaagguucugaugaguaccaaauaaugccccgcuauuauggugaugacaaaaaaaaggaaaauagcgauaaauauuggaguaaauauccaaagaaagacgaacaucgaguugguaagagauacuaugaagaugacccaaauaauucugacgaugagaauauggaaaacaagagagcagggaaaaaagcuuccaaagacgacaaaaaaguagaagauaaaucggucauuaaaccucgugaaagaaaaaccguagaucuucuaacaucacgcacuggaggggcuuauauccccccugcaaaauugcgaaugaugcaagcagaaauaacugauaaaucaucagcagcauuucaaagaauugcuugggaagcuuuaaaaaaguccauucauggauucauuaacaaaauaaacacgucaaacauuggaauuauugcaagggaauuguugcaugaaaauauaaucagaggaagagguuuauuauguaaaucaauuauucaagcucaagcggcuucaccaacauuuaccaauguauaugcagcauuaguugcuguuauaaauucgaaauuucccaauauuggagaacuuuuacucaaaagauugguauuacaauucaaaagaggcuucaaacaaaauaauaaaaccauuuguauaucagcaucaacauucauugcccauuugguuaaccagucuguugcacaugaaauuuuagcacuggaaauuuuaacgcuacuuauugaaacuccuacugaugauucuguagaaguuucaauugcauuucuaaaggaauguggacagaagcucucagagguuacaagcagagggauuaaugcuauuuuugaaaugcuaaggaauauuuugcaugaggggaaauuggaaaaaaggauccaauacaugauugaggucauguuucaaauaaggaaagaugguuucaaggaucaugcugcuguuauugaagagcuggacauuguggaagaagaugaucaguuuacucauuugauaaaacuugaugauguaguacaggcagauacugaugauauauugaaugucuucaaguuugaugaugacuaccaaaucaaugaaggcaaauacaaaauuuuaagcaaagaaauuuuacaaagugauggagaaucgggaucgggagaaucagguucggaagaggauucggaugaagauagugacgaagaugaugaagaggaggaaguaaaaaaggaucagggcacuauuauugacaacaccgagacaaauuugauagcacuaagaagaacuauuuauuugacuauucaaucgaguuuggauuuugaagaaugugcccauaagcuacugaaaauggagcuaaaaccuggucaggaaauugagcugugucauauguucuuggauugcugcgccgaacaaagaaccuaugaaaaauucuaugggcuauuagcccaaagauuuugucaaauaaauaaaaccuaugucgaaccguuucaacaaauuuucaaggacacuuauucaacaacucaccgauuggacgcuaacaggcugagaaaugugagcaaauucuuugcgcauuuacuuuucacagacgcaauuaguugggaauguuuagaagccaugaaaaugaaugaggaagacacuaauaguucuagcagaauuuucauuaaaauuuuguuucaagaauuggcugaauauaugggauugggaaaguugaaucaaagacuuaaggauccgacacuucaaggacauuuugccgaacuguuuccaagagauaauccaaagaacacuagguuuucaauuaacuuuuucaccucaauuggguuaggugguuugacugaugaauuaagagagcauuugaaaaauuugccaaagaacaugccaacagugacuaaagaggaaagcagcucuaguucuucuuccaguuccagugaagauaguaguaguucagauucaagugaugaggaaucggaagaugagaagacaaagaaaaaagauaaacagaaaauauccaaaucaucacaagaaagacccagagauaaaacacagaggacuagcagagaugaaacuaacaaaagaagcucuagagaagaugaagaaaauuaucguaaacaaucuagaagaagagagcaacgaaauaauucagaagaaagggaaaaccgggaaagguccagauauaaugaccaaaauaaagacagaagaagggauuaugaaugggucaaaaguagauacgaagauaauauuagucaguugaaggauagaaggagagcauuugaaagaccuagaggaaaagaugauagaguaaaagaagaaaaaaauagaaggucgaggucgagagauaggauuagggugaaagaugaggaugacagaaguaaagacagggaguaucgucacagaaggaaucaugaaaggcaacgaaguuaa

SEQ ID NO: 6749 - RNA, 1785 nt, Ceutorhynchus assimilis
auggcauugaaaaaucaggucggccaaaaaaucaugaacgaagugauaaaauacaaaccccaaaagaaaaauggcccugcugcuguggcaggaggaaaaauggaauggagaguccugguuguagacaaacuggccaugaggaugauaucugcuugcuguaaaaugcacaauauuucagcugaaggcauaacuuugguugaagauauuuucaaaacccgcgaaccauugcccacaauggaagcuguuuaucugauaacuccuucaaaagagucuguggaagcacuaaugagggacuuugacggcaucaaacauauuauguacaagggggcacauguuuucuucacugaagcauguccugaccaguuaauuaaugacuuagcucgucacccuguggccaaauauauuaaaacccuuaaagaaaucaacauugcuuuuguaccaaaugaagcucagaucuuuucguuggauugugccgagacuuuccaaugcuacuauaauccagccuauucccaaaaauacagcgccaauauggaaaggauggcagagcaaauagcuacuuugugugccacuuuaggcgaauauccuucuguaagauaucgcagugacugggacaaaaacguugaacuagcccaacugauucaacaaaaauuggacgccuacaaagcagaugaaccuacaaugggcgaagguccagaaaaagccagaucacagcuguugauucuggaucgcggcuucgauuguguuuccccacuuuuacacgaauugacuuuccaagcuauggccuacgauuuguuaaauauacaaaaugauguuuaugaguaugaagcuucugcugguguaaaaaaagaaguccuccuugacgaaaacgacgaaauguggguggaacugcgucaccagcacauugcaguugucucccaaagcguuaccaaaaaccuaaaaaaguucaccgacuccaaaagaaugacagcuagcgacaaacaauccaugaaagaccugucuacaaugauuaaaaaaaugccccaauaccaaaaagaacugucaaaauacgccacccauuugcaacuggccgaggacugcaugaaacaguaccaaggcuacguggacaaguugugcaaaguggaacaagauuuggccauggguacugacgcugaaggcgaaaaaaucaaagaccacaugcguaauauugugccaauuuuacuugaucccaaaauaacugagcaguacgauaaaaugcgcauuauugcucuauacgccaugaccaaaaauggcauuacugaagaaaacuugcaaaaacuugccacucaugcccagauuucgaauaaacaaacaauugccaauauccaguauuugggggucaauguugucaaugaugguagcaccaggaaaaaaccguacacagugccucguaaagaacgcauuacggagcaaaccuaucaaaugucgcguuggacaccuguagucaaggacaucauggaggacuguauugaggauaaauuggaucagaaacauuuuccuuauuuggcugggcgggcucagagcacuggauaucauccgacaucagccagugcccguuauggucauuggcacaaagaccgcagucaaccgacagucaaaaauguaccccguuugauugucuucaucguuggagguguuugcuucuccgaaauccguugcgccuacgagguaacaaacgcccugaaaaauugggaaguuaucgucgguucuucucacauuuugacgccgagagcuuuucuugaacagcugacgucacucacacccaacuag

SEQ ID NO: 6750 - RNA, 2142 nt, Ceutorhynchus assimilis
augaugcaacaguacaugaaagaacuugaacaggaacccuuugaugcagaagaauucgucgaacgacucgcuuggagaacuauaaaugaaaccaaaaccgaaggcgaugaaggggauuugaauccuaccuuuuuacaugauucauucgugcaagcaauuaaagauuuaacguugcuucaagaaagacagcaaaagaaaugcgaaaggcucgaaggcgcugucagagaggacgaggcaauguuuuuucaggaaauuuauacuuuacuggaacaaaacaagcaaucaauggacacauuucaagagcuggacaguaaaauuaaccauguagccacaaaagucuuacauuuaggagaccaauuggacagugucaauggucccagagcccgaguaguagacgcucaaaaacugaugacccauuuaagugaauuuuuaucaaaugguccguuaaccagcuccauuuucaacgaucccuauagaaucgacgaagcggcugacguaauacagaaacuauuuuuaauaucacaagauuugccuucgcccaaguuugaaaauguuaaaaggaaaaucgaaaggacuuacucggauauugaaaaggcuuuaauugaagauuuuguuagggcuaugagcaaagaggaucugguuaggaugagggcuauagcuaacgugcugagucaguuuaaagguuacagccaguguguugaugccuauauugaucaaagucaagcagguuguuuguugagcaaagacguuuucgcucauuugguuccgcuuugcaagcacaacuacgaaauuauaaaagaaguuuucaauaguccagaacaaguaauggcuaaauuuguucugaacuuguaccaguugaaauuggcugauuauauagacuccaggcuaagugcuaaaguuggcagcuacgguuacuugcaaauacuuuaugaguuguacucaaaaacaaaucaguuuuccaacgaauugagcgucuaugauuuggguaacgaucagaauuauuugagcaaauugacuacgaagauuuuuaauaaauauaucagcgauuaugugcagauugaguugaaaugccucaaagaacggugcgcagcaaaucugcaaaaguacuacgaagccaagaaccaccagaaaaaacaaauccaaaccggcgguuuucaggaauugagacgagacuugcaagcagucaucgguaccagagccaacauaaauaucgcucagauugaaaacuauggcggcgagacauuuuuguccgaggaauuggccauaacaauccugcaggauaccaaaaaugcuuuuuugcgaugucaacuucuuucaaaacccgaagaaaaagccacaaaugcuucaaaaauccucaacacuuuaguaaacagccuccuuauagaacauguagacuaugcaguugaauuaggccuacaagcuguaccuguaguagaaggugcuaaaacaucuccaacuuuauccuucuucacuauaguucaucaaugcaacaauauaacgcauuuacuugaaaaacaauucaccgacaugguagugcccuuaauaaucaauacucaauucuauagugagagccuucaaaagaaaaaauacgucuuggaggacauugagagaaaagucaaugugggccuugaccgaugccucaaugcaguagcugcuuggguuaaauuauauuugcaaacugaacaaaaaaaaggugauuuuaaaccugaaacugaugauuuugauacagugucuucuccugcaugcaaggcaguuugucaacacauaucaaauauaauaaaacaaauaaaaagcagccuggauggcaauaauguaauggcaguacuugaagaauugggugucagguugcauagaaccauuuacgaucauaugcugcaguuccaauacaauaccgcuggugcaaugguugcaauuugugacuuaaacgaauacaggucuugcacuaagucaauggggcccuugguuacggaguuauuugaaacuuuacacgcucugugcaauuuacuuuugguaaaaccugaaaauuuacaucaaguuugcucagaggauucauuggugaauuuagaaaaaucuauucuacacaauuuuauacagcuacguagugacuuuaagacccaaaaacccacaauuuuuaaaacauaa

SEQ ID NO: 6751 - RNA, 816 nt, Ceutorhynchus assimilis
auggauuuccaaaauagagcugguggaaaaacgggcggaggcggcguagcaucaugguccgaaucgaacagagaccgcagggaaagauugaggcaauuagcccuugaaaccauagauuugcaaaaggaccccuauuuuaugaaaaaccauuugggguccuacgagugcaaauugugucugaccuugcacaacaacgagggaaguuauuuggcccauacacaaggaaaaaagcaucaggcuaauuuagcuagaagggcagcuaaagaagccaaagaugccccuagcaugcuacaaccugaaaaacccaggguggaacccaaaaaauucguuaaaaucgguagaccuggauacagggugaccaaacaaagggaccccgaaacuggacagcaaagcuugcuguuucaaaucgauuaucccgaaauugccgaucauguuuugcccaggcacagauucaugucugcuuacgagcaaaaaauugaaccuccagaccguaaauggcaauauuuguuguuugcugcagaacccuaugagacuauagcauuuaagguuccuagcagagaaguugaaaaaaccgaccagaaauucuggacucauuggaacagagacaccaaacaauuuuuccugcaauuugccuucaaaaucgaaaacaagaaacugaccaacauagugccaaggccuccuaugaugggaguuggaauaccuccuccaccuccuauguugccaguaccuccaccaccgagaccuccaauguucaaucauccuaugccaccuccgcccaugaugagagguguuaugccaguaccaccaccacguuag

SEQ ID NO: 6752 - RNA, 405 nt, Ceutorhynchus assimilis
auguccaucggugugccaauuaagguccuccacgaagcggaagggcacauagugaccugcgaaacuauuaccggcgaaguuuacagaggaaaacuuaucgaagccgaagauaauaugaauugccaaaugacucaaaucacugugacuuaccgggacggcagaguagcucagcuagaaaauguuuacauuagagguucgaaaaugagauuuuuaauacugccggauauguugaaaaaugcuccuauguuuaagaagcaaacuaaggcugggguggcugggagaggaaaaucugggauacuucgagcucaaguggcaagaggucguggaaggggugguccgccucaaagaggcagaggaaaugcuccuuggcagcagcaagucagcgcagguggcagaggcagauag

SEQ ID NO: 6753 - RNA, 1323 nt, Ceutorhynchus assimilis
auggcaucgaauauugcaaaaaguaccauuuuucgugcugucgggacuagaggcuacgcucagcuggccccaguuaguggcagcaccaauuaccaaguuaauguaaaaacgcuacccaauaagcuugugguagugucugcugacaaugauucgccucuagccaggguuucgauaguguuccgugcuggagcaagaaacgaaacgagcgaaaaucuaggagccgcucacguaauucgcaccgcugccggucucucgacacaaaacaugacucaguucgccaucacccgcaacauucaacaacuaggagccagucuaaccgccacuuccgauagagaaaccauuucuuacacccuagaaggcacuagacaagccguggaaaaagcucuaccauaccuaacagaaguagccacccaacaagucuuuaaaccaugggaauuggccgaacucucagaccgucucagaaucgauuuggccacaagacccuugcaauugcgcgcagucgauuugcuucacaaagcagccuuccguacggguuugggcaauucgcuuuacgcgcccaaauuccaaauuggaaaaauuucaucugaaacucuucagcauuacgugucgagcaacuucacuucggcuagaggggcuguuguuggauugggacucgaugaaugcaaaauggacgagcuggcucagucuuugacuuuggacgacagcaauggccauguuaaugugaguccuuacaaaggaggcgaaauaaggucggacaaaggugggaguuuugccuuuauggcuguagcaggugaaggggcuucgguuaaaaacccuaaagaagcuauggcuacugcuguuuugcaacgggcgcucggaguuggaccucaaaucaaauggagcacuguagauaaugguauuuugagcaaggcuauuugcaguagugaaggcuacgccucuucugcuauuagugcuaccuauucagacacagguuugguugggguuuuaauugcugcgccugcuaaagcugcagguaaaauuuuggaaggugcaguuaaggcuuugaagaguggcaauguuaccgaugcagaugucgcuagaggcaagaaccaauugaaaacagcccugcugcuucaucuggaaagcggcucugaagcuguagaauugcuaggaaagcaagcuguuuuggcugggggugcuaugucucccugugaauuggcugcugcuguugacucaguuuccacugccgauguucgugcugcacuuucgaaggcuggccgaaaacuuacaauugcuucaguggguaaucuauccaauguaccauacgcugacgaccuaaaauaa

SEQ ID NO: 6754 - RNA, 333 nt, Ceutorhynchus assimilis
augcguaggucccacgcaggcaauuacuacgaaccuuugccccaagacaacaacgaaaucgaacacgaaaaugaacguauggcacaggaacuaucugacaaaauaggcguccugaaauccuuauccauagacaucgguaacgaggugcaguuccagcacaaacuguugagggacguagacgaugacauggauagaacuggaggguuucucggcaaaaccaugucuaggguagucaaauugucuagagggucacauaacuauauuauaauuuauuuguuuguguuugcaauaauuguguuuuucauauuguauuugguguuaaaguuuagguag

SEQ ID NO: 6755 - RNA, 1479 nt, Ceutorhynchus assimilis
augucaauaucaaccaaacaagcugccagagaacauguucuggccguaucuagggauuucguuucccagccaagauuaaccuacaaaacuguaucugguguaaaugggccucugguuauucuagaagaugucaaauuuccaaaauucaaugaaauuguugaacugaaacuggcagauggaagucucaggucuggucaagucuuggaagucagugggucaaaagcugugguacaaguuuuugaaggcacgucuggaauugaugccaaaaacacauuaugugaauuuacuggggauauuuugaggacucccgucucagaagauauguugggacguguauuuaacggaucuggaaaacccaucgacaaaggacccccaaucuuagccgaagauuacuuggacauccagggacaaccaaucaaccccuggucacguaucuacccagaagaaaugauccaaacugguauuucugcuauugacgucaugaacuccauugcccguggucagaagauucccauuuuuucagcagcugguuugccccacaacgaaaucgccgcccaaaucuguagacaagccggucuugucaaggugccuggaaaaucaguucuagaugaccaugaggauaacuuugcuauuguguuugcugcuaugggugucaacauggaaaccgcuagauuuuucaaacaagacuuugaagagaaugguucuauggaaaacguaugcuuguucuuaaacuuggcaaaugacccaacuauugaaagaauuauuaccccacguuuagcuuuaaccgcugccgaauuuuuggcuuaucaaugugagaagcacguucuaguuaucuugacugauaugucuucauaugccgaagcguugcgugagguauccgccgccagagaagaaguacccggucgucgugguuucccagguuacauguacacugauuuagcuaccauuuaugagcgugcuggucguguugaagguagaaacgguuccaucacucaaauucccaucuuaacgaugccuaacgacgacauuacgcauccaauuccugauuugacugguuauauuacugagggucaaaucuauguagacagacaguugcacaacagacagaucuacccgccaguuaauguguugccauccuugucgcguuugaugaagucugcuauuggugaggguaugacccgaaaggaccacucugauguaucuaaccaacuguaugcuugcuacgccaucgguaaggauguccaagccaugaaggccguggucggugaggaagccuugaccccugaugaucuccuuuauuuggaauucuugaccaaguuugaaaagaacuuuaucucgcaaggaaacuacgaaaacagaaccguauucgaaucuuuggacauuggcuggcaguuacuccguaucuuccccaaggaaauguugaagcguaucccugccgccacgcucgcagaauucuauccuagagauucgcgucacuaa

SEQ ID NO: 6756 - RNA, 390 nt, Ceutorhynchus assimilis
aaauauuuaaaagccgagagaccgaaacaagaacuagaucuagaccaaaaacucgcggauaaagaaacccaaacaauaccaugcgguaaaccaaaaguacccgaagguuaucaggauuuauugcuagaguuuaccauaaauuguaaucuccaucauccgagaaaccucgucgauuaugccgcugaauauuuugccgccuugaaagaucaaaaacauaccaagauugucuacgaucugguuuguacugagaaagaagaaaaaacagacagggacaguacugcuuuuagugaagcuacaacagucacggauucggaauuuucaaaagaugaacaugaaaaaauaauacuuacaucagcagaaucagauucaguaccuauacucuugaauuga

SEQ ID NO: 6757 - RNA, 2397 nt, Ceutorhynchus assimilis
augagcuaucaaagcagggcaaugccuuaccaaggcacaggugacaugccaauggcaaacuccaaagaacaaaacgugaugucguggcaacaaaacaacuauaugggugacucuggaauccauuccggagcucaaacccaggucccaucuuugaguggcaaagaagaagaggauauggaucucuucgaucuugaccagggauaucaaggauucacucaagaccaaguugaugacaugaacaaucagcugaacacaacccguucucacagaguaagggcugcuauguuuccugaaacauuggaagaaggaauugagaucccuucaacacaauuugacccuggacaccaaacagcuguccaacguuuagcugaaccaagucaaaugcuuaaacacgcuguaguuaaccuaauuaacuaccaagaugaugcugaauuagccacuagagcuaucccagaguugauuaaacuuuugaacgacgaagaucaaguaguuguuucucaggcagccaugauggugcaucaacugucaaagaaggaggcauccagacaugccaucaugaacaguccacaaaugguggccgcuuuggucagagccauuucaaacucuaaugauuuggaaaccaccaaaggagcuguugguacucugcauaaauugucacaccacagacaagguuugcuugcuauuuucaaaagcggugguauaccagcuuuggugaaacugcucaguucaccagucgaaaguguuuuguucuaugccauaacuacucuacacaauuuauugcuucaucaagaugguucuaagauggcggugagacuugcuggaggucuucaaaaaaugguugcacuauugcaaagaaacaauaccaaguuuuuggcuauuguuacugauugucugcaaauuuuggccuauggcaaccaggagaguaaacugauuauucuggcgucucaaggucccguugaauuggugcgaaucaugagaucuuacaauuaugagaagcuuuuguggacaacuuccagaguuuugaagguucuaucaguaugcucaagcaauaaaccagccaucguggaagcuggaggcaugcaagcuuuagccaugcauuugggcaacucgagccaacgucugguucaaaacugucucuggacuuugagaaaucucucugaugcugccaccaaagucaauggauuggacucuuuauugucaucuuugguccaaguccuugcaucauccgauguaaauguuguuacuugugcugcagguaucuuaucaaauuugacaugcaacaaccaauucaauaaagaaacaguuugucaauacgacgguauuucggcucuuguacgaacuaucaugaacgcuggcgaucgagaagagauaacugaaccugcuguuugugcucugagacacuugacuuccagacacgagaaaucugaguuggcucaaaaucaagucaggucaguaccuagugaucagaaugacaggcuuguuggagguauuccuguuaucgucagacuauugaauccgccaucacguuggcccuuggugaaagcuguaauuggacugaucaggaaccuugcacugugccaggauaacuucgcaccauuacgggaaucuugugcuaucaauuauuuggugcaauuauugaugagagcuuaucaagauacacagagacgagcuagcuuggcaaguggaggcagucaacaaccaggaacuuacgcugaugguguuagaauggaagaaauuauugaagguacuguuggcgcucuacacguucuugccagagaauucuacaaucgcgaacaaaucagacaacaaggcguuauucccguuuucguacaacuucuauucaacgacaucgaaaauauacaacgaguagcugcuggaguacuuugugaauuggccgccgauaaagaaggggcggauuugauagagcaagagggcgccacugcaccgcugaccgagcuuuugcauucacggaacgaagguguugcaacauacgcugcagcagugcuauuccguaugucugaagauaagccucaagacuacaaaaagcgccucuccauggaguuaucaagcucacuguuuagagaggagaaccuuuggaacccugaccugggcauggggacagauuuccaggauauuuugaguccggaacaggccuaugauaauauguacgcccaagggccgccuaguguacauagcagccacacugguaggccuuaucagcaacaaggcuaugaccagauacccuuaaacaugcaagcuauggacaucggcucaccccuagacgcuauggacguaacaggggcugagccugacuugaauuuugauggaauagaccagcuaccaacuccgccccaagacaacaaccagguggcggccugguacgauaccgaucuuuaa

SEQ ID NO: 6758 - RNA, 837 nt, Ceutorhynchus assimilis
auggcaagaaacgcagaaaaggcgaugacaacacucgcaagauggcgggcagcacaagcaggggaaauugauaaaucgaagagaagaagaccuuaucuagccucggauugcaaaagcuuguaugcaugugagaaauggcguaugcacauuaucagagaaauagcuaaaaaagucgcucagauucaaaacgcugguuuaggugaauuuagaauaagggauuugaacgacgaaauuaacaaauugcucagggagaaacggcacugggaagaccaacuaaaagaacuuggugguccugauuaucagaaaaucggcccucgaauguuggaucaugaaggaaaggaaguaccaggaaauagaggauacaaauauuuuggagcagcaaaagagcuaccugguguaagagagcuuuuugaacaagaaccaccuccuccuccuagaaagacccgggcagagcuaaugaaagauauugaugcagauuauuauggguauauggaugaugaugaugguauuuugauaccacucgaaaugcaagcugaaaaaauagcuguccaaaaagcaguaacagaauggaaggcaaagaaagaagcuagaaaggcugcaggugaagcuucggaugaagaggaucaagaaguaaguguauaugcaguugaugaggacguagagaaagaugaaauacuagaagauccaagucagcaacuucucgaugggucacaacaaagauuuguggcucacguaccaguuccaucacaacaagaaaucgaacaagccuugcugaggagaagaaaacaagaauuaauggaaaaguauggaguauuagacaaaacaauaaauaaauaa

SEQ ID NO: 6759 - RNA, 648 nt, Ceutorhynchus assimilis
auggcugcagaacagcaacugccaacauucaagugugugcuuguaggugacggugguacugggaaaaccaccuuuguaaagcgucauuugacuggcgaauuugaaaaaaaauauguagccacccucgguguagaagugcaucccuuaguuuuccacacaaacagaggcgaaauccgcuucaauguuugggauacugcuggccaggaaaaauuuggaggucuucgugaugguuauuacauccaggggcagugcgcaauuauuauguuugauguuacuucucguguaacuuacaagaauguaccaaacuggcacagagaucuggucagggugugugagaauguuccaauuguacuuuguggcaacaaaguggacaucaaagauaggaaagucaaggcuaagaguauaguguuccauaggaaaaaaaaucuacaguauuacgauaucucugccaaauccaacuacaauuuugagaaacccuucuuguggcuggcccguaaacuaauaggcgaucccaaucuggaguuuguagcuaugccagcgcucguaccaccagaaguacacauggacccacaguggcagcagcaaauugagaaggacuugguggaagcccaaaacaccgcccugccugacgaugaugaggauuuguaa

SEQ ID NO: 6760 - RNA, 2556 nt, Ceutorhynchus assimilis
augccgcguauaaugauaaaaggugguguuuggagaaacaccgaggaugaaauucuuaaagcggccguaaugaaauauggcaaaaaucaauggucucguaucgccuccuugcuccaccggaaaucggccaaacaaugcaaagcucguugguucgaguggcuggaucccagcaucaaaaaaaccgaauggucucgcgaggaagacgaaaaacuuuugcauuuggccaaguugaugccuacgcaauggagaacuauugcuccuauuauuggacguacugcugcucaauguuuggaaagauacgaauauuuauuggaucaagcucaaaagaaagaagauggagacgacggugacgauccaagaaaacucaaaccaggcgaaauugaccccaauccagaaaccaagccagcuagaccugacccuaaagacauggacgaagacgagcucgaaaugcuguccgaagccagagccagacuggcaaacacucaaggcaaaaaagccaaacguaaagccagagaaaagcaacuggaagaagccagaagauuagccgcucugcaaaaacgacgagaacuucgcgcagccggcaucgaaguugcuccuagaagaaggaagaagcgcggcgucgauuacaaugcugaaauuccauucgaaaaacgcccagcaauuggguucuaugacacuuugaaugaagaauuagacccgauggcaccagauuuuucagaaaugacccaacagaagcuggauggcaacuugagggccgaacaagaggaucgcgaaaggaaaaaggauaaacaaaagcugaaacaaagaaaagaaaacgauaucccugaagccaugcuucaaaaucaggaaccugccaggaaaaggucgaaacuuguuuugccagaaccacaaaucucugaccaagaacuacaucagguagucaaguugggcaaagcaagugaaauugccagagagguugcuucugaaagugguguggauucaacggacacuuuguugaaugacuacacuguuacgccucaugcuacagccacuccaagaacaccggcagcacaaacugacagaauuuuacaggaagcucaaaacguaauggcacuuacccacguugauacuccacucaaaggcggccugaauacuccauuacauaauucggauuuuagugggguugugccucaacaacaagcuauugccacuccaaacacuguguuggcuacuccuuauaggucaguuaggagugaaacugguucaacuccuggaaauacagguuuuaugacacccaaaaguggagcuauggugccaguggguggaacaucuacaacuuauguggcaccaucuauaagggauaaauuaaauauuaauacugaagaugcccuagaaguaggagauacuccagcacagcaucuuauguaucagauguccaccaagcagcaacuuaaaaugggcuugaguaguuuaccaacgccuaaaaaugauuacgaaauuguuguuccggauaaugaagaacagacuauuccagaacaagcucaagaaaaaucaauugaagaccaagcugacguagauaugagauaucaagaagaaaugaaagccaaagcugccaaagagcuuuuauugagaucacaggugauccaaagagauuugcccaggccacaagauguuaaccucucaguuuuaaggccugccaaugagaguuacucacugacugagcuccagaaagcagaagaacuuauaaaguuggaaaugucaacuaugcuucaauuugauaauuugaaaaacccuguggcuacucaaaguaagccgucuaacaagagucaggcucagcaguuggcauuucuagaggaacauccauauagaaauuuccaagcugaagaacuugaaacggcaaagcaaauguugaaaaaggaaauggaaguaguuaaaaaaggcaugaaccauggagauuugccgauggacgcuuacacucaaguuugggaagaauguuugggucaaguguuguuuuugccuaaucagaaucguuacacgagagcuaauuuagccagcaaaaaagaucguuuggagucggccgaaaaacguuuggaacaaaaccgagcccacauggccaaagaagccaaaaaagcugccagaauggaaaaaaaauugaaaauccucacuggaggauaucagucgaaagcucaaaguuuaauaaaacaauuaaccgacgccuacgaaaacaucgaucaagccaauuuagaauugaaaacauuuaaauuuuuacaagaacaagagagaaacgcgcuaccaagaagaauccaaggccuaacagaagauguuaguagacaacuagaacgagagaagggcuuacaaacaaaauauaaugauuaucaaaauaaaaucauagauuuacaagagcaauugggauacgagcaacaagaaacugcagagcaaguugaggauuuagaugggguaagcgugcagccagaaacagagcaaguuaccaacaauuuaaaugcaacuguugaagaaaauaucaguucuacaaucaaugggcuagauaaggaggaggaaaauguugcaguucaauaa

SEQ ID NO: 6761 - RNA, 471 nt, Ceutorhynchus assimilis
augcaguucaugcuguuguuuagucgucaaggaaaacuacguuuacaaaaaugguacguugcacauccagacaaauugaaaaagaagauuaccagagaacuuaucacuacuauacuggcuaggaaaccuaaaauguguaguuuccuugaguggagagaccuuaaaauaguguacaaacgauaugcuaguuuguauuucugcugugcaauagaacaagaugacaacgaacuucuuacuuuggaggucauccauagauauguggaacuccuggacaaauacuuugguaguguuugugagcuugacauuaucuuuaacuucgagaaagcuuacuuuauauuagacgaacugauguugggaggugaaauacaagaaacuagcaaaaagaacguucucaaagcgauugcugcacaagaucuucugcaagaagaagaaacgccucaagguuucuuugaugaucacggacuuggcuag

SEQ ID NO: 6762 - RNA, 1260 nt, Ceutorhynchus assimilis
augcaucaaauaagcaaauuucuguucuaucaggccgcacggacaucaaaaaaugggguucgguacuacucgagagagccgcaaaaacgacccacauucuugucgagauuauacgacaauuuuagagaagaaauguccaaaaacaaagagaugaaagaaucuuuaaaaaaauucaaagaagaagcagaaaaacuagagcaaagugaugcauuaaaagcggcccgucagaaguuugaaacuguagaaaaagaggcaacgaaaagcagugauguuuuuaaggaaagauucaguacuaucaaagacaaaguauccagugucauagacgaggcugguaagacugaacuugugaaaaaagcuggaaagauuucagaggagauuucaaaaaccacacauucaauuggggaaaaagcacaagaaauagguaaaacuaaugcuuuucaaaguaucagcaaagcuacugaagcaguuaaaaaagaaauggauaccaauaguaugcaagguagaguuuacguuaguccaauaaaacuucggaaaagaacagaaaccucggcgguacaaaaccaaaaacauuacgaaccaaacacagaagcgauggguauugagcuacauaaagauucuaaauuuuaucagucauggcaaaauuucaaagacaauaauccauauguucacaaagucauggauuggaaauuaaaauuugaugaaagugaaaacccaguaauaagggcuucaagggugcuaacugaaaaaguaucagauauuaugggaggacuauuucagaaaacugagcuuucagaaacuuuaacugaaaucugcaaaauugacaacaguuuugauacuaaacgauuuuuaaaacagugcgaagcugacauaauacccaauguauuggaagcuaugacuaggggugauuuggaaguucuaaaagacuggugucacgaagguccuuacaaucucuucucgauuccuauaaaagaagcuuacacgaaagguuauaaaauagagucaaaaaucuuagauauagauaauguagaucuagucauggguaaaguaauggaacaagguccuguucuaauaauuucauuuacuucccaacaaguaauggccguaagagauucucagggaaaugugguugaaggagacccagauaagauaaugagaguaacauauguuuggguuuuauguagggauauuagugaaacugauccuagagcagccuggagacuauuagauuuaucagcaagcaguaaugaacaacugguguga

SEQ ID NO: 6763 - RNA, 909 nt, Ceutorhynchus assimilis
auggauuacucuagcgauucugaacucagcgacagcgaucgggagcugcaagaagcuuuuguugagggaaaauugaagccgggacuaaauacaguacaccaagcaccaaaaaaggcaguuaacaauguugaagguuuaaaucacaaacuagaggaaaucuauuuaaaucuaccauggaucgaaagauuagacugcauaaacgcacaagcaccuuuagcuccagaacuggcugcucaauuaauggcucaugaacagaaacgagaaaaccaauuaaagaauaauaaaaaacugccacagcuuaaagcaagcgaggauccuauauugaaugauuuuaaaagggaaauggaguuucauagacaagcccaagccgcuguacuugaugccauaccaaaguugaaggcucuuggaauaccuacuaaaagaccugaugacuauuuugcugaaauggcaaaaacagacgagcauaugcaaaaaaucagagaacauuugaugacaaagcaacagcagcaacagagaagcgaaagaguuaaacaacuaagacaacaaagaaaagaaggcaaaaugcuucaaauacagaccaaacuccaaaggcagcaagagaaaaaagaaaugcuggaccagguuaaaaagcaccgcaaaggagucucgaaagaucuagacuuccuggauuccaaaaaaagcaaagcuauuucgcggaaggcauuggaaaagagaaauaugaaaaauaagaaauuuggauuugguggcaagaagaagggugggaaguugaacacaagagauacagcagcagacauuagugaauauaggagcccuaaaccaggcgguagaaagggcagggauucuaaggguaaacagaagaauaauaggccaggcaagaauaggaggauaaaagcuaaaaauaagaaauag

SEQ ID NO: 6764 - RNA, 1869 nt, Ceutorhynchus assimilis
augaaccaaggggccccaaauuaucccauggcgucucuguacgucggggauuugcaugcugauauaacugaggccguacuuuuugagaaguucucuaccacugguccaguuuuguccauucgugucugcagggacuuaaucacucggaggucuuuaggauaugccuauguuaacuuccaacaaccugcugaugcggaaagagcucucgacaccaugaauuuugauuuaauuaaaggaaggccgauccguauuauguggucccaacgagauccuucacuucguaaaucaggugucggaaacguguuuaucaaaaauuuggaucguuccauugauaacaaagccauguaugacacuuucucugccuuugguaacauuuugagcuguaaaguggcucaggaugaaacuggcucgagcaaaggcuaugguuuuguccacuucgaaacugaagaagcggcaaacaaauccauugaaaaaguaaauggaauguugcuuaacggcaaaaagguuuacguuggccgcuucauuccucgcaaggaaagggagaaggaacuuggagaaaaagcgaagcuauuuacuaacgucuauguuaagaauuucggagaggaauuaucagaagaacaauugcguaacauguuugaaaaauacggaaagaucacgagcuacaagaucaugaauaaagaugauggaaaaucgaaaggauuuggguuuguugcuuuugaauguucggaagcagcugaggcagcaguggaagcacuuaauggaaaagaaucaguugaugggaaaccucuuuacguuggucgugcucagaagaaagcugagcgccaacaagaguuaaaacgucgcuuugaggcuuuaaaaauggaaagacuuaaccgauaccaagguguuaacuuguaugucaaaaauuuggaugacacaauugacgaugaacguuuacguaaagaauucacuccauucggaacaauaacuucagcuaaaguaaugauggaagaagggcguaguaaagguuuugguuuugucugcuucuccuccccugaagaggccaccaaagccguuacugaaaugaauggacgcauagucggcuccaaacccuuguacguggcauuggcucagaggaaagaagacagaaaagcucauuugacaucccaauacaugcaacggauggcaaauaugcgcaugcaccaaaugggucaauuuauucagccuggagcauccaguggauacuucaugccaacgauaccugcuccacaaagauuuuaugcaggugcucaaaugccuccaauccguacaagcccuagauggcccucucagucacaaguuagaccaacuggucaaggaguuccugcugcuuacccaggcaugacuaacccauucagggcaacuacgcguccuccaaaucaaacaaugucaaugcguggcaauauuaauguuuccagaucaaucacuuguccacagcccaccaauaugcagggacguccccuuccaggacaaaguguuguugcuucaaacagaacuacauucaaguauaccgccaacaugcgcaauccaccucagucuaugguaccauugcccagucagccgguucaacaagcagugcacauccaaggucaagaaccacuuacugcaacaauguuggcugcugcucuuccaccagagcaaaagcaaaugcugggagaacgucuguuuccacuuauccaacgcauguaugcagauuuagcuggaaaaaucacugguauguuguuggaaauugacaauaccgaguuauugcacauguuggagcacaacgagucccuuaaaaacaaaguggaggaggcuguagcuguguuacaagcccaucaagccaagcaaucaguuaucaagaaggacuga

SEQ ID NO: 6765 - RNA, 2763 nt, Ceutorhynchus assimilis
augaccgacucgaaguauuucacuaccaccaaaaagggagagauuuuugaguugaaaucugaauuaaacaaugauaaaaaggagaaaaagaaggaggcaguuaagaaggucauagcaucaaugacaguaggcaaagacguaucggcccuauuuccugacguaguaaacugcaugcaaacugacaauuuggaacucaaaaaauugguuuaucuuuacuugaugaacuaugccaaaucucaaccugauauggccauuauggcggugaauacuuuugugaaggauugugaagacccaaaccccuugauccgugcuuuagcugugagaacuaugggcuguaucagaguggacaaaauuacugaauaucuuugugaacccuuaagaaaaugcuugaaggacgaggauccuuauguuagaaaaacugcugcuguuugugucgcuaaauuauaugacauuucuucagguuuaguugaagaucaaggauuccuggaacaacucaaagaacuucuaagcgacucaaacccaauggugguugccaaugcuguggcugcuuuaucagaaauuaacgaaagcagcccaacaggacaaccuuuaguugaauugagcacgucaacgauuaauaaacugcuaacagcauugaacgagugcacugaauggggucaaguguucaucuuggacucgcuauccaauuacacuccgagagaugacagggaggcucaaaguauuugugaaagaaucacaccaagauuggcucaugcuaaugcugcuguuguccuaucagcuguuaaaguuuuaauuaaaaugauggagauuuuacaaggagauguugaguuuuguaauacuuugaguaaaaaauuggcaccaccuuugguuacuuugcuuaguucugaaccagagguucaauauguugcuuuaagaaacaucaaucugauugugcaaaagaagccugauauuuuaaaacacgaaaugaagguauucuuugugaaauacaaugaucccaucuacguaaaacuggaaaaacuugauauaaugauucgucuagcuucucaagcuaauaucgcccaaguuuuaagugaguugaaggaauaugcuacagaaguugauguugauuuuguaagaaaagccgugagagccauuggaaggugugccauuaaaguggaaccaucugcagagcguuguguaucaacuuuguuagaucugauccagaccaaaguuaauuauguggugcaggaggcuaucguugugaucaaggauaucuucagaaaauauccaaacaaauaugaaaguaucaucaguacauugugcgaaaaucucgauacacuggacgaaccagaagcucgugccucaaugguauggauuaucggugaauacgccgaacgaaucgauaacgcugacgaacucuuggacaguuuccuggaaggauuugccgaugaaaacgcucaaguacagcuucaguuacuaacagccguuguaaaacuguuccuaaaacgaccacagcacacucaaggucuagugcaacacguucuaaguuuggccacucaagauucugauaaucccgauuugagagauagaggauuuaucuauuggagauuauugaguaccgauccggccgcagcuaaggaaguaguucuugcugauaaaccacugauuucugaagaaacugacuuauuagagccuacacuguuggaugaauuaauaugucacauuucaucuuuggcuagugucuaucauaagccuccuacagcuuuuguggaagggcgcagugcugguauaagaaaaacguuaccagcgcgucaagggucugaagaagcuccuacucaggaagcaacaguuauuccaaaucaggagagucucauuggagauuuauugucaauggaucuuggggggccaacuauacccacuccagcugcugcaccuguuguugcuccaacuaguaauguggaucuguuagguggaggauuagauguuuuguuggguggugguccagaaguaaccagcaacguaggugcugcucccucaaccacaggccuucuaggugacaucuucggaaucacaacaacaccuacaauguacacgccaccaaaagccuuaugguugccggccgacaaaggcaaaggccuggaaauucaaggcacauuuucucguagaucgggacaaauuuacauggaaaugacguugaccaauaaggcgaugcaagcaaugaccggauucgcaauucaguucaacaaaaauagcuucgguuuggcaccuucgguuccgaugaacgugacugcgcugcaaccaggacaaaguuuggaguauaguuugccuuugaguacuacuggaccugugcagaggauggaaccguuauccacuuuacaaguugccauuaaaaacaaugucgacguauuuuacuaugcuugucaaauuccccuucaaguaaucuuuuuggaagauggcaccuuagauaaacgaguauuuuugacuacuuggagagacauuccuucugcuaacgagauacaguacacguuaaaugacaucaacgguggcacgaccgauuccauuucuaauaaaaugacucgaaacaacauuuucacaauagccaagcguaauguggaaggucaagauaugcucuaucagucgcugaagcucacgaacaauauuugggugcuucucgaauugaaguugacuccaggguugaguuaugcgacccugagucuaaaaucuagguccuuggaaguggcuccuuuuguauuucaggcuuaugaaaugauuugcaagaauuaa

SEQ ID NO: 6766 - RNA, 498 nt, Ceutorhynchus assimilis
augccaccaaaauucgaucccaaugaagucaaauacguauaccucagaugugugggaggagaaguaggagccacaucaucccuugccccuaaaaucgguccccuaggucugucucccaaaaaagucggugaugacaucgccaaaggcacagccgauuggaaaggucugaaaaucacuguacaauugaaaauccaaaaucgucaggccaccauuucuguaugccccucagcggcuucucuaaucauuaaagcuuugaaagaaccaccaagggaucguaagaagcaaaagaacaucaaacacagcgguaacauuucuuuugacgauguaaucucuaucgccagacaaaugaggccccguuccauggccaaaaacuuggcaggcacaguuaaagaagucuuagguacugcccaaucuguuggcugcacaauugaugguaaggcaccacaugacgucauugacgaaguaaaugcugguuccguugaaguggcagaagaguaa

SEQ ID NO: 6767 - RNA, 1098 nt, Ceutorhynchus assimilis
augagugaucagagugguaugagagccuuaauuuuggucgggggcuacggcaccaggcugaggccuuuaacuuugagccguccaaaaccuuuaguggaauucgcaaauaaaccuauuuuguugcaccaaguggaagcccuaguuaaagucggugucacugaaguuauccuggcgguuuccuaucgugccgagcaaauggaacaggaacuagccgaugaagcuaaaaaauugggcgugaaaaugguguuuucgcaugaaacugaaccgcuaggaacugcuggcccuauagcuuuggcuggagaacauuugagaaaaagcgacaaaccguuuuucguguuaaacucugacaucauuugugauuuuccauuuaaaaaguugauugaauuccacaaaucgcacggcaaagaaggcaccauuguagugacaaaaguugaagagccuucaaaauacggugugguaguuuacaaugagcaaaagugcauugaaagcuuuguagaaaaaccucaggaauuuauuucaaauaaaaucaaugcgggauuguauguuuuaaauccuaguguuauugauagaauagaacuuaaaccaacuucaauugaaaaagaaguuuuuccuaauauggcaacugacaaucaauuguuugccuucgagcuggaaggauucuggauggaugugggacaaccaaaagacuuuuugauuggaaugugcuuguaucuuaaacauuugaggagugcagauccagagaaauuguacaggggaccaggcguaauagguaaugucuuaguagacccuacagcaaaaauaggcaaaaguugccaaauaggaccaaaugucaccaucggcccagguguaguaaucgaagauggcgugugcaucaaacgcaccacaauccugagagacgccaccauccggucaaacacuuggcuggaaaguugcauuauuggcuggagaugcaccgugggccaauggguacgcauggaaggcauuacaguuuuaggagaggauguuauugucaaagacgaaacuuauauuaauggggggcagguguugccgcacaagaauauuggggauucggugcguacgccacaaauuauuauguga

SEQ ID NO: 6768 - RNA, 867 nt, Ceutorhynchus assimilis
auggcgucugagggggacgaaauaauuucugaucaagaaaaagugcgaauaguuuccgauuuuauaauacauucgccgcccggcgaguuuaacgagguauuuaaugauguuagaaaauugcuggacaacgacgaccugcucaaagagggggccagcggggcauucgcccaauacaacaaggaccaacugacccccguccgaauagagaauucugaucauuggguacugauuacugaauacaacgauuuaggaaauaauagguuuuuugauccccgcuccaaacaaaguuuccguuaugaccaccucagaaaagaagcguccgacuaccaauccuacagcccggauacaacagccgaaccguggcggucugcccucgacacagaauuuguucaauacacaagaaaucacuauaaagaugguguaugcagcguuauagggcgcagccaagggggcguggucaguuugacagcauguaucgaggaccaucaguuucaacccaaaaauuucuggaaugguagauggcguagucaaugguucauaacccuaaacgguaccucaggugccgaacuacgagguguccucaaaguacaaguccacuacuaugaagaagguaacgugcaacuggucagcaccaaggaaacaaaagacacagucagcauuaccacugaagcacaaacuguuaaagauauuguucaggcaauagaggcugcggaaaaucuuuaucaaacugcuauuucggagaauuaccauacaaugucugauacgacuuuuaaagcucuuagaagauuauugccagucacacguacaaaaaucgacuggaacaaaauuguuuccuacagcaucggaaaggaacugaaaacucaauga

SEQ ID NO: 6769 - RNA, 3825 nt, Ceutorhynchus assimilis
augaaacuacgaauaauuuuacuagugacaguuuuuugugguguaaguuuaggacaagauuuaaaugaaucaaacccagacguugaagccguuccaggcauuauucuagacuugggagaaucuucuggacaaccaguacccgcugaggauguaccacaaacuccaacgcaaccuaccaauaacgauacagauaauguagcaguagaugauguagagcagaugccugguaacacuaguuugcguacaggucaaaaaauauuacguuuuggaaaauacguuacuuauuaugaagcugauuacgauccaaugacuucccauguugcaccaccagacacagaucaaaggggugguucugguacucccuacacccuaacagaaaccagauugcaaacaauuaggaaauuauucauguaucccuucuaugaccaaggagguaaugcagacaaugagggcgauuaccaaaaagaaauccagucaucgucgccucaaguccacaaaaacuucaacuuccaguugccguuuuucggcuucagauucaacuacacuagagugucuuugaauggguauuuggaauucagugacccgccacccaacuacaacuaucccuugacuuuuccuguaagggauuggcccaagaaaaacgauccuucguuuauuggaauauuuuucagcaaauguagaauaggcaaucuucgugaugaagacgaagacaaacgcuuaccaggaguauauuuccgcauggaaagagauuugcucaccagaaccgaucaaaugggaguggaaauucgugaaagauuaaagugggacauucgagaagggguuauuggcucggaagccuucgauccuaaacacgcugucauuguuaccuggaaaaauguuuccuuuaauggaggcuuuggaaaugcuauuuacaaaaccaacacuuuucaaaugguccuugcaacagaugaagucuacaccuaugcaauuuuuaacuauuugaauuuggauuggacgagucauacugaagcuggaggggauaccacuagaggcgaaggaggugugccagcuuauauuggguuuaaugcagguaaugguaccagauccugggaauacucucccuacagucaagcaucaguccuaagagauuugagcggcagaggcuacgcuaacggauucccaggcagacacuuauucagaaucgacgaaaacauccugguuggcacgugcaauaaagacaucgauggcgcaaauuuaccccuaauguuugcuccagaaucuggcaacauguugggugguaccguugucaacauuacuggcccauguuucaacccaaccgaucaaaucuuaugcaaauuugacguagccaauguaguuuacgguaccguagugagcagaaacagggcaauuugcguccaaccuuuacuaaugguagaaggauacguaagauuugaaaucgccauuggaccagguacuuacaaguggaaaggccgguacuauguggaaacuccugcaagugcggcucagaaaaucuacuucaaagacaugaaaguacacgaaaaauccccuagugaaauaaaaauaacuugggaaaaauauaauuugacuacaaacgaaaacgcaaacauuagaauuucgcuuuggggcuaccgcgaaaccuccauaagacccucacuauuauacauuacagauauagcugaaaacguccaaaacacuggagaguacacgauaguaccuucacaguaccgcaacagagaaaacaccuuuuuaaccgacauaaaauucggcuucauucaaaucaauuuaaccgaaucaauaccuauucaguacgauuauagcgguaccacucaaacaacuacccaagcuacaaccauuaacccuguaguauggagcaggccuauaccuuuaggcugguacuucggcuggcaaugggaacgcauguacgguaccaacuggcccaaaaccuuaugcgacgauuggcuaaggaccgacagauaccuaaaaaacuuugcccacgagcuaccgcaauguccuugcacccuggaacaagcccucaucgacaaaggcaaauacaugcccgauuuugauugcgacaaagacucaaaccccacuugcuacuacaacaaccaagcaguacauugugugagaacugguucuccuacacuagaagguuccgagcaacaguguugcuacgacaaaaaccacuaccuaauguugucuuaugaccaacaauggggcuccagcccgaaacguugccacaauuuaggccuaaugccguaccaggaagcaacaaaaguacccacuuugucucaaugguucaacgauaugguaccaaaauauuugugcuguuuguggcaagaugaacaagcaguuggaugugaaacuguacguuuugaacgcaggcccagucaggauuguguagcuuaucaagcuccagggguugcaggaguuuauggagacccacacauaguuacauuugaugauuuagaauacacauucaacgguaaaggggaguuuguuuugguuaaaucaaaggccaagcugaauaauauugaagugcaaggcagguuugagcaaauggauccuaauuuguauggggaaguaagggcgacucaauugaguucgguuguugcacgaggcaauucgucuacuauuguugaaguuaggagaaggcccgaauaugcccgauggcguuacaggcuggauguuauugccgaugguaaaagagucuacuuugauaggccuuccuugaaguuccaacauuucccuggaguaacuguuuauacuccuacuuauauucuuaaucagucugaggugauuaugauguucgauaauggaguuggaguggaaguuuuggacaaucaaggauacaugacugcaaggguuuauuugccuuggacuuuuauuaauaagacagcuggguuguugggcaauuggaguuuuaauaaggaagaugacuuuacuuugccugauggaaguaaagucaguguugcuacaaauguuaaugacauggaaaggguuuauacgacguuugggucuuuguggaugguugaugauguucuggauucgaauaaaggucgcgcaauguuccuuagggaaaacggccaaucaucggccaacuucaacaacaaauccuucguuccaauuuucgcgaugacacccgaggaaauuauaccggccaaccggucgucacaaaucgaccggacuuaccaaauuuguacuuccaaaauguacgagugcuacuacgacuacgccaugacacugaacagagauuuggcccauuacacucagaauuauaaagcuacaauauaucaguauaaggaacuuaguaggacaaagguuauuucguguggugucuugccaacaccaagauuuggccgcaagaguaccuuccuguuuauaccagguaccaaagugacguuugagugcgaucaagauuucguccuaguaggagaugcuagaagaacuugccaggcaaacggacaaugggauguuccagaauauggauacacuuauuguuuacgucaacaagaguacucucaaaggcaacuagccauggccuccggugugguauucuuaauaauaauuccucuacuucuauuauucuucuauuuggccuacauguaccugagaaagaagcaacaggaaaaggaagaagaagagaugcuggauagcgccuacgaagcacaaaaaaggagagcucaagaagcggcugccaaaaaacugaccgaagcuaacgaguacgacgacgacgaugacgucacuagcaauuuaaccaguacagcuucgccgguaccucauaccgcaccagcuucaccuacagccaaagaaucgacgauuuauuaa

SEQ ID NO: 6770 - RNA, 336 nt, Ceutorhynchus assimilis
augcguuacguggcugcuuaccuuuuguccgucuugggcggaaaagccucccccagugcggcugacauugaaaaaauccuugggucaguagguaucgaagcugaagcagaaaaacugaaaaaggucaucucugagcucaauggcaaauccaucgaggaaguuauuucucagggccgagaaaaguugagcuccaugcccacugguggcgcugcugcacccgccgccgccgcuggugcugcuccagcagccgaagagaagaaagaguccaaaaaagaagaaaagaaagaagaauccgaaucagaggaugaugacaugggcuuugcccuauuugauuaa

SEQ ID NO: 6771 - RNA, 2763 nt, Ceutorhynchus assimilis
augacuacuaugacugcauugccauuggguacgauuggugaucauuuuggucucaaaugggacccaaaaaaucuagaaauaaggacaaugucaguggaaaaaacacuggagcccuugguacuucaaguuaccacucucguuaacacaaacgggccuuccaagaagaaaaagggcaaaucuaaacgugccaaugcuuuaguacagacuguugaaaaggccacugaaaauuuuauagaaaaaggcgaacaaaucgcuuaugaaaauccugauaucacugaggagauguuggcugccguugaugaaguuagaaaaacaggaacucaaaugaguagagaugcuagagauuucucagaagacccauguucaucgcucaaacguagcaauaugguaagagcggccagaaaucuucucucagcaguuacgaggcuucucauccuggcagacaugguggauguacaccuauugcucaaaucacuccacauuguggaaaacgacuuggaaaaacucaaaauggcuucuagcaaugacgaauuguuagacaacauagaaacauuuagacacaaugcuaacgaacugaugaaucaggcagcuaaacggcagcaagaauuaaaagauccacagcucagagaugauuuggcugcugccagggcagugcucaagaaacauucaaccauguugcucacagcuucaaaaguguauguacgucauccagaacuugcugcagcuaaagcaaacagggauuauguucugaaacagguuugugaagcuguuaauacuaucaaugauguugcucaagguagggcaccuccugcugcggguccauaugauggaccuggugaauuagcagcagcucuugaugauuuugaugaacauauugucaucgaaccuuuggcuuauaaugagguucauacuaggccaucccucgaagaacgccuggaaagcauaaucagcggggcugcgcuaauggcggauucuagcugcacaagagaugacaggcgcgaacgcauuguugcugaaugcaaugcuguacgucaagcacuacaagaccuguugucagaauacaugucaaauauggguaauaaggacaagacagaaaguuuaggaaaggcaauugauaacaugaaggguaaaacuaaggauuugaggaggcagcuaagaaaggcaguuguugaucauauuucugacagcuucauggaaacaggcaucccucuucuuauuuugaucaaagcagcacaaaacggcgacgagaagcagguugaagacuaugcugguguauuuacugagcauucuaacaaacucguagaaguggcuaauuugguguguagcaugucaagucaugaagacggcgucaaaauggugcguuacgccgcugcucaaauugacucacuaugcccagaagucauaaaugcugccaggauuuuggcagcuaggccucguagcaaaguugcucaagagaauauggacgcguuuagacuuacuugggaaaaucaggugcggauuuuaacagaugcuauugaugacauaacaaccguggacgauuucuuggccguauccgaaaaucacaucuuagaagaugugaauaaauguguguuagcucuccaggaaaaugaagcugauacucuggaaagaacugcugcugccauuagaggucgaacuggacggauaggaguuguuguugcagccgagauggauaauuacgaaccuuguaucuauaccaaaaggguuuuagaagcuguaaaggugcucaaugaucaagugaugccaaaguuuacacaacgcguacaaguugccguucaagcaauaauaaauggacaacagggucaacccucuaaagaauuggacgaaaaugaauuuauugaugcuucaagauuggucuaugauggcgucagagaaauccgcagggcaguucuuaugaacagggcugaugaagauuuggauccagaagauguugaacuugaugaaaauuauacuuuggagacuaagaguaaaucgagugcccauacaggugaacaugguguugaugaauauccugauauaagugguaucacaacagcccgugaagcuaugggcaaaaugccagaagaagaccguaagaagauccuucagcaaguagaauacuucagaagugagaaacucaaguuugacagagaaguggcuaagugggaugacacugguaaugauaucaucguuuuggccaaacacaugugcguuaucaugauggaaaugacugauuuuacucggggcagaggaccauugaagacuaccauggauguaauuaaugcggcaaagaaaauaucagaagccggcacaaaacuugauaagcuaaccagacaaauugcggagcaaugcccagaaaguucuaccaagaaagauuugauagcauaucuucaaagaaucgcuuuguauugccaucaaaugaauauuaccucuaagguaaaagcugaugugcaaaacaucaguggggaguuaauuguaucuggucuggauagcgcuacaucucuaauucaggcugcuaaaaauuugaugaaugcaguaguauugacuguuaaggcauccuauguugcaucaacaaaauauccaagacagggaacuguugcgucuccaauugugguauggaagaugaaagcaccugaaaaaaagccauuggugagacccgaaaaaccagaagaaguucgcgcaaaaguuagaaaaggaucacagaaaaaacuccaaaauccaauacaugcucuauccgaauuccagagcccaaccgaaucaguguaa

SEQ ID NO: 6772 - RNA, 1266 nt, Ceutorhynchus assimilis
augucuuuuaacuucggaacuccgccuaauacaauggcaccgccuaaugcaacugcaccgccuaaagccgcuacaggauucacuuuacccucuucgaccccaguuucagcugccucaggugcuccaggcgguggguucgcguucaacuuaagccaaacacccggugcaggugacaacaaacaaacacccucacuauuuucccaauuuaaaccugcuacaccagcaacaccaacuggcuugaauuucaauuuaggacaagcaccuaaaacagcugcacccacuuuaucauuuggaacacccacugcuccugcaacaacuggcgcuacagcaggauuuggugguuuuggauugggaacugcagguaagcguccagcuccugcuucuguaacaucuacagcugcaaccagugugccaggacuucaguucagcuucaguucaccagcuucugcagcugcaacaacugccacaacuacuuucacuccuauuguugguuccacugcaacuagcacuauaaauguuccagcaacagcuccaacuuccagugcuccaaagcugggauuagguguugcaccuacuacuacuacuccggcaaccacaggauuuucuuuggguuuagguaguacagcugccacuacaacaacuguuacuucagcucagucgacaacuucuacagcagccacuacaaccacuggaucacugacuuuugcccaauuagaagaugcaaucaacaaauggacuauugauuuggaagaacaaggaaaauucuuuaucaaucaagcuaagcagcuuaacgcuugggacacuuuauugauuucaaauggugacaaaauucugaauuugaacaccaacauuguaaaaguacagcaacaacaaucccaacuagaucaggaauuggauuuuauuagugcucaacaaaaagaacuggaagaacuccuggugccacuagaaacagaauuaauggauguuccugcgacugauaucaacaggaaccaaauguaucaguuuucagaaauaauugauucacagcuuaaacaaauuucugaugaucuaaaagaaaucguugaaauaauuaaugguucaaauaaagaccaggacacuucaaauccaauucagcaaguaaguaaaauucugaauucucauaugcacuccuuacaauggaucgagaaaaauaccucagaaauuaguaagcaaauugaagaacuuuccaagauggaugaaaacacuagaaaaaacaucaguuuuaaugguucuaauuuguaucaguga

SEQ ID NO: 6773 - RNA, 582 nt, Ceutorhynchus assimilis
auguucaucugggauugguuuacuggaguuuuaggauacuuagguuuauggaagaaaucuggcaagcuccucuuccugggucuggauaaugccggaaagacaacacuguugcauaugcucaaggaugaucggcuagcucagcaucuuccaacgcuacauccuacaucugaagaacuuucgauuggcaacaugagauuuacuacuuuugauuugggaggccacacacaagccagaagaguauggaaagauuacuucccagcaguagauucaauaguguucuugguagacgccuacgauagaucuagauuuaaagaaaguaaacaagaauuggacucguuacucacagacgaaaguuuggcaaauuguccuguuuugauuuugggaaauaaaaucgacuugcccggcgcugcuuccgaagacgaacuuaggaauuacuuugccuuguaucaacaaacaacaggaaaggguaaagugccaagagcagaucuuccaggacgcccccuggaacucuuuaugugcuccauuaaaaaaagacaagguuacggugaagguuuucguugguuggcacaguauauugacuga

SEQ ID NO: 6774 - RNA, 558 nt, Ceutorhynchus assimilis
auggacggaauugauuuguuggaaaaacgcauugaagcccucgaagagcaaauauugcccaaggaaaccucguuggaaaacaagucccaggccaucaccgauuuacuguugcagucucaaacgaugaucacuuccgcucugagcugucgagaaucaaucacuucuauccuaggccacaugacuacaaucaacaacuauuuggacccuugcaauugggaaaacgaucuggaaguugaagcuaagaggcauuacuuauuggaauuguauccagagcucagaaacacuguccagcugguacguucuguccaaaaacucaucccauacaccaacucagauaagaucaugaaagugacugagcugucaggcaaacuggagcagcugacugaaaccaaucugguuguauacucagaaagucgagacgugacucagaaggugcuaaaaucauugcaacaauacaaugacaucaccaccuccauuaaagucuuguuugcucagcuggaucgagcuguaguuguuuuggaagaggcucuacuacccaaauuugaaacugaagaguag

SEQ ID NO: 6775 - RNA, 1752 nt, Ceutorhynchus assimilis
auguccacgucggaaguauauagcgauuuaacuuuauauacaacagcagaaaaacuauaucuagaacccaaaacaagugacgaguugcuuauaaucgaccgagcauccgaaguuaucagcuuacaaaggaacgcgggccaaauuccuccauccaauacccgaauagacuuuugcgguuuguugggaucaaucgaauuacuugcuggccgguauuugguuaucauaacucagagagauuuaguggguuauauugcuggucauccuguauggaaacuagucaaagcagaacuuauuccuuauucaaaaagucuauuacauuugaccaaugaaaaacaagcagacaauaaugucuaccuuaguaugguggaaaauguuuuagccacuccaagcuuuuauuuuaguuauagcuacgauauaacacauucaauucaaagauugcacgauaucagccccgaauucuggcaacagucauugcuagaacggucugaugcgagauuugucuggaauaagcaccuuuugcaacaauucagggagccgagcuuaaaacgguucgcuuuaccguuaaugcaugguuuugccuccauaaaucaguguguaauuaauggacauaauuuuguuugggcucuuauaucacggagaagugugaacagggcaggcacaagaugguuccguagaggcauugacaaaucggguaacguagccaacuuuguagaaaccgaacaaauuguagaaucuggagaaggagacagagcuucuuuuguucaaauuagagggucaauuccuuuauuuugguuccaaaaacccgaccucagguauaaacccagcauugauauugaccauagugucgauccucaggagcaucaaaaugcuugucugaggcauauugaaucgauggccggaguuuauggcaggcaaguuaugguugauuuggucgaucaaguuggaucagaagguagauuagaaaaagccuucaaagacaccaucaauuauuuagcucauccguccgugagauaugaaccauucgauuuucacgccgaauguagaaaaaugaaauggcaucgauuaucaauuuuaauagacagagugucuuuggaucaggacgaaaugggguacuuuuugauuuugaaagaugguacucuguccucauuacaagaaggugucuuuagaacaaacuguauagauugccuggaucguaccaauguaguccaaaguauguuagcgcacaggaauuuagaaauugugcuuaggaaauucgauauuuuaagcccagaucaaaagcuagaaaugcaacuuucuuucgagucuuugaacaaaaauguuugggcugaucaugccgaccucaucaguacucaauauucagguacuggagcuuugaaaacggauuuuacuagaacgggcaaacgaacaaaagcgggacuuauucaggauggaaucaauucguugaugcguuauuauaagaauaacuuuaacgaugguuuccgacaagacucuaucgauuuguuuuugggcaauggaaaagucguuucaccaauugcaccaccaccaggauggagauauauuacuuuuccuucaguuuuacuuauagcuacggcgauguuuguagcuucagcuauauugcccgcagaauauuccacugaaugcuugauguauuugauguuuuggggaggaaugauggcagcuacagcuuauuauauauuucaauacgguccagaguuuguggauaagccaaaacuaacuaauaauaauucauag

SEQ ID NO: 6776 - RNA, 1677 nt, Ceutorhynchus assimilis
augacgauacaaaacggagcuccugccgaaaaacgacaggacagaccaucaaaaccuccggaaaaaaagcaagaacuaauaguucguguaaaguacagcaacaccuuaccagacuuaccauuugaucugaaauuuaucuccuaccccuuugagccuucaagauuuauccaauacaauccaaccucuuuggaaagaaacuauagauacgauguccuuacagagcaugauuugggcguaaauauagaccuaauaaacaaggacacuuauccuacugaaccggguguuguuuuggacccagcugaugagaaacuucucgaggaagauauucuugcgccacaagauucaaaaagaucccggcaccaugcuaaagcagucuccuggcuuagaagaacugaguacaucuccacugaacaaaccagauuucagccacaaacaauggacaaaguggaagccaaaguugguuuuagcauuaaaaaaucucucaacaaugaaacacauuauauggauagaaaugcgcaaauugaggcuauugaaaaaaccuaugcagacuccaaaauaccuauugaaaagcacuauaguaaacccaacguuguaccaguugaaguguuuccaguuuauccugauuucaauuuguggaaauauccuugcgcucaaguuauauuugauucagauccugcuccgguugguaaagguguuccagcucagauugaagaaaugucucaagcaaugauucguggugugauggacgaaaguggugagcaauuuguugccuacuuccuucccauugaagaaacauugaaaaagcguagagaagauuuugcuaauggugucgcuuaccaagaagacgaggaguacgaguacaaaauggcacgugaauauaauuggaaugucaagagcaaggcaagcaaaggcuacgaagaaaauuacuucuuuguuauucgcccugaugguguuuauuauaaugaacuggaaacaaggguaagauugagcaaaaggcgucaaaaaguaggucaagccccuagcaacacuagauugguuguuaaacauagaguuaugaaugcuggcgaauuuaaaauacaaagauacagggaaaaacaauuggaaccuccacgugaagaugaugaagaagaauuugaaauggaugaaacucaggaagaugaaguggcagccaaugauagccaaggagaaucugaccaagaaaaagacaauguugacauugaagauaaaccucaagacagugacaaugaaagcaaaggcggcagaacaucuagacaaucgcgugccucuucacgcacuuccagaaaauccaaauccgcuuccagaucuaaaucgggcucaagguccucauccaaaucaagaucacgcucaguuucaagaucaaaauccaagucuccuucaagauccagaucagcuucugcaucaaaaagcagauccccgagcaagucaccuuccagaucucgaucagcuucgaaaucaccaucuagaucaaggucgcgguccaaguccgcaucuagaucaaggucgcggucuaaguccgcuucuagaucuagauccaggucaaagucugguagaucuagguccaggucaaagucggguagaucuagguccaggucaaagucggguaguucuaggucugguuccgguucaggaucaggaagugcuucagaaagugaguaa

SEQ ID NO: 6777 - RNA, 1170 nt, Ceutorhynchus assimilis
augccugucgaaaaccuggaagaucaaggccuggaaaagaaccccgacuuggaauuggccaauuacaaguuccugcucacuuugcccgaauuucgaaaugauaaggggguacaugcgaaaaucacugaagcuaucaagaaagaugauauggcuccuugguaugaacucguuugccaagacgccggcuggaaaaaagacgaaaaacuccugaaaaccuucaaaacgaaaaacgaggaacaaauaaagaagcuggacgaagcuauugaagaugcggaaaagaauuugggcgaaauggaagugagagaggccuacuugagaaaagccgaauacuacaguagaauaggugacaaagaaaaugccaucagcaccuucaggcaaaccuaugacaaaacuguaucuuuggggcacaggcuagacaucauuuuccacuugauaagaaucggguuguuuuucauggaccaugaucuuaucacgaggaauauugaaaaagcuaaaacccugauugaggaaggaggcgauugggacagacgcaaucgccucaaaguuuaucaaggggcuuacuguauggcuguaagagacuuuaaaacugcugcuaacuuguuuuuggacacuguuagcacuuuuacuucguaugaguugauggauuauaaggcuuuuguacguuauacgguuuauacuucuauuauaaguuugccaaggaaucaauugagggauaagguuguaaaagguucagaaauccuugaaguauuacacucugagccuuucgucaaagacuaccuguuuuccuuguacaauugccaguacgccgauuuuuucaaaaacuuagccaaaguagaagagauauugagaaaggacuacuuccucaacccccacuacagauacuacauccgggaaaugaaaauaucagcuuacacucaacuguuggagucuuacaggagucucacuuugcaguacauggcugaagcuuucggcguuaccaugcaauuuauugacgaggagcuuucauuuuucauugccacaggccgagugcacugcaaaaucgacagggugggcggaauaguggaaaccaacaggccagauuugaaaaacgcccaauucaaugcuguggugaaacaaggcgacuuuuuacugcaacgcguccagaaacuauccagaguuauuaauauuuaa

SEQ ID NO: 6778 - RNA, 15705 nt, Ceutorhynchus assimilis
auggaugaauuaccuccgguucuagauccagacgagcuuauggaucuagaagaaccggaaacuuaugaaauugaagacgaugacgaagaaauuguugaagacccaucaucaucucccuuucaacaguuuucuucuggaccggcaucuaaugcgacaucugcagccucaucaccacacaccaaugaugauuuuccaccaccuuucaauuuuaacgggaaaccuguuacuauuaaaaggggccguggacguccuaggagagaaggagguaaaccgacucccagacgauccgguggcguugguguucccagaguuagaagagcaaaaucugcuggauuuucccguuguagaggauccaggaguguuagacaaccagacagaauggauuuugauuuuucuuauaucagcccuacuucuauugaugacaugggucucacugacaucgaugguuuuuucuucccagaaagggaaagacccaguccaguuuuugaagaacuaccuuaugcaccagaggucuggccuggaaaagucugugcuuuuuguaauuugggugaacgcagucagcuaggacaaggugaaauaaugagauuaaauugcccagaugguuuuacgccucaaagaucagucggugaaucuaacacuccagcuguucaauuaccagauagggauuuuggugauaaaaguccgcgugguccuguuacaugcaggaggaauaaaaauuuuaauagaagucgaaguuuuguguccaauaaugaacauauagaugagcuuaccauaauuggacaugcugaagaaccaagugugaacauuuuguaugaaauaaguggacaauuuuauguucauagaaacugugccuuauggucaaaugggguuacccgcacagaacaucaagccuuagaaaauguuggaccaguuguacuaaaaaguucaucucagaaauguucauuuuguaaucauuucggugcaagucucacaugcaggucgaccgguuguacaaaaguuuaucauuucccaugcgccacugccucaggugccuuccaggauaucacuaguuugcaaguuuuuugcaccaaucaccuucacgaagcugccuuguguucggaauccgccauuugcuauacguguaaaagcgugggagauauuucaaacuuaauguauugcucaagcuguggcacgcauuaucauggaaguuguguggguuuagcucaguuaccuggcguaagggcugguuggcaauguagaaaaugucgcaauugccaaguuugucgaaugaugggggacgaaacuaaauugaugaguugugagcagugcgacaagguuuaucacgccagcugucaacgcccauuaguuacguccauuccaaaauaugguuggaaauguagauguuguagaguauguggcgacugugguucccgaacaccaggcgcuggucuaucuucuagauggcauuuacacuauacaguuugcgauucgugcuaucaacaaagaaauaaagguuguuguugcccaauuugucaaagggcuuauagaucacaugcucauagggaaauggugcaauguggaaccugccgaaaguuuguucaugggacaugugauccagaagcagauuugguaacauaucaacagaaaaaggaaauaaauccugauuaugaguaucauugcguuauuuguaaaaauucauugcagcaacucuccagccgcccugucacuagcaaaagaucaagucuagaugacuuuggagauuuguccgcuucccaagaaucuuuauaugaugacauaucagaauuugauaugccuucugaagaaucuuucagagggacaggguugggaaaaggcaaaccauaugcaaguaaaauugcgaagaagaaauugaguuauucaacuggaaugccugggagaccaaaggguaguuuuggcaaaggcaacccuggcaaacaaggauucaugaaacgucagcgcuuagucgaauuuggccguaaaagaggcgccaaagcuaaaauacgggguguguuuggaguaccgggaguuggauuaucucgucccguaucugaugguaaaggagacgaagaaccaggaguagaaaaccgacuaguuuuguguucugccaaagauaaauuuguucugacacaagacauuugugugauguguggagccuugggcaccgaccaggaagguugccuuauuucuugcguucaauguggacaauguuaucauccuaacugcgugaacguuaaaguuacuaaaguuauucuuaccaaaggcuggagauguuuggauuguacaguuugcgaaggcugcggucaacgcaaugacgagccuagacuaauucuuugugacgauugugauguaucuuaucauacuuauuguauggauccuccuuuggauuacguaccacauggaaauuggaaaugcaaguggugugcauguugucgaagcuguggcuccacagauccaggauuuaauagcacauggaugaauggauguacagaauguggaccaugugccucccauucagcuuguccuagcuguaaugagucauaugcggagggagaucuuauuauucaaugugcucaaugugaacggugguuacaugguauaugugaucucauuaaaacagaacaggaugcagaaaaaugcgcugaagauggcuacacuugccugcuaugccgcccuagagacgucccaccuccacacuuaauuccuuccucgauagcccccaaaccaccgacgccuacuaaaagcccugagguccgcucgcaacccaacaucuucgucgaugguguuugucucagcgaauggggccauagucuaauuaaaucccuuucccaggaguaucacgguacucgcaagaaacgcaagaaacuuccaccaguuguacaugauaaagaagcugguauaauggcaacuauugagucaguuguugcuggaggaaguggaggcgaaaauaguuuugaagauaccaaaauagaauuaguggauaugaaagacgaaccgcaagagcuuuauaaagaaggcaugauuuggacuaaagaagaugguucuccaccugaaggauuuacuauuuuuaccauggaaagugguauauguguuuuaaggagaaaacggcaaagaaaucugcaaaaauuggguauaggaggcuuuuugguucggaugagaggcuucaagagucaggaaaaugaugagauugauacuuuaccuggacaaaguacacuuaauuuugauuuaccaauaccaaugacgucaacacucgaaggcgauaaaccaaaaaagaaacccauaagacgcaagcaaaaaucuaaauuggcugaaacauuuccugcauaucuucaggaagcuuucuuuggcaaagaucuuauggauguaacugaguuuaaaaaagaaauggagggcgguguuagcagugacgaagauaaacuuuuugaaaauaagcagcaggcgaucaaguuaacagcagaggaacuacuggcaguugaaagugcuagacaagaaaagaccaccucugaggggcgcucucaaccgagagacggcuuuucagauacuuuaaaaauagauaaaccaauuuugauuaaagaggaagaggacgacacugcugaagacuugaaagauguacuugcuuugccuggcgacuuacuggauacugauuugguuaauagcauuauaaaugaagaugaugaauugacuaaaaacacagaauuggaugcuuuggcagaugaugacgcagaacuuccucagacuuuaggaagcucagaaaauucuaaagaugccaaagacgaauuaagugauauuuuaggaucacacuuuucacuagaaucuauaccuaauauaaauaguaaagauguugaggauauauuuaagggcguucuuaccgaugaaucgcaagaaucgcagcuuucccaagaagccacaaauauguauccuucaaugccauccacgccgacuccaauuaguccaauguuuccaaguaauucgucucaacuaccgacagcugguauaauaccucaaaugcauuugccuucagcuccaguuagaccgacugcguuaccuggaguucagcauguuagcuucccuccgucgccuuaucauucugaauauagcaauaguccccaguuuaguccggcguuuucugaaccuccaaguccuuggguaaacauaaacgacaacacagaaauggacacugccagcguugcaggugugccauccacccauaaucaacguucuucggaaaaaaugaaggcagaugaaggucucgguaauggggccacuauaucggcaguucucuaugccaauaggaaucauccagaauggaaagcugaguauccuguguggucugacagauacaagcauauuaucaaaaaguggagaacuuugagucaagacgagaaggcuccauaucuucaacaagcucgcgacaaucgaagccagcuucgaaugaagaaacaacaacagucacagaccagcaaggaaaccuccacaacgaguccugucgcucccacaaagccacccccuaccguaguaccggcagcugcuuugguuaccaaucugccuucaccgggguuaccaccaccuucgcucguuacacaggcgcaggcgcaacagaguccuaccgcgauaacuacugaggaccaagaaaaauuagcccaacaacagagaacagcccgagaggcugagcaagaaagacaauggaaacauuuacaagccaugagacagcaacaagcucagcaacaagcgcauguuauucaagaacaaagaguucaagcaauugcaagaguccaacggacaaugucagacccuaauccucaauuuauccccaccaaccaaacgaguccccuacaaguuaccacaacaucgcaagaaggcaguccuguggcuccuccaucacccagacaauuuaucgguauaaaaucgccaccauuugcccauccuucaccuccuuccacuaauauucguacuccuaccucuucacagucuccgguucacgaguuccagcaaccaaaucagcaaacuccgaauccugaggaauccuuuauagaacccacuaguccgcaagucaauuucucuaaaguaccaaccggaaaugaggcguuuggucaaccgccuccaccgaggaguccauuuguugcugcaagaccgcccaugcaggcuagaccggaucaaccagaaaucgcacgucaguugcgggaguugcuccagaggcagcagcagcaacaacaauugaaaaacuucgauuuggugcaagcaaaaucaacucaaagaaucuggaauccuaaugauccgccugcaacugaaccugugaaugcgggugcgacugcagaagaaauaacuuucaggcaaccacuaccgccuggauccguaagacccagaaucccauuacaacuaggacccaggccugguccaaaucuccguaugccgcaauuagaaggcaggcuucaagggcucgauccuagauuaagacucauucuacaccaaucaagggcugcucugccuggccaacaaguaccggcaggcgguauacgcuucacccaaggagcaaaccgaccggcaacaaucgaacaauaugaacaauuguugcaccgacaagcucagcuacaagcuagaaaucaagcuuuagagcaacaaggugucggugugagguugccuuuaggacaaaguggugguggggugauucagaaacaaccuuccucgauaacucaagcaaugccuguaguucaaccagcucaacaagcggcugcaacaaaugaccaagaaauaccugauaauguaacugcagaacuagaaaaauuggaacaagaaacuggcacaauggccgagcugcaaggugucagcgaaauauugggagguuugggagaugaugacgacgaacuccuagcugaaaugggagcagauuucaauauuuuggaguaugcggauccagaauuagaagcauuagcgggagagaagacaaacauucuggauuuggauuuggaagaugacaauaugaagcaggaaaagaagagggaagcuaugaugcaacgacaaaauaaugucucuucugcccaaacagcaacgucucaagcgacuaaaacuguaguugcaaguaauucacagaaagaacaaaagcuagaaaaacgaccaaccuccacugcugcagaagagccgcauaaaucagaugcaucugcuuuaccucaaccuaauaauaauccuccacugccucuucaaaaacaucaacaaguuccucaaacacaucaaguuucucaaaaacaucaagugucucaaaaacaucaaguuucucagaaacaucaaccucauuccgauaauaauuuacguccucaaacgccagcauuggcagaucagucucaaaaucaaauaacucaaaauuuaucacaacagcguguuguacaaaauauauccucaucgcaaccccaacuagcccaggcuuuggcuaauaauucaaauccacaacaacagcagcaacaacagcugccucagccagagccucccguguuacagcaacaauuacaacaacaguuacaacaacaaccaccacaauuacaacaacaacaaccuucuccuucccaacaucaacccaauauugcuuuaacagcccagcaacuccaucaacagaugcugcagcagguaggaugcaaaauguccaaauauguacagcaagcugcugcuaugggaaaaccgaugccaccgggauccaaacuacaaaccccugaagguauugucggcauuguuuuggcuaauaauaauguccaauugcaaauaccuccgaauuuccaacaaagacugcugcaaacauuacaaaaucaaaaacuccaaaugcgaaucgggcgaacuguuccccguccccaacagccgaauauaaaucaacccccucagccuguuccuggacaaauagcaagacccagaauggcuuuaccaacgccaccuccaccgccuccguacccugguccaccgccacccuauccagggaaucucauggcucagcaacaggcaaugccucagcaggaacagccucuguugcuggaagaucuauuggaacaagaaaagagagaacaggagaaacaaaaccacaaucauccucuaccuucagauaucaacacaagaaguaacgauucagaaucggcuuuguguguuagcgaucaugauuuugaaagacucaaagcugauguauucaguagugggcauucugauaccucaucuucagacuccacaguuggcauggugcaacaacaauggcaaccuaaucgucuacagaugcccagugcgccaacucaacacacuacagaaguuacgaccaaaauucaaauguucaaugcaaauuuaaugccugcuccgccacuaccaucagaaaauaucguuacggaacaagacaaacaggcucaacuuuuauaugagcaguggcuuaauaaucaaaauaauguuuugacucagcaacuucgauacuaugaaacugaagugcuaaaauuacguaaaaguaaaaagucauuaaauagcaagcaaagacagcuaaggaaaucuggcaaucagcuaacugaaauugauucaaaugagcuacaaaggauuucugccgagcaagcuauuuuacaaaaacaucuagaguccagcagaaagcagagucgucaacauggaaugcucauacaggaauaccggaauaaacaacaacugcuccagaagccccucaugggcgggccgcagacgcaacuagccuccccucuaggaccuccaggaucuucuccaauacaucacgcagcugccagucacucacccauguugucaccgcaacagucgccuuugccucagcagucuccauugacgcagcauaauucaccuaugaauaguccggguccuaugaugguucauucuccagggccuggaucaguggcugcuuuguuacagaguccaggcgggagugugucuccaauacagacuaggauugggacaccauugucucaagaaggaagcccagguccaauccaaucgccuucccaaguuugucugccaccaccgaugccucgaaugacaucuccccaacaucgccgagugguaaccagcccuguuggauauacaggagauaugcgcaguggagugacacaaaugagauuuaugagacccaccguggaacauaauucucugcaacguaucagaggucaagcgccuggucaauugcagaauuuccccucuaaaguuggcacuccaucuccucucaauaguccaccucugaaucaaaugucacuggcucaucagcaaauauuacaaaagcaauugcaucagcaucaacaagcuuugcuucaucaacaacagcagcaacaacaacaacaacagcagcagcaacaacaacaacagcagcaacaacaacagcagcaucaacaacaacagcagcaccaacaacaacuacaacagcagcagcaccaacaacuacaacagcaacagcaccaacaaauacaaauuuccgaugguacucagcaacaagaagcaaauguuaugcauucuccccgcguugcccaauuaauacagcauagaaaucuuggacgaccgcagcagcaacaacaacagcaaacuuugacggcucaacaacaucagcuuuugaccaaacagcaucaacaaauagcucuucaauuacaagcaaggcugaaucaacaaucucagcagcaaucaccuacuccacaaucaccaaugccuccaaaaagucccaugcacaaccagaauaugucuccucuaucgaugcccaccucgcccaugccuccaaaaagcccuauguugucuuucaaucaacagcaaagcacuccuaauucuccagcagcucauagaaauucuuacucucaaaauccuacuaugaaucaaccuccgaguagucccaugaugcaucaauaucaucaaccuacuucuccuaugauacaaucuccacacgcaauacgucgaccuccaagcaguccugcuaugccugagaggcccuugagcguagaaaauccugguacgcccagaacuccuuacaguuuagauaugcaucuucaagauaauaugcacacagggggaggaaauccuaauaauccaaauaauccaauuccauugccuccugauggguuuugcuacucuaagcuaggcuuaagaggcgguauguggagcggauuuggaagaggagaaaaacgagucccaacaccuccuacaagcucaucuacuagugaaacugaaaagcaauuaccaguugaaguaacuacuuugaacaaaccuaaaaaagaggcucauauuaauaaaguuuccauucucaaaaagaggacaccacugccaaaaaguaguccuaaaucuauuauaaccagcaaaaucgcugauuuuacagaauaugaugaaacuucuucuacaucuccugcuucuacaucuucuuuauuagcuggacguggaggggcaggacugaaaccccugucaaaacaagaugccacuggggauaaguuacaacuuccugaaaugguggauuaugaggaugacaauaguacaauacuuucuucagagauuucguuauguuccgcagcucagcaaaacgaugacgaaauugaaauaacugaaacucuuucacaaaaugacauuggugaagucuuaucaaguccaauggaagcugaucaaauuucggaugaguuuaugcuguuucaagaaaauauguugguugaucauuugaguggcauucaauauucagauaaagaagaaacugaggaggaguaugcaaauauugucauucgaaguccaacuacuagugaugaugaauuuauuaugcaaggccgaacaaagaaauauaauauauugaacauugcagaaacuucugguucuccagagcaagauaccacuauggagccauccacagagccagaagaugaggaaauuacucagccauuugacgaaucggaagugguuauuauugagcaaccuguaaaaucaccugaggaacaaauuucaacuaaagaagauuuugaagaacuuauugaugaagguucucgaaaagaaaaaaugaagcaagacacaaaaaguguaguugaaccuccacaauuuacugcugccagcguguauagguuuccuucuaagaccccuauuacuguaacuagaacucaaaacguuaugacaacagcaaaaguggcaccaaaaauaucauuaauuacaacggcgccaauuauucaaaauuucacugcucguucugaggguggaaaacugaaugcagaaacucaacaacuuauauuaacuccuacaacaaaaauaacuaccacaaaugcagguucaaagcuaacaagcauuauuuugacacauaauccuguuagaaguaauauuuugaaugugggacaaaaacuuguaacaucaucaccaggaauuacaauuguuagugccaguacuucucaaauagcuucgauuuugccuuccaaauuuaguguuccaauuaucagcgcaagugcagugaggcaacugccaaacguaaaaguuauugacaagcccagcucuucgcuaucuuugacgccacgcgauaguacuuugcccaauaaaauauuugaagaugaaucagucucuccagaaaaugcaaauuuugaugaugaaaagaaaaauuuauuugaugagaaguugaaggcagaauuuaccgcagcuaauggaagaaugccaauguuugggaaaaaugucauugcaacaaauaauaaaaaugaugagaauaacacuagucaacguaaaaaugacaaaucugaaauuaguaauauuguuacuaaagaaaaaguucaagucauagcuaguccaauaauagcgaaaucuguaucuccuguaauaauucaucaugcaccaccugaauugaaaaugacggcucaaguaauccaagaaacauccacucguaugcaaauaacugccacugaaacuguuaguacuuucaugggugaugguucagucgaagauaaaucaguaguuauuuccauaccuuccccuacgccaucucaagaacaaaugcuugauaauauugcuuugcaagccuuggaggagaauaggaaaagagaauuugauucuuucgauuauguauugaauaugauugaaaacaugcaacauucagaaacuccagagcagucagaugaacaaaauacugagaaaaaaucaacuaaaccagcaguaaaagaggaagcuaaugaaucuacugcaaauaaacaaacuaugccgcaguugucgccuuuaucacaaccagcugaucugaccacaaauauggcaaaugcgucucaacaguugaggaguuugcuuuccaauauacaaacuacaaguucuucucaugugcccaaaguugaaacucuuguaaaaaccgcaaauaaacaaaaaauaaucaauguuacuucuucaacuauuacuuccccuguuguugcuucaagaauaauucaacaagcaacaacuacaaguaaugucaguacuguuauaguuccuaauguagucaagcaaaaaguaacucuugcaccuacuaguaaagcuagaacaucgaguacagaaaguuuuuuaacuaaccgauuucuaggaagugaaccuaaauccacaacaucuacuccaucucagacaacugaaacuaucaauaaaucuccagaucucaauaaaaaagcuucacuaacguuaaccgcuaugcuucaaaaucaaccaucagcuacucccacaacaaaauccucaccugauacaauaacugcugccaguuuauuagcuacuccugugagccugucaagaacuaguuuuucaccggcuuuggcucuagcacaacccaaugccauuauagcuaguagccuagcuaauacuaguaccaguucuguaauuucgucugcuuucaaaacaaucacuucaacaaacuuauugcauacucaccuaacuaagucgagaacuaaaagucuugaugauauuaaagauuugaaaacugaugaucaaaagucugaagcugauauuauaacaagcauaaaacaggagcuuagugguuguagauauuuacccguaacuucgucaagucaaauaaauaaaugugaagacucgcagaauguccuauuaaagcaacuucuucagaauacugcuugugcaagcacucaaucgccgccaccaaguacuacauccacaauaacgacagcuccaacuacugaaguucagaaaguuagcccaccaacuuugucaucuuuacuuccuccaguaacuaaaaccgaaguucaaccuacuaguaccccucagucaagaccuccaaugcaaagagguuuaauacgagaaacuuccuuuguuucuagcccaauaauucaacauacuccaacuaguacaacugucgcagcuaccacuacaacucaacagcuacauauugauauuaaaaaaugugcuccuguaguuaggccuucuaguagagaugauuuacuaucuccacccacuccgagaucgugcgguagucaagagucuaguuuacaaacgcccccguuaauagucaaaaaagaaaguccagcuucuacuucuacaugucuuaguauugagggcaucaaaaaagaauuacuagaugaaucuucccaacacucggaaauaucugauuugggcaaagcugacauucaaauaaaagaagagucugagccaggggagauuagugauaaaauuauuguugauaaagaagaauuaaaaaagcaaaaaaggagaauguauaaucaaaagagacgucaaaaucaguuacugaacaaagaguugaauaauaaaccuaauaagagaccgaggaaaaauuccaaaauugaagaagauuacgauucuuauauagacaguguuuuaaaccagauaaggcauuugcauccuaugguugucucagaaccugcuauaguacgaaaucauggaauuuuaccaguuuuuggcucuggcgauuuauccaaauuagguacaaaaucuuucgaucccagauuuggugauuuaacugguacuuauggcaacgcaucgauucccggauauucagauuuuuauaauacaauuccuuauggcgaugaagaacccauuccugaaaaaccaccagcuucuacacagagaggauuuuaugaucaagaauuuccucuuauuaaauuugauacagaagaugauaagaaguuugauuuguuuuccagagaagauacaccagauucaauuguuaguuguucuucccccgaaugugaugcuuuugaugcuucugauagauauuuggguuugaaacuuauuagugacgaugaagaagaagaagaauuauccaaggguagacguucgccgaaaauaccaauaguuaaacccauugcuauuaaacuaaaagccgcuggcuuguucuugaaagagcccgcuacuacgaaaauugcuucggauaauaauaaagaaaauauucugaaagaaauggaucaggaaaaacugaaaccaaauccuucgccuucagguccaguaaaagauaaugaaaauauuaaaguuacgcugacguucacaucaucggcugcugaagauauugucggcgugcuaagagauuuggcgaauauuuuacaaauuccuccaccuaccucuuaucagauuguugauagaacuucuucaccgacuagucagaagcugggauuguaucggaccaagggaaaagauggaaaggaaggagcuccuaucgauauacagaguauccuuaauggggcagcaaaguuuuguaaacauugugacguaguuauucuaaacaacuuggugaaaaagaagccuucagauuugccauuuuugucaaaagauuccgaauuacuaagugaaggagaagaacuauauuuuugugguucuucuugcuacaugcaauuugcuuugaugaauagaucgccgucuauuccagaggacaaggcugcggcuaucauagaucaucuaucacaaaaagacugucaaaacuuaaagcaacauggacaacuucaagauccuuucgauucgaaaucagcucucguuaaccguuuguugacagaaaauaccggauucaaucaguacuuugguggggccuucaaacaaacuaugaaauuugggucguucaaaccaccugagcaugcaaaaagccauagaaaugcgucgguuaaauuuuggacuccuggaugcuugcagccuagucacaagcauaagaaaccuacugauaaggagaugacggaaaugcuguaucagauggggauuacgguuacaccuucaaaauugccugacgauaccaggaagugcauguuuugucaaguuauuggagaugguguagcugacgguccagcucgcuugcucaacaucgacguagacaaaugggugcaccucaauugcgcccucugguccgauggagucuacgaaacaguuaauggcgcccuuaugaauuuggaaaacgccaugcagcaaaguuuaaccucaacaugcauccauugcaguaagcugggagcuacaauacgauguuuuaaaaccagauguucgaguguauaccauuuaucuugugcuguaagagaaaacuguguuuucuauaaaaauaagacuguuuucuguauggcgcauguucccaaacaugaaaaagauaaugaguugacuaccuuaucagugggcaggagaguuuauauaaacagagaugaaaauagacaaguugcugcugugaugcauaauucagauacuaauaauuuauugaggguuggcaguuugauuuuucucaauauuggacaguuauuaccucaucaguugcaaaacuuccauacaccaaauuauauuuauccuauagguuauagaauaauccguuucuacuggagcaugagaaacgugaauaaaagaugucgcuacauuuguucuauuaacgacaauaugggacgucccgaauuucgaguguuaguucaagaacguuccgaagaagauaccgaauuuaaagacuuuacaccuaaagcagugugggcaccuauucucgaaaaaauugcuagcauacgaaaagaaaacaagugccuacaaauguucccuagauuuauuucgggugaagaucuuuuugguuuaacugaaccagcuauuguuaggguuuuggaaagucuaccuggaauugagacacuuuccgacuauaaguuuaaauauggaagaaauccgcugcuggaauuaccuuuagccauaaauccaacgggugcugcuagaagugaaccaagauuacgccaucaaacucauuggaaacguuuccauagaacuacaggaucuaguucgagaccuuuguuugcaccacuuccuuccaacgcaucagcgcccucuucuuuuggagaaaguguaugcccuuauagcaaacaauucguucauucaaagaguucacaauauaaaaagaugaaacaggaauggagaaacaauguuuauuuggcgaggucaaagauucaagggcuuggauuauaugcagcuaaggacauagaaaaacacacuaugguuauugaauauauuggagagguuaucagaagugaauuaucugaauguagagagaagcaguaugaagauaggaaucguggcauauacauguuuagacuugacgaugacaggguuguggacgcaacguuaagcggaggucuagcacgguacaucaaucacucgugcaacccuaacuguguagcagaaacuguugaaauugacagagauuugaaaauuaucauuuuugccaaaagacgaauucaaaggggagaagaauuggcguacgauuacaaguucgacauugaagacgaucaaaauaaaauauccugcauguguggagcaccaaacuguagaaaauggaugaauuaa

SEQ ID NO: 6779 - RNA, 4173 nt, Ceutorhynchus assimilis
auggaugaugacucugaagcgagaaaaccaaaaaggcaaaaaacaagcuacaaggcaaaagccuuugaaaaauuuaaacagcuuaaaagugguggucguaauaaauaugaaaucgaagaaguugauaaccuuuaugaagucguugaugagagagaauaugccaaaaaggugcuggacaggcaagacgaugauuggauaguugaugaugaugguagugguuauguggaagauggcagggacauuuuugacgaugauuuagaugcugaaucaaucaaucaagccaaauccaaaaauaaagguguuaaaaggaaaaaagcugucucugauaaugcaccuaaaggcaauuugaaauauaugcuuucaaauauuacuagcaaaaagaaagaggaaacacaaauagaagaugauaauaugcugucagaaauuuugggcgaaaucgaugccucuccaucuacaagcaaaaaggauucgaaaccuuuugucccuaaaagucagcuggcucaaaauuaccucaagaaauuuucaauugauaagaaaacgaaagcugaaaaacccccaauugauacugucauggaugaagagauuguugaaauaccuuuaaaaaauguagacucagaaaaggaugaauuauugucgaauucaaaacaagcaacuaagauaauuccacagaaacagaaagaagaagucucugaaucacaucaaaaugaagauuuucaugaugcagaagacgucuuugcugacgaucuugauuuaguccaaauggacgcuauugaaucaaaaaucacugaaucugagacugcugcggagcccaaaaacgauucauuugauuuagcugcuauguuuacgcagagcagcggcuucaaugaaucuuuggaagaagaggaaauuuguacaccuucuguaucugaugaugaggcuuucagauucuuuuggugggacgcauucgaagaugccgaaaaacaaaaaggcaaaguuuuucuauuugguaaaacuuauugcagaaaauccaaaucuuacuugaguuguuguguugcuguagaaaauuuaagcucgcagguuuucgugcuuccacguccauuuaugcuagaugauagcggaaagccaacagaaaaacccgugacuuaucaagagcuguauaaagaauuuacaucguuaguugccgacaagaugaauauucaaaauuauaaagccaggcugugucagaaaaaauacgccuucgauccaacuguucccgccgaguccgacuauauggaaguuagguuuccagcaaauggccccagaaucuuuccagaauccaucaaaggaugcccgaaaacauuuuccaaaauauucggcgccuuuuccagcacccuggaacgauuccuuuuggaggccaaacucaaaggcccuugcugguuggacaucaaaaauccuauauucaauaaucauccgaugaccuggugcaaaauugaagucaaaugugcuuccauaagagaugugguuaaaguugcagaaaauuuaccaccaccuccauugacuguggcuacaauuaacuuuaggcaucauauaaauuuagguacaaaucagcaagaaauuuugauggucucuugugugacucagacgaguuaugcuguugauaagaaagcuccuaggcagguguuugaucaacauuuuuguguguuuacugguccuucaaagcaaccucuucccuuaaauauccacgcacagcuacaaaacuacaaaggaacucguguacaaaaaauggacuccgaaaaggcacuuuuaaacuauuucaucauccaauuugccaaaaucgauccagauuuaauugucggucacgauuugguuggauuacaaauugacauuuuggcuaaucgccuaauaaaacgcgauguuucuacguuuaguaaacugagcagggucaagcgggcagaaaagggccgcuugguacaagauuuguuuaccggacguuugguggcggauuuaaaaauuuccgccaaagaauuaaucaaguccagaacguacgauuugccaacgcuuugucagcaaguccuuaagcuacgagaagaccaaauaacagauuuggaaccagacgagguuguaagaauguaugaaaacacagaagauauuuuuaaauuaauagaauauacaaugcaagauacugcuuauaugcucaaaaucuuauacgauuuaaacauuauuccuuuggcauugcaaauaaccaacauagcaggaaauauuauguccaaaacacuuauggguggcagaucugagagaaaugaauauuugcugaugcaugcuuuucaagaaaaggacuauauuguuccagagaagaaguucaaaagaagaagaaacaauaaugauagccaacaaguagcuaagaagaaaccugcauaugcaggugguuugguucuggaaccuaaaaucggcuucuacgacaaacuucuuuuacucauggauuuuaauucacuuuaucccagcaucauacaagaauacaauauuuguuuuaccacauuacccaccacagacgaagacaauaauuuaguuuugccugauaaaaaucuaccucccggcaucuugccuguggaaauaaaaaaacuuguugauaguagaaagcaaguuaaaaaguuaauggccacuccugaucuaucuccagauauguggaugcaguauaauaucaggcaaauggcuuugaaauuaacugcuaacaguauguauggguguuugggauuugcaaauucaagauucuaugcaaaaaaucuagcugcucuugugacacaaaagggcagagaaauuuuaacaaacaccaaagaucuaguagaaaaaaugauguuugaaguaguuuacggagacacugacaguauaaugauuaacacaaacuugcuagauuaugaucaaguccuuaaaauuggcaacaaaauuaaacaggaagugaacaaguauuauaaaaugguggaacuagauguugauggaauuuucaaauauuuacuauuauuaaaaaaaaagaaauaugcugcagucacacuuaaaagaacaaacgaugggcaguuacaagaagaaaaagaauauaaggguuuggauauugugagaagagauuggucucgaauaucuucugaggcaggcaaacaaguucuggaguauauucugagugaccaaaccgaagaugaacgcuuaauuaauauacaaaauuacuugagaaaguugcgugaagauuuggaagaggguagaaugccgauucaguugcuugaaauuaccaagcaauuggcaaaagauccuaaagaauauccgaauaaagauaacuuugcucauguguuaguugcuuuaagguacaaucaagaacacagaggucaucucagaguuggggacgcuguaugcuacguuauuugugaagauggcacaaacaacucggccacaaaacgugguuaucauccugaagaacuaaaaaucaaagagcaccuaaaaaucgauguuaaauacuaccuaucccaacaaauucauccuguuguggccagauuaauugauccucuggaaggaauugaugccgaugugauugccgaauguuugggcuuggacgggacuguuuacaaaaaggcuguugcaaagaaaccucaagauguaggagaaaauauuauguuacccgaagugaaauuucgaaauuguguuaaguuuaccuucaaaugccucguaugccaagaagagaauaucguuaacgggccuuuaaacgaagacaaaguaccauuuuugacgaaaugcucuaacccagacugcacagcuaaaccuauagauuaucuguaucacauccaaaaucaauuguguuucaaaaucaacgaauucauaaggaaauauuacaauaacaaguugauuugugaagauccaaguugcaccaccgaaacuaacaaguugccaaucaaguuuaugucgaaauauccaguuugucagggaugucagcaaggcguuuuguauagggacuacacugaggcagagcuggcuacucaauuggaauauuuuguuuauauauuuaaucucgcuaauuugaauaaaaaaccauuacuugaagauuccauagaacgagguuaucaccaguuaguggaaacugucagcaguuaugugaaaagaucugccuacucugugguuaauuugaaggaaguuuuugaaauucuugagaaaaucgggucugaaaaauguauucguuaa

SEQ ID NO: 6780 - RNA, 1392 nt, Ceutorhynchus assimilis
auggcuucugcagcugccgcuaaaauagccgaagugcgugaaacuaccaggguagaaagaauuggggcccauucgcauaucagagguuugggacuagaugauugucucgaggcucgcccggucucccaagggauggucgggcaauugucggccagaagagcugucgguauugucuugcagauggugcgugaaggcaggauugcuggaagggcuguuuuguuggcuggacaaccaggaacugguaagacugcuauugcuacagcuuuagcagccgcccuaggaucugauacuccauucacaagcauggcuggauccgaaauuuacucacuggaaaugagcaaaaccgaagcauugacucaagcuaucagaaaaagcauuggaguuagaauaagagaagaaacugaaauuauugaaggcgaaguuguggaaguucaaauugaacgaccagccacuggaaugggcacaaaaguuggaaaacucauccuuaaaacuacugauauggaaacaguguaugauuugggcggaaaaaugauugagaguguuuuaaaggaaaaaguucaaucgggagauguuauauuuauugauaaagcaacuggaaaaauuacacguauugguagaucauuugcaagagcacgugauuacgaugccacaggugcucaaaccagauuuguucaaugcccugaaggagaauugcaaaaaagaaaagaaguaguucauacaguuacuuugcaugaaauugauguaauuaauagcaggacgcauggauuuuuggcuuuauuuucaggugauacuggagaaauuaaaccugaaauaagggaccaaauuaauggaaaaguggcagaauggagagaggaaggcaaggcagaaauugucccuggaguucuauuuauugaugagguucacauguuggacauugaaugcuuuucauuccugaacagagcauuagaaaacgaaauggcuccaauuguaauuauggccaccaaucguggcauaacaaaaaucagaggcaccaccuacaaaucuccucacggcauuccuuuggaccuuuuggaucguacaauuauugucccuacaaguccuuacgaagagaacgaacucaaagaaauucugagcauccgaugugaagaagaagacugucaaaugucagauaaugcuuugacugugcugacaagaauaucuaaagaaacuucuuugagauaugguaugcagcugaucaugacguccaguuugauugcuaggaaacguaaagcgcaugagguggauguugaggauauuaagagggccuaucagcuguuuuucgaugaagguagaucugugcaguuccugaaggaauaucagcaagaguuuauguuucaugaguuggaugaugacaugcgaauggaauuaaguuaa

SEQ ID NO: 6781 - RNA, 1116 nt, Ceutorhynchus assimilis
auggcuauuagaacuuauggagauaaaccuauaacuuuccaauuggaagagaauggcgaauacuauuguguuggaucagaggugggaaauuaucuucggcucuuuagagggucucuauauaagaaauacccugggauguucagaagguccauuacaaaugaagaaagaaaacgauugauugauuugggacuuucacaacacugccuugccaguaguguaucuuugcuaagggcuucugaggucgaagacaucaucgaaggaaaugaugacaaauauaaagcugucucgguucauacaagugacccaccaguaccaagggaagguaaaagcaaaaagaaccaacaauggguaccaucuuugccaaauuccagucauuuagaugcuguaccacaagcuacuccgauuaauagaaacagaguugcugcaaaaaaaguaagaacuuuuccuuugugcuuugaugauaccgauccccagcucaacauugaaaaugguugucaacaagagguucuggugcccauccguuuggacauggaaauugaaggacagaaauugagagacacuuuuacuuggaauaaaaacgaaagcuuaauaacuccagaacaauuugcugaagucuuaugugaugauuuggauuugaaucccuugacuuuugugccugccauuucucaagcuaucaggcaacaguuggacgcuuuuccuccagaaccuccuaguauuauugaggaaaacgcugaucaaagaguuauuauuaagcugaauauccauguuggaaacacuucauuaguugaucaaguugaaugggauaugagcgaaaaacaaaacaauccagaagaauuugcuuugaaauugugcucugaacugggauugggcggagaguuugucacagcaauagccuacucuaucagaggacaauugaguuggcaucaaaggacuuuugcuuucagugaagcuccauuaccaacuguugaaguuccuuucagaacuccaucugaaucugaccaaugggcaccguuccuugaaacuuugacagaugcugagauggagaagaagaucagagaucaagaucgaaacacgagaaggaucagaagacuagccaauaccacuccuggcugguga

SEQ ID NO: 6782 - RNA, 624 nt, Ceutorhynchus assimilis
auguuuuguuguuggucucaacaggaggacuuuggaaaagguccgauggcagcuauucgaaaaaaguuaguaauugucggugauggagccugcgggaaaacuugccuguugauuguguuuaguaaagaccaauuuccugaaguguacgugccuaccguuuucgaaaauuauguggccgacauugaaguggauggaaagcaaguugaacucgcuuuaugggauacugccgggcaggaagauuacgaccgucuucgcccccugucuuauccagacacagaugugauccuuaugugcuucucaguagacucgccagauucuuuagaaaacauacccgaaaaauggaccccugaaguuaaacacuuuuguccuaauguacccauuaucuuaguugguaacaaaaaggaucuccguaaugaucccacuacaaucaacgagcugaaaaauaugaagcaagaaccagugaaaccgcaggaugguagaucuauggcugaaaaaaucaacgcauuugcuuaucuugaguguucagcuaaaagcaaggaaggcguccgagaagucuuugaaaaugcuacacgugcugcacuacaagucaaaaagaagaagaagcaucguugcauuuuguuuuga

SEQ ID NO: 6783 - RNA, 4146 nt, Ceutorhynchus assimilis
augauaaacacaagcucaacgaugaauuccacacaaaagucucaaaauacucaauucccguugccgaaaauggaaguggcugcuagucaaaucgacaaagcucuugccgaagacgccugcgcccccaaacugauugacuugaugaauauaaacgcggaaacggguccaacuuauaccgguuuuguggauucugauuauccugugcugagcaacaaugauaugcauaauauggcucugggcgaucugguccagaucaaaaauguuagcaguaacccucugccuccaggaauaucggaucauuucagucaagcucaguaucagugcacuauggggcuauuuccagaaauaaacagggcuuggcuaaucgccgauagugaucuuuauauuuggacuuaugaaacuaacauagauauggcuuauuuugaugguaucagucaaaccauuuugugugugggccuuguuaagccuaaaccaggaguucuucaugaguuuaucaaguacuuguuggugguggcuacugcuacggauauuauaguacuuggagucacuuuuacagaagcuaaguaugggguggaggaagagaugcauuuaauuccagauccaguauucagcauuuccacugaugguaauacaauuacaacuauaacugcugcaaauaauggcagaauauuuuuugguacuaaagaagguucuuuauuugaaauaacuuaccagacagcaagugguugguuuggaaaacguuguaaaauuguaaaccuuucaacuagucgcuuaucauuccuuguaccaucauucauaaaugcagcucuaggcgaagaagauggaauuuuccaaauaguuauagacaaauccagaaauauuuuguacacucuaacagaaaaaggagcaauagaaguuugugauuuaggcgaaagaggcaacaguuuuuccagaauuauuaaacucucccaaaaaagcauuguucaucaaguuuugcauacaguuacaacuuuagacaguggggcuuuucggccaauugucagcauugcuccaauugaagcuuaugaaucaacaaauuuaaaucuaguugccaucaccaaaaguggcguaagauuuuauuucacugucacuggauuaucauaucagcaacccaaugcucgcccuuaugcuuuaacuuuagcccacguccgauuaccaccagguuuuucugcaaauaucacuguuagaccuagagacguacacauuggcuacuacagagaccguaacgccauuuuauuaacuacaguaaaccacaaagacguuuuguggugcuuaagcucggaccuauucccuuucagcuauaauuugaaggaggcuuacacaacuaucaacuuggacgcgcccgcuuuagcuauggcggaaauucgacaugaagauuuucuacauuugaauccucaaaaugaagaagaaccuccuuugguggucaggcagcaugcagaggcgcccaaaaaguauguggugcucacuucucacaguguucaaguguuuauuaaauugagaccgguggauaugcuuaagcagauuuugcuggauaguaauggucaagauacauuaccucucaccacauuuuucucgauacaaagcgagguccaagcuugugcuacuagccuaauuuuagcuucacuauugagcgaagaaaaugucgaaauagcugaauuagccacaagagccuuuuuccuauuuggcggagagccucaauuaauacaagccaaucaacagaauauucaucaacaaaauacuacucuuuuagguucuacaauguuuucgccgcaaauaauuuccaccccggccccgcaaaaucaacaauaccacaugcaaagaacacaaucgccuccugguuauauguuuaauguaacucaaaggccucaaauggguaguuauguagcugaacggccacaaucgccuaauuauaugacaacaggaaguguaaugcaacaacaacaacaacaaucuuuuguacagcccuuugauccaaguauuuuuauuaauuuuucccauaaacacaacggcuuguacuuauauuuaugcagaauuuuaaggcuuauuuggaauagacauuguguggaacguuucuguccugauggugaauucgcuuuguuucaaagcagcauaucuguagaagacuguaucaaauugcaaaauaauuuaaaugcccugcacaauuuuuugacuuuaaauacugauuuuucuggaacuacuaaucaaauggcaauucauaauaauucuacauugaaucaaacuuuggugcgucagccugucacacuucaggacgcucaacuuauagaacgcaagucuuuggaugcccuaaagacuuuucugugucauuguugucaaauuaugggcuuguggaggauauugugcgaucaucaauuucacgagcuggucgcuuguuugccggacaacgaccaggaaauuuugcagaagacuacuuucaaggaauuguuccuuuucagaaaagacauuugcacuguuuuaauacaaacuuuggugaauagcuauuuaggugauaaugcuucaguggacgcuauuaguaauaggcuuauggagguuuguccgcauuuguauaagccugaggaugcugcuuuuacgaaggccagcgaacuucucaaaacaacacgaggcauacaaaacguagaugaaagagaagagaaacuuuuaacggcgcugcaacucugcaaaaauauagcuccaaaugugaaacuuccugugguuugcaaacaauucacugccuuaaaagcuuacaaggcugucauagaacuuugcgccuacugugcuagaaggauagaccccgacaauauugcuaagaguuauuuucacagugaggaugacgaugcugaugaggacggucuuaaaauguaccacaaacgaauggaaacuuauagggaaauaauuguaaugcuugaaacuuuguauugcgaacaagauccugugcagccugcaacuuacgauccugauuuaacuaauacuagaucuauauugcuugaugguacugaggguccuaaauuaggugaaaguauaaaugauauaauucaaacaaucuuguuuuacgaugacgaaauaaugcacguggcaguuuacgaguggaugguuucuaggcaaaugacgagcgauauucuucaaaucaaggcacguucuuuggagcuuuauuugaaaaaagccuccaugcaaaaucccaauaaucuuguagugaugaauuugcuauggcaauacuacgagacuaauucuaaccaugcguuggcugcuaagauuuuacauaauuuggccaguagaacagauauuaauauaccucuaaaagaaagacugacuuaucuagcgagagccauaauguguaugagaugcgauaaaacgggcuacucuguagauuccgguauguuucugagagaucuggaggauaaaaucgaaguugccaaaguccaaaaucucauuuuggaggacauuaccaauuucaggacacaaauugccaccgccgacgaggccauuucggcuuugaauaguggacuuuaugaaauuucacagcuguaugaaaacuuugcagaaccauuuaaccuccuagaauguaaauuagccaucauagauugugcaggguacacggauaacaauaacgcccuagcgacgucgaucuggcaagaaauuuuggccaacgaacuacgaaaaacgacaacgggaggcgcugaucgaauaaaaccgauuuugcaaaaagucaaaaauuuagcccggcucuacgguagcucagacaauucguuuccguugucguauaucacuucagaauuggaaaugaucaaugccaagcucagagggcccaaagguuuagugccgaauacuuuuaucgaagucaauaucgauuuucagcgguugauugaaguuuacucgagucugcuuaauuugucaggaaauuuaaauuuuuggcaaaacgaagaucacgaauuucacuugugcgaaucuacuugugcuuuaguuaugucauuuauaaacaaucacaaugcguuuagcagcauugaaaagaggaaaauuguagcaacaugucaagacaccaugacgacguuguugucaaauuuauacaccaaggccaacagugacgcucuaguuaaucaaguuaggaauauccaaacuaaauugucaagaauauaa

SEQ ID NO: 6784 - RNA, 4083 nt, Ceutorhynchus assimilis
augacacaguuuacuuugggcuaucgcgaagugauagcagaccaagaccugauugaaaaauggacagaaauaccgauuuucacuggaggcgcccagagcaccuugcaggacaucaaaguaaccgaaaaggcaagcggcuacagcuaugcagauuccaaccguuacuauacaagaaauagauucauauacuggcgaauagauucagauauccuugagcuaauagaacacaguuuggauauaaacuuaacuggaaacaaacuuagauacaaguucauugauagcccuauucuagacgguguaucgguuaaagaaacagaggaucauauuuuuauauuggucccuacuguuuguagugugcauaaguucacauucccacauccaucaaaauaccauagacaggaugaauuauuggacucgcaccuaaaacuggccgccccuucaauuuucuguaaugccauccacaccggggaugauccuacuaguuacuauguauucaauaauccaagcacagcuaaugaccagcuaccaaacuuagcuaaauccuuuuacaauccagacacagaagaggcaguuuuuauucuggccuauccaucugccgagcuccuuuugaucaaauuaaauucacaaggccgcgcauuguguauggaacuaaaaggugaaucguugaugcccagauuuuuaucgggaauaacugaaaaauucagaucaaaacauaaggacggcaaccaaauaaucagcgcuuugauugaaguguuugaauaugaaguuuacgcuuuaacuuuggccagaaauggacauuugaaauucuggucgugcagaaauggucaguguguggcugcuauugauaugaugccucaaggaucagauagauuacaaaaugcuuuauuaaggaaggcagagggaaauguugaaaguuacagccccauagcaauauucaugaguuucccauccagaggacaguuucauauauuaaaaccuauuauuaauaaugaacaaauuacuauugaaguaguaagagucauagagucuguugagaaaaugguuuuggacuuuucauuacaauccaaccaaauuugguuggcuugugucacagguaauacccaaugcagugucuauaugcguccaauggaaggaggaggaacuuggaggccugucaucaaggaagcuguucacgaaaaagaggcacuugauggaaaaucagauccucgucaaguuuauucgcagcaccuuuuccauccuggaagauuuccauuauacacauugaauaaaucuuuggggacuuuaaugaaaaacgaagucaaauuaacaucaguggcagcccuaaaacaagccauaugccuagcaauagaaaacgauauccaaaaucaauucgccgacaucgaagauauaaccgacgaggaauauuuggaaaaagccaaauggugcugggaaaaauucuacucaaguugcugucaguauuaucaaaucagccugaaacccuuaggccugaugcuucugccucaaaacucugcagcuauucucauuaggaaagcaaccuuuucacuugucagacccauggaaccuuuggaacauauguuuuugugcaacgauuccgguuucaaagaucaguuuauaaauuuugcucuuuugggcgaagaacaagacuuacuggauaaugucaagaaauuauuugauuugauugucuuuauugagagucaaaugagcaaaaauuuaaagacuacuuuugaaagggaaauugguauuacuuugcaaccaaagcuuguuguuuccaguuuaugugaaauauuacguaaagagcacccuaguauccgcgaucaaguaaaugaauuaaaaaaaguaaaagacuuauacaaagcgauacacaaacuauuggaucuauuacgucacgacaguaccccggcuaauccugacaacgaauccaauccucaggcaaugcauuacuuuagcagcgcacuggguauuucguuugugucgacuuguuuaaggcaacagugucaaaaucguuucgccauuugcaggaauuuguuaauaauuugccacaguuugaacaauguugacgcuguuacaagggacauacgacaagcuugugaaagugauauuaucgagcuuacucaggcuaauuauguuaugcuuuggcuggcuaauuugccugcauucaauaauguggcacaagaaucagcgcuucagcgguuaaauacaauaaagcuaacaccagccuuuaaugucacacgaaauauuuuuucacuuuuggaagcauuuauuuccucuaccggggguuaugaggcaaggaaaauguuguccaaaauggauuaucauggagaagcuagggcgcauuggcauuugagcuuguugccauuuaucagcaaccuuagaacuauacuauggccucuuaaaaccggcacaauuuuaccagaaugguugguaagcagcggucaacaucugugguugcagcaauauacaagacuacuaaguccuugguguguacagaauaaauacagcuguaaauuucuguuagcugcaucguuuuuaacaugugcagaaaaccauaaagcauugaaacuauuccaagcagcaagcgauggcauuuuaguugaaccuuuuuuacaaaaacuaauaaaagacgcacacgaaggucaagaaaaaaucuuuuauuaucuaaaagugauucaucuauuugaacuacacaaauccagagauugugcaauucaaauggcuguuuacgccuugaaggcaauugaaccugaaagugcuuuaguaccuacguuguacucgauuaaauucaagcaucauuuagcuuugagacauuacaaaugggcuuuugacgauuugaaagcgaauccggauuuggaaagacggaaagacaauuugagggauuugguuaagacuuuguuggacgaaagggaauuugauguauugcuaggauuuacuuacggagacauggaggaauuguuuacuaauauucuguuuacaagggcaagagcuacugaugcacuuaauaauguguuuuacgauauuuuguauucucaccaaaucaacagggggucacuuuauuauagauuagcugccuccauaaaauaugagcaauccuucaggcucucccguugcaacaccguccaagcuuuagaaaaacaaguaaaauguugccucauagcuaaaaauguacuacaacuaaccgauccagaauaugcuuggguuauacguccuucugauccugacgaagaagaaacugaaaucauuauggaaucccuugcugguucuggaaaagacuuugaaguuuuccguauuaaaaagcaaguagaagucguuacuguugauacaauggaaaaggaacuuguuuucuugauggccaaacugaaacuaaucaaauuucauccugaagcuuccagcaaaauuacaaauauuuaugaaucugaagaacuuguuaugcauuuaaauaaugcaggauuauucaaggaagcauuacaagugugcaaaaccuauaaacugucuuaugcgucagucuuuagugauuuaacuggcagaugcguuauacucagugaagaugaaaauucguauccuugugauuggcuaucugaaaaugauuuccaagauuugucggcauauaggaacaacuauucaacacuagcaugggaauuauuacaaaaacuauuaaaagaaugugaagaaccuaauuuaacaguacuucauaaagugguuacugaaaaaaucauuaguaugagaauguauuugccuuuuugguuaaaaguuuccuauaagaaaagaaauucaggugagcuccuaagacugcuacacuuauccggucauuuagacgaagccuucgaacugugccgagaauaccuucuacucgcccuaacaucucuaucacccaauucucaggccuuuuguaugcccguguacgaaauccagucucucguguaccagcuuaaguugcaaaacgaaaaacauuucaacaggccuuuuaaaaaugagcucaaaacauugagugaacuuuuccagaaguacuuaacuagugccaugcggauuuccaacgaaaaggcccaacuucagaugucaaccuuugguacuauuccauuaaauagauag

SEQ ID NO: 6785 - RNA, 2910 nt, Ceutorhynchus assimilis
auggaaaucucagaugaaaaccuccaaacguuagccagauaucuccaagaaacccucaacccagaggucaauguccguagaccagcagaaaaguuuuuagaagguguagaagucaaccaaaacuacccucuacuacuacuaaacuuaguccacaaacccgaaguugauaugacugugagaauagcuggaucuguugccuuuaaaaauuauaucaaacgcaacuggacuguacaagaagaucaaccagacaggauacaugagucagauagagcugcuaucaagaguaugauagugacucuuauguuaacuucuccagaaucuauucagaaacaacuaagugaugccauaagcaucaucggcaagacagauuuuccuguuaaauggcccgaauuaauaacacaaaugguggaaaaauucgcuacgggugacuucaauguuauaaauggcauuuuaagaacuggucauaguuuauucaagaaauaucguuuugaauucaaauccaacgaacuuuggacugaaauuaaauauguuuuggaaaaauuggcacaaccuuuaaccaauuuauucguggcuaccguaaaucuaacacaaacacaugcaaaugauguuaaugcacuucaaacuauuuauagcuccuuaguauuaauaucgaaaguauuuuauucauuaaacuuccaagauuugccagaauuuuuugaagauaacaugcaaauauggaugcagcacuuucaccuguuacucacuguggaagcuaaaaauuuacaaucagacacugaugauaguguaggaguuauugaacaacugaaaacacaaauuugugacaacauugcucucuaugcccaaaaauaugaugaagaauuucgggaauauuuaccacaauuugucacagauguauggaguuuguuaguaggcacaggauuagaaccaaaaaaugauuuacuagucuccaaugcauugcaauuuuuaucuaccguagccgaaagaaaucauuauagaaauuuauuugaagacgaucaaguuuuaagcagcauuugcgaaaaagucaucaucccaaauauggaauuuagagaaucugaucaagaauuguuugaagauaauccagaagaauuuacaagacgagauaucgaaggcucagauguggacacaagaagacgugcagcaugugauuugguuaacacuuuaagugugcauuucgaggaaaaaauaaugaaaauuuuuggucaguauuuacaagucauguuagccaaauucgcagagaaucccaaaaguaacuggcgacacaaggaugcagcuuuauauuuagugauaucguuagucagcagaggagcgacacaaaaacacggaguaacucaaaccaguaaauugguagauauuucccaauuuuuccagcaaaauauuguagcugaguuacagcggcccaauguagacgaacuuccuguacugaaagcugacgccauaaaauauuugaugacuuucagaucaguguugcccaguacuuuaguuguuuccagccugccccaguugauuagacauuugagcugugaaagcgcgguaguucacacuuaugcagcuuguuguauagaaaaaauacuaaucaugagagauaguaauaaucauccacaugugacaggagcucaaauucaaccuuuugcugcugaauuaauuucacaauuguuuggaguuuuggagaagccaguaucugaagaaaaugaguauguuaugaaggcuauuaugaggacuuuuucgacuuuacaggauuuaguuauuccauuccuuggagcgucuuugccuaaacugacggaaaaacuacaggcaguugcgaagaacccauccaaaccucauuuuaaucauuauuuguuugagacucuuucauuauccaucaugauuguuuguaaaucuaaucaagcagcagugaaaucuuucgaggacauuuuauucccuacuuuucaagccauuuuacaacaagauauucaagaauuuauuccuuauguuuuucaaauuguuucguuauuuauggaauauacuccugcagggaauauuccagaauccuauaugcaacuauugccguguuuauuagcuccaguuuuaugggaaaggccagcaaauauuaguccucuaguaagguuauugagggccuacauuacacaggcggcuccucaaauuauagcucaagauaaacuuucggguuuucuuggaguuuuccagaagcuuaucgccucuaaaucuaaugaucaugaagguuucuauuugaugcaaaguaugauacaaaauaucccgaaagaaacauuagccccauuuuuaaaacaaauauucuuuuuauuauuucaaaggcugucgucuaguaaaacaacuaaauuuguuguugguuuuauuguucuuauuugucuguuuauggucaaauauucggcaagugaguuaauaaugcucauugauggaauucagccucaaauguuugggaugguacuugaaaaauuguugauagcagaaauucaaaaagucaccgggcgaauugagagaaaaaucguaucuugugguguuaguaaguuauuaggcgaaagcccugaaaugauugaugguauuuauggaaaauauuggccacaacuuuuacaagcuuuguuaguauacuuugaaaugcccccagacgaauccacuuugcccgaugaucauuuuaucgaaguagacgacauuccuacuuaucaaacaucaaaugcucgccuuaauuuugcuaauaccacaaaggaagauccucugccaaauguaagcgagccaaggcaauucuugguacaaaguuugaagaguuugagcaacucucaaccaggcagggugccuacuuuaaucagcaacacuucgacucagucucagacaugucuucaaaauuauuuggccaaguuugguguucaauuaguguaa

SEQ ID NO: 6786 - RNA, 591 nt, Ceutorhynchus assimilis
auggcaaaaguucaacuuugcaauauuacgguuauggacaauccgagccccuuuuugaacccguuucaauucgaaaucacguucgaguguauugaagaacuuaaggaagaucuggaauggaaaaugauauacguuggaucagcugaauccgaggaauucgaccaaguuuuggauucuguuuuuguuggccccauuccagagggcaagcauauguucguauuccaggcugauccaccaaacguuucgagaaucccagaaaacgacgcuuuggguguaacaguuguccuucuaaccugcuccuacagagcccaagaauucauaagagugggcuacuucaucaacaacgaguacagcgaucccgagcucaaggaauugccacccagcccaccacaauucaacaaaguuaccagaaauaucuuggcuucagaacccagaguuacccgauucaaaauuaacugggaagaaccgaacgcucaggaauccaugccuggaccaucagaaaaugccgagccuauaccuaucccgccacuaggacaaacacccaguuucaaugaaaguucaaacucuugggcuacuauggaaugcucuuag

SEQ ID NO: 6787 - RNA, 948 nt, Ceutorhynchus assimilis
auggaucaaaugcuuccgaguccuggcuucaguauucccaguauugguacuccauuacaucaguuagaagaagaccaacaaauccuuccaaaugcauuacagcagcaacagcaaccaauaacaagucaggugcccccuuuggccccaaugggugggcuaacgcccacuuuaaguuugggcauggguaaugccauugcaaugccccauacaaaauaugugacugguuucaguaugccuaugggggguaauaauaguggaaugaccccacagacaccucaacauucaaugaugacuucgaugguaaauuugggggguacaggggguaguacccccaguaugacccccauagugggagggccuucgacuccaagcccgaugacccccaugacgccccauucugcugauccuggaaucguaccucaauuacaaaacaucguauccacaguuaaccuaaacugcaaacuggaccugaaaaaaaucgcuuuacaugccagaaaugccgaguacaacccgaaacguuucgccgccgucauaaugcgaauaagggaaccccgaaccacggcccugauuuucaguuccggcaaaauggugugcaccggagccaaaagcgaagaagauuccagauuagcugcccgaaaauacgcucggaucauccagaaguugggauucaacgcaaaguuucuggauuuuaaaauacagaacauggucggcaguugugacguaaaauucccgauccguuuggaagguuuagugcugacucacagcucuuucagcucguaugagccugaauuauuuccuggauuaauuuacaggauggucaagccuaggauuguuuuguugauuuucguuuccggaaaagucgugcuaacuggagcgaaagucaggcaggagauuuaugaggccuuugauaauauuuauccgauacuuaagaguuuuaagaagcaguga

SEQ ID NO: 6788 - RNA, 477 nt, Ceutorhynchus assimilis
auggccgcaaugagaucaaugucccgucuuuugaccagcagggcuuuaaauaccaccauccgacggggcuacgcugaagaaaugaacuuuacuuuugcugcuggaaaccaaguauuuuaugauggaaaaaguguaaaacaaguugacguaccaucauucucaggcaguuuugguauccuccccaaacacguccccacuuuggcuguccucaaacccggaguaguuucuguauacgaagaggaugguggugucaaaaaaaucuuuguauccagugguacaguuacuauuaaugaagacucuucaguacagauuuuggcugaagaagcacauccaauagaaaauauugaugcuucagcugcuagagaacuucucacuaaaucacaaagucaacuuucuucagcggccaacgaucaagcuaaagcugaagcagaaaucgccauugaaguuucagaagcuuuaguaaaagcugcugaauaa

SEQ ID NO: 6789 - RNA, 990 nt, Ceutorhynchus assimilis
augaguggugacggugauaaagcugaacaguucgacucucuuuuccucacaauagcgcaacaccauccagaaggcgcccucaagcuucuagacacguuuguaaguuuuuugggccgaaaaaccgacuuuuucacaggcggcaaugaaggcgauugggaaaaacuuguuaugaacacguucaaaaaacaugaaagaauaagccguuccagccgugaggccgaacugaaagcaaaaaaagaaaaagaggcugcgagaaaagcuaaaaaggaggcuaaaaagcuugaagagcaaucuguucagccugcagaaauuaaagaacugacagaugaagaagcggaaaaguugcaaaaagaacuugacacuaagcaaaguguugaaaguguugcaaccucaagcgcaguuggcacuucuucugaaacaacggaugagguaacugaagaggaagaagaugaaucagaaaagggaaaaauuaaaccuaauaaaggcaaugguugcgauuugggcaaguacaaauggacgcaaacauuacaggauauugaguugagaauucccuugaacaaaaacuaucaagucaaaggaaaagaucugguagucaaucuaacgaaaaagcaucucguuugcggauucagaaacgaaccuccuauuaucgaugacgauuuucagcaugaaauuaagcuagaagaaucuacaugggugauagaagacggaaaaacucuacuuuuuaauuuggagaagaucaacaaaaugaacugguggggcaaacuagucaugucggaucccgaaauuagcaccaagaaaauuaaucccgaaccgucgaagcucagcgaccuugauggcgaaacuaggggccuuguggagaagaugauguacgaucagagacagaaggagauggguuugccuacuagcgacgaacagaagaagcaagaugcaaucaaaaaauuuauggagcaacauccggaaauggacuuuuccaaaugcaaguuuaauuag

SEQ ID NO: 6790 - RNA, 459 nt, Ceutorhynchus assimilis
auggcuggucauuccggagcaccgcccguuuuacaauggagcccugauaagacgcacagcgauagagaaagauggguuugccucuauccagccuacauaaacagcaaaaaguccuuggccgaaggcagaagaauccccagaaauaaauguguugaaaacccgacuuaccaagaaauaagggauguucuugcugcagcagguuugaauguuggaguugaaaacaagcucuacagccgcgaaagaagcaaagaacuccucuacagaggucgcauucgcguucaacucaaaaacgacgacggcucuuuggucaauccugcauuuucuucaagagacacacugaugcuucaucuuggugacaugauaccaaagcugaaaacgcguuugcauaaaccgucuacggaccagccaagucaggcuagucaaggaaaaggaaagggcaaggguaaaggaaggagauaa

SEQ ID NO: 6791 - RNA, 2052 nt, Ceutorhynchus assimilis
auggaaggaaaagcccaaaaaaugccgaaaguggccaaagucaaaaacaaagcacccgccgaaauccaaauuaccgccgaacaguugcugcgcgaagccaaagaaagagauuuggaaauccuaccgccgcccccgaaacagaaaaucucugauccagccgaacuagccgacuaucagcucagaaggcguaagcaauucgaagacaacauccguaaaaaucguacaguaauauccaacuggauuaaauaugcacaaugggaagagucucaaaaggagauucaaagagcgaggucuauuugggagagagccuuggauguggaccacagaaacaucacaauauggcuaaaauacaccgaaauggaaaugcgaugcaggcaagugaaccacgcgagaaauuuaugggauagagcaguaacuauccucccaagagucaaucaguuuugguauaaauacaccuacauggaagaaacgcuagagaacauuccaggagcucgugcaguauuugaacguuggauggaauggcaaccagaagaacaagccuggcaaaccuauauuaacuuugagcuuagauacaaggaaaucgauagagcaaggcaaauuuaugaaagauuuguaauaacccacccacaaguaaaacauuggaucaaauuugcacguuuugaagaaaaccaugcauucauacauucagccaggcaaauauuugaacgugcaguacaauuuuuuggugaugauuacauggaugagaaacuauacauugcuuuugccaaauuugaagaaaaucagaaagagcacgauagagccaggguuauuuacaaauacgcucuagaucacauucccaaagaagaaacuaaagagcuuuauaaagcuuauacuauucaugaaaaaaaguuuggggauagaaguggaauugaagaaguuauuguaucuaaaagaaaauuccaauaugaacaagaaauagcugcaaauccuacaaauuacgaugccugguuugauuauauuagacuuguagaaggccaaggugaaacugauauuauaagagaaacuuacgaaagggccauugcuaacguuccaccuuuaaaaaauaaagauuuuuggagaagauacauuuauuuauggaucaauuaugcuugcuacgaagaacuagaagcccaagacuaugacagaacuagacaaguauacaaagccuguuuggaacuacuaaaucauaaaguguucacuuuuuccaaaguuugguugcucuaugccaaauuugaaauaaggcaaaaaaauuuaacaucagcuagaaaaauacuuggaauggccauaggcaugugcccaagagacaaauuauuccgcggcuacauagagauagaaauucagcuaagagaauuugacaggugcagaaaauuguaugagaaauuucuggaauuugggccugagaauuguguuacuuggaugaaguuugcugaacuugaaacccuauugggcgauuuugagagagcuagaggcauuuaugagcuugcaauuaaugugccuagauuagacaugccagagcugcuauggaaaucuuauauugauuuugaaauagcucaagaagaaccagaaaaugcuaggcaaauuuaugagagacuuuuagaaagaacuucacacguuaaaguauggcugucuuaugcuaaguuugaauuaaaccaagagucugaugaugguaugaacauucguuuggccagaagaguguuugaaagagcuaaugaaaaccugaaaaguuccccggacaaagagagcagggcguugcuguuugaaaauuggaaagaguuugaaaauaugcauggagaugaaacaucucugaacaaaaucaccaacaugaugcccaagagaauuaaaaagaggcaaaaggucauugacgaggaaggcaacgaacaaggcugggaagaaguguuugauuacauauucccugaagaugagucuaauaggcccaauuugaaguuguuagcggcugcuaaaaguuggaaacagaaaauggaaaaggaagcuacuaaagaaguuauugucagugcaaaugauaauaaugaauaa

SEQ ID NO: 6792 - RNA, 1431 nt, Ceutorhynchus assimilis
augggaauaaaauucuuggagguuaucaagcccuucugcagcauuuuaccugaaauagccaagccugaacgaaagauucaauucagggaaaaaguuuuauggacggcaauuacacuuuucauauuuuuaguauguugucagauaccacucuuugguauaaugaguuccgacucggcagauccuuucuacuggauucgugugauucuggcaucaaacagaggaacacuuauggagcuggguauuucaccuauuguaacuucuggauugaucaugcaguuguuggcuggugcaaagauuauagaaguaggcgacacucccaaggaccgggcauuauuuaauggugcacaaaaauuauuuggcaugguuaucacuguuggucaagcuauugucuauguaaugacagguauguacggagauccugcagaaauuggagcaggaguaugccucuugaucaucauccaguuauucguugcuggacuuauaguauugcuucuggaugaacuuuuacaaaaagguuauggauuaggaucugguauuucucuuuucauugccaccaauaucugcgaaacgauuaucuggaaggccuucucaccagcuaccgucaacacuggacgugguacugaauuugaaggagcuguaauugccuuguuccacuugcucaccaccagacaagauaaaaucagggcuuugcgugaagcuuucuaccgccagaacuugccuaacuugaugaacuuauuagccacuauuuuaguguucgcuauagugauauacuuccaagguuucaggguggaccuaccuaucaaaagugcaagauaccgcggacaauauuccaguuauccaaucaaacuuuucuacaccucaaacauacccauuauuuugcaaucugcucuaguuuccaacuuguauguaauaucccaaaugcuggcaguaaaauuccaaggcaacauucugauuaauuuacugggcguuugggcagauguaggcggugguggcccagcaagaucguaccccaucggugguuuauguuacuauuuaucuccaccagaaagugugagucacauucucgaagauccaguucacgcuuuccuuuacauuguuuucauguugggaucuugugccuuuuucucaaaaacguggauugaaguaucaggcagcucagcuaaagauguugccaagcaacuuaaagaacaacaaaugguuaugcgaggacacagagauaacuccaugauucaugaauugaaucgguauauuccuacagcugcugcauuuggaggccucaguauuggagccuuaucaguacuagcagauuuuaugggagcuauugguucugguacugguauuuugcuagcuguaacaauuauuuaccaauacuuugaaauuuuuguuaaggagcaaagcgaaauggguggaaugggaacucuauuauucuaa

SEQ ID NO: 6793 - RNA, 483 nt, Ceutorhynchus assimilis
augguuagugucagugcugccucaguggaacuaagcuccuaccgugaccaacauuuuaaaggcacccgagcagaacaagacaaacuucuacgccucucauguacccucuacguaggcaaucuaucauucuacaccacugaagaacaaauauacgaacuauuuucaaaaugcggcgaaauccgucgaaucauuaugggccuggacaaguacaagaaaaccccgugcggguucugcuuugucgaguacuacauucgugaggacgcagaaaauuguuugcgguacauuaacgguaccagacuggacgauaggauagugaggacugauugggaugcgggcuuuauugaaggccgucaguauggacgagguaaaacuggcggucaaguuagggacgaguacaggacagauuaugaugcaggaagaggcggauaugggaaauuaauucagcagaaaauuggaacagaaguuccuucauuuuuacgauaa

SEQ ID NO: 6794 - RNA, 924 nt, Ceutorhynchus assimilis
auggcugccagaguugggcgaauuugcggagcuggacuuuucaaguccaauacaacuucuaguuugaaucagauuaguuccuauucaacaaccagagauuggucaagaggaagaaaagcacugguugguagccuggguauacuggcaggaggagcuggagccauuauuuucgcccuggacagguccgugagggcuucugaauuagaauugcacccaccuaagaacccauggagccacaauggcugguuugauuccuuagaucaugcuaguguaagaagagguuacgaaguuuacaagcaaguauguucggcuugucacucauugagguuuauugcuuaccguaacuugguaggagugacacauacugaggaagaagcuaaggcugaggcagaagaacaaaugauuacugauggaccugacgaagcugguaacauguucaaaaggccuggaaaacuguccgacuacauccccaguccuuaucccaaugaagaagcugcuagagcagcuaacaauggugccuacccaccugauuugaguuauauuacguuggccagacauggaggugaagauuacauuuucgcucuucuaacggguuaccaugaugcuccugcuggaauugcucuaagagagggccaguauuucaauccguacuuugucgguggugcuauuucaauggcccaaucuuuguacaacgaaguaauugaauauagugauggaacaccagccucugccagucaacuugcuaaggauguaucaacuuucuugaaauggaccgcagaaccagaauucgacgaucgcaaacgcaugaugguuaaggcgaucggcauuuucaccauuuuaacaaugguguccuauuacgccaaaagauucaaaugggcaaguuugaaaacaagaaaaauugaauucaaacccaaaaguaaguaa

SEQ ID NO: 6795 - RNA, 1683 nt, Ceutorhynchus assimilis
augauguccauacaggccuacagugguaguagcagcagcggcgacgaagaaaccccugcggcgcccccuccuguaaguuuuuccgcaaaaacccuacaaauaugcgcggcccccacaguccuaccccccgccauugacgaagacaaaauccacauccaucccgauacuguagagcuccaauacaaccccaaauacgaagaguuauuugcuccaacuguggggcccacaaaccccuucaaacccaaacaucaagaaaucgaaaaaaacacgcuuuccggccacguagaaccggcccauguaagcgaauuccaauucgaaaaccaacgccgcaccuuugcaaguuacggcuacgcuuuggaccccucuauaagcgcacaugaacaaggccucacuaaaguaauuggcgacucagaagaagccaccgauucacucaaaacuguauuugaaaagacccaacucagacccuuggacaaaaggaagcgcaaaaaaaacgacaaaccggacgauauugaaggguuuuuaggccccuggggcggauucgaagacgaacaaaaaaucgcaaggccuacagaagaagaacaggccgaauugcaagaacuuguaagcaaaagaaccaaaaaaggcaaagaaccugaagaaaaacacacagaagaaaaaucaguguugcacaucaaagaugccauugauuaucaaggcagauccuucuugcacgccccccacgaugucggaguuaaccucaaaucugacaugccuccugauaaaugcuucuuaccuaaaucccacauccacuccuggaccggacacacuaaaggcgucucagcuauuagaugguuccccaaaacugcccaucucuuuuuaucaaguggcauggauugcaaaaucaaaauuugggaaguauacaaggaacgcagauguguacgcaccuauuauggacauagacaagcugucagggauauuaauuucaauaauaauggcaaucaguuuuugucugcuggcuaugacagguauauuaagcugugggacacugaaacuggccggguuguuucaagauuuacaagcagaaaaauaccuuauugugucaaguuuaauccugauuacaauaagcaacauuuguuuguugcugggacuucggauaaaaaaauuauuuguugggauacuagaucaggagacauuguacaagaauaugacagacauuuaggggcugucaacacaauaaccuuuguagacgagcauaggcguuuugugacuacaucggaugauaaaucauugagagucugggaaugggacauuccagucgacaugaaauacauugcagauccuacaaugcauaguaugccagcaguuacucccgccccaaacggcaaauggcuggccugucaaagcauggacaacaaaaucgucauauuuuccgcucugaaccgguucaaguugaaccgcaagaaaaccuuuaccggacacaugguggccggguacgcgugccagcuggacuuuuccccggacaugucuuauuugguaucuggggaugcugauggcaaguguuacauuugggacuggaagacuaccaaguuguauaagaaguggaaggcgcacgauaauguguguaucaguugcuuguggcacccccacgaacccagcaaaaugaucacugcaggcugggacggccuuauuaaauacugggauuga

SEQ ID NO: 6796 - RNA, 810 nt, Ceutorhynchus assimilis
auggaccagaagaaaccccagaagaagacuggcgguaaaaaaguggcagaagcuccucuugcuguaaaaaaaguagaagcaaagaaagaaguaacuccuuuauucgaaaagaggccaagaaacuuuggaauuggucaagacauccaaccuccacgugaucuuuccagauucguaaaauggcccaaauacaucagaauccaaaggcaaaaagcugucuuacaaaaaagauugaaggugccaccaccaaucaaccaauucacccagacuuuagauaaacaaacagcaacucaacuuuucaaaguuuuggaaaaauacaggcccgaaacugcccuucaaaagaagaacagguuaaaggcaaaagcugaggcuaaaguggcuaaaaaagaagaggcucccucaaagaaacccaacacucuuagggcagguaccaacacuguuaccaaguuaauugagcaaaagaaagcccaauugguuguuaucgcccaugauguugaccccauugagcuuguacucuuccuuccagcccuuugcaggaaaaugggaguaccauacuguauuguuaaaggaaaggcucguuuggggcuccuugucagacguaaaacuugcucagcuguagccuugacccaagucgauuccggugacagauccaacuucaacaaaaucgucgaagccaucaagaccaacuucaacgaucgcggugacgaaauccguaaacacuggggcggcgguuugcugggauccaaauccgcagcgcgaauugccaagaucgaaagggcgaaggccaaggaauuggcccagaaacaaggauaa

SEQ ID NO: 6797 - RNA, 999 nt, Ceutorhynchus assimilis
auggcaacccuaaaaaaagacauacaacucccagaaaaccuagucaaaaaaauccucuucaaaaaacacauagauuucaucaaugaauauggcaaagacgaaaacaauuucgaauauggaaugaccgauuaucuucgagucucugguauguauuggggccucacagcucuggaacuaaugaaagcacagccugugcaaaguaaagaccacauuauugcuuauauuaaacaaugccaggacccacaaaguagaggaaucagugcuuguauuggucacgauccccacauacuucauacacuuucugccguccaaauauuggcuauguacgauaaacuugaugcaauagacugcgaagggguugugaaguauguacaaagucuccagcaaccugacggaagcuuuucgggcgauaaauggggugaaaucgauacgcguuucucuuuuuguucuguuaugacguugacuuugcuuaaaaaagaggaugcuguugauuuggacaaagcaguggaauuuguucagaguuguaagaauuuugacgguggauauggaucgaggccucuaucagagagucacgcaggauugguuuauuguaguguaggauuuuuuucacuuacaaagagauuagauuugguggauagagauacuuuggcuuggugguugugugaaaggcaacuaccuucagggggcuuaaaugguaggccagaaaaauuaccagacguuugcuauucgugguggguauuagcaucuuuggcuauauuaggaagauuacauuggauugauggagaagcgcugaaaaacuuuauuuuugcuugccaagauacugaaacuggugguuuugcagauaggccuggagauguagcggauccguuucacacaguauuuggaauugccgcauuaucgcuuuugggucaggagaauguacagaaaguaaauccaacuuauuguaugccccaacaugucaucaagcgaaugggauuaaauccugaaauuuuaucguag

SEQ ID NO: 6798 - RNA, 2727 nt, Ceutorhynchus assimilis
augcaucaggaaacccuacaacuggugcaaguccuagaaaaaaccguaucgccggacaaaaaugaucaggaucaagccuccuccuuccuugaacaagcagcagccacaaaucugcugggcuucaucaaaacucuguccgacguccucagacauggcggcaacaguucuguggcccgaauggccgcugggcuacagcucaagaaucaacuuacagccaaagaccugagcaugaaagaucaauaccaacaaagauggcucgccuuuccugccgacguuagaaccuacaucaaaaaaaauguuguuggggcucuuggaacugaaacuaauaggccauccucugcggcucaauguguggcuuauauuggaguagcugagcugccaaagggagauuggccagauuuaauuucaacuuuaguugccaauguugugaaugcuacaucagaaaugcaaaaagaagcgacccuagaaacuaucgguuauauuuguucugaaauugacuccgacguucuuguaagucaaucaaaugacauucuaacagccauaguaaaugguaugcgaguaacugaacaaaauaaucacgucagguuagcagcuacaagggcuuuauugaauucuuuggaguucacuaaagcuaauuuugagcaaccaacugaaagaaacuauauuauggaaguuguuugugaagccacccaaucuccugaggcccaaauuaaaguuacagcauuggaaugcuuaguaaaaaucaugacacuuuauuaccaacacauggaagccuacaugugugcugcauuauuuccuaucacauuagaagccaugaagucagagaaugaugcaguugcauugcaaggaauagaauuuugguccaaugucagugaugaagagguagauuuauccauagaagauagugaagcucaagaagcuggcaggccaccuucucgaguuucgcgucauuaugcuaaaggugcccuucaguacauugucccaauuuuauugcaaaaacuaacaaaacaagaagaauuagaugaugaagaugauuggaaucccagcaaagcugcugguguuugcuugaugcugcuagcgacauguugugaagaagaaauugucccucauguauugccauucauuaaagacaacauuaaaucugauaauuggagauauagagaugccucucuuauggcuuucgguucuauauuggguggucuagauucugcuacauuaaaaccuuuaguagaacaagccaugccaacacuaauagaacuuauguaugauagcaguguuguagucagagauacagcagcuuggaccuucggcaggauuugugagauaauaccugaagcugccauaaaugaagccuuuuugaaaccauugcuggaaaguuugauuacuggacuuaaagcugagcccagaguuggagcaaauguuugcugggcauuuucagguuuggcugaagcugcauaugaagcugcuaaccgcgacauuggcggcggugaugauccaacuccugaaacuuauuguuuaucgcaauauuuugaauuuauagugcaaaggcuauuggaaacuacagacagaccagacggggcacaggccaaucuuaggccugcugccuacgaagcccuuauggaaaugauuaaaaauucgccuagggauuguuacguuacuguacaaaagacaacaaugaucauuuuggagagauuacaacagguccuucaaauggaaucucacauuaguaaucacaacgaucguucccaauucaacgaucuacaaucccuauuguguggcacauugcaaucuguuuugagaaaggucacuccugaggaugccccucaaauuucagaugcuguuaugacagcucuccuaacaauguucaacucaaacaaaagugguggaguccaggaagaugcacuuauggcuguuucuacgcuuguugaaacguuaggagaaggauucuugaaguacauggaugcuuucaaaccauuuuuguauuugggauuaaaaaaucaugcugaauaucaaguuugcgguacagcugugggacuuacuggggacauauuuagagcuuuaagauucaaagcucuaccauauugcgaugaaauuaugacacuuuugcuggaaaaucuaggugaaccuucuguacaccguagcguaaaaccucaaauucuauccguguucggcgauauaguuuuaaguauaggagcugaauucaagaaauauuuggagguuguuuugggaacuuuggcgcaggcgucucaagcccagguugaucggucagacuuugacaugguagacuaccugaaugaguuacgcgaaggaguccuagacgcauacaccggaaucauucaaggccuaaaaggcgauggaccgacaccuucaucagaaguggcugcacuagaaccccauauaccauucauaguucaguuuaucacaauugucgcgcaagauacugagcacucggacggaacuguggcugucgcugcagguauuguaggugauuuguguaccgccuucggcccuccgauguugccccuuuuggacuuaguucccaucaaugauaugcuagcacaaggacgaagauccaggguggggcguacuaaaacucuugccacuugggcuucaaaggaacucaagaagcugaaguaugcacagaccaacagccuagugcgccugcggccaguuggaaacuuguugaggugcagcagaaauuuuauugagaacagcacuauuuccuag

SEQ ID NO: 6799 - RNA, 1503 nt, Ceutorhynchus assimilis
auggaaacaauuuuggaacagcaaagacgcuaccaugaagaaaaggaacggcucguggaugccauggucaaagaaaaucuacauaaaaagaauucuuauagagaacaaauaaacucugaucaaagauuaaaauaucuacuggauagauauguaaugucaaccaauaaacuuauugaccuauaugacgacaaagauggccaaagaaaagcugaaguugcuucucuuacaggcccgaaugaauucaaugaauuuuauagcagguugaaacaaauuaaggauuuuuauaggagacauccaaaugagaucagugugccaaugucuguggaguuugacgaguuagcaaaggcaagagaaaauccuacugaggaaaugucaaauuugguggaauuuacugaugaagaaggauauggaaaguuucuggacuugcacgaaugcuaugaaaaauacaucaacuuaaaaggcauagaaaaaguugauuacaucaguuaccugaguauguuugaucagcucuacgacauacccaaagaaagaaaaacaggcgaauaccgaaaauacuuaaauugucucauagaauaucuauguugguuuauccaaagaauaaaaccuuuauugcauuuggacauucuuuuagaugacgaagcuagaaaggcugcuauagaaugggaaacggauucuuguccuggauggccaaaagaagcagggucugcuuuggcuaauguuggagcucauuuagacuugucugcauuuucuaguugggaagaauuagcuucacucggacuagauagauugaaaucugcuuugauggcgcuggggcucaaauguggagggacuuuagaagaaagagcacaaagacuguuuucaacuaaaggucaaagcucacuggauccugccuuaaugacuaaaacaacuaaaggaaaggcaagcaaagaaaaagaauuguugagacaaagagauuuggcuaugauggaagcucaaauuuacaaacuuucugagauaguuagugaccaacgaguagcaacuaaagaaaacguccaacggaaacaagccagaaccgauggcgaaagggaugacagugaaaaugaggaaucugaagacgaaaguggugaugaaaaugacgaugauguaccauauaaucccaaaaauuuaccccugggaugggacggaaaaccuauuccuuauugguuauauaaacuacacggccugaacaucagcuacaacugcgaaauuugugguaauuuuguuuacaaaggccccaaagcauuccaaagacauuuugccgaauggagacaugcucaugguaugagauguuuggguauacccaacacagcucauuuugccaaugugacacaaauugaggaugccuuagcauugugggaaaagcuaaagguucagaaacagagcgaacguuggcagccagaaacugaagaagaauaugaagauucucaggguaauguagugaacaggaaaacguaugaggauuugaaaagacaagggcuacuuuag

SEQ ID NO: 6800 - RNA, 651 nt, Ceutorhynchus assimilis
augacgauagguaagaauaacaagaugauccagcacauaaacuaucgugugcggaucacccugaacgacucucgaacguuuauuggcacguuuaaagccuucgauaagcauaugaacaugauuuugggcgacugugaagaguuuagaaaaaucaaacccaaaaauuccaaaguugaacgggaggaaaagcgaguacuuggcuuuguguuauugagaggcgaaacuguuguuucucugacuguagaaggaccuccgccaccagaagagggacugccuagaguaccgauuccaggagcaacuucuggaccaggcauuggcagagcugcaggucgaggaaugccugcaggaaugagcggagucccuguaggauuacaagguccagucagagguguaggcgggccaucucagcaagugaugacgccuggaggaagaggucaaauggcggguccaccacaaaugaaccacgguccaccuaggaugggugcaccuccaccaggaaugaugggcgguccaccaccugguaugaugggcaugccuccaaaugccaugggcauggguagaggugguccaccaccgccaccaaugggaauuagaggucccccaccugguaugaugagagggggaccuccuggaccaccaagaggauauuag

SEQ ID NO: 6801 - RNA, 1179 nt, Ceutorhynchus assimilis
auggacgcgcaacuguguaccucgggcguuguugccguggcagcauauugucuaauucaaaggaaaaaagcaagaaaaagacgauuuuggguacauccuauugucaaccaaagguuacugaaaggugcauuuguuacccuuuauucggaguuaagggagcauccaagaaaauuuuuuaauuacuuucguaugaguacuacgaccuucgacgaauuguauguaaaacuagaauccaaguugauccauaaaaaugugguuaggcuaucuauuucggcgacagaacgacuauguguagcucucagauauuuggcaacuggcaacacauucacagauuuacauuacacauaucgacugggcauuucaacuaucagcauuguuguggaagaaguuuguaccguuauuuggacuuugcucaaggaugaauguauggguauaccaaguaccgaaaagugggaaaacauuuccauggaauuugaagagcgugcaaauuuuccuaauuguaucggagccgucgauggcaaacacaucagaauuauuaagccgacaaaaaguggcucucucuuuuuuaauuauaagcauuucuucucaguccuuuuauuagccguuugugacgcgaauuauugcuucacuuauaucgauguuggagcauauggaaaguuuucugauuccacaguauucaaaaaugguccguuuuggcaaaaacuucaaaacgauucauuaaauaucccaaaaggaaaaccuuuaccuaaagaaaguauugcucaaccuuaugucauagugggugaugaagccuucccgcugacaaaaaauuuacuacggccguaugcacgaaagaaucuaaauuacaaaaaaaaaauauucaacuauagguuaacccgugcuagaagauauaucgaauguaccuucgggauauuaucaaauaaauggcgaauuuuucacagaccauugaauguaaguuuacgccuuucaaaaaaaauuauuaaagccugcugcauucugcacaacuuuguucguguaagagaugguuucaaguucgaagauacuuuaacaguucauggauuucgcgauucgacacaaagaauaccacaaaauucuacuauaaacacaacaagagaugcuuucgccaauuauuuuauaggcaguggacaaguggcuuggcaagauaguaaaauaaauuag

SEQ ID NO: 6802 - RNA, 15819 nt, Ceutorhynchus assimilis
auggaugaauuaccuccgguucuagauccagacgagcuuauggaucuagaagaaccggaaacuuaugaaauugaagacgaugacgaagaaauuguugaagacccaucaucaucucccuuucaacaguuuucuucuggaccggcaucuaaugcgacaucugcagccucaucaccacacaccaaugaugauuuuccaccaccuuucaauuuuaacgggaaaccuguuacuauuaaaaggggccguggacguccuaggagagaaggagguaaaccgacucccagacgauccgguggcguugguguucccagaguuagaagagcaaaaucugcuggauuuucccguuguagaggauccaggaguguuagacaaccagacagaauggauuuugauuuuucuuauaucagcccuacuucuauugaugacaugggucucacugacaucgaugguuuuuucuucccagaaagggaaagacccaguccaguuuuugaagaacuaccuuaugcaccagaggucuggccuggaaaagucugugcuuuuuguaauuugggugaacgcagucagcuaggacaaggugaaauaaugagauuaaauugcccagaugguuuuacgccucaaagaucagucggugaaucuaacacuccagcuguucaauuaccagauagggauuuuggugauaaaaguccgcgugguccuguuacaugcaggaggaauaaaaauuuuaauagaagucgaaguuuuguguccaauaaugaacauauagaugagcuuaccauaauuggacaugcugaagaaccaagugugaacauuuuguaugaaauaaguggacaauuuuauguucauagaaacugugccuuauggucaaaugggguuacccgcacagaacaucaagccuuagaaaauguuggaccaguuguacuaaaaaguucaucucagaaauguucauuuuguaaucauuucggugcaagucucacaugcaggucgaccgguuguacaaaaguuuaucauuucccaugcgccacugccucaggugccuuccaggauaucacuaguuugcaaguuuuuugcaccaaucaccuucacgaagcugccuuguguucggaauccgccauuugcuauacguguaaaagcgugggagauauuucaaacuuaauguauugcucaagcuguggcacgcauuaucauggaaguuguguggguuuagcucaguuaccuggcguaagggcugguuggcaauguagaaaaugucgcaauugccaaguuugucgaaugaugggggacgaaacuaaauugaugaguugugagcagugcgacaagguuuaucacgccagcugucaacgcccauuaguuacguccauuccaaaauaugguuggaaauguagauguuguagaguauguggcgacugugguucccgaacaccaggcgcuggucuaucuucuagauggcauuuacacuauacaguuugcgauucgugcuaucaacaaagaaauaaagguuguuguugcccaauuugucaaagggcuuauagaucacaugcucauagggaaauggugcaauguggaaccugccgaaaguuuguucaugggacaugugauccagaagcagauuugguaacauaucaacagaaaaaggaaauaaauccugauuaugaguaucauugcguuauuuguaaaaauucauugcagcaacucuccagccgcccugucacuagcaaaagaucaagucuagaugacuuuggagauuuguccgcuucccaagaaucuuuauaugaugacauaucagaauuugauaugccuucugaagaaucuuucagagggacaggguugggaaaaggcaaaccauaugcaaguaaaauugcgaagaagaaauugaguuauucaacuggaaugccugggagaccaaaggguaguuuuggcaaaggcaacccuggcaaacaaggauucaugaaacgucagcgcuuagucgaauuuggccguaaaagaggcgccaaagcuaaaauacgggguguguuuggaguaccgggaguuggauuaucucgucccguaucugaugguaaaggagacgaagaaccaggaguagaaaaccgacuaguuuuguguucugccaaagauaaauuuguucugacacaagacauuugugugauguguggagccuugggcaccgaccaggaagguugccuuauuucuugcguucaauguggacaauguuaucauccuaacugcgugaacguuaaaguuacuaaaguuauucuuaccaaaggcuggagauguuuggauuguacaguuugcgaaggcugcggucaacgcaaugacgagccuagacuaauucuuugugacgauugugauguaucuuaucauacuuauuguauggauccuccuuuggauuacguaccacauggaaauuggaaaugcaaguggugugcauguugucgaagcuguggcuccacagauccaggauuuaauagcacauggaugaauggauguacagaauguggaccaugugccucccauucagcuuguccuagcuguaaugagucauaugcggagggagaucuuauuauucaaugugcucaaugugaacggugguuacaugguauaugugaucucauuaaaacagaacaggaugcagaaaaaugcgcugaagauggcuacacuugccugcuaugccgcccuagagacgucccaccuccacacuuaauuccuuccucgauagcccccaaaccaccgacgccuacuaaaagcccugagguccgcucgcaacccaacaucuucgucgaugguguuugucucagcgaauggggccauagucuaauuaaaucccuuucccaggaguaucacgguacucgcaagaaacgcaagaaacuuccaccaguuguacaugauaaagaagcugguauaauggcaacuauugagucaguuguugcuggaggaaguggaggcgaaaauaguuuugaagauaccaaaauagaauuaguggauaugaaagacgaaccgcaagagcuuuauaaagaaggcaugauuuggacuaaagaagaugguucuccaccugaaggauuuacuauuuuuaccauggaaagugguauauguguuuuaaggagaaaacggcaaagaaaucugcaaaaauuggguauaggaggcuuuuugguucggaugagaggcuucaagagucaggaaaaugaugagauugauacuuuaccuggacaaaguacacuuaauuuugauuuaccaauaccaaugacgucaacacucgaaggcgauaaaccaaaaaagaaacccauaagacgcaagcaaaaaucuaaauuggcugaaacauuuccugcauaucuucaggaagcuuucuuuggcaaagaucuuauggauguaacugaguuuaaaaaagaaauggagggcgguguuagcagugacgaagauaaacuuuuugaaaauaagcagcaggcgaucaaguuaacagcagaggaacuacuggcaguugaaagugcuagacaagaaaagaccaccucugaggggcgcucucaaccgagagacggcuuuucagauacuuuaaaaauagauaaaccaauuuugauuaaagaggaagaggacgacacugcugaagacuugaaagauguacuugcuuugccuggcgacuuacuggauacugauuugguuaauagcauuauaaaugaagaugaugaauugacuaaaaacacagaauuggaugcuuuggcagaugaugacgcagaacuuccucagacuuuaggaagcucagaaaauucuaaagaugccaaagacgaauuaagugauauuuuaggaucacacuuuucacuagaaucuauaccuaauauaaauaguaaagauguugaggauauauuuaagggcguucuuaccgaugaaucgcaagaaucgcagcuuucccaagaagccacaaauauguauccuucaaugccauccacgccgacuccaauuaguccaauguuuccaaguaauucgucucaacuaccgacagcugguauaauaccucaaaugcauuugccuucagcuccaguuagaccgacugcguuaccuggaguucagcauguuagcuucccuccgucgccuuaucauucugaauauagcaauaguccccaguuuaguccggcguuuucugaaccuccaaguccuuggguaaacauaaacgacaacacagaaauggacacugccagcguugcaggugugccauccacccauaaucaacguucuucggaaaaaaugaaggcagaugaaggucucgguaauggggccacuauaucggcaguucucuaugccaauaggaaucauccagaauggaaagcugaguauccuguguggucugacagauacaagcauauuaucaaaaaguggagaacuuugagucaagacgagaaggcuccauaucuucaacaagcucgcgacaaucgaagccagcuucgaaugaagaaacaacaacagucacagaccagcaaggaaaccuccacaacgaguccugucgcucccacaaagccacccccuaccguaguaccggcagcugcuuugguuaccaaucugccuucaccgggguuaccaccaccuucgcucguuacacaggcgcaggcgcaacagaguccuaccgcgauaacuacugaggaccaagaaaaauuagcccaacaacagagaacagcccgagaggcugagcaagaaagacaauggaaacauuuacaagccaugagacagcaacaagcucagcaacaagcgcauguuauucaagaacaaagaguucaagcaauugcaagaguccaacggacaaugucagacccuaauccucaauuuauccccaccaaccaaacgaguccccuacaaguuaccacaacaucgcaagaaggcaguccuguggcuccuccaucacccagacaauuuaucgguauaaaaucgccaccauuugcccauccuucaccuccuuccacuaauauucguacuccuaccucuucacagucuccgguucacgaguuccagcaaccaaaucagcaaacuccgaauccugaggaauccuuuauagaacccacuaguccgcaagucaauuucucuaaaguaccaaccggaaaugaggcguuuggucaaccgccuccaccgaggaguccauuuguugcugcaagaccgcccaugcaggcuagaccggaucaaccagaaaucgcacgucaguugcgggaguugcuccagaggcagcagcagcaacaacaauugaaaaacuucgauuuggugcaagcaaaaucaacucaaagaaucuggaauccuaaugauccgccugcaacugaaccugugaaugcgggugcgacugcagaagaaauaacuuucaggcaaccacuaccgccuggauccguaagacccagaaucccauuacaacuaggacccaggccugguccaaaucuccguaugccgcaauuagaaggcaggcuucaagggcucgauccuagauuaagacucauucuacaccaaucaagggcugcucugccuggccaacaaguaccggcaggcgguauacgcuucacccaaggagcaaaccgaccggcaacaaucgaacaauaugaacaauuguugcaccgacaagcucagcuacaagcuagaaaucaagcuuuagagcaacaaggugucggugugagguugccuuuaggacaaaguggugguggggugauucagaaacaaccuuccucgauaacucaagcaaugccuguaguucaaccagcucaacaagcggcugcaacaaaugaccaagaaauaccugauaauguaacugcagaacuagaaaaauuggaacaagaaacuggcacaauggccgagcugcaaggugucagcgaaauauugggagguuugggagaugaugacgacgaacuccuagcugaaaugggagcagauuucaauauuuuggaguaugcggauccagaauuagaagcauuagcgggagagaagacaaacauucuggauuuggauuuggaagaugacaauaugaagcaggaaaagaagagggaagcuaugaugcaacgacaaaauaaugucucuucugcccaaacagcaacgucucaagcgacuaaaacuguaguugcaaguaauucacagaaagaacaaaagcuagaaaaacgaccaaccuccacugcugcagaagagccgcauaaaucagaugcaucugcuuuaccucaaccuaauaauaauccuccacugccucuucaaaaacaucaacaaguuccucaaacacaucaaguuucucaaaaacaucaagugucucaaaaacaucaaguuucucagaaacaucaaccucauuccgauaauaauuuacguccucaaacgccagcauuggcagaucagucucaaaaucaaauaacucaaaauuuaucacaacagcguguuguacaaaauauauccucaucgcaaccccaacuagcccaggcuuuggcuaauaauucaaauccacaacaacagcagcaacaacagcugccucagccagagccucccguguuacagcaacaauuacaacaacaguuacaacaacaaccaccacaauuacaacaacaacaaccuucuccuucccaacaucaacccaauauugcuuuaacagcccagcaacuccaucaacagaugcugcagcagguaggaugcaaaauguccaaauauguacagcaagcugcugcuaugggaaaaccgaugccaccgggauccaaacuacaaaccccugaagguauugucggcauuguuuuggcuaauaauaauguccaauugcaaauaccuccgaauuuccaacaaagacugcugcaaacauuacaaaaucaaaaacuccaaaugcgaaucgggcgaacuguuccccguccccaacagccgaauauaaaucaacccccucagccuguuccuggacaaauagcaagacccagaauggcuuuaccaacgccaccuccaccgccuccguacccugguccaccgccacccuauccagggaaucucauggcucagcaacaggcaaugccucagcagaugggauugagaauggggccugguuuucaucaucacaugggacucgugcauccccuggcacugcaggguuucccgaugcacccacacuuugagaggagaccgcuuuuacuggaggaacagccucuguugcuggaagaucuauuggaacaagaaaagagagaacaggagaaacaaaaccacaaucauccucuaccuucagauaucaacacaagaaguaacgauucagaaucggcuuuguguguuagcgaucaugauuuugaaagacucaaagcugauguauucaguagugggcauucugauaccucaucuucagacuccacaguuggcauggugcaacaacaauggcaaccuaaucgucuacagaugcccagugcgccaacucaacacacuacagaaguuacgaccaaaauucaaauguucaaugcaaauuuaaugccugcuccgccacuaccaucagaaaauaucguuacggaacaagacaaacaggcucaacuuuuauaugagcaguggcuuaauaaucaaaauaauguuuugacucagcaacuucgauacuaugaaacugaagugcuaaaauuacguaaaaguaaaaagucauuaaauagcaagcaaagacagcuaaggaaaucuggcaaucagcuaacugaaauugauucaaaugagcuacaaaggauuucugccgagcaagcuauuuuacaaaaacaucuagaguccagcagaaagcagagucgucaacauggaaugcucauacaggaauaccggaauaaacaacaacugcuccagaagccccucaugggcgggccgcagacgcaacuagccuccccucuaggaccuccaggaucuucuccaauacaucacgcagcugccagucacucacccauguugucaccgcaacagucgccuuugccucagcagucuccauugacgcagcauaauucaccuaugaauaguccggguccuaugaugguucauucuccagggccuggaucaguggcugcuuuguuacagaguccaggcgggagugugucuccaauacagacuaggauugggacaccauugucucaagaaggaagcccagguccaauccaaucgccuucccaaguuugucugccaccaccgaugccucgaaugacaucuccccaacaucgccgagugguaaccagcccuguuggauauacaggagauaugcgcaguggagugacacaaaugagauuuaugagacccaccguggaacauaauucucugcaacguaucagaggucaagcgccuggucaauugcagaauuuccccucuaaaguuggcacuccaucuccucucaauaguccaccucugaaucaaaugucacuggcucaucagcaaauauuacaaaagcaauugcaucagcaucaacaagcuuugcuucaucaacaacagcagcaacaacaacaacaacagcagcagcaacaacaacaacagcagcaacaacaacagcagcaucaacaacaacagcagcaccaacaacaacuacaacagcagcagcaccaacaacuacaacagcaacagcaccaacaaauacaaauuuccgaugguacucagcaacaagaagcaaauguuaugcauucuccccgcguugcccaauuaauacagcauagaaaucuuggacgaccgcagcagcaacaacaacagcaaacuuugacggcucaacaacaucagcuuuugaccaaacagcaucaacaaauagcucuucaauuacaagcaaggcugaaucaacaaucucagcagcaaucaccuacuccacaaucaccaaugccuccaaaaagucccaugcacaaccagaauaugucuccucuaucgaugcccaccucgcccaugccuccaaaaagcccuauguugucuuucaaucaacagcaaagcacuccuaauucuccagcagcucauagaaauucuuacucucaaaauccuacuaugaaucaaccuccgaguagucccaugaugcaucaauaucaucaaccuacuucuccuaugauacaaucuccacacgcaauacgucgaccuccaagcaguccugcuaugccugagaggcccuugagcguagaaaauccugguacgcccagaacuccuuacaguuuagauaugcaucuucaagauaauaugcacacagggggaggaaauccuaauaauccaaauaauccaauuccauugccuccugauggguuuugcuacucuaagcuaggcuuaagaggcgguauguggagcggauuuggaagaggagaaaaacgagucccaacaccuccuacaagcucaucuacuagugaaacugaaaagcaauuaccaguugaaguaacuacuuugaacaaaccuaaaaaagaggcucauauuaauaaaguuuccauucucaaaaagaggacaccacugccaaaaaguaguccuaaaucuauuauaaccagcaaaaucgcugauuuuacagaauaugaugaaacuucuucuacaucuccugcuucuacaucuucuuuauuagcuggacguggaggggcaggacugaaaccccugucaaaacaagaugccacuggggauaaguuacaacuuccugaaaugguggauuaugaggaugacaauaguacaauacuuucuucagagauuucguuauguuccgcagcucagcaaaacgaugacgaaauugaaauaacugaaacucuuucacaaaaugacauuggugaagucuuaucaaguccaauggaagcugaucaaauuucggaugaguuuaugcuguuucaagaaaauauguugguugaucauuugaguggcauucaauauucagauaaagaagaaacugaggaggaguaugcaaauauugucauucgaaguccaacuacuagugaugaugaauuuauuaugcaaggccgaacaaagaaauauaauauauugaacauugcagaaacuucugguucuccagagcaagauaccacuauggagccauccacagagccagaagaugaggaaauuacucagccauuugacgaaucggaagugguuauuauugagcaaccuguaaaaucaccugaggaacaaauuucaacuaaagaagauuuugaagaacuuauugaugaagguucucgaaaagaaaaaaugaagcaagacacaaaaaguguaguugaaccuccacaauuuacugcugccagcguguauagguuuccuucuaagaccccuauuacuguaacuagaacucaaaacguuaugacaacagcaaaaguggcaccaaaaauaucauuaauuacaacggcgccaauuauucaaaauuucacugcucguucugaggguggaaaacugaaugcagaaacucaacaacuuauauuaacuccuacaacaaaaauaacuaccacaaaugcagguucaaagcuaacaagcauuauuuugacacauaauccuguuagaaguaauauuuugaaugugggacaaaaacuuguaacaucaucaccaggaauuacaauuguuagugccaguacuucucaaauagcuucgauuuugccuuccaaauuuaguguuccaauuaucagcgcaagugcagugaggcaacugccaaacguaaaaguuauugacaagcccagcucuucgcuaucuuugacgccacgcgauaguacuuugcccaauaaaauauuugaagaugaaucagucucuccagaaaaugcaaauuuugaugaugaaaagaaaaauuuauuugaugagaaguugaaggcagaauuuaccgcagcuaauggaagaaugccaauguuugggaaaaaugucauugcaacaaauaauaaaaaugaugagaauaacacuagucaacguaaaaaugacaaaucugaaauuaguaauauuguuacuaaagaaaaaguucaagucauagcuaguccaauaauagcgaaaucuguaucuccuguaauaauucaucaugcaccaccugaauugaaaaugacggcucaaguaauccaagaaacauccacucguaugcaaauaacugccacugaaacuguuaguacuuucaugggugaugguucagucgaagauaaaucaguaguuauuuccauaccuuccccuacgccaucucaagaacaaaugcuugauaauauugcuuugcaagccuuggaggagaauaggaaaagagaauuugauucuuucgauuauguauugaauaugauugaaaacaugcaacauucagaaacuccagagcagucagaugaacaaaauacugagaaaaaaucaacuaaaccagcaguaaaagaggaagcuaaugaaucuacugcaaauaaacaaacuaugccgcaguugucgccuuuaucacaaccagcugaucugaccacaaauauggcaaaugcgucucaacaguugaggaguuugcuuuccaauauacaaacuacaaguucuucucaugugcccaaaguugaaacucuuguaaaaaccgcaaauaaacaaaaaauaaucaauguuacuucuucaacuauuacuuccccuguuguugcuucaagaauaauucaacaagcaacaacuacaaguaaugucaguacuguuauaguuccuaauguagucaagcaaaaaguaacucuugcaccuacuaguaaagcuagaacaucgaguacagaaaguuuuuuaacuaaccgauuucuaggaagugaaccuaaauccacaacaucuacuccaucucagacaacugaaacuaucaauaaaucuccagaucucaauaaaaaagcuucacuaacguuaaccgcuaugcuucaaaaucaaccaucagcuacucccacaacaaaauccucaccugauacaauaacugcugccaguuuauuagcuacuccugugagccugucaagaacuaguuuuucaccggcuuuggcucuagcacaacccaaugccauuauagcuaguagccuagcuaauacuaguaccaguucuguaauuucgucugcuuucaaaacaaucacuucaacaaacuuauugcauacucaccuaacuaagucgagaacuaaaagucuugaugauauuaaagauuugaaaacugaugaucaaaagucugaagcugauauuauaacaagcauaaaacaggagcuuagugguuguagauauuuacccguaacuucgucaagucaaauaaauaaaugugaagacucgcagaauguccuauuaaagcaacuucuucagaauacugcuugugcaagcacucaaucgccgccaccaaguacuacauccacaauaacgacagcuccaacuacugaaguucagaaaguuagcccaccaacuuugucaucuuuacuuccuccaguaacuaaaaccgaaguucaaccuacuaguaccccucagucaagaccuccaaugcaaagagguuuaauacgagaaacuuccuuuguuucuagcccaauaauucaacauacuccaacuaguacaacugucgcagcuaccacuacaacucaacagcuacauauugauauuaaaaaaugugcuccuguaguuaggccuucuaguagagaugauuuacuaucuccacccacuccgagaucgugcgguagucaagagucuaguuuacaaacgcccccguuaauagucaaaaaagaaaguccagcuucuacuucuacaugucuuaguauugagggcaucaaaaaagaauuacuagaugaaucuucccaacacucggaaauaucugauuugggcaaagcugacauucaaauaaaagaagagucugagccaggggagauuagugauaaaauuauuguugauaaagaagaauuaaaaaagcaaaaaaggagaauguauaaucaaaagagacgucaaaaucaguuacugaacaaagaguugaauaauaaaccuaauaagagaccgaggaaaaauuccaaaauugaagaagauuacgauucuuauauagacaguguuuuaaaccagauaaggcauuugcauccuaugguugucucagaaccugcuauaguacgaaaucauggaauuuuaccaguuuuuggcucuggcgauuuauccaaauuagguacaaaaucuuucgaucccagauuuggugauuuaacugguacuuauggcaacgcaucgauucccggauauucagauuuuuauaauacaauuccuuauggcgaugaagaacccauuccugaaaaaccaccagcuucuacacagagaggauuuuaugaucaagaauuuccucuuauuaaauuugauacagaagaugauaagaaguuugauuuguuuuccagagaagauacaccagauucaauuguuaguuguucuucccccgaaugugaugcuuuugaugcuucugauagauauuuggguuugaaacuuauuagugacgaugaagaagaagaagaauuauccaaggguagacguucgccgaaaauaccaauaguuaaacccauugcuauuaaacuaaaagccgcuggcuuguucuugaaagagcccgcuacuacgaaaauugcuucggauaauaauaaagaaaauauucugaaagaaauggaucaggaaaaacugaaaccaaauccuucgccuucagguccaguaaaagauaaugaaaauauuaaaguuacgcugacguucacaucaucggcugcugaagauauugucggcgugcuaagagauuuggcgaauauuuuacaaauuccuccaccuaccucuuaucagauuguugauagaacuucuucaccgacuagucagaagcugggauuguaucggaccaagggaaaagauggaaaggaaggagcuccuaucgauauacagaguauccuuaauggggcagcaaaguuuuguaaacauugugacguaguuauucuaaacaacuuggugaaaaagaagccuucagauuugccauuuuugucaaaagauuccgaauuacuaagugaaggagaagaacuauauuuuugugguucuucuugcuacaugcaauuugcuuugaugaauagaucgccgucuauuccagaggacaaggcugcggcuaucauagaucaucuaucacaaaaagacugucaaaacuuaaagcaacauggacaacuucaagauccuuucgauucgaaaucagcucucguuaaccguuuguugacagaaaauaccggauucaaucaguacuuugguggggccuucaaacaaacuaugaaauuugggucguucaaaccaccugagcaugcaaaaagccauagaaaugcgucgguuaaauuuuggacuccuggaugcuugcagccuagucacaagcauaagaaaccuacugauaaggagaugacggaaaugcuguaucagauggggauuacgguuacaccuucaaaauugccugacgauaccaggaagugcauguuuugucaaguuauuggagaugguguagcugacgguccagcucgcuugcucaacaucgacguagacaaaugggugcaccucaauugcgcccucugguccgauggagucuacgaaacaguuaauggcgcccuuaugaauuuggaaaacgccaugcagcaaaguuuaaccucaacaugcauccauugcaguaagcugggagcuacaauacgauguuuuaaaaccagauguucgaguguauaccauuuaucuugugcuguaagagaaaacuguguuuucuauaaaaauaagacuguuuucuguauggcgcauguucccaaacaugaaaaagauaaugaguugacuaccuuaucagugggcaggagaguuuauauaaacagagaugaaaauagacaaguugcugcugugaugcauaauucagauacuaauaauuuauugaggguuggcaguuugauuuuucucaauauuggacaguuauuaccucaucaguugcaaaacuuccauacaccaaauuauauuuauccuauagguuauagaauaauccguuucuacuggagcaugagaaacgugaauaaaagaugucgcuacauuuguucuauuaacgacaauaugggacgucccgaauuucgaguguuaguucaagaacguuccgaagaagauaccgaauuuaaagacuuuacaccuaaagcagugugggcaccuauucucgaaaaaauugcuagcauacgaaaagaaaacaagugccuacaaauguucccuagauuuauuucgggugaagaucuuuuugguuuaacugaaccagcuauuguuaggguuuuggaaagucuaccuggaauugagacacuuuccgacuauaaguuuaaauauggaagaaauccgcugcuggaauuaccuuuagccauaaauccaacgggugcugcuagaagugaaccaagauuacgccaucaaacucauuggaaacguuuccauagaacuacaggaucuaguucgagaccuuuguuugcaccacuuccuuccaacgcaucagcgcccucuucuuuuggagaaaguguaugcccuuauagcaaacaauucguucauucaaagaguucacaauauaaaaagaugaaacaggaauggagaaacaauguuuauuuggcgaggucaaagauucaagggcuuggauuauaugcagcuaaggacauagaaaaacacacuaugguuauugaauauauuggagagguuaucagaagugaauuaucugaauguagagagaagcaguaugaagauaggaaucguggcauauacauguuuagacuugacgaugacaggguuguggacgcaacguuaagcggaggucuagcacgguacaucaaucacucgugcaacccuaacuguguagcagaaacuguugaaauugacagagauuugaaaauuaucauuuuugccaaaagacgaauucaaaggggagaagaauuggcguacgauuacaaguucgacauugaagacgaucaaaauaaaauauccugcauguguggagcaccaaacuguagaaaauggaugaauuaa

SEQ ID NO: 6803 - RNA, 2058 nt, Nezara viridula
augaguagcaaacauaagcauaagaaauaugaagaaaaggaggagagaagaaagaaacacaaaucucgguacucagaugacucagaggaugaaggggaaagaaaaaguuccucaucaaggcaucaguacaagaagaaaaaaaaugaccacagucauaagcauaaaaaagaaaagaaaaauaaaucgaaaaggucugaaaguucagauucaaguaccaguucugauucaucaucugacaauucaguaaaacuuuuaaaaagguuacaugauaagcaugaaaaaaugauucaacaaaaaaagaaagaaaaagaacugaugaagguaaaugagacuccagaagaaaaaaggauuaggcgacuuuugaaaaaagaagcaaaagaaagaaaaaggaaacaacguaugggaugggacaaagauuauuuacacuauacuaauacugacaauccauuuggugaugcaaacuugcuuuccacuuuuguuuggucaaaaaaacuagcaaaagauggacucacagauguaucccgugaagaauuagagaggauuaauagaauaaaacaagaggagaauaaaauagaauuagaaaagguuaaaaagagacgacaagagagagaacaagaaaggcaagaacgggaagaagccaugaugagauugcagcgcgauaaggaagcugaacaguuugaggcaugggcaacgcaggaagaucaguuucaucuugagcaagcaaggcugagaucaaggaucaggauagcugaugccagagcaaaaccuauugaucuucuugcaaaauauaucaauucagaagaagaaguggaugcuguugagaugcaugaaccauauacuuaucuuaauggucuaucaauuaaagaccuugaagaccucguugaagauauuaaggucuauaugaaauuagaaaaaggaaaaaauuuggauuacuggaaugauauuacuguuauuguugaagaugaauuguauaagcugaggaaaaugggaaagaaaucagacuaugaagcagcuguuggcagaagagaagguauucaugaaucuguagcuaaagaaguaucuucagucuucagagguaaaacagcuucacaacuugcagccaugcaaaaacagauugagaagaaaaucagugauaaaggugaaggaaucgauauuggauacugggaaucucuucuuucccaacuaaaagcucauauggcacgagcucgucucagagauaaacaccaagaaaaccuaaaacagaaauuggaauuacucaaagcggaacaaagacagcaagaacaagaaauaaaagaagaaccucuagacgaaucagaacaacaggagaaugaaaauagugaugaaaucaaagaagaaaaagaagauagugaagaagagcauaguggaggugaugaggaugguggggagucuaugcuaaaagaaaguuucggagaguacgaagcuggagcauacucaccaguuuauguugauccugcaagucuugaaccuggaacucuuaucauuggugaagaggaggaugcucagaggcuggaguaugcuaggcagcaucuuaccucucaagaaagucaggugggagcuacaucugaagaguuggcaaugcaaagggaagcacguaaaggcaugucuagugaugaagccauauuuucaguugaaucugcucucgauucucaaguguaucuguggucagauaaauaccguccucgaaaaccaagauauuuuaauagaguacauacaggauuugaguggaacaaguauaaucaaacccauuaugauauggauaauccuccuccaaaaauuguacaaggauacaaauucaauauauuuuuuccagaucuuauugauaaaacaucaacaccagaauauuaucuuaccacuuguccugauaaucccgacuuugcuguucuucgguuucaugcuggaccaccuuaugaagacaucgcauuuaagauuguuaauagagaaugggaguauucguacaaacgaggauucagaugucaguuccacaacaauauauuucaguugugguuucauuucaaaagauacagauacagaagauaa

SEQ ID NO: 6804 - RNA, 1209 nt, Nezara viridula
augggggacgcuaauauuauugauaaaucuaugagaucgguguucguggguaauauuccuuaugaagccacagaagaaaaauugaaagauauauuuaaugaaguugggccuguucucucauucaaacuaguuuacgaucgggaaacuggaaaacccaagggcuaugguuuuugugaauauaaggaucaagaaacagcucucagugcuaugaggaauuuaaauggauaugaaaucgguggacggucuuugagaguugauaaugcguguacagaaaaauccagauuagaaaugcaaagucucuuagcuggaccaccaauugauaauacauauggggagucaguggaaucugauaaggcaccggaagcuauaagcaaagccguugcuucauuacccccugagcaaauguuugagcuaaugaaacagaugaagcuuuguauacaaaacaauccuacagaagguaaagcaauguuguuacagaauccucagcuagcguaugcucuuuugcaagcccaggucgugaugaggauaguagauccacagauugcuaucacaauguugcacaaggccaacccaagcguaccuccucuucagccgccuccugucgaggcaauacggccugugccugugccacagccugcuccagcugucgcaccgccuccaguuguaccgccaauagugcagacgagaccugucguggaaccggaguggguaccuccggcuaggccgcaucaaccaccucauccaccaacauucauuccucaaccagguggugauuuagauaugagaacauuggacccgaggguaccaccggugagauugaaucaagaccaagacuugaggauaccuccgaugguuccagcgccucagcagccuccggcucagccuccucagccguacccucaggaacaugugauaucaaguacuguucgggauccaagacaguaucgugauccucgcacaggugcagcaccuguucccgucccgccaagaccgguuguugcccaggcaguggugccaccacgaccuguagcuccuccacccagucauaucacaucagcgcuuccuccugcggcuucagaccaggagaaggcugccuuaauaaugcaaguacuacaacuuuccgaggaacagauagcaaugcucccaccggaacagcgucagagcauccuugugcucaaagaacaaauagccaagagcacucaacguuga

SEQ ID NO: 6805 - RNA, 1188 nt, Nezara viridula
augacggcuucucaagcaauggaaccaaacagagaaaaggcuuuacaagauuaucguaaaaaauuacuggagcauaaagaaguugaagucagacuuaaagaaaugagagaccaguuaaaagaucuuaccaaacaauaugauaaaucugaaaaugacuugaaagcccuucaaaguguuggucagauuguuggagaaguauuaaagcagcuuacugaagaaaaauuuauugucaaggcuaccaaugguccaagauauguuguugguuguagaagacaacuugauaaauuaaaacuuaaaucuggcacgaggguagcauuggacaugacaacuuuaacaauuaugcgacauuugccgagagaaguugauccauuaguguauaacaugucucaugaagauccaggagauguaacauauucugcuauuggaggucuugcagaacaaauuagagaacuucgugaggugauugagcugccucuguugaauccugaacuuuuucaacgaguugguauuacuccaccuaaaggaugucuacuuuacggcccuccugguacuggaaagacuuuguuggccagagcuguagccagccaauuagaugcaaacuuccuuaagguagucuccagugcuaucguugacaaauauauuggagaaagugcucgucuaauuagagaaauguuuaauuaugcaagagaucaccagccuugcauaauuuuuauggaugaaauugaugcuaucggaggucgacgauucucagaaggaacaucugcugaucgugaaauacaaagaacucuuauggaacuucuuaaccaaauggauggauuugauucucugggacagguuaaaaugaucauggccacuaaucgucccgauaccuuagacccugcucuucuccguccuggcaggcuagacaggaagauugaaauuccuuugccaaaugaacaggcaaggcuagaaauccucaagauccaugcugggccuauuucuaagcauggagauauugauuaugaggcugucgugaaguugucugauaauuucaauggagcugacuugagaaauguuuguacugaagcuggccuuuuugcuauucgagcugaaagagaauauguaaugcaggaagacuuuaugaaagcugugagaaaaguggcugacaauaagaaacuugagucaaaacucgauuacaaaccaguauaa

SEQ ID NO: 6806 - RNA, 777 nt, Nezara viridula
auggcuagacguuaugauucaagaacaacaauuuuuucuccugaagggcgcuuauaucagguagaauaugcuauggaagcaauaagucaugcagggacuugucucgggauccuagcaaacgauggcauuauucuuguagcugagaaaaggaauacuaacaaacuucuugaugaaucaguauauucagaaaaaauuuucaaacuaaaugagaacaugauaugcaguuuagcugggaucacagcugaugccaauguucugacuaaugaguuaaggcuuauuucucaaagauauuuguuacaauauggagaaacaauuccuugugaacaacuugucucgugguugugugacaucaaacaagcauacacucaguauggagguaaaaggccguuuggaguauccauauuauauauggguugggauaagcacuauggauaucaacuuuaccagucugacccaaguggaaauuacucugguuggaaggcaacauguauagggcauaacaguggugcagcuguuuccaguuugaagacugauuacaaagaaggugaaaugacagugaaagaugcuuuggcuuuggguaucaaaguucuaaguaaaacauuagauacugcuaagcuuucaguugauagaguugaaguugcgacauuaucucaaaagaauggaaaauguguuacuuguauccuaccuacugaagagguucaagaacuuaucaaugcauaugaaaaaucagaagcugaggcuaaugcuuuaaaaaaagaaaaaacuccaaaaucuuaa

SEQ ID NO: 6807 - RNA, 2643 nt, Nezara viridula
augacgaaaauucaagaaccacaacaagaagaaaugucugaagaagacaaacgacuucaagaagaacucaauaugcuuguggagaaaaucacgggaacagacacccacuuguauauuccugcguuggagagcaugcgagaccugauaagaaguuccaccacaaguaugacaucagugccaaugccccugaaguuucuuagaucucauuauggugcucuuaaagaggccugugcugucauggcagauaaaaaagcucaggagcuuugugccaguauagucucuguucuugcgaugggacaggaucuaccaggggcucgagaaugucugaaguauuguuugcaaucacaucagaaagaaguuggugauuggggccaugaauauguuagacaauuggaaggagagauagcggaugaaugggccucuacagaagaaaaagauaagcugcuagguuugguggagaguauaauuaaauuugauauggagcauaaugcagaaauccaagccugugaucucuugauggaaaucgaccgacuugauaugcuggacaagcucauggauuugacuaauuauucuagaguuugucuuuacuugauuaauugugcaguuuauguagaagagccagaaagaggaaauauuguaaaugguguuaugaaucacuacaugcgauuuaaggaauauccccgugcacugugccuugcuaugcaauuaaauaaacaugacuuaaugauagacaucuuuaaccaaugccaagauccauugguucguaaacaguuggccuuuaugguaggcaggcaacaguuaagucuggaauugagugaugaccuaccugacaaaucagaucucacuaacaucaugucuaaugcccaugugaaugaucauuuucacaguuuaggaagagaguuggauaucauggaaccuaaaaccccagaagaaguauauaaaguuugguuagaaggguugguccuucgcccaacuuacaaucuggaaguaccucucgauucugcuaggcauaaucuugcuucuacauuuguaaaugcuuuugugaaugcuggcuuuuccagagauaaguugguaucaguugaagauggcaacaaguggauguauaagaauaagcaacacgguauguugagugcugcugcaucucuuggccugauucauuugugggauguugauggagggcugacucccauugacaaauaucucuacacuucugaagauuauaucaagaguggugcauugcuggcuuuggguauugugaauuguggagucagaaaugauugugacccugcauuggcucuucuuucugauuaugugcuucaugagagcguuacuuugaggauuggugcuguuuuagguuugggucuggcuuauguugggacaaaacgacaagaugccauuacccuuuugcugccagugcucuccgauucgagaucgacaccagagguugucgcuauggcagccuuggcaugugcccucauuacacuuggcacgccucacccugauguuguaucaaccauccugcaaacucuccuugaucuuccuguagcugagaugacugaaggccauuauuccaaguuuuuaccucuugcacuuggcuuauguuaccugggucagcgagaagguacugaagcuacaaaagccgcucuugaagcacuuccggaaccuuugaggucuuuaucacaacauauguugaagaugugugucuaugcagggacuggugauguacuugucauccaggagcagcuucaagugugcucagaacauuacccuacuccagaagaaaagaaagaaacugauaagaaggacaaggauaaagacaaagacaaagaugagucgaagaguaguaaagugaaggacaugacaugcaugcaggcaguggcugcucuuucuguagcagugauugcuaugggcgaagagacaggaucugaaauggccaccaggauauucgcacaauugggaagguauggugaaccugccguacggagagcuguaccuuuagccauagcuuugucuucgauaucaaacccucaguuagcuguuaucgauguucuuaauaaauauucacacgaccucgacgaagaaguugcccacaaugcuauuuucucuaugggucuuguuggugcaggcacuaacaaugcuagguuggcuaccaugcuacgucaguuggcacaguaccacgcuaaaaauaccggucacuuguuuauggugcgcauugcucaaggauugacgcaucuugguaaagguacucuuucacuuuguccguuucacacugauaggcaggucaugaacuauucagcaguugcuggucuucuuaucacccugguuuccuuccuggacacaaagacaauaaugcuuggaaaaucccacuauuugcucuacacacuugcgacugccauguacccaaggugguugguuacgcuugaugagcaucuggaaccacucccugucuccgucagaguuggacaggcggugaaugugauugguaaagcuggaacuccaaagacgauagcugguguccauacucacacuacuccugugcugcucgcuguuggugaacgugcugaacuggccaccgaggauuauacuccucucacaccuguuauggaaggauuugucauucucagaaagaaacaaccagcauga

SEQ ID NO: 6808 - RNA, 1302 nt, Nezara viridula
auggagccuccagcggcagagcagccccaacagcagccggagcaggaggcaggcguaauccggcagaggacaaucaccacguccggcacgaucaccaccaguccccagccggaggccaguccgucccccgaacagccagcucaggaacaugaugcucgaagaagcgggaaggacguggaggugccguacgagaucgugcagcugcggccggggaccuacgacgagggguacagccuggaggaggcgacgcgcuacagccccggcuccggccgcuacuacaccaccgacggcagcgucaaguacgagcgggacgacaagggcgaaggcagcuacgucacgcuggagccugucaacuauccgcccggcggcgccuaccaggagcccgcggccggcuacuacaccuacaaggaggaggaggaugucuacaucaaggcggacccgccgcucacaccgaagaacuucgcgcacuucgaucauccggucaccucgcauccgacacagcucagugcacagguuacuuacgugacgggaggaggcagccgaggagaguacgugacggccaaccagccuggcuacugguccagugaguacgucuaccagcagccgcagcaggagauccagcugccuccaggaacacccuacgucuucuccagcaaugggcaggcuaccugggccaucgacgagucuuacgaucccaauaugcugucuacgagcgacaucaaggagugcguaaacugcgcggcgagcguuaccccgcuguggagaagggacgggacuggacaccaccucugcaacgccugcggccucuacagcaggaucaacggaguacacaggccaccggugaggacucaccacaagaaaguacacaauauuggcaacagaagaaauggcguaagcugugccaacugccagacaaauaauacaacccucuggcgcaggaacaauacaggagaaccagugugcaaugcuugcggccuguauuuuaaacuacacgguguaaauaggccucauaccaugaagaaggaagguauccaaaccaggaaacggaaaccaaagaacccccaaguaaaccuuccaaguccuaaaaacgauauaaagacaacaggugaaaaaucaggcaguugggauaaaugugacaacgaccuacuagacaguggauauacgauggcuccaucauccauauuucuuccuaguuccuuuuuaacaaagccuguaggagucaguguaucuggcuuagaaaguguaccacccagugucaucauuccacccacaucgagucaagacacacagagaacugaauaa

SEQ ID NO: 6809 - RNA, 5439 nt, Nezara viridula
augucauuaccaggagggaaaauggcuugcccuggaaaugggauuuauguuauucaaggagaaaugucuguucugcuuacugcuaugaagaaaguaaacagauggucuucucauguccaccaggaugaugaaaaugauauucuuaucagaagcuucacugaucucaaagacguuuuaaaucagauuggugaucuuagagaaguagagccaaaccauuuucuuagccccuuucuggaaguaauuagaucagaagaaacuacuggaccuguuaccagucuugcuuuauccucugucaacaaguuucuuucuuauggauuaauagauucgaagucgaagacaauugcagcuacuguugaaaacauagcagaagcaguuacuagggccagguuuguugggacugaccaaaccaaugacucaauuguuuuguuaaaaauuuugcagguucuucgaacuuuguuacuuucuccugaagguuguuggcuuaccaaugaaaguguuuuagaaaucuugcugaguuguuuucgaauguguuuugaaccccguuuaaaugaauuguugaggagaugugcugagaauuguuuacgugauaugguucaauuguuauuuagucgacuuccuaguuuuacugaggauaauaggaaaauccagcaaaaacucaaaaugaauacuagugccccuuuggauucagguaaagggaagaaaaaaaccagccgaccauccuccagaaaaguuuccaggaaaagucaagacaaaucuccaagcccuguauuugguucagaaguuucaaaugcucugaaagaaugugauauccagcaauugcccuuaccugaugagccaccaauuacaucucaugauaaauuagaacccgagauucuuacugugccuacugaggagucgcuagcuaaaauuccaucuaaugguucacuugaaauuaauucuguuaauaauguuuccaaugugaauaauuuggaggaacaucaaaaugccacuucaucagcgauucuugaugaugguguuauuaucaguauugaagauucaaguucccaaaauagugaaucaacagaacaacuggcaaccauugguaacuuguccgaagugaagaggccagaugacuuagaugugaauccuucugaaacuaauuucgcuucuccguuggauucgaaagcggaagaagaaccuuugauaaguccuacaacuccugaaagcccuguagaaggacaagauuggacaaaccagcaagggguuagguuuaccaauacugaaagugauacaacagcuccuucugguccuuacggacugcucagugcucaugagcucuugagguuuuuggcuucucuuugcaauccucuagacaagcagaauucagauaguaugauucacaucgggcucacucuuaucacuguugcucuugaaguuggggccgacagcauugcgaaguuuccuucacuuuuaucaacugugaaaaaugaugucugcagaagccuuuuagcuuuguuaaauacugaaaaacuuccaauuuucgcaucagugcugcaaguuucauuccuucuguuugaaucucuucgaacacaucuuaaauuucaacuggaacguuauuuaucaaggcugacugaaauaaucauuucugauuccucaaagauuucauaugaacaccgagaaauagcacuagaaucugucguacaucuuuggcgaauaccuggcuuagugacggagcuguaccuuaauuaugacugugcucuguacuguccuaauuuauaugaagaacuaaccaaucuuuuaucuaaaaaugcuuuuccuguuacugguguuuacaacacccauuuacugucauuggaugcuuuauugacugucauagacucuauagaaagucacuguaauaguagaauauuaaaugaaaggcaaaauccaucaaaagauggagaaauuaauaaauuagaguuccaugauuuugccagcaauuauauccaucgcacuggcacccgucaaaaguugucauugaauaucccuagucacgagcaauugauggcugugaaaagaaagaaaaagcuccuggcuacuggcacugaacauuucaauucaaaaccuaaaaaaggaauccaguuuuuacaggaacacaaccuguuaucgacaccucuagaugcuguugaaguuguuggguuccugagagaaaauccucaucucgauaagaaaaugauuggggaauacaucaguaauagggccaacauugcuauacuugaucaguuugucaagucauuugacuuuacugagaugcgcauugaugaagcauuaagguuauaucuagaaacguuuaggcuaccuggagagucuccucuaauaucuuuagugauggaacauuuugcugaacauuggcauaaauguaauggagagccuuucgcuaaugcugaugcagcauucacacuugccuacgcgauuauaauguugaauguggaccaacauaaucauaauguuaaaaaacaaaauacuccuaugucaucagaugcuuuuaaacgcaacuugaaaaaugugaauggagggcaagauuuugaagaagaaaugcuugaugaaauuuauauugcaauuaagacugaagaaaucguaaugccugcugagcagacuggucuaguuaaagaaaacuacgaguggaaaguauugcuacggcgaggaaccggaccagaagguuguuauguacaugcuccuaaugguuuguuggaucacgaucuguuuucucugauuuggagcccgaccauuucagcuuuguccuauuuguuugauaagaccaaugauccaacuauuuaucagaaagcuauaucuggguucaggaaaugcgcaaugauaucagcucauuauggaaugaguaaugauuuugauaaucugauugugucacuuugcaaauauacuaugcuucauuauagugccgagaguccagaaaaucuuacuaucuccuuuggaucgagcccuaaggcuagacgugcugcuaaaacaguuuuugaccuugcucaucgccauggugacauaauuagggaaaguuggagaaauauuuuagauuguaucuugcaacuguauagguguaaacuauuaccaaagauccucguugaggcugaagauuuuauugaauuaagcgguaagauaucucuuauacgugaagacauacaacucagcccuaaaaccgaaacuggaauccucagcucauuauauucuuacauagcucucggagcagaaacgaauacucaaaaaggaccaucaguugaagaucaagaagccauuaaaguugcacagaauuguauaagggagugucaucucgagcagcuuauuacggaaucuaaauuucugcgcauugauuccuuacaacauuuugucaaggcacuugucacugcaucuuauggaccugaaggccacguuucucucgguacuucuuauagugaggauacugcuguauuuuucuuggagcuccuuuugaaagucguuauucagaacagagaucgcauuucuucaauuugguguucugugaaagagcacaucuauacccugcuuaugggcgcugcugcuugugaucaccacuuccuaguugagaggucugucguuggucuccucaggcuugcgauucgcuugaugcacaaagaagaaaugggaccuaugguauugcaaucucuucgcaugcugcuccuccuuaaaaguucuacauugucacguguuucucgucagguuucauaugguacauuugagcuuuugaagacaucggcagcaaauauucauuccgcuaccgauugggcaauaauauuuacccuuuuggaaugugucggagcaggugcuccuccuccgaaagucguuucgaaaccugucaguucuacugaaucagcaggcgcccggucggaaggagaagugcagguggauagcggacuggguaacgaaaggggcuauacuucugauucagagcuaagcaaagcugguaguguuccuuuaucaccuagucugaguccagaggcuccucuuagcaacacuccuacuggcuggauucuggugggccgagaaggugaaauccaaccgguaagcugugugaggagaacaauguugccagaauugucucgcuaugaucccuuaucgauggugaagugugucgacaguuugucguuucuagucagggauguuguucauaucacgccauacaauuuucaugauuguauucguugcauaaggacauuuguugaagcagcagcuaauacaguugaaaggaaaagcagaaaaucugggagggauacggcuaggcaggcuaagaggaaaaguacaaaaaggagagaagaacgaggacucagccccacaggaagugccuaugaugcagaugaaagugauccugaggauucgccugguuaucagcaaguuuguauucagcuuuuggaacugaugcauacccuucacacaaggacagcucagaucuuucgauggugggcugaagagacaggacagaaagaaguggccaaccccucuuacuggacuccagguuggugcccucuucuccaaggcauauccaggcuuugcucacacccuaauagagcuguucggaugucagcaauaaccuaucugcaaagagcgcuucucaugcaagauuuacagucccucuccggagaggaaugggaagaauguuuuacucaagugcuguuuccacuccuguccacucuauuaucuguuaauauuccagcgauugaagaaacaaggauaagggcagccacuguacuauccaagguguuccugcaccacuugucuccucugcaaacccuuccuaguuuugcacagcuauggcugacuauacuugauuauauggauaaguauaugcacgcagacaacagugaccuacuuuaugaggcuauuccugaaucauuaaaaaaccucuugcuuguaauggacucggcugguguuuucaauggauuagacgggcgcaaugagauuugggucguaacuugggaucgaauuagcucauuccuucccaaccuucaggcagaccuauuuaaagaucaucuaccaguuguagaugcuaguucacuugaaacaaaagaagcuuuagaaacaucuaaaagugaaacagaagucguucaaaccgagcaaccaacauugcaaaggccuccaggcucucaacagucaucuccucuaccuccguuaaugccuaaaccuggagaagcuguugaaauaucuggaccuacgacuaacaauaauguugguucacagaauuggcaaccuccugcuccugucuacccucaucuugagcagaugguuucaacuccuaucggcccagcaagucaucucccaguuuacucuggauuugcgaguaugccacaucaacccccucccccgucggcccaauuuuucuaucaggacaugucuucuucaagcccgccuaauaugauccaaaguucugagcaaccugcagguauacuaagaaucauauag

SEQ ID NO: 6810 - RNA, 618 nt, Nezara viridula
augucaaucuuagcguauaacggcagugcuguaauagcuaugaagggaaaagauuguguugcuauugcuucagacuugagguuugguauucaagggcagacuguuucgacuaauuuugaaaaaauuuuugaaauggguccucacuuauacauuggacuuccuggguuaacuacugauacauuuaccguucuaaauaaacuuaaauuuagggcaaacauguuugaauugaaagaagauaggaaaauagcuccagauguguuucuuucaauggucucgaauuuguuguaugaaagaagguuugggccauuuuuuguugaaccuauaauugcuggauuaaaaccaaaaacguuugaaccuuuuauagcuucgauggauuuacuugguuguccuaacaaaccugaagauuuuguaguggcaggaacagcuucugaacaacucuacggaaugugugaagcucuuugggaaccagaucuuaguccugaagauuuauuugaaacuauaucucaagcccuuguuaaugcuugugacagagaugcacuuucggguuggggagcuucuguuuacauaauagagaaagacaaaguaacccacaggagaauaaaaacaagaauggacuaa

SEQ ID NO: 6811 - RNA, 2778 nt, Nezara viridula
auggagucaucuccgucauuggaaacaguccaucaggcuguuuacgcucuuuaucauaauccagauccugcugaaaaagagaaggcuucauuauggcuaggccaguuacaaaaaucuguuuucucguggaaaaucgcugaugaaauacuacauaccaguacagauguugaaugcuguuauuuugcagcucaaacuaugagaacuaaaauccaacauucuuuucaugaacuuccuccaggaucucaccuuccuuuaagagauucuuuaauggaucacaucagcaaaauuaaugagacaacaaauucugugauugguacucagcuguaccuugcuuuggcagaucuagcauuacaaaugggaucuugggaaaagccugcaauugauuugauugaacgauauuccaugacuucaguuccuccccuucuugaaauguuaacauuuuugccagaagaaguuaauuccagagcuuugcguuuggguucuaaccgaaggcaagagcuucuccacaaguuuucacuugcuguuccuaaugucuccgaguuccugaaaaugugucucaacaauucuggaaauaauccucaaauucaaaucaaaguuuucaagugcuuuacaaguuggguaucaguacaggcgaugacucuuaaugauguaacugacaauauaguuguggcuacagcuuuccauguucuugccaauagaauggcaucauccaauuuacaugaagcagccgccgauuguguuugcucucuucuugaaugccuugaagauaacaauaaucaacaaucgaucgagaugcaacuguucaacggagucauuucauuagagcaaccguuucauauuucugucgcacaugaagaacaugaaaaguguguuaauuauugucgaguauuuacagaacuugcugagaguuuccuagaaaaaauaguuagugggaguagucccaacaaagcacauuuugcuauuaagauuuucgaucucguucuaacuuguguuggucaucaugacuaugaaguagcugccauuacauuuaauuuaugguaucgucuuucggaagaauuauaccaaaagaaaaacucuggacugaccucuuuauucaaaccauacaucgaaaggcuuauugaagcauuauguagacauugucagauggaacccgaucaugaagggauccuugaagaaggggaugauuuuccugauuuuaggaugaaaguugcugaacugauucgugaugucguauucauaaucgguucuuccaacugcuuuaggcaaauguuuauuucccuacaggggccaaauaccaccugggacaccacagaagcagcguuguuuauaaugcaagcugucgccaaaaacauuauuccggaagaaaacgauguugucccuaagguugucgaggcaauuuuaaaccuuccuccaaacacacacauagcagucagaucuacaucaguucuccuacugggagaauugugcgaguggauugaaaagcauccccaauauuuagaaccaguauugaauauggugcuguucugucuucagcagccacaguuggcgaauucagcugcaaacuguuuacaaaguauaugcaguacauguaaaaaucaaaugguggccaaauuuuuaggccuucuccagauacuucaaucucucgacaaauucguucugacgaaugaaucaguugucggacuuuuaaaagguguggcuucaauauugagcauaaugcaccccgaucaguuacagcaggcuaugagggauguuugucucauccagauuaagccacuuguucauuuaauugagaaugauguuaaacuggagaaagguacaaaaacagauccagcaguuuggauggacaggcugucugcuauauuccgccauaucaaucucacuguuaggaauggugaaauucauccuugucaaccugucauaaccgaaauauggccaguucuuuccuccguuuguucaaaauaccaagccaacucacaugugauggagagauguuguagaugucucagguucgcuguucguuguguggguaaacagucugugaauuuacuugaaccguuagucaaacagauagucucucucuauucucaacacgagcauagcuguuuccuguaccuugguucuauccugguugacgaauaugcuucugaaccaggcugcauccaagggcuguuagacaugcuucaagcuuucauucacccgacguuuacccuccuucaaggagaagcgggccugaaauugcacccagacacuguggacgaucucuucaggcucugugcgagguucuugcagagggcucccauggcguuccucaccucgcccgccaucaacuccauccuggagugcgcccuuucgugcaucccacuugaccauagggaugccaauucuucaguuaugaaauuuuucuaugaccuaauucacgcuggaaugacuaaugaagaucacgaagauuucgcauugaggcaaagacugguacaaaauauaauccaagaaaaggguucagauuuaguaaacaaucuucucacagcaucaguuuucuuccuucagauauauaugcugucggauguagcggacguuuuaauggagcuaauauuacuugacaagcaggcugcuggcagguggauagaacaaucauugaaaagaaugccaacgcacaacaguacaggaaguauuaccgcaacaccaaagcaauugcaagauuuccaucgcucucuacucagcgccugcaguuccaaaacucuuacaacuacacugaaagaauuuucucgccucuaccgcuga

SEQ ID NO: 6812 - RNA, 1173 nt, Nezara viridula
auggcgcaaagguuuccuccgucgcaaccaacuccgagcccaguucagcagccucaaagauauccuacgcccucaggaccuccacucaggcaauaugcaaccccuacguuuccaggaggugguaugggaagcgggaugaugccucguccccagcagcaaccguacaaccccaucagaccuccgauuccucagucccaaaaaaggccuagcgaugucagaccaccacaacaacaaccaaaaggggaguuuccucauacauccgcugguggaaguaguggcaagaagaaaaagaagcuggcagauaagaucuuaccccagaaaguacgagaccuggugccggagucacaagcauacauggacuuauuggcauucgagagaaaauuagauucuacaauaaugagaaagaggcuugauauucaggaagcguugaaacgucccaugaagcaaaaaaggaaauuacgcauuuuuauuucuaauacuuucuauccagcuaaagaggcaacugagacggaagaaggcaguguagcauccugggagcugagagucgagggaagacuguuggaagauucuaaaaaugauccuaacaagccuccaccguuacagguaaagaggaaguuuuccucuuucuucaaaagucuuguuauugaguuggauaaagaacuauacgggccagauaaucaccucguugaauggcacagaaccccuaccacacaagaaacagaugguuuucaggucaaaagaccaggugauaaaaauguuagauguaccauacugcuccuuuuagauuaucagccuuuacaguucaaacuugauacccgacuugcucgucuucuaggaguucacacucaaacaagaccuguuauuauaagugcgcuuuggcaauauauuaagacucauaaauugcaagauccgcaugaaagagaguauauaaauugugacaaauaucuugagcaaaccuucaguuguccaaggaugaaguuugcugaaauaccgcagcgucucaacccucuucuucauccuccagauccuauagucauuaaccauauuaucaguguugaagguaccgaacagaaacaaacagcuuguuacgacaucgauguagaaguagacgacacauuaaaaacacagaugaacaacuuccucuuaucaacagccagucagcaagaaauacag

SEQ ID NO: 6813 - RNA, 435 nt, Nezara viridula
augccuaaaguacgaagaagcaagaagccuccaccagaugguugggaacuuauagaaccuacccuagaagaauuagagcagaagaugagagaagccgaaacugaaccccacgaggguaaaagaaaaguugaaucuuuguggccaauuuuuaaaauucaucaccagaaaucgcgauauauauaugauuuauauuaucggaggaaagccauaaguaaagaauuguaugagcauugucucaaugaaaauauugcugauaaaaauuugauagccaaauggaaaaaacaaggcuacgaaagucuuugcuguuuaagaugcauucaaaccagagacacaaauuuuggaacaaguugcauaugccgggucccaaaggccaagcucgaagaggguaagauuguggaaugcauccacuguggcugucgaggaugcucuggauaa

SEQ ID NO: 6814 - RNA, 1029 nt, Nezara viridula
augaaagugcuacuugagagugauguccaacuaacuacucauuuuuggggagcaucggacuacaaggauaaacuuagcguugcgauaggagaaccuuugguucugagcucagaugccaguugggcgaaucacauucuccuaggacacccugcuaugcccacagccacaggacacaguggggucaucccaaguaaugaagaaugcggcauucgcgauguaugggcucauaaucugaaggaugaauuuaaaguuaucaggaagaucauucauaaauacaauuauguugcaauggacacugaauuuccuggagugguggcaaggccuauuggugaguuccgaaguucagcugacuaucaguaucagcuucuaaggugcaauguggaucuucuccguaucauucaauugggacuuacuuucuuggaugaaaauggaaaagcuccagcugguccuuacaguaccuggcaguucaauuuuaaauuuaaucucucggaagauauguaugcucaggacaguauugaucuucuucaaaauucuggaauacaauuuaagaaacaugaagaagaugguaucgacccuguugauuuugcagaacuucucaugaccucagggaucguccugauggagaauauaaagugguuauccuuucauaguggcuaugauuucggauaccuauugaaacugcuuacgaaucagaacuuacccaaugaugaaagcgaauucuuugagcuucugaaaaucuacuucccuacuguuuaugauguuaaauaucucaugaagaguuguaaaaauuugaaagguggucuucaagagguugcugaccagcuggagcuuacgaggguaggaccacaacaucaagcuggcucggauucguuauugacaggaauggccuuuuucaaaaugagagagauguuuuucgaagauaauauagacgauggcaaauacugcggucacuuauacggauugggugcauccuuuguugugaacgguaacaguuuccacgacaacggagacaacucaaguaauucauga

SEQ ID NO: 6815 - RNA, 1206 nt, Nezara viridula
augucugacucacggagaguucaacugaaagaagacuugucuuuuguggaguuugaaacaagcgaaaauguugaaguuauaucuucuuuucaaagcaugggacuuaaagaagauuugcucagagggauauaugcuuauggauuugaaaagccaucugcuauucagcaaagagccaucauucccauaguucgugguagagauguuauugcacaagcucaaucugguacaggaaaaacugcgacauuugccauugccauuuuacaauccuuggauacccaaacaagggacacucaaguuuuauguuugucuccaacaagagagcuugcuguacaaauacaaaagguuauucuugcuuugggugaucucaugaauguucagugccaugcuuguauaggaggaacaagcuuaggagaagauauuagaaaacuugauuauggucaacauguuguaucugguacaccuggucguguuuucgauaugauaaaacggcgaacucuaaggacaaggucaaucaaaguauuaguucuugaugaagcugaugagauguuaaauaaagguuucaaagaacaaauuuaugauguauaucguuucuuaccuccagcuacucagguaguucuuauuucugcaacccuuccccaugaaauucuugaaaugaccagcaaauuuaugacugacccaaucagaauuuuaguuaaacgugaugaauugacauuggagggaauaaaacaauuuuuuguugcuguugaaagagaagaauggaaguuugacacacucugugauuuauacgauacuuugacuaucacucaagcuguuauuuucugcaauacaagaaggaaggucgauugguuaaccgaaaaaaugagggaugcaaauuucacaguuuguucuaugcauggugauaugccucagaaagaaagagaugcgauaaugaaggaguuuagagcuggaaaaagccgagugcuuauaacaacagacgugugggcuagagguauugauguacaacaggucucccuugucauuaacuaugauuuaccgaacaaccgagaguuguacauucauaggauugguaggucaggaagauuuggaaggaaagguguagccaucaauuuugugaagagugaugauauuaggauuuugcgagauauugaacaguauuacaguacacaaauugaugaaaugccuaugaauguugcugaucugauuuag

SEQ ID NO: 6816 - RNA, 1599 nt, Nezara viridula
augacgcaugccgcuggagauggacacaggucacacaguaaugucuauaaggacaaaaguaaaccacaagauguucgaaccaguaacaugacugcggcuaaaggccuugcugaugcuauucguacaagucuugguccuaagggcauggacaaaaugauccagaaaggaaacggagaaguuacuauaacgaaugauggugcuacuauuuuacaacagaugaauguuaugcauccugcugcuaaacuuuuggucgaacugucucaagcucaagauguugaagcaggugauggaacaaccacaguugucauauuggccggagccauaauggaagcugcugaaaaacugaugaaccguggaauucauccaacaacaauuuccgaugcauucagcauugcaguugaaaaggccaucccaauuuuaagagagaugucuauuccucuacaacaaaacgauaacgaaagucuuaucaggagugcaucaacaucucuuaauucaaaggucguuucucaacauucaucgauauuggcuccauuagcugugaaugcuguucuuagaauuaccgacccaaagaaagacaaaaaugucgaccuaaaagauaucaagaucauuaagaaacuuggaggcaccguggaagauacagaacucauugagggcuuagucuucacgcagaaguuggcaaauauaaacggaccaaagcgucuugagaaagucaaaauuggucucauucaguuuugcauuucucccccuaaaacagauauggaucacaacguggucaucuccgacuaugcagcaauggacaggauucuaaaagaggaaagagccuacauacucaacauugcgaagcaaaucaagaaggcuggauguacuauguuguugauccagaaaucuauuuuaagggacgccuuguccgauuuagcuauucacuucuuugacaaguugaaaauuauggucgugaaggauaucgagagggaagauaucgauuucgucuguaagacucucggcugccgacccauugcgucuuuggaucacuucaccagcgaggcucuggucagugcugagcuagcagaagaaguaucggcaggaucuucucguaucgucaaagugaccggaauucacaauccugcgaagacaguaacaauucuaguucgaggaucuaacaaucuuguccucgaagaagcugaucguucuauucacgaugcucuuugcgucauccgaugucuuaucagggaaagagcucuucuuccuggagguggagcucccgagauugaguugucucuucguuuaggacagcaugcucagguuuuggggucgguggaagcuuauuguuugagggaguaugccaaagcuuuggaaaucguuccuuacacucucgcugagaaugcuggucucaaucccguagcuacuguuacugaacuuaggaauaagcacguucauggccaaaccagugcugguauuaauguuaggaagggccagguaacagauauucuugaagaaaauguccuacagcccaugcuggucacagcaagugcuaucaccuuagcgacggaaacagucaggaguauucuaaaaauagaugacauucugaacgucgcucacuga

SEQ ID NO: 6817 - RNA, 1248 nt, Nezara viridula
auggaugaaauugguaucguucuccccgagaaagaagaaaacagucaagauggaaaguuaaguaccauacuaggacagaauuugucagaugacagugauaguagugauuuauucaccaaguuuaagaaauuacagagacagcuugaauuuuuagcuguucaggaagaguauaucaaagaugaacagcgaaauuugaagaaagaauauuugcacgcucaggaagaagucaaacgaauccagaguguuccuuuaguuauuggucaauucuuagaagcaguugaucagaauacuggaaucgucgguagcacuacagguucuaauuauuaugugaggaucuuaucgacgauugauagagaauuauugaagccuucggccagcguugcucuccacaagcacagcaaugcccuuguugacgugcuuccgccugaagcagauuccuccauuucaaugcuucaagcugaugagaaaccagauguucaguauucggacauuggugguauggacaugcaaaagcaggaaauucgugaggccguagaauugccuuugacgcacuucgaacucuaccgccagauugguaucgacccuccuaggggcgugcugauguacggcccaccgggcuguggcaaaacuaugcuugccaaagcaguugcucaucauacuacugcugcauucaucagaguaguuggcucugaauucguucagaaauaucuuggagaaggaccgagaaugguucgugauguuuucagacucgcgaaggaaaacgcuccggccaucaucuucauugaugaaauugaugcuaucgccacuaaaagguuugaugcucagacuggugcagauagagaagugcagaggauucuauuggaacugcucaaccagauggaugguuucgaccaaaccacaaacguaaagguuauaauggcuacaaacagagcagacacauuggauccugcucugcugcgacccgguaggcuggacaggaagaucgaauucccucuuccugacaggcggcagaaaaggcucgucuucuccaccaucacugccaagaugaaccucuccgaggagguugacuuggaagacuacguagccaggccggacaggguauccggugcugacauaaaugcuauuugccaagaggcuggaaugcaugcuguccgggaaaaucguuauaucguccuugcgaaagauuuugaaaaagguuauaagaacaauauuaaaaaggacgagucugaacacgaguucuacaaauaa

SEQ ID NO: 6818 - RNA, 489 nt, Nezara viridula
augccuaacaucaaguugcagaguucugauggagaaauauuugaaguggauguggaaauugcaaaauguucaguaaccauaaagacuauguuggaagaucuagguauggaugaagaugaagaagaaguuguuccuuugccaaauguuaauucugcuauuuuaaagaaaguaauucaaugggcuacauaccauaaggaugauccaccaccaccugaagaugaugaaaauaaggaaaagagaacagaugacaucucaucuugggaugcagacuuuuugaaaguugaucaaggaacucuuuuugaguugauuuuggcugccaacuaucuugauaucaaaggccugcuugauguuacaugcaaaacaguggcuaacaugaucaaagguaaaacuccggaagaaauucguaaaacauuuaauauuaagaaugauuuuucggcugcugaagaggaacaaguacguaaagaaaaugaauggugcgaagagaaguaa

SEQ ID NO: 6819 - RNA, 930 nt, Nezara viridula
auggaagauaagacuucguuaaaagaacuggaucaguggauagaacagcugaaugaaugcaaacaacuuaccgaaagccaagucaaaacucuuugcgauaaggcaaaagaaauauuagcuaaggagucaaaugugcaagaagucaaaugcccugucacaguuuguggagauguacauggacaguuccaugacuuaauggaacuguuuagaauaggaggaaggucuccagacacuaauuauuuguucaugggugacuauguugauagaggguauuauucuguggagacagugacauuacuaguagcucuaaagguaagauaucgagaaagaaucacuaucuuaagagguaaucacgaaucacgccaaaucacacaaguauaugguuucuaugaugaauguuuacguaaauauggaaacgcaaauguuuggaaauauuucacagauuuauuugacuauuugccauugacggcucuuguuaauggucaaauauuuugucuucaugguggucuuucaccgucuauagacacucuugaucauauccgugcuuuagaucgucuucaagaaguuccacaugaggguccuaugugcgacuugcuuuggucagauccugaugacaggggugguuggggcauaucuccaagaggugcugguuacaccuucggucaagauauuucagaaacauuuaaccacucuaauggucucacucuuguguccagagcucaucaacuuguaauggaaggcuauaacuggugucaugaucguaauguuguaacaauauuuucugcaccuaauuacuguuaucguugugguaaucaagcagcuauaauggaguuggaugaugcgcagaaauauucauuccugcaguuugacccagcgccgaggagaggagaaccacacguuacuaggagaacuccugauuacuuccuauaa

SEQ ID NO: 6820 - RNA, 927 nt, Nezara viridula
uuugcagguaaacagcucgaagauggucguacauugucugacuauaauauucaaaaggaaucuacucugcauuugguccuucgucugagaggaggcaugcagaucuuuguuaagacacuuacugguaaaacaaucacacuugaaguugagccuucagacacaauugaaaaugugaaagcuaaaauucaagauaaggaaggaauuccuccagaucagcagagguugauuuuugcagguaaacagcucgaagauggucguacauugucugacuauaauauucaaaaggaaucuacucugcauuugguccuucgucugagaggaggcaugcagaucuuuguuaagacacuuacugguaaaacaaucacacuugaaguugagccuucagacacaauugaaaaugugaaagcuaaaauucaagauaaggaaggaauuccaccagaucagcagcgauugaucuuugcuggaaaacaguuggaagauggucguacuuuaucugauuauaacauucagaaggaaucaacacuacauuuaguauuacguuuaagagguggaaugcagauuuuuguuaagacgcugacuggaaaaaccauaacuuuagaaguugaaccgucagauaccauugaaaauguaaaagccaaaauucaagauaaggaaggaauuccgccagaucagcaaaggcugaucuuugcaggaaaacaguuagaagaugggcguacucuuucugauuacaacauccaaaaggaaucuacuuuacaucuuguacuuagacuucgaggaggcaugcaaauuuuugucaagacuuuaacagggaagaccaucaccuuagaaguugaaccaucugauacuauugagaacguaaaagcaaaaauccaggacaaagaaggaauuccaccagaccagcaacguuugaucuuugcuggaaaacaa

SEQ ID NO: 6821 - RNA, 1629 nt, Nezara viridula
augcaaccacagauaauacuuuugaaggagggaacugaaaguucucaggguaaaccucagcugguauccaacauaaacgcuugccaaauaaucgcagaugcaauucgaacaacccuuggcccaaggggcauggauaaacuuauuguggaugguaaugggaaagcaacaauaucaaaugauggugcuacuauuuuaaaacauuuggauauagugcaucccgcugccaaguguuugguggauauagccaaaucucaagaugcugagguuggagacggaacuacaagcguaguccugaucacuagugaaauuuugaaacagcuaaaaccauacguugacgagggugugcauccuagaauaaugaugaaagcagugagaaaggcaacacaauuauguuuagacaaaauuaacagcuuagcuguuaagauugaaaagaguagugcagaacaacaucgcucucugcuggagaggugugcugcuacugcacucaguuccaaguugauucaucagcagaaagauuuuuuuucgaaaaugguuguugaugcuguguuguuguuagaugaacuccuuccacuugaucucauuggaaucaagaaaguaccugguggagcuuuggaggaaucuuuguuggucucugguguggcauuuaagaaaacuuuuucuuaugccggcuuugaaaugcaaccuaaaaaguacaccaauccaaaaauagcuauucucaacauugaauuagaauugaaagcagagagggacaaugccgaaaucagacuugauaauguagaggaguaucaaaaaguaguagauguugaauggcaaauucucuacgaaaaauuggacacuauuguuaaaucaggagcucagguugugcugucuaaacuuccaauaggcgauguugcuacucaguauuuugcagacagagauauguucugcgcuggucguguugcugaugaagacaucaggagaacacagaaagcaugugguggcacuaugauuaccacuacuaaagauaugucagcuucaguucuugguacuugugaaguauuugaagaaagacaaauugguggugacagauauaauuuguuugcuggcuguccaaaugcuaaaacauguaccaugauacugagagguggagcugaacaguucuuggaggagacagaaagaucucuacaugaugccaucaugauugucaggagaacgauuaagaaugacgcuguuguugcaggugguggagcuauugaauuggaacuuuccaaaauguugcgggauuacucaaggacuauugcaggcaaagaacaacuguuaauaggagcaguugcuaaagcuuuagaaauuauuccacgacaguugugugauaaugcugguuuugaugcaacugcuauucuuaacagacucaggcaaaagcaugcucaaggaagcugcugggaagguguugauguagcacuugaggauaucuccgacaauauggagaaauguguuugggagccgucaguaguuaagagaaaugcuuuagaagcagcuugugaagcaguaugccugauccuuucuguugaugaaacaauuaagaaccccaagucaggagguggcgggcagggagaccaaccaaugaugccuccgagaggcaggccuauguga

SEQ ID NO: 6822 - RNA, 5226 nt, Nezara viridula
auagacaggauauucagacagccacaggggcacuugcugcucaucggugucucuggagcuggcaaaaccacucugucucgcuuugucgccuuuaugaauggacucucuguauuccaaauaagaguucauaauaaguacacuagugaagauuucgaugaagacuugagaucaguucuaaggagaucugguuguaaaaacgagaaaauagcuuucauccuugaugaaucaaauguucuagaauccgguuuucuagagaggaugaacacacugcuugcuaacggugaagugccugguuuauuugaaggugaugaguacagcacguugaugacccagugcaaggaaggagcccaacgggaaggauugaugcuggacucuaacgaggaauuguauaaaugguuuacgggucaagugaugagaaaccuccacguuguguucacgaugaacccgagccaugaagggcuuaaggacagggcugcuacaucaccugcucuguucaauagguguguucucaacugguuuggagauuggucggauggugcauuguaucagguggguagagaguucacuaacacucucgauuuggauggaccuccuacuuggaaagcgccagacuuuuucccaauugcuuaugcaaauuuaccaucaccuccgaaccacaggcaagcaguuauaaacggauguguuuuuguucaucaaacuuugcacaaagccaaucaaaggcuuaccaaacguggagcacgcacaauggccaucacuccuagacauuacuuggacuuuaucaaucauuuuguaaaguuauauagagagaaguguucugaacuugaagaacagcaacuucauuugaacguugguuuaggaaaaauagcagagacuguugagcaggucgaagagaugcaaaagaguuuggcaguuaaaucucaggaacuucaagcuaagaaugaagcugcuaaugccaagcuaaagcagauggucaaagaccaacaggaagcagagaagaagaagguucagucucaggaaauccagucccagauugaaaaacaaaaacuacuuauagcgcagaagagagaaggugugauggcagaucuugcccaaguggaaccagcuguuauugaugcucagcaggccgugaaagagauaaagaagcagcagcugguugagguuaggucuauggccaacccucccgcuguagucaaauuggcacucgaguccaucugccuccugcuaggugagagugccacugacuggaaguccaucagggccgucgucaugagggacaacuucaucaauucuaucgucaacaauuucucuacagaaaauauauccgaugaaguuagagagaagaugcauacccguuaccugaguaacccagaauacacauuugaaaaaguuaacagggccaguauggcuugugggcccauggugaagugggccguugcccagaucaguuaugcagacauguuaaagaaaguggaaccacugagggaagaauugcgaucauuagaagagcaggcuggugagaaugaacaaaaaggagaagacacaaaagcacucauugcgcaguuggagaagaguauagcagcuuacaaggaagaguacgcccaacuaauacaggaagggcuugcgauuaagcaagauuuagaaaacguucaagcuaagguugaucggucuauugcucuccugaaaucucuuggucuugaaagaucaagaugggaagccacaucagaaacauucaagucucaaauggcgaccauuauuggugaugucuuacuaucuucagcuuaccuugcauaugcugguuauuuugaccaacacucucgacauaaccuucugucccgguggacggagcaccuuaguucugcggguauccaguucaggcaagacauagcucuuacagaguaccuaucuaauccugaugaaagacucagguggcaggcaaacagucugccgaccgaugaucuauguacugaaaaugcaauuauguugaagagauucaaccguuauccacuaaucauugauccaucaggacaagcuacagaauucauuaugaaugaauacagagauaaaaucaccaagaccaguuuccuagaugauucauucaggaaaaaucuugagucugcucuucgauuuggaaauccuuuacuuguucaggauguggaaaauuaugauccuauuuugaauccuguacucaaccgugaagugagacgaacugguggcagaguauugauaucauuaggagaccaggauauugauuugucaccaucauuugugauauuccucucuacuagagauccaaccguugaauucccaccagauaucugcuccaggguuacguucgucaauuucacugucaccagauccucauugcagucgcaauguuugaaccaaguacuuaaagcugaaagaucugauauugaugagaagagaucugaccuucuuaaauugcaaggugaauuccaucugagauugagacagcuagagaaaucuuuauugggagcuuugaacgaagccaaggguaagaucuuagaugacgacucugugauuacuacguuagagacacugaaacaagaggcugcagagaucaguaagaagguugaagaaaccgauaggguaaucggggaaauagagacuguuucacaacaguauaagccucuaucacaggcaugcagcaacauguacuucacccucgauucuuuacaccaaauacacuuccucuaccaguacagccucaaguucuuccuugauauuuucucagcuguucuuuucucuaauccaucucuggauggacuuacugaccacacccagaggcugggugugauaacgaaacagcuguuugcuguuugcuaugagagaguggcucgagguaugcugcauacugacagauugacacuugcauuguuauuaucuagaauauaucuccguggguugccccaagaagaccagcuggaagcugaguuccaucauuuccucaggggcaaagagggagucauagcuucaaguggaggagcuucccaucuggaaggguuguccagugaccaacuagaagcccucauuagguuaagcaauaggcuaccacaauucaaagaauuaaugaagaaaguuaaugaaaugccugaguuuguagcguggcuccagcaaucaacaccagagcagaauguuccaacauuauggcaugaagacaaacccuuaucuucaaucgcaacugcuaugaacaggcuucuucuaauucaagcuguacgaggagauagggugacugcagccggugccuggcuuguuagugcggugcucggcgaaggcuuuacagcucgagcugagagggaauuagauuuggcucauauugucgaaucugaaaugaccgcuggcgugccuguucuuuuaugcucugugccuggauuugaugccacuucaaggguugaugacuuggcugcugaaucggguaaacaguuggcaucuauagcuauugguucugcugaaggauucucacaagcagacucuauaaucaauauggcugugagaucaggaagguggguacugcuuaagaauguccaccucgcuccacaguggcuuguacaauuggagaaaaaacuucacucgcugcaaccgcacucaggcuuccggcuguuccuuacaauggaaauuaauccuaaaguuccuguuaaucuucugagagcaggucgcaucuucgucuuugaaccaccuccaggaaucagggcaaaccuauuaaggacauucagcacuguuccugccucaagaaugaugaaggcacccagcgaaagagcgagauuguacuucuugcuggccugguuuaaugcuauugugcaagagagguugcgauaugcuccccuuggcugggccaagcauuaugaauucaaugagucagaucuuaggguggcaugugauacuuuagauacuuggauugaugccacagcugucgggagaacacaguugccacccgagaagguaccuugggaugcuuugguuacacuuuuaucacaauguaucuauggugguaaaauagauaaugacuuugaucagagguuguuaucuucauuccuuucaaaauuguucacaccgagaagcuuugaggcagacuucgcauuaguagccaauguugaugcuggagcuccaggaggucagaggcauauaacaaugccagauggaacgagaagggaccauuucuuacauuggauagagucuuuggcugauagacaaacuccaucauggcuuggucugccuaauaaugcagagaaaguucuuuugaccaauaaagguacugacuugguuauuaaacuucucaagaugcaacagcuggaagacgaggacgagcuugcuuacaccgaacaggagucaggaccuccgucgucccugcagccaggaacugacccgggcaggccugcuuggaugaggacacugcacaacuccgcucucaccuggcuccaguuauuaccaacaagucuucagacauugaggaggacgguagaaaacaucaaggauccauuauaccgguacuuugagcgugaagucaacuccggggccaaacuucuuagggauguuauucaugaucuuacugauguaguugccauuugucagggagagaagaaacagaccaacuaccauaggaccaugcugagugaucucguuaaaggaauucucccuucagguuggaggagguauacuguuccuagaggguguacuguuauucaauggauaacagacuucagcaacagggugaaacaguuggacacaauuucacagcuugcuucgcaaagaggaccaucugaaauuaagaauacuccaaucugguugggugguuugaugaacccugaggccuauaucaccgccacuaggcaauguauugcacaagcuaauaguuggucucuugaagaguuaauccuagauguuacuauaccugaaccaacaccuaauaacucuauugccacugaugaaugcaguuuuucuguuacugggcucaaacugcaaggugcacagugcagaaauaaucaacuucuccucacaucaacaauuaugauggaucuaccaacaacauuacucagguggcaccgggcugguggagagggagacucugggaagcugucuuuaccgguauaccuuaauucaacacguagcgagcuucuuuucacugucgacuugaacauugcuccuggucaagaaccacacagcuucuacgagagaggaguagcucuccucacuucaacagcgcucaacuag

SEQ ID NO: 6823 - RNA, 2640 nt, Nezara viridula
auggcuaagucaaguuccgaaucuagugauagugaggaggauaggaaacagagagaugaauucgcugcacgacuuaggaaaaaagauaaagaaaauacaagaaaaauuacaacuauucauucagauaagagagcauaugaagaagcggcaaaaagauuaaaaauugauucagagcaccaggaaaaauugauuccucgauuaagaguugaaucaagaaggaaauacuuagaaaaacgaaaagaagauaaaguucucgagcuugaagcagauguuguugaugaugaauaucuuuucaaugaggaagaacucacugagcgggaaaggaaagacagagaucauaaaaagaaauuauuaauucucgcaaaggaacaugagagagcaagagaauuggaaaagguucagagauaucauaugccuagggauguuaaagacagugucgaacaauaugaagaagucgaugagagagaaaacaaaccaaauuacgaacaaaggaaaugggaggaggaacagaugucaucugcuguauuucacuuuggcgcuaagaaaaaagauaaaucccaagaagaauacgauuuaguucuagauaaucagaucgaguuuauucaggcuaugagucuagcuggaacuaaagaaaagccugagccacaauuaacagaaaaagaaagaaaaagauugacuauugaagaaacucaaaaaagccucccuguuuacaaguuuaagaaugaacuuguacaagcuaucaaggaucaucaaguucugauuaucgaaggugaaacaggcucagguaaaacuacucagaucccacaguauuuauaccaaucaggcuuuacugaugaugguaagaagauuggauguacucagccaaggagaguugcugcaaugucagucgcagcgagaguugccgaagagauguccguuaaguuaggaaaugagguagguuacaguauucguuuugaagauugcacuucagaaagaacaauuauaaaauauaugacggaugguacucuucaccgagaauuucucucugaaccagaucugcaaacuuacagugugaugaucauugaugaagcucacgagagaacguugcauacagacauauuguucgguuuaguuaaagauauugcuagguuuagaucagaucuuaaacuucuuauauccagugcuacgcuggacgcagaaaaauucucagcauuuuuugaugaugcuccaauauucaggauuccaggaagaagguuuccaguugauauauauuauaccaaagcucccgaagcagacuauauugaugcuugugucguaucgauccuacagauacaugcaacgcaaccacuaggcgauauucuuguguuccuuacuggucaggaagaaaucgagaccugccaagaaauuuugcaagauagaguaaggcgucuuggaagcagaauuaaagaacuauuaauccuuccaguuuacucuaauuuaccaucugacaugcaggccaaaaucuuccagccaacuccuccgaaugcaagaaagguuguguuagccacaaauauugcugaaaccucucuuacuauagacaacauuauuuaugucauugauccugguuucuguaagcagaauaauuucaacucuaggaccgguauggaaucauugauaguugugcccguuucaaaggcuucagccaaucagagagcaggaagagcuggacgcguggccgcuggaaaaugcuuccggcucuuuacagcgugggcauacaaacaugaacuggaagauaacacuguuccagaaauucaaaggaugaacuugggaaauguugugcucacccucaaagcucuaggaauuaaugacuugauuaauuuugauuucuuagauccuccuccacaugaaacauugguacuugcuuuagaacagcuuuacgcauugggagcuuugaaccaucauggugagcugacgaaauugggucgaagaauggcugaguuuccauuagacccaaugauggggaaaauguuacuugcuucugaaaaguauaaauguagcgaggaaauaguuacaauugcugcaauguugucagugaauggugccauuuucuacagaccuaaggacaaaguuguccacgcugauacugcgagaaaaaauuuuuuccuuccuggcggugaucaccuuguucucuggaacguauacaagcaguggucggacacugauuucaguacucaaugguguuaugaaaauuauauccaguauaggucaaugaaaagagcuagagauguucgggagcaacugguaggucugaugcagcguguagagauggacauaauuuccaauccuacugauagcauugccauaaggaaaacuaucacagcuggauauuuuuaucacauugcaaggcuuucuaagggcggucauuacaaaacagucaaacauaaccaaacuguaaugauacauccaaacaguugccuguucgaggaucucccucgcuggguugucuaccaugagcuuguuuucacuacaaaggaguuuaugcgacagguugcugaaauugagaguaaauggcugcuugaagucgcaccacauuauuauaaaccucgugaauuagaagauucaacaaauaccaagaugccuaagguauuaggaaagacgagagcacagcugggagaacauuag

SEQ ID NO: 6824 - RNA, 1440 nt, Nezara viridula
auuaccucccguugccauagcgcguuuaaacuucugaguuuugaguguuggucacaacuuauuaaaaagaugaagauugaagaaguuaagaguacugugaaaacacaaagaauuucuagucauagucauauuaaagguuugggcuuagacgaaaauggggugccuauacaaauggcggcugguuugguaggccaagaaaaugccagagaggcugcuggaauaguaguugaaaugauuaaaucaaagaaaauggcaggaagagcugugcugauggcgggaccaccaggaacugguaaaacagcaauagcucuagcuauggcucaagaauuaggaaauaaaguaccauuuugcccaaugguagguucagaaguguucagcucugaaauuaaaaagacagaaguauugauggaaaauuuuaggagagcuauuggccuaagaauuaaagaaacuaaagaaguauaugaaggugaaguuacagagcucacaccuguagaaacagaaaauccaaugggaggguaugguaaaacuguaucccaugugaucauuggcuugaaaacagcgaaagguacaaaacaguugaaguuagacccuagcauucaugaaaguuuaaccaaggaaaagguagaaguuggagauguuauauacauugaggcuaacaguggugcuguuaagaggcaaggaaggagugauacauaugcuacugaauacgaucuugaggcagaagaauaugucccucuaccuaaaggcgauguucauaaaaaaaaagaagucauccaagaugugacauuacaugaucuagacguugcaaaugcuagaccacaaggagggcaagauguuuuaucaauaauggggcaacuuauuaagucaaagaaaacagaaauuacugacaaguuaagagcugaaauuaacaaaguuguuaacagguacauagaccaagguauugcugaacuagugccuggggugcuuuuuauugaugaaguccacaugcuggauauagaaaccuucacuuaccuucaucaggcucuugaaagugcgauagcuccuauuguagucuuugcuacaaaucgaggucguugucaaguuagaggggcugcagacauuauuucaccacauggacuaccguuggaccuucucgauaggcugcucauuauucguacugcgccuuacacccaaccagagauggcccaaauugucaaguugagggcuguaaccgaaggacuuagcauugaugaagaugcauuaucagagcugagugauauuggaagcaaaacaacucucagguaugcaguucaguuacuaacuccauccaauuuaacugcaaaagugaauggucguuccucuaucacuagagaagauguagcagaagugggacaacuguuucuagaugcaaaaucaucugccaaaauacuagcaaaacaucaggaccaguuuaugaaauaa

SEQ ID NO: 6825 - RNA, 2196 nt, Nezara viridula
augacauccauaauuaaguuccaugcuuuaucuggaguuauggaugaaucuccaccauguuauauuuugcaaguugaugaauuucgcuuuuuacuagacuguggcugggaugagcacuuuaaccaggauuauaucaaagaacuuaagagacauguucauuuaaucgaugcaguuuugcuuacuuauccugaccacuuacauuugggagcauuacccuacuuaguuggaaaauguggacuuaguugcccuguauaugcaacuauuccaguuuacaagaugggacaaauguuuauguacgauuuauaucagucucguuauaauauggaagacuucaauguguuuagccuugaugauguugacgcugcauuugauaaaguuguucaguuaaaauauaaccaaucaguaacaaugaaggggaaaugcuauggacuuagcauuguuccuaugccagcuggucauaugauaggaggaacaauguggaaaaucaugaagacuggggaagaagauauuauauaugcuaucgauuuuaaucacaaaaaggaaagacaucucaaugguugugaccuagaaagauugcagaggccaucauugcuuauaacugaugcauuuaacgcaacuuaucagcaagaacgaagaagagcaagagaugaaaaacuuaugacaacaauucuucaaacauuaaguaauaaugguaacauucuuauugcuguugauacugcuggucgccuuuuggaguuggcacacaugcuggaucaacuuuggaggaauaaaaauucugguuuacagauucacccuuuaugccuuauuaauaauguaaguuauaauguugucgaauucgcuaaaucucaaauagaauggaugagugauaaauuaaugaaaagcuuugaagcuguucguaauaauccuuuucaauuuaaacauauacguuuaugucauaguguuucagagcuuaacaaaauuccuucugcaaaaguaguucuugccaguaugccugaucuugaauguggauuugcucgugaaauauuuuuucaaugggccucugauucuaaaaacagcauuguucuaacaucaagauguugugaagguacacuagcaagagauuuauuagacaaugguguuggaaggaccauucaaaucacuguuaaaaaaagaguucgucuugaaggggaagaauuaaaggaauacuuaaaagcacauaaaaaaacuaaugacaaaaaugaagaaaaggaaaguucugagucagaagaugaaauccaauugcucagugucaccaaagguagucaugauuuaguuauuaagcaagaacgaaggaaaaaaaaccaaaaaucuuuaaagaaauuuuauccaauguuuccuuucauugaucguaaaguuaaauuugaugaauacggugaauuugugcgcauagaagauuacaaagcuccugauaccgcuaaacguccuccugaaaaaaagucuaaaaagaaggaugaugauauuuuagauccugccgauauuccaaccaaauguguuucuuaugagaagucacuaacuguaaaugcucaaguucaauacauagauuuugaaggaagaucugauggagaaucaguacagaaaauaaucacucaguugagaccaagaagaguaauacuuguccgugguaccucagaaaauacggaagcuuuagagaagcaucuuuugcaauggucugaggcuaaaauauucugcccgaaaaaaggugauauaguggaugcuaccacugaaagucauauauaucaaauaagauugacagauucuuuaguaucuucauuacacaugcaaaaagguaaagauucagagcuugcauggauugaugcuauuaccaaauaccgucagaaacccucugacacuaugcagucgacagaagaaauggaaguugaagaagaugguaauuacagcauuuacaaugaugacuacuuaacucuggaaccucuccccuuaacugaagucaauccucaucaagcaguguuuauaaaugaguuaaaauuaucagacuugaaacaaauuuuaucucguaaugguauagaaucugaauucucuggugguguauuguggugcuguaaugguacuauugcuauucgaagguuggagucuucuaaaguguacuuagaaggguggauuucagaaaauuacuauagaauuagagaaauuuuauauggacaauaugcaauuuuauaa

SEQ ID NO: 6826 - RNA, 2421 nt, Nezara viridula
augcccucgauagauguuauacagccuccuccuccuccuccuaccuuggagaaggaggaaccuuuacuucaaccaacaacuaagccuauuguugguauuauauacccuccaccugaaguaagaaauauuguugauaaaacugccaguuuugucgcccguaauggaccagaauuugaaucuagaaucaggcagaaugaauugggaaauccuaaauucaacuuucucaauacgggugacccuuaccaugccuauuaucaacacaaaguuaaagaauuuaaggaaggaaagggaacugaaccaccaccaccuccaccuccagugcaacagaagacuguagcuucugcgacacaacugaaacagcaagaaauccuaaagcaggucacggaacagccguuuguaccaaaagauccuccuccagauuaugaguucauggcugauccaccuuccauuucggcucuggauuuggauauaguaaaguugacagcacaguucguugcuagaaaugggcgccaguucuugacuaaccucaugaacagggaacaaagaaauuaccaauuugauuuucuucggccacaacauucucuuuuucuguauuucaccaaacuacucgagcaguauacaaagguguugauucccccgaaagaccuaaugucccgucuaaaagaagaauguuccaauccuacuggaguucuggagcaagucagguaucgugcagacuggcuucacuaccaagaauugcagaagagaaaagaggaacaagcgcuugagaaagaaaggguggcuuaugcacagauagauuggcaugacuuuguuguugucgagacaguggacuauauuccaggugaaguaggcaacuuuccuccaccuacuacuccagacgaaguuggugcccgagucuugaugcaggagcgaaucuuagaaaauggaggagaggaucugacggaaggaacagguagcgaugaugagagagagaaggaagauagcgaaagagaagaagcagcuggcgauaagggagauaauacucagguccaagauauggaagaagaaucauccagugacagugacgaagacgaugaacagagggaccaaucucuucaagaaaaacaacaggcaacaccugcccagaaacagcaagcguugcaacaaaaucaacagcaccccuccgccgauggcaagaaaccccaaccuucgaugcaaccuccucugcccccugcuccagauaaaguuaucgucaagaaaggcuauaauccuaagcagcaccagaaaacuucgaaaggugcagauaacuaucuuauuucuccauugaccagugaaaagauaccugccaacaagguacaggaacacaugagaauuggucuguuggauccucgcugggucgaacaaagagacaaacacauucaggauagaaucaaccaggagacugucuacgcaggagguucugcuauugaggccagcuugaaacaacuugcggagagaagaacugauauuuuuggugugggugaugaagaaacugcuauugguaagaagauuggugaagaggauaagaagaaagaugauaaggugacuugggauggucacacuucgagcguggaggcugcaacucgcgcugccagggcuaacaucaccaucgaggaacagauccaccagauucacaaggugaagggauugcucccugaugaagaaaaggagaagauaggacccaagccugucccaggagcggggagcagcagcggaggaaauccaauggcugguggcccccaaaucguuguccaagccaaagccccuccccucccuccuccaccgaaggugccuccacuuccaccuccagcuccucugccgccuccaccgggccuuguaccucagccacccauaaugaugguaccugcaccucuucguccuccgcuaaugguuccgccgggagcauuccccguaguugcugcuacuccuucugcuuucauggcuccaccaggaacugcgcccuugccccccgccccgcagccgcccccucaggucacucagguggggaacuuguuaaagcacgucgcuucugccucugugggcgaggcugaugaugagccuaugaccaagaaggcuaaaacagaagauugucuuguaccagaagcucaguuccucauacagaacaagagcccugucacauucaaagugaucguaccgcuuuuggcugaaaagccagaauggaaguugaacggccaggcacugacguucacccauccguugacggacaccaucgccucuaucaaagccaauauuucugaagccauaggaaugccggcugcuaagcagaaguuacauugugaugguaucuuuuacaaggauucuaacucuuuagcauucuauaauauuucuccugcuacuguagucuacuugcaggugaaggaaagagguggcaggaagaaauaa

SEQ ID NO: 6827 - RNA, 942 nt, Nezara viridula
augccaggaguagagcauguuacuaacaaagucguuguucauccuuuaguucuauuaaguguuguugaucauuucaauagaauggguaaaauugggaaucagaagagaguaguuggcguauuauuaggaugcuggaaggcaaaagguguuuuagacguaucuaauaguuuugcagugccauuugaugaagaugauaaagacaaaucaguuugguuuuuagaccaugauuauuuagaaaauauguauggcauguuuaagaaaguuaaugcaagagaaaaaguuguuggcugguaucauacaggcccaaaguuacaucaaaaugauguugcaauuaaugaacuuauacgccguuacugcccuaacucaguucuuguuauuaucgaugcaaaaccaaaggaucuugguuuaccuacagaagcauauagagcaguugaagaaguacaugaugaugguucuccuacgacaaaaacauuugagcauguucccagugaaauaggggcugaagaagcagaggaaguggguguugaacaucugcugagagauauaaaagauacaacugucggcucacuuucgcaaaggguuacuaaucaauuucuuggucucaaaggccuuaaucaacaaauucaagacaucagggauuaccuuaugcagguuguugaaggaaaauugcccaucaaccaucaaauaauauaucagcuucaagacauauuuaaucuccuuccugacaugaaccaugggaacuuuguugauucauuauacauaaaaacaaaugaucagaugcuugucguuuaucucgcugcccucguuagagcuauuguugccuugcauaaucugaucaauaauaaacucaguaaucgugaugccgaaaaaaaagaaagcaccaaaaaagaagaaaaaccuaaagaagaagaaaguguaaaaaaagaauugaaggcuaaguaa

SEQ ID NO: 6828 - RNA, 1623 nt, Nezara viridula
auguuucagcccauuuucguguuaagccaaaacucuaaaagggaaucaggcaauaaaguucggacugagaauauugcugcagccaagaugauugcagaaguuauuagaacuugucuuggaccacaggcaaugcuuaaaauguuaauggauccaaugggugguauaguuaugaccaacgaugguaaugcuauuuugagagaaauaacuguucaacacccugcugcaaaaaugaucauugaaauugcuaggacacaagaugaagagguuggagauggcacuacaucaguugugauucuuuguggucaaaucauggcagaaauugaaagacauauagaugaaguccauccuacgacaaucauuaaagaauuuaaaagagcuuuggaugauauuuuaaaaauacuuccagacauaaguacuucucuugaucuuaaggacaaagcuaaagugauagaagugguuaaaggauguuuagguaccaaauuuuuagguacuuggucugaaauggcuugucagauggcaauugaugcuguagauacugucagagaucuaaaaggucuuggaauugauuuaaaaaacuuugcuaaaauugaaaagguuccuggugguuuuauugaagauucuaaaguauuggaagguguaaugcuuaacaaagaugugacacaucccaaaaugucacgguucauuaaaaauccacgaauuuuauuacuagauuguucucuugaauauaagaaaggggaaagucagacuaacguggaaauaauuaaggaaggugauuauacaaggcuucuacaaauugaagaagaguacauugaaaaaaugugcaaucauauuauugagcagaaaccuaauguugucauuacugaaaaaggaauuuccgauuuggcucaacaccaucuuuucaaggcugguauuacagccauucguagaguuaagaagacugauaauaacagaauugcucgagcaguagaugcaacuauuguuagucguguggaagaaaucaaaccuuaucauauugguuguggugcuggucucuuugaaguaaagaagauaggagaugaguacuucacuuucauuacugaguguaagaacccaaaagcuuguacaauuuugcugcgugguccaagcaaagauguguugaaugaaguucagagaaauuuacaagaugcaaugaauguugucaggaacuuguacuuggauccucgaauacuuccaggagguggugcuguagaaauggcccuacauagagcucuaaucaaagcaaauuacaccauagauauggaagaugauuguuaugcugccaucccaucugcuuuaagaauuauuccuagaacacuguugcaaaaugcuggugguaaagugauuagaucaaugaacgaacuugagaaacaacauaauucugguauucuuaaaggaguugauggaauaacuggagaauuaaaaacuguugaagaauuagguguaugggaacccuauucagucaaaguccagaucuauaaaacugcuauugagucagcaauuuuauuguugaagauugacgauauuguuucuggugcuaagaauaaagauagggaaagaaauagcggcucuguagcgcaaccuacugaagaaucacuuaaagaauaa

SEQ ID NO: 6829 - RNA, 699 nt, Nezara viridula
auggcaaugccaagaaguuaugguggcuuaucugauuacagaaccguuccugcaccuucuuuuaguccauauucugaaaauggagggaguguaguagcuguagcuggcgaugacuucgcaauuauagcaucugauacacguuuaaguacagguuuucaaauuuauaccagaaaccagucaaaauuauuuaaauugucugacaaaacaauucuugguaguacugguuguuggugugauguucuuucucuuacuaggcuuguucaaacccggauaaaaauguaucaguacgaucauaauaaaguuauguccacuccagcaguugcccaaaugcucucuguacuacuuuauuauaaacgcuuuuucccauacuauguagccaauauucuugcuggaauagaugauaaugguaaaggagugguuuacaguuacgauccaaucggucaucaugaaagcucaaaauucagagcuggaggaacagcuggagcuuuauuacaaccacuguuagacaaucagcucgguauguugaaucaagaaaauguucaagacaaaacauacacuuuggaaaaagcccaugcaauuguaaaagaugucuuuauaucagcugcugaaagagauauuuuuacuggugacagaauaucaauuaacauaauaacaaaggaugggaucagagaagauucauuugagcuuaggaaggacuag

SEQ ID NO: 6830 - RNA, 900 nt, Nezara viridula
auguuuggguuuaguauguuuccauuuccuccuaggccuuuuaagguccaguauuauuguuuuucuguugcaaugauaccagggaaugaaagggaugauguugaacguggggguaaaauuauuaugccuccuucagcacuggaucacuugacuagauuaaacauuaauuauccuaugcuuuuuaaguugcauaacgcgaaaacgaauagaucuucucacagugguguauuagaauuuguugcagacgagggaaaagucuauuuaccccacuggaugaugaggaauuuaaugcuugaagaaggugauguuauugagauagaaagugucucccugccuguugcaacuuuuucgagguuucagccucaggcuccagauuuuuuggauauuucgaauccuaaagcagucuuggaaaacugucucagaaacuuugcuuguuuaacuacuggugacauuauuaauauuaaguauaaccaaaaagauuaugagcuuucuguuuuagaaacacaaccaggggcagcaguaacaauuauugaaugugauaugaauguugaauuugcugcuccuuuaggauauaaagagccuaauucugaacaggagucauuggaugagucaucugaaagaacagaaaacuuaucuaaugagggaaguggauucaccccauucuuuggugaaggcuauaggcuugauggaaaacagaagaaagcgauugaagaugaaaauaugaaauuuaaaaucccgacugugagaggaauuccugauuaugacuggaaaguaggugugauuaccuucaugagaaaugugcgucaaccuguuaaagaagcucagaaagaugaugaagauaaauuucaacccuuuuaugggcaagggcaugugcuaaguacgaaucgucacaggaaauaa

SEQ ID NO: 6831 - RNA, 1629 nt, Nezara viridula
auggcugcuuuuccaggauccauugcauuugaugaguaugguagaccauuuauuaucaucaaagaucaggaaaaacaaagacguuuaaccgguaaugaugccaucaagagccauauacucucagccaaagcaauuuccaaaauuguuagaacuuccuuggguccaaaagguuuggacaaacuauuggugucgcaagauggugauguuaugguaagcaaugauggagcuaccaucaugaagcaaauggauguggauaaugaaauugcaaaacugauggugcaacugucucaaucccaagaugaugaaauuggagauggaacuacaggagucguuguucuugcuggugcuuuguuagaacaagcugauguuuuauuagauaaagguauucauccuauuagaauugcagauggguaugaauuagcugcucgagcugccauagaacauuuagauucuaucgccacaaaauuuccuguugauccuaauaauuuagaaccucuuauuaagacugcuaugacaacucuuggaucaaaaaucguuaacaaaugucaucgccaaauggcagaaauagcuguuaaggcaguauuaucaguggcugaucuggaaaagagggaugucaacuucgagcucauaaaaguugaugguaaagucgguggaaggcuggaagauucuaugcuugucaaagggguggucauugauaaggauuucucucauccccaaaugccaaagguauuaaaggauguuaaaauagcaaucuuaacuugcccauuugaaccgccuaagccaaaaacaaaacauaaguuggauguaacaucuauugaugacuauagggcguugaggaaguacgaagaagagaaauuuaauaccaugguuucucaagucaaagaggcaggugcuacucuugcuauuugucaauggggauuugaugaugaagcaaaucaucuucuucuaaagagagaacuuccugcaguuaggugggucgguggcccagaaaucgaguugauugccauugcaacugguggacguaucguaccccgauuugaagaguugaauccugaaaaacuuggucgugcuggacuuguuagagaaaucucuuuugguacuacaaaggauaaaaugcuugugauugaggaaugugccaauucucguucugucacaauuuucauuagagguucaaaccaaaugauaaucgaugaagcuaagaggucaaugcaugaugcacuuugugucguuagaaauuugauuugugaugacagcauuguuuaugguggaggugcugcugaacuuucauguucuauugccacugccaaacaggcagauaagauuucaacaauugaacaguacgcauuccgugcauuuucugaagcuuuggaguccauuccuuuugcucuagcagagaauucagguuuaccaccaaugcagguuguaacuaguguaagaggaaggcaaauccaagaaaacaacccugcacuugguguugauuguauggggaaaggaacuaaugauaugaaagagcagcauguuauugaaacacuuaaaagcaaaaagcaacaaauaaugcuugcuacacaauuggugaaaaugauacuuaaaauugaugaugucagaacaccuaaugauaugcaauauuaa

SEQ ID NO: 6832 - RNA, 342 nt, Nezara viridula
auggcuucagcaauggacguugacgaugaggagaacgagguuccgaccuccagcaguggaaaaggugaaaaaaagagguucgaaguuaaaaaauggaaugcuguugcacuuugggccugggacauaguuguugauaauugugcuauuugucgaaaucauauaauggauuuauguauugaaugccaagcuaaucaagccucugcuacaagugaggaaugcacaguggcgugggguguuuguaaucaugcauuucauuuucauuguaucucaagauggcuaaaaacuaggcaaguuugcccauuagacaaucgugaaugggaguuucaaaaauaugggcauuaa

SEQ ID NO: 6833 - RNA, 1605 nt, Nezara viridula
auggugucuuuaaauccgauuagaauacucaaacaugaagcagaacaagaaaagggugaaauggcuagaauguccaauuucaucggagcaauugccguuggugauuuagugaaaaguacacucgguccgaaagguauggauaaaauucuuguaucuuacggccgaaaccgugggcagauagaaguuaccaacgauggugcuacuauuuuaaaaucaguggguuuugacaaucccgcugcuaaaauucuggucaacaugucuaaaguucaagaugaugaaguuggagauggcacaacuucggucacuguuuuggccgccgaacuucuccgagaagccgaaaaauugaucgaaaggaaaauccauccucagacaauaauaagcggauaucgccgcgcgacaaauguagcucuugcugcauuagauaaaugugcuguugacaauagcagcaaugauaaggaguuugccgaagauuugcucaaaauugcccguacaucauugaguuccaaaauuuugaauuuacauaaugaaaaauucaguaaauuggcaguugaagcuguucuccgccuuaaaggaucagguaauuuaagugcgauucagaucaucaaaaaaacagguggcuccuuggaugauucauuuuuagaugauggcuuccuucuggacaagaaaguuggucaauuccagccuaaaaggguugaaaaugccagaauucuuauugcaaauacuccucuugacaccgauaaaauuaaaguuuucgguucgagaauacguguugacucuguagcuaaaguggcagauuuggaauuagcugaaaaagaaaagaugaaggaaaaaauugacagaauuauaagucauaaaugcaacguauuuguuaaccgucagcugauauauaauuauccugaacagcuauuugcugaugcuggaauuauggcaauugagcaugcagauuuugaugguauugaacgccuagcgcuugucacugggggugaaauugucucuacauuugauacaccugagcuuguuaaauuaggugaaugugauuuaauugaggaaauaaugauuggugaagacaauuuguugagguucaguggagucaaguugggagaggccugcaguauugucauaagaggcgcaacacagcaaauuguugaugaagccgaacggucucuucacgaugcauuguguguacuuguaaccacugucagggauaagaaaacuguuuuuggugguggauguucagaaauaauuauggcgagugcuguaagcgaugaagccaucaauguuacuggcaaagaagcaguugcuauggaauccuuugcuaaagcuuugcucgaguugccuaugaccaucucugauaaugguggcuuugauucugccuauuuaguuacagcucuaagggcugcucauaauaaaggucagauaacuuauggcuuggacaugaagaaugguggaguagcuugcaugagagaacuugguaucgucgaaucccauucaguaaaacgucaaaugcuucuaucugcuucugaagcaacugaagucauauugagaguugaugauauucucaaagcagcuccucgcaagcgaacggaagaucgaggcuacuguuga

SEQ ID NO: 6834 - RNA, 834 nt, Nezara viridula
auguuccgaaaccaguaugauuccgacguuaccguuuggagcccucagggccgguuacaucagguugaauaugcuauggaagcuguaaagcuuggagcagcaacuguuggugugaagaauaaacaguaugcuguccuuguugcucuuaaaagagcaucuucagaacuuucagcucaucaaaagaaaauuauuccucuugauaaucacauaggcaugagcauuucuggccuaacugcugaugcucguauauugagucggcaaaugagaagugaaugucuaucuuauucauauucauauggaacugaaauuccuauuaucaggcuuaugaauaaaauaucuaacaugaugcaaaguucaacucagcgcuaugacagaagaccguaugggguuggucuacugguugcaggauuugaugccgacgguccucacauuuuucaaauuuguccuucugcaaauuuguaugagugucguucaauggcuauuggugcuagaucccagagugcaaggacguauuuggaaaagcaucuagcagacauuggaaacucuggcacccucacagaccuucuuaagcaugcacuucgggcucuuagggauucuucuccuaaugauacagaacuuagcucuaagaauguagcaauagcgguaguaggaaaagauaccccacugaaggaauuaucugaggccgacacccagacuuaucuggacaugauccugagugaagagagaagaaguggcgauacagcaggagguagugacgaugcuccuccuccaccaccgccguccgauccaccagcucaagauccuacaccaguuguggcuauggaaacacaauaa

SEQ ID NO: 6835 - RNA, 2544 nt, Nezara viridula
augccaguuuaucaagaaagaaaaccuaaaauaguaauuaaugaagaagauuugccuuaugaagaggaaauucuucgaaauccuuuuucuauuaaacauugguuaagguacaucgaguuuaagaaggaugcaccaaggaauggggugaacauaaucuaugaaagagcauuaaaagagcuuccuggaaguuauaaacugugguauaauuauuuaauacuaagaaaaagacagauuaaaggacgaugcauuacagauccuucuuuugaacauuuaaauaauacuuaugaacgaucuuuaguauuuaugaauaagaugccuaggauauggauggaauauugccaguuucuuguugaucaauguaagauuacuaaagcccgucacguauuugauagaucuuuaagggcauugccuaucacccagcaccaucguauuuggccucuuuauauaaaauucuuaaaaaaacauaacauuccagaaacugcaguccguguauuucgaagauaucuaaagcucugcccagaagauacagaagaauauauugauuauuuaacugcaauccaucgucuagaugaggccgcuguuagauuggccgauauuguaaauacugaugauuuuguuucaaagcauggaaaaucaaaccaucaguuguggacugaauuaugugauuuaaucucuaaaaauccucaggaaguuaggucucugaauguggaugcaauaauaagaagugguuugaaaaaauauacugaccaguuaggucauuuauggaauucauuagcugauuauuauaucagaaguggacuuuuugaaaaggcaagggauauuuaugaagaagcaauacaaacuguuacuacugucagagauuucacucaaguuuuugaugcuuaugcucaguuugaagagcuuucuuugaguaagaaaauggaagaaguuucucaaaaagcuuuucccacugaugacgaugauauagacaucgaacuucgcuuagcaagguuugaagauuugauugaaagaagauuauugcuucuaaauucaguucucuugagacaaaauccucauaauguucacgaauggcugaaaaggguucagcuuuuugaaggaaaaccacaugauauaauuuauacuuacacugaagcuguucaaacaguugauccaaaacuagcugucggaaaaccgcacaugcucuacguuaauuuugcaaaauucuaugaagaaaaugggcaaguagaagauucuagaauaguucuugaaaaaggaacacagguaccuuauacuaaaguugaagaucucgcaucuguguggugugagugggcagagauggagauuagaaaugaaaacugugaugaagcauuaaaaauucuucaaagagcuacugugaugccagcuaggaaaguugauuaucaugaugacucagaaacugugcaaaugagauuauauaaaucacugaaaauauggucauuguaugcugaucuagaagaaaguuuuggaacauucaaaucuuguaaaucaguguaugacaggauaauugaucugaaaaucgccacuccucaaauuauuauuaacuauggucuuuuucuagaagaacacaauuauuuugaagaagcuuuuaggacuuaugaaaaaggaauugcuuuguucaaauggccuaauguuuuugauguauggaauacuuauuuaacuaaauuuuugaagcguuaugguggagguaaacuugagaggacaagagaucuuuuugaacaauguuuggaaaauuguccuccuaaguaugcuaaagguuuuuaucucuuauacgcuaaauuagaggaagaacauggauuagcaaggcaugcuauggcuguuuaugaaagggcuacuucugcuguuuugccggaagaaauguuugagguuuucaauauuuauaucaagaaggcugcugaaauuuaugguguucccaaaacucgucaaauuuaugaaaaagcuauugaaguguuaggagaagauaauucaagagaaaugugucuuagguuugcugaaauggaaacaaaauuaggagaaauugaucgagccagagcaauuuaugcacauugcagccaaaugugugauccucgaguuacugguucuuuuuggcaaacauggaaagauuuugaagugcgccauggcaaugaagauacuaugagagaaaugcuaagaauuaaaagaaguguacaagcuacauacaacacucagguuaauaugaugucagcacagauguuaucugcugcaaguaauguuucugggacaauugcugaucuugcuccuggugcuaaagauggaaugcgcauguuagaagccaaagcagcugaaaugacuguaacuacgaaaucugguucaucagcaauaauguuuguaagaggugaagcccagaacacaucccaggaagugcagaaggaaauaauuaauccugaagcuuuaaauguugauucagaugaugaagaagaaaaccuggaggaugaugaucugccuguugaaaagcagauuauuccugacgaaguguuuuguggccugaagaaaggaagugauucugauuaa

SEQ ID NO: 6836 - RNA, 990 nt, Nezara viridula
auggccgcuggaccuauugccgaaaggaaucaagaugccacgauauaugucgguggauuggaugauaaaguuacugaaacucuuaugugggaguuauuuguucaagccggaccgguugucaauguucauaugccgaaagacagagugacgcaacaacaucaaggcuauggcuuuguugaguuuuugggugaagaagaugcugauuacgccauaaaaauuaugaacaugauaaaaguucauggaaaaccuauucgugucaacaaggcuucagcacaucagaaaaauuuggacguuggggcuaauguguucauugguaaucuggauccugagguugacgaaaaauuguuauaugacacauuuucagccuuuggagucauucugcagacaccuaagauuaugagggauccugauacaggaaauucaaaagguuuugcauuuaucaauuaugcuucauucgacgcuucagaugcugccauugaugcaaugaauggccaauuucucugcaaucgcccaguuucaguuucuuaugccuauaagaaggaugcuaaaggugaacgacauggaucggcggccgaacgucuccuagcugcucaaaacccauuaucacaagccgacagaccucaucauauguuugcagaugcucccccugcaccucugccaccuccuccaguacugccgccaccuccuguuuucaauccuccacccccuccucauaugccaccuccuccguuaccaccucaacggaugguugcuccuaugccuccaccuccuccugguccuccuccaccaaugccuccuggaaugaugccauggccuccaaugcaaccacacuuuccaccuccuccuccuccaccaccuacaaacaaagcucccccucuuccuccuccacccccuccacaagcuuggcguccuccaccaccuccuuacaaucgaccaccauuuccuccaccaccuccaccuccagucagaccuccaccaccaauguucuag

SEQ ID NO: 6837 - RNA, 777 nt, Nezara viridula
augggacgaguuaucagagcucagaggaagggugcugggagcguuuucagaucccacaccaaacaccgaaaaggugccccaaaauugaggucuuuagauuucgcugagaggcaugguuacaucaagggaguugugaaagauauuauccaugacccugguagaggagcuccuuuagcaguugugcauuuuagagauccuuacagguuuaagacccguaaagagcuuuucauugccccugaaggaauuuacacuggccaauuccuguacuguggaaagaaagccaacuuacauguuggaaauguuaugcccgucggcacuaugccugaagguacuaucaucuguaauuuggaagagaagaccggagacaggggucgguuagcuagagcuucaggaaauuaugcuaucguuauugcacacaauccugauucaagaaggaccaggguuaagcuuccaucaggugcaaagaaagucauucccucuaacaacagagccaugguugguaucguugcuggagguggacguauugauaagccaguccuuaaggcuggucgugccuauuauaaauauaaggcaaagaggaacugcuggccuaagguuagagguguugccaugaacccagucgagcauccucacgguggugguaaucaccagcacaucgguaaagcuuccaccgucaagagaggaacuucagccgguagaaagguuggucuuauugcugccaggcguacugguaggauucguggugguaagacugaucagaagaagggagacgauuaa

SEQ ID NO: 6838 - RNA, 411 nt, Nezara viridula
auggcccguaccaagcagaccgcuaggaaaucgacaggaggcaaagcuccgaggaagcagcuggccaccaaagccgccaggaagagugcuccggccaccggggguguuaagaagccucacagguauaggcccgguacagucgcucugagagaaaucaggagguaccagaagaguaccgagcugcucaucaggaaacucccguuccagagguuggugagggagaucgcccaggacuucaagaccgaccugagguuccagagcucggcagucauggcccuccaggaggccagcgaagccuaucucguaggucucuucgaggauaccaacuugugcgccauccacgccaagagggugaccaucaugccuaaggauauccagcuggcucgccguauccgcggagaacgagccuaa

SEQ ID NO: 6839 - RNA, 1596 nt, Nezara viridula
auggcggcaauuacuuuauugaauccgaaagccgaaguugugagaaaaacagaagcuuugucuaugaaccagagugcagcuaaagguuuacaagacgucaugaagacaaaucucgguccacgagguaccaugaaaauguuaguuucaggugcuggugacauuaaaauuacuaaagacgguaauguuuugcugaaggaaaugcaaauacagcauccuacagcuucucuuauugccagaacuucuacagcuauggaugacauuaccggugauggaacuaccuccacagucuuacuuauugcugaauuauuaaagaaagccgacaauuauauuauugaaggugugcauccuagguuaauuacugaagguuucacuguugcuuguaaacacgccauggaaguuuuggauaguaugaagaaaacaguuagucuugaugauaaggaaacucuuauugcuguugcuagaacagcucuuaauacaaagguagagucuaaaguagccgagguauuaacccagauuuguguugaagcugugcaagcuaucaaacucccugauaaaccccuagauuuacacaugauugaaauuaugacaaugcagagccgucuugaaucugaaaccagauuaguuagagggcuugucuuagaucaugguucacgucacccuaauaugcccaagaaacuaaccaaugcuuauauucuaacguguaacguaagucuugaauuugagaaaacagagauaaauaguggguuuuucuauaaaucagcacaggaaagagagaaacuggucgcauccgaaagagaguucauugaguuaagaguugcaaaaauuauugcuuugaagaaaucuguaugugauggaacagacaaaggauuuguugucauuaaucagaaagguauugauccugucucuuuggauaugcuagcuagagaaggaauaauggcucucaggcgagccaaaagaagaaauauggagagacuaacuuuagcuugugguggaguagcgaugaauagccuugaugaucucacugaagauugucuuggacgagcaggucucguuuaugagcauguucuuggagaaacuaaguauacauuugugucugauugcccaaacccucauagcgucacuguacuuguucauggcccgacuucauaugccauuacucaaauucaagaugcucuucgggaugguuugagagcugucaaaaaugcaguugaagauggugguguacuuccagguggaggagcaguagaauuaaaauuacgccaugaauugaaaaaaguugcugagaaaacuaaggaaaaguaucguguuggaauugaggccuucugugaugcacuccugguuauucccaaaacccucgcaaugaauaguggauucaacacucaagaaguaauuacacaacuugauuaugaugcaaaggagaaugauucaaucggauuggaucuucaaacuggcaagucgaugaucccuacugauuuaggaauccuugacaacuauucuguaaaaaaacaguacauagcuucaagugucauuguagcaaguaaucugcuccuuguugaugaaguuaugagagcuggaaugucaucuuuaaaaggauaa

SEQ ID NO: 6840 - RNA, 3144 nt, Nezara viridula
augucuagugcugaaguggccaacaauuccauagaaccuccagccaagaagcggaaaauugcuacaggagagacugcuccagcgaacuccguuucaaaggcaauaucagccauggcgaauaauggaucuuuugauuccaaucaagaaauugaugagggacuuuacucucgccaacuuuacguuuuaggacaugaugccaugcgacgaauggcaucaucugauguucuuauuucagguuuaggaggacuugguguagaaauagcuaaaaacguaauauuaggugguguuaaaucuguuacauuacaugaugaaacuguaugcacuauaucagaucugucuucacaauuuuauuuaucugaaaauucuauugguuuaaaccgagcugaaguaucuugccaguuacuugcugaacuuaacaauuauguuccaaccagauccuacacuggaccucuuacugaugauuuuaucaaaggauuuaguguuguaguuuuaacaaaugcuucagaagaagaaaaauugagaguuucugaaauagcucaugcaucugauguaucauuaauuauagcuucaacuauggguguauuugcucaaguuuuuugcgauuuugggcgagaauucaguguaguugacacaaauggugaaaauccaguuucugcuaugauagcaagcauuucucgagacgaagaagguguuaucgcuugucuagaugauacuagacauggucuagaagauggagauuauguuacuuuuucugaaauucagggaaugacugaacugaauggcugugagccgacuaaaauuaaaguucuuggaccauauacauuuaguauuggcaauacuuccaauuuuggagaauacauuagagguggaauuguucaacaaguaaagaugccaaaagugcuucaauuuaagucauauucagaagcucucaaaucuccugaauuuauauuuacugauuuuggaaaauuugaucacccacagcaacuucauguugcauucaaagcuguugaaucuuauaagaaagaauuugguaaguugccaucaccaugggacaacaagaaugcuuuagauuuuguaaacuguuguaaaucuguauuaucugacuuaagccuagauguagaauuaaaugagaagcuuauggagcaauuugcuaaaaccuguucuggaaauaugaauccuauugaugcauuuauuggugguguuguugcacaagaagugaugaaagcuuguagcggaaaauuucauccaauuuuccaauggcuguauuuugauucuauugaacuauugccaaaugaagaucuagcuccuaaugacugugcaccuacuaauucuagauaugauggacaaguugcaauuuuugguaccgaguuucagaaaacuuuaggugcccugaaauauuuuguuguuggagcuggagcaauuggaugugaacuucuuaagaauuuuucaaugaugggugugggagcagaugguggaaaaguaauuguuacagauauggaccuuauugaaaaaucuaaucucaacaggcaauuuuuauuuagaccucaugauguucagaaaccuaaggcagccacugcugcgaaggcaauuaaaaagaugaauccauuaaugaaugugaucgcucaugaaaaucgaguuggaccagaaacugagaaaguuuaugaugaugccuuuuucgaggacuuggaugguguugcaaaugcauuagauaaugucgaugcaaggauauauauggaucgucguugugucuacuauagaaaaccucuguuagaaucaggaacucuugguacuaaagguaauacacaaauuguuguacccuuccuaacugaaucuuacagcucaucucaagauccaccugagaaaaguauuccuauaugcacauuaaagaauuuuccuaaugcgauugagcauacacuucaaugggcuagggauguuuuugaaggccuguuucgucaaucugccgaaaaugcugcucuuuaucugagugauccuaauuuuaucgaucgaacuuuacguuugccuggcguacagccgauggaaguccuagaaucuaucaaacaagcucuuauugaugacagaccaaaauccaucgaagauuguauuacuugggcuagaaaucauuggcaagaacaauauucaaaucaaauccgucaacuucuuuucaauuucccaccugaucagaugacaacuaauggucagccuuucuggucuggucccaaaaggugcccaguagcuuuagauuuugaugugaauaaugaccuucauuuggauuauauuuuggcugcggcuaaccugaaggcugaagucuacgguauuccccagguccgugauagaagcauuauugccaaaauaguccagaauguugaggucccugaauuuacuccuaaaucagguguaaaaauugcuguaacugauucgcaaauggccaauggagcuggugggcaaguugaucaagauagaauuggacaguugcagaacgaacuaccuucaaaagaaauguucaacggcuuaaauaucacaccccucgaauuugaaaaagaugaugacaauaaccuucauauggauuucaucguugcugcaucaaauuugagagcugcgaauuacaacauaccuccagcugauagacacaaaaguaaguugauagcugguaagauuauaccagcuaucgcuacuacaacaucagucguugcuggucuaguuuguauugaacucaugaaguuggcuaaggguuauaaagauauaaguuuguuuaagaaugguuuuguuaauuuggcgcuuccauucuuuggauucucugagccuauauuagcacccaaauugaaguauuacgaaaaugaauggacauuaugggaucgauuugaaguuacuggagagaugacucuuaaggaguucaucgauuacuucaaggauaaacaucagcuggaaauaacaauguuaucccaagguguuuguaugcuguauuccuucuuuauggcuaagagcaaauuagaagauagacuuaaucuuccaaugucggaagugguucguagaguuucuaaaagaaaacuugaaccucacguaaaagcacucguguuugaacuuugcugcaaugacaccgauggcaaugauguggaaguaccuuaugugagguauacauugccuuga

SEQ ID NO: 6841 - RNA, 1278 nt, Nezara viridula
auggcugauaaugaugaucuguuggauuaugaagaugaagaacagacagagcaaccuauuguugaagguucaggagauacagcuccccgcaaagaugugaaaggagcuuauguaucgauacauaguucugguuuuagagauuuccuuuuaaagccugaaauuuuaagagcaauaguugauugcggcuuugaacauccuucugaagugcaacaugaguguauaccgcaagcaguucuugguauggauauacuuugucaagcgaagucuggaauggguaaaacagcuguauuuguguuagcuacccuucaacaaauggaguugacugaaaaucaaguaacaguuuugguuaugugucauaccagagaauuagcauuucaaauaagcaaagaauacgaacgauuuucuaaauauaugccaaacaucaagguugcuguauuuuuuggugguuuaccuauccagaaggaugaagaagucuuaaaaaauaauuguccucauauuguaguugguacaccaggacguauuuuagcuuuagugaagaauaaaaaacuaaauuugaaaaaccugaaacauuuugugcuagaugaaugugacaagaugcuugagcaguuagacaugaggcgugauguucaagaaauuuuuaggaauaccccucauaguaaacaaguuaugauguuuagugccacacuaaguaaagauauaaggccaguuuguaagaaauuuaugcaagauccgauggaaguguauguugaugaugaagcaaagcuaacccuacacgggcuucagcaacacuauguuaagcuaaaagaaaaugaaaaaaacaagaaauuauuugauuuacuugacaucuuagaguuuaaucagguuguaauauuuguaaaaucaguucagagauguauggcuuuggcucaacuguuaugugaccagaauuucccagcuguagcuauucauagagcuaugagucaagaagagagacuugcuaaguaccaagaauucaaagacuuccaaaagagaauacuuguugcuaccaauuuguuuggaagaggaauggauauugaaagaguuaauauuguauuuaacuaugauaugccugaagauucagacacuuaccuucauagaguagcgagagcaggacguuuuggaacuaagggucuggcaaucacauuugcuagugaugaggcagaugcuaaaguucuaaauaauguucaagauagauuugauguuaauauuacugaguuaccugaugagauugaccuuucaucuuauauugauggacgauaa

SEQ ID NO: 6842 - RNA, 1464 nt, Nezara viridula
augccuguugaagcuaugcaaacugauguggagaugaagguaguagauucuccuuccacagaagauccaguggcuacggcaguucaagaaauaagggagcacauacgucaauuggaaaaggcaguugcuaauaaagaaccucguuucauauuaagaguuuuacgucuucuuccuucuacacgucauaaacuuucuguaucaguccuccgcaauauaauaucuucauuuuauuuaaguaguccugaaaaagaugcuuuauuucuauauauugaagaugcuguagauucagauaccauccaaaaaacaaaacugaucaaaaauucuaauguuccucucuugccagaaauugaugcuuacauucauuuguugguacuugugagacuaauagaugcuggaaaggaaucagacgcugugaaguguucugaugcucuuauggccaagauaacugcucaaaaucgcaggaguuuagauuuaguggcugcuaaauguuacuuuuaccauucucgaguuuaugaacuuacuaaccaauuggaaaaaaucagaggauuccugcaugcuagacucagaacugccacucuuagaaaugauuuugaaggucaagcaguuuuaauaaauugccuuuugagaaauuacuuacauuauaaguuguaugaucaagcugacaaauuaguauccaaaucaguauacccagaaucagcaaguaacaaugagugggcuagauuucuuuauuauuuaggaagaauuaaagcagcucguuuagaauauucagaaucacacaagcaccuaguucaagcucugagaaaagcuccucaacaugcugcugucggguuuaggcagacuguucaaaagcuugcugucacuguugacuuacuucuuggugauauuccagaccgacagauauuucgucaggcaccacuucgucguucucuugcaccuuaucuucaauuaacacaagcugucagaacuggugauuugcaaagauucggugaaguauuggagauguucggaccccaguuucguucugaucauacauuuaccuuaauucuucguuuaagacauaauguuauaaaaacugcuaucaggugcauugguuugucuuauucacguauuacuccaaccaguauagcuucaaagcuuggacuagauucaccagaggaugcagaauucauuguugcuaaagcaauaagagaugguguuauugaagcuaccuuagauccugagcaugguuauaugcaaagcaaugaaguaacggauauuuaccggacuagagaaccacaauuagcauaucaccaacguauaucguuuugucuugaucuacauaaccagaguguaaaagcuaugagauacccuccuaaaucuuauggaaaagauuuagaaucagcugaagagcgucgagaacgagaacagcaggacuuagaguuagcaaaagaaauggccgaagaagaugaugacguuuuucccuaa

SEQ ID NO: 6843 - RNA, 1764 nt, Nezara viridula
auggcuuuaaguaauccuucagugccaguuucugaaaucuugaagaguagugcugauucagaugagcccaaaaagaaaucuagggaggauuggcguaaagcgaaggaauuggaggaagcaagaaaggcugguacugccccugcugcuguagaugaggaagggaaagauauuaacccccacauuccacaauacauuucaucugcuccuugguacuauagugcuaaaggcccuacacuuaaacaucagagaauacaagaagagaguguuaaaaaguuuuccgguauugaugaaugguacaagcgaggaguugacucuucaaaagugauaacaaaguauagaaaaggugcuugugagaauuguggagccauuacccaucaaaaaaaagauugcauggagagaccacggaaaauaggugcuagauuuacuggugcuaaaauugcaccugaugaauuuguucaaccugagcucucacgagauuaugauggcaaaagggaccgaugggcaggauaugauccaauacaacauaaaaugguuauugagagauaugcuaggauugaugaggccaaaaggcaguugagggcagauaaacuuaauucugaacagucagaagaagcugaagaagaagaaacaaaagaaaguauugcugaugaagguggugaagaugaggauaaauauguggaugaaguagacaugccagggacaaaaguagauucgaaacagagaaucacugugagaaaucucagaaucagagaagacacagccaaauauuugagaaaccuugaucccaguucugccuacuaugacccuaaaacaaggaguaugagggacaacccuuacgcuggauccgcagauacugauguggacuaugcuggagaaaauuuugugcgcuucaccggagauacguuagaucaugcaaaagugcaguuguucgcaugggaggcacauaacaaggguguugacguucauccucuuggagaacccaccaggcuggaaguacuuaagaaggaauuuguugggaagaaagaagaguucaaacaaaaaggacaagaagaccucauuaaaaaauaugguggagaggaacaucuaaaagccccuccuaaagaacuuuuauuggcucagacugaauauuaugcugaguauacucguuauggaacuguuauuaagggacaagaaaaagaaguggugagguccagguaugaggaagaugugcuuauaaauaaucauacaacuguauggggaucauuuuggcauucaggaaaauggggauauaagugcugucauucuuuuauuaaggggucuuauugcacuggugaagcugguagacuagcggcaucugcuggagagguagcugucaagggcccggcauuuauuccuccacauccgucuacaccaucugccuccuccucuucuacgucuuccgauucuucaucgucgucgucaucaucagaggaugaagaagagaaagaaaggaugaagaagaaacaagaaaagaagaaagcgaagaagaagaagcaaaaaguaaagaaacuuaagaacaaaaucaaaaauaagaaaccugaagaaaagacugaagaagaaaaacuucaggaagccuugaaaaaggaggaagaagcucagaaagaaggugaaagacuuucaaaaauggaugaccguaagaggccauacaacagcauguuugaaguacagaaaccuacugacguggaaauggaagcauauuauaugaagaagaagagggaugaggaucccauggcaaacuucuuauaa

SEQ ID NO: 6844 - RNA, 627 nt, Nezara viridula
auggguauuucaagagaucauuaucauaaaagaaggaagacuggagguaagagaaaacccaucagaaagaagaggaaguaugaguuaggaagaccagcagccaacacuaaguuaggcaccaaaagaguucauuugguaagaacuagaggagggaauacuaaauuuagggccuugagauuggacuauggaaauuuuucaugggguucugaauguuguaccagaaaaacucgucugauugauguagucuauaaugcaucaaacaaugagcuuguacguacuaaaacacuugugaagaaugccauaguugugauugaugcuacuccauucaggcagugguaugaagcccacuacgcucucccauuaggaaggaagaagaaugccaaauugucugaagcugaggaggcuguccuauacaaaaagagguccaggaaaacggaaaacagguauaaggcgaggcagaaacuggcuaaagucgaaccugcauuagaagaacaauuccagacuggucguuuacuugcuugccuagccagccggccugggcaauguggacgagcugaugguuacauccuugaggggaaagagcuugaguucuauuugaggaaaaucaaagccaagaaaggaaaguag

SEQ ID NO: 6845 - RNA, 936 nt, Nezara viridula
auggaucgucucuugcguuuaggggguggaaugccaggauuaagucaagcaccaccuccuucugaugccccuguuguagauacugcagaacaagucuacauuucuucucuggcucuccuuaagauguuaaaacauggaagagcuggagucccuauggaaguuauggggcuuauguuaggagaauuuguugaugacuauacuguaagaguaaucgauguguuugcuaugccacagacaggaacaggugugaguguagaagcuguggauccuguuuuccaagcuaaaauguuagacauguugaagcaaaccggucgccccgagauggugguaggaugguaucauucccauccaggauuugguuguugguuaucagguguugauaucaacacucagcaaagcuuugaagcucuuucagaaagagcuguagcuguuguuguugauccaauccagagugucaaaggaaaaguugucauugaugcuuucagauuaauuaaucccaauaugaugguucuuggccaagaaccacgacaaacuaccuccaauuuggggcaucugcaaaaacccuccguacaggcuuuaauacacgguuuaaaucgccauuauuauuccaucagcaucaacuacaggaaaaaugaauuggagcaaaaaauguuguuaaauuuacauaagaagucauggauggauggacugaugcucucugacuauucagagaauuguaaaguuaaugaaaccacagucggggacaugcuugaauuagcuaagaauuacaauaaggcauuagaagaagaggagaaaaugacacccgaacaacuugcuauaaagaacguugguaagcaagauccgaagaggcauuuggaagagaaaguugaugugcugaugucggcaaauauagugcagugucuuggugcuaugcuagauacuguuguguucaaauga

SEQ ID NO: 6846 - RNA, 1218 nt, Nezara viridula
augacguacacgacuuuugagcaaauggauguugacgaaaagaagggggaaggcuuucguucuuauuacaucacuaaaauugaagaacugcaauuaauaguugcggaaaagagucaaaaucugagaaggcuccaagcacaaaggaaugaacugaaugcuaaaguuaggauguuaagagaagaauugcaacuacuccaagaacaaggaucauauguuggugaaguagugaaaccaauggauaaaaagaagguacucguuaaagugcauccugaaggaaaguuuguuguugauauugauaaaaauauugauauaaaugaugugacuccuaacucucgaguggcuuuacgaaaugagaguuauacucugcacaaaauucuaccuaauaaggucgauccucuuguaucauugaugaugguugagaaaguuccagacucuacauaugaaaugguuggaggucuugauaagcaaauuaaggaaaucaaagaaguaauugaacuuccuguaaaacauccagaacuguuugaugcacuaggaauagcucagcccaaaggaguuuuauuauauggaccaccuggaacagguaaaacacuuuuggcaagagcaguugcccaucacacugagugcacguucauucgugugucaggaucugaguugguucagaaauucauuggggaaggauccagaaugguuagagaauuguucgucauggcaagagaacaugcuccaucuaucauauuuauggaugaaaucgauucaauagguucaucacguaucgaaucugggagugguggugauucugaaguccagagaacaauguuagaguuauugaaccaauuggauggcuucgaagccacaaaaaauauuaaggucauaauggccacuaauaggauugauauuuuggacccugcucuucugcguccuggaaggauagaucguaagauugaguuccccccaccaaaugaggaagcucguuuagauauccuuagaauucauucacguaaaaugaaucuuacccgggguaucaacuugcguaaaauugccgagcucaugccuggagcuucaggugcagaaguaaagggugucuguacugaagcagggauguaugcccugagggagaggagaauccaugucacccaagaagauuucgaaauggcuguggccaagguuaugcaaaaggacuccgagaagaauaugucaaucaagaaauuauggaaauaa

SEQ ID NO: 6847 - RNA, 603 nt, Nezara viridula
augguuaaguuguaugcgcuucauauuuuauacaaaaacuuaaauagugcaguaugguugaagacagcuuaugauguccaaaguuuuggguauuuucaaagaggaacugcccaggacaccauggcuuuugccaguaaaacaauaguugaaaggacucaaucugcgaccaggcaaucugucaaagaaggagauuauauuugucacguuuauguaagagcugacaacuuagcagggguugugauaucuaaucaugaauacccucaucgaguugcccacacucuaauaacaaaaguauuggaugaauuuagugcuaaguauccaccuucaacuugggcaucagcaaaugaagccaacauugauuuuccugcauuagcagcucaccuucaaaaauuucaaaauccaaaagaagcugaugcucuuaugaaaauucaaagugagcuugaugaaacgaaaaucauucuucauaacaccauuggagcuguuuuagagcgaggagagaaauuagacgaucucaucaugaaaucagagagucucaguuaucaguccaaagcauuuuauaaaacugcuaggaaaacaaauucgugcuguucguaugucgguuaa

SEQ ID NO: 6848 - RNA, 747 nt, Nezara viridula
auguuucucacacguucagaguacgacaggggggucaauacuuucucaccugaggguagauuguuucaaguggaguaugccauagaagcuauuaaguuagguuccacugcaauagguguuugcacuccagaaggaguuguaaugggagcugaaaagagaauuaaguccacauuaauggagccagaggcuguagagaagauucugcaaguugaugaucauauugguugugcaguaagugguuugauggcugauucuagaaccuuaguggagcaugcuagaguacagugccuuaaucauugguuuguuuaugaugaaaagaugccuauagagucggcugcccaggcaguuucaaauuuggcuaucagauucggugaugcugaugaagaugcuggcccagcgaugaguaggccuuuuggaguagcugucauguuugguggauuugauuauagaggaccucaacucuaucauauggacccuucagguacauucauuuauuuugaugcuaaagccauagguucuggaagcgaaggagcacaacaaagacuucaagaguuguaucauaagggaaugagccucaaagaagcuacacauaugauuuugacuauuuugaaagaaguuauggaagaaaaauugaccgauaacaacguagaaauagcaguaguaacugcagaagagaaacaauuucguauguauaccaaggaagaaguuucuaaaguaauaggagaaacgcaggcacaaacuucauaa

SEQ ID NO: 6849 - RNA, 1167 nt, Nezara viridula
augagugaauacuggcuaauaucagcuccuggcgacaaaacaugccaacagacaugggaaaccaugaacaaucuuaccaguaaacagcacaauuugucugaaaauuucaaauuucauauuccugauuuaaaggugggaacuuuggaucagcuuguuggacuuucugaugauuuaggaaagcuugacaauuuuguugaucaggucacucacaaaguagcucaguaucugggcgaaguuuuagaggaucagaaggauaaauuacaggaaaaccuaauggcuaauaacacugauuuaucuaccuauauuacaaaguuccagugggauauggcuaaguauccuauuaagcaaucucuucguaauauugcugauauuauaagcaaacaagugaaucaaauugaugcugaccugaaaacaaaaucuaccgcuuacaauaaucuaaaaagcagccuucaaaauauggaaaagaagcagagugcaaguuuguugacacggaacuuagcagacuuaguuaaaaaagaacauuuuauuuuagacucugaauaucugacgacauuauuaguuguuguuccaaaaucaaacuucaaugaguggaauaccagcuaugaaaaacuuacuaauaugauaguuccccguucaagucaacuuguuuaucaggauucugauuuugguuuguucacugucucauuauuuaagaagguuguaaaugauuuuaaauuaauggcuagagaaaagaaauuuguuguacgugauuuuauuuauaaugaagaggaacuagcugcuggaaaaaaugaaauuacaaaauuggugacugacaagaagaagcaauuuggaccucuaguucguuggcugaaggucaauuuuagcgaauguuuuugugcuuggauacauguaaaagcauugagaguuuuuguugaaucuguuuugagauaugguuuaccuguuaacuuccaggcuauguugauccauccucacaaaaaguccguuaaacguuugagagauuuacugaaucaacuauaugcaccauuggacaguagugcucaacagcaaggaaaucaagguggugguaaugauaguguggacauuccuggauuaggauucggccaaucagauuauuauccauauguauauuauaaaauaaauauugauauguuagacacaaaggcuuaa

SEQ ID NO: 6850 - RNA, 1653 nt, Nezara viridula
augucaacuuuaggcguuccguuaucgguuggaggcacaagacaaucaggagcuccagucagaacccaaaauguuauggcggcaugcuccauugcaaauauugucaaaagcuccuuggguccacucggauuagacaaaaugcugguugaugauauuggggaugucaccguuacuaaugauggagcuacaauucuacgacugcuugagguagaucauccugcugcaaggguucuugucgaucuagcucagcuucaagaugaggagauuggugaugggacaacuucuguggucaucauugcagcugaacuuuugaggaaugcagaugaauuggucaaacagaauauucauccaacuucuaucaucagugguuacagacuugcuugcaaggaagcucagaaguauauucaagaacaucugugcgucaguguugaagaauugggaaaagauucuaucauaaauauugcaaaaacuuccuuguccagcaaaguuauuggaauugaugaugacuucuuugcaaccaugguagucgaagcugcacaggcuguaaaaguuagugauagcaaaggaaaagcuaccuauccuauuaaagcuauaaacauuuugaaagcccacggcggaucagcuaaagaaagcauuuugguuaauggauaugcccuuaauugcaugguugcaucaaugggaaugacuaagcgaguagaaaaugcuaaaguugcuugucucgauuucucuuuacaaaaaacgaaaaugaaauuagguguagaaguuuuaguagaagacccuaaucaguuagaagcgauuagagauagggaagcugauauuacaaaagacagaauucaaaaaauucuuaguguuggaaccaauguaguucuuuugagugggggcauugaugacauuuauaugaaauauuucaucgaagcaaaugcuauggugguaaggaggguuaaaaaagcugacuuaaaacgaaucgcuaaagcaacuggugccucuuuugcaacaucccuaacuaauauggaaggugaagaaucauuugaugcuagcuuauuaggagaggccgcugaagugucucaagaaagaauuugugaugaugagcuuauccuuguuaaagguccaaaagcacacucagcugccuccauaauccuccguggaccuaaugauuauuucugugaugaaauggaaagaucaauucaugacucauugugugcaguaaaacggguucucgaaaguaaaacaguuguggcuggugguggagcuguugaagcugcuuuaucaaucuauuuggaaaacuuugccacaucuuuaaguucaagagaacaguuggcaaucgcugaguacgcuaaaucacuauugguaauuccgaaaauacuugcggucaaugcagcucuugauucgacugauuuaguugcuaaauugagagccuaccacaacaccagccagacgaaaaaagaucaugcucaccugaaauggcauggacuugauuuguauggaggugcagugagagacaacaaaaaggcugguguccuugaaccaacuauuucaaaaaucaaguccuugaaauucgccaccgaggcugccaucacgauucuucgaauagaugaccucauccgucuggaagcugagaaaaaagaucaucaaggccauggggauaugaacuaa

SEQ ID NO: 6851 - RNA, 777 nt, Nezara viridula
auguugaauauaucugaugcuaugacaucuuuugagcguaauucuaucagaaguaacgacagcacacuugaagaucaucaaguuaaaauuaucaaagcuccggauuuucuaacuaggacuuuauauccuaugacaacuacagcaucugugguuggaaucaaauucaauaaugguguugcuauugcugcagauguugguggcuauuauggaucauuaaaucguuucaaaucucuugauaggcucuacaaaguuaauaacaacauuguaaugacaacaacuggagauuaugcugauuuucaauacaugagagaguuaauucaacaaaaaguuaucagugaagaaauuuuagaugauaguuuuuccuuaaaagccuuuucucuucauacuuggcucacucgccugauguacaacagaaggucaaaauuugaucccuuguggaauaauguuauuguugcugguuaugauaacaauggacccuuccugggaauaguggacaaacuagguaugaguuaugaagauaguuguguagccacugguauggguggauaccucgcuacuccgcucuugagggauguguuugaacgcgguaaaggaaauuugacuaaacaagaggcccaugcugcccuucagaaauguauggaaaucuuguacuacagagauacacaaucacuuccuaaguuccgaauugcaacagucaccgaagaagguguugaaauaucaccugaauuagaaguagaagguaauugggaaaucgucaaacauucuaagggauuuuga

SEQ ID NO: 6852 - RNA, 2052 nt, Nezara viridula
augaaugaucaucuuaagaaauuuucuggugucgauuucaacccugacaaauaugugaaagaaauaucucaagucuguguugguggaauugaacuucaaagccacagagcuaaaauucaggcucuugcugaagaaacaagccaaaauuuaaagaaaaauguuuauaaaaauuauaugcaguucauugaaacugcaagagaaauaucucaucuugaaggggaaauguaucagcuaucacaccuauuaucagaacaacgugcccuucuugguucaaugaguaauucaggugcugaaccaguucuucaagcuucaagcaaagcccaagaagaaaaaagaauugcagcuuuaucaucuguuuuggagaucauagaauccugcccggaucuucuugacacuccagguagggaacuuuugcacgaaggugacauuguggaacuagauccucuagaaaauacagcucuucaucgaacccgggcuuuacucuuuucugauauguuucugauugcuaccuggauaucagaaaggaaaggacaagcuaaguauaaguuugaaagcaguuaugaucugggaagcauggcuguuguaaaugugagggaucuuggacaaguuaaacaugcuuuuaaacuuuuaguauuuccugauacuaggcuuuuucaauguguuaauaaugaagccagggaggaauggcucaaaagguuugaugaagcuaagaaagcucgauugaauucagaacaaauuaaaaaaaaagaugauaauguaaaagaaccgcauaccauucaugagcaauuggcaaaacccccugagagaacugauucgguugaauuuggaucuaauccauuuggauuugugcuggaugaugaugaagauugcaaugcacucccagaaugguugacugaagcagcugaugaucuugauguaucuauagcucaaagacauuuugaagaagccuaugcaaucauucaaaaagccgaggaguauuuugcgucugcacaagaugaucaaucacuaacagauauaaaguccaaaguggagaauaggaaagauguauugaucagcguucuccuaucagaguugaacgucagugcugaaaaaucauuacaaggaggucuucgagcuagccggagagcuguuaggcuacuuaaucagcugaacaaaucaacccaggcaugugaacuguauuugaaaguuuguacaaaccuccuaaaagcacaaaguaaacgagugaaaagagagggcgcaacaguggcauacgucaagagauuaucagaaguauauuuuucaaaucuagcgucuauaacuucugaauuucaauaccgugcauucccucacaaucaagauuguacaucagcuuuuguuguaugggugucaauggaagccucucauuuccuuucacacaucauaaagcaaguauucaucccucagacaccucucgguacgcuagcagagugcauagacauuauuaggaagcaaucucagcagaugugugagcuuggacuagaucuaagcuaccagguuaauggccagacuaugaccgcaguuacacgcgcaguagcugaagcaggagagaaagcuguugaugccgucaaggugagagcugccgaagacccauggagaccguccaggcagacgcagcaaucagucaacaagauucagucagaguuagggcucccuguuucagaauaucuggcucaggauggagucuuugagcugacugcaaacagccugucuuuugcuaaguuguuauccucuuugacggaugagggucuuaugauauccugucaggauuuggaguucgcacuaaguaaaguauugaaggaaguacuuaaggcacauuugaaccaucuuucagccucuuacucuaguaauaaauuugguucucagagaagucuuauacagcaaaaugcaaaguucauucucgaucaauuauuagaaucagugcagaggaaauauagugaaaaaaugggccauagauguaagaaauuggacacauuaaggaaagaauuuaauuuuauuuugaaggagaguaaaacaacaauuacugguuacauuuag

SEQ ID NO: 6853 - RNA, 3780 nt, Nezara viridula
auggaugaagugaaaaaacuugagcaccuuucauuggugucgaaaauauguacagaacuugaaaaucauuuaggauuaaaugacaaagauuuagcugaauuuaucauugauuuggcgucaaagaauaauacuuuugaaagcuucaagaaagccuuacuagauaaugaugcagaguuuucugauuccuucauuucgaacuugcugaggaucauccagcauaugcgaccuaagagcgagcuaaccguaacgaaagacaugacuaaacaagaaaaacugagcaugaaauuuccaggacuagcuauccccaaugaugugcagccgaugaagagccauaaugagaaaaaguugaaucugucuacgauuaaggaagacccugaagacaaugaagucgaagaugcgauggcagcucuugaagcuuuagcuccuucuaaagaaaugaaauucaauuacaagacugaaagagcauccaagucuccagaaaaaauuauuaaacaagaauuggagaagcccagaaaacguagucgcagccguaguagaaauagagacaaaaagagaaauaggaguaggaguagaaguagaggaagaggaagaaguaaagagaagacauccaguaaaagcaggcagagaagugugagucgagggagaagaagaagaaguagagacagaaguucuagucgaaauagaaaucauguaaagaacagggauagagaaaggagagacaaaaaugaucguaggaguagaagcaggagcaaugguagaaagaggaaugaaagaagucggagcaggagcacugguaggagaagaaaugacagaagucggagcaggagcuaugacagaaagaaaaaugacaggaaacgagaaaaugaagaugagaagaauaagaaugaugaaccucuugaacccgaaguugguaaaauauauaauggaaaaguuaccaauaucguuucuuuugguuguuuuguucaaaucgaggguuuaaagagacguugggaagggcucguucauauaucgcaacugagaagggaaggaagaguuacgagugcuucugaugucguuucucguggaaugaaagucaugaucaaaguauugucggucgcugggcaaaaggugucucugucuaugaaggauguugaucaggaaacuggaaaagaucuuaauccaacuguucgucaugccgccaauaaggacagagaagaagaagcuucgaugcgaaacccugaccgcccgacgacgcuucuagacuuaggcuccuucgaugaucaugacgacuuucagagcagaaaaaggguuaauaggauaucuucacccgagaaaugggagaucaagcagauguuaucugcaaguugcauugauaaaagugagcuuccugauuucgaugaagagaccggauugcuuccuaaagaggcugccgaggaagaagauauagaaauagaaaucgucgaagaggaaccuccuuuucuacaaggacacggaagaaauuuacacgaucuuaguccuguuaggaucgugaaaaacccugaugguucucuagcucaggcagccaugaugcagagcgcccucgcgaaggagagacgggaacagaaaauguugaacagggaacaggaaauggaccaaguaccgacgggcuuaaauaaaaauuggaucgauccacuuccugagagugaugguagaacucuggccgcaaacaugcguggaauuggccuaacgaaccaagaucuuccagaauggaaaaaacauguuauuggagggaaaaagaguucuuuugguaugaagacaaacaugacccuuuuggaacagaggcaaagucuuccaauuuauaaacucaaggaggagcucaucaaggcuguuaccgauaaucaaauuuuaaucguuaucggugaaacaggaucaggaaagaccacucaaaugacucaguauuuggccgaagcagguuucacguccagaggaaaaauugguuguacacaaccgagaagagucgccgcaauguccguggcaaaaagaguggccgaggaguucgguugccgcuuaggccaagaagucggcuacaccauucguuucgaagauuguaccagcccagaaacagucaucaaguacaugacagaugguauguuacuucgagaaugccucguagauuuggaucugaaaaguuauucuguuauaauguuggaugaagcccaugaaaggacuauacauacugacgugcucuucggacucuuaaagcaagcuguucaaaaaagaucugaacuaaaacuaauuguuacaucagcuaccuuagacgcugucaaguucucacaguauuucuucgaagcaccuauauucaccauuccaggucguacauucccuguugaagugcuuuauacaaaggaacccgagacagauuacuuggaugcaucacuuauuaccguaaugcaaauacaucugagggaaccuccuggagauauuuuguuauuucuuacaggucaggaagagauugauacagccugugaaauuuuguacgagagaaugaaaucacuaggucccgauguuccagagcuuauuauucucccaguuuauucugcacuuccgagugaaaugcaaacucgaauauuugaagcagcuccaccuggaucgagaaagguugucauagcaacaaauauagcugaaacaucucuuacaauucauggaaucuucuacgucgucgauccuggauuuguuaaacagaaagucuacaauucaaagacaggaauggacucucucguuguuacaccuaucucacaggcacaggcaaaacaaagagcggguagagcugguagaacaggaccaggaaaaugcuauagguuauacacagaacgugccuacagggacgaaauguuacccacuccgguaccugaaauucaaagaacuaacuuggccacaacugugcuacaacugaaaacgauggguauuaaugaccuccuccauuucgauuuuauggaugcuccgccagucgaaaguuuaauaauggcucucgaacaacuucacagccucagugcccuugaugacgaggggcuucuuacaagacuuggaagaaggauggcagaauuuccuuuagaaccuaauuuaucaaaaauguugauuaugucaguucaccugcaguguucagacgagauacuuacuguaguaucaauguuaucuguucaaaauguauuuuacagaccuaaagauaaacaagcgcucgcugaucagaagaaggcuaaauucaaucaagcagaaggugaccaucucacacuacuagccguuuauaauucguggaagaauaauaaauucagcaaugcgugguguuaugaaaauuuuguucagauaaggacgcugaagagagcucaagauguuaggaaacaauuguugggaauaauggaucggcacaaauuagauguuguaucagcugguaaaaauacaguccguguucagaaagcugugugcucugguuucuucagaaacgcugcaaagaaggauccucaagaaggauauaggacauuaguagauagucagguuguuuauauucauccuagcagugcucuuuuuaaucgacaaccugaauggguuauuuaucaugaacuuguucaaacaacaaaagaauacaugagagagguuacaacgauugauccgaaauggcuggucgaauucgcaccagcuuucuucaaguuuucugauccgaccaaacucagcaaauuuaagaaaaaucaaagacuggaaccucucuauaauaaguaugaagaaccuaaugcuuggagaauaucaagaguucggcgaagaagaaauuaa

SEQ ID NO: 6854 - RNA, 1245 nt, Nezara viridula
auggcaccuacuagaaaaucugaagggcugcuggcccgaguuaauuuucccuuauacacuuugcaaaugcuaacaagucgucauguucuuguugguggagguggagguucagcuaaaacugggguugccaaugguuuugaaauuuuugaguuaucuuaugacggaacccguuuuucugcugaagaaguuauucgacaugaaacuggcccuaaaguugugaugaacucagcuuguuuuagugacaagaaaaguacuuuuuuaguugcugggcaagaaagccacugucaguuauacagaguugguauuagcguggagaaggagguuuccgaagaaucaaugaauggcacaucggauccaccuaaucucagacacagaaaaacuucuaaaaaucaccagaaugggaucagugaagugacaaauaauguuaaaaagaaauuaguuuuuaaauucaacucuggggauaguauacagucugauuuuagugaaaaggaaccaugccaaaggguaguuacaauaucucguuguggcgguuggauggcaacugguggcacugaugguauuguaaggaucuggucauuuccuggccuucgaaugauuagagcucuuaaggcccacacgaaggagcuggaugauuuacauuucaguccugauucaaagcagguagccaguguggcaaaagauggacaagcaauuauuugggagcugaagucaggaaaacagguucauaaacuugauuggacucauccuacaggaaucaaauaucucuucaaacgaugucgguucggugugguugaggguaaagguuguagauuguuuacuacagcuaacccuguggcuggugggaaggaagcccaaggcuggauccacgccugggacgauggucguauuuccaagucgacugcuguaucugaaccuacuucagcacuugcuguuagagacgaugguguuuucauugcuauuggcaccauguucacaggaucuguauccauuuacauagcauucucccuucagagagugcugcauguugagggugcacauucaauguucguaacugggguugaacuguuacccuguucuucugcauggggugcgauagaagcugcugcuuuaaguauuucugucgauaacagagucuguauucacagcuuaccauuuagaaaaacguuaccgccaugguuagugaucaucauuauuuuguucacucuauuguuuacuuuuguauugugcagcuucaucggccuuuaa

SEQ ID NO: 6855 - RNA, 1251 nt, Nezara viridula
auggcgggugcaauguuguuugagaggacugucucuuccagagauagggauaauagucgaauucuuccaacuucuagcagaaacguugacgaagaaaaugaagaagacaucaaaaauaaggaacaaggaauuuugcaguugggagagcaauauaagaaagaaggcaaagcuaaagaguuagcagagcuuaucaaggcaaguagaccauuucuuagccagauuaguaaagcuaaagcugcaaaauuagugcguucuuugguagauuauuucuuggaucuugaagcuggaauaggaauagaaguucaacuuuguaaagaguguaucgaaugggcuaaagaugaacacaggacuuuucucaggcagucacuggaagcuaggcuuaucgcucuauauuucgacacaggaauguuuacagaagcacuacagcuuggcucaagucuucuuaaagaauuaaagaaauuagaugauaaaaauuugcuuguugaaguccuuuuguuggaaucuaaaacuuaucaugcuuugagcaaccuuucaaaagccagggcugcuuugacaucagccaggacaacugcuaauuccauauauuguccacccaaaaugcaagcagcccucgauuugcaaucugguauauuacacgcagcagaugaacaagauuucaaaacagcuuacucauauuucuaugaagcuuuugaaggcuaugauaguguagagagcccaaaggcuuuaguugcucuuaaauauaugcuucugaguaaaaucauguuaaacacaccagaagacgugcagcaguugguuagcgggaaacuugcucuuaaacaugcugguaaagauauugaugcaaugaaaucaguugcucaagccagccauaagagaucacuugcugauuuccagcuaacuuuaaaaaauuacaagaaagagcuugaggaagauccaauuguacgagcucacuuggguacacucuaugauaauauguuggaacaaaauuuguguaggaucauugagccuuauuccagagcucaagucgauuuuauuucaaaaucaauuaaacuuccccuuccucaaguugaaaagaagcuuucucaaaugauucuugauaagaaguucaaugguauucuugaccaaggugagggaguucuuauaguguucgaagaugcgauuguugaaaaaaccuacgaaauggcccuggaaguuauuaacagcauggguaagguuguagacacauuauaucaaaaagcuaagaagcucucuuaa

SEQ ID NO: 6856 - RNA, 1686 nt, Nezara viridula
augucuaccaagucaccuaaaaaaacuacuccagcuggugcuucaucagcagguccuucuagaaguucaccuagaaaaagugaaacuccuacuccucaaggugcuagaaagaguccuuuaaguccuacaagauauaguagacuucacgaaaagcaggaacuugcuaauuugaacgaucgcuuagcauguuacauugacagagucaggaauuuagaaacagaaaauaaccgguuaacucgggagguuaaaaguucucaagaaaauauuacgagagaaguaacuaguguuaaaucuuuauaugaaagugaguuaucagaagcaagaaaacuuuuagaugaauuaucgcgggaaaagacaaaacuucaaauugauacacggagguuguauacugaaaaugaagaacuuaaaacugagcuugaaaagaagacuaaagauuguaauauucuccagacuucacuuucugucagugaaaauagacuugcagaucucacaacaaaauauaaucaacugcaaggugaaaggaagaagcuugcagaugaaaacaaggcauuggaaaaugaaagaaauaaacuuucaauccaguuaucagauacacgaaaacauuuggaggaagaaacucuccagagaguagaucuagaaaaugcugugcaaaccuuacgugaagauuuuucauucaaagaacaguuacaugaacagcaguuauuggaaacucguacuaaaaaacaaguggaaauaagcgaacuugaugguagauuaacccaggaguaugaagaaagauuauaccagagucuccaagaaauacgcgaucaauaugaaugugauauugaaaauaacaaggaagagauuaaaaaacuguaugaggaaaaaauccgcagucuugguagucaauugacacggaacagcaaugcagcagcaauggcuauugaagaaaugaaaaauaugcaagcuaaacuuaaugagcuuaauaggaaauuacuugacuuagaagcugacagaaaugcagcccagcaaaaggcuagagauuuggaaaagauuuuggaacaggcuaaagcucaauauauggaagaauauagucagagagaagcugaaaucacaacucuucgugaagagauggcucaccaaguucaagaauaucaagauuuaauggauaucaaaguugcauuagauuuagaaauagcagcuuaucgaaaguuacuugaaggagaagaagcuagguugaauauaacaccugugaguucuccugcucagacuucuucccguaaauuuuuagggaggaaaaggaaacguacuuucauugaagaaucugaugaaacagaucuuucuaauuauucuguuacuucuucaucaaaaugugacguugccaucucagaaguuuguagugaaggucaauucauuaaacuucuuaauaaaucuacuaaggaaguaucgcuuggggguuggcaacuaacucguaaagcuggagauuccuccacaauuuacaaguuucaucgaaauauuaaaauggaaccuggggcuacuaucacuguuuggucuucagauguuccagauaaaucucaugaaccaccagaaaguuuacuuaugaaaggucagcgcuggaugguugcugauacuaugacaacaguuuuguugaauccugcuggagaagaaauggcuauaucugaacacaaaaaaacaacaacugaguga

SEQ ID NO: 6857 - RNA, 2409 nt, Nezara viridula
auggcugauaugaaaaguaaugaagauuuguccacugcuauccugaaaaagaaagaucggccgaauagauugauuguugaagaugcagucaacgaugauaauucaguuguugcucuuucacaggcuaagauggaugaacuucaauuauuucguggagacacugugcagcuuaaagggaaaagaaggaaagaaaccguuuguauuguguuaucugaugauaccugcccugaugaaaaaauuaggaugaacagaguuguuagaaauaaucuacgaguucguuugucagauauuguuucaauucaagcuuguccugaaguaaaguauggaaaaagaauucauguuuuaccaauagaugauacuguugagggauuaacagggaaccuuuuugaagucuuucuuaaaccauacuuucuggaagcauaucguccuauucauaaagaugauacauuuguugucagaggugguaugcgugcuguugaauuuaaaguaguagaaacggauccugcuccuuauuguauuguagcaccugacaccauuauucauugugagggcacucauaucaagagagaggaagaagaagaagcuuuaaaugcuguuggauaugaugauauuggagguuguagaaaacaacuugcucagauuaaagaaaugguugaacuuccuuugagacauccuagcuuauucaaagccauuggugucaaaccuccucguggaauauuacuuuauggaccaccuggaacugguaaaacauugauagcacgugcuguggccaaugaaacaggagcauuuuucuuuuuaaucaaugguccagaaauuaugaguaaacuagcaggugaaucggaaaguaaccugcguaaagcauuugaacaagcugaaaaacaugcaccuuccauaauuuuuauagaugaauuggaugcuauagcuccaaaacgagacaagacccauggagaaguagagcggagaaucgucucacaauugcuuacuuugauggauggucuuaaacaaaauucucauauaauuguuauggcugcuaccaacaggccuaauucaauugaugcugcucuuagacguuucggacgauuugaucgugagauugauauugguauuccagauacuacuggacguuuagaaguucuucgaauucacacaaaaaauaugaaacuugcugaugauguuaauuuagaacagauugcagccgaaacacauggucauguuggugcugauuuagcaucucucuguucagaagcagcucuucaacagauucgugaaaaaauggaucuaauugauuuagaagaagaccaaauugaugccgaaguucuuaauucucuugcuguuaccauggauaacuucagguaugcuaugggcaaaaguagcccuagugcccuucgugaaacagugguugaaguuccuaauauuacuugggaugauauugguggucucgauaauguuaaaaaagaguuacaagaauuaguucaguauccuguugaacauccagagaaguucuugaaguuuggaaugcaaccuucccgugguguuuuguuuuauggaccaccagguugugguaagacuuuguuggccaaagcuauugcuaaugaaugccaggccaacuucaucucgguuaaggguccugaauuauuaacuaugugguuuggagaauccgaagcuaauguccgugauauuuuugauaaggcuagagcugcugcaccauguguucuuuuuuucgaugaacuggauuccauugcuaaaucaagagguggaagugucggagaugcuggaggugcagcugauagaguuaucaaccaaauacucacagaaauggaugguaugggagccaagaaaaaugucuuuauaaucggagccacuaauagaccagacauaauugauccugccauacugagaccuggucguuuagaucagcucauuuauauaccuuuaccugaugagaagucaagagaagccauuuucagagcaaacuuaagaaagucaccuguugcuaaggauguugauuuacaauacauugccaaaguuacauuugguuauucuggagccgaucuuaccgagguaugucaaagagcuuguaaacuugccaucaggcagucaauugaagcggaaauuaaaagagaaaaaaguagauuagauggagcuacacgaauggauauggaugaugaagauccuguuccugaaauaacucgugaacauuuugaagaggcaaugagguuugcuaggcgaucagucacugauaaugauauucgcaaguaugaaauguuugcucagacauuacaacaaucaagagguuuuggaacuaauuuuagauucccugcuagcucaaauaucccuagcgcaccaggagguggaggaacagaaacuaacaacuuuccagaugauggagaugaugaccuuuauaauuaa

SEQ ID NO: 6858 - RNA, 834 nt, Nezara viridula
augacggaccagcaaauggacugugcucuugacuugaugcgaagauugccuccucaagaaauugaaaaaaauuugagugaucuaauugauuuaguuccaagucuuugugaagaacuguugucuucaguagaccaacccuuaaaaauugccauugauaaagggguugguaaagauuauuuguuaugugauuacaaucgggauggugauucauacagaucaccuuggagcaauacauaugauccucccuuagaagaugguucaaugccuucugagaggcuaagaaaacuagaaguagaagccaaugccgcuuucgaucaauauagagagauguauuuugaaggcggugugucuucuguuuaccugugggauuuggauaugacugguuuugcaggugcuauuuuaauuaaaaaggccggagaugguucgaaaaaaauuaaagguugcugggauucuauucacguaguugaaguucaagaaaagacaacugggcgaaaugcucauuacaaauuaacuucaacuguuaugcuuuggcugcaaacuaacaaaacuggcucagguacgaugaaccugggagguaguuuaacuaggcagauggaacaagaugcaccuguuucagaggcuucuccacacauugcuaauaucggccgaaugguagaagauauggaaaacaaaauuaggaacauacuuaaugauauuuauuuuggaaaaacuaaagacauugucaauggcuuaagaagcacacaggcauuaucagaacagaaagcccaggcugcucugaggcaggaucuugcuguagcucuucagaagcggcaggcaaagacugcggaaaauuga

SEQ ID NO: 6859 - RNA, 3489 nt, Nezara viridula
augcagcaaauggacuccuugcaaccuaacaacgcaacaggacuggugaaaacuggacuagaggcgggggccgguagcggcaugaaagagcccccgccacgagaggagccgguccuagacccaaucaacgguguuguccagccaccggucauaccuccaucccacaggccuggccgaguaaccaaccaguugcaauauauucagaaaaauguccucaaagcagucuggaaacaucaguaugcuuggccccuacagcaaccugucgaugcuaacaaacucaaucuuccggauuaucauaaaguuauuaaacauccaauggaucuugguacuaucaaaaaacgacuggaaaacaauuauuauugguguggugcagaauguauucaagauuucaauacaauguuuaacaauugcuauguuuauaacaaaccuggagaagacguuguuguuauggcucaaacauuggaaaaacuauauuugcaaaagcuggaaacgaugcccaaagaagagauugaacuggagccuccaccaccuaaaggcuccaagccaguuaagaagcggccuggaguuauaggaccuggaagaggaggugggacuacuggugccgggagggggaggccuuccaauucaaccacagcagccgcagcaguaguugcugccccuguaccuccugccacuccuccgucucaccuuccagcgaccauaccugguucaacugcuaccacuaccguaccuaccacacaccauaacucucuuccuccacagguugggcagccagcagcuguacccuccaacuucaaugccacuaccguugauccucucuuaacaccuggauuggcucccgguguggguccaaaagguggcaaaggggccgucguccagaccccaacggcgcccaaaccgaagaaaggggucaaaagaaaggcugaucuagcaaaugauagcccugccggguuugacccgaccuacaccccaggugacuccaaagcugccaagguuggcacuaggagagaaucuggaaggcaaauuaaaaagccucaaagacagucagaugaugguaugccguuuucucaaagcccaauggcacccuauucacauucgaauucaacucaggcuucucacgaaaagccaaaagaaaaacuuuccgaaacauuaaaagcgugcaaugaaauauuaaaagaauuguuuucuaaaaaacauuucaauuaugcguggccauucuauaaaccugucgaugcugaauggcucgguuuacaugacuaucaugauauuauuaagaaaccuauggaucucggaacaguuaagcaaaaaauggacaaucgagaauacaaaacagcgacugaauuugcugcagauguaaggcugauauuuacaaauuguuauaaguauaauccucccgaucaugauguuguugcaaugggcagaaaauugcaggauguuuuugaagucagauucgcucaaguaccugaagacuccccuacaucgacuguucccgaaaaggaagacgaauccaccucugggucaucaucuggcucugaauccgaaacugauaauucagaagaugaaagggcccgcaaacuuagucaauuacaagagcaguuaagaaucaugcaggaggagaugagaaaacuuguugaagaaggcaccguaaaaaagaaaaagaagaaaaaagaugggucagguucugguggaagcucuucuaguaagaaaaggaaaucugcugauagaacacuugguaaagcugucgaugguggacuuuuagcuggugucggagcgccugcuaucauggaaaugaaggcuaccgaugguguaaaggccguuccuccuccaggcaggaaugcuguccccucaccucagguuaaaccaaacaagggcaaagcccccggcaggacaccaggaaaaacuaauucucaggguaagaggccaaagccaaacuccaggucuaccaacucaaagaagaagaauccuguggucacaucagaguuuaacucagaagaugaagauaacgcaaagccuaugucuuacgaugaaaagagacagcuaagcuuggauauuaacaagcuaccaggugauaagcuuggcagaguaguccauaucauucaggccagagagcccucuuugagggauucgaauccugaugaaauugaaauugacuuugagacauugaagccaucaacccugagggagcucgaguccuacguugcaucaugucucaggaaaaagccacauaagaaaguuucugcaaaaucaaaagaugaagcgauggcagagaaaaaacaagagcuagaaaaaaggcuucaggaugugacuggccaguugggaggaucagcaaagaagcaagcuaaaaaacaaggucagggaaggcuuucagcaucuucaucaucaagcucagauucugauacuagcaguucaagucucucaagcaguucuuccgacucaucugauagcgaagcagggaaagcugggcguccaccgagaaagaaaaacaagaaaaaucaccaauuagcaacaacugcugcuucagcuguccaacagaaucagacaguccccagcuugaccaugacaacagcuaccgguacaauuguaaauaaaucugucggggcuacacagcccguaguaccguuagcaagcaccaauaaacuuaccguaccuacaguaucugcagucgcacacccugaaccugugaaaccugucguggcaucucauaguagccugccucaacaaccugcgaggccgaccgcuacagcagccccucucacaaccgcuaagagagcgucaaucccuacaccugccacagccuuagguauaccuccuccugcgccaaccagccuugaaacagguccugucgagauuaaacaagaauuggauguuccuguuucacuagcuccugugccagaccacuuggauuucaaaaaccuuuuggaaguuaagcccgaguugaaugauauuguaacagggaugccuucaguauuugauccucugcccgacucaccccccauaauaaaggaagaaaaacaugccauacucccucaccacgcugauggacaucugaauaacucacuucccccuauaaguaacauaccuguucaaccaauuauaccgagugcugcacuuccaacaacaccacacgucuuagauaugaacaaaaauucucagccuccucagcuuccucagacaccaguuuuaccacacuccuuuaagccuaagacugucgaacaaaacuugaaaaacgccaguucauggucuucacuugcccaaucuccaacaccugcucuuaccccaacuccacccacugcagcggcacugaagucaucgauggcugacaguuuucaagcauuuaagaaacaagcuaaagaaaaugccaaaaagcgugcccucauugagcagcaagaaaugagacggcaucaaaaagaacaggcugaaagggaaagauuacguguugaaaaugagaagaggagagaaagagaagaagaagaagcuuuggaaaaggcc

SEQ ID NO: 6860 - RNA, 1284 nt, Nezara viridula
augauucccccgucuucucggccacaggucacuguauacagugacaaaaaugaaccaacuggugaauuauugacucucccugcagucuuuaaugcuccaauuagaccagauguaguaaauuuuguucaucaaaauauugcuaaaaaucauagacaacccuaugcugucagugcugaagcaggucaucagacuucugcugaaucauggggaacuggacgagcuguggcucguauaccucguguaagggguggugguacccaucguucuggucagggugccuucgguaacauguguagagguggacgcauguuugcaccaacuaggguauggcgcagauggcaucguaaggugaauguuaaucaaaagagguaugcaaugguuucugcuauagcugccacuggagugccagcacucgugaugucuaaaggacacauggugaaugaaguuccugaaauuccucuuguagugacugauaagauucaggaguauacuaaaaccaagcaggcaacaaucuucuuacaucgcaucaaggcuuggacagauauucagaagguauacaagucuaaaagguuccgugcugguaaagguaagaugcguaauaggaggcgcauucagcguagaggaccucucauuaucuacggccaggaucaaggccuaacucgugcuuuucguaacauuccugguguugaucuuaucaacguuucacgauuaaacuuacuuaaacuggcaccugguggucacguggguagguuuguaaucuggacccaaucagcuuuugaucaacuuaaugcucucuauggcacauggaagaaaaaaucaacuuugaaaaaggacuacaacuugccaaugcccaagauggugaauacugaucugucccgacuuuuuaagucugaagaaaucaagaguguccucaaaccuccaaggaagaccauagucaggaggguaaggaaacugaacccauugaggaauacacgagcaaugcugaagcucaacccauuugcugcuguucugaagaggaaagcuauuuuggcugacaggaaacuuaagcuugagagggcuauugagagaucaaagaaggaaggaguugagcuuaccccucaucaaaagagguauguugcuaugcuugagagaaggaaagcucagaucaaagccgccaaggcugcuaagccuaaaaagguuaagaagccuaaggcugaaaaagccgcugcugaugaagcaaagaaagcugcuguaacuaaaaaaccagcaaaaaaggcugcugcucccaaaccucccaaaaaauga

SEQ ID NO: 6861 - RNA, 5469 nt, Nezara viridula
auggcagauuucauagauucugaggcugaagaaagugaggaugaggaagaguuggaaguccaugagaaaaaaaaguugaaacgguugaaagcuauggaaagugaugaagaugaggaagaagaagaugaugaggaacgucuucgggaagaauuaaaagauuuaauugaugacaauccaauagaagaagaaagugaaagugaugguaguggaucugaagaaggaaguggagaagaucggggaggugagaaacguaagaagcaugaugaagauuuugaugaucgucuugaagaugaagauuaugauuuauuggaagaaaaucugggacgaaagguugaaagaaggaaaagauuuaaacgauugcgaagaauugaagaugaagagucagauggugagagagucgaagaugaaggugaaguuagagaagcuauagccaaugaacucuucgaaggaucugaccaugaaccagaggaccgagaagaagaucggagcucuuccagaggcccagcaccugagagauaugaagaugaagaggaagauggugaauauucagaugcugaugauuuuauuguugacgaugaagguagaccuauugcugacaaaaggaaaaaaagaaaaccuauauucacugaugcugcuuugcaagaagcucaggauauauuuggaguugauuuugauuaugaagauuuugaaagacuuggugaggaugaauaugaagaagaggaagaugaagaugaguauguugaugaagaaggaauugaagauagugagagaaggcggaaaccuacaaagaaggcugccaggaagaaaccaacuagaaaaucuaucuuugaaauuuaugaaccuagugaauuaaagagaggucauuucacugauuuugacaacaaaguucggaauacagauauuccggaacgaaugcagcuuagagaaaucccagugacgccaguuccagaagguucugaugagcuaucugaggaagcugaauggauuuauaaacaagcauuuuguaaaccaacuacaucuaaucaggaauggggcaauacgauggagagaggaaaaccaaagaaggagccucaaacaguugagaagauuaaaaaagcucuugauuuuaugagaaaucaaaauuuugaaguuccuuuuauagcuuucuauaggaaagaauauguucuuccagaacuuaacaucaaugaucucuggagggucuucaaauaugaugccaaguggugccaguuaagaagcagaaaaaugacuuuacuuucauuaauggaaaagaugagggacuaucaggcugaacagcugaugaaggacauugaugcaccuauuccagaucauguuagggucauuaaggaugaugauauugaaagguugaaagcuguccagacaacagaagaauugaaagauguucauucucauuuucugauguauuaugcugacgagguuaaaaucauguuggaagcuacaagaauaaaggagcgggaagcugcuaaagccaaagcuagacaagagaagcaacuagaugaaaauggugauccuaucgaaacagaaguagaagaacaagaagaaccucuuccuccugaaauaccuucuguaaagcauucuauacguucuggaccuuaugcaauaugccgaaaagcuggaauagguggcuuggcuaaacgguuugguuugaaaccugaacaguuugcugaaaaucuuagggauaauuaucagcgucaugauguugaacaggagccauccuuaccucuugaauuggcuaaagaguuuguuucaucgaaauuucaagcaccagaagauguuuugaaagcugcaaaguuuaugguugcgacacaacugagcagggaaccucuuguucggcguuguaugcgggauacguuuuuugaaaaagcaaaaauugauguuaaaccuaccaagaaaggaucaaaggaaguugaugaaaaucauccuuguuacguuaugaaauaugucaaaggaaaaccggugagagauuuaacugcugaccaauauuugaaacugcauauugcccaucaagauaaacuuuuaaauguuucuauuagugaucauauuggaggccauacaacaacuuccuauauugaggaaauuaagcaacucuacuaccgagaugaguucaugcagcauguacaagaguggaauaauauucgucaagaauguguugacguagcgauuaagaagauguuagucccagaacugauaaaagaacuccauacucgucuccuugaagaagcuaaagaauuuguucugagaucaugugccagaaaaguuuacaauuggauuaagguggcuccauuuaauguugaauucggagaugaugaugaagaugacugggauacaagcaaggguauucgugucaugggaaucgcuuauguaccugauuuagcucaggccucuuuugccugcaugguggcuccugauggugaauguacugauuuucuuaggcuacccuaucuuuuaaaaagaaaaaauacuuggcgagaagaugaaagaaugcaaaaggaaucagauuuggcucugauacguaauuuuauacuaacaaaaaaaccucaugcuguugucauuggaggagaaucaagagaugcucuuaugguagcagcagaucuuagagaaauaauauccaauuugguugaagaugaacaauuuccucaaaucccgguugaaaucauggauaaugauuuagcaaaaguuuaugccaacucauugaaaggagagagugauuuccgagauuauccaauguuauuaagacaagcugugucccuugcccgaagacugcaagauccguuaguggaguuuucucagcuauguacuccagaugacgaaauucuuugccuuagauuucaucccuuacaagaacaacuuucuaaagaagagcuucuugauguugucacauuagaauuuguuaaucgaacgaaugaaguugguguugauauaaaugaaguuguagcaaauccaauuugugggaacuugguucaguuuguuuguggucuggguccaagaaaaggaacuacgcuuaucaaaauuuugaagcagaccaaucagcgucuugaaaacaggacucaacuuguuacaacgugucauaugggaccuaaaguuuuuauuaacugugcaggauucaucaaaauugauaccaaugcucuuggagacaguacugaagcuuauguagagguauuagaugguucucguguccacccugaaacuuaugaaugggcucguaagauggcuguagaugcucuugaauaugaugaugaagaugcuaauccugcuggugcucuggaagagauucuggaaaaaccugaaaagcuaaaagauuuagaucuggaugcuuuugcugaggaauuggaaagacagaguuuuggaaacaagagcauuacucucuacgacauaagaucagaauuaaaccacagauacaaagaccugaggguugcuuaccaaucuccugggccugaguugauguuugauaugcuuacuaaagaaaccccugaaacauucuacauaggaaaacuugucaccgcaacaguuauugguauuucucauagaaaacccgaaaaagaucagcuagaucaagccaauccgguacgaaaugaugaaacaggauuguggcaaugcccauuuugucugaaaaaugauuuuccugaauuaucugagguuuggaaucauuuugaugcuggagguugcccuggacaagcuacagguguuagaauacgauuagauaaugggauaacuggcuauauucacauuaagaauuugucugauaaacaugucacugauccugcucagagaguuacacguggucaaaugauacauugcagaguaaccaaaauagagguagagagguuuucaauugaagcuacuucaaaaucuucugaucuguuagauaaaaaucaugauuggaggccucaaaaggauccuuauuacgaucaugaaaaugaaaagaaagauuuacauacagaagaagaggcgaagaaaaacaggcaaaaauugacuuauauuaaaagaguuauuguucacccugccuuucauaauauuuccuauauugaagcagaaaaaauuauggcuacaauggaacagggugaugucauugugaggccuucgagcaagggugcugaucaucuaacuguuacuuggaaaguugcggauggcauuuaucaacauauagacguuagggaagaagggaaagagaaugcuuucucauugggucagucguuguggaucggcaaugaggaguuugaagauuuagaugaaauaauagcuaggcauguuaauccaauggcagccuaugucagagauauguuugccuucaaguauuuaaaagauacugaaggaggacucaaggauaaagcugaagaauacuuaaaagaagaaaagaaaaagaauccagcaaaaauacacuacauuguuucuguauccaagaauuauccugguaaguuucugcuuuccuaccugccaagagcuagguguaaacacgaguauauuagcauaacaccuaauggauucagguuuagaggacaguuuuuugaaucugugaauucauuguucaaaugguuuaaagaacacuucucggaucccauacccggcacacccaguaccccuagaucugcaaugucagcacguacuccuuauacaaauacuccugggccaaugccaauaaauaugaaugcugaagcaauacagcguguagcucagaauaugccaaaucauaugcuccauagucuuucacaaguugccagucauacuccccacuacccucauacuccuggagcauauucucuacaucaguauccagccacuccauacacuccguccggccaaacuccuuucaugacuccauauaccacuccaagguacgguagugguaugacgccuggucaccagagcaucaugucuucugguucuauaacaucaccucaaaguucaacaccaggccaaccuguuuuccuccacccuggcucaauuacuccuucccauaggacuccuguagcuaauuuucauagaccuggugguacucauccagaagauugggguaagaaagcagaagaauggguugcaaagaaaagagaaaaugcuaguagaacaccuaggucuacuccaaauucuggcaccccacgccaugggacgccgcgagaugaugccaacaagaaucgaacacccagguaugcugauaaugauuucaccucuccacgcccuggugcaaauuucacuuccccgagguauuccaauuggaacaaaguugcuggcacuccuaauucacauauaucugcuuaugaagaugccaacuaugaugccagaagccucaaaucuccacguccuccuccugcacagggaaaguaugacccauacgaacuuggucaaggaaaaucaccucgguauucacuuacuccucguuccacaccucguaccaucaauucaccucguucuaugucacuuggugauucgacuccacucuaugacgagagcaucuag

SEQ ID NO: 6862 - RNA, 2280 nt, Nezara viridula
auggaggaaccuaaagaacgaaagaauugcagaaaacauagaagaaauagugauaaaacugaauauaaaucgaaaagugauaaagagcuuucagguagggaaaguaaacgcagaagaaauuaugauuaugauaaaucuagcaaucauucaucaggagaaagaagguaugauucagaacauagaagguaugaaaaauugaaaagauauugggauaaagauacaggcaaggaucgucaugacaaagauguuaaagcugauuaucuaguugguucaagauauuauaaugagacccccaaacauucucuaauuaaaaguucagaggguccuacuaaaaguaaggaaaauguaaacccacuugagaguacucguaaagaaaaccaagugaccaggaaaaagaaugaugacaucauuacguccagaacuggcggugcuuacauaccacccggaaaacugaaauuaaugcaagccaguaucacugauaaaucaagugcugaauaucaacguauagcuugggaagcauugaagaaaucaauucauggucauauaaauaaagucaauacuuccaauauugguguaguugccagauuauuauucaaggagaauauaauucgugguagaggccuccuuugcagaucaauuauacaagcucagucugcuucuauaacauuuacuaauguguaugcuugucugguggcuauaauuaauucuaaguucccaaacauaggagaacucuuacugaagaggguuaucauucgauucaaaagagcuuauaaaagaaaugauaaagcaguuuguauuucuucagcuacauuuauagcacaucuuaucaaccaggguguagcucaugaaauucucggacuggaauugguuacuuuauuaguagaaaacccuacagaugauucaauugagguugcaguagcguuuuuaaaagaagcaggccagaaauuaagugaaguaacaagcaaaggcacaaaugcuauauuugauauguuaagaaauauucuucaugaaggaaaguuggagaaaaggguacaauacaugauugaaguuauguuucaaguuaggaaagaugauuuugcuacuuuuccagcaguaccagaagagcuggaucuuguagaugaagaaaaucaguucacucacuuaauuggacuugaugaugcaauagauacccaagauauacuaaauguauucaagcuugauuccgaauaucaggcaaaugaggaacguuacaaagaauugagaagugaaauucuugauacugauucugaagauagugggucugaaggaaguaguacugaagcagaagaggauucugauucugaagaugaagaaaagaaagucacaauuguagauaauacagaaacaaaccugauaucacucagaaaaacuauuuaucuaacaauucaaucaagucuugacuuugaggaaugcgcccauaaguuguugaaaauggaaauuaagccuggacaagagaaggaacuuugucauauguuucuagauugcugugcugaacaaaggaccuaugaaaaguuuuuuggucugcuugcucaacgguucugccaaguaaauaauacuuacauagcaccuuucgaacagauauuugcugacacauauucuacaguucaucguuuagacacuaauagauugcguaauguagcaaaauuauuugcacaucuucucuucacagaugcuauuucuugggcugugcuuucuaauauucgacuuaacgaagaagauacuacaagcucaagcagaauuuuuaucaaaauuuuauuucaagaguuaucugaauauauggguuugguuaaccuuaaugccagauugaaagauccaacucuucaaucagccauggaagguuuauucccgagggacaauccaaagaacacacgcuuugccauuaacuuuuucacaucuauuggucuugguggucucacggaugaacugagggagcauuuaaaaaauuuaccaaaauccauuccugugucacaacuuauucaagaauuaucaucugaaucuuccacuucuucaucaucugaaucuucuucugaaacugagucaacgucgucuagugauucaucagaggaugaacgcaguaaaaagaaaaaaaagaaaaaaaggccuaaugcuucaaaggagauuccaaauaagaaaagggaaaagaaccaaggaaauuuucaagaaaauaauagaucaaccaaagaaacaaagaaaaaaaguuauuacaaaacaaaacaugaaagagaggaaaagcaucauccuagaaaaucaaaaaagaaauaa

SEQ ID NO: 6863 - RNA, 1725 nt, Nezara viridula
augaaugaagcgauucggcagaagaaaaaggcuaaagagguugaauggagaguucuugucguggaucaguuagcaaugcgaaugauuuccgcuugcuguaaaaugcaugaaauauccgcagaaggcuugacaauuguugaagauauuaauaaaaagagagagccacuuccaacaauggaagcugucuauuuaauaacaccgagugaaaaaucaguacacucccugaugaacgauuuugcuucaccuaaucguaucauguacaaagcagcccaugucuacuucacagaagcuugcccaaauccuuuauuugacacacugugucaugcgaggguaucuagauuuauaaagacuuugaaggagauaaauauagcauuuauuccguacgaacagcagguguucucguuagaugcuccugaaacuuuccagugcuuuuacaauccaucauugaguaacagcagacuugcaaauauggaacguaucgcagaacagauagccacuuugugugccacgcuuggagaauacccuucugucagauacaggagugauuucgauaaaaauguagaauuagcucagauagugcagcagaagcuggaugccuauaaagccgacgaaccaacaaugggugaaggacccgagaagucucguucccaguuguugauucuggaucgaggcuuugaugcagucucuccucucuugcacgaacucacucuucaggcgauggcuuaugaucugcuuccuauugagaaugauguauacaaguacgaagcuacagccggagcuccagaaaaagagguguuguuggaugaaaaugaugaacuguggguagaauuacgucaucaacauauugcuguggucucacagaaugucacaaagaauuugaagaaguucacagagucgaaacggaugccucaaggagacaaacaguccaugagggaccuuagucaaaugauuaaaaagaugccacaauaucagaaagaacucagcaaguauucaacucauuuacaccuugcggaagauugcaugaaugccuaucaagggcaugucgauaagcucugcaagguugaacaggauuuggcuauggguaccgaugccgaaggagaacguauaaaggaccacaugagaaauauuguuccuauucuccucgaccaauccgucucaaauuaugacaagaugagaaucauccuccuuuauacucuguccaagaaugguauuucugaagagaacuugaacaaacuuguucaacacgcucagauccagccacaugagaaacaggccauugucaacuuaggaaaucuuggccuaaauguuguaguugaugguacucguauaaagaagccauaugugccuccucgcaaagagcguauuacugagcaaacauaucagaugucucguuggacaccuguaauuaaggaucucauggaagauuccauagaugacaagcucgacuugaagcauuuccccuuccuagccgguagggcagcuucuucaggauaucaugcuccugccagcgugcgauauggacacuggcacaaagauaagggucagcagacugugaagaauguaccucguaucaucgucuucaucaucggcggcaugagcuucucagagauccgaugugccuaugaaguuaccaacgccgucaagaauugggaagucauaauugguucuucacacauccugaccccugaagacuucuuaaguaaccucgccaaccugagcaacuag

SEQ ID NO: 6864 - RNA, 2151 nt, Nezara viridula
augaugcaacaauauaugaaagaacuugaacaagauccuuacaguuaugaagacuuuguugaacguuuagcuuggagaacaguagauggguuuaaggaagaugggauucauggauuugauccuaauuuaaugcacgaaacauuucuccaagcaauuaaggauuugcaaguucuucaagaucgucaguguaagaaaugugaaaaacuugaacucauuugcaaggaagaagaagcuaaucauuuccaggauauagcucauuugcaggacaaaaauaaggaagcuuuugcuuuguuucaagauuuggaugaaagaauaaauuuuguugcaacuaaaguaauacaucuuggagaucaguuagaaagugucaauguucccagaucuagagcuguugaagcacaaaggcuaaugguauauuuuagugaauuucuaagcccuggaccuguucuugccagcgucuuuucaaauaaagaagaggucuuugaagcugcugauauuauacaaaaacuucauaugaucucacaagaacuuccaucugacaaauuuaaagaugcaagaucaaaaaucaguuuaaaauaugaugaaauugaaagaucauuaauugaagaauuuguaaagucacauaggguucaugaaacaaccagaaugaaagaaauugcgaauauccuuaugcauuucaaaucuuacucacagugcauugaugcuuucauugaagaaagucagaugggaacauuuguuggaaaagauauuuucaaggaaauauuaccucucacaaaaaaaaauuuuagcaucaugagagaaguuuuuaguaacccggaacaagucauggccaaauuuguuuugaauauuuaccacuuaaaacuacagaaacauauuguaagcaaccuuucugacaagucugauacaaauaaauaucuaagaaacuuaauggaauuauauacuaggacuacugaacuaucugcagaauugagcuguuucaaaauggggucugacgauucauaucuucaaaagcuaacucauaauauauuucaaaaauauuuagaaucguauauaagugucgaagucaagggcuuaaaggaaaaauguucaacauuguuacaaaaauauuaugauuccaaagaucaccauaaacgacaaauacagucuggaggauuucaagacuuuagacgugaucuucaagcuguaauuggcacaagagcuaauauuaacauugcucaaauugaagauuauggaggagaaacauuuuuaucugaagaauugguuauuagucuuauacaagagucuaagcaggcguuuuacagauguaaauugcucucuaaaccugcagacuuagcaaguaaugcagugcagcuguuagaaguucuauuaaauuguauuauaauugaucauguugauuaugcuguagaauuagcuuuacaagcaguaccgauuccugaaaguaaaacacagucucagccaauuuauuucuuugauguuguaagacaggcaaauacuauugugcaucugauugaaaaacacuucaacgauucugcucuuccuuuaguaaugucgacuucuaaacauggagaauguguuaugaaaaaaaaguuccugcuaaaucauuuagaacagaaauuggacagcgguauugauagggcacugaaugcuauagugggguggguaaaaguauuucuucaaucugagcagaaaaagacugauuucaaaccugaaacugaguugaauacauuaucauccccugcuuguauagcuguaguggaguacuucaaugauaacgucaaacauauuagagccugucuagauggcagaaauauugaauguguaaugacagaauugggcugucguuuucauagaguaauuuaugaucauuugcagcaauuucaauacaauucgaccggcgcacuuuguguuauaugugacaugaacgaauauaggaaaugugugaaggaacuuaauucuuguuugguuaauacauuauuugauacucuacaugcucuuugcaacgugcugcuagugaaaccugaaaauuuagaucaagugugcacaggugaucaguugucucucuuagaucguucugucguacuaaauuucauccaguuaaggaaugauuacaagacucagaaguuaucaaauuuucuuaaagggaugucugcuuga

SEQ ID NO: 6865 - RNA, 831 nt, Nezara viridula
auggauuuucaaaaucgaccuggagguaaaacuggaaguggugguguugcaucauggucagagacaaaucgagaccgaagagagaggcuaaggcaacuagcucucgaaacaauugauauaaacaaagaucccuauuuuaugaaaaaucauuuggguucuuacgaauguaaguuaugucucacccuacauaauaaugagggaaguuauuuagcccacacucaaggaaaaaaacaucaagcaaacuuagcaagaagagcagccaaggaagccaaagauucuccacagcaaccugcuccagauaaaccaagaauagaaccaaaaaaauuugucaaaauugguagaccugguuaucgagucacuaaacaaagagaucccgaaacuggucagcaaagucuucuuuaucaaguagauuauccagaaauugcagaaggaaucuuaccuaggcaucguuucaugucagcuuaugaacaaagaguggaaccuccagauaggaaauggcaauaucuucuauuugcugcugaaccuuaugaaacuauagccuuuaaggugcccagccgugaaguagacaaaucugaaaacaaguuuuggacacauuggaacaaagacacaaaacaauuuuuccuccaguuugcauuuaagaaugaaccucuugcuccuccuaugggugcaccucacuuaggucaaaugagaccuccacauaugcugccaccaccuaugagcguaccuccaccucccauguuuaauccuguuccaccucccccuccaaaucuaaugcuugcuccuccuccuccaccugcaccacucccaccuccuccgcagccuaugaaauaa

SEQ ID NO: 6866 - RNA, 405 nt, Nezara viridula
augucuaucgguguuccuauuaaaguauuacacgaggccgaagggcauaucguuacaugcgagacaaaaacuggagaagucuacagaggaaaguugaucgaagcugaagauaauaugaauugucaaaugaccgguuuaacuguuaccuaucgcgacggccgaguggcucaguuagaaaauguuuucauuagaggcucaaaaauacguuuucuuauauuaccggacauguugaagaaugcgccgauguucaaaaaacaagggaauaaagguaauacuggugcggggagagguaaaucugcaauucucagagcucaagcagccaggggaagagguucacaguccagaggaggugcaacuucuucuagaccaucguggcaaagcgguucuaaucaaucaaggaaauaa

SEQ ID NO: 6867 - RNA, 1323 nt, Nezara viridula
auggcuucgaguguuucaaaaguuccucuucuccagacauuggcgaagagaacauuugcugcuguugcugcucccaaagcugcaggaagucaaaauaaaguagaggugacuacucuucccaauaaggccauugucacuucuuugggaugugggcccaaacccauuguacaaguagcaguggcauucagagccgguagucgaaaugaaacuucugaaaauuauggagcuagucacauucugcggagcucugcuggucuuagcacuuguaaugcauccucguuuuauaucugucguaguuugcagcaaauuggcgcuagccucacugccacuucugaccgagaaacaauuguuuauguccuugaaucuucugcuagcaauauaaaugaaggacuugauacucugaggaaggcuguuacuggucaagaauucaggccuugggaauugucugauaauauuucuaggaucaaaauugaauuggcaucauugccuucacaggcaaaaguaauagauuugauucauaaagcagcuuucaggagugggcuuggaaauucuauuuuuguucgagaauucaauauuaagaaacuuaacagugaaacgcugcaacauuaugcugcuaauaauuuaacuggggacaaagcugccauagcugguugugguauaucccaaucugaucugacuuguuucgccgaaucccuugggcucugcccugguaguggcagugcauugccugcaucuaaguauaguggaggagaaaucaggauugaggaaaacauuccacuccagcauaccaucauugcugcugaagcaccaagcuuagacaaaagugaugcccuggccuacgcuguucugcgauaugcccuuggaacugguccuucagucuaccguggcacaggaucuggaccacuuuccaagguugcuggugugcuugucggugcucaggcccuuuccauggcacacucugacgcugggcucuuugguauuuauguugcuucuccaggcuacaacgcuaaagaggcuguugaagcagcagugaaaguuuugaaggguggaguuacugaucaagauguugcacgagguaaagcgcaauugaaagcagccuuauuguauuccaacgaaaggugccggggauuaguggaugaucuuguuggccaggcuuuacuuguuacaggaguuccucccaaaucugcugcugaauuggcugaccaaguuucuucuguuaccacucagcaggugcaacaggcuuugcaaaagauccagucuggaaagaaaucacuugcuacuauugguaguauaagcaaagugccauauuuggaugaauuguaa

SEQ ID NO: 6868 - RNA, 339 nt, Nezara viridula
augaggagagcucaugggaauuauuaccaaccggucccuacauucgauggaccuagcgguucacucgaagaggaaaaugaccagaugacaaauaaacugaaagauaaaauaacugcuuuaaagcacuugucaaucgauauuggugcagaaguaaaguaccaggauaagaugcuacaugggaugucagaagacuucgaccguaccggaggcuuucuaggaaauacuaugaauagaguauuacgccucaccaaaggaagucacaauuauuauauuuuguaccuuuuuauauuuucuauuguuguuuuuuuuguacuguacauaauauuaaaauuuagauaa

SEQ ID NO: 6869 - RNA, 1389 nt, Nezara viridula
aauggaccuuuagucauuuuagaugaaguuaaauuuccaaaguauaaugaaauuguucagcuaagacuugcugacggaacauuaagaucuggccaaguuuuggaagucagugguuccaaagcuguuguucagguuuuugaagguacuuccgguauagaugcuaaaaacacaauaugugaauucacuggagauauucuucggacuccagugucugaagauaugcuuggacgagucuucaaugggaguggaaaacccauugacaagggaccuccaauccuugcagaagauuauuuggauauucaaggacagcccauaaauccuuggucucguauuuauccugaggaaaugauucagacugguaucucugcaauugauguuaugaauucaauugccagaggacaaaagaucccuaucuucucagcugcugguuuaccccacaaugaaauugcugcucagauuugucgacaggcugguuuaguaaaaucaccuggaaagucuguucuugaugaccaugaagauaauuuugcuauaguauuugcagcuauggguguuaacauggaaacugcucgauuuuucaagcaagauuuugaggaaaaugguuccauggagaaugugugcuuguuuuugaacuuggcaaaugacccaacuauugaacguauuaucacgccucgccuugcucucacugcugcagaguuucuugccuaccaaugugagaagcauguuuugguuauauugacagacaugucuucuuaugcagaggcccugcgagagguaucugcugccagggaagaggugcccgguagaagagguuucccagguuauauguacaccgauuuagcaaccauuuaugagagagcuggacguguugaaggcagaaauggcaguauaacucaaauuccaauucuuacuaugccuaacgaugauauuacucacccaauuccugauuugacgggauauauuacugagggccaaaucuauguugaccgucaauuacauaacagacaaauuuacccaccaauuaauguacugccaucauugucccguuuaaugaaaucugccauuggagagggaaugacccgaaaggaucauucagaugucucaaaucaauuguacgccugcuaugcuauugguaaagaugugcaagccaugaaggcuguugugggagaagaggcacuuacacccgacgaucuucucuacuuagaguucuugacaaaauuugaaaagaacuucauuucacaagguaccuacgagaacagaacaguuuuugaaucauuagacauugguuggcaauuacugcguauauuccccaaggaaauguuaaagaggaucccagcaucuacccuggcagaguucuaccccagggacucaaggcauacaaccacaaaauaa

SEQ ID NO: 6870 - RNA, 2229 nt, Nezara viridula
augaugcaacaagcucaaaguaggccaaugucccauggcaacuaccagggcgggccagauuugcccaugggcucugucaaagaccagacgcucauguggcagcagagcucauauuuggcugauucaggaauucauucaggugcaacuacaacggcccccucucuuucugguaaagaagaagagauguauggggaucaagacauguuugaccuggaucaaggguuuacucaggguuucacccaagagcaaguugaugaaaugaaucaacaacucucucagacaaggucccagagaguucgagcugcaauguuuccugaaacuuuagaagaagguauagagauuccaucuacucaguuugaucaggcucaagccacagcaguccaaagacuuucagaaccgagccaaauguugaagcaugcuguuguaaaucucaucaauuaucaggaugaugcagacuuagcuacccgugcuauaccagaauugauaaaguugcuuaaugaugaggaucaaguagugguuucacaggcugcuaugauggugcaccagcugucuaaaaaagaagccucucgucaugccaucaugaauaguccucagaugguugaagcuuuagugagggcauuaucgaauagcaaugaccuggaaacaacuaaaggagcuguagggacauuacacaauuugucucaucacaggcagggucucuuggcuauuuucaaaagcgguggcaucccugcucuagugaagcuuuuaaguuccccaguggaaucuguucuuuucuaugcaaucacuaccuugcacaaccuccuucuucaucaagaaggaaguaagaccgcugugcgaguugcuggaggauugcaaaagaugguuguuuuacuacaacgaaauaaugugaaguucuuagccauugugacugacugucuccaaauucuagcuuacggcaaucaagaaaguaagcuuauuauuuuggcaucucaggguccuauugagcuagugcgaaucaugaggaguuacgauuaugagaaacugcuuuggacaacaucaagaguacuuaaaguauuaucugucuguucgaguaacaaacccgcaauaguugaggcuggagguuuaccugcacuggcagugcaccuggggcauccaucgcagcgacuuguucagaauugccuuuggaccuugagaaaucuuucagaugcuggaacaaaaguugguggcuuagaagggcuucuucagucucuuguucaacuccuggauuccucugauaucaauauuguuacuugugcagcugguaucuuaucaaauuugacuuguaacaaucaaaggaauaaagugacugugugccagguugguggugucgaugcucuuguccguacaauuauaucagcuggagacagagaagaaauuacugaaccugcuguuugugcuuugaggcaccuaacuucucgccauauggagagugagcuugcccagaaugcuguccgccucaacuauggcuugcaagugauugucaaguuguuacacccaccaucaagauggccucuagucaaggcuguuauugguuugauuagaaaccuugccuugugucaggcuaaccacacaccgcugagggaucacggcgcgauacaccacuugaucaggcuucuaaugcaagcauuccaggauacacagagaagauccaguguuaccagcggaggaacucagucaggugguauuuaugcugacggugugcgcauggaagagauaguggaaggcacugugggugcucuccauaucuuggcaagagagagccacaacagagcuaucaucagaggccagauggucauaccgauuuuugugcagcuucuuuucgaugagauagagaacauucaacgaguggcugcuggcgugcucugugagcuugcccaggacaaggaaggugccgagcucauagaacaagaaggugcaacugcuccucuuacagaauuacuccacucucgaaaugaagguguugcuacuuaugcugcugccgugcuguucagaaugucagaagacaaaccucaggauuacaaaaagagacuuucaauggagcuuaccaacucucuuuuuagggaagaucaaaauuuguggaauggugauuuaggaauggcuccugauuuacaggacaugcugggggagcaaaauuacgacaccauguacucucauggaccaccuaguguccauaguagucacggaggucggggauaucaaccagggcucuga

SEQ ID NO: 6871 - RNA, 834 nt, Nezara viridula
auggcucgaaaugcagagaaagcuaugacuacuuuggcucgauggcgggcugcucaauuaggggaaggugaucaagccaaacaaagaagaccauauuuagcaucugaauguacugaucuucagcaagcugaaaaauggagaaugcaaaucauaagagaaauagcucguaaaguuucucaaauucagaaugcuggucuuggagaguuuagaauucgugauuuaaaugaugaaaucaauaaacuacugcgagaaaaagggcauugggaagcacaaauucgagaacuuggugguccagaccacucaaggucugggccuaaaaugcuggaugcugaaggaaaagaagugccaggaaauagaggcuacaaauacuuuggugcagcaaggcaacuuccuggaguuagagaguuguuugagcaggcuccuccuccaccuccgcauaagacacguggggaacuaaugagagauauugaugccucuuauuaugguuauauggacgacgaagauggaaucauuauaccacuagaagaaauugaggaaacuaaagcuauuaaaaaagcuguagcagaauggacuguaaaaaaggaaaaaucaauggaaauagacgaagaagaaaaagaagaagucgaagaagauaacaucuacaaagcagcaggaaauaaagagggcggagaagaugaugaagaggaagaugcaggggaagacgauggguucgaacugagugcuaaguuacuggaaggguacagagcucauauuccuguuccuucacaaagagagguggaagccgcaauucuugaaaggaaaaaacaagaacuucuggagagauaugcucucuag

SEQ ID NO: 6872 - RNA, 645 nt, Nezara viridula
auggaagaggcugauguaccaucauuuaaauguguccuuguuggugauggugguacuggcaaaacuaccuuugucaaacgccauuuaacuggugaauuugaaaaaaaguauguugccaccuuagggguagaagugcaucccuuaguuuuccacaccaacagggguccuauucgcuucaauguaugggauacugcaggucaggagaaguuugguggacuuagggauggauacuauauucagggucaaugcgcuaucauuauguuugauguuacuucaaggguaaccuacaaaaguguuccuaauuggcauagagauuuaguacgcgucugugaaaacauucccauaguacuuuguggaaacaaaguagauauuaaagauagaaaagugaaagcuaaaaguaucguuuuccauagaaagaagaaccuucaauacuacgacaucagugcuaagaguaauuauaauuuugaaaagccuuuucugugguuggcucgaaaacugaucggugauccaaaucuagaauuuguugcuaugccugcucuguugccuccugaaguuaacauggauccugaauggaaggaccagauugaaagggaucuccaggaagcacaagacacagcacuuccugaagacgaugaggaccuguaa

SEQ ID NO: 6873 - RNA, 480 nt, Nezara viridula
auggacauccaaacuauugcaacaauauuuauuaaaguuuuaaaacuuguaauuaauuuuaucauucuuaugcucuaccguuauggcgggaaacaaggauuucugggaguagguggaacguggaacuuguaugaaguaaaaagugcugaugcugaaauuauugcaucuggaguuuuugugggauuuuucaucuacacaucaguuaucuuaauuucauacugcuuuggaacaacaaagcacaaauauagugcaguagauauaauaaugaaugugaguggaacuauauuguucaccgcuguaggaggcauagcauuacauuacuggguugguuuccaggaugaaaaccauuaugugggaauuucucaagaaaaacaaauaggacuugcauuaggcagucuuaguguaguaugugcugcuaucuaccuucucgauacaguuuuaucauguauacauauugcacacaagcaugcuauugcuuaa

SEQ ID NO: 6874 - RNA, 2337 nt, Nezara viridula
augccgcgaauuaugauaaaagguggugucuggagaaacacugaggaugaaauucuuaaagcugcuguuaugaaauauggaaaaaaccaauggucucgaauugcuucuuuauuacaccgaaaaucugcaaaacaaugcaaagcuagaugguuugaauggcuugauccaagcauuaaaaaaacugaguggaguagagaggaagaugaaaaauuauugcaucuugcaaaguuaaugccuacucaauggcgaacuauugcaccgauuauaggucguacugcagcacaaugcuuagagagauacgaauauuuacuagaucaagcccaaaaaaaagaagaaggggaagauggagcugaugauccuaggaaauugaaaccaggagaaauagaccccaauccugaaaccaaaccugcucguccagauccuaaggauauggaugaagaugaauuggaaauguugucugaggccagagcaagauuagcuaacacgcagggaaaaaaagcuaagaggaaagcgagagaaaaacaguuagaagaagcaaggagauuagcagcuuugcagaaaaggcgagaauugagagcugcagggauugaauaugcagcacgccauaagcguaaaagaggcaucgauuauaacgcugaaguuccguuugaaaaaaaaccugcucccggauuuuacgauaccaguaaugaagcuauugauccucaugcuccuaauuuuaauaggcuucgucaacaaaauuuagauggugagcuucguagugaaaaggaagaaagagaacguaggaaagacaaacaaaaaauaaagcagaggaaggaaaaugacaugccucuugcgaugcugcagaaccaagagccagccaagaaaaggaguaaacuugucuugccacagccucaaauaucugaucaggaacugcaacaaguugugaaguuaggaagagcuaguuacgcugcgcgggaggcaguaacagagggcucugaaagugcuucggacacgcuucucaacgauuaugcuuuagccacacccaaugccggaucuacuccucguacgccugcgccuacaacugacaggauacuucaagaagcccaaaauaugauggcauugagucauguagauacuccacugaaaggagguuugaacacaccacuuuauaacucagaguuuaguguucauccaccgucugaucagaucacaacaccgaacacuguacugacuacgccguuuucuaaucgaacucaugaaggaaggacuccagguuuccaaacuccgcaagacguaagaaccagccucaccacuccugucagagauaaauuaaacauuaauccagaggaagguggugauacaccauaugcuccuguaaauaaucaaaaacagguaaaagaggaacuugcugcucgucuuaggucacuaccacagccuaagaacgauuaugaaaucguuguuccugaagaugaaguuucguccgaaacagcugcagaggguucugguaugcuaaguguugaagaucaagcugauaucgaugcuagaaauuugaguuuccuugcucaacaacgcgaaaaagaauuaaagaguagaucacagguaauucaacgagcuuugcccagaccuggagacaucaacauaguacuccgcccggcuaauacagauccaccucuaacagaucuucagaaggcugaagagaugauaaaggaagaaaugauaacaauguuacauuaugaugccauucacagcggugagccuucuucugcaagaaaaauaggaacuguaagucaggcacagcaccuugccuaucucgaacaacacccauaccacacuuacucagaagaccaaauagagaaggccaaagaaaugcugaaagccgaaauggaaguugucaagcaagguaugaaccauggugaucugucgcuggaaacauuuacgcaaguuugggaagaauguuuagcgcagguauuguauuugccuaaucaaaauagauauacaagagcaaauuuagcuaguaaaaaggaccgucuggagucuguggaaaagagacuagaacaaaaucgaacacacaugacccgagaggcaaaaagagcagcgaaaauggaacgaaaaauuaaaauaaucacugguggauaucagacuagagcucaggcacugauaaagcaacuucaggauuuagcugacgagacagauaaggcucauauggagcugucgacguucaagcuccuucagcagcaggaagagaaugccauccccaagagaauagagucgauaucagaagacguaaacaggcagcuugaaagggagaagagcuuacaaaaaagguuuagccaacuucagcugguuucgcaaucauaa

SEQ ID NO: 6875 - RNA, 474 nt, Nezara viridula
augaugcaguucaugcuuuuauucagucgucaaggaaaguugcgauuacaaaaaugguauguugcacauccagauaaauugaagaaaaaaauuaccagagaacuaauuacuacaauuuuggcaaggaagccaaaaauguguagcuuuuuggaauggaaagauuugaaaauaguauacaaaagguaugcaaguuuauauuuuuguugugccauagagcaaaaugauaaugaacugcuuacauuagaagugauucaucgauauguugaacuucuugacaaauacuuuggaaguguuugugaguuggauauuauauucaacuuugagaaagcauacuucauucuagacgaacuuuuacuuggaggugaaauucaggaaacaagcaaaaagaacguccugaaagcuauagcugcucaggaucuccuucaggaggaagaaacuccacaaggauuuuucgaggaucacggucuuggauaa

SEQ ID NO: 6876 - RNA, 1314 nt, Nezara viridula
auguccuacagcaucauucucagucguuugaguagguucccacuauucucuuacucaagaggauauagugucauuaccagccaaaaugugaaaaauaucccugugaguuucagauauuauucaucugguggaaggaggccuaauuuuuucucccaauuuauagaaaauguuaggcaagacuuggcaaaaaguaaagagaugaaagaaaguuugaaaaaguuuagggaagaagcgcagaaauuagaacaauccgaagcuuuacagaaagcaagagccaaguuucaaacuguugaaucagaagcaucgaaagguggugaaguuuucaaggagaaauuggaccacauuaaagauaaagucagugaugugcuggaggaagcagcaaaaucagaaaucgggaaaaaagcaggucagcugggagcagaaauuggaaagacugcgaggggagcugcugaaacauuaucagaaacaggacagcagaucggaaaaaguggagcuuuucaaacuaucagccaaacagcugcagcuguaaaacaagaauuagaucaauccggaauucaugcucauguuuaucagccgccacgaaaacuaagaaaaagauuggaaauaguaccagauaauaaagcuuuaaaaccugacacagaaacauuagguauugaucuccauaaggacucaaaauuuuuccaaaguuggcaacaauucaaagacaauaaugcuuauauuaacaaaguucucgauuggaaaaugaaguaugaugagagugauaaucccgucauccgagcaucucgaguauucacagacaaaguuucaaguguuauggguggccuuuuucagaaaacugaacuuucugaaacacugacggagauaugucgaauagauccgaauuuugaccgagcucacuuuuugaaagauugugagaaagauaucaucccgaauauucuugaagcuaugguccguggagauuuagacauauugcaagacuggugccaugaagguccauauaauguucuugcugcuccaauuaaacaugcaaaagaagcccacuuuaaguuuuguucuaaaauuuuagauauugauaacgucgauuuaguaauggguaaaguuauggaccaaggaccuguguuaguuauuaguuuccaaucccaacaauuacuguguaucaaagauaaaaaugguaauauaguugaaggugauccgaacaaaguauuaagaguuaauuacguuuggguucuuuguagagaccccucugaauuggacccaaaggcagcguggcgucuuuuagauaugucagcacaaagcaaugaacaguuguuauga

SEQ ID NO: 6877 - RNA, 759 nt, Nezara viridula
augaagaggccaacgcuuagagagcuagaauuacaagagcuugaaaauuaugagggagaaacugauucagaaacagaggcaauacaagaagcuuuugccagaggagaucuuaagccaggacuuaacauuccuguuaaagauaaagucaagacaaauaauguuccucuccugaaagacacauuaagugaaaucaaguuggaccuuccguggauugaaagauuggauguaacaaacgaacaagcaccauuggccccugaacucgcuuugcagaucagggaagaagaacaaggacauaauccauuaguuuaugacgaguugaagagagaaagcguauucuauagacaagcucagaacgcagccaugaaaguguuaccaaaauugaaagaacugggccuuagaacugagaggccugacgacuauuuugccgaaauggccaagucagaucagcauaugcagaaggugaaaggugaagccaucaagaaaaaacuaaugauggaaagaauugaaaaacugagagaaauacgagcucagaagaaaguucagaaagcucuucacgcucaagcuaagguugcuaaaguucaaaguaaaaaacaaaugcuagaagaagugaaaaaguacaggaaaggagaaacuaagaguuuagcuuuccuugagccaggauuuaagccaaaagccaaaccaaacaaaucccaaauuaaaagacaacgcaaggauacuaaauuuggucauggaggaaaaaaaagaggagcuaaaagaaau

SEQ ID NO: 6878 - RNA, 3780 nt, Nezara viridula; identical to SEQ ID NO: 6853

SEQ ID NO: 6879 - RNA, 1998 nt, Nezara viridula
augaauacaggaccaggaggaccuaauuaccccauggcaucuuuauaugugggugaucugcauucagauguuaccgaagcaaugcuguucgaaaaauuuucaucggcuggacccguacuuucuauuagaguaugcagagacaugaucacucgaagaucauuagguuaugcauaugucaauuuccaacaaccugcagaugcugaacgcgcuuuggauacuaugaauuuugacaaccuuaagggucguccaauucguauaauguggucacaacgugauccuucucucagaaaaucuggcgugggcaaugucuuuauuaagaauuuagacaaaaguauugacaauaaggcuauguaugacacuuucucagcuuuuggcaauauucucaguugcaaaguggcacaagaugaaaauggcguuuccaaaggauaugguuuuguccauuuugaaaccgaggaagcugccacuaagucgauagauaaagugaacggcauguugcucaaugguaaaaagguuuuuguugguaaguucauuccacgaaaagaacgugaaaaggaauuaggugaaaaagccaaacuguuuaccaauguauauguuaaaaauuuuggggaagacuuuacugaugacaugcugaaagagauguuugagaaauauggaccaauuaccagucacacuguuguuguaaacaaagauggcaagucucguggcuuugguuuuguugcuuucgaagacccagaagcugcugaaagagcaguugaagaucugaauggaaaagagcuuauugaaggaaaaccacuauauguaggaagagcgcagaaaaaagcugagcgucagcaagaauuaaaacggaaauuugaacaacucaaaauggagcguaugaaccguuaucaaggcgucaacuuauauguuaaaaaucuagaugauacuauagaugaugaaagauugaggaaagaauucucuccuuucggaaccaucacuagugcaaaggucauguuagaggaagggcguaguaaaggauuuggcuuuguauguuuuucaucucccgaagaggcuaccaaagcaguaacugaaaugaacggucguauuguugguacgaaaccuuuauauguugcucuugcucaacguaaagaagaucguaaagcucauuuagcaucucaauacaugcaaagaauggccaauaugcguaugcaacagaugggacagaucuuuccuacuggugguacagggggcuauuuuguuccuacuuuaccucagccccaaagauuuuuuggaccugcucaaauggcacaaaugcgcccucagccccguuggccagcucagccucaagucagacccagcacacaagcagcugcaucaggauuucccaauaugcaaggcccauucagaaguggaccacgagguccaggugcugcuggcggugguggcggcccaggaagugccgccgcugcugcugcagccaugcgcucaucuaucagugcugcugcugcagcuguggcagcggcugggcgaccaacagccaaugcugcugcugcugccgcugccgcugcugcaaacccagcugucgcccggcaauuggcccaaggagguucucagggugccccuguaucugugucugcucaaggccguccugcaaauuacaaguacaccgcgaacaugcgcaacccacccccaaugggagguggagcaggagcaggugcagguggaccuccacagcaagcccuacacauucaaggacaggaaccacucaccgcaagcauguugucaucagcaaacccucaggaacagaaacaaaugcuuggagaaaggcucuucccccuuaucagaaguauguaccccgaucuggcugguaagauuacaggaauguuauuagaaauugauaacucagaauugcuacacaugcuggagcaucaugagucccucaaggccaaggucgaagaggcugucgcuguacuacaggcccaccaggcuaagcaagcugcugcaucugucaaaaaagaauaa

SEQ ID NO: 6880 - RNA, 2739 nt, Nezara viridula
augacggacucaaaguauuucacaaccaccaaaaaaggugaaauauuugaauuaagaucugaauugaacagugauaagaaggagaaaaaaagagaagcaguuaaaaaagucauugcuucuaugacaguuggaaaagacgugucagcucuuuuuccugauguuguuaauuguaugcagacugauaauuuagaacuuaaaaaguuagucuaucuguauuuaaugaacuaugcuaagagucaacccgacauggcaauaauggcuguuaauaccuucgucaaagauugugaagaugcuaacccucuuauaagagcucuugcaguaagaacgauggguugcauuagaguugacaaaauaacugaauaucuuugcgaaccacucagaaaaugucugaaagaugaagaucccuaugugaggaaaacagcugcgguaugcguugcaaaauuauaugacaucaauccccagcuuguugaagaucaagguuucuuagaucagcucaaagaacuuuuaucugauuccaacccaaugguuguagcuaaugcuguugcagcacucucugaaaugaacgaagccucaguuaauggggcgccccucauugaaaugucugcugcgacuauaaacaaacuucuuacugcucuuaaugagugcacagaauggggccaaguuuucauauuagauucuuuggccaauuauaguccuaaagaugaaagagaagcucaaaguauuugugaacguauuacuccaagacuagcucaugcuaaugcugcugucguuuuaucugcaguaaagguuuugaugaaguuuuuagaaauguugccaucugaaucugacuuuguaucaacuuugacaaagaagcuugcacccccauugguuacccugcugucauccgaaccugagguucaauaugucgcuuugcgaaauauaaacuuaauuguacaaaaacgaccagauauccugaaacaugaaaugaaagucuucuuugugaaguauaaugacccuauuuauguuaaacuggaaaaacuggauaucaugauuagauuagcuucucaagcuaacauagcucaaguucuuuccgaauuaaaagaguaugcaacagaaguugauguagauuuugugaggaaagcagugcgagcaauuggccgaugugccauaaaaguugaacaaucugcugaacguuguguuucuacucuucuugacuuaauucacacuaaggugaauuauguuguucaagaagccauugucgucauaaaggauauuuuuaggaaauacccuaacaaauacgaaaguauuauuucgacauuaugugaaaauuuagacacuuuagaugaaccugaagcaagggcuucuaugauuuggauaguaggugaauaugcugaaagaaucgauaaugcagaugaauuacuggagucauuuuuggaagguuuucacgaugaaaauacacagguucaacuccaacuccucacggcuauuguuaaacuauuucuaaagaggccuacucacacucaggaacuagugcaacagguauugagucuagcuacucaggauucugacaauccugaucuccgagacagaggauucauauacuggagguuguuaucaacugauccuggugcugccaaagaaguuguacuugcugagaaaccacuaauuucagaagaaacugaucuucuagaaccgacucucuuagaugagcucauaugucauauuucuucccuugcuucaguuuaucauaagccaccuacugcuuuuguugaaggcagagcugguuugaggaaguccuuaccagcaagaucuggaucugcugaaguggugcaagaaacuccuggugcgcaaguuauuccuucacaagauucacugauaggggaccuguugucuauggauaucgguggggucucagccccuccuccaccucaaccgacgucugcuccuguugaucuucuggguuuggauucacuucuuggaggggugccugaaccugcugucucucagaguacaacugguuugcuuggagauauauuugguuuaggaacagcugggccuacugcauaugcuccacccaaaaccauguggcucuccagcgauagggguaaggggugugaaauaucuggaacuuuuucucgaagaaauggccaaauccaaauggauaugaccauugugaauaaagcuaugcagccgaugacuagcuuugccauacaacugaauaagaacaguuuuggugugacuccagccagagcucuccagguuuugaguccauuaccaccuggagugucacaugacugcucauuaccuuuaguuacuacuggagcaguucaaagaauggaaccauugacuaaucuucagguugcuauaaaaaacaauauugauguuuucuauuuugcuuguguuauuccaaugcauguauucuucacggaugauggacaaauggauaagcggguguuucucgcuacuuggaaggacauuccagcucaaaacgaaguucaauacacacuuacaaauguccagucuaaugcagauauaguuguccaaaaaaugcaagaaaauaauguuuucacuauugcuaaacgaaauguugagggacaggauauguuauaucaaucaguuaaacugaccaaugguauuuggguacugauugaauugaaaauacaaccaggaaauccaaauauuacucuuucuuugaaaucgagagcucucgauauagcugcugguauauuccagguauacgaugcuauucuucauucuuaa

SEQ ID NO: 6881 - RNA, 498 nt, Nezara viridula
augccaccaaaguuugauccuaacgaaguaaaaacagucuucuugagguguguugguggugaaguuggagccacaucuucucuugcuccaaagauugguccucuuggucuguccccuaagaaagugggugaugacauugcuaaagcuacagcagauuggaagggucugaaaauuacaguuugccuuacuauucaaaacaggcaagcugcuaucucaguuguaccaucagcggcuucucucaucauuaaagcccugaaagaaccaccaagggacaggaagaaagucaaaggaguaaaacauaaugguaaccucaccuucgaugaaauucucaccauugccaggucaaugaggccaagauccaugucuaggaaauuagaggguacuauuaaggaaauucucggcacaugccaaucuguugguuguacaguugaugguaaaacuccuuccgaaguuaucugccaaauaaaugauggagaaauagauguagccgaugaauga

SEQ ID NO: 6882 - RNA, 1110 nt, Nezara viridula
auguguggagaagaaccaaauauuggagaaaugaaagcucuuauuuuagucggaggguauggaacucgacuuaggccucugacauuaaguaggccuaagccauugguugaauuugcuaauaaaccuaugcugaugcaucaaauugaagcauuagucgaagcuggaguaacugaaguuguauuagcuguaucauacagagcggaacagauggaaaaggaguugagugaugaggcaaaaaaguuggguguuaaauuaauuuuuucgcaugaaacagaaccccuggguacagcuggaccucuggcuuuagccaaagauauuuuaucaucgacuaaugaaccauuuuuuguucugaauucugauauuauuugugaauuuccguucaaagaacuuguuucuuuccauaaaaaucauggaaaagaaggaacaauuguagugacaaaaguggaagaaccaucuaaguaugguguuguuguuuaugaugagaaagguuguauugccaguuucauugaaaaaccacaagaauuuguuucuaauaaaauaaaugcaggcauguacauacuaaacccuucaguuuuaaaaagaauuaaacuggaaccaacaaguauugagaaagaaguauuuccguuuauggcugaggcaggagaauuguaugcuauggagcuuaguggauuuuggauggauguuggacaaccucaagauuuucuuacaggcaugugcuuauaucuuacaucuuugcgucagaaagcaccugaaaaguuguacgcuggcccuggauguauuggaaauguucuaguucauccuacugcucgaauagguucuggguguucgaucggaccgaauguaacccuugguccugggguugucguugaagaugguguuuguauaaaaaggugcaccauuuuggaaaaugcuauuaucaagucucauucauggcuuucuggguguauuguuggauggaaaucuguugugggacaauggguucgaauggagaauacuaccguucuuggagaaaauguaaauauaaaagacgaacucuaugucaauggaggucaaguacuuccucauaagagcauugcuaagucugugcaagauccacagauuauaauguaa

SEQ ID NO: 6883 - RNA, 864 nt, Nezara viridula
augacuuuggacggugaagaaacuauaucggaucaagaaaaggugcgaaucguuucuaauuuuauauuacauucgccaccgggagaauuuaacgaaguuuuuaaugaugcaaggauauuauuaaacaacgauacucuucugaaagaaggagcucuuggagucuucgggcaguacuguaaagaccagcuuacgccugugaagauuaagaacagugaguauccaguuuuaauuacagaacauaaugaucuaggauccaacagguuuuaugaugcaaggucgaaacagucauuuaaauaugauccauuaaggagagagacaucuaauuaugacucaugggaagcagaaccugguacagaaaaguggagaucagcuuuagagagugaauuagaugcauauauagcuaaacacuuugaaaguggcucugguaguguauuuucuaaaagagaggauggcaaaguaaacuugguugcgugcauagaagcccauuuauuccaaccaaaaaauugcuggaaugguuguuggcgaucucagugguuugugacaauagauucagauaaugcggaugugaaagguguuuuaaaaauucaaguucauuauuaugaagauggcaaugugcagcuugucaguuuaaaagauauuaaccaaacacugccaguuguugaugaagaacaguuaaguaaggcuuuaauuaaaauauucgaagacucugaaacagaguaccaacaagcgauaucugaaaacuaccauacaaugucagacacuacuuuuaaagcuuuaagaaggcaguuaccuguuacucggucaaaaauagauuggaauaagauggugucuuacagcauugccaaagaacucaaaccccaguga

SEQ ID NO: 6884 - RNA, 3558 nt, Nezara viridula
augauggagguggcgucgucguuguuguugcugcucuuagucgccuuuguggccagcaaagaugucagcaaagucagugagaacuugguccgcccauacggcaagaacuacuuuaccaguaggcgagucaucgguaguaacuuucugccaaaugucgaugaugaccgaauggcucccuccacugaggagccgcguauuccguauguuauuacggaagaucgucugaagaagauaagaucaaauuucauguauugguuuuuugaccaagauucuaaugaugguuauggagaucugcagaaggacauaacaccaucgauuacccaaguuaauaagaauuuaaauuuccaauugccguuuuucggauuccgcuucaauuauacaagaguuucacuaaacggcuauuuagaauucagugacccuccggaacaauacagcuacccccucaauuucccaaguguggacuggccacguaaaaacgacccugcguucauuggaauauucuacaguaagugcaggauuggacaauuggguaucaaugauguagaccagagagaaccaggaguguauuuuaggauggaaagggacuugaugacaagaaaagauaaauucggaguugaaaugagagagagggugaaaugggacauacgagaaaguguugucggcuccgauucuuuugaacccaaacaugcugugauuguuaccuggaaaaauguuucguuugcugguggcauugaaaacucaguacaaacaacaaacacguuucaauugguucuagcaacagacgaaguauucacuuaugcuauauucaauuaugcucaaauuaaguggaccacacauacugaagcacgaggggacacaguuaaaggagaaggaggugugccagcauacauaggauuuaaugcuggcaauggcacaagaaguuacgaauauagaccuuauucacagacaucgacaaucagagauuugguuggccgugguugggcuaacgguuucccaggaaggcacauuuuuagaauugaugaaaauauucuuccaggaacuuguaacaaggauauugcugcagcaaguuugccucucgcauucgcuccugaaagugguaacaugcucggugguaccauagugaauauaacaggaccuuguuuugaaccaacuaugaagauuguaugcagauuugacaugaaagcuguauaugguacaguuguggacaggaauagagcaauuuguguucaaccuuucgucauggcagaagguuacauauuguuugacaucgccaucgaugacggaaaauacguuuggaagggacaguauuucaucgaaacaccugcaacagcugcugaaaaaauauccuucgcugacgacagcguucaccaaaaauauccuccagaagucagaauaacauggaaucaguauaauuuaacaucaaauuuagcugcuccaguucaaaucucaauauggggauacagggaaaaaucaauccgcccacagcuacuuuauauagauucuuuagacguggguguuccaaacaacggcauguacucaauuauuccagcaacuuauaaaaaucgugauaaccauuuauucacugauaugaguuucgguuucauacaaaucaaccugacgacugcaacggaauacaauggacuuaaaguaaccccaguuauauggagcaagccaauacccuuaggcugguauuucgccgcgcaaugggaaaggcaacuggguuccaauuggccagaggggaaauguaacaguuggauuaugaacgaucgauaucugaagaacuuuccugcugaacugaguauuugucccuguaaauuagaacaugcucuugccgauaaaggaagauuuaugccggauuucgacugugacauggacgcuaacccucauuguuuuuaccaugaaggcgcuaggcacugcguaaaaacaggugcucccaggcaggaagguuccgaacagcaauguuguuaugacaaaaacaacuauuugaugcuuuccuacgaucagcagugggguuccucgccaaagagguccaguaauuuaggaaucuugccauggaaugaaccuaacaagguuccuacucugucacaaugguaccaugauaucucacccuuuuaccauuguugcuuguggcaguuugaacaaucagucgguugugaaacauucagguuugaaagaagaccuucacaggacugcguugguuaccaaucaccuuacauugcaacuguuuuuggagacccacauuucauuacuuuugaugguuuggaauacaccuucaacggcaaaggagaauucguacugcugcacaccgauucugagaaguuuaagcuagauguucaagcaagguucgaacaaguuggaaaaaauauuuauggugauguggcagcaacacaguugacaucuauagcagcaagagacaauacuucaagcaucauugaaguaaggcuuagaccaaaggaggcacaauggagguacagacuagauguuuuugcaaacaagaaaaggauauauuuugacaggccaucucuucgaguacaacacuuuagaggugucacuguuuaucagccuucacauauacucaaucagucugaaauuguuaucauguuucaaucggguguugguguagaaguuguugaaaauguaggauauauggcagcaaggguuuauuugcccugggaauauauuaacagaacaagaggccuguuuggaaauuggaguuucgauccuucgaaugacuucacucuaccagauggaacuguggccagugccgauucccugaaugauuuggaaagaauacacaaacaauucgcuauucauuggagauuagaagacaacguugaaccaaauaaaggugaaccucuuuuugucagagaauauggaagaacaucaaguuauuauuugaauagaacuuuuguuccuguauggaaaucaacuccucaagaaauuauaccuccuaacagaacugcacaaauacaacaagcucuagcacuuuguggugaaucuuaucaaugcagauaugauuaugcugucaccuuaaauagagaaauggcuuucuauacuuuaaauuauuacagugaauauacacaacuaagacaaacaaauaaagacagaguuuugucuugugggguguuggaaacaccaagauuugggcgaaaauccaacuuuuucuucguuccugauucuaagguuauauuugaaugugaucaaggauuuauucuugugggugaucaaaggcgaacauguuccucaaauggaagguggucuuuugaauauggauacacugaaugucuacuggaagaagaguauucuuugcgggcauuugguuggacuugggguauaauagcucuaguccuuauacccauuauuauuguacuuguaugugcugguuuucgaauuguaaggcggauaauagagcagaaaaagaaugaacuacauacagaucaaagaacucaguaucauccagauuacacugcugguccuuuaagguacaaugcaagggaaguuagucuuucgaucaaucccgaaaaugaaccauugaaaaaagaaacagaagugaauuaa

SEQ ID NO: 6885 - RNA, 342 nt, Nezara viridula
augcguuacguggcagcuuaucuucucuccacccuugguggaaaagaaacuccaucagcagcugauauugauaaaauauuaagcucuguuggaauugagucugauucagaacgagugaacaaaguaauuucggagcugaaaggaaaaaacauugaagaagugauagcugcagguaaagagaaguuggcuucagugcccucaggaggugguggugccccugccgcugcugcugcugcacccgcugcagccucaccugccaaagcagccgaagagaagaaggaagcaaagaaagaagaauccgaccagucggaugaugauaugggcuuuggucucuuugacuaa

SEQ ID NO: 6886 - RNA, 2736 nt, Nezara viridula
augaugacugaucauauugguggaauaacccuuaaaugggauccaaaaaaccuggaaauacgaacuuugucaguggagaaaacuuuagaaccacuugucuuacaggugacaacacuuguaaauacuaaagggcccaguaaaaagaaaaagggaaggucaaaacgcgcucauguuuugguugcagcugucgaaaaagccacugaaaauuuuauugaaaaaggugaaaugauagcuuaugaaaauccugauauuaagcaagaaaugcugucagcuguagaagaagugagaaaaacaggggaagcuaugagugcagcugcaagagaauuugcugaugauccaugcucaucaaucaaacgugguaauaugguacgagcagcccgcaacuugcucucugcugugacuagacuacugauucuagccgacaugguagauguacaucugcuguugaagucucuuagaguaguugaagaugaucuggucaaaguuaaaaaugcaucaagccaaccagaacugcuugaaaacauuaaagcauuuggacguaacgcuuccgaguuaaugucucaggcugccaaacggcagcuugagcuaaaggauucacagcugagggacgacuuagcugcagcacgugcuguuuugaagaaacauagcaccauguuacugacugcauccaagguauaugucagacauccagaacuugcugcugcuaaggcaaaucgugauuauguuuuuaaacaaguuugugaagcugucaauacaaucagugauguagcucaggguaaaggaccaucgaucacuaccaauccuuacgaaggcccuggcgagcuugcagcugcuuuggaugauuuugaugaacguauggugauggaaccuuuggcuuauucugagguagcuacaagaccaucucuugaagaaagguuagaaagcauuauaaguggugcagcgcuuauggcugacucuucuugcacaagagacgagagaagggagcgcauaguugccgaguguaaugcuguacgucaagcucuucaagaucuucugucggaauauauggcuaauaugaguguuaaagaacaaagcgaaggucuggagagagccauugaucauaugugucgcaagacgagagauuuaagaagacaguugaggaaggcaguugucgaccauguuucugauagcuuucuugaaaccagugucccucuacugguuuuaauugaagcugcuagagcggguaaugagaaagaugucgaagaauaugcauugguuuuucaggagcaugccaauaaacuuguugagguugcuaauuuagcaugcucuaugucuggaaacgaggaugggguuaagauggugcguuaugcugcggcucagauagaugcucuuugcccacaaguuauuaaugcggcucguauucuuggagcuagaccuaaaucaaaaguugcucaagaaaauauggacgucuucagggacucaugggagucucaaguucguguauuaacagaagccguugaugacauaacaacaauugaugauuucuuagcuguuucugagaaccauauccuugaagauguuaacaaguguguuauggccuugcaagagggagauggagauucuuuagauagaacagcuggugcuaucaggggucguucagcucguguagcaaacguuguuacugcugaaauggacaauuaugaaccaggaauuuacacagaaagaguucuggaagcuauuaaaguucuuagagaacaggugaugccuaauuuugcucaaagaguagaaguugcuguagacgcucuuucaucaaauccuccuaaagauguugaugaaaaugaauucauugaugcuucacguuuggucuacgaugguguuagagaaauuagaagagcuguccucaugaacaggagcucugaagauuuagacacugacacggaauucgaaccaugugaggacaacaugacuauugauacgaagacuagaccuagugcacauacugaucaugguguugaugaguauccagaaauuagugguauuacuacagcaagggaagccaugcguaagaugacagaggaggauaagcagaagauugcucaacagguggaauauuucagaacagagaaguugaaguucgacagagaaguggccaaaugggaugauacgggcaaugacauuauuguuuuagcaaaacauaugugcaugauaaugauggaaaugacggauuucaccagaggucgagguccguugaaaacaacaauggaugucauuaaugcugccaagaaaaucucugaagcuggaaccaaacuggauaaauuaaccaggcagauagcugaucagugcccggaaucaucuacuaaaaaagaucuuuuggccuaccuucaacgaaucgcucuguacugucaucaguugaacaucacuucgaaagugaaggcugauguucagaauauaaguggugaacuaauaguuucagggcucgacagugcuacaucucuaauucaagccgccaagaacuugaugaaugcgguuguacugaccguaaagucaucuuauguugcuagcacgaaguacccacgacaaggaacaguaucaucuccaauuguuguuuggaaaaugaaagcccccgaaaagaaaccucuugucagaccagaaaaaccugaagaaguuaaagcaaaagugagaaaagggucacagaagaaaauacagaacccuaucaaggcucuaucugaauuucagagucccgcagaaucaguuuaa

SEQ ID NO: 6887 - RNA, 1170 nt, Nezara viridula
augaaugagaguaaucuucaaucgacucccaaaaccaaugccgcuacugguuucuuccaaaccaccacuccuaaacaagcgggcgguguuagcuuugguucuacuaccauguuuaugccuccagcaucuuccucuaauacaaguacuccaaagacuacagcaacagguaaugcaacauuguuuaguuuaucuacuacaacagcuaccucugcuccaauggcuaguggugcaguuacaacaucaucauuucccauuaguucuuccccauuaacuacucagcaguucaagcaaccuucuacuucucaaccuaugcaacugaaaacaacugcuaguaccgcuaugccuuuggguacuggcuuaucaucaaucggaggaaaugcuccagccaguaccggacugaauuucggaagcacugcuaaaucuacuaaugcuggagccacuuuguucagugcaacuaaaagcgcacuugcgccugucaacacggcugcgacaacuucaucuuuaacauugccaccuucuuccacaacaucucucacuaguucauuaucaaacaaaccuguuacuaguacugguccuucaaucucucagcaacaaaaucuuacauuucaacaauuggaagaauugauuuugaauaaauggacugcagaauuauacgaacaggagaaaguauuuuuaaaucaagcaacacagauuaauauaugggacaagguuauuaaugaaaaugcugaaaaauuaacucaguuacauucuacuauggagaaaguacggaagcaacaaggaaaaauaaaugaugaccuagaaauuauauuuacucaucagaaggacuuggaagcaugucuuguucccauggaaaaggaagacuuacuuucgguccuuaaggcugauccgaauagaaaaaaucuguauauaaaugcuaagaaaauugauucucagauuaaaacuaugucagaggauuugaaggaaacaauugaacauaucaaugaaacgucacgaucacaugauacagaagaucccgucauccagguagggcgaauuuuaaaugcucacauggaaucuuuaagauggauagaugagcauacugcuagaaugcaagauuauuuugauucuuuauuaaaaaugcacgaugacuugaggagggaaugugagauaagcaaacaugauguauauuaa

SEQ ID NO: 6888 - RNA, 582 nt, Nezara viridula
auguucauuugggauugguuuacaggaguucuaggcuauuuagguuuauggaaaaagucaggcaaacuguuauuuuuaggauuagauaaugcugguaaaacaacucuucuccauagguuaaaagaugacagauuggcacagcauguaccaacacuacacccaacuucugaagaacuauccauaggaaauaucagauucacaacuuuugaccuuggaggacacacucaagcucgucgaguauggaaagauuacuuuccggcaguugaugcuauuguuuuucuuguugacgcuugugacacaacucgguuaccugaaaguaaagcagaauuagaugcccuuuugacugaugagagucucaucaacuguccuguccuuauucuuggcaauaaaauugaucuuccaggugcagcuucagaagaugaucucaggaauuuuuucaacuuauacgggcaaacaacuggcaagagcaaaguuccacgaagugaauugucuggucguccauuagagcuauucauguguucaguucugaaaaggcaggguuauggugaagguuuccguugguuagcccaauauauagacuga

SEQ ID NO: 6889 - RNA, 1791 nt, Nezara viridula
augucuggaaacaauguuuauggugaaaugcuccucaccauaacgucugagaaguuuuauaucgaaccuguucaagauauggauaauagccuuauucuagauaggguuacaggaaauauaacaauaucaaauguuccaggaagcaguggggaugcaccagugguuggagaaaaaaaaacuauuuaugguauucuugguacuauuaggcuacuagcugggcaauaccugguaguagugacuggcagaacuaaaauugguaauauauggagaagggaaguuuuucagauggacucugcugagguuauauguuuuucuagaaguaccacucaucugaaugauaagcagaaaaggauugaaaaggaguauauaucaauguuggaauccauucuugcuacgccuuacuucuacuuuucauauuccuaugaccuuucucacacaguucagagauugcauaauauaucaccagacuuuuuaaaaaugccuauguaccagagagcagagcagaaguuuguuuggaaugaauaucuuuuaucugacuuugccaaaaacucaggggucucuagauucugccuuccaaucauucauggcuaucuuucaauuacaucuugcauuuuaaauggcaaaaccuucagucucaucuuagucuccagaagaucuaaggauagagcugggaccagacuauuuacuagaggaauugacucuaauggaaauguugcuaacuuuguugagacugaacaaauuguugaggcaaaauuugagcgugcuaguuuuguccagacacgagguucuaugccauucuucuggcagcaguacccuaaucugaaacugaaaccaaggccuaguauaauccaagaggaaaaucauacugcugccuucaguaagcauuuugaaacacagcugauggacuaugggagacaaguuauagugaauuugguugaccauucuggcucugagggcaagcuggaaggauucuauagaaaacuagugaaugaagcaaauaaucccaaucugaaguaugaagcuuuugacuuccacagagaauguucuaagcuaagguaugauagauugaagauucucauagaucgccuggccuaugauuuagaacaaaugucggugacuaugauuguuggagauggaacuguuauaucucagcaggaagguguauucaggacaaauuguauugacugccuggacaggacuaaugugguucaaucguuguuggcuagggccaaucuuacauauauuuuacagagacuaacaauauuaaagaaaggacaaacaguugaggaucaaguuggucuugaaaacacauuuaaaauacucuggagugaccaugcagaucuaauaucaauccaguauucagguacaggagcauuaaaaacggauuauacuagaacaggaaaaagaacgaaguccggaauaauucgagaugggauaaacucucuugugcgauacuacaaaaauaauuuucagcaugguuuucguaaagaugcauuggaccuuuggcuuggucauuaccggguuucuucagaagaaggaauagucaucagaagcccucuugauguuaaaagggaauucaaauauacagcuuuuccacuuauccuucuuguugcuauugcuauguucuucgcaaaucugguuacaccaagugaauauaccacuggcacucuccugucucugauauucuggugcucuaugguuucagcaacucucauugccauauuuuacaaugguucagaguauguagauugcccaagacugugcccucuucuuaggucaccaucugucuag

SEQ ID NO: 6890 - RNA, 1362 nt, Nezara viridula
augucuccuacuguuccaacuaccacaaauguugauaagaggccaacacuugucaaaccacacucugcugaaagaagaucagaauuaguuugccgugucaaguacugcaacacuuugccugauauuccguuugauccaaaguuuauucaauauccauuugaauccacucgguuuauccaauauaaucccacaucgcuagaacguaauuauaaauaugaaguucuuacugaacaugaucucgggguuacuauugaucucauuaacaaagauauguaugcugcugaucauaaugcaguacuugauccugcugaugagaaacuacuugaggaagauauccucacaccucaugauucuaaaaggucuagacaucauucucgaucaguuucauggcuucguagaacugaauacauuuccaccgaacaaacacguuuucaaccgcaaguuauggauaaaguugaagccaaaguuggauucagcauuaagaaaagucuuaaggaagaaacucuuuacauggauagagagagccaaauuaaagcuaucgaaaagacauaugacgaugcuaaacuaccuauagagaaacaucauagcaaaccuaaugucguuccgauagagguucuuccuguguuuccagacuuucaguuauggaaguauccuugcgcucagguuauguucgauucugauccugcaccaauaggaaagaccguaccugcucagcuagaacaaaugucucaagcuaugaucaggggugugauggaugagaguggagaacaauucguagcuuauuucuugccuacugagccaacuuuagaaaaacguagaagagauuuuacaaaugguauugauuaugaagacgaggaggaauaugacuacaaaauagcaagagaguauaauuggaaugugaaaacuaaagcuucaaaaggauaugaagaaaauuauuuuuuuguuauaaggcaugauggaguauauuauaaugaauuggagacaaggguacgucugaguaaaagaagacaaaaggcuggcacugcuccaaauaauacuagauuaguuguuagacauaggccaauggaugcuaacgaauuuaacauucaucgucuaagggagaagcaacuucagcauccaauugaagaagaagaugaagaagaaagugcuggugaagaagaaaagaaagaggacgaaaagaaaacaaauagcaaagauacugaugaaagugacaaggaagaagguagugacaaggaagguggaagugauaaagaugaaggcagugguaaagaagaugguagugguaaagaaaaugauagugcuaaagaaaaugauagcgguaaagaaaaugauagugguaaggaagaugguagugguaaagaa

SEQ ID NO: 6891 - RNA, 1026 nt, Nezara viridula
augaaacuuuaugugcacauauggcaaaaaaauaaugaaguacgguuggcagaacuagaaaaagaacaugaaaauucaguuauugaagaugaagagcaagugagcggucuguggcaggcaaaguuggacuaucuguguagcauuggggacaaggaaaaugcuagcgcauuagccaacagcaaguuacaggacaaaacgguuccuaagacucaucguaucgaugcgguuuuugcauuauuuaggauaucguauuuccacgguugcgauaucaaagggaugucugcagcaaucgaaaaagcaaccgaacucaucgaagggcaaggggauuggagcucuaggaauaaauuaaaagccuacgaaggaguguggaguuucgccgugagggauuauuugcgugcugcaaagcuauuuguugauguuguucccacauuugaaucauacgagcuugcugacuuugggacaauuauuaaauacacaguacuuucguguaugauagcguugcccaggugcgaguugaagaagaagcugaugcaccauggcgugauggcccaggcacuucacucucaauauagaaacuugaaggaguauuuccagucacuuuacgauggccacuaugcagaauuccuagucgcgcuagcucagguggaauccgauaugaaacgugauccucuacuucauccucauuaucgccacuaugugcaagaaaugagacuuagagcuuauaagcaaaucuugcaagcauaucguucacucucuuuagauuauauggcggaagcguuugguguuuccugugaauuuauugagcgugaaguagccaaauucgcugcuucagggcgucuacaauguaaaaucgauucuguggcucguucuguuaucacaagcguccaucucagugacgaagcucuccguguuaaagauucaucugaucuugaucucgaucgcucucuccuguauaagaccacugucaagaggggugacauucugcuuaauagacugaaaaaguuggccaggguuauggauuuuuag

SEQ ID NO: 6892 - RNA, 11247 nt, Nezara viridula
uggcaauguauagauugucgugucugccagcucugcagagaaaaugaagagacggggagaaugcuagucugugacuauugugauaaggcauaucauccgcacuguguuaggccugcgaugucuucuguuccaaaaguugguuggaagugcaagcggugucgguuaugcagugauuguggggcuagaaccccuggaggcggucuuucaucaagauggcacuccaauuacacaguuugugacuccugcuaucagcaaaggaauaaaggcuuuuccuguccggugugucacaaagcguaccgggcugccgcacucagggaaauggucaaguguucgcaaugucgaagguuuguacaugggaccugugacaaagaggcagacuuuguuaguuaccacagaaagaaagaagcccauccugauuaccaguauauuuguuuaucauguaaaaauaauucaaccauucucuaccugaagaggaaagauagcacugaagauguaaauauggauucugcuuugaauauaucucaagaaucucuagcuacgccagaggauauagacguggauuccgaaaggucugaugauccuccguuucgaccaucugguguuggccuaggcaaaggaaaaccauucuacgccucuaaaauagcaaagaaaaaacucggguuaggcccaggucggcccaaaggaagugggaaaaugucuucuauugcguuaucucacuuucaaaagagaccucguuacgcagauuuugguaggaagcgaggugcuaaaacgaaaaugagaggaauauucgguguccccgggcuugguuuacagagaccuuuaauggauucuaauaccaaaccugaagacgaaccaggacuugaaaauaaguugguucuuguaucaucucgugacaaauacguuuuaagucaagacguuuguguuauguguggugcuuuagggcaagaccaggaagcaugucuuauagcuugugcacagugugggcagucguaucaucccuacuguguaucaguuaagguuaccaaagugaugcuucagcguggcuggagaugccuugauugcacgguaugugaaggcugcggccaaagaaaugacgaaggacgauuaauauuaugugacgauugugacauuucauaccacaucuauugcauggacccuccacucggugccgugccuucagguguuuggaagugcaaguggugugcccauugccagaccugcggauccaacagcccaggucccaaugcaacguggcaguccaacuucacccagugcggaccuugugcuucaagaacuguuuguccagcuugccuagagcuuuauacagacggugaucucauaauuaaguguauucacugugauaggugguuacauugccucugugauacaauaucuaacgaaaaugaagcggaagcgugcugugcgcaagguuauacuugcauccucuguaggccaaauaaugcugcuuugguauuaccugcuacgacaccaucaagagcuccaucaccugaaauuaacuuagaaagcaaagcuacagacuauuauguagaugguguuugccuaucugaaaccggacugcaauuaaucaaaacucuuucaauggauaauggaaaucaaccaguucggcguaaaaggccagguuucagaaggcaggaucccuccguugaccuaucuguagaugauauagaaaaugaagggaaagacgcagucuacaaagacgguaugaucuggggcucuaaagaaaaugguccgaucccaaguccaccugaaggcuuuacauuguacacccgggaauguggagucgucgucuugaaacggauaaagaagagaaaucuucagaggcuuggcauugguggcuucaccacuguaaagaugaggagcuccagguucaaagaagaugaugaacaucuuuauccugaagaaaaacccaggaggaaaccuagaguuccuaagaagaaaagcaaaauugccgagaguuauccuagacaucuccaagaagcuuucuuuggcaaagaauuacucgauacaacuaaggaaaccucccaagaauuagagagcacuggugaugaaucagaugaaggaaaauuaaggguugucgaagaagagagcucuaaccaggaaaauguuagcgauaaaaggagggaagucgccaacaguucaucuucagcuaaaauaacuauaaaggaggaagaagguagcgauggugagacguugaaggauauucuacaucucccugaaaaucuucuucacaaugaucuagucaacacaaucaugaaugaaagugcagauaguaucaaaucagaaaaucuaaugucagagagcggacaugaagguaguggcagccaaaaagacgaacuaugugauauucucggaccucauuuuaauauagaaucuaugguaagagaaacaggucuuccaaacauggacagcaaagauguugaagaaauuuucaaaggaguucuuacugaugagagucgaaaucagagccaucauaaucaaccguccccccaucaacagcauccuguuccuaaaaguacaccuacaggaauggcuucuucuccgcuccaauauccaucagcuucuccauauaauucagaauauagcaauagcccucaguucaguccagaaaguucgugggaugauuguggcucuuauaacaggacaacaucauuaaaaauggaagcagaugaaucccucgggagagacgcuaccauaucuccuguucuguacgccaacauuaaucauccagaguggaagaaagaauauccaaguuggaaugaacguuucaaacaaauuuuaaagaaauggcgugcucuacccucugaagagaaagcuccuuaucuucaacgugcaagagacaauagaacaaacuuucgcaguagaaagcaggagcaugacaaaacauuaaauaccaaaucuugccgggaagcugaacaagagcgacaguggaaggaguugcaagcucugaggcagcagcagcaacacaugcuaucucaaacgaggguucagcaagguacaaauacaaaggauaauuacgugauaaugaaccguguccgccaaguugguaaugcaggacuuguacaauuuucaacaaaugagcagucuccaucuccccauuugacgcaacaguuacagguuucaacuuccacucaggaggcuaaucuaggagguuuaggaucgccuagagcacaguuugcuucugguacugguggcacaguuaaggucgcaacuccuggugguaccauuuaccgacaggugaggccgccucaaucgccuuuucagagcccaaggcaaccugcuacaccacagcaacagcaggaggaaguuaggcaacucagggaucucuuacagaggcaacaaguuaaacaagaaggaacggaaaccgucuugucuagugguguucuucaaggaguacaaaugagaccucagcccccuaggagcagccugcacccacagguuguucaugguauggaaccuagagucagguuaguaguacaacaacaggccuccagguuuccaggaaccacucaagugagauuggcugcuccuaggacacaacuucaagaucaguuccucauccaacggcaguucgcuguggccgcugcugcccaacaugcucauaaugcaagugcaauaauuaggaauaguaguacuuuaguugaucaaacaagauugcaaacucugccagucgaccaaagaauccaaaccggaggccgaggagaaggagaagaaauaccagagaguguuacugcagaacuugaaaaguuggaggaagaaggagguaccauugguggugaagcugaugagguuuccgcaaucuucucugaccuaguggaagaugacgaugaauuacucgcggaaaugggcccagauuuuaacauccuugaauaugcugauccagaacuugacacuguaucgggaggagaaaagacaaauauccuugaugaucuagaagacgaaguugagaaaaaaaaacaaguugggaguuccagaaaagaagauacugcacgaaggaggucugcagaaaguauuaauaaagagcuuaccgaaccuagaccagaaaguaaaccaagcgaagaagugaauaggguaucuguaacauccacaccaccccaucuaccucaacagauaucacuaacuggaaaaagcggcauuggccaaccaaaaauuguuggaucagguuaccaaacacaauuugcaacuccaacuacgccccucccaaggaugcaaguuuugcaagguggaaaucaagugagucguggaggcgcaagcuucgucgggaauccuccaccaccucccccaccuuauccuggccccccuccuccauauccggggcagcaagcugcgauacgaggaagggguguuagaucgcacaucaucccaggcccagcaucgcaggcucaacaaagaagaaccuugcuacuucaagagcaaccacuacuguuggaagaauuacuggaagaggagaaaagggagcaagagaaagcuucaguaacacccucuccagcgaguucccucaugagugacgcugacuuugagaugcugagggccgauguccucggcucaaggaccaccagcccuccucagucucaaucucucggcacucuuaaucuugucggacaaccuccuccgcccccuccagaaaauaucgugaccgaggcugauaggcaggcccagauccaauaugaagcauggcucaggacaaccggaagugcagucagccaacagauacgauauuuugaaacagaaguucaaaaauuaagaaaaauacgcaagucguuaaauaguaaacagcgacaauugagaaaaaauggcaaugaauuaaaugagaaagacgcuauagaacuacagcguguaaccggcgaacaaacaacuuuacagaaacaccuggaagcagcccgaaaacaaagcaggcagcauaccauggugaugcaggaauaucaaacgaaacaggauagcaaaggagguggagguagcgcugguucugcuucuccgcagucuccucuuuugucgccggcugguggaggcaucgguggacaucagucccaccaaccuuccccucaaacaucgucggucuccccaguaagacauagcccagccggaacaccacauucacagaguggugaugacaaaagcgaaggcaguggucuuccaucucccaggccaccccccaugacacccacuccgccuagcccucaucaauuccaucagauaaggcaucccucgauggugucaagguuugccagauccccugaaggaggauuaaggccacguuuggcuccucuccaaacgucugguuucaauucucccaggggaaugucgccucaaccgccaucuccucagacaaugagauugacucaacagcagcaacuucuccuucaaagacaucaacuucagcagcaaaaacagcagauucuagaacagcauccugaagcgggggcuauucugaguagacaacucuugagacaagaaccacagaggcaguacagaacauucccagguccucagaguccugguucucaaggagggucuccauuguauaguccucgugcuccaccuaguccgaugguuuaccaaggacuucagacaccgacaucuccgaugccucaguuuacccagcccacaucuccaaugcagucuccucguuuacaguaugcaccuaguaguccucaucaacagcaauaucgucccaacucccccaugguaccauccccuaugagaaggccauccucagcuaguccacaaggagaaggugguggaggaaaucccuucaauccuaacaacccuauuccuauaccuccugaaauacggagguuaaaauuaggcuuaaaaggagguucgccuauguggagugauaagagaaaaagggugcaaccuaguaccaguucagaaaaaguugcuagcuuaguuuguguggacuacaacgauuuugaagaggaaucuccuccuauuacuccaccaucuaaaccugccuuaauuaaaaaaacagaaaauguuaaagcucgacaauccgaagacacagauucagaauuaacuguuuaugaugauauuguguuaguugaaggcugcaaagaaacuaacuuggaaguugcagaguugcggucugcauuagaaggaaaugucauguccacugucguuuccaugccaaugguuauagauucgggccagauucagaugauggauguugaaggggaguugcuugaugaccuuguaguuuuggguguaggaaauggaaccacugacagugauuguauuuuagaagugaacaaagaucucauuuuggacgaugauguuaaagaagaugaacuugaugaugguucuccaccaagagcuaggaugcaagguaaaguucuuccugguggaggcucucauaauucaccuucuccugaaucuagaaauaacugugauauauucaaaaaagucgaggaaaagucuaaaaaacuggaaaaggagagaaaaaguacugaugaaaggacaguuccuguucaaccaaacauuguagucucgcgaacuccaacaacuuuuacaccugucguuacucagaaaucaauaccaauagcugacaaucgucaauuagcuaugcagcaagcagcuguugcuagccuuguccaagaugcuguaaaugcugcaaaguuggcagcugaagcccaaaaucuguugaaaucaagucaggccaaugaacagcacagaaacgcaauuucccguggcaauuuuguuccauuaucgguuauuacgaguaaagcagcggauagcgaaccucuugucaacaauuccaucaagucugauuuaagaaagucagaacugagcagguuucaagauguugacaacgggcaaaaagagaugccagaaaauaaacaagaacaucaaaaguuucguuuagaaaaugcaagugauuuacgaauaauuaauacugagaguucaauuaucaaguauaaaacaucagagucgguagaucgucaucaugcccauaaugaaauaaauguaauuaaagaaaaugaagaaacuaaugauaagcgagaacacaaaauuguugaaaggauuaaccaugucgcuccaaaaguagaaaaugucacucuuccuugugucaguucgaguauccuugaggcucaguuaacaucgauguugagaacgaguagugaacccacuuccaaucaaaauuuuauuuaugcaguuguuaaucauacugucaaagaccagaggagggaagaaaauaaucaggaugacaugagggucgaaggucuugcugcucacuuccaaaggacuguuaaaaaugaagagcuuauguugacugaaagugauauuuauaaaaauucuaggaauccucaucucaauaaaaaacauggcaacauauaugugaguucucagauaaagacugauacuguaaugguaggaggaaaaucuuauaaaauuuaucaagcugguccacaauccaguacgagugauauucugaccuuaagggaugacaaggaagaagcaaauggcagaguugcccacaaggugaauacaauagagagaaggcucucugucaguaaugaaaaagcugcgaacgaaaugcuucaacagaggguuguuucgaguucugaaacagcugagaaagaaacacaucauuugaguuucggugggccaaaagcacaagugguugcucaaaaagaagaaccaaaaaaguuuguugcccuugcuacgauguuguuaccacggaauaaugaagagaaaagaguaagaccuggcgaagacucgcaaaauguucuucuuaaacagcugcuucagaacacugcaugugcuaccaccaccacugccucucuaccaauuguaccaucccuggaggcucagcucgcucguccuguaccuccaaccccuucuucucucuugccaucaguuuuaaaugaaccuccuaaagagauacagcagccaaaaccucaacaccagauaauagaaucaccaaaacaagaaacacgcccccacaucggcccaucaucgcuagaugagcuacuguccccaccaccaccuccucaacagcuucagcaccacccgccuucagcuauccaaacaaguccaguaaucaagcgugaaccuguuuuuucuuugagccagccuggcccugugaugacacccaugguggaugucaaaagggaagucgaaguuaaaaaagaagugaugucuucugaugaaauguugucuccaggacuacguuuggaucagaucgacucccaaccgcaagauaucaaaaaauugaagaagcguccuuaucaccaucaaaaacgacgccaaaguuuaggaaaagaaaugauuggaggaacaccgaaaaagaggccucgaaagagcucgaaaguagaagaagauuaugauucuuucauagauucuguuaugcaucaacugagacagacucccggaaugucaauuugugaacccaaccucacuuauaauuuuacuggaugcccgccauuuggggccggcgacaugagcaaagucaauucaugcacacgccuuggagaauuacgugguacuuauggcaccgcuuauuuaccucaugaaaaugaucauuauaauacauuaccuuuuggugaucuuccaccuaaagcuccuucgacaccagcuacucagcggggauuuuauaacgaggaguucgcacccuuaaaguuacacacugcaaaggaugacuuugaugaucggaaauaugauuacaaccgagaucgugacaaugauacaccugauacaaucauaaguuccuccaguccugaguguaucaugccagaauuccauccaagguuuccagguuuacaauuaauagacucagauaaugaagaagaaagauuccgauuauccagguuuucuccagacauuccuaucaucgcuccauuagcuauaaggccgaagccuauacgauucuauagugacauggauaaggaaaaugaaacuccugacggcgagagagguagaauuagggaaaguguaacaguuacuuuaacacugacuagucaagcagcugacgacguucuaucuguauuacgcaauuuagccaauguacuccgaauaccuguaccugcaacgcauagcauuacggaaaggaguuccgcaucccaccgccucggaauauaucgacugaagggcaaagauggcaaagaaggagcucaagucgauauccaaucuauucugaauggaacugccaaguuuuguaggcauugcgaugucguaauaaugaacaaucuuaugaggaaaaaggcgucggaaaugccccuaguugccaggcaaggggaagaagaucuuuacuucugcaguacgucauguuacaugcaguuggcccucucucauccacagggucccaacaaggaaaaggcuuuaacaauaauagaucaucuagaaacaccuuccaaaaagacgaaaguugaaucaacaacugauugcaaugcuguaaagaucgaaccaaagaaagaauuuaaacuuucuucggaccccucuuacaugacuaccaggggcucagggaaacgugaaaaacaaaguagugcuuaugauaaaacggcugugacaaauuccuaugccucccaugcccuaggaaagaaaucuccuucaagauaucggacauggacaacggcaacuauuccaccuccuuccgccaggcauaagaagccuacugacaaggaaauuacugagaugcuguucaagagugguaucacugugaugccuuugaaguugccugaagauagucgacacugucuccuuugccaucaaguuggcgauggugucacugaugguccugcaagauuauuaaauuaugauguaaauaaguggauucauuugaauugugcccuuuggucugaugaaguauaugaaacagugaauggagguuugaugaauguugaaaucgcucuucaaaauggccuuucaguucauugugcuuauuguaacacaccuggagcuacuuuaaaauguuacaaaaugcgcuguuccuuaguuuaucaccuaccgugcgcagucaaagaccaauguguauuuuucaaaaauaagacgcuguacuguaguagucauguaccaaagaaugaaaaggaaaaugaauugacuacuuuauccguaaugaggcguguguauauaucucgagacgaaaaucgccaaguggcagccauaaugcaccauucugaacagacaucacuuuugagaguggguucccugauuuuuuuauccgucggucaauuacuuccucaucaacugcaagcauuucauacaccaaauuauauuuaccccguuggauauaaaaucauaagaauguacuggagcaugcgcacugucaacaagcgcuguagauacauuugcuccauugcagauguggauggcaaaccugaguuccguaucacgguagaggagcgaggugaggcagauauggaacuucgugacaccacuccaagaggaguuugguugaagguuuuagaaccucuggcugagcuucggaaaguuuccucgguuguucaauuguuuucucgcuauguuacgggagaagaucuuuuuggacuuacugaaccugcaauagucaggguucuugaaucuuugccaggcguugaaacacuuagugacuauaaauucaaauauggaagaaauccuuuacuggaauuaccuuuggcugugaacccaacuggcugugcucguucggaagggaaaccaaaagguuggaaaagagcucauacgcagagagcuacgucucuuagggggggaggaagugguccugcguuugcuccaucugcuccacuacccggagaacuugccugccccuacucgaagcaauuuguucauucuaaaucgagucaauauaagaaaaugaaacaagaguggaggaauaauguauuuuuggccaggucuaagauucaaggauuaggauuguaugcagcaagagauuuggagaggcauacuaugguuauugaauacaucggugaaauaauccgaucagagcuugcugaaaccagagaaaaacaauacgaagcuaagaaucgggguauuuauauguuucgucucgacgaagaccguguuguugaugcuacguuguguggaggauuggcucgguauaucaaucauucuuguaguccgaacuguguugcagaaacagucgaaguugacagagaucucagaaucauuauuuuuacuaaaagaagaauuucucggggugaagagcuugcuuacgauuacaaauuugauaucgaagacgaccaacauaagauaccgugcaugugcggugcccccaacugucgaaaauggaugaauuaa

SEQ ID NO: 6893 - RNA, 702 nt, Nezara viridula
gagguuuuaagauucuacuauugggaugccgcagaggaaauguacucacaaccagggacuguauuuuuuuuuggaaagauuuugauugaaucagcuaauacuuauguaagcuguugugucucuguaaaaaauauugaaaggcguauauuucuccuaccaagagaaaggaaaaugaaucucaagacaaaugaaacauauggugauccugugacaaugacugauguuuaucaggaauucagcucaauuguagcugaaaaguauaaaauaaagcaguucaaaucaagaaaaauuuccaagaaauaugcuuuuggugauaacaguguuccugcagagucugaguaucuggaaauaagauauccgaguacuucuccagcacugcccagugaucucaaaggcgaaaccuuuucucacguauuuggaaccaagacaucauuuuuagaaauucuucuguuggaaagagggaucaaagguccuaguuggauugagaucacaaaugcugaaccuguucuagcuccauuuacuuggugcaaaguagaggcauccuguaugaaagccagcgauguucauguguugaaaccugguuugccgcacauuccuccauuaguuuugguuacucuucauccacaagcuguccauaauccgaaaacaaaacaaacagaaauuguugcuguaggcugcuuaggcaguaacucauacccuguu

SEQ ID NO: 6894 - RNA, 1440 nt, Nezara viridula
gggaaacagucaguaagguuauuguuuuuaaaaggcgacauggcggcugggacccagguuaaaaauguggaaguccgcgacauugcaagaauugaacgaauuggagcucauucccauauucgagguuuggguuuggaugacagcuuggaagcgagagccguaucacaagggaugguaggacaacaaauggccagaagagcagcuggaguuguuuuaggaaugauuaaagaagggaaaauugcuggaagggcuguuuuacuugcuggacccccuggcacagggaagacugccauugcuauggguauuucaaaaucacuugguaaagauacuccauucacagcuauggcugggucugaaauuuacagucuugaaaugaguaaaacagaagcucugacacaagcaauacggaagucuauuggcauccggauaaaagaagaaacugaaaucauugaaggugaaguugucgaaauacagguggaacgaccagcuacaggaguuggugccaaaguuggaaaacucacuuuaaagacuacagaaauggaaacugucuacgaccuuggaacaaagaugauugaugcucuuaccaaagaaaagguucagucgggugauguaauuacuauugacaaggcuacugguaaaauuagccgaaucgguagaucauuuaccagagcaagagauuaugaugcgacugguccucagacuagguuuguccagugcccugagggagaguuacaaaagagaaaggaaguuguacauacuguaucgauacaugaaauugaugucaucaauucuaggacccauggauucuuagcucucuuuucaggugauacuggugaaaucaagccagaagucagagaacaaaucaauacaaaaauugcugaauggagagaagaaggaaaagcagaaaucucaccugguguuuuguucauugaugaaguucauaugcuugauauugaaugcuucucauuuuugaaucgagcucuugaagaugagauggcgcccguuguuauuauggcuacaaaccgagguaucacuaacaucagaggaacuaauuauacaucaccucauggaauuccuauugaucucuuagacaggaugauaaucauuuccaccucgcaauacagggagagugagcuuagagaaauuuugaaaauuaggugugaagaagaagauugugaauugucugaugaugcuuugacaguucuuacuaggauagcuauggagacuagccuacgguacgccauacaacugauaacacuagcaggccugguauccagacggagaaagaguaaugagguagaaauugaagauguaaagaaagucuauucuuuguuuuuggaugaaggaaggucaacacagaucuugagugaauaccaagaucaauaccuuuacgaucagaagccugauguugguggaaguggagaaccaauggaucuguga

SEQ ID NO: 6895 - RNA, 1110 nt, Nezara viridula
augucuauccgaacuuauggugauaagccgaucaguuuccaaguugaagaaaauggagaauauuacugcauuggaucugaagucgguaauuauuugcgaauguuucgaggauccuuauauaaaagguauccuggaauguaccgaagaacucuuggaaaugaagaaaggaaaaggcuuauagaacuuggacuaagcucucauuguuuagccuccaguauaucuuuacuaagagcuucagaagucgaagauaucauugagggaaaugaugaaaaauacaaagcuguuucaguucauucuucugaaacuccuauuacgaguucuucuaaacccaaaaaagcuaugccuuggguaccuucgcuuccaaauaguucacauuuagaugcuguaccacaggcaacaccaauuaacagaaauagaguuguuaguaaaaaaguuagaagcuuuccucuuugcuuugaugacacugauccaucaucuauaauggaaaaugcuucacaaauggaaguacuuguaccaauacgucuugauauggaaauagagggacagaaacuucgugauacauuuacuuggaauaaaaaugaaaguuugauaacaccagagcaguuugcagaaauacuuugugaugaccuagauuugaauccucucaguuuugucccugcuauagcccaagcuauucgucagcaaauugaagguuuuccuacugacaauauuuuagaagaucagacugaucaaagaguuauaguuaaacugaauauacauguugguaauaccucucucguugaucaaaucgaaugggacaugagugaaaaagagaauaguccugaacaguuugcuaugaaauugugugcggaacuuggauuaggaggcgaauuuguuacagcuauugcuuauucuauucgaggacagcuuaguuggcaucagaaaacguacgcuuuuagugaaucuccucuucaaacuguugaagugccuuuccgaccgcagucagaagcagaucaguggugcccguuccuggaaaccuugacugacgcagagauggagaagaagauaagagaucaggacagaaauacaagaagaaugaggcgauuggccaacacuacuccugggugguaa

SEQ ID NO: 6896 - RNA, 654 nt, Nezara viridula
acagcugcucuuugggcuaggaauguccacuuaguacuguugggaguuguucuaagugguuauuguuuugugauggcugcuauacguaaaaaauuaguuauaguuggcgauggugcuugcggaaagacuuguuuguugauuguauuuaguaaagaucaauuuccagaaguauaugugccuacuguguucgagaauuauguugcugauaucgaaguugauggaaagcaaguggaacuagcauugugggauacugcuggucaagaagacuacgaucggcuaagaccacuuucuuauccugauacggauguuauuuuaaugaguuuuucuauugauucaccagauucauuagaaaacauaccugaaaaauggaccccugaaguaaaacauuuuugcccaaauguaccuaucauucuuguaggaaauaaaaaagauuugcgaaaugauccaaacacaauuaaagaguuggcaaaaaugaaacaagaaccaguuaaaccagaagaagguagagcuauggcugauaaaauuaaugccuuugacuaucuugaauguucugccaaaacaaaagaugggguuagacaaguguuugaaacagcuaccagagcugcucuacaagucaaaaagaagaagaggaaccgcaaauguaagcuucuuuga

SEQ ID NO: 6897 - RNA, 3966 nt, Nezara viridula
augaauuugaguuugaguaauuaugaaagaguuccaccacuggauuguuaucaacccucugggaaucuuuuagauuuagccgaccguaugcuagaaaaauuuacuguagaagauaauaauuuaccucaacugcuggacagacuucaaaucacuugugaaaguggaacaacaucaagcggaacaaaggauacugauuauauuaauaauguggacuccaguuacuuaucucaaauaucucaguuccgauugauuaauaagauaccacuuccucaagaaauaucugaccaguuuaccacucuugcagcugguucaucaggagauacaacuaccaugggaauguuuccagauauuaauagagccuggauggcaguugaaagugauauauauuuauggaacuucgaaacaggaggggauguggcauacuuugaugguuuaagugacccuauagugaguguuggccuuuuagcuccuagaccuggaguuuuucaaaguuuuauuagucaucuucuuauucuuacuacaccuguagaaauaacuguucuuggaguuauuuuggcaucuucaagugaucgaaaaguuggugaugaauugcaacucacaccagauaccauuuacacuuuaucuacugaugguguuccuauaaggguuauuaaaggaacaaagaauggacgaauauuucuuggaggaaaagauggaaaucuuuaugaauuaguuuacagaaaagaaaugagcuggggugguaagagagcuuggaaagugaaucauaccaaggcuauucuguccuaucuuguuccaacauuugugucaggagcuuuuucugaagaagaucaaauaacagaaauaacggucgaugaaucccgaaauauucuuuauacacuaucaauaagaggaucuauugaaguuuucgaucuugguagaaauggagauacaacguguagaguugcaucacuucaucauucuuuuaucaaccgaaguacuguugaucuuauuaggaauauaacuccuccagauguuagucgagucgugagucuuugccccauuucugaaaaugauucuccacauuuuggaguuguggguguuacagaaaauggaauucgguuauauuuuacuacaggaagcccaccuaggccaucuacauugucucuucuucaugccaggcugccuccuggacaugcuccuaauacaucaaaugugaggauuggcagaguagcuauggcuauucauaaaucagguacauuuauuaugguaucauccaugggugacuauucuccugaccgguuauggugcuucacuauggaugguuuaucugcuuugaaguuacccuuaacagaauuugucuuuacgaauccucaaaaugcuucaauugcuauugcugaaucacgggaaaauaugaguuugacagaucgaggauuacauggacacuuucuaguuuaccagcaaaauuauccccaggauagauuuauuauuuuaagucagcagggcacagauauuuaugaaaagcugagaccuguugacauauuuggugagcuaaugcgagagaaagguggaccagacugugaagaaguaaaacaauucuuugcucagcaugguucagaucaagcaugugcaauggcucuuauacuugccugugacgaaaccaaucaacauauggcagaaugggcaacucgugcuuuuuuucuuuauggaggugacccuaaauauguucuacaaaccauucagcaaccuauacaacagccaaccaugaccaacccucuucagcaaagcauaaugcaucauacauuaccuuuagguuucaaaccagguaccgucaguacuccuuuaggagagaagcaagugcaacccucaagaaguauagaaacuuauggaguaucaaugucauccaaacauaaugggcucuacauuuuccuuagucggaugcuucgaccaguuugguuaagaagaguuuuagaugucaauuauaauaaaaaaccuauuuaccugccaacuauuacuugugaagaacuuaguuuaaagacaguucaacuguaugagcuucguucauuucuugcaagauacaccuuaagcucaucagauguugguacaaguuugcagccagccaacaauacaacugugguuucuccaaguggccaacgcacucguuugcaggaagcgcucauucaagaaaaggccucacuugaugcuuuaaggaauuuuguugagcgaaucacccaaguuuucucucuuuggaaguuguuaugugaucaugaauugccucuaauuguggaaucucuuucuccggaaagucaagaucaauuaauacacauuacauuuagagaguuuauucuuaaaggagaagauuuaugucaugaacuuaucucaaaauuagucaguuuguauuugaaugauaaugcuucugucgauccaaucaguucaaaacugagagaaguguguccucuucuuuauaaaaaugaagacgcaacauguacaaaaguaaaugaaauucuucaaauggcauuagaugaaguugaugaggaagcuaaguugaaccucuuacgaucagcgauugaucuuuguaaaaauguaucaccaaauguugauauugauucagugugcaagagcuuagucaaauguggauauuaugacggaguuuuagaaaugugccaggaugucgcuagcaaaucugauucaaauucacuggcuucaaaguuuauagcuagagguaggccuguagaagauguugaaggaagcaaggcauuugaagccagacauaaggcuuaccaacaaauaguucauuuauuagacuuccuguaccaacagugccaauugggaggcaauaauauucccccucucuuuggaagugcugacuuaucuucucacucacaaaaacuuuuggaggccacccuugaaaaaugcuugucaguagaagaugaaacuugucacauugugguuuaugauuggcuuguuagccgagaacuccaagcaucacuuguuucauuagguagaccuucaguugagagauuucuuucacgcuauccugucgauagcccucuaagagaucuuuuauggcaauaucaugagaaaucagggaaucaugcuccugcugcuaauauacuguauaagauugcuacugccccuggagaauuuauaacucuccaucaacgauuaacauaucuuggaaaggcuguuauguguaugcgaagugauggagugggaugugcaucacauuuagguguauuucuccaugaauuagaagauuuaguacauguugcucgagugcagaaacagauuuuagaaaggaucaccucaaugccagauguuagugacauaaauguacaagaugcuuguagaaaacucaaugccaauuuacuuucaaucacugagcucuaugaaucuuuugcugagccuuuuggacuuugggaacagaaacuugccauuuuagacugugcuggucaugaugauaaagaacucauaaauucuauuugggacaauauaauacuaaaagagcuugaucaguguaauucuagagauccuucugggcaaaugguuguacuaguaucaaaaguuagaucauuaggccuucaguuugguauacagucuccauguuuuccuauugaauaucuuguuuggcaauuggaauugaucagcugcaagcuuggaguagauaaauuucauguacacaauaucaugacaucauuagguguuccuuauucaacacuucuggauaucuauucaaagauguauucagcaaaugauaacuguuggcuugaaucugauaaugaauuucauuugauucaagugauugcaagcuucugugaauccuuuagcgauaacaaacaguugacaaccucagcacaagaaagaaaaucaacugcuguacuaaugcaugacuugauuaaugaauguauaauuguucuucauagcaaaacuggauugggugagcuggucgguuaucuuaaaagcauacaaacuaaauuggaaagaaucuag

SEQ ID NO: 6898 - RNA, 3633 nt, Nezara viridula
augucuggaagugauuuuuauggggcugauacguugcacaaagaagucuauauaagaaaagggcaugaggacuggaaugaaauaaauuugaauccaggaggaauugcaaguacccuucaggauguuaaaacccaacaacgagcaggagcuuaugccuacaaaaaaauucccaauagauucauauauuggaggacugaaggaaauguucuugaaaugguugaagaaucccuugacguaacauugcaugguaaucagauuagauacaaauuuacugauagucaaguguuggaugguuugacuguuacagaaacuaugaaaagacugauuauucuuguuccuacugugucuagccuucacguuuucacauauccacauccugagaaacucuugaaaaagggauuuggugaagugucuaguuugucuguuuuucauggcauuagugaaagugaugcuacggauccacagaccuaccaucaacugaauuguucuuccagugcaauuguuagcugcacaucuuguauugcaaauaauggagaagcuauauuugcucuuggauuagcaaaugcuucaguucuucuugucauuguagauucuguuaguggcuuaucuucuucucguauucuuucccaugauaacauuguuccuagauuucucacaggaauuuugggaaaggaugguggagaauggguuccaguuaguuugauuuugcauuauauaaaaaaagaacuuuuucucuucacacuuuguagaggaggaagccuucguguauggucaguugauagaggaucauuuaucacgucucuaugugugaaguuaacaagucaaacaacauugaaagcucagaaacacaagaugugcaaaggauauauaaauggcacuuuuauauuacacuguuguguacaaggugcugcuauuguaacauuagcuccagauuaugguaaugguguauucaacuuuacgaccauuucggaaauaccuauucaaccugguuuugaaguuacaaauauguguccuggggaggagggauauuuuugguguaguugguuaacauuagaugaaucaccugcuguuaccaagaauaaugucauucauccaggauuuucuaagguggcauuaaccagaccuucucuucaagugccagugucagacuacauuccuagggauccagcuucucauuauuuagaugccauauuuuccucugguuucuucacuucuuuggauauagcuaaagcaauuucacuuuauaaaauaacugcuguaauaaaaccaaacaucgauguugcugaacagauuugugccauaguggaaacugaaauuuauucagaaauuggugaacaagaauuggaugaugaugaauucuuagauauugcuuuuagguguuggaaucgauuauauucauguugcagucaguauauuauuucaaguaugcuuccucuuggaaugguuuggcucggagauuacuuaguuuuaauucaagaaugugguuucucaauaguuguugauauugaaccauuagaacuuuuuaugacaacugcuguaaagucuucacaauuuccacaaguuggauacggcuggcuuguagaaaagcuuagggauauuaauuuagaaucuggcauuguuaagcuggaauugagcauucauacuggagaaucaauugaugagcuuuccauccuucaagaagcugcugaucucauucauccuucuaagcaacuugaugaugcucuaaguaucuucuaugaagaagguuuaggaagaaguuuaaauugucuuauagaagaauuagcugugccugaagauuuuaauaaagaugguaccugggaaucguuuuguaguuauaguggcguuggugcugugacaucugcauuucgagauuauguugcugugagguuaaagauuugugaaaaaauguuauugcuuacugagcuugcuaugagagaugaugauggugcugcagauaggacucaacacaggagcuuagcugcccuuuguaaagcguauuauauuuuaaaauggaucuguacauccaaguccacuggaaaugcacccaugauucauguguuuucuuuggucaacccaacaucaauuaugcaaucuucucuugaacaaugugugcuuggccuugcuaauugcuuauggccauuagcaacaaauaguacacuugcucagcauuugcuaucaaccaaacaguaugcacuucuacaaacauuugcaagauuaguuggaauaaauaacuggaguuuacuacuagcagaaucauacauucugacaggacagccuggcaaggcauuugauguuuguuuaaaaaaugcuggaucagauguugugcacuuccugaaugcuauaagacuuuuugaaaaacauucgaggucugauuuaguaauagaaauggcaacuaaagcuuuggaacuccuuauuguuucacauucugauagggaaacacucgaaucagcauuauuuguucaugaauuaggaauggaaaauuaugaugcugcuuggaguuggauugaaucguguaguucuuggucccgcagaucugacuuuuugcagcgucuuguugcuaacaugauaucagaaggaaaacucacugaucuuaucucauuuucuuauacuggucuccuagaugaauuagaaaagcuucuugcuucgcgugcuagaucuuugacuuucggccuugccacuaacuacuauaauaucuuguaugcuuuccaugucaaacaugaaaacuuuaagaaagcugcuaguauuauguuagaaaaagcucuacgugcagacacugcugaaguacaauggaaauguuauggugccugccucagcuccuugauguugauaaaugauccccaacaagcuuggcuagugcguccuaauccauucucucaagaggaugcuguagaaauacuagaaaucgaggauauucaaagagaauuugaguugucuggagcucgauauaauuuagauggauguucaccagaugcuucucaggaagagguaauugcauuaugugucacccaaaaacuauacaaaacagcacuucggcuagcuaauaugugcaaacuuucuugugcaccuuguauucaagcuuucacagcuaguugugcagcucucucugaacaaucaauauccuggcauugguugaaagcaaaugaaauugaugauauuauuauaacugaaucuaaugcaaaugaaauguuauggaggauuuuagaaagauguauuuugaaguaugaaaaagaaaaugaaacagugcuucaucgggcuucugcuaaccaacuuuuaacuguugguuuguuuauuccuacuuggcuucuucaaucuuauaagaaaagaaauagcucagaauugcuucgccuguuuguucaacauggauauuuggaagaagcugaggagcuagcaugugaauacuuaaaugcagcucuugggauugguagagaacauuuuucaauugauuuuccacugcaucuuucaucuccuccccuuugucuaccuuuacaaacuauagauauuuuacuucuagagcuaaaacauuauaauauaggggaccggcugcaaaaaaaauuggauacauauguaaacacaauuucaaggauuacuuuggaaaggccuaugauuguuucuacaaaaaaaaauaacuuguaa

SEQ ID NO: 6899 - RNA, 2901 nt, Nezara viridula
auggagauuucagaagagaauuuacacacccucacuaacuauuuaaugcagacacuaagcccagaucccaaugucaggagaccugcugaaagguuccuugagucaauagagauaaauaaaaauuauccuauuuuacuauuacaccuuaucaauaaagaggauguccauuacacgauucgugucgcuggugcaaucacuuuuaaaaauuacacucgcaggaauuggccaauaaaugaugacaacuuggaaaacaagaucgauccugaagaccggcaacgggucaaagaguugauaguagauguuauguugguugcaccuucuaguauucagaagcagcuuucugaagcaauuggcacuauuggaaagugugauuucccaaaagauuggccugggcuucugacaaauauggucgagaaguuugccggaggugacuuccacgucauuaauggaauucuacaaacugcccauuccauauucaaaagauacagauaugaauucaaaucucaaaaguuaugggaggaaauaaaguuugucuuggacaccuuugcaaagccuuugacugaucuggcuguggcuacgcaaaaucuaacucaaguacaugcuacaaauccagaugcucuacgagugauuuauucaucacugcuccucauuucaaagauuuuuuacucucuaaauuuucaggaucugccugaguucuuugaagauaauaugaauauuuggaugccacuauuucauacacuccuuacuacugauguuaagugucuucauacugauguugaugacgaggcagguuuacuugagcaacugaggucucaaguguguucgaauauugcauuguacgcacagaaguacgaugaggaauuucaaccauaucuccaggguuuugucacugauaucuggagccuucuuguaucaguuucacuucagccuaaaaaugaucugcuugucagcaaugcacugcaguucuuaucaacaauugcugagagacaacaguaccgccaucucuuugaagacaaaaauguucucacuggaauaugugaaaaggucaucauuccuaauauacacuuuagagacgcugaucuggagcucuuugaagacaauccagaggaguacauccgaaaggacauugaagguucugauguugaaucgcggaggcgaucuucaucagaguuggucaaaguguuggcaggucacuuuccugaaacugucaggaccauuuuuggcgcuagauuacaggaaaugcuuggagaguauaauagugauccagguaaauggagguugaaaaacacagcuguguacauugucacaucucuagcggaaagggguucaacagcaaagcaugguguuacaaaaucaucugaccuuguugaccuucaugauuuugcugggcaauauauuauuccugaacuaaaaaaagaagugaauacguugccuguuauuaaagccgauuccaucaaguaccucaucaccuuuaggagucuucuugccccacaggugguuauagcugccuuuccugauauaguaaagcaucuuucgucacccagccucguaguacacuccuaugcagcuucagcuauugagaaguuauuaauucugaaacagaacaaccaaccacuaauaacacaggagcuccuacgaccaauugcuggugaacuucuuacuggucuauucaauauucucaaccuaaaaggcucagaagagaaugaauaugcuaugaaagccauaaugagagcuuucagcaccuuggacgagucuguuaucccaugcuuagccgaacugcugcccaagcugacacagaaguugacuauuguugcuaagaauccuagucguccacacuucaaccauuaucuuuucgaaaccauuucucucucuauuaggauaguguguaaaaauaacccuggugcugugagugcauuugaagaagcucucuuuccaaccuuccaaauaauauuucaagaagauguucaagaguuuguaccuuauuguaugcaaguuuugucucuaacacuugcacggaggucacccccucugccugcgcccuauguugcucuauacccaugucuauugucaccucaacucugggacagaccaggcuguguucgaggucuuguuugccuucugcguuccuaugucagggucucguccaaugaugauuucaaucagacaguuaaaguuaacgggcuucuugggguauuccagaaguugauaucuucucgguugaacgaucaugaaggauucuaucugaugcagucucucauagaacacugcccucgagaacuucuugacccguuuaugaaacagguaguucuccuucucuuccaaagacugacugcggcuaagacaaccaaauaugucaaaggucucaucacguucuucuguuuacuugucgucaaauauggggcaccaacauuuauagaacuuguugacucuguacaaccucagauguucucaaugguuguagagaggcucauuacuccugauugccggaaaguaucugguucuguggagagaaagauaacuguuguuggauuaugucgccuuguugcugacuuaaaacaaguuuucucuggaccauacucagccugcuggccagcucuugcuaaaagugugguugaauuauuagaagccccggaggaugauucuguugcuccugaagaucacuuuauagagguggauaauuuaccaggcuaugaaccagcuuauguccaucugacugcaaucggcagugauaagcaugauccuuuuccugauauuagugauuugagaagagaacuugcuaaugggaucggcagccucuucaaaguuucaggacaaguugucacccaagcuaucgccaaccuuggagaaccuuauacuagucacaucaaaagcuaucucacccugauaggaguuaucauauag

SEQ ID NO: 6900 - RNA, 576 nt, Nezara viridula
auggcgaaaguccagauagguaauguuuuggugcucgauaaucccuccucuuuuuugaauccguuucaauucgaacuaacauucgaauguaucgaagaauuaaaagaagauuuagaauggaaaaugauuuauguugguucugcagagagugaagaauaugaucaaguuuuagauacuauuuauguugggccuauuccggaaggaagacacaaauuugucuuucaggcagauccuccugauguaacuaaaauaccuauugaagaugcgcuugguguuacugugguuuuacuaacuuguuguuaccguggccaggaguucgugcgaguaggauauuuuauuaauaaugaauauuccgauccugagcuaagagagaauccuccugcgauaccacaguuugacaagguuguaaggaacauuuuaggcucugaaccgaggguuacaagguucaaaaucaauugggacgacucagagucacaagaucaaccuagucaagaaucggaagaacaacagcaaacgacagaaaauguaggcuuugcugaaaauagcggcagucauaauuuuauggaaguaucuuga

SEQ ID NO: 6901 - RNA, 891 nt, Nezara viridula
auggaucacaugcuugcaaguccguuuaauuuaccuaguauagguacuccaguccaucaacccgaagaagaucaacagauauuaccuauagcacaacagcaacaacaauuacaaccaccuuugcaaaugccaccuuuacuaccaauacaaucuucaauuaaucagccaaaaccaaugaacacuuaugccccuucaauggguuucacaacaccgcaaaguaugaugcauccacaaacaccacaaaaucucaugucaccuaugguaaauagaauggaccagacgccaaauaguauuauuaauccaaccacuccuggaccaaugacaccuaugacaccaucgucugcugacccuggcuuuaugccgcaguuacagaauauagugucuacugucaauuuagguuguaaauuagaucuuaaaaagauugcauugcaugcaagaaacgcugaauauaauccaaaaagauuugcugcuguuaucaugaggauaagagaacccagaacaacagcucuuauuuuuaguucaggaaaaaugguuugcacuggugcaaagagugaggaugauucuagacuagcagcaaggaaauaugcacgaauaauucaaaaauuaggauuccaggcuaaauuucuagacuucaaaguacaaaacaugguugguaguugugauguuaaauuucccauaagauuagaggguuugguuuuaacucauggacaauucagcaguuaugaaccugaacuuuuuccuggacuuauuuaucgaauggugaaaccucgcauuguuuuauuaauauuuguaucaggaaaagucguacucacaggugccaaaguacgucaagaaauuuacgaggcauuugauaauaucuacccaauauugaaaaguuuuaagaaacaguaa

SEQ ID NO: 6902 - RNA, 483 nt, Nezara viridula
auggcuucugucggcacaaccagaucuguuuugaggcuucucucuucacagccuauuuuaaaacaagcuguuaggggcuaugcggaugagauggcauucacauuugcugcagcuaauaagguuuucuaugccaacuccaaugugaaacaaguugauguucccucuuucaguggagcuuuugguauccucccuaaacacguuccaacucuugcuguuuugaaaccugguguuguuacuguuuuugaacaagauggcuccucuaagaaaguuuuuguuucaaguggaacgguaacaauaaaugaggacucuucaguacaaguauuggcagaggaagcgcacccuguugaagaccuugaugcauccgcagcuagggagcaacucucuaaagcacaaggggacuuaucgaaggccaccucugagcaggaaaaagccgaagcacucauugcuauugaaguagcugaagcccuuguagcggcugccuaa

SEQ ID NO: 6903 - RNA, 936 nt, Nezara viridula
augccuucggacgaacaagauaaauuugaugguauguugcuggcuauggcacaacaacaugaaggaaucaaagaucuccuugauacuuucuucaguuuuuuggcaaggaagacugauuuuuauauuggugcucaagccgaugcagcaaaaucauuaguuuuagauuccuuugagaaauaccagucaaaagcaaauuuggcugcugaaaagaaaagaacugaaaguguugaagcugaaaagaaaaggaaagaaaagcuugcugccaaggccacuccuaaaguaauggaaauaacugacgaagaagcaaaaguaauugaagaugaagaaaaaaagagaaaagaagaugaagaaauagcucuaucaaaaccaauuacagaaaccgaaggcgaagaugaggaacaagauaaaggaaaacuuaugcccaaugcgggaaauggugcugaccuugagaauuacagguggacacaaacucuccaagaguuggaaauaagaguuccucugaagacuacuuuuaauguaaagucaagggacuuggugguagaccuugguaagacacaucugaaaauugggcugaaagggcaugaaccaauuguggacggcgaauuagagcaugaaaucaaaauugaagaaucaaccugggucauugaggauggcaagacucuauuucuaacuguugagaagguaaauaaaauggagugguggucaaggcuguuagcaacggauccugaaauagcuacccgaaaaauuaauccugaaccaucaaaguuauccgauuuggauggugaaacuaggggucugguugaaaaaaugauguaugaccaaagacaacgugagcuuggacuuccaaccucugaugagcaaaagaaaaaagacaugcucaaaaaauucauggaacagcacccagaaauggauuucucaaaguguaaauucucauaa

SEQ ID NO: 6904 - RNA, 429 nt, Nezara viridula
augacgacaccauggagcccagacaaaaagcacagugacagagagagauggauuugcauauauccagcauauuugaacagcaaaaagacccgugcugaggguagaauuauugcaaaagauaaagcaauagaaaauccuacauaccaagaaauaagggauguguuaucagcagcugguuugaaaguagguguugaaaacaaacuuuacaguagagaaaaaaguaaagagcuucuuuacagaggucgaauaagaguucaguugaaaaacgacaaugguacuccauuaaauccagauuucgcuaccagagaauccguaauacuucaugcuuguucaaugauuccgaaguugaaaacacgccagggugggaagcauacgacugagcagagucaggguggaacaagcaagaaaaaaggaaaagggagaagauaa

SEQ ID NO: 6905 - RNA, 2031 nt, Nezara viridula
auggagaaaccucagaaaaugccuaaaguggccaagguuaaaaacaaagcgccugcugagauccagaucacagcggagcagcuuuugcgagaagcaaaggaaagagauuuggaaauaguucccccaccuccaaagcagaaaaucucugauccugaagaauuagcagauuaucaacaucguaaaagaaaggcuuuugaggauaacaucagaaaaaguagaauggucauuaguaacuggaucaaguaugcacagugggaagaaagucaaaggcaggucgauagggcucgaucgaucuaugaaagagcucuugaugucgaucaucgaaacaucacccugugguugaaauauaccgaaauggaaaugaggaaucgucaaauuaaucauucaaggaaucuuugggaccgggcaguuacaauacuuccuagagcaaaucaauuuugguauaaauacacauauauggaagaaaugcuuggaaauauugcugguugcagacaaguuuuugacagauggauggagugggaaccagaagaacaggcauggcucacauauaucaaauuugaauuacguuauaaagaaauagaaagagcuagggaaauauacacuagauuuguuaugguacauccugauguucaaaauuggaaaagauucgcagguuucgaagaaagacauggauucauuucuggugcuaggaaaguuuaugaaagagcaguugaguuuuucggagaggauauuauggacgaacgucuauacauugcuuuugccaaauuugaagaaggucaaagagagcaugauagagcaagggucauuuauaaauaugcucuagaccaucuuccuaaagaacgcacugccgaaauauauaaggccuauacuauucaugagaaaaaauauggagacaggacuggaauugaggauguaaucgugagcaaaaggaaauaccaauauuuagaggaaguaagaacaaacccgaucaauuaugaugcuugguuugacuugcugaggcuugucgaagaagaggguaacguagauacuauuagggaaauguacgagagagcuauugcaaacauaccaccaucaagggaaaaagauauguggaggcguuauaucuauuuguggauuaauuaugcccuauaugaagaauuagaagcagaagaugaagacagaacaaggcaaauuuauaggacaugccucgacaucauuccucauaagacguucacguucaguaaaauauggcuguuauaugcccaguucgaaauaagacauaaaaaccuuucaacagcaagaaaaacucugggaauggcuuuaggagucuguccuagggauaagcucuaccgugguuacauagaucuugaaauacaauuaagagaauuugauagauguagaacauuauaucaaaaauuuuuggagcaugguccugaaaacuguauuacauggaugagguuugcugagcuagaaacacuauuaggugacacagauagagcaagggcuaucuacgaacuugccguuaaucaaccaaggcucgauaugccugaaauucucuggaaagcuuacauagauuuugaaauaaacauuggugaaucgaggaaugcaaggcaacuguaugaaaggcuuuuagaaagaacucaccaugucaagguuuggaugaguuacguuaaauuugagaugucucauagcgaagaagagggaaucgaaccuauuucauuggcaagaagaauuuaugagagagguaacauugcuuugagagaaucgggagaaaaagaagaaagaauuuuguuguuggaagcguggagagaaauggaaaagguucauggugacgaggaaagucauaagaaggucgaagccaaacuuccaaggcgaguccgaagaagacaagcugucauugcugcagaugggaccgaagaaggaugggaagaaguauacgauuauauuuucccugaagacgaagccgucaagcccaaccucaaacuuuuggagaaagcaaaagcuuggaaaaagaagcaagaagccgauauccaaacaaaugaugaagacuga

SEQ ID NO: 6906 - RNA, 1431 nt, Nezara viridula
auggcuaucaaguuuuuggaaguaauaaaaccauucugcaguauauugccugagauagcgaaaccugaacgaaagauccaguuuagggagaaaguauuauggacugccaucacacuuuucaucuuuuuggucuguugucaaauuccucuauucggaauuaugaguucagacucagcagaucccuuuuauuggauucgugugauucuugccucaaacagagguacucucauggaacuuggaauauccccaaucguuacaucaggccucauuaugcaauuacuagcuggagcaaagauaauagaaguuggugacacgccuaaagacagggcucuuuucaauggagcucagaaauuguuuggaaugguuauuacuguuggacaagcgaucguuuauguaaugacuggcauguauggagacccagcugaaauuggagcagguauuugcuugcuuaucaucguucagcuguuuguagcuggccuuauaguucuuuuacuugacgaacuucugcagaagggcuacggucuugggucaggaaucucuuuauucauugcuacaaacaucugugaaacuauuguuuggaaagcauuuucuccagcuacugucaacacugguaggggaacugaauuugaaggugcugucauugcauuauuccaucuccuggcaacaaggcaagacaaaguccgugcuuugcgugaagcuuucuauagacaaaaucuuccaaauuuaaugaacuuacuggcuaccauccuuguguuugccauagugauuuauuuccagggauucaggguagaccuuccuauuaagucagcucguuaucgaggucaauacagcagcuauccuaucaagcucuucuacacuucaaacauuccuauuauucuucagucagcucuuguaucaaaucuauauguuauaucucagauguuagcugugaaauuccauggaaauguguuuguuaacaugcuuggagugugggcagauguuggagguggugguccagcccgagcuuauccagucggcggucuuuguuauuaucuaucgccuccugaaaaucuuggucauauacuugaagauccuauccaugcuauguuauacaucauuuucaugcuugguucuugugcuuucuucuccaagacuuggauugagguuucuggaucaucggcaaaagauguugcaaagcaacuuaaggaacagcaaaugguaaugcgaggucaucgugacaauuccaugauccaugaacugaacagguacauuccaacugcagcagcguuugggggucuuuguauuggugcccugucaguccuagcugacuuuaugggagcaauuggcucaggaacugguauccuccuugccguuaccauuaucuaccaguacuuugaaauauuuguaaaggagcagagugagacugguggcaugaguacucuucucuucuaa

SEQ ID NO: 6907 - RNA, 612 nt, Nezara viridula
cgccauuguuucgauagguuauucgugguaguauuuagguuuagcugggacguuacuguuugguguguauuuuauuguucgaaugugaaauuuguaaaaaugaaucuccugaaggcgaugaguccuacuucggugacuccuuccgucgaacucaguaccuacagggaccagcauuuuaagggcucucggacagaacaggaaagacuucuucgcguaucaacuacuuuauauauuggaaauuuaucguuuuauacaacagaagaacaaauauaugaacuguuuucaaaauguggugauauuaagaggauuauuaugggauuggauaaauauaagaaaauuccauguggauucugcuuuguagaguauuaccaacgaccggaugcugagagcgcuaugagguauauuaauggaacaaggcuugacgaucguauuauaagaacagacugggaugcaggguucguugaaggaaggcaguauggaaggggaaagaguggugggcagguucgugaugaauauagaagagaauaugaugcuggacgaggugguuauggaaaagugaugcaacagccuacaacaaaagcugaagcugcaucaauauuuaauggacaguga

SEQ ID NO: 6908 - RNA, 936 nt, Nezara viridula
auggcugcugcuguaggucggauauauggcucuagacuuuuaaaaaauaauccgguuucgaagcaccuacagauaggcagcuuuucuacuacuaaaucauggucaagaggaaagaaagcuuuguauacuucacuugguauuuuaacgggaggaacaggcauguugauauaugcucuugaaaaaagucuucaagcuggagaucuugaacuccauccucccaaacuuccuuggagccacaguggguauuuucaaucacuggaucaugcaagcauucgacgagguuaugaaguuuacaaaaaugugugugcagccugccacaguuuaagauuuguuugcuaucgagaucuuguagguguuucacauacugaagcugaggcuaaagcggaagccgaagaacaacucguuuuggauggaccaaaugaaguuggugaaauguuuaaaaggccuggaaaacuuucugaucauaugccuaguccuuauccaaaugaagaggcugcaagagcagcuaauaauggagcauauccuccugaucuuucauacauaguuccuggacgucauggugaagaagauuauauauuccacuuacugacuggauacugugaugcuccugaagguuugauuuuaagggaaggccaauauuuuaacccuuauuuuccuggaggagccauaaguauggcacaagcauuauauaaugagauuauugaauacucugauggaacuccagccacucaaagucaauuagcuaaggauguugcaacuuuccuuaaauggacuucagagccugagcaugauguacgaaaacaaauggccuuaaagguaauuuuuaucuuuucacucuucaucgcugcugcaguuuacuggaaaagacauaaguggagcacucucaagagccgaaaaauugucuuuagaccaccaccaucuccaccaaaauuguga

SEQ ID NO: 6909 - RNA, 1719 nt, Nezara viridula
auguuagcucuucagcaguauggagaaagugacagcgauaaggaagaugaagaaaaacaaaauauuaacgaugaagcuuuacuacauuuaaaaccucuuucugaaucaucuauuauacaaacagcuauuuguccugcuccaacagcuuuaccaccuguugaguacaauccucuuaaauucauuaaaccugguugcacugaaaugacagugaaucuuaaguaugaagaacucuuugcugcugacguugguccugaaaauccuuuuuugacagaucagcaaaaagcuccuaaaaacauacuuucagguuauguugaagcagcucacaugagcgaauuucaguuugaaaaucagcgaaagacuuuccaaaguuaugguuaugcucuugacccuucaauugauaauaugggucgcacugaagauaguauaccugucgucggggcuguagauguugcaaaagaaacuaaccugaagacaguuuuugaaucuacuucaaaacgaccucuugacaaacggaaaagaaauaaaaacgaugauccggcugauaucaauggcuuccuuggcccauggggguccuacguggaugagaaaaaaguaguuaaaccugacccugaaguugcugcugaacuugaagaauaucuugcuaagagacaaaagcuagguaaaaaaguugaagacaaaccucuggaggaaaagacaguccuucacaucaaagauccaguugauuaccaaggccgcaacuucuuacauccuccucaggauguuggagucaaccuuaagucugauucuccuccggacaaauguuuuaucccgaagucagaaauacauguuuggaaaggacacacaaaagguauuucugcuauacggugguuccccaaauaugcucaucuucuucucucuugcaguauggauugucgugucaaguugugggagguauauaaugaaagacgguguauuagaaccuauuauggacacaggcaagcuguuagagauguuuguuuuaauaaccgaggaacaaaauuccuaucagcugcuuacgaccgcuacauaaaauuaugggauacagaaacuggagaaugcauaucacgauucaccagcagaaaaauucccuauuguguaaaguuuaaucccgaugaagacaaacaaaacuuauuuguugcuggaacauccgacaaaaagaucauauguugggacuuacggucuggugaaauaguucaagaauaugaccgccauuugggagcuguaaauucuauuacuuucgucgaugaaaauaggagauuugucaccacuucugaugauaaaagcuuacguguuugggaaugggacaucccgguugacaugaaguauauagcugacccaucuaugcacucaaugccugccgugacuccaucaccuaaucaaaaauggcucgcaugccaaagcauggacaacaagauugugauauucuccgcucucaacagguucaaacugaauagaaaaaagacauuuacugggcauauggucgcugguuaugccuguacucuugacuucucuccagauaugaguuauauugugucaggugaugcugauggaaaagcuuauguaugggauuggaaaacgacaaaacuuuucaagaaauggaaggcucaugaucaugugugcauugguguucuguggcauccgcacgaacauaguaaaguagugacagcaggcugggacggucuuauuaaauauugggauuaa

SEQ ID NO: 6910 - RNA, 807 nt, Nezara viridula
augguucaaaagaagcccaagaagaagacuggaaaaaagguugcagcagcaccucuugcuguuaagaagcaagagguucagaaaguugucaauccacuuuuugaaaagcgagccaggaauuuuggaauuggucaggacauccaaccuucccgugauuuaagcagauuugucagauggcccaaauauauucguauccaaaggcagaaaucuguuuuacagaagaggcugaaaauuccuccuucaauucaucaauuuucucaaucuuuagacaagcaaacagcuacucaacuguuuaaaauucuggaaaaacacagacccgaaacugcacuugcuaagaagcagagguugaaggcuagggcagaaggaaaaauaaaacaaaaggaagaaguuccuacaaaaagaccuaauguuaucaggucugguguuaauacuguuacuagacuuguugaacagaaaaaagcucuccucguugugauugcccaugauguugacccaauugagcuggugcuuuuccuaccugcacuuugcagaaagaugaacguuccauauuguauuauuaaaggaaaggcucgucuuggcagguuagucaggagaaaaaccugcacuucaauugcaguaacccagauggaggguaaugaucguacugcuuuaaauaaggucauugaagccgucaagaccaauuacaaugacagauaugaagaaaucaagaggcacuggggaggugguuugcuuggcuccaagucagcagccaggauagcuaaacuugaaaaggcuaaggcuagagaguuggcucagaaacaaggauaa

SEQ ID NO: 6911 - RNA, 1005 nt, Nezara viridula
auggcuaacauguuaaaagauguuacaauugaugauaagaugccaaaugaacuuuuauuggauaaacacauaaaauucguuuuggcuuauggagcaaauaaggaugaauucgaauuuugcacuacugaacacuuaagaaugucugguauguacuggauucuaacaacuuuagcaguuacuaaaaagcuggaugaaguugacaagaaagaauuuauugacuucauacuugaauguacugaugagaaaacagguggcauuggugcuuguguuggucaugauccucauauucuauauacuuuaagugcuguucaaauagcuuguaucuuaaggucauuagaccuacuuccuuuagaaaagauuguaaguuuuguggccaguuugcaaaaagaagaugguaguuuuaugggugacaaauggggugaagucgauacgagauuuucauucugugcuauugcuugucugucucuuauuggccgcuuagaugccauaaaucuugaaaaagcaguagauuuugugcuuagcugucaaaacuuugaugguggcuuugguucccaacaaaauucagaaagucaugcuggauuaaucuacuguuguguugguguuuugucaaucacacagaauuuguaucgaauagaugccgaucaacuagguuggugguuaugugagcgccaacugccuucagguggauugaauggaagaccagaaaagcuaccagauguuuguuauucuugguggguguuaucaucuuuaacuauguuaggaagacuacauuggauugauaaacagcuuuugaagaaauauauucuugcuagucaagauucugauggagguuuuagugaucgaccaggagauaugccagaucccuuccauacuuuauuugggaucgcugcucuuucacuuuuaggagaaucagaucuauugaaaauuaauccuaccuauuguaugccacaauacauuauugaugaacuuaauuuggauccagaaauaaugcagucacaaccuuaa

SEQ ID NO: 6912 - RNA, 2688 nt, Nezara viridula
augauguugaaaaugaauagcgaagcuacagcacagcuuauacaaauuuuagagaagacuguuucuccagacaaaaaugaacuugaggcugcucaaaauuaucuggaacaugcugcacaaaccaauuuggcugaguuccugcaaacuuugucacacauucuucagcauggagguaacuccccaguugcacguauggcagcuaguuuacagcucaaaaauaaccucacuuccaaagaucaaaacaucaaagcacaguaucaagccagguggcucgccuuucccgaggaaacuagaauguauauuaagaaaaauaucuuaggagcuuugggaacagaaaacacaaggccuagcucggcugcucaaugcgucgccuauguugcgguagcugagaucccuguuggucaguggccugauuuaauuccaacauugucugcuaauguaacuggacccacuucgacugaaaucaugaaagaggcuacucuugaagcaauugguuauauuugccaagaaauagaacaugauuguuuagcuagucaaucuaaucaaauuuuaacagcaauaguccauggaaugcggucuggugagagaaguaauuacgucagacuggcagcaacaaccgcgcuucuuaauucacuugaauucacuagggcuaauuuccagcaagauauggagcguaacuacuugauggaaguaguuugugaagcuacacagucaacugauacacaaguccguguugcagcucuacaaugucuuguuaaaauaaugacucuauacuaccaauacauggagaccuauaugggucaggccuuguuuccaauuacauuagaagcaaugaaaucugacauaaaagaaguggcucuucaaggaauugaauuuuggucuaaugucucugaugaagaagucgacuuagcgauagaagaaucagaagcuguagaaauggggaaaccuccagcuaggacaucucgguauuaugcuaaaggagcucuucaguaucugguuccuguaguucuuaccaaacuuacuaaacaggaggaguuugacgaugaagaugauuggaacccaagcaaagcugcuggaguuugcuuaauguuacuagcgacaugcugugaagaagacauugugccacauguauugccauuuguucaacagaauauaaaaucaccagacuggagguacagagaugcugcugugauggcguucgguuccauucugaguggacuucacuccaguacccugaaacccaugguagaacaagcaaugccuacucuuauugaauugauguaugacaguucaguugcggugagagacacagcugcaugggcauuuggucguauuugugaaauaguaccugaagcagcuacaaacgaaacuuauauuaaaccccuucuugaaucucugcuuaacggccugaaggcagagccgaggguagcagcgaacgucuguugggccuuuacugguuuggcugaagccaguuaugaucaggcugaaaaccaggucgaagaugguucccagccugagacauacauccucuccagauauuuugaguacaucgugcacagccuucuagcuaccaccgauaggguagacggggcacaggccaauuuacgcccugcugcguacgaagcacugauggagauggugaagaacucgcccaaagauugcuauaccgucguccagagagccacucucauuauauuggaucgucugaaucagguccuggcuauggaacaacaaauacaaagccacucggacagggcacaguucaaugaccuccagucgcuccucugugccacgcuacagaguguccuacggaaaaugaccccagaagaugcaccucaaauaucugauacaaucaugaaugcacuucuacaaauguucaauuccaauucaugcaagucagguucaguccaagaagaugcaauaauggcaguuucaacacuaguugaaguucuuggugauggcuuuauuaaauauaugccugcauuccaaccuuuucucugcaugggucucaaaaaucaugcugaauaucagguuuguugugcugccguuggucucacuggagauauuugucgggccuugaaaaacaaaguucuuccauauugugaugauaucaugaggcuucuucuugaaaaucucagugauaacaguguucaccguucuguaaaaccacaaauucuaucaacuuuuggagaugucgcauuaagcauuggcucugauuucaaaaaguacuuggauguaguacuccacacacuuaugcaggcugcucaagcgcaaguugauacgagugacuucgacaugguugauugguugaaugaauuaagggaaggaaucguggaagccuacucugguaucauucaaggauugaaaggagaagauaacaacacggccgucaguguugcuaaucuugcacugcuggagccccauaucccagugauggcccaguucuuaaccuguauuucuagagauaccuccaagcaggauaaaguuuuggccggcucagcuggucuaguuggagaucuuuguuccgcuuucgguccuaaggucauaccccuguuggauauugauccaaucaaugagcugcugacacagggaaggaggucgaggauuaacaaaacgaaagcuguuucaaacugggcauccaaagaaaugaggagauacaaagcuacuauagcuaacgcagccuccuga

SEQ ID NO: 6913 - RNA, 1506 nt, Nezara viridula
auggagacuauauuggagcaacagagaagauaucaugaggaacgggaaagguugauggaugcaauggugaaagaaauguugcauaaaaaaucaaguuaucgagaacaaauaaauucagaucacaggcucaagaugcuucuugaucaguauauggagaguacucauaaguuaaaggaacuguaugaagacaaggaugguauaaggaaagaugaaguugcugcacuuucagguccuaaugaauuuuccgaguuuuauucgagguugaaaacuauuaaggaauucuaucgcagaauuccuaaugaaauuucaguucccaugucuguugaauuugaggaacuggcaaaacuaagagaaaaucccacugaagaaacaucaaauuuaguugaauuuacagaugaagaaggauacggaaaauaucucgaccuucaugaauguuaugaaaaauauauuaauuuaaaaggaguagagaaaguggauuauauaacauaccuuacuacauuugaucgacuuuaugaaaucccuaaagauaggaagaguucugaguacaaacgauauguuauuaugcuccugaauuaucucugugauuacauugcuagaauaaaaccucugcuugaccucgaccaggaauuaacuaauguucaaaaggacuucacgucacagugggaagcaggaacauucccugguuggccgaaagaaacuggcaguguguuaagcaauguuggugcccaucuugacuuaucugcuuuuucauccccugaagaguuggcuucucucggucuggacagacuuaaaucagcauuaauggcuuuaggauuaaaauguggagggacauuagaagaaagggcccagcguuuauucagcacuaaagggaaaaaaucccuugauccaaauuuacuugccaagucaaagccagguaaaucaaaccgagaacgugaucuugaaagacagcgggacauagcauucuuggaagcacaagcuuauaaguuagcugaauuacuaagugaacaacgagcugcuacuaaagaaaauguucaaaggaaacaagcuagaacaggagaagaaagaggagauucggaaggugaagcaucaucgucaggaagugaaagugagggagaagaugauggaguuccguauaauccaaaaaauuuaccucuugguugggauggaaagcccauuccguauuggcuuuacaaguugcaugggcucaacaucaguuauaauugcgaaauaugugguaauuuuaucuauaaaggaccaaaggcuuuucaaagacauuuugcugaguggaggcaugcucacgguaugcguugccuuggaauuccaaauacagcacauuucgcuaacguuacccaaauagaagaugcuuuggcuuugugggagaagcuaaaaacaaugaaacacgaugaacguuggcaaccugaacacgaagaagaauaugaagauucccucggaaacguagugaauaggaaaacauaccaagauuuaaaaagacaaggacuuuuauaa

SEQ ID NO: 6914 - RNA, 636 nt, Nezara viridula
augacggucgguaagaacaauaaaaugcuucaacauaucaacuacaggguucggauaauuuuacaagauucgagaacauuuauuggcacauuuaaagcauuugauaaacacaugaaucucauucuuggagauugugaggaguucagaaaaauuaaaccaaaaaauaccaaacagccagagcgggaagaaaagagaguguuaggauuuguauuguuaagaggcgaaaauauaguuucccuuacagucgaagguccuccaccuccagaagaaggguugccuagggugccccuuccuggagcaggugguggaauugguucagcaagaccugcgggacguggaguuccagcuccugguacaccagcugcaccuggucuccaagguccaguucgugguguagguggcccaucugcacaaguuaugacuccagcggggcguggaggacaaguuucugcuccuccucagaugcgugcuccacccccaggaaugcccccaaugaugggagcuccaccaaugaugaacauggcaccaggaauggcgaugggaagaggugggccaccuccucaaaugggugcuccuccagcuccaccuaugcgaggucccccaccaggaaugaugagaggucccccuccuuuuuaa

SEQ ID NO: 6915 - RNA, 1437 nt, Nezara viridula
auggcagauguagaacugguugaugcaguaggugcaauuguuuuagaaauucaaaggcgcacuauuaaaaaaaaacgaagaauauggaccaaaaauugguuucucaaaaggaaucaacuaagacaaucucagguccuaguaaaggaacuucuaucagaagauccacuuaguuucuuaaacaugcuaggaaugaauaugguaauguuugacuccuuacuagagaagauuggucauaauauacaaaaaugugacacuguaaugcgagaagcccuaccagcuaaaguuaaacuagaaacagcaugccguuaccuugcuacgggugaaucaauggccucuaugcaauaccuguacagugugccuaagugcacaauaaguaaauuuuuaccagauguuuuugaugccauauaugaaggacugaaggaauucauacagaucccagcaacugaaagugauuggaaagaaauucaaaaagguuucagugacuuaaggaacuucacggauuguguugguugcauagguggaaagcaugucauggucaaaugucccaccaauuuaggaucacaguauuucaauaacaaaggaacuuuauguauagugcuuuuggcaaugguggacuacaacuacaacuucacauuuauugacauuggaaauuaugguaguauugaagacuauggaauauuugcaaaaucaucccuuaugaaagugauugagcaaaaucagaucaauaugccugaaggagcagucauacugggugauucaacuuuuccuucaaagucuuauucaauaaagcaguauccuacagaaaaaaauuugaauguugcucaagaaauagauaaugacagacacuaucaugcaaagcgcuucguugagaauucauuugauaucuucacaucucguuuccggguauuaaggaaaccaauucacuuacuuccugaaacagugguaaaaaugacaaaagcugcaugugcuuugcauaauuggauuagaaaaucuacaaaucugauuaugacagcaaauaaugaagauaauggcugcucugguagaauaauucgagagucuuggcagaaagaugacuacagaguagaugauguagcuaaugucaugccauuacuucaacauaauuaugugccagacacgagagaaaaaagaggugaauuucuaaaauacuccaccaagaaaguagcuguuaguugucagaugacagaggagaaugacugucuccuuaaagaaacagaacaaaaagaagaaauaaacacuucagagcaagccugcgcaaagaaauuaacuucacacccacuucccgucuugcauucccaacaccaauccucaccgucucagccaacagccuuucagccucccaggcggaucaauuuuacaaaucaacagaggagaagaaggaagggaggucuucagagucaaagaaaaaagaacaaauuu

SEQ ID NO: 6916 - RNA, 2058 nt, Euschistus heros
augagcagcaaacacaaacacaagagauaugaagaagaggaagagaggagaaagaaacacaaaucucgauacucugaugacucagaagaugguaggaagaguucuucaucaaggcaucggucuaagaaaaaaaagcaugaccauagucauaagcauaaaaaagaaaacaaaaagaaaucaaagaggucugaaagcucugauucaagcaccaguuccgauucuucuucugacaauucggugaaacuucuaaaaagguuacaugauaagcaugaaaaaaugauucagcaaaagaagaaggaaaaagaauugaugaaggcaaaugagacaccagaagaaaaaagaauaagacgucuuuuaaaaaaagaagcgaaagaaaggaagagaaaacaacguaugggaugggacaaagauuaucugcauuauacaaauacugacaauccauuuggugaugccaauuugcuuucuaccuuuguuuggucuaagaagcuagcaaaagauggacuuacggauguaucucgugaagaguuagaaaggauuaauagaauuaagcaagaggaaaacaagauugaacuagagaagguuaaaaaaagacggcaagagagggagcaagaaaggcaagaacgagaagaagcaaugaugagauugcaacgugagaaggaggcugaacaguuugaagcaugggccacgcaggaagaucaguuucaucuugaacaagcgagguugaggucaaggaucaggauagcagaugcaagagcuaaaccaauugaucuucuugcuaaauacaucaauucagaagaagaaguagacgcuguugagaugcaugaaccauauacuuaccugaaugguuuguccauaaaggaccuugaagacuugguggaggauauuaaggucuacaugaaacuugagaaaggaaagaauuuggauuacuggaaugauauuacuguuaucguugaagaugaacuguauaagcuuagaaaacuggggaaaaaaucagacuaugaagcagccguugguaggagagaagguauccacgaaucaguagcuaaagaaguuucuucagucuuuagaggaaaaaccgccucacaacuugcagccaugcaaaaacagauugaaaaaaaaaucagcgauaaaggagaaggcauugauaucggguacugggagucacuucuuucccagcugaaagcccauauggcacgggcucggcuuagagacaaacaucaagaaaaucuaaaacagaaauuagaacuacuuaaagcggagcagaggcaucaagaacaagaaaucaaagaagaaccuauagaugaaucagaagaacagcaagaggcuguaguuagugaugaaaucaaacaggagaaagaugauagugaagaagaagaaggaaguggaggugaagaagaugcuggggagucuaugcugaaagaaagcuuuggagaguaugaagcuggagcguacucaccugucuacguugaucccgcuagccuugaaccaggaacucuuauaaucggugaagaggaggaugcucagagacuagaguacgccaggcaacaccuuaccucucaugagagucaggcuggaucuacuucagaagaauuggcgaugcaaagggaagcacguaaaggaaugucaagcgaugaggccauauuuucuguugaaucugcucuugauucucaaguuuaccuauggucagauaaauaccgcccuagaaaaccuagauauuuuaauaggguacauacuggauuugaauggaacaaguacaaccaaacucauuacgauauggauaauccuccuccgaaaauuguacaaggauacaaauucaacauauuuuucccagaucucaucgauaagucaacaacgccagaauauuaucucacaaccuguccugauaauccagacuuugcuguucuucgguuucaugcuggaccaccuuaugaagauauugcauuuaagauuguuaauagggaaugggaguauucuuacaaaagaggauucagaugucaauuccacaacaauauauuucaguugugguuccauuuuaagagauauagauauagaagauaa

SEQ ID NO: 6917 - RNA, 1206 nt, Euschistus heros
augggagacgcuaauauaauugacaaaucgaugcgaucuguguucguggguaauauucccuaugaagcuacagaggaaaaauugaaagauauauucaaugaaguugguccuguucucucauuuaaauuaguuuaugaucgcgaaacuggaaagccuaaagguuauggauuuugugaauauaaggaucaagaaacagcucuuagugcuaugagaaauuuaaaugguuaugaaauugguggacgaucuuugaggguugauaaugcauguacugaaaaaucaagauuagaaaugcaaagucuuuuagcuggaccaccgauugauaauacauauggggaaucaguagagucugauaaggcuccugaagcuauaagcaaagccguugccucuuuaccaccagaacaaauguuugagcuaaugaagcagaugaagcuuuguauacaaaauaauccaacugaaggcaaagcaaugcuauuacagaauccucaauuagcuuaugcucuuuugcaagcccagguugucaugaggaucguagauccucagauugcuauuacaauguugcacaaggccaacccgagugugccuccucuucaaccaccuccugucgagacaauacgcccagugccugugccucagccugcuccagcaguugcuccuccucccguggugccaccaguugugcaggcgaggccaguugaaccagaguggguaccuccagcuaggccgcaucagccuccucauccaccgacauuuauaccccagccagguggugaucuggauaugagaacauuagacccgaggguaccgccugucagguugaaccaagaccaggauuugaggauaccuccgauggugccagcaccucagcaaccaccggcucagccuccucagccguacccucaggaacaugugauaucaaguaccguaagagauccaagacaguaucgugauccucguacaggugcagcaacagucccggugcccccacggccaguugucgcacaggcagugguuccaccgagaccaguggccccuccggccagucacauuacuucagcacuuccuccugcugcuucagaucaggagaaggcugcuuugauaaugcaagugcugcaacuguccgaggaacagauagcaaugcugccaccggagcaacgccagagcauucucguucucaaggaacaaauagccaagagcacucaacguuaa

SEQ ID NO: 6918 - RNA, 1188 nt, Euschistus heros
augacggcuucucaaggaauggaaccaaacagagaaaaagcauugcaagauuaccguaaaaaauuauuagagcauaaggaaguagagguucggcuuaaagaaaugagagaucaauuaaaagauuugacaaagcaauaugauaaaucugaaaaugacuugaaagcucuucaaaguguuggucagauuguuggagaaguauuaaagcagcuuacugaagaaaaguuuauugucaaggcaacaaaugguccgagauauguuguugguuguagaagacaacuggauaaaucuaaacuuaaaucugguacaaggguagcauuggacaugacuacauuaacaauuaugaggcauuugccuagggaaguagauccauuaguauauaacaugucccaugaagauccaggagaugucacguauucugcuauuggaggucuugcagaacaaauuagagaacuucgagaggugauugaacugccacuuuugaauccugaacuguuucaacguguuggcauuacuccuccgaaaggaugccugcuuuauggaccuccugguacuggaaaaacuuuacuggcuagagcuguagccagccaauuagaugcgaauuuccuuaagguagucuccagugcuauuguugauaaguauauuggugaaagugcucgucucaucagagaaauguuuaacuaugcaagagaucaucaaccuugcauaauuuuuauggaugaaauugaugccauuggaggccgaagauucucugaaggaacaucugcugaucgugaaauacaaagaacucuuauggagcuuuugaaccaaauggauggauuugauucauugggucaggugaaaaugaucauggccacuaacaggccugauacccuagauccugcucuucuccguccuggcaggcuagauagaaagauugaaaucccucugccaaaugaacaggcaagacuagaaauccuuaagauacaugcugguccuauuucuaagcauggagauauagauuaugaggcuguugugaaauuaucugauaauuucaauggggcugauuugagaaauguuugcacugaagcuggccuuuuugccauucgagcugaacgagaauauguaaugcaagaagauuuuaugaaagcuguaagaaaaguagcugacaacaagaagcuggagucaaaacuggauuauaaaccaguuuaa

SEQ ID NO: 6919 - RNA, 777 nt, Euschistus heros
auggccagacgauaugauucaagaacuacaauuuuuucuccagaaggucguuuauaccagguugaauaugcuauggaagcuauuagucaugcuggaaccugucuugguauucuagcgaaugauggcauuauucuuguugcugaaaaaaggaauacuaacaagcuucuugaugaaucaguauacucugaaaaaauuuucaaauugaaugagaacaugauaugcaguuuagcugguauuacagcugaugcaaauguucuaacuaaugaacuaaggcucauuucucaaagauauuuguuacaauauggagaaacuauuccuugugaacaacuuguuucuuggcugugugacauuaaacaagcauauacucaguauggagguaaaaggccauuuggaguaucuauauuauauauggguugggauaagcacuauggauaucaacuuuaccagucugacccuaguggaaauuacucaggcuggaaggcaacuuguauagggcauaacaguggugcagcuguuuccaguuugaagacugauuacaaagaaggagaaaugacagugaaagaugcuuuggccuugggaauuaaaguccuaaguaaaacauuggauaccgccaagcuuucaguugauagaguugaaguugcaacauuaucccagcagaauggaaaguguguuacuugcauucuaccaccugaucaaguucaagaacuuauuaaugcuuaugagaaaucagaagcugaagcuaaugcuuuaaaaaaagaaaaaacuccaaaaucuuaa

SEQ ID NO: 6920 - RNA, 2643 nt, Euschistus heros
augacuaaaguucaagauccacaaccagaagaaaugucugaagaagacaaacgacuucaagaagaacugaauaugcuuguggagaaaaucacuggaccagacacccaccuguacguaccugcauuagaaagcaugcgagaucuuauaagaaguucuacaacaaguaugacuucagugccaaugccucugaaguuccucagaucucauuauggcgcucucaaagaagccugugcuguuauggcagauaggaaggcucaggagcuuugugcaagcauagucucuguucuagcaauggggcaggauuuaccaggggcacgagaaugucuuaaguauuguuuacaaucacaucagaaagauguuggugacuggggccaugaauauguaagacaauuagaaggagaaaucgcugaugaaugggcaucuacagaagaaaaagauaagcuacugggauugguugagaguauaaucaaauuugauauggagcauaaugcagagauucaagccugugaucucuuaauggagauugacagacuugauaugcuggacaagcacauggauuuaacuaauuauucaagaguuugucuguaccuaauuaauugugcuguguauguggaagaaccagaaagaggaaacauuguaaguggaguuaugaaacauuauaugcgauuuaaggaauacccgcgagcacucugucuugcgaugcaauugaauaagcaagauauaauguuagacauuuuuaaccaaugccaagauccguugguuagaaaacaguuagccuuuauggucggaaggcaacaauugagccuugaauugagugaugauuuggcagauaaaucagaucuaacuaacaucauguccaaugcccaugugaaugaucauuuucauaguuuagggagagaauuggauaucauggagccuaaaacuccugaagaaguuuacaaaguuugguuggaaggguuaguccugcguccaacuuacaaucuggaaguaccucuugauucagcuaggcauaaucuugcuucaacauuuguaaaugcuuuuguaaaugcugguuuuucaagagacaaguuaguaucgguugaagauggcaacaaauggauguacaagaauaaacaacaugguauguuaagugcugcagcaucucucggucugauucacuugugggauguugauggagggcuaaccccaaucgauaaauaccuuuacacuucggaagauuauauuaagaguggugcauuacuugcuuugggcauugugaacuguggugucaggaaugauugugauccugcuuuggcucuucuuucugauuauguucuucaugagagugucacccugagaauuggugcuguuuuagguuugggccuagcuuacgucggaacaaaaaggcaagaugccauuacccuuuuacugccagugcucucagauucaagaucaacaccugaaguuguugcgauggcagcauuggcuugugcccucauuacacuugguacaccacauccugauguaguaucaaccaucuugcaaacucuccuugaucuuccuguugcugaaaugacugacggccauuacuccaaauuuuugccccuugcacuuggucuauguuaccuuggucagcgagaaggcacugaagcuacaaaagcugcucuugaagcacucccagaacccuugcggucauuaucgcaacauauguugaagaugugcgucuaugcggggacuggagauguacuugucauccaggaacagcuucaagucugcucagaacauuaucccacuccagaagaaaagaaagaaagcgauaagaaggacaaggauaaagacaaagacaaagaugaaucuaagaguaguaaagugaaggacaugacaugcaugcaggcaguugcugccuuaucuguggcaguaauugcgaugggugaggagacaggaucugaaauggccacuaggauauucgcucaguugggaagguauggugaaccugcuguacggagagcuguacccuuggccauagcuuuaucaucgauaucaaauccucaguuagcugugaucgauguucuuaauaaguauucacaugaccuugaugaagaaguugcacacaaugcuauuuucucaaugggucucguuggcgcaggcacuaacaaugccagguuggcuaccaugcugcgucaguuagcacaauaccaugccaagaacacuggucaccuguucauggugcgcauugcucaaggauugacucaccuuggcaaagguacucucucccuuugcccguuccacaccgacaggcaggucaugaacuacucagcagucgccggccuacuuaucacccuuguuucauuccuugacacuaagacgauaaugcuuggaaaaucccacuauuugcucuauacacuugcgacugccauguauccuaggugguugguaacucuugaugaacaucuagagccucuccccguaucagucagaguuggacaggcggugaauguaauuggaaaagcuggaacuccgaagacuauagcugggguucauacucacacuacaccugugcugcuagccguuggugagcgugcugaacuggccacugaggauuacacuccacucacaccuguuauggaaggauuugucauucucagaaagaaacaaccagcauga

SEQ ID NO: 6921 - RNA, 1257 nt, Euschistus heros
auggagccucccgcggcagagcagagccagcagcagcaagagcaggagucgggugucaucaggcagcggaccauaaccacuucugggaccaucaccaccaguccgcagcacgaggccaccccgucccccgagcagccgguacaagagcagagcggaaaggaaguugaaguaccauaugaaauagugcagcugcgacccggaagcuacgacgaaggguacagccuggaggauacaacgagguauagcccaggauccggccgguacuacaccacugaugguaccgucaaguacgaccgggacgacaaaggcgaagguagcuacguuacucuagaaccugucaacuaucccccgggcagugcguaccaggaaccugcaacgggauacuacaccuacaaggaagaggaggacgucuacaucaaggcugagacuccccuaacccccaagaacuucgcccacuucgaucacccggucaccucucauccaacacaacucagugcacagguuacuuaugugacuggaggagguagcagggaguacgugacaacuaaccagccuggcuacugguccagcgaauacguguaccagcagccucagcaggaaauccagcugccuccuggaacaccuuacgucuucuccagcaaugggcaggcuaccugggcuauugaugaguccuacgaucccaguaugcugucggcuagcgacaucaaggagugcgucaacugugcggcaagcgugaccccgcuguggcggcgggacgguaccggacaccaccucugcaacgccugcggccucuacagcaggaucaacggaguacacaggccaccgauugguaacaggagaaauggcguaaguugcgccaacugccagacaaauaacacaacccuguggcgcagaaacaacacaggagagccagucuguaaugccugugggcuguauuuuaaacugcaugguguaaacaggccacauacaaugaagaaggaaggcauccaaacuaggaaacggaaaccuaagaacccucaaguuaauauaccaaguccaaaaaacgacauuaaagcaccaggugaaaaaucaggcaguugggauaaaugugauaaugaccuacucgacaguggcuauacaauggcuacaucauccaucuuucuucccagcucguuuuuaacuaagccuguuggagucaguguaucuggaauggaaagugugccaccuagcguuaucaucccacccacaucaagccaagaaacacagagaacugaauaa

SEQ ID NO: 6922 - RNA, 5505 nt, Euschistus heros
augucguuggcaggagggaaaauggcuuguccugggaauggaauuuauguuauccagggggaaaugucuguucugcuuacugcuaugaagaaaguaaacagauggucuucucauguccaccaggaugaugaaaaugacauucuuauuagaagcuucacagaucucaaagauguguuaaaucagauuggugaccucagggaaguagagccaaaccauuuucuuaguccauuucuggaagugauaagaucagaagaaacuacuggaccuguuaccagucucgcuuuaucuucugucaauaaguuucuuucguauggacugauagauucuaagucuaagacgauugcggcuacuguugaaaauauugcugaagcagucacaagggccagauuuguugggacugaccaaacuaaugauucaauuguuuugcuaaagauuuugcagguucugcgaacuuuguuacuuucuccugaaggcugcuggcuuacaaaugaaaguguuuuagaaauucuauugaguuguuuucggauguguuuugagccccguuuaaaugaauuguuaaggagaugcgcugagaauuguuuacgugauaugguucaauugcuguuuaguaggcucccuaguuuuacugaggauaacaggaaaacauacacaauccagcaaaaacugaaaaugaacacuagugccccuuuggaugcagggaaggggaagaaaaagaccagccgaccaucuucuaggaaaguauccaggaaaagucaagaaaaaucucccaguccuguuuuaggaucagaaguuucagcugcucuuaaagaaagugaaagccagcaauugucuuuaccugaugagccagaaacuacaucgcaugguaaaucagaaucugaacgucuucuugugccuagugaagagucauuagcuaaaaucccuucuacugauuccuuggaaacuaauguuguuaaugguguuccaaaugugauugcugcagaggaaaaccaaaacauaacuccuccugugauacuugacgaugguguuauuaucaguauugaagauucaaguucucaaaauagugaaucaacagaucagcuggcaaccauugguauugugccagaagcuaaaaggccagaagacuuagaucugaauccuacugaaacuaauauuucuuccccuucagauuugaaaucagaagaagagccuuugcuaaguccuaccacgccagaaaauaauauggaagggcaagauuggaccaaucagcaagggguuagguuuacuaauacugaaaaugauaccuuaacuccuucugggccauauggacuguuaagcguucaugaacuuuugagguuuuuggcuucacuuugcaauccacuugacaagcagaacucugacagcaugauacauaucggacucacccuaauuacaguugcucuugaaguuggggcggauagcauugcaaaguuuccuucgcuucugucaacuguuaaaaacgaugucuguagaagccuuuuagcuuuguuaaauaccgaaaaacuaccuauauuugcaucugugcuacaaguuucauuccuucuguuugaaucucuucgaacacaucuuaaauuucaacuggagcguuauuugucgaggcuuacugaaauaauuguuucugauucuucaaagauuucauaugaacaccgagagauagcauuagaauccguuguacaucuuuggcgaauaccuggcuuggugacagagcucuaucuuaauuacgauugcucucuuuacugccccaauuuguaugaagaacuaaccaaccuguugucuaagaaugcuuucccuguaacuggugucuauaacacacauuuacuaucuuuggaugcuuuauugacaguuauagacucuauagaaagucauuguaauagccgaauauuaaaugaaaggcaaaauccaucaaaagauggagaaauuaauaaauuagaauuucacgauuuugccagcaauuauauaaaucggacugggacccgucaaaaguugucacugaacauuccaagucaugagcaauuaauggcugugaaaagaaaaaaaaaacuucuggcuacuggaacugaacauuucaauucaaaaccaaaaaaaggaauccaguuuuuacaggaacauaaccuucuuucgacuccuuuagaugcaguugaagucguugccuuuuugagagaaaacccccaccucgauaaaaaaaugauuggagaauauauuaguaauagagccaacaucgcuauacuugaucaauuuguaaaaucauucgacuuuacugagcugcgcaucgaugaagcauuaagguuguauuuagaaacuuucaggcuaccuggagagucuccucucauaucuuuagugauggaacauuuugcugaacacuggcauaaauguaauggagagccuuuugcuaaugcugaugcagcauuuacccuugcauacgcaaucauaauguuaaauguggaccagcauaaccauaauguuaaaagacaaaauacuccuaugacaacagaagccuuuaaacgcaacuugaaaaauguaaacggagggcaagauuuugaagaagaaaugcuugaugauauuuauacugcgauuaagacugaggaaauaguaaugccugccgagcagacuggucuagucagggaaaacuaugaauggaaaguucuguuaagaagaggagcuggauccgaagguuacuacguacaugcaccaaaugguuuguuggaucaugauuuguuuucacuuauuuggagcccgaccauuucagccuugucguauuuauuugauaagaccaaugauccaacuaucuaucagaaagcuauaucuggguucaggaaaugugcuaugauaucggcucauuacggaaugaguaacgauuucgauaaucucauugugucucucugcaaauauaccaugcuucacuacacuucugagagcccagaaaaucuuacuauuucuuuuggaucgagccccaaggccagacgugcugccaaaacugucuuugaucuugcucaccgccauggugauauuaucagggaaaguuggagaaacauuuuggacuguauuuugcaacuguauagauguaaacuguuaccuaaaauccuuguugaggcugaagauuuuauugaauuaagugggaaaauaucucuuauucgugaagacauacaacucaguccaaaaacugaaacuggaauucuuagcucguuguauucuuauauugcauuaggaacagaaacaaauacacaaaaagguccaucaguugaagaccaagaggcuauuaaacucgcacaaaauuguauaagagagugucaccucgagcagcuuauuacagaaucuaaguuucugcguauugauucuuuacaacauuuugugaaggcacuugucacugcgucuuauggcccugaaggacauguuucacucggcacaucuuauagugaagacacugcuguauuuuucuuggaaguccuuuugaaagucguuauucagaauagagaucguauuucuucaauuugguguucuguaaaagagcauauuuauacccuacuuaugggugcugcggcuugugaucaccacuucuuaguugagaggucuguuguuggacuucucaggcuggcuauccguuugaugcacaaagaagaaaugggaccgaugguacugcaaucucuucguaugcugcuccuccuaaaaaguucaacucuaucacguguaucucgccagauuucauaugguacauuugagcuucugaagacgucagcugcaaauauacauucggcuacugacugggcaauaauauucacucuucuagaaugugucggagcuggugcuccuccucccaaaguuguuucaaaaccugucagcucuacagaaucaggugcccgcucggaaggugaagcccagguggauagcggacuagguaacgagaggggcuacacuucagauucugagcuaagcaaagcuggcagugucccuuugucgcccagucuuagucccgaggcuccucuuagcaacacuccuacuggcuggauucucguggggcgagaaggugaaauucaaccuguaaguugugugaggagggcaauguugccagagcugucucgcuaugauccuuugucgauggugaaguguguugacaguuuaucauuucuuguuagggacguuguucauaucacgccauauaauuuucaugauuguauccgcugcauaagaacauuuguugaagcagcugcuaauacagaaaggaaaagcaggaaagcugggagggauacugcucgacaagcuaagaggaaaaaugcuaaaaggagagaagaaagaggaccaaguccgacaggaagugcuuaugacgcagaugagagugauccugaggauucaccugguuaucaacaaguuugcauucagcuuuuggaguugaugcacacucuucacacgagaacagcucagaucuuccguuggugggccgaagagacaggacagaaagaagucggcagccccucuuauuggacuccugguuggugcccucuccuccaaggcauauccaggcucuguucccauccuaauagagcuguucggaugucagcaauaacuuaucuucaaagagcacuccucaugcaagacuugcaaucucugccuggggaggaaugggaggaauguuuuacucaaguuuuguuuccacuuuugucuacauuauuagcuguuaauauuccagcaauugaagaaacaagaauaagggcagccacggugcuuucuaagguauuccugcaucacuuggcuccucugcaaacucuucauaguuuugcgcaacuguggcugaccauccuagauuauauggauaaguacaugcaugcagacaauagugaccuacuuuaugaggcuauuccugaaucauuaaagaaucucuugcuugugauggacucagcuggcguuuuuaauggauuagauggacgcaaugagauuugggucgucacgugggaucgaauaaguucauuucucccuaaucuucaaucagauuuauuuaaagaucaucuaccagugguagaugccaauuuacuugaaaccaaagaagcuuuggaaaccucuaagagugaaacugaaguaguucaaaccgagcaaccuacacugcaaagacccccuucaagcacucaaguugugcagucuccuccucagccuacuucgaugccuaaaccuggugaagccguugaaauaucuggaccaacgaguaacaauaaugucgguucacagaacuggcagccuccugcuccuguuuauccucaccuagagcagauggucucgacaccuauugguccaucaguuccagucuauucuggauuugcgaguaugccacagcagccuccucccccaucggcccaauuuuucuaucaggauaugucuucuucagucccaacuaauauggcccacaauucugagcaaccugcaguuggaagcucuuuauuauuggccucugcuggauuggaacacccaaagcuuccaguuauaucuccuccgacuucuucauga

SEQ ID NO: 6923 - RNA, 618 nt, Euschistus heros
augucaaucuuaucuuauaaugggagugcaguaauagcuaugaaggggaaggauuguguugcuauugcuucugacuugagguuugguauucaaggacagacugugucaaccaauuuugaaaaaauuuuugaaauggguccucaucuauuuauuggacuuccugguuuaacuacugauacuuuuacuguucuaaauaagcuucaauuuaggaaaaauauguuugaguuaaaagaagauaggaaaauagcaccagauguauuucuuucuauggucucaaaucuuuuguaugaaagaagguucggaccauuuuucguugaaccaauaauugcugguuugaacccaaaaacuauggaaccuuuuauagcuucgauggauuuacuuggcugcccuaacaaaccggaagauuuuguuguggcagguacagcuucugaacaacuuuauggaaugugugaagcucuuugggaaccagaucuuggcccagaugauuuauuugaaacuauaucucaagcacuuguuaaugcaugugacagagaugcucuuucagguuggggagcuucuguuuucauaauagagaaagacaaaguaacucacaggagaauuaaaacaagaauggacuaa

SEQ ID NO: 6924 - RNA, 2778 nt, Euschistus heros
auggaguccccuccgucuuuggaaacaguccaucaggcuguuuacgcacuguaucauaaucccgacccugcugaaaaagagaaggcuucauuauggcuaggccaguuacagaaaucuguuuucucauggaaaauugccgaugaaauacuucauaccaguacagauguggaaugcuguuauuuugcugcacaaacuaugagaacuaaaauccaacauucuuuccaugaacuuccugcagagucucaucuuccgcuccgagauucucugauggaucauauuagcaaaauuaaugagucaacaaauucugugauugguacucaguuguaccuugcucuagcugaucuugcauuacaaaugguaucuugggaaaaaccugcaauugauuugauugaacgauauucugcgaccucaguuccuccucuucuugaaauguugacauuuuuaccagaagaaguuaauucucgagcauugcgcuuggguucuaaccggaggcgagaacuucucaacaaauuuucucuugcuguuccaaauguuucugaauuuuugaaaaugugucuuaacaauucaggaaauaauccucaaauucaagucaaaguuuucaaauguuuuacaaguugggugucaguucaagcgaugacacuuaaugauguuaccgacaauauaguuguggcuacagcuuuucacguucuugcuaauagaauggcauccucuaauuuacacgaagcagcugcagauuguguuugcucgcuucucgaaugccucgaagauaacaauaaucaacagucgauugagaugcaacuguuuaauggcgucauuucauuagaacaaccauuucauauuucugucgcccaugaagaacaugaaaaguguguaaacuauugucgaguauucacagaacuagcugagaguuuccuggagaaaauaguuagcggcaguagucccaauaaagcacauuuugccauuaagauuuucgaucuuguucuaacuuguguuggucaucaugacuacgaaguugcggccauuacauuuaauuuaugguaucgccuuucagaagaacuauaucaaaagaagaacucagggcuaaccucauuauuuaaaccauacauugaaaggcuuaucgaggcauuauguaggcauugucagauggagccagaccaugaaggaauccuugaagaaggggaugacuuuccugacuucaggaugaaggucgcagaacugauccgugaugucgucuuuauaaucgguucuuccaacugcuuuaggcagauguucaucucccuccaggggccaaauaccaccugggacacuacagaagcugccuuauucauaaugcaagcuguugcaaaaaacauucuuccggaagaaaacgauguuguaccuaaaguuguagaagcaauuuugaaccuuccuccuaacacacacauagcugucagguguacaucuguucuccuacugggggaauuaugcgaguggaucgaaaagcauccccauuauuuagaaccaguguugaacauggugcuguucugccuccaacaaccucaguuggccaauucagcugcaaacuguuuacaaaguauuugcaguauguguaaaaaucauauggugaccaaauuuuuagggcuuuugcagauacuucaaucucuggacaaauucguucugacaaaugaaucaguugucggacuauugaaaggaguagcuugcaucuugagcauuaugcaccccgaucaguuacagcaagccaugagggauguuugucucauccagaucaagccacuuguucauuuaauugagaaugauguuaaacuggaaaaagggacaaaaacagauccagcaguguggauggacaggcuuucugcuauauuccgccauaucaaucuuaccguuaggaauggugaaauucauccuugccaaccagucauuaccgagauuuggccuguccucuccucaguauguuccaaauaccaagccaauucucacguuauggaaaggugcuguaggugucucagauucgcuguccguuguguugguaaacaguccgugaaucuucuugaaccauuagucaaacagauuguaaauuuauauucucagcaucaacacagcuguuuccuauaccucggguccauccugguugacgaauacgcuuccgaaccgggcugcauccaggggcugauagacaugcuucaagcauuuauucauccgacguucaccauccuucaaggagaagcgggucugaaguuacauccagauacuguugacgaucucuuuaggcuuugugcgagguucuugcagagggcaccgauuccguuccucaccucacccgccaucaacuccauccuggagugugcccuaucgugcaucccacucgaucacagggaugcuaauucuucaguuaugaaguuuuuuuaugaucugauucacgcuggaaggacagaugaagaucacgaagauuucucuuugaggcaaagacugguacaaaauauuauccuugaaagaggggcagacauagcgaauaaucuucucacugcguccguuuucuaucuucagaucuacaugcuuucagauguugcugaugucuugauggaguuaauauuacuugacaagcagucugcugguaauuggaucgaacaaucauugaaaagaaugccaacgcacaacaguacaggcaguguuacugcgacaccuaagcaaauggaggauuuucaccguucccugcucagugcgagcaguuccaaagcacuaacaacuacacuaaaagaauuuacucgucucuaccgcuga

SEQ ID NO: 6925 - RNA, 1497 nt, Euschistus heros
auggcgcagagguuucccccgacacagccgacuccgagcccuguccagcagccucaaagauauccuucgccuucgggaccucccuugaggcaauaugcuacuccuacguuuccuuugcaacagaggccggguggcuuugugcagggagguggaaugggaagcgggaugaugccucgcccucagcagcaaccauacaaccccaucaggccuccgauaccucagucacagaaaaggccuagcgaugucaggccaccacagcagcaaccgaaaggggaguuuccucauacauccgcugguggaaguaguggcaagaagaagaagaagcuggcggauaagauacuaccccagaaggugcgagaccugguaccagagucgcaagcuuacauggaccuucuggcauucgagaggaagcuggauucuacaauuaugagaaagagacucgauauucaggaagcguuaaaacgcccaaugaagcaaaaaagaaaauuacguauuuuuauuuccaauacuuucuauccugcgaaagaggcgacggagacugaggaaggcaguguagcauccugggagcugagagucgaaggaaggcuauuagaagauuccaaaaaugauccgaacaagccuccaccguuacaggugaaaaggaaguuuucaucuuucuucaaaagucuugucaucgaguuggacaaagaacuguacgggccagauaaucaccuuguagaauggcauagaacuccuaccacacaagaaacggaugguuuucagguaaaaagaccuggugauaaaaaugucagauguaccauccuacuucuuuuggauuaucagccccuacaguucaagcuugauacccgacuugcucgucucuuagguguucacacucagacgagaccugucauuauaagugcacuuuggcaauauauuaaaacucauaaacugcaagauccacaugaaagagaguauauaaauugugauaaauaccuugagcagacuuucagcugccccaggaugaaguuugcugaaauaccgcagcgucucaacccucuacuucauccuccagacccuauuguuaucaaccauauuauuaguguggaagguaccgaacagaaacaaaccgcuuguuaugacaucgauguagaagucgacgacacauuaaaaacacagaugaacaauuuccucuuaucaacagccagucagcaggaaauacagagucucgacaauaagauccaugaaacaguugaaacgauaaaucaguugaagaccaacagggaguucuuuuuaagcuucgccaaagacccccaacaguucauuaauaaauggauaauaucucaaacucgagacuuaaagacaaugacugauguugucggaaaucccgaagaagaaaggcgagcugaauucuauuaucagaacugggcccaagaagcagucuguagauacuuuuacacgaaggugcaacaaaagagggccgaguuagaacaggcccuaggaauuagaaauacuuaa

SEQ ID NO: 6926 - RNA, 435 nt, Euschistus heros
augccuaaaguaagaagaaguaagaagccuccaccagauggaugggaacugaucgaaccgacucuugaggaauuagaacagaaaaugagagaagcugaaaccgaaccucaugaagguaaaaggaaaguggaaucauuguggccuauuuucaaaauucaccaccagaaaucucgcuacauuuacgauuuauacuacagaagaaaagcuaucaguaaagaauuguaugagcauugccuuaaugagaauauugcugauaaaaacuugauugccaaauggaaaaaacaaggcuaugaaagucuuugcuguuuacgaugcauucagaccagagacacgaauuuuggaacgaguugcauauguagaguuccaaaggccaagcuugaagaggguaagaucguagaaugcauccacuguggcugcagaggauguucaggauaa

SEQ ID NO: 6927 - RNA, 1029 nt, Euschistus heros
augaaagugcuacuugagagugauguccaacuaaccacucauuuuugggcagcaucggacuacaaggauaaacuuagcguugcgauaggagaaccucugguucugagcucagaugccaguugggcgaaucacauucuccuaggacacccugcuaugcccacagccacaggacacaguggggucaucccaaguaaugaagaaugcggcauucgugauguaugggcucauaauuugaaggaugaauuuaaaguuaucaggaagaucauucauaaauauaauuauguugcaauggauacugaauuuccuggagugguggcaaggccuaucggugaguuccguaguacagcugacuaucaguaucagcuucugagaugcaauguggaucuucuccguaucauccaauuggggcuuacuuuccuugacgaaaauggaaaagcuccugcggguccuuacaguaccuggcaguucaauuucaaauuuaauuuggcagaggauauguaugcucaagacaguauugaucuucuucagaauucagggauucaauuuaagaaacacgaagaagauggaauugauccuguggacuuugcagaacugcucaugaccucaggaauuguacugauggaaaauaucaagugguuauccuuucauagcggcuaugauuucggauaucuauugaaacugcuuacuaaucagaacuuacccaaugaugaaagcgaauucuuugagcuucugaagaucuacuuuccuacuguuuaugauguaaaauaucucaugaaaaguuguaaaaaucugaaaggaggucugcaggagguugccgaccagcuggaacuuacgaggguaggaccacaacaucaagcuggcucagauucauuauugacgggaauggccuuuuucaaaaugagagagauguuuuucgaagacaauauagacgauggcaaauacuguggucacuuguacggauugggugccuccuuuguugugaacgguaacaguuuucacgacaacggugacaacucaaguaauucauga

SEQ ID NO: 6928 - RNA, 1206 nt, Euschistus heros
augucugagucgcgaagaguucaauugaaagaggacuugucuuuuguggaguucgaaacaagugaaaauguugaaguuauuuccucuuuucaaagcaugggacuuaaagaagacuuguugagagggauauaugcguauggauuugaaaaaccaucugcuauucagcaaagagccaucauccccaucguucgugguagagauguuaucgcacaagcucaaucugguacaggaaaaacggcaacuuuugccauugcuauuuuacaaucuuuggauacccaaacuagagauacccaaguuuuaugcuugucaccaacaagggagcuggcgguacagauacaaaagguaauucuugcguuaggugaucucaugaauguucagugccaugcuugcauuggggguacaagcuuaggagaagauauaagaaaacuugauuauggccaacauguuguaucuggcacaccuggucguguuuuugauaugauuaagcgacgaacacugaggacaagaucaaucaaaguuuuaguucuugaugaagcugaugagauguugaauaaagguuucaaagaacaaauuuaugacguuuaucguuucuuaccuccugcuacccaggugguccuaauuucagcuacacuuccucaugaaauucuugaaaugaccagcaaguuuaugacugacccuaucaggaucuuaguuaaacgugaugaauugacguuagaaggaaucaaacaauuuuuugucgcuguugaaagagaagaauggaaguuugauacacucugugaucuauaugauacauugaccauuacacaagcuguuauuuuuugcaauacaagaaggaagguugauuggcugacugaaaaaaugagggaugcaaauuucacuguuuguucuaugcauggugauaugccacaaaaggaaagagaugcuauaaugaaggaauucagaucaggaaaaagccgaguccuuauaacaacugaugugugggcuagagguauugauguacaacaggucucucuugucauuaacuaugauuuacccaacaaccgugaguuguauauucauaggauugguagaucaggaagauuuggaagaaaggguguugccauuaauuucgugaagagugaugacaucagaauuuuacgagauauugaacaguauuacaguacacaaauugaugaaaugccuaugaacguugcugaucugauuuaa

SEQ ID NO: 6929 - RNA, 1599 nt, Euschistus heros
augaagaacgcugcuggagauggacacagaucacauagcaauguauauaaggacaaaagcaaaccucaagauguucgcagcaguaauaugacugcagcuaaaggccucgccgaugcuauccguacaagucuugguccuaaaggcauggacaaaaugauucaaaaaggaaauggagaaguuaccauaacaaaugacggugcuacuauuuuacaacagaugaaugucacccauccugcugcuaaacuuuuggucgaacugucucaagcccaagauguugaagcuggugauggaacaacuacaguugucauauuggcuggugcuauaauggaagcugcugaaaaacuuaugaaccgugguauucauccuacaacgauuucugaugcuuucagcauugcuguugaaaaagccuuaccaauuuuaagagaaaugucaauuccccuacaacagaaugacaaugaaagucucauuagaagugcaucaacaucucuuaacucuaagguuguuucucagcauuccucaauuuuagcaccauuagcugugaaugcagugcuuagaauuacagacccaaagaaagauaaaaauguugaccugaaagauaucaaaaucauaaagaagcuuggaggcacuguagaagacacagaacucaucgaaggcuuaguuuuuacucagaaguuggccaauauaaauggaccaaaacgucuagaaaaagucaaaauuggucucauucaguuuuguauuuccccacccaagacagacauggaucacaaugugguuaucucugacuacgcagcaauggauaggauauugaaagaggagcgagcuuacauacugaauauugcaaaacaaaucaagaaggcugguugcacaauguuauugauacagaaaucuauuuuaagagacgccuuguccgauuuagcuauucacuucuuugacaaguuaaagauuauggucgugaaggacauugaaagagaagauauugauuucgucuguaagacucuugguugccgcccuauugcaucuuuagaucacuuuacaagugaagcacuuguaagcgcugagcuugcagaagaaguaucagcaggaucuucccguaucgucaaagucacaggaauucacaauccugcaaagacugucacaauucuaguccguggauccaauaaucuuguccuggaagaggcagaucguucaauucacgaugcccuuugugucauccgaugucuuaucagggaaagggcacuucugccuggaggaggagcuccugagaucgaguugucucuucgguuaggacagcaugcacagguuuuggcaucaguagaggcuuauuguuuaagagaguaugcaaaagcuuuagaaauuguuccuuauacccuugccgagaaugcuggucucaauccuguagcuacagugacagaacugaggaauaagcacguucacggccaaaccagugcugguaucaauguuaggaagggccaaguaacugacauucuugaagaaaaugucuuacagccgaugcuggucaccgcaagugcuaucaccuuagcaacggaaaccguuaggaguauucuaaagauagaugacauucugaaugucgcccauuaa

SEQ ID NO: 6930 - RNA, 1248 nt, Euschistus heros
auggaagaaauugguaucguucucccugagaaagaagaaaauagucaagaugggaagcuuagcaccauucuaggacaaaaucugucugaugacagcgacaguagugauuuauucaccaaguuuaagaaauugcaaagacagcucgaguuuuuggcaguucaggaagaguauaucaaagaugaacaacguaaucugaagaaggaauauuuacacgcucaggaagaaguaaaacgaauccagaguguuccuuuaguuauuggucaauuucuagaagcaguugaucaaaauacuggaaucguugguagcacuacagguucuaauuauuauguaaggauuuuaucgacgauugauagagaacuguugaagccuucagcgaguguugcucuccauaagcacagcaaugcccucgucgaugugcuuccaccugaagcagauuccucuauuucaaugcuucaagcagaugaaaaaccagaugugcaauauucagacauuggugguauggacaugcaaaagcaggaaauccgugaagccguugaauugccgcuaacacacuuugaacuauaucgucagauugguaucgaucccccaagaggggugcugauguaugggccucccggcuguggcaaaacuaugcucgcuaaagcuguugcucaucauaccacugcugcguucauucgaguggucggcucugaauucguucagaaauaccuuggagaagggcccagaaugguucgugauguuuuuagacuugcuaaagaaaaugcuccagccaucaucuuuauugaugagauugaugccaucgcaacaaaaagguuugacgcucaaacuggugcagacagagaagugcagaggauucuauuggaacugcuuaaccagauggauggcuuugaccagacaacgaacguaaagguuauaauggcuacgaacagagcagauacauuggaucccgcccugcugcgaccugguaggcuggacagaaagauugaauuuccucuuccugacaggcggcagaagaggcuugucuuuucgacaaucacugccaagaugaaccucuccgaagagguggacuuggaggacuacguggccaggccagauaggguaucuggugcugacauuaaugccauuugccaagaggcuggaaugcacgcuguuagggaaaaucguuauauuguccuugcgaaagauuuugaaaaagguuauaagaacaauauuaaaaaggaugaauccgaacaugaguucuauaaauaa

SEQ ID NO: 6931 - RNA, 519 nt, Euschistus heros
augccuaacauuaaguugcagaguucugauggagaaauauuugaaguggauguggaaauugcaaaauguucaguuacuauuaagacuauguuagaagauuuaggcauggaugaagaugaggaagaaguaguuccauugccaaauguuaauucugccauucugaagaaaguaauucaaugggccacauaccacaaggaugauccaccuccaccagaagaugaugaaaauaaggaaaagaggaccgaugauauuuccucuugggaugcugacuuucugaaagucgaucaaggaacucuuuucgaguuaauucuugcugcuaauuaucuugacauuaaaggcuuacuugauguuaccuguaaaacaguagcuaacaugauuaaaggaaaaacccccgaagaaauacguaaaaccuuuaauauuaagaaugauuucucugcugcugaagaggaacaaguacguaaagaaaaugaauggugcgaagagaaauaccuuccaacaguaacguuuuuaccucaauga

SEQ ID NO: 6932 - RNA, 930 nt, Euschistus heros
auggaagauaagacuucguuaaaagaacuggaucaguggauagaacagcugaaugaaugcaaacaacuuaccgaaagccaagucaaaacucuuugcgauaaggcaaaagaaauauuagcuaaagagucgaauguucaagaaguuaaauguccugucacaguuuguggagauguacauggacaguuccaugauuuaauggaacuguuucgaauaggaggaagaucaccagacaccaauuaucuguuuaugggugacuauguugauagaggauacuauucuguggaaacagugacuuuacuaguugcucuuaagguaagauaucgagaaagaaucaccaucuuaagagguaaccaugaaucgcgccaaaucacacaaguauaugguuuuuacgaugaauguuuacguaaauauggaaaugcgaauguauggaaauauuucacagaucuauuugacuauuugccauugacagcucucguaaauggucaaauauuuugucuucacgguggucuuucaccgucuauagacacucuugaucauauccgugcacuagaucguuuacaagaaguuccgcacgaggguccuaugugcgacuuacuuuggucggaccccgacgauaggggugguuggggcauaucuccaagaggugcugguuacaccuucggucaagauauuucagaaacauuuaaccauucaaauggccucacucucguaucuagggcccaucagcuuguuauggaaggcuauaacuggugucaugaucguaauguuguaacaauauuuucugcaccuaauuauuguuaucguugugguaaucaagcagccauaauggaguuggaugaugcgcagaaauauucauuccugcaauuugacccagcgccgaggagaggagaaccacacguuacuaggagaacuccugacuacuuccuauaa

SEQ ID NO: 6933 - RNA, 951 nt, Euschistus heros
uuaguacuucgucuuagaggagguaugcagauuuucgucaaaacucuuacuggcaagacaauaacccuggaaguugaaccuucagauacaauugaaaauguuaaagcuaaaauucaagacaaagagggaauucccccagaucagcaaaggcugaucuuugcuggaaaacaguuagaagauggucguacuuuaucugacuacaacauucaaaaggaaucuacucugcacuugguuuuacguuuacguggugguaugcaaauuuuuguuaagacucugacaggaaagaccauuacuuuagaaguugaacccucugauacuauagaaaauguuaaagcaaaaauucaggauaaggaagguauuccgccagaucagcaaagacugaucuuugcaggaaaacaacuagaagauggccgaacacuuuccgauuacaauauccaaaaagaauccacuuuacaucuagugcuucgucugcgaggugguaugcaaauuuuuguuaaaacucuuacuggcaagaccaucacccuggaaguugagcccucugacacaauugaaaauguuaaagcuaagauacaggauaaagaagguaucccuccagaucagcagcgguugauuuuugcugguaaacaauuggaagauggacguacucugucugacuacaacauucagaaagaaucuaccuuacaucuuguguuaaggcuuaggggaggugcaaagaagcguaagaagaagaauuacuccacuccaaagaaaaucaagcacaagaagaagaagguuaagcuagcugugcuuaaauauuacaagguugaugagaacgguaaaaucagcagguugagaagggaaugccccucugagcagugcggugcuggugucuuuauggccgccauggaggauaggcacuacuguggaaagugugccuacacccuugucuucaauaagccagaagauaaauaa

SEQ ID NO: 6934 - RNA, 1629 nt, Euschistus heros
augcaaccacaaauaauacuuuugaaggaagggacugagagcucucagggaaagccucagcuaguuucaaacauaaaugcuugccaaauuauugcagaugcaauucgaacaacucuuggcccaaggggcauggacaaacuuauuguggauggugguggaaaagccacaauaucuaaugauggugcuacuaucuuaaaacauuuagauauugugcauccugcugccaaguguuuaguggauauagcaaaaucacaagaugcagaggucggagaugguacuacaaguguugucuugaucacuagugaaauuuugaaacagcugaaaccauauguugacgaggguguccauccuagaauaaugaugaaagcaguaaggaaggcgacucaauuauguuuagacaaaaucaacagcuuagcuguuaagaucgaaaagaguagugcggagcagcaccgcucucugcuggagaggugugcagcaacagcacucaguuccaaauugauucaucaacagaaagauuucuuuucgaaaauggucguagacgcuguacuauuguuagaugaacuccuuccacucgaucucaucgguaucaagaaaguaccugguggagcuuuggaggaauccuuguuggucucugguguggcuuucaagaaaaccuuuuccuaugcaggcuucgaaaugcaaccuaaaaaguauacaaacccaaaaauagcuauucucaacauugaauuagaauugaaagcggagagagacaaugcugaaaucaggcuugacaacguagaggaguaucaaaaaguuguagauguugaauggcaaauuuuguacgaaaaauuagauacaaucgucaaaucuggagcucaggucguucugucaaaacuucccauaggagauguagcuacucaguauuuugcggacagagauauguucugugcuggacguguugcugaugaagacauaagaaggacacaaaaagcuugcgguggcaccaugaucaccacuaccaaagacauguccucuucuguccuuggaucuugugaauuguuugaagaaaaacaaauugguggagacagguauaacuuuuucucuggcugcccgaaugcaaagaccuguacaaugauacuuagagguggugcugaacaguuccuagaggagacggaaaggucucuucaugaugcuauuaugaucgucaggagaacaauuaaaaaugaugcaguugucgcaggugguggcgcuauugaauuagaacuuuccaaaaugcuccgugacuauucaagaacuauugcuggcaaagaacaauuguuaaucggagcugucgcuaaagcucuugaaaucauaccgaggcaauugugcgacaaugcugguuuugaugcuacugcuauucuuaacaggcucaggcagaagcacgcucaaggaagcugcugggaaggugucgauguaacacucgaagauaucucugauaacauggagaaguguguuugggaaccgucagucgucaagagaaaugcuuuggaagcagcuugugaagcaguaugccucauuuuguccguugacgaaacaauuaagaaccccaaguccggaggcggcggacagggagaccagccgaugaugcccccaagaggcaggccuauguga

SEQ ID NO: 6935 - RNA, 13965 nt, Euschistus heros
augaugacugauuccuuggaaucaaaugauccucccccggaggagcagccagugucgauaauagauauaacggauuuuuuagacuaucuucgugaaaauauuaaauugaauuuauuagguguuaaaaguguaccuucuucuuuagauucugcuuuagaugauaauggaaauuuggauuguauuaagaaguuucuuagugacccacaauuugcuacacuaauagugcaaaagaauucaaccaaagaugaugacccagaacaggguggugagggugaagaugaaaaggaaacacccaccauaacgauaucuaacaugguucaguucuguagucccaaggcaucuagucuucuauuuaugaagaauggagcgauuauggaugcugacaaaagcauucagucacaauuacacaugauugaauuuucugaggguacugcguaugaaagucuucaugccauuguuagcaaagggaugucaccuuauuuuaaaaguuauguuaaagaaucuggccgggcugauagggauggagauaaaauggugccaucuguugaaaagaagauugaugaguuagaaaugggccuguugcauuuacagcaaaacauagauauuccugaaauaacacuuguaguucauccaauaguaucaaauguuauuaaaaagugugcugaagaaggaaggaagcccaaaguagcagauuuuggagaccguguugaagauucgaccuuccuuaaccagcuacaacaugguguuaaucgauggaucaaagaaauucaaaagguaacaaaacuggaucgggauccagcaucugggacugcacugcaggaaauauccuuuugguuaaaucuugaaagggcauugcaucgaauucaagaaaagagagaaucuauugaaguugggcuuacauuagagauucugaagcauggaaaacguuuucaugcuacuguuagcuuugacacagacacuggguuaaaacaggccuuggcaacuguaaaugacuacaacccauugaugaaggauuuucccauuaaugaccucuugagugccacugaacuugaccgaauaaaacuugcuguucaacagaucuucacccaucugagaaagauucguaauacuaaguauccgaugauuagaggauuacgacuaauugaagccauauccagagaucucacgacucaacucuuaaaaguuuuaggcacucgccgcuugaugcacauuccauuugaugaguuugagaaaguaauggcacagugcauuagcguauuugucacaugggaugaugaguaugaaaaacuacaaaaucuuuugagagauauaguuaaaaaaaagagggaugaacaacuuaaaaugguuuggaggguuaugccugcucauaaaaagcuccaaacaaggauggaacagaugcggaaguucaggcaucaacaugaacaacugaggacuguuauauuaagaguucuucgaccugugccugccucccuuaucaacggucaagagguuacugggcaggauaaaguaguugaugaugcaccuaauauuucugcuguugaagaaguaaaccuugccuaugaaaacgugaaagaaguugauuguuuggacaugucaaaagaaggaggcgaagcuugggaagcagcuguagcacguuaugaagaaaagauugauaaaguugaaacacguauuacugcucauuuacgggaccaguugggacaggcaaaaaaugcuaaugaaauguuuaggauauuuucucguuuuaaugccuuguuugugaggcagcauauucgaggugccauuagagaguaccagacacagcuuauacaaagaguaaaagacgacaucgaagcacuucaugagaaauuuaagguucaguauggacaaaguaaaggcugucggaugaguucuaucagggauuuagcaccaguuucugguucuauaaucuggguaaaacagauugaucgccaacuuacgacauaccuuaggaggguggaggauguuuuagguaaaggcugggaaaaucauauugaaggccaagcccugaagucugauggagacaguuuucggcuuaaacuuaauacucaagaaauauuugaugacuggucucguucuguucaacagaggaaccuuucaguaucugguagaauuuucgcuauugagaguacacguucacguucuggaagaggcaacuuacugaagcucaaggugaauuuucucccagaaauuauuacucuguacaaagaagugagaaacuugaagaacuuaggauuucgaguuccgcuagccauaguaaauaaagcucaccaggcuaaccagcuuuacccuuuugcugucucucugauagaaagugucagaacauaugaaagaacucuugaaaaguuagacgauaaagcuaguauuauuccauugguugcuggucugagaaaagaaaugcaacaacuuguagcugaggggauacaauugguuugggagagcuacaaacuagaacaauauguccaucgauuugcugaacaagucuguacauuccaggagaaaguugaggaucuucugguuguugaagaacagcuugauguugauguuagaucuuuggaaacauguccauauucugcaucaacccuucgagauauucuugcuaaaguccagcaugcaguagaugaucuuucauuaaaacaguauuccaaucuccauauaugggucagcagacuugaucaagcuguugagaaaaaucucggaggaaggcuucaggcaggcauugaugcuuggacugaugcauuagaaggcaagagccaugagcuagaucugaguauggacacugaugcgccagcgagaccaacccaugcaccugguggugacccacaugugcagacagugacucaugaaguucgcauuaccaaucagauuauguaccuuuauccgagcauagaggaagcaagauuccagauaaugcaacaguuguuucaguggcaggcuguuguaacuucccagcaaagacuucagagcucacgauaucagcuuggacuugaaaggcucaugucccagucauauagagacuuguugacuaagcuaccuaaugguucccaagcccucaucaaugcauaugauucaauagacaggaaaaucaaagauguugucaacuauguagaugagugguugagguaccaaucuuugugggaucuccaaucagauacccuguacagucgguugggagaugacauuaccauguggaugagaugucuuucugaugucaagaaaucacgaacuacauuugauacaucugagacucgccgacaauucggcccuauugccauagauuaugcuaaaguucaaaguaaaguagcacugaaauaugauucucuugauaaggaaaucuuggcuaaauuugguggccuuuuaggccaggauaugucuggauuucauucccaaauuucuaagucccgaagugaauuggaacagcagucaauugaagcagccagcacuucagaugcagucugcuuuauuacuuauguccagucauugaaaagaaacaugaaaucuuggcagaaacagguagaaauuuacagagaaggacagagaauacuugagcgucaaagauuccaauuuccuaauaacuggcugcauguggacaauguugaaggagaauggucagcuuuuaaugaaaucaucaagaggaaggaccuaucuauucaggcucagguugugagccugcagcagaagaugguggcugaggaccgugcgguugaggccaggacuaaugaucuucuuucugauugggaacacuccaagccaauagaagguagacuaaggccagaugaagcucuugcucaguuaaaugaauuugaagugaaguuugcucgacuuaaagaggagagagacaauguugcuaaagcuaaggaggcacuugaacuacaauauacaggugcuagcagugguagcgaggagagaguggcugugguauuugaagagauggaagaucugaaggaaguauggacugaauuaucuggcauuuggcgacguuuagaugagacucgagaaauaccauggcuuucaguucagccuagaaagcuucgucaacaguuagauggucugucucaacaacugaaagaguuaccagcacgcgucaggcaauacuccucguaugaguaugucaagaaacucuuacaaggguauacaaaggugaacaugcugaucgucgaguugaagagugaugcgcuuaaggagaggcauuggagagcccugaugagaaagcugcguguuaacuggguucuuucugagcuuucacugggucaaguuugggaugucgaccuucaggccaaugagaguguugucaaagacauuauucuuacagcccaaggugaaauggcacuugaggaguuccugaggcaggucagagaaucuuggcagaacuaucagcuagauuugaucaauuaccaaaauaagugucgucuuaucagagguugggacgaucuuuucacgaaagucaaagaacacauuaauucuguggccgccaugaaacugucaccauauuauaagguguuugaagaagaggcccucacuugggaagaaaaacugaauagaauaaaugcucuguuugauguuuggauugauguucagaggcguuggguuuaccuggaagguauuuuuucuggaagugcagacauuaaaacccuucuucccauugaaaccucucguuuccauaauauaagcucagacuuucuuggauugaugaagaaaguggcuaaaucuccuaugguaauggauguucucaauauccaaggugugcaaagaucauuagaaagguuagcugauuuguuagaaaagauacagaaagcucuuggagaguaucuugaacgggagaggaugucauucccuagauuuuacuuuguuggugaugaagacuuacuugaaauuauugguaauucaaagaacauugcaaggcuacaaaagcauuucaagaaaauguucgccgguguugcuucaauuuuguugaaugaagauaauacaauuaucacuggaaucgcaucaagggaaggcgaagagguuaucuuuacuaauccaguuucuacuguagaucauccuaaaauaaaugaauggcucucauugguggaaaaagagaugcgauugacauuagcugcuacucuaguuucugcuguuggugaacuuagggcuuucaaagaugcaccuuuggagccuucgaauuacauggcuuggguugauagguaccaaggacagauagcugucuuagcugcucaaguucuuuggucagaggacguugaagcagcacuaucagggaaaucugggggcuugcaaggugugcuuacccaaguugagggcacucucacuguucucgcugacuguguccuucacaagcagccaccgcucagaaggaggaagcuagaggcauugauuaaugaguuuguucacaagaggacaguaacucgucgauuaauacaagcaaauauaucuucucccaaaucauuugaguggcuuugucaaaugagguucuaucuggauccaacgcagacugaagcucucucacaacucucuauucacauggcaaaugcuaaguucuauuauggcuuugaauauuuaggaguucaagauagacuaguucaaacucccuuaacugauagguguuaccugacuaugacucaagccuuggaagcacguuuagguggaucaccauuugguccagcugguacgggaaagacugagucagucaaagcucuuggucaccagcuuggacguuucguucuuguuuuuaauugugaugaaaccuuugacuuccaagcuauggguagaauauuuguuggucucugucagguuggagcaugggguugcuuugaugaauucaacaggcuugaagaacgaauguugucagcugucucucagcagauucagaccauccaagaggccuuaaaauaucacauggauucaaacaacagagauagcacuuuaacaguugaacuagucggcaagcaaguucguguaucaccagauauggcgauauuuauuacaaugaauccuggauacgcuggacguuccaaccuuccugauaacuuaaagaaauuguuccgaucacuugccaugacaaaaccagauaggcagcucauugcugaaguuaugcuguuuucucaggguuucagaucugcagagaaauuggcaucuaaaauuguaccauucuuuaaacuaugugaugaacaacugucgaaccagucucacuaugauuuuggccucagagcccucaagucugugcuuguuagugccgguaauguuaaaagggauaggauucagagaauaaaggaaaagagggaaggaggcucuggagaugaagcaaccauugcugaaaaccuuccugaacaagagaucuugauucagucaguuugugaaacaaugguaccuaaauugguggcugaagauauuccucuguuguuuucacuucuuaaugauguuuucccucaaguccaauauaccagggcugaaaugacaaaauuaaaggaagagauaaggaaaguaugccaggaagaauaccuuguuuguggagaaggagaugagcagggaggaccuuggauggaaaaguauaugggagaaacauggauugaaaagguuuuacagcuuuaccagaucucaaacuuaaaucaugguuugaugaugguuggaccaucugggucuggcaagucuucagcuuggaggguguuauuaaaagcauuggagcgcuuugaaggaacugagggagucgcccauguuauagauccaaaagcaaugucgaaggaagcccucuaugguguccuagaucccaacacucgggaauggacagauggucucuuuacucauguucuuaggaagauaauugacaauguuagaggagagauuaacaaaagacaauggauuauauuugacggagauguugauccagaauggguugaaaacuugaacucagugcuugacgauaacaaacuucuuacuuuaccuaauggugagagauugucucuaccaccaaaugucagaguuauguuugagguacaagauuugaaauaugcuacccuugcaacuguuucucguugugguaugguaugguuuucugaagauguacuaucaacagagaugauauuugaaaauuaucucucucgccuuagacacauuccauuagaggaagcagaagaagaaucuucuuucccucagcugaagaagauagguggagagaggaaagaagaaggaauaucaccagcgaugcagguucagacagauguugccaacaucuugcagagcuauuucucaccagaugggcuugucgucaggugccuggaguaugcucucaagcaggaacauauaauggaucucacuaggcuuagggcucucggcuccuuguuuuccaugcucaaucaugguguuagaacugucauucaguauaaccagagccacucugacuuuccauuaccaucagagcagcuggauagauuuauuccuaaaauuuuaaucuacucacuuuuguggucauuuggaggagaugcgaaacucaaagugcgcucagaccugggugauuuuauucgaucuguuaccacaauaccauuaccaccaaacaauccuaacauaccaaucauagauuaugagguuaauauaucuggggaauggagcccauggucagccaaaguaccucagauugaaguggaaacucauaaaguggcagcaccagauguggugguuccuacucuugacacgguccgccaugagucucuuuuguauacauggcucgcugagcauaggccuuuaguucucugugguccaccugguucagguaagaccaugacccuauuuucugcacuaagggcucuuccagauauggaagucgucggccuuaauuucagcucugcaaccacaccagagcuucuccugaagacuuuugaucauuauugugaauauagaaagacuccuaauggaguuguauuagcaccuguucaguugggaaaaugguugguucuuuucugugaugagauuaacuugccugauauggacucuuaugggacccaacgaguuauauccuuuuugagacagcuagucgaacagcgaggauucuacaggucuucugaccuugcuuggguuucccucgaaagaauccaguuuguaggugcuuguaauccacccacagauccuggcaggaaacccuugucccauagauuucucaggcauguaccugucauauacguugauuauccuggugaaacaucucucaaacagauuuauggaacauuuucacgagcgaugcucaggcuuauuccuucauugcggggauaugcagaaccucucacaaaugcaaugguugaauucuaccucucaucacaggaaagguuuacucaggacaugcagccucacuacgucuauucaccuagggaaaugacaagauggguuagggguauaugugaagcuauaaggccauuggauagcuugaaaguagaaggacuuguaagguuaugggcucaugaagcucuccgccuuuuccaagacaggcuuguugaagcuagugaacgagaauggacaaaugaaaauauugacaaaguugcucuaaaacauuuuccaucaguggacaaggaaucuucucuuggccgaccaauccuuuauuccaauuggcugucaaaggacuauauuccuguugaaagggaccagcugagagauuaugucaaggcaagacugaaaguauuuuaugaugaagaauuggauguaccucuugucuuguuugaugagguucucgaacauguucucagaauagacaggauauucaggcagccacaggggcauuugcuccuuauaggugucucuggagcaggcaaaacaacacuuucucgcuuuguugccuuuaugaauggacugucaguauuucaaaucaggguucacaauaaguacacuagugaagauuuugaugaagacuuaagaucugugcuaaggagaucugguuguaaaaacgagaaaauagcuuucauccuugaugaaucaaauguuuuagaaucugguuuucuagagaggaugaacacacugcuggcuaacggugaagugccuggucuauuugaaggagaugaauacaguacauugaugacccagugcaaggaaggagcucaaagggaaggacucaugcuggauucgaacgaggaguuauauaaaugguuuacuggucaaguaaugagaaaccuccacgucguuuucacgaugaacccuagccaugaaggacucaaggauagggcugcuacaucaccugcucucuucaauagguguguucucaacugguuuggagauuggucagauggcgccuuguaucagguggguagagaguucacuaauacucuugaccuugauggaccgcccaccuggaaagcuccugacuuuuucccaaucgcuuaugcaaauuuaccaucaccuccuaaucacagacaagcaguuauaaauggauguguuuuuguacaucaaacauugcacaaagccaaucaaaggcuugcaaaacguggagcgcgcacaauggccaucacuccaagacauuaccuagacuuuaucaaucauuuuguaaaguuguauagagagaaauguucagagcucgaagaacagcaacuucauuugaauguugguuuaggaaagauagcagagacuguugaacagguugaagaaaugcaaaaauccuuggcuguuaaaucucaggaacuucaagcaaagaaugaagcugccaaugccaagcuuaagcagauggucaaagaccaacaggaggcagaaaaaaagaagguacagucucaggaaauccagucgcagauagaaaagcagaaacuacuuauagcucaaaagagagaagguguaauggcugaucuugcucaaguugaaccagcuguuauugaugcccagcaggcugugaaggaaauaaagaagcagcagcugguagagguuaggucaauggccaacccuccugcuguagucaaguuggcacucgagucgaucugccuccuccuaggggagagugccacugacuggaaauccaucagggcugucguuaugagggacaacuucaucaauucuauugucaacaauuucuccacagaaaacauaucugacgaaguuagagagaagaugcauacucguuaucuuagcaacccagaauauacauuugaaaagguuaacagagcuaguauggcaugugguccuauggugaagugggcuguagcacagauaaguuaugcagacauguugaaaaaaguggaaccacugagagaagaauuacggucuuuagaagagcaggcuggugaaaaugaacagaaaggagaagacacaaaagcacucauugcacaguuggaaaagaguauugcagccuacaaggaagaguaugcucaacugauacaggaagggcucgcuaucaagcaagauuuagaaaauguucaagcuaagguugaucggucuaucgcucuccugaaaucucucggccuagaaaggucaaggugggaagcaacaucagagacauuuaagucucaaauggcaaccauuauuggugaugucuuacucucuucagccuaccuugcauaugcugguuacuuugaccaacauucccgacacaaucuucugucccgguggacagagcaccuuaguucugcagguauucaauacaggcaagacauagcccucacggaauaucuuucaaauccagaugaaagacuuagguggcaggcaaauagucugccuacagaugaccuaugcaccgaaaaugcuauuaugcuaaagagguucaaccgauauccacucaucaucgauccaucuggacaggcuacagaauuuauuaugaaugaauacagagacaagaucacaaagacuaguuuccuugaugauucauuuagaaaaaaucuggaaucggcucuucgauuuggcaauccuuuacuugugcaggaugucgaaaacuaugauccuauuuugaauccuguacuuaaccgugaagugaggcgaacugguggcagaguauugauaucauuaggagaucaggauauugauuugucgccaucauuugugauauuccucucuacaagagauccaacuguagaauucccaccagauaucugcuccagaguuacauuugucaauuucacugucacaagauccucauugcagucccaauguuugaaccaaguacuuaaagcugaaagaucugauauugaugaaaagagaucugaccuccuuaaauugcaaggcgaguuccauuuaagauugagacagcuggagaaauccuuauugggagcuuugaaugaagccaaggguaagaucuuagaugacgauucugugauaacuacauuggaaacauugaaacaagaggcugcggagauuaguaagaagguugaagaaacagacagaguaauuggagaaauagagacaguuucacaacaauauaaaccucuuucacaggcaugcagcaauauguacuucacucuugauuccuugcaccaaauacauuuccucuaccaguauagccucaaguucuuccuggacauuuucucagcuguucucuucuccaauccaucucuggauggucuuacugaccacacucaaaggcuggguguuauaacgaagcagcuguuugcuguuugcuaugagagaguugcucgagguaugcuucauacggaccgauugacacuugcauuauuauuaucuagaauauaccuucguggguugccacaagaagaccaauuggaggcugaauuccaucauuuccucagaggaaaggagggagucauuguuucagguggaggggcaucccaucuggaaggguuguccagugaccaguuggaagcccucauuagguugggcaacaggcuaccucaguucaaggaauuaaugaagaagguuaacgaaaugccugaguuuguugcuuggcuccagcagucgacaccagagcaaaauguaccaacauuauggcaugaggauaagcccuuaucuccgaucgcuacugcuaugaaccggcuucuccuuauucaagcugugcgaggagauaggguuacugcagcaggugcuggacuugucagugcugugcuuggugaagguuuuacagcucgagcugagagggaauuagaucuggcccauauuguugagucugaaaugacugcugguguaccuguucuguuauguucugugccugguuuugaugcuaccucaaggguugaugacuuggcugcugaaucuggcaaacaguuggcaucuauagcuaucgggucugcugaaggauucucgcaggcagacucaauaaucaacauggcugugagaucaggaagauggguacuacucaagaauguccaccuugcaccucaauggcuuguacaauuggagaaaaagcuucacucacugcaaccgcacucaggcuuccggcuuuuccuuacuauggaaaucaaucccaaaguuccuguuaaucuucugagagcaggucguaucuuuguauuugaaccaccuccuggaauuagagcaaaccuauuaagaacauucagcacuguuccugccucaagaaugaugaaggcaccuagugaaagagcaagauuguacuucuuguuggcuugguuuaaugcaauaguacaagagagauugcgauaugcuccccuuggaugggccaagcacuaugaguucaaugagucagaucuucgaguggcaugugauacauuagacacuuggauagaugccacagcugugggaagaacacaguugccgccugaaaagguuccuugggaugcauuaguuacacuuuuaucgcaauguaucuaugguggcaaaauagauaaugacuuugaucagagguuauuaucuucauuccuuucgaaauuguucacaccaagaagcuuugaggcggacuuugcuuuaguagcuaauguugaugcuggagcuccaggaggucaaaggcauauaacaaugccagauggaacaagaagggaccauuucuugcauuggauagaaucucuggcugauagacaaacaccaucuuggcuuggcuugccuaauaaugcagagaaaguucuuuugaccaacaaggguacugauuuggugauuaaacucuugaagaugcaacaacuggaagaugaagaugagcuugcuuacaccgaacaggagucaggaccuccuucuucccuucagccaggaccugauccuggcaggccugcguggaugaggacacugcacaacucagcucugacauggcuccaguuguuaccaacuaaucuucagacauugaagaggacaguagaaaacaucaaggacccacuuuaccgguacuuugaacgugaaguuaacucaggcgccaaacuucucagggauguuauucaugaucucacugauguuguugccauuugucagggagagaagaaacagaccaacuaucauagaacuaugcucagcgaucuggucagaggaauccucccaucaggcuggaggagguauacuguuccaagaggguguacuguuauucaauggauaacagacuuuagcaacagggugaaacaguuggacaccauuucucaacuugcgucgcaaagaggaccaucugaaauuaagaacacuccaaucugguugggugguuugaugaacccugaggcuuauauuacugccacuaggcaguguauugcucaggcuaacaguuggucucuugaggaguuaauccuggauguuacuauuccugaaccaucaucgacuuccucuguugcuacugaugaaugcaguuuuucugucacugggcucaaauugcaaggugcacagugcaggaacaaucaacuucugcucacuucaacaauuaugauggaucugccaacaacauuacucagguggcacagggcugguggagagggagacucugggaagcuaucuuuaccgguauaccuuaauucaacacguagcgagcuucuuuucacuguugacuuaaacauugcuccuggucaagaaccacauagcuucuaugagagaggaguagcccuucucacuucuacagcgcucaacuag

SEQ ID NO: 6936 - RNA, 2640 nt, Euschistus heros
auggccgacucaaguacugauucuagugauagugaagaggauagaaaacaaagagaugaauucgcugcacgucuuagaaaaaaagauaaagaaaauaugaggaaaauuacaacuauucauucugauaaaagagcauaugaggaagcagcuaaaagauuaaaaauugauucugaacaucaagaaaaauugauuccuagguuaagaguugaaucaagaaggaaguauuuagaaaaacguaaagaagauaaaguucuugagcuugaagcagacauuauugaugaugaauaucuguuuaaugaugaugaacucacggagagggaaagaaaagauagagaucauaaaaagaaauuauugguccucgcaaaggaacaugaaaaagcuagagaacuagaaaaaguucaaagauaucauaugccuagagaugucaaagaggguguugaacaauaugaggaaguugaugagagagaaaacaagccuaauuaugagcaaaggaaaugggaggaagaacagaugucuucagcuguguuucacuuuggugcaaaacaaaaagauaaauaccaagaagaauaugacuugguucuugauaaucaaauugaauuuauccaggcuaugagucuagcugggacuaaagaaaagccugaucagcaguuaacagagaaagaaagaaaaagguugacuauugaagaaacacaaaaaagccucccuguuuucaaguuuaaagaugaacuugugcaagcaaucaaggaucaucaaauccugauuauugaaggugaaacaggcucagguaaaacuacucagauuccacaguauuuauaccaggcaggauuuacuaaagaugguaagaaaauuggaugcacucaaccaaggaggguugcugcaaugucaguugcagccagaguugcugaagagaugucuguuaaguuaggaaaugagguuggcuacagcauucguuuugaagauuguacaucagaaagaacuguuauaaaguauaugacugaugguacucuucacagagaauuucucucagaaccagaccuccaaacuuacagugucaugauaauugaugaagcucaugagagaacauugcauacagacauacuguuugggcuaguuaaggauauugcuagguuuaggucagaucuuaaacuuuuaaucuccagugcuacacuagaugcagaaaaauucucaacauuuuuugaugaugcuccuauauuuaggauuccaggaagaagguuuccaguugauauauacuacaccaaagcaccugaagcagacuauauugaugcuuguguggucucaauucuacagauacaugcuacucaaccauuaggugauauucuaguguuccuuacuggucaggaagaaauugaaaccugucaagaaauucuacaagauagaguaagacgucuuggaagcaggaucaaagaacuacuaauccuuccaguuuauucuaaucuaccaucugacaugcaggcuaaaaucuuucagccuacaccuccaaaugcgaggaagguuguuuuagccacaaauauugcugagaccucucucaccauagacaacauuauuuaugucauugauccugguuucuguaaacagaauaauuuuaacucaagaacugguauggaaucauugauaguugugccuguuucaaaggcuucagccaaucagcgggcuggaagagcuggucguguggcugcuggaaaaugcuuucgacuuuauacugcaugggcauacaaacaugaguuggaagauaacacuguuccugaaauucaaaggaugaaucugggaaacguuguacuuacccuaaaagcauuaggaaucaaugauuugaucaauuuugauuucuuagauccaccuccccaugaaacauugguacuugcuuuagaacagcuuuacgcauugggggccuugaaucaucauggggaguuaacuaaguugggucgaagaauggcagaauuuccauuagauccaaugauggggaaaauguuacuugcuucugaaaaauauaaauguagugaggaaauaguuacuauugcagcaauguuaucuguaaauggugccauauucuauagaccuaaggacaaaguuguucaugcugauacugccagaaaaaauuucuuccuucccgguggugaucaucuuguucucuggaauguuuauaagcaaugggcagauacugacuucaguacacaauggugcuaugaaaauuauauucaguacagauccaugaaaagagcucgagauguucgagaacaacugguaggucuaaugcaacguguagaaauggacuuuauuucuaauccuacagauacuauugcaauacgaaaaacaauuacuucugguuauuucuaccacauugcaaggcuuucuaagggaggucauuacaaaacuguuaaacauaaucaaacuguaaugauccauccaaacaguugucuauuugaggaucuuccucgcuggguuguguaucaugagcuugucuucacuaccaaggaguuuaugaggcagguugcugaaauugaaagcaaaugguugcuugaaguagcaccacauuauuauaaaccucgugaauuggaagauucuacgaacacaaagaugccuaaaguauuaggaaagacuagagcacagcuaggggaacauuaa

SEQ ID NO: 6937 - RNA, 1371 nt, Euschistus heros
augaagauugaagaaguuaaaaguacuguaaaaacucagaggauaucuagucauagucauauuaaagguuugggccuagaugaaaaugggauaccaauucaaauggcagccgguuuagugggccaagaaaaugccagagaggcagcuggaauaguaguggaaaugauuaagucgaagaagauggcuggaagagcuguuuugauggcuggaccaccaggaacuggaaaaacagcuauugcgcuugcuauggcccaagaacuaggaaauaaaguaccauuuuguccaaugguaggaucagaaguguuuagcucugaaauuaagaagacggaaguguuaauggaaaauuuuagaagagcuauugggcuuagaaucaaagaaacuaaagaaguuuaugaaggugaaguuacagaacuuacaccuguagaaacagaaaauccuaugggaggauaugguaaaucuguaucccacguaguuauuggcuugaaaacagcaaaggguacaaaacaguuaaagcuagacccuagcauucaugaaagcuuaaccaaggagaagguugaaguaggagacguuauauacauagaggcaaacagcggugccguuaagaggcaaggaaggagugauaccuaugcuacagaauaugaucuggaggcagaagaauacgucccacuuccuaaaggagauguccacaaaaagaaagaagugauccaagacgugacauuacaugaucuugacguagcuaacgcgaggccgcaaggaggucaagauguacugucuauaaugggacagcugauuaagucaaagaaaacugaaauuaccgauaaauuaagagcugaaauuaacaaagucgucaacagguacaucgaccaagguaucgcugaacuugugccuggcguccuauuuauugaugaaguacacaugcuagauauagagaccuucacuuaccuucaucaggcucuugagagugcaauagcuccuaucguagucuuugcuacaaaucguggucguugucaaguuagaggugcuguggauauuauuucaccccauggauuaccguuggaccuccuggauagguugcucauaauucguaccgcaccuuacagccaaccggaaaugugccaaauucuaaaauugagggcuguaacugaggggcuuagcaucgacgaggaugcauuaucagagcucagugauauuggaagcaaaacaacucuaagguaugcaguccaguuguugaccccuucuaacuuaacagccaaagugaacggucguucaacgauuacaagggaagauguagcagaggugggacaacuguuucuggaugcaaaaucuucugccaaaauucuugcaaaacaucaggaucaauauaugaaauaa

SEQ ID NO: 6938 - RNA, 2196 nt, Euschistus heros
augaccuccaucauuaaguuccaugccuugucaggaguuauggaugaaucuccacccuguuauauuuugcaaguugaugaguuucgguuuuuacuagauugugguugggaugaacacuucaaucaggacuacauuaaagaacuuaagagacauguucauuuaauugaugcgguuuuacuuacuuauccugaucauuuacacuuaggagcauuaccauauuuaguuggaaaauguggacuuagcugcccuguuuaugcuacuauuccaguuuacaagaugggacaaauguuuauguaugauuuauaccaaucucgcuacaacauggaagacuuuaauguguuuagucuugaugauguugaugcugcauuugauaaaguuguucaauuaaaauauaaccagucaguaacaaugaaggggaagugcuauggacucagcauuguuccaaugccagcuggucauaugauuggaggaacaauguggaaaauuaugaagacaggagaagaagauauuauauaugccauugauuuuaaucauaaaaaggaaagacaucuuaacggcugugaucuagaaagauugcagaggccaucauugcuaauaacugacgcauuuaaugcuacuuaucagcaagaaagaagacgagcaagagaugaaaaacucaugacaacaauucuucaaacauugaguagcaauggaaacauucuuauugcuguugauacugcuggucgccuuuuagaguuggcacauaugcuggaucaacuuuggaggaauaaaaauucugguuuacagauucauccuuugugccuuaucaauaauguuaguuauaauguaguugaguuugcuaaaucucaaauagaauggaugagugauaaauuaaugaaaaguuuugaggcaguucguaauaauccauuucaauucaaacacauacguuuaugucauaguguuucagaacuuaauaaaauaccuucagccaaaguaguacuugccaguaugccugaucuugaauguggauuugcccgugaaauauuuuuucagugggcaucugauuccaaaaacaguauuguacuaacauccagauguugugaaggaacauuagcaagagauuuauuagacaaugguguuggaaggaccauccaaaucacuguuaaaaaaagaguccgucuugaaggggaagaauuaaaagaauacuuaaaagcacauaaaaaaacaaaugauaaaaaugaagagaaggaaaguucugagucagaagaugaaauucaauugcuuagugucacuaaagguagucaugaucucguuauuaagcaagaaagaagaaaaaagaaucaaaaaucuuuaaagaaauuuuaucccauguuuccuuuuauugaccguaaaguuaaauuugaugaauauggugaauuuguacguauagaagauuauaaagcuccugaugccacuaaacguccuccugagaaaaaguccaaaaagaaggaugaugauguuuuagauccugcugauauuccaaccaaauguguuucuuaugagaaaucacuaacugugaaugcccagguucaguacauagauuuugaaggaagaucugauggagaaucaguucagaaaauaaucacucaguugaggccaagaagagugauacuuguucgugguaccucagaaaacacagaagcuuuggaaaagcaucuuuugcaauggucugaggcaaaaauuuucuguccgaaaaagggugauauuguggaugccacaacugaaagucauauauaucaaauaagauugacugauucuuuaguuucuucuuuacauaugcaaaaagguaaagauucagagcuugcauggauugaugccauuacaaaauaccgucagaaacccucugauacuaugcaaucggcagaagaaauggagguugaagaugaugguaauuauaguauuuacaaugaugauuauuuaacucuagaaccucuuccauuaacugaagucaauccccaucaagcaguauuuauaaaugaguuaaaauuaucugauuugaaacaaauuuugucucguaauggaauagagucugaauuuucuggugguguguuguggugcugcaaugguacuauugcuauucgaagauuagagucuucuaaaguguacuuagaaggauggauuucugaaaauuacuauagaauaagagaaauuuuauauggacaguaugcgauuuuauaa

SEQ ID NO: 6939 - RNA, 2424 nt, Euschistus heros
augcccucaauagauguuauccagccuccuccuccuccuccuuccauggagaaggaggaaccuauacuucaaccgacaacuaagccgauugucgguauuauuuauccuccaccagaagugagaaauaucgucgauaaaacugccaguuuugucgcccguaauggaccagaauuugaaucucgaaucaggcaaaaugaacugggaaauccuaaguuuaacuuucucaauacaggcgacccuuaucaugccuacuaccagcauaaaguaaaagaauuuaaggaugggaaaggagccgaaccaccaccgccuccagcgccuguccaacagaaaaccguugcuuccgcuacacaguugaaacagcaagaaauccuaaaacaagucacugaacagccauuuguaccgaaagauccuccaccagauuaugaguucauggcugauccgccuucaaucucugcuuuagauuuggauauuguaaagcuaacagcacaguucguagcaagaaaugggcgacaguucuuaacuaaccucaugaacagagaacaaagaaauuaccaauuugauuuucuucgaccacagcauucucucuuuuuguacuucacgaaacuucuugagcaauauacaaaggucuugauuccuccaaaagaccuaaugucucgucuaaaagaagaguguucuaauccuacuggaguucuggagcaagucagguaccgugcggacuggcuucacuaucaagaacugcagaagaggaaagaggaacaagcacuggagaaagaaaggguggcuuaugcucagauugauuggcaugacuuuguuguuguugagacuguagacuauauuccgggugagguaggcaacuucccuccuccuaccacuccagaugaaguuggagcuagaguccugaugcaggagagaaucuuggaaaauggaggagaagaucuuacggaaggagccgguagcgaugaagagagggagaaggaagacagugaaagagaggaggcaacuggugacaagggagacaauacucagguucaagacauggaggaagagucaucuagcgauagcgaugaugaugaugaaagagaucaaucucuuggggagaaacaaccagcaacacaagcucagaaacaacaaauguuacaacaaaaucaacagcuggccucagcagauggcaaaaaaccaucuacacagccuucaaugcaaccuccccugccuccggcaccugauaaaguuaucgucaaaaaaggcuauaacccuaagcagaaccagaagauaucgaaaggugcagauaauuaucuuaucucuccacugacaagugagaagauaccugccaacaaggugcaggaacacaugagaauuggucuguuggauccucgcuggguugagcaacgagacaaacacauccaagauagaaucaaucaggagacuguuuaugcuggagguucugcuauugaggccagcuugaaacaacuugcggagagaagaacugauauuuuuggugucggugaugaagaaacugccauugguaagaagauuggugaagaggauaagaagaaagaugauaaggugacaugggacgggcacacuucaagcguggaggcugcuacucgcgcugcgagggcuaacaucaccauugaggagcagauccaccaaauucacaaggugaaggguuugcuuccagaugaggaaaaagagaagauaggaccgaagccagucccaggaucagugaguacaaguucagcgaauccaaugauuggugguccuccgauuguuguccaagcuaaagcacccccacuuccuccuccuccgaagguaccuccacuuccaccuccagcuccuuugccgccuccaccaggucuugucccgcagccacccauuaugaugguaccugcaccgcuccgcccuccacucaugguuccuccuggagcguuccccguagucgcugcuacuccaccugcuuuuauggcuccuccaggaacugcaccccugccaccugcuccacagccaccaccucagguuacucagguuggaaacuuauuaaaacauguugcuucugcugcugcgggagagacugaggaugagccaaugacuaaaaaggccaaaacagaagauugccuuaucccggaagcucaguuccucaugcagaacaagagcccuguuacauucaaagugguggugccgcuuuuggcugacaaaccagaauggaaguugaauggccaggcauugacauuuacucuaccacuaacagacaccaucgccucggucaagagcaacauuucagagaccauaggaaugccagcugccaaacagaagcuacagugugauggcauuuuuuacaaggauucaaacucuuuagcauucuacaauaucucuccugcuacgguuguguaccugcagcucaaggaaagagguggcagaaagaaauaa

SEQ ID NO: 6940 - RNA, 942 nt, Euschistus heros
augccaggaguagagcuuguuacuaacaaaguagugguucacccuuuaguccuauuaaguguuguugaucauuucaauagaauggguaaaauugguaaucagaagagaguaguagguguauuauuagguugcuggaaagcaaaagguguuuuggacguaucuaauaguuuugcagugccauuugaugaagaugacaaggauaaaucaguuugguuuuuagaccaugauuauuuagaaaacauguaugggauguuuaagaaaguuaaugcucgagaaaaaguuguuggcugguaccacacugguccaaagcuucaucaaaaugauguugcaauuaaugaacuuauucgucgcuacugcccuaauucuguuuuggugauaauugaugcaaaaccuaaagaccuugguuuaccuacagaagccuacagagcaguugaagaaguucaugaugacggcuccccuaccacaaaaacauuugaacacguucccagugaaauaggagcugaagaggcagaagaaguggguguugaacaucuguugagagauauuaaggacacaacuguaggcucauuaucucaaaggguuacuaaucaauuucugggccucaaaggccuuaaucagcaaauucaagauaucagagauuaccuuaugcagguaguugaaggaaaauuacccaucaaccaucaaauaauauaccaacugcaagacaucuuuaaccuacuuccagacaugaaucauggaaacuuuguugauucauuguacauuaaaacaaaugaucagaugcuugucguuuaccucgcugcucuuguacgagcaauaguugcuuugcauaaucugauuaauaauaaacucaguaaucgugaugcugagaagaaagaaagcaccaaaaaagaagaaaagccuaaagaagaagaaacgguaaaaaaagaauugaaggccaaguaa

SEQ ID NO: 6941 - RNA, 1623 nt, Euschistus heros
auguuucagccgauuuucguguuaagucaaaacuccaaaagggaauccggcaauaaaguucgaucggagaauauugccgcagcuaagaugauugccgaaguuauaagaacuugucuuggaccacaggcuaugcuuaaaauguugauggauccgaugggugguauaguuaugacaaaugauggaaaugcuauuuugagagaaauaacuguucagcauccugcugcaaaaaugauuauugaaauugcgagaacacaagaugaagagguuggagaugguacgacaucaguuguuauucucuguggucaaauuauggcugaaauugagaggcauauagacgaaguccauccuacuacaaucauuaaagaguuuaaaagagcuuuagaugauauuuuaaaaauacuuccagauauaaguacaucucuugacuugaaggauaaaucuaagguuauugaaguuguuaaaggaugucuaggaaccaaauuuuuagguacuuggucugaaauggcuugccaaauggcaauugaugcugucgauacugucagagaccugaaaggucauggaaucgacuuaaagaacuuugcuaaaauagagaagguuccaggagguuucauugaagauuccaaaguauuggaaggugugaugcucaacaaagaugucacucaucccaagaugucucgguuuauuaaaaauccacgaauuuuguuacuagauuguucucuugaauauaaaaagggagaaagucagaccaauguggaaaucauaaaagaaggagauuauacaagacuuuuacaaaucgaagaagaauacauugaaaaaauguguaaucauauuauugagcagaaaccaaauguugucauuacugaaaaggguguuucugaucuagcccaacaucaucuuuucaaggcugguauuacaaccauccguaggguaaagaagacugauaauaacagaauagcucgagcuguagaugcaacuauuguuagucguguugaagaaaucaagcccuaucauauuggauguggugcuggucucuuugaaguuaagaagauuggagaugaguauuucacuuucauuacugaaugcaagaauccaaaagcuuguacaauauuauugcgugguccuaguaaagauguauuaaaugagguucagagaaauuuacaagaugcaaugaauguuguuagaaacuuguacuuggauccuaggauacuuccaggaggaggugcuguagaaauggcccuucauagagcucuaauuaaagcuaauuuuacuguagauauggaugaagacuguuaugcugccauuccaucugcuuuaagaauuauuccgagaacccuuuugcaaaaugcuggugggaaaguaaucaggucuaugaaugaacucgagaaacaacauaauucugguguucuuaaaggaguugaugggauuacuggcgaguuaaagacaguugaugaauuagguguaugggaaccauacucaguuaaaguucagauuuauaaaacugcuauugagucugcaauccuauuguugaagauugaugacauuguuucuggugcgaagaauaaagauagagaacgaaauucagguccaauagcacagccuucugaagaaucgcuuaaagaauaa

SEQ ID NO: 6942 - RNA, 819 nt, Euschistus heros
acggugguuuaucagauagggcauugcgaucuuagucauauccucuccagaaagguuauauuugaaaacguuggucauucuuugggugacuuaguuguuuaucaagaauuagucuuuacaauggcaaugccaagaacuuacggugguuuaucagauuauagaaauguuccugcaccuuccuuuaguccauauucugaaaauggaggaaguguaguugcuguagcaggugaugauuuugcaauuauugcaucugauacacguuuaaguacugguuuucaaauuuacaccaggaaccaguccaaacuguuuaaacuuucugauaaaacaauacuugguaguacuggauguuggugugauguccuuucucugacuaggcugguucagacccgaauaaaaauguaucaguaugaucauaacaaaguuaugucuaccccagcaguugcacaaauguugucuguucuacucuauuacaagcgauuuuucccuuauuauguagcuaauauucuugcuggaauagaugacaaugguaaagguguuguuuauagcuaugacccuauuggucaucaugaaagcucaaaauucagagcugguggaacagcuggagcuuuauugcaaccauuguuggacaaucagcuugguauguugaaucaagaaaauguucaagauaaaacuuauacuuuggagaaagcccaugcaauugugaaagaugucuuuauaucagcugcugaaagagauauauuuacuggugacaggauaucaauuaacauauuaacaaaggaugggauaagagaagauucuuuugagcuuagaaaagauuaa

SEQ ID NO: 6943 - RNA, 900 nt, Euschistus heros
auguucggguucaguauguuuccauucccuccuaggccuuuuaagguccaguauuauugcuuuucuguugcaaugauaccagguaaugaacgggaugacguugaacguggaggaaagauuauuaugccuccuucagcacuugaccacuugacuagauuaaauauaaauuauccuaugcuuuuuaagcugcauaacucaaagacaaauagaacuucucauagugguguguuagaauuuguugcagaugagggaaaaguguaucucccgcacuggaugaugcggaauuuaaugcuugaagaaggugauguuauugagauagaaaguguuucauuaccuguugccacuuuuucuagguuucagccucagucuccagauuuuuuggauauaucaaacccaaaagcaguguuagaaaacugccuuagaaacuuugcuuguuuaacuacuggugacauaauaaacauuaaguauaaccaaaaagacuaugagcuuucuguuuuagaaacgcaaccaggugcugcugugacaauuauagaaugugauaugaacguagaauuugcaccaccuuuaggguauaaagagccaaauucugaacaggaggcuuuggaugaaucauccgaaagaucugaaaacuuaacaaaugaaggaaguggguucauuccauucuuuggugaaggauaucggcuugaugguaaacagaagaaagcuaucgaagaugagaguguaggauuuaaaauaccuacugugagagggauuccugauuaugacuggaaaguuggugugauuaccuuuaugagaaauguacgccaaccuguaaaggaagcccagaaagaugaugaagauaaauuccaaccuuuuuauggacaggggcauguauuaaguacaaaucgcaaccggaaauaa

SEQ ID NO: 6944 - RNA, 1629 nt, Euschistus heros
auggcugcauuuccaggaucuauugcauuugaugaguaugguagaccguuuauuauaaucaaagaccaagauaaacaaaaacguuuaaccggcaaugaugcuauuaagagccacauucuaucagcuaaagcaauuucaaaaauugucagaacuucacuggguccaaaagguuuggauaagcuccuuguaucacaagauggugauguuaugguaagcaaugauggagcuaccaucaugaagcaaauggauguggauaaugaaaucgcaaaauuaauggugcaacuuucacaaucucaggaugaugaaaucggugaugggacaacuggaguuguuguucuugcaggugcuuuauuagaacaagcugacauuuuacuggauaaaggaauucauccuaucaggauugcugauggguuugaauuagcugcuagagcugccauacaacauuuagauucaaucgccacaaaauuuccuguugauccuaacaauuuagagccccuuauaaagaccgcuaugacaacucuuggaucaaaaauuguuaacaaaugccaucgucaaauggcagaaauagcuguuaaagcgguauuaucaguggcugaucuugaaaaaagggauguuaacuuugaacugauaaaaguagacggcaaaguugguggaaggcuugaagauucgaugcucguaaaagggguaguaauugauaaggacuucucucauccacaaaugccaaagguauugaaggauguuaaaaucgcaauuuuaaccugcccauuugaaccacccaagccaaaaacaaagcauaaguuggacguaacuuccauugaugauuauagggcauugaggaaguacgaagaagagaaauucaacaccaugguuucucaagucaaagaugcuggugccacucuugcuauuugucaauggggauucgaugaugaagcuaaccaucuucuuuugaagagagaacuucccgcaguuagauggguuggugguccugaaaucgaguuaauugccauugcaacugguggacgcaucguaccccgauuugaagagcugaguccugagaaacuuggucgagcugggcuuguuagagaaauaucuuucgguaccaccaaggacaaaaugcuugugauugaagaaugugccaauucucguucugucacaaucuucaucagaggcucaaaccagaugauaaucgaugaggcuaagagaucaaugcaugaugcacucuguguugucagaaauuugauuugugaugacaguauuguauacggcggaggugcugcugaacuuucuugcuccauugccacugccaaacaagcagauaagauuucaucaauugaacaguaugcauuccgugcauuuucugaagcucuggaguccauuccuuuugcacucgcagagaauucuggcuuaccuccaaugcaaguuguaacacauguaagaggaaggcaaauucaagaaaacaacccagcucuugguguagauuguauggggaaaggaaccaaugauaugaaagagcagcauguuauugaaacacuaaaaagcaaaaaacaacaaauaaugcuugcuacacaguuagugaaaaugauacuuaaaauugaugaugucagaacaccuaaugauauucaguucuaa

SEQ ID NO: 6945 - RNA, 342 nt, Euschistus heros
auggcuucagcaauggacguugacgaugaagagaacgagguuccgaccuccaguaguggaaaaggugaaaaaaagagguucgaaguuaaaaaauggaaugcuguugcacugugggccugggacauaguuguugauaacugugcuauuugucgaaaccauauaauggauuuguguauugaaugccaagcaaaucaagccucugcuacaagcgaagaaugcacaguggccuggggaguuuguaaucaugcauuucauuuucauuguauaucgagaugguugaagacuaggcaaguuuguccacuagacaaccgugaaugggaguuucaaaaguauggacauuga

SEQ ID NO: 6946 - RNA, 1605 nt, Euschistus heros
auggugucuuuaaauccgauuagaauucuuaaacaugaagccgaagaagaaaagggugaaauggcuagauugucaaauuucauuggugcgauugcgguuggugauuuagugaaaaguacucuugguccgaaagguauggauaaaauucugguaucuuacggccgaaaucguggaaacauugaaguuaccaacgauggagcuacuauccugaaaucgguggguuuugacaaccccgcagcuaaaauccugguuaauaugucuaaaguacaagaugaugaagucggugacgguacaaccucaguaacaguucuggcugcugaacuucugcgagaagcugaaagauugaucgaaaggaaaauccauccccagaccaucauagguggauaucgccgugcaacuaauguugcucuagccgcauuagauaaaugugcuguugacaacaguagcaaugaugccgaguucgccgaagauuugcucaaaauagcucguacaucauuaaguuccaaaauuuugaauuuacauacugaaaaauucagcaaguuggcuguugaugcaguucuucgccuuaaaggaucaggaaauuuaagcgcgauacagaucauuaaaaaaacagguggcucauuggaugauucauuucuagaugauggcuuccuucuggacaaaaaaguuggccaguuucaaccuaaaagaguugaaaaugcuaaaauucuuauugcaaauacuccucuugauacugauaaaauuaaaguuuuugguucaagaauacgcguugacucuuuagccaagguggccgauuuggaguuggcugaaaaagaaaagaugaaagaaaaaauugauaggauuauaagucauaaauguaauguuuucgucaaccgucagcugaucuauaauuauccugaacaauuguuugcugaugcuggaauaauggcuauugagcaugcagauuuugaugguauugaacguuuagcccuuguuacaggaggugaaauaguuucuacguuugauacaccagaacuaguuaaauuaggagaaugugacuuaaucgaagaaaucaugaucggugaagacaaauuauugagguuuagcggggugaaguugggagaggcuugcaguauugucauuaggggagcaacacagcaaauugucgaugaagcggaacgaucuuuacaugaugcauuaugugugcucguuacuacuguuagggauaagaaaacaguuuuuggugguggcuguucggaaauaauuauggcuagugcuguaagugaugaugcuauuaauguaacuggcaaggaagcaguugcuauggaauccuuugcaaaggcauuguuggaguugccuaccacaauuucagacaacgguggcuuugauucugcauauuuaguuacagcauuaagagcagcacacaauaaaggucagauaacuuaugguuuggauaugaaaaaugguggaguagcuuguaugagagaacuuggaauugucgaaucccauucuguaaaacgccaaaugcuucuguccgcuucugaagccacagaagucaucuugagaguagaugauauucuuaaagcugcaccucgcaaacgaacagaagauagaggcuacugcuaa

SEQ ID NO: 6947 - RNA, 834 nt, Euschistus heros
auguuccgaaaucaauaugauucugauguuacgguauggagcccucaaggccgauuacaucagguugaauaugcuauggaagccgugaaacucggagcagcaacaguugguguaaagaauaaacaauuugcaguccuuguugcucuuaaaagagcaucuucugaacuuucagcucaccaaaaaaaaauuauuccucuugauaaucauauaggcaugagcauuucugguuuaacugcugaugcucguauauugagucggcaaaugagaagugaaugccuuucuuauucauauucuuauggaacugaaauacccauuaucaggcuuaugaauaaaauaucuaacaugaugcagaguucaacucagcgcuaugacagaagaccauaugguguuggucuacugguugcuggauaugauggagaugguccucauauuuuucaaauuugcccuucugcuaauuuauaugaaugccgcucaauggccaucggugcuagaucccaaagcgcaaggacauauuuggaaaagcaucugguagacaucucaaacucuccgacucugacagaccuucucaagcacgcacuucgugcucuuagagauucuucacccaaugauacagaacuuagcuccaagaacguagccauagcgguaguugggaaagauaccccgcucaaggaauuaucugaagccgauacccaaacuuaucuggacaugauccucagcgaggagagaagaagcggcgauacagguggagcuagugaugacgcuccuccuccucccccaccuuccgauccaccagcucaagauccuacuccaguuguugcuauggaaacacaauaa

SEQ ID NO: 6948 - RNA, 2538 nt, Euschistus heros
augccaauuuaccagcacaaaauagugauuaaugaagaagauuugccuuaugaagaggaaauuuuacgaaauccuuucucuauaaagcauugguuaagauauauagaauucaagaaggaugcccccaaaaauggggugaauauuauauaugaaagagcauuaaaagagcuuccuggaaguuauaaacuaugguacaauuauuuaauucuuagaaaaaggcagauuaaaggacggugcauuacugauccuucuuuugaacauuuaaauaauacauaugaacguucuuugguauuuaugaauaagaugccucgaauauggauggaauauugucaguuucuugucgaucaauguaaaauuacuaaagcacgacauguuuuugauagauccuuaagagcacugccuaucacccaacaucaccgcauuuggccuuuauauauaaaauucuuaaagaagcacaauauuccagaaacugcgguucguguguuucgaagauaucugaagcuuuguccugaagauacagaagaauacauugauuacuuaacugccaucagucgucuagaugaggcugcuguuagauuggcagauauuguaaauacugaugauuuuguuucaaaacauggaaaaucaaaucaucaauuauggacugaauuaugugauuuaauaucuaaaaauccucaagaaguuaggucucugaauguagaugcgauaauaagaagugguuugaaaaaauauacugaccaguuaggccacuuauggaauuccuuagcugauuauuauaucagaaguggacuuuuugaaaaggcaagggacauuuaugaagaagcgauacaaacuguuacuacugucagagauuuuacucagguuuuugaugcguacgcccaguuugaagaacuuucuuugagcaagaaaauggaagaaguaucucagaaggcuuuuccuacugaugaugaugauauagacauugaacuucgcuuagcaagguuugaagauuugauugagagaagauuauuacuucuaaauucaguucuguuacggcaaaauccucauaauguccaugaauggcugaaaaggguccaacuguuugaaggaaaaccacaugauauuauuuauacuuauacugaagcuguccaaacaguugauccaaaacuagcuguugguaagccacacaugcuguauguuaauuucgcuaaauucuaugaagagaauggccaaguagaagauucuagaauaguucuugaaaaaggaacacagguaccauacacuaaaguugaagaucucgcauccguuuggugugagugggcugaaauggaaauuagaaaugagaacugugaugaagcauuaaaaauucuucaaagagcaacagugaugccagcuaggaaaguugauuaucaugaugauucugaaacugugcaaaugagauuauauaaaucguugaagauauggucauuguaugcugauuuagaagaaaguuuuggaacauuuaaaucuuguaaaucaguuuaugacagaauaauugaucugaaaauugcuacaccucaaauuauuaucaacuauggccuuuucuuagaagaacacaauuauuuugaagaagcuuuuaggacuuaugaaaaggggauugcuuuguucaaauggccaaauguauuugauguguggaauacauauuuaacuaaauuuuugaagcguuaugggggaaguaagcuugaaagaacaagagaucuauuugaacaauguuuagaaaauugcccuccaaaauaugcaaaagguuucuaccuguuauaugcaaaauuagaagaagaacauggauuagcaaggcaugcaauggcaguuuaugaaagagcuacuucugcuguuuugccagaagaaauguuugagguuuucaacauuuauauuaaaaaagcugcugaaauuuaugggguucccaaaacucgucagauuuaugaaaaggcuaucgaaguguugggugaagauaauucaagagaaaugugucuuagauuugcugagauggaaacuaaauuaggagaaauugaucgagccagggcaauuuaugcacauuguagccaaaugugugauccuagagucacuaguacauuuuggcaaacauggaaagauuuugaagugcgucaugguaaugaagauacaaugagagaaaugcuacgaaucaaaagaaguguucaagcuacuuauaacacacaggucaauaugaugucagcacagauguuaucugcugcaaguaacguuucugggacaguugcugaccuugcgccuggugcuaaggauggaaugcgaauguuagaagcaaaagcagcugaaaugacuguaacuacaaaaucugguucaucagccaucauguuuguuaggggugaaacccaaaacaccccucaagaaguacagaaagaaauaauuaacccugaggcuuugaauguugacucagaugaugaugaugaugaaaacuuggaagaugaugaucugccuauagaaaaacagauuauuccagaugaaguauuuuguggucuaaagaaaggaagugauucugacuga

SEQ ID NO: 6949 - RNA, 990 nt, Euschistus heros
auggccgcuggaccuauugccgaaaggaaucaagaugccacgauauauguugguggacuggaugacaaaguuacugaaacucuuaugugggaguuauucguucaagccgguccagucgucaauguucauaugccaaaagacagaguaacacaacagcaucaaggauaugguuuuguugaguuuuugggugaagaagaugcugauuaugcuauaaaaauuaugaacaugauaaaaguucaugggaaaccuauucgugugaauaaggcuucagcucaucagaaaaacuuggauguuggagcuaauguguucauugguaaucuggauccugagguugaugaaaaauuauuguaugacacauuuucagccuuuggaguaauucugcagacaccaaagauuaugagagauccugauacagggaauucgaaagguuuugcauucaucaauuaugcuuccuuugaugcaucagaugcugcuauugaugcuaugaauggucaguuucucugcaaucgcccuguuucuguuuccuaugcuuacaaaaaagaugcuaaaggugaacgacauggaucggcagcugaacgucuccuagccgcacaaaauccauuaucacaagccgauaggccccaucauauguucgccgaugcucccccugcaccucucccaccuccuccaguccugccuccaccuccugucuucaauccuccaccgccuccccauaugccgccuccuccauugccaccccaaaggaugguugcuccuaugccuccaccuccaccugggccuccuccaccaaugccuccuggaaugaugccguggccaccgaugcagccccacuuucccccuccucccccaccuccaccuacaaacaaagcuccuccucuuccuccuccacccccuccucaagcuuggcguccuccaccaccuccauacaaucgaccaccguuuccuccaccaccuccaccuccagucagaccuccgccaccaauguucuaa

SEQ ID NO: 6950 - RNA, 777 nt, Euschistus heros
augggucgaguuauuagagcucagaggaagggagcugggagcgucuuuagaucccacacaaaacaccguaaaggugccccuaaacugaggucauuagauuuugcugaaaggcaugguuacaucaaagguguugugaaagacauuauccaugacccugguagaggagcuccuuuagcaguugugcauuucagagauccuuacagguuuaagacucguaaagaacuuuucauugcuccugaaggaauauacacuggucaguucuuguacugcggaaagaaagcuaacuuacacguuggcaauguuaugcccguuggugguaugccugaagguaccaucaucuguaacuuagaagaaaaaaccggagacaggggucguuuagcuagagccucaggaaauuaugcuauuguuaucgcccauaauccugauucaagaaggacaaggguuaagcuuccaucaggcgcaaagaaaguuauccccuccaauaacagggccaugguugguaucguugcuggagguggucguaucgacaagccaguccuuaaagcuggucgugcguacuauaaauauaaggcaaagagaaacugcuggccuaagguuagggguguugcuaugaacccagucgagcauccccacgguggugguaaucaccagcauauugguaaagcuuccacugucaagagaggaacuucagccgguagaaagguuggucuuauugcugccagacguacugguaggauucguggugguaagacugaccagaagaagggagaagauuaa

SEQ ID NO: 6951 - RNA, 411 nt, Euschistus heros
auggcccguacuaagcagaccgcuaggaaaucgacaggaggcaaagcuccgaggaagcagcuggccaccaaagcugccaggaagagcgcuccggcgacuggaggagucaagaaaccucacagauacaggcccgguaccgucgcucucagagaaauuagaagguaccagaagaguaccgaguugcucauuaggaaacucccguuccagagguuggugagggagaucgcccaggacuucaagacagaccugagguuccagagcucggccgucauggcccuccaggaggcuagcgaagccuaccucguaggucucuucgaggauaccaacuugugcgcaauucacgccaagagggucaccaucaugccaaaggauauccaguuggcucgccguauccgcggagaacgagcuuaa

SEQ ID NO: 6952 - RNA, 1596 nt, Euschistus heros
auggcggcaauuacuuuauugaauccuaaagcagaaguuguuagaaaaacagaggcauugucuaugaaccaaagugcagcuaaagguuugcaagaugucaugaagacuaaucucgguccacgaggcaccaugaaaauguuaguuucuggugcuggugacauuaaaauaacuaaagacggcaaugucuuguugaaggaaaugcaaauucaacacccuaccgcuucgcucauagcuagaacuucuacagcuauggaugacauaaccggcgauggcacuacuucaacagucuugcuuauugcagaauuauugaagaaggccgacaguuauauuauugaagguguucauccuagguuaauaacugaagguuucacuguagcuuguaaacaugccauggaaguuuuggauaaaaugaagaaaacaguaagucuugaugauaaggagacucuucuuucuguugcaagaacggcgcuuaauacaaaaguugaaucuaaaguggcagagguauuaacucagauuuguguugaggcugugcaagcaauuaaauugccugaaaaaccucuugauuugcauaugguagaaauuaugacaaugcaaagccggcuugaaucugaaacuaggcugguuagagggcucgucuuagaucauggcucacgucacccuaauaugcccaagaaacucacuaaugcuuuuauucugacauguaauguuagucuugaauuugaaaaaacugaaauaaauagcggauuuuucuacaaaucugcagaggaaagggaaaagcuuguggcaucugaaagagaguuuauugaguuaagagucaagaaaauuauagcuuugaagaaaucuguaugugauggaacugacaaaggauuuguugucauuaaucaaaaagggauugacccugucucuuuagauuuacuggccagagaagguauaauggcucuuaggcgagcuaaaagaaggaauauggagagacuaacuuuagcuuguggugguguagcaaugaauagucucgaugaucucacagaagaaugucuaggucgagcaggucucguauaugaacauguacuuggugaaacuaaguauacauuuguuacugauuguccaaauccacauagcguuacuguacuuguucauggcccuacuucauaugccauuacucaaauccaagaugcgcuucgagaugguuugagagcuguuaaaaaugcaguugaagauggugguguccuuccugguggaggagcaguugaauuaaaaauacgucaugaauugaagaaaguugcugagaccacuaaagaaaaguaccguguuggaauugaggccuucugugaugcucuccugauuauucccaaaacucucgcaaugaacaguggauuuaauacccaagaaguuauuacacaacuugauuaugaugcaaaagagaacgauucaauuggauuggaccuucaaaguggaaagucaaugaucccuacugaucuaggaauccuagauaacuauucggucaaaaaacaguauauagcuucaaguaucauuguugcuagcaaucuucuccuuguggaugaaguuaugagagcaggaaugucaucuuuaaaaggauaa

SEQ ID NO: 6953 - RNA, 3144 nt, Euschistus heros
augucuagugcugaaguggccaacaauuccauagaaccuccagccaagaagcggaaaauugcuacaggagagacagcuccagcgaacuccguuucaaaggcaauaucagccauggcgaauaauggaucuuuugauuccaaucaagaaauugaugagggacuuuacucucgccaauuguauguuuuaggacaugaugcuaugcgacggauggcaucgucugauguucuuauuucagguuuaggaggacuugguguagaaguagcuaaaaaugucauauuaggugguguuaagucuguuacauuacaugaugaaacuuuaugcacuauuucagaucugucuucucaauuuuauuuauccgaaaauucuauugguuuaaaucgugcagaagcuucuugccaguuacuuucugaacuuaaccauuauguuccaacaagagcuuacacuggcccucugacagaugaguuuauuaaagaauuuaguguuguaguuuuaacuaaugcuucagaagaugaaaaauuaaggauuucugaaauagcucaugcaucugacguuucguugauuauagcaucaacuguggguguauuugcucaaguauucugugauuuuggccgagaauucacuguaguugacacuaauggugaaaauccuguuucugcuaugauagcaagcauuucucgagaugaagaagguguaauugcuuguuuagaugauacuaggcauggucuugaagauggugauuaugucacauuuucugaaauucagggaaugacugaguugaaugguugugagccaaccaaaaucaaagugcuuggaccuuauacauuuaguauugguaauacuucuaaguuuggagaauauauccgagguggaauaguucaacaaguaaaaaugcccaaaguuuugcaauucaagucauauucagaagcucucaaggcuccugacuuuauagcaacagauuuuggaaaauuugaccacccagaucaacuucauguggcauuuaaagcucuagaugcuuacaagaaagaauuuggcaaguuaccuucaccauggaacagcaaggaugcuucugauuuucugaacuguuguaagacuguaaugccugauguaagagaaaaucuagaauuaaaugaaaaacuuauggagcaauuuuccaaaacuuguucuggaaauaugaauccuauugaugcauucauuggugguguuguugcccaagaagugaugaaagcuuguaguggaaaguuucauccaauuuuccaguggcuauauuuugauugcauugaauuauugccaaaagaagauuuaaguccuaaugauugugcacccaccaauucucgauaugauggacaaguugcuauuuuuggaaaagaguuucagaaaacuuuaggcgcucucaaauauuuuguuguaggugcuggagccauugggugugaacuucucaagaauuuuucaaugaugggaguaggagcagauggugguaaaguaauuguaacagauauggaucuuauugaaaaaucuaaccuuaacaggcaauuuuuauuuagaccucaugauguacagaaaccuaagucagcuacugcugcuaaagcaauaaagaaaaugaacccauuaaugaaugugauugcucaugaaaauagaguuggcccugaaacugaaaaaguuuaugaugaugcguuuuuugaagauuuagaugguguugcuaaugcauuagauaacguugaugcgaggauauauauggaucgacguuguguuuauuauaggaaaccauugcuagaaucaggaacacuggguacuaaagguaauacacaaguugucguuccuuuccuuacugaauccuacagcucuucucaagauccaccugagaaaagcauuccuauauguacuuuaaagaauuuuccuaaugcgauugagcauacucuucagugggcuagagauguuuuugaaggucuguuucgccaaucugcugaaaaugcugcucuuuacuuaagugauucuaauuuuauugaucgagcauugcguuugccuggaguucagccuauggaaguguuagaaucuaucaaacaggcacuuauugaugacagacccaaaucaauagaugauugcguugcuugggcuagaaaucacuggcaagagcaauauuccaaucaaauucgccaacuucuuuucaauuucccaccugaucagaugacuacaaauggccaaccauucuggucaggucccaagagguguccaguaccuuuaguuuuugaugugaauaaugacuuacacuuggauuauauuauagcugcugcuaaucuuaaggcugaagucuacggaauaccucagguccgcgauagaaguguuaucgcuaaaauuguacagaauguagaaguuccagaauucacuccuaaaucaggaguuaaaauugcagucacugauucacagauggccaauggagcuggcgggcaaauagaucaagauaaaauuguucaguuauacaaugaacuuccuuccaaagaaauguucagugacuuuaauaucacaccucuggaauuugagaaagaugaugauaauaauuuucauauggauuucauuguugcugcaucaaaucugagagcugcgaauuauaacauaccuccagcugauagacauaaaaguaaauugauagcugguaagauuaucccagcaaucgcaacuacaaccucaguuguugcaggcuugguauguaucgaacuuaugaagcuagcuaagggcuauaaugauauagaaauguuuaagaauggcuuugcuaauuuggcacucccguucuuuggguucuccgagccaauaacagcuccuaaauugaaguauuaugagaaugaauggacauugugggaucgauuugaagucacaggagagaugacucucaaagaguuuauugauuacuucaaagauaaacaucaacuggaaauaaccauguugucucaagguguuuguaugcuguauucauucuuuauggcuaagaguaaauuagaagauaggcucaaucuuccuaugucugaagugguucgucgaguuuccaaaagaaaauuggaaccccacguuaaagcucugguguuugaacuuugcuguaaugacaccgauggcaaugauguugaaguaccuuauguaagguauacauuaccuuga

SEQ ID NO: 6954 - RNA, 1278 nt, Euschistus heros
auggcugauaaugaugauuuguuggauuacgaagaugaagagcagacagagcagccuauuguggaagggucaggagauacagcuccgcguaaagaugugaaaggagcuuauguaucuauacauaguucagguuuuagagauuuucuguuaaagccugaaauuuuaagagccauuguugauugugguuuugagcauccuucugaaguccaacaugagugcauuccucaagcaguucuuggcauggauauucuaugucaagccaagucugggauggguaaaacugcuguauuuguauuagcgacccuucagcagauggaguuaacugaaaaucaaguaacaguuuugguuaugugccauacuagggaauuagcuuuccaaauaagcaaagaauaugaacgauuuucaaaauauaugccaaauaucaagguugcuguauuuuuuggugguuuaccuauucagaaggaugaagaaguuuuaaaaaauaacuguccucauaucguaguugguacuccuggacgaauuuuagcuuuagugaagaauaaaaaacugaauuugaaaaaccuuaaacacuuuguguuagaugagugugacaagaugcuugagcaguuagacaugaggcgugauguucaagaaauuuuuaggaauaccccacauagcaagcaagucaugauguucagugccacucuaaguaaagauauuaggccaguuuguaagaaauucaugcaagauccaauggaaguuuauguagaugacgaagccaagcugacccugcauggccuucagcaacacuauguuaagcuuaaagaaaaugaaaaaaauaagaaacuguuugaucugcuugacaucuuagaauuuaaucagguggugauauuuguaaaaucaguucagagauguauggcuuuggcucaacuguuaugugaccaaaauuucccagcuguagcuauucauagagcuaugagucaagaagagagacuugccaaguaccaagaguucaaagauuuucagaagagaauucuuguugcuaccaaccuguuuggaagaggaauggauauugaaaggguuaacauuguauuuaacuaugauaugccagaagauucagauaccuaccuccaucgaguagcaagagcaggacguuuuggaacuaagggucuggcaauuacuuuugcuagugacgaggcagaugcuaaaguucugaauaauguucaggauagguuugauguuaauauuacugaguuaccugaugagauugaccuuucaucuuauauugauggacgauaa

SEQ ID NO: 6955 - RNA, 1464 nt, Euschistus heros
augccuguugaagcuaugcaaacugauguggagaugaaggugguugauucuccuuccuccgaagauccaguggcuucagcaguccaagaaauaagagaacacauacgacaguuagaaaaggcaguugcuaauaaggaaccccguuucauauuaagaguuuugcgucugcuaccuuccacacgucauaaacuuucagcuuuaguacuccgcaauguuaucucuucuuuuuauuuaaauaguccugaaaaagaugcuuuguuucuuuauauugaagaugcuauggauucagauaccacacaaaaaacaaaauugaucaaaaauucuaauacuccucucauaccagagauugaugcuuacauucauuuguugguacuugugagacugauugaugcugggaaggaaucagaggcugugaaguguucugaugcucuuauggcuaaaauaacugcucaaaaucgcaggaguuuagauuuaguggcugcuaaauguuauuuuuaccacucucgaguuuaugaacucacuaaccaguuggaaaaaauacgaggguuucugcaugcuaggcugagaacugcuacucucagaaaugauuuugaaggucaggcgguucuaauuaacuguuuauugagaaauuacuugcauuauaaacuguaugaccaagcugacaaguuaguauccaaaucaguauauccagaaucggcaaguaacaaugaaugggcuagauuccuuuauuauuuaggaagaauuaaagcagcacguuuagaauauucagaaucacacaaacaucuaguucaagcuuuaagaaaagcuccucaacaugcugcuguuggauuuaggcagacaguucaaaagcuugcugucacuguugacuugcuucuaggugacauuccagacaggcagaucuuuagacaagcaccucuucgucguucucuugcaccauaucuucaguuaacacaagcuguuagaacuggugauuuacaaagauuuggugaaguguuagaaauguuugggccucaguuucguucugaccauacauuuacauuaauucuucguuuaagacauaauguuauaaaaacagcaauaagauguauugguuuaucuuauucacgcauuacuccuaccagcauagcuucuaagcuuggguuagauucaccggaggaugcagaguucauuguugcuaaagcaauuagggaugguguuauugaagcaaccuuagauccugagcaugguuauaugcaaaguaaugaagucacagauauuuacagaacuagagaaccacaauuagcauaucaucagcguauaucauuuugucuugauuuacauaaccagagugugaaagcaaugagauacccuccuaaaucuuauggaaaagauuuagaaucagcugaagagcgucgagagcgggaacaacaggacuuagaguuagcuaaagaaauggcggaagaagaugaugauguguuuccuuga

SEQ ID NO: 6956 - RNA, 1761 nt, Euschistus heros
auggcuuuaaguacacccucaguaccuguuucugaaauuuugaagagcagugcugauucagaugagcccaagaagaaaucuagggaggacuggcguaaagccaaggaauuggaagaagcuagaaaggcugguacugcuccugcugcuguugaugaagaagguaaagauaucaacccucacauuccacaguacauuucuucagcaccuugguacuacagugcuagagguccuacauuaaaacaucagagaauacaagaugaaaguguuaaaaaauacucugguauugaugaaugguacaaacgaggaguugacaauucaaaagugguuacgaaauauagaaaaggggcaugugagaauuguggagcccucacccaucaaaaaaaggacuguauggaaaggccacgaaagauuggugccaaauuuacuggugcuaaaauugcacccgaugaauuuguucaaccugaacucucacgagauuaugauggcaaaagagaucgaugggcaggauaugauccaucacaacauaaaaugguuauugagagauaugccaggaucgaugaagcuaaaaggcaguugagggcagauaagcuuaauucugaacagucugaagaagccgaagaagaagaggcaaaagacaauaucgcugaugaaggaggugaagaugaggauaaauauguggacgaagucgauaugccugguacaaaaguagauucgaaacagagaauuacugugagaaaucucagaaucagagaagacacagccaaauauuugagaaaccuugaucccaauucugcauacuaugauccuaaaaccaggaguaugagggacaacccuuacgcuggaucugccgauacugauguggacuaugcuggagaaaacuuugugcguuucacuggugauacauuggagcaugcgagagugcaguuguuugcaugggaagcacacaacaaaggaguugauguucauccucuuggggaacccacuagguuggaaguacuuaagaaagaauucguuggaaagaaggaagaguucaagcaaagggggcaagaagaucucauuaaaaaguaugguggagaggaacaccugaaugccccacccaaagaacuuuuauuggcucagacugaauauuacgcugaauacacucguuauggaacugucauuaagggccaagagaaagaaguggugaggucuagauacgaggaagacgugcuuauaaacaaccauacuaccguauggggaucauucuggcauucuggaaaaugggguuuuaaaugcugccauucuuuuauuaaggggucauauugcacuggggaagcuggacgauuagcuucuucagcuggugagguugcugucaaagguccagcauucauuccuccgcggccugcaacaccaucugcaucauccucuucaucuucuucugcuucuucuucaucgucaucgucuucaucagaggaugaagaagagaaggagaggaagaagaagaagcaggaaaagaagaaagcaaagaagaagaagcaaaaaguaaagaaacucaugaacaagaacaagaaaccugaagaaaaaacugaagaagaacaacugaaagaugccuugaaaaaagaggaagaggcccagaaagagggcgagaggcuuaugaaauuggaugaucguaagagaccguacaacaguauguuugaagugcagaaaccuaccgaugucgaaauggaagcauauuauaugaagaagaagagggacgaggauccaauggccaacuucuuauaa

SEQ ID NO: 6957 - RNA, 627 nt, Euschistus heros
auggguauuucaagagaucauuaucauaaaagaaggaagacuggagguaagagaaaacccaucagaaagaagaggaaguaugaauuaggacgaccagcagccaacacuaaguugggucccaaaaggguucauuugguaagaaccagagguggaaauacuaaguuuagggccuugagguuggacuauggaaauuuuucaugggguucugaaugcuguaccagaaaaacucgucugauugaugucgucuauaacgcuucaaacaaugaacuuguacguaccaaaacccucgugaagaaugccauaguagugauugacgguaccccguucagacagugguaugaagcccacuaugcgcucccauugggaagaaagaagaaugccaaauugucugaagcggaggaagccguacuuuauaagaagaggucuaggaaaacagaaaauagguacaaggcaaggcagaaacucgccaagguugagccugcuuuggaagaacaguuccagacuggucguauucuugcauguuuagccagccgaccugggcaauguggacgagcugaugguuauauccucgaggggaaagagcuugaguucuauuugaggaaaauaaaagccaagaaaggaaaguag

SEQ ID NO: 6958 - RNA, 936 nt, Euschistus heros
auggaucgucuuuuacguuuaggggguggaaugccuggauuaagucaagcacaaccuccaucagaugccccaguuguagacacagcagaacaagucuacauuucuucucuggcccugcuuaagauguuaaaacauggaagagcugggguucccauggaaguuaugggacuuauguuaggagaauuuguugaugauuacacuguaagaguuauugauguguucgcuaugccacagacaggaacagguguuaguguugaagcuguggauccuguuuuccaagcuaaaauguuagacauguuaaaacaaacuggccgaccagaaauggugguuggaugguaccauucccauccaggauuugguuguugguuaucugguguugauaucaacacucagcaaagcuuugaagcucuuucagaaagagccguagcaguuguaguugauccaauccaaagugucaaagguaaaguuguuauagaugcuuucagauuaauuaaucccaacaugaugguucuuggucaagaaccacgacaaacuacuucuaauuuagggcaucuucagaagccuucuguucaggcguugauacacggauuaaaucgccauuacuauucuaucagcauuaacuacaggaaaaacgaauuggagcaaaaaauguuguugaacuuacauaagaagucauggauggauggucugaugcucuccgauuauucugaaaauuguaaaguaaaugaaacuacaguuggugauaugcuugaauuagcuaagaauuacaacaaggcauuggaagaagaagaaaaaaugacgccugaacaacuugcuauuaagaauguuggaaaacaagacccuaagaggcauuuggaggagaaagucgauguacuaaugucagccaauauagugcagugucuuggugcuaugcuagauacuguuguguucaaauga

SEQ ID NO: 6959 - RNA, 1290 nt, Euschistus heros
auggauucguuuuuaaaaacaguugguuguuacauccaucguccucaucaugacaaagaaguucuuguucauggaaaagcaaauauucuggagcaaauggauguggaugagaaaaagggggaggguuuucguucuuauuacaucacuaaaauugaagagcuucaguugauaguugcagagaaaagucaaaaccuuaggaggcuccaagcacaaaggaaugaacuuaaugccaaaguaaggauguuaagagaagaauugcaacuacuucaagaacaaggcucuuauguuggugaaguugugaaacccauggacaaaaagaaaguguuaguuaaagugcacccagaaggaaaguuuguuguugauaucgauaaaaauauugauauuaaugaugugacuccuaauucaaggguggcccuucgaaaugagagcuauacucugcacaaaauucuacccaacaaggucgauccuuugguaucauugaugaugguugagaaaguuccugacucgacguacgaaaugguuggaggucuugauaagcagauuaaggaaauuaaagaaguaauugaacuucccguaaaacaucccgagcuauuugaugcguuagggauagcucaacccaagggaguauugcuauauggaccuccuggaacagguaaaacacuucuagcgagggcaguugcccaucacacugaaugcacauucauucgugugucagguucugagcugguacagaaauuuauuggugaagggucaaggaugguuagagaacucuucgucauggccagggaacaugcuccauccaucauauuuauggaugaaauugauucaauagguuccucaagaauugagucaggcagugguggagauucugaaguccaaagaacaaugcuggaguuauugaaccaauuggaugguuuugaagccaccaaaaauauuaaggucauuauggcaacuaacaggauugauauucuggacccagcucuucuacgcccuggaaggauagaucguaagaucgaguuucccccaccaaaugaggaagcucguuuagauauccuuagaauucauucucguaaaaugaaucuuaccagaggcaucaacuuacgaaaaaucgcugagcucaugccuggagcuucgggugcugaaguuaagggugucugcacugaagcaggaauguaugcucugcgagagaggaggauccacgucacccaagaagauuucgaaauggcugucgccaagguaaugcagaaagauucagagaagaauaugucuaucaagaaauuauggaaauaa

SEQ ID NO: 6960 - RNA, 603 nt, Euschistus heros
augguuaaguuguaugcccuucauauuuuauacaaaaauuuaaauagugcaguaugguugaaaacagcuuaugauguucaaaguuuuggguauuuucaaagaggaacugcccaggacacuauggcuuuugccaguaaaacgauaguugaaaggacucaaucugcaaccaggcaaucugucaaagaaggagauuauauaugucauguguaugugagagcugacaauuuagcugggguuguaauaucuaaucaugaauacccucaucgaguggcucauacucuuauaacuaaaguguuagaugaauuuagugcaaaguauccaccuucaacuugggcgucugcuaaugaagccaacauugauuuuccggcauuggcagcucaccuucagaaguuucaaaauccuaaggaagcugaugcuuuaaugaagauucaaagugagcuggaugaaacuaaaaucauucuucacaacaccauuggagcuguuuuagaacguggcgagaaauuagaugaucucauuaugaaaucugaaagucucaguuaucagucuaaagcauucuacaaaacugcuaggaaaacaaauucgugcuguuccuauguugguuaa

SEQ ID NO: 6961 - RNA, 750 nt, Euschistus heros
auguuucucacacguucagaguacgacagaggggugaauacuuucucucccgagggaagauuguuucaaguggaguaugcuauagaagcuauuaaguuagguuccacggcuauagguguuuguaccccggaaggaguugucaugggagcugaaaaaagaaucaagucaccuuuaauggaaccagaagcaguggaaaagauccuucaaguugaugaucauauugguugugcuguaagugguuugauggcugauuccagaaccuuaguugagcaugcuagaguccaaugccuaaaucauugguuuguauaugaugaaaagaugccaauagagucugcugcucaggcugucuccaauuuagcuaucagauuuggcgaugcugaugaagaugcugguccugcuaugagcaggccuuuuggaguugcugucauguuuggaggauaugacuacagaggaccucagcuguaucauauggauccaucaggcacauuuauuuauuuugacgcuaaagcuaucggcucuggaagugagggagcacaacaaagacuccaagaauuguaucauaaaggaaugagccuuaaggaggcuauccagaugauucugaccauccuaaaagagguaauggaagaaaaguuaacugauaacaauguagaaauagcaguaguaacugcagaagagaaacaguuucgcauguauaccaaggaagagguuucuaaaguaauaggagaaacacaaucggccccaacuucauaa

SEQ ID NO: 6962 - RNA, 1167 nt, Euschistus heros
augagugaauauuggcuuauaucagcaccuggcgauaaaacaugccaacagacaugggaaacaaugaauaauuuaaccaguaaacagcacaauuugucugaaaauuucaaauuccauauuccggauuuaaagguagggacuuuggaccagcuuguuggacuuucagaugauuuagggaaacuugacaauuucgucgaucagguuacucacaaaguggcccaauaucuuggagaaguauuagaagaucaaaaagauaaauuacaggaaaauuugauggcuaauaacacugauuuaucuacuuacauuacaaaguuucagugggauauggcuaaauauccuauaaagcagucacuucguaacauugcugauaucauaagcaaacaaguuaaccaaauagaugcagaucuaaagacgaaaucuacugcuuauaauaauuugaaaagcagccuucaaaauauggaaaagaaacaaagugcaaguuuguugacccgaaacuuagcagaucugguuaaaaaggaacauuuuauuuuagacucugaauauuugacuacauuacuaguuguuguucccaagucaaacuuuaaugauuggaauuccaguuaugaaaaacugacuaauaugauuguuccucguucuagucaacuuguuuaucaagauucugauuuugguuuguucacuguaucauuguucaagaagguuguaaaugauuuuaaacuaauggcaagagaaaagaaauuuguuguacgugauuuuauuuacaaugaagaagaguuagcugcuggaaaaaaugaaauuacaaaauuggugacugauaagaagaagcaguuuggaccucuuguacguugguugaagguuaauuuuagugagugcuuuugugcuuggauucauguaaaagcauugaggguuuuuguugaaucugucuugagauaugguuuaccaguaaauuuccaggcuauguugauucauccucauaaaaagucuguuaaacguuugagagauuuacugaaucaacuauaugcgccuuuggauaguagugcccagcagcaaggagggcaagguggugguaacgauaguguggacauuccugguuuaggauuuggccagucagauuauuauccuuauguguauuauaaaauaaauauugauauguuagauacaaaagcuuaa

SEQ ID NO: 6963 - RNA, 1650 nt, Euschistus heros
augucaacuuuagguguuccauuaucuguuggggguacaagaaccucgggagcuccugucagaacucaaaauguuauggcagcaugcuccaucgcaaacauugucaaaaguuccuuggggccucuuggguuggacaagauguugguggacgauauuggggauguuacuguuacuaacgauggagcaacuauucuaagacugcuugaaguagaucauccugcugcaaggguucuugucgauuuagcucaacuucaagaugaggagauuggugauggaacaacuucugugguaaucauugcagcagaacuucugaggaaugcugaugaauuagucaaacagaauauccacccaacuucuauuauuagugguuaucgacuugccugcaaggaggcucagaaguauauccaagaacacuuaugugucaguguugaugaauugggaaaagauucuaucaucaauauugcaaagacauccuuguccagcaaaguuauuggaauugaugaugacuucuucgcaucgaugguuguugaagcugcacaggcuguuaaagucagcgauagcaaaggaaaagcuacuuaucccauuaaagccaucaacauccuuaaagcccaugguggaucagcaaaagaaagcauauugguuaauggauaugcccucaacugcacagucgccucaaugggaaugauuaaacgaguagaaaaugcuaaaauugcuugccuugacuucucuuuacaaaaaaccaaaaugaaauuagguguugaaguccugguagaagacccgaaucaguuagaagcuauuagagauagggaagccgauauaacaaaagauaggauacagaaaauucucagugucggcaccaauguaguucuuuugagcggaggcaucgaugacauuuacaugaaauacuucguggaagccaaugcaaugguuguaaggagggugaaaaaagcagacuugaaacgaaucgcuaaagcaacuggugccuccuuugcaacaucccuaacuaauauggaaggcgaagaagcauuugaugcuaguuuguuaggugaggcugcugaaguaucacaagaaagaauaugugaugaugagcuuauucuugucaaaaguccaaaagcacauucagcugcuuccauaauccuccguggaccaaaugacuauuucugugacgaaauggaacguucaauucaugauucacugugugcagucaaacgaguucuugaaaguaaaacaguuguggccgguggcggagcugucgaagcugcuuuaucgaucuacuuagaaaacuuugcuacuuccuuaaguucacgggaacaguuggcgauugcugaguaugcuaaaucacuuuuaguaauuccaaaaauccuugcugucaaugcagcucucgauucgacugauuuaguugcuaagcugagggccuaccacaacacuagccagacaaagaaggaucacgcacauuugaaauggcauggacuugauuuguauggaggugcugugagggacaacaagaaggcuggcguccuugaaccaacuauuucaaaaauuaaguccuugaaauucgccaccgaggcugcaaucacgauacuccgaauagaugaucucauucgccuggaagcugagaaaaaagaucagggccacggagauaugcacuaa

SEQ ID NO: 6964 - RNA, 777 nt, Euschistus heros
auguugaauauagcugaugccucaauggcuuuugagcacaguucucucagaaguaauaauaacacacuugaugaucaucaaguaaaaauuauuaaagcuccggauuuuuuaacuagaacuuuauauccuaugacaacuacagcuucugugguuggaaucaaauuuaguaauggcguagcuauugcugcagauguugguggauauuacggaucauugaaucguuuuaaaucucuugauagguuguacaaaguuaauaacaacauuguaaugacaacaacuggugauuaugcugauuuucaguacaugagagaauuaauacaacaaaaaguuauuagugaagagauucuagaugacaguuucuccuuaaaagcuucuucucuucauacuuggcuuacucgccugauguacaauaggaggucaaaauuugaucccuuauggaacaauguuauuguugcuggauaugauagcaauggacccuuuuugggaauuguggauaaauuagguaugaguuaugaagacaguuguguagcgacagguauggguggauaucuagcuacaccucuuuugagggaugugcaugaacgaaguaaaggaaauuugacuaaacaagaagcccaugcagcucuucagaaguguauggaaauuuuauacuauagagauacucagucacuucccaaguuccaaauugcaacagucacugaagaagguguugaaauuucaccugaaauagaacuagaaggaaauugggaaaucguaaaacauucaaagggauuuuga

SEQ ID NO: 6965 - RNA, 1881 nt, Euschistus heros
augcaguuuauugaaacugcaagagaaaucucccaucuugaaggugaaauguaucaguuaucccaucuguuaucugagcaacgugcacuucucgguucaaugaguaauucaggcgcugaaccuguucuucaagcugguggaagcaaagcccaagaagaaaaaagaauugcagcuuuaucgacuguuuuagaagucauagaaucuuguccggaucuucucgacacuccugguagggaacuuuugcaugaaggugaccuuguggaacuagauccucuugaaaauacagcucuucaucgaacccgugccuuacucuuuucugauauguuuaugaucgcuaccuggauguccgaaaggaaaggacuugccaaguauaaguuugaaagcaauuaugaucuggguagccuagcuguuguaaaugugagggaucuuggucagguuaaacaugcuuuuaaacuucuaguuuuuccugauaccagacuuuuucaaugugugaauaaugaagccagggaggaaugguugaaaaaauuugaugaagcuaagaaagcuagauugaauacagaucagaccaaaaaaaaagaugaaaaugaaaaagaaucucauccuguucaugaacauuugacuaaacccccugauagaacugacucggucgaauuuggaucuaacccauucggguuuguacuggaugaugauggagacagugacgcucugccugaaugguugacugaagcagcugaugaucuugauguauccauugcucagaggcauuuugaagaagcuuaugcaaucauacaaaaagccgaggaguacuuugcaucugcgcaagaugaucagucacuggccgauauaaaguccaaaguggaaaacagaaaagauguauugauaagcguucuucuaucagaguugaaugucagugcugagaaaucauuacaaggaggucuucgagcuagccgaagagcuguuagacuccuuaaccaacuuaacaagucaacccaagcaugugaacuauaucugaaaguuuguacgaaccuacuaaaagcccaaaguaaacgagugaagcgagaaggugcaacaguggcauaugucaagagauuaucugaaguauauuuuucaaaucuagcaucuauaacuuccgaauuucaauaucgugcauuuccucauaaucaagauuguaccucagcuuuuguuguauggguaucaauggaagucucacauuuucuaucacauaucauaaaacaaguauuuauuccucagacaccucucgguacgcuggcugagugcauagacauuauucggaaacagucucaacagaugugcgagcuuggacuugaucucagcuaucaaguuaauggucaaacgaugacugcaguuacacgugcuguagcagaagcuggagagaaagcugucgaugcuguuaaggugagagcugcugaggacccauggagaccaucgaggcagacacagcaaucagucaauaaaauucagucagaaauagggcucccuguuacggaauaucucgcagaugauggggucuuugagcugacugcaaacagccuuucuuuugccaaguuguuguccuccuugacggaugaaggucucaugauauccugucaggauuuggaguuugcacuuggaaaagcucugaaagaaguacuucaggcacacuugaaucaucuuucagccuccuacucuagcaauaaauuuaauucucagagaagucugauacagcaaaacgcaaaguuuauucuugaccagcuauuggaaucagugcagaggaaauauaaugaaaaaaugggccauagguguaagaaauuggauacauuaaggaaagaauuuaauuuuauuuugaaggagaguaaaacaacaaucacugguuacauuuag

SEQ ID NO: 6966 - RNA, 1248 nt, Euschistus heros
cucauuauucuaccaguuuauucugcucuacccagcgaaaugcagacuagaauauuugaggcagcuccaccuggcucgagaaaggugguaaucgcaacuaauauagccgaaacaucucuuacuauccaugguauauucuauguuguugauccaggauucguuaaacagaaaguguacaauucaaagacaggaauggauucucuuguuguuacuccuauuucacaggcucaagcaaagcaaagagcagguagagccgguagaacaggaccagggaaauguuaucgacuauacaccgagcgugccuacagggaugaaauguuaccuacucccguuccugaaauccaaagaacaaacuuagccacuacugugcuacagcugaagacaaugggcauuaaugaucuccuucauuuugauuuuauggacgcuccgccaguugaaaguuuaauaauggcucuugaacaacuucacagucucagcgcucuugacgaugaaggacuccuuacaagacuaggaagaaggauggcggaauuuccuuuagaacccaauuuaucaaaaauguuaauuaugucuguacaucuccagugcucggacgagauacuuacuguggucucgaugcuuucuguccaaaacguauuuuauagaccaaaagauaaacaagcccuugccgaucagaagaaggcgaaauucaaccaagccgaaggagaucaucuaacacuccuugcuguuuauaauucauggaaaaauaauaaauucaguaaugccugguguuaugaaaauuuuguucagauuaggacgcugaagagagcccaagauguuaggaaacaguuguuaggaauaauggacaggcacaaauuagauguuguaucagcugguaaaaauacagugcguguucagaaagcugugugcucugguuucuucagaaaugcugcgaagaaagauccucaagaagguuauaggacacuaguugacagucaaguuguuuauauucacccgagcagugcucucuuuaaccgacaaccagaaugggucauuuaccaugaacuuguucaaacaacgaaagaauacaugagggagguuacgacaauugauccaaaauggcuggucgaguucgcuccagcuuucuucaaguuuuccgacccgaccaaacuuagcaaauuuaagaagaaucaaaggcuugaacccuuguauaauaaauacgaagagccaaaugcauggagaauuucuagaguccgacgaagaagaaauuaa

SEQ ID NO: 6967 - RNA, 1248 nt, Euschistus heros
auggcaccuacaagaaaaacugaagggcuacuugcccguguaaacuuuccuuuauacacauugcaaaugcuaacuagucgucauguucuuguuggaggaggaggaggcucagccaaaacaggaguugcuaauggauuugaaauuuuugaguuaucuuaugaugggaaccguuuuucugcugaagaaguuauucgucaugaaacuggucccaaaguuguaaugaauucugcuuguuacagugacaaaaaaaguacauuuuuaguugcuggacaagaaagccacugucaguuauacagaguuggaauuacuguggagaaggaguuuuccgaagagccaaugaaugguguuguggaaucuccuaaccucaggcauagaaaaucuuccaaaaaucaccaaaaugguaucagugaaacaacaaaaaacucuuuaaggaagaaauuagcuuucaaauucaacucuggugacaguauacaaucugacuuuagugaaaaagaaccaugccaaaggguaguuacaauaucucguugugguaguuggauggcaacugguggcacugaugguauuguaagaaucuggacguucccuggccuucgauuaauuagagcucuaaaggcccauaccaaagagcuggaugauuuacauuucaguccugauucaaagcagguugccaguguggcgaaagaugggcaagccauuauuugggaaauaaaaucaggaaaacagguucauaaacucaauugggcucacccuacaggaauuaaauauauuuuuaaaagaugucgcuuuggaaugauugaggguaaaggaaguagacuauuuaccacuguuaauccuguggcugguggaaaggaagcccaagguuggauccacgccugggaugaaggccguaucucgaagucuacaucuguaucugaacccacuucagcacuugcuguuagagacgauggaguuuucuuagcuauugguacaauguucacaggaucaguauccauauacauagcauuuucucuucagagaguucugcauguugauggugcucauucaauguuuguuacugguguugaacuguugcccuguucaucuucauggggugcuauagaagcugcugcuuuaaguauuucuguugauaacagaguuuguauucauagcuuaccauucagaaaaacguuaccacccuggcuagugaucaucauuauuauguucacuuuaauguuuacuuuuauacuuugcaguugccucggccuuuaa

SEQ ID NO: 6968 - RNA, 1254 nt, Euschistus heros
auggcgggugcaauguuguuugagaggucugucucuuccagagauagagauaauagucgaauucuuccaacuucuggcagaagugucgacgacgacaaugaugaagaagagaucaagaauaaggaacaaggaauuuugcaguugggagagcaauauaagaaagaagguaaagcuaaagaguuagcugaacuuaucaaggcaaguagaccguuccuuagucaaauuagcaaagcuaaagcugcaaaauuggugcguucuuugguagauuauuucuuggaucuugaagcugguauaggaauagaaguucaacuuuguaaagaauguauagaaugggcgaaagaugaacacaggacuuuccuuaggcagucacuggaagcuaggcucauugcucuauauuuugacacaggaauguuuacagaagcucuacagcuuggcucaagucuccuuaaagaauugaagaaguuagaugauaaaaauuugcuuguagaaguacuuuuguuggaaucuaaaacuuaucaugcuuugagcaaucucucaaaagccagggcugcuuugacaucggccaggacaacugcaaauucaauuuauuguccacccaaaaugcaagcagcccuugauuugcaaucugguauacuucaugcugcagaugagcaagauuucaaaacugccuauucauacuuuuacgaagcuuuugaagguuaugauagcguugaaagcccaaaagcuuugguugcucuuaaauacaugcuuuugaguaaaauuauguugaacacaccagaagauguacaacaauuagucagcgguaaacucgcacuuaaacaugcagguaaugacaucgaugcuaugaaaucgguugcucgagcuagccauaagagaucccuugcugauuuucaacaaaccuuaaaaaaauacaagaaagaacuugaagaagauccuauuguucgagcacauuugggaacacuguaugacaauauguuagaacagaacuugugucggauaauugagcccuauuccagaguucagguugauuuuauuuccaaaucgauuaaacuuccucugccucaaguagaaaagaagcuuucucaaaugauucuugauaagaaguucaacggcauucuugaccaaggugacggaguucuaauaguguuugaagaugcaauuguugaaaaaaccuacgaaauggcgcuugaagucauuaacaguauggguaagguuguagacacuuuauaucaaaaagcuaagaagcuuucauaa

SEQ ID NO: 6969 - RNA, 1800 nt, Euschistus heros
auguccaccaaaucaccuaaaaagacuacuccagcuaguacaucaucagcaggccccucuagaaguucaccaagaaaaagugaaacuccaacaccucaaggggccagaaagagcccuuuaagcccuacaagauacagcagacuucaugaaaagcaagaacuugcuaauuugaaugaucgucuagcauguuacauugauagaguucgaaauuuagaaacugaaaauaaccggcuaacccgcgaaguuaaaaguucucaagaaaauaucaccagagaaguuacuaguguuaaaucuuuguaugaaagugaguuaucagaagcaagaaaauugcuagacgaauuaucgcgggaaaaaacaaaacuccaaauugauacacgaagauuauauacagaaaaugaagaacuuaaaacugagcuugaaaagaagacuaaggacugcaacauucuccagacuucacuuucagucagugaaaacagacuggcugaucucacaacaaaauauaaucaacugcaaggugaaaggaagaagcuugcagaagaaaacaaggcauuggaaacagaaagaaauaaacuugcugcccaguuaucagauacgagaaaacuuuuagaggaagaaacccuccagagaguagaucuugaaaaugcuguacaaacuuuacgugaagauuuuucauucaaggaacaguuacaugaacagcaguuauuggaaacucguaccaaaaagcaaguggaaauuagugaacuugaugguagauuaagccaagaguaugaagaaagauuguaccaaagucuucaagaaauacgugaucaguaugaaugugauuuagagaauaacaaggaagaaauaaaaaaauuauaugaggaaaaaauucgcagucuuggaagucaauugacacggaacagcaaugcugcagcaauggcuauugaagaaaugaaaaauaugcaagcuaaacugaaugagcuuaauaggaaauugcuugacuuagaagcagauagaaauacagcccagcaaaaggcuagagauuuggaaaaaaucuuagaacaagcuaaagcccaauacauggaagaauauagucagagggaagcugaaauaacaacucuucgugaagaaauggcucaucaaguucaagaauaucaagauuuaauggauauuaaaguagcauuagauuuagaaauagcagcuuaucgaaaguugcuugaaggagaagaagcuagguuaaauauaacaccugucaguucuccugcacagacuucuucucgcaaagucuuagguagaaaaaggaaacguacuuucauugaggaaucugaugaaacagauguuucaaauuacucuguuacuucuucaucgaagugugauguugcaaucucagaaguguguagugaaggacaauucauuaaacuucugaauaaaucaaauaaggagguaucacuuggugguuggcaacuagcucguaaagcuggagaagcuucuaccaauuacaaguuucaccgaaauauuaaaauggaaccuggugcuacuguuacaauauggucuucagaugucccagacagaucucaugaacccccagaaaaucugcuuaugaagggucagcgcuggaugguugcugauacuaugacaacaguuuugucaaauccugcaggggaagagauggcuauaucagaacacaaaaaacaacugcugagugacagaacaucaucaagacaaagagaagguaguuuuuaucaaaagagaacauuuuuaucaucuuccaugcguccuccuagugaaacuccuggugaagaaaggugugugauuugguaa

SEQ ID NO: 6970 - RNA, 2409 nt, Euschistus heros
auggcugauauuaaaaguaaugaagauuuguccacugcuauccuaaaaaagaaagaucgaccaaauagauuaauuguugaagaugcugucaaugaugauaauucgguuguugcucuuucucaggcuaagauggaugaacuucaauuguuucguggagacacuguacagcuuaaaggaaaacgaaggaaagaaacuguuuguauaguauuaucugaugaaaccugcccugaugaaaagauuaggaugaaucgaguuguaagaaauaaucuacgaguucgguuaucagauauuguuucaauucaagcuuguccugauguuaaauauggaaaaagaauucauguuuuaccaauagaugacacuguugaaggguugacugggaaucuguuugaaguguuucuuaaaccauauuuucuggaagcauaucgucccauucauaaagaugauacauuuguugucagaggugguaugcgugcuguagaauuuaaaguuguagaaacagacccugcucccuauuguauuguagcaccagauacaaucauucauugcgaggguaaucauaucaaaagagaggaggaggaagaagcuuuaaaugcuguuggauaugaugauauuggagguuguagaaaacagcuugcccagauuaaagaaaugguugaacuuccuuugagacauccuagcuuauucaaagcuauugguguuaaaccuccucguggaauccuacuuuauggaccaccuggaacugguaaaacuuuaauagcucgagcuguggccaaugaaacuggugcauuuuucuuuuuaauuaauggcccagaaauaaugaguaaauuagcuggugaaucugaaaguaaccugcguaaagcauuugagcaagcugaaaaacaugcuccuuccaucauuuuuauugaugaauuggaugccauugcuccaaaacgagacaagacccauggagaaguagaacgaagaauugucucacaauugcuuacuuugauggauggucuuaaacaaaauucucauauaauuguuauggcugccaccaacagaccuaauucaauugaugcugcucuuagacguuuuggacgauuugaucgugaaaucgauauugguauuccagauacuacuggacguuuagaaguacuccgcauucacacuaaaaauaugaaacuagcugaugaugucaauuuagaacagauugcugcugaaacacauggucauguuggugcagauuuagcgucucucuguucagaagcagcucuucaacagauccgugaaaaaauggaucuuauugauuuagaggaagaccaaauugaugcugaaguucucaauucacuagcuguuaccauggauaacuucagguaugcuaugggcaaaagcagucccagugcccuucgugaaacagugguugaaguuccuaauauuacuugggaugauauuggugguuuggauaauguuaaaaaggaguuacaagaauugguucaguauccaguggaacauccagaaaaguuccugaaauuuggaaugcagccgucccgugguguucuauucuauggaccaccugguugugguaagacuuuguuggcuaaagcuauugcuaaugaaugucaggcaaauuucaucucaguaaaggguccagaauuauuaacuaugugguuuggagagucugaagcuaauguccgugauauuuuugauaaggcuagagcagcugcaccuuguguucuauuuuuugaugaacuggauucaauugcuaaaucaagaggggggaguguuggggaugcuggaggugcagcugauagaguuauuaaccaaauccuuacagaaauggaugguaugggagccaagaaaaauguuuuuauuauaggugcuacaaauagaccagacauaauugauccugcuauccugagaccuggucguuuagaucagcugauuuauauaccuuuaccugacgagaaguccagagaagcuauuuucagagcaaacuuaaggaagucaccuguugcaaaggauguugauuuacaauauauugccaaagucacauuugguuacucuggugcugaucuuacugagguaugucaaagagcauguaaacucgcuaucagacagucaauugaagcugaaauuaaaagagaaaaaaguagauuagauggagccacacgaauggagauggaugaugaagauccuguuccugaaauaacccgugaacauuuugaagaggcaaugaggaaugcuaggcguucggucacugauaaugauauucgcaaguaugaaauguuugcucagacauuacaacaaucaagagguuuuggaucuaauuuuagauucccugcuagcucaaauauuccaagugcuccaggaggugggggaacagaaaccaacaacuuuccagaugauggagaugaugaccuuuauaauuaa

SEQ ID NO: 6971 - RNA, 834 nt, Euschistus heros
augacggaccagcaaauggacugugcucuugacuuaaugcgaagacuaccaccucaggaaauugaaaaaaauuugagugaucuaauugauuuaguuccaagucuaugugaagaacuauugucuucaguagaccaacccuugaaaauagccauagauaaagggguugguaaagauuauuuauuaugugacuacaacagggauggcgauucauacagaucaccuuggagcaauacuuacgauccaccccuugaagauggcucaaugccuucagaaaggcuaagaaaacuagaaauagaagcaaacgccgcuuuugaucaauauagagagauguauuuugaaggcggagugucauccgucuacuugugggacuuggauaugacugguuuugcuggugcaauuuuaauaaaaaaggccggcgaugguucaaagaagaucaaagguuguugggauuccauccaugucguugaaguucaagaaaagacgacuggacgaaaugcucauuacaaauuaacuucaacuguuaugcuguggcuccaaacuaacaaaacagguucggguacaaugaaccugggggguaguuuaacgaggcagauggaacaagacgcagcuguuucagauucuucaccacacauugccaauauuggccgaaugguugaagauauggaaaauaagauuaggaauauccugaaugauaucuauuuuggaaaaacuaaagacauugucaauggcuuaagaagcacucaggcauuaucggaacagaaagcacaggcugcucuucgacaggaucuugcuguagcucuucagaaacggcaggcaaaaacagcggaaaauuga

SEQ ID NO: 6972 - RNA, 3705 nt, Euschistus heros
augcaacaaauggacuccuugcaaccuaacaacgcaacaggacuggugaaaagcggacuagaggcgggggccgguagcggcaugaaggagcccccgccacgagaggagccgguccuagacccaaucaaugguguuguccagccuccggucauaccuccuccccacaggccuggccgaguaaccaaccaauugcaauauauucagaaaaauguccuuaaagcagucuggaaacaucaauaugcuuggccucuacagcaaccugucgaugcuaauaaacucaaucuuccugauuaccauaaaguuauuaaacauccaauggaucuugguacuaucaaaaaacgacuggaaaacaauuauuauugguguggugcugaguguauucaagauuucaacacaauguuuaacaauuguuauguuuauaacaaaccaggagaagauguuguuguuauggcucaaacgcuggaaaaacuuuauuugcaaaagcuggaaacaaugcccaaagaggaaauugagcuugagccuccaccaccuaaagguucuaagccaguuaagaagcgaccuggaguuauagguccagguagagggggcgggaccacuggcgcaggaagagggaggccuuccaauucaacgccagcagcugcggcaguagucaccacuccuguaccgccugucacucccccaucacaccuuccagcaaccauaccugguucgacugcuacuaccacuguaccuacuacucaccauaacucucuccccccucagguugggcagccagcagcuguacccuccaacuucaguacaacuacuguugauccccuuuuaacaccuggauuggcuccugguguugguccaaaagguggcaaaggggccgucguccagaccccaacggcgcccaaaccgaaaaaaggggucaaaagaaaggcugaucuagcgaaugauagccccgcuaguuuugacccaacauacaccccaggugacuccaaagcugccaagguuggcacuaggagagaaucuggaaggcaaauuaaaaagccucaaagacagucagacgaugguaugccauuuucucaaagcccaauggcaccuuauucacuuucaaauucaacgcaggcugcccaugaaaagccgaaagaaaaacucucugaaacauuaaaagcauguaaugaaauauugaaggaguuauuuucuaaaaaacauuuuaauuaugcuuggcccuucuauaaaccuguugaugccgaauggcuagguuuacaugacuaccaugauauuauuaagaaaccuauggaucucggaacuguaaagcaaaaaauggacaaucgagaauacaaaacagcaacugaauuugcugcugaugugagacuaauuuuuacaaauuguuacaaguauaaucccccggaccaugauguuguugcaaugggccgaaaauugcaggauguuuuugaagugagauucgcucaaguaccugaagacuccccuauaucgacuguuccugaaaaggaagaagaauccaccucugggucaucgucuggcucugaauccgaaacagauaauucagaugacgaaagggcccguaaacuuagucaauuacaagagcaguuaagaaucaugcaggaagagaugagaaaacucgucgaagaaggaacuguuaaaaagaagaagaaaaagaaagaagguucagguucugguggaaguucuucuaguaagaaacggaaaucugcugauaggacauuagguaaaacagccgauggugggcuuauagcuggugccggagcacccgcuaucauggaaauaaaggcuacugauggcguaaaggcugucccuccuccaggcaggaaugcagucccuucaccccaggucaaaccaaacaagggcaaagccccuggaagggcaccaggaaaaaccaauucucaggguaagaggccaaagccgaacuccaggucuacuaacucuaagaagaagaauccuguugucacuucagaguuuaacucggaagaugaggauaaugcaaagccuaugucuuaugaugaaaagagacaacuuagcuuggauauuaacaagcuaccaggugauaaacuuggaagaguaguccauaucauucaggccagagagcccucuuugagggauucaaacccugaugaaauugaaauagacuuugagacauugaagccaucaacccugagggagcucgaguccuacguugcaucaugucucaggaaaaagccacauaagaaaaauguaucagcaaaaucaaaagaugaagcgauggccgagaagaaacaagagcuagaaaaaaggcuucaggauguuacuggucaauugggaggaucagcuaagaaaacagcuaaaaaacaaggucagggaaggcuuucagcgucaucgucaucaagcucagauucugauacaaguaguucaagucucucuagcaguucuuccgacucaucugauagcgaagcagggaaggcagggcguccaccgaggaagaaaaauaagaaaaaucaccaaauagcaacaacugcugcaacaacuguccaacagaaucaaacuguaccaagcuugaccaugacaacugccacugguacuauuguaaauaaaaaugcuggggcuccacagcccguaguaccguuagcaagcaccaacaaaccuacuguaccuccggucucugcagugacacagccugaaccugugaaaccuguuguagcaucacauagcuugccuccccaaccugcgaggccuaccgcaacggcugccccucugacaacugcuaagagggcaucaauccccacgccagcgacaucgaugggcauaccuccgccugcuccgacuggucuugaaacagguccuauugagaucaaacaggaauuggauguuccuguuccacuagcacccguuccagaucauuuggauuucaaaaaccuuuuggaggugaagcccgagcuaaaugauaucguuacugggaugccuucuguauuugauccuuugccugacucaccucccaucauuaaggaagaaaagcauccuauacucccccaucacacagauggacacuugaacaauucucuucccccugucagcaacguaccugguccgccaaucauaccgagugcugcacuuccaacuacaccacaucacuuagauaugaauaagaauucccagccuccucagcuuccccagacgccaacuuuacaacaccccuucaaaccuaagacuguugagcagaacuugaaaaaugccaguucauggucuucacuugcccaguccccaacaccagcucucaccccaacuccaccgacugcggcucugaaguccuccauggcugacagcuuucaagcuuuuaagaaacaagcuaaagaaaaugccaagaagcaacgagcccugauugaacagcaagaaaugaggcgacaucaaaaagaacaggcugaaagggaaagauuacguguugaaaccgaaaagaggagagaaagagaagaagaagaagcucuggagaaggcuaggaaggcugcuguaguggcuucuggaagaguugaagagguuaaaaaugcugcuaucgaggaagguaccagcccagguucggcagacaaagcugcugcagagcgagaacgucuaaggcaacgagagcaagagaggcggcgaagagaagcauuggcugggcaaauugauaugaacaggcaaagugauuuaauggcugcuuuugaacagaccuuguaa

SEQ ID NO: 6973 - RNA, 1293 nt, Euschistus heros
augauucccccgucuucucggccacaggucacuguguacagugacaaaaaugaaccaacuggugaauuauugacucucccugcagucuuuaaugcuccaauuagaccagauguugucaauuuuguacaucaaaauauagccaaaaaucauaggcaaccuuaugcaguuagugcugaagcaggucaucagacuucagcugaaucaugggguacuggacgagcuguggcucguauaccucguguaaggggcggugguacucaucguucuggucagggugcuuuugguaacauguguagaggugggcguauguucggucccacaagaacauggcgcagauggcaucguaaagugaaugugaaucaaaagagguacgcaaugguuuccgccauugcugcuacuggaguuccagcucuugucaugucuaaaggacacauggucaaugaaguuccagaaaucccucuuguaguaacugauaagauucaggaauauacuaaaaccaagcaggcuacaauuuuccugcaucguaucaaggcuuggucugauauucagaaggucuauaagucuaagagauuucgugcugguaaagguaagaugcguaacaggagacgcauucaacguaggggcccucuuaucaucuauggucaagaucaaggccuaacucgugcuuuccguaacauuccugguguugaucuuaucaauguuucacgauugaacuugcuuaagcuggcaccugguggucacguagguagauuuguuaucuggacacaaucagcuuuugaucaacucaaugcucucuauggcacauggaagaaaaaaucaacuuugaaaaaggacuacaacuugcccaugcccaagaugguaaacaccgaccuuucucggcuguucaaaucagacgaaaucaagaguguucuuaaaccuccaaggaagaccauaguuaggaggguaaggaaacugaacccauugagaaauacucgugcaauguugaagcucaacccauucgcugcaguucugaagaggaaagcuguccuugcugacaggaaacugaagcuugagagggcuauugagagaucgaagaaggaaggaauugagcuuacuccucaucaaaagagguauguugcuaugcuugagcgaaggaaggcucagauuaaagcugccaaagcagcaaagcccaaaaagguuaagaagcccaagggggaaaaaacugcugcuccugaacccaagaaagcuacugugacuaaaaaaccagcaaaaaaagcaacaacagcugcugcacccaaaccagccaaaaaauga

SEQ ID NO: 6974 - RNA, 5457 nt, Euschistus heros
auggcagauuucauagauucugaggcugaagaaagugaggaugaggaagaauuggaaguucaugagaaaaagaaguuaaagcguuugaaagcuauggaaagugaugaagaugaggaagaagaagaugaugaggaacgccugcgagaagaauugaaagauuuaauugaugacaacccaauagaagaagaaagugaaagugaugauggcaguggaucugaagaaggaaguggggaagaucggggaggggagaaacguaaaaagcaugaugaagauuuugaugaucgccuugaagaugaggauuaugauuugcuggaagaaaaucuugggcgaaagguugaaagaagaaaaagauuuaaacgguugaggagaauugaagaugaagaaucugauggugagagagcugaagaugaaggugaagugagggaugcuauagccaaugaacuuuuugaaggaucagaucaugaagaagaucggagcucuucuagaggaccagcaccugagcgguacgaugaugaagaggaagauggugaauacucagaugcagaugauuuuauuguagaugaugaagguagaccuauagccgauaaaaggaaaaagagaaaaccuauauucacugaugccgcuuuacaagaagcucaagauauuuuuggagucgacuuugauuaugaagauuuugaaagacucggugaagaugaguaugaagaagaagaagaugaagacgaauauguugaugaagaaggcaucgaagacagugagagaaggcgcaaaccuacaaagaaggcugcuagaaagaagccaacaagaaaaucaaucuuugaaauuuaugaaccuagugaauugaaaagaggucauuuuacggauuuugacaacaaaguucggaauacugauauuccugagcgaaugcaacuuagagauauuccagugacaccaguuccagaagguucugaugagcugucugaggaagcugaauggauuuauaaacaagcauuuuguaaaccaacaacaucuaaucaggaauggggcaacacaauggagagaggaaaaccaaagaaggaaccucaaacaguugaaaagauaaagaaagcacuagauuuuaugaggaaucaaaauuuugaagucccuuuuauagcuuuuuacaggaaggaauauguucuuccagaacuuaacaucaaugaucucuggagagucuucaaauaugaugcaaaguggugccaguuaagaagcagaaaaaugacuuuacuuucauugauggaaaagaugagggauuaucaggcugaacagcugaugaaagacauugaugcaccuauuccagaucacguuagggucauuaaagaugaugauauugagagguugaaagcugugcaaacuacugaggaauugaaagauguccauucucauuuucugauguauuauucugaugacguuaaaguuauguuagaagcaacaagaauaaaggagcgggaagcugcaaaagcaaaagcaagacaggagaagcagguugacgaaaauggugacccuauugaaaccgaaguagaagaacaagaggaaacuccuccuccugaaauaccuucuguaaaacauucuauacguucuggaccuuaugcaauuugccgaaaagcuggaauaggugguuuggcaaaacgauuugguuugaaaccugaacaguucgcugaaaaucuuagggauaauuaccagcgccacgauguugaacaggagccauccuuaccucuugaacuggcaaaggaguuuguuucaacgaaauuuguuacaccagaggauguuuuaaaagcagcaaaauuuaugguugcuacacaacugagcagagaaccccuuguucggcguuguaugagggacacuuucuuugaaaaagcuaauauugauguuaaaccaaccaagaaagguucuaaagaaguugaugaaaaccauccuuguuaugucaugaaauaucuuaaagguaaaccagugagagauuuaacugcugaccaguaucuaaaacuacacauugcucaucaagauaaacuauuaaauguuacuauuagugaucauauugguggccauacaacaacaucuuauauugaggaaauuaaacaacucuacuaucgugaugaguucaugcagcaugugcaagaauggaauaauauucgccaagaauguguugauguugcuauuaagaagauguuaauuccagaauugauuaaagaacuccauacucgucugcuugaagaagcuaaagaguuuguuuugaggucaugugcuagaaaaguuuacaacuggauuaagguagcuccauuuacuguugaauuuggagacgaugaugaagacgauugggauacaagcaaaggaauucguguuaugggaguagcuuauguaccugauuuagcacaggccucuuuugcuugcaugguggcuccugauggugaauguacugauuuucuuagacuaccucaucucuuaaaaagaaagaauacuuggcgagaagaugaaagaauucauaaggagucggacuuagcacugauucgaaauuuuauacugaccaaaaaaccucaugcuguugucauuggaggggaaucaagagaugcacuaaugguugcugcagaucuuagggaaauuauaucaaauuuggucgaagaugaacaguuuccucaaauuccuguggaaaucauggauaaugauuuagcaaaaguuuaugccaacucacugaaaggagagagugauuuccgagauuauccuauguuacucagacaagcuguaucucuugcucgaagauuacaggauccauuaguggaauuuucccagcuauguacaccagaugaugaaauucuuugucuucgauuccaucccuuacaggagcaacuaucaaaagaagaacuucuugauguggucacauuggaauucguuaaucguaccaaugaaguuggugucgacauaaaugaagugguagcaaauccgauuuguggaaauuuagugcaguuuguuuguggucuugguccaagaaaagggaccacacuuauuaaaauuuuaaaacagaccaaucagagacuugaaaacaggacucaacuuguaacaacaugccacaugggaccuaaaguuuuuaucaacugugcuggauuuauuaaaauugauacuaaugcucuuggagauagcacugaagcuuauguagagguauuagaugguucacguguccacccugaaacuuaugagugggcucguaaaauggcaguagaugcucuggaauaugaugaugaagaugcuaauccagcuggggcauuggaagagauucuagaaaagccugaaaagcuuaaagauuuagaucuggaugcauuugcugaagaacuggaaagacagaguuuugguaacaagagcauuacccucuaugacauaagaucagaauugaaccacagguauaaagaucugagaguuccuuaccaaucuccuggaccagaguugauguuugauaugcuuacuaaagaaacuccugaaacauucuacaucggaaaacuuguuacugcaacaguuauugguauaucucauagaaaacccgaaaaagaucaacuagaucaagcaaauccuguaagaaaugaugaaacaggacuuuggcaauguccguuuugucugaaaaaugauuuuccagaauuaucagagguauggaaucacuuugaugccggugguuguccuggacaagcaacaggaguuagaauacgauuagauaacggcauuacuggauauauucacauuaaaaauuugucggauaagcaugucaccgauccugcucagagaguuacccguggucaaaugauacauugcagaguaaccaaaauagagguugagagguuuucaauugaagcuacuucaaaaucuucugaucuacuagauaagagucaugauuggaggccucaaaaggauccuuauuaugaccaugaaaaugaaaagaaagauuuacauacagaagaagaagccaaaaaaaauaggcaaaaacugacguacaucaaaagaguuauuguucaccccgcuuuucauaauauuuccuacauugaagcugaaaaaaucauggcuacaauggagcaaggugauguuauuguaagaccuucgagcaagggugcugaucaucuuacugugacuuggaaaguagcagaugggauuuaucagcauauugauguuagggaagaggggaaagagaaugcuuucucauugggccaaucauuauggaucggaaaugaggaauuugaagauuuagaugaaauaaucgcuaggcacguuaauccaauggcagccuauguuagagauauguuugccuuuaaguauuuaaaagauacagaaggaggucuuaaggauaaagccgaagaauuuuugaaagaagaaaaaaaaaagaauccagcaaaaauucauuauauaguuucuguauccaagaauuauccuggcaaauucuugcucucuuaccugcccagagcuaggugcaaacaugaguauauuaguguuacaccuaauggauuuagguuuagaggacaguucuucgaaucugucaauucauuauucaaaugguuuaaagaacauuucucggacccuauaccugguacacccaguacuccuagaucugcaaugucagcucguacuccauauacuaauacuccuggaccaaugccaauaaauaugaacgcugaagcuauacagcguguugcucaaaauaugccaaaucauaugcuccacagccuuucacaaguugccagucauacuccucauuacccucauacuccuggagcauauucucuucaucaguacccagcuacgccauauacuccaucuggccaaacuccuuucaugacuccauacacaacuccacgguauggcagugguaugacuccuggccaccaaaguauuauuucuucuggaucuauaacgucaccucaaaguucaacaccaggccagccuguuuuccuucauccaggcucaauuacuccuucucacagaacuccuguugccaauuuucauaggccugguaguacucauccugaagacugggguaagaaagcagaagaauggguugcuaagaaaagagaaaaugcuacuagaacaccuaggucuacaccaaaugcuggcacuccacgccaugggacaccacgagaugaucccaauaagaaucgaacaccaagguaugcugauaaugauuauaccucuccacggccaggugcuaauuucacuuccccgagauauuccaauuggaauaaaguugcuggcacuccuaauucacauauaucugcauaugaagaugccaacuaugaugcucgaagccugaaguccccacgaccuccaccugcgcagggcaaguaugaucccuaugaacuuggucaagggaaaucuccucgguauucauugacaccucguucuacaccucguaccauuaauucaccucguuccaugucucuuggugauucgacuccacuguaugacgagagcaucuag

SEQ ID NO: 6975 - RNA, 2286 nt, Euschistus heros
auggaggaaucuaaagagcggaagaauugucgaaaacaugagagaaauagugauaagucugaucuaaaaucgagagaugaaagagauaguuacaguagagaagguaaacauaggcgauaucauguuaaugacaaaacaaucaauuauucaucaagggauagaaaguaugacucagaacauaaaagauaugaaaaauuggaaagauauuggggaagaggcgcugacaaggaucgucaugguaaagauaugaaagcugauuaccuaguugguucaagguacuauaaugaaacgcugaaaaauucucaaaucaaaacuucagagaguucuacuaaaaguaaagaaaauguuaauccacuagagagugguaguaaagaaaagcaagccccuaaaagaaagaaugaugauaucauaacaucuagaacaggaggugcuuacauacccccaggaaaacugaaauugaugcaagcaaguaucacugauaaaucaaguacugaguaucaacguauugcuugggaagcauugaagaagucuauucauggucauauaaauaaagucaauacaucuaacauuggugucguugcuagguuauuauucaaggaaaauauaauucgugggagaggccuucuuugcagaucaauuauacaagcucagucugcuucuauuacauuuaccaauguauaugcuuguuugguggcuauaauuaauucuaaguuuccaaguauaggagaacuuuuacugaagagaguuauuauuagauucaaaagggcuuauaaaaggaaugauaaagcugucuguauuucuucagcaacauuuauagcacaucuuaucaaucaggguguugcucaugaaauucuuggauuggaauuaguuacuuuauuaguugaaaauccuacagaugauucaauagagguagcaguagccuuuuuaaaagaagcaggacagaaauuaagugaaguaaccagcaaaggcacuaaugcuauauuugacauguuaagaaauauucuucaugaaggaaagcucgaaaaaaggguacaauacaugauugaaguuauguuucaaguaaggaaagaugauuuugccacuuuuccaucaguaccagaagagcuugaccuuguugaugaagaagaucaguucacucauuuaauuggacuugaugaugcuauugauacccaagauauauuaaauguguucaagcuugauucagaauaucaggcaaaugaggaacguuauaaagaauugaggagugaaauucuugauacugauucugaagauaguggcucugaagcuaguaguucagaaggagaagaggauucugaugaggaagaugaagaaaagaaaaucacaauuguugauaauacagaaacaaaccuaauaucucugaggaaaacuaucuaccuaacaauucaaucaagucuugauuuugaagaaugugcucauaaguuguugaaaauggaaauuaagccuggucaagagaaagaacuuugucauauguuucuagauugcugugcugaacaaaggacauaugaaaaauuuuucggucuucuuucucaacgguucugucaaguuaauaauacuuacauagcuccuuucgagcagauauuugcugacacuuacucuacuguucaucguuuagauacuaauagauugcggaauguagcaaaauuguuugcacaucuucucuucacugaugcuauuucuugggcagugcuuucaaauauucgacuaaaugaagaagacacaaccagcucaagcagaauuuuuaucaagauuuuguuucaagaauuaucagaguauauggguuuaguuaaccuuaaugccagauugaaagacccaucucuucaaucugccauggaaggucuguuuccuagggacaauccaaagaauacacgcuuugcuauaaacuuuuuuacaucuauuggucuugguggucuuacggaugaauugagagaacaccuaaaaaauuuaccaaaauccauuccagugacacaacucauccaagaauuaucaucugcauccuccacuucuucaucaucuucaucuuccucugaaacugagucaucaucaucuagugauucaucagaggaugguagaaagaaaaggaugaaaaagaaaaaaaggccuauuauuccaaaaaaggauucacauuuaaauaagaaaaagcacaaaaaacuuggaaacucucaagaaagugauagaucuacuaaagaaaccaaaaggaaaaaugaguacaaaaaaucacaugauagagacgaaaaaucucaugguagaaaaucaaaaaggaaauaa

SEQ ID NO: 6976 - RNA, 1758 nt, Euschistus heros
auggcgcugaaagcucucguuggucaaaaaauuaugaacgaugcgaucaggcaaaagaaaaaagggaaagagguagaguggagaguccuugucguggaucagcuagcgaugcggaugaucucugcuugcuguaaaaugcaugaaauuucugccgagggcuuaacaauuguugaagacauuaauaaaaagagggagccacuuccaucaauggaagcuguuuaucuaauaaccccgagugaaaaauccguacaugccuugaugaacgauuuugccucaccgaaucguaucauguacaaagcugcccaugucuauuucacagaagcaugcccaaauccuuuauuugacacccugugucaugcgagaaucgcuaaauuuauaaagacucugaaggaaauaaauauagcauuuauuccauacgaacagcagguguuuucccuugaugcuccagaaacauuccagugcuucuacaacccaucauuggcuaacagccgacuugcuaauauggagcguauugcagaacagauagccacauugugcgccacgcuuggugaauacccaucugucagauauaggagugauuuugauaaaaauguagaauuagcucagauagugcagcagaaauuggaugccuacaaagcugaugaaccuacaaugggugaagggccugaaaaaucucguucccaauuguugauccuugaucgagguuuugaugcaguuucuccucuucuucacgaacucacucuucaggcaauggccuaugaucuucuuccaauugagaaugauguauauaaguaugaagcuacugcuggagcuccggagaaagaaguauuguuagaugaaaaugaugaacuauggguagaacuacgccaucagcauauugcuguugucucacagaaugucacaaagaaccugaagaaauucaccgagucuaagagaaugccacaaggagacaaacagucaaugagggaucucagucaaaugauuaaaaagaugccacaauaucagaaagaacuuagcaaguauuccacucauuuacaucuugcggaagauuguaugaaugcuuaucaggggcauguugauaagcucugcaagguugagcaggauuuggcaauggguaccgacgcugaaggagaacguauaaaggaccacaugagaaauauuguuccgauacuccuugaccaauccguaucuaauuaugacaaaaugaggaucauccuucuguauacauugucaaagaaugguauuucugaggaaaacuugaacaaacucguucaacacgcucagauccagccacacgagaagcaggccaucgucaaccuaggaaaucuuggccuaaauguuguuguugaugguacucguauaaagaagccauacguacccccucguaaagagcguaucacagaacaaacuuaccagaugucucguuggacuccugucauaaaggaucuuauggaggacuguauagaugacaagcucgaccucaaacacuuccccuuucucgccgguagggcugccucuucuggauaucaugcuccugccagcgugcgauauggacacuggcacaaagauaagggccagcagaccgugaagaaugugccucgaaucaucgucuucaucaucggugguaugagcuucucagagauccgaugugccuaugaaguuaccaaugcugucaaaaauugggaggugauaauugguucuucacauauccugacaccugaagacuuccuaaguaaccucgccaacuugagcaacuag

SEQ ID NO: 6977 - RNA, 2118 nt, Euschistus heros
gacccuuacagcuaugaggacuuuguugaacguuuagcuuggagaacuguugauggcuucaaggaagauggcauucauggauuugauccaaauuuaaugcacgaaacauuucuccaagcaauuaaggauuuacaaguucuacaagaucgucaguauaagaaaugugaaaaacuugaacuaauuugcaaggaagaagaagcuaaucauuuccaggauauagcccauuugcacgauaaaaauaaggaagcuguugcuuuauuucaagauuuggaugaaagaauaaauuuuguugcuacuaaaguaauacauuuaggagaucaguuggaaaguguuaauguuccaagaucuagagcuguugaagcacaaaaacuaaugacuuauuuuagugaauuuuuaaguccuggaccuguuguugcaaguguuuuuucuaguaaggaugagguauuugaagcugcugauauuauccagaaacuucauaugaucucacaagaacuucccucugauaaauuuaaagaugcuagaucaaaaaucagucuaaaauaugaugaaauugaaagaucauugauugaagaauuuguaaaggcacacaggguucaugaaacaaugagaaugaaagauauugcaaauauucuuaugcauuucaagucuuauucacagugcauugaugcuuucauugaagaaagucaaaugggaacauuuguugggaaggauauuuucaaggagauauugccucucacaaaaaaaaauuuuaguauuaugagagaaguuuuuagcaacccggaacaaguuauggcuaaauuuguuuugaauauuuaccauuuaaaacugcagaaacauaucguaagcaaccuuucugacaaguccgauacuaauaaauaucuaagaaacuuaauggaauuauacacuaggacgacugaacuaucugccgaauugaguggcuucaaaaugggaucugaugauucuuaucuucaaaaacuaacucaaaacauauuucaaaaauauuuagaaucuuacauaaguguugaaguuaagggccugaaggaaaagugcucaacguuguuacaaaaauauuaugacucaaaagaucaccauaaacgacaaauacagucuggaggauuccaagauuuuagacgugaucuucaggcuguuauuggcacuagggcuaacaucaauauugcucaaaucgaagauuauggaggagaaacauuuuuaucagaagaauuaguuauuagucuaauacaagagucuaagcaggcauuuuacagauguaaauugcugucuaaaccugcugacuuggcaaguaacacaguccagcuguuagagguacuacugaauuguauuauuaucgaucauguugauuacgcuguagaacuagcuuuacaagcaguaccaauuccugaaaguaaaacacaggcucagccaauauauuucuuugaugucguaaggcaggcaaacaccauugugcaucugauugaaaaacacuucaaugauucugcucuuccuuuaguaaugucaacuucuaaacauggggaaugugucaugaaaaaaaaauucuuauuaaaccauuuggaacagaaacuggacaauggcauugacagggcacuaaaugcaauaguugguuggguaaaaguauuccuucaaucugagcagaagaagacugauuucaaaccugacacugaguuaaauacauuaucaucugcugcuuguauagcuguggugcaguauuuuaaugauaauguaaagcauauaagagccuguuuggaugguagaaauauugaauguguuaugacagaauugggcugucguuuucacagagucaucuaugaccauuugcagcaauuucaauacaauucaaccggugcucuuuguguaauaugugacaugaaugaguauagaaaaugugugaaggaacuuaauucauaucuaguuaauacauuguuugauacuuuacaugcucuuugcaaugugcuacuaguaaaaccugaaaaucuugaccaagugugcacaggugaucaguugucucuauuagaccguucuguuguucuuaauuucauccaauuaagaaaugauuacaagacucagaaguuaucaaauuuucugaaaggaaugucugcuuga

SEQ ID NO: 6978 - RNA, 831 nt, Euschistus heros
auggauuuccaaaaucguccuggagguaaaacugggaguggugguguagcaucauggucagaaacaaaccgagaccgaagagagaggcuaaggcaacuagcucucgaaacuauagauauaaacaaggaucccuauuuuaugaaaaaucauuuagguuccuaugaauguaaguuaugucucaccuuacacaauaaugagggaaguuauuuagcccauacccaaggaaagaaacaucaagcaaauuuagcaagaagagcugcuaaagaagcgaaagauucuccacaacagcccgcaccagauaaaccuagaauagaaccuaaaaaguucguaaaaauugguagaccugguuaucgaguuaccaaacaaagggaucccgaaacuggccaacaaagucuucuuuaccaaguggauuauccagaaauugcagaaggaaucuugccuaggcaucguuuuaugucagcuuaugaacaaagaguugaaccuccagacagaaaauggcaguaucuccuuuuugcagcugagccuuaugaaacaauagccuuuaaggugccaagucgugaaguagacaagucugaaaacaaguuuuggacccauuggaacaaagauaccaaacaauuuuuucuccaguuugcauuuaagaaugaaccucuugcuccuccuaugggcgcaccacaucuaggccagaugaggccuccacacaugcugccuccuccaaugaguguuccuccaccuccuauguuuaauccaguuccaccucccccuccaaaucuaaugcuugcucccccgccaccaccugcuccacuuccgccuccuccucaaccuaugaaauaa

SEQ ID NO: 6979 - RNA, 405 nt, Euschistus heros
augucuaucgguguuccuauuaaaguucuucaugaagccgaagggcacaucgucacaugugaaaccaaaacuggagaagucuacagaggaaaacuaauugaagcggaagauaauaugaauugccaaaugacugguuuaacuguuaccuaccgcgauggcagaguggcacaguuggaaaauguuuucauuagggguuccaaaauacguuuucuuauacugccggacaugcuaaagaacgcgccuauguuuaaaaaacaaggcaauaaaggaaauacgggugcggggagagguaaaucagcaauauuaagagcucaagcugcccgggguagagguucacaaucaagaggaggugccacuucuucacgaccgucuuggcaaagcggcucuaaucagucaagaaaauaa

SEQ ID NO: 6980 - RNA, 1428 nt, Euschistus heros
uauaaucaguugaaucguaauuuaguguuggcagaacuaccauauuuucucucugauaauccaauucuaucucgaaguucugcacucuugaaaaguuucagaauuuuuauacaaauggcuucgaguguuucuaaaguuccucugcuucagacgguggcgaagagaucauuugcugcuguugcugcgccucaaucuggaagauguaagaacaaaguugaaguaacuacucuuccaaauaaggcuguaguuacuucuuuaggaugugaacccagcuccuugguaaaaguugcuguugcauucagagcuggaagucguagugaaaccucugauaauuuuggagcuagucauauuuugcgaagcucugcuggucuuagcacuugcucugcaucuucguuuuacaucugucgcaguuugcagcaaaauggugccagucucacugccacuucugaucgugaaacuauuguuuaucuucucgaaucuucugcuaccaauauaaaagaaggccuugauguaaugaagaaagcgauuacuggacaagaguuuaggcccugggaauugucugacaauauuccucgaaucaaacuugaauuggcaucauugccuccacaagcuaaagugauugauuugauucacacugcugcauuccggagugggcuuggaaauucuauuuuuguucgagaauucaauauuaagaaaauuaacugugaaacguugcaacauuuuuaugcuagcaauuucacuggugauaaagcugcuguagcugguuguggaauaccucauaguuuucugacuucuuuugcugauucacuggggcuguguucuggaauucccagucaaauacaagcauccaaguauagagguggugaaauaaggauugaggaaaacauuccauuccaucauaccaucauugcugcagaagcaccagguuuagacaaaagcgaugcacuugcuuaugcugucuuacgauaugcccugggcacugguccuucugugcaccguggucaaggaucuggaccucuuuccaagauuccugcuaaggcuauggcgcuuuccauggcccacucugacgcuggucuuuuugguguuuacguuucuucucuugguacagaugcuaaagaggcuguggaaggagcagugaaagcuuuaaaguguggagucacugaacaagaugucgcacgagguaaagcacaguuaaaaucagaauuguuauauuccggcgaaaccugucggggaauaguggaugaccuuguugggcaggcuuuacuugucaaaggggcaccucccaugaccauuguugaauuggccgaaaaaguuucuucaguuacuacucagcaggugcaacaggcauugcaaaagauccagucuggaaagaaaucauuugcuucuauugguaacauaagcaaagugccauauuuagaugaauuguaa

SEQ ID NO: 6981 - RNA, 339 nt, Euschistus heros
augaggagagcucauggcaauuauuaccaaccgguuccaacguuugacggaccuagcgguucccuugaagaggaaaaugaccagaugacgaauaaacucaaagauaaaauaacugcuuuaaagcacuuaucuauugauaucggcgcggaagucaaguaucaggauaagaugcugcauggcaugucagaagacuuugaucguacugguggcuucuuaggaaauacaaugaaucgaguuuuacgccugaccaaagggagucacaauuauuauauuuuguaccuuuuuauauuuucuauuguuguuuuuuuuguacuguacauaguauuaaaauuuagauaa

SEQ ID NO: 6982 - RNA, 1491 nt, Euschistus heros
auggcuauaucuucuaaucaagcuguuaaagaacauguuuuggcuguuucaagggauuucgucucucagccuagauuaacuuacaaaacuguaucuggagugaauggacccuuagucauuuuagaugaaguuaaauuuccgaaguauaacgaaauuguucaacuaagacuugcugauggaacauuacggucuggccaaguuuuggaagucaguggcuccaaagcuguuguucagguuuuugaaggcaccucugguauugaugcaaaaaacacaauaugugaguucacuggagauauucuucguacuccagugucugaagauaugcuuggacgagucuucaaugggaguggaaaacccauugauaaagguccuccaauucuugccgaagauuauuuggauauucaaggacaacccauaaauccuuggucucguauauacccugaggaaaugauucagacugguaucucugcaauugauguaaugaauucaauugcuagaggacaaaaaauaccaaucuucucugcugcuggauugccucacaaugaaauugcugcucagauuugucgacaggcugguuuaguaaaauuaccuggaaaaucuguucuugaugaucaagaagauaauuuugccauaguauuugcagcuaugggaguuaacauggaaacugcccgguuuuucaagcaagauuuugaggaaaaugguuccauggagaacguuugcuuguuuuugaacuuggcaaaugauccaacuauugaacguauuaucacaccucgucuugcucuuacugcugcugaauuucuugcuuaucaaugugagaaacauguuuuaguuauauugacagauauguccucuuaugcagaggcccuucgagaaguaucagcugccagggaagaggugccugguagaagagguuucccugguuacauguacacugauuuggccaccauuuaugagagagcugggcguguugaaggcagaaauggaaguauuacucaaauuccaauucuuaccaugccuaacgaugauauuacccacccuauuccugauuugacgggauauauuacugagggccaaauuuauguugaccgucaauuacacaacaggcagaucuacccuccaauuaacguauuaccaucucugucccguuugaugaaaucugcuauuggagagggaaugacucgaaaagaucauucugaugucucaaaucaauuguacgccuguuaugcuauugguaaagaugugcaagccaugaaagcuguugugggagaagaggcccuuacuccugaugaucuucucuauuuggaguucuugacaaaauucgaaaagaacuuuauuucucaagguacuuaugagaacagaacaguauuugaaucauuagacauugguuggcaacuacuucguauauuccccaaggaaauguugaagagaaucccagcaucuacucuggcagaguucuaccccagagauucaaggcauacaaccacaaaauag

SEQ ID NO: 6983 - RNA, 2229 nt, Euschistus heros
augaugcaacaagcucaaaguaggccaaugucccauggaaauuaccaggguggaccagauuugcccaugggcucugucaaagaccagacacucauguggcaacagagcucauauuuggcugauucaggaauucauuccggugcaacuaccacagcccccucacucucagguaaagaagaagaaauguauggggaucaggacauguuugacuuggaucaagguuuugcccaggguuucacccaagaacaaguugaugaaaugaaucagcagcucucucagacacgaucucagaggguucgggcagcaauguucccugagacauuagaagaagguauugaaauuccaucuacccaguuugaccaagcucaauccacagcaguucaaagacuugcugaacccagccaaaugcuaaaacaugcuguugugaaucucauaaauuaucaggacgaugcagaucuagcuacucgugcuauuccugaauugauaaaauuacucaaugacgaggaccaaguaguagugucacaggcugcuaugaugguacaccagcugucuaaaaaggaagccucucgccaugccaucaugaacaguccucagaugguugaagcuuuggugagagcauuaucaaacaguaaugacuuggaaacaaccaaaggagcuguugggacauuacacaauuugucucaucacaggcagggucuuuuggcuauuuucaaaagugguggcaucccugcucuaguaaaacuuuuaaguucgcccguggaaucuguucuuuucuaugcaaucacgacuuuacacaaccuccuucuucaucaagaaggaaguaaaacggcugugagaguugcuggaggauugcaaaagaugguugcuuugcuccaacgaaauaaugucaaguucuuagccauugugaccgacugucuccaaauucuagcuuauggaaaucaagaaaguaagcuuauuauuuuggcaucucaggguccuauugagcuagugcggaucaugaggaguuaugauuaugagaagcuccuuuggacaacaucaagaguacuuaaaguuuugucugucugcucgagcaacaaacccgcaaucguugaagcuggaggguuaccugcucuggcaaugcaccuggggcauccaucacagcgacuuguucagaacugucuuuggacccugagaaaucucucagaugcugggaccaaaguuggugguuuagaaggccuucuccaaucccucguucaacuuuuagacuccacugacauaaacauuguuacuugugcggcugguauucuaucaaauuuaacaugcaauaaucaaaggaacaagguaacugugugccaggucgguggugucgaugcucuuguuaggacaauuauuucagcuggagacagggaggaaauaacugaaccugcuguuugugcuuugaggcaccugacaucucgccauauggagagugagcuugcacagaaugcuguccgccucaacuauggcuugcaagugauugucaaguuguuacacccaccuucaagauggccucuagucaaggcaguuauugguuugauuagaaaccuugccuugugccaggcuaaccacacaccgcuuagagaucacggugcaauacaccaucugaucaggcuccuuaugcaagcauuccaggacacacauaggagguccaguguuacaaguggaggaacacaaucaggugguauuuaugcagacggugugcgcauggaagagauaguggaaggcacugugggggcucuucauaucuuagcgagagaaagccauaacagagcuaucaucaggggccaaauggucauaccuauuuuuguacagcuucuuuuugaugagauagagaauauucaacgaguggcugcuggugugcuuugugagcuugcccaggacaaagaaggugccgagcucaucgaacaagaaggugcaacagcuccacuuacagaauuacuccacucucgaaacgaagguguugcuacuuaugcugcugcuguccuguucagaaugucagaagacaaaccucaggauuacaaaaagagacuuucgauggagcuuaccaacucccuuuuuagggaggaucagaaucuguggaauggugauuuaggaauggcaccagaucuacaggacaugcugggagagcaaaauuaugauaccauguacucucauggaccaccaagcgugcauaguagucacggcgguaggggauaucagccagggcucuga

SEQ ID NO: 6984 - RNA, 822 nt, Euschistus heros
auggccagaaaugcugagaaggcuaugacuacuuuagcucgguggcgagcugcacaauuaggagaaggugaucaagcuaaacaaagaagaccguauuuagcaucugagugcacugaucuucaacaagcugaaaaauggagaaugcaaauuauaagagaaauagcucguaaaguuucacaaauucaaaaugcuggucuuggugaauucagaauucgugauuuaaaugaugaaaucaauaagcuuuuacgggaaaaagggcauugggaagcccaaauucgagagcuugguggcccagaccacucuaggucugggccgaaaaugcuggaugcugaaggaaaagaaguuccuggaaauagagguuacaaauacuuuggugcagcaaggcaacucccuggagugagagaguuauucgagcaggcuccaccuccuccuccacauaaaacacguggugagcuaaugagagauauugaugcuucuuacuaugguuauauggaugaugaagauggaaucauuauuccccuggaagaaauugaagaaaguaaagcuauuaaaaaagcuguaucggaauggacuguuaaaaaggaaaaaucaauggaaauugaggaagaagagaaagaagaagucgaagaagacaauaucuacaaaauagggaauaaagagggugaggaagaugaugaagaaguagaagaugauggauuugaauuaagugccaaguuacuggaaggguaccgagcucauauuccuguuccuucacaaagagagguggaagcugcaauucuugaaagaaaaaaacaagaacuuuuggagagauaugcucucuag

SEQ ID NO: 6985 - RNA, 645 nt, Euschistus heros
auggaagaggcugauguuccaucauuuaaauguguacuuguuggugauggugguacuggaaaaacuaccuuugucaaacgccauuuaacuggugaauuugaaaaaaaguauguugcaacuuuagggguagaaguacauccuuuaguuuuccacacaaauagaggcccuauccgguuuaauguuugggauacugcaggccaagagaaguuugguggacuuagagauggauacuauauucagggucagugugccauuauuauguuugauguuacuucaaggguaacauacaaaaguguccccaacuggcaucgagacuuagugcgaguuugugaaaacauuccuauuguacuuuguggaaauaaaguagacauuaaggauaggaaagugaaagccaaaagcauuguuuuccauaggaagaagaacuuacaauacuacgacaucagugcuaaaaguaacuacaacuucgaaaaacccuuccugugguuggcucgaaaacuuauuggugauccaaaucuggaauucguugcuaugccugcuuuguugccuccugaggucaacauggauccugaauggcgugaccaaaucgaaaaggaucuccaggaagcacaagacacggcccuuccugaagacgaugaagaccucuaa

SEQ ID NO: 6986 - RNA, 480 nt, Euschistus heros
auggauauccaaacuauugcaacaauauuuauuaaaguuuuaaaacuuguaauuaauuucaucauuuugaugcuuuaccgcuaugguggaaagcaaggauuuuuggggguagguggaacauggaaccuguaugaaguaaagagugcagaugcugaaauuauugcaucggguguuuuuguuggauuuuuuauauauacaucugucauuuugauuuccuacugcuucggaacaacaaaacacaaauauagugcaguggacauaauaaugaauguguguggaacuauacuguuuacugcaguaggaggaauagcauuacacuauugggucggcuuccaggaugaaaaccauuaugugggaaucucucaagaaaaacaaaucggccuugcacugggcagccuuugcgucgucugugcagcuauuuaucuucuagauacaguuuuaucuuguauucauaucgcccacaagcaugccauugcuuaa

SEQ ID NO: 6987 - RNA, 2337 nt, Euschistus heros
augccgcgaauaaugauaaaaggugguguuuggagaaacaccgaggaugaaauucuuaaagcugcgguuaugaaauauggaaaaaaccaauggucucgaauagcuuccuuacugcaucgaaaaucagccaaacaaugcaaagcuaggugguuugaguggcuugauccaagcauuaagaaaacagaguggaguagagaagaagaugaaaaauuauugcaucuugcuaaguuaaugccuacucaauggcgaacaauagcaccaauuauuggucguacugcugcacaauguuuagaaagauacgaauacuuacuagaccaagcucaaaaaaaagaagaaggggaagauggagcugaugauccuagaaaauugaaaccaggagagauagaccccaacccggaaacuaaaccugcucguccagauccuaaggauauggaugaagaugaauuggaaaugcuaucugaggcaagagcuagauuagcaaacacacagggaaaaaaagcaaaaaggaaagcaagagaaaaacaauuagaagaagcaaggagauuagcagcuuuacagaaaaggcgagaauuaagggcagcagggauugaauaugcggcacgccauaaacggaaacgaggcaucgauuauaacgcugaaguuccauucgaaaaaaaaccugcgucugguuucuacgauacuaguaaugaggcuauugauccucaugcuccuaauuuuaauaggcuucgucagcaaaauuuagacggugaacuucguagugaaaaggaagaaagagagcguaggaaagacaaacaaaaaauaaaacagaggaaagaaaaugacaugccucuagcgaugcugcagaaucaagagccagccaagaaaaggaguaaacuugucuugccacagccacaaauaucugaccaagaacuccaacaaguugugaaauuaggaagagcuaguuaugccgcuagggaagccgugacagaaggaucugagagugcuucagacacacuucucaacgauuaugcuuuagccacacccaaugcuggcucaacuccucgaacaccagcgccaaccacugacaggauacuucaagaagcacaaaauaugauggcauugagccacguagauacuccauugaaaggaggauugaauacaccccuuuacaacucggaguuuaguguuaauccuccagccgagcagaucacuacaccgaauacuguucuaacuacaccauuuuccaaucgaacucaugaaggaaggacuccagguuuccaaacuccgcaggauguuagaaacagccuuaccacuccugucagggauaaauuaaacaucaacccagaggaagguggugauacaccuuaugcacccguaaauaaucagaaacugguaaaagaggaacuugcugcucgccuuaggucauuaccccagccuaagaacgauuacgaaauugucguuccugaagaugaaguuucaucugaaacagccgcggaggguucugguaugccaagcaucgaagaucaagcagauaucgaugccagaaauuugagccuucucgcucaacaacgugaaaaagaguugaaaaguagaucgcaaguaauucaacgagguuugccucgaccuggagacaucaauauaguacugcgcccagcuaacacagauccaccucuaacagaucuucagaaggcugaagagaugauaaaagaagaaaugauaacgaugcugcauuaugaugcuaugcacaguggugaaccuccuuccucgaggaaaauuggaacuuugagucaggcacagcaccuugccuaccucgagcaacauccguaucaaacuuacucagaagaucaaauggaaaaggccaaagaaaugcugaaagcugaaauggaaguugucaaacaagguaugaaucauggcgaucucucgcuggaaacuuuuacgcaaguuugggaagaauguuuagcucagguuuuauauuugccaaaucaaaauagauacacuagggcaaauuuagcaaguaaaaaggaccgacuggaguccgucgaaaagaggcuugaacaaaauaggacucauaugacucgagaggcuaaaagagcugcgaaaauggaacgaaaaauuaaaauaaucacugguggauaucagacaagagcucaggcacugauaaagcaacuucaggauuuagcugacgaaaccgacaaggcucauauggagcugucgacauucaaacuucuucagcagcaagaagagaaugcuauuccuaaacggauagagucaauaucagaagauguuaauaggcagcuugaaagggaaaagaguuugcaaaagagguucagccaacuccagcuggucucgcaaucauag

SEQ ID NO: 6988 - RNA, 474 nt, Euschistus heros
augaugcaguuuaugcuuuuauuuagucgucaaggaaaauugcgauuacagaaaugguauguugcacauccagauaaauugaagaaaaaaauuacaagggaauuaauuacaacuauuuuggcaagaaaaccuaaaauguguagcuuuuuagaauggaaagauuugaaaauaguuuacaaaagguaugcaaguuuauacuuuuguugugcuauugagcaaaacgauaaugaacuguuaacauuagaagugauucaucgcuauguagaacuucuugacaaauacuuuggaaguguuugugaguuggauaucauauucaacuuugagaaagcauacuuuauccuugaugaacucuuacuuggaggcgagauacaggaaacaaguaaaaagaacguccugaaagcuauagcggcucaggaucuccuccaggaggaagaaacaccacaaggauuuuucgaagaucacggucuuggauaa

SEQ ID NO: 6989 - RNA, 1116 nt, Euschistus heros
augaaagaaaguuugaaaaaauuucgagaagaagcacagaaguuagagcagucugaagcuuuacaaaaagcaagagcaaaguuucaaacaguugaaucagaagcaucgaaaggcagugaaguuuuuaaggagaaauuagaucacauuaaagauagagucagugaugugcuagaggaggcagcaaaaucagaaauaggaaaaaaagcuggacagcugggagcugaaauuggaaagacugcaaggggagcugcugaaacuauaucagaaagagggcaacagauuggaaaaaguggagcuuuucaaaccauuagccaaacugcugcagcuguaaagcaggaauuagaucaaacuggaauccaugcucauguuuaucagcccccacaaaaacuaagaagaagguuggaaacaaugcccgauaacaaaacauugaaaccugacacagagacauugggcaucgaucuucauaaggauucaaaauuuuuccagaguuggcagcaauucaaagacaauaaugcuuauaucaacaaaguucuugauuggaaaaugaaguaugaugagagugauaauccuguuauucgggcuucucgaguuuucacugauaagguuucaaguguuauggguggccuuuuucagaaaacugaacuuucugaaacuuuaacagagauauguagaauagaucccaauuuugauagagcucauuucuugaaagauugugagaaagacaucaucccaaauauucuugaagcuaugguccguggugauuuagauauauuacgagacuggugucaugaagguccuuauaauauucuugcugcuccuauuaaacaagcaaaagaugcccauuuuaaguuuuguucuaaaauuuuagauauugauaauguugauuugguaauggguaaaguaauggaucaagggccagucuuaguuauuaguuuccaaucucagcaauuacuauguaucaaagauaaaaaugguaauauuguugaaggugauccaaacaaggugcugagaguaaauuauguuugggugcuuuguagagacccuucagaauuggacccuaaggcagcauggcgucuuuuggauaugucagcacaaagcacugaacaguuguuauga

SEQ ID NO: 6990 - RNA, 903 nt, Euschistus heros
augaagagaccgacguuuagagagcuucaguuggaagaacuugagaauuaugaagaggagacugauucagauacugaggcucuucaagaagcuuuuguuaaaggggaacugaagccaggucuuaauauaccaguuaaagaaagaacaaaaacuaauaauguuccucuucuaaaggaaguauuaaaugauaucaaguuggaucugccuuggauugagagauuggauguaacuaaugaucaagcaccucuggcuccagaacuugcccuucagaucagagaugaagaaaaaggccauaauccauuaguuuaugaugagcuuaagagagaaaguguauucuaccgacaagcucagaaugcugcaaugaagauucuuccaaaauugaaacaauuagguuugagaacugagagaccaggggauuauuuugcugaaauggcuaaaucagaucagcacaugcaaaagguuaaaggcgaagcuauaaagaaaaaauuaaugauggaaaggauugagaaauugagagaaauacgagcacagaagaaaguucaaaaagcucuccaugcacaagcuaaaguugccaaaguacaaaauaaaaaagaaaugcuugaugaagugaaaaaguauagaaaaggagagaccaaaaguuuagcuuuucuagaaccaggcuauaaggcaaaaccaaaagccaauaaaucacaaauuaaacggcaacacaagaaugccaaauuuggucaugguggaaagaaaaggggagcuaagaggaauacacgagacagcaccagugguauugaaaggcgccagagcaaaccaucuuuugccaauucagcaggaaaagggaaaaaagcgaugaaacagaaaaggccugguaaaaaugcucgccugaaacagaaaucaaggagaaagaauuaa

SEQ ID NO: 6991 - RNA, 2550 nt, Euschistus heros
auggaugaagugaagaaacuugagcaccuuucguuggugucaaaaauaugcacagagcuugaaaaccauuuagggcugaaugauaaagauuuagcugaauuuauuauugauuuggcaucgaagaauaacacauuugaaagcuucaagaaagccuuauuagauaaugaugccgaguuuucagauucuuucauuuccaacuuauuacgaaucauucagcauaugagaccuaagaaugagccaguuuugacuaaagacuugacuaaacaagacaaauugaguaugaaguuuccaggacucgccaucccuaaugacguucaacagccuaagaaccauaacaauaaaaaguucaauuugucuguaauuaaagaagauccugaagacaaugaagucgaagaugccauggcagcucuugaagcguuagcuccuucuaaugaaaagaaauucucuagcaagguugaaagagcaucacauucuccagaaaagauuguuaaacaagaaguggaaaaacccagaaaaagaagucgcagccguaguagaaauagagacaggaagaggaauagaaguagaaguaggaguagaggaagggguagaaguaaagagaaaacauacgguaaaagcaggcagaggagugugagucguggaagaagaaggaggaguagagacagaaguucaagucguaauagaaaucaggugaagaacugggaaagagacaggagagguaaaaaugaucgaagaagcagaagcaaugguaggaagagaaaugaaaggaguagaagcaggagcguugguaaaaggaggaaugauagaaguagaagcaggagcuaugauagaaaaaaaaaugauaagaaaagggaaaacgaugaugagaagaauaagucugaugaaccacucgagccagaaguuggaaaaauauauaaugggaaaguuacgaauauuguaucguuuggauguuuuguucaaaucgaggguuugaagagacgaugggaaggacucguucauauaucgcaacugagaagagaaggaagaguaacgagugccucugaugucguuucucguggaaugaaagucaugaucaaaguauugucgguggcuggacaaaagguaucucugucaaugaaagaugucgaccaagaaacuggaaaagaucugaacccuaccguccgacaugcuaucaauaaggacagggaagaagaagcuucgaugcgaaaucccgaucgcccuacgacacuucuagauuuaggcuccuuugaugaccaugaugacuuucagaguagaaaaaggguuaauaggauaucuucaccugaaaaaugggaaaucaagcagauguuaucugcgaguuguauugauaaaagugaacuuccugauuuugacgaagagacuggccugcuucccaaagaggcugccgaggaagaagauaucgaaauagaaauuguugaagaagaacccccuuuccuccaggggcacggaaggaacuugcaugaucuuaguccuguuaggaucgugaagaaucccgaugguucccucgcucaggcagcuaugaugcaaagugcgcuugccaaagagaggcgugaacaaaagauguuaaacagggaacaggagauggaucaaaugccgacugguuugaauaaaaauuggaucgacccccuuccugaaagugauggaagagcauuggcugcgaauaugcgaggaaucggacuuacuaaccaggaucugccugaauggaaaaaacaugugauuggagggaaaaagaguucauuugguaugaagacaaauaugacacuuuuggaacagaggcaaagccuuccaauuuauaaacugaaggaacagcuuaucaaggcaguuacugacaaucaaauuuugauuguuaucggugaaacggguucaggaaagacgacucaaaugacucaguauuuggcagaagcagguuucacuucgaggggaaaaauagguuguacgcaaccuaggagaguugcugcuauguccguugcaaaaagaguggcagaggaauucgggugucgcuuaggucaagaagucgguuauacuauucguuucgaggauuguaccagcccugaaacagucauuaaauacaugacagacgguauguugcuucgagaaugccucguggacuuggaucugaaaaguuauucaguuauaauguuggaugaagcgcacgaaaggacaauacauacagauguacuguuuggacuuuuaaagcaagcuguucaaaaaagaucugaauuaaaguugaucguuacaucagcuacuuuagaugcugucaaguucucacaguauuucuucgaagccccuauauucaccauuccaggccgaacguucccugucgaagugcuguauacaaaagaacccgagacagacuacuuagacgcaucgcucauaacuguaaugcaaauacauuuaagagaaccgccuggugauauuuuguuauuucuuacaggucaggaagaaaucgauacagccugugaaauauuguacgagagaaugaaaucgcuaggucccgauguaccagagcucauuauucuaccaguuuauucu

SEQ ID NO: 6992 - RNA, 1998 nt, Euschistus heros
augaauacaggaccaggaggaccaaauuaccccauggcaucuuuauacguuggugaucugcauucagacguuacugaagcgaugcuauuugaaaaauuuucaucagcaggacccguacuuucuauuagaguuugcagagauaugaucacacgacguucauuagguuaugcauaugucaauuuccaacaaccugcagaugcugaaagagcuuuggauacaaugaauuuugacaaccuaaagggucguccaauucgaauaauguggucacaacgugauccuucccuuagaaaaucuggugugggcaaugucuuuauuaagaacuuggacaaaaguaucgauaacaaggcuauguaugacacuuucucagcuuuuggcaauauucucaguugcaaaguggcacaagaugaaaauggagucucaaaagguuaugguuuuguccauuuugaaaccgaggaagcugccacuaagucuauugauaaaguaaauggaauguugcucaacgguaaaaagguuuuuguuggcaaguucaucccuaggaaagaacgugaaaaggaauuaggugaaaaagccaaacuguucacuaauguauauguuaaaaacuucggagaagacuuuacugaugauaugcucaaggaaauguucgagaaguauggaccaauuaccagucauacuguuguuguuaacaaagauggaaagucucgugguuuuggguuuguugcuuuugaagacccggaagcugcugaaagagcaguugaagaucuaaauggaaaagagcuuauugaaggaaaaccauuauauguugggagagcacaaaaaaaagcugagcgccaacaagaacuuaaacgaaaauuugaacaacuuaaaauggagcguaugaaccguuaucagggugucaacuuauauguuaaaaauuuggacgauacuauagaugaugaaagauuaagaaaagaauucucucccuuuggaaccaucacuagugcaaagguaauguuagaagaagggcguaguaaaggauuugguuuuguauguuuuucaucuccugaagaagcuacuaaagcuguaacugaaaugaauggucguaucguuggaacuaagccuuuguacguugcucuugcccaacguaaagaagaucgcaaagcucauuuagcaucucaauauaugcaaagaauggcuaauaugcguaugcagcagaugggacagaucuuuccuacuggugguacuggaggcuacuuuguuccuacucugccacagccgcaaagauuuuuuggaccagcucaaauggcgcagaugcguccucagccucguuggccagcacaaccucaagucagacccagcacgcaagccacugcaucagguuuucccaauaugcaaggcccauucagaaguggaccacgaggcccaggugcugcaggcgguggugguggcccaggaagugccgccgcugcugcugcggcuaugcgcuccuccaucagugcugcugcugcagcgguggcugcggcuggccgcccgacagccaaugcagcugcugcagccgccgcugcugcugccaacccagcuguugcccggcaauuggcccaaggagcuucucaaggugcuccaguaucugugucugcucaaggucguccugcaaauuacaaauauaccgcaaacaugcgaaaccccccacaaaugggagguggggcuggagcaggugcuggagguccuccgcaacaagcauuacacauccaaggacaagaaccccuuaccgcaaguauguuaucaucagcgaauccccaggaacagaaacaaaugcuuggagaaagacucuucccacuuaucagaaguauguaucccgaucuugcugggaagauuacaggaauguuguuagaaauagauaacucagaauuguuacacaugcucgaacaucacgagucccucaaggccaagguugaagaggcuguggcuguacuacaggcccaccaagcuaagcaagcugcugcaucugucaaaaaagaauaa

SEQ ID NO: 6993 - RNA, 2739 nt, Euschistus heros
augacggacucaaaguauuuuacgaccaccaaaaaaggugaaauuuucgaauuaagaucugaauugaacagugauaagaaagagaaaaaacgagaagcuguuaaaaaggucauugccucuaugacuguugggaaagaugugucagcucuuuuuccugaugucguuaauuguaugcaaacugauaauuuagaacuuaaaaaauuaguuuauuuauauuuaaugaacuaugcaaagagucaaccugacauggcgauaauggcugucaacaccuuuguaaaagauugugaagaugcaaauccacuuauaagagcccuugccguaaggacaauggguugcauuagaguugauaaaauaacugaauaucuuugugaaccccucaggaaaugucuuaaagaugaggauccuuauguuagaaaaacagcugcaguauguguugcgaaauuauaugacauuaauccgcagcuuguugaagaccaagguuuucuugaucagcuuaaagaacuuuuaucugauuccaacccaaugguuguagcaaaugcuguugcagcauugucugaaaugaaugaagccucaguuaauggugcaccucucauugaaaugucugcugcgacuauuaacaagcuucuuacugcucuuaaugagugcacagagugggggcaagucuucauauuagauucacuggccaauuacaguccuaaagaugaaagagaagcucaaaguauuugugaacguauuacaccacgacuggcucaugccaaugcugcuguuguuuuaucugcagugaaaguucugaugaaguuuuuagaaauguuaccaucugauucugaauucguaucaacuuugacgaagaagcucgcucccccauuagucacucuacucucaucugaaccagagguccaauauguugcauugagaaacauaaauuugauuguacaaaaacggccagauauccuuaaacaggaaaugaaaguuuucuuugugaaauauaaugauccuauuuauguuaaauuggaaaaacuggauauuaugauccggcuggcuucucaagcuaauauagcucaagugcuuucugaauuaaaagaguaugcaacagaaguugauguagauuuugugaggaaagcuguccgagccauuggucguugcgcuauaaaaguugaacaaucugcagaacguuguguuuccacucuucuggacuuaauccacaccaaggugaauuauguuguacaagaagccauuguugucauaaaagauauauucaggaaauaccccaauaaauaugaaaguauuauuucaacauuaugugaaaauuuagauacuuuagaugagccugaagcaagggcuucaaugauuuggaucguuggagaauaugcugaaagaaucgacaaugcagaugaauuauuggaaucauuuuuggaagguuuccacgaugagaauacacagguucaacuucagcuacuuacggcuauuguuaaacuguuuuugaagaggccuacgcauacacaagaacuuguacaacagguguugagccuagcuacucaggauucugacaauccugaccuccgagacagaggauuuaucuacuggaggcugcuaucaacugauccuggugcugcaaaggaaguugucuuagccgagaaaccacuaauuucagaggaaacugaucuucuugaaccaacucucuuagaugagcuuauaugucauauuucuucacuugccucuguuuaucacaagccaccuacugcuuuugucgaagguagagcugguuugaggaaaucccuaccagcaagaucuggaucugcugaagugguucaagaaacuccuggugcucaagucauuccaucacaagauucacugauuggggaccuccuauccauggauauaggcgggguuucagcuccuccuccaccuccaacgacaucugcuccuguugaccucuuggggcuggauucucuucuuggaggggucccugaaccuacaguaucacagaguacuacuggauugcucggugauauauucgguuuaggaucagcuggaccgacaacauauucuccaccaaaaaccauguggcucuccagugaaagggguaaagguugugaaauaucaggaacuuuuucacgaaggaauggacaaauccaaauggauuugacaauuguaaauaaagcuaugcagccaaugaccggcuuugccauacaauugaauaagaacaguuuuggugugacuccagcaagagcacuacaaguuuugagcccguuaccaccuggcacaucacaugacugcucauugccuuuaguuacuaccggagcuguucaaagaauggauccauuaacuaaucuucagguugccaucaaaaacaauauugauguuuucuacuuugcuugcauuaucccgaugcauguauuuuucaccgaagauggacaaauggauaagcggguauuccuggcuacuuggaaggacauuccagcucaaaaugaaguacaauacacacuuaccaauguucagucuaaugcagauaugguuguccaaaaaaugcaagaaaacaacauuuuuacuauugcaaaacgaaauguugaaggacaggauauguuauaucaaucaguuaaacugacuaaugguauuuggguacucauugaacuuaaaauacaaccaggaaauccaaauauuacucuuucuuugaaaucaagagcacuugauauagcugcuggcauauuccagguauacgaugccauucuucauucuuaa

SEQ ID NO: 6994 - RNA, 498 nt, Euschistus heros
augccuccaaaguuugauccuaacgaaguaaaaacuguuuucuugagguguguugguggugaaguuggagcuacaucuucucuugcucccaaaauuggaccucuugguuugucuccuaaaaaggugggugaugauauugcuaaagccacagcagauuggaagggucugaaaauuacaguuugucucacaauucaaaacagacaagcugcuauuucuguaguaccuucugcagcuucacuuauaaucaaggcucucaaagaaccaccgagggacaggaagaaagucaaaggaguaaaacauaaugguaaccucacuuuugaugaaauccucagcaucgccagaucaaugagaccaagguccaugucaaggaaacuugaggguaccguaaaagaaauucuugguacaugucagucuguugguugcacaguagauggaaaaacaccuucagagguuaucagccaaauaaaugauggagaaaucgauguugcagaugaauaa

SEQ ID NO: 6995 - RNA, 1110 nt, Euschistus heros
auguguggagaugaacccaaauuaggagaaaugaaggcucugauuuuagucggaggguauggaacuagacuuagaccccugacacuaagcaggccuaagccgcuuguugaauuugcaaacaaaccaaugcuaauccaucagauagaagcauuaguugaagccggcgugacugaaguuguuuuagccgugucauauagagcggaacaaauggaaaaagaauugagugaggaagcuaaaaaauuggguguuaaauugauuuuuucccaugaaacagaaccucuugguacagcuggaccucucgcucuugccaaagauauucuaacaucgaguaaugaaccauuuuuuguucucaauuccgauauuauuugugaauucccauucaaagagcuuguuucuuuucauaaaaaccaugggaaagaagguacuauuguagugacaaaaguugaagaaccuucgaaguaugguguuguuguuuaugaugaaaaagguuguauugccaguuuuaucgaaaagccacaagaauuuguuucaaauaagauaaacgcuggcauguacauucucaauccuucggucuuaggaagaaucaaacuagagccaacuaguauugagaaggaaguuuucccguuuauggcugaagaaggggaguuguaugcuauggaguugaaaggauuuuggauggacguaggacagccucaagauuuucucacaggcaugugcuuguaucuuacaucucuacgucagaaagccccugaaaaguuauacucuggcccuggaugcaucgguaauguuuugauucauccuaccgcucgaauagguucuggcuguucgaucggaccgaauguaacacucgguccaggagucgucguugaagauggcguguguauaaaaaaaugcacaguucuagagaaugccacuaucaagucgcacucauggcucuccggcuguauagucgguuggaaauccguuguaggacaauggguucgaauggaaaacaccacaguccuuggagagaauguaaauauuaaagaugaacucuaugucaacggaggccaaguucuuccucacaagagcaucgcuaagucuguucaagauccacagauuauaauguaa

SEQ ID NO: 6996 - RNA, 864 nt, Euschistus heros
augacuuuggacggugaagaaacuauaucggaucaagaaaaggugcgaaucguuucuaauuuuauauuacauucgccaccgggagaguuuaacgaaguuuuuaaugaugcaaggauauuauuaaacaacgauacccuuuugaaagaaggagcucucggugucuucgggcaguacugcaaagaccaacuuacgcccgugaagauuaagaacagugaguauccaguuuugauuaccgaacauaaugaucuaggauccaacagguuuuaugaugcaaggaguaaacagucguuuaaauaugauccuuuaaggagagagaccucuaauuaugauuccugggaggcagaaccagguacugaaaaguggcgaucagcauuagagguugaauuagaugcauauauagcuaaacauuuugaaagugguucagguaguguauuuucuaaaagggaagauggaaagguaagcuugguugccuguauagaagcccauuuauuucagccgaaaaacugcuggaaugguuguuggcgaucucaaugguuugucacgauagauucagauaaugcugaugugaaagguguucugaaaauucagguucauuauuacgaagauggcaaugugcagcuugucaguuugaaagauauuaaucaaucacuccagguugcggaugaacaacaguuaaguaaggcuuuaauuaaaauauucgaagacucugaaacagaguaucaacaagcaauaucugaaaacuaccauacgaugucagacacuacuuuuaaagcuuuaagaaggcaguuaccuguuacucguucaaaaauagauuggaauaagauggugucuuacagcauugccaaagaacucaaaccccaguga

SEQ ID NO: 6997 - RNA, 3804 nt, Euschistus heros
auggaggugggauugcuguuggugauccuugucgggcuuguggccagcaaagaggucaaccaagugagugagaaguuaguccgucccuuuagcagguaucccacuagauugcguggguucgccaaugggcuacagccaaaugcggaugaugaucgaguggcacccuccacugaucaaccgaacauuccguacgugauaacggaagaucggcuaaagaagauuagaucgaacuuauuguacugguuuuuugaccaagaucuugagggagguuauggagaccugcagaaggauauaacaccaucaauuacacaaguucauaagaauuuaaauuuucaacuuccauuuuuuggauuucgauucaauuacacaagaguaucacuaaacggcuauuuggaauucagugauccaccagaacaauauucguauccuuugacuuucccaaccguagaauggccucguaaaaacgauccuucauuuauuggaauauucuacaguaaaugcaggauugggcaguugggugucaaugauguggaccaaagagaaccuggaguuuauuuuaggauggaaagggauuugaugacaagaaaagacaaguucggaguagaaaugagggagaggcuaaagugggacauacgagagaguguuguugguuccgauucauuugaaccuaagcaugcuguuauugucacguggaaaaaugucucauuugccgguggaauugaaaacucuguuaaaacuacaaacucauuccaauugguucuugcaacagaugaaguuuucgcuuaugccauauucaauuauguucaaauuaaguggacuacacacacugaagcacgaggagacacuguuggaggggaaggagguauuccagcauucauuggcuuuaacgcaggaaaugguacgaggucuuacgaauauagaccauacucacagacauccacuaucagagaucugguuggccgugguugggcuaaugguuucccuggaagacacauuuuuagaauugacgaaaauauccucccuggaacguguaacaaggauauugcugcagcaaguuugccucuaucauuugcaccugaaagugguaacaugcuuggugguaccauugucaauaucacaggaccauguuucgaaccaacuaugaagaucguaugcagauuugacaugaaaucaguuuuugggacaguuguggacaggaacagggccauuuguguacaaccuuucgugauggcagaggguuacauauuguuugacauugcuauugaugaugggaaguacauuuggaaagggcaauauuucauagaaacacccgcaacagcugcugaaaaaauaucuuuugcugacaauaguguucaucaaaaauauccuccggaagucagaauaacauggaaccagaauaauuuaacuacaaauuuagcugcuccggugcaaauaucaauuuggggauacagagaaaaaucgacucgcacagagcugcacuauauagauucuuuagacguggggguuccuaacaacgggcaguacucaaucauuccaggaacuuacaaaaaucgugauaacaguuuuuucagugauaugacuuuuggauucauacaaaucaaccugacaacugcaauggauuacaauggacuuaaaguuacaccaguuaucuggagcaaaccaauaccuuuaggcugguacuuugccccacaaugggaaagacaacucgguaaaaacuggccggaagggaaauguaauaauuggauuaugaaugauagauauuugaaaaacuucgcugcugaacugagcauaugcccuuguaaacuagaacaagcacuugcugacaaaggaaaauucaugccagauuuugacugcgauauggaugccaauccacacugcuuuuaccacgaaggugcuaggcauugcguaaaaacuggagcucccagacaagaaggagcugaacaacaaugcugcuaugacaaaaacaauuauuugaugcuuuccuaugaccagcaguggggcucaucgccaaagaggugcaguaauuuaggaaucuugccauggaaugaagcaaacaagguuccaacauugucacaaugguaccaugauaucucgccauuuuaucauuguuguuuauggcaauuugaacaaucaguugguugugaaaccuuuagguucgaaagaaggccuucucaggauugcguuggcuaccaaucuccuuauauugcaacuguuuuuggagacccacauuucauuacauuugaugguuuggaguauacuuucaauggcaaaggagaguuugugcuacugcacacugauucugaaagguuuaagcuagacguucaagcaagguucgagcaaguaggaaaaaacauuuauggcgauguggcagcaacucaguugacaucuauagcagcaagagauaauacuucaagcaucauugaaguaaggcuuagaccaaaggaggcacaauggagauacagacuagaugucuuugcaaauaagaaaaggauauauuuugacaggccaucucuucguguacagcacuuuacaggugucacaguuuaccaaccuucacauguacuuaaucaguccgaaaucauuaugauguuucaaucagguguuggaguagaaguuguugaaaauaaaggauacauggcugcaaggguuuauuugcccugggaauauauaaacagaacaagaggccuguuuggaaauuggaguuucgauccaucuaaugauuucacucuuccugaugggacuguggucagugcugaaaaccucaaugacuucgagagaauacacaagcaauucgcaauuuacuggagauuagaggacaauguugaacccaauaaaggugaaccucucuuuguuagagaauauggaagaacuucaaguuauuauuugaauagaacauuuguuccaguauggaaaucaacuccucaagaaauuauuccuccuaacaggaccaaagauauacaacaagccuuggcacuuuguggugaaucuuaccaaugcagauaugauuaugcugucacuuuaaauagggaaauggccuuuuauacucugaauuauuauagugaauacacucaauuaagacaaacaaauaaagaaagaguuuugucuuguggaguguuagaaacaccaagauuugggcgaaaauccaacuuuuucuuuguuccugauuccaaaguuauauuugaaugugaucaaggauauauucuagugggagauccaaggcgaacauguucuucuucaggaagauggucauuugaguauggauacacggaaugucuacgguauaucgaauaugaugcacaacaaauugcaaagacugugaugguuauuggacugaucuugguaccucuaauuaugauuguaauaugcgcugcaguauacauaauuaagaaagccaaaggagauaguucacaagcuuccuggaaauuuuccaaaguuuauuccgccccuucaagcucauacauaccagcuaaaacacaucccucucaagauccucaucaggcuucagcacccuucaugaaaaaugaugauaguagcccugacacuacaagaaguauuggauauccuggucauucaaacaugucucuugauaaaagucaaggauuaaagccaauacuaucuuugccauaugacaaaacauauuacacucaugaaccauugcgaaauagaccuccaauugacuuugaagauuaugaagaagaaggaguacaacuuucaggagauuucaaugaucguaaugaugccccaacuuugaaagucaaagaugauuuuagaaggcacaauaguguugaaacagauaucuucuga

SEQ ID NO: 6998 - RNA, 342 nt, Euschistus heros
augcguuacguggcagcuuaucuacucucuucccuugguggaaaagaaucuccaucagcagcugauauugacaagauauuaagcucuguugggauugagucugauucagaacgagugaacaaaguaauaucagagcuuaaaggcaagaauguugaggaaguuauugcugcagguaaagagaaguuagcuucaguaccaucaggaggugguggagcaccugccgcagcugcugcugcccccgcugcagccucaccugcuaaagcagcugaggaaaagaaggaggcaaagaaagaagaauccgaccagucggaugaugauaugggcuuuggucucuuugacuaa

SEQ ID NO: 6999 - RNA, 2748 nt, Euschistus heros
auggucgugaugaugucugaucauauugguggaauuacccuuaaaugggaucccaaaaaccuagaaauacgaacguugucaguggaaaaaacuuuagaaccacuugucuuacaggugacaacacuuguaaauaccaaagggccuaguaagaagaaaaaggguaggucaaagcgagcucauguuuugguugcugcuguugaaaaagccacugaaaacuuuauugagaaaggugaaaugauagcuuaugaaaacccugauauaaaacaagaaaugcuuucugcuguugaagaagugagaaaaacaggugaagcaaugagugcagcugcuagagaauuugcugaugacccaugcucaucgauaaaacgugguaauaugguaagagcagcacgaaaucugcucucagcugugacaagacuauuaauucuagcugauaugguugauguacaucuguuguugaaaucucuuagaguuguugaagaugaucuuguuaaaguuaaaaaugcaucaagucagccugaacugcuugaaaauauuaaagcauuuggacguaaugcuucggaguuaaugucacaggcugcgaaacgacaacuugagcugaaggauucacaauuaagggaugauuuagcugcggcacgugcuguauugaagaaacauucuaccaugcuacuuacugcuucaaaggucuaugucagacacccugaacuugcugcugcaaaggcaaaucgugauuauguuuucaaacaaguuugugaagcugucaauacuaucagugauguagcucaagguaaaggaccauccaucacuaccaaccccuaugaaggccccggugagcuugcagccgcucucgaugauuuugaugaacgcauggugauggagccucuggccuauucugaaguagcuacaagaccuucucuugaagaaagguuagaaaguauuauuaguggugccgcacucauggcagacucuucuuguacuagggaugagcggagggagcgcauuguugcugaauguaaugcuguacgucaagcucuucaagaucuucugucagaauacauggcuaauaugaguguuaaagaacaaagugaaggucuggagagagccaucgaucauaugugucguaagaccagggauuuacguagacaauuaaggaaggcgguuguugaccauguuucugauagcuuucuugagaccaguguuccucugcuaguuuuaauugaagcugcuagagcggguaaugagaaagaugucgaagaguaugcccuuguuuuucaggaacaugcuaauaaacuuguugaggucgccaauuuagcauguucuaugucuggaaaugaggauggggugaaaauggugcguuaugcugcugcucaaauugaugcucuuugcccacaagucauuaaugcagcucguauacuuggagcuaggccuaaaucgaaagucgcacaggaaaacauggauguuuucagagauucgugggagucacaaguucgaguacuaacugaagccguagaugauauaacaacuauugaugacuucuuagcuguuucugagaaccacauccuagaagauguuaacaaauguguuauggccuuacaagaaggagauggagauucuuuagacaggacagcuggugcaauuaggggucguucagcucguguagccaauguuguuacugcugaaauggacaacuaugaaccaggaaucuacacagaaagaguucuagaagcaauuaaaguucuuagggagcaggugaugccaaauuuugcucaaagaguggaaguugcuguagaugcucuuucuucaaauccaccuaaagauguugaugaaaaugaguuuauugaugccucucguuugguguaugaugguguuagagaaauucgaagagcuguucucaugaacaggaguucagaagaguuagacacugauacggaauucgaaccaugugaggacaacaugacuauugauacgaagaauagaccuagugcacauacugccgaucaugguguugaugaguauccugaaaucagugguauuacuacugcuagggaagccaugcguaagaugacugaagaagacaagcagaagauugcccaacagguugaauauuucagaacagagaaauugaaauuugacagagaaguagccaaaugggaugauacuggaaaugauauaauugucuuggcgaaacauaugugcaugauaaugauggaaaugacagauuuuaccagaggucgaggaccauugaaaacaacaauggaugucaucaaugcugcaaagaaaaucuccgaggcuggaacuaaauuggauaaauuaaccagacagauugccgaucagugcccugaaucaucuaccaagaaagaucuguuggccuaucuucaacgaaucgcgcuguauugucaucaauuaaacauaacuucaaaagugaaagcugauguucaaaacauaaguggugaacucauaguuucagggcuugacagugcaacuucccuuauccaagcugcuaaaaauuugaugaaugcuguaguauuaacagugaagucaucuuauguggcaagcacuaaauacccgcggcaaggaacaguuucaucucccauuguuguuuggaagaugaaagcuccagaaaagaaaccucuugugaggccagaaaaaccagaagagguuaaagcuaaagugaggaaggguucgcagaagaaaauucagaacccuauaaaggcacuuucagaguuucagagccccgcggagucuguuuaa

SEQ ID NO: 7000 - RNA, 1242 nt, Euschistus heros
augaacgacaauaaucuucaaucuacuccgaaaaccaaugccagcagcaguuucuuucaaaccaacacgccaaaaccagcguccaauguuaguuuugguucuacuauguccacuaaucaaacucaaggcacaggauuuuuaaauuuuacgccuccagugggaacuucuaaacagucuacaauguuuaugccaccugcaucuuuaacuaauacaaguacuccaaaaacuacagcaacagguaaugcaacauuguuuaauauuacaacuacagcagcaacuccugcuucaguuccugguggugcaguuacaacuucauuuacucuugguaguucuucaucauuaacuacuucucagcaguucaaaccaccuuccacaucucaaccaauacaauuaaaaacuucuaccccaggugccucuaugccauuagguacugguuuaucaucuacaggaggaaaugcuccaccaacuggccugaauuuuggaucugcuccuaaaucaacuaauucuggaucuacuaucuucaguucaacaaaaaguucacucccagcuucuaaugcuguuacaaccucaucuuuaacauuaacuccuucuucuaccacuucucuuaccaauucauuaucuaacaaaccuguuacuagcacuggggcuacaaccucccagcaacaaagccuuacauuucaacaauuagaagaauugauucuuaauaaauggacugcagaauuguaugaacaggaaaagguauucuuaaaucaagcuacacagauuaauauuugggauaagguuauuaaugaaaaugcugaaaaauuaacucaguugcauucuacuauggaaaaaguacggaagcaacaaacaaaaauaaaugaugaccuagagaucauaucuacacaucaaaaagacuuggaagccugucuugugcccauggagaaggaagacuuguuaucaguucuuaaagcugauccaaauaggaaaaaucuuuauauaaaugccaaaaaaauugauucucagaucaaaacuaugucugaggauuugaaggaaacaauugaacauauuaaugaaacuucacgaucucaugauacagaagauccugucauucagguagggcgaauuuuaaaugcucauauggaaucuuuaagauggauugaugaacauacugcaagaaugcaagauuauuuugauuccuuauuaaaaaugcaugaugaccugaggagagaaugugaaauaagcaaacaugauguauacuga

SEQ ID NO: 7001 - RNA, 582 nt, Euschistus heros
auguucauuugggauugguuuacaggaguuuuaggcuauuuagguuuauggaagaagucaggcaaacuguuguuuuuaggauuagauaaugcugguaaaacaacucuucuccauagguuaaaagaugacagauuggcccagcaugugccaacauugcacccaacuucugaagaacuauccauaggaaauaucagauuuacuacuuuugaccuuggagggcacacucaagcucgucgaguauggaaagauuacuuuccggcaguugacgcuauuguuuuucuuguugacgcuugugacacaagucgauugcccgaaaguaaagcagaauuagaugcacucuugacugaugagagucucaucaacuguccaguccucauccuuggcaauaaaauugaucuuccaggugcagcuucagaagaugaucucaggaauuuuuucaaucuauauggacagaccacuggcaagagcaaaguuccacgaagugaauugucuggucguccauuagaacuuuucaugugcucaguucugaaaaggcaggguuauggugaagguuuccguugguuagcccaauauauagacuga

SEQ ID NO: 7002 - RNA, 1785 nt, Euschistus heros
auggcugaaaacaauauuuaugaugaaaugauccucaccguuacaucggagaaguuuuacaucgagccuauugaagauguugauaacaaucuuguccuggacagguugacuggaaauauaacaucaaauguuucaagaaacaguggagaugcaccaauaaucggagaaaaaaaaccuauuuauggaauaauugguaucauuaggcuacuagcuggccaauaccugguugugguaacuggcagaacaaaaauugguaauauauggaggaaagaaauuuuccagaugggcucagcugaagugauauguauuucaagaaguauuacucauuugaaugauaugcaaaaaaagauugaaaaggaauauguaucgaugcuggaauccauucuuucuacacccaauuuuuauuuuucauauuccuaugaccuuucucauacuguccagaggcugcauaauauuucaccugauuucuugaaaaugcccauguaucagagggcagaacagaaguuuguauggaaugaauaucuuuuaucugaauuguccaaaaacugugcagacucuagauuuugucuuccaguuauucaugguuaucuuucaauuacuucuugcauuuuaaaugguaaaaccuucagucugaucuuagucuccagaagaucuaaggaaagagcuggaaccagauuguuuacuagggguauugacucagauggaaauguugcaaacuuuguugagacagaacagauugucgagacaaaauuugagcgugcuaguuuuguccagacacgaggcucuaugccauucuucuggcaacaauacccuaaucuaaaacugaaaccacggccuguuauacaagaggaaaaucauacugcugccuucacuaagcacuucaauacccagauaauggauuauggaaggcaaguuauagugaauuugguugaccauucuggaucugagggaaagcuagaagaguuauauagaaaguuaguaaaugaagcaaauauugcagaucuaaaguacgaagcuuucgauuuccauagggaauguucuaaacuacguuaugauagguuaaaaauucucauugaccgccuggccuaugauuuagaacagaugucagugacaaugauuguuggaaaugggacuguuguaucucagcaggaagguguauuuaggacaaauuguauugacugcuuggacaggacuaauguuguccagucaauguuggcuagggucaaucucucuuauguuuuacaaaagcuuucaauauugaagaaaggagaaacaguagaagaucaaguucaacuugagaaaguguuuaaacuacucuggagugaccaugcagaucuaauaucaacccaguauucuggaacuggggcauuaaaaacagauuauacaagaacaggaaaaagaaccacagcuggaauuguucaagaugggauaaacucgcuuguacgauauuacauaaauaauuuucagcaugguuuucguaaggaugcauuagaucuuuggcuuggucauuaucggguuucuucugaagaagggauugugaucaaaagccccauuggugucaaaagagaauucaaguauaaagcuuuuccacucauccuacucguugcuguugcuauauucuucgcaaaccuggucacugcaaaugaauauacuacagguacucuccugucucucauauucugguucucaaugguaucagcuacuguuaugguuauauuuuacaauggaucagaauauguaaauugcccaagacuguguccccuucuuaggucgccaucugucuag

SEQ ID NO: 7003 - RNA, 1551 nt, Euschistus heros
augucuccaacugucccaaccaccacaaacguuguugacaagagaccaacacuugucaaaccacacucugcugaaagaagaucagaauuaguuugucguguaaaguacugcaacacuuugccugauauuccauuugauccaaaguuuauucaauauccauuugaaucuacucgauuuauucaauauaauccuacaucacuugaacgcaauuauaaauaugaaguucucacugaacaugaucucgggguuacuauugaucucauuaacaaagauauguaugcugcugaucauaaugcuguucuugauccugcugaugagaaauuacuugaggaagauauccuugcaccucaugauucuaaaagguccaggcaucauucucgagcaguuucauggcuucguaggacagaauauauuuccacagaacaaacacguuuccaaccucaaguuauggauaaaguugaagccaaaguuggauuuagcauuaagaaaagucuuaaggaagaaacucuguacauggauagggaaagccaaauuaaagcuauugaaaagacauaugaugaugcuaaacuaccuauagagaaacaucauagcaaaccaaauguuguuccaguugaaauucuucccguuuuuccagauuuccaguuguggaaguauccuugugcucagguuauguuugauucagacccugcaccuauaggaaagacuguucccgcucaguuagaacaaaugucacaagcuaugauucggggugucauggaugaaagcggagaacaguuuguagcuuauuucuugccuacugauucaacuuuagaaaagcgcaggagagauuuuacaaacgguauugauuaugaagacgaggaggaauaugauuacaaaauagccagagaguauaauuggaauguaaaaacaaaagcuucaaaaggauacgaagagaauuauuucuuugucauuaggcaugaugguguuuauuacaaugaauuagaaacuagaguacgguugaguaaaaggagacagaaggcuggaacugcuccaaauaauacuagauuaguuguuagacauagaccaauggaugcuaaugaauuuaacauucaccgucuaagggagaaacaacuucaacauccaguggaagaagaagaugaagaagaaagcgcuggugaagaagauaagaaggaggaagaaaaaaagacaaacagcaaagauuccgaugagagugacaaagaggaggguaguagugagaaggagggaagugacaaagaugaaggaagugguaaggaagauggaaguggaaaagaagaugguaguggcaaagaaaauaauagugacaaagaugaagcaagugacaaagaagcugagagugaagcuucugauaaagaggauagugacaaagaagccagcgauaaagaugauaaagaagaaaguggaaaagaaagagguagugguagugaaaaaaguggagaugaaagugaagcagagucgagugcuucagguggaggaaguucucgaaguucugcaagugguuccaguaagucuggaagcgaggaagaagauuaa

SEQ ID NO: 7004 - RNA, 1203 nt, Euschistus heros
auggauaacgaaggaguuacaccagcauauaugaagcucucccagauuaaauuugcuuuaagucuuccagaguaucagggagauguugccuuaaaagaagaacuucucaaugguauuaaagcaggaaauauggcaccauacuaucgugagguuugcaaugaccuuggguggguaauggaugaaaguuugugugcacauauggugaaaaauaaugaacuaaggcuugcagaauuagagaaagaacaugagaauucaguuauugaagaugaagagcaagugaguggucuauggcaggcaaaacuagacuauuuguguaguauuggagacaaagaaaaugcuacuacauuagcaaauaguaagcuacaagauaaaacugugccuaagacucaucguauugaugcuguuuucgcccuguuuaggauaucauauuuccaugguugugacauuaaagggaugucugcagcgauugaaaaagcuacugaauugauagaaggccaaggugauuggaguucaagaaauaaauugaaagcuuaugaaggaguguggaguuuugcaguuagagacuauuugcgggcugccaaacuauuuguugauguaguaccaacauuugaaucuuaugaacuugcugacuuuggaacaauuauuaaauauacuguacuuucauguaugauagcauuaccgaggugugaauuaaagaagaagcuuaugcaccaugguguaauggcucaggcucuucacucucaguaccguaacuuaaaggaguauuuccagucccuuuaugauggucacuaugcagauuuccuagucgcucuggcacaaguagaaucugauaugaaacgggacccucugcuacauccccauuaccgccacuaugugcaggaaaugaggcuuagagccuauaaacaaaucuuacaagcguaucgcucacugucuuuagacuauauggcagaagcauuuggcgucuccugugaauucaucgaacgggagguagccaaauuugcugcuucaggccgucuccaauguaaaauugauuccguggcucguucuguaauuacaaguguccaucucagugaugaagcucuccguguaaaggauucgucagaucucgaccuugaccgcucucucuuauauaagaccacuguuaagaggggugauauucugcuuaauaggcugaaaaaguuagcuaggguuauggauuuuuag

SEQ ID NO: 7005 - RNA, 3981 nt, Euschistus heros
augucuucuauuacacuaucucacuuccaaaagagaccucgauaugcagacuuugguaggaaacggggugccaaaacgaaaaugagaggaauauuugguguacccgggcuugguuuacagagaccuuuaauggauucaaauaccaaaccugaagaugaaccuggacuugaaaauaaguugguucuuguaucaucucgugacaaauacguguuaagucaagauguuuguguuauguguggugcuuuagggcaagaccaggaagcaugucuuauugccugugcacagugugggcagucguaucaucccuacuguguaucaguuaagguuaccaaaguaaugcuucagcguggcuggagaugccuugauuguacaguaugugaaggcuguggccaaaaaaacgaugaagggcgguugauacuuugcgaugauugugacauuucuuaccacaucuauugcauggacccaccacucgguuccguaccuucugguguuuggaagugcaaguggugugcccauugccagacuuguggauccaacaguccggguccuaaugcaguauggcaggcuaacuuuacccagugcgguccuuguuuuucaagaacuacuugucccgcuugccuagagcuuuauacagacggugaucucauaauaaaguguauucacugugauaggugguuacauugccucugugauacaauaucuaaugaaaacgaagcagaagcgugcugugcgcaagguuauacuugccuucucugcaggccaagucauguggcuuugguguuaccugcaacaaccccaucgagagcuccaucgccugaaauuaauacagagaguaaagcuacagacuacuauguagacggcguuugcuuaucugaaacugggcugcaauuaaucaaaacucuuucgauggauaauggaaaucaaccagugagacguaaaagaccaggguuccggaggcaagauccuucccuugagcuaguugaugacauggauaaugaagggaaagagacucucuauaaggacggcauguuuugggguucuaaagaaaauggaccaauuccaagcccaccugaagguuucacgcuguauacaagggaaaguggaaucguuguucugaaaagauuaaaaaagagaaaucuucaaaggcuuggcauuggcgguuucacuacugucaaaaugaggagcacuagauuaaaagaagaugacgagcaucuguauccugaagaaaagcccaggagaaaaccuagaguuccuaagaagaaaagcaaaauugccgaaaguuauccacgacaccuucaggaagcuuucuuuggcaaggaauuacuugauacaacuauggaaacuucacaaaaauuagagagcacuggagaugaaucagacgauggaaaauuaagggaggaagaagguagugauggcgagacguugaaggauauucuucaucuuccugaaaaucuucuucacaacgaucuagucaacacgaucaugaaugaaagugcagauaguaucaaaucagaaaaucuaaugucagagaguggacacgaagguagcggaagccaaaaagacgaacuaugugauauucuuggaccucauuuuaguauagaaucaaugguuagggaaacaggucuuccaaauauggauuccaaagauguugaagaaauuuucaaaaaaguucuuacggacgagagccgaaaucagggccaccauaaucaagcuuccccucagcaacagcauccugcugcgaaaaguacaccagcagcauuggcuucuucuccucugcaguauccaucagcuucuccguauaacucugaauauagcaauagcccucaguucaguccggaaaguucuugggaugaucuuggcucuuauaauagaacuacaucauuaaaaauggaagcagacgaaucacucggaagagacgcgaccauaucuccuguacuuuaugcuaacaucaaccauccagaguggaaaaaagaauuccccaguuggaaugaacgcuuuaaacaaauucuaaaaaaguggcgugcgcuacccucugaagaaaaggcuccuuaucuucaacgagcuagggauaacagagcuaacuuccgcaguaggaagcaggagcaugacaaaacauugaauacaaaaucuugccgggaagcugaacaagaacgacaguggaaagaguuacaggcucuaaggcagcaacaacaacacaugcugucucaaaccaggguucagcaagugaaccguguccgccaaguuggcaauacagggcuuguacaauuuucaacuacugagcaacccccuucuccccauuugacucaacaauuacagguuucaacuucgucucaggaggcuagccuugguggcuuaggaucaccuagagcucaauuugcuucugguacugguggcacugugaagguggcgacaccugguggugguaccacuauuuacagacaggugcgaccaccucagucaccuuuuccaagcccgagcccgaggcaaccaucaaccccgcaacagcaacagcaggaggaagugagacagcugagggaucuguugcagaggcaucaaguuaaacaagaaggaacggaaacugucuugucuggagguguucuccaaggaguacaaaugagaccucagccuccuaggagcagccuucacccacaggcugugcacggcauggaaccgaggguuagacuagugguacaacaacaacccucaagguuuccaggaaccacccaaguaagauuggcugcuccuagggcgcaacuccaagaccaguuucucauacaacggcaguucgcugcagccgcugccgcucaacaugcucauaaugcaagugcaauaauuaggaauaguaguaauuuaguugaacaaacgaggcugcaaucuauaccugucgaccaaaggauccaaacuggaggccgagaaggagaggaaauaccagaaaguguuaccgcggaauuagaaaaguuggaagaagaaggagguacaauugguggugaagccgacgagguuucugcaauuuucucuggucuuguggaagaugaugaugaacuucucgcggaaauggguccggauuucaauauucuugaguaugcugauccagaacuugauacuguaucuggaggagaaaagacgaauauccuugacgaucuggaagaugaaguugagaaaaaaaaacaaaugucuuccagaaaagaaaauacugcuagaagaaguucuucagacaguauuaauaaagagcuaacugaaccaagaccugagaguaagccaagcgaagaagugaauaggguaucgguaacauccacuccaccucaucuaccucaacagauuucauuaaguggaaacaguggcauuacacaaccaaaaauuguuggaucagguuaccaaacgcaauuugcgacuccuaguacaccucucccgaggaugcaaguuuugcaaggugcaaaucaagugagucguggaaaugcaagcuuuguuggcaauccuccgccuccuccacccccauauccuggcccucccccaccauauccagggcagcaagcugcgauacgaggaagggguguuagaucgcacaucaucccaggcccagcggcacaggcucaacagagaagaaccuugcuccuucaagagcagccucuacugcuggaagaauuacucgaagaggagaaaagggagcaagagaaagcgucgguagcacccucaccggcgaguucucuuaugagcgacgcugacuucgagauguugagggcugauguccuugguucccggaccaccaguccuccucaaucucaaucucucggaacucuaaaucucgugggcccaccuccaccuccaccuccagaaaacauuguuacggaagcugauaggcaggcucaaguccaauaugaaacauggcuucgaacaaccggaagugccgucagccaacagauccgguauuuugaaacggaaguucaaaaauuaagaaaaauacgcaagucguuaaauaguaaa

SEQ ID NO: 7006 - RNA, 4308 nt, Euschistus heros
auguccgaagacagugaaaaccauaaagcccgcccgaaaagaaauuuaucugggaagcagaaaaaacuugaucuacucgaaaaacuuaaaaguggaaagaaaaacaaauaugauauuggggaacucgaaaacgucuaugaagaaguugaugagaaagaguauacucgcaaaguauuagaaaggcaagaugaugauuggauuguugaugauggugguuguggguauguggaagauggaagagaaauauuugaugaugauuuggacgaagaaucaaucaaaaagucucagaauauuguuacugguaggaaaagaggccgagauauugcuccugaaaagaaaggaaauauucguaauaugcuugcaaaaaugccuucuaaaaagaaaaaaaaagagacuguuguuaaacuggaagaagaugauauucuuggagauauaauuggugaaauagauucaacaucagugguaccauuaaaaaauaguaauaagcagccugaaauaucugaaaaagacuauuuaaaaucauuaaccaauuuuaaaucaaccaaaguuaaaccaucacccgugaaacguguaaaaacaaguucugaagucaagacucuuccuuugguuaaggaaacugaaaaacauaaaauggcagauuuaccaguugagaccucuccuauuaagauaaaagaggaaccgauagauguugaugagauacaagauuacaguugugauauguuuggugaugacuuugaucaugaagauauagaaauuucugauucuaaagccgaggaaguauguucaagggauaucaaaguagaaccuguuucuccuccaagagaggcaucuccaguuaaaauggaaguugucaaagaugaaauaagugaagauugggacaagcaaauugaauuugauucuccagugacuuaugucaauguugauaaaucuaaauuaccucugcugaaaaaugaaacuggucaagagguuuuaagauucuacuauugggaugcugcugaagaaguauacucccaaccaggaacuguauuuuuuuuuggaaagguuuugauugaaucugcuaacacuuauguaagcuguugugucucgguaaaaaauauugaaaggcguauauuucuucucccaagagaagagaaaaugaaccuuaagacaaacgaaacuuauggugauucugugacaaugacagauguuuaucaagaauucagcucagcuguagcugacaaauauaaaauuaagcaguucaaauccaggaagauuuccaagaaauauucuuuuggugauaguagugugccuucagagucugaguaucuggaaauaagguauccgaguacuuuuccugcauugccuagugaucucaaaggugaaacauuuucucauguauuuggaacaaagacaucauuuuuagaaauucuucucuuagaacgagggaucaaaggaccuaguuggauugaaauuacaaaugcugagccuguccuagcuccauucacauggugcaaaguugaggcauccuguaugaaggcaaaugaugucaauguguugaaaaauggucuuccacccauuccaccauuaguuuugguuacucuucauccacaagcgguucauaauccuaaaacaaaacagacggaaaucguugcuguagguugcuuggucaguaacucuuacccaguugacaaaccuccuccagauaggcuauuuaaucaacacuucuguguuuuuucaaagccaucugaucucacuuggccauaugauauaaaagaaucacuauccaauuucaaaaaaacaucacuggagcggauggaaucagaacgugcacucuugaaucuucuuuugacaaaauuguaucguauagauccugacauaauuguaggucaugaucuuucuggauauggaauugaauugcuugugaaaagguuagcauuucacaaaguucccaauuggucacgucuaggucguuugaaacgaucggugauaccuacgacuaaggccagaaaucaaauagaaaaaauugcucuuacuggucgcuugaugugugauauaaaaguaacugguaaggaacuucuuagagcucguaguuuugauuuggauucucucugucagcugguuuuacauuuccaagaaaauaaaagacaagauuuuacugaugaggaauuuaaaaguuguuuuuuuuccggagagaauuuagucaaggccuuauggucaauaaugacagaugcuuccuauauauuaagaauuuuuacugaacuuaaugcacuuccuuuggcuuuacaaaucacuaauauugcagguaaugucaugucuagaacauugauggguggucgcucagagagaaaugaauuuuuguuacuucaugcuuuucauagcaaaggguauauuguuccugacaaagaauauaaaaagacugccaaggaugaugauguagauggcacugcagaaguuacaacgaauuccagaaaaaagccaucuuaugcuggaggucuagugcuugauccaaaagucggguucuaugaugauuugauucuccuuauggauuuuaauucuuuguauccuagcauaauucaagaauacaacaucuguuucacuaccauuccuccaucaucuauugauauggaugaagauuuuaaugaaaauuaucaaaaauauuuuccugaggagucuauggaaccaggaauuuuaccuacugaaauucguaaauuaguugaaagucgaaggcauguaaagaagcuucugaagucagccgcuucuccugagcagaaaaugcaguaugauauucgucaaauggcuuugaaauugacugcuaacaguauguaugguugcuuaggauuuucaaauuccagauuuugugccaaaggucucgcugcucuuguuacagcuaaaggcagagaaauacuuuuaacuaccaaaagaaugguagaaucuuuuggcuaugaaguuauuuauggagauacugauucaaucaugaucaauacuagaaccaaagacuuugaacaaguacaucaaguugguaagaaguugaaauuugaggugaacaaauguuacaaacaaguugaauuagauauagauggaguuuucaaguauaugcuucuguuaaaaaaaaagaaguaugcugcuguaacaauuaauaagcuuccaaauggugaguucguugaaaaacaagaaaugaaagguuuggauauuguuagaagagauuggucucaacuagcugcugcagcuggaaggcacauuuuaaaugaaauauugucgaacaaaucaagcgaugauagaauugauggaauucacaauuauuuagaaaaaauccgcucugauuuagagacuaauaaaguaccaguuaccuugcuaacagucaccaagcagcugacuaaaccaccagaagaauauacugaugcuaaaaaucuuccucauguccaaguugcccucaggcuuaacaaaaauucugcuaaacggcucaagcaaggagauacuguuuccuaugucauuuguaaggaugguacaaauaauucugcagcucaaagagccuaucaugucgaagaauuaaaaaaccaagauaaucuuucaauugauguacuguauuaucuugaacaacagauccauccugugauuucacgucuuugcgacccgauagacggaauugaugcagcgaguguggccagaugucugggucuugauccaacgaaauaugcacgugugacaacuauuacugaagagucugaugaaauaacuaaauacacauuagguagagcuaaugaagaaagauucaaggauugugaaagguuuguuuuuacuuguaaaaauccuaacuguaaaacugauaauacuguugagggauuaagacauaaagaagauaaugguguagaaggcuugcuuauguuagaaaaauguaaaaauccggagugcaaaguuucaccaguggaguauuugccaaguauacaaaaucagcuucauuuccggauucguuaccacauccagaaauauuaugaggguugguuaauaugugaagauccaguuugucaaaauaggaaacgaauaauuaaucccauuuuuucuaaagguuuccccgaguguaacaaauguuaucgaagcacaaugaggagagagguaucuaacuugaguuuguauacucaacugacauauuuucaguuuuuauuugaccugagcagggaugcuauuacaaccauuaaaguagaaccggaaauaguuaaugcuuacaaaagguuguacgaucaaguuggggaaguucugaaacagaauaaauacucuguuauugaucuuggaagccuguuuucucaacucuuuccuuucaaaagagacaaauaa

SEQ ID NO: 7007 - RNA, 1461 nt, Euschistus heros
cgcuauuaucuauggcgaccgagaaaacauucaggaagguuauuguuuuuuaaaagcgagauggcggcugggacucagguuaaaaauguggaaguccgugacauugcuagaauugaacgaauuggagcucauucccauauucgaggacuggguuuggaugacagcuuggaagcgagagccgugucacaaggaaugguugggcagcagauggcuagaagagcugcuggagugguuuuaggaaugauuaaagaagguaaaauugcuggaagggccguguuacuugcuggaccuccuggcacaggaaagacagcuauagcaaugggaauuucaaagucacuugguaaagauacuccguucacugcaauggcagggucagaaauuuacagucuugaaaugaguaaaacggaagcccuuacucaagccauacgcaagucuauuggaauaagaauaaaagaagaaacugaaaucauugaaggugagguuguugaaauucagguagaaagaccagcaacaggaguuggugcuaaagucggaaaacuuacauuaaagacgacugaaauggaaacugucuaugaccuuggaacaaaaaugauugaugcccuuaccaaagaaaagguucaguccggugauguaauuacaauugacaaggcuacugguaaaauuaguaggaucggaagaucauuuacaagagcgagagauuaugaugcgaccgguccucagacaagguuuguccaguguccggagggagaauugcagaagagaaaggaaguuguacauacuguaucuauucaugaaauugauguuaucaacucaaggacacauggguucuuggcucuuuucucaggugauacaggugaaauaaaaccagaaguuagagaacaaaucaacacaaaaauugccgaauggagagaagaaggaaaagccgaaaucucaccagguguucuguucauugacgagguucacaugcuggauauugaauguuucucauuuuuaaaucgagcucuugaagaugagauggcaccuguuguuaucauggccacaaacagaggcauuaccaauaucaggggaacuaauuacacuucgccucauggaauuccgauugaucucuuggacaggaugaucaucauauccacaucucaguauaaggagaaugaacuuagagaaauucuaaaaauuaggugugaagaagaagauugugaauugucugaugaugcuuugacaguccuuacuaggauagcuauggagacaagucuucgguaugcuauacagcuaauaacacuagcgggccugguuuccagaagaagaaagaguaaugagguugaaauugaagauguaaaaaaaguauauucuuuguuuuuggaugaaggaagaucaacacaaaucuugagugaauaccaagaucaauaccuuuacgaccagaagccugauccuaguggaggaggugaaccaauggauauguaa

SEQ ID NO: 7008 - RNA, 1110 nt, Euschistus heros
augucuauccgaacuuauggugauaaaccgauuaguuuccaaguugaagaaaauggagaauauuacugcauugguucugaagucgguaauuauuuacggauguuucguggaucucuguauaagagauauccuggaauguauagaagaacucuuggaaaugaggaaagaaaaagacuaauagagcuugggcuaagcucucacuguuuggcuuccaguauaucucuguuacgagcaucugagguugaagauauuauugagggcaaugaugaaaaauacaaagcuguuucuguucauucuucugaaacucccauuacaaguucuucuaaaccgaaaaaagcuaugccauggguaccuucucuuccgaauaguucgcauuuagaugcuguaccgcaagcaacaccgauuaauagaaauagaguuguuagcaaaaaaguaagaaguuucccucuuugcuuugaugacacugauccaucaucuaucauggaaaaugcuucgcaaauggaaguacucguaccuauacgucuugacauggaaauagaaggucagaaacuccgugauacuuuuaccuggaauaaaaaugaaaguuugauaacuccugagcaguuugcagaaauucuuugugaugaccuagauuuaaauccccuaaguuuugucccugcuauagcccaggcuauccgacagcaaaucgaagguuucccuacugacaauauuuuggaagaucagacugaucaaagaguuaucguuaaacuaaauauucauguugguaauacuucccuuguugaucaaauagaaugggacaugagugagaaggaaaacaguccugaacaguuugcgaugaaguugugugcagaacuuggauuaggaggggaauuuguuacagcuauugcuuauucgauucgagggcagcuuaguuggcaucagaaaacauaugcuuuuagugaaucuccccuucagacuguugaagugccuuuccgaccgcaguccgaagcugaucaguggugcccguuccuggaaaccuugacugaugcagagauggagaagaagauaagggaucaggacagaaacacaagaagaaugagacgauuagccaacacuacuccugggugguaa

SEQ ID NO: 7009 - RNA, 711 nt, Euschistus heros
gggaaaucgcgagugccaucuaaaaugucaaacuuaguuauauuaaaggcacuggaaacagcugcuuuuugggcuaggaauguccacuuaguacuguugggaguugcuccaagugguuauuguuuagugauggcugcuauacguaaaaaauuaguuauaguuggggauggugcuugcggaaagacuuguuuauugauaguauuuaguaaagaucaauuuccagaaguauaugugccuacuguguucgagaauuauguugcugauaucgaaguugauggaaagcaaguggaacuagcauugugggauacugcuggucaagaagacuacgaucggcuaagaccacuuucuuauccugacacugaugucauuuuaaugaguuuuucuauugauucgccagauucauuagaaaacauaccugaaaaauggacuccugaaguuaaacauuuuuguccaaacguacccaucauucuuguaggaaauaaaaaagauuugcgaaaugauccaaauaccauuaaagaguuggcaaaaaugaaacaagagccaguuaaaccagaagaagggcgagcaauggcagauaaaauuaaugccuuugauuaucuugaauguucugccaaaacaaaagaugggguuagacaaguauuugaaacagcaaccagagcugcucuucaagucaaaaagaagaagaggaaccgcaaauguaaacuucuuuga

SEQ ID NO: 7010 - RNA, 3987 nt, Euschistus heros
augaaucuuaguuuaaguaauuaugaaagaguuccacccuuggacuguuaucagcccucaggaaaucuuauagauuuggcugaccgaaugcuagaaaaauucacuguugaggauaauaauuuaccccaacugcuggacaggcuucaaaucaccugugaaaguggaacuacaucuagugggacaaaagacacugauuauauuaacaauguagacucaaguuauuuaucucaaauaucucaguucagauugauuaacaagauaccucuuccucaagaaauaucugaccaguucagcacucuugcagcaggaucaucaggagauacaucuaucaugggaauguuuccagacauuaacagagcuuggauggcaguugaaagugauauauacuuauggaacuuugaaacaggaggggauguugcauauuuugaugguuuaagugacccuauuguuaguguugguuuaauagcuccaaggccuggaguuuuucaaaguuuuauuagccaucuucuuauucuuacaacaccuguagaaauaacuguacuuggaguuauuuugucaucuucaagugaucgaaaaguuggugaugaguuacaacuuacaccagauaccauuuacaccuuaucuacugacgguguuccaauaaggguuauuaaagggacaaaaaauggacgaauauuucucggaggaaaagauggaaaccuuuaugaauuaguuuacagaaaagaaauaaguuggggugguaaaagggcuuggaaaguaaaucauaccaaggcuauucuuuccuaucuuguuccaacuuuuguaucaggagcuuuuucggaagaagaucaaauuacagaaauaacuauugaugaaucccgaaauauucuuuauacacuuucgauaaaaggaucuauugaaguuuucgaucuugguagaaauggagauacaacauguagaguugcaucacuucaucauucuuuuauuaaccgaagcacaguugaucuaauuaggaaaucauuucauuucaggaauaugacucccccagaaguuagucgaguagugagucuauguccuauuucugaaaaugauucuccacauuucggaguugugggcauuacggaaaaugguauucgauuauauuuuacuacaggaagcccuccuaggccauccacauugucacuucuucaugcuaggcuacccccuggacaugcuccuaacacaacuaauguuaggauuggcagaguugcuauggcuauucauaaaucagguacauuuauuaugguaucauccaugggugacuauucaccugaccgccuuuggugcuuuacuauggaugguauaucugcucugaaguugcccuuaacagaauuugucuuuacaaauccucaaaaugcuucaauugcuauugcugaaucacgggagaauaugagcuuaacagaucguggauugcauggacacuuucuaguuuaccagcaaaauuacccucaagauagguuuauuauuuuaagccagcagggcacagauauuuaugaaaagcugagaccuguugacauauuuggugagcuaaugcgagagaaagguggaccagauugugaagaaguaaaacaauucuucgcucagcaugguacagaucaagcaugcgcgauggcccuuauacuugccugugaccagacuaaccaacacauggcagaaugggcaacacgugcauuuuuucucuauggaggugaucccaaauauguucuacaaacuauucagcaaccuguacaaccgccaacuauuacuaacccucuucaacagaguauccuucaucauacauuaccucuggguuucaaaccuaacacaguuaguacuccauuaggggagaagcaagcacaaccuucaacaagaaguauugaaaccuaugggguagcaaugucaucaaagcauaauggucuuuaccuauuccugagccguaugcuuagaccaguuuggucaagaagaguuuuagaugucaauuacaauaaaaaaccuauuuaucuaccaaccauuaccugugaagaacuuaguuuaaagacaguacaacuuuaugagcuucguucauuucucaccagauacaccuuaaguucgucagauguugcuaccaguuugcagccugccaacacuaugacuguuguuucuccaaguggucaacguacucguuuacaagaagcacuaauacaagaaaaagcaucacuggaugcauuaaggaauuuugucgagcgaaucacccaaguuuucucucuguggaaguuacuaugugaacaugaauugccucuuauuguggaaucacuuucuccggaaagucaagagcaauuaaugcauauuacauuuagagaacuuauucuuaaaggggaagaucugugccaugaacugauuucaaaauuagucaguuuguauuugaaugauaaugcaucuguggauccaaucaguucaaaacugagggaaguguguccucuucuuuauaaaaaugaagaugcaacaugcacuaaaguuaaugaaauucuucaaauggcauuagaggaagucgaugaggaagccaaauugaaccuguuacguucagcaauagaucuuugcaaaaauguaucaccuaauguugauaucgauucaguuugcaagaguuuagucaaauguggguauuaugacggaguuuuagaaaugugucaggauguugccagcaagucugauccaaauucguuggccucgaaguauauagcuagaaguaggccugcagaagauguugaaggaagcaaagcauuugaagccaggcauaaggcuuaccaacaaaucguucauuuguuagacuuccuauaucaacagugucaauuaggaggaaauaauauuccuccucuauuuggaagugcugacuuaucuucucacucacaaaaacuuuuggaggcuacccuugaaaaaugcuuaucuguugaugaugaaacaugucacauagugguauaugacuggcuuguuagccgagaacuucaagcaucgcuuguuucguuggguagaccuucaguugaaagauuucucucacgcuauccuguugauagcccucuuagggaucuuuuauggcaguaucaugaaaaaucugggaaucaugcugcugcugcucaaauauuauauaagauugcuacugcuccuggugaauuuauaacacuucaucaaaggcugacauaccuuggaaaagcuguuauguguaugcggagugauggaguagguugugcuucucaucuagguguauuucuccaugaauuagaagauuuaguacauguagcucgaguacaaaaacagauccuggaaaggauuaccucaaugccugaugcuagugacauaaaugugcaagaugcuugcaggaaacuuaaugccaauuugcuuucaauuacugagcuuuaugaaucuuuugcugagccuuuuggacuuugggaacagaaacuagccauuuuagacugugcuggccaugaugauaaagaacucauaaauucuauaugggauaauauaauacugaaagaacuugaucagugcaauucaagagauccgucugggcagaugguuguccugguaucaaaaguuagaucauuaggccuucaguuugguauacaguccccaugcuucccuauugaauaucuaguuuggcaguuagaauugaucagcuguaagcuuggaguugauaaauuucauguucacaauaucaugacaucauuaggaguuccuuauuccauacuccuggauaucuauucaaaaauguauucagcuaaugauaacuguuggcuugaaucugauaaugaauuucauuuaauucaagugauugcaagcuuuugugaauccuuuugugauaauaaacaguugacaaccucagcacaagaaagaaaaucaacugcuguacaaaugcacgacuuaauuaaugaauguauaauaguucuucauaguaaaacuggauugggggagcugguuggauaucuuaaaaguauacaaacuaaacuagaaagaauuuag

SEQ ID NO: 7011 - RNA, 3621 nt, Euschistus heros
augucuggaagugauuuuuauggggcugauacuuuacacaaagaagucuauaucagaaaaggacaugaagacuggaaugaaauaaauuuaaauccaggagggauugcaagcacucuacaggacauuaaaacccaacaaaaaucaggagcuuaugcauacaaaaagauuccuaauagauucauauauuggagaacugaaggaaauguacuugaaaugguugaagaaugccuugauguaacuuugcaugggaaucagauuagauacaaguuuacugauagucagguguuggaugguuuaacaguuacagaaacuaugaaaagacugaucauucuuguuccuacagugucuagccuucauguguuuacauacccacauccagagaaacuccugaagaaggguuuuggugaggucucuaguuugucugucuuucaugguauuagugaaagugaugcuacugauccgcagacuuaccaucaacugaauuguucuuccagugccauugucagcuguacuucuuguaucacaaauaauggagaagcaauauucgcucuugguuuagcaaaugcaucaguucuccuugucaacauagauucuguuagcggcucaucuucuucucguauucuuucucaugauaacauuguuccuagauuucucacuggaauuuuaggaaaagaugguggagaauggguuccaguuaguuugauuuuucauuacauaaaaaaagagcuuuuucuuuucucacuauguagaggaggaagccuucgcauuugguccguagacagaggaucauuuaucacuuaucuuuguguaaaguuaacaagucaaacaacacuaaaggcucaaaaacacaagauguguaaaggauauauaaacgguacuuuuauauugcauuguugcguacaaggugcugcuauuguaacauuagcuccugauuacgauaauggcguauucaacuucacgaccauuucggaaauaccuauucaaccugguuuugaaguuacgaacaugugcccuggagaggaaggguacuuuugguguaguugguuaacacuugaugagucaccugcugugaccaagaauaaugucauucauccaggauuuucaaagguggcuuuaacuagaccuucccuucaagugccaguaucagacuauauuccgagagauccagcuucucauuauuuagaugcuauauuuucuucugguuucuuuacuucuuuggacauagcuaaagcaauuucucuuuauaaaaucacugcuguuauuaaaccaaauauagauguagcugaacagauuugugcuauaguggaaacugaaauuuauucagaaauuggugaacaagaauuggaugaugaugaauucuuagauauagcuuuuaggugcuggaaucgacuauauucauguugcagucaauauauaauuucaaguaugcuuccacuuggaaugguuuggcuuggggauuacuuaguuuuaauucaagaauguggauuuucaauaguaguugauauugagccauuagagcuuuuuaugacaacugccguuaagaccucacaauuuccucaaguuggauauggcuguuuaguagaaaaauugagagauauuaauuuggaaccugguauugagaagcuagaauuaagccuucauacuggagaaucuauugaugaacuuucuauucuucaagaagcugcugaucuuauuccuccuucuaaacaacuugaugaugcucuaaguaucuucuaugaggaaggcuuaggaaaaaauuuaaauagccuuauagaagaauuagcuguaccugaagauuuuaauaaagauggcucuugggaaucauuuuguaguuauagugguguuggugcuguaacaucugcauuucgagauuaugucacugugagauuaaaaauuugugaaaaaauauuauugguuacugaacuugcaaugagagaugaugauggugcugcagacaggacucaacacaggagccuagcugcucuuuguaaagccuauuacauauuaaaauggaucuguacaucuaagucuacuggaaaugcaccuuugauccauguguuuucauugguuaacccaacaucaauaaugcagucuucucuugaacaauguguucuuggccuagcuaauugcuuauggccauuagcaacaaauaguacucuugcucaacauuuauuaucaacaaaacaauaugcccuucuacaaacauuagcaagauuaguuggaauaaauagcuggaguuuacuacuagcugaauccuacauucuaacaggucaaccuggcaaggcauuugauguuuguuugaaaaaugcuggaucagauguggugcauuuccuuaaugcuauaagacuuuuugaaaagcauucaaggucugauuuaguuauagcgauggcuacuaaagcauuagaacuucuuauuguuucacauucugauagggaaacacuugaaucugcauuauuuguucaugaauugggaauggaaaauuaugaugcugcuuggaguuggauugaaucguguaguucuuggucccgcaggucugacuuuuugcagcgcuugguagcuaacaugauaucagaaggaaaacucacugaucuuaucuccuuuuccuauacugggcuccuugaugaacuagaaaagcuucuugcuucccgugcuagaucauugacuuuuggacuugcuaccaauuacuauaauauuuuauaugcuuuccaugucaaacaugaaaacuuuaaaaaagcugcaagugugauguuagaaaaagcacuucgugcagaaacugcugaaguacaguggaaauguuauggugccugccuaagcucauugauguugauaaaugauccccagcaagcuuggcuaguccgucccaauccauuuucucaagaggaugcuguagaaauacuugaaauugaggauauucaaagagaguuugaauugucuggagcccgauauaauuuagguggauguucaccagaugcaucucaggaagaaguaauugcacuauguguaacucaaaagcaauacaagacagcacuucgacuugcuaacauguguaaacucucuugugcaccuuguauucaagcuuucacagcuaguugcgcugcucucucugaacaaucaauaucuuggcauuggcucaaagcuaaugaaauugaugauauuaucauaacagaaucuaaugcaacugaaauguuauggagaauuuuagaaagauguauaaugaaauaugaaaaaaaaaaugaaacugugcuucauagagcugcugcuaaccaauuuuuaacuguugguuuguuuaucccuacuuggcuucuucagucuuauaagaaaagaaauaguucagaguuacuacggcuguuuguucaacauggauaucuggaagaagcugaggaauuagccugugauuacuugaaugcagcucuggggaucgguagagaaaauuuuucaauugauuuuccucuucaucuuucaucuccuccacuuuguuuaccuuuacaaaccauugauauuuuacuucuagaacuaaaacauuacaauauaggugaacgauuacaaaaaaaacuggauacauauauuagcacaauaucaaggauaacuuuggagagaccaaugacuaccuguaaaaaauaa

SEQ ID NO: 7012 - RNA, 2901 nt, Euschistus heros
auggaaauaucagaagagaauuuacacacgcucuccaacuauuuaaugcaaacacuuagcccagaucccaaugucagaagaccugcugaaagguuucuugagucaaucgagauaaauaagaacuauccuauuuuacuccugcaccucaucaauaaggaagaaauccauuacacaauucguguugcuggugcuaucacuuucaaaaauuacacucggagaaauuggccuauaaaugaugauaacuuggaaaacaagauugauccagaagacaggcugcgagucaaggaguugauaguagauguuauguugguugcaccuucuaguauucagaagcagcuaucugaagcaguugguacuauuggaaaaugugacuucccaaaagacuggccuggacuucugacaaauauggucgagaaauuugguggaggggacuuucauguuauuaauggaauccuucaaacugcccauuccauauucaaaagguauagauaugaauucaaaucucaaaaguuaugggaggaaauuaaguuugugcuugacacguuugcaaaaccuuugacugaucuugcuguggcuacacaaaauuuaacacaaguucaugcuucaaauccagaugcucuaagagugauuuauucaucuuuacuucucauuucaaaaauuuuuuacucuuuaaacuuucaggaucugccugaguucuuugaagacaauaugaaugucuggaugccgcucuuucauacauuacuuacuaccgauguuaagugucuucaaacugaugaugaugaagaggcaggcuuacuugaacaacugaggucucaaguguguucuaauguugcacuguaugcacaaaaauacgaugaagaauuucaaccauaucuccaggguuucgucacggacaucuggagccuucuugugacuguuucacuucagccuaaaaaugaucugcuugucagcaaugcacugcaauucuugucaacuauugcggaaagaccacaauaccgucaccucuuugaagauaagaauguucucacuggcauuugugaaaaagucaucauucccaacauacacuuccgagacucugaucuggagcucuuugaagauaauccagaagaauacauucgaaaggacauugaagguucugauguagagucaaggaggaggucaucaucugagcuugugaaaguauuggcuggacacuuuccugaaaccgucaggaccauauuuggugcuaggcugcaggaaaugcuugcugaauauaguagugauccugcuaaauggagguugaaaaacacugcuguguacauugugaccucucuagcugaaaggggaucaacugcaaagcauggugucacaaaaucuucugaucucguugaccuucacgauuucgcggggcaguauauuauuccagaacucaaaaaagaagucaauacauugccuguuaucaaagcugacuccaucaaguaccuuaucaccuuuaggagucuucuugcuccacagguacugauagcugcccuaccugauauagugaagcaccuugcaucuccuagccucguuguacacucauaugcagcuucggccauagacaaaaugcuaacauugaaacagaacaaccagccacuaauuacacaggcucuccugcagccaaucgcuggagauguccucacuggccuuuucaauauucucaacuuuaagggaucagaagagaaugaguaugcuaugaaagcuauaaugagaacuuucuacacucuggacgugucaguuaucccauucuuagcagaacuucuccccaaguugacucaaaaacugacuaucguugcuaagaauccaagccguccacauuucaaccauuuucuuuuugagacuauaucccucucuauuagaauugugugcaaaaauaacccuggugcuguuggcgcauuugaagaagcucucuuuccaaccuuccagauuauauuccaagaagauguucaagaauuuguaccuuauuguaugcaaguguugucucuaacacuugcacggaggucaccaccucugccugcaccuuacgucgcccucuacccaugucuguugucgccacagcucugggauaggccuggauguguucgaggucuuguuugccuuuugcgaucuuacgucagggucucaucuaaugaugauuuuaaucagacaguuaaaguuaauggacuucuuggaguguuccagaaguugauaucaucuagacuaaaugaccaugaaggguucuacuuaaugcaaucacuuauagagcacugcccccgggaacuucuugacccauuuaugaagcaggucguucugcuucuauuccagaggcugacugcggccaagacuacaaaguacgucaaaggucuuaucacauucuucuguuuacuugucgucaaguacggggcuccuacuuuuauagaacuuguugacucuguacagccucagauguucucaaugguagucgagaggcuaauuacuccugacugucguaaaguaucaggagccguugaaaggaaggucacugcuauaggauugugccgccuuguagcugacucaaaacaaguuuuugcagggcccuacucagccugcuggccagcucuugccaagaguguuguagaaauuuuagaagccccagaagaugauucagucgccccagaagaucauuucguagaaguagauaacuuaccagguuaugaaccagcauauguccaccugacugcagucggcagugauaagcaugauccuauuccugaaauuacagauuugaggagagaacuugcaaaugguauccgggaccuuuuccagguuucaggacaaguagucacucaagcuaucgcuagccucggggaaccuuaugcuagucauaucaagagcuaucucauccugguuggaguuaacauauag

SEQ ID NO: 7013 - RNA, 573 nt, Euschistus heros
auggcgaaaguccagauagguaauguuuuggugcuugauaaucccuccucauuuuugaaucccuuucaguuugaacuuacauucgaauguaucgaagaauuaaaggaagauuuagaauggaaaaugauuuauguugguucugccgagagcgaagauuaugaucaaguucuagauacuauuuauguuggcccuauuccagaaggacgacacaaauuugucuuucaggcagauccuccugauguaacuaaaauaccuauugaagaugcucuugguguuacuguuguuuuauuaaccuguuguuaccgugggcaggaguuuguacgaguaggauauuuuauuaacaaugaauauucugauccagaacucagagagaauccuccuccaaugccacaguuugacaagguuauaagaaacauuuuagguucugaacccagaguuacaagguuuaaaauuaauugggaugauucagaaucacaagaccaaccuagucaagaagcugaggaacaacagcaagcaacagaaaauguagguuuugccgagaauaguggucauaauuuuauggaaguauccuga

SEQ ID NO: 7014 - RNA, 891 nt, Euschistus heros
auggaucacaugcucgcgaguccuuucaauuuaccuaguauagguacuccgguccaucaaccugaagaagaucaacaaauauugccaauagcacaacagcaacaacaaauacaaccaccuuugcaaaugcccccguuacuaccaauacaaucuucaauuaaucagcaaaagccaaugaauacuuaugccccuucaaugggauuuacuacaccacaaaguaugaugcauccgcaaacaccacaaaaucuaaugucaccuaugguaaauagaauggaacagacaccgaacaauauuauuaauccaacuacuccuggaccaaugacaccuaugacgccaucaucugcagacccuggcuuuaugccacaauugcagaacauaguuucuacugucaauuuagguuguaaacuagaucuuaaaaagauugcuuugcaugcaagaaaugcugaauacaauccaaaacgauucgcugcuguuaucaugaggauaagagaacccagaacaacggcucuuauuuuuaguucaggaaaaaugguuugcacuggugcaaagagugaggaugauucuagacuggcagcaaggaaauaugcacgaauaauucaaaaauuaggauuccaggcaaaauuucuagacuuuaaaguacaaaauaugguugguaguugugauguuaaauuucccaucagguuagaaggauugguuuuaacucauggacaguuuagcaguuaugaaccugaacuuuuuccuggccuuauuuaccgaauggugaaaccucguauuguuuuauugauauuuguaucaggaaaagucguacuaacaggugccaaaguacgccaagaaauuuaugaggccuuugauaauaucuacccuaucuugaaaaguuuuaagaagcaguaa

SEQ ID NO: 7015 - RNA, 483 nt, Euschistus heros
auggcuucugucggcacaaccagaucuguuuuaaggcuucuuucuucucagccuauuuuaaaacaggcugugagaggcuaugcagaugagauggcuuucacauuugcugcagcgaauaagguuuucuaugccaauucuaauguaaagcaaguagauguucccucuuucaguggagcuuuugguauccuuccaaaacauguuccaacuuuggcuguucugaagccuggugucguuacuguuuuugaacaagaugguagcuccaagaagguuuuuguuucaaguggaacaguuacaauaaaugaggacucaucaguacaaguauuggcugaggaagcccacccaguugaagaucuugaugccuccgcagccagggagcagcuuucuaaggcccaagcagaucuaucuagggccagcagugaguuggaaaaggcugaggcucucaucgcuauugaagucgcugaagcccucguagcggcugccuaa

SEQ ID NO: 7016 - RNA, 930 nt, Euschistus heros
augccuucggacgagcaagauaaauuugauggcauguuacuggcuauggcucaacaacaugaaggaaucaaggaucuccuugauacuuucuucaguuuuuuggccaggaagacugauuuuuauguaggugcucaagcagaagcugccagaucuuugguuauagauucauuugagaaauaccagucaaaagcaaauuuggcugcugaaaagaaaaggacagaaagugcugaagcugaaaaaaagaggaaagaaaggcuuaaugccaaauccaccccuaaaguaauggagauaacugaugaagaagcgaaaaaaauugaagaggaagaaaaaaagagaaaagaagaagaaagucuuucaaaaccaauuacagaagccgaaggugaagaugaagaacaagacaaagggaaacuaaugccaaaugcuggaaauggugcagaucucgaaaauuacagguggacccaaacucuucaagaguuagaaguccgaguuccucuuaagacuucuuuuaauguaagguccagagacuugguuguagaccuuggcaagacacaccuaaagauugggcugaaagggcaggaaccaauuguggacggugaauuagagcaugaaaucaaaauugaagaaucaacuugggucauugaggaaggcaaaacucuauuucugacggcugagaaaguaaauaaaauggaguggugguccaagcuguuaacgacagacccugaaauagcuacccggaaaauaaauccagaaccaucgaaacugucugauuuggauggcgaaacaagagguuugguugaaaaaaugauguaugaucaaagacagcgugaauuaggucuuccaaccucugaugaacaaaagaaaaaagacaugcucaaaaaguucauggaacagcacccagaaauggauuucucaaaguguaaauucucauaa

SEQ ID NO: 7017 - RNA, 429 nt, Euschistus heros
augaccacagcuuggaguccggacaaaaaacacagugauagagaaagauggauuugcauuuauccagcguauuuaaacaguaagaagacccgugcagaagguaggauuauuucaaaagaaaaagcaguggagaauccuaccuaccaagaaauaagggaugucuuaucugcagcugguuugaaaguugguguugaaaacaaacuuuacaguagggagaaaaguaaagagcuucuuuauagaggucgaauaaggguucaauugaaaaacgauaaugguacuccacuaaacccagauuuugcuaccagagaaucugucauacuucaugcaugugcaaugauuccgaagcugaaaacacgccaaggagggaagcauacgacggaacaaggucaggguggcacaagcaagaaaaaaggaaaagggagaagauaa

SEQ ID NO: 7018 - RNA, 2031 nt, Euschistus heros
auggagaagccucagaaaaugccuaaaguggcaaagguuaaaaacaaagcuccugcugaaauacagauuacagcggagcagcuuuuacgagaagcaaaggaaagagauuuggaaauaguccccccuccuccaaagcagaaaaucucugacccugaagaauuagcagauuaccaacauagaaagagaaaagcguuugaagauaauauuagaaaaaacagaauggucauuaguaacuggaucaaguacgcacaaugggaagaaagucaaaggcaggucgauagagcucgaucgaucuaugaaagagcucuugauguugaccaucgaaauaucacacugugguuaaaauacacugaaauggaaaugaggaaucgccagguuaaucaugcacggaaucuuugggaucgagcuguuacaauacuuccuagagcaaaucaguuuugguauaaauauaccuacauggaagaaaugcuuggaaacauugcugguugcaggcaagucuuugaaagauggauggaaugggagccugaagaacaagcuuggcuuacauucaucaaauuugaauugcgcuauaaggaaauugaaagagcuagagaaaucuauacuagauuuguuaugguacauccugauguucaaaauuggaaaagauuugcaaguuuugaagaaagacauggauuuauuucuggugccaggaaaguuuaugaaagagcuguugaguuuuuuggagaagauauuauggaugaacgucuauauauugcuuuugcaaaauuugaagaaggccaaagagagcaugauagagcuagagucauuuauaaauaugcucuagaucaucuacccaaggaccgaacagcugaaauauauaaggccuacacuauucaugagaaaaaguauggagacaggacgggaaucgaagauguaauugucagcaaaaggaaauaccaauauuuggaggaaguaaaaaccaauccaaauaauuaugaugcuugguuugacuuauuaaggcuuguugaagaagaggguaacauugacacaauuagggaaauguaugagagggcuauugcaaacauuccaccaucaagggaaaaagauauguggaggcgcuauaucuauuuguggauuaauuacgcucuuuaugaagaacuugaagcagaagaugaagauaggacaaggcaaauuuauaggacaagucuugacauaauaccucauaaaacauucacauuuaguaaaauauggcuguuauacgcacaguucgaaauuagacauaaaaaccuuucaacagcccgaaaaaccuugggaauggcauuaggagucuguccaagagauaaacucuaccgggguuauauagaucucgagauacaguuaagagaguucgauagauguagaacauuauaccaaaaauuuuuggaacaugguccugaaaacugcauuacauggaugagguuugcugaguuagaaacacuguuaggugacaucgacagggcaagagcuauuuaugaacuagccguuaaucaaccaaggcuugauaugccugaaauuuuauggaaagcuuacauagauuuugaaaucaacguaggugaagcaagaaaugcuaggcaacuguaugaaaggcuuuuagaaagaacucaccaugucaagguuuggaugaguuacguuaaauuugaaaugacucauagccaagaagaagaaauugaaccuauuucauuggccagaagaauuuaugagagagguaacacugcuuugagagaaucuggagaaaaagaagaaagaauuuuguuguuagaagcauggagagagauggaaaaagcccauggugaugaggaaagcuauaaaaagguugaagccaaacuuccaagaaggguccggcggagacaagcuguuauugcugcagauggaagugaagaaggaugggaagaaguauaugauuacauuuucccugaagacgaagcaguuaagccuaaucuuaaacuuuuggagaaagcaaaagcuuggaaaaagaagcaagaaacugagaaccaaacaaaugaugaagacuga

SEQ ID NO: 7019 - RNA, 1431 nt, Euschistus heros
auggcuaucaaguuuuuggaagugauaaaaccauucugcaguauauugccagaaauagcaaaaccugaacgaaagauccaguuuagagagaaaguacuauggacugccaucacacuuuucaucuuuuuggucuguugucagauuccucuuuuuggaaucaugaguucagacucagcagaucccuucuauuggauucguguuauacuugccucuaacagagguacuuuaauggaacuuggaauaucuccgauuguuacaucaggccugauaaugcaguugcuagcuggagcgaagauaauugaaguuggugacacacccaaagacagagcucuuuucaauggagcucagaaauuauuuggaaugguuauuacaguuggacaagcuauuguuuauguaaugacuggaauguauggagauccagcugaaauuggugcagguauuugcuugcuuaucauuguucagcuguucguugcuggucucauaguucuuuuacuugacgaacuucugcagaagggcuacggucuugggucaggaaucucucuguucauagccacaaacauuugugaaacuauuguuuggaaggcauuuucaccugcuacagucaauacagguaggggaacugaguuugaaggugccgucaucgcacuuuuccaucuucuggcaacaagacaagacaaaguucgugcauugcgugaagcuuucuauagacaaaaucuuccuaauuuaaugaacuuauuggcuaccauccuuguguucgcuauaguuauuuauuuucagggauucaggguagaucuuccaaucaagucagcccgcuaucgaggacaauauagcagcuauccuauuaaacucuucuauacuucgaacauuccuaucauucuucagucagcucuuguaucaaaucuguauguuauaucucagaugcuugcuguaaaauuccauggaaauguauuuguuaacaugcuuggagugugggcagauguuggagguggugguccagccagggcuuauccaguuggcggucuuuguuauuaucuuucaccuccugaaaaccuuggucauauacuugaagaucccauucaugcuaugcuuuauaucauuuuuaugcuugguucuugugcuuucuucuccaaaaccuggauugaaguuucuggaucaucagccaaagauguugcaaagcaacuuaaggaacaacaaauggugaugagaggacaccgugauaauucuaugauucaugaacugaacagguacaucccaacugcugcagcuuuuggaggucugugcauuggugcauugucaguucuagccgacuucaugggagcuauuggcucaggaacugguauccuucuugccgucacuauuauuuaccaguacuucgaaauauuuguaaaggagcagagugagacugguggcaugaguacacuucucuucuaa

SEQ ID NO: 7020 - RNA, 513 nt, Euschistus heros
augaaucuucuaaaggcgaugaguccuacuucggugacuccuuccgucgaacucagcaccuacagggaccagcauuuuaagggcucucggacagaacaggaaagacuucuucgcauaucaacuacauuauauguuggaaauuuaucauuuuauacuacagaagaacaaauauaugaacuuuuuucuaaauguggugauauaaaaagaauuauuaugggguuagauaaauauaagaaaauuccauguggcuucugcuuuguagaauacuaccaacgagcggaugcugagagcucaaugagguauauuaauggcaccaggcuagaugaucguauuauaagaacagacugggaugcagguuucgucgaaggaaggcaguauggaaggggaaagaguggugggcaggugcgugaugaauacagaagagaauacgaugcuggacgaggugguuacggaaaagugaugcagcagcccacaacaaaagcugaagcugcaucaauauuuaauggacaguga

SEQ ID NO: 7021 - RNA, 942 nt, Euschistus heros
auggcugcagcuauaggucggauauauggcucuagacuuuuaaaaaauaauccaguuucuaagcacuuacagauaggcagcuuuucuacuacuaaaucauggucacgaggaaagaaagcuuuguauaccucacuugguauuuugacugguggaacaggcauguugauauaugcucuugaaaaaagucuucaagcaggagaucuugaacuccauccucccaaacuuccuuggaaccauaguggguauuuucaaucacuggaucaugcaaguauacggcggggcuaugaaguauacaaaaaugugugugcagccugucauaguuuaagauauguuugcuaucgagaucuugucgguguuucucacacugaagcugaggcuaaagcagaagcugaagaacaacuuguuuuagauggucccaaugaacuuggugaaauguucaaaaggccugggaaacuuucugaucauaugccuaguccuuauccuaaugaagaggcugccagggcagcuaauaauggagcuuauccuccugaucuaucauacauaguuccuggacgucauggagaagaagauuacauauuccacuuauuaacuggcuauugugaugccccugcuggagugguuuuaagggauggccaguacuuuaaucccuauuuuccugguggagccauuaguauggcacaagcacuguauaaugagauuauugaauaugcugauggaacuccagcuacucaaagucaauuagcaaaggauguugcuacuuuccuuaaauggaccucugagcccgagcaugauacacgaaaacaaauggccuuaaagguaauguucaucuuuucauuguucaucgcugcaacuguuuacuggaagagacacaaguggagcagucucaagagcagaaaaauuaucuuuaauccuccuaaaucaucgucgccaccgaaauuguga

SEQ ID NO: 7022 - RNA, 1728 nt, Euschistus heros
auguuagcucuacagcaguauggagaaagugacagugauaaagaagauggagaaaaaagcccagauccuaacgaugacgcuuugcugcauuuaacgccucuuucuacuggacauucaucuauuauccagacugcuauuugcccugcucccacugcuuuaccaccuguagaguacaauccucugaaguuuaucaaaccugguugcacugaaaugacaguuaaucuuaaauaugaagaacuguuugcugcugauguaggcccugaaaauccuuuuuuaacagaucaacaaaaagcucccaaaaauauccuuucugguuauguugaagaagcucauaugagugaauuucaguuugaaaaucagagaaaaacuuuucaaaguuuuggauaugcucuugacccuucuauugauaauaugggucguaccgaagaaucuuugucugucguuggagcuguggauguugcaaaagaaacaaacuuaaaaacuguuuuugaaucuacuucuaagcgaccucuugauaaacggaaaagaaauaaaaacgacgauccuucugauaucaaugguuuccucgguccuugggguucuuauguugaugagaagaaaguagucaaaccugaaccugaaguugcugcagaacuugaagaauaucuugccaagagacaaaaacuugguaagaaaguugaagauaaaccucuugaagaaaagacuguccuucacauuaaagauccaguugacuaccaaggacgaaacuucuuacacccuccucaggauguaggugucaaccugaaaucagacucuccuccagacaaauguuucauuccgaagucagaaauacacguuuggaaaggacauacaaaaggcauuucugcuauccgaugguuucccaaguaugcccaucuccuucuuucuugcaguauggauugccgugucaaguuaugggaaguauauaaugaaaggcggugcauuagaacuuauuauggccacagacaagcuguaagggauguuuguuuuaacaaccgaggaacuaaauuucuuucagcugcuuaugaucgcuacauaaaauuaugggauacagaaacuggggaguguauaucgcgauucacaaguagaaaaauuccauauugugugaaguuuaauccugacgaagacaaacaaaacuuauuuguugcuggaacuucugacaagaagaucauuuguugggacuuacggucuggugaaauaguacaagaauaugaccgccauuugggagcuguaaauucuauuacuuuuguggaugaaaauagaagauucgucaccacuucugaugacaaaagcuuacguguuugggaaugggacaucccgguugacaugaaguauauugccgacccauccaugcauucaaugccggcugugaccccaucuccuaaucaaaaguggcuugcuugucaaaguauggacaauaagauuguaauauucucugcucuuaacagguucaaacugaauagaaaaaagacauucacugggcauauggucgcugguuaugccuguacacuugauuucucuccagauaugagcuacauuguguccggugaugcugaugggaaagccuauguaugggauuggaaaacgaccaaacuguucaagaaauggaaagcucaugaucaugucugcauagguguucucuggcauccccaugagccgagcaaaguggugacggcuggcugggacggccucauuaaauacugggauuaa

SEQ ID NO: 7023 - RNA, 807 nt, Euschistus heros
augguucaaaagaagcccaagaagaagacuggaaaaaagguugcagcagcuccuuuagcuguuaaaaagcaagagguucagaaaguuguaaacccucuguucgaaaagagaccaaggaauuuuggaaucggucaggauauccagccaucucgugauuuaagcagguuugucagauggccuaaauauauucguauucaaaggcagaaaucuguuuuacagaagaggcugaaaauucccccuucaauucaccaauuuucucaaucuuuggacaagcaaacagcaacucaauuguuuaagauucuugagaaacaccgaccugaaucagcacuugcuaagaagcagagguugaaggcuagggcugaaggaaaaauuaagcaaaaagaagaaguuccaaccaagaggcccaauguuaucaggucugguguaaauacugucacuagguugguugaacaaaagaaagcccuccuuguugugaucgcacaugauguugauccaauugaguuggugcuuuuccuaccugcacuuugcagaaagaugaauguuccauacuguauuaucaaaggcaaggcccgucuaggcagacuuguuagaaggaaaaccugcacaucaauugcaguaacucagauggaggguaaugaucguacugcucugaauaagguuguugaagcagucaggacuaauuacaaugaccgauaugaagaaaucaagcgacacuggggaggugguuuacuuggcucuaagucagcagccagaauagccaaacuugaaaaagcaaaggcuagagaguuggcccagaaacaaggauaa

SEQ ID NO: 7024 - RNA, 1005 nt, Euschistus heros
auggcuaauauguugaaagauguuacaauugaugauaagaugccaaaugaacuuuuauuggacaaacauauuaaauucguuuuagcuuauggagcuaauaaagaagaauaugaauuuugcaugacagaacacuugagaaugucugguauguauuggguucuaaccacauuagcaguuaccaaaaaguuggaugaaguugacaagaaggaauuuauugacuuuauacaugaauguacugaugagaaaacugguggcauuggugcuuguguuggucaugacccucauauuuuauauacuuuaagugcuguucaaauagcauguauuuuaaggucauuagaccagcuuccuuuggaaaagauuguaaguuuuguagcaggacuccaaaaagaagacggcaguuuuaugggugauaaauggggagaaguugacaccagauuuucauuuugugcuauugcuugucuaucacucaucggccgcuuggaugcuaucaaccuugaaaaagcaguagaguuugugcugaguugucaaaacuuugauggugguuucgguucucaacaaaauucggaaagccaugcuggauugaucuauuguugugucggaguuuugucgauuacccagaacuuauaccgaauagaugcugaucaacuagguugguggcuaugugagcgucaacugccuucggguggucuuaauggaagaccagaaaagcuuccagauguuugcuauuccuggugggucuugucgucuuuaacgauguugggaagauuacauuggauugauaagcagcuucugaagaaauauauucuugccagucaagauccugauggagguuucagugaucgaccaggagauaugccagaucccuuucacacuuuguuugguauugcugcucuuucacuuuugggugaaucagaauuaacaaaaauuaauccuacuuauuguaugccacaauacauaauugaugaacucaacuuggauccagaaauaaugcagucacaaccauag

SEQ ID NO: 7025 - RNA, 2688 nt, Euschistus heros
augauguugaaaaugaauagcgaagccacagcacagcuuauacaaauuuuagagaagacuguuucuccagacaaaaaugaacucgaggcugcucaaaauuaucuggaacaugcugcacaaaccaauuuggcugaguuucugcaaacauugucacauauucuucaucauggugguaacucuccaguugcacguauggcagcuaguuuacagcucaaaaauaaccuuaccuccaaagaucccaauauuaaagcacaguaucaagccagauggcuugcuuuucccgaagaaacuagaauguauaucaagaaaaauauuuuaggagcuuugggaacagaaaacacaagaccuagcucugcugcucaaugugucgccuauguugcaguagcugaaauaccaguuggucaguggccggauuuaaucccaacauuaucagcuaauguaacuggacccucuucaacugaaaucaugaaagaggcuacucuagaagcaauugguuauauuugccaagaaauugaacacgauuguuuagcuaaucaaucuaaucaaauuuuaacagcuauuguacauggaaugcggucugcagagagaaguaauuauguuagacuggcugcaacaacagcacuccucaacucacuugaauucacucgggcgaauuuccaacaagauauggagcguaacuacuugauggaaguaguuugugaagcuacacagucaacagauacacaaguccgugucgcagcacuucaaugucuagucaaaauaaugacucuuuacuaccaauauauggaaacauauaugggccaagcuuuguuuccaauuacauuagaagcaaugaaaucugacauuaaagaaguagcucuucaaggaauugaguucuggucuaaugucucugaugaagaaguugauuuagcuauugaagaaucggaagccguagaaaugggaaaaccuccagcuagaacaucacguuauuaugcaaaaggagcucuccaguaucuuguuccuguagugcucaccaaauugaccaaacaggaggaauuugaugaugaagaugauuggaauccaagcaaagcugcuggaguuugcuuaauguugcuagcuacaugcugugaggaagacauuguaccccauguguuaccauuuguucagcaaaauauaaaaucaccagauuggagguauagagaugcugcugugauggcuuuuggcucaauucuaaguggacuucacucaagcacccugaaaccuaugguagaacaagcuaugccuacccugauugaauugauguaugacaguucaguugcugugagagacacagcugcaugggcauuuggucguauuugugaaauuguaccugaagcagcgacaaacgaaacauacauaaaaccucuucuugaaucccugcucaauggcuugaaggcagagccaaggguagcagcaaaugucuguugggcuuuuacugguuuggcugaagccaguuaugaccaggcugagaaccagguagaagaugguucccaaccagagacuuacauccucuccagauauuuugaguacaucguacacagccuuuuagcuacuacugauagaguagauggggcccaggcuaauuuacgucccgcugcguacgaggcacuaauggagaugguuaagaacucucccaaagacugcuacacuguuguccagagggcgacucucauuauacuggaucgcuuaaaucaaguucuggcuauggagcagcagauucaaagccacucagacagggcacaguuuaaugaucuacagucacuccucugugcaacucuucagaguguucuuagaaaaaugacaccagaagaugcaccucaaauauccgacacaauuaugaaugcacuucuucaaauguuuaauuccaauucguguaagucaggaucagugcaagaagaugcaauuauggcaguuucaacacucgucgaaguucugggagaugguuuuauaaaguauaugccagcauuucaaccuuuccucugcaugggucucaagaaucaugcugaauaucagguuuguugugcugcuguuggucucacuggagauauaugucgagcauugaaaaacaaaguucuuccauauugcgaugauauuaugcggcuccuucuugaaaaucuuagugacaauaguguucaccgcucugucaaaccucaaauuuuaucaacuuuuggagauauugcuuuaagcauuggugccgauuucaaaaaguacuuagauguaguacuucauacacuuaugcaggcugcucaggcacaaguugauacgagugauuuugacaugguugacugguugaaugaauuaagagaagguauuguugaagcuuacucugguaucauccaaggauugaaaggggaagacaacaauacagcugcuagugcugcuaaucuugcccuacuugagccucauaucccagucauggcucaguuccugaccuguguuucgagagauaccuccaaacaagauaaaguccuugcuggcucagcugguuuggucggagaucuuuguucugcuuuuggugcaaaaguuauaccucuguuggauaucgauccaauuacugagcuucuaacacagggaaggagaucaaggaucaauaaaacuaaagccguuuccaacugggcaucuaaagaaaugaggagauacaaagcuacuauugcuaaugcagccuccuga

SEQ ID NO: 7026 - RNA, 1506 nt, Euschistus heros
auggagacuauacuagagcagcaaaggagauaucaugaggaaagagaaagguuaauggaugcuaugguaaaagaaaugcuccauaaaaagucaaguuaucgagaacaaauuaacucagaucacaggcugaagaugcuucuagaucaauauauggagagcacccacaagcugaaggaacuguaugaagauaaggauggcauaagaaaagaugaaguugcugcgcuuucagguccuaaugaguuuucugaauuuuauucgagauugaagacuauuaaggaauucuaucgcaggauucccaaugaaauuucuguuccuaugucugucgaauucgaagaacuggcaaagcuuagagaaaacccuacugaagaaacuuccaauuuaguagaguuuacagaugaagaaggauauggaaaauaucuugaucuccaugaaugcuaugaaaaauauaucaauuugaaaggagucgagaaaggagauuacauuacauaucuuacuacguuugaccgacuuuaugaaauucccaaagauaggaagaguucugaguacaaaagauauguuauuaugcucuuaaauuaucugugcgauuacauugcuagaauuaaaccucugcuugaccuagaccaggaauuaaauaacguccacaaggauuucacaucacaaugggaagcaggcaccuuucccggcuggccaaaagaaacaggcagcguguuaagcaauguuggugcccaucuugacuuaucugcauuuucaucuccugaagaauuggcuucucuugguuuggacaggcuuaaaucagcauuaauggcucuaggauuaaaauguggcggaacuuuagaagaaagggcucagcguuuauucagcacaaaagggaaaaagucucuugauccaaauuuacuugccaaguccaagccagguaaaucaaaucgagaacgugaucuugaaaggcagcgggacauugcauucuuagaagcacaaguuuauaaguuagcugaauuauugagugaacaacgagcugcuacuaaagaaaauguucaaaggaaacaagcuaggacaggagaagaaagaggagauucagaaggcgaagcuucaucaucuggaagcgagagcgagggcgaagaugauggaguuccuuauaauccuaaaaaucuaccucuugguugggacggaaagccgauuccguacuggcuuuacaaguuacauggacucaacaucaguuauaauugugaaaucugugguaauuuuauuuauaaaggaccgaaagcuuuucaaagacauuuugcugaauggaggcaugcucacggcaugcguugccuaggaauuccaaauacugcacauuuugccaauguuacucaaauagaagaugcuuuggcuuugugggagaaacuaaaaacaaugaaacacgaugaacguuggcaaccugaacaugaggaagaauaugaagauucucucggaaauguugucaacaggaaaacuuaccaagauuuaaaaagacaaggacuuuuauaa

SEQ ID NO: 7027 - RNA, 636 nt, Euschistus heros
augacggucgguaagaacaauaaaaugcuacaacauauuaacuacagaguuagaaucauuuugcaagauucgaggacauuuauuggcacauuuaaagcguuugauaagcacaugaaucucauucuuggagacugugaagaauucaggaaaauuaagccgaagaacacaaaacagccagagcgagaagaaaagagaguguuaggauuuguauuacuaagaggugaaaauauugucucccuuacaguugaaggcccuccuccaccagaagaaggauuaccuaggguaccccuucccggagcaggugguggaauugguacugcaagaccugcuggucgugggguuccagcaccugguacuccagcugccccaggucuucaagggccaguucgugguguagguggcccaucugcccaaguuaugacuccagcuggccgugggggccaaguuucugcaccuccucagaugcgggcaccuccuccaggaaugcccccaaugaugggagccccaccaaugaugaauauggcaccuggaauggcaauggguagagguggacccccuccucaaaugggugccccuccugcuccaccuaugagaggaccuccaccaggaaugaugagaggucccccaccauuuuaa

SEQ ID NO: 7028 - RNA, 897 nt, Euschistus heros
augaauucuguugaaaaggcgcuccugguaucccugcuguauuaccgauggaaaagacggacaagaaacaggaagauauggauucauccaauaguggaaaaaagaaaagaaaaaggacauuuuuauaauuuauauucugaauuaaggaaucauccagaucaauuuuucaauuauucucggauguccaugugcaguuucgaugaauuacuggggcuuauaaaagaucaaauuacaaaaaaugacacuaggaugagaagcugcauaccaccugaagaaaagcucaucauaacauugagguaucuugcaagugguuguucuuuagcugaucugcgcaacaacuuucgcguaggaaaaaguacugcugguguuauuguaagagaaguaugcaacgcauuauggauaugucuucgcgaaaucaccaugccuccuuuaacuaaugauagauggcuugaaauugcuaaaggguuugaaacgugggcaggguucccuaauuguauuggcgccauugaugguaaacauauaagaaugaagcagccauguaacaguggaucaauguuuuacaacuucaaaaauuauuuuucuacuguucuauuugcgaugugugaugcaaauuauugcuucacauacauagagguuggaucguauggaaaauccagugauucaggaauauuuaagaauucguuacuuuacaaaaaaaugugugaugguaguuuacaaauaccugcuccacgcucauucgacaauaauucaagugagcaguuuucauaugucauagucggugacgaugcuuucccuuugucagauaauuugcuuaagccuuauggaggcccacgcuuaucgccagauaaacaaaucuuuaacaaacguuuauccacagcccgacgauacauugaaagc

SEQ ID NO: 7029 - RNA, 2052 nt, Piezodorus guildinii
augaguagcaaacauaaacacaagaaauaugaagaaaaggaggaaagaagaaaaaaacacaaaucucgauacucugaugauucugaagaugaagaaaaauguuccucauccaggaaucgaucgaagaagaaaaaaagugaucacagucguaaacauaaaaaggaaaagaaaaagaaaucaagaaggucugaaaguucagauucaaguaccaguucugauucaucuucagacaacuccgugaaacuuuugaaaagguuacaugacaaacaugaaaaaaugauucaacaaaagaaaaaagaaaaagaauugaugaaggcuaaugagacuccagaagaaaaaagaauuaggcgacuucugaaaaaagaagcaaaagaaaggaagaggaaacaacguaugggaugggacaaagauuauuuacauuauaccaauacugacaauccauuuggugaugcaaauuugcuuucaacuuuuguuuggucaaaaaagcuagcaaaggauggacuuacagauguaucucgugaagaauuggaaagaauuaacagaauaaaacaagaggagaauaaaauugaacucgaaaaggucaaaaaaagacggcaagagagagagcaagaaagacaagaacgggaagaagccaugaugcgaaugcaacgagagaaggaagcugagcaguuugaagcaugggcuacgcaggaagaucaguuucaccuugaacaagcuaggcugagaucaaggaucaggauagcugaugcaagagcgaaaccuauugaucuucuugcuaaauacaucaauucugaagaagaaguggaugcuguugagaugcaugaaccauauacuuaucuuaaugguuuaucgauuaaagacuuggaagacuugguugaggauauuaagguauauaugaaacuagaaaaaggaaagaauuuggauuauuggaaugauauaacuguuauuguugaggaugaauuguauaagcugaggaaaauggggaaaaaaucugacuaugaagcagcuguugguaggagagaagguauucaugaaucuguagcuaaagaagucucuucagucuucagaggaaaaacagcuucacaacuugcggccaugcaaaagcagauugagaaaaagauaagugauaaaggagaagguauugauauuggauacugggagucucuucuuucccaacugaaagcucauauggcacgagcucgucucagagacaaacaucaagaaaaccuuaaacagaaauuggaacugcuuaaagcggaacaaagacagcaagaacaagaaauaaaagaagaacccauagaugaaucagaacaucaggagacuaugaguagagaagaaaucaaagaagaaagagaagauagugaugaagagcacaguggaggugaugaagaugcuggggagucuaugcuaaaagagaguuucggagaguaugaagcaggagcuuacuccccuguuuauguugaucccgcaagucuugaaccaggaacucuuaucauuggugaagaagaggaugcucagagauuagaguaugcaagacagcaucuaacuucacaagaaagucaggugggagcuacaucagaagaguuggcuaugcaaagggaagcacguaaaggaaugucaagcgaugaagccauauuuucaguugaaucugcucuggauucccaaguuuacuuguggucagacaaauaccguccacgaaaaccaagauauuucaacagaguacauacuggauuugaguggaacaaguauaaccaaacccauuaugauauggacaauccuccuccaaaaauugugcagggauacaaauucaacauauuuuucccagaucuuauugauaaaagcgcaacaccagaauauuaucuuaccaccugcccugauaauccugacuuugcuguucuucgguuucaugcuggaccaccauaugaagacaucgcguuuaagauuguuaacagggaaugggaauacucuuacaagcgagguuuccgaugccaauuccauaacaauauauuucaguugugguuucauuucaagagauacagauacagaagauaa

SEQ ID NO: 7030 - RNA, 1209 nt, Piezodorus guildinii
augggggacgcuaauauuauugauaagucuaugcgaucgguguuuguggguaauauucccuaugaagccacugaagaaaaauuaaaagacauauucaaugaaguuggaccuguucuaucauucaaauugguuuaugaucgggaaacugguaaaccuaaggguuauggauuuugugaauacaaggaucaagaaacagcccuuagugcuaugagaaauuuaaauggauaugaaauuggugggcguucuuugaggguugauaaugcauguacugagaaaucaagauuagaaaugcaaagucuuuuagcugggccgccaauugauaauaccuacggagaaucgguugaaucagauaaggcaccugaagcuauuagcaaagcuguugcuucguuaccacccgagcaaauguucgagcuuaugaaacagaugaagcuuuguauucaaaacaauccuacagaagguaaagcgauguuauuacaaaauccgcaguuggcuuaugcucuuuuacaagcacaaguugugaugaggauaguugauccccagauugcuaucacaaugcugcacaaggcuaacccgagcgugcccccucuccagccgccccccguggaagcuauucgcccagugccaguaccucagccugcuccggccguggcuccuccuccaguggugccaccugucguucaggcgaggccugucguggagccagaguggguuccuccugccaggccccaucaaccuccgcauccgccaacguucaucccacaaccagguggugaccuugauaugaggacuuuggacccgaggguuccuccggugcgacugacccaggaccaagacuuaaggaucccgccgauggugcccgccccacagcagccuccgacccagccgccucagcccuacccucaggaacacgugauauccaguaccguacgagauccaaggcaauaucgugauccucgcacaggugcagcaacugugccagugccuccacgaccuauugugacacaggcagugauaccaccgcgacccguagcuccuccgaccagucauaucacaucagcgcuuccuccugcagccucagaccaagagaaggcugccuuaaucaugcaagugcuacagcugucagaggaacagauagcgaugcuaccucccgagcagcgacagaguauccucguccucaaggagcagaucgccaagagcacucagcgcuga

SEQ ID NO: 7031 - RNA, 1188 nt, Piezodorus guildinii
augacggcuucucaagcaauggaaccaaacagagaaaaagcuuuacaagauuaucguaaaaaauuacuagagcauaaggaaguagaaguuagacuuaaagaaaugagagaccaguuaaaagaucuuacuaaacaguaugauaaaucugaaaaugauuuaaaagcccuccaaaguguuggccagauugucggagaaguuuugaagcagcuuacugaagaaaaauuuauuguaaaggcuacaaacggcccaagauacguuguugguuguaggcgacaacuggauaaguugaaacugaaaucugguacucgaguagcauuggauaugacaacacuaacuauaaugagacacuuacccagggaaguugauccauuaguguauaacaugucucaugaagacccaggagaugucacauauucugcuauuggaggucuugcggaacaaauuagggaacuucgugaggugaucgagcugccucuauugaauccagaacuuuuucaacguguugggaucacuccccccaaaggaugucuacuuuaugggccuccugguacuggaaagacuuuauuggcuagagcuguugccagccaauuagaugcuaauuuccugaagguuguuuccagugccauuguugacaaguauauuggugaaagugcucgucugaucagagaaauguuuaauuaugcaagggaucaucagccuugcauaauuuuuauggaugaaauugaugcuauugguggucgaagauucucagaagguacaucugcugaucgugaaauucaaagaacccuuauggaacuucuuaaccaaauggauggauuugauucauuaggacagguaaaaaugaucauggccacuaaucggcccgacacccuugacccagcucuccuccgucccgguagguuagacaggaagauugaaauaccacugccaaaugaacaggccaggcuagagauccucaagauccacgcuaguccuauuucgaagcauggagauauugauuacgaggcuguugugaaguugucugauaauuucaauggagcugauuugagaaauguuuguacugaagcuggucuuuuugcuauucgagcugaaagggaauauguaaugcaggaagauuuuaugaaagccgugaggaaaguggcugacaacaagaaacuggagucaaaacuugauuacaagccaguauaa

SEQ ID NO: 7032 - RNA, 777 nt, Piezodorus guildinii
auggcaaggcgauaugauuccagaacaacaauuuuuucuccagaaggccguuuauaucagguugaauaugcuauggaagccaucagucaugcuggaaccugccucggcauccuagcuaaugauggaauuauucuuguagcugagaaaaggaauaccaauaaacuucuugaugaaucaguauauucugaaaaaauuuucaaauugaaugagaacaugauaugcaguuuagcugguauuacugcagaugccaauguucuuaccaaugaacuaagacuuauuucucaaagauauuuauugcaauauggagaaacuauuccuugugaacaauugguuucaugguugugugauaucaaacaagcauacacccaguauggagguaaaagaccauucggaguauccauauuauauauggguugggauaaacacuauggauaucaacuuuaccagucugauccuaguggaaauuacucagguuggaaggcaacauguauugggcauaacaguggggcagcuguuuccaguuugaagacugauuauaaagaaggugaaaugacagugaaagaugcuuuggcuuugggaaucaagguucuaaguaaaacauuagauacagcuaagcuuucaguugauagaguugaaguugcgacauugucucaaaagaauggaaaguguguuacaucuauccugccuccugaugaaguucaagaacucaucaaugcuuaugaaaaaucagaagcugaagcaaacgcuuuaaaaaaagaaaaaaccccaaaaucuuaa

SEQ ID NO: 7033 - RNA, 2643 nt, Piezodorus guildinii
augacgaaaauucaagagccacaacaagaagaaaugucugaagaagacaagaggcuucaagaagaacucaauaugcuuguagagaaaaucacugguccugacauacaccuguauguaccugcauuggaaaguaugcgagaccugauaagaaguucuacuacaaguaugacaucagugccaaugccucugaaguuucuuagaucucauuauggugcacuuaaagaggccugugcuguuauggcggauaaaaaagcucaggagcugugugcuagcauaguaucuguucuugcaaugggucaggaucuaccagggucucgagaauguuugaaguacuguuugcaaucucaucagaaagauguuggugauuggggucaugaauauguuaggcaauuggaaggagaaauagcagaugagugggcaucuacagaagaaaaagauaagcuguuaggauugguagagaguaucauuaaauuugauauggagcauaaugccgaaauccaagccugugaucucuugauggaaauugacagacuugauaugcuugauaagcacauggauaugacuaauuauucuagagucugucuuuacuugauuaauugugcuguauauguggaagagccagaaagaggaaauauuguaaguggagucaugaaacauuauaugcgauuuaaagaauacccccgagcacuuugccuugcuaugcaauuaaauaaacaagauauaauguuagacaucuuuaaccaaugccaagauccauuaguuaggaaacaguuagcuuucaugguagguagacaacaguuaagucuggaauugagugacgauuugccagacaagucagaucuuacuaacauuaugucuaaugcccaugugaaugaucauuuucauaguuuaggaagagaguuggauaucauggaaccuaaaacuccugaagaaguuuacaaaguuugguuggaaggguugguucuccgcccgaccuauaaucuggaaguaccucuugauucagcuaggcauaaucuugcuucaacauuuguaaaugcuuuugugaaugcuggcuuuuccagggauaaguugguaucaguugaagauggcaacaaauggauguauaagaauaagcaacaugguauguuaagugcugcagcaucucuuggccugauucauuugugggauguugauggaggauuaacuccuauugauaaauaccucuacacuucagaagauuauaucaagaguggagcacugcuggcuuuggguauugugaauuguggagucagaaaugauugugauccugcauuggcucuucuuucugauuauguacuucaugagagugucacuuuaaggauuggugcuguuuuagguuugggccuggcauacguuggaacaaaaagacaagaugccauaacucuuuugcugccagugcucucagacucgaggucgacaccagaggugguugcuauggcagcguuggcaugugcucucauuacccuugguacaccucauccugauguaguaucgacgauacugcaaacccuccuugaucuuccuguggcugagaugacugauggccacuacuccaaguuuuugccacuugcccuugguuuauguuacuuaggucagcgagaaggcacugaagcuacaaaggcugcacuugaagcacuuccagagccuuugagaucuuugucgcaacauauguugaagaugugugucuaugcagggacuggggauguacuugucauccaggaacaacuacaagugugcucagaacauuacccuacuccagaagaaaagaaagaaaccgauaagaaggauaaggauaaagacaaagacaaagaugagucgaagagcaguaaagugaaagacaugacauguaugcaggcagucgccgcucugucuguggcagugauugcaaugggugaggagacgggaucugaaauggcaacuaggauauucgcgcaauugggaagguauggugaaccugcaguacggagagcuguacccuuggcuaucgcauuaucaucgauaucaaacccucaguuagcagugaucgauguucucaauaaauauucacaugaccuagaugaagaaguugcucacaaugcuauuuucucuaugggucugguuggugcuggcacuaacaaugccagguuggcgacgaugcugcgccagcuggcucaguaucaugcuaagaacacuggucaccuguucauggugcgcauugcucaagggcugacacaucuugguaaaggcacccucucucuaugccccuuucacacugauaggcaggucaugaacuacucugcaguugcuggucuucuuaucacccuuguuuccuuccucgacaccaagacgauaaugcuuggaaagucgcacuauuugcucuacacauuagccacagccauguacccaaggugguuaguaacgcuugaugaacaucuggaaccacuaccugugucugucagaguuggacaggcggugaaugugauugguaaagcugggacgccuaagacgauagcuggcguccauacccacacuacaccugugcugcuugcuguuggcgaacgugcugaacuggccaccgaggauuacacuccccucaccccuguuauggaaggauuugucauucucagaaagaaacaaccagcuuga

SEQ ID NO: 7034 - RNA, 1344 nt, Piezodorus guildinii
auggcugagguacugaggcccgaauauuggugguuccagaacauggagccuccagcggcagagcagguccaggcacagcaacagcaacaagaacagcaggagccuggagucauccggcagcgaaccauaaccacuucggggacaaucaccaccaguccgcagcacgagaccacuccaucaccggagcaacccguccaagagcaagggaacaaggaaguggaggugccguacgagaucgugcagcugcggcccgggacguacgacgagacguacagccuggaggagacggcgcgguacagcccgggcuccggacgguacuacaccacagagggcaccgucaaguacgagcgggacgacaaaggcgaaggcagcuacgugacgcuggaacccgucaacuacccgcccggcggagccuaccaagaaccugccacgggauacuacaccuacaaggaggaggaggacgucuacaucaaggcugacccuccgcugacgccaaagaacuucgcgcacuucgaccaccccgucaccucccauccgacgcagcucagugcacagguuacuuacguuacgggaggugguagcagagaguacgugacaaccaaccagccuggcuacugguccagugaguacgucuaccagcagccucagcaggaaauccagcuuccuccaggaacaccuuacgucuucuccagcaaugggcaggcaacaugggcuaucgacgagucguacgaccccaguaugcugucuacgagcgacaucaaggagugcgucaacugcgcggcgagcguuaccccgcuguggagaagggacgggaccgggcaccaccucugcaacgccugcggccucuacagcaggaucaacggcguccacaggccaccggugaggacgcaccacaagaaaguacacaauauugguaauagaagaaauggcgugagcugugcaaacugccaaacgaacaauacaacccuguggcguagaaauaacacaggagagccuguguguaaugccuguggacuguauuucaaacuucaugguguuaauaggccgcauaccaugaagaaggaagguauacaaaccagaaaacguaaaccaaagaacccacaaguaaaccuaccgaguccaaaaaacgauauaaagacaacaggugaaaaaucagggaguugggauaaaugcgacaacgaucuacucgacagcggguacacaauggcaacaucauccauauuucugccaaguucauuuuuaacuaagccuguaggagucaguguaucaggcuuagaaaguguaccaccuagcgugaucaucccacccacauccagccaagaaacacagagaccugaacaauaa

SEQ ID NO: 7035 - RNA, 5505 nt, Piezodorus guildinii
augucguugccuggagggaaaauggcuuguccugggaacggaauuuauguuauucagggagaaaugucuguucugcuuacugcuaugaagaaaguaaacagauggucuucucauguccaccaggaugaugaaaaugacauucucauuagaagcuucacagaccucaaagauguuuuaaaucagauuggugaccuaagagaaguagagccuaaucauuuucuuaguccuuuucuugaaguaauuagauccgaagaaacuacuggaccuguuaccagucuugcuuuauccucugucaacaaguuccuuucuuauggacuaauugauucuaagucaaagacgauugcagcuacuguugaaaacaucgcagaagcaguuacuagggccagguuuguuggaacugaccaaacuaaugauucaauuguguuauugaaaauuuuacaggugcuucgaacuuuguuacuuucuccugaaggcuguuggcuuacaaaugaaaguguuuuagaaauccuacuuaguuguuuucggauguguuuugagccccguuuaaaugaauuguugaggagaugugcugagaauuguuuacgcgauaugguucaguuguuauuuagucgacuuccuaguuuuacugaggauaauagaaaaauacagcaaaaacucaaaaugaauacuagugcccccuuggaugcugguaaaggaaaaagaaagacaagcagaccaucuucuaggaaaguuucuaggaaaagucaagagauaucuccuaguccuguuuuagguuuagaagguucaaaugcuucaaaagaaugugauauccaacaaauggcucuacgugaugagccagaaauuacaucacacgauaaaucagaaccugaaauucuuccugugccuagugaagaaucacuagcuaaaguuucaucuauugauucacuugaaacuaauguugcaaauggcauuucaaaugggacgaagucagaagaacaucaaaacucuacuucuccugucauucuggaugaugguguuguuauuaguauugaagauucaaguucucaaaauagugaaucaacagagcagcuggcagccauugguaaugugucagaaauaaagaggccagaugaauuagaucuaaacucugcugaaacuaauuuugcuucuccaucgucagauucuaaagcagaagaagaaccuuuauuaaguccuaccacuccagaaaauauuauggaagggcaggauuggacuaaccagcaaggaguuagguuuaccaauacugaagccgauaauuuaacuccuucuggaccuuacggacugcugagcguucaugaacuccuaagguuuuuggcuucacuuugcaauccauuagacaagcagaauucagauaguaugauucacauugggcuaacccucauuaccguggcucuugaaguuggugcugauagcauugcaaauuuuccuucacuuuuaucaacuguuaaaaaugaugucuguagaagccuuuuagcuuuguuaaauacugaaaaacuuccaauauucgcaucagugcuacaaguuucauuccuccuuuuugaaucucuucgaacacaucuuaaauuucaacuggaacguuauuugucuaggcuuacugaaauaauuguaucugauucuucaaaaauuucauaugaacauagagaaauagcauuagaaucuguagugcaucuuuggcgaauaccuggcuuagugacagagcucuaccuuaacuacgauugugcuuuguacugucccaauuuguaugaagaacugaccaauuuguuaucuaagaacgcuuuuccuguaacugguguuuauaacacccauuuacugucuuuggaugccuuauugacaguuauagacucuauagaaagccauugcaauagccgaauauuaaaugaaagacaaaauccaucaaaagauggagaaauuaauaaauuagaguuucacgauuuugccagcaauuacauccaccggacugguacccgucaaaaguuaucauugaacauuccuagucaugagcaauuaauggcugugaaaagaaaaaagaagcuccuggcuacuggaacugaacauuucaauucaaaaccaaaaaaaggaauccaguuuuuacaggagcauaaccuauuaucgacaccacuagaugcaguagaaguuguuggauuuuugcgagaaaauccucaucuugauaaaaaaaugauaggugaauacaucaguaauagagcgaacauugcuauucucgaucaguuugucaagucauuugacuucacugagaugcgcauugacgaagcuuugagguuguauuuagaaacguuuagguuaccuggagaaucuccuuugauaucuuuagugauggaacauuuugcagaacauuggcauaaauguaauggagagccuuuugcuaaugcugaugcugcauuuacucuugcauacgcgaucauaauguugaaugucgaccagcauaaucacaacguuaaaaaacaaaauacuccaaugacagcagaagcuuuuaaacguaacuugaaaaaugugaauggagggcaagauuuugaagaagaaaugcuugaugauauuuauaaugcaauuaagacugaugaaauuguaaugccugcugagcagacuggucuaguuaaagaaaacuaugaauggaaaguacuauugcggcgagguuccggaucggaagguuacuauguacaugcuccaaauggucuauuggaucaugauuuguuuucauugauuuggagcccaacuauuucagcuuuguccuauuuguuugauaagaccaaugauccaaccauuuaucagaaagccauaucuggauucaggaaaugugcuaugauaucggcucauuauggaaugaguaacgauuuugauaaccucauugugucucuuugcaaguacaccaugcuucauuauacuucugagaguccagaaaaucuuaccaucucuuuuggaucgagccccaaggcuaggcgugcugcaaaaacugucuuugaucuugcucaucgccauggcgacauaaucagagaaaguuggagaaauauuuuggacuguauuuuacaacuguauagauguaaacuuuuaccuaagauucuuguugaggcugaagauuuuauugaauugagugguaaaauaucucuuauucgugaagacauacaacucagcccuaaaacugaaacuggaauccucagcucauuguauucuuauauagcccucggagcagaaacgaauacucaaaaaggaccaucagucgaagaccaagaagcuauuaaaguugcccagaauuguauaagggaaugucaucuugagcagcugauaacagaaucuaaauuuuugcgcauugauucuuuacaacauuucgugaaggcucuagucacugcaucuuauggaccugaaggacauguuucacucgguaccucauauagugaagacacugcuguauuuuucuuggagcuucuuuuaaaagugguuauucaaaacagagaucguaucucaucaauuuggugcucuguaaaagagcauaucuacacucuacuuaugggcgcugcugcgugugaucaccacuucuuggucgagaggucuguuguuggucuucucaggcuugccauccguuugaugcacaaagaagaaaugggacccaugguauugcaaucucuucgcaugcugcuccuccuuaaaaguucuacccugucgcguguuucucggcagauaucguaugguacauuugagcuuuugaagacaucggcugcaaauauucauuccgcuacugauugggcaauaauauucacccuccuggaauguguuggagcaggugcuccuccuccgaaagucguuucgaagccugucaguucuacugaaucaggugcucgcucagaaggggaaguacagguggacaguggacuagguaacgagagaggcuauacuucugauucggagcugagcaaagcugguaguguuccuuugucgcccagccuuaguccggaggcuccucuuagcaacacaccuacaggauggauucuugugggacgagaaggugaaauccaaccuguaagcuguguaaggaggggaaugcucccagagcugucucgguacgauccuuugucaaugguuaagugcguugauagccugucauuucucgucagggaugucguucauaucacgccuuacaacuuucaugauuguauucgaugcauaaggacauucguugaagcagcugcuaauacaguugaaaggaaaagcagaaaagccgguagggauacagcuaggcaauccaagaggaaaaauacaaaaagacgagaggaaagaggacugagcccuacggggagugccuaugacgcagaugagagugauccugaggacuccccuggcuaucagcaaguuugcauucagcuuuuggaauugaugcauacacuucacacaaggacggcucagaucuuccgauggugggcugaagagacaggacagaaagaaguguccaaucccucuuacuggacuccagguuggugcccucuucuccaaggcauauccaggcuuuguucacacccuaauagagccguucggaugucggcaauaacuuauuugcaaagagcacuucucaugcaagauuugcaaucuuuaucuggggaagaaugggaagaauguuucacucaaguacuguucccacuccuguccacucuguuagcuguuaauauuccagcgaucgaagaaacaaggauaagggcagcuacuguacuuuccaagguguuccugcaucacuugucuccucugcaaacccuaucuaguuuugcacagcuguggcugaccauacuugauuauauggauaaguauaugcacgcggacaacagugaccugcuuuaugaggcuauuccggaaucauuaaagaaccuguuacuugugauggacucagcugguguuuucaauggauuagaugggcgcaaugagauuuggguugucacuugggaucgaauaagcucauuccuuccuaaccuucagucagauuuauuuaaagaucaucuaccaguuguagaugcuaguucacuugaaacaaaagaagcuuuagagaccucuaaaggugaaauugaagucguucaaacugagcaaccaaccaugcaaagaccuccuacuucucaaguuguacagucgccaccucagccuccgucaaugccuaaaccuggagaagcuguugaaauaucaggaccuacgaccaacaauaauguugguucacaaaauuggcaaccuccugcacccgucuauccacaucuugagcagaugguuucaacacccaucggcccaucaagucaacucccaguuuacucuggauuugcgaguaugccgcaucagcccccucccccgucagcccaauuuuucuaucaggacaugucuucuccaagucaaccuaaugcgacccucaauucugagcaaccugcaguuggaggcucuuuauuauuagcgucagcagagauggaaccuccaaagcuucccgugauaucucccccgacuucuucauga

SEQ ID NO: 7036 - RNA, 618 nt, Piezodorus guildinii
augucgauccuagcauauaacggcagugccguaauugcuaugaaggggaaggauugugucgcuauugcuucagauuugagguucgguauucaaggacagacuguuucaacuaauuuugaaaaaguuuuugaaauggguccucauuuauacauuggacuuccuggauuaacaacugauacguuuaccguucuuaacaaacuuaacuuuaggaaaaacauguuugaauugaaggaggauaggaagauagcuccagauguguuucuaucaauggucucaaaucuauuguaugaaaggagguuugggccauuuuuuguugaaccuauaauugcugguuugaaaccaaaaacuauggaacccuuuauagcuucaauggauuuacucgguugcccuaacaaaccagaagauuuuguuguggcaggaacagcuucagaacaacuuuauggaaugugugaagcucuuugggaaccgaaucuagguccugaagauuuauuugaaacuauaucucaagcucuuguuaaugcuugugacagagaugcacuuucggguuggggagcuucuguuuacauaauugagaaagauaaaguaacccacaggagaauuaaaacaagaauggauuaa

SEQ ID NO: 7037 - RNA, 2778 nt, Piezodorus guildinii
auggaguccccaccuucuuuagaaacuguacaucaagcuguuuacgcucuuuaucauaauccagauccugcugaaaaagaggaggcuucauuauggcuaggccaguuacaaaaaucaguuuucucauggaaaauugcugaugaaauacuccauaccaguucagauguggaaugcuguuauuuugcagcucaaacaaugagaacuaaaauccaacauucuuuccaugagcuuccuccagaaucucaccuuccccucagggauucucugauggaucacaucaguaaaauuaaugagucaacaaauucugugauugguacucaguuguaucuggcucuggcagaucucgcauugcaaaugggaucuugggaaaaaccugcaaucgauuugauugaacgauuuuccaugacuucaguuccuccacuauuagaaauguugaccuuuuuaccugaagaaauaaauucuagagcuuugcguuuagguucuaaucguagacaagaacuucuccacaaguuuucacuugcuguuccuaaugucucugaauuccugaaaaugugucucaacaauuccggaaacaauccucaaauucaaaucaaagucuucaaguguuucacaagcugggugucaguacaggcgaugacacucaacgauguuaccgacaauauaguuguagccacagcguuucauguucuugcaaauaggauggcaucuuccaauuuacaugaagccgcugcagacuguguuugcucacuucucgaaugccuagaagauaacaacaaucaacagucgaucgaaaugcaacuguuuaauggugucaucucuuuagagcaaccguuucauauuuccguagcccacgaagagcaugagaaguguguaaauuacuguagaguauuuacagaacuugcugagaguuuucuggaaaaaauaguuagcggaaguaguccuacuaaagcgcauuucgccauuaagauuuuugaccuuguucuuacuuguguuggucaucaugauuaugaaguagcugcuauuacauuuaauuuaugguaucgccuuucagaagaacuguaucaaaagaaaaacucuggacuuacaucguuauuuaaaccauauauagaaaggcucauugaggcguuauguaggcauugucagauggaaccugaucacgaaggaauccucgaagaaggggaugacuuuccagacuucaggaugaaaguugccgaacugauucgugaugucguuuucauaaucgguuccuccaacugcuuuaggcaaauguuccuaucccuccaaggacccaauaccaccugggacaccacagaagccgcauuguucaucaugcaagccguagccaaaaacaucaucccggaagaaaacgauguuguuccaaagguuguugaagcuauuuugaaccuuccuccaaacacacacauagccgucagguguacaucaguucuucuacuaggagaauugugcgaguggaucgaaaaacauccccaauaucuagaaccaguguugaauauggugcuguucugucuucagcaaccacaguuggcgaacucagcugcuaacuguuuacaaaguaucugcaguacauguaaaaaucaaauggugaccaaguuuuuaggucuucugcagauacuucaaucccucgacaaauucguucugacgaaugaaucaguugucggacuauugaaaggcgucgcuuccaucuugagcaucaugcaacaugaucaguuacagcaggccaugagagauguuugucucauccagauuaagccgcucguucauuuaauugagaaugauguuaaacuagauaaagguacaaaaagcgauccagcgauuuggauggauaggcuguccgcuauauuccgccauaucaauaucaccguuaggaauggagaaauucauccuugccaacccgucauuaccgaaauuuggccaguccuuuccuccguuuguacgaaauaccaagccaauucacaugucauggaaagaugcugcaggugccucagauucguuguccguugugugggcaaacaaucggcgaauuugcuugaaccauuagucaaacaaauagugacccucuaugcucaacacgagcacagcuguuuccucuaccugggcucuauccuggucgacgaauaugcuuccgagcagggcugcauccagggauugauagacaugcuucaagcuuucauucacccgacguuuacccuccuucaaggagaagcgggucugaaauugcauccagacacuguggacgaucuuuucaggcucugugcgagguucuugcagagggcaccugugccguuccucaccgcgccagccaucaacuccaucauggagugcgcccugucgugcaucccgcucgaucauagggaugcuaauucuucaguaaugaaauucuuuuaugaucugauucacgcuggaaugaccaacgaagaucacgaggauuucucuuugaggcaaagacugguacaaaauauaauccaagaaagagguucagauuuaguaaacaaccuuuugacagcauccguuuucuuccuucagaucuauaugcugucagauguagcggauguuuugauggagcuuauauuauucgauaagcagucugcuggaagguggguagaacaagcauugaaaagaaugccaacgcacaauaguacaggcaguauuacugcuacaccaaagcaauuggaagauuuccaucgcucucuacucagcgccagcaguuccaaaacucuaacgacuacacuaaaagaauuuucucgccucuaccgcuga

SEQ ID NO: 7038 - RNA, 1533 nt, Piezodorus guildinii
uggaccuucuggcguucgagagggagugcuucaaagauggcgcaaagguuuccuccgucgcagccagcuccgagcccgguucagcaaccucaaagauauccaucgccuucggggccaccucucaggcaauaugcaccuucuaacuuuccuuugcaacagaggcccgguggcuuugugcagggaggugguaugggaagcgggaugaugccacgcccacagcaacaaccuuacaaccccauuaggccaccaauaccccaggcgcaaaaacggccaagugaugucaggccaccacagcaacaaccaaaaggggaguuuccucauacauccgcugguggaaguagugguaagaagaagaagaagcuggcggauaagauccuaccccagaaggugcgggaccugguaccggagucgcaagcuuacauggaccuucuggcguucgagaggaaacuggacucaaccauaaugaggaagaggcuugauauccaggaagcauuaaaacgucccaugaagcaaaaaaggaaauuacggauuuuuauuucuaauacauucuauccagcgaaagaggcaaccgagacugaggaaggaaguguagcauccugggagcugagagucgagggaagacuguuggaagauucuaaaaaugauccuaacaagccuccaccguuacagguaaagaggaaguuuuccucuuucuucaaaagucuuguuauugagcuagacaaagaacuuuaugggccagauaaucaccucguugaauggcacagaacuccuaccacacaagaaacagaugguuuucagguuaaaagaccaggugacaaaaaugugagguguacaauucuucucuuguuagauuaucagcccuuacaguucaagcuugauacccgacuugcucgccuucuaggaguucacacucaaacaagaccuguuaucauaagugcgcuuuggcaauauauuaagacucauaaacugcaagauccucacgaaagagaauauauaaauugugacaaauaccucgagcagacauucaguugcccuaggaugaaguuugcugagauaccucagcgccucaacccucugcuucauccuccagauccuauugugaucaaccacaucaucagcguugaagguacugaacagaaacaaacagcuuguuacgauauugauguagaaguugacgacacauugaaaacacaaaugaacaacuuccucuuaucaacagcuagucaacaagaaauacagagucuugacaauaagauacaugaaaccguugagacuauaaaucaguugaagaccaaucgagaguucuuuuuaagcuucgcuaaagacccacaacaguuuauuaauaaauggauaauaucucaaacucgagaccuuaagacaaugaccgauguuguuggaaaccccgaagaggaaaggagagcugaauuuuauuaucagaacugggcccaagaagccgucuguagauauuuuuacacaaaagugcagcaaaagagagcagaguuagaacaagcccuuggcauucgaaauacuuaa

SEQ ID NO: 7039 - RNA, 435 nt, Piezodorus guildinii
augccuaaaguacggagaagcaagaagccuccaccagaugguugggaacuuaucgaaccgacuuuagaagaguuggaacagaaaaugagagaagccgaaacugagccucaugaaggcaagaggaaaguggaauccuuguggccuauuuuuaaaauacaucaccaaaaaucucgguacauuuacgacuuguacuauagaaggaaagcuauaaguaaagaauuguacgagcauugccuuaaugagaacaucgcugauaaaaacuuaaucgccaaauggaaaaaacagggcuaugaaagucuuugcugcuuacgaugcauucaaaccagggauaccaacuucggaaccaguugcauuugcaggguccccaaggccaagcuugaagagggaaagaucguggaguguauccauugcggaugucgaggaugcucgggauga

SEQ ID NO: 7040 - RNA, 1029 nt, Piezodorus guildinii
augaaagugcuacuugagagugauguccaacuaacuacucauuuuuggggagcaucggacuacaaagauaaacuuagcguugcaauaggagaaccucugguugcgagcucagaugccaguugggcgaaucacauucuccuaggacacccugcuaugcccacagccacaggacacaguggggucaucccaaguaaugaagaaugcggcauucgcgauguaugggcucauaaucugaaggaugaauuuaaaguuaucaggaagaucauacauaaauacaauuauguugcgauggacaccgaauuuccuggagugguugcaaggccuaucggugaguuccgaaguacagccgacuaucaguaccagcuccugaggugcaauguggaccuccuccgcauuauccaauuggggcucaccuuccucgacgagaacggaaaggcucccgcagguccuuacagcaccuggcaguucaauuucaaauucaaucuugcagaagauauguacgcccaggacaguaucgaucuucuucagaauucagggauucaauucaagaaacaugaagaagacggaauagacccuguagacuuugcagaacuucucaugaccucaggaaucguacugauggagaauaucaagugguuauccuuucauaguggcuaugauuucggauaccuauugaaacugcuuacuaaucagaacuuacccaaugaugaaagugaauucuuugagcuucucaagaucuacuuuccaacuguuuaugauguuaaauaucugaugaagaguuguaaaaacuugaaaggagggcugcaggagguggccgaccagcuggaacuuacgaggguagggccacagcaccaagcuggcucugauucauuauugacgggaauggcguuuuucaaaaugagagagauguuuuucgaagacaauauagacgacgguaaauacugcggucacuuguacggauugggggccuccuucguugucaacgguaacaguuuccacgacaacggcgauaacucaaguaauucauga

SEQ ID NO: 7041 - RNA, 1206 nt, Piezodorus guildinii
augucugacucgcggagaguucaacuuaaggaagaccuaucuuuuguagaguucgaaacaagugaaaauguugaaguuauaucuucuuuucaaagcaugggacuuaaagaagauuugcugaggggcauuuaugcuuaugguuuugaaaaaccaucugccauccagcagagagcaaucaucccgaucguccgcggucgagauguuauugcacaagcucaaucugguacaggaaaaacugcaacuuuugccauugccauuuuacaaucuuuggauacgcaaacuagagauacacaaguuuuauguuugucgccaacaagagagcuugcuguacagauucagaaaguuauucuugcuuugggugaucucaugaacguucagugucaugcauguauagggggcacaagcuugggagaagauauaaggaaacuugauuauggccaacauguuguaucugguacaccuggucguguuuuugauaugauaaagcggcgaacccuaaggacaagaucaaucaaaguuuuaguucuugaugaagcugaugagauguugaauaaagguuucaaagaacaaauuuacgauguuuaucgcuucuuaccuccagcuacucaggugguucuuauuucugccacauuaccucaugaaauucuugaaaugaccagcaaauuuaugacggacccuaucagaauuuuagucaaacgugaugaauugacauuggagggaauaaaacaauuuuucgucgcuguugaaagagaagaauggaaguucgauacucuuugugauuuauaugauacauugacuaucacucaagccguuauuuucugcaauacaagaaggaagguugauuggcuuacugaaaaaaugagggaugcaaauuucacuguuuguucaaugcauggugauaugccacagaaggaaagagaugcuauaaugaaggaauucagggcuggaaaaagccgagugcuuauaacaacagaugugugggcuagaggaauugauguacaacaagucucccuugucaucaacuaugacuuaccuaacaacagagagcuguacauucauaggauugguaggucaggaagguuuggaaggaaagguguagccauuaacuucguaaagagugaugacaucaggauuuuacgagauauugaacaguauuacaguacacaaauugaugaaaugccaaugaauguugcugacuugauuuag

SEQ ID NO: 7042 - RNA, 1599 nt, Piezodorus guildinii
augacgaacgcugcuggagauggacacagaucgcacagcaauguauauaaagacaaaagcaaaccucaagauguucgcagcaguaacaugacugcggccaaaggccucgcagaugcuauucguacgagucuugguccuaagggcauggacaaaaugauucagaaaggaaauggagaaguuacaaucacaaaugauggugcuacuauuuuacaacagaugaaugugacucauccagcagcuaaacuuuuggucgaacugucucaagcccaggauguggaagcaggugaugguacgaccacagucgucauauuggccggagccauaauggaagcugccgagaagcugaugaaccguggaauucacccgacgacaauuuccgaugcguucagcauugcgguugaaaaagccaugccaaucuugagagagauguccauuccucugcaacagaacgacaaugaaagucucaucaggagugcaucuacaucucuuaacucaaagguuguuucucaacacucaucgauauuggcuccguuagcuguuaacgcuguucuuagaauaacagauccgaagaaggauaaaaauguugaccuaaaagauaucaagaucauuaagaaacucggaggcacgguagaagacacagaacucaucgaaggcuuaguauucacccagaaguuggccaacauaaauggucccaagcgccuugagaaagucaaaauuggacucauucaguucugcauuucuccucccaaaacagauauggaucacaaugugguuaucucugacuaugcagcuauggacaggauacucaaagaggaacgagcguacauccucaauauugccaagcagaucaagaaggcaggguguacuauguugcugauccagaagucuauuuugagggaugccuuguccgauuuagccauucacuucuucgacaaguugaagaucaugguugucaaggauaucgaaagggaagauaucgauuucguuuguaagacucucggcugcagaccgaucgcaucucuugaccacuucaccagugaggccuuggucacugcugagcuagcggaagaaguaucagcaggaagcucccguaucgucaaagucaccggaauacacaaucccgcaaagacuguuaccauuuuaguucgaggauccaacaaucuuguucucgaagaggcugaucguuccauucacgaugcccuuugugucauccguugucucaucagggaaagggcacuucuucccggaggaggagcucccgagauugaacuuucccuucgccuagggcagcacgcucaggucuugggcucgguagaggccuacuguuugagggaauaugcuaaagcucuagaaaucguuccuuacacccuagccgagaaugcuggucuuaacccaguagcuaccgugacggaacugaggaauaagcacguucauggccaaaccagugcugguaucaauguuaggaagggccagguaacagauauccuugaagaaaauguccugcagccgaugcuggucacagcuagcgcaaucaccuuagcgacagaaaccguuaggaguauucuuaaaauagaugacauucugaaugucgcccauuaa

SEQ ID NO: 7043 - RNA, 1248 nt, Piezodorus guildinii
auggaagaaauugguaucguucuccccgagaaagaagaaaacagucaagauggaaagcuuagcaccauacuaggacagaaucugucagaugacagcgauaguagugauuuauucaccaaguuuaagaaauuacaaaggcagcuugaauuuuuagcaguucaggaagaguacaucaaagaugaacagcguaaucugaagaaggaauauuuacacgcacaggaagaaguaaagcgaauccagaguguucccuuaguuaucggucaguucuuagaagcaguugaucaaaauacugggauuguagguagcacuacaggcucuaauuauuaugugaggaucuuaucuacgaucgauagagaacuauugaagccuucagcuagcgucgcccuucacaagcacagcaaugcucuuguugacguccucccgcccgaagcagauuccucuauuucgaugcuccaagcagacgaaaaaccagauguucaguauucggacaucgguggcauggacaugcagaagcaggagauucgugaggcuguggaauugccuuugacacauuucgaacucuaccgccagauugguaucgauccucccagaggagugcuuauguauggaccuccaggauguggcaagacuaugcuugcuaaagcuguugcucaucacacaacugcugcauucauucgaguaguuggcuccgaauucguucagaaauaccuuggagaaggaccgaggaugguucgugacguuuuuagacuugcuaaagaaaacgcuccugccauuaucuucaucgacgaaauugaugcaaucgccaccaaaagguuugacgcucaaaccggugcagacagagaaguacagaggauucuguuggaacugcucaaccagauggacgguuuugaccaaaccaccaaugucaaggugaucauggcuaccaacagagcagauacccuggaccccgcccuccugcgacccgguaggcuggacaggaagauagaguucccccuuccggacaggaggcagaagaggcuugucuucucgaccaucacugccaagaugaaccucuccgaggagguagacuuggaagacuacgucgcucgcccggacagggugucuggugcugacaucaacgcuaucugccaagaggcuggaaugcaugcuguuagggaaaaucguuauaucguccuugcaaaagauuuugaaaaagguuauaagaacaauauuaagaaggaugaaucugaacaugaguucuauaaauaa

SEQ ID NO: 7044 - RNA, 489 nt, Piezodorus guildinii
augccuaacauuaaguugcaaaguucugauggagaaauauuugaaguggauguggaaauugccaaauguucagugaccauaaaaacuauguuggaagauuuaggcauggaugaagaugaagaagaaguuguaccauugccaaauguuaauucugccauuuugaagaaaguaauccaaugggccacuuaccacaaagaugauccaccuccaccagaggaugaugaaaacaaggaaaagagaaccgaugacauuucuucuugggaugcugauuuucuuaaaguugaucagggaacucuuuuugaauugauacuugcugccaacuaucuugauaucaaaggucuacuugauguuacaugcaaaacuguggcuaacaugauuaaaggaaaaacuccugaagaaauucguaaaacauuuaauaucaagaaugauuuuucugcugcugaagaggagcaaguacguaaagaaaaugaauggugugaagagaaguaa

SEQ ID NO: 7045 - RNA, 966 nt, Piezodorus guildinii
augaaaauggaaguagaaaauaugauuuccauugagauggaagauaagacuucguuaaaagaacuggaucaguggauagaacagcugaaugaaugcaaacaacuuaccgaaagccaagucaaaacucuuugcgauaaggcgaaagaaauauuagccaaggagucaaauguucaagaagugaaauguccugucacaguuuguggggauguucaugggcaguuccaugauuugauggaacuguuucgaauaggaggaagaucuccagacacuaauuacuuguucaugggugacuauguugauagaggauacuauucuguggaaacagugacauuacuaguugcuuugaagguaagauaucgagaaagaaucacaaucuuaagagguaaucacgaaucacgccaaaucacacaaguauaugguuucuaugacgaauguuuacguaaauauggaaaugcaaauguuuggaaguauuucacagauuuauuugacuauuuaccauuaacggcucuuguaaauggucaaauauuuugucuucaugguggucuuucaccguccauagacacucuugaucauauccgugcauuagaucgccuacaagaaguaccacaugaggguccuaugugugacuuacuuuggucagaucccgaugacagaggugguugggguauuucuccaagaggugcagguuacaccuucggucaagauauuucagaaacuuuuaaccacucaaauggccucacucuugugucaagagcucaucagcucguaauggaaggcuauaacuggugucaugaucguaauguuguaacaauauuuucugcaccuaauuacuguuaucguugugguaaucaagcagccauuauggaguuggaugaugcgcagaaauauucauuccugcaauuugacccagcgccgaggagaggagaaccacacguuacuaggagaacuccugauuacuuccuauaa

SEQ ID NO: 7046 - RNA, 966 nt, Piezodorus guildinii
gauggcagaacuuugucugauuacaacauccagaaagaaucaacccugcaucuaguacuacguuuaagaggaggcaugcagauuuuugucaagacacucacuggaaagacuaucacucuagaaguugaaccaucugauacuauugaaaacguuaaggcuaaaauccaagacaaagaaggaauuccaccagaccaacaaaggcuuauuuucgcuggaaaacagcuugaagauggcagaacuuugucugauuauaacauccagaaagaaucaacccuacauuuaguauugcgucugcgaggagguaugcagauuuuugucaaaaccuugacugguaaaaccaucacccuggaaguagagccuucagauacuauugagaauguuaaagcuaaaauucaggauaaagaagguauuccaccagaucagcaaagauugauuuuugcagguaaacaacuugaagauggucgcacccuuucugacuacaauauucaaaaagaaucaacucuucaccucguccuccguuuaagagguggaaugcaaauuuucguuaaaacuuuaacuggaaagaccaucacccuagaagucgaaccaucugacacaauagagaauguuaaggcuaaaauucaagauaaagaaggaauucccccagaucagcagcgauuaauuuuugcaggaaagcagcucgaagauggccguacucuuucagauuacaacauucagaaagaauccaccuugcauuuaguacuucgucugagaggagggaugcagauuuuugucaagacuuuaacagguaaaaccauuaccuuggaaguugagccuucagacacaauugaaaauguuaaagccaaaauucaagacaaagaaggaauuccgccagaccaacagagguugauuuuugcaggaaagcagcuggaagauggccguacucucucagauuacaacauucaaaaagaauccaccuugcauuua

SEQ ID NO: 7047 - RNA, 1629 nt, Piezodorus guildinii
augcaaccacagauaauacuucugaaggaggggacugaaaguucccaaggaaagccucagcuagucucgaacauaaaugcuugccagauuaucgcagaugcaauucgaacaacucuuggcccgaggggcauggacaaacucaucguugaugguaguggaaaagcaacaauaucaaaugauggugcuaccauuuuaaaacauuuggauauagugcauccugcugccaaguguuuaguggauauagccaaaucucaagaugcugaggucggagaugguacuacaaguguuguccuuaucacuagcgaaauucugaaacaguugaaaccauauguggacgagggugugcauccuagaaucaugaugaaagcaguccgcaaggccacacaguuaugcuuagauaaaauuaacagcuuagcugucaagaucgagaagagcagcgcggagcagcaccgcucccugcuggagaggugcgcugccacggcccucagcuccaagcugauccaccagcagaaggaguucuucuccaagauggucguagacgcuguucucuuguuggacgagcuccuuccucuggaccucaucggaaucaagaagguuccugguggagcuuuagaggaauccuuguuggucucuggaguagccuuuaagaagaccuucuccuacgcaggcuuugaaaugcaacccaaaaaguacacaaauccuaaaauagcuauucucaacauugaauuagaauugaaagccgagagggacaacgcagaaaucaggcucgacaacguggaggaauaucaaaaagucguagauguugaauggcaaauuuuguaugaaaaauuagacacaauuguuaagucuggagcucagguuguucuuucaaaacuucccaucggcgauguagccacucaguauuuugcggacagagauauguucugugcugggcguguugcugaugaagacaucagaaggacucagaaagccugugguggcacgaugauuaccacaaccaaagauaugucugcuuccguccucggaacaugcgaauuauuugaagaaaaacagauugguggugacagauauaaccuguucgccgguugccccaaugccaagaccuguaccaugauccugaggggcggagcugagcaguuccucgaggagacugagaggucccuucacgaugccaucaugauagucaggagaacaaucaagaacgacgcagucguugcaggugguggcgcuaucgaacuggagcuuuccaaaaugcuacgagacuacucuaggaccaucgcugguaaagaacagcuguugaucggagcgguagccaaggccuuggagaucaucccgaggcagcucugcgacaaugcuggcuuugaugccacugccauccucaacaggcucaggcagaagcacgcucaaggaagcugcugggaagguguugaugugacauuggaagauaucuccgauaacauggagaagugcgugugggagccuucgguggugaagaggaacgcccuggaagcagccugcgaggcugugugccugguccugucugucgacgagaccaucaagaaccccaagucagguggcggugggaugggcgaccagccugugaugccuccgagggggcgucccauguga

SEQ ID NO: 7048 - RNA, 13935 nt, Piezodorus guildinii
augacugauuccuuggaaucaaaugauccucccccagaggagcagccagugucgauaauagauauaacggauuuuuuagacuaucuucgugaaaauguuaaauugaauuuauuagguguuaaaaguguaccuccugcuuuagauacugcauuagaugauaauggaaauuuggauuguauuaagaaguuuuuaagugacccacaaauugcuacucuaauaguacaaaagaauucaaccaaagaugaugacccagaacagaguggugagggugaagaugaaaaggaaacacccaccauaucaauaucuaacaugguucaguuuucuagcccuaaagcaucaagucuucuguucaugaagaauggagcgauuauggaugcugauaaaagcauccagucucaguuacacaugauagaauuuucugagggcacugcguacgaaagucuacaugcuaucauuagcaaagggaugucaccuuacuuuaaaaguuauguuaaggaaucuggccgagcugauagagauggagauaaaauggugccaucuguugaaaagaagauugaugaauuagaaaugggccuguugcacuuacaacaaaacauugacaucccugaaauaacgcuuguaguucauccaauuguuucaaauguuauuaaaaaaugugcugaagaaggaagaaaaccaaaaguggcugauuuuggugaucgugucgaagauuccaccuuucucaaucagcugcaacaugguguuaaucgauggaucaaggaaauccaaaagguaacaaaauuagaucgagacccaucuucugggaccgcauugcaagaaaucuccuuuugguuaaaucuugagagagcguugcaucgaauccaagaaaaaagagaauccauugaaguugggcuuacauuagaaauucugaaacauggaaaacguuuucaugcuacuguuaguuucgacacagacacaggacuuaaacaggcccuggcaaccguaaaugauuacaacccguugaugaaggauuucccuauuaaugaccucuugagugccacugagcuugaucgaaucaaauuagcuguucaacagaucuucacucaccuuagaaagauucguaacacuaaguacccaaugauaagaggacuaaggcuuaucgaagccaucucaagagaucucacaacacagcucuuaaaaguuuuagguacuaggcgcuugaugcacauuccauuugaugaguuugagaaaguaaugcaacaauguauuaaugucuuugucacgugggaugacgaauaugaaaaacuacaaaaucuucuaagggauauuguuaagaaaaaacgagaugaacagcuuaaaaugguauggaggguuaugccugcccauaaaaagcugcaaacgaggauggaacagaugcguaaguucaggcaucaacacgaacaacugaggacugugauauugagaguucuccgaccaguaccugcaucccuuauuaacggucaagagguuacuggccaagacaaaguagucgaugaugcacccaacauaucugcaguggaagaggugaaccuagccuacgagaaugugaaagaaguggauugcuuagacaugucaaaggaaggcggugaagcuugggaagcugcgguagcgcguuacgaggaaaagauugauaaaguugaaacacgcauuacugcccacuuacgagaucagcuggggcaggcgaaaaaugccaaugaaauguuuaggauauuuucucguuucaaugccuuauuugugaggcaacauauucgaggggccauaagagaguaccagacucagcugauacagagggucaaagacgauauugaagcacuccaugagaaauucaagguucaauacggccaaaguaaaggcuguaggaugagcucuaucagagauuuagcaccaguuucagggucuauaaucuggguaaagcagaucgaucgacagcucaccacguaccuaaggaggguggaggauguucuagguaaaggcugggaaaaucauauugaaggucaagcgcugaagucugauggagacaguuuuagacucaaauuaaauacucaagaaauauucgaugacuggucucgauccguucagcagaggaaccuuucaguaucugguaggauuuucgcaauagagaguacucguucccguuccgggagaggaaacuuacugaaguugaaagugaauuuucucccagaaaucauuacccucuacaaggaggugaggaacuugaagaauuuaggauuucgaguuccauuagccauaguaaacaaagcacaccaggccaaccagcuguauccguuugccgucucccugauagagagugucagaacguaugagagaacacuugaaaaguuggacgauaaagccaguauuauuccucugguugcuggccugagaaaagaaaugcaacaacuuguggcugaggggauacaauuggucugggagagcuacaaguuggagcaauauguccaucgauucgcugaacaggucuguacuuuccaggagaaaguugaggaucuucuggucgucgaggagcaacucgauguugauguuagaucuuuggaaacgugccccuacucugcaucaacucuucgagacauucuugcuaaaguccagcaugcaguugaugaucuuucauugaaacaguauucaaaucuucacaucugggucagcaggcuugaucaagcuguugagaaaaaucuugguggcaggcuucaggcaggaauugacgcuuggacugaugcauuggaagggaagagccaugagcuagaccugaguauggacaccgaugcaccagccaggccgacacacgcuccugguggcgacccacauguacagacggugacucaugaaguucguauaaccaaccagaucauguaccuuuacccaagcauagaggaagcaagguuccagaucaugcagcaguuguuccaauggcaggcuguuguaacaucucagcaaagacuucagaguucccgauaucagcuugggcuugaaaggcucauaucccagucguauagagaccuuuugacuaagcuaccaaaugguucgcaagcccuuaucaacgccuaugauucaaucgacaggaaaaucaaagauguugucaacuauguagacgaguggcugagguaccaaucucuaugggaucuucagucggauacccuguacagcaggcugggagaugacaucaccauguggaugagaugucuuucugaugucaagaaaucacguacuacguuugauacuucugagacacgcagacaguucgguccuaucgccaucgauuacgcuaaaguacagaguaagguagcgcuaaaauacgauucucuugauaaggaaaucuuggccaaauucgguggccuucuaggccaggaaaugucuggauuccauucucaaauuucuaagucccgaagugaauuggaacaacagucgaucgaagcugcgaguacuucagaugccgucuguuucauuacguauguucagucauuaaaaagaaacaugaaauccuggcagaaacaggucgaaauuuauagagaaggacaaagaauucucgagcgccaaagauuucaauuuccuaacaacugguuacauguggacaauguugagggagaguggucagcuuuuaaugagaucaucaaaagaaaggacuugucuauccaagcacagguggugagccugcagcagaagauggucgcugaggaccgugcaguugaggcaaggaccaacgaccuccuuucugacugggagcacuccaagccaauagagggcaggcucaggccggacgaagcgcucgcucagcucaacgaguuugaagugaaguucgcucgacucaaggaggagagggacaacguagcuaaggcuaaggaggcccucgagcugcaauauacuggugcaagcagcgguagugaagaaagaguggcugugguauuugaagagauggaggaccuuaaggaaguauggaccgaauuaucuggaauauggaggcgauuagaugagacucgggagauaccauggcuuucaguucagccuaggaagcuucgacagcagcuggauggucugucccaacaacucaaagaguuaccagcgcgugucaggcaguacucuucguaugaguaugucaagaaacugcuccaaggauauacuaaggugaacaugcugaucguggaguugaagagugaugcacugaaggagaggcacuggagggcgcucaugaggaagcugcgugugaacuggguccuguccgagcugucgcugggucagguuugggacguggaccuucaagcuaacgagagugucgucaaggauaucauucucacggcacaaggugaaauggcacucgaggaguuccugaggcaggucagagaaucuuggcagaacuaucagcuagaucugaucaauuaucagaauaagugccgucuuaucagaggcugggacgaucucuucaccaaagucaaagaacacauuaauucuguagcggccaugaaacugucaccauauuauaagguguucgaagaagaggcucucacuugggaagagaaacugaauagaauuaaugcucuguuugacgucuggaucgauguucagaggcgauggguuuaccuggaagguauuuucuccggaagugcagauaucaaaacccuuuuacccauagaaaccucucguuuucauaacauaagcucagauuuucuuggucucaugaagaaaguagcuaaaucaccgauggugauggauguucugaacauccagggugugcaaaggucauuggagagauuagcugauuuguuagaaaagauacagaaagcucuuggagaguaucucgaacgggagagaaugucguuccccagauuuuacuucgucggugaugaagauuuacucgaaauuauugguaauuccaaaaauauugcaaggcuucaaaagcacuucaaaaaaauguuugcuggaguugcuucuauuuuguugaaugaagauaauaccaucauaacugguauugcaucucgggaaggagaagaggucaucuuuaccaauccaguuucaaccguugaucaucccaaaauaaaugaauggcugucauugguagaaaaagagaugcgauuaacauuagcugcuacccuugugucugcuguuggcgagcuuagggguuuuaaagacgcuccuuuggauccuccgaauuauauggcuuggguugacagguaucaggggcagauagccguacuugcugcccaagugcuuuggucggaggacguugaagcagcacugggaggaaagucgggaggccuucaggggguucugacacaggucgagggcacccucacuguccucgcugacuguguccuccacaaacagccaccgcucaggaggagaaagcuugaggcauugauuaaugaguuuguucacaagagaacuguuacucgucgauuaauacaagcaaauauaucuuccccuaaauccuuugaauggcuuugucagaugagguucuaucuagauccuacgcagacugaagcucugucucaacucucuauucacauggcuaaugccaaauucuauuauggcuuugaauauuugggcguucaagaucgacuaguccaaacaccuuuaacugauagguguuauuugacaaugacacaagcuuuggaggcacguuuggguggaucaccauuugguccggcugguacaggaaagacagagucaguuaaagcucuuggucaccagcuuggucguuuuguucucguuuucaauugugaugaaacuuuugacuuccaagcuauggguagaauauuugucggucucugccagguuggagccugggguuguuucgaugaauucaacaggcuugaagaaaggauguugucugcugugucucagcaaauucaaaccauucaagaggcacugaaauaucauauggauucaaauaauagagacucuacuuugaccgucgaacugguuggcaagcaaguucguguaucuccagacauggcaauauuuauuacuaugaauccuggauacgcuggacguuccaaccuuccugauaacuugaagaaacuauuccgaucacuugccaugaccaaaccagacaggcagcucaucgcugaaguuauguuguucucucaggguuucagaucugccgaaaagcuagccucuaaaauuguaccauuuuucaaacuuugugaugaacagcuguccaaccaaucucauuacgauuucggccugagggcccugaagucugugcuuguuagugcuggcaacguuaagagagacaggauucagaggaucaaggaaaagagagaaggcggaaguggugaugaagcaaccauugcugaaaaucuuccagaacaagagauuuugauucagucaguuugugaaacgaugguaccaaaauuaguggcugaagauauuccucuguuguuuucacuccucaaugauguuuucccacaaguccaguauacaagggcugaaaugacaaaauuaaaggaagagauaaggaagguaugucaggaagaauaucuugucuguggagaaggagaugagcagggaggaccuuggauggaaaaggucuuacaacuuuaccaaaucuccaacuugaaccauggguugaugauggucggaccuucuggguccgguaaguccucggcuuggagagugcuacugaaagcguuggagcgcuucgagggaacagaagguguagcccacguuaucgaucccaaagccauguccaaggaggcucucuacggugucuuagauccaaacacucgagaguggaccgauggucuauucacucauguucuuaggaagauaauugacaaugucagaggagaaauaaacaaaagacaauggaucauauuugauggugauguugauccagaaugggucgaaaacuugaacucuguacuugacgauaacaaacuucuuacuuuacccaauggugagagauugucucuaccuccgaauguccgaguuauguuugagguacaagauuuaaaauaugcaacccucgcaacugucucucguugcgguaugguaugguucucugaagauguuuuaucgacagaaaugauuuuugaaaauuaccuuucccgccuuagacacauuccguuagaggaagcagaagaagaaucuucuuucccgcagcugaagaagauugguggugagagaaaagaagaaggaauaucgccagcgaugcagguacagacggacguugcgaacaucuugcagagcuacuuuucaccagacggucucguaguuaggugccucgaguaugcucucaagcaggaacauauaauggaccucaccaggcucagagcucuugguuccuuguuuuccaugcucaaucauggugucagaacugugauacaauauaaccagagccauucugauuuuccauuaccuucagagcagcuggauagauauaucccuaagguuuuaauuuauucccuguuauggucauuuggaggagaugcuaaacucaaaguucgcucagacuugggcgauuucauucguucuguuaccaccauaccguugccgccaaacaaucccaacauaccaaucauagauuaugagguaaauauaucuggggaauggagcccaugguccgccaaaguaccucaaaucgaaguggaaacucacaaaguugcagcgccagaugugguugugccuacgcuggacacgguucgccacgagucucuauuguauaccuggcuugcagagcauagaccuuuagugcuuugugguccuccuggaucagguaagacaaugacccuguuuucugcacuaagggcccuuccagauauggaaguggucggccuuaacuucagcucugcuacaacgccagagcuucuccugaagacuuucgaucauuauugugaauauaggaagacucccaaugggguugucuuggcgccaguucaguugggaaaaugguugguucuuuucugugaugaaaucaacuugcccgacauggacucuuacggaacccaacgagucaucuccuucuugagacaacuugucgaacagcggggauucuauaggucuucugaucucgcuuggguuucccuugagaggauccaguuugugggugcuuguaauccucccacagauccuggcaggaagcccuuaucacacagauuccugaggcaugugccggucauuuauguugauuauccgggcgaaacaucucucaaacagauuuacggaacauucucacgagcuaugcugaggcuuauuccuucauugcgagguuaugcagaaccguuaacgaaugcaaugguugaauucuaucugucaucucaggaaagguuuacucaggauaugcagccacauuaugucuauucaccuagagaaaugacaagauggguuagggguauuugugaagcuauaaggccauuggacaguuugaaaguagaaggacuugugagguuaugggcucaugaagcucuccgccuuuuccaagacaggcuuguugaagccagugaaagggaauggacaaaugaaaauaucgacaaaguugcccucaaacacuucccaucaguggacaaggaaucggcucuuggacgaccgauccuguauuccaauuggcugucgaaggacuauaucccugucgagcgugaucaguugagggauuacguuaaggcaaggcuuaaagucuuuuaugaugaagaguuggacgugccucucgucuuguucgacgagguccuggaacaugugcugaggauagacagaauauucaggcagccacaggggcacuugcuccuuauaggggucucaggagcuggcaagaccacucucucccgcuuuguagccuucaugaauggacucuccguauuccaaaucaggguucacaauaaguacacuagcgaagauuucgacgaagacuugagaucuguguugagaagaucugguuguaaaaaugaaaagauugcuuucauucuggaugaaucgaauguccuagaaucugguuuccuagagaggaugaacacccuucuggcuaacggagaagugcccggacuguuugaaggugaugaguacagcacccugaugacgcagugcaaggagggagcccagagggaggggcugaugcuggacucaaaugaggagcuguacaagugguucaccggccaggugaugaggaaccuccacguaguguucacgaugaaccccagccaugaggggcucaaggacagggcugccaccucgccggcucuauucaacagguguguccuuaacugguuuggggacuggucugauggugcccuguaccagguggguagagaguucacuaauaccuuggaucuggacggaccaccuacauggaaggcuccagauuuuuucccaaucgcuuaugcaaauuugccaucaccuccaaaucacaggcaagcgguuauaaauggguguguuuucguacaucaaacgcugcacaaagccaaucaaaggcuugccaaacguggagcacgcacaauggcuaucacgccaagacauuacuuggacuucaucaaucacuuugucaaguuguauagagagaaauguuccgagcuugaagaacagcaacuucauuugaauguugguuuaggaaaaauagcagagacuguugagcagguugaagaaaugcaaaaauccuuggcaguuaaaucucaggaacuucaagcaaagaaugaagcugcuaaugccaagcugaaacagaugguuaaggaccaacaagaggcagagaagaagaagguacagucucaggaaauccaaucgcaaauugagaaacagaaacuucugauagcucagaagagggaagguguaauggcagaucucgcccaaguggaaccagcuguuauugaugcucagcaggccgugaaagagauaaagaagcagcagcugguugagguuaggucgauggccaacccuccggcgguagucaagcuggcauuggaguccaucugccuccuccucggggagagugccacugacuggaaguccaucagggcggucgucaugagggauaacuucaucaauucuaucgucaacaauuucucuaccgagaauauaucugaugaaguuagagagaagaugcauacccguuaccugaguaacccagaauauacuuucgagaagguuaacagagccaguauggcaugcgggccuauggugaagugggcuguggcccagauaaguuacgcagacauguugaagaaaguagaaccacugagggaagaauuacgaucauuagaagagcaggcuggcgagaacgaacagaaaggagaagacacaaaagcucucaucgcccaauuagagaagaguauagcugccuacaaggaagaguacgcccaguugauucaggaagggcucgcgaucaagcaagauuuagaaaaugugcaagccaagguugaccggucuauugcucuccugaaaucucucggucuugaacgaucaagaugggaagcaacaucagagacauucaagucccagauggcaacuauuaucggggaugucuuacucucuucagcuuaccuugcuuaugcugguuacuuugaccaacauucucgacacaaccuccugucucguuggacggagcaccucaguucugcagguauccaguacaggcaagacauagcccuuacagaguaccuuucuaauccugaugagaggcucagguggcaagcuaauagucugcccaccgaugaccucugcacggaaaaugcaauuaugcugaagagauucaaccgcuauccacucauuaucgauccaucuggacaggcuacugaauucauuaugaaugaauaccgagauaaaaucacuaagaccaguuuccucgaugauucauucaggaagaaucucgagucugcucuucgauucggaaauccauuacuuguccaggauguugaaaacuaugauccuauuuuaaaucccguacucaaccgugaaguaagacgaacugguggcagaguuuugauaucacuaggagaccaggauauugauuugucaccaucauuugugauauuccuaucuacgagagauccgacuguggaauucccaccggacaucuguuccagaguuacguuugucaauuucacuguaacuagauccucauuacagucccaaugucugaaccaaguacuuaaagcugaaagaucugauaucgacgagaagagaucugaccuccucaaacuacagggugaguuccaucuaagauugagacaguuggagaaaucuuuacugggagcuuugaacgaagccaaggguaagaucuuagaugacgauuccguuaucacuacccuggagacacuuaaacaagaagccgcagagauuaguaagaagguugaagaaaccgacagggucauuggggaaauugagacuguuucacaacaguauaaaccucuaucacaggccugcagcaauauguacuucacccuggacuccuugcaccaaauacacuuccucuaccaguacagccucaaguucuuccucgauauuuucucagcuguucucuucuccaauccaucccucgacggccuuacagaucacacccaaaggcugggugucauuacgaagcagcuguuugcuguaugcuaugagagaguugcacgggguaugcugcauaccgaccgauugacacuugcgcugcuacuaucuaggauauaccugcguggauugccccaggaagaucaacuggaggcugaguuccaccacuuccugagagguaaggagggagucguagccuccgguggaggagcuucucacuuggaaggucucuccagcgaccagcuggaagcacuaauuagguugagcaacaggcuaccacaauucaaggaauuaaugaagaagguuaaugaaaugccugaguuuguugcauggcuccagcagucaacaccagaacagaacgucccuacauuguggcacgaggauaagccguuaucuucuauugcaacugcuaugaacaggcuucuuuuaauucaagccguacgaggagacaggguuacugcagcuggugccggacugguuagugcugugcuuggcgaaggauucacagcccgagcugagagggaauuggaucuggcucauauuguugagucugaaaugacugcugguguaccuguucuacucugcucugucccugguuuugaugccacuuccaggguugaugacuuggcugcugaaucugguaaacaguuggcuucuauagcuauugguucugcugaaggauucucacaggcagacucuauaaucaauauggcugugagaucaggaagguggguacugcuuaagaauguccaccucgcuccacaguggcuuguccaauuggagaaaaaacuucacucucuacaaccgcacucuggauuccggcuguuccuuacgauggaaaucaaucccaaaguuccuguuaaucucuugagagcaggucguaucuucgucuucgaaccaccuccaggaaucagggcgaacuuauugagaacauucagcaccguucccgccucuaggaugaugaaggcgccaagugaaagagcaagauuguacuucuugcucgccugguucaacgcuauugugcaagagaggcugcgauacgcuccacucgguugggccaagcacuacgaauucaaugagucggaucuucguguggcuugugacacuuuggauacuuggauugaugcaacugcugugggaaggacacaauugccgccugagaagguaccaugggaugcauugguuacacuuuugucacaauguaucuauggugguaagauagauaaugauuuugaucagagguuguuaucuucauuccuuucaaaauuguucacaccaagaagcuuugaggcggacuucgcauuagucgccaauguugaugcuggagcaccuggaggccagaggcauauuacaaugccagacggaacuagacgggaccauuucuugcacuggauagagucuuuggccgacagacaaacuccaucuuggcuuggucugccuaauaaugcagagaagguucuuuugaccaauaaggguacugauuuggugaucaaacugcuaaagaugcagcagcuggaagaugaggaugagcuggcuuauacagaacaggaaucuggacccccuucgucacugcagccgggcccagacccuggcaggccggccuggaugaggacccuccacaacucggcccucaccuggcuacagcucuuaccgaccagccuucagacauugaagaggacgguagaaaacaucaaggauccauuauaccgguacuuugagcgugaagucaacucaggggccaaacuucucagggauguuauucaugaucucacugauguugucgccauuugucagggggagaagaaacagaccaacuaucauaggaccaugcuuagcgaucucgucaggggaauucuuccuucaggauggaggagguauaccguuccaagaggaugcacuguuauccaauggauaacugacuucagcaaucgggugaaacaguuggauacuauuucacagcuugcgucacaaagaggaccaucugaaauuaagaauacuccaaucugguuggguggucugaugaacccugaggcuuacaucacugcuacuaggcagugcaucgcgcaggcuaacaguuggucccuugaggaguugauccuggacguuacuauaccugagccaucauccaacuccucuguugcuacugaugaaugcaguuuuucuguuacugggcuuaaauugcaaggugcacaguguagaaauaaucaacuucuccucacaucuacaauuaugauggaccugccuacaacauuacuuagguggcacagggcuggcggagagggagauuccgggaagcugucuuuaccaguauaccuuaauucaacacguagcgagcuucuuuucacuguugacuugaacaucgccccaggucaagaaccacacagcuucuacgagaggggaguagcccuccucacuucaacagcgcucaacuag

SEQ ID NO: 7049 - RNA, 2640 nt, Piezodorus guildinii
auggcuaagucuaguccugaaucuagcgauagugaggaggauaggaaacaaagagaugaauucgcugcacgacuuaggaaaaaagauaaagaaaauacaagaaaaaugacaaccauucauucagauaaaagagcauacgaggaagcagcuaaaagauuaaaaauugauucugaacaucaagaaaaauugaucccucgguuaagggucgaaucaagaagaaaguauuuagaaaaaagaaaagaagacaaaguucuugagcuugaagcugauauaauugaugaugaauaucuuuucaaugaggaugaacucacugagagggaaagaaaagacagggaucauaaaaaaaaauuauugguccuugcaaaagagcaugaaagagcuagagaacuagaaaaaguucagagauaucauaugccaagagauguaaaagauaguguugaacaauaugaggaagucgaugagagggaaaauaagccaaauuaugaacaaaggaaaugggaagaggaacagaugucaucugcuguguuucacuuuggugcaaaacaaaaggauaaauaccaggaagaauacgauuugguuuuagauaaucagauugaauuuauucaagcuaugagucuagcuggaacuaaagaaaagccugagcagcaacugacagaaaaggaaagaaagagauugacaauugaagaaacucaaaaaagccuuccuguuuuuaaauuuaaggaugagcuagugcaagccaucaaggaucaucaaauccugaucauagaaggugaaacaggcucugguaaaacuacucagauuccacaauauuuauaucaagcagguuuuacuaacgauggcaaaaaaauuggcuguacucaaccgaggagagucgcugcgaugucuguugcagcuagaguugcugaagagaugucugugaaguugggaaaugagguagguuacagcauucguuuugaagauugcacuuccgagagaacaguaauaaaguacaugacugacgguacgcuucacagagaauuucucucagaaccagaucugcaaacuuacagugucaugauaauagaugaagcucaugagagaacauugcacacagacauuuuauuuggguuaguuaaagauauugcaagauuuagaucagaucuuaaacuuuuaauauccagugcuacauuggaugcagaaaaauuuucaacauuuuuugaugaugcuccaauuuuuagaauuccaggaagaagguuuccaguugauauauauuauaccaaagcucccgaagcagacuauauugaugcuuguguggucucaauucuacagauacacgcaacucaaccuuuaggcgauauucuaguauuccuuacuggacaggaagaaauugaaaccugccaagaaauuuugcaagauagaguaaggcgucuuggaagcagaaucaaagaguuauuaauacuuccaguuuauucuaaucuaccaucugacaugcaggccaaaaucuuccaaccaacuccaccuaaugcaagaaagguuguuuuagccacaaauauugcugagaccucucucacuauagacaauauaauuuaugucauugauccugguuucuguaaacagaauaacuuuaacucgaggacugguauggaaucauugauaguugugccuguuucaaaggcuucagccaaucagcgugcaggaagagcuggacguguagcugcuggaaaaugcuuuaggcuuuauacagcaugggcguauaaacaugaacuggaagacaacacuguuccagaaauucaaaggaugaacuugggaaaugucguauugacccucaaagcccuuggaaucaaugacuugauuaauuuugauuuuuuagacccuccuccucaugaaacauuggugcuugcucuagaacagcucuaugcuuugggggcuuugaaucaucauggagagcuaacgaaauugggucgaagaauggcagaauuuccauuagauccaaugauggguaaaauguugcuugcaucugaaaaguauaaaugcagugaggaaauuguuacuauugcugcaauguuaucggugaauggugccauuuucuauagaccaaaggacaaaguuguucaugcugauacugcuagaaaaaauuuuuuccuuucugguggugaccaucuuguucucuggaauguuuauaagcagugggcugacacugacuucagcacucaauggugcuaugaaaauuauauucaguauaggucgaugaaaagagcuagagauguucgggaacagcuugugggucuuaugcaacguguagaaauggaccucauuuccaauccuacugauaguauugcuauaaggaaaacaauuacuucugguuauuucuaucacauugcaagacuuucuaaggguggccauuauaaaacagucaaacauaaccaaacuguaaugauacaucccaauaguugucuguuugaggaucuuccucgcugggucgucuaucaugagcuuguuuucacuacuaaggaguucaugcgacagguugcugaaauugagagcaaauggcuacuagaaguagcaccacauuacuauaaaccucgugaauuagaagauucaaccaauaccaaaaugccuaaaguauuaggaaagaccagagcacagcugggggaacauuaa

SEQ ID NO: 7050 - RNA, 1371 nt, Piezodorus guildinii
augaagauugaagaagucaagaguacuguuaaaacacaaagaauaucuagucauagucauauuaaagguuugggauuagaugaaaauggaguaccuauucaaauggcagccgguuuggugggucaagaaaaugcuagagaggcagcuggaauaguaguggauaugauuaaaucgaagaaaauggcugguagagcuguauugauggcuggaccaccaggaacugggaaaacagcaauagcucuagcuauggcccaagaauuaggaaauaaaguaccauuuugcccaaugguagggucagaaguuuuuagcucugaaauuaagaagacugagguguuaauggaaaauuucagaagggccauuggccuuaggaucaaagaaacuaaggaaguuuaugaaggcgaaguuacagaacuuacaccugucgaaacagaaaauccaaugggaggauauggcaaaacugugucccacguaauaauuggauugaaaacagcaaaagguacaaaacaguuaaaacuagacccaaguauucaugaaaguuuaacgaaggaaaaaguagaaguuggagauguuauauacaucgaggcaaacagcggugcugucaagaggcaaggaaggagugauaccuaugcaacugaauaugaucuugaggcagaagaauacguuccucuuccuaaaggugauguucauaaaaagaaagaaguuauucaagaugugacucuacaugaucuagauguagccaaugcuagaccacaaggagggcaagacguuuugucaauaaugggacaacuuaucaagucaaagaaaacagaaauuacugauaaauuaagagcugaaauuaauaaaguugucaacagguacauagaccaagguauugcugaacuagugccuggugugcuuuuuauugacgaaguucacaugcuugauauagaaaccuucacuuaccuucaccaggcucuugaaagugcaauagcaccuauuguagucuuugcuacaaaucggggucguugucaaguaagaggugcugcagacauuauuucaccacauggacuaccuuuagaucugcuggauagguugcucauaauucguacugcaccuuacagccaaccagaaaugugccaaauucuuaaguuaagagcuguaacagagggacuaagcauugaugaugaugcguuaucagagcuuagugauauuggaaguaaaacuacucucagguaugcgguacaguuguugaccccuucaaauuuaacagcuaaagugaauggucguucuacaaucacuagggaagauguagcagaaguaggacaacuauuuuuagaugcaaaaucuuccgccaaaauacuagccaaacaucaggaucaguauaugaaauaa

SEQ ID NO: 7051 - RNA, 2196 nt, Piezodorus guildinii
augacaucaauuauuaaguuucaugcuuugucuggagugauggaugaaucuccaccuugcuauauuuugcaaguugaugaguuucgguuuuuguuagauugugguugggaugaacacuuuaaucaggauuauaucaaggaacuuaagagacauguucauuuaauugaugcgguuuugcuuacuuauccugaccauuuacauuuaggagcauuaccuuauuuaguuggaaaauguggacuuaguugcccggucuaugcuacuauuccaguuuacaagaugggacaaauguuuauguaugauuuauaucagucucgcuauaacauggaagacuuuaauguuuuuagucuugaugauguugaugcugccuuugacaaaguuguccaauugaaauauaaccaaucaguaacaaugaagggaaagugcuaugggcugagcauuguuccaaugccagccggccacaugauuggaggaacgauguggaaaaucaugaagacuggagaagaagauaucauauaugcuaucgauuuuaaucauaagaaggaaagacauuugaauggcugugacuuggaacgauugcagaggccaucauugcuuauaacugaugcauucaaugcaacuuaucagcaagaaagaaggagagcaagggaugagaaacuuaugacuacaauucuucaaacuuuaaguaacaaugguaacauucuuauugcaguugauacugcuggucgucuuuuagaguuggcacacaugcuugaucaacuuuggaggaauaaaaauucugguuuacagauucauccuuugugccuuauuaauaauguaaguuauaauguagucgaguuugccaaaucucaaauagaauggaugagugauaaguuaaugaaaagcuuugaggcuguucguaauaauccauuucaauuuaaacacauacguuuaugucauaguguuucagagcuuaacaaaauuccuucagcuaaaguaguacuugcaagcaugccagaucuugaauguggauuugcucgugaaauauuuuuucagugggccucugauucuaaaaacaguauuguuuuaacaucaagauguugugaagguacauuagcaagagauuuauuggauaacgguguuggaaggaccauccagaucacaguuaaaaaaagaguucgucuugaaggggaagaauuaaaggaauacuuaaaagcacauaaaaaaacaaaugacaaaaaugaagagaaggaaaguucugagucagaagaugaaauucaguugcuuagugucacuaaagguagccaugaucuuguaauuaagcaggaacguaggaaaaaaaaucaaaaguccuuaaagaaauuuuacccuauguuuccuuuuaucgaucguaaaguuaaauuugacgaauauggugaauuugugcggauagaagauuauaaagcuccugauacugcuaaacguccuccugaaaaaaagucuaaaaagaaggaugaugacauuguagauccugcugauauuccaacuaaauguguuucuuaugagaagucgcuaacagugaaugcccagguucaauauauagauuuugagggaagaucagacggagaaucgguacaaaagauaaucacgcaguugaggccgcgaagggugauacuuguccgugguacuucugaaaauacugaagcuuuagaaaagcaucuucaacaauggucugaggcaaaaauauucugcccgaaaaaaggugauauaguggaugcuacuacugagagucauauauaucaaauuagauugacagauucuuuagucucuucauugcauaugcaaaaagguaaagauucggagcuugcuuggguugaugcuauuacaaaguaccgucagaaacccucugauacuaugcaaucagcugaagaaauggaagucgaagaugaugguaauuauaguauuuacaaugaugacuacuugacucuggagccucucccucuaacugaagucaauccucaucaagcuguguuuauaaaugaguuaaaauuaucagacuugaaacaaauuuugucucguaaugguauagaaucugaauuuucuggugguguauugugguguugcaacgguacuauugcuauacggagguuggaaucuucuaaaguuuacuuagaaggauggauuucugaaaauuauuauagaauuagagaaauuuuauauggacaauaugcaauuuuauaa

SEQ ID NO: 7052 - RNA, 1821 nt, Piezodorus guildinii
augccaucaauagaugucauucaaccuccuccuccuccuccuucaauggagaaggaggaaacuauaguucaaccaacgacgaagccuauuguugguauuauuuacccaccaccugaaguaagaaauaucguugauaaaacugccaguuucgucgcccgaaauggaccugaauuugaaucuagaaucaggcagaaugaauugggaaaucccaaauuuaacuuccucaauacaggcgauccuuaucaugcauauuaucagcauaaaguuaaagaauucaaggaaggaaaaggaacugaaccaccuccaccuccaccgccggugcaacagaagaccguagccuccgcuacgcaauugaaacaacaagaaaucuugaagcaagucacugaacagccguuuguacccaaagauccuccuccagauuaugaguucauggcagauccgccaucuaucuccgcucuagauuuggauauuguaaaguuaacagcacaguucguggccaggaacgggcgccaguucuugacuaaccucaugaacagggaacagagaaauuaucaauuugauuuccuucguccccagcauucucuguuucuguauuucaccaaacuacucgaacaauauacuaaggugcugauuccuccaaaagaccuuaugucccgccugaaggaagagugcuccaacccuaccggaguccuagagcaggugagguaccgugcggacuggcuucacuaccaggagcuucagaagaggaaggaggagcaagcccucgagaaggaaagaguggcuuacgcucagauagauuggcacgacuuuguuguugucgagaccguggacuauaucccgggcgaggugggcaacuuccccccgccuaccacaccagaugaagucggugccagggucuugaugcaggagcgaauauuagaaaauggaggugaagaucuggcggaaggagcuggcagcgaugaagagagggagaaggaagacggugaaagggaagaaggagccggugauaagggagauaacacucagguacaagacauggaagaagagucaucgagcgauagcgaugaagacgacgaacagagagagcagccgccaggagagaagcagcaggcgcagcccggucagaagcagcagccucccgacggcaagaagccuccccuccagccgucgaugcagcccccgcuaccucccgcaccggacaaggucaucgucaagaagggauacaaccccaagcagaaccaaaagauuucgaaaggugcagauaauuaucuuauuucuccgcugacgagugagaagaucccggcgaacaaggugcaggaacacaugaggauuggucugcuggauccucgaugggucgaacagagggacaagcacauucaagauaggaucaaccaggagacuguauacgcuggagguucugcaauugaggcuagcuugaaacaacuugcugagagaagaacugauauuuucggugucggcgaugaagaaacugccaucgguaagaagauuggugaagaggauaagaagaaagaugauaaggugacaugggacggacacacaucuagcguggaggcugccacccgcgcagcucgugccaacaucaccaucgaggagcagauccaccagauccacaaggugaagggucuccucccggacgaggagaaggagaagauugggcccaagccggucccuggaucggugagcagcaguggaggcacccccaugccgggugguccuccgauaguggugcaggccaaggccccgccgcugccgccgccacccaaggucccgcugccaccgcccccagcuccucucccccca

SEQ ID NO: 7053 - RNA, 942 nt, Piezodorus guildinii
augccaggaguagagcuuguuacuaacaaaguuguaguucauccuuuaguucuauuaaguguuguugaucauuucaauagaaugggaaaaauagguaaucagaagagaguaguugguguauuauuagguuguuggaaggcaaaagguguuuuggacguaucuaauaguuuugcuguuccuuuugaugaagaugacaaggauaaaucaguuugguuuuuggaccaugauuauuuggaaaacauguauggaauguuuaagaaaguuaaugcaagggaaaagguuguuggcugguaucauacugguccaaagcuucaucagaaugauguugcaauuaaugaacuuauucgccgcuacugccccaauucaguucuuguuauaauugaugccaaaccaaaagaucucgguuuaccuacugaagccuauagagcaguagaagaaguacaugaugauggcucuccuaccacaaaaacauuugagcauguccccagcgaaauuggagccgaagaagcagaagaaguggguguugaacaucugcugagagauauuaaagacacaacuguaggcucacuuucgcaaaggguuacuaaucaauuucugggccucaaaggccuuaaucaacaaauucaagauaucagggauuaucuuaugcagguuguugauggaaaauuaccuaucaaccaucaaauaauauaccagcuacaggacauuuucaaccuucuuccugacaugaaccaugggaacuuuguggauucauuguacauaaaaacaaaugaucagaugcuugucguuuaccucgcugcccucguuagggcgauuguugcuuuacauaaucugauuaauaauaaacucaguaaccgugaugcugaaaaaaaggaaagcaccaagaaagaagaaaagccuaaagaagaagaaaauaucaagaaagaauugaaggcuaaguaa

SEQ ID NO: 7054 - RNA, 1626 nt, Piezodorus guildinii
auguuucagccaauuuucguguuaagccaaaacuccaaaagggaauccggcaauaaaguucggucugagaauauugccgcagcaaagaugauagcagaaguaauuagaacaugucuugggccacaggcuaugcuuaaaauguugauggauccaaugggugggauagucaugaccaaugaugggaaugcuauuuugagagaaauaacuguucagcauccugcugcaaaaaugaucauugaaauugcaaggacacaagaugaagagguuggagaugguacuacaucagucgugauucuuuguggucaaauuauggcugaaauugaaagacauauagaugaaguucauccaacuacaaucauuaaagaauuuaaaagagcuuuggaugauauuuuaagaauacuuccagacauaagcacuucucuugaccuaaaggauaaagcuaaaguaauagaaguaguuagagguuguuuaggaaccaaauuuuuggguacuuggucugaaauggcuugucaaauggcaauugaugcaguagaaacugucagagaucugaagggucuuggaauugacuuaaagaacuuugcaaaaauagaaaagguuccuggugguuuuauugaggauucuaaaguauuggaagguguaaugcuuaacaaggaugugacgcaucccaaaaugucccguuacauuaaaaauccacgaauuuuauuacuagacuguucucuugaauauaagaaaggggaaagucagacuaauguggaaauaguuaaagaaggugauuauacuagacuuuuacaaauugaagaggaguacauugaaaaaaugugcaaucauauuauugagcauaagccaaauguugugauaacagaaaaggguguuucugacuuggcacaacaccaucuuuuuaaggcugguauaacugccauucguaggguuaagaagaccgauaauaacagaauugcucgagcgguagaugcaacuauugucagucguguagaagaaauaaagccccaucacauugguuguggugcuggucucuuugaaguaaaaaagauaggagaugaauacuuuacuuuuauuacugaauguaagaauccaaaagcuugcacaguuuuacugcgugguccaagcaaagauguauuaaaugaaguucagagaaauuuacaagaugcgaugaaugucguuaggaacuuguacuuggauccuagaauacuaccgggagguggugcuguagaaauggcccuucauagagcucucauuaaagcaaauaaugccauagauuuggaggcagauuguuauacugcaaucccaucugcuuuaagaauuauuccuagaacacuguuacaaaaugcuggugggaaaguaauaagaucuaugaaugaacuugaaaagcaacauaaugcugauguccuuaaaggaguugaugguauaacuggagaguugaaaacaguugaugaauuagguguaugggaacccuauucugucaaaguccagaucuacaaaacagcuaucgagucugcaauuuuauugcugaagauugaugauauuguuucuggugcuaaaaacaaagauaaggaacgaaauuauagcucuacaauggcacagccuacugaagaaucacuuaaagaauaa

SEQ ID NO: 7055 - RNA, 771 nt, Piezodorus guildinii
aggaagguuauauuugaaaacguuggucauucuuggggugacuuaguuguuaaucaaaaauuauucauuaaaauggcaaugccuagaacuuauggugguuuaucagauuauagaagcguuccugcaccguccuuuagcccuuauucugaaaauggagggagugugguugcuguagcaggagaugacuucgcgauuauagccucugauacacguuuaaguacugguuuucaaauuuacaccaggaaccagucaaaauuauuuaaacugucugauaaaacaauucuuggaaguacuggauguuggugugauguucuuucucuuacuaggcuuguucaaacccgaauaaaaauguaucaguaugaucauaacaaaguuaugucuacuccagcaguugcccaaaugcuuuccguacuacuuuauuacaaacgcuuuuuuccuuacuaugucgccaauauucuugccggaauagaugauaauggcaaaggaguuguuuacaguuaugauccuauuggucaucaugaaagcucaaaauucagagcuggaggaacugcuggagcauuauuacagccucuguuggacaaucagcuugguauguugaaucaagaaaauguucaagacaaaacauacacuuuggagaaagcgcaugcaaucguaaaagaugucuuuauaucagcugcugaaagagauauauuuacuggugacagaauaucaaucaauauauuaaccaaggaugggaucagagaagauucauuugagcuuaggaaggacuag

SEQ ID NO: 7056 - RNA, 900 nt, Piezodorus guildinii
auguuuggauuuaguauguuuccauucccuccuagaccuuuuaagguccaguauuauuguuuuucuguugcaaugauaccugggaaugaaagggaagauguugaacguggaggcaaaauuauuaugccuccuucagcacuugaucacuugacaagauuaaauauuaauuaucccaugcuuuuuaaacugcacaacucaaaaacaaauaggacuucucacagugguguguuagaauuuguugcagaugagggaaaaguuuauuuaccacauuggaugaugaggaauuugaugcuugaagaaggugauguuauugaaauugaaaguguuuccuuaccuguugcaacuuuuucaagguuccagccucagucuccagauuuuuuggauauaucgaauccaaaggccguucuagaaaacugccucagaaacuuugcuuguuugacuacuggugacauaaucaauauuaaauauaaucaaaaagacuaugagcuuucgguuuuagaaacgcaaccaggcacagcagugacaaucauagaaugugauaugaauguagaauuugcugcaccuuuaggauauaaagagccgaauucugaacaggaaucauuggaugaaucuucugaaagaucagaaaacuugacaaaugaaggaaguggauucaucccauuuuuuggugaagguuacaggcuagauggaaaacagaagaaaaauauugaagaugaaaauguuggauuuagaauaccagcugugagaggaaucccugauuaugacuggaaaguuggggugauuacuuuuaugagaaaugugcgccaaccugugaaggaaucucagaaagaugaugaagacaaauuucaaccuuuuuauggggagggacauguguuaaguacaaaucgucaccggaaguaa

SEQ ID NO: 7057 - RNA, 1629 nt, Piezodorus guildinii
auggcugcuuucccaggaucuauugcauuugaugaauaugguagaccauuuauaauuauuaaagaucaagaaaaacaaaagcguuuaaccggcaaugaugcuaucaagagccauauccucucagccaaagcuauugcuaaaauugucaggacuucuuuggguccaaaagguuuggacaaacugcuugugucacaggauggugauguuaugguaagcaaugauggugcuaccaucaugaagcaaauggauguggauaaugaaauugcaaaacugauggugcaacuuucacaaucccaagaugaugaaauuggugacggaacuacuggaguuguuguucuugcuggugcuuuauuggaacaagcugauauuuuguuagauaaaggaauucauccuauuagaauugccgauggguuugaauuagcugcaagagcugccauacaacauuuagauucaauugccacaaaauuuccuguugauccuaacaauuuggaaccucuuauuaagacugcuaugacaacucuuggaucgaaaauuguuaauaaaugccauaggcaaauggcagaaauagcuguaaaagcaguauuaucaguggcugaucuggaaacacgggaugucaacuuugagcuaauuaaaguugacggaaaagucgguggaagacuggaagauucaaugcuuguuaaaggggugguuauugauaaagauuuuucucauccccaaaugcccaagguguugaaggauguuaaaauagcaauuuuaacuugcccauuugagccacccaagccaaaaacaaaacauaaguuggauguaacaucuauugaugacuauagggcauuaaggaaguacgaagaagagaaauuuaauaccaugguuucucaagucaaagaugcuggugcuacacuugcuauuugucaauggggauuugacgaugaagccaaccaucuucuuuugaagcgagaacuuccugcaguuagaugggucgguggaccagaaauugagcuaaucgccauugcaacugguggacguaucguaccucgauuugaagagcugaguccugaaaaacuuggucgagcuggacuuguuagagaaaucuccuuugguaccacaaaggacaaaaugcuugucauugaagaaugugcuaauucucgcuccgucacaauuuucaucagagguucaaaucaaaugauaauugaugaagccaagagaucaaugcacgaugcacuuuguguugucagaaauuugauuugugacgacaguauuguuuauggaggaggugcugccgaacuuucuuguuccauugccacugcuaaacaagcagauaagauuucaucuauugaacaguaugcauuccgugcauuuucugaagcuuuggagucgauuccuuuugccuuagcagagaauucaggcuugccuccaaugcaagucgugaccagcguaagaggaaggcaaauucaagagaacaauccugcucuugguguugauugcauggggaagggaacuaaugauaugaaagagcagcaugucauugaaacacuuaaaagcaaaaaacaacaaauaaugcuugccacacaguugguaaaaaugauacuuaaaauugaugaugucagaacaccuaaugacauucaauucuaa

SEQ ID NO: 7058 - RNA, 342 nt, Piezodorus guildinii
auggcuucagcaauggacguugacgaugaagagaacgagguuccuaccuccaguaguggaaaaggugaaaagaaaagauucgaaguuaaaaaauggaaugcuguugcccugugggcuugggacauaguuguugauaacugugcuauuugucgaaaccacauuauggauuuguguauugaaugccaagcgaaccaagcuucugcuacaagugaggagugcacaguggccuggggaguuuguaaucaugccuuucauuuccauuguauaucaagaugguugaaaacaagacaaguuugcccauuagacaaucgugaaugggaguuucaaaaauauggacauuaa

SEQ ID NO: 7059 - RNA, 1605 nt, Piezodorus guildinii
auggugucuuuaaauccuauuagaauacuuaaacaugaagcggaggaagaaaagggugaaauggcaagaaugucgaauuucaucggagcgauugcaguuggcgauuuagugaaaaguacucucgggccgaaagguauggauaaaauccuuguaucuuacggcagaaaucguggaaacauugaaguuaccaaugauggagcuacuauucugaaauccguagguuuugacaaucccgcugcuaaaauucucguuaauaugucuaaaguucaagacgaugaagucggagaugguacgacuucgguuacaguuuuggccgccgaacuucucagagaagcugaaagauugaucgagaggaaaauccacccucagacaauaaucagcggauaucgaaaggccacgaauguagcccuggcugcuuuagauaaaugugcugucgacaauagcagcaaugacaaagaguucgccgaugauuugcucaaaaucgcccguacuucguugaguuccaaaauuuugaauuugcacacugaaaaauucagcaaauuggcaguugaggcaguacuucgccucaaaggaucuggaaauuuaagugcgauacagaucaucaaaaaaacagguggcucauuagaugauucauuuuuggaugauggcuuccucuuggacaagaaagucggucaguuccaaccuaaaagaguugaaaaugcuagaauucucaucgcaaauacuccccuugacaccgauaaaaucaaaguuuucgguuccagaauacgcguugauucuuuagcuaaaguggccgauuuggagcuagcugaaaaagaaaaaaugaaggaaaaaauugaaagaauuauaagccacaaaugcaacguguuugucaaucgccaguugauuuauaauuaucccgaacaacuguuugcugaugcuggaaucauggcgauugagcaugcugauuucgaugguauugagcgucuagcccuugugacaggaggugagaucguuucuacauuugacacaccugagcuugucaaauuaggagaaugugauuuaauugaagaggucaugauuggugaagacaaauuguugcgauuuagcggagucaaguugggagaagcuugcaguauuguaaucagaggagcaacacagcagauuguugaugaagcugaaaggucuuuacacgaugcgcugugcgugcuuguuaccacugucagggauaagaagacaguuuuuggaggugguuguucggaaaucaucauggccagugcugugagugaugaagcuauuaauguaacuggcaaagaagcuguugcuauggaauccuuugcaaaggcuuugcuugaguugccaaugaccaucucugacaacgguggauuugauucugcuuauuuaguuacugcuuuaagagcugcacacaacaaaggccagauaacuuacgguuuggauaugaagaacgguggaguagcgugcaugagggagcuugguaucguagaaucacauucuguaaaacgucaaaugcugcugucugcuucagaagccacugaagucauauugagaguugaugauauccucaaagccgcaccucgcaaacgaacggaagaccgaggcuacugcuga

SEQ ID NO: 7060 - RNA, 834 nt, Piezodorus guildinii
auguuccgaaaccaguaugauuccgacguuacgguauggagcccccaaggccgauuacaccagguugaauaugcuauggaagcggugaagcuuggagcagcaaccguugguguaaagaauaagcaauaugcaguccuuguugcucuuaaaagagcuucaucagaacuuucagcucaucaaaagaaaauuauuccucuugauaaucauauaggcaugagcauuucuggccuaacugcugaugcucguauauugagucggcaaaugagaagugaaugccuuucauauucguauucauauggaacugaaauuccuauuaucaggcucaugaacaaaauaucuaauaugaugcagaguucaacucagcgauaugauagaaggccuuauggaguuggucuccugguggcaggauaugaugcugaugguccucauauuuuucaaauuuguccuucugcaaaucuuuaugaaugucguucaauggcuauuggcgcuagaucccagagugcgaggacauauuuggaaaaacaucugguagacaucgguaacucuccgacgcucacagaccuucuuaaacaugcacuucgugcucuuagagauucgucacccaaugauacagaacuuaguucuaagaacguagccaucgcaguuguggggaaagauacgccgcugaaggagcugucagaggcagauacucagacguaccuggacaugauccugagcgaggagagaaggaguggggauacugcaggaggcaccgaugaugcgcccccaccaccaccacccuccgauccuccagcucaagaucccacuccgguaguggcuauggaaacacaauaa

SEQ ID NO: 7061 - RNA, 2541 nt, Piezodorus guildinii
augccaguuuaccaagaaagaaaaccuaaaauaguaauuaaugaagaagaucuaccauaugaagaggaaauuuuacgaaacccuuuuucaaucaaacauugguuaagauacaucgaauuuaagaaggaugcuccaagaaauggagugaacauaauuuaugaaagagcauuaaaagagcuuccgggaaguuacaaacuaugguauaacuauuuaauacuuaggaaaagacaaauaaaaggacgaugcauuacugauccuuccuuugaacaucuaaauaauacauaugaacgcucucugguuuuuaugaauaagaugccuaggauauggauggaauauugucaguuucuuguugaucaauguaagauaaccaaagcacgacauguuuuugauagauccuuaagagcauuacccauuacccaacaucaucgcauuuggccucuguauauaaaauucuuaaagaagcacaauauuccagaaacagcgguucguguauuucgaagauaucugaagcucugcccagaagauacagaagaauauauugauuacuuaacuacuauuggucgucuagaugaggcugcuguuagauuggcugauauuguuaauacugaugauuuuguuucaaagcauggaaaaucaaaccaucaauuauggacugaauuaugugacuuaaucucuaaaaauccucaagaaguuagaucacugaauguggaugcaauuauaagaagugguuugaaaaaauauacugaccaguuaggucauuuauggaauuccuuagcagauuauuauaucagaagcggacuuuuugaaaaggccagagauauuuaugaagaagcgauacaaacuguuacuacuguaagagauuuuacucaaguuuuugaugcuuaugcucaauuugaagaacuuucuuugaguaaaaaaauggaagaaguuucucauaaagcauuucccaccgaugaugaugauauagauauugaacuccgcuuagcaagauuugaagauuugauugaaagaagauuauuacuucuaaauucaguucuuuugcgacaaaauccucauaauguccaugaauggcugaaaagaguccagcuuuuugaaggaaaaccacaugauauuauuuauacuuauacggaagcuguucaaacaguugauccuaaauuagcuguuggaaaaccacacaugcuguauguuaauuuugcaaaguucuaugaagaaaauggucaaguagaagauucuagaauaguucucgaaaaaggaacacaggugccuuauacuaaaguugaagaucuugcaucuguauggugugaaugggcugagauggaaaucagaaaugagaacugugaugaagcauuaaaaauucuucaaagagcuacugugaugccagcuagaaaaguugauuaucaugaugacucagaaacuguacaaaugagauuguauaaaucuuugaaaauuuggucauuguaugcugauuuagaagaaagcuuuggaacauucaaaucuuguaaaucaguguaugacaggauaauugaucugaaaauugccacaccucaaauuauuaucaacuaugggcuuuuucuagaagaacacaauuauuuugaagaagcuuuuaggacuuaugagaaaggaauugcuuuguucaaauggccuaaugucuuugacguauggaauacauauuuaaccaaauuuuuaaagcgcuaugggggaaguaaacuugaaagaacgagagaucuauuugaacaauguuuggaaaauuguccuccaaaguaugcuaaagguuucuaccuauuauaugcaaaauuagaggaagaacauggauuagcuaggcaugcaauggcaguguaugaaagggcuacuucugcuguuuuaccugaagaaauguuugagguuuucaauauuuauaucaaaaaggcugcugaaauuuaugguguuccgaaaacucgucaaauuuaugaaaaagcuauugaaguguugggugaagauaauucaagagaaaugugucuuagguuugcugagauggaaacuaaauuaggagaaauugaucgagccagggcaauuuaugcgcauuguagucaaaugugugauccacggguuacuaguacuuucuggcaaacauggaaagauuuugaagugcgccauggcaaugaggauacuaugagagaaaugcugcgaaucaaaagaagcguacaagcuacauacaacacacaggucaauaugaugucagcacaaauguuaucugcugccaguaauguuucuggaacaguugcugaucuugcuccuggugcuaaagauggaaugcgcauguuggaagcuaaagcagcagaaaugacuguuacuccaaaauccggagcaucggccaucauguuuguaagaggugaaacucaaaauaccccucaagaugugcaaaaagaaauacauaauccugaagcuuugaauauugacucagaugaugaagaaaacauggaggaugaugaucugccuguugaaaaacagauuauuccugaugaaguauuuuguggucugaagaaaggaagugauucugacuga

SEQ ID NO: 7062 - RNA, 990 nt, Piezodorus guildinii
auggccgcuggaccuauugccgaaagaaaucaagaugccacgauauauguuggcggauuggaugauaaaguuucugaaacucuuaugugggagcuauucguucaagccggaccaguugucaauguucauaugccgaaagauagagugacacaacaacaucaaggauauggguuugucgaguuuuugggagaagaagaugcugauuaugccauaaaaauuaugaacaugauaaaaguucauggaaaaccuauucgugugaauaaggcuucagcacaucagaaaaauuuggauguuggugcuaauguguucauugguaaucuggauccugagguugaugaaaaguuauuauaugacacauuuucagcuuuuggggucauucugcagacgccuaagauuaugagggauccagauacaggaaauucaaaaggcuuugcauucaucaauuaugccucauuugaugcuuccgaugcugccauugaugcaaugaauggucaguuucugugcaaucgcccaguuucaguuucuuaugcuuacaaaaaagaugccaaaggugaacgacauggaucggcugcugaacgccuguuagcugcacaaaaucccuuaucacaagcugacaggccccaucauauguuugcggaugcuccuccugcaccccugccacccccuccaguauugccuccuccuccugucuucaauccuccacccccuccucauaugccuccuccuccauugccaccacaaaggaugguagcuccuaugccgccaccucccccuggcccuccgccaccaaugccaccuggaaugaugccguggccuccaaugcagccucacuuuccacccccuccaccacccccaccuacaaacaaagcaccuccucuuccuccuccacccccuccucaagcuuggcguccuccaccaccgccuuacaaucgaccaccauuuccuccaccaccuccaccuccagucagaccuccaccaccaauguucuaa

SEQ ID NO: 7063 - RNA, 777 nt, Piezodorus guildinii
augggucgaguuauuagagcucagaggaaaggugcugggaguguuuuuagaucccacaccaaacaccgaaagggagccccuaaauugaggucuuuggauuucgcugaaaggcaugguuacaucaaaggaguugugaaagauauuauccaugacccugguagaggagcuccauuagcuguuguucacuuuagggauccuuacagguucaagacucgcaaagagcuuuucauugccccugaaggaauuuauacaggucaauuccuguacuguggaaagaaagccaacuuacauguuggaaauguuaugcccguugguacuaugccugaagguaccaucaucuguaauuuggaagaaaaaaccggagauaggggucgucuagccagagcuucaggaaauuacgcuaucguaauugcucacaauccugacuccaggaggaccagggucaagcuuccaucaggagcaaagaaagucauucccuccaacaacagggcuaugguugguauugucgcuggagguggucguaucgacaagccagugcugaaggccggucgugcguacuacaaguacaaggccaagaggaacugcuggccuaagguuagggguguugccaugaacccaguagagcauccccacgguggugguaaucaccagcacauugguaaagcuuccacugucaagaggggaacuucugccgguagaaagguuggucucaucgcugccaggcguacugguaggauucguggugguaagacugaccagaagaagggagaagauuaa

SEQ ID NO: 7064 - RNA, 411 nt, Piezodorus guildinii
auggcccguaccaagcagaccgcuaggaaaucgacaggaggcaaagcucccaggaagcagcuggccaccaaggccgccaggaagagugccccggccaccggagguguaaagaagccucacagguacaggccuggaacagucgcucucagagaaaucaggagguaccagaaaaguaccgagcugcucaucaggaaacucccguuccagagguuggugagggagaucgcccaggacuucaagaccgaccugagguuccagagcucagccgucauggcccuccaggaggccagcgaagccuaucucguaggucucuucgaggauaccaacuugugcgcaauccacgccaagagggucaccaucaugccgaaggauauccaguuggcucgccguauccgcggagaacgugccuaa

SEQ ID NO: 7065 - RNA, 1596 nt, Piezodorus guildinii
auggcagcaauaacuuuauugaaucccaaggcagaaguuguaagaaaaacugaggcauugucuaugaaccagagugccgcuaaaggauuacaggaugucaugaagacuaaucucgguccacgagguaccaugaaaauguuaguuucuggugcuggagacauuaaaauuacaaaagacggcaauguucugcugaaagaaaugcaaauucagcauccuaccgcuucucucauugccagaacuucuacugcuauggaugacauuaccggugauggcacuaccucaacaguccuacucauugccgaauuauuaaagaaagcugacaauuauauuauugaagguguccacccuagguuaauuacugaagguuuuacuguggcuuguaaacacgcuauggaaguucuggauaguaucaagaaaccuguaagucuagaugauaaggagacacuuauuucuguugcuagaacugcucuuaacaccaaaguagaauccaaaguagcagagguauuaacucauauuuguguugaagcuguacaagcaauuaaacugccugauaaacccuuagauuuacacaugguugaaauaaugacaaugcaaagccgacuugaaucugaaacucggcuaguuaggggacucguccuugaucauggaucacgucauccuaauaugccuaagaagcuaacuaaugcuuauauuuugacauguaauguuaguuuagaauuugaaaaaacagagauuaauaguggguuuuucuauaaaucagccgaggaaagggaaaaacugguggcaucugaaagagaguuuaucgaguugaggguuaagaaaauuauugcuuugaagaagucuguaugugauggaacagacaaaggauuuguugucaucaaucagaaaggaauugaucccgucucuuuggauaugcuagcccgagaagguaucauggcacuuaggcgagcuaaaagaaggaauauggaaagacucacuuuagcuugugguggaguagcuaugaauagucuugaugaucucacagaagauugucuagggcgagcaggucuuguuuaugaacauguucuuggugaaaccaaguauacauuuguaucugauuguccaaacccucauagugucacuguacuaguccaugggccaacuucuuaugccauuacucaaauccaagaugcucuucgggauggucugagagcugucaaaaaugcaguugaagauggagguauacuuccugguggaggagcaguagaauuaaaauuacgucaugaauugaaaaaaguugcugagaacacaaaggaaaaguaccguguuggaaucgaagcuuucugugaugcucuuuuaauuauucccaaaacccucgcuaugaacaguggauucaauacucaagaagucaucacucaacuagauuaugaugcuaaggauaaugauguaauuggauuggaucuucaaacugggaaaucaauggucccaacugaucuaggcauucuugacaauuauucugucaaaaagcaguauauagcaucaagugucauuguagcaagcaaucuucuccuuguugaugaaguuaugagagccggaaugucaucuuuaaaaggauaa

SEQ ID NO: 7066 - RNA, 3144 nt, Piezodorus guildinii
augucuagugcugaaguggccaacaauuccauagaaccuccagccaagaagcggaaaauugcuacaggagagacugcuccagcgaacuccguuucaaaggcaauaucagccauggcgaauaauggaucuuuugauuccaaucaagaaauugaugagggacuuuacucucgccaacuuuacguuuuagggcaugaugccaugcgacggauggcauccucugauguucuuauuucagguuuaggaggacuugguguagaaauagcuaaaaacgucauauuaggugguguuaaaucuguuacguuacaugaugaaacuguaugcacuauaucagaucugucuucucaauuuuauuuaucugaaaauucuauugguuuaaaucgugcugaggcuucuugccaguuacuugcugaacuuaacaauuauguuccaaccagagccuauacuggaacucuuacugaagacuucaucaaagguuuuaguguuguuguuuuaacuaaugcaucagaagaggagaaauugagaauuucugaaauagcucaugcaucugauguuucauuaaucauugcuucgacuagagguguauuugcacaaguauucugugauuuuggccgagaguucaguguaguugacacaaauggugaaaauccaguuucugcaaugauugcaagcauuucuagagaugaagaaggaguuaucgcuuguuuagaugauacuagacauggcuuagaagauggagauuauguuacauuuucugaaauucaagggaugaccgaauuaaaugguugcgagccuacuaaaauuaaaguucuuggaccauacacauuuagcauugguaauaccucaaauuaugcagaauacauccgugguggaauaguucaacaaguuaaaaugccaaaaguuuugcaauucaaaucauacucagaagcuuugaagucuccugaauuuauauuuacugauuuugguaaauucgaucacccacaacaacuucauguggcauuuaaggcucuagaaaauuauaagaaggaauuuggaaaguugccuacaccaugggacaacaaagaugcugcagauuuugucaacuguuguaagucaguaguaucugaucuuggcuuagauguagaauuaaaugagaagcuuaugcagcaauuugcuaaaacuugcucuggaaauaugaauccuauugaugcguuuauuggugguguuguggcccaagaagugaugaaagcuugcagugggaaguuucauccuauuuuccaauggcuuuauuuugauucuauugaauuauuaccuacugaagaucucaauccuagugaaugugcaccuaccaauucucgauaugauggacaaguugccauuuuuggaacagaauuccagaaaauguuaggugcucugaaauauuuuguuguuggagcuggagcuauugguugcgaacuucuuaagaauuuuucaaugauggguguaggagcagauggcggcaaaguuauuguaacggacauggaucuuauugagaaaucuaaccuaaacagacaauuuuuauuuagaccucacgauguucagaaacccaaaucagcuacugcugcgaaagcaauaaagaaaaugaauccauuaaugaaugugauagcccaugaaaaucgaguuggcccugaaacugagaaaguuuaugaugaugccuuuuucgaagauuuagaugguguugccaacgcucuagauaacguagaugcuagaauauacauggaucgccguuguguuuauuacagaaaaccguuguuagaaucuggaacucuugguacuaaagguaauacacaaguuguuguuccuuuccugacugaauccuacagcuccucucaagacccaccugagaaaagcauuccuauuuguacuuuaaagaauuuuccuaaugcuauugagcauacccugcagugggcuagagauguuuucgaaggccuguuucgccagucagcugaaaaugcugcucuuuacuuaagugauccuaauuuuauugauagaacacugcguuugccaggaguccagccaauggaaguuuuagaaucuaucaaacaggcucuuaucgaugacagaccgaaaucuauugaagauugcaucgcuugggcuagaaaccacuggcaagaacaguauucaaaucagauccgccagcuucuuuucaauuucccacccgaucagaugacuacgaauggccaaccuuucuggucuggccccaagaggugcccaguuccacuugaguuugaugugaauaacgaccugcauuuggauuauauuuuagcugcugcuaaccugaaggcugaagucuauggaaucccucagguucgugauagaaacuucauugcuaaagugguccagaacguagagguuccugaauucacucccaagucuggugugaaaaucgcuguaacugauucacagauggcuaauggugcuggugggcagguugaucaagauagaauugggcaguugcagaaugaacuuccaucgaaggagauguucaacggcuugaauaucacaccucucgaauuugaaaaggaugacgauaacaaccuccauauggacuucaucguugcugcauccaaucugagagcugcuaauuacaacauaccaccugcagacaggcauaagaguaaguugauagcugguaagauuauacccgcgauagcaaccacaacaucuguuguugcugguuugguauguauugagcucaugaaguuagcuaaggguuacaaagauauagcuuuguucaagaauggcuuugucaacuuggcucuuccauucuuuggauucuccgagccgauuucagccccuaaauugaaguauuaugagaacgaauggacauugugggaccgauuugaaguuacuggagagaugacucucaaagaguuuaucgacuauuuuaaagacaaacaccagcuugaaauaaccauguuaucccaagguguuuguauguuguauucuuucuucauggccaagaguaaauuagaagacagacuuaaucuucccauguccgaagugguccguagaguuucuaaaagaaaacuggaaccucacguuaaggcgcucguuuuugaacuuugcuguaacgauacagauggcaaugauguugaaguacccuacgucagguacacauugccuuga

SEQ ID NO: 7067 - RNA, 1278 nt, Piezodorus guildinii
auggcugacaaugaugauuuguuggauuaugaagaugaagaacagacagagcaaccuauugucgaagguucaggagauacagcuccucguaaagauuugaaaggagcuuauguaucaauccauaguucaggguuuagagauuuccuucuaaaaccugaaauuuuaagagcaauuguugauugugguuuugaacauccuucugaaguacaacaugagugcauuccucaagcaguucuugguauggauauacuuugucaagccaaguccggaauggguaaaacugcuguguuuguauuagccacccuucaacaaauggaguugacugaaaaccaaguaacaguuuuggucaugugccauacccgagaauuggcauuucaaauaagcaaagaauaugagcgauucucaaaauauaugccaaacaucaagguugcuguauuuuuuggugguuuaccuauacagaaggaugaagaaguuuuaaaaaauaacuguccucacauuguaguugguacaccaggacguauuuuagcuuuagugaaaaauaaaaaacuaaauuugaaaaaccuuaaacauuuuguauuagaugagugugacaaaaugcucgagcaguuagacaugaggcgugauguucaggaaauuuuuaggaauacuccucacaguaagcaaguuaugauguucagugcaacucuuaguaaagacauaagaccaguuuguaagaaauuuaugcaagaucccauggaaguauauguugaugaugaagcuaagcucacccugcacgggcuucaacagcauuauguuaagcuaaaagaaaaugaaaaaaauaaaaaauuauuugaucuacucgacaucuuagaguuuaaucagguuguaauauucgugaaaucaguucaaagauguauggcuuuggcacaacuauugugcgaucagaauuucccagcuguagccauucauagagcuaugagucaagaagagaggcuugcuaaguaccaagaauucaaagacuuucaaaagagaauucuuguugcuacuaacuuauuuggaagagggauggauauugaaagaguaaacauuguguuuaacuaugacaugccugaagauucugauacuuaccuccauagaguagcaagagcuggacguuuuggaacuaagggcuuggcuauaacauuugcuagugacgaggcugacgcuaaaguucugaauaauguucaagauagauuugauguuaauauuacugaguuaccugaagagauugaccuuucaucuuauauugauggacgauaa

SEQ ID NO: 7068 - RNA, 1464 nt, Piezodorus guildinii
augccuguugaagcuaugcaaacggauguggagaugaaggugguugauucuccuuccucugaagacccaguggcuucagcaguucaagaaauaagggagcauauucgucaguuggaaaaggcaguugcuaauaaagaaccucguuuuauauuaagaguuuuacgucuacuuccuucuacacgucauaaacuuucugcagcaguccuucguaacguaauaucuucuuuuuauuuaaguaguccugaaaaagaugccuuauuucuuuauauugaagaugcugaugauucagauacaacacaaaaaacaaaacugaucaaaaauucuaauguuccucucuuacccgaaauagaugcuuauauucauuuguugguacuugugagacucauugaugcuggaaaggaaucugaggcugugaaguguucugaugcucuuauggcuaagauaacugcucagaaccgcaggaguuuagauuuaguggcugcuaaauguuauuuuuaccacucucgaguuuaugaacucacuaaccaguuggaaaaaaucagaggauuucugcaugcuaggcuccgaacugccacucuuagaaaugauuuugaaggucaagcaguucuaauuaauugucucuugagaaauuacuuacauuauaaguuguaugaccaagcagacaaguuaguauccaaaucaguauacccagaaucagcaaguaauaaugaaugggcuagauuucuuuauuauuuaggaagaauuaaagcagcucguuuagaauauuccgaaucacacaaacaucuaguucaagcuuugagaaaagcuccucagcaugcugcuguuggauuuagacaaacaguucaaaagcuugcugucacuguugacuuacuucuuggugacauuccggacagacagaucuuucgacaagcaccacuucgucguucucucgcaccuuaucuucaguuaacacaagcuguuagaacuggcgauuugcaaagauuuggugagguuuuggaaauguuugggccccaguuucguucugaccauacauuuaccuuaauucuucguuuaaggcauaauguuauaaaaacugcuauaagauguauugguuuaucuuauucgcguaucacuccuaccaacauagcuucaaagcucggauuagauucacccgaggaugcagaauuuauuguugcuaaagcaauuagggauggugucaucgaagcaaccuuagauccugagcaugguuauaugcaaagcaaugaaguuacugacaucuaucggacaagagaaccacaauuggccuaucaucaacguauaucauuuugccuugaucuucauaaucaaagugucaaagcuaugagauacccuccuaaaucuuaugggaaagauuuagaaucagcugaagagcgucgagagcgggagcaacaggacuuggaguuagcaaaagaaauggcagaagaagaugaugauguuuucccuuaa

SEQ ID NO: 7069 - RNA, 1761 nt, Piezodorus guildinii
auggcuuuaaguacuccuucagugccaguuucugaaauauugaagagcagugcugauucagaugaacccaagaagaaaucaagggaagauuggcgcaaagccaaggaauuggaagaagcaagaaaggcugguacugcuccugcugcuguugaugaggaaggaaaagauaucaauccccacauuccacaguauauuucaucugcuccuugguacuauagugcuagagggccuacucuuaaacaucagagaauacaagaugaaaguguuaaaaaguucuccgguauugaugaaugguacaaacgaggaguugacacaacaaaagugguuacuaaauauagaaaaggugcuugugagaauuguggagcccuuacucaucaaaagaaagacuguauggagagaccacggaagauuggugccaaauuuacuggagcuaaaauugcaccugaugaguuuguucaaccugaacugucacgagauuaugacggaaaaagggacagaugggcaggauaugaucccucacaacacaaaaugguuauugagagauaugccagaauagaugaggccaagcggcaacugagagcagaaaaacuuaauucugaacagacagaagaggcugaagaagaagagacgaaagacagugcugcugaugagggaggugaagaugaagauaaauauguggacgaaguagacaugccgggcacgaaaguugauucuaaacagagaaucacagugagaaaucucagaaucagagaagacacagccaaauauuugagaaaccucgauccuaauucugccuauuacgauccuaaaacgaggaguaugagggacaacccuuaugcuggaucugcagaugcugauguggacuaugcuggagaaaacuuugugcgcuucacuggugauacauuagagcaugcgaaagugcaauuguuugcaugggaagcgcauaauaaagguguugauguccauccucuuggagaacccaccaggcuggaaguucucaagaaggaauucgucggaauaaaagaagaguucaaacaaaagggacaagaagaccucauuaaaaaguaugguggagaagaacaccugaaagcuccuccuaaagaacuuuuauuagcacagacagaauauuacgcugaguauacucguuacggcacagucaucaagggccaagaaaaagaaguugugagaucaagguaugaggaagacguguuuauuaauaaccauacgacuguauggggaucguuuuggcauucuggaaaguggggauauaaaugcugucauucuuuuauuaagggaucuuauugcaccggggaggcugguagacuggcaacggcuggagagguggcugucaaaggcccagcuuuuauuccaccgcgucccgcuacaccaacugccucauccuccucgucuucaucuucugauucuucaucgucgucaucuucaucaucugaggaugaagaagagaaggagaggaagaagaagaagcaggaaaagaagaaagcaaagaagaagaagcaaaagguaaagaaacucaagaacaagaacaaaaaaccugaagaaaagacagaagaagaacagcugaaggaagccuugaaaaaagaggaagaagcccaaagagaaggugacaggcuugcuaaaauggaugaccguaagaggccguauaacaguauguucgaagugcagaaaccuacugacgucgaaauggaagcuuauuacaugaagaagaagagggaugaggauccaauggcuaacuucuuauaa

SEQ ID NO: 7070 - RNA, 627 nt, Piezodorus guildinii
auggguauuucgcgagaucauuaucauaagagaaggaagacuggagguaagagaaaacccaucaggaagaagaggaaguaugaguuaggaagaccagcagccaacacaaaguugggcccuaaaagaguucauuuaguuagaacucgagguggaaauaccaaguucagggcuuugagguuggacuacgguaacuuuucaugggguucugaauguuguaccaggaaaacucgucuaauugauguagucuauaaugcaucaaacaacgagcuuguacguaccaaaacucuugugaaaaaugccauaguugucaucgacgcaaccccuuucagacaaugguaugaagcccacuacgcucugccauuaggaagaaagaagaaugcuaaauugucugaagcugaggaagcuguccuauauaagaagaggucuaggaaaacugaaaacagguauaaggcgaggcagaaacuggccaaaguugaaccugccuuagaagaacaauuccagacuggucguuugcuugcaugccucgccagccgaccugggcaauguggacgagcugaugguuacauccucgaggguaaagagcuugaguucuauuugaggaaaauaaaagccaagaaaggaaaguag

SEQ ID NO: 7071 - RNA, 936 nt, Piezodorus guildinii
auggaucgucuuuugcguuuagggggugguaugccaggauuaagucaagcuccaccuccaucagaugcuccuguuguagacacagcagagcaagucuacauuucuucucuagcccuucuuaagauguuaaaacauggaagagcuggugucccuauggaaguuaugggucuuauguugggagaauuuguugaugauuauacagugagaguaauugauguguuugcuaugccacagaccggaacaggugugagugucgaagcuguagacccuguuuuccaagcaaaaauguuagacauguuaaaacaaacuggucgaccagaaaugguuguuggaugguaucacucacauccaggauuugguuguugguuaucagguguugauauuaacacucaacaaagcuuugaagcucuuucagaaagagccguagcuguuguaguugauccaauccagagugucaaaggaaaaguugucauugaugcuuuuagauuaauuaaucccaauaugaugguucuugggcaagaaccacgacaaacuaccucuaauuuggggcaucugcaaaaaccuucugugcaggcauuaauccacgguuuaaaucgccauuacuauuccaucagcauuaacuacaggaaaaaugaguuggagcaaaaaauguuguuaaauuuacacaaaaagucuuggauggauggauugaugcucucugauuauucagaaaauugcaaaguuaaugaaacuacaguuggcgacaugcuugaauuagcuaagaauuauaacaaggcauuggaagaagaagagaaaaugacgcccgaacaacuugcuauuaagaacguuggaaagcaagauccgaagaggcauuuagaagagaaaguugauguacuaaugucagccaauauugugcagugucuuggugcuauguuagauacuguuguguucaaauaa

SEQ ID NO: 7072 - RNA, 1218 nt, Piezodorus guildinii
augacauacacaacuuuugagcaaauggauguggaugagaagaagggagaagguuuucguucuuauuacaucacuaaaauugaagaacuucaauuaauagucgcagagaagagccaaaaucuuagaaggcuucaagcacaaagaaaugaacucaaugcuaaaguucguaugcuaagagaagaacugcagcugcuucaagaacaaggcucuuauguuggcgaaguagugaaaccaauggacaagaagaaaguucuugucaaagugcauccagaaggaaaguuuguuguugauauugauaaaaauauugauauuaaugauguuacuccuaacucccggguggcuuugcgaaaugagaguuauacucuacauaagauccugccuaauaagguugauccccuggugucauugaugaugguugaaaaaguuccagauucuacuuaugaaaugguuggaggucuugacaagcaaauuaaggaaaucaaagaaguaauugaacugccuguaaaacauccagaacuguuugaugcauuagguauagcacaaccuaaaggaguguuacuauacggaccuccuggaacaggcaaaacacuucuggcaagagcggucgcucaucacaccgaauguacauucauucgugugucugguucugagcugguacagaaauucaucggugaaggaucaagaaugguuagagaauuauucgucauggcaagggagcaugcuccguccauaauauuuauggaugaaauugauucaauugguuccucacguauugagucugguagugguggagauucugaaguacagagaacuauguuagaauuauugaaccaauuggaugguuuugaagcuacaaagaauauuaaggugaucauggcgacaaauaggaucgauauucuagacccugcucuccuucgcccuggaaggauugaucguaaaauugaguucccaccaccaaaugaggaggcucgauuagauauccuuagaauucauucacguaaaaugaaucuuacacgugguaucaacuugcguaaaauugcugagcucaugccuggagcaucuggugccgaagucaaggguguauguacugaagcaggaauguacgcccuucgugagaggaggauucaugucacucaagaagauuuugaaauggcaguggccaagguuaugcaaaaggacucagagaagaacaugucuaucaagaaauuauggaaauaa

SEQ ID NO: 7073 - RNA, 603 nt, Piezodorus guildinii
augguuaaguuguaugcucuucauauuuuauacaaaaauuuaaauagugcaguaugguugaaaacagcuuaugauguccaaaguuuuggauauuuucaaagaggaacugcccaagacaccauggcuuuugcuaguaaaacaauaguugaaaggacucagucugcaaccagacagucugucaaagaaggagauuauauaugccauguguauguaagagcugacaauuuagcagggguugugauaucaaaccaugaauacccucaucgaguagcucauacacuaauaaccaaaguauuggaugaauuuagcgcuaaauauccaccuucaacuugggcaucugcaaaugaauccaauauugauuuuccugcauuggcagcucaccuucaaaaguuucaaaauccuaaagaagcugaugcucuuaugaaaauucaaagugagcuugaugaaacuaaaaucauucuucauaacaccauuggagccguuuuagagcguggagagaaauuagaugaucuuaucaugaaaucugaaagucuuagcuaucaguccaaagcauucuacaaaacagcuaggaaaacaaauucaugcuguucauaugucgguuaa

SEQ ID NO: 7074 - RNA, 750 nt, Piezodorus guildinii
auguuucucacacguucagaguacgacaggggugucaauacuuucucuccugagggaagguuguuucaaguggaauaugcuauagaagcuaucaagcuagguuccacagcaauagguguuugcaccccagaaggaguuguuaugggagcugaaaagagaauaaaguccccuuugauggaaccagaagcuguggagaagauucuccaagucgaugaucauauugguugcgcuguaagugguuugauggcugauuccagaaccuuaguagagcaugcucgaguccagugccuuaaucauugguuuguuuaugaugagaagaugccgauagagucugcugcucaggccgucucuaacuuggcaauaagauuuggugaugcugaugaagaugcuggcccagcgaugaguaggccuuuugguguggcugucauguucggaggauaugauuacagaggaccucagcucuaucauauggacccaucaggaacauuuaucuauuucgaugcuaaggcaauagguuccgguagcgaaggagcgcaacagagacuucaagaauuguaucauaaaggaaugagccucaaagaggccaugcagaugaucuugacaauuuuaaaagaaguaauggaagaaaaauugacugacaauaaugucgaaauagcuguaguaacugcagaagagaaacaguuccguauguauaccaaggaagaaguuuccaaagucauaggugaaacgcaaucggcacaaacuucguaa

SEQ ID NO: 7075 - RNA, 1167 nt, Piezodorus guildinii
augagugaguacuggcuuauaucagcuccuggcgauaaaacaugccaacagacaugggaaaccaugaauaaucuuacuagcaaacagcacaacuugucagaaaauuucaaauuccauauuccugauuuaaaggugggaacauuggaccagcuugucggacuuucggaugauuuagggaaacucgauaauuucguggaucaggucacucacaaaguagcucaguaucuuggagaaguuuuggaggaccagaaagauaaacuucaggaaaacuugauggcuaauaauacggauuuaucuacguauauuacaaaauuccagugggauauggcuaaauauccuauuaagcaaucucuucguaacauugcugauaucauaagcaagcaaguuaaucagauugaugcugacuugaagacaaaaucuacugcuuacaauaaucucaaaagcagccuccaaaauauggaaaagaagcaaagugcuaguuuguugacccggaacuuagcugaccuuguuaaaaaagaacauuuuauuuuagacucugaauauuugacgacauuacuaguugugguuccgaagucaaacuucaaugauuggaauuccagcuaugaaaaacuuacuaauaugauuguuccacguucaagucagcuuguuuaucaggauucugauuuugguuuguucacagucucguuauuuaagaaagugguaaaugauuucaaauuaauggcuagggaaaaaaaauuuguuguucgugacuuuaucuauaaugaagaggaauuagcugcaggaaaaaaugaaauuacaaaauuaguuacugacaaaaagaaacaauuuggcccucuuguacguuggcugaagguuaauuucagugaauguuuuugugcuuggauucauguaaaagcauugagaguuuuuguugaaucaguuuugagauaugguuuaccaguuaacuuccaggcuauguugauccauccccacaaaaaguccguuaaacguuugcgagauuuauugaaucaacuuuaugcaccauuggacaguagugcucagcagcaaggaaaucaagguggugguaaugauagcguggacauuccugguuuaggauuuggccaaucagauuauuaucccuauguauacuauaaaauaaauauugauauguuagacacuaaggcuuaa

SEQ ID NO: 7076 - RNA, 1647 nt, Piezodorus guildinii
augucaacuuuaggcguuccauuaucgguugggggcacgagaaccucgggagcuccagucagaacucaaaauguuauggcagcaugcuccauugcaaacauugucaaaagcucuuuggggccucuuggauuggauaaaaugcuggucgacgauauuggggaugucacuguuacuaaugauggagcaacaauccuacgauuacuugaaguagaucaucccgcugcaagaguucuuguugaucuagcucaacuucaagaugaggagauuggcgauggaacaacuucuguaguaauuauugcagcagaacuucuuaggaaugcugaugaauuagucaaacagaauauucacccaacuucuaucaucagugguuacagacuugccugcaaggaagcucagaaauauauucaagaacaccuaugugucaguguugaugaacugggaaaagauuccaucaucaauauugcaaagacauccuuguccaguaaaguuauuggaauugaugaugacuucuuugcaucaaugguuguugaagcugcacaggcuguaaaaguuaaugacagcaaagggaaagcuucuuauccuauuaaagcuaucaacauuuugaaagcccaugggggaucagcuaaagaaaguauauuggucaauggauaugcccucaacugcacagucgcaucaaugggaaugacaaagcgaguagaaaaugcuaaaauugccugccuugauuucucuuuacaaaagacgaaaaugaaauuagguguugaaguucugguagaagauccuaaucaguuggaagcaaucagagauagagaggcugacauaacaaaagacaggauucagaaaauucuuaguguuggcaccaauguaguacuuuugagcggaggcauugaugacauuuacaugaaauauuucgucgaagcaaacgcgauggugguaaggagaguuaaaaaaucagacuugaaacguauugcuaaagcaacuggugccucuuuugcaacaucucuaacuaauauggaaggugaagaagcauuugaugcuaguuuauuaggcgaggcugccgagguaucccaagaaaggauaugugaugaugaacuuauccuuguuaaagguccaaaagcacacucugcugccuccauaauccuucguggaccaaacgauuauuucugugaugaaauggagagaucuauucacgacucgcugugugcaguaaaacguguucuugaaaguaaaaccguuguagcagguggcggagccguugaagcugcucuuucaaucuacuuggaaaacuuugccacaucuuuaaguucaagagaacaauuggcgaucgccgaguaugcuaaaucacuuuuggugauaccaaaaauacuugcugucaaugcagcucuugauucgacugauuuaguugcuaagcucagagcuuaccacaacacaagccagacaaagaaggaucaugcucacuugaaguggcauggacuugacuuguauggaggcgcagugagggacaacaagaaggcugguguccuugaaccaacuaucucaaaaauuaaguccuugaaauuugccacugaggccgcuaucacaauucuccgaauagacgaucuuauccgccuggaagccgagaagaaagaucagggccauggagauauguga

SEQ ID NO: 7077 - RNA, 786 nt, Piezodorus guildinii
auguugaguuuagcugaugcuucaacaaauuuugaucacaauucuaucagaagcaaugauagacaugguaacacacucgaugauaaucaaguuaaaauuauuaaagcuccggauuuuuuaaccaggacuuuauaucccaugacaacuacagcaucuguaguuggaaucaaauuuaauaaugguguagcuaucgcugcagaugucgguggauauuauggaucauugaaucguuucaagucucuugauaggcuguacaaaguuaauaacaauauuguaaugacaaccacuggagauuaugcugauuuucaauacaucagagaauuaauacaacaaaaaguuaucagugaggaaauccuggaugacaguuucucuuuaaaagccuuuucucuucauacuuggcucacucgccugauguacaacagaaggucgaaguuugaucccuuauggaacaauguuauuguugcuggauuugauagcaacggacccuucuugggaaucguggauaaacuaggaaugaguuaugaagauagcuguguugcaacugguauggguggguaucuugccacuccacuuuugagggaugucuaugaacgaggcaaaggaaauuugacuaaacaagaagcccaugccgcccuucagaaaugcauggaaauuuuguacuacagggauacucaaucgcuucccaaguuucaaauugcaacagucaccgaagaagguguugaaauaucaccugaauuagaaguggaaggaaacugggaaauugucaaacauucuaagggauuuuga

SEQ ID NO: 7078 - RNA, 2055 nt, Piezodorus guildinii
augaaugaucaucuuaagaaauuuucugguguugauuucaacccagacaaauaugucaaagaaauaucucaaguuuguguugguggaauagaacuccaaagccauagagcuaaaauccaggcucuugcugaagaaacaagucagaaucuaaaaaaaaauguuuauaaaaauuacaugcaauucauugaaacugccagagaaaucucucaucuugagggugaaauguaucaguuaucucacuuacuaucagagcagcgugcccuucuugguucaaugagcaauucagguucugaaccuguucuucaagcagguggaagcaaagcccaagaagaaaaaagaauugcggcuuuaucgucuauuucggaggucauagaaucuugcccggaucuucuugauacuccaggcagagaaauuuugcacgaaggugaccuuguggaacuggacccucuggagaacacagcucuucaucgaacucgggcuuuacuguuuucugauauguuuaugauugcgacuuggaugucugaaaggaaaggacaagcaaaguauaaguuugaaagcaguuacgaucuggguagcauggcuguuguaaaugugagggaucuuggacaaguuaaacaugcuuuuaaacuuuuaguuuuuccugauaccagacuuuuucaaugcguaaauaaugaagccagggaagaauggcugaaaaaguuugaugaagcuaagaaagcacgauugaauucagagcagaccaaaaaaaaaggugaaaaugacaaagaaucuuauacgauucgugagcaaucgacuaaacccccugagagaacugauucuguugaauucggaucuaauccauuuggguuugugcuugaugaugaugcagacagcgaugcucuuccagaaugguugaccgaagcagcggaugauuuugauguuuccauagcucagaggcauuuugaagaagccuaugcaaucauucagaaaacugaggaguauuuugcaucugcgcaagacgaucaagggcuggcugauauaaaauccaaauuggaaaauaggaaagauguauugaucuguguccuccuaucugaguugaacgugagugcugaaaaaucauuacaaggaggucuucgugcgagccgucgagcuguuaggcuucuuaaccaacuuaauaaaucaacucaggcaugugagcuauaucugaaaguuuguacaaaccuccuaaaagcacaaagcaaacggguaaagcgagagggugcaacuguggcguaugucaaacgauuaucagaaguauacuuuucgaaucuugcaucuauuacuuccgaauuucaauaucgugcauuuccucacaaucaagauuguacaucagcuuuuguaguaugggugucgauggaagucucuaauuuccucucacauaucauaaaacaaguauucaucccucagacaccccuugguacccuggcugaguguauagacauuauaagaaagcagucccagcagaugugcgagcuuggcuuggaucugagcuaccagguuaauggccagaccauggcagcaguuacgcgugcaguagccgaagcuggagagaaagcuguugaugcugucaaggugagagcugccgaggacccuuggagaccuucaaggcagacccagcaaucgaucaauaagauccagucagaguuaggucuuccuguuucagaauaucucguugauuauggagucuucgagcugacugcuaacagccugucuuuugccaaguugcuguccucuuugacagaugagggccuuaugauauccugccaagaucuggagcacgcuuugaguaaagcauugaaugaaguucuuaaagcgcacuugaaccaucuuucagccucuuacucuaguaacaaauuucguucucagagaagucuuauacagcaaaaugcaaaauuuauucucgaucaauuauuggaagcagugcagagaaaauacagugaaaaaaugggccauagauguaagaaauuggacauauuaaggaaagaauacaauuuuauuuugaaggagaguaaaacaacgguuacugguuacauuuag

SEQ ID NO: 7079 - RNA, 3792 nt, Piezodorus guildinii
auggaugaagugaagaaacuugagcaccucucauuggugucgaaaauuugcacagagcuugaaaaccauuugggauuaaaugacaaagauuuagcugaauuuaucauugauuuggccucuaagaauaauacauuugagaguuucaagaaagccuuauuagauaaugaugcagaguuuucggauucuuuuauuucuaauuugcugaggaucauucaacacaugcgaccuaagaaugagguaaccgugacgaaagacaugaccaagcaagacaaacugaguaugaaguuuccaggacuagcuauuccgaaugagguacaacagacgaagaaccauagcgagaaaaaguucaaucugucuacaaucaaggaagauccugaggacaaugaagucgaggaugcgauggcagcucucgaagcauuagcucccucgaaagaaaugaaauuugccuugaagacugaaagagcauccaggucuccggaaaaaguuaucaaacaagaaucggauaagaucagaaaacgaagucgcagccgcagcagaaacagagacaagaagaggaauagaagucggaguaggaguagaggaaggggcaggaguaaagagaaauccuccgguaagagcaggcaaaggagcacgagucgugggaggagacggagaagcagggacaggaguucuagcaggaauagaggucaggugaagaacugggacagggagagagagagggagaggagggugaagaaugaccgaaggaguaggagcaggagcaacggaaggaggagaaacgaaaggagucguagcaggagcacaggaagaaggaggaacgaucggaguaggagcaggaguuaugacaggaagaaaaaugauaaaaaaagagaaaaugaagaugaaaagaauaaaacugaugaaccgcuugaacccgaaguuggaaaaauauauaauggaaaaguuacaaauaucguuucuuucggauguuucguucaaauugaggguuugaagagacguugggaaggacuaguucauauuucacagcugaggagagaaggaagaguaacaagugcuucugacguugucucccguggaaugaaagucaugaucaaaguguugucggucgcugggcagaagguaucucucucuaugaaggacgucgaccaggaaacuggaaaagaucugaaccccaccguucgccaugccaucaacaaggacagggaagaagaagccucaaugcgaaauccugaccguccaacgacacuacuagaucuugguuccuucgaugaucacgaugacuuucagagcagaaagaggguuaauaggauaucaucgccugagaaaugggagaucaagcagauguuaucugcgaguuguaucgauaaaagugaacuuccugauuucgaugaagagacuggguugcuuccuaaagaggcugccgaagaagaagauauagaaauagaaauuguagaagaggaaccaccuuuucuacaggggcauggaagaaauuugcaugaucuuaguccggugaggaucguuaagaauccugacggcucccuugcucaggccgccaugaugcaaagcgcacucgcgaaggagaggcgcgagcagaagauguugaacagggaacaagagauggaccaaaugccgaccgguuugaauaaaaauuggaucgauccccuuccugagagugaugguagaacuuuagcugcgaauaugcguggaaucggacuaacgaaucaggaccucccggaauggaaaaagcacguuauuggcgguaagaagaguucauuugguaugaagacgaacaugacacucuuggaacagaggcaaagucuuccuauuuauaaacugaaggaacagcugauuaaggcuguuaccgaaaaucaaauuuugaucgucauuggugaaacaggaucaggaaagaccacccagaugacucaguauuuggcagaagcugguuucacaucgagaggaaaaauugguuguacgcaaccgaggagaguugcggcgaugucaguggcuaagagaguggccgaggaguucgguugucguuuaggucaagaggucggcuacacgauucguuucgaagauuguaccagcccggaaacagucaucaaguacaugacagacgguauguuacuccgagaaugccuuguggacuuggaucugaagagcuauucgguuauaauguuggacgaagcgcacgaaaggacaauacauacugauguacucuuuggacuuuugaaacaagcuguucagaaaaggucagaacuaaaguuaaucgucacaucggcuaccuuagaugcugugaaguucucgcaguauuucuucgaagcuccuauuuucaccauuccuggacguacguucccugucgaaguacucuauacaaaggaaccagagacggauuacuuagacgcaucgcuuauuacugugaugcaaauacauuuaagagaaccuccuggggauauuuugcuauuucuuacaggucaggaagagaucgauaccgcuugugaaauauuguacgagagaaugaaaucgcuugguccugaugucccagagcucauuauccuucccguuuauucugcacuuccgagcgaaaugcaaacuagaauuuuugaagcagcuccaccuggcucgagaaagguuguaauugcuacaaacauagccgaaacaucucucacuauucauggaaucuucuacguugucgauccaggauucgucaaacagaaaguguacaauucaaagacaggaauggacucucucguuguuacaccuauuucacaggcucaagcaaaacagagagcagguagagccgguagaacaggaccugggaagugcuauagauuguacacagagcgcgccuaccgggacgagaugcugcccacuccagucccugagauccagagaaccaaccuggccaccaccguccuccagcugaagacuaugggcauuaacgaccuccuucacuuugacuucauggaugccccgccgguggagaguuugauaauggcccucgagcagcuucacagccucagcgcucucgaugacgaagggcuucuuacgaggcucgggagaaggauggcugaauuuccuuuggaaccuaaucuaucaaaaauguugauuaugucgguucaccuccagugcucggaugagauacuuaccguugugucgaugcuuucuguccagaauguauuuuacaggccuaaagauaagcaggcacucgcugaucagaaaaaggcuaaauucaaucaagccgagggagaucaccuuacccuacucgccguuuauaauucguggaaaaacaauaaauucagcaacgccugguguuacgagaauuucguucagaucaggacgcucaagagggcacaagauguuaggaaacagcuguuaggaauaauggacaggcacaaauuagauguuguaucagcugguaaaaacacaguucguguucaaaaagcagugugcucugguuucuucagaaaugcugcgaagaaagacccccaagaagguuauaggacuuuggucgacagucaggucguuuacauucacccgagcagugcucuuuuuaaccgacaaccugaauggguuauuuaucaugaacucguucagacaacaaaggaguacaugagggagguuacaacaaucgauccgaaauggcuggucgaguucgcaccugcuuucuucaaguuuuccgauccgaccaaacucagcaaauucaagaagaaccaacggcuugaaccucuguauaauaaguaugaagagccaaacgccuggaggauaucaagaguucgaaggagaagaaauuaa

SEQ ID NO: 7080 - RNA, 1245 nt, Piezodorus guildinii
auggcaccuaccagaaaaacagaagggcuccuugcccgaguaaauuuucccuuguacaccuugcaaauguugacuaguagacauguucuuguugguggaggugguggcucagccaaaacaggaguugcaaaugguuuugaaauuuuugaauugucuuaugauggaacccguuuuucugcugaagaaguuauucgucaugaaacugggucuaaaguggugaugaauucugcuuguuacagugacaagaaaaguacguuuuuaguugcuggacaagaaagucacugucaguuauacagaguuggaauuacuguugagaaggagguuucugaagaaccaaugaauggcauucuggaaccuccuaaucuaaggcaccgaaaaccuuccagaaaucaccaaaaugguauaagugaagugaagaauauugucaaaaagaaauuaguuuuuaaauucaacucuggugauagcauacaaucugacuuuagugaaaacgaaccaugccaaaggguaguuacaauaucucguugugguggcuggauggcaacugguggaacugauggaaucguaagaaucuggucauucccuagccuucgauugauuagagcucuuaaggcccacacgaaagaacuagaugauuuacauuuuagcccugauucaaagcagauagccaguguggcaaaagauggacaagcaauuauuugggagcugaagucaggaaaacagguucauaaacuugauuggacucauccugcaggaaucaaauaucucuucaaaagaugucgcuuuggcauuguugaaggcaaagguugcagauuauuuacuacaguuaauccuguggcuggugggaaggaugcccaaggcuggauccaugccugggaugauggucgcauuuucaaguccgcagcuguaucugaaccuacuucagcacuugccguuagggaugaugguauuuucauugcaaucggcacuauguucacaggaucuguauccauauacauagcauucucucuucagagaguucugcauguugauggagcacauucaauguuuguuacugguguugaauuauugccuuguucuucuucauggggugcaauagaagcugcagcuuugaguauuucuguugauaacagagucuguauucacagcuuaccauucagaagaacguuaccaccaugguuagugaucaucaucaucauguugacucuucucuuuacuuuuguauugugcagcuuuaucggccuuuaa

SEQ ID NO: 7081 - RNA, 1254 nt, Piezodorus guildinii
auggcgggugcaauguuguuugagaggacugucucuucuagagauagggauaauagucgaauucuuccuacuucuagcagaaaugucgacgaugacaaugacgaagaagacaucagaaauaaggaacaagggauuuugcaguugggagagcaauacaagaaagaggguaaagcuaaagaguuagcagaacuuaucaaggcaaguagacccuuucuuagucaaauaagcaaagcuaaagcugcgaaauuggugcguucuuuaguggauuauuucuuggaucuugaagcugggauaggaauagaaguucaacuuuguaaagaguguauagaaugggcaaaagaugaacacaggacuuuccucaggcagucacuggaagccaggcuuauugcucuauauuucgacacuggaauguucacagaagcacuccagcucggcucaagucuccuuaaggaauugaagaaguuagaugauaaaaauuugcuuguugaaguucuuuuguuggaauccaaaacuuaucaugcuuugaguaaucuuucuaaagcccgggcugcucugacaucggccaggacaacugcuaauucaauuuauuguccaccuaaaaugcaagcagcccucgauuugcagucugguauauuacacgcagcugacgaacaggauuucaaaacagcuuacucauacuuuuaugaagcauuugaagguuaugauaguguugacagcccgaaggcuuugguagcucuuaaguacaugcuuuugaguaaaaucauguugaauacgccagaagaugugcagcaacuaguuaguggaaaacuugcucuuaaacacgcugguaaagauaucgaugcaaugaaaucaguugcucaagcuagccauaagagaucccuugccgauuuucagauaacuuuaaagaauuacaagaaagagcuggaagaggauccgaucguaagagcucacuuggguacacuuuacgacaacauguuggaacagaauuuguguaggaucauugagccguauucaagaguucaggucgauuuuauuucaaaaucgaucaagcuuccccuuccucaagucgaaaagaagcuuucucagaugauucuugacaagaaguucaacggaauucucgaccaaggugaaggaguucuaauaguguuugaagaugcagucguugaaaaaaccuacgaaauggcuuuagaagucauuaacaguauggguaaggucguagacacauuauaucaaaaagcuaagaagcucucauaa

SEQ ID NO: 7082 - RNA, 1800 nt, Piezodorus guildinii
augucuacgaagucacccaaaaagacaacuccagccgguucuucaucagcagguccuucuagaaguucacccagaaaaagugaaacuccuacuccucaaggugccaggaaaaguccuuuaaguccaacaagauauaguagacuccaugaaaaacaagaacuugcuaauuuaaaugaucgcuuggcauguuacauugauagaguuagaaauuuagaaacugaaaauaaccgguuaacccgugaagucaaaaguucucaagaaaauauuaccagagaaguaacuaguguuaaaucuuuguacgaaagugaguuaucagaagcaagaaaauugcuugaugaauuaucccgggaaaagacaaaacuccaaauagauacacgaagauuauauacugaaaaugaagaacuuaaaacugagcuugagaagaagacuaaagauuguaauauucuccaaacuucacuuucagucagugagaaccgacuugcagaucucacaacaaaauauaaucaacugcaaggagaaaggaagaagcuugcagaugaaaacaaggcuuuggaaaaugaaagaaauaaacuugcaguccagcuaucagauacacgaaaacauuuggaggaagaaacucuccagagaguagaucuagaaaaugcugugcaaacauuacgugaagauuuuucauuuaaagaacagcuacaugaacagcaguuauuggaaacucguacuaaaaagcaaguggaaauuagugaacuugaugguagauuaagccaagaguaugaagaaagauuauaccagagucuucaagaaauacgcgaucaauaugaaugcgauuuagaaaauaacaaggaagaaauuaaaaaacuguacgaggaaaaaauucgaagucuuggaagucaauugacacgaaacagcaaugcugcugcaauggcuauugaagaaaugaaaaacaugcaagcuaaacucaaugagcuuaauagaaaauuacuagacuuggaagcagacaggaaugcagcccagcaaaaggcuagagaucuggaaaagauuuuggaacaggcuaaagcucaauauauggaagaauauagucagagggaagcugaaaucacuacucuucgugaagagauggcucaucaaguucaagaauaucaagauuuaauggacaucaaaguugcauuagauuuagaaauagcugccuaccgaaaguugcuugagggagaagaagccagguuaaauauaacaccugucaguuccccagcccagacuucuucccgaaagguauuaggcaggaaaaggaaacguacuuuuauugaagaaucugaugaaacagaccuuucuaacuacucaguuacuucuucuuccaagugugauguugccaucucagaaguuuguagugaaggacaauuuauaaaacuccuuaauaaaucuaauaaggagguuucacuuggugguuggcaacuaacucguaaagccggagaauccuccacuauuuacaaguuucaccguacuauuaaaauggaaccaggugcuacuauuaccauauggucuucagauguuccggauaaaucucaugagccuccagaaaauuugcuuaugaaaggucagcguuggaugguugcugauacuaugacuacaguuuuguccaauccugcuggggaagaaauggcuauaucagaacauaagaaacagcagcugagugaccgaacaucaucaaggcaaagagaagguaguuucuaucaaaagagaacauuucuuucuucuucaaugcgcccuccuagugaaacuccaggugaagaaagaugugugauuugguaa

SEQ ID NO: 7083 - RNA, 2409 nt, Piezodorus guildinii
auggcugauaugaaaagcaaugaagauuugucaacugcaauccugaaaaagaaagauagaccaaacagauugauuguggaagaugcagucaaugaugacaauucuguuguugcucucucacaggccaaaauggaugaacuucaguuauuucguggagauacugugcagcuuaaagggaaaagaaggaaggaaacuguuuguauaguuuuaucugaugauacaugcccugaugaaaaaauuaggaugaacagaguuguacgaaauaauuuacgaguucguuugucagauauuguuucaauucaagcuuguccugaaguaaaauauggcaaaagaauacauguuuuaccuauagaugacacuguugagggauugacugggaauuuguuugaaguguuccuuaaaccauauuuucuggaagcauaccguccuauucauaaagaugauacuuuuguuguuagaggugguaugcgugcuguagaauuuaagguaguagaaacagaucccgcuccuuacuguauuguagcaccugauacuaucauucauugugaggguaaucauauaaagagagaggaagaagaagaagcuuuaaaugcuguuggauaugaugauauuggagguuguagaaagcaacuugcucagauuaaagaaaugguugagcuaccuuugagacauccuagcuuauucaaagcaauugguguuaaaccuccucguggaauauuacuuuauggaccaccuggaacugguaaaacauuaauagcacgugcuguggcuaacgaaacaggagcauucuucuuuuuaaucaauggccccgaaauuaugaguaaauuagcuggugaaucugaaaguaaucugcguaaagcauuugaacaagcugaaaaacaugcuccuuccaucauuuuuaucgaugaguuagaugccauugcuccaaaacgagacaagacucacggagaaguggaaagaagaaucgucucacaauuacuuacauuaauggauggucuuaaacaaaauucucauauaauugucauggcugcuaccaacaggccuaauucaauugaugcugcucuuagacguuuuggacgauuugaucgugaaauugauauugguauuccagauacaacuggacguuuagagguucuucgaauucauacaaaaaauaugaaacuagcugaugaugucaauuuagaacagauugcugcugaaacacauggucauguuggagcagauuuggcaucucucuguucagaagcagcacuucagcagauccgugaaaaaauggaucuaauugauuuagaagaagagcaaauugaugcagaaguucuaaacuccuuggcuguuacuauggauaacuuccgguaugcuaugggcaaaaguagcccaagugcccuucgugaaacugugguugaaguuccaaauauuacuugggaugauauugguggucuggauaauguuaaaaaggaauugcaagaauugguucaguacccuguugaacauccagaaaaauucuugaaauuuggaaugcaaccuucccgugguguuuuauuuuauggaccaccagguugugguaagacauuguuagcuaaagcuauugcuaaugaaugucaggcaaacuucauuucagucaaggggccagaauuauuaacuaugugguuuggagaaucagaagcuaauguucgugauauuuuugauaaggcuagagcugcugcaccauguguucuauuuuuugaugaacuggauuccauugcuaaaucaagagguggaaguguuggagaugcuggaggugcagcugauagaguuaucaaccaaauccuuacugaaauggauggaaugggagccaagaaaaauguuuuuauaauuggggcuacuaauagaccagacauaauugauccugcuauucugagaccuggccguuuagaucaacucauuuauauaccauuaccugaugagaagucaagagaagccaucuucagagcgaacuuaagaaaaucaccuguugccaaggauguugauuuacaauauauugccaaaguuacauuugguuauucuggagcugaucuuacugagguaugucaaagagcguguaaacuugcgaucagacaguccauugaagcugaaaucaaaagggaaaaaaguagauuagauggagcuacacgaauggauauggaugaugaggauccugucccugaaauaacacgugaacauuuugaagaggcaaugagguuugccaggcguucugucacugauaaugauauucgcaaguaugaaauguuugcucagacauuacaacaaucaagagguuuuggaacuaauuuuagauucccugcuagcucaaauauuccuagugcaccaggaggugggggaacugaaacuaacaacuuuccagaugauggagaugaugaccuuuauaauuaa

SEQ ID NO: 7084 - RNA, 834 nt, Piezodorus guildinii
augacggaccagcaaauggacugugcucucgacuugaugcgaagacuaccgccucaagaaauugaaaaaaauuuaagugauuuaauugauuuaguuccaagucuuugugaagaacuauugucuucaguugaccaaccuuuaaaaauugccauugauaaagggguugguaaggauuauuuauuaugugacuacaaucgggauggugauucauacagaucaccuuggagcaauacuuaugauccaccucuggaggaugguucaaugcccucugaaaggcuaagaaaacuagaaguagaagcaaacgcugccuucgaccaguauagagaaauguauuuugaaggaggugugucaucuguuuacuugugggauuuggauaugacugguuuugcaggugcuauuuuaauaaaaaaggcuggggaugguucaaaaaaaauuaaagguuguugggauucaauacacgugguugaaguucaagaaaaaacaacuggacgaaaugcucauuauaaauuaacuucaacuguuaugcuuugguugcaaacaaauaaaacagguucaggaacgaugaacuugggagguaguuuaacuagacagauggagcaagaugcagcuguaucagaugcuucuccacacauugcuaauauuggccgaaugguugaagauauggaaaacaaaauuaggaacauccugaaugauauuuauuuuggaaaaacuaaagacauagucaauggguugcgaaguacacaagcuuuaucagaacagaaagcccaggcugcccugaggcaggaucuugcuguagcucuucagaaacggcaggcaaaaacugcggacaauuga

SEQ ID NO: 7085 - RNA, 3717 nt, Piezodorus guildinii
augcaacaaauggacuccuugcaaccgaacaacgcaacaggacuggugaaaagcgggcuagaggcgggggccgguagcggcaugaaggagcccccgccacgagaggagccgguccuagacccuaucaaugguguuguccagccaccggucauaccuccaccccacaggccuggccgggucaccaaccaguugcaauauauucagaagaauguccucaaagcaguguggaaacaucaauaugcuuggccucuacagcaaccugucgaugcuaacaaacucaaucuuccugauuaccauaaaguuauuaaacauccaauggaucuugguaccaucaaaaaacgacuggaaaacaauuauuauugguguggugcugaauguauucaagauuucaauacaauguuuaacaauuguuauguuuauaacaaaccaggagaagauguuguuguuauggcucaaacgcuggaaaaaauuuauuugcagaagcuggaaacaaugcccaaagaagaaaucgagcuggagccuccaccaccuaaagguuccaagccaguuaagaagcgaccuggagugauaggaccagguagaggaggugggaccacuggugcugggagggggaggccuuccaacucgacaacggcagccacugcagcaguagucgcgacuccuguaccaccugucacuccuccgucucaccuaccaccaaccauacccgguuccacugcuaccacuacuguagcuacuacucaucauaacucucuucccccucagguugggcagccagcagcuguacccuccaacuucaaugcgacaccuguugauccucugcuaacaccuggauuggcuccugguguugguccaaaagguggcaaaggggccgucguucagaccccaacggcgcccaaaccgaagaaaggggucaaaagaaaggcugaucaaaacgauagcccggcuggcuucgauccaaccuacaccccaggugacuccaaagcugccaagguuggcacuaggagagaaucuggaaggcaaauaaaaaagccucaaagacagucagacgaugguaugccauuuucucaaagcccaauggcacccuaugcucauucgaauucaaaucaggcuucucacgaaaagccaaaagaaaagcuuuccgaaacauuaaaagcgugcaaugaaauauugaaagaauuauuuucuaaaaaacauuuuaacuaugcguggccauucuauaaaccuguugaugccgaauggcucgguuuacacgacuaucaugauauuauuaagaaaccuauggaucucggaacaguuaagcaaaaaauggauaaucgagaauacaaaacugcgacugaauuugccgcagaugucagacuaauauuuacaaauuguuauaaguauaauccuccugaccacgauguuguugccaugggaagaaaauugcaggauguuuucgaagugagauucgcucaaguaccugaagaguccccugcuguagcaccuccuccuccagaaaaggaagaagaauccucuucugggucaucuucuggcucugaaucugaaacagacgauucagacgaugaaagggcccguaaacuuagucaauuacaagaacagcugagaaugaugcaggaagagaugacaaaacuccucgaaaaaggcgccuugaaaaagaagaagaaaaagaaagaugggucggguucugguggaagcuccucuaguaaaaaaaggaaaucugcugauaggacacuugguaaaacagcugaugguaguauguuagcuggugcuggagcgccugcugucgcagaaaugaaggcugccgacgguguaaaagccgcacccccuccaggcaggaaugcuguccccucaccccaggucaaaccaaacaagggcaaagccccuggcagaacaccaggaaaaacaaauucucagggcaagaggccaaagccaaacuccagguccaccaacucaaagaagaagaauccugucguaacuucagaguucaacucagaagaugaagauaaugcaaagccuaugucuuaugacgaaaagagacaacuuagcuuggauaucaacaagcucccaggugauaagcuuggaagaguaguccauaucauucaggccagagagcccucuuugagggauucgaauccugaugaaauugaaauugacuuugagacauugaagccgucaacccugagggagcucgagucuuacguugcaucaugucucaggaaaaagccacauaagaaaguaucugcaaaaucaaaagaugaagcaauggcagagaagaaacaagaacuugaaaaaagacuucaggauguuacuggccaguuaggaggaucagcaaaaaagcaggcuaagaaacaaggccagggaagacuuucugcaucuucaucaucaagcucagauucugauagcaguaguucgagucucucaagcaguucuuccgacucaucugacagugaagcagggaaagcagggcguccagcaaagaagaaaaacaagaaaaaucaccugcuggcaacaacuacugcauccacuguccaacagaaucaaacaguccccagcuugaccaugacaacugcuacagguaccauuguaaauaaaacugucggggcuucacagcccauaguaccauuagcaagcaccaauaagccuacuguaccuccugucucuucaguugcucagccugaacccgugaaaccuguggugguggcaucucauauccucccuccccaaccugcaaggccgaccgcuacagcagccccgcugacuaccgcaaagagggcaucgaucccuacaccaggcacaaccuuagguauaccaccuaccgcuccgaccgcccuugagacagguccuauugagaucaaacaagaauuggacguuccugugucauuagcuccugugccugaccauuuggauuucaaaaaccuuuuggaagugaagccugagcugaaugauaucguaacagggaugccuucuguuuuugauccauugccugacucaccucccaucauuaaggaagaaaaacuucccauauuaccucaucacacugauggacacuugaauaacucucuuccccccgugaguaacgugccuggcccgccaguuauaccuagugcugcacuuccuacaacaccucacaucuuagauaugaacaaaaauucucagccuccccagcuuccucagacgccaguuaugcaacacaacuucaagccuaagaguguugaacaaaaccugaaaaaugccaguucauggucuucauuggcccaaucgccgacaccagcucuaacuccuacuccacccacugcagcagcacugaaaucaucaauggcugacaguuuucaagcauuuaagaaacaagcuaaagaaaaugccaagaagcaacgcgcccugauugagcagcaggaaaugagacggcaucaaaaagaacaggccgaaagggaaagguuacgugucgaaacugagaagaggagagaaagggaagaagaagaagcuuuggaaaaagccaggaaggcugcuguaguggcuucugguggaagaguugaagaggucaaaaaugcugcgaucgaggaaggcucuagcccugguucagcugauaaagcugcugcagagcgcgagcgucugaggcaacgagagcaagagaggcggcgacgugaagcgauggcuggacaaauugauaugaacaggcaaagugauuuaauggcugcuuuugaacagaccuuguaa

SEQ ID NO: 7086 - RNA, 1293 nt, Piezodorus guildinii
augauucccccgucuucucggccgcaggucacuguguacagugacaaaaaugaaccaacuggugaauuauugacucuaccugcagucuuuaaugcuccaauuagaccagaugucgucaauuuuguacaucaaaacauagcaaaaaaucacaggcaaccuuaugcugucagugcugaagcaggucaucagacuucagcugaaucauggggaacugggcgagcuguggcucguauuccccguguaagggguggugguacccaccguucaggccagggugcauucgguaacauguguagagguggacguauguuugcucccaccaggguauggcgcagauggcaccgcaaggugaauguuaaucaaaagagguaugcaaugguaucugcuauugcugcuacuggaguuccagcucucguuauguccaaagggcacaugguuaacgaaguuccggaaaucccucuuguuguuacugauaagauccaagaguauacuaaaaccaagcaggccacaaucuuuuuacaucguaucaaggccuggucugauauucagaaggucuacaaaucuaaaagauuccgugcugguaaagguaagaugcguaauaggagacgcauucagcguagaggaccacucaucaucuaugggcaagaucaaggucuaacucgugcuuuccguaacauuccugguguugaucuuaucaacguuucacgguugaacuugcuuaagcuggcaccugguggucauguuggaagguuugugaucuggacccaaucagcuuuugaucaacuuaacgcucucuauggcacauggaagaaaaaaucaacuuugaaaaaggacuacaacuugccuaugcccaagaugguuaauacugaccugucuaggcuguucaagucugaagaaaucaagaguguccuuaaagcaccaaggaagaccauaguuaggaggguuaggaaacuaaacccauugaggaacacucgagcaaugcucaagcucaauccauucgcugcaguucugaagaggaaagccauacuugcugauaggaaacuuaagcuugagagggcuauugagagaucaaagaaggaaggaauugagcuuaccccucaucaaaagagguauguugcuaugcucgagcgaaggaaagcucagaucaaagcugcuaaggcugcuaagccuaaaaaggucaagaaaccaaaagcugaaaaaacugaagcugcugaagcaaagaaagcuaguguaacuaaaaaaccagcaaaaaaggcaacaacagcugcugcucccaaaccugccaaaaaauga

SEQ ID NO: 7087 - RNA, 5460 nt, Piezodorus guildinii
auggcagauuucauagauucugaagccgaagaaagugaggaugaggaagaguuggaaguucaugagaaaaagaaguugaaacgguugaaggcgauggaaagugaugaagacgaggaagaagaagaugaugaggaacgucuuagagaagaauuaaaagauuuaauugaugacaacccuauagaagaagaaagugaaagugaugauggcaguggaucugaagaaggaaguggggaagaucggggaggggaaaaacguaagaagcaugaugaagauuuugaugaccgucuugaagaugaggauuaugauuuauuggaagaaaaucuggggcgaaagguugaaagaaggaaaagguuuaaaagauugagaagaauugaagaugaagagucagauggcgagggagcugaagaugagggugaagugagggaagcuauagccaaugaacuuuuugaaggaucagaucaugaagaagaccggagcucuucuagaggcccggcagcacccgagagguaugaagaugaggaggaagauggugaauauucagaugcugaugauuuuauuguggaugaugaagguagaccuauugcugacaaaaggaaaaagaggaaaccuauauucaccgaugcugcuuugcaagaagcucaggauauauuuggaguugauuuugauuaugaagauuuugaaagacuuggggaggaugaauaugaagaagaggaagaugaagaugaguauguugaugaagaaggcauugaagauagugaaaggagacguaaaccuacaaagaaggcugcuagaaagaagccaacaaggaaaucaaucuuugaaauuuaugaaccuagugaauugaagagaggucauuuuaccgauuuugacaacaaaguucggaauacagauauuccugaacgaaugcaacuuagagaaaucccugugacaccaguuccagaaggcucugaugagcuuucugaagaagcugaauggauuuauaaacaagccuuuugcaaaccuacaacauccaaccaggaauggggcaacacgauggagagaggaaaaccgaagaaggaaccucaaacaguggagaagaucaaaaaagcucuugauuuuaugagaaaucaaaacuuugaaguuccuuucauagcauuuuauaggaaagaauauguucucccggaacuuaacaucaaugaucucuggaggguauucaaauaugaugccaaguggugccaguuaagaagcagaaaaaugacuuuacuuucauuaauggaaaaaaugagggacuaccaggcugaacagcugaugaaggauauagaugcacccauuccagaccaugucagggucauuaaagaugaugauauugaaagguuaaaagcuguacagaccacugaggaauuaaaagauguucauucccauuuuuugauguauuaugccgaugaagugaaaauaauguuagaagcuacaagaguuaaggaacgggaagcagcuaaagcaaaagcuaggcaagagaagcagguagaugaaaauggugauccaaucgaaacagaaguagaggaacaagaggaaccuccuccuccugaaauaccagcaguaaaacauucuauacguucuggaccguaugcuauaugccguaaagcuggaauaggugguuuggcuaaacgauuugguuugaaaccugaacaguuugcugaaaaccuuagggauaauuaucagcgccaugauguugaacaggaaccaucuuuaccuauugaauuggccaaagaauuuguuucaucaaaauuucaaucaccagaagauguuuuaaaagcugcaaaguuuaugguugcuacacaacugaguagagaaccucuuguucggcguuguaugcgggauacauuuuuugaaaaagcaaaaauugauguuaaaccuaccaaaaagggaucaaaggaaguugaugaaaaucauccuuguuaugucaugaaauacaugaaaggaaagccuguaagagauuuaaccgcugaccaauaucugaagcugcauauagcucaucaagauaagcuuuugaacguuagcaucagugaucauauuggaggucauacaacgacauccuauauugaggaaauuaagcaacucuacuaccgggaugaguuuaugcaacauguacaagaauggaauaauauccgucaagaauguguugauguugcgauuaagaagauguugauuccagaacugauaaaggaacuccauacucgucuucuugaagaagcuaaagaauuugucuugagaucaugugcuaggaaaguuuacaauuggauuaagguggcuccauuuuccguugaauuuggagaugaugaugaagaugauugggacaccagcaaggguauucgugucauggggguugcguaugugccugauuuagcgcaggcuucuuuugcuugcauggucgcuccugauggugaauguacugauuuucuuaggcugccccaucugcuuaaaagaaaaaauacuuggcgagaagaugaaagaaugcaaaaggaaucagauuuagcacugauacgaaauuuuauauugaccaaaaaaccucaugcuguugucauuggaggagaaucaagagaugcucuuaugguggcagcagaucuaagagaaauaauauccaauuugguugaagaugaacaguuuccucaaauuccuguugaaauuauggauaaugauuuggcaaaaguuuaugccaacucauugaaaggagagagugauuuucgagauuacccaauguuacugagacaagcuguuucacucgcucgaagauugcaggauccauuaguggaauuuucccagcuaugcacuccagaugacgaaauucuuugucuuagauuucauccuuuacaagaacaguuaucuaaagaagagcuccuugauguuguuacauuggaauuuguuaaucgaacuaaugaaguuggugucgauauaaaugaaguagucgcaaauccgauuuguggaaacuugguucaguuuguuuguggucucgggccaaggaaagggacuacgcuuaucaaaauuuuaaagcaaaccaaucagcggcuugaaaacagaacucagcucguuacuacaugccauaugggaccuaaaguuuuuauuaauugugcaggauucauuaaaauugauaccaaugcucucggcgacaguaccgaagcuuacguagagguauuagaugguucucguguucacccugaaacuuaugagugggcucguaagauggcuguagaugcucuugaauaugaugaugaggaugccaauccugccggugcuuuggaggagauucuagaaaagccugaaaaacuuaaagaucuagaucuagaugcauuugcugaggaguuggagagacagaguuuugguaacaagagcauuacucuuuaugacaucaggucggaacucaaccauagauauaaagaucuuagaguuccuuaucaaucuccuggacccgaguugauguuugacaugcucacuaaagaaacuccugaaacauucuacauuggaaaacuugucaccgcaacaguuauuggcauuucucauagaaaaccugaaaaagaucagcuugaucaagcuaacccgguacggaaugaugaaacuggucuguggcaguguccguuuugucugaaaaaugauuuuccugaauuaucagagguuuggaaucauuuugaugccggugguuguccuggccaagccacaggaguuagaauccgauuagauaacgggauuacugguuacauucacauuaagaauuugucagauaaacaugucacugauccagcucagagaguuacucguggucaaaugauucauugcaggguaacuaagauagagguagaaagguuuucaauugaagcuacuucaaaaucuucugaucuguuggauaagaaucaugauuggaggccacaaaaggauccuuauuaugaucaugaaagugaaaagaaagauuuacauacagaagaagaagccaaaaaaaauaggcaaaaacugacauauaucaaaagaguuaucguucacccugccuuucauaauauuucuuacauugaagcugaaaaaaucauggcuacaauggagcagggugaugucauuguaagaccuucaaguaagggugcugaccaucuaacuguuacuuggaaaguagcagauggcauuuaucaacauauagaugucagggaagagggcaaagaaaaugcuuuuucauugggucagucguuguggaucggcaaugaagaguuugaagauuuggaugaaauaauugcaaggcauguuaauccgauggcagcuuauguuagggauauguucgcauucaaguauuuaaaagauacagaaggaggccuuaaggauaaagcugaagaauuuuugaaagaagaaaagaaaaaaaauccagcaaaaauacauuacauuguuucuguauccaagaauuauccugguaaguuuuugcucuccuaucucccaagagcuagguguaaacaugaguacaucagcauaacaccuaauggauucaaguuuagaggacaguucuuugaaucugucaauucauuguucaagugguuuaaagaacauuucucggauccuauaccuggcacaccuaguacuccaagaucugcgaugucagcacgcacuccuuauacgaauacgccuggaccuaugccaauaaauaugaaugcugaagcaauacagcguguugcucaaaauaugccaaaucauaugcugcauagccuuucgcaaguugccagccauacuccucacuacccucauacuccuggagcauauucccuucaucaguauccagccacuccauauacuccguccggucaaacuccuuucaugacgccauacacaaccccaagauacgguagugguaugacaccuggccaccagaguauuaugucuucaggaucuauuacaucaccucaaaguucaacuccaggucagccuguuuuccuccauccuggcucuaucacaccuucccacaggacuccugucgcuaauuuccauagaccuggugggacucauccugaagauugggguaagaaagcagaagaauggguugcgaagaaaagagagaaugcuaguagaacaccuaggucaacuccaaauacuggcacuccacgccauggaacaccacgagaugaugccaauaagaaccgaacacccagguaugcugacaaugauuauaccucuccacgaccaggugcgaauuucacauccccaagauauuccaauuggaauaaaguugcuggcacuccuaauucacauauaucugcuuaugaagacgccaauuaugaugccaggagccucaaguccccacgcccuccaccugcccagggcaaguaugaucccuacgaacuuggccaaggaaaguccccucgguauucaaugacaccacguuccaccccucguaccaucaauucgccucguucuaugucacuaggugauucaacuccccuguaugacgagagcauuuag

SEQ ID NO: 7088 - RNA, 2304 nt, Piezodorus guildinii
auggaagaaucuaaagaacguaguaagaguuguaggaaacauggaagaaguagugaaaagacugaacauaaaucaaaaagugauaaagauuauuccgagagagaaaguaagaggaggcgaaaccacgauuaugauaaguaugauaaacauucaucaagagauagaaggcgugauucggaucguagaaauuaugaaaaauaugaaagauacuggggaaaagacaaagaagaggaucaucaugacagagauguuaaagcugacuauuuaguggguucaagguauuauaaagagaccccuaaacaugagccacaggugagaaaaucagagggugcuaauaaaaguaaggaaaauguuaauccauuggaaagugcugguaaagaaaagccagucaccagaaagaagaacgaugauaucauuacauccaggacuggaggugcuuacauacccccuggaaaacuuagauuaaugcaagccaguaucaccgauaaaucaagugccgaauaccaacguauagccugggaagcguugaagaaaucgauucauggucauauuaauaaagugaauacuuccaauauuggcguuguugccagauuguuauucaaggaaaacauaauucgaggcagaggucuacuuugcagaucgaucauacaagcucaaucugcgucuauuacauucacuaacguuuacgcuugucugguggcuauaguuaauucaaaguuuccaaguauaggagaacuauuacugaagagagugaucauucgguucaaacgagcauacaaaaggaaugauaaagcagucuguauuucuucggcuacuuuuauagcacaucuuaucaaucaggguguagcccaugaaauccuuggacuggaauuggucaccuuauuaguagaaaacccuacagaugauucgaucgaagucgcagucgcuuuuuuaaaagaagcaggucaaaaauuaagugaaguaaccagcaaaggcacuaacgcaauauucgauauguuaagaaauauucuucaugaaggcaaauuggaaaaaaggguacaauacaugauugaaguuauguuucaagugaggaaagaugauuuugcaacuuuuccaucgguaccggaagagcuagaccuuguugaugaagaagaucaguucacucacuugauuggucucgaugaugccauagauacccaagacauacuuaauguauucaagcuugauucggaauaucaagcgaacgaggaacguuauaaagaauugaggagcgaaauccucgauacugauuccgaggagagcgguucugaaggcgauagcaguggagaaggagaagacgaugauucugaugaggaagaugaagaaaagaaagucacaaucgucgauaacacagaaacgaacuugauaucgcugagaaaaacuauuuaccugacgauucaaucaagucuugacuuugaagaaugugcucauaagcuguugaaaauggaaaucaagccugggcaagagaaggaacucugucacauguuucuagauugcugcgcugagcagaggacuuacgaaaaguuuuuuggucuccuugcucaaagguucugccaaguuaauaauacuuacauagcacccuucgaacagauauucgcugacacauauucgaccguucaucguuuggacacgaacagguugcgaaacguagcaaaauuauucgcacaccuucucuucacggaugccauuucuugggcuguacuuucuaauauucgacucaacgaagaagauaccacaaguucgagccgaauuuucauuaaaauuuuauuucaagagcuaucugaauauaugggcuuagcgaaccucaaugccaggcuaaaggacccaacucuucaaucugcaauggaaggucuauucccaagagacaauccaaaaaacacaagauuugcgauaaacuuuuucacaucuauaggucuugguggucugacugaugaauugagggagcauuuaaaaaauuuaccuaaaucaaucccuguggcacaacucauucaggaauugucuucugaaucauccucuucuucugaaucgucaucuucuucuucuuccuccgaaagugagucaucaucgucuagcgauucaucagaggaagaacgaagaaaaacggccaaaaggaaaaagaggccaaauguuucaaaggaggauucaaauaagaaaaaagaaagaaaacgaggaaacucacaggaaaaucaucgaucgaccaaagaaaccaagaacaagacuccagagaagaagagaaaacaucagagagaggaaaaacaccauucucgaaaaucgaaaaggaaauaa

SEQ ID NO: 7089 - RNA, 1758 nt, Piezodorus guildinii
auggcgcuuaaggcucucguuggucaaaaaauuaugaacgaugcgaucaggcaaaagaagaaagggaaagagguggaguggaggguccucgugguggaucaguuagcgaugcggaugaucucagccugcuguaaaaugcaugaaauuucugcugagggauugaccauuguagaagacauaaauaaaaagagggagccacuuccaacgauggaagcugucuauuuaauaacaccaagugaaaaaucuguccacgcuuugaugaacgauuucgccucaccaaaucguaucauguacaaagcagcucaugucuauuucacagaagcgugcccaaacgcuuuauuugacacccuuugucaugcgagacucgcuaaauuuauaaagacauugaaggagauaaauauagcguuuauuccguacgagcaacagguguucucucuagacgcuccugaaacauuccagugcuucuacaauccaucauugagcaacagccgacucgcaaauauggagcgaauugcagaacagaucgcaacguugugugccacgcuuggugaauacccaucugucagauacaggagugauuuugauaaaaacguagagcuagcccagauaguacagcagaagcuggaugccuauaaagcugacgagccuacgaugggggaagggccagagaagucucgcucgcagcugcugauccuggaccgaggcuucgacgcugucuccccacuccuccacgagcucacccuccaggcgauggccuacgaucuccuuccuaucgagaacgauguuuacaaguaugaagcuacagcuggagcuccagaaaaagaaguguuguuggaugaaaaugacgaacuguggguagagcuacgccaucaacauauugcuguaguaucacagaaugucacaaagaaucuaaagaaguucacagagucuaagcggaugccacaaggagacaagcagucgaugagggaccugagccagaugaucaaaaagaugccgcaauaucaaaaagagcucagcaaauauuccacucauuugcaccucgcggaagauugcaugaacgcuuaccaaggccauguugauaagcucugcaagguugaacaggaccuagcgauggguaccgaugcugaaggagagcguaucaaggaccacaugaggaacaucgucccgauccuccucgaccagucggucuccaacuacgacaagaugaggaucauccuccucuacacccucuccaagaacgguauuuccgaggagaacuugaacaagcucguccagcaugcucagauucagccgcacgagaagcaggccauugucaaccuuggcaaucuuggucucaauguugucguugaugguacucguaucaagaagccauacgugccuccuaggaaagagcguaucaccgagcagacuuaccagaugucacguuggacgcccgugaucaaggaucuuauggaagauugcauugacgacaagcucgaccucaagcacuuccccuuccuugccgggagggcugcgucuucaggauaccacgcuccugccagcgugcgauacggacacuggcacaaagacaagggccagcagaccgucaagaacgugccucgcaucaucgucuucaucaucgguggcaugagcuucucagagauccgaugugccuacgaaguuaccaacgcaguuaaaaacugggaggucauaauugguucuucgcacauccugaccccugaagacuuccucaguaaccucgccaacuugagcaacuag

SEQ ID NO: 7090 - RNA, 2208 nt, Piezodorus guildinii
auaaccugguuauguuauuauuuugauuuagcaggguuaaauucuacucuuuucauaaugaugcaacaauauaugaaagaauuggaacaagaucccuauaguuaugaagauuucguugaacguuuagcuuggagaacuguugauggcuucaaggaagauggaauucauggauuugauccaaauuuaaugcacgaaacauuucuccaagcaauuaaggauuugcagguucugcuagaucgucaguguaaaaaaugugaaaaacuugaacugauuugcaaggaagaagaagccaaucauuuccaagauauaucccauuugcaggacaaaaauaaggaagcuguugcuuuauuucaagauuuggaugaaagaauaaauuuuguugcuacuaaaguuauacauuuaggggaucaguuagaaaguguuaauguucccagaucuagagcuguugaggcacaaaggcugaugacauauuuuagugaauuucuuagcccuggaccuguucucgcuaguguuuuuucaaauaaagaagagguauuugaagcugcugauauuauacagaagcuucauaugaucucacaagaacuuccuucugauaaauuuaaagaugcaagaucaaaaauaaguuuaaaauaugaugaaauugaaagaucguuaauugaagaauucgugaagucacauaggguucaugaaacaagcagaaugaaagaaauugcaaauauucuuaugcauuucaagucuuacucacaguguauugaugcauuuauugaagaaagucaaaugggaacauuugcuggaaaagauauuuuuaaggaaauauuaccucuuacaaaaaaaaauuuuaacaucaugaaagaaguuuuuagcaacccugaacaaguuauggcuaaauuuguuuugaauauuuaccacuuaaaacugcagaaacauauuguaagcaaccuuucugacaagucugauucuaauaaauaucuaagaaacuuaauggaauuauauacuaggacuacugagcuaucuguugaauugaguuguuuuaaaauggggucugaugauucauaucuucaaaagcuaacucauaccauauuucaaaaauauuuagaaucauacauuaguguagaaguuaagggcuugaaggaaaaaugcucaacauuauuacaaaaauauuaugauucuaaagaucaccacaaacgacaaauacagucuggaggauuccaagauuuuagacgugaucuucaagcugugauuggcacaagggcuaacauuaauauugcucaaauugaagauuacggaggagaaacauuuuuaucugaagaauuaguuauaagucugauacaagaguccaagcaggcauuuuacagauguaaauugcucucuaaaccugcagacuuagcaaguaaugcaguucaguuguuagaaguucuauuaaauuguauuauaauugaucauguugauuaugcuguagaauuagcuuuacaagcaguaccaauuccugaaaguaaaacacaggcucagccaauuuauuucuuugauguuguaagacagacaaauacaauugugcaucugguugaaaaacacuucaacgauucugcacuuccuuuaguaaugucaacuucuaagcauggagaauguguaaugaaaaaaaaauuccuacugaaccauuuagaacagaaacuugacaauggcaucgaucgggcucugaaugcuauaguuggauggguaaaaguuuuucuucagucugagcagaaaaagaccgauuucaaaccugaaacugaauugaauacauuaucauccccugcuuguauagcugugguggaauacuuuaaugauaaugucaaacacaucagaucuugucuggauggcagaaauauugaauguguaaugacagaauuggguugucguuuucauagaguaauuuaugaccauuugcaacaguuucaauacaauucaacaggugcacuuugugugauaugcgacaugaaugaauauagaaaaugugugaaagaacuuaauucugucuugguuaauacuuuguuugauacuuuacaugcucuuugcaauguucuacuagugaaaccugaaaaccuugaucaagugugcacuggugaucaguugucucucuuagaucguucugucguuuuaaauuuuauccaguugagaaaugauuacaagacucagaaguuaucaaauuuucugaaaggaaugucugcuuga

SEQ ID NO: 7091 - RNA, 831 nt, Piezodorus guildinii
auggauuuccaaaaucgaccuggagguaaaacaggaagugguggcguagcaucauggucagagacaaaucgggaccgaagagagaggcugaggcaacuagcucuugagacuaucgauauaaacaaggauccguauuuuaugaaaaaucauuuagguucuuaugaauguaagcuaugucucacccugcauaauaaugagggaaguuauuuagcccacacucaaggaaagaaacaucaagcaaacuuagcgagaagagcagcgaaagaagcuaaagauucuccacaacaaccagcaccagauaaaccaagaauagaaccaaaaaaguuuguaaaaauugguagaccugguuaucgaguuacuaaacaaagagauccugaaacaggccagcaaagucuucuuuaucaaguagauuauccagaaauugcagaaggaaucuuaccuaggcaucguuuuaugucagcuuaugaacaaagaguggaaccuccagacaggaaauggcaauaucuucuguuugcugcugaaccuuaugaaacgauagccuuuaaggugccuagccgugaaguagacaagucugaaaacaaguuuuggacucauuggaacaaggacacaaaacaauuuuuccuccaguuugcauuuaagaaugaaccacuugcuccuccuaugggugcaccccacuuaggucaaaugagaccuccgcacauguuaccaccaccuaugagugugccuccaccaccaauguucaauccuguuccaccucccccuccuaaucuaaugcuugcaccuccaccuccaccugcaccgcucccaccuccuccucaaccuaugaaauaa

SEQ ID NO: 7092 - RNA, 495 nt, Piezodorus guildinii
gaggauaauaugaacugcuggggcauuagucguucaugcggcguuaguccuguuuguaaccucuuguuguuuucgaguuguguuuucaucauguccaucgguguuccuaucaaaguuuugcacgaggccgaagggcacaucgucaccugcgagaccaagacuggagaagucuacaggggaaagcucauagaagcggaggauaauaugaacugccagaugaccgguuugacuguuaccuaccgcgauggacgaguagcucaauuggaaaacgucuucaucagaggguccaaaauacgcuuucugauauuaccggacauguugaaaaacgcgccuauguucaaaaaacaagggaauaaaggcaauacgggcgcugguagagguaaaucggcgauacugagagcucaagcagccaggggcagagguucacagacgagaggaggugcuaccucaucaagaccuucguggcaaggagggucuaaucagucgaggaaauag

SEQ ID NO: 7093 - RNA, 1464 nt, Piezodorus guildinii
uggccaccaggucaccgcucagggcccccccccgggcccccccccacggcgggcccuuuuuuuuuuuuuuuuuuuuuuucucucuuucugauaucccaauucucacugauauucugcagccugaaguuuaaguuuuaucaaauggcuucaaguguuucaaaagucccccuucugcagacauuagcgaagagaacauucgcagcugcugcggcuccuaaagcugcuggauguaaagcuacuguugaaguuucuacucuuccgaauaaggcuauugucacuucuuugggguguggaccuaaacccuuuguacaaguagcuguagcauucagagcuggaagucguaaugaauguucugaaaacuauggagcaagucaccuucugaggagcucugcuggucuuagcacuuguggugcaucuucauucuacauuugucgcaguuugcaacaaauuggugcuagccuaacugccacuucugaccgugaaacgauuguuuauguccuggaaucuucugcuagcaagauaaaugaaggccuugauauuuugaagaaggcuauuacuggucaagaguucaggcccugggaacuuuccgacaauguuucucgaaucaaaguagaauuggcaucacuaccuccacaagcuaaagugaucgauuugauucauacagcugcauuuaggaguggacucggaaauucuauuuuuguuaaagaauucaacauaaaaaaacuuagcagugaaacgcuuaaacauuaugcugcuaccuauuuaacuggagacaaagcaguuauuggugguuguggauuaccucauuccagauugagucauuuugcugauuccuugggacuuugugcuggaagugucggugcaaucccagcaucuaaguauagagguggcgaaaucaggguugaggaaaacauuccgcuccaucauaccaucauugcugcugaagcaccaagcuuagauaaaagcgaggccuuggccuacgcuguucugagauacgcccuuggaacuggcccuucagucuaccgcggaacaggauccgggccacuugccaaagucucuggccaccaggucaccgcucaggcccucuccauggcucacucagaugcuggucucuuuggcauuuauguuucuucuccagguuauugcgccaaggagguuguugaaggagcagugaaagugcugaaggguggagucacugaucaagauguugcacgggguaaagcacaguuaaaagcagcuuuauuauauuccagcgaaucuugccguggauuaguggaugaucuuguugggcaggcuuugcuuauccaaggggcuccucccaagacuaccgcugaccuggccgaagagguuucuucuguuacuacucagcagguccagcaggcauuacaaaagguccaaucuggaaagaaaucaauugcuucugucgguaguguuggcaaaguaccauauuuagaugaauuguaa

SEQ ID NO: 7094 - RNA, 339 nt, Piezodorus guildinii
augaggcgggcucauggcaacuauuaccaaccuguuccuacguucgacgggccuagcgguucccucgaagaggaaaaugaucagaugaccaacaaacugaaagauaaaauaacugcuuugaagcaccugucgaucgacaucggugcggaagugaaguaucaggauaagaugcuucauggcaugucggaagacuuugaucguaccggaggcuuuuuaggaaauaccaugaauagaguuuuacgucugaccaaaggaagucacaauuauuauauuuuguaccuuuuuauauuuucuaucguuguuuuuuuuguacuguacauaguauuaaaauuuagauaa

SEQ ID NO: 7095 - RNA, 1491 nt, Piezodorus guildinii
auggcuauaucuucgagucaagcuguuaaggaacauguuuuggcuguuucaagagauuuugucucucagccaagauugacauacaaaacugugucuggaguaaauggacccuuaguaauuuuagaugaaguuaaauuuccaaaauauaaugaaauuguucagcugagacuugcugauggaacauuacggucuggccagguuuuggaagucagugguuccaaagcuguuguucagguuuuugaagguacuucugguauugaugcaaaaaacacaauaugugaguucacuggagauauucuucggacuccaguguccgaagauaugcuuggacgagucuucaaugggaguggaaaacccauugacaagggaccuccaauucuagcugaagauuauuuggauauucaaggccaaccuauuaauccuuggucucguaucuacccugaggaaaugauacagacugguaucucugcaauagauguuaugaacucaauugcuagaggacaaaaaauucccaucuuuucagcugcugguuugccucacaaugaaauugcagcucagauuugucgacaagcugguuuaguaaaauugccugguaaaucuguucuugaugaucaagaagauaauuuugccauaguguuugcagcuaugggaguuaacauggaaacugcccgauuuuucaagcaagauuuugaggaaaauggcuccauggagaauguuuguuuguuuuugaacuuggcuaaugacccuacuauugaacguauuaucacaccucgucucgcucugacugcugcugaauuucuugcuuaucaaugugagaaacacguuuugguuauauuaacggauaugucuucuuaugcagaggcccuucgagagguaucggcugccagggaagagguaccugguagaagagguuucccagguuacauguacacugaucuggccaccauuuaugagagggcugggcguguugaaggcagaaauggaaguauuacucaaauuccaauucuuacuaugcccaacgaugauaucacucacccuauuccugauuugacggguuauauuacugagggccaaaucuacguugaccgucaauugcacaacagacagauuuacccgccaauuaauguacuaccaucacugucccguuugaugaaaucggccauuggcgagggaaugacccgaaaggaccauucagaugucucaaaucaauuguaugccugcuaugcuauugguaaagaugugcaagccaugaaagcuguugugggagaagaagcucuaacuccugaugaucuucucuauuuagaguucuugacaaaauucgaaaagaacuucauuucacaagguacuuaugaaaacagaacaguuuuugaaucauuagauauuggcuggcaacugcugcguauauuccccaaggaaauguuaaagaggauuccagcaucuacauuggcagaguucuaucccagggacucaaggcauacaaccaccaaauag

SEQ ID NO: 7096 - RNA, 2229 nt, Piezodorus guildinii
augaugcaacaagcucaaaguaggccaaugucccauggaaacuaucagggugggccagauuugcccaugggcucugucaaagaccagacccucauguggcaacagagcucauauuugggugauucagggauucauucaggugcaaccaccacagcuccuucacugucaggcaaagaagaagagauguauggcgaucaagacauguuugaccuggaucaaggauuuacucaggguuuuacccaagagcaagucgaugaaaugaaucaacaacucucucagacaaggucccagagaguucgagcugcaauguuuccugagacauuagaagaagguauagaaauuccaucuacacaguuugaccaggcucaagccacggcaguucaaagacuagcugaaccaagccaaaugcuaaaacaugcuguuguuaaucucaucaauuaucaggacgaugcugaccuagccacccgugcuauuccugaauugauuaagcugcucaaugaugaggaucaaguagugguuucacaggcugcuaugaugguacaccagcugucgaaaaaggaagccucucgccaugccaucaugaauaguccucaaaugguugaagcuuuggugagagcauuaucaaacaguaacgacuuggaaacuaccaaaggagcuguaggaacauuacacaauuugucucaucacaggcaaggucucuuggcuauuuucaaaagugguggaauuccagcucuggugaagcuuuugaguuccccaguagaaucgguucuuuucuaugcaauuaccacuuugcacaaccuccuucuucaucaagaaggaaguaagacggcugugcgaguugcuggaggauugcaaaagaugguuguuuugcuccaacgaaauaaugugaaguucuuagccauugugaccgacugucuccaaauucuagcuuauggcaaucaggaaaguaagcuaauuauuuuggcaucucaggguccuauugagcuagugcggaucaugaggaguuaugauuaugaaaagcuccuuuggacaacaucaagaguacuuaaaguuuugucugucugcucgagcaauaaaccagcaauaguugaagccggagguuuaccugcucuggcaaugcaccuggggcauccaucacagcgacuuguucagaacugccuuuggacccucagaaaucuuucagaugcugggaccaaaguugguggcuuagaagggcuucuccaaucgcuugugcaacuuuuggauucuucugauauuaauaucguuacuugugcagcugguauccuaucaaauuugacuugcaauaaccaaaggaacaaggugacugugugccagguugguggugucgaugcucuaguccgcacuauuauaucagcuggagauagagaagaaauuacugaaccugcuguuugcgcuuugaggcaucugacuucucgccauauggagagugagcuagcccagaaugcuguccgccucaacuauggcuugcaagugauugucaaguuguuacaccccccaucaagauggccucuagucaaagcuguuauugguuugauuagaaaccuugcuuugugucaggcuaaccacacaccacuuagggaccauggugcgauacaccacuugaucaggcuccuaaugcaagcauuccaggauacacagaggagauccaguguuacgaguggaggaacacaaucagguggaauuuaugcugacggugugcgcauggaggagauaguggaaggcacugugggugcucuucauaucuuggcaagggagagccacaacagagcuaucaucaggggucagaugguuauaccgauuuucguacagcuucuuuuugaugagauagagaauauucaacggguugcugcuggugugcuuugugagcuugcgcaagacaaggaaggugccgagcuuauagaacaagaaggugcuacagcuccucuuacagaauuacuccacucucgaaaugaagguguugcuacuuaugcugcugcaguccucuucaggauguccgaagauaaaccucaggauuacaaaaagagacuuucgauggagcuuacuaacucccucuuuagggaggaucagaauuuguggaauggugauuuaggaauggcuccugacuuacaggauaugcugggagagcaaaauuaugacaccauguacucucaugggccgccuaguguacauaguagucacggugguaggggauaucagccagggcucuga

SEQ ID NO: 7097 - RNA, 735 nt, Piezodorus guildinii
auggcccgaaaugcugagaaggcuaugacuacuuuagcucgauggcgagcugcucaguuaggagaaggcgaucaagccaaacaaagaagacccuacuuagcaucugaauguacugaucuucaacaagcugagaaauggagaaugcaaaucauuagagaaauagcucguaaaguuucucaaauucagaaugcuggucuuggugaauuuagaauucgugauuugaaugaugaaaucaauaaacuacugcgagaaaaaggacauugggaagcucaaauucgagaacuugguggcccagaccacuccaggucugggccaaaaaugcuggaugcugaagggaaagaagugccaggcaauagggguuacaaauacuuuggugcagcaagacaacuuccuggagucagagaguuguucgagcaggcuccaccuccaccuccacauaaaacgcguggcgagcuaaugagagauauugaugcuucuuauuaugguuauauggaugaugaagacggaaucauuauaccacuugaagaaauugaggaaaccaaagcuauuaaaaaagcuguagcagaauggacuguuaagaaagaaaagucaauggaaauggaugaagaugagaaagaagaagucgaagaggauaacaucuacaaagcugcaggaaacaaagagggugaugaagaugaugaugaugaugaugaagaggcaggagaagaagauggguuugaacugagugcuaaguua

SEQ ID NO: 7098 - RNA, 645 nt, Piezodorus guildinii
auggaagaggcugauguuccaucauuuaaauguguacuuguuggugauggugguacuggcaagacaacauuugucaaacgccauuuaacuggugaauuugaaaagaaguauguugcuacauuagggguugaagugcauccuuuaguuuuccacacaaaccgaggcccuauccguuuuaauguuugggacacagcagggcaggaaaaguuugguggacuuagggauggauacuacauucagggucaaugugcuauuauuauguuugauguuacuucaaggguaacuuacaagagugucccuaacuggcaucgagauuuagugcgugugugugaaaacauucccauuguacuuuguggaaauaaaguagacauuaaggauagaaaagugaaagccaaaagcauuguuuuccacaggaagaagaaccuucaauacuaugacaucagugcuaagaguaacuacaacuucgaaaagccuuuccuguggcuggcuaggaaacucaucggugauccaaaucuugaauuuguugcuaugccugcauuguugcccccugaagucaacauggauccugaauggcgugaccagauugaaaaggaucuucaggaggcacaagacacagcacuuccugaagaugaugaggaccuguaa

SEQ ID NO: 7099 - RNA, 531 nt, Piezodorus guildinii
uuuuuuuuuuuuuuuuuuuuuuuuuuuggugaggugaaaaaaacuauuaacauggauauccaaaccauugcaacgauauuuauuaaaguuuuaaaacuuguaaucaauuuuaucauuuugaugcucuaccgcuaugguggaaaacaaggauuucucggaguugguggaacauggaacuuguaugaaguuaaaagugcugaugcugaaauuauugcaucuggaguuuuugugggauuuuuuauauauacaucuguaauccuuauuucauacugcuuuggaacaaccaaacacaaauauagugcaguagauauuauaaugaacgugagcggaaccauauuguucacagcaguuggagggauagcuuuacacuauuggguuggcuuccaggaugaaaaucauuacgugggaaucucucaagaaaagcaaauaggacuugcguugggcagucuuagcguaguuugcgcagcuauuuaccuucuugauacaguuuuaucuuguauacauaucgcgcauaagcacgcgaucgcuuaa

SEQ ID NO: 7100 - RNA, 2337 nt, Piezodorus guildinii
augccgcgaauuaugauaaaagguggugucuggagaaacacugaggaugaaauucuuaaagcugcuguuaugaaauauggaaaaaaccaauggucucgaauagcuucuuuauuacacagaaagucugcgaaacaaugcaaagcuaggugguuugaauggcuugauccaagcauuaagaaaacagaguggaguagagaagaagaugagaaauuguugcaucuugcaaaguuaaugccuacucaauggcgaaccauugcaccaauuauaggacgaacugcagcacaaugcuuagaaagauacgaauauuuacuagaucaagcccaaaaaaaagaagaaggagaagauggagcugacgauccuagaaaguuaaaacccggagagauagaucccaauccagaaaccaaaccugcucguccagauccuaaggauauggaugaagaugaauuggaaauguugucugaggcaagagcuagauuagccaacacccaagguaaaaaagcaaagaggaaagcgagagagaaacaauuggaagaagcaagacgauuagcugcuuugcagaaaaggcgagaauugagagcugcuggaauugaauaugcagcacgucauaaacguaaaagaggcauugauuauaaugcugaaguuccauuugagaagaaaccugcugccgguuuuuacgauacuaguaaugaagcuaucgauccucaugcaccuaauuuuaauaggcuucgucagcaaaauuuagauggugagcuucgcagugaaaaagaagaacgagaacggagaaaagacaaacaaaaaauaaagcagaggaaagaaaaugacaugccucuagcgaugcugcaaaaucaagagccagccaagaaaagaaguaaacuugucuugccucagccucagauaucugaucaggaacugcaacaaguagugaaauugggaagagcuaguuacgcugcucgggaagcagugacagaaggcucugaaagugcuucagacacucuccucaaugauuaugcuuuagcuacacccaaugcuggcuccacuccucguacgccugcaccuacuacugacaggauacuucaagaagcccaaaauaugauggcauugagccacguagauacuccgcuaaaaggagguuugaauacaccucuuuacaacucagaguuuaguguucauccaccagcagagcagaucacaacaccaaacacuguucuaacuacuccguuuuccaaucgaacucaugaaggaaggacuccaggcuuucaaaccccgcaggacgugaggaacagccugaccacuccugucagagauaaguuaaacaucaacccagaggaagguggugauacacccuaugcaccuguaaauaaucaaaaacaggcgaaggaggaacuugcugcucgccucaggucacuaccccagccgaagaacgauuaugaaauugugguucccgaagaugaaguuucaucggaaacgacugcagagggugcugguuugccaaguguugaagaucaagcugauauugaugcuagaaauuugaguauucucgcucaacaacgugaaaaagaauugaagaguagaucgcagguaauucagcgagcuuugccccgaccuggagauaucaacauaguauuacguccagcuaauacagauccaccuuuaacagaacuucagaaggcugaagagaugauaaaagaagaaaugauaacgaugcuacauuacgaugcggugcauagcggugaaccuccuuccucgaggaaaauaggaaccgugagucaggcgcagcaccuagccuaucucgagcaacacccuuaccacaccuauucagaagaucagaucgaaaaggcaaaagaaaugcugaaagcagaaauggagguugucaaacaaggaaugaaucauggugaucugucgcuggaaaccuuuacacaaguuugggaagaauguuuagcucagguauuauauuugccaaaucaaaauagauacaccagagcaaauuuagcuaguaaaaaagaccgucuggaaucaguggaaaaaaggcuagaacaaaauaggacacacaugacucgggaggccaaaagagcagccaaaauggaacgaaaaauuaaaauuaucaccgguggauaucagacuagagcucaagcgcugauuaagcaacuucaggauuuagcugacgaaaccgacaaggcucacauggagcugucgacguucaagcugcuucagcagcaagaagaaagugcuaucccuaaaagaauagagucaauaucagaagacgucaacaggcagcuugaaagagaaaagagcuuacagaaaagguuuagccaacuucagcugguaucgcaaucguag

SEQ ID NO: 7101 - RNA, 474 nt, Piezodorus guildinii
augaugcaauuuaugcuuuuauuuagucgucaaggaaaauugcgauuacaaaagugguauguugcacauccugauaaacugaagaaaaaaauuacaagagaguuaauuacaaccauuuuggcuaggaaaccuaaaauguguagcuuuuuggaauggaaagauuuaaaaauaguguauaaaagguaugcuaguuuauauuuuuguugugcuauagagcaaaacgauaaugaacugcuuacauuagaagugauucaucguuauguugaacuucuugacaaauacuucggaaguguuugugaguuggauauuauauucaacuuugagaaagcauacuucauucuagaugaacuguuacucggaggagagauucaggaaacaagcaaaaagaacguccugaaagcuauagcugcucaggaucuccuucaggaggaagaaacuccacaaggauuuuuugaagaucauggucuuggauaa

SEQ ID NO: 7102 - RNA, 1311 nt, Piezodorus guildinii
auguccuacagcauaguucucagucgguugaguagauuuccauuaaucucuuacucaagaggauauaauaucgcaggucacaaugugaaaaaucauucagugaguuucagauauuacucaucuagugggagaaggccuaauuuuuucucucaauuuauagaaaauguuaggcaagacuuggccaaaaguaaagagaugaaagaaaguuugaaaaaguuuagagaagaggcacaaaaauuggagcagucagaagcauuacagaaagcaagagccaaguuucaaacuguugaaucagaagcaucaaaagguggugaaguuuuuagggaaaaacuagaccacaucaaagauaaagucagugauguucuggaggaagcagcaaaaucggaaauuggaaaaaaagcagggcagcuuggagccgaaauuggaaagacugcuagaggagcugcagaaacauugucagaaacaggacaacagauaggaaaaaguggagcauuucaaaccauuagucaaacugcagcagcugugaaacaggaauuagaucaaacuggaauccacgcucauguuuaccagccuccacgaaaacuaaggagaaggguggaaauaaugccagauaacaaagcauugaaaccugacacagaaacauuggguauugaucuucauaaagacucaaaauuuuuccaaaguuggcaacaauuuaaagacaauaaugcuuauaucaacaaaguucuugauuggaaaaugaaauaugaugagagugauaauccugucauucgggcaucucgaguauucacugauaaaguuucaaguguuauggguggccuuuuucagaaaacagaacuuuccgaaacucugacugagauauguagaauagauccgaauuucgacagagcucaguuuuugaaagauugugagaaagauaucaucccaaauauucuugaagcaaugguucguggagauuuagacauauuacaagauuggugucaugaagguccauauaauguucuugcugcuccaauuaaacaagcaaaagaagcccacuuucaauuuuguucuaaaauuuuagauauugauaauguugaucugguaauggguaaaguuauggaccaaggaccaguguuaguuauuaguuuccaaucucagcaauuacuguguaucaaagauaaaaaugguaauauaguugaaggugauccaaacaaaguuuuaagaguuaauuauguuuggguucuuuguagagauccaucugaacuggacccgaaagcagcauggcgucuuuuggauaugucagcacaaagcacugaacaguuguuauga

SEQ ID NO: 7103 - RNA, 903 nt, Piezodorus guildinii
augacaaggccgacucuaagagagcuucaauuagaggagcuugaaaauuaugaagcggagacggauucagauacugaggcauugcaagaagcuuuugcccgaggggaucucaagcccggucuuaauauaccagucaaagauagacccaggacaaacaauguuccucuucugauggaagcauuaagugaaauuaagcaggaacuaccuuggaucgaaagauuagauguuacgaaugaucaggcacccuuggccccagaacuugcccuccagaucagggaugaagaaaaaggucauaauccguugguguacgaugaguugaagagagaaaguguauucuacaggcaggcucagaaugcugcuuuaaaaguccuaccgcagcugaaacaguuaggccuuagaacugaaagaccaggagacuauuucgccgaaauggcuaagucagaucaacauaugcaaaagguuaaaggugaagcuaucaagaagaaacuuaugauggaaaggauugaaaaauugagagaaauacgagcgcagaagaaaguccaaaaagcucuccaugcucaagcuaaagucgccaaaguacagaguaagaagcaaaugcuagaugaggugaagaaguacaggaaaggggagaccaaaagcuuagcuuuccucgaaccuggcuacaagccaaaacccaaagccaauaaaucccaaauaaaacgacaacacaagaaugccaaauucggccaugguggaaagaaaagaggagcuaagcgaaacaccagagacagcacgagcggaauugaaaggcgcccgagcaaaccauccuucgccaauucagcaggaaaggggaaaaagguuaugaagcaaaaaaggccggguaaaaaugcucgacuaaaacagaaaucuaagagaaagaauuaa

SEQ ID NO: 7104 - RNA, 3792 nt, Piezodorus guildinii; identical to SEQ ID NO: 7079

SEQ ID NO: 7105 - RNA, 1998 nt, Piezodorus guildinii
augaauacaggaccaggaggaccaaauuaccccauggcaucuuuauaugugggugaucugcauucagacguuacugaagcaaugcuuuuugaaaaauuuucaucggcaggacccguacuuucuauuagaguuugcagagauaugaucacccgaagaucauuagguuaugcauaugucaauuuccaacaaccugcagaugcugaacgagcuuuagauacaaugaauuucgacaaccuuaaaggucgcccuauucguauaauguggucacagcgugauccaucucucagaaagucaggaguaggcaaugucuuuauuaagaacuuagacaaaaguauugauaauaaagcuauguaugacacuuucucagcuuuuggcaauauucucaguugcaaaguggcacaagaugaaaauggugucucuaaaggauaugguuuuguccauuuugaaaccgaggaagcugccacaaaguccauagauaaagugaauggcauguugcuuaaugguaaaaagguuuuuguugggaaauucauuccacggaaagaacgugaaaaggaauugggugaaaaagcuaaacuguucacaaacguauacguuaaaaauuucggagaagauuucacugaugauaugcuuaaagaaauguuugagaaauauggaccaaucaccagccacacuguuguuguaaacaaagauggcaagucucgcgguuucgguuuuguugcuuuugaagacccggaagcugcugaaagagcaguugaagaucuaaacggaaaagaacuuauugaaggaaaaccguuguaugucggaagagcacagaaaaaagcugagcgucaacaagaacuuaaacgaaaguuugaacaacuaaaaauggagcguaugaaccguuaccagggugucaacuuguaugucaaaaaucuggaugauacuauagacgaugaaagauuaaggaaagaauucucuccuuucggaaccaucacuagugcuaaagucauguuagaagaaggacguaguaaaggauuugguuuuguuuguuucucaucuccugaagaagcuacuaaagcaguaaccgaaaugaacggucguaucguuggaacuaaaccccuauauguugcucuugcucaacguaaagaagaucguaaagcucauuuggcaucucaguacaugcaaagaauggccaauaugcguaugcaacaaaugggacagaucuuuccuacugguggaacuggaggcuacuuuguuccuacauuaccccagccgcaaagauuuuucgguccagcccaaauggcccagaugcgcccucaaccucguuggccagcacagccacaagucagacccagcacacaagccacugcaucaggcuuccccaauaugcaagguccuuucagaagcgggccacgaggcccuggcgccgccgguggugguggugguccaggaagugcugcagcugccgcggcagcaaugcgcuccucuaucagugcugccgcagcugcgguggcugccgccgggcgacccacagccaacgcagcugcugcugccgcugcagcugcugccaacccagcuguugcccgccaauuggcccaaggagcuucucagggugcuccaguaucugugucugcucaaggccguccugcaaauuacaaauauaccgcaaacaugcgcaacccgcccccgauuggagguggcgcuggagcaggugcaggagguccuccacaacaagcauugcacauccaaggacaggaaccgcucaccgcaaguauguugucaucagcaaacgcucaagaacagaagcaaaugcucggagagaggcuauucccacuuaucaggagcauguaucccgaucuugcugggaagaucacaggaauguuauuagaaaucgacaacucugaauugcugcacaugcucgaacaucaugagucccucaaggccaagguugaagaggcuguggcuguacuacaggcccaccaggcuaaacaagcugcugcaucugucaaaaaagaauaa

SEQ ID NO: 7106 - RNA, 2742 nt, Piezodorus guildinii
augacggacucaaaguauuucacgaccaccaaaaaaggugaaauuuuugaauuaagaucugaauugaacagugauaagaaggagaaaaaacgagaagcaguaaaaaaggucauugcuucuaugacuguuggaaaagaugugucagcucuuuuuccugauguuguuaauuguaugcagacugauaauuuagaacuuaaaaaauuggucuaccuguauuuaaugaacuaugcaaagagucaaccagacauggcgauaauggcuguuaacacuuuugucaaagauugugaagaugccaauccacuuauuagagcucuugcugugagaacaauggguugcauuagaguagauaaaauaacugaauaucucugcgaaccucuaagaaaaugucucaaagaugaggauccuuauguuagaaaaacagcugcagucuguguugcaaaauuauaugauaucaauccacagcuuguugaagaucaagguuuccuagaucagcuuaaagaacuuuuaucugauuccaacccgaugguuguagcgaaugcuguugcagcgcugucggaaaugaaugaagcaucaguuaaugggacaccucucauugaaaugucugcugcaacuaucaacaaacuucuuacugcccucaaugaguguacagaauggggacaagucuucauauuagauucacuggccaauuauagucccaaagaugagagagaagcacaaaguauuugugaacguaucacaccacggcuggcccaugcuaaugcagcuguuguucuaucugcagucaaaguucugaugaaguuuuuagaaauguugccaucugaaucugacuucguuuccacuuugacgaaaaagcuugcucccccauugguuacccuuuuaucaucugagccugagguucaauacguugccuugagaaauauuaauuuaaucguacagaaacggccagauauccugaaacaugaaaugaaagucuucuuugugaaauauaaugacccuauuuauguuaaacuggaaaaauuggacaucaugauucgauuagcuucucaggcuaauauagcucaagugcuuucggaauuaaaagaguaugcuacagaaguugauguagauuucgucaggaaagcuguucgagccauuggccgaugugccauaaaaguugagcaaucagcugaacgcugcguuucuacucuucuagacuuaauccauacaaaggugaauuauguuguucaagaagcuauuguuguaaucaaggauauuuuuagaaaauauccuaauaaguacgaaaguauuauuucaacauuaugugaaaaucuagauacuuuagaugagccugaagcaagggcuucuaugauuuggauaguuggggaauacgcugaaagaauugauaaugcugaugaauuacuggagucauuuuuggaaggauuucaugaugaaaauacucagguucaacuucaacuucuaacggcuaucguuaaacuauuuuugaagaggccuacccauacucaagaacuuguacaacagguguugagucuagcuacucaggauucugacaauccugaucuccgagacaggggauuuaucuacuggagguuguuaucgacugacccuggugcugccaaagaaguuguuuuagccgagaaaccacuaauuucagaggaaacugaccuucuugaaccaacucucuuagacgagcucauaugucauauaucuucacuagcuucaguuuaucacaagccaccuacugcuuuugucgaaggaagagcugguuugagaaagucuuuaccagccagaucuggaucugcagaaguaguucaagaaacuccuggugcucaagucauuccaucucaagauucgcugauuggcgaccuccuuucuauggauauugguggcguuucagcuccuccuccaccuccaacgacaucugcuccuguugaucuuuugggucuggauucacuucuuggagggguaccugaacccguugucucucagaguacaaccgguuugcuuggagauaucuuugguuugggaacagccgccgggccuacagcauauucuccacccaaaaccauuuggcucuccagcgauagggguaaagguugcgaaauaucuggaacguuuucucggagaaaugggcaaauccaaauggauaugacuuuuguaaacaaagcuaugcagccgaugacuggcuucgccauucaguugaauaagaacaguuucggugugacuccagccggaacucuccaaguuuugaacccacuaccgccugguacuucgcaugacugcucauugcccuuaguuacgacuggagcaguacaaagaauggaaccuuuaacaaaucuccagguugcugugaaaaacaacauugauguuuucuacuuugcuugcauuaucccgaugcauguauuuuucacugaagauggacaaauggauaagcguguauuccucgccacuuggaaggacauuccagcucaaaacgaaguacaauacacacugacaaauguucagucuaaugcugauacugucguucaaaaaaugcaagaaaauaauguuuuuaccauugcuaagcgaaauguugagggacaggauauguuguaccaaucuguuaaacugacuaaugguauuuggguauugauugaacuaaaaauacaaccaggaaauccaaauauuacucuuucuuugaaaucaagagcucucgacauagccgcugguauauuccagguauaugaugccauucuucauucuuaa

SEQ ID NO: 7107 - RNA, 498 nt, Piezodorus guildinii
augccuccaaaguucgaucccaacgaaguuaaaacaguuuucuugagguguguugguggugaaguaggagcuacauccucccuugcucccaagaucgguccucuugguuugucccccaaaaaagugggugaugauauugccaaagcuacugcagauuggaaaggucugaaaauuacaguuugccucacaauucaaaacaggcaagcugcuaucucaguugugccaucugcagcuucccucaucauuaaagcccuuaaagaaccaccaagagacaggaagaaggugaaaggaguuaaacacaaugguaaccucaccuucgaugaaauccucacuauugccaggucaaugaggccaagguccaugucuaggaaacuagaggguacuguuaaggaaauucuuggcacaugccaguccguugguuguacaguugauggaaaaaccccaucugagguuaucugccagauaaacgauggagaaauugauguagcagaugaauga

SEQ ID NO: 7108 - RNA, 1110 nt, Piezodorus guildinii
auguguggagaagaaccaaaacuaggagaaaugaaggcgcucauuuuagucgggggguauggaacucgucuuaggcccuugacuuuaagcaggccuaaaccuuugguugaauucgcaaacaaaccuaugcuuauucaucagauagaagcauuaguugaagcugguguaacugaaguuguuuuagccgugucuuacagagcggaacagauggagaaagaauugagugacgaagcuaaaaaguuggguguuaaauuaauuuuuucucaugaaacagaaccacuuggaacugcagguccucuggcucuagcaaaagauauucuuucaucggguaaugagccauuuuuuguucuuaauuccgauauuauuugcgaauuuccuuucaaagaacuuguuucuuuccauaaaaaucacgggaaagaagguacgauuguagugacaaagguagaagagccuucgaaguaugguguuguuguuuauaaugaaaaggguugcauugcuaguuucauugaaaaaccucaagaauuuguuucaaauaaaauuaaugccgguauguacauucucaauccuucuguauuaagaagaaucaaacuggaaccgacaaguauugagaaagaaguuuuuccguucauggcugaggaaggagaauuguaugcaauggaguugaauggauuuuggauggauguugggcaaccccaagauuuucuuacaggaaugugcuuguaucucacaucucugcgccagaagucucccgagaaguuguacucuggcccuggaugcaucggaaacguccugguccacccuacagcaaggauaggcacgggcuguuccaucggaccgaacguuacgcucgguccuggagucauuguggaagacgguguaugcauaaaaagguguacagucuuggaaaaugccacaaucaaaucucauucuuggcuuuccgggugcaucgucggguggaaaucuguugucggacaauggguucgaauggagaacaccaccguucucggugagaauguaaauaucaaagacgaacucuacaucaacggaggacaaguacucccucauaagaguaucgcaaagucugugcaagauccgcagauuaucauguaa

SEQ ID NO: 7109 - RNA, 864 nt, Piezodorus guildinii
augacuuuggacggugaagaaacuauaucggaucaagaaaaggugcgaaucguuucuaauuuuauauuacauucgccaccgggagaguuuaacgaaguuuuuaacgaugcaaggauauuauuaaacaacgauacccuuuugaaagaaggagcucucggagucuucgggcaguacuguaaagaccagcuaacgccugugaagauuaagaacagugaguauccaguuuuaauuacagaacauaaugaucuuggauccaacagguuuuaugaugcaaggucgaaacagucauuuaaauaugauccauuaaggagggagacaucuaauuaugacacaugggaugcugaaccugguacugaaaaguggagaucagcuuuagagguugaauuagaugcauauauagcuaaacacuucgaaaguggaucugguaguguauuuucuaaaaaagaagaugguaaaguaagcuugguugcgugcauagaagcccauuuauuucagccaaaaaauugcuggaaugguuguuggcgaucucagugguuugugacaauagauucugauaaugcagacgugaaagguguuuugaaaauucaaguucauuauuaugaagaugguaauguacagcuaguaaguuugaaagauauuaaucaaucacucccaguugucgacgaagagcaguuaaguaaggcuuuaauuaaaauauucgaagacucugaaacagaguaccaacaagcgauaucugaaaacuaccauacgaugucagacaccacuuuuaaagcuuuaagaaggcaguuaccuguuacucguucaaaaauagauuggaauaagauggugucuuacagcauugccaaagaacucaaaccucaguga

SEQ ID NO: 7110 - RNA, 3660 nt, Piezodorus guildinii
cgugaugaaauguuuuuaucugggcgaaguuuuguuaucauauuuacacaggcuagguguggcaugaaagugauaacggaucgaggugaucgcuucaagucagucgagaggauggagguggcguugcuucugcuuuuugucacuuuuguggcaaguaaagaugucaauagagucagugagaauuuggucaggcccuauaacaagaauuauuauacuucaagauugcgcggcgguccugguggucuacagccaaacgcugaugaugaucgagaggcuccuuccauugaccaaccgaguaucccuuaugugauaacagaagaucgacuaaggaagauaagaucgaacaugauguauugguuuuuugaccgagauucuaaaggcgguuauggagauuugcaaaaggauauaacaccaucaauuacccaaguugauaagaauuuaaauuuucaauugccauuuuucggauuucgcuucaauuauacaaggguuucacuaaacgguuauuuagaauucagugacccuccagaacaauauagcuacccucucacuuucccaacuguagauuggccucguaaaaacgacccuucauucaucggaauauuuuacaguaaguguaggauuggacaguugggucucaaugauguugaccaaagagaaccaggaguuuauuucaggauggaaagagauuugauaucaagaaaagacaaauucggcgucgaaaugagggagcggcugaaaugggacauccgagagaguguuguuggcucagauucuuuugaaccaaagcauucgguuauugugacuuggaaaaauguaucguuugcugguggaauugaaaacucaguacaaacaacaaacacauuucaacugguucuugcaacagacgaaguguucacuuaugccauguuuaauuauguucaaauuaaguggacuacacacacggaagcaagaggagacacaguaaaaggggaaggcgguguaccagcuuacauuggauuuaaugccggcaaugguacgagaaguuaugaauaucgaccauauucucagacaucaacaaucagagauuugguuaugcguggcugggcuaaugguuucccugguagacauauuuuuagaauugaugaaaauauccuaccuggaacuugcaacaaggauauugcuggagcaaguuugccccucgcauuugcuccugaaaguggcaauaugcuaggugguaccauugucaauaucacaggaccuuguuuugaaccuaauaugaagauaguaugcagauuugacaugaaagcuguuuauggaacaguuguggacaggaacagagccauaugcguucagccuuuuaucauggcagaagguuacauauuguuugauauugccauugacgaugggaaauacguuuggaaaggacaauauuucauugaaacaccugcaacugcagcugaaaaaauaucuuuugcugacgacaguguucaucaaaaguauccuccggaagucagaauaacauggaaucaguauaauuuaacuucaaauuuaggugcuccaguucaaauuucaauauggggauacagagaaauaucuauucgcccagagcugguuuauauagauucuuuggacgugggugucccaaauaauggcuuguauucaaucauuccagccaccuauaaaaaucgugauaaccguuuauucacugauaugaguuucggauucauacaaaucaaucugacagaaucgacgaauuacaauggacucaaaguaacaccaguuauauggagcaaaccaauaccuuuagguugguacuucgcaccgcaaugggagagacagcuagguuccaaauggccggaagggaaauguaacacuuggauaaugaaugaucgauauuugaagaacuucccugcugagcuuagcauaugucccuguaaacuagaacaugcgcuugcugauaaaggaagauuuaugccagauuuugacugugacauggaugcaaacccucacugcuuuuaucaugaaggagcaaggcauugcguaaaaacuggagcucccaaacaggaagguuccgaacagcaauguuguuaugacaaaaaccauuauuugaugcuuuccuaugaucaacagugggguucgucaccaaagagguccaguaauuuaggaaucuugccauggaaugaaccaaauaaggugccaacacuaucacaaugguaucaugauaucgcacccuuuuaccauuguugcuuauggcaguucgaacaaucaguaggcugcgaaacauuuagguuugaaagaagaccuucacaggacugcgugggcuaccaaucaccuuacaucgcaacuguuuuuggagacccacauuuuauuaccuuugauggcuuggaguacaccuucaacgguaaaggagaguuuguguuauugcauacagauucugaaaaguuuaaguuagauguccaagcaagguuugagcaaguggguaagaacauuuauggugaaguggcggcaacucaguugacaucuauagcagcaagagacaauacuucaagcaucauugaaauaaggcuuagaccaaaggaggcacaauggagguacagacuggauguuuuugcaaacaagaaaaggauauauuuugaccguccagcucuucgugugcaacacuucacaggugucacaguuuaucagccaucacauauacuuaaucaauccgaaaucauuaucauguuucaaucggguguugguguagaaguuguugaaaauguaggauauauggcugcgaggguuuaucugcccugggaauacauaaacagaacgaggggucuguuuggaaauuggaguuucgacccgucuaaugacuucacgcuaccagacggaaguguugucagugcugauaaucugaacaacuuggaaagaauacacaaggaauucgcaauucauuggagauuagaggauaauguugaacccaauaaaggugaagcucucuuugugagagaauauggaagaacuucaagcuauuauuugaaucgaacuuuuguuccugaauggaaaucaacuccucaagaaaucauaccuccuaacaggacuaaagauauacaacaagcuuuagcacuuuguggugaaucuuaucaauguagauaugauuaugcuguaacuuuaaacagggaaauggccuuuuauacucuaaauuauuacagugaauuuacccaacuaaggcaaacaaauaaagacagaguucugucuuguggugugcuagaaacaccaagauuugggcgaaaauccaacuuuuucuuuguuccugauucaaagguuauauuugaaugugaucaaggauuuauucuggugggugaucaaagaagaacaugcucuucuacuggaagauggucuuuugacuauggauauacugagugucugcgugaagaagaauauucuuuacgugcauuugguuggacuugggguauaauagcucuaguccuaauacccauuguuauuguacuuguaugugccgguuuucgaauugugagacgaauaauagaacagaaaaagaaugaauuacguacugaccaaagaacucaguaucauccagauuauagugcugguccuauaagguacaaugcaagagaaguuagucuagccauuaauccagaaagcgaaccauugaaaaaagaaacugaaguaaauuaa

SEQ ID NO: 7111 - RNA, 342 nt, Piezodorus guildinii
augcguuacguggcagcuuaucuucugucuucccuugguggaaaagaagccccuucugcagcugauauugauaaaauauuaagcucaguuggaaucgagucugauucagaacgaguaaacaaaguaauuucugaacuuaaaggcaaaaauaucgaagaggugaucgcugcaggaaaagagaaguuggcuucaguuccuucuggagguggcggagcucccgccgcugcugcugccgcaccugcagcagccuccccugccaaagcagcagaggagaagaaggaagcaaagaaagaagaauccgaccagucggaugaugacaugggcuuuggucucuuugacuaa

SEQ ID NO: 7112 - RNA, 2742 nt, Piezodorus guildinii
augaugacugaucauauugguggaauaacccuuaaaugggauccaaaaaaccuugaaauacgaacauuaucaguggagaaaacauuagaaccacugguauuacaggugacaacacuuguaaauacaaaagggccuaguaagaagaaaaaaggaaggucuaaacgcgcucauguuuugguugcugcuguugaaaaagcuacugaaaauuucaucgaaaaaggugaaaugauagcuuaugaaaauccugauauaaaacaagaaaugcuuucagcuguagaagaagugaggaaaacaggagaagcaaugagugcagccgcgagggaauucgcugaugacccaugcucauccauaaagagagguaacaugguacgugcagcacgcaacuuacucucugccgugacuaggcuccucauccuagcugauaugguggauguucaucucuuguugaagucucuucgaguuguugaagacgaucuuguuaaaguuaaaaaugcaucaagccaaccagaacugcucgagaacaucaaagcauucggacguaaugcuucugagcugaugucccaggcugcaaaacgacagcuugaacugaaggauucucaguugagagaugacuuagccgcagcacgugccguauugaagaaacauuccaccauguugcugacagcaucaaagguuuacgugagacaucccgagcuagcugcugcgaaggcgaaucgugauuacgucuucaagcaggugugcgaagcggugaacaccaucagcgacguggcccagggcaaggggccauccaucacuaccaacccuuacgaagggccuggcgagcuggcagcugcucucgacgacuuugaugagcguauggugauggaaccucuggcuuauucugaaguagcuacgaggccaucccuggaagagagguuggagaguaucauuagcggagccgcccucauggccgacucuucuugcaccagggacgagaggagggagcgcauuguugccgagugcaaugccguacgucaagcacuucaggaccuucuaucggaauacauggccaauaugagcgucaaagaucaaagcgaaggcuuggagagggcgauugaccauaugugucgcaagacgagggauuuaaggaggcaauuacggaaggcuguuguugaccauguuucugacagcuuucuugagacgagcguuccucuccugguuuuaauugaagcugcgagagcugguaaugagaaggaugucgaagaguacgcacuuguauuucaggagcaugcuaauaaacucguugagguugccaacuuggcuugcuccauguccgggaaugaggacggagugaagauggugcgcuacgcggcagcucagaucgacgcccucugcccgcaggucaucaacgcagcccgcauccucggggccaggcccaaguccaaaguggcucaggagaacauggacgucuucagggacuccugggagucgcagguccgagugcucacggaggcugucgacgacauuaccacuauugaugauuucuuagcugucucugagaaccauaucuuggaagacguuaacaagugugugauggcguugcaagagggagacggagacucauuggacaggacggcuggcgccaucaggggccgcucugcccgcguggcuaacguggucacugcggagauggacaacuaugagccuggcaucuacacagagaggguucucgaggccaucaagguccucagggagcaagugaugccaaauuuugcucaaagaguagaaguugcaguagaugcucuuucuucaaacccuccuaaagaugucgaugagaaugaauucauugaugccucccguuuggucuacgauggcgucagagaaauuagaagggcaguucucaugaacaggacggaugaggaacucgauccugaagaaguugaguuagacgaacacuacacguucgaaacucgcagcaaaucuagcgcucauacugccgaucauggugucgaugaauauccugaaaucagugguauuacaacagcaagggaagccaugcgaaagaugacugaggaggauaagcagaagaucgcccagcagguggaauauuucagaacugaaaaguugaaguucgaccgagagguagccaagugggacgauaccggcaaugacaucaucguucuagccaagcauaugugcaugauaaugauggaaaugacagacuuuacuagaggccgagggccgcugaagacaacaauggacgugaucaaugccgcuaaaaagaucucugaggcagggaccaagcuggacaagcugacgaggcagauugcagaccaguguccagaguccuccaccaagaaggaccuccucgccuaccuccagcggaucgcccucuacugccaccagcuuaacaucaccuccaaggucaaagcugacguacagaacaucaguggagagcucauaguuucagggcuugacagcgcgacuucucuuauucaagccgccaagaacuugaugaacgcagucguauugaccgucaagucuucuuacgucgcuaguaccaaguacccccgacaggguacagugucgguaaguccuucuccgauagucgucuggaagaugaaagcacccgaaaagaaaccccucgugagaccagaaaagcccgaagagguuaaagcgaaagugagaaaaggaucacagaagaaaauacagaacccgauuaaggcauuaucagaauuccagagcccugcagagucaguuuaa

SEQ ID NO: 7113 - RNA, 1239 nt, Piezodorus guildinii
augaacgaaaguaaucuucaaucaacuccgaaaaccaaugccaguacuggguuuuuucaagccaccacgccgaagcaaggauccaguguuaguuuugguucuaugucaacuaaucaaacccagcaaacgggauuuuugaauuuuacgccucaaguuggaaccucuaagcagucuacaauguucaugccaccuacagcauugucugguacaaguacuccaaaaacuacagcaacagguacugcaacauuguuuaauauuacaacuacaacagcuucugcucccauuuccaguaguucagcaacaacaucaggguuuucacuugguucuucaucagcagcuagcucucagcaguucaaaccaccuucuacaucucagccgaugcaguuaaaaacaacuguaucaggugcuucuaugccauuaacuacugguuuaucauccacuggaggaaauacccaggcaacugccggcuugaauuuuggaaguaccgcuaaaucuaccccuggauccacugucuucaguccugcuaaaaguucacucccagcugcgaguucuacuacaaccucauccuuaacauugccaccuucuucuacaacuucucucacuaauucauuaucgaacaaaccuguuacuaguacuggugcuucgacuucucaacaaccaaauaaccuuacuuuucaacaauuagaagaauugauucuuaauaaauggacagccgaauuguacgaacaggaaaaaguguuuuuaaaucaagcuacacagaucaauauaugggacaaaguuauuaaugaaaaugcugaaaaauuaacucaauuacauucuaccauggagaaaguuaggaagcaacaagccaaaauaaaugaugaucuugagaucauauuuacucaccagaaagacuuggaagcaugucucguucccauggagaaggaagacuuacuuucaguucuuaaagcugauccaaauagaaaaaaucuguauauaaaugcuaagaaaauagauucucagauuaaaacuaugucagaagauuugaaggaaacgauugagcauaucaaugaaacaucacgaucacaugauacugaagauccuguuauccaaguuggacgaauuuugaaugcucauauggaaucucugagguggauugaugaacacacugcaaggaugcaagauuauuucgauucauuauuaaaaaugcaugaugaucuuaggagagagugugagauaagcaagcaugauguuuauuaa

SEQ ID NO: 7114 - RNA, 582 nt, Piezodorus guildinii
auguucauuugggauugguuuacuggaguuuuaggcuauuuagguuuauggaaaaagucaggcaaacuauuauuuuuaggauuagauaaugcugguaaaacaacucuucuccauagguuaaaagaugacagauuggcacagcacguaccaacacuccauccaacuucugaagaacuauccauaggaaauaucagauuuacuacuuuugaccuugguggacacacucaagcucgccgaguauggaaagauuacuuuccggcaguugacgcuauuguuuuucuuguugaugcuugugacacgagucgauuaccagaaaguaaagcagaauuagaugcucuuuuaaccgaugagagucucaucaacuguccaguucucauucucggcaacaaaauugaucuuccaggugcagcuucugaagaugaucucaggaauuuuuucaaucuguauggacaaacaacuggcaagagcaaaguuccacgaagugaauuaucuggucguccauuagaacuauucauguguucaguucugaaaaggcagggcuauggugaagguuuucguugguuagcccaauauauagacuga

SEQ ID NO: 7115 - RNA, 1791 nt, Piezodorus guildinii
augucuggaaauaauguuuauggugaaaugcuacuuacuguuacauccgagaaguuuuacaucgagccuguucaagauauugauaauagccuuaucuuggauagagucacuggaaauauaacuauaucaaauguuccuggaagcaguggggaugcaccaaugaucggggaaaaaaaaacuauuuaugguauucuugggacuauuaggcuacuagcuggacaguauuuaguuguagugacuggcagaaccaaaauuggcaauauauggagaagagaaguuuuccagauggacucugccgagauuuuauguuuuucuaggaguacuacucaucuaaaugauaaacagaaaaggauugaaaaggaguauauaucaaugcuggaaucuauucuugcuacgccccacuuuuacuuuucauauucuuaugaccuuucucacacuguucagagauugcauaauauaucgccagacuucuuaaaaaugccaauguaucaaagggcagagcagaaguuuguuuggaaugaauaucuuuuaucugaauuugcgcaaaacucuggugucucuaaauucugucuuccuaucauccauggguaucucucaauuacaucuugcauuuuaaauggaaaaaccuuuagucuuaucuuggucuccagaagauccaaggaaagagcugggaccagauuauuuacuagaggaauagauucaaauggaaacguugccaacuucgucgaaacugaacagauaguugaggcuaaauuugaacgugcuagcuuuguccagacacgagguucuaugccauucuucuggcagcaguauccuaaucugaagcugaaaccacgaccugccauaauucaagaugaaaaucauucugcugccuucaguaagcauuuugaaacacagcugauggauuacggaagacaagucauugugaauuuggucgaccauucuggcucugaggggaaguuggaagaguuuuauagaaagcuagugaacgaagcaaauaaugcugaucugaaauaugaagcauuugacuuccacagggaaugcucaaagcuacgguacgauagauugaagauucuuauagaucgucuggccuaugauuuagagcagaugucaguaacgaugauuguuggagauggaacaguuauaucacagcaggaagguguauucaggacaaauuguauugacugucuggacaggacuaaugugguacaaucauuguuggcucgagccaaucuuacauauauuuuacagagacuagcaauauuaaagaaaggacaaacaguugaggaucaaguuggucuugaaaacacauuuaaaguaauauggagugaccaugcagaucuaauaucaauccaguauucagguaccggagcauugaaaacagauuauacuagaacaggaaaaagaaccaaaaagggaaugauucgagauggaguuaacucucuuguucgguauuacaaaaauaauuuucagcaugguuuucguaaggaugcuuuggaucuuuggcuuggucauuaucgcgucucuucagaagaaggaauaaucauuagaagcccucuugauguuaaaagggaauucaaauauacagcuuuuccgcucauccuccuuguugcuauugccauguucuuugcaaaucugguuacaccaaaugaauacacuacuggcacacuccugucacuuauauucuggugcucuaugguaucagcaacucuuaucgcuauauuuuacaaugguucagaauauguagauuguccaagacuaugcccccuccuucggucaccaucugucuag

SEQ ID NO: 7116 - RNA, 1299 nt, Piezodorus guildinii
augucuccuacuguuccaacuaccacaaauguuguugacaagagaccaacccuugucaaaccacacucugcugaaagaagaucagaauuaguuugccguguaaaguacugcaacacuuugccugauauuccauuugauccaaaguuuauucaauauccauuugaaucuacucgauucauucaauauaaucccacuucacuggaacgaaauuauaaauaugaaguucuuacugaacaugaucuugggguuacuauugaucucauuaacaaagacauguaugcugcugaucacaaugcaguucuugauccugcugaugagaaacuacuugaagaagauauccuuacaccucacgauucuaaaaggucuagacaucauucucgaucaguuucauggcuucguagaacugaauauauuuccacugaacaaacacguuuccagccacaaguuauggauaaaguugaggcuaaaguuggauuuaguauuaagaaaagucucaaggaagaaacccuuuacauggauagagaaagccaaauuaaagcaauugaaaagacauaugaugaugcuaaacuaccuauagagaaacaucauaguaaaccuaauguuguuccaauugaaauucuuccugucuuuccagauuuccaguuauggaaguacccuugugcucagguuauguuugauucagacccugcaccuauaggaaagacaguacccgcucaguuagaacaaaugucucaagcuaugaucagaggugucauggaugaaaguggugaacaauucguagcuuauuucuugccuacugauucaacuuuagaaaaacgcaggagagauuuuacuaaugguauagauuaugaagacgaggaagaguaugacuacaaaauagccagagaguauaacuggaaugugaaaacuaaagcuucuaaaggauaugaagaaaauuauuuuuuuguuauaaggaaugauggaguguauuacaaugaauuagaaacuagaguccgguugaguaaaagaagacaaaaagcuggcacugcucccaacaauacuagauuaguaguuagacauaggccaauggaugcuaaugaauuuaauauucaccgucaaagggaaaagcaacuucaacauccuauugaagaagaggaugaagaagaaagugcuggugaagaagaaaagaaggaagaagaaaagaaaucaaacagcaaagauucugaugaaagugacaaagaugaagguagugagaaggaggguggaagugauaaagaugaaggaagugguaaggaggaugguagugguaaagaaaaugau

SEQ ID NO: 7117 - RNA, 1203 nt, Piezodorus guildinii
auggauaacgaaggaguuacaccagcauauaugaagcuggcccaaauuaaguuugcuuuaagucugccugaguauaaaggugaccuggccuuaaaagaagaacuucuuaauggcauuaaagcuggaaauauggcaccuuauuaucgggagguuugcaaugaccuuggauggguaauggaugaaacuuugugugcccagauggcaaaaaauaaugaaaccaggcuggcagaauuagagaaagagcacgagaauucaguuauugaagaugaagagcaagugagugggcuauggcaggcaaaguuagacuacuuguguagcauuggggacaaggaaaaugccaguacauuagccaauagcaagcuucaagacaaaacagugccuaagacucaucguaucgaugcaguuuuugcauuauuuagguuaucauauuuccacgguugcgauaucaaaggcaugucuucagcuauugagaaagcuaccgaacugauugaagggcaaggcgauuggaguucaaggaauaaauugaaagcauaugagggaguguggaguuuugcuguaagagauuaucuacgggcugcaaagcuuuucguugaugucguacccacuuucgaaucuuacgagcuugcugacuucggaacuaucauuaaauacaccguacucucguguaugauagcauugccgaggugugaauugaagaaaaaacucaugcaccacgguguuauggcccaagcacuucacucucaauaucgaaacuugaaggaguacuuccagucccuuuacgauggucacuacgcagacuuccuugucgcuuuggcacagguggaaucugauaugaaacgcgacccucuccuucauccgcauuaucgccacuauguacaggaaaugaggcuuagggccuacaagcagaucuugcaagccuaucgcucacucucuuuggacuauauggcagaagcauuugguguuucuugugaauucaucgaacgugaagucgcuaaauuugcugcuucugggcgucuccaguguaaaauugauucuguggcucgcuccguaauuacaagcguccaccugagugaugaagcucuccgcgucaaggauucaucugauuuagaucucgaucgcucccuccucuacaagaccacugucaagaggggugauauuuugcuuaacaggcugaaaaaguuagcuaggguuauggauuuuuag

SEQ ID NO: 7118 - RNA, 12339 nt, Piezodorus guildinii
auggaggaggguucuggggaccgugaagguaaaagcggcgggggggaagaagauauggauguuggugauugcucugaagaagaggaagaugaggaagaagauuuggaaauggguuccucacccaugcagcaagaacagucuucuauaauggauauaaccucuccugcuucucaaccauaugaaggcuuagcaucgacacuucguaugguuccucccaccguucuguccgcaggaaaaccuuugcaaggaacgaguggauuaaaaaggggaccggggaggccaagaaguagaggagcugguggaaauucagcugccacuccgaggccuaucaagaagccugcgguuggucuuaaacuaaagagguggaaagggcuucuugucucuggaguguacggugcagcugguggaaaaggcgguggagagggagacccugaaggagaaaguacauccccuucucagccaucaacuccugucgaucaacucaaaggccccaucuuuguggacgaacccuuauuugaugagcaguggcccgguaaacuauguguucuuuguaacuuaagugagcacagucaacuuggccaggggaagaugaugcgagcggaauguagcuuggaagaccuuccaagagaucuuccgcgagaaucucuuaugucaccacccgaaacucccccaccuauagauucuuucucaccuagaccuccucuucaaaaucguagacaaaagggauuugccaaauucaguggacaagagccaguugaagaauugagcuuaguuggacauaucgacauuccagaaccaucaaauuuaauagauuccggcuacauuuauguccaugaauggugugcugucuggugcccuggcguccgacgagaugaaaguggucaguuguugggauugguaguggccguugcugccgcugcuacccgucgauguuaccauugcucucgcuauggugcugguccgccaugcauuguuccaucauguaacaaacacuuccauauccccugugcugcggccgcaucagcauuccaacauguucgcacauuaacucucauuugcagucaacauuuagaccauguugccaauaguucuucuaugaguaaugugaccugucccuccuguaacagccuagguaauguugcaaaucuugucaugugcucuguaugugguaaccaucaccauggggcaugcauagggaaugcucuacauccuggccugagggcugguuggcaguguaucgacugucgggugugccagcuuuguagggaaaaugaagagaccgguagaaugcuagucugugacuauugugauaaggcauaucauccgcacugcgucaggccugcgaugucuucuguaccuaaagucgguuggaagugcaagcggugucgauuauguagugacugcggggcuagaacucccggagguggccuuucauccagauggcacuccaauuauacagucugugacucgugcuaucagcagaggaauaaaggauuuuccugcccugugugucacaaagcauacagggcggcugcucucagggaaauggucaaguguucgcagugucgaagguuuguacacgggaccugugacaaagaggcagacuuuguuaguuaccacagaaaaaaagaagcccaucccgauuaccaauauauauguuuaucguguaaaaauaauucaaccauucucuaccugaagaggaaagauagcacugaagauguaaauauggauucugcuuuaaauauaucucaagaaucucuugccaccccugacgaacucgauauggauucagaaaggucugaugacccuccauuucgaccaucugguguuggcuuaggcaaaggaaaaccauucuaugccucuaaaauagccaagaaaaagcucggguugggcccaggucggccaaaaggaagugggaagaugucuucuauagcccuaccucacuuucagaagagaccucgauacgcagacuucgguaggaagcgaggcgccaaaacgaaaaugagaggaaucuucgguguucccgggcuugguuuacagagaccuuuaauggauucuaacaccaaaccugaagaugaaccagggcucgaaaauaagcugguccuuguaucaucucgugacaaauacguguuaagucaagauguuuguguuauguguggugcuuuggggcaagaccaggaagcaugucuuauagcuugugcacagugugggcaguccuaucaucccuacuguguaucaguuaagguuaccaaagugaugcuucagcguggcuggagaugccuugauugcacugugugugaaggcuguggccaaagaaaugaugaagggcgauuaauacugugugaugauugugacauuucuuaccacaucuauugcauggacccuccacucgguuccguaccuaccggugucuggaaaugcaaguggugugcccauugccagaccuguggcuccaacaacccaggcccaaauucgacguggcagucuaacuuuacccagugcgggccuuguaauucaagaacuguuuguccugcuugccuagagcuuuauacagacggugaucucauaauaaaauguauucacugugauaggugguuacauugccucugugauacaauaucuaaugaaaaugaagcagaagcgugcugugcucaagguuauacuugcauccuuugcaggccaaauaaugcugcauugguguuaccugcaacaacaccaucaagaguuccaucuccugaacucaauacagagagcagagcuacagacuacuauguagaugguguuugcuuaucugaaacugggcuacaguuaaucaaaacucuuucaauggauaauggaaaccaaccaguacggcgaaaaagaccaggauucaggagacaagauccuuccguugacuugguagaugauauggauaaugaaggaaaagauacaguguauaaagaugguauguuuugggccucuaaagaaaacggcccgauucccaguccaccugaaggcuuuacauuauacacuagggaaaguggaauaguuguccugaaaagaauaaaaaagagaaaucuucaaaggcuuggcauuggugguuucacuacugucaaaaugagaagcuccagauuaaaagaagaugaugaacaucuauacccugaagaaaaacccaggaggaaaccucgaguuccaaagaagaaaagcaaaauugcugaaaguuauccuaggcaucuucaggaagcuuuuuuuggcaaagaauuacuagauacaacuaaagaaacuucgcaagaguuagagagcacuggugaugaaucagaugauggcaaaaugagggaggaagaagguagcgauggugaaacguugaaggauauucuacaucucccugaaaaucuucuccacaaugaucuagucaacacaaucaugaaugaaagugcagauaguaucaaaucagaaaaucuuaugucagagagugggcacgaagguagcagcagccaaaaagacgaacuaugugauauucuuggaccucauuucaauauagaaucuauggugagggaaacaggucuuccaaauauggauuccaaagauguugaagaaauuuucaaaggaguucuuacugaugaggcucguaaucaggcccaucauaaucaagcguccccucaacaacagcauccaguugcaaaaagcgcaccugcaggcuuggcuucuucuccauugcaguauccaucggcaucuccuuacaauucagaauauagcaauagcccucaguucaguccggaaaguucgugggaugauuguggcucuuauaauagaacuacaucguugaaaauggaagcagaugaaucacucggaagagaugcgacgauauccccuguucuguaugccaacaucaaucauccagaauggaaaaaagaguauccgaguuggaaugaacguuucaaacaaauuuuaaagcaguggcgugcuuuaucaucugaagaaaaggcuccauaucuucaacgugcgagagacaauagaacgaacuugcgcaguaggaagcaggaacaugacaaaacauugaauaccaaaucuugccgggaagcugagcaagaacgacaguggaaggaguuacaggcucugaggcagcagcagcaacauaugcuuucucaaaccaggguccagcaagugaaccguguccgccaagugggcaaugcagggcuuguacaauuuucaacaaacgaccaaucuccaucuccucauuugacucagcaauuacaaguuucaacuuccacucaggaggcuaaccuaggaggcuuggcaucuccaagagcucaauuugcuucugguacuggcgguacgguuaagguugcgacaccuggugguacgauuuaccgucaggugaggccaccucagucaccguuuccaagcccgaggcaaccauccacaccucaacagcaggaagaaguuagacaacucagggaucucuuacagcggcaucaagucaagcaagaaggaucagaaaccguccugucgggugguguucuucaagcaguacaaaugcgaccucagccuccuaggagcagccugcacccacaagucguucaugguauggaaccgagagucagguuagugguacaacaacaggccucuagguucccaggaaccacgcaagugagauuggcugcuccuaggacacaacuucaagaacaauuccucauccaacggcaguuugcuguagccccugcugcccaacaugcucauaaugcaagugcaauaauuaggaauaguaguacuuuagucgagcaaacaagguugcaaacucugccagucgaccaaagaauccaaagcggaggccgagaaggagaggaaauaccagaaaguguuaccgcagaacuggaaaagcuagaggaagaaggagguaccaucgguggugaagcugaugagguuucugcaauauucucugaccuaguggaagaugacgaugagcugcucgcggaaaugggcucagauuucaacauucucgaauaugcugauccagaacuugauaauguauccggaggagagaagacaaauauccuugacgaucuggaagaugaaguugagaaaaaaaaacaaguuggggcuuccagaaaagauaauuccguacaaaggaauucuucagaaaguauuaauaaagagcuuagugaaccuagaccagaaaguaagccaagcgaagaagucucuagggugucgguaacauccacaccaccucaucuaccucaacagauaucucuaagcggaaacaauggcaucguacaaccaaaaauuguugggucagguuaccaaacacaauucgccacuccaaguacaccucucccuagaaugcaaguuuugcaaggugcuaaccaaguuaaucguggaggagcaagcuucguuggaaacccuccaccaccuccaccuccguacccugguccaccuccuccauauccagggcagcaagcugcgauacgaggaagggguguuguuagaucucacaucaucuccagccaggcgucucaggcccagcaaagaagaaccuugcuccuucaagagcagccucuacuguuggaagaauuacuugaagaggagaaacgagagcaagagaaagccucagugacaccuucuccagcaaguucucucaugagugaugcagacuuugaaaugcugagagccgauguccucgguucgcggacugccagcccuccucaaucucaaacucucggcacucugaaucuuguuggaccuccuccucccccuccuccagaaaacauagugacggaggccgauaggcaggcucaaauccaauacgaaacauggcuuaggacgacuggaagugccgucagccaacagauccgauauuuugaaaccgaaguucaaaaauuaagaaaaauacgcaagucguuaaauaguaaacagcgacaauugagaaaaaauggcaaugaauuaaaugagaaagacgcaaaugaacuacaacguguaaccggugaacaaacaacuuuacagaaacaccuggaagcagccagaaaacaaagcaggcagcauaccauggugaugcaggaauaucaaacaaaacaagagagcaaaggagguggagguagugcugguucugcgucuccgcagucuccccuccuaucaccggcuggcggaggcgucggcggacaucagucccaucaaccuucuccucaaacaucgucagucucuccggugaggcauagcccugccggaacuccucauucucagaguggugaugacaaaagugaaagcaguggucuuccgucaccaagaccuccucccaugacgccaacuccacccagcccucaucaguuccaucagauaaggcauccuucaaugguaccaagguuugccagauccccugaaggagguuuacggccacguuuagcuccucuccaaacguccggcuuuaauucuccuagaggaaugucaccucaaccaccaucuccgcagacaaugagauugacccaacaacagcagcuucuccugcaaagacaucagcuacagcagcaaaaacaacagauucuagaacaacauccugaagcaggagcuauucugaguagacaacuaaugaggcaagaaccucagaggcaguucaggaacuuuccagguccucagaguccugguucucaaggagggucuccucuguacagcccucgugcuccuccuaguccuauggucuaucaaggacuucagacaccaacuucucccaugccucaguuuacccagcccacgucuccaaugcagucuccucguuugcaguaugcaccaaguaguccucaucaacagcaauaucgacccaacucccccaugguaccaucccccaugagaaggccuucaucugcuaguccucaaggagaaaauccagguggcggaggaaacccauucaauccuaauaacccuauuccuauaccuccugaaauacguagguugaaauugggcuuaaaaggagguucaccuauguggaaugaacagagaaaaagggugcaaccuaguaccagcucagaaaaaguugcuacuagcuuaguuugugcagacuacaacgauuuugaagaggaaucuccaccuauuacuccaccaucuaaaccugccuuaauuaaaaaaaccgaaacagugaaagcucgacaaucugaagacacugauucagaauuaacuguuuaugaugacauuguguuaguugaaggcugcaaagaaacaaacuuagaaguugcagaguugcggucugcuuuagaaggaaauguuaugucuacuguuguaucaaugccaaugguuaucgauucaggccagauucagaugauggauguugaaggggagcuccuggaugaccuuguggucuuagguguaggaaauggaaccaccgauagcgacuguauuuuggaagugaacaaagaucucauuuuggacgaugaugucaaagaagaugagcuugaagaugguucuccaccuagagcuagaaugcaagguaaaguucuuccuggugggggcucucacaauucaccuucuccugaaucuagaaauaacugugauauauucaaaaaagucgaagaaaaagcuaaaaaacuugaaaaagaaaggaaaaguacugacgaaaggacaguuccuguucaaccuaacauuguagucucacgaacuccaacaacuuuuacacccguuguuacucaaaaaucaauaccaauagcagacaaucgucaauuagcuaugcagcaggcagcuguugcuagccuuguccaagaugcugugaaugcugcaaagcuggcagcugaagcucaaaauuauuugaaagcuagucaaggcaaugaucagcauagaaaugcgauuucccgugggucuuuuguuccauugucaguuaucacaaguaaagcugucgauaaugaaccucucgucaacaauaccaucaaaacugauguaaggaaaucugaaaugaacagguuuucugaggccgacaauggucaaaaagagccagaaaacaaaccagagcaacaaaaguuccgauuagaaaaugcuaaugauauacggauaauuaauacugauaguucaaucaucaaguacaaaacaucagauucuguugaacgccaucuuguccauaaugaaaucaauguaauuaaagaaaaugaagaaacuaacgauaagcgagaucacaaacuucccgaaagaaugaaccacgucucuacaaaaguagagaacgucacccuccccugugucaguucuaguauucuugaggcucagcuaacaucuauguugaggacuaauagugaacccucuuccaaucaaaauuuuauuuaugccguuguuaaucauaccgucaaggaucagaggagagaagaaaauaaucaggaugacaugagggucgaaggucuugcugcucacuuccaaaggacaguuaaaaaugaagagcugauguugacugacagugauauguauaaaaauucuaggaauccucuucuuaauaaaaaacauggcaacaucuaugugagcucucaauuaaagacugauacaguaaugguaggaggaaaaucuuauaaaauuuaucaagcugggccacaaucgaguacgagugacauucugacguugagggacgacaaggaagaggcuaauggcaggguugcccauaaagugaauacauuagagcggaggcugucugucaauaacgagaaaucagcaaacgaaaugcuucaacagagggucguuucaaguucugaaacagcugagaaagaaacgcaucacuugaguuucggcgggccgaaaacucagguaguugcucaaaaggaagaaccaaaaaaguuuguugcgcuugcuacgauguuguuaccacggaauaaugaagagaaaagaguaaggccuggugaagacucucaaaaugugcuucuuaaacagcugcuucagaacaccgcaugcgcuaccaccaccgcuucgcugcccauugucccaucuuuggaggcucagcucgcucgaccaguaccaccuacaccaucuucucuccuucccucaguuuugaacgaaccuccuaaagagauaccacagccaaaaccucaacagcagauaauagaaucaccgaaacaagagucacgcccccacaucgguccuucaucucuggaugaguugcuuucgccuccaccgccuccucaacagcuccaacauccacccucagcgauacagacgaguccgauaaucaagcgugaacccguuuuuuccuugagucagccuggcccggucaugacacccaugguggaugugaaaagagaagucgagguuaaaaaagaagugaugucuucugaugaaauguuguccccugggcugcguuuggaucaggcugacucccagccacaagauaucaaaaaguugaaaaagcguccauaccaccaucaaaagcgaaggcaaaguuugggaaaagaaaugauugggggaaccccgaagaaaaggccucgaaagagcucgaaaguagaagaagauuaugacucuuuuauugauuccguuaugcaucaacucagacagacuccuggaaugucaauuugugaaccuaaucucacuuauaacuuuacuggauguccuccguuuggugcuggcgauaugagcaaagucaauucaugcacacgucuuggugaauugcgugguauguaugguacugcuuauuuaccucaugaaaacgaccauuauaauacguuaccuuuuggagaccuuccaccuaaagcuccaucgacgccugcaacucagcguggauucuauaaugaggaauuugcaccuuuaaaguuacacacugcaaaggaugauuuugaugaucggaaauaugacuacaaccgagaucgugacaaugauacuccugauacaaucguaaguucuuccaguccggaguguauuaugccagaguuccauccaagauuuccaggguugcaguuaauagacucagauaacgaagaagaaagauucagguuauccagguuuucuccugauauuccuaucauugcuccauuagcuauaaggccgaagccuauacgauucuauagugacauggauaaagaaaaugaaacuccugauggugagagagggcgcauucgugaaagcgugacgguuacuuuaacgcugacuagucaagcagccgacgaugugcucucuguauuacguaauuuagccaauguucugaggauaccuguaccugccacucacagcauaacggagaggaguucugcaucccaccgccuuggaauauaucgauugaagggcaaagaugggaaggaaggagcucaaguugauauccagucuauucugaacggaacugcgaaguuuuguaggcauugcgaugucguuauaaugaacaaucucaugcggaaaaaagcuucggaaaugccucuaguugccaggcaaggagaggaagaucuuuauuucugcagcacgucguguuauaugcaguuggcucucucccauucacaggguccuaacaaggauaaggcuuuaacaauuauagaucauguagaaacaccuuccaaaaagacuaaggucgaaucaacaacugacugcagcgcuguaaaaauugaaccaaagaaagaauacaaucuaucuuccgauccuacuuauaugaccacaaggggcucaggaaaacgcgagaaacaaaguagugccuaugacaaaauggcugugacaaacuccuauaauacacuuggaaagaaaucuccuucaagauaucgaacauggacgacagcaacuauuccaccuccuucugccaggcauaagaaaccuaccgauaaggaaauuacugagaugcuguucaagagcgguaucacgguuaugccuuugaaauugccugaggacagucgccauugccuucuuugccaucaaguuggcgauggugucacugaugguccagcgagguuauuaaauuacgauguaaauaaauggauucauuugaacugugcccuuuggucugaugaaguauaugaaacuguaaauggagguuugaugaacgucgaaaucgcccuucaaaaugggcuuucuguucauugugccuauugcaacacaacuggagcuacuuuaaaauguuacaaaaugcgcuguucuuuaguuuaccaucuuccaugcgcagucaaagaccaauguguauuuuuuaaaaauaagacacuguacuguagcagccauguaccaaagaacgaaaaggaaaacgaacugaccacuuugucugucaugaggcguguguacauaucucgagaugaaaaucgccaaguggcagcuauaaugcaccauucugaacagacaucgcuucucagggucgguucccucauuuuuuuaucugucggucaguuacuuccucaucagcugcaagcguuucauacaccaaauuacaucuaucccguuggauauaaaauaauaagaauguacuggagcaugcgcacagucaacaagcgcuguagauacauuuguuccaucgcagacguggaggguaaaccagaguuccguauaacgguagaggagcgaggugaggcagauauggaacuucgcgacaccacuccaagagggguuugguugaaaguuuuagaaccucuggcugagcuucgaaagguuuccucaguuguucaauuguuuucucgauacguuacuggugaagaucuguucggccuuacugaaccagcaauagucaggguucucgaaucuuugccagguguugaaacgcuuagugacuauaaauucaaauauggaagaaauccuuuacuggaauuaccuuuggcugugaauccaacuggcugugcucguucugaaggaaaaccaaaagguuggaagagagcucacacgcagagagccacuucucuuaggggaggaggaagugguccugcguuccccacgucggcuccgcugccuggagaacuugccugccccuacuccaagcaguucguccauuccaaguccagucaauauaagaaaaugaaacaagaauggaggaauaauguuuacuuggccagguccaagauucaaggauugggauuauacgcagcaagagauuuggaaaagcauaccaugguuaucgaguacauaggugaaauaauaaggucagagcuugcugaaacccgagaaaaacaauaugaagcuaagaaccgagguauuuauauguuucgcuuggaugaagaccguguuguugaugcuaccuuguguggagguuuggcucgguauaucaaucacuccugcaguccaaacuguguugccgaaacgguugaaguugacagggaucucagaauaauuauuuuuacuaaaagaagaauuucgcggggugaagagcuugcuuaugauuacaaauuugauaucgaagacgaccaacauaagauacccugcaugugcggugccaccaacugucgaaaauggaugaauuaa

SEQ ID NO: 7119 - RNA, 3276 nt, Piezodorus guildinii
auguccgaagacagugaaaaucacagagcccggccgaaaaggaauuugucagcgaaacaaaaaaaacucgaacuacuugaaaaacuuaaaagugggaagaaaaauaaauaugacauuggagaacuugaaaacguuuaugaagaagucgaugagaaagaguacacucguaaaguacuugaaaggcaagaugacgauuggauugucgaugauggugguugcggguauguggaagauggaagagaaauauuugaugaugauuuggaugaagaaucaaucaaaaaaucacaaaguauuguuacuggcagaaaaagaggaagagauauugccccugaaaagaaaggaaacauucguaauaugcuugcaaaaaugcccucuaagaagaaaaagaaagagacaucaguuaaacuggaagaagaugauauuuuaggagacauuauuggugaaauagauucaacaucaguggcaccauuacaaaacggcaacaagaagccuguaauaucugaaaaagauuauuugaaaucuuuaaccaauuuuaaacaaacaagccauaaagcaucuccugugaaacgugcaaaaauaaguucugaagucaauccacuuccuuuaguuaaagaaaccccaccaaaaaaguugguugauguaccaguugagacuucuccuauuaagauuaaagaggaaccaauagaugucgaugagauucaagauuacaguugugauauguucagugacgacuuugaucaagaaguuauugaaauuucugauacuaaagauaaugaaguaugcucaagagauauuaaaguagaaccugcuucuccuguaaaagaugcaucuccaguuaaaauggaaauuguuaaagaugaaguaagugaagagugggacaagcaaauugaauuugauucuccuguaacuuaugucaaugucgauaaaucuaaauuaccccuggugaaaaaugaaaguggucaagagguuuuaagauucuacuauugggaugcugcagaggaaauguacucacaaccagggacuguauuuuucuuuggaaaaauucuaauugaaucagcuaauacuuauguaagcuguugugucucaguaaaaaauauugaaagacguauauuucuucugccaagagaaaggaaaaugaaucuuaagacuaaugaagcauauggugauccugugacaaugacagauguuuaucaagaauucagcucaacuguagcagagaaguauaaaauaaagcaguucaaaucccgaaaaauuuccaagaaauaugcuuuuggugauaguaacguuccuucagagucugaguaucuggaaauaagguauccgugcacuucuacagcuuugccaagugaucucaaaggagaaaccuuuucucauguauuuggaacaaagacaucauuuuuagaaauucuucucuuggagcgaggaauuaaagguccuagcuggauugagauuaccaaugcugagccuguucuagcuccauuuacuuggugcaaaguggaggcauccuguaugaaggccagugauguuaauguauugaaaccugguuugccgcacauuccaccuuugauuuugguuacucuucauccacaagcuguccauaauccuaaaacaaaacagacagaaauuguagcuguagguugcuuagucaauaacucauaccauguugacaaaccuucuucugauagacuuuuuaaucaacauuucuguguguuuucaaagccaucugaucucacuuggccauaugauuuaaaagaacaucuaucaaauuucaagaaaacgucacuggaacgaauggaaucagaacgugcacuucuaaaccuucuuuuaacaaaauuguaucgaauagauccugacauuauugucggucaugaucucucuggauaugggauagaauugcuagugaaaagauuggcauuucacaaaguucccaauuggucacgucugggucguuugaaaagaucaguuauaccuaccacuaaggcuagaaaucaaauugaaaaaauugcucuuacuggucgcuuaaugugugacaucaaaguaacugguaaagaacuuauuagagcucguaguuuugacuuggauucccucugccagcugguuuuaaauuuccaagaaaauaaaagacaagauuuuacagaugaggaauuuaaaaguuguuuuuauucuggagagaauuuagucaaagcuuuguggucaauaaugacagaugcuucuuacauauugagaauauuuaaugaacuuaaugcacuuccuuuggcucuacaaauuacuaauauugcagguaaugucaugucuagaacauugauggggggucgcucagagagaaaugaguucuuguuacuucaugcuuuucacagcaaaggauacauuguuccagauaaagaguacaaaaagacuacuaaggaugaugauauagauggcacugcagaaguuacuacuagcucaaggaaaaagccaucuuaugcuggaggacuugugcuugaucccaagguuggguucuacgaugauuugauucuccucauggauuuuaauucauuguauccuaguauaauucaagaauacaauauuuguuucaccaccauuccuccaucuucuauugauauggaugaagauuuuaaugaaaauuaucaaaaauauuuuccugaggaaacuguggaaccaggaauuuuaccaacugaaauccguaaauuaguugaaagccggagggauguaaagaagcuacugaagucagcuguuucuccugagcagaaaaugcaguaugauauucgacaaauggcuuuaaaguugacugcaaacaguauguaugguugcuuaggauuuucaaauuccagauuuugugcuaaaggccuugcugcucuuguuacagcuaaagguagagagauacuuuuaacuacuaaaagaaugguggaaucuuuuggcuaugaaguuauuuauggagauacugauuccauuaugauuaauacuagaacuaaagacuaugagcaaguucaucaaguugguaagaaguugaaauucgaggugaauaaauguuauaaacaaguugaauuagauaucgacggaguuuucaaauauaugcuucuguugaaaaaaaagaaauaugcugcuguuacuauuaguaagcuuccaaauggugaguuuguugaaaaacaagaaaugaaagguuuggauauugugagaagagauuggucucagcuagcugcagcagccggaaggcauauuuuaaaugaaauauuaucaaacaaaucaagugaugauagaauugauggaauucacaac

SEQ ID NO: 7120 - RNA, 1401 nt, Piezodorus guildinii
auggcggcugggacccagguuaaaaauguggaaguccgugacauugcaagaauugagcgaauuggagcucauucccauauucgaggauuggguuuggaugacagcuuggaagcgagagcugugucccaaggaaugguaggacagcaaauggcaagaagagcagcuggagugguuuuaggaaugauuaaagaaggaaaaauugcuggaagggcaguuuuacuugcuggaccuccuggcacaggaaagacugcuauugcuaugggaauaucaaaaucacuugguaaggauacuccguucacugcaauggcuggcucugaaauuuacagucucgaaaugaguaaaacugaagcccuuacacaagccauacguaagucuauugguauccggauaaaagaagaaacagaaaucauugaaggugagguuguugagauacagguagagcgaccugcuacaggggucggugccaagguuggaaaacuuacauuaaagacaacagaaauggaaacuguuuacgaccuuggaaauaagaugauagaugcucuuacuaaagagaagguucagucgggugacguaauuacaauugauaaagcuaccgguaaaauuaguagaauuggaagaucauuuacuagagcuagagauuaugaugccacuggcccccagacgagguuuguccaaugcccagaaggagaguuacaaaaaagaaaagaagugguacauacuguaucuauucaugaaauugauguaaucaauucucggacccauggauucuuagcucuuuucucaggugauacuggugaaaucaaaccagaaguuagggaacaaaucaacacaaaaauugcugaauggagagaagaaggaaaagcugaaauuucaccugguguauuguucauugaugaaguucacauguuggauauagaauguuuuucauuuuuaaaucgagcccuugaagaugagauggcucccguuguuauuauggcuacaaacagagggaucaccaauaucagaggaacuaauuacacaucaccgcauggaauaccuauugaucucuuggacaggaugauuaucauaucuaccucgcaguacagggagagugagcuuagggaaauuuuaaaaauuagaugugaagaagaagauugugaauuaucugaugaugccuugacaguucucacuaggauagcaauggagacuagccuuagguacgcaauucagcugauaacacuagcuggccugguuuccagaaggagaaagaguaaugagguagaaauagaagauguaaagaaaguauauuccuuguuuuuggaugaaggaagaucaacccagaucuuaagugaauaccaagaucaguaccuguaugaccagaagccugauguugguggagguggggaaccaauggauauguga

SEQ ID NO: 7121 - RNA, 1110 nt, Piezodorus guildinii
augucuaucaggacuuauggcgauaagccaauuaguuuccaaguugaagaaaauggagaguauuauugcauugguuccgaaguugguaauuauuuacguauguuucgaggauccuuguauaagagguauccuggaauguacagaagaacucuuggaaaugaagaaaggaaaagacuuauagaacuuggauuaaguucucauuguuuggccucuagcauuucuuuacucagagcuucagaaguugaagauaucauugaggguaaugaugaaaaauacaaagcuguuucaguccauucuucugagacgccuauuacaaguucuucuaaacccaagaaagcuaugccauggguaccuucgcuuccaaacaguucucauuuagaugcuguuccacaggcaacuccuaucaauaggaauagaguuguuagcaagaaaguuagaaguuucccucucuguuucgaugacacugauccaucaucuaucauggaaaaugcuucccaaauggaaguucucguaccuauucgucucgacauggaaauagaagggcagaaacuucgugauacuuuuaccuggaacaaaaaugagaguuugauaacuccagaacaguuugcugaaauucuuugugaugauuuagauuuaaacccucucaguuuugucccugccauagcacaagcgauucgccagcaaaucgaagguuuucccacugauaauauuuuagaagauucgagugaccaaagaguuaucaucaaacugaauauacacgucggaaacacgucucuggucgaucaaaucgaaugggacaugagugaaaaagagaacaguccugagcaguuugcgaugaaguugugcgcugaacuuggauuaggaggagaguuuguuacggccauugcuuauucgauucgaggacagcucaguuggcaucagaaaacguacgcuuucagcgaaucuccccuucaaacuguagaagugccuuuccgaccgcagucagaagcugaucaguggugcccguuccuggagacguugaccgaugcggagauggagaagaagauaagggaccaggacagaaacacaagaagaaugagacgauuagccaacacuacuccugggugguaa

SEQ ID NO: 7122 - RNA, 654 nt, Piezodorus guildinii
acagcugcuccuugggcaaggaauguccacuuaguaguguugggaguugcuuuaagugguuauuguuuugugauggcugcuauacguaaaaaacuaguuauaguuggggauggugcuugcggaaagacuuguuuguugauaguauuuaguaaagaucaauucccagaaguauaugugccuacuguguucgagaauuauguugcugauaucgaaguugauggaaagcaaguggagcuagcauugugggauacugcuggacaagaagauuacgaucggcuaagaccacuuucuuauccugauacagauguuauuuuaaugaguuuuucuauugauucaccagauucauuagaaaacauaccugaaaaauggacuccugaaguaaaacauuuuugcccaaauguaccuaucauucuuguaggaaauaaaaaagauuugcgaaaugauccaaauaccaucaaagaguuggcaaaaaugaaacaagaaccaguuaaaccugaagaagguagagcuauggcugauaaaauuaaugccuuugacuaucuugaauguucugccaaaacaaaagaugggguuagacaaguauuugaaacagcaacuagagcugcucuucaagucaaaaagaagaagaggaaccgcaaauguaagcuucuuuga

SEQ ID NO: 7123 - RNA, 3984 nt, Piezodorus guildinii
augaaucuuaguuugaguaauuaugaaagaguuccaccucuggacuguuaucagcccucaggaaaucuauuagauuuagcugaucguaugcuagaaaaauuuacucaagaagacaauaauuugccucaacugcuggacaggcuccaaaucacuugugaaaguggaacuacaucuaguggaaccaaggacacugauuauauuaacaauguagacucaaguuauuuaucacagauaucucaguucagguuaauuaacaagauaccacuuccucaggaaauaucugaccaguucagcacccuugcagcaggaucaucaggagauacaacuaucauggggauguuuccugaaauaaauagagcuuggauggcaguugaaagugauauauacuuauggaauuucgaaacaggaggcgauguggcauauuuugaugguuuaagugacccuauagugagcguuggccuaauagcuccaagaccuggaguuuuucagaguuuuauuagccaucuucuuauucuuaccacaccuguagaaauaacuguucucgggguuauuuuggcauguucaagugaucgaaaaguuggugaugaauugcaacucacaccagauaccauuuacacuuugucuacugaugguguuccuauaagagugauuaaaggcacaaaaaguggacgaauauuucuuggaggaaaagauggaaaccuuuaugaauuaguuuacaggaaagaaaugagcuggggugguaaaagagcuuggaaggugaaccauaccaaagcuauucuguccuaucuaguuccaacauuugugucuggagcuuuuucagaagaagaucaaauaaccgaaauaacuguggaugaaucucgaaauguucuguauacacuuucaauaaaaggaucuauugaaguauuugaucuggguagaaauggagauacaacauguagaguugcaucacuucaucauucuuuuauuaaucguugcacuguggaucuaauuaggaaaucauuuuauuucaggaauauaacuccuccagagguuagucgaguagugagccuuugcccuauuucugaaaaugauucuccacauuuuggaguuguuggggucacagaaaauggaauuagauuauauuuuacuacaggaagcccaccuagaccaucuaccuugucacuucuucaugcuaggcuaccaccuggacaugccccuaacacugccaaugugagaauugguagaguagcuaugucuauucauaaaucagguacauuuauuaugguaucauccaugggugacuauucaccugaccgccuguggugcuuuaccauggaugguuuaucugcuuugaaguuacccuuaacagaauuugucuuuacaaauccucaaaaugcugcaauugcuaucgcugaaucaagggaaaauaugagcuugacggaucguggauuacauggacacuuucuaguuuaccagcagaauuauccccaggauagguuuauuauuuuaagucagcagggcacagauauuuaugaaaagcugaggccuguggauauauuuggugagcugaugcgagaaaaaggugguccggacugugaagaaguaaagcaguucuuugcccagcaugguucagaucaagcaugugcaauggcucuuauacuagccugugaccagaccaaucaacauauggcagaaugggcaacacgugcauuuuuucuuuauggaggugauccuaaauauguucugcaaaccauucagcaaccucuacaaccaucagcaguuaauaauccucuucagcagaccauacugcaucauacauuaccuuuagguuucaaaccagguacuguuaguaccccacuaggagagaagcaaacgcagcccucaagaaguaucgaaacuuauggagugucgaugucaucuaagcauaauggucuuuauauuuuccuuagccgaaugcuuagaccaguuugguuaagaagaguuuuagaugucaauuacaauaaaaaaccuauuuaucuaccaaccauuacuugugaagaacucaguuuaaagacaguucaacuuuuugagcuucguucauuucuugcaagauacaccuuaagcucaucagacguuggcuccaguuugcagccagccaacaauacaacugugguuucuccaaguggucagcgcacucgccuucaagaagcacucauucaagaaaaagcaucgcuugaugccuuaaggaauuucguugagcgaaucacccaaguuuucucucuuuggaaauuauuaugugaucaugaauugccucugauuguagaaucucuuucuccggaaagucaagaccaauuaauacauauuacauuuagagaacuaauucuuaaaggagaagauuuaugucaugagcucauuucaaaauuagucaguuuauauuugaaugacaaugcuuccgucgauccaaucaguucaaagcugagagaaguuuguccucuucuuuauaaaaaugaagaugcaacuuguacaaaagucaaugaaauucuucaaauggcauuggaggaaauugaugaagaagccaaguugaaccuguuacgauccgcaauugaucuuuguaaaaacguuucuccgaauguugauauugauucaguauguaagagcuuagucaaauguggguauuaugauggaguuuuagaaaugugccaggaugucgcuagcaagucugauucaaauucacuggcuucaaaguuuauagcuagagguagaccuguugaagauguugaaggaagcaaggcuuuugaagccagacauaaggcuuaccaacaaauaguucauuuauuagacuuccuauaccaacagugccaacuaggggguaauaauauuccuccucucuuuggaagugcugauuuaucuucucauucacagaagcuuuuggaagcuacucuugaaaaaugcuugucaguugaagaugaaacuugccacauuguuguuuaugauuggcuagugagccgagaacuucaagcgucacuaguuucuuuaggcagaccuucaguugagagauuucucucacgauauccuguugauagcagucucagagaucuuuuauggcaauaucaugaaaaaucuggaaaucacgcugcugcugcucaaauauuauauaagauugcuacugccccuggugaauuuauaacucuucaucaacgauuaacauaccuuggaaaggcuguaauguguaugcgaagugauggagugggaugugcaucacauuuaggaguauuucuccaugaauuagaagauuuaguacauguugcacgaguacagaaacagauucuagaaaggauuaccucaaugccagaugcuaaugauauuaauguucaggaugcuugccggaaacuuaaugccaauuugcuuucaauuaccgaauuauaugaaucuuuugcugaaccuuuuggacuuugggaacaaaaacuagccauuuuagacugugcuggccaugaugauaaagaacuuauuaauucuauuugggauaacauaauacuaaaagagcuugaucaguguaauucaagagacccaucuggucaaaugguuguauuaguaucaaaaguuagaucauuaggucuucaguuugguauacaguccccaugcuuccccauugaauaucuaguuuggcaguuggaauugauuagcugcaagcuuggaguagauaaguuucauguacacaauaucaugaccucauuaggaguuccuuacuccacacuuuuggauaucuauucaaagauguauucagcuaaugauaacuguuggcuugaaucagauaaugaauuucauuuaauucaaguuaucgcaagcuucugugaauccuuuugcgauaauaaacaguuaacaacaucagcacaagaaagaaaaucaacugcgguacaaaugcacgacuuaauuaaugaauguauaaucguccuucauagcaaaacuggcuugggggaacuuguuggauaucuuaaaagcauacaaacuaaacuagaaaggauuuag

SEQ ID NO: 7124 - RNA, 3624 nt, Piezodorus guildinii
augucuggaagugauuucuauggggcugauacuuugcauaaagaagucuauauuaggaaaggccaugaagacuggaaugaaauaaguuugaauccaggagggauugcaagcacucuccaggacauuaaaacccagcaaagagcaggagcuuaugcauacaaaaagauucccaauagauuuauauauuggagaacugaaggaaauguacuugaaauuguugaagaaugucuugauauaacauugcauggcaaccagauuagauacaaguuuacugauagccaaguguuggaugguuuggcuauuguugaaacuaugaaaagacuaauuauucuuguuccuacaguaucuagucuucauguuuucacuuauccacauccugagaaacuccugaaaaagggguuuggugaaguaucuagcuugucaguuuuucauggaauuagugaaaaugaugcaacugauccacagaccuacuaccaacugaauuguucuuccagugccauugucagcugcacaucuuguaucacaaauaauggagaagcuaucuuugcucuuggguuggcaaauacaucaguucuucuugucaacauagauucuguuagugguucaucuaguucucguauucuuucucaugacaacauuguuccucgauuucuuaccggaauuuuaggaaaggacgguggagaauggguuccaauuuguuugauuuugcauuacauaaaaaaagagcuuuuucucuuuucacuuuguagaggaggaagccuucguguguggucaguugauagaggaucauuuaucacuucucuaugcgugaagucaacgagucaaaccacguugaaagcucagaaacauaagaugugcaaaggauauauaaauggaacuuuuguauugcauuguuguguacaaggagcugcuauuguaacauuggcuccugauuaugauaaugguacauucaacuucacaaccauuucagaaauaccuauucaaccugguuuugaaguuacaaauauguguccaggagaggagggauacuuuugguguaguugguugacacuugaugaaucaccugcuguaaccaaaaauaauguaauucauccuggauuuucuaagguugcuuuaaccagaccuucccuucaagugccagugucagacuacauuccuagagauccagcuucucauuacuuagaugcuauauuuuccucugguuucuucacuucuuuagacauagcuaaagcaauuucacuguauaaaauaacugcuguuauaaaaccaaauauagauguugcugaacagauuugugccauaguggaaacugaaauuuauucagaaauaggugaacaagaauuggaugaugaugaauuuuuagauauagcuuuuagguguuggaaucgauuauauucauguugcagucaguauauuauuucaaguaugcuuccacuaggaaugguuuggcuuggagauuacuuaguuuuaauucaagaaugcgguuucucaauaguuguugauauugagccauuagaacuuuuuaugacaacugguguaaaguccucacaauuuccacaaguuggauauggcugguugguggaaagacugagggauauuaauuuagauccagguauugagaaguuagaauugagucuucauaccggagaaucaauugaugaacuuucuguucuucaagaagcugcugaucucauuucaccuucuaaacagcuugaugaugcucuaagcauguuuuaugaggaaggcuuaagcagaaguuuaaacagucuuauugaagaauuagcugugccugaagauuuuaauaaagauggaucuugggaaucauuuuguaguuauagugguguuggugcuguaacaucugcauuucgagacuauguugcugugagauuaaagauuugugaaaaaauauuauuaauuacugaacucgcuaugagggaugaugauggugcugcagauaggacucaacauaggagcuuagcugcccuuuguaaagccuauuauauuuuaaaauggaucugcacaucaaaguccacuggaaaugcaccuuugauucauguguuuucauuggucaauccaacaucaauuaugcaaucuucucuugaacaauguguucuuggccucgcaaauugcuuauggccccuagcgacaaauuguacacuugcucaacauuuacugucuacaaaacaauauucccuucuacaaacuuuagcaagauugguuggaauaaauaacuggaguuuacuacuggcagaaucguacauuuugacuggacagccugguaaggcauuugauguuuguuuaaagaaugcugguucagauguggugcacuuccuuaaugcuauaagacuuuuugaaaaacauucaagaucagauuuaguuauagcaauggcuacuaaagccuuggaacuucuuauuguuucacauucugauagggaaacacuugaaucagcuuuauucauucaugaauuaggaauggaaaauuaugaugcugcuuggaguuggauugaaucauguaguucuuggucccgcagaucugacuuuuugcagcgucuuguugccaacaugauaucggaaggaaaacucacugaucuuaucucauuuucuuauacugggcuccuagaugaguuagaaaagcuucuggcuucccgugcuagaucuuugacuuuuggacuagcuacuaacuacuauaauaucuuauaugcuuuccaugucaaacaugaaaauuuuaagaaagcugcaaguauaauguuggaaaaagcucuucgugcagaaacagcugaaguacaguggaaauguuauggcgccugccucagcucuuugauguugauaaaugauuccaagcaagcguggcugguacguccuaauccauucucucaagaggaugcuguagaaauacuagaaauugaggauauucaaagagaauuugaauuaucuggagcucguuucaauuuagauggguguucaccggaugcuucucaggaagagguaauugcauuauguguuagucaaaaacaauauaaaacagcacuucgucuagcaaccaugugcaaacuuucuugugcuccuuguauucaagcuuuuacagcuagcuguguugcucuuucugaacaaucaauauccuggcauuggcugaaagcaaaugaaauagaugauauuauuauaacugaaucuaaugcaacugaaauguuauggagaauuuuagaaagauguauaaugaaauaugaaaaaaaaaaugaaacagugcuucaucgggcuugcgcuaaccaauucuuaacuguugguuuguuuauuccuacuuggcuucuucaaucuuauaagaaaagaaacagcucagaauugcuucguauguuuguucaacauggauaucuggaagaagccgaagaauuagccugugaauacuuaaaugcugcucuugggauugguagagaaaauuuuucaauugauuuuccauuacaucuuucaucuccuccucucugucuaccuuuacaaaccauugauguuuuacuucuagagcuaaaacauuauaauauuggugaacgacuacaaaaaaaauuggauacuuauguaagcacaauaucaaggauaacuuuggaacgaccaaugauguugccuacaaaauauuaa

SEQ ID NO: 7125 - RNA, 2901 nt, Piezodorus guildinii
auggagauaucagaggaaaauuuacacacccucucuaacuauuuaaugcagacacuaaguccggacccaaaugucagaaggccugcugaaagauuccucgagucuauugagauaaauaagaacuauccuauuuuacucuuacaccuuaucaauaaagaagaaauccauuacacaauucguguugcuggugcaaucacuuucaaaaauuauacucgcagaaauuggccaguaaacgaugauaacuuggaaaacaagauugauccagaagacagacaaagggucaaagaguugauaguagauguuauguugguagcaccuucuaguauucagaagcagcuuuccgaagcaauuggcacuauuggaaaaugugacuuuccaaaagauuggccagggcuacugacaaauauggucgaaaaauuugcuggaggugacuuccauguuauaaacggaauccuccaaacugcccacuccauauucaaaagauauagguaugaauucaaaucucaaaaguuaugggaggaaauuaaguuugugcuugacacauucgcaaagccguugacugaucuugcuguggcaacacaaaaucuaacccaaguucaugcugcgaauccagaugcacugagggugauuuauucaucauugcuucucauuucgaagauauuuuacucauugaauuuucaggaccugcccgaguucuuugaagacaauaugaauguuuggaugccacucuuucauacacuccuuacugcugauguuaagugucuucaaacagaugaugaugaugaggcuggaauacuugagcaacuaaggucucaaaucuguucaaauguuucacuuuaugcacagaaauacgaugaagaauuucaaccuuaccuucaagguuucgucacugauaucuggagccuucuuguaacaguuucacuucagccuaaaaacgaucugcuugugagcaacgcacugcaauuuuugucuacaaucgccgaaagacaacaguaucgacaccucuucgaagauaaaaauguucucacuggaauaugugaaaaggucaucauaccuaacauacauuuuagagacgcagaucuugaacucuuugaagauaacccggaggaguacauuagaagagauauugaagguuccgauguugagucaaggagacggucaucgucagagcuugucaaagugcucgcaggucacuucccagaaacugucaggacuauuuuuggugcuagguuacaggaaaugcucgcugaauacaauagugauccagcuaaauggagguugaaaaacacagcuguauacauugugaccucucuggcugaaagggguucaacggcaaagcacgggguaacaaaauccucugaccuuguggaccuucaugauuuugcagggcaauauauuauuccugagcucaaaaaagauuugaauacguugccuguuaucaaagcagauucuaucaaguaucuuaucaccuuuagaagccuccuugcuccacaggugcugauaacugcuuuaccugauauagugaagcaccuugcaucucccagccuuguuguucacucauaugcugcaucggcuaucgacaaguuguugacacugaaacagaacaaucaaccauuaauaacacagacccuacugcagccgauugcuggagauauccucacuggucuuuuuaauauucuaaacuucaagggcucagaagagaaugaauacguuaugaaagcuauaaugagaucuuucaacacccuggacgaguccguuauuccauucuuagccgaacuucuucccaagcugacgcaaaagcucaccguuguugcuaagaacccaagucgcccacacuucaaccacuaccuuuucgaaaccauaucucucucuauuaggauaguguguaaaaauaauccuggugcuguuggcgcauuugaagaagcucucuuuccuaccuuccagauaauauuucaagaagauguucaagaguuugugccguauuguaugcaagugcugucauuaacccucgcccggaggucaccuccccucccugcucccuacguugcccucuauccuugucuccugucgccacagcucugggaaaggccuggcuguguucgaggucucgucugccuccugcguuccuacgucagggucucauccaaugaugauuuuaaccagacaguuaaaguuaaugggcuucuuggaguauuccaaaaauugauaucaucucggcugaacgaccaugaagguuucuaccugaugcaaucacucauagaacacuguccaagggaacuccuugacccguucaugaagcagguaguucuccuccucuuccagaggcugacugcggcuaagacgaccaaguaugucaaaggccugaucacguucuucuguuugcuggucgugaaguacggggcaccaacguucauagaacuuguugacucuguacagccucagauguucucaaugguaguagagaggcucauuaccccugacugucguaaaguaucaggaacuguugagaggaagauuacugcuauugguuugucacgccucguugcugaaucaaaacaaguuuucuccggaccauacucagccugcuggccagcucuagccaagaguguuguugaaauuuuggaagccccagaagaugauuccguugcuccugaagaucacuucguagaggucgacaauuuaccaggcuaugaaccagcauacguccaccucacugcagucggcaaugauaagcaugauccuguuccugauguuacugauuugagaagagaauuugcaaaugggauccguaaccuccugcagguuucaggacaagucgugacccaagccaucgcuagccucggagaaccuuacgcuagucacaucaagagcuaucucauuuugguaggaguuaacauauag

SEQ ID NO: 7126 - RNA, 576 nt, Piezodorus guildinii
auggcgaaaguccagauagguaauguuuuggugcuugauaaucccuccucuuuuuugaauccguuucaauucgaacuuacauucgaauguaucgaagaauugaaagaagauuuagaauggaaaaugaucuacguuggcucugccgaaagugaagaauaugaucaaguuuuagacacaauuuauguggguccuauuccagaaggaagacauaaauuugucuuucaggcagauccuccugauguuacuaaaauaccuauugaagaugcccuagguguuacugugguuuuacuaacuuguuguuaucguggacaggaauuugugcgaguaggauauuuuauuaauaaugaauauucugauccagaguugagagagaauccuccuccagugccgcaguuugacaagguugucagaaacauuuuaggcucugaaccgaggguuacaagguuuaaaaucaauugggaugauucagaaucacaagaucaaccuagucaagaaucagaagaacaacaacagacaacagaaaauguagcuuuugcugaaaauaguggaagucauaauuuuauggaaguaucuuga

SEQ ID NO: 7127 - RNA, 1011 nt, Piezodorus guildinii
acuauaaccuacugcauuaucugcugucaacaaaacaauacuauaauuguguuuauaauuucucaugguguauuauuuacguuuuugaucuuuaauuuucaucccuauaucaaaauggaucauaugcucgcgaguccguuuaauuuaccuagcauagguacuccuguccaucaaccugaagaagaucaacaaauauugccuauagcacaacagcagcaacaacaacaaauacaaccaccuuugcaaaugcccccuuuacuaccaauacaaucuucaauuaaucaaccaaaaccuaugaacacuuaugccccuucaauggguuuuacaacaccacagaguaugaugcauccacaaacaccacaaaaucucaugucaccaauggugaauagaauggaacagacgccgaacaauauuauaaaucccaccacuccuggaccaaugacacccaugacaccaucaucggcagacccuggcuuuaugccgcaguuacagaauauaguaucuacuguuaauuuagguuguaaauuagaucuuaaaaagauugcccuacaugcaagaaaugcugaauauaauccuaaacgauuugcugcuguuaucaugaggauaagagaacccagaacaacggcacugauuuuuaguucaggaaaaaugguuugcaccggugcuaagagugaggaugauucuaggcuagcagcaagaaaauaugcccgaauaauacaaaaguugggauuccaggcaaaauuccuugacuucaaaguacaaaauaugguugguaguugugauguaaaauuuccuauaagguuagaaggauugguuuuaacucauggacaguuuagcaguuacgaaccugaacuguuuccuggacuuauuuaucgaauggugaaaccucguauuguuuuauugauauuuguaucaggaaaagucguacucacaggugccaaaguacgucaggaaauuuaugaggcuuuugauaauaucuauccuauuuugaaaaguuucaagaaacaauaa

SEQ ID NO: 7128 - RNA, 483 nt, Piezodorus guildinii
auggcuucugucggcacaaccagaucuguuuugaggcuucuuucuucccagccuauuuuaaaacaagcuguucgaggcuaugccgaugagauggcauucacauuugcugcagcaaauaagguuuucuaugccaauuccaaugugaagcaaguugacgugcccucuuucaguggagcauuugguauccuuccgaagcacguuccaacucuugcuguuuugaaaccuggcgucguuacaguuuuugaacaagacgguucauccaagaaaguuuuuguuuccaguggaacagucacaauuaaugaagacuccucaguccaagugcuggcugaggaagcccacccaguggaggaccuggacgccuccgcggcgagggagcagcucuccaaggcccaggcagaucugucgagggcgaccucugagaucgagaaggcagaggcucuuaucgccaucgaaguagcugaagcccucguagcagcugcauaa

SEQ ID NO: 7129 - RNA, 936 nt, Piezodorus guildinii
augccuucggacgagcaagauaaauuugaugguauguuguuagcuauggcucaacagcaugaagggaucaaagaucuucuugauacuuucuucaguuucuuagcaagaaagacagauuuuuauauuggugcucaagcagaugcugcuagaucuuugguuauagauucauuugagaaauaucagucaaaagcgaauuuggccgcagaaaggaaaagaacagaaaaugccgaagcugaaaagaaaaggaaagaaaggcucgcugcuaaagccacuccuaaagugauggaaauaagcgaugaagaagcacaaaaaauugaagaugaagaaaaaaagaggaaagaagaagaggaaaaagcuuugucgaaaccaauuacagaaacagaaggugaagaugaugaacaggacaaaggaaaacuaaugccaaaugcuggaaacggugcagaucuugagaauuacagguggacccaaacacuucaagaguuggaaauacggguuccucuuaagaccacauucacuguaaggucaagagacuuaauaguagaucugggcaagacacaucugaagauaggauugaaagggcacgaaccacuuguggauggcgaauuagagcaugaaaucaaaauugaagaaucuacuugggucauugaagacggcaagacgcuguuucugacaguugaaaaaguuaacaaaauggaguggugguccaagcuguuugcuacagauccugaaauugccacccgaaaaauuaauccugaaccgucaaaguuaucugauuuagauggugaaacacgggguuuggucgaaaaaaugauguaugaucaaaggcaacgugagcuuggacuuccgaccuccgaugaacagaagaaaaaagacaugcucaaaaaguucauggaacaacauccagaaauggauuuuuccaaguguaaauucucauaa

SEQ ID NO: 7130 - RNA, 429 nt, Piezodorus guildinii
augacaacaccuuggaguccagacaaaaagcacagugauagagaaagauggauuugcauuuacccagcuuauuugaacaguaaaaagacucgugcugaagguagaauugucgcaaaagaaaaagcuguagaaaauccaaccuaccaagaaauaagggauguguuaucagcagcugguuugaaaguugguguugaaaacaaacuuuauugucgagagaagaguaaagagcuucucuauagagguagaauacggguucaguuaaaaaaugauaaugguacuccucucaacccagauuucgcuaccagagaaucuguaauacuucaugcaugugcaaugauuccaaagcugaaaacucgccaagguggaaaacauacaacugagcaaggucaggguggaacuagcaagaagaagggaaaagggagaagauaa

SEQ ID NO: 7131 - RNA, 2031 nt, Piezodorus guildinii
auggagaagccucagaaaaugccuaaaguagccaagguuaaaaacaaagcaccugcugagauccaaaucacagcagagcagcuuuugcgagaagcuaaggaaagagauuuggaaauaguuccuccuccuccuaagcagaaaaucucagauccugaagaauuagccgauuaccaacauagaaaaagaaaagcuuuugaagauaauauuaggaaaaauagaaugguaauuaguaacuggaucaaguaugcacagugggaagaaagucaaagacagguugauagaucucgaucaaucuaugaaagagcccuugauguugaucaucgaaacaucacccuuugguuaaaauacacugaaauggaaaugaggaaucgucaaaucaaucaugcaagaaaccuuugggauagagcuguuacaauacuuccuagagcgaaccaauuuugguauaaauauacuuauauggaggaaaugcuuggaaauguugcugguugcagacaaguuuucgaaagauggauggaaugggagccagaagaacaggcuuggcuaacuuacauuaaauuugaauuacguuauaaagaaauagaaagagcuagggaaauuuacacuagguuuguuaugguucaucccgauguucaaaauuggaaacgauuugcaaguuuugaagaaaggcauggauucauuucuggugccagaaaaguuuaugaaagagcuguugaauuuuuuggagaggauauuauggaugaacgucuauacauugcuuuugccaaauucgaagaaggacaaagagagcaugauagggcaagggucauuuauaaauaugcucuugaucaucuucccaaagaacgaacugcugaaauauacaaggccuacacuauucaugagaaaaaguauggggacagaacuggcauugaagauguaauugugagcaaaaggaaauaccaauacuuggaggaaguaagaacaaacccgaacaauuaugaugccugguuugacuuauugaggcuuguugaagaagaggguaauguagauacuauuagagaaauguaugagagagcuauugcgaauauaccaccuucaagggaaaaagauauguggaggcguuauaucuauuuguggauuaauuaugcccuuuaugaagaacuugaagcagaagaugaagaucggacuagacaaauuuacaggacaugucuugacauuauuccccacaaaacguucacguucaguaaaauauggcuuuuauaugcucaguuugaaaucagacauaaaaaucuuucaacagcucgcaaaacacuggggauggcuuuaggaguguguccuagagauaaacucuaccgagguuauauagaucuugagauacaacuaagggaauucgauagauguagaacauuauaucaaaaauuuuuggagcaugguccugaaaacuguauuacauggaugagguuugcugagcuugaaacacuguuaggugacacagacagggcaagggcuauuuaugaacuggcuguuaaucagcccaggcuugauaugccagaaauucuguggaaagcuuacaucgauuuugaaauaaacauuggugaagcuaggaaugcaaggcaacuauacgaaaggcuuuuagagagaacucaccaugucaaggucuggaugaguuauguuaaauuugagaugucucauagccaagaagagggaaucgaaccuauuucauuagcaagaagaauuuaugagagggguaacacugcuuugagagaaucgggagaaaaagaagaaagguuauuguuguuagaagcauggagagagauggaaaaaguucacggugaugaggaaagcuauaagaaaguugaagccaaacuucccaggaggguccgaagaagacaagcuguuauugcugcagaugggagugaagaagguugggaagaaguuuacgauuauauuuuccccgaggacgaagcaguuaagccuaaucucaaacuucuggagaaagcaaaagcuuggaaaaagaagcaagaagcugauaaccaaacaaaugaugaagacuga

SEQ ID NO: 7132 - RNA, 1431 nt, Piezodorus guildinii
auggcuaucaaguuuuuggaaguaauaaaaccuuucugcaguauauugccugaaauagcgaaaccagaacgaaagauccaguuuagagagaaaguacuauggacugccaucacacuuuucaucuuuuuggucuguugucagauuccucuauucggaaucaugaguucagacucagcagaucccuucuauuggauucgugugauccuugccucgaacagagguacccucauggaacuuggaauauccccaaucguuacuucuggacucauuaugcaauugcuagcuggagcaaagauaauugaaguuggugacacgccuaaagacagggcucuuuucaauggagcucagaaacuauuuggaaugguuauuacugucggacaagccauuguauauguaaugacuggaauguacggagacccugcugaaauuggagcagguauuugcuugcuuaucauuguacagcuguucguugccggccuuaucguucuuuuacuugacgaacuucugcagaaggguuauggucuuggcucuggaaucucucucuucauugccacaaacaucugugaaacuauuguguggaaggcauuuucuccugcuacugucaacacugguagaggcacagaguucgaaggugcugucauugcacuuuuccaucuuuuggcuacaagacaagacaaaguccgugcucugcgugaagcuuucuauagacaaaaucuuccaaauuuaaugaacuugcuggcuaccauucuuguguucgccauaguuauauauuuccagggauucaggguagaucuuccaaucaaaucagcucguuaccguggccaauacagcagcuauccuaucaagcucuucuauacuucgaacauuccuaucauccuucaaucagcucuuguaucaaaucuuuacguuauaucucagaugcuggcugugaaauuucauggaaauguauuuguuaacaugcucggagugugggccgauguuggaggugguggcccugcccgagcuuauccugucgggggucuuuguuauuaucucucgccuccugaaaaucuuggucacauccuggaagaucccauucacgcuaugcucuacauuauuuuuaugcuugguucuugugcuuucuucuccaagacuuggauugagguuucuggcucaucagccaaagauguugcuaagcagcuuaaggaacaacaaaugguuaugcgaggccaucgugacaauuccaugauucacgaacugaacagguacaucccaacugcugcggccuucggaggucuuugcaucggcgcacuuucaguccuagcugacuuuaugggagccaucggcucgggaacugguauccuccucgccguuaccauuauuuaccaguacuuugaaauauuugucaaggagcagagugagacugguggcaugagcacucuucucuucuaa

SEQ ID NO: 7133 - RNA, 522 nt, Piezodorus guildinii
augugcgaacugaacguucucgcuucugugagcccguccaucgugacuccuucgguggagcugagcaccuaccgggaccggagguucaguggcaccaagagcgaacaggaagagacccugcugcacuccuccacgcucuaugucggcaaccucuccuucuacacgacggaggagcaaaucuucgagcucuucuccaagugcggggacgugaagaagaucgugaugggacugcacaaguucaagaagauacccugcggcuucugcuucguggaguacuacgagaggcagagcgccgagggggcgaugagguacgucaacggcacgcguuuagacgaccggaucgugcggacggauugggacgcaggguucguggaggggaggcaguucggacgaggccgcagcggaggccaggugagggacgaguucaggagggacuacgacgcggggcgaggaggauacgggaagauggugcaagaggugagcagcaaggcggaaguugcaaccaucuucgcuggccaguga

SEQ ID NO: 7134 - RNA, 963 nt, Piezodorus guildinii
uuuuuuuuucucuccacaccaucuaaaauggcugcugcuauaggucggguauauggcucuagacuuuuaaaaauuaauccaguuucuaaacauuuucagauuggcagcuuuucuacuacuaaaucauggucaagagggaagaaagcuuuguauaccucacucgguauuuuaacuggagguacaggcauguugauauaugcccuugaaaaaagucuucaagcaggagaucuugaacuccauccucccaaacuuccuuggaaccauaguggguauuuucaagcacuggaucaugcaaguauaaggcgagguuaugagguguacaagaaugugugugcagccugucacagcuuaagauauguuugcuaucgagaucuuguagguguuucacacacugaagcggaggcuaaagcagaagcugaagaacaacuuguauuagaugguccaaaugaacuuggugaaauguucaaaaggccaggaaaacuuucugaucauaugccuaguccauauccaaacgaagaggcugcuagagcagcuaauaauggagcauaucccccugaucuuucauauauaguuccuggacgucauggagaagaagauuacauauuccacuuauuaacuggcuacugugaugcuccagcaggucugguuuuaagggauggccaguauuucaauccuuauuuuccuggaggugccauuaguauggcacaagcuuuauauaaugagauuauugaauacucugauggaacgccagccacucaaagucaauuagcuaaggaugucgcaacuuuccuuaaauggaccucagagccugagcaugaugugcgaaaacaaauggccuuaaagguaauguuuaucuuuucaaucuucauagcugcuacucuuuacuggaaaagacacaaguggagcacucucaagagccgaaagauuguguuuagaccaccuucaucuccaccaaaaguguaa

SEQ ID NO: 7135 - RNA, 1728 nt, Piezodorus guildinii
auguuagcuuuacaacaguacggagaaagcgacagugauaaagaugaagaagaaaagaaagaagaaguugauaaagaugcuuugcugcauuuaacgccucuuucuacuggacaaucaucuauaauacagacugcuauuugucccgcaccggcugcuuuaccaccuguugaguacaauccgcugaaauucauuaaaccugguugcacugagaugacuguaaaucuuaaauaugaagaacuguuugcugcugauguugggccugagaauccauaucuuacagaucaacaaaaggcucccaaaaauauucucucagguuauguugaagcagcucauaugagcgaauuucaguuugaaaaucagaggaaaacuuuucaaaguuucggauaugcucuugauccuucgauugauaauaugggucgcagcgaagacgguauacccguuguaggagcaguagaaguugcgaaggaaaccaaucucaagacaguuuuugaaucuacuuccaagcgaccucuugauagaaggaaaagaaacaaaaacgacgauccgucugauaucaauggcuuccucggcccgugggggucuuacguugaugagaagaaaguuguuaaaccagauccugaaguugcugcugaacuugaagaauaccucgcuaagaggcaaaagcucgguaaaaaaguugaagauaaaccucuggaagagaagacuguccuucauaucaaagacccaguggauuaccagggccgcaacuucuugcacccuccucaggaugucggcgucaaccucaagucagacucuccuccggacaaauguuucauccccaagucagaaauacacguuuggaaaggacauaccaaaggaaucucugcuauccgcugguuuccaaaauaugcacaucuucuccuaucgugcaguauggauugucgugucaaguugugggagguauauaaugaaagaagauguauuagaaccuauuauggccacagacaagcuguuagagauguuugcuuuaauaaccgagggacuaaauuccuuucagcugcuuaugaucgcuacauaaaauuaugggauacggaaacuggagaauguauaucacgauuuaccagcagaaaaauucccuauugugugaaguucaaucccgaugaagacaaacaaaaucuauuuguugcuggaaccucugacaaaaagaucaucugcugggacuugcgaucuggugaaauaguacaagaauaugacaggcauuugggagcugucaauucuaucacuuuuguggacgagaauagaagauucgucacuacuucugacgauaaaaguuuacguguuugggaaugggacaucccagucgacaugaaguauauugcugacccaucgaugcauuccaugccugccguaacccccucaccuaaccagaaguggcucgcgugccagagcauggacaacaagauaguaauuuucuccgcucuuaacagguucaaauugaauaggaaaaagacguuuacuggacacauggucgcagguuacgccuguacgcuugacuucuccccagauaugagcuacauuguaucaggugaugcugauggaaaagccuauguaugggauuggaaaacgacaaaacucuucaagaaauggaaggcucacgaucacgugugcauugguguccuuuggcacccgcacgagccgagcaaaguggucacugcgggcugggacggucucaucaaauauugggauuaa

SEQ ID NO: 7136 - RNA, 807 nt, Piezodorus guildinii
augguccaaaagaagcccaagaagaagacagggaagaagguugcagcagcaccucuugcuguuaaaaagcaggagguucagaaaguugugaauccucuguuugagaagagacccaggaauuuuggcauuggucaggauauucaaccuucuagagaucuaagucgauuuguuagauggcccaaauauauucguauucagcgacagaaaucuguauuacagaagaggcugaaaauuccuccuucaauucaucaauuuucucaaucauuagauaaacaaacagcuacccaguuguucaagauucuugaaaaacaucgaccugaaacugcacuggccaagaaacagagguugaaggccagagcagaaggaaaaauuaaacaaaaggaagagguuccaaccaaaaagacuaauguuauuaggucagguguuaauacuguuaccagauugguugaacagaagaaagcucugcuuguugugauagcucaugauguugauccuaucgagcuggugcuuuuccuuccugcacuaugcagaaagaugaaugugccauacugcauuauuaaagguaaggcacgccuuggcagguugguuaggaggaaaaccuguucuucaauugcaguaacccagauggaggguaaugaucguacugcuuuaaauaaggucauugaagcuguuaggacuaacuacaaugaccgauaugaagaaauuaagcgacacuggggaggugguuugcuuggcucuaagucagcggccaggauagccaaacuugaaaaggcuaaagcuagagaguuggcucagaaacaaggauaa

SEQ ID NO: 7137 - RNA, 1005 nt, Piezodorus guildinii
auggcuaauaugauaaaagauguuacaauugaugauaagaugcccaaugagcuuuuauuggacaagcauauaaaauucguuuuagcuuauggagcuaauaaggaugaauaugaauauuguacaacagagcacuugagaaugucugguauguacuggauuuuaacaacuuuagcaguuaccaagaaguuagaugaaguugacaagaagcaguuuauugacuuuauacuugaaugcacugaugagaaaacgggugguauuggugcuuguguuggacaugauccucauaucuuguauacucugagugcuguucaaauugcuuguauuuuaaggucauuagaccaacuuccccuagaaaagauuguuaguuuugugucaaguuuacagaaagaagauggcaguuuuaugggugauaaguggggagaaguugauaccagauuuucuuucugugcuguugcuuguuuaucuuugaucggucgcuuagaugcuaucaaucuugaaaaagcagucaauuuuguguuaagcugucaaaacuuugauggcgguuuugguucucaacaaaauucugaaagccaugcuggauuaaucuacugcuguguugguguucugucaauuacccagaacuuguauagaauagaugcugaucaacuggguuggugguuaugugagcgucaacugccuucaggugggcugaauggaagaccagaaaagcuaccggauguuugcuauuccuggugggucuugucuucauuaacaauguuaggaagacuacauuggauugauaaacagcuuuugaaaaaauauauucuugcuagccaagauucugaaggagguuuuagugaucggccuggagauaugccagaucccuuccauacucuuuuuggaauugcugcuuugucacuguuaggagaaucagauuuaaugaaaauuaauccaacuuauuguaugccacaauauaucauugaugaacugaacuuggauccugaaauuaugcagucacaaucauaa

SEQ ID NO: 7138 - RNA, 2748 nt, Piezodorus guildinii
augauguugaaaaugaauagcgaagccacagcacagcuuauacaaauuuuagagaagacuguuucuccagacaaaaaugaacuugaggcugcucaaaauuaccuggaacaugcugcacaaaccaauuuggcugaguuucugcaaacauugucacacauucuccagcauggcgguaacucaccaguugcacguauggcagcuaguuuacagcucaaaaauaaccuuaccuccaaagaucccaguaucaaagcgcaguaucaagcuagauggcucgcauuuccggaggaaacuagaauguauaucaagaaaaauauccuaggugcuuugggaacugaaaacacaaggccuagcucagcugcucaauguguugcuuacguugcaguagccgagauaccuguuggucaguggccugauuuaaucccaacauugucugcuaauguaaccggacccucuucgacugaaaucaugaaagaggcuacucuugaagcgauugguuauauuugccaggaaauagaacacgauuguuuagcuagucaaucuaaucaaauuuuaacagcuauaguacauggaaugaggucugcugagagaaguaauuaugucagacuggcagcgacaacagcacuccuuaauucccuugaauuuaccagggcaaauuuccaacaagauauggagcguaauuacuuaauggaaguaguuugcgaagcuacacagucaaccgauacacaaguccguguugcagcucuucagugucuuguuaaaauuaugacucucuacuaccaauauauggagacguacaugggucaagcauuguuuccuauuacuuuggaagcaaugaaaucugauauaaaggaaguggcacuucaaggaaucgaguuuuggucuaaugucucugaugaagaaguugaccuagcuauagaagaaucagaagcaguagaaaugggaaaaccuccagcuagaacaucucguuauuaugcaaaaggagcacuccaguaucuuguuccuguaguucucaccaaguugacuaaacaggaggaauuugaugaugaagaugauuggaauccaagcaaagcugcagguguuugcuuaauguuacuggcaacaugcugcgaagaagacauugugccucauguguugccauuuguucaacaaaauauuaagucuccagauuggagguauagggaugcugcugugauggcuuuuggcucaauucugaguggacuucacucuaacacguugaaacccaugguagaacaagcaaugccuacucuuauucaauugauguaugacucuucagucgcugugagagacacagcugcgugggcauuuggucgaauuugugaaauaguacccgaagcagcuacaaaugaaaauuauauuaaaccccuucuugaaucucugcucaauggccucaaggcagaaccaaggguagcagcaaaugucuguugggcuuuuacuggguuggcugaggcuaguuaugaucaggcugaaaaucagguugaagaugguucucagccugagacuuacauccucuccagauauuucgaguacaucgugcacagccuucuagcuacuacugauaggguagauggggcacaggcuaaucuacguccugcugcguacgaagcacuuauggagauggugaagaacucuccuaaagacuguuauaccguuguccaaagagccacacucauuauauuggaucguuuaaaucagguucuggccauggagcaacagauucaaagccacucagauagagcgcaguuuaaugaucuccagucacuccucugugccacucuccagaguguucuaaggaaaaugaccccagaagaugcaccccaaauaucugauacaauuaugaaugcucuucuucaaauguucaauuccaauucaugcaaaucagguucagugcaagaagaugcgauaauggcagucucaacacuaguugaaguucuuggugauggcuuuauaaaguauaugccagcauuccaaccguuucugugcaugggccucaaaaaucaugcugaauaucagguuuguugugcugccgugggucucacuggagauauaugucgggcauugaaaaacaaaguucuuccauauugcgaugauauuaugcggcuucuccuugaaaaucucagugauaacaguguucaccguucuguaaaaccacaaauccuaucaacuuuuggagauguugcauuaagcauuggugcugauuuuaaaaaguacuuggauguaguacuucacacacuuaugcaggcuucucaggcacaaguugauacgagugacuucgacaugguugauugguuaaaugaauuaagggaaggaauuguugaagccuacuccgguauuauucagggauugaaaggggaagauaacaacacagcugcaagcgcugccaaucuugcacugcuugagccucauauaccagugauggcucaauucuuaaccuguguuucaagagacacuucuaagcaagauaaaguguuggcuggcucugcuggucuaguuggagaucuuuguucugcuuuuggugcaaagguuauaccccuguuggacauugauccaaucaaugagcuccuuacccagggaaggagaucaaggaucaacaaaacaaaagcuguuuccaauugggccucaaaagaaaugaggagauacaaagcaacuauugcuaaugcugccucaugcgggagugaaguggugaccaauggugcucaggcgaugaugucaccaccaggugccauguaa

SEQ ID NO: 7139 - RNA, 1506 nt, Piezodorus guildinii
auggagacuauauuggagcaacagagacgauaucaugaagaaagagaaaggcugauggaugcaauggucaaagagauguugcauaaaaaaucaaguuaucgugagcaaauuaacucagaucacagacucaagaugcuucuugaucaguauauggagagcacucacaaacucaaggaacuguaugaagacaaggaugguauaaggaaagaugaaguugcugcacuuucagguccaaaugaauuuucugaauuuuauucaagguugaagaccauuaaagaauucuaucguagaauuccuaaugaaauuucgguuccuaugucuguugaauucgaggaguuagcgaaacuucgagaaaauccuacugaagaaacaucaaauuuaguagaauuuacugacgaagaaggauauggaaaauaucucgaucuucaugaauguuaugagaaauauaucaauuugaaaggaguugagaaaguggauuauaucacauaucuuacuacauuugaucgacuuuaugaaaucccaaaagauagaaagaguucugaguacaaacgauauguuauaaugcuccugaauuaucuuugugauuacaucgcuaggaucaagccacuacuugaccucgaccaggaauuaacuaauguucaaaaggacuucacaucacagugggaagcuggaacuuucccugguuggccuaaagaaacaggcaguguguuaagcaauguuggugcccaucuugacuugagugcauuuucaucuccugaagaauuggcuucucuuggucuggacaggcuuaagucagcuuugauggcuuuaggauuaaaauguggaggaacuuuagaggaaagggcucagcguuuauucaguacuaaaggaaaaaaguccuuggauccgaauuuacuugccaagucaaaaccagguaaaucgaaucgagaacgugaccuugaaagacagcgggauauugcauucuuagaagcucaaguuuacaaguuggcugaauuacuaagcgaacagcgagcugcuacuaaagaaaauguucaaagaaaacaagccagaacaggagaagaaagaggagauucagaaggugaagcgucaucuucaggaagugaaagugagggagaagaugaugguguuccguacaacccaaaaaauuuaccucuuggcugggauggaaagccuauuccauauuggcuuuacaaguuacauggacucaacauuaguuauaauugugaaauaugcgguaacuuuaucuauaaaggaccaaaggcguuucagagacauuuugccgaguggaggcaugcucauggcaugcgaugucuuggaauuccaaauacagcacauuuugccaacguuacucaaauagaagaugcuuuggcuuuaugggagaagcuaaagacaaugaaacacgaugaacguuggcaaccugaacacgaagaagaauaugaagauucucucggaaauguagucaauaggaaaacuuaccaagauuugaagagacaagggcuuuuauaa

SEQ ID NO: 7140 - RNA, 636 nt, Piezodorus guildinii
augacggucgguaagaauaauaaaaugcuucaacauauuaacuacagggugagaauaauuuugcaagauucaaggacauucauaggcaccuuuaaagcauuugauaaacacaugaaucuuauucuuggagauugugaagaguuuagaaaaauuaaaccaaaaaauaccaaacagccagagcgagaagaaaagaggguauuaggauuuguauuacuaagaggugaaaauauuguuucacuuacgguugaagggcccccaccuccagaagaaggauugccuagaguaccucuuccuggagcagguggaggaaucgguacggcaagaccugcuggacguggaguuccagccccugguacuccagcugcaccuggucuucaaggaccaguucgugguguuggaggcccaucugcacaaguuaugacuccagcugggcgaggcggacaaguuucagcaccuccucaaaugcgugcuccaccuccaggaaugcccccaaugaugggagcucccccaaugaugaauauggcaccuggaauggcaauggguagaggugggccuccuccucagaugggugcuccuccugcuccaccaaugcgggguccuccaccaggaaugaugagagguccuccaccuuuuuaa

SEQ ID NO: 7141 - RNA, 1251 nt, Piezodorus guildinii
augcaagcuuccuuaucgucaaaucaauuaguagggauugcaguggcauugucaacgauuccgaaugagaaacguaggagaaaaagaaaaauuugggccaaagauuuguuccuccaacgucccaggguuagagaaaccggaauuuccgaaguauuagaaagugaugauuuuaaacuuaugaggauuacgccugaugcauuuuauaaguuacuuaagauggugcggccuuuaauuaagaaaaauaauacuguuaugagagaagcagucacugaggaggaacgguuaauuauuacucuuaggcauuuagcuaccgguaagagcuaugcugauuugcaaaacaguacugcaguuucuccaucgcuuaugacuucaguuauuagagaaacuugugacgcuauuuaucucagucucaaaaguggaauaaagaugccuacuacagaacagcaauggcuugaggucgcugaugguuuugaaaagaaguggaacuucccgcauugccugggcucuuuugaugggauacacguggcgauaaauaaaccagcgcauagcggugcaaucuuucucaacuacaaaggauauccaagugucguuuuguuggcacuuguugaugccaauuaucaguuuauguauuuaaacacuggugcaaaugggagugcaucagguucaacuguguucgaaaacacuauuuuuuaccaaaaauaucugucaggaaagcuaaacuuaccuaaggacaguccacuaccugguauggaagaaaaaguccccuauguuuuucugggagauugugcauuuucccuugaugaaaauuguaugaacacauuuccgguuaaaaauauugaccacccgaaaaggauuuucaauuaccgucuuucccgagugaggaaucuugcugaaaauacauuagguauucucacgucaagauuuagaguucuacgccaaauuucuucuguaaaauuagauaccauugauucaaucguucuugcaugcuguucuuugcacaauuaucucucgaaaaauaauccuuccuacuuagaugaugguguaaccguagauuacgaagauuuacaaaacauugaauuccgucccggagaauggaggcuagauaauaagcuuguaccauugugucauaaaaguauaagaaauagauuucaagaaggugaugauguacgucaaauauuuguugacuacuucaacucugucgguaguguuccuuuucaagaagacaugcuuaaagucaucccagaaggauag

SEQ ID NO: 7142 - RNA, 1710 nt, Leptinotarsa decemlineata
augaaaaaggaagcaaaggaacggucaaggaaagaacggaugggaugggauaaugaauaccuacacuacaccaauagcgauaauccauuuggcgacggaaaucuuuugucaacauucguguggaauaaaaaauuaucaaaggaaggacuaauaggugucagccacgaagaaauagaagcaagaaacagauucaagcaagaagaaaauaaaagagaacuugagaaggucaagaagagaagacaagaaagagaauuagaaagacaaaagagggaagaagaaacacaacuuuuacagaggaguaaagaagcggcacaauuugaggagugggagcgucacgaagaucaguuucaucuagaacaagcucgauugcguucucacauucgaauucaggauggaagagcgaaaccuaucgaccuccucgccaaauauauaagugcugaagaagaaguggaugcgguagaaaugcaugagcccuauacauaucuuaaugggcuacauauuaaagaucucgaggaucucguagaagauauaaaaguuuauaaagagcuggagagaggaaaaaauuuggauuacuggaaugacauuacugucauuguggaagaugaauuacaaaaauugcgaaaacuagaaaaacaagacgauuuugauauggguuugaacagacgugaaggaauucaucaagcaguugcaucggauguuacuuccauauucaaagggaaaacagcaguucaguuggcagcuuuggagaaacaaaucgaggccaaaaucaguaguagagcagauggaauugauauuggauauugggaguccuuguuaucucaguugaaagcucauauggcacgagcacggcuaagagauagacaucaagacaguuugagacguaaauugcaaguauugaaagcugaacaagcaauuauuaucccugcacaggccgaagccaguuccaaugaaguagacgagccaaguaccaguaaaaauuuugagccgaaaccagguguaucacaagaagaugaucgagucagcgaaaaugaaggaaaugaagaugaagcaaaagacaugcucaaugaauacuucauugccuaucaaacaggaggcuacaguccgaaauuuuuaucaccagaagauauugaaccuggaaccauuguuguaacugaagaagaugacuuaaaaagguuggaauucgcuaggcuacaaguuguuggcagugguaaaaaaguugagaauguuaucacaaaggaagaguugcugcuucaaaaggaagcgaggaagggaauggaugcggacgaagcacaauuuucuguggaacaagcucuagauagccaaguuuauuuguggucugauaaguauagaccucggaaaccgagguauuucaacagaguucauacagguuucgaauggaauaaauauaaucagacacauuaugauauggacaauccuccaccaaagauugugcaaggguacaaguucaacauuuucuauccugaucuaauagauaaaagcagugcgcccgaauacuuuuugauuccgugcuuggaaaauaaagaauucaccauccuacgauuccaugcaggcccuccauacgaagacauugcuuucaagauugugaauagggaaugggaguauucuuacaaaagaggauuuagaugucaguuucacaacaacauauuucaauuaugguuccauuucaagagauaucgauaucgacgauga

SEQ ID NO: 7143 - RNA, 1107 nt, Leptinotarsa decemlineata
auggauaauuuagaagcaaauauaauggacaaguccaugagaucuguuuuuguuggaaacauacccuaugaagcuacugaagaaaaguugaaagauauauuuggugagguuggucaaguauuaucauucaaacuugucuuugaucgugaaaccgguaaaccaaaagguuauggauucugugaauauagggaucaagaaaccgccuugagugcaaugagaaauuugaauggguaugaaauaggaggucguaacuugagaguugauaaugcuuguacagaaaaaucuagaauggaaaugcaaaaucugcucaaucagccaccuguagaaaauccuuauggggagccuauucaagcagaaaaagcaccugaagcaauaaguaaagcuguagcuucucuaccuccagaacagauguucgaguuaaugaagcagaugaagacaacaauucagaauaauccaacagaagcaaggcagaugcuuuugcagaauccucaacuggcuuacgcucuucuucaggcucaaguuguaaugaaaguuaucgauccgcaaacagcagcuagccuauugcaucccaucaaucaaguuccagcgacucugaugccuggugauaagaauguuccaguucagguuccaauuagcaaucaauauagagaaccuccugcaccaguacagccgcccaggcaagaauuucagccaguaccagcgccaguuuuacauccaagugcccagccuucaguguuugcaggucaagacauagaucuaagaucuauuggaggcucaacagaucuaagaaugacaagauuaggggaucaggauaugagacagauuccuggaccauuacagaauccuuugccaccaccgguggcugaaaguuuccaaagggaucugagagauccccguccuauaccucaagcauucucaguugaacccagacaagcucguaucgaucccaggcagaaaccaucagcuaugccuccuguucaguugcaaccacaaccugugagaccuccauuacaaccucaaacaacuggaccuguaccucuucgucccccaguaccccagccuauggcuaacccugucccagcuacugucaguccuggaaucggccca

SEQ ID NO: 7144 - RNA, 651 nt, Leptinotarsa decemlineata
ggacccccaggaacuggaaaaacucuucuugcuagggcuguagccucucaauuagaugcaaauuucuugaaaguuguuuccagugcaauuguugauaaauacauuggagaaucugcuagauugauaagagaaauguuuaauuacgcuaaagaucaccaaccuuguaucauuuuuauggaugaaauugaugccauagguggccgcagguuuucugagggaacuucagcugacagagaaauucaaagaacccugauggaacuucuaaaucagauggacggauuugauucauugggacagguaaaaaugauaauggccacuaauaggccugauacauuggauccugcuuugcuccgcccaggucguuuggauagaaaaauugagauaccucuaccaaacgagcaagcaagacuugaaauucuuaaaauucaugcuuugcccaucgccaaacauggugaaauugacuacgaggcaauugucaagcuaucugacuccuucaauggagcagauuugagaaauguguguacagaagcaggguuguuugcaauccgggcagaaagagaauauguaauucaggaagauuucaugaaggcagugagaaaaguugcagauaacaagaaauuagaaaguaaauuagauuacaaaccuguauaa

SEQ ID NO: 7145 - RNA, 762 nt, Leptinotarsa decemlineata
gauacgagaacgacaaucuuuucaccagaaggaagacuuuaucagguggaauaugcaauggaagcuauaucccaugcugguaccugucucgguauuuuagcuaaugaugggauuuuauuagcagcagaaagacgcaauacaaauaaauuauuggaugagguguuugcuucugaaaaaauauauaaacugaaugaagauaugguguguaguguugcuggcauaacaucugaugccaauguuuuaacuaaugaauugcguuugauuggacagcgauauuuauuccaguauggagaaucuaucccuugugaacaguuaguaucaugguuaugugaugucaaacaggccuacacucaauauggaggaaaacguccauuugguguuucaauauuauauauggggugggauaaacauuauggauaucagcucuaucaaucugaucccaguggcaauuauagugguuggaaagcaacuuguauuggaaacaauaguucggcugccauuuccaacuugaaacaggaguauaaagaaggagaaaugacacuaaaggaugcaaaaucucuggcuauaaaaguucuugucaaaacuuuggauauggcuaaacuuacuucagaaaaaguggaaauggcuacuuuaucacgugugaauaauaaaacaguaaucaacauuuugagcaguacagaaguggaaaacuugauaagugaguuugaaaaaaaugaagcuacucuugaggcuaccagaaaagaacagaaacaagcagucuga

SEQ ID NO: 7146 - RNA, 2646 nt, Leptinotarsa decemlineata
auggaaacuuccaaaaucgaaguaaaaacuaaugaugauaagaacaaaaaugagcugucugaugaagauaagcugcugcaagaagaacucaacuuauguguggaaaaacuacaggaaagugaugaaaaacuuuauuuaccugcucuacaugccuuggguaauaauauucgagcaucuaccacaucuaugacguccguuccuaaaccucucaaauucaugaaaccacauuaugaaacuaugaagcaagcuuaugagaaagucacuaacccagaaauaaaaaauguuuuugcugauauuauuucuguauuggccaugacgaugggagaaggaagggaaugucucaaauauagacuucucucuaauuuggguaauaucggagaguggggccacgaauauguucgucacuuggcaggagagauugcuggagaaugggcagaaacugauuucauggugaacacagaaauaagagauaaauuaauuuuacuggcuaagcagauccuuccuuauaacauggcucacaaugcugaagcagaagcaugugauuuacugauggaaauugaaagacuugaucuacuagaacaauacguggaugaaaauaauuaucaaagaugcuguuuguaucucacaaguugcauaccauauguggccgauccagaaaauaauacgcuucuucagacugcucuauugcuguuccgcaaauucaaacaguauucgcaagcauuacguuuagcuaugcaguugaaugaucauucucugauagaagaaauauucacaacuuguccagauacggcuauccagaagcaguuggccuucauguuggguagacaacagauuuacauagaaauucccgagaguacuccagaauaugaagauauuauagaaauuauggcuaacugccacuugaacaaucacuuccugaaucuugccagggagcuugacaucauggauccgaaaacucccgaagauguuuauaaaucccauuuggaaaauagucguccucccuuuggaggcagucaaguugauucugccaggcaaaauuuagcagcuaguuuugugaauggauucguaaaugcggcuuucggccaagacaaacuucuaauggaggauggaaauaaauggcuuuauaaaaacaaagagcauggaaugcugagugccaccgccucccuuggguuaguccuccucugggauguugaugguggucugacuccaauugauaaauaccuguauucuuccgaagauuacauaaaaucuggagcucugcuagcuugugguauugucaacuguggaguccgaaaugagugugauccugccuuagcccucuugagugacuauguucuucauaauacuaauauuaugaggauaggagccauuguugguuuagguuuggcuuacguugguucuaacagagaagcuguccugagucugcucacuccaguauucucagauccuaaauccaacauggaaguaauaggcaugucggcauuagccugugguaugaucgcuguuggaucuggcaacccccaagucaccacaacaauuaugcaaacucuaauggagaaaucagauacagaacugaaagauacauacgcucgguuuuugccuuugggucugggucuuugccauuugggaaaacaggaagguauagauacuauuauugccacuuuggaagucauaccugaaccuuuccggucgauggcuacaacaaugguggacauuugugccuacgcuggaacgggaaacguucucaaaguucagaauuugcugcacauuuguucagagcauuaugaaggcucugauagcaccgacaaaagcuccaaagauaaggacaaaaaggaaacuguuaaagaaaaagaucuaucuaccaggcaggcuguagccguacuugguauugcauugauuagcaugggggaagauauuggcagugaaauggcuuucaggacauuugggcauuuacuucguuauugugaaccagcgauucggcgagcuguaccucuggcuuugggacucaucuccguguccaauccaaaguugggcauucucgacacccucagcaaguuuucacaugacagugaugcagaggucgcccacaaugcuauuuucgccaugggauuggucggagcugguacuaauaaugccagacuggcagccauguugaggcaguuggcacaauuucaugccaaggacccaaacaauuuguucaugguucgcaucgcucaagggcucacucaucugggcaaaggaacacuuaccuuaaguccuuaucacagcgauaggcaacugaugaguccuguagcuguagcaggauugauggcaacacuuauuggauucuuggaugucaaaaauauaauauuaggaagaucucauuaucugcuuuauaccuuagcagcggcuaugcaaccuagaaugcuugugacauuugaugaggaacugaauccacugcccauaccugugcgagugggauuggcuguugaugugguuggucaggcaggcaaaccaaagacaauuacugguuuccaaacucacacuacuccuguucuguuggcuuauggugaaagagcugaauuagccaccgaagaauauguagccuuaacaccaauuauggaagguuuugugauuuuaaggaaaaauccugauuucaauccauaa

SEQ ID NO: 7147 - RNA, 1242 nt, Leptinotarsa decemlineata
auggauccggccgaagaacaagaagucaaagacgucaaaccaaaagcugacucagaugaagacaaaaaccagcagcaaccacaacaaccgcagcaacaaccucaacaacgaccuccaccaucauccaccgucaucaaacgaaauuucaucacaacugcuggaacaauaguugaaaauuacgacgaacagccuccagaggcagcaggcgaagaaauaguuaacaccucuacgucaacuccacaagaacaaaguccugugacgcacaaaauugagucuccagaaucgggaucauaccaagagauuaucacccaacgagacauaaagacuuauucggucgagguaccggauacuuauacagcuuccggcaccuacuccucagaguuauacucaauagauaacagcaugacaucaguuacuaucucuagugacuuggaacaucaaggagacuacacuaacuugcagacugcucaguacaauaacggauacaccgaugcuucgcaguauauggaacagcaucaguaccagacccuguacacugagagaggagccguggauaguucuccaccgguuuuguauaggaacgaucccaauuuggggucuucuagguaucaaggcgacuacgaaccguccacgcaaacccaagucagccuccucaacccguccagcgaaaccgucuacuccacauuucccuccacgagcagcgccaccuaccaccaguucuaccagaauaaccccaacguccugcacccagcggacagcacccaggcguaugggggggcguacgugaauacggccugguccaguggcggcggcuuggacgacgggcaccgggccagucaagagaucggaaacagacgaaacggaguucagugugccaacugcaagacaaauacaacaacucuuuggcgacgaaauaaucaaggggaaccaguauguaaugcauguggacuauacuucaaauuacacaauguuaacaggccgaucaguaugaaaaaagaaggcauccagacacguaaacgaagaccaaagaauucuuccagcguuucuagcgcaggagcaucgaaucaaguuagauuggcaccuuauauggguuaccuacaaguuucggaugaauugccucaagaccaguaccaaccucccaugaacauuuauccaacuuccaaucaaccagucuacaaccaauacaccccagcugcaaucgaacaacuuagaaauuugagugccauucaaccaaucauggug

SEQ ID NO: 7148 - RNA, 3111 nt, Leptinotarsa decemlineata
gguacagaguauuucaaccaaaaaccuaaaaaagguauagaauuucuucaagaacauggguuucuuaaaccuguauuagacauagaagaaauugugauguuuuugcgagaaaauccuggucuaaguaaagcuaugauuggugaauacauaagcaauaggagcaaucugaagauuuuagaagcuuuugugaagacauucaacuucacagauguuagaauagaugaagcuuugagagcguuuuuggaaucuuucagauuaccuggugaagcaccuacaauuucacuuauuuuagaacauuuugcagaucauuggcacaaaaguaauggggaaccuuuugcugauguugauucagccuuuacuuuggccuaugcaauaauuauguugaauguggaucaacauaaugaaaaugcaaaaaaacaaacuguaccaaugagugcuucugcauuuaaaaagaauuugaaaggcguuaaugguggagaugacuuugaugaagaacuacucgaugaaauuuauaauacaauaaaaaaugaugaaauugucaugccugcagaacaagcagguaucaucagagauaauuaccucuggaaguuacuguuacggaaaggucaaucaaaagaggcuucguauguucaugaaaauaguggcacauaugauuuugaauuauuccagauucuauaugguccagcugugucugcucuaucaucugguuuugaaaagagugacaauccaaguauauacaaaaaaauaaugaagggauuugaacagugugccuuuauagcuucuaaucugaauauuccuaagaguuuagacaugcuucuuuugacaaucucuaaauuuucucuauuccauaaugggggaagacaaaacaauguuguuauucaguuuggcgcaaauaauaaagcacaauuggcauugaaaacuuuuuuugccuuguuccaucuucauggcaauagcauuacagaagguuggaaaacuuuguuugauuuaauguuguccuuauacaccaaugacuugcucuccaaaacuuucacugaaauugaagauuucauugaaccaaguggaaaauuuguguuacacuuugaagaggcucccaauuuggaaaaacaagauacaggucucuuaagcucauuauauuccuacaugguuucagcugaaaaucucucgaaaguaccaacaccugaggaacaauauuuuauugaaauaaccaaagaauguauaaaagauuguaauuuggaucaguugauaaccgacucuaaauuucuccaugaaaaugcucuucuggaaaugguuaaaacuuugauagaguuauccagaggaccugacauucaagaaagccugggguacaacuauaaucagaauguaacaguguuuuucuuggaacuccuuauaaaaauuguuaugcaaaauagagaucgaguaaugucaauauggcagaauguacgagaccacauauauacuauuguaaugaaugcaucucuguuugauuaccaguuccuucuggagaggucaguaauaggauuauuacgaauagcuauacguuugaugagaaacgaagaaaugagucauauaguucugcagucacuucgaaugcuucuucuguugaaaaguaguacauuaagcagaauaucccgacagaucucguuuggauuauuugaauuauugaaaacuucugcccagaauauacauacuaauacugacuggacgauuauuuucacacuucuugaaugugucggagcaggagcccaaccaccuaagccuauuucagaagauucaucuuugcugagccaugagauuaaaucuggcgaggaauauccugauaauacuagagaagacgaugccauuguugauagaggauacaaauccgauucagagcuaacaaagaguaccaaacaugaccaagagcaucaaaaaaguuuuguuccuguuucaccacuuggaacgcccaguacuggagguuggauacugguugguaacgaaggugaaauucaacccgucaugggcagaacugugccaccaacccaauaugaacuuuguuuggaaaagaacuugggaauucaugauccucguaguaugaugaagugcugugaaagccuugcauuuuuaguuagagauguagcucauauaacaccguauaauuuugauauuuguguucauuguaucaggacauuuguugaggcaaacguacagaguuguaacggaacuaagagauucgcuaaucacgaaucuaggccacgaaucaaaucuaaccgaacaagauugaggguuuccagaaauagaaaaaguccgacaagcagcccagaugaggaugaagaaagugaagaagaggggguaccuaguggcuaucaucaaauuucaauacaguuacuggaucucaugcauacacuacauacuagaacugcucaaauuuucaaguggugggcugaagaagguggagaaguuucacaagaaacauccuuguggucccaagguugguguccucuuuuacaaggaauugcuaggcuuuguugugacucuagauaucaagucagaacaagugccauaacauacuuacaaagagccuuauugguucaugaucugcaaacuuugagugguccagaaugggaacagugcuuccagagaguccuuuuuccuuugcugaauuaccuuuuacagccaacaaugccgaaagaugcugguucaauggaagaaaccaggaugagagcagcuacucuuuuaucgaaaguuuuccuucaccaucuaacuccuuuaucaucucucucuacauucaguaauuuaugguugauuauacucgauuuuauggauaaguacaugcaugcagauaaaagugauuuguuguacgaagcuauuccagagucuuugaaaaauaugcuguuggucauggauuccgcuaaaguauuugaugggccugaagguagaaguauuuuguggaaugcuacgugggaaagaauaacuaaguuuuuaccagaauuaaagaaugaccuuuucagggaaauugagagugaaucccaggcuaguguggaagacaaacuacuagaaaauaugcgaaacacucaacagucguuugaaacuaaagaaucaacuccauauucugaaaagcuaauaaccuguuag

SEQ ID NO: 7149 - RNA, 405 nt, Leptinotarsa decemlineata
uucagccccuaugcugauaauggagggagcguaguggccauagcuggagaugauuucgugguagugggagcagauacacgucuaagcgccggcuucuccaucuacacuagagaccaaaauaaguuguuuccucuuucaaaaacaacgguucucggaugcucagguugcuggugugacacgcuaacguuaacucguauuuugaagucucgcaugcagauguacgagcaagagcauaauaaagugaugucgaccacugcuugcgcgcagaugcucuccaccaugcucuacuacaaacgcuuuuuuccuuauuacaucucuaacguucucgugggucucgacaacgaaggaaaagguuguguuuacagcuacgacccuauuggacauugugaaaagacuacguacaga

SEQ ID NO: 7150 - RNA, 2808 nt, Leptinotarsa decemlineata
auggaucagaaaccaggauuggauuugguaauuucggcaguuucggcgcuauacaauaaucccgaaagaagugaaaaggaaagagcaucccaauggcuuuuggaacuccagaaauccguccacgcguggacaguagcagacgaacuccuccaccucaaaagggaccucgagucaugcuauuucgcagcccagacgaugcgaacgaagauucaucaguccuuccacgaacugccugcggaaguucacaauucccugagagacucucuacuagaacacauuagucagauaaaugaaggcaccaaugcugugaucgugacucagcugugcguugcccucgcggaccuagcucuacagaugccaucguggcaaaaaccuacguuggaucuaaucaacaaauucucgcagacuaauauauggccgcuuuuagaaauuuuaacuguguuucccgaagaauuagagaguaggucuguaagauuaggagaaaauagacgaauugaaguacuggaagauaugagguauugugccccuaccgugaacgaguuccugaagcacuguucgaaccucuauggaacagaguggcaagaccaagugcagaucaacgugaagaucuugcgcugcuucaauuccugggugucugugggggcgauaggacugggagaucuagccgauaauguggucaucaacagggcguuugaaauacucaacuuuaaaccucaaaacgacaaauacacgccugcaggauccuuccacgaagccgcgacggacugcauuugcacgcucuugcucugccuugaagacaauaacaaccagauggugcuggagaauuaccuuuucaacaauaucauaaacuuggaaguggcguaccaucugucgguagccaaugaggaccaaggcaagucuauggacuacugcaggcucuucacggaacuggcggaauccuuccuugagaagaucauaucaaacagcagucagaagcagacacauuacgcuaucaagauuuuggauuuggugcugaugugugucgggcaucaugacuaugagguagccgaaaucaccuucaaccugugguacgucuugagcgaggagcucuaccagaagaacaacaaggaacugacggaacuauucaggccguauguugaacgacugauaacagcgcucugcaggcacugucagauggagccagacugcgagggccugcuugaggagggagacgaguucaaagauuuccgauugaagguaucugaucugauuagagacgucgucuucauugucggcagcagcaguugcuucaggcagauguucaucaaucugcaggcacccggcgugacgugggauuccagugaagccgcccuuuucgugaugcaggccguggcgaaaaacguuuuaccgacugauaacgaaguaauuccgaaugugguggaagccauccugaacguccccgagaacacucacaucgcugucaaauauacgucaguguugcugcucggcgagcuaugcgaguggaucgaaaagcacccgaacacgcuggaccccauccugaacuuccucgugugcuguuuaccccaagcagguauuggcgcugcagcugcuguagcccugcagaacaucugcgcuagcugcaaugaucauaugccgaggcacguucccauuuuacuacagcuacuguaccaagucgacacguucgccauaacgaacaacgccgucauuggucuccugaaaggcgucgccucuauaguagguaggaugccggccguagaaauggcaccugcgaugcgcgagcugugcuuuaugcagcucaaacagaucgaccagcucaucgagcaggacgucgucccuguacgagguacgaagacggacccugggcuguggcuugacagacugagcgccauucuuagauauguuaaugucaacgugucagaaggcgaaauccacccgugcaaaccagucauccuggagguguggccccagcugucgcgcgccuucaacaaauaccaaucagacauccggauaaucgaaaaaugcugccgcucggugcgcuuccugcugcgcugcugcagccagcaggcgaaagaacuccucgaagaccucgucagccagauggugcggauuuauucgauacacaaacacucgugcuuccucuacguugguagcauucucgcggacgaauacgccagugauucggagugcgugcgcggucugcucgacaugcugcaggcguuccucgaaccgacguuucagcugcugcaggaggagaacggccucaggcaccauccggacacugucgacgacuucuucaggcugugcgggcgguuuaugcagcgcgcccccgucgauuuuuugcagugcaccgcgcucguccacauucuucagugcgcguugauggcuucgacgcucgaccacagggaggccaacaugucugucaugaaguucuucuacgaucugaucagccaggggcagaacggacguacucagcccgacuucgagaagaggaaaaugcugguuacgagcauacuagaggaguacggccagcaacucacgacgaaccucauccauucgugcgucuucuaccugcacucguacaugcucaccgagguggcggacgucuucguccaguugcuggacuucaacagagaagcgaccaguaagugguuggucaacgguuuggaccagcucccgaaacacagcaacgguggaaucauggcugcaaccccccagcaauugaacgacauccacaugucuauuacaacgucgaacacgucuagaucagugacucacgcuuuaaaagauuugacucgauuauaucguuaa

SEQ ID NO: 7151 - RNA, 1512 nt, Leptinotarsa decemlineata
auggcccaaagguuuccagggccagguccaacacaaggaccuggaggaauuccaccucaaagauaucaaccuccucaaaauucgggaaugcgucaguauaaccaacagaauuuuccgcaaagaccugguuacaauccaccaccuccaaccaugucgucgagcggcgguaccaugauucaaagacccacugguucuccuuauucgccaaugagagcagggccuaugccucagccaucaagcagcaaaaggccugcuacugaaaauaggggcccuguuccacaaaagacggauuauccacauacuacucccagcaguaguaaaaaaaagaaaaaacuggcugacaaaauuuugccacagaaaguaagggauuuaguucccgaaagucaagcauacauggauuuacuagcuuuugagagaaaacuggacucuacaauaaugagaaagcgauuagauauacaggaggcucuaaaaagacccaugaaacagaaaagaaaguuacgaauuuuuauuucaaauacuuucuauccagccaaggagccacagccugaugguccugaagguccuugucaagaagguucuguggccucaugggagcuucguguugaaggaaggcuuuuggacgauuccaaaaaugacccuaauaaaguuaaacguaaauucucaucauuuuucaaaucauuggucaucgagcucgauaaggacuuauauggcccugauaaucaccuaguagaguggcacaggacucuuacaacacaagaaacugauggguuccaaguaaagcguccaggugauaaaaaugucaggugcacaauucuccuauuauuggacuaucagccuuuacaauucaaacuagauccuagacuagcucgccuucuaggaguucauacucaaacuagaccaguuauuauaucugccuuguggcaguauauaaaaacccauagacuucaagaugcucaugaacgugaauacauuguaugugaaaaauaucuugaacaaauuuuuaauuguucucguaugaaguuugcugaaaucccucagcgucugaauccuuuguuacauccaccagacccgauuguuaucaaucacguaauaucuguugaagguggcgcagaaagcaaacaaacugcuuguuaugauauugauguagagguggaugauacucugaagaaucaaaugaauaauuuucuuuugaguacagcgagucaacaagaaauacaaggauuagauucaaaaauucaugaaacuguggacacuaucaaccaacuaaaaacaaauagagaauuuuuccugaguuuugcuaaggauccacaacaauuuauucauaaauggauuguaucucaaacuagagaccucaagacaaugaccgauguuguugguaauccagaagaagaaaggagaucagauuucuuucaucaaccaugggcccaagaggcagucugcagauauuuuuauacuaagguacaacaaaaaagagcugaacuggaacaggcacuugguauucguaauaauuaa

SEQ ID NO: 7152 - RNA, 435 nt, Leptinotarsa decemlineata
augccaaaaguacgccggaguaaaaaggccccaccggaagguugggaauugauugaaccaacccuggacgaauuggagcagaaaaugcgagaagccgagacugaaucccacgaagggaaaagaaagaacgaaucuuuguggccaauuuucaagauccaccaucagaagucccgguauauuuucgaccuguuuuauagacggaaagccaucagcagagaacuguacgaguauugcuugauggaaaacaucgcugacaaaaaccucaucgccaaguggaagaaacaaggguaugaaagucuuugcuguuuacgaugcauccagacgagagacacaaauuuuggaacaaacuguauaugcagagucccgaaggccaaacuggaggagggaaggauaguggagugugugcauugcgguugcagagggugcucuggauag

SEQ ID NO: 7153 - RNA, 885 nt, Leptinotarsa decemlineata
augccugcagcuacucuuaguagccuccaacacccaaacaaugaagauugcgggauaagagauguuugggcacacaauuuggaagaugaauuucgaacaaucagacaaauuguucaaaaauaccaauacguagcaauggauacagaguuuccuggaguuguugcgagaccgauuggggaguuccguaguucagcagauuaucaguaccagauguugagguguaauguggauuuacucagaauaauacaacuuggacuaacauucuuggaugauaauggaaagacaccaggaggaucauauaccaccuggcaguucaauuucaaguuuaauuuacaggaagacauguaugcccaggacaguauagaucugcuucagaauucuggcauucaauucaaaaaacacgaagaugaaggaauugagccucucgaguuugccgaguugcuaaugucuucugguauugucuugauggagaacauaaaaugguuauccuuucauucuggcuaugauuucggauaucucauaaaacuauuaacggauaacaacuugccacaagaugaaaaugaauuuuucgauuuauugaaguuauauuucccaacuauauacgaugucaaguaccucaugaaaucuugcaagaaucugaagggaggacuacaggagguugcggaacagcuagaacuugagagaauuggaccacaacaucaggccgguucggauucauuacuaacaggaauggcauuuuucaaaaugaaggagauguuuuucgaagacaccaucgaugacuccaaguuuucuggccaucuuuacggacugggaacuucauuugcugucaacgguacuucaaacaauuaugcaaacgauaauggugacaccacgaauucuucauga

SEQ ID NO: 7154 - RNA, 1212 nt, Leptinotarsa decemlineata
auggcuggugcuacuaaaagggcagcuucaguuuuugaagaccucucuaauguggaauucgagacaagugaagauguggaaguuaucgacaaguucaagaauaugaaucuuaaagaagaacuccucaggggaauuuuugcauauggauuugauaagccaucugcuauucagcagagagcuauaaagccaauuaugaaaggaagagacgugauugcacaggcucagucugguacugguaaaacugcaacguuuucaaucuccauucuacaaucucuagaucuuacaaugagagaaacucaaguuuuaugcuuguccccaacuagggaauuggcaguucaaauucaaaaaguaauucuagcuuuaggagauuuuaugaauguucaaugucaugcuuguauugguggcacaaauuuaggagaagacauaagaaaacuagauuauggacaacaugucgucaguggaacaccaggaagaguguaugauaugauucguagacgagcacuacgaacuagaucugugaaaauguugguauuagaugaagccgaugaaauguugaacaaaggauucaaagaacaaauuuaugauguuuaucgauuucucccacccucuacacagguuguuuugauuucugcaacuuuaccucaugaaauuuuggagauaacuucuaaauuuaugacagauccaauucguauacugguaaaacgugaugaauugacucuggaagguaucaaacaguucuucguagcuguggaacgugaagaguggaaauuugacacucucugugaccuuuaugauacucuuacuauaacucaagcuguuauauucuguaauacaaaaaggaagguggacuggcugacagaaaaaaugagagaaaacaacuucacugugagcgccaugcauggagauaugccccaaaaggagagggacaacaucaugaaggaguucaggucaggacagagcagaguucuuauuaccaccgauguuugggcccgaggaauagacguucagcaaguuaguuugguaauaaacuaugauuuaccaaauaaucgugaauuguacauucaucguauugguagaucugggcguuuuggacguaaggguguugcaaucaauuuugucaaguccgaugacauuagaauuuugagagauauugaacaguauuauucaacacaaauugaugaaaugcccaugaauguugcugauuugauauaa

SEQ ID NO: 7155 - RNA, 1605 nt, Leptinotarsa decemlineata
augacugcuccuacugcugguggugauucaaacagggggagaacacuagcguauaaagauaaaaguaaaccugcugauguaagaaccagcaacauaaaugccgcaaaagcuguuugugaugcaauucgaacaaguuugggucccagaggaauggauaaaaugauccagucuggaaauggagaaguaacuauuaccaaugauggggccacaauauugaagcaaauuaauguuauacauccugcugccaagauguugguugaguugucaagggcccaagacauagaagcuggagaugguacuacauccguugucguuauugcuggagcauuauuagaugccgcagagaaguugcuacaucguggaauccaucccacugcaauuucugagucauuccaaagagcagcagugcuagcucuugagauauugaaugaaauuucaacuccuguugagauuacaaacagagaagaacugauaaagagugccucaacuucucucaacuccaaaguugugucacaacaguccagccauuuagggccuuuggcaguagaugcaguacucagaauaguggaaccuggacgcgagcaggcuuguaaucuuaacgauaucaaaguuaucaagcaauuagggggaacuguagaagacacagaguuagucgaaggaaucguguucccucagagaucuucaaauguuucugggccaaaacguauugaaaaagcuaagauuggauucauccaguucugcauuucaccucccaaaacagacauggaccacaacguuauugugucagacuacgcugcaauggauagaguucugaaagaagaaagagcuuacauucugaauaucguuaaacaaauuaagaaagcuggaugcaacguucuucugauccaaaaaucuauacugagagaugccguauccgauuuagcacuacacuuuuuggacaagauaaaaugcaugguaaucaaagacaucgagagagaagauguggaauuuguuuguaaaucucuagggugucgcccuauugcgucguuggaucauuuuguagcugaaaaucuggugucagcugaucuaguagaagagcuuggagcugcuggcaauagaaugguuaaaauuacaggugcucagaacgcuggacacacuguuacacuucuuguacgaggaucgaauaaacugguucucgaagaagcggaucgcucuauucaugacgcccugugugucauucguugucuuguucguaagcaggcagugauugcaggaggaggagcaccugaaauugagauagcucucaaguuagccgcuauagcgaacagauuggaaggcauagacgcaauuuguacaagagcuuaugccaaugccuuggaaaucaucccauucaccuuggcagaaaacgccggguugaauccuauucagaccguuacagaguugaggaaucgccaugccaaaggagaaauaucagcuggaauuaauguucgaaaggggaccauuuccgauauucuggaagaaaaugucguucagccccuuuuaguaagcacaucugccuugaguuuggccacagaaacugucaggucaauucugaaaauugaugauauugugaacacuauaacauaa

SEQ ID NO: 7156 - RNA, 1230 nt, Leptinotarsa decemlineata
auggaggcuauggaaguuguuguuccugaaaaggaagaagguagcccuucagacgcaaaacagaccuuacaggacguggauauugaagauuuguauaccaaauauaaaaaguuacaacaaaugcucgaguuuuuagagguucaagaagaauauaucaaagaugaacaaagaaaucugaagaaggaauauuuacaugcccaagaagaagugaagcguauucaaucuguuccucuaguaauuggucaauuuuuggaagcuguugaucaaaauacugguauuguuggguccacuacagguuccaauuacuuuguucguauucucuccacaaucgaucgggaacuuuugaaaccuucagcaaguguugcucuucacaagcacaguaaugcacuugucgaugugcuuccuccagaagcagauuccuccauaaguaugcugcaagcugaugaaaaaccagauguacaguauagugauauuggaggaauggauaugcagaaacaagaaauuagagaggcaguugaauuaccacuuacucauuuugagcuauacaaacaaauugguauugauccaccuagagggguguugauguauggaccuccuggauguggaaaaaccauguuggcaaaggcuguugcccaucauacaacagcugcuuuuauccgaguagugggaucugaauuuguucaaaaguaccuuggagaaggaccccguaugguacgagauguguuucguuuggccaaagaaaauucuccugccauuauauucauugaugaaauugaugcuauagcaacuaagagauuugaugcucaaacuggggcagaucgugaaguucaaagaauuuuacuagaguugcucaaucaaauggaugguuuugaccaaacuacaaauguuaaaguuauaauggcaacaaauagagcagacaccuuagauccugcucugcucagaccuggucguuuggauaggaaaauugaauuuccucugccggaccguagacaaaaacguuugauauucagcacuaucacaucaaaaaugaauuuaucugaagagguggauuuggaagauuacguugccagaccugacagaauuucuggggcagauaucaaugcuauuugucaagaagcugguaugcaugcuguaagagaaaaucguuacauuguuuugccuaaagauuuugaaaagggauauaaaaauaauaucaagaaggacgagagugaacaugaauucuacaaauag

SEQ ID NO: 7157 - RNA, 489 nt, Leptinotarsa decemlineata
augccgcauauuaaacuucagucgucagauggagaaacauucgaaguugauguggagauagcaaaaugcucaguaaccaucaaaacaauguuggaagaucucggcauggacgacgaggacgaagaaguugugccuuuacccaaugucaacucugccauuuugagaaaagugauucagugggcuaccuaccacaaagaugauccuccaccaccagaagaugaugaaaacaaagagaagcgaacagaugacauaucuucuugggacgcagacuuccugaaaguggaccaagggacuuuguucgagcucauuuuagcugcgaacuaucuggauaucaagggacuucuggacguuacaugcaaaacuguugccaauaugaucaaaggcaaagcuccggaggaaauucgcaaaacuuucaacauuaagaaugauuuuacugccucugaagaagagcaaguacguaaagaaaaugaguggugcgaggaaaaauga

SEQ ID NO: 7158 - RNA, 1038 nt, Leptinotarsa decemlineata
augaaggcuacuaauauagcaaaacccucaaaaaugcuuacacaaaaaauuauaaauuccaaugaauccuuggacaaaacagagaaaauuaagcugaaaccaucaguuauggaugauaaggcguccuguaaagaacuggaucaguggauagaacaguuaaaugacugcaagcagcuaacagaaaaucaagucaaaacacuaugugauaaggcaaaagaaauauuaucaaaggagucuaauguacaagaaguaaaaugcccggugacgguguguggagacguccaugggcaguuccaugauuuaauggaacuauuuaggauaggugggcgaaguccggauaccaacuacuuguuuaugggggauuauguugaucguggauauuacucugucgaaacagugacuuuguuaguagcccucaaagugagauauaaagagagaaucacaauuuugagaggcaaccacgaaucucgacaaauuacucaaguguauggcuuuuaugaugaaugcuuaagaaaauauggaaaugcuaauguuuggaaguucuucacugauuuguuugauuauuuaccccugacugcacuuguugacagccagauuuucugucuacauggugguuugaguccuagcaucgauacuuuggaucacauuagagcccuagaccguuuacaagagguuccccaugaaggcccuaugugugaucugcuauggucugauccugaugaucguggagguuggggcauuuccccaagaggcgcugguuacacuuuuggacaggacauuucugaaaccuucaaucauagcaauggucucacccuuguuucucgagcacaucaguuggucauggaggguuacaauuggugucacgauaggaacgucguaacuauauucagugccccgaacuauuguuacagaugcggcaaccaggccgcuauuauggaguuagaugaugcccucaaguauucuuucuugcaguuugauccagcaccacgacguggcgaaccucauguaacucgccgaacaccagauuauuuccuauaa

SEQ ID NO: 7159 - RNA, 354 nt, Leptinotarsa decemlineata
ccagaccaacaaagauugaucuucgcuggaaaacaacuugaagauggccgaaccuugucagauuauaacauucaaaaagaaucuacacuucacuugguucuucgacuccguggugguaugcagaucuuugucaaaacucuaacuggaaagacaauuacuuuggaaguugaaccaucugacaccaucgagaauguuaaagccaagauccaagauaaggaaggaauucccccagaccaacaaaggcuuaucuucgcuggaaaacaacuggaagauggccgaaccuuaucagauuauaacauucagaaagaaucuacacuucacuugguucuucgucuccguggugguaugcagauc

SEQ ID NO: 7160 - RNA, 1629 nt, Leptinotarsa decemlineata
augaugcaaccacaaauuuugauuuugaaagagggcacugauucaucucaaggaaaaccucaauugauauccaacgucaacgccugccaaaauguaguagaugcaguucgaaccacauugggacccaggggcauggauaaacuuauaguacagagaaauggaaaaucuacgauaucaaacgacggagcaacaauacucaaacuacuagauauuguccacccagcugcuaaaacucuaguagauaucgccaaaucucaagacgcugagguaggugauggaacuacaaguguaguacuauuagcaggggaauuuuugaagcaaauaaagcaguacguagaagaaggugugcauccuagaaucauaaucaaagcugugcgccagucgcugcaaaucugucucgauaaaauaucugaauuaucuguaaaaguaaacaaguccagugcugaggaguucagaucauuacuggaaaaaugugcagcaacggcaaugaguuccaaguugaucaaucagcagcgugccuucuucucuaaaauggucguagaugcaguuuuacuguuggaugacuuacugccacuaaacaugauugguaucaaaaaaguucaggguggggcauuagaagauucaauguuaguugcaggcguugcuuucaaaaaaaccuuuucauaugcuggauuugagaugcaacccaaaguuuacaaaaauuguaaaauugcucuucucaauauugaacuugaacucaaagcugaaagggauaaugcagaaguaagaguggauaauguuaaggaauaccagaagauuguggaugcugaauggaauauauuguacaauaaacuacaaaaaauucaugaaucuggagccaauguuguacuaucuaaacuaccuauuggagauguggccacacaguucuuugcagacagggauauguucugcgcuggccgaguacaagaagaugaucugaagcgaacccucaaggcuugugguggagcuguuaugacaacuguuaaugaccucaauaacucaguucuuggcaaaugugauuuguuugaagagaaacagauaggcggugagagauacaauuucuucaaaggcuguccgaaugccaagacuugcacuuuaauccuccgaggcggugcggaacaauuucuagaggagacugagagaucucuucacgacgccaucaugauuguaaggagaacaaucaaaaaugaugcagugguagcuggaggaggagccauugagauggaauuguccaaaauccugagggaucauucccguacaauagccgguaaagagcagcuguugauuggggccaucgcuaaagcgcuggaggugauuccuagacaacugugcgacaaugccggguuugaugccacuaauaucuugaacaagcugaggcagaagcaugcacagggugguugcugguuugggguagauguuaauaacgaggauauugcugauaacuuuaaaaacugcauuugggagccggcaguuaucaaaaucaaugcucuuacagccgcuucggaagccaccuguuugauacugucuguggacgagacaauuaaaaaucaaaagucaggagacgggcagaugccacagaugggaggacgugguaugggaaggccaauguaa

SEQ ID NO: 7161 - RNA, 8802 nt, Leptinotarsa decemlineata
auuuuugcgcacuuacgcaaaguuagaucaacuaaguaucccauucaaagaugccuaagacuuguagaggcaauuucaagagauuugggaacucaguuguugaaaguucucggaacuaggagguuaaugcauauuccuuuugaugauuucgaaaagguuaugacccaaugcuuugaaguuuucucaauuugggaggacgaguaugagaaauugcaagcuuuauugagggauauaaugaaaaagaaacgugaugagcacaugaaaaugguuuggcgaauaucuccgcaacauaagaagcugcaaaaucguauggaccagaugcguaaguuucgucgucagcaugagcaauugcggaccguuauaguacgaguuuuacgaccaaccauuagagaaauaguagcaccaauagagggagaggacuuagaaccuccaaaagcaacauuuucauuagaugcggccgaugcgaaugcuauugaggaggucaauuuagcauaugagaaugugaaagagguagauugcuuggauauauccaaggagggacaagaugcuugggaugcugcuguacaaagauaugaagaacggauagauaggguagaaacaagaaucacagcccaucuccgugaucagcuuggaacugcuaaaaaugcaaacgagauguuuagaaucuucucgagauuuaaugcucucuuuguuagaccacauauaagaggggccaucagggaauaucagacacaucugauacaaagggucaaggaugauauugaggcccuacaugaaaaauucaagguacaauauccucagaguaacagugcuaagaucaguaaaguucgugaucuaccacccguugcugguucuauaguuugggccaaacagauugaucaucaacucaccacauaucugcgacgaguggaagauguucuuggaaaaggcugggaaaaucacaucgaagggcaaaaacucaaagcagauggagacaguuuucguuugaaauugaacacccaagaaauauucgaugaaugggcucguacugugcaacagcgcaaucucgggguuucugguagaauuuucaccaucgaggcaguacguuccaaaagcgguagagggaauguuuugaaacuaaaagugaauuuucuaccggaaaucaucacuuuagccaaggaaguucguaauuugaagugucuuggauucagagugccacuugcaaucguaaauaaggcacaucaggcaaaucaacuuuauccguuugccauaucacuuaucgaaaguguuagaacuuaugagaugacacuagaaaagauugaagacaaggcaagcaucauuccacuugucgcaggcaugcguaaagaaguucaaacucuuauugccgagggaauucaacuugucugggagaguuacaagcuugauccuuauguccaacgucucuccgauaauauugugaguuuucaagagagagucgaggaacuugucauuguaggagaacaacuggaaguugauguuaggucauuggaaacgugucccuauucagcgaacacuuuugucgauauccugucaaaaauucaacaugcuguugaugacuuguccuugaaacaauauucaaaucuucauauuugggucagcaggcuggaugaggagguugagaaaaauuuagcucgccgccuucaagcugguauugaagcauggacugaugcuuugaguggucagaagaaagauauagaucacagcauggacaccgaugccccagugcaaccuacacacaaacccgggggcgauccacaaauacaaauugugauucaugaaguucgaauaaccaaucagaccauguaccuauauccgagcauagaagaagcucgauuccagauuaugcaacagcuguuugcuuggcaagcuauuguaacuucacagcaacgacuucaaagcagucgauaucaagugggaguugauaaaccagugacugaaaccuaccggaauaucuugacaaaacuucccggaggaccacaaccucugaauaaugcuuauagugccaucgcuuccaaaauaaaagaggugcaaaaauauguuaaugaaugguuaaccuaccaaucuuugugggaucuucaagcugaaaaccuuuauggcaaacuaggugaagacaucaguaaauggauggagugucugaaugauaucaagaaaacccgaacuaccuuugacacaucagauacucgacgugaauuuggacccauugugauagacuucgccaaaguacaaagcaaagucucucugaaauacgauucauggcauaaagaaacucucaguaaauucggaggacuccuuaguaacgaaaugacuaccuuccacgcuaacguuucaaagucgagaucugaccuagaacuacaaaguauugaagcagccagcacuucagaugcuguuaguuucauaaccuaugugcagcagcuaaaacguaguaugaaagccugggagaagcagguugagauauauagggaaggucaaagaauucuggagcgucaacguuuccaauuuccuacuaauugguuacacguugaaaaucuagaaggugaauggggugcuuuuaaugagauuaucaaaagaaaggauucuagcauucagacucaaguggccagucuucaacaaaagauuguggcagaagauaaggcgguagaaacucgcacuaaugacuuccuuguugauugggaacguagcaaaccuguugaaggacauuugagaccagaugaagcacucucccaacuucaauuauucgaaagcaaauuugcucgucucaaggaggagagagacaauguagcaaaagcuaaggaagcuuuagaauugcaagauccuggugguauuaacagcagugaagaucgaaugcaggugguuuaugaagaauugcaagacuuaagaggaguuuggucagaacuaucaaagaucuggcagcaaauagaugaaaccagagaaaaaccuugguugucuguacaaccuagaaagcuucgccaacaacuggacggaaugagugcacaacucaaagggcuaccugcuagauugagacaguauucuucuuaugaauaugucaagaaaacauuacaaacuuacaccaaaguuaauaugaugauuguggaguugaaaucagacgcucucaaggaacgacacuggaaacaacucaugaaacaacugagagucaauuggguucuuuccgaccuaacacuagggcaaguuugggacgugaauuuacagaagaacgaauccauugucaaagacauuauacucauugcucaaggagaaauggcucuggaagaauuuuugaaacaaguucgcgagucuuggcagacauaugaguuggaucuuaucaacuaucagagcaaaugcaagcuuauucggggcugggaugaucucuuuaauaagguuaaagaacauaucaauucgguggcagcaaugaagcuguccccuuauuauaaaguuuucgaagaggaagcucuaacuugggaggaaaaguugaaccgcauuaaugccuuguuugauguuuggauugauguucaaagacguuggguauauuuggaaggcauuuuuucuggaagugccgacaucaaaacacuacuaccuguugaaacaucaagauuucaaaguauuaguuccgaauuuuugggauugaugaaaaaaguuaguaagagcccaaugguuauggaugucuugaacauaccgggaguucagagagcuuuagagaggcuagcagauuuacuuggaaagauacaaaaagcucugggugaauauuuggagagagaacguaccucauuuccacguuucuacuuuguuggugaugaagauuuauuggaaaucaucggcaacagcaaaaauauugccagacuacaaaagcauuucaaaaaaauguuugcuggaguagcauccauucuucuuaaugaagacaacacgguuauuacugguauagcaucaagagagggcgaagaagugguuuucggaaaaccugugucuaccguagaacauccaaagauuaaugaguggcuaaccuuagucgagaaggaaaugagaguuacuuuggcuucgaaucucacugaagcuguacaagauaucaaacaauucaaagauggcaucgauccgaaauuguacaugcaguggguugacaaauaucaggcacagaucgucguacuugccgcccaaauauuuuggagcgaagacguugaagcugcuuuagucaaaaugaacagcgagccgcaaaagggcccucuugaaaaagucuugcaacaagucgagaauacucucaauguccucgccgauucaguuuuacaagaacaaccgcaacugaggagaaagaaauuggagcacuugaucaaugaauuuguucauaaaagaacuguuacucgccgacuuauaucgaaugggguaugcaguaacaaggccuuugaaugguugugcgaaaugagauucuauuuugauccucgucaaacugaaguauugaagcagcuuacaauucacauggcaaacgcacgauucuauuaugguuuugaguaucucgguguucaagauagauuaguacagacuccacuuacugauagaugcuauuugacaaugacccaggcuuuggaagcaagauugggagggucuccauuugggccugccgguacugguaagacagagucugucaaagcucuugguaaccaauugggccgauucgucuuggucuucaacugcgaugagacauuugauuuucaggcuaugggaagaauauuuguuggacuuugccaaguuggagcuugggguugcuuugacgaauucaacagauuggaagaaagaaugcugucugcuguuucucaacaaguacagaccauccaggaggcucugaaaucacagaaagaagcugcagcugauggagcagcuucagugggcaguaucaguguggaguuaguaggaaaacaagugaaaguauccccagauauagcaauuuucauuacaaugaauccuggauaugcaggaagaucaaaucucccagacaaucugaaaaaacuauuuagaucucuugccaugacuacaccugauagacagcucauugcugagguuauguuguucucucaaggauuucgacaagcugaaaaauuggcuucuaaaauuguuccauucuucagauuaugugaugaacaacugucaaaucaaucucacuaugauuuugguuugagagcuuuaaaaucaguguuaauaucugccgguaauguaaagagagacagaauccaacguauuaaagagacuaagacgcaacgaggagaaacaaauauugaugaagcuaguauugcagaaaacuuaccagagcaagaaauuuugauacagucagugugugaaacaaugguacccaaacuuguugccgaagauauuccucuucuguuuaguuuacugaaugacguguuccccaauguacaauauaccagagcugaaaugaaaggucucaaagaugagaucaggaaagucugugcugaagaauuuuugguauguggcgaaggagaugagcaggguucugccuggauggaaaagguauugcaacuguaucaaauauccaaucuuaaucaugguuugaugaugguuggucccagugguucaggaaaaaguacugcuuggcguguucuuuugaaagcuuuggaaagguaugaagguguagaaggugucgcacaugucaucgauccgaaagcgauaagcaaggaggcacucuacggugucuuagaucccaacaccagagaguggaccgauggucucuucacccauauuuugaggaaaauaauugauaauguacgaggagaaauaaacaaaagacaguggaucauuuuugauggugacguagauccagaauggguagagaauuugaacucuguccuugaugauaacaaauuguuaacgcugccuaauggagagcgucucucgcuaccuccaaauguuagagucauguuugagguucaagauuugaaauacgccacccuagcaacaguaucucguugcggcaugguuugguucucugaagacguucuauccaccgaaaugauuuuugagaacuacauucucaguuugaagaacauuccucuugaagaaggugaagaugauaguuuuggaaagacuucagagucgaaagaugacguacucucacccacacuucaagugcaaguugauguugccaaucuucuucaaccuuaucuggcuccagaugguuuaguggugcguugcuuggaguaugccauggaacaagaacauaucauggacuucacaagauugcgugcucuaaguucguuauuuucaauguugaaccaggcuauaagaaauguuuugcaguacaaccauucucauucagacuuuccucugucaaacgauucuuuggaaaaguauauuccaagauguuugguuuauuccguuuuauggaguuucgccggugacgcuaagcuuaaaguaagaucagagcuuggagauuucaucagaucagugacaacugugccuuugccgccggacaacaauaugccgauaauagauuaugaaguuaccauugaaggugauuggucaccauggucccauaagguuccccaaauagaaguggaaacccacaaaguagcuucuccugacauuguugugccuacgcuugauacaguucgucacgagucuuuacuuuacaccugguuagcggaacauaaaccucuaguuuuaugugguccaccugguucugguaagacuaugacauuguuuucugcuuugagagcacuuccagacauggaaguagugggauugaauuuuucaucugcgacuacaccagaauuauuauugaaaaccuuugaucauuacugugaauacagaaagacgcccaacggaguuguuuuggcuccuauccaguuggguaaaugguugguguuguucugugaugagauuaacuuaccagauauggacaacuacggaacucaaagagucauuauguuccugcgucaaauagucgaacagaaagguuuuuauagggcuucagaccaaucuuggguagccuuggaacgcauacaguuugugggagcuuguaauccuccaacggauccuggcagaaaacccuuaucucacagauuuuugagacacgucccuguuauuuauguggauuauccaggagaaacuucuuuaaagcagauuuaugguacuuuuaccagggccauguugcguuuggcuccuggacuaaaagguuaugcugaaccauugacgaacgccaugguagaauuuuaucuugcaucucaggauagauucacucaagauaugcagccucacuauguauauucaccucgagaaaugaccagauggguuaggggaauaugugaggcuauuaggcccuuggauaaucuugcaguugaagguuugguucggcugugggcacacgaagccuuacggcuguuccaggacagacuugucgaagaugucgagcggcguuggaccaaugaaaacauugaugcuguugcauugaaacauuuuccuucggcaaauugugagaaagcauuggaaaggcccauucuuuauagcaacuggcuuucaaaagauuauaugccaguggaaagagagcaacuuagggaauaugucaaggccagauugaagguguuuuacgaagaagaguuggaugugccucugguuuuguuugaugaaguacucgaucacguccuuagaauugauagaauuuuuaggcaaccccaaggucaucugcuucugauuggugucucuggugcaggaaaaacaacucuguccagauuuguagcauggaugaauggucuuuccauuuuccaaaucaaaguucauaacaaauauacugcagaagauuuugacgaggauuuacgaucaguuuugagaagaagugguuguaaagaugaaaagauugccuucauuuuggaugaaucaaauauguuggacucuagcuuuuuagaaaggaugaacacauugcuggcuaauggugaaguuccuggauuguuugagggagaugaauauaccacuuugaugacucagugcaaagaaggugcucaaagagaagguuuaauguuagauucaaaugaugaacuuuacaaaugguucacucaacaaguaaugcguaauuugcauguugucuucacuaugaauccaucaacggauggacugaaagauagagcugcuacaucaccagcucucuucaauagguguguuuuaaauugguuuggagauuggucugauggggcuuuauuccagguggggaaagaguuuaccaaccgucuggauuuggauaaaccacacuggaaauguccagauuucuuuccggcagcuuguacacuuauaccuacaacuccuaaucacagggaagcugucauaaaugcauguguuuauguccaucaaacacuucacaaggcaaacagucgauuagugaagaggggaagccguacuauggcaaucacaccucgccacuaucucgauuucauacaucauuucguaaaacuccauaaugagaaacgcucagaccuggaagaacaacaacuucaucugaauguugguuugaguaaaauugcagaaacuguugaacaaguggaggagaugcaaaaaaguuuggcaguuaaaucccaagagcuacaagccaaaaaugaagcagcaaaugcaaaacucaaacagauggugaaagaccaacaagaagcugaaaagaaaaaaguucagagucaggaaauucaacaacagcuggcugagcaaacuguucauauagaacaaaaacguucugaaguaauggcugaucuggaacaaguagaaccugcugugauugacgcucaaacugcuguuaagucaaucaaaaaa

SEQ ID NO: 7162 - RNA, 2640 nt, Leptinotarsa decemlineata
augaguaagcaaaaacuaaugaaagaccauaaauuagaugagacgaauauggccgauaacguagaagaagcccgaagaaaagaucuugaagaaagagaugaauuugcccaucguuugaaaaaacgagaugaaaaucguaccagaaauauugcacauccuucagguucuaaggcguacgaagaagcugcgaagagacucaaauuagaaaaugcugaccgcggugaaauuauucccaagcuuagggugcaaucuagaaggaaauacuuggagaaacguaaagaagauaagcuucaagaacuugaagcugauauugcugaugaugaauaucuguucgaggaagagauacugaccgaaagagaacgaaaagaaagguaccacaagaaagaauuauuaaaacuugcaaaggaacaugaaaaagcaagagaacuugagcgagugcaucgauaucacaugccucgagauuuaggaaaagauucugugucugauuauauugaaguugaugaauuagaaaaaguuccucaaucggagcagaaaaaaugggaaaaagaccagauggcuucugcuguuuucaaauuuggugcgaaagauucugucagaacagaugaauacgagcuauuacuugaagaucaaauccauuucauccaagcauuacaaauaccugguguaacagagaaaaaagagacuaaauuaacagagguacaaaaaaaaaagcuuaguaucgaagagacaaaaaagaguuugccaauauauccuuucaaggaugacuugauucaagcuauacgagaacaccaaauauuaauuauagaaggagagacuggaucaggaaaaacaacacaaaucccacaauacuugcacgaagcaggauuuacaaaaaauaauaaaaaaauugguuguacucagccucgaagaguugcugcaaugucaguagcagcaagaguugcucaagaaaugggcguuaagcuuggaaaugaagugggguaugcuaucagauuugaagacugcacuuccuccagaacuguuauuaaauauaugacugaugguacguuacacagagaauuuuuaucagagcccgauuuacagucauauaguguuaugaucauugaugaggcccacgagagaacacuacauacagauauuuuauuuggccuuguuaaggauauugccagauuucgaccagauuugaaguuguugauuucaagugcuacacuagauguugcuaaauucucagaauuuuuugaugaugcaccuauguuucaaauuccaggaagaagauuuccuguagauauauauuacacuaaagcaccagaggcagauuauguagaugcauguguuauaucaguguugcaaauacauguuacacaaccucugggggauguuuuaguauuuuugacuggucaagaugaaauagaaucaugucaagaacuacuucaggaucgaguucgaagauuagguucgaaaguuaaggagaugauuauuuuaccuguauaugcuaauuuaccgagugacaugcaggcaaaaauuuuugaaccuacuccuccaggauccagaaaaguuauacuggcuacaaauauagcagaaacuucuuuaacaaucgauaacauaauuuauguuauagauccaggauuugcuaagcaaaaccauuuuaacucacgaacaggaauggaaaguuuaaugguagugccaauauccaaagcuucagcuaaucaaagggcaggacgagcaggucgaguggcugcaggaaaaugcuuuagauuauacacagcaugguccuacaaacaugaauuggaagauaauacaguuccggaaauucaaagaaugaauuugggaaaugcaguauugauguugaaagcacuuggaauaaaugacuuaguucauuuugauuuccuagauccaccaccacaugaaacguugguauuggcauuagaacagcuguaugcauuaggagcucuaaaucaucauggcgaacucacgaaacuaggaagaagaauggcugaguuuccaguggacccuaugauggcaaaaauguuguuagcuucagaaaaguacaaguguuccgaggaaauaguuucgauagcagccaugcugucaguaaauggagcaauauuuuacagaccaaaggacaaaaucauacaugcggauacugcccgaaaaaacuucaaucauauuggaggagaucaucugaguuuacuuaacguuuauaaucaguggagagauucugauuauuccacacaaugguguuaugaaaauuucauacaauauagauccaugaaacgugcacgagauguuagagagcaguugguagguuugaugcagagaguagaaauagaaaugguuagcaacauaacugaaacaguuaauauacguaaagccauaacugccggguauuuuuaccacaucgcaaaauuguccaaagcaggaaauuacaaaaccgugaagcacaaucaaaguguuaccauucauccaaacaguucacuguuugaggagcucccuagauggauuuuauaucaugaauugguguucaccacuaaagaauuuaugcgacaaguuauagaaauagagaguaagugguugcuagaaguugcaccacauuauuacaagcagaaagaauuggaagaaacaaauuugagaaggaaaguuuga

SEQ ID NO: 7163 - RNA, 804 nt, Leptinotarsa decemlineata
augaagguggaagaaguuaaaaguacaguuaaaacccagagaauuagugcucacagucauauaaaggguuuaggauuggaugaaucaggauuugccauacaaucagcagcagguuuggucggccaagaacaagcaagagaggcagcaggaguaguaguggacaugauaaaaaguaaaaaaauggcugguagagcagugcuccuagccggaccaccaggaacaggcaaaacugcuauagcuuuggccauugcacaggaacuuggaaauaaaguuccuuucuguccaaugguagguucugaaguuuacaguucagaaauuaagaaaaccgaaguccuuauggaaaacuucaggagagcgauuggguuacggauuagagaaacuaaagagguuuaugaaggagaaguuagcgagcuaacaccaguugaaacagaaaauccuucaggagguuauggcaaaaccgucagucaugucauuauuggguugagaacagccaaagguaguaaacaauugaaacuugauccuagcauuuaugaggcacuucaaaaagagaaaguagaaguuggagauguuaucuauauugaagccacaaguggagcuguuaaaagacaaggaagaucugaugcauuugcuacugaauuugaucuggaagcugaagaguaugucccccuuccgaagggagauguacauaaaaaaaaggaagucguucaggaugucaccuugcaugauuuggaugcagccaaugccaagccacaaggaggucaagauguauuaucaaugauggggcaacuccucaaacccaagaaa

SEQ ID NO: 7164 - RNA, 2208 nt, Leptinotarsa decemlineata
augacuucaauuauuaagguucaugcucucucuggggcuauggacgaaucgcccccuuguuauauucuucaaguagaugaagucagaauauugcuagauugugguugggaugagaaauucaacauggaauuuaucaaggaaauaaaaaggcauguacauaccauagaugcaguauuacuuucuuacccugaugugacacacuugggagcuuuaccuuauguuguuggaaagcuuggucucaauuguccuaucuacucaacaauaccaguuuauaaaaugggacagauguucauguaugauuuguaucagucccaacacaauaugaaggaguuuuguauauuuucucuagaugacguagaugcuaccuuugaaaaaaucauacagcugaaauauaaccagacuguuccucugaaaggaaaaggauauggucuuacaguuacccccuuaccugcaggucacaugauuggagguacaaucuggaaaauuaugaagguaggagaagaggauauaauauaugcuaaugauuucaaccacaaaaaggaaaggcaccugaaugguugcgaacuugaaaaacuucaacgacccucuuugguaauuauugaugccuucaaugccacuuaucagcaagcaagacgaagagcaagagaugagaaacugaugacaaacauucuucagacacugagaaacaaugguaauguucucauugcuguugauacagcuggacgaguauuggagcuagcccauaugcuugaucaacuguggcgcaacaaagaaucuggucuucuugcauauucuuuagcauuacuaacuaacguuagcuauaacguuguugaguuugccaagucgcagauugaguggaugagugauaaguugaugagaaguuuugaaggggcucgaaacaauccauuccaguuuaaacauuuacaguugugucacacucagggagaguugagcaaaguuuccaguccaaagguugugcuugcuaguucagcagauauggaaaguggcuacuccagggaacuguuccuacagugguguucaaauccugccaacaguguuauuuugaccacaaggacaucuccugguacucuagcuagagacuuaguggauaauggaggagagaggaccguagauuuaacaguagaaaagagagucagguuggaaggagcagaacuugaagaauacgagaaacgacagagagaaagaugugaagacgaugaaaccaaagaagaaggugauucagauucugaugaugacauugagaugucagucauuucgaaaggcaggcacgacauugucauaaaacaggaaggcaaaauuucuacaggguuuuucaaaguaacaaaaaaaauguauccgauguacccauuccacgaggaaaaagucaagucugaugaauauggagagaucaucaggccagaagauuauaaauuagcagaugugccuuuagaaggagaagauaauaaagaaaacuugguaguuaaaaaagaagaagaggaaauaacugagaucccggagaugccaaccaagugcauuguucuucaaaggacuguccaggucaauugucaagugcauuauaucgacuuugaaggucgguccgauggcgaaucccucaugaaaauauuaucacaucuuaaaccaagacgagugauuguuguucgagguacugcagagaauacagcaguuauugcaaaauacugugaggagaauguucaaguugcgaggguacuuacuccugcuaaaggagaaauuguggaugcgacuagcgagacucauaucuaccaggugcgucuuacagaugccuugguaucucauuuagcauuccaaaaagccaaagacgcggaaguagcauggcuuaaugcccaaauagucguaagggagacccaggcugaugcuaagagaaugaacauugauaaugaaccaauggaaauugacgacgaugacaugaggauacucacuuuagagccagccuccgaagaagauaaucaugaacccguauucauaaaugaacugaaauuggcagaauuuaaacagauuuuagcaaggaguaauaucaguucagaauuuucuggaggaguuuugugguguucgaauggaacuauugcgauacgaaggguggauccuggcaaaauaaugcuggaagguuguauaucagaagauuauuauaggguuaaggaacuuuuauaugaacaguacgcaauuuuauaa

SEQ ID NO: 7165 - RNA, 2280 nt, Leptinotarsa decemlineata
augccacccuuagaggugacaccaaauaguaauaaugaagaaccaggcccaauaaauccuguaguggguauaauuuauccaccaccagaagugagaaauauuguugacaaaacugcaaguuuuguggcaagaaauggaccagaauuugaggcacguauucgacagaacgaacuuggaaaucccaaauucaauuucuugaacacuggagacccuuaccaugcuuacuaucaacauaaaguuaaggacuuucgagagggaaaaggacaagagccugcugcuggacugaaucaggcuauuuugaagcuaucuguaacuucagcagcucaacaaaaacaacaagaaauuuugaagcaagucgagcagccuuuuguaccaaaggauccuccaccugaauuugaauucauugcugauccaccauccauaucugcucuugaucuugacauugugaaacucacugcacaauucguagcaagaaacggaagagcauuucucacacaguugaugaauagagaacaacgaaacuuccaguuugauuuucuaaggccacaacauuccuuauuucaguauuucacaaaacuuuuggaacaauauaccaagguacucaucccuccaaaaaguaugcagcaacgucuccgugaugaagcuaaaagugccaaaucaguucuagaacaaguaaaauaucgugcagaaugguuaaaauaucaagaagcacaaaaggcaaaggaggaggaaaucuuggaaagagaaagaguugcuuacgcacaaauugacuggcaugacuuuguugugguagaaacaguugauuaccaaccauucgaaauagguaauuuuccuccucccacuacaccagaagaaguaggagcacggauucucauccaagaaaggauugaagauggugaagacaucgaaaugcagcuugaaagugaugaggaagaaccaccaccagcggacgaaggacuaaguacaaugcaagacaaaacacauagucguaaaggacgugaugauaaucguauucaggauauggaggaggaaaguucugaagaagaagaugaauccucacuuaaaccacccccaccuccuucuauucaacccccucugccaccugcaccugauaagguuuuaguuaagaaguaugauccuaaacaagcuguuaagguaaccagaccaacuguaggcgaugacuacuugguaucgccaauaacuggugagaagauuccagccagcaaaguccaggagcauaugcguauaggucuccuugacccuagguggguugaacaacgugauaagcaaguuauggauaaaaugaaucaagaaacaguuuacgcagcugguucagcaaucgaugcuucauugaaacuucuggcagaaagacguacagauauuuuugguguuggugaugaggaaacugcaauugguaagaaaauaggagaagaagauguuaggaaggacgagaaaguaauuugggauggacacacgaguaguguggaaacugcuacuagagcugcuagagcuaacauaacacuggaagaacagauacaccaaauccauaaggucaaaggauuacucccugaugaagaaaaagaaaaaauuggccccaaaaauauagggucaaaaucuggcaagaucaacauucagaguguaauaacuacaaaaccaccaaaucaaccaccgccaccuaagccucagguuucucucauucagacgcaaccggcuccuccaauggcuauaccuguaccuccccaaccuacuaugauggcuacgcaaccaccaauaaugaugaugacugcuccuccuaugccuccaaugagaccuccuccuauaaugauggcagcaccaccuccuauggccagcuuuguuacuccaaugccuccuccuaugggacagccaaugggaaugccaaugaaacauccaaacgaugguauguuagaugaugaaccaaguaauaaaaaguugaggaaugaagauucucuuguacccgaagaaguauucaugacaagaaauccagguccagugucuaucaagguaacaauaccacuuuugccugagaagucugaauggaaauuaaccggacaggugaugagccucacauuacccuugggagaaaguguggcuaauuugaaggcaaaggugcaggaagaaacaaauaugccaccagcuaagcagaaguuguuuuucgauggaauguuuuucaaggauucuaauacuuuggcauacuauaauguuacacagggugcaacgauucaacuucaaguuaaggaaagaggaggccgaaaaaaguga

SEQ ID NO: 7166 - RNA, 963 nt, Leptinotarsa decemlineata
augccuagucaagaagugucgacaacaaaaguaauagugcaccccuugguguugcugagcguuguagaccauuuuaaucgcaugggaaaaauugguaaccagaaacguguuguaggaguucucuuggguuguuggcgagcuaaaggaguccucgacgucuccaauagcuuugcaguuccuuuugaugaagaugacaaagauaaauccgugugguuucuggaccacgacuaccuggaaaauauguauggaauguucaaaaaaguaaaugcuagggagcgagugguagguugguaccacacagguccaaaauuagaccagaaugacauagcaauaaacgaacuaauuaggagauacugucccaauucuguguugguaauaauugaugccaaaccgaaggaucuaggccucccaaccgaggcauaucaagcuguggaggaaguccacgaugauggaucgcccacuuccaaaacauuugagcauguaccuagcgaaauaggggcggaagaagcagaggaggugggaguggagcaccuucugagggauaucaaagauaccacaguuggcacguugucucaacgaauaaccaaucaacucuuagguuugaaaggucugcaccugcaacugcgggaaauccgagacuacuugauacaagucuccgagaacaaacuaccaauuaaccaucaaaucauuuaccagcugcaggauaucuucaauuugcuucccgauauuaaccaagccacuuucaacucauccuucuauauaaaaaacaaugaccaaauguugguugucuaucuugcugcuuugguuaggucuaucguggcuuugcacaauuugaucaacaacaaacuuaccaauaaagaugcagaggagggaaagaaagaagaggcgaaaaaagauaaagaaaauaaggagaaagagaaggaaaaagauaaagaugggaagaaggaugacaagaagaaauaa

SEQ ID NO: 7167 - RNA, 1596 nt, Leptinotarsa decemlineata
auguuugguggaggacgugccccuauuuuaguuuuaagccaaaauacuaagcgugaaucaggcagaaaaguccagguggaaaacaucaaugccggaaagcaaauagcagaugugauucgaacaugccuggggccacaagcuauguugaaaauguugauggaucccauggggggcaucguaaugacgaacgacgggaaugcgauccuucgugaaaucacagugcaacacccugccgcgaagaguaugauugaaaucgccaggacacaagacgaagagguaggagauggaacuacuucaguuauuguauuagccggagaaauguuggcagcugcugagcaguuuuuggaacagcagaugcaucccacaaucauuauucgacaguacaggcaagcucucgaagauauugugcaguuaugugaaggaccucuaaguauugccauagaaagagaugacaaagcagcucuugcuaaugugguuaaagguuguguuggcacuaaauuccucagcaaauggucagauuuggcaguaaacauugcccuggaugcuguuaacacaguuuuucuagaagaaaauggucgcauugaaguggauaucaaaagauacgccaaaguagaaaaaauuccuggaggaucuauagaagagucucgaauuuugaaaggugugauggucaacaaggacgugacacauccaaaaaugaggagauauaucaaagauccacggaucauucuuuuggacugugcacuggaauacaaaaaaggagaaucucaaaccaauguugaaauuacuuccaacauggauuucucaagacuacuggagcucgaagaggaacacgucaaacgucagugcgaugacauuaucgcccucaaaccugauguagucuucacagagaaagguguuuccgaccuugcccaacauuuccuucucaaagcuggcaucacugccauacgacgaguucgcaaaucagacaauaauagaaucgcaagagcuugcggagcuaccaucgucaacagaacggaagaauuacaggaauccgauuuaggauugggagcugggcucuuugaaaucaagaagauuggagaugaauacuucuguuucauugucgaauguaaggaucccaaggcuugcaccauauugcuacguggcgcuagcaaagauauccugaacgaaacugaaaggaaucuccaagacgccuugcaaguagcgagaaauauaguucuguccccaaggcugguuccuggaggaggugccaucgaaauggcgguagcccagcgauuauugcaaaaggcuagucaugguccuuacagggcuuuagcgcaugcuuuagagauaaucccucguacguuggcccaaaacuguggugcuaacacaauacguacguuaacgacucuaagagcaaaacacgccaaccauacagacuugaauaaaccaugcacuugggguauugauggagagagcggugaauugguggaaauggacaagaaggagcuuugggaaccacuggcugugaaacuccagaccuacaaaacugccguagagacagccauucuucuuuuacguaucgacgcggucguuucugguucuaagaagaagggagau

SEQ ID NO: 7168 - RNA, 405 nt, Leptinotarsa decemlineata; identical to SEQ ID NO: 7149

SEQ ID NO: 7169 - RNA, 951 nt, Leptinotarsa decemlineata
augucgagacgugcauauagagcuagacgugauagagauagaccagcauacaaugaguuucaauuuggauucaacauguuuccggaaauuccgaggccuuucaacauuacauaucagugcuucucuguagcuaugcuaccuggaaaugaaagacaggacguugaaagaggaggaaaaauuaucaugccaccuuccgcgcuugagaagcugaccaggcugaacauaaauuaccccauguuauuuaaacuuguuaacaaaaaaacuaauagagucacucacugugguguuuuggaguuuguggcugaugaaggcaaaguuuaucuaccacucuggaugaugcacaauuugguacuugaagaaggagauuugguacaaauggaaaguguuucucugcccguuggaaccuucucaaaguuccaacccuugaauccagauuuucuugacaucacaaauccaaaggcaguguuggaaaauuguuugaggucuuuugcuugccucacuacaggggaugucaucgcaguuaaauacaaucagaaagccuaugagcuguguguacuggaaacuaaaccuggagacgcuauuagcauuauagaaugugacaugaacguugaauucgcugcucccguggguuauaaagagccugaacaaaggaagaaagaagaagaagaagccgcaguggauccugccgagcugaugccggagccuucuggguuuguugcuuuucguggaacuggaaaucguuuggacgggaagaaacgaaaagauuccacaucuagugauuucgcaucagccaaacccgucuaugucagagguauaccagauuaugacuaccaaaucgggacuuugaaauuuaucaggcgaccaaucaagcagaagagugaugauaucgaagagagugaggaauuuaaagcuuuuagcggaacaggauuuaguuuaagagguagaaauuaa

SEQ ID NO: 7170 - RNA, 1617 nt, Leptinotarsa decemlineata
augucuaguuuuccaggaaguauugcuuuugacgaauauggucgaccuuucaucauuauucgugaucaagaccaacaaaaacgauuaacaggaauugaugcacuuaagucacauauuuuggcugcaagacaaauugcuaacacuauuaguacuucuuuggggcccaagggauuggacaaauugauggugucuccugauggugaagugacugucaccaacgauggagcuacgauauugaagaugauggauguggagcaugaagucgccaaguuguuaguggaauugucucaaucacaagaugaugaaauuggugaugguaccacaggugugguaguucuugcuggagccuugcucgaacaagcuggaucucuucuugaucguggaauccaucccaucagaauagcugauggcuucgaauuggcuugccaaacugcaguucagcauuuagaaaaaauugcugaaguuuuuccaguuuccgccgaaaauacagauccucuuaucaagguagccaugaccacuuugggaucaaaaaucaucaacaaaugucaccgucagauggcagaaauagcaguuaaugcaguuuuagcuguugccgacuuaaagacuaaagauguuaauuuugaacucauuaaaauggaaggaaagguugguggaaaguuggaagacaguacacucguuaaaggaguggucauugacaagacaaugucucauccacaaaugccgaaagaauugaagaauguaaaguuagcuauccucaccugcccauuugaaccaccaaaaccaaagaccaaacauaaguuggauguuaccaauguugaugaauauaaggaacuacgacaguaugaacaagacaaauucaaagaaauaguuggauugguaaaaaauguuggagccacuuuggcuaucugucagugggguuucgaugaugaagcaaaucauuuauuacuucaacaggagcuuccagcagucagaugggugggaggaccagaaauagaacucauagcuaucgcaacuggaggacgcauuguaccuagauuugaagaguugagcccagagaaacuuggcacugcuggucuaguuagggaaauaucuuuugguaccacaaaagacaggaugcuggucauugaagagugcucaaauucucgagcugucacuauucucguacguggcggcaaucagaugcugguagcugaggcaaagaggaguuuacacgaugccuuguguguuguucgaaguuugguucaggaacccagaguuguuuauggagguggugcagcugaaauuucgugcagucuggcugucucugcccaagcagaucagcuugcuacucuagagcaauacgcuuuccgugcauucgcugaagccuuagaaagcauuccguuggcuuuggcagaaaacaguggauugucauccguucauguucuuggagaauugaaggccaagcaguccgcugccgaagaucccgcuuugggugucgauuguauggauacagguaacauaaacaugagagaacagcacgucauugaaucucuuaggucuaaacgucaacagcuccuccuggcgacucaacuggucaagaugauauugaaaauugacgacguucgccagcccaauuaa

SEQ ID NO: 7171 - RNA, 342 nt, Leptinotarsa decemlineata
auggcuucagcaauggauguagaugcugaagaaguugaaaugcccacuucaaguaguuccaaaggagaaaaaaagcguuuugaaguuaaaaaguggaaugcuguggcauugugggcaugggauauugucguggauaauugugcuauuugucguaaucauauuauggacuuguguauugaaugucaagcaaaucaagcuucagcuaccagugaagaguguaccguagcuugggguguauguaaucacgccuuucauuuccacugcauuucaagaugguugaaaacuagacagguuuguccuuuagauaacagggagugggaauuccaaaaauauggccauuga

SEQ ID NO: 7172 - RNA, 1605 nt, Leptinotarsa decemlineata
auggucucccugaacccaguuagaauuuuaaaaaaugaagcugaagaagauaaggcagaaauugcuagacugagcaguuuuauaggugcuauaacuaugggggaucuaguaaaaaguacuuuggggcccaaaggaauggauaagauucuaguauccagcggaagaaaugcaggaucuguagaaguaacuaacgauggugccaccauucucaaaucugucgguguggauaauccugcugcaaaaauucucguugacaugucgaaagugcaagaugaugaaguaggugauggaaccacaucugucacaguuuuagcugcugaacuucuuagagaagcagaaagacugaucgaacagaaaauucauccccaaacgauuauugcugguuggaggaaagcuguugauguagccagaaaagcccugcgggaugcuucaauggauaacagcgauaaucucgaaaaauuccgugaagaucuguugaacauugccaggacaacucugagcucgaaaauucucucacaacacaaggaacauuuugcaaaacuauccguugaugcgguacucagguuaaagggaucaggagauuuacaagcuauccagcuuaucaagaaaacuggugguacucuggaagacucauuucuagacgaagguuucuuauuggacaaaaaaccaggaguccaucaacccaaaacaguggagaacgccaaaauacucaucgcaaacacucccauggacucugacaaaauuaaaguauucggcucccacaucaaaguugacucaauggccaaaauagcugagcuggaguccgccgaaaaggaaaagaugaaggacaaagucaacaagauccugaaacacaaugccaacguuuucaucaauaggcaacucaucuacaacuaccccgagcagcuguuugccgaugcgggcguuauggcgaucgaacaugcugauuuugaugggauugagcgucuggcgcucgucacuggaggagaaauugucucuacguucgaccacccagagcuggucaaguugggaacaugcgaucucauugaacagauaaugaucggagaggacauucuccugcgcuucagcggcgucgcucucggagaagcgugcaccauugucauccgcggcgcgacucagcaaauaaucgacgaggcggaccgaucccuccaugacgcccucugcgucuuggcagcgaccgucaaagagagucgcaucgucuucggcggcggcugcagcgagacgcucaugucgacagcagugagcagggcggccgccaacacgcccggcaaggaggccgucgccauggaggcguucgccagggcgcugcuccaguugccaaccaucaucgcugauaacgcaggguacgauucugcgcagcuaguuagcgaguugagggccgcacacaaugccggaaagagcacucuggggcuggacauggaacgcggggaagugggcgacaugagcgugcucggcaucacggagucuuuugucgucaagaggcaggugcuggugucugccucugaagcugcugagaugauccugcguguggauaacaucaucaaggcggcgcccaggaagcggacggaggacagggggaugugcuag

SEQ ID NO: 7173 - RNA, 846 nt, Leptinotarsa decemlineata
auguuuagaaaucaauaugauagugaugugaccgucuggagcccccaggggcgucuucaucagguagaauaugcaauggaagccguuaaucuagguucagcgacuguagguuugaaaaguaaaacucaugcagugcucauugcucuuaaaagagccucuucggagcucucugccuaucagaaaaagaucaucaacaucgacgagcauauuggaauaacuauuucaggacucacugcagaugcuaggauccuuagucgauauaugaggaaugaguguuugaauuacaaauauucuuuagaugcccauaugccucugaauagacucauaagcacguuagguaauaaaaugcagcacuguacucagcgcuaugaccguagaccauuuggaguuggucuucuaguugcuggcuaugaugagucagguucucauaucuaucaaacauguccgucagccaacuuuuaugacugcaaagcuaugucaauaggugcuaggucccaaagugcgagaacuuaccucgaaaaacaccuagaugaacuuccuuccuguucccuggagcaacucgucaaacacgguuuacgugccuuaagagauaccuugcccccagagguagacuugacuacaaaaaauguugcgauugguuauguugguaagggacagccuuuccaaauauuggaagaaaaugaaacggcuccauauuuggcccugauugagggagaggaaagaagaggugguggggcaggaggagcugguguugaggcucagcaagccgauccccugagggaagauacgggggacgaagggcccagagacccagugccaacaacagcaauggauaccacagauuaa

SEQ ID NO: 7174 - RNA, 2502 nt, Leptinotarsa decemlineata
auggugcaacaauccgaacacauagaaauaaaauucagugaugaugacuugccuuaugaagaagagauucuucgcaacccguauucagucaagcacugguugcgauauguugaacacaaaaaggcagcucccaaaggagucaacaucguauacgaaagagcccugaggcaacugccagguucuuacaagguaugguauaaauaucuacgaacuaggagaaugcaagucaaaucucggugcauaauagaccccgaauaugaagagguaaauaaugcauucgaaagggcccuaguguucaugcacaagaugccucgaaucuggauggacuacugcacauuccuuaccgaucaguguaaaauaacaagaaccagaaauguguucgacagagcuuugagagcguuacccguaacacaacauaauaggauuuggccuuuguacuugaaauuuguaaagcagcaugauauuccugagacugcuguccggguauucaggagguacuggaaacuguguccagaaaaugcugaggaauauguggacuaccucacagaaauaggucggcuugacgaagcugcccaaguauuggcaaaaauugucaaugaugaaaauuuugcuucccagaaaggaaaauccaagcaucaacucuggaacgagcuuugcgaacucauaucaaaaaauccugacaagauucguuccuuaaauguggaugcuaucaucagaggaggccugagacgcuauacugaucaacugggccaccucuggaacuccuuagcaaacuacuauguacgcaguggccuauucgaaagagcaagagauauuuaugaggaagcuauucaaacagucacuaccguucgugauuucacccaaguuuuugauucuuacgcacaguuugaggaauugagucucagcaagaaaauggaagagguugcuaaucaggcuaauccuacagaagaugaugauacagaucuggaaaugaggcuauccagguuugaaaaucucauggaaaggagauuacuguugcuuaacuccguacuucugagacagaacccgcauaacguccaagaauggcauaaaaggguccaacuguaugaagauaaaccacuggaaauaaucaacacuuacacagaagcagugcaaacuguggauccaaaacuagcuguggguaaacuucacaccuuauggguggauuucgcaaaauucuaugagaaaaacgggcagauugaugaugccaggcuuauuuucgaaaaggccacgcaaguuccauaugugaaaguagaugauuuggcgaauguuuggugugaaugggcugaaauggaaauccgaaaugaaaauuaugaugaagcuuugcaacuuaugcauagagcaacaguuaugccuagucgaaaaguggccuaucaugaugacucagaaacggugcaaaguagggucuauaaaucgcugaaagugugguccauguaugcugauuuagaagaaaguuucgguacauucaaaucuugcaaagcuaucuaugaucgcauaauagauuugaaaaucgccacaccucagaucaucaucaacuacggauuauuuuuggaagaaaauaacuacuuugaggaagcguucagggcuuacgaaaaaggcaucucucuuuucaaguggccaaauguuuacgacauuuggaauacuuaucucaccaaguuccucaaacgauauggagguacuaaacuugaacgagccagggaucuuuucgagcaguguuuagagggguguccuccucaguucgcgaaacaucucuaccuucucuacgccaagcuggaagaagagcauggaauggcuagacaugcgauggcuguuuacgaaaggucuaccaaagcugugccagaaggagaaauguucgaaauauucaauauauacauaaagagagcggcagaaaucuaugguaucccaaaaacuaggcaaauuuaugaaaaggcgauugaggugcuaccagaagauaaaacgagggauaugugcauuagguuugcugauauggagacaaaauuaggugaaauagacagagcgagagcuaucuaugcucauugcagccaaauuugcgauccgcguauaacaaacgaauucuggcagauuuggaaggaguucgaaguacgacacggcaacgaagacaccaugcgcgagaugcugaggauaaagcguaguguccaggcaauguucaacacccagguuaacaugaugucggcgcagaugcugaguacagcugccaguaugucugggacugucgcagaucuggcaccuggugucaaagauggaaugcgauugcuggaagccaaagcaguggaaaugucuggaauaaacuuugucaggggagaaacccagggagauaaaaaagacaaaguugucaauccugaugagauugauaucgaugaugaagaugaagaagaggagauaccuguggaaaaacaaaguauucccuccgagguauuuggaaguuugcgggugcagguaccuguagaggaagaugaccaguga

SEQ ID NO: 7175 - RNA, 1185 nt, Leptinotarsa decemlineata
auggcaaauggaccaauagcagaaagaaaucgagaugcuacuauauauguuggaggcuuggaugacaaagugucggaaucucuuuuaugggaacuuuuuguucaagcuggaccauuggucaauguucauaugcccaaagaucggguaacuaugaugcaucagggauauggauucguugaauucaugggcgaagaagaugcugacuaugcuauuaaaauaaugaauaugauuaaguuauauggaaagccuauucgagucaauaaagccuccgcacaccaaaaaaauuuagauguuggggcuaauaucuucauaggaaauuuggauccugaaguugaugaaaaauuguuauaugacacauuuucugcauucggagucauuuugcaaacuccuaagauuaugagagauccagaaacagguaacuccaaaggauuugcauucauaaauuucgccaguuuugaagcuucagaugcauccauugaagcaaugaacggccaguaucucugcaaucgaccuauuucuguaucguaugcuuucaaaaaggacuccaagggugaaaggcacgguucugcugcagaacguuuacuugcugcucagaauccucucucacaagcagacaggccucaucagcucuuugccgaugcuccuccaauugguaugaugcccaugacgauagcuccaccaccuccuccuguuauuuuaacagggaugaugccaccucccacucccgcaaacaugcacccuccuccgccaccaccaguuccuccuccaaguggauuuccuucagguauaccgccuccuccauuaccaccaucccaaccaccguuaccuccgggagcuccuccuccacccccaauuucggccuccacuggaucuacaccuagaccaccacuucccccuaauccgacuuccgcuccagguggucccccuccuccaccucguuugauuccaccaccauggccaggagcaggggcagguguuaucccaccucccccaccagguccaccugggucuguaucgucaacugcagcuacaccauuugcaggaauguuuccaccaccaccgccaccaggaggucgaccaccuccuccaaacuggagaccuccgccaccuccuaguuuuccugcggggcgaccuccauuuccuccgagagggccaccuccaccccccgcaacuuuugaaagcuga

SEQ ID NO: 7176 - RNA, 774 nt, Leptinotarsa decemlineata
augggucguguaauucgugcccaacguaaaggagcgggaucaguguucaaaucucauacaaagagaaggaaaggagcaccaaaauugcguuauuuggacuuuucugagcgacauggauauauuaaaggugucguuaaggaaauaaugcacgaucccggccguggcgcuccauuagcuaugguucauuucagggaucccuauaaauuccaaacaagaaaagaguuauucauugcucccgaagggauguauacaggacaauuucuguauugcggaaagaaggcuaguuugcagauuggaaauguuuugccuguuggaaccaugccagaagguacaaucguauguaacuuagaagaaaagacuggcgaucguggucgucuugcaagggcaucuggaaacuaugcaacaguuauugcccacaaucaugacacaaaaaaaaccagggucaaguuaccaucuggugccaaaaaagucauuccuuccaacaauagggccaugguugguauuguugcaggggguggucguaucgacaaaccaauucuuaaagcuggacgugccuaucacaaauacaagguuaagcguaacugcuggcccaagguacgugguguugcuaugaaucccgucgaacauccccaugguggugguaaccaucaacacauugguaaagcauccacuguuaaaagagguaccucugcuggucguaagguuggucucauugccgccaggagaaccggucguauucggggugguaaaguggaugccaagaaggaagauuaa

SEQ ID NO: 7177 - RNA, 411 nt, Leptinotarsa decemlineata
auggcucguaccaagcagaccgcucguaaaucgacuggagguaaagcuccgagaaaacaauuagcuacuaaagcagcucgcaaaagugcaccggcuacgggagguguuaaaaaaccucaucguuacagacccgguacuguugcucuccgagaaauucgacguuaucagaagaguacugaauuguugauuaggaaauuacccuuucaacguuuaguucgagaaaucgcucaagauuucaaaaccgauuuacgauuccaaaguucagccgucauggcuuugcaagaagcuagcgaggcguauuugguaggacucuucgaagauacgaauuugugcgccauucacgccaagcgcguuaccauuaugcccaaagacauucaguuagcaaggagaauacgcggagaacgagcuuaa

SEQ ID NO: 7178 - RNA, 1593 nt, Leptinotarsa decemlineata
auggcuauaaguuuguugaauccuaaagccgaaguagccagagcugcacaagcacuggcugucaauauuucugcugcuaaaggaauccaggauguaaugaaaaccaauuugggccccaagggaacuguaaaaauguugguaucuggagcuggugauaucaaaauaaccaaggauggaaacgugcuguuacaugaaaugcaaauccaacacccaacagccucucuuauugcccgagccucaacugcucaagaugacaugacuggugacggaacaacaucuacuauucuugucauaggugaacuucucaaacaggccgauauuuauguugcugaagguuugcaucccaggauacuuacagaaggauuugauaaagcucgggcuaaagcguuagaaguguuggaaaaaaucaaaauuccuguugaaaucaacaaggaaaguuugaccgacguuugcaggacuaguuugagaaccaagguucaucaaaaacuugcugauguauugacagauguuuguguugaugcaguacuagcaaucaaacaaggcgauaaaccuguagaucuucauaugguugaauugauggaaaugcaacauaaaacagaaacagacacccaacucguuaaaggucugguucuugaucauggugcucgucauccugacaugccgaagagccuuaagaauuguuacauucuaacuuguaacgugagcauggaguaugagaaaagcgaggucaacucgggauucuucuacaaaacagcggaagaaagagaaaagaugguuucugcugaacguggauucauugagcaaagggucaaaaaaguaauagcuuuaaagaaaucuguaugcgacgguacaaacaaaacauuuguggucaucaaccagaaagguauugauccgaugagccuggauaugcuggccaaagaagguauuauugcccuucgcagagcuaagaggcguaauauggaaagacuugcuuuggcauguggaggaauugcuaugaauaguuuugacgaccuccaggagucucaucuuggucaggcuggucacguauaugagcauguacuaggugaaaacaaguauaccuucauagaagacuguaagguuccacaaucuguuacaauuuuaaugaaaggaccuaauaagcacaccuugguacaaaucaaggauuccguaagagaugguuugagggcuaucaauaaugcuauugaggauaaagcuguuauaccaggugcuggagcuuuugagauuacggcaaauaaagagcuauuagcuuucaaagacacuguuaaaggaaaaguucgucuugguauugcagcuuaugccgaggcacuuuuagucauucccaaaacauuggcuguuaauucuggauuugaugcucaggacaccauugucaaacuccaagaagaaucucgauugaauccugaaccuguaggacuugaccugacaucuggagaaccuaucaauccaaaagaugcuggcaucuuugacaacuacguggucaagaaacaaaucauaaacuccugcucugucauugccaguaaccuauuacuuguggaugagauuaugagggcaggcaugagcaguuugaaaggauaa

SEQ ID NO: 7179 - RNA, 3147 nt, Leptinotarsa decemlineata
auggacgaauccucaaaccgcggucuuucgcguccgaugucuagugcugcaauugcaggcagcuccgucgauccaccagcaaagaagcgaaagcucgaaacuucaacccucgaaauggcgaacaguucaggaccgucucgagccagcgaaaucgacgaggggcuguauucucgccagcucuacguuuugggacacgacgcaaugcgucguauggcuaaaagugauguacucauaucgggcuugggggggcugggaguggaaaucgcgaagaacguuauccuggggggcgucaagucggugacccuccacgaugaggucguuuguacuauuagcgacuugucuagucaauuuuauauuucagaaucugacgucgggaagaacagagcggaggcuuguugcaaaucucugucagaacucaauaacuauguacccacgaaggcguacacgggcccucucgacgaacaguucaucaaaaacuucagcgucgugguccuuaccacgaguucaaggucugaacagcugcgcaucagcgaaaucacucacucaaauaacaucgcccugauuaucgcagauacuaggggcuuauucgcccagguguucugugauuucggggagucuuucaccgucguugauaccaauggggaacccaccguuucggcaaugauugcugauauuuccaaagauaaggaagguguugucaccuguauagacgauaccaggcaugguauggaagacggggauuacgugacauucuccgaaguucaaggcaugacagaauugaauaacugcgagcccaucaaaaucaaaguacugggacccuauacuuucagcaucggcgacacuacauccuucgggaaauaugaaagaggcgguaacgcaucucaggucaaaaugccaaaagagcugcauuucaaaccccucaaagaaucgcugcuggcuccagaguucgucauaacggauuucgccaagauugacagcccccagcaacuccacuuagcuuucaccacccuccacaaguacuucgagaagaacgguaggguucccaaaccuuggagcaacgaagacgcugacgaguuuguuucuuuggcaaagucuauagccguagacgguucaaaugauacugaagucaaugguaguuuauuggaaacguuugcuaaaguugcggcaggagauuugaauccgaugaaugccacgaucggaggcguuguggcccaggaagugaugaaggcuugcuccgggaaguuccacccgauuuaucaauggcucuauuucgauucgaucgaaugucuaccccaagaucguucugaaaucacagaagaauuagcugcucccuucggcagucguuaugaugggcagauugcaguuuucggaaaagaauuccaaaagaaacuagccgcacugaaauacuucguagucggcgcuggcgccauaggaugcgagcuuuugaaaaauuucgcaaugaugggugugggcacugagggacaaauaacggugacggauauggauuugauugaaaaguccaacuugaacaggcaguuccuguucagaccacacaaugugcagcagccaaagucugcuacagcagcaaagguaaucaaaaagaugaacccugaaguaaacgucguggcccacgagaaccgcguaggcccagagacggaaagcaucuacaaugacgcuuucuucgagaaacuugauggcguugccaacgcccuggacaacgucgacgccaggauauacauggaccgcagaugcgucuacuaccgcaaaccucugcuggaaucugggacgcucgguacgaaaggcaacacucaagucauuguuccguucuugucugagucguacagcucgucucaagacccuccugagaagagcauacccaucugcacccugaagaacuucccgaacgccaucgaacacacuuugcagugggcucgcgacaacuucgaggggcucuuuaggcagaacgccgagaacgcgucgcaguacuugaaggaugccgguuucaucgaucgcacccucaaguuaccuggagugcagcccuuggaaguccucgaaucggucaaggcagcuuuggucgacgagaggccuaaaucuuuugaagacuguaucgccugggcccgcaaccacuggcaggagcaguacucgaaccagaucaggcaguuguuguucaacuuuccuccggaucagcucacaaccaccggccaguuguucuggucggggccaaaacguugcccggaagcgcucacuuucgauaucaauaauccucuccauuuggauuacguccuugcggcugcuaauuugaaagcgcagguguaugguauuccgaccaacagggacagggcauauauugcugaaguggucagcaagguugagguaccagaguuugugccgaagucuggcgucaaaauagcuguuacagacucccaaauggccaugaacgguaacaacgucgacuuggaucgaguaacucaaauuaaagaggagcuacccuccgucgaagaacugaacgggcuccgucuuacuccgcuagaauucgaaaaggaugacgacaccaauuuccacauggauuucauuguugcugcuucuaaccuccgagcagcaaacuauaaaauaccucccgcagacagacacaagucuaagcucauugcagguaaaaucaucccggcuauugcuaccacgacauccgucguaggggggcucgucugcuucgagcuguacaaacugacacgaagcaugaagaguuuagaaccauucaaaaacggcuuugucaaccucgcgcugccuuucuuuggcuucuccgagccgaucgcggcccccaagauggaguacuguggcaacgaguggacacugugggaucgcuucgagguccaaggagagaugacgcucagcgaguucuuaacguacuucaaagagaagcacaaccucgagaucacgaugcucucccagggcguuugcaugcuuuacucguuuuucauggcaaaggccaaggcgcaggaaagacucggacugaccaugucagagguagucaagaaggugucgaagaagaagcuagaaccgcaugugagggcucuuguuuucgaguugugcugcaacgacgccgaaggcgaagacguugaagugcccuacgugaaauauaaucuguguuga

SEQ ID NO: 7180 - RNA, 792 nt, Leptinotarsa decemlineata
auggcagaugcagaugaucuuuuggacuacgaagaugaagaaaauacugaacagacuaccacugagacaacagcuaaugaagcacaaaagaaaggggucaagggcacuuacguauccauacacaguucaggcuucagagauuuuuuauugaaaccagaaauucuaagagcuauaguugacugcgguuuugaacacccuucagaaguucaacacgaauguauuccucaagcugucauuggcauggacauuuuaugucaagccaaaucugguaugggcaaaacggcaguguuuguucuggcgacacugcaacaauuggaaccagcggacaauguuguuuacguuuuggugaugugucacacucgugaacuggccuuccaaaucagcaaagaguacgagagguucaguaaauauaugcccagugucaaggugggcgucuuuuucggaggaaugccuauugcuaacgaugaagaaguauugaaaaacaaauguccacacauuguuguggggacgccugggcguauuuuggcgcuuguuaagucuaggaagcuaguccucaagaaccugaaacacuucauucuugaugagugcgauaaaauguuagaacuguuggauaugaggagagacguccaggaaaucuacagaaacaccccucacaccaagcaagugaugauguucagugccacacucagcaaagaaaucaggccggugugcaagaaauucaugcaagauguaauugaaaauuauuuaaauacaaauuuagugcccgcuugcuauccucguaucguuaaauga

SEQ ID NO: 7181 - RNA, 864 nt, Leptinotarsa decemlineata
augggucugguugaaacagacgucgaaaugaagaacgcugauagcccuccagguuuggaagcuggggacagcaaacgugauacagaccuacaaaguguuuuggagauucgugagcaugccaggcaaauagagaaguccgucacuaguaaagaaaaccguuuuauucuaagaguucuacgguguuuacccaauacaagaagaaaacugaauggugucguucugagaagucuuaucaaucaaaucuauccagucuccgaacgugaagcucugcugaauuucacugaagaagcuguuggagauuuagacaccacccaggcaagggccagaucugccaccaaaucgccauuaccagagguugauacauauauaaauuuauugauuuugguucgucucaucgauaccaauaaacuacaagaagcagaaagguguucucaggcacuaaugaacaaaauaacaacucaaaaucgacguaccauagaucacauagcugccaaguguuacuuuuaucacucuagaguugcugaacuuucaaauaaacuugauacgaucagagcuuucuugcacucacgucuucguacugcuacgcuucgaaaugauuuugaaggucaagcaguucuugucaauuguuuacuaagaaauuaccugcauuacucguuauaugaucaagcagauaaacuggugagcaaauguguauuuccagagacggccagcaacaaugaaugggcaagauuuuuauacuauuuaggucguaucaaagcggcucgauuagaguauaguguugcucagaaacaucuuguacaagcuaugaggaaagcgccucagaacgcugcuauuggauuccgccaaacagugcaaaaacucacc

SEQ ID NO: 7182 - RNA, 981 nt, Leptinotarsa decemlineata
augccaggaacaaaaguggauagcaaacagcgaaucacaguaaggaaccugaggauaagagaagauacugcaaaauaucugaggaauuuggaccuuggcucagcguauuacgauccaaagacuaggucuaugagggaaaauccaaauccuaauaaagaugauacuuaccauggagagaauuucguucgauuuucuggagacacucaaaaucaugccaaagcccaauuauuugcuugggaagcauaugaaaaaggagucgacguccauuuacuggcugaaccgacaaaacuugagcuacuuaaaaaagaguaugagaaaaaaaaagaacaaaucaagaccaaaauucagagcaauguucuggaaagauacggaggugaggagcacuuagaagaaccuccuagaagucugcugcuugcucaaacagaagauuauauugaauacucaagaucaggcaaaauuauuaaaggagcugagaaggaggugaucaaauccaaguaugaggaggauguuuacauaaauaaucauacuucuguuuggggaucguauuggcguggaggccaguggggcuauaaguguugucauucauuuaucaaaaauuccuucugccuuggagaagccgguagaaauucggagauuguuaagccucacgagcugccagaaaguagaggugaugugaacgaagauauaccugaugauaagaaagggaauagugaucgagaugagagcagcuccaguucaucggacgaaaaaucuaagaagaagaaacagaaaagagaaaagaaaaaacucaagaaaaugaagaagaaacugaggcaagaaaaacacauaaccaacaaaauggaagaaacagaagaaaucauggaugagagaaaacgaccguauaacaguauguaugaggugaaaaagccuacggaagaggagauggaacaauauuucaagaagcgaaagagggaugaagauccaaugaaucaguucuuguag

SEQ ID NO: 7183 - RNA, 627 nt, Leptinotarsa decemlineata
auggguaucagccgagaucacuggcauaaacgaagaucaaccggaggcaaaaggaagccucugcguaagaagaggaaguuugaauuaggucgccccgcagcuaguacuaaacuaggaccucgcaggauccacuauguucguaccagaggugguaauuugaaauauagggcucuaaggcucgacacuggaaauuuugccugggguagugaaggaacugcgagaaaaacccguauuauugauguugucuacaaugcuagcaacaaugaguuggugcguaccaaaacauuagugaagaaugcaauaguuguuguagaugccacuccauucagaaugugguaugagaaucauuacauccugccuuugggucgcaagaagggagccaaacugacugccgaagaagaggcucuuuuagcgaagaaacguaguaagaaaguacaaaagaaguacgaaacucgucagaagacuucuaaaguagaaccugcuaucgaagagcaauucacaacuggaagguuguuggcuugcuuggcgucucgaccaggacaguguggaagggcagauggcuacauuuuagaaggaaaagaauuagaguucuacaucaggaaaauuaaaucuaagaaagcaaaguaa

SEQ ID NO: 7184 - RNA, 936 nt, Leptinotarsa decemlineata
auggaccgacuuuugagacuuggaggagguaugccagguuugagucaagcaccuccuccuucagaugcaccugugguagauacagcugaacaaguguauauuuccucucuggcuuuacugaagaugcugaagcacggccgugcaggaguaccaauggaaguaauggggcuuauguuaggugaauuuguagacgauuacacagucagaguuauugauguauuugcgaugccacagacagguacagguguuaguguagaggcuguagauccaguuuuccaagcuaagauguuggacauguuacggcagacugguagaccagaaaugguggugggcugguaccauucccauccaggauucgguuguuggcugucgggugucgauaucaauacccagcaaaguuuugaagcccuuuccgaaagggcaguugcuguuguaguagacccaauucagucuguuaaaggcaaaguuguaauugaugccuucagguugauaaacccuaacaugaugguuuugggucaggaaccucgacaaacaaccuccaacuuaggacaccuccagaagccuucagugcaagcucucauucacgguuugaauaggcauuauuacucgauaaguaucaauuaucgaaaaaaugaacuggaacagaaaaugcuucucaacuuacacaaaaaguccuggauggauggccuuaccuuagcggacuaugcagagaacuguaguguaaaugaaaaaaccgugucugacaugcuggauuuggcuaaaaauuauaacaaagcucuggaagacgaggaaaagaugacaccggagcaacuagcgaucaagaacgucggcaaacaggauccgaaaaggcauuuggaggagaaaguugacguuuuaaugacaaauaacauuguucaguguuugggagcuauguuggacaccguugcauuugaauaa

SEQ ID NO: 7185 - RNA, 1215 nt, Leptinotarsa decemlineata
augacggugauuaauaaaauggagauugacggugccacuaaaggugaaggcuucaggucuuacuacauaacuaagauagaggaguuacaacucauaguugccgaaaaaagccaaaauuuacgucgucuacaagcacaaagaaaugaacuaaaugcaaaaguucgaauguugagagaagaauuaaugcugcuucaagaacaggggaguuauguuggugaaguaguuaaaccaauggacaaaaagaaaguccucguuaaggugcauccugaaggaaaauuuguaguagacauugacaaaaacauugacauuaaugaugugacaccaaacugccgaguugcauugaggaacgagaguuauacuuuacauaaaauuuuaccuaauaaagucgauccccuuguaucuuugaugaugguugaaaaaguaccugauucaacuuacgaaauggugggaggcuuagauaaacaaauaaaagaaaucaaagagguuaucgaauuaccugugaaacauccugaacuauucgaugcccuugguauagcacagcccaaaggggugcuucuuuauggaccaccaggaacugggaaaacucuucuugcuagagcuguugcucaccauacggaauguacuuuuauucguguaucugguuccgaguuaguucaaaaauucauuggagaagguucucgcauggugcgugaacuauucguuauggccagggaacaugcuccuucuaucauauucauggaugaaauugauucuauuggaucaucucgaauugaaucagguucugguggugauucugaagugcagaggaccauguuggaacuccuuaaucaacuagacgguuuugaagcuaccaaaaacaucaaagucauuauggcuacgaauagaaucgauauuuuagacccugcacuacuuaggccaggcagaauagaucguaaaauugaguuuccuccaccgaaugaggaggcaagguuggauauucugaagauccauucucgaaaaaugaaucuaacuagaggaauaaacuugaggaagauugcugagcugaugccuggggcaaguggagcagaaguuaagggagucugcacugaagcagguauguaugcacugagggagagaagaguacauguaacucaggaagauuuugaaauggcuguugcuaaaguuaugcaaaaagauucugaaaagaauaugucuaucaaaaaguuguggaaauga

SEQ ID NO: 7186 - RNA, 645 nt, Leptinotarsa decemlineata
uuuuuguuacuugucaaaagucuuguagguguuuguuuauugaaaauggucaaguuguacuguauuaguauuuuauacaagggcccuacuucagcuacaugguuaaaaucugcauucgaauugcaaacauuuaauuuuuuccaaagagggucuguccaagaguuuaugacuuuuuuuuguaaaaccaucguggaaagaaccauaccugcuucuagacagucagucaaggaaggagaauaucuguguaauguguauguccguucagauaauuuggcuggggucguaauaucggaccaugaguauccauccaggguaucacacacuuuaauaacaaagcuuuuagacgaguuugcagaaagaauaucaccugcaaauuggccuaaccuucaagagaaagauguggcauuuccacaaguuacuacuuauuuagcaaaauaccaaaacccucgagaggcugaugcauuaacuaaaauacaagaagacuuagaugaaacuaaaauaauuuuacauaauacaauucaggcgguguuggaaagaggggagaaguuggaugauuugguaucuaaaucagaaggauugagcaugcagucgaaggcuuuuuauaaaacggcaaagaaaacaaauaguuguuguacauuuaguuaa

SEQ ID NO: 7187 - RNA, 804 nt, Leptinotarsa decemlineata
auguuccuaacaagaagugaauaugaccgagggguuaauacguucucuccugaaggacguuuauuccaaguggaauaugcuauugaagccauuaaauuggguucuacagcuauuggaauaugcaccagcgaaggagucguuuuagcuguugagaaacguauaacauccccguugauggaacccacuacaaucgagaaaauagucgaagucgacaagcacaucgguugcgcagugucuggccuuauggcagauucucgaacaaugauagacagagcccguguagaaugccagaaccauugguuugucuacaaugagaacaugaguguagagucaugcgcccaagguguguccaacuuggcuauucaguuuggggauucugaugaugacggagcggcuaugucuagaccauuugguguugccauuuuauucgcugguauugaugagaagggaccucagcuguaccacauggacccaucuggcacauuuguccaauucgaugcaaaagccauugguucuggcuccgagggggcucagcagagucugcaagaaguguaucaccgcaguaugacacuggaagaagcuaugacugcagccuugacaauucucaaacaaguuauggaagaaaaguugaacgcuucgaauguugaaguugccacgaugacuucaaaagauuuauuccacauguucacgaaagagcaaguggaagaggugcugaaauguauggagaggaaugaaccagagcaucaucacaucggggguauggaggcggcuucugguaaacguaauacucccacaaugucauaa

SEQ ID NO: 7188 - RNA, 1311 nt, Leptinotarsa decemlineata
auuuuuaaaauuauuucaaugaugcauuucauucaucaucauggcaaaaaagaagacaaugguucuaaggaaaaaaaacacgaauguagcaguaaaaaggaagaaaaagacgauacugguuuaaggagaccuucaucugagcacgaagcagucauggcggaauauuggcucauuucggcuccuggugacaaaacaugucagcagacuugggaaaccaugaauaaucucaccagcaaacagaauaauuugugcacaaauuauaaguuccacauuccugauuugaagguuggcacacuggaucaguugguaggucugucggaugauuuggguaaacuggauggguucguggaacaaguuacccgaaagguagcucaguacuugggggaaguauuagaggaucaaagagauaaacugcaagaaaaccugauggccaauaacaccgauuugccaaauuaucuaacgagauuccagugggacauugccaaauauccgauaaagcagucucuccguaacauugccgauauuaucagcaagcaggucggucagaucgacgccgaucucaaaaccaagucuucggcguacaacaacuugaaaggcagccuccagaauuuggaaaagaagcaaacagggaguuuauuaucucgcaacuuggcagacuuggugaagaaagaacacuuuauauuggauucggaauauuugcaaacacuccuaguuaucgugccaaaacagcaguucucggaguggaacgccacuuaugaaaagaucaccgacaugaucguaccccguucgacgcagcucaucacccaggacaacgaguacggacucuauaccgugacauuguucaagaaagucguggaggaguucaaacugcacgccagagaaaagaaguucaucgugcgcgacuuuauuuauaaugaggaagaguuggcugcgggcaagaaugaaaucacgaaacucgucacggauaagaagaagcaguucgguccgcuagucagaugguugaaggugaacuuuagcgagugcuucugcgcuuggauucacgugaaagcucugagaguuuuuguggagucuguguugagauaugguuuaccggucaauuuccaagccaugcuaauccaucccaauaaaaagacaaugaaacgguugagggacguuuugaaucaguuauacggccaucuagauaguagcgcugcccuuucugggcccaauuuugauagcgucgacauuccaggcuuagguuucggccaaucagaguauuacccuuacguauauuacaagauaaacguggacaugauugaagcaaagaucuag

SEQ ID NO: 7189 - RNA, 1017 nt, Leptinotarsa decemlineata
augucgauuuuagccagcccuuuguccguugcgggauccagaacgacuggaucuucaguucguucccaaaaugucauggcagccgcaaccaucgccaauauaguuaaaaguucuuuaggccccguaggauuagauaaaauguugguagacgauguuggagaaguaacggugacaaacgauggggccaccaucuuaagacuccuggaggucgaacacccugcugcuaggguguuagucgaauuggcacaacuucaagaugaagaaguuggcgacgguacuacuucuguuguugucauugcagcugaauugcugaagaaugcagaugagcuggucaagcaaaaaauucaccccacuuccaucauaagugguuacagacuggcuugcaaagaagccugcagguauauacaggaccgucuuaccauaccagucgaggaucugggaaaugauugcauuauaaauguugcgaaaacgucgaugagcucaaaaauuaucggagcagaugcagaccuauuuucauccauaguaguagacgcagcaaaugccaucaaaguaacggacucgagagguaaugcgauguaccccaucaaggcuguuaauguucucaaggcccaugguaaaagugccagagagagcuuccucauccaaggauaugcuuugaacuguacaguagccagucaagccaugccaaaaaaaaucguaaaugccaaguuggcgugcuuggacuucucccugcagaaggccaagaugaagaugggaguccagguguugaucacggaccccgaccaguuggaaggcauccgcagccgagaguuggacauaacgaaggaacgcauccagaagauccucucuacaggcgugaacgugguccucgucucgggcggcauugacgaccucugccugaaguacuucguggagagcggugccauggccgugcgccgcgucaagaaggcugaccugaagcgcaucgccaaagcgacgggcgccgccuuccucaccucgcugacgaauauggacggc

SEQ ID NO: 7190 - RNA, 771 nt, Leptinotarsa decemlineata
auguucaguucacugucugaugcaccaccccuuuggaauaauggcccagcaccaggaucuuuuuacaauuuuccaggccaccaagugaaacccaaugauuauuucacacauacucagucuccaguuacaacggcaacuucuaucgucgcaauugcguacgacaaagggguuuugauagcaggagaucuuuuggcuucuuauggaucuuuggcacgauauagaaauugucccagagugauugaagucaacuccaauauuauacugggagcugguggugauuacgcugauuuccaauaugucaaaucauucauagaucagaaaauaaucgaugaagaauguuuggacgaugguuugaaauucaaacccaagucaauguauuguuggcuuacaaggauuauguaccagagaaggagcaaauuugauccuuucuggaauaaucuugugauugguggaauucaggauggugaacccuuccuugggacuguagacaaacuaggaacagccuaugucgauaaggcaauuuguacuggauauggagcacauauugcacuuccaaugcuucgugacgcaauggauaaaaaaccaaaccucaaucaagcugaagccagagcccucguagaaaaguguuuggaaguuuuguucuacagagaugccaggagcuuucccaaauaucaguugggcaucauugauaaagaugaagguguuaagaucgagggaccacuuucaguaaaacagaauuggucaauugguacuaucaucaaaucugucuag

SEQ ID NO: 7191 - RNA, 1455 nt, Leptinotarsa decemlineata
auuuuggaaaaaguugaaggauguaaggaauuacuggaaguuccaggacgaauauuuuuguaugaaggagauuuacuagagauugacccgacugaaaauacugcauuaaaaaguguacauguauacuuguuuacugauggauuuaugauuacaaacagaaacucaaacagccgggguuugaugaaguacauuuaugaaauuauuuaugaucuaaguagucuagcuguugucaaugugagggauuugggaaauauuaaacaugcuuucaaauuauugauuuuuccggauaccagaguguuucaguguucaucaaauucaaauaagaaagaauggcuggauaaguuugauauugcaaagaagacgagauuagcacaagagcaacaaaaaagagaaucaguuguagaaaaauccccgucucguucagcuucgauggaaucaccaaguuucaauccauucgaugagguagaagaggauacaggacugguucauccagaaugguuuauagauuuaccagaagaacuugauguauguguugcacaaagacacuuugaagaagcguugguuuuauuacagaaagccaaagauuauauuaaugagugucuuaccacgaaugaccaauuagaucacguaaugauugauauccaaaggaagguggaacaaagacaaaauaaucucacagaaguuuucaugaaggaacuugaaguuaaucccgauaaaucuuugcaaggugguuuacgagcagcaagaagagcagugagauuacuaaaucaguuaggaaggucaacgcagucuugcaaccuguuccucaaacuauguagcaguauguuaaaaaaucaauguaagaggguuaaaagagagggaucuacugcaaccuaugucagacaucuuucaaguguaguguuuacaaacaugugucacaugucugaagaauuuuugagagcauuucaagauucacccacuugugcuucagcauauguuaugugggccagcagugaauugucucuuuucacaacccauuuuauaaaacaaguauucaugccgcaaacuucgcuuucaacaauugcugaauguguaguauucauaaggacacaaugugaaaggcuuuauaguuauggaguugauuugugcuaucagcuggauggaucguuaaugucuuccuugacgaaagcucugaaggaugccagagauaaacuuauugauucagugaaauugagggcuauugacgauaaguggauuccaauaaauuugcauucaaagucagcacuggcgaggugucuccaggagcaugcccaaaugggucuucauuuagagaguuacaucacaggugauacguggcuacaacucacacccaguacauuagcuuucacuaaaauguuccugcuauuuuugaaugauuguuugaaguuaaaaaccaaugaauugauguuuacuaucgaugaaaugcuuuauaguguu

SEQ ID NO: 7192 - RNA, 2658 nt, Leptinotarsa decemlineata
augaaauacguuugccaaaugacugguaaagauuugaacccucacucucaugcuccuuugaagcgugaagauaaagauagaaacccagauagaccugcauacaguagcacaucagugcugagacuucccguaagcaucgaugaaggcgaggaggauucaagaaaaagaguuacgaggauuucuagcccugaacgaugggaaaucaaucagaugauaucauccggauguauugacaagagugaguugccugaguucgaugaagauacagggcuguuacccaaagaugaggauggaggcgaagcagauauagaaauugaguuaguugaagaugaaccgccauuuuuacaaggucauggucgagcugugcaugaucugaguccaguacgaauaguuaaaaauccagacggaucucuagcgcaggcugcuaugaugcaaucugcuuuagcuaaggaaaggcgggaacagaagaugcuccaacgagaacaggaagucgauucucagccaucaggaaaaaauaagaauuggauagacccucuuccagaagaagaauccaaggcuacaacuguccgagggauuggcuugcaaucacaagacuuaccagaguggaaaaaacaugugauagguggcaaaaaaucuucauucggaaagaaaacaaaucuaucaauaauugaacaacgucaaucacuuccaauuuauaaacugaaagaagaacuaagaaaagcagucacugauaaucagauccucauuguaauaggagaaacaggaucaggaaaaacuacgcagaucacccaguaccuggccgaagcgggacuaacugcucggggaaaaauuggauguacucagccaaggcguguggcagccaugucuguggcaaaacgaguugcugaagaauucgguugcagauuggggcaagaaguuggauauaccauacgguuugaggauugcacgagcccagaaacaaugaucaaguacaugacagacgguauguuauugcgagaaugucucauggacuuggauuugaaacaguacucgguuauuaugcuggaugaagcucacgaaaggacaauccauacugauguacuguuugggcuacucaagcaagcuguucugaaacgaaaggaguuaaaacugauugucacuucugcuacacuggaugcagucaaguuuucugaguauuuuuucaaagcuccuauuuuuaccauuccugguaggacuuuuccgguugaaguuuuauauacaaaagagccagagacugauuauuuggacgcuagcuuggugacuguuaugcagauucauuugagggagccgccuggugauauucuuuuguuuuugacuggacaagaagaaauugacacugcuugugagauuuuauacgagcgaaugaaaucuuuagguccugauguuccugaucuaaucauucuuccuguuuacuccgcacuuccuucugaaaugcagacacgaauuuuugaaccugcaccaccaggcagcaggaagguuguaauugcuacuaacauugcagaaacaucacuuaccauagauggaauuuucuacguuguagaccccggauucgugaagcaaaaaguuuauaauucuaaaacuggaauggauucuuuagucgugacacccauaucucaggcacaagccaagcaaagggcaggacgagcuggacgaaccggcccuggaaaauguuacaggcuuuauacagaacgggcauauagggacgaaauguugccaaccccgguuccagaaauucagcgaacgaaucuaacaaccaccguacuccaacucaaaacaauggguaucaacgacuugcugaauuuugauuucauggaugcaccaccaguugaaucacuaaucauggcuuuggaacagcuucauucguuaucagcuuuggacgaugaaggauugcuaacaaggcuagguagaaggauggcagaguuuccucuagaacccaaucuuuccaagaugcucaucaugucagucgaucuacuaugcuccgaugaaauuuuaacaauugucagcaugcuuuccgugcagaacgucuucuaucgacccaaagauaaacaagcuuuggcugaccaaaagaaagcaaaguucaaucagccugaaggcgaccaucucacccuucucgcuguguauaauaguuggaaaaacaacaaauuuuccaaugcuugguguuaugagaauuucguccaaguaaggacuuugaagcgugcccaagauguuagaaaacaauuguuggguauuauggaucggcauaaacuggacguuguaucagcaggaagaaauaccgugaggauacaaaaggcuauauguucaggguuuuucagaaaugccagcaagaaggauccucaagaaggauauaggacccugguggauggucaagugguuuacauacauccuucaagugcucuguucaacagacagccugagugggugauauaucacgagcuaguacaaacaacaaaagaauauaugagagaaguaacuaccaucgauccaaaaugguuaguugaauaugccccugcauucuuuaaauucucggauccaacaaagcuguccaaauucaagaaaaaccagaggcuggagccauuguacaauaaguacgaagaagccaaugcuuggagaauaucaagagugagaagaagaagaaacuaa

SEQ ID NO: 7193 - RNA, 1245 nt, Leptinotarsa decemlineata
augguucggagaaaaaaaaaugucgaugauauucuugcucguauuaacuucccacuuuuuacgguucagauauugucuccaagauauguaaucguuggggguggugguggaauugcaaaaacaggaauagcuaaugguuuugaaauuuucgaacugucccaugaugguuccaaauucauugcugaggaaguuaccaggcaugaaacugggggaaacguugugauguauuguuccacuuucacugauaacaaacguucauauguaguagcaggucaggaagaucacugucaacuauaucaugugaauagugaacuugucagcgaagaaguugaaaauauugaucauaacucgcccgagacucgacaaagaaaaccgcaaaaaacugauaggaacaaaaauuugaaaaagaguuugaaguuugucaugaaacccagugauaguauacaaacugauuucauugguccagaaccucuaucuagaguagcuaggauacaucauaaugguaaacucauggccacaggaggaacugauggacacauaagauuauggaaauuuccgaguuugcaacccuuaaccguguugaaggcgcacgagaaagaaauugaugacauugacuuuagccaguuuggaaauuuucugauuacuguagcgaaggauggcuuggggauucuuugggacuguauuaaaggaaaagaauacaguagguugaauuggaaacagccugaagguuccaaauauuuguacaaacgauguagauuugguguaaucgaaggggaagauaaaaagucugcguuauauacaauauccaauccuacuggcguugcaaaaaaacagaaaucuuaucuucaacaguggcucccugaagauggacuacuaaaaaaaguugcagaauucgacgaaugucuuuccgcuuuggcaguuagagaugaugguagauuuguagcuguggguaccauguucagcggaucaguuuuaauuuaugcgucuuuuaguuugcagccaauguugaauauuguuggugcacauuccauguuuguuacuggacuagaauuuuucccuguguugaaugaaagucguacuguuuguagcguggccgaggcugcaguauuaucaauuucuguggauaaccauguuuguauccauacacugccauauagaagaacaaugccgcuguggguaggaauauugauauuaauuuucacauuguuccucuccuucacauuuugcucuuauauaggauuauaa

SEQ ID NO: 7194 - RNA, 1242 nt, Leptinotarsa decemlineata
auggcuggcgcaauguuguuugaaagagcucaguccguaccuucucaacaugauaaacuguuaaauuuaaaaagaaaugaagaugacgaugaucagaacaucguuaauaaagaacaggacauccucaaccucggcgaaaaguacaagaaagaggguaaggcuaaagaacuggcggaauugauaaaggcuacucguccguuucucagcauuauaagcaaggcgaaagcugcgaaacuggucaggucucuggucgauuauuuccuagauuuggaagcagguaucggaauagaaguccaacuguguaaagaauguauagagugggcaaaagaagagaaaaggaccuuucuucgucagucuuuggaagcgcgauugauagccuuguauuucgauacugguauguaugccgaggcucugauucuggaauccaccuuguugaaagaauugaaaaaguuggaugacaaaaauuuacugguagaaguacaguugcuugaaaguaagacauaucacgccuugaguaaccugcccaaggcucgugccgcauuaacuucagcucguacaacagccaauuccaucuauugcccuccuaagaugcaagcugcgcuugaccuucagucuggaguucugcaugcagcugaugaaaaagacuucaaaacugccuauucauacuuuuaugaggcauuugaaggguuugacagcguagaaucaccaaaagcguugacagcuuugaaauauaugcuucuuucaaaaauuaugaucaacaguccggaagauguacaacaaauuguaagcgggaaauuagccaucagauaugcuggucaagacauagaagcaaugaaagcuguugcacgagcuucucacaagagauccuuggcagauuuucaguuagcggugaagcaguucaaacaugaacuagaggaugauguuaucgucagagcccauuuaggaacuuuguaugauaauauguuggaacaaaaucugugcaggauuauagaaccauauuccagaguacagguggacuauguugcaaaaacaaucaaacuuccaauguuacaaguggaaaagaagcucucgcagaugauucuugaugcuaaauuucaugggauauuggaucaaggagaagguguucuaauaguuuuugaagcaacuccaguagacaaaacauaugaaauggcccuagaaacaauacaaagcaugaguaaaguaguagauacccuauaucaaaaagcuaaaaagcugucauag

SEQ ID NO: 7195 - RNA, 1764 nt, Leptinotarsa decemlineata
auggcaucaaaaucuaaaaaaaguucaacgccugcaucuacacaucagcggccggcaagccccuuaaguccuaccagacauucaagacugcaggagaaacaggacuugcaaaaucuaaaugaucgucuagcguguuacaucgacaaaguucgcuacuuagaagccgaaaacagcagguuaaccagagaaauacaaacaacacaagaaacuguuacuagagaaguaucaaacauuaagucuauguaugaucaugaacuaucagacgccagaaaguuguuagaugaaacucaccgagagaaagcccguuuggaaauugauguuaaacgucuguuagaugaaaacgaagagcuaaaagcugauuuagccaaaaaaagcaaagauuugguucuggcugagaauucugccagaauuuaugaaacuaggugcaaugaauuacaacucaaagcuaaucaggcagcugcagaugcuaaaaaagcugcuacagaugcuagagaccuugaaaaggaaagggauaagcuaagaaagcuccuugaugaacaucguaagcaacuggaggaagaauccuuagcuagaguugaaguagagaacuccaaccagagucucagagaagaacuauccuucaaagaccaaguguaccaacaacagcuuaccgagacgcgcacucgucgccagguggagaucagcgaaaucgacggucgucucgcugaaaaguaugaagccaagcuccaggaugcucuacaggaacuccgagaucaguaugaaucccagauggcaaccaaucgucaugagaucgaauugcucuacgagcagaagauuaaaaaccugcaggcggccaacgauagacaccagucgucugcuguaggcgcucuugaugaacugagacaggucaggaccaggaucgauacucugacuucgaggaucucagacuuggagaaucagaacgcuggccugucaggcagagcuagggaucuugagaaguuguuggagaaugaaaggcuucggcaugcugaagaccuggcucuccuugaaagggaauugcaaagauaucgugaugagaugcaggugcaacugcaggaauaucaagaccuuauggacaucaaagugucauuagauuuggaaaucgccgcauaucgcaaacuacucgagucagaagaagcuagacugaacaucacuccucaugguaccgaaagggagguaucccaucacagcgugcgcagcuccucucagcgccgcaccccaguacgagcgggugccaaacggaagcgcacacuucuugaagagagccaggaaucuaguuugucugacuacagcgucaacaguuccucaaaaggagauauugaaguagcugauguggauccugagggacaguaugugaaauugcacaacaaaaguaaccaggagguugcucuuggaggauggcauguugucagacguguaggcgacaaugagacucaguuuaaauuccacaggucgcugaaguuggaaggaaaugguuuuguuacgauuuggagcucugaucucaacaaagaccaugaaccgccaaacaacuuggucaugaaaggacagaaauggauuguuggagauaacaugacuacaacaguauugaauaacaauggugaggagguagcaguauccgaaagaguaaaaaggcaguuauccaguucauuacugagacacagagaaauggcuggagguuaucuuucugaagaacuccaucaucaacaaggugauccucagggugaugaaaagugucgaauaauguga

SEQ ID NO: 7196 - RNA, 2412 nt, Leptinotarsa decemlineata
auggcugaaggaaaaagucccgacgaucuggccacugcaauucuucguaaaaaggaccguccaaacaggcucuuggucgaagaagcugccaacgaugacaauuccguuguugcuuuaucacaagcuaaaauggacgaguuacagcuauucaggggggacacaguauuacucaaaggcaaacgaaggaaagaaacagucuguauaguccuuuccgaugaguccuguagugacgaaaaaauccgcaugaacagaaauguuaggaacaaccuucguguccgucuuucagauguugucuccauccagccuuguccagaugugaaauaugguaaaaggauccauguucugcccauagaugacacaguugaaggccucacaggaaaccucuucgaagucuacuugaaacccuacuuuuuggaagcguauagacccauccacaaagacgaugucuuugucguucguggugguaugagagcaguagaauucaaaguaguugaaacggauccugcccccuacugcauaguagcucccgacacugucauccacugcgauggagauccaaucaaacgagaagaagaagaggaggcucucaaugccgucggcuacgaugacaucggaggaugcaggaagcagcuagcgcagaucaaggagaugguggagcucccgcugagacacccgagccuguucaaggcuaucggcgugaagcccccuagggguauacugcuguauggucccccugguacggguaagacccugauugcucgcgccguggcuaaugagacuggggcguucuucuucuugauaaacgggccggagaucaugagcaaacucgcuggcgagucugagaguaacuugcgcaaagcuuuugaagaagcugacaaaaacucuccggcgaucaucuucaucgaugagcuggacgccaucgccccgaagcgugagaagacucacggggaggucgagcgccguauagugucgcagcugcucacucuuauggauggcaugaagaagagcucacaugucauugucauggcugccacaaacagaccaaauuccaucgauccggcucugagacguuucggcagguucgacagggagauugauaucgguauuccggaugcaacaggcagauuggaaguuuuacguauccacacaaagaauaugaaacuggccgacgacguggauuuggagcaaauugccgccgagacacacggucaugugggugcugauuuggcuucgcugugcucugaaucugcucuccagcaaauccgagaaaaaauggaccucaucgacuuggaagacgaccaaauugacgccgagguacugaacucucuugcuguaacgauggaaaacuuccgcuacgccaugacaaagagcagccccagugcucucagggaaacaguuguugaaguaccaaaugucucuugggaggacauugguggucucgaaaacguuaaacaugaacugcaagaacugguucaguaccccguugagcauccugacaaguuccucaaguucgguaugcaaccuucucggggugugcucuucuacgggccgccugguugcgguaagacgcugcuggcuaaggccaucgccaaugagugucaggccaauuuuauauccgucaaggggccagagcugcucaccaugugguuuggugagucugaggcuaaugucagggauauuuuugauaaggcuagaucugcagcuccuuguguauuguucuuugaugaauuggauuccauugcaaaaucgagagguggcaacguaggcgaugcagguggugcagcagacagaguuaucaaucaaauuuugacagaaauggacggaaugggugccaaaaagaacguauucaucauuggugcaacgaacagaccugauaucaucgauccugccaucuugagacccgguagauuagaucaguugauuuacaucccauuaccagacgagaagucuagagaggccauuuucaaaucgaaccugaggaaaucuccuaucgccaaggauguagauuuaggauacauagccaaagugacacacgguuucucuggugcugaucugaccgaaauaugccagcgcgcuugcaaguuggccaucaggcagagcauugagagcgaaaucaggagggaaagggagagggcgaugaaucccaauauugccauggacuuggacgaagacgauccggucccagaaaucaccagggcccacuucgaagaggccaugcgcuucgcccgaaggucaguuucugauaacgauaucagaaaauacgaaauguucgcgcaaacucugcagcagucucgaggcuucggcacgaacuuccgcuucccgacggccgccggggggccggccgcgcccgggggcaccggcggggaccaggccaacuuccaagacgaucccgaggaugauuuauacaguuag

SEQ ID NO: 7197 - RNA, 825 nt, Leptinotarsa decemlineata
augggugaccaguucgauugugcuuuagauuuaaugcgacgccuaccuccccaacaaauagagaaaaauuugagugauuugaucgauuuaguuccaaguuuaugugaagauuugcugucuucaguagaccagccuuugaaaauugccaaggacaaagaaacuggaaaggauuaccuucuaugcgacuacaaccgagauggagacucauacagauccccauggucuaauaccuauuauccuccauuagaugacgguuccaugccuucugaacguuugagaaaacuugaauuagaugcaaaucaugcuuuugaucaguauagggagauguacuuugaagggggaguuucgucuguuuacuuuugggauuuggaucaugguuuugcuggaguaauuuuaaucaagaaaacuggcgauggaaguaagaaaaucaaagguuguugggacucuuuacauguuguagaaguucaggaaaagaguucgggucggaauucacauuacaaaaugacuucaacugccaugcuguggcuucaaacuaauaaacaggguucuggaacaaugaaucuuggcgguagucuaaccaggcagauagaacaagaugccacaguaaaugaaaucaacccacacauugccaauauuggcaggaugguagaggacauggaaaauaaaauucguaacacucuuaaugaaaucuacuucagcaaaacuaaagauauuguaaauaguuugaggucuguccaaucgcugacugagagccgucaacagcaggcucuaagagaggauuuggcugcugcuuugcaacgcaggcacaauaaaucugacaacuga

SEQ ID NO: 7198 - RNA, 2439 nt, Leptinotarsa decemlineata
auggaacgaccgccucguaacgaaccuccaguggaacccguaaauggcauaguccaaccugcuguucaaccuccuccagacaugccagggcguguaaccaaucagcugcaauuuuugcagaaaacuguacuaaaggcuguuuggaaacaccaguuugcauggccuuuucaacaaccagucgaugcaaagaaacuuaauuugccugauuaccacagaauaauaaaacaacccauggaccugggaacaauaaagaaacguuuagauaacaauuacuauuugucggguaaagagugcauucaagauuuuaauacaauguuuacgaauuguuacguuuacaauaaaccgggagaagauguugucguaauggcacaaacuuuagaaaaaguguucuugacuaaaguagcggacaugcccaaagacgaauuuguaguggaaacaccuacgaaaggacucaagggaaagaagggaagaacaaguacaggcccugcugguccuguuucaagugugggaagggguagaccaccugcgacaguaucuucaaccagugcuacaccaguggcuacuacuacagguuccuccggccugccuuugggaacucaggcuccggcaacugucccugguagcaccgccaccacaacgauagcuccugcuaccacuaauagcucucuuccuucucaaccuccagcacaaccuuccaauuuucauggugcacccuccauaguuaauucuuuagauucgaaugugaauccgggggugcuaccgggaaguguuguaccuccuucacaaccagcuaaggugaaaaaaggggugaagagaaaggccgacacuacgacacccacggcuacugcauaugauuaugcaccaccguuggagucaaagucggcaaaaauaucaacaagacgugaaucagguagacagaucaagaaaccgguaaggccagaauuggauggccauguuccccagccagcaucacagaaacugaaagagaaacuuucugaaucuuugaaagcguguaaugaaauuuugauggaauuguucuccaagaagcaugcuaauuaugcuuggccauuuuaucagccuguugaugcugacuuauugggguuacaugacuaucacgauauaauaaagagacccauggacuuuggcacagucaaacaaaaaauggauaacagggaguaucguacuccacaagacuuugcugccgauguuagacugauuuuuaccaauuguuauaaauacaacccuucagaucaugauguaguugcgauggcuagaaaacuacaggauguauuugagguuaaguuugcuaaaaucccugacgaaccacuaaauaggauaggugguagugcugcaguaucgacuuuagcuguaaaaucugaauccaguaguucugguucaaguucggagucaucgagugauacagaggauucugaagaagaaaagcggaacaaacaguugaaguuauuagaaaaagaacugacggcaaugcaggaaaaaaugaagaaacucguugaggaaagcacgaagaagaaaaaagaaaagaaaaagaccaaggugaaaccgaaaaaaccucccgcagcagcauugccaaauaguaguagcaguauugguaagccuggagcgcacggggcucuaaacaagcccaacucccuugcagacagcguugacgacagcaucgccaguguugugucgggggcugaucucaagauugccgccgaggcacaucauccgacggccaacaagucucucaacaugcaccacaacauggcggcuggcgccaacgcuucugcccaagcuaaaacuccuaaaaguaaagguuuaagagguaacaaaccugcaacuacucccagugcuccaccuaaacgagugaaagcaaacaauaaggcuggcccaggaaggaaaaaaucugcagcccaaccaccuccagcacagugugaaucugaggaagaggacaacgcgaaaccuaugucuuaugaugaaaagcgucagcugucauuggauauuaauaaauuaccaggagauaaacugggaaggguaguacauauaauccagucacgagaaccauccuugagggauucaaacccagacgaaauagaaauugauuuugaaacauugaaaccaucaacccuuagagaguuggagagcuauguugcaucgugucuucgaaaaaagccacauaaaaagguuacuggaaaauccaaggaugaacaaauagcugaaaaaaagcaggagcuagagaaaagacuuauagaugugaaugacaaaauaggaaauucaaaaaaggccgcuaaaaaagaagaagccaguaagucagauccaacuggugcggggggaccuuccggucgaaugucuucuaguucaaguaguucagacucugauaguaguaguagcagcuuaucaaguaguucgagugauuccagcgacagcgaagcagguuag

SEQ ID NO: 7199 - RNA, 1221 nt, Leptinotarsa decemlineata
augucuuuaucaacugcuaggccacugaucagugucuacaaugaaaaaucagaagucgucaaagaaacgagcauugcccuuccggcaguauucaaagcccccaucaggccugauguagucaacuuuguucaucaacaaguaucgaugaaccaucgucaacccuacagugucagcgacaaagcuggucaccaaacuuccgcggagucuugggguaccggucgugcugucgcccguauuccccgugucaggggcggcgguacccaccguuccggucagggugcuuucggcaacaugugucgcggaggucgcauguucgcucccacaaagccauggcgcagguggcaccgcagggucaacgucaaucagcgccgauacgcccuggcuucggcagucgccgcuagcggagugcccgcccuugugaugagcaaagggcacgucgucgaccagaucccugagcugccucuggugguguccgacaaagugcaggagaugagcaagaccaaggaggcugugcaguucuugaggaggaucaaggcauggucugauauccaaaagguauacaagagccagagauuccgggcuggaaaagguaagaugcguaauagaagacgcauccaaaggaaaggaccucucgucguuuaccacaaagaucaaggccuccgccgugccuuccguaacauuccuggcaucgaucuggucagcguggagaagcucagcuuguugaaacucgcucccgguggucacguuggacguuucgucaucuggaccgaaucugccuuccaacgauuggacaaacuguucggcagcuggaagaccccuuccuuggaaaagaaggguuacaaccugccacagcccaagauguccaacacggauuuguccagguuauugaaggcugaugaaaucaaggcuguucuucgugcuccacagaagaagguuguucgucguguacgccgucugaauccuuugaccaauaccagagcuuuguugaaacucaauccauacgcugcaguccugaagcgacaagcuuuguugacugcccagaaaaggaaguugcagagagacgaacagcucgcuaagaagagaggaauaacuuugucagcugauagugcggucaucaagucagcagcauuacagaagagaaggagggaacaguuguugaaagucaagaaagaaggaaaagcuaagccuguaaaagccaagaaguccucuggcaagaaauga

SEQ ID NO: 7200 - RNA, 4596 nt, Leptinotarsa decemlineata
auggcagacuuuauagauagagaagcugaagagagcagugaggaggaagacuuagaaccacgcgaccgcaagaaagcaaagaaagcuaaagcuguugacaguucugacgaggaggaagaagaugaugaagaccguuuacgugaagaacuaaaagaucuuauugaugacaaucccauugaagagagugaugcagaaucugaugcaucugguaguaguagaagucaaaagcgaaagaaaucagaugaagaagauuuagacgaucguuuggaagaugaagauuaugacuuacuugaagagaauuugggugucaaaguugugagacguaaauucaaacgucuacgucguuuugaugauaaugagagugaaggagaagaggaacaaaaugcugaucaagaucgagaucaaauugccauggauauauucucagaagaugaugaugaacgaagaucggagcguagccauagggccccugaaccugaagcauuuggagaugaagaagaugaaggagaauacucugaugccgacgacuucauuguggacgaugaggguaggccuauagccgagaagaaaaggaaaaaaaagcccauuuucagcgaugcggcucuucaagaagcccaagaaacuuucgguguugacuuugauuaugaugaauuuuccaaauaugaccaagaugaguaugaugagucugaagaagaugaggaagacgaguaugaggaagacgacgaaggagaaagaaggaggagaucuaagaaagcugcuaagaagaagccuacuaaaaaaucaaucuucgaagucuacgaaccuagugaacucaaaagggguuucuuuacugaccuugacaaugaaauccgaaacacagauauuccagaaagaaugcaacuacgagacgucccaguuacgucuguuccugacgacucuucugaacucgacgaugaggccgaauggaucuacaaacaagcguuuuguaaaccgucaguguccaauauggacgcgaacuuaucuccugaagcucgagauaaaaugaaaaaagggccgcaaacaaucgucaagaucaggaaggcguuggauuucaucagaaaucagcagcuggaaguuccuuuuaucgcuuucuacaggaaggaguauguucaaccggaacugaauaucaaugaucuuuggaaaguuuauagauuugaugcaaaguggugucaacugaaaacacguaaagaaaacaugcugagacuauucgagaaaaugagaucauaucaguuggacauacuaaugaaagaucccgacgcucccauaccugauaacgugcgaguuaugaaagauucagauauagagcaguugaagaaugugcagaccccugaagaacucaaugacgugcacaaucauuucauucuuuauuacgcugccgacuugccugccaugcaugcggcuuggaggaucaaggauaaagaagagaaaaaacgggccaaaagggaagccaggaugaagcucauugcugaaagcgaggaaggagcagacauuccugaagagguagaagaaguugaggaugaugagccggaaccugagacuuugaaguaugcaaauagaucuggcaguuacucauuguguguaaaggcgggauuggacgguuuaacgaagaaauuugguuuaacaccugaacauuuugcggaaaaucuacgagacaauuaucagaggcacgaaguagaucaagaacacguggaaccgcucgaaauugcgaaagaauucauaucucccaaauucucaacaguugaagaaguccuccaagcggccaaguauaugguugcucugcaaauugcuagagagccuuugguucgaaagugugugagagaaacuuuuuacgaaagggcaaaaaugaauguaguaccaacuaagaaaggucagaaggaaauugacgagucccacaacuguuacagcaugaaauaugucaagaacaaaccuguuagagacuugaccggcgaucaguuccucaaacuuugccuugcagaagaagaacaucugcugaccauuuccauaaaugaaacgauugaagguaauaccaguggaucauacauugaugaaguuaagcaacuguauaucaaggacgaauucagcaagaacguacaagauuggaaugcucucagaauggaauguguagagagagcuuuaacaaaaaguguuuucccagauuugaaagcagaacuaaagagagugcugcuauccgaagcgaaggaauguguacugagagcuuguuguagaaaauuauacaauuggauaaagauugcuccauacacaauaacauuuuccgaagaagacgaggaugacugggacacuuccaaaggaaucagaacuaugggccuugccuauguuccggauuauaccgugucagcuuucgcuuguauugcugcuccagacggagaaauaaccgauuauuugaggcucccccauaugcuaaaaaggaaaaauaguuacaggaaugaagagaaguugcugaaggaguccgacuugcaagcaguuaagaacuuuaucuacaccaaaaaaccucacgugaucgccaucgguggagaaucuagggaggcacugaugaucgccgaggaccuacgagggguuauaaaugaguugguggaaucagaccaguucccccagauaaagguugagauuguggacaaugagcuggcgcagguguaugccaacucuaauaaggggcaagcagauuucagagacuacccagaacuucugaggcaggcuguaucaguggccaggaaaaugcaagauccucucguugaguacucccagcuuuucaaugcggaucaggaaauuuugaguuugagguucaguccgcuacaggaaucucucccaaaagaagaauugcucgaagcguuauguuuggaauuugucaacagaacaaacgaagugggcguagaugucaaucuggccguucaacaagcccacaaaaguaaucugguucaauucaucugcggucucggaccgcguaaaggccaagcuuuauugcgaguuuugaaacaaaccaaucagcgacuggaaaauagaacgcagcuuguuacaucgugccacauggguccgaagguuuucauaaacuguucaggauuuauaaagauagacacgaguaguuugggagacaguacggaggcuuauguggaaauacuggaugggucucgcguucauccagaaacauacgaaugggccaggaaaauggcaguggacgccuuagaauaugaugaugaugagggagcgaaccccgccggagccuuggaggagauccuugaggcgccugaaagguuaaaagauuuggaucuugaugcuuuugcagaggaguuagagaggcaaggauuugguaauaagagcaucacccuguaugacauaagggcggaauugaacugcagauacaaagauuugaggcaaccguuucguucagcuaauccugaggaguuguucgauauacucacgaagcagacucccgaaacuuucuauauagguaaaauggucacggcuucaguuaucgguaucgcuagaagaaaacccaaaccggaucaacuagaucaagcgaauccugucagaaaugaugaaacuggccucuggcaauguccuuucuguuugaagaaugauuuuccugaguugucugauguguggaaucauuuugaugcuggcucuugucuaggacaagcgacugguguaagguuaaggcuugauaacgguguauuagguuauauuuauauaaaaaauaucagugacaaaccaguaucgaaucccgaagaaagaguuaaaguaggccaacucauucauugcagaauacaaaagauugauguagaacgguucagcguugacuguacuucaaaauccagugaucuuuuggauaaaaaccaugaauggaggcccccucgagauccuuauuacgaucaagaacaagaagauaaagacaaaggcauagaagcggagagaaaaaaagacuuacaacguaaaacguacgugaagcgaaucauaguucaucccgccuuccacaauauuuccuaugcugaaacagaaaaaugcauggccaauauggaucaaggggaagucauuauaaggccuucaaguaaaggcuucgaccauuugacaauaacguggaaaguggcagaugguauuuaccagcauaucgaugucaaggaagaggguaaagcaaauccauuuucauugggaaaaucacuguugauugguaaggaggaauuugaagauuuggaugaaauaauagccagacacaucacuccaauggcuucauacgcaagggacuugcuuuacuuuagguaucacaaagacuuugaaggugggcaaaaagauaaagcggaggaguucuugaucgaggagaagaagaaaaauucuucuaaaauucacuaugucaucagcgcugcuaaaaacuucccuggcaaauuuuuacucucuuaucuaccacgaaacaaagucauucacgaauauguaacgguaacuccagagggauuccgauacagacagcaaauguuugacucgcuaaauucucuguucaaaugguucaaagaacacuucagggauccaccucccggaggacuuacuccagguacuccgcggucuucuggucgc

SEQ ID NO: 7201 - RNA, 2415 nt, Leptinotarsa decemlineata
auggaaaaaaaacggccgagaaaaucaagaucuagaucucuugaaaauggccaaggaaagaaaaaaucacaagauuaugaugaucuuccaaaggacuauccaagauauuauggugaagaucggccaaauagugacagauauuggaauaaguauccaagaaaagauaacauaaaaguuggucagagauauuaugaagcuggaugugagaagaaagaaaaaaaacgagaggagaagccagccauugauaaggaaccugaagacaaaucuguuauaaaaccucgagaaagaaaaacaguggaucucuuaacuucuaggacuggcggugcuuacauccccccugcaaaauugagaaugaugcaggaaaguauuacugauaagucuucugcugcuuaucagcgcauugcaugggaagcucucaagaaaucuauccauggauauaucaacaaaauuaauacauccaauauugguauaauugccagggaacugcuucaugagaacauaguaagagguagaggucugcuauguaaaucuaucauucaggcccaagcagcuucuccuacauucaccaauguuuaugcugcccuuguagcaguuauaaauucuaaauuuccaaauauaggugaacucuuauugaagagguuaguacuucaauucaaaagaggauuuaaacaaaauaacaaggucaucuguauaucagccacaacauuuguugcccauuugguaaaucagaaaguggcucaugaaauuuuagcauuggagauucucacucugcugguugaaucaccaaccgacgauucuguugaaguggcaauuucuuucuugaaggaaugcggacaaaaacucacagagguauccaguaaagguauaacagcuauauuugaaauguuaagaaauauucuucaugagggaaaguuggaaaaacgaauucaguauaugauagaaguuauguuccaaauucggaaagauggcuucaaagaucaugcagcugucuuggaagaacuggacauaguggaagaggaagaucaguucacccacuugauuaccuuggaagaugugaagcaaguugauacugaagauauuuugaaugucuucaaguuugaugacaaguaugaagaaaaugaaggaaaguacaagacacucagcaaagagauacugggaagugauagcgagucagggucuggaucugaagguucugaagacgguuccgaagacgaugaagaagaugaagaagugaaggaucaaggaaaaauaauagacaauaccgaaacuaauuugauaguuuugagaaggacaauauaucuuacaauacagucuaguuuggauuuugaagaaugugcucacaaacuccuaaaaauggaacucaaaccaggacaggaaauagaacucugucauauguuuuuagauuguugugccgaacagcguacauaugagaaguuuuauggguuauuggcgcaaagguuuugccaaauuaauaaaauuuauauugagccuuuucaaaaaauuuuuaaagauacauaugccacuacucacagacuugaugccaacagacuaaggaauguuaguaaauucuuugcucauuuacuguuuacugaugcaauuaguugggaaguuuuagaaauaaugaaacucaaugaagaagauacuaauaguuccaguagaauauucauuaaaauccucuuucaagaacuugcagaauauaugggccuugggaaguugaauaccagacugaaagaugaaacucuucaggagcauuuugcugguuuguuuccaagagauaguccuaaaaacacgagauuuucuaucaauuuuuuuacgucuauuggucuuggaggauuaacagaugaacuaagggaacaucugaaaaauauuccuaaaaacacgagauuuucuaucaauuuuuuuacgucuauuggucuuggaggauuaacagaugaacuaagggaacaucugaaaaauauuccuaaaaacacugaauugaauuuagcaguugggaaagaaagcaguagcagcaguagcucuagcaguuccagcgaaacaaguucugaagaaagcagugaugaaucaucaaguucagaagaugaaaagcagaauagaagaggaaaaguuuauaaaaagaaaaaugaaauagagagaaaaggugaucaucacaguaccaagaaaaaagaaagauauaccucaaaagaugaucacaaacaagaaaaugagagacauaacgauucaagugauagaagaaaaaaaaaagauuaugaaaggguuaaaaguagaucugaagacaauggccaucgauugaagaaugagcggagaguuuuugagaaacauacuucugaaaaacgaucacaaucuaaagaucauggaaaauaugaaaaaaguagacgucacaaaaauaaggaugacagagaacgcaggaauaguuga

SEQ ID NO: 7202 - RNA, 1782 nt, Leptinotarsa decemlineata
auggcucuaaaggcccaaguuggucaaaaaauaaugaaugaagucauuaaacauaaaccugucaagaagaaugguccuguugcacaacaacagucucauggcguugaauggaggaucuuagugguggaucaacuugccaugagaauggugucugcauguuguaagaugcacgacauaucggcugagggaauuacuuuggucgaagauauaaauaaaaaaagggaaccccuaacaacuauggaagcuguuuacuugaucacgccuucugaaaaaucuguucgugcccugaugaaugauuuugaaucgccucgauacauguauaaggcugcucacgucuuuuucacagaagcauguccagaccaauuguucaaugaguuaugccaucacccaauagcaaaacacaucaaaaccuuaaaagaaaucaacauagcauuuauuccaucugagucacagguguuuucuuuagauucgccagauacauuccagugcaguuacgauccuaccuuugcugcagcucguaacggcaacauggaaagaauggcggagcagauugcuacacugugugcaacccucggagaguauccccacgugagauaucguagugauugggaaagaaacguugagcuugcucaguugauucagcagaaauuggacgcauauaaagcagaugagcccacuaugggagaaggucccgaaaaagcuagaucucaguugaucauuuuggaucgcggcuucgauuguguuucccccuuguuacacgaacuaaccuuccaagcuauggcauaugaucuguugcccaucgaaaacgauguguacaaauaugaagcaucagccggaguccugaaagagguccuccuggacgaaaacgaugaacuauggguugagcuucgacaccaacacauugcugugguaucacaaagcguaacgaaaaauuuaaagaaauucacugacucgaaacgcaugacacagagcgacaaacagucaaugaaggauuugucgacaaugauaaaaaaaaugccgcaguaccaaaaagaauugucaaaguacgccacucauuugcacuuggccgaagauugcaugaaagcuuaccaaggcuacaucgacaaacucugcaaagucgaacaggauuuagcaauggguacagaugcagaaggugaaaaaaucaaagaccacaugcgcaacaucguucccauucuguuagacccuaaaauaaccaaugaauaugacaaaaugcggaucauagccuuauaugcaaugacaaaaaaugguauaacagaagaaaacuugucaaagcuugccacucacgcccaaauuaaggauaagcagacaauugcuaauuugcaauaucuaggcgucaaugucaucaacgaugguggcaagagaaacaaagguuacaccauaccgagaaaagaaagaaucacagagcaaacauaccaaaugucgagguggacaccaguuaucaaagaccugauggaggauugcauugaggauaaauuggaucagaaacacuuuccauaucucgucgguagagcucaguccacuggauaucaugcugcaccaucaagugcucgauauggccaauggcauaaggauagaggucagcaggccgucaaaaauguaccgaggcuucuagucuucguagugggaggaaucaguuucucagaaauucguugcgcuuaugaaguuaccaacgcccagaaaaauugggaagucauaaucgguucuucgcacauacucacuccagaagguuuccucagugauuuggcuacgcuugcuggcuag

SEQ ID NO: 7203 - RNA, 2139 nt, Leptinotarsa decemlineata
augaugcaacaguacaugaaagaauuagaacaggagccuuucaaugccgaagaauucguggaacguuuagcuuggcgaacaauugcugagacaaaaaaugauggcgaggaagaggaguuuaacccaaauuuguuacaugagucauucguacuggccauaaaagaccucacucuucuccaagaucgucagcagaagaaaugugaaaaguuggagauggccgucagagaagacgaggcaauguuuuuccaggaaauuuauaauuuguuggagcaaaacaaacaagcuauagacaccuuccaagaacuggaugguaaaauaaaccacguugccacuaaaguauugcauuugggagaucaacuugacagcguuaauggucccaggcuuagaguugucgaugcccaacguuugaugacucaucugaaugaguuucuaaccacuggaccgccauccucagcaauauucacugaucccuauuuaauagaugaggcugcagauaugauucaaaaauuguacaugauaucccaagauuugccuuccaaauuugacaguguuaaacguaaaauagaacgaaaauauugugauaucgaaaaaagcuuaaucgaggaauuugugaacgcaauggcuaacgaagaucuagaucgaaugaaggaaauagccagugucuuaucacaauucaaggguuauucucagugcaucgaugcuuacaucgaucaaagucaagugggaugccuuucaaccaaagacguguuuggccaucuguugacuuugugcaaauacaacaaugauauaaucagaaggguuuucaacaauccugaacagguuauggccaaguuuguccuuaacaucuaccaguugaaaaucguggaguauaucgaccaaagauugggccccaaucuuggcaguuacaauuaccuacaaacucuguuugaacucuauucgaaaacuaaccagcuaucgaguaacuugagcaccuucaauuuaggaaacgacaaaaacuauuugaccaagcuuacuacgaauauuuucaauaaauacguaaacgaauauauuacgauagaauugaaaugccucaaagaaagauguuccgccaauuuacaaaaguauuaugaauccaaacaccaccagaaaaaacagauccagucuggaggauuccaagaccugcgaagggacuuacaagccgucauagguaccagagccaauauaaacauugcgcaaauagaaaacuauggaggcgagacuuuuuugucagaagaaguugccaucaugauacuccaagauaccaagcaagccuuccaacguugucaguuguuaucaaaaccuaaagagaaagaaucaaaugcuacgcagauuuuggacagacuuaucaacagccuuuugaucgaacacguagauuacgccguagaauuaggacuccaagcugucccaguugucgaaggcgcuaaaaguccuccaguucucuauuuuuuuaacguaguucaucagaguaacaauauuacgcacuugauggagaagcaguucacggaucuggucgugccucuagucgagaauacaccgaaauauaaugacugcauacagaagaaaaaguuuguuuuggaagacauugaaaggaaaauaaauacaggcuuggacagaugucucaaugccguugcuacuugggcaaaacuguaccugcagucggaacagaagaagagugacuucaaaccugagacugacgauuuugacacaguagcgucuccagccugcaaaaccguucugaacuacguuaaaagaauaaucaaagagauaaaggccaguuuagauggaaauaauguaacggcaguucuucaggaguugggaauacgguuacacagggugguguaugaacauaugcuacaguuucaguauaauaccgcaggugcuaugguggccauuugcgaucuuaaugaguaccguucaucaacuaagacucugggaccucugguuacggaacuauucgacacguuacauucucuuugcaaccugcuacuggugaaaccggagaaucuacagcaagucugcucggaagacaccuuggcuaaauuggaaaggccgauucuccacaacuuuauacagcucagaagcgauuuuaaaguacaaaaacaaaugauuuuaaauuuuuag

SEQ ID NO: 7204 - RNA, 465 nt, Leptinotarsa decemlineata
auggauuuccaaaauagacccggagguaaaaccggaggagguggcguggccucuuggucagaaacaaaucgggaccgaagagaaaggcugagacagcuagcuuuggagaccaucgacuugcaaaaggauccuuauuuuaugaaaaaucacuugggaucuuaugaauguaaacuuuguuuaacacuacauaacaacgagggaagcuauuuggcccauacucagggcaaaaaacaucaagccaauuuggcaagacgagcagccaaagaagcuaaagauucgccgucucuuuuacaaccugaaaaaccaagaguugaacccaagaaauuugugaagauuggaagaccugguuaucggguuacaaaacagagagacccugaaaauggacaacagagcuuguuguuucaaauugacuauccagaaaucaaugauaugguuuugccucgucaucgauuuaugucugcuuau

SEQ ID NO: 7205 - RNA, 411 nt, Leptinotarsa decemlineata
augucuauugguguuccuauuaaaguucuucaugaagccgaaggucauauuguaaccugugaaacuauuaccggugaagucuacagaggaaaacuaauagaagcugaagauaauaugaauugucaaaugacacaaaucacuguuacauaccgagauggcaggguagcccaguuagaaaauguuuauaucagaggaucaaaaaucagauuucuuauucuaccggauauguugaagaaugcuccaauguuuaaaaagcagacgaaagcgggaacugcagggagaggaaaaucugcaauacuuagagcacaagcucggggaagaggacgggggcagcagccucagaugcgugguggucggggagguacuuggcagaaccagcaagguggugcaccuaccggucguggaagauaa

SEQ ID NO: 7206 - RNA, 1473 nt, Leptinotarsa decemlineata
augcucacugauucauucccgcucgaaacaaaaugugucacuuuuucgcucuggagcaacuuucagccuucaguucguauuuugagcaccuugaaaaaucccuacuccccaacacugguuucguguuuguguaauaauuuauuuagguggagaaacauggcuucaaaguugcaaaaagcuccauuacuucgauuauuuaugagcagaggauuuucucaacuagcaccaguuuccggaaauccaaauuaugaacugaaaacaacuauucuuucaaauaagcugacugucguaugugcugauaacgaauccagcuugguucgaguuucgguuauauucagggcagguagccgauaugaguccagugauaauuuaggagucacacacguauugcguacugcagcagggcugucaacaaaaaaugcuucccaguuugccauuauucguaacauucagcaaguuggugcuaacuugacagcuacaucugaucgugaaacuauuucauauacucuagaagguacaagacaagcaguugaaaaaguucucccauuccuuacugaagucgcaacccagcaaauauucaaacccugggagguuucagauaucacuuccaggcuccaauuagauauugcaacgagaucucuaccguugagagcaauugaucuacuccacaaugcugcauuucguacugguuugggcaauucaauguucaucccuaaaucacagauugggaaaauauccagugagacucugcagcacuauguugccagcaauuuucuauccgggcgugccgcuguaauuggauuugguaucgaucagucugaacucauucauuaugcacaaacuuuaaacauugagucuggggagggauguaauaauuccucuaguuauaaagguggugaauugagaucaaacaaagguggagauguagcuuuugucacuguagcuggagaaggcgccucuuugaaagaccccaaggaagcucuagcuuuugcaauucuucaaaaagcaauugguguuggaccucaagugaagugggguaauaauaauggaauuuuuagcagaguuguagguacuggagagcauacaucaucugcuaucaaugucagcuacuccgauacaggacuuuuugguauuuugauugggacuccugcaaaaucugcaggaaaauuaguagaaucugcugucaaguuauugagaagugggaguguuuccgacgaggaugucaauagagggaagaaacagcuaaagucuucacuucuuuuggaagcugaaaguggagcagaugcuguaagagauauugcuucacaaucuguuuugacugguaauccucaaacugccagccagauaguugcagcgguggauucuauuuguacaagugauguucgagaugcccucagaaaugcuggacgaaaaauaacuuuggccucaauugggaaccuuaguaauguucccuaucuggacgaauugaaauaa

SEQ ID NO: 7207 - RNA, 333 nt, Leptinotarsa decemlineata
augagaagggcucauggugguaacuauuaccagccccuuucccaagauuccaacgaaaucgaagaugaaaauaaucgaaugacucaagaacuacaagagaaaauugguguucugaaaucuuuaucuauugauauuggcaaugaagugaaauaucaagacagauuacuuggagauguugaugaugacauggauagaacuaguggauucuugggaacaacuaugaaaaagguguugaggcuauccagaggaucucacaacuacuauauucuguacauguucuuauuuucaauaauuguauuuuuuauucuuuacuuagucauuaaguucagguaa

SEQ ID NO: 7208 - RNA, 1476 nt, Leptinotarsa decemlineata
augauuucgucaagacaggcagccaaggagcauguuuuagcaguuuccagagauuuuguaucacaaccaagacucaccuacaaaacagucucugguguaaacggcccucugguaauccucgaagauguuaaguuccccaaguacaaugaaaucguacaacucaaacuggcugauggcacuauacguucgggacaaguucuggaagucagugggucaaaagcugugguucaaguguucgagggcacaucaggaaucgacgccaaaaacaccgcuugugaauucacaggagauauuuugaggacuccuguuucugaagauauguugggacguguuuucaauggaucaggaaaacccauugacaaaggucccccaauuuuggcugaagacuucuuggacauccagggucaaccaaucaauccguggucccguaucuauccugaggaaaugauccagacggguauuaccgcuauugacgugaugaacuccauugcucguggucagaagauccccauuuucucugcagcuggucugccucacaaugaaauugcugcccagaucuguagacaggcugguuuagucaagauuccugguaaaucuguacuugaugaucaugaagauaacuuugcuauuguuuucgcugcuauggguguuaacauggaaacagcuagguucuucaaacaggauuucgaagagaacgguucuauggagaacgucugccuguucuugaauuuggccaacgauccuaccauugaaagaauuauuacaccccgucuugcguugacagcugcggaauucuuggcuuaccaaugugagaagcacgucuuggucaucuugacagauaugucuucguaugcagaagcuuugcgugagguaucggcugccagagaagaagugccuggucgucgugguuucccagguuacauguacaccgauuuagcuaccaucuaugaacgugccggccguguugaaggacguaacggauccaucacccagauuccuauauugacuaugcccaacgacgacaucacccauccuauuccugauuugacugguuacauuacugagggacagauauacgucgaccgucagcuccacaacaggcaaaucuacccuccgauuaauguguuaccaucucuuucucgucucaugaaguccgcuauuggugaaggcaugaccaggaaggaucacucugaugugucuaaucaacuguaugcuuguuacgcuaucgguaaggauguccaagccaugaaagccguaguaggagaagaggcucucaccccagacgaucuccucuaucuggaguuccugaccaaguuugaaaagaauuucaucucgcaaggaaacuacgaaaaccguacgguguucgagucacucgacaucggcuggcagcugcuccguaucuucccuaaggagaugcugaaacguauaccagcuuccguacuggcagaauucuacccaagagacucucgucacuag

SEQ ID NO: 7209 - RNA, 2388 nt, Leptinotarsa decemlineata
augaguuacauccaggguaacaggccaaucuaccagggcucuggagacuuaccaaugccuucgucaaaggaacaaacccugauguggcaacaaaauucauauauggaugacucuggaauccauucugcaggugcuacugcaguucccucacugacagguaaggaggaagaggauauggaucucuucauggaucaaggauaccaagguuuuacccaagaccaaguugacgaaaugaacaaucagcuuaaucaaacaagaucacaaagggugagagcagccauguuuccagaaacucuggaggaaggucaguugagaauugagauaccaucaacucaguucgacccuggucaucagacugcuguacagcgacuugcagagcccagccagaugcucaaacaugccguggugaacuugauaaauuaucaagaugaugcagauuuagccacaagggccauuccugaauugaucaagcuucucaaugacgaggaucaggucauuguuucacaggcagcuaugaugguacaucagcugucaaagaaagaagcuucucgccaugccauuaugaauaguccccagaugguugcugcucugguucgggcuauuucuaauucaaaugaucuggaaacaaccaaaggagcaguuggaacacugcacaaauuaucacaccaucgccaaggucuuuuggccaucuucaagaguggaggcauuccagcuuugguuaaguugcugaguucuccaguggaaagcgugcuuuuuuaugcuaucaccacucugcauaaccuguugcugcaucaagaugguuccaagauggcagugagacuggcaggaggguuacaaaaaaugguggcauuacugcaaaggaacaauguaaaguucuuaacaaucguuacagacugcuuacaaauucuggccuacggaaaucaagaaaguaagcuuauuauuuuggcuucgcaaggacccaucgaauugguaaggauuaugagauccuaugauuaugagaagcuuuuguggaccacuucaagagucuuaaagguuuugucaguuuguuccaguaacaaaccugcugugguugaggcagguggcaugcaggcuuuggccaugcacuuaacuaauuccagcucaagguuggugcagaauugucuuuggacacuccggaauuugucagaugcagcaacaaaaguugaugguuuggagaguuuacuccagucuuugguccaaguacuugcuucuucagaugugaauguugugacgugugcagcuggaauucuuucuaaucucacaugcaacaaucaacgcaauaaagugacagucugucagguuggugggguagaugcccugguucgcaccauagugagugcuggggaucgugaagaaaucaccgagccagcugucugugcuuugcgccacuugacuucaaggcauguugagucagaaauggcccagaacgcuguuagacuaaacuauggaguucaggucauuguaaaacuauugaacccaccaucucguuggccauugguuaaggcuguaauugguuugauaagaaaccucgcucuauguccagcaaaucaugcuccucugagagaacauggagcuauacaccaucugguacaguuauugaugagagcauuccaagauacacagaggagagcaagcguagccagcggaggcagccagcaaccaggaaauuauccugauggagugcguauggaagaaauugucgagggcacaguuggcgcacuccacauuuuggcgagggaaucgcauaauagagcgauaauaaggggucaaauggucauccccauauuuguucagcuacucuucaaugauauugaaaauauucagcguguugcugcaggaguuuugugugaauuggcggcugacaaggaaggagcugaaauaaucgaacaagaaggggcuacugcccccuuaacugagcuccugcauucgaggaaugaagggguugcuaccuaugcagcagcaguucucuuccgaaugagugaggacaaaccucaagauuacaagaaaagacucucaauggaauuaacuaauucccuguuucgcgaagaaaaccuguggaacccggaucucggcauggggccugaucuacaggauauuuugagcccagaucaagcuuacgauauguaugggcaaggaccuccuucagugcacaguagucauggugguaggccauaccagcaacaaggguaugaccagauacccuuagauaugcaagggcucgagaucgggucacacgcuggagguuccaacuacagcacccuugacgcuauggaugucgcugacgcagaugcugaccucaauuucgaucaacuccccacccccccucaagauaacaaccagguugcagcaugguacgacaccgauuuguaa

SEQ ID NO: 7210 - RNA, 483 nt, Leptinotarsa decemlineata
auggcacguaacgcugagaaggcuaugaccaccuuagccagauggagagcagcucaguugggagaaacagaaaagcacaaaaaaaggaggccuuaccuagcaucggaauguaaaaguuuauaugcuugugaaaaguggcgaaugcagaucauuagagaaauugccaagaaaguugcucaaauccaaaacgcgggucuuggagaauuccgaauaagagaccugaaugaugaaauuaacaaacuucuucgagagaagcaccauugggaggaucagauugaagagcugggaggaccagauuaucagagaguggggccucguaugcuggaucaugaaggaaaagagguuccagggaauagggguuacaaguauuucggugcugcgaaagaauugccagggguucgcgaguuguuugaacaagagccuccgccuccuccccgaaagacuacagcggaacugaugaaagacaucgacgcagauuacuau

SEQ ID NO: 7211 - RNA, 648 nt, Leptinotarsa decemlineata
auggcuacugaacaagaaaugcccaccuucaaauguguuuuagucggagauggagguacuggaaaaacgacauuugugaaacgucauaugacuggugaauuugaaaaaagauauguagccacuuugggaguugaaguccauccucuggucuuccauacaaacaggggcccuauucgguucaauguaugggacacugccggucaggagaaguuugguggucuccgugauggauauuacauucagggacagugugcuauuaucauguuugauguaacuuccagaguuacauacaagaauguaccaaauuggcacagagaucuugucagagucugugaaaauaucccgauaguacuuugcgggaacaagguugacaucaaagauagaaaaguaaaagcgaaaaguauugucuuucauaggaagaagaauuugcaguacuaugauaucucugccaaaucuaacuacaacuuugagaagccuuuccuauggcuagcuaggaagcucauuggugaucccaaucuagaauuuguagccaugccugccuuggugcccccagaaguucaaauggauccacaauggcagaaacaaauugaaaacgaucucaaggaagcgcaagaaacugcucuacccgaagaugaugaagaguuguaa

SEQ ID NO: 7212 - RNA, 480 nt, Leptinotarsa decemlineata
augacuaguauggaaacaguggguacccuuuucauaaaacugcugaaauuggugaucaauauaaucguuuuaauuuuauaucgaacaggauuccagggggaauuuuugggaguagguggaacauggaauuugaacgaagagaagaauccggaugcagaaaucguggccuccgguguuuuuguugguuauauaauauauaacauugucaguaugaucagcuuuugcuucgccacuuuggaucacaaauacaacuucacagauauccugaugaauauaauuggucuuuugcuguggguagcaguaggagcaacugcuauccacuauuggcacgguuauuuggccgaacauaaauauacccacgucgacucggagagaucgguuggauuggccauggggucccuuugcguccugaauggugcagcauauuugauagauucagugcuaucgauaauauucuugguuaaaacaaaaaugaauuga

SEQ ID NO: 7213 - RNA, 1839 nt, Leptinotarsa decemlineata
gaaaaacucuuacauuuggccaagcuuaugccaacacaauggagaacuauugcuccgauuauuggaagaacagcagcucagugcuuggaaagauacgaguuuuuacuggaucaagcccaaaagaaagaggaaggugaagaaguugacgauccucggaaauugaaaccuggagaaauagauccaaacccagaaacaaaaccagcacguccugacccgaaagauauggacgaagacgaacuggagauguugucugaagcccgagcucgucuagcaaacacccaaggcaagaaggcgaaaaggaaagcucgugaaaagcaacuagaggaagccagacgcuuggcagcguuacagaaaagaagggaauugcgggcggcggguauagaaguuacuuccaggagaaagaggaagcgugggguagauuacaaugcugagauuccauucgaaaagagaccggcuauaggauuuuaugauacgucuaaugaggaguuagauccuauggcaccggacuuuucaaaaaugaggcagcaacauuuggauggagaauugaggagugaaauugaagagaaagaacggagaaaggauaagcagaaauugaaacaacguaaagaaaaugauuuuccgcaagccauguuggaaaaccgugaaccagccaaaaagagauccaaguugguuuuaccagaaccucaaauuucugaucaagaaaugcaccaggugguuaaauugggcaaagccagugaaguagcgcgggagguugcuuuagagagcggaguugagacaacagacacucuauugagugacuauacuuuuacuccacaagcuacugccacuccaagaacuccagcuccucaaacugacagaauccuucaagaggcucagaacaucauggcccuaacucauguagacacucccuugaagggaggucugaacacaccucuacacaauucggauuucaguggggcauugccucaagcacaaacuguuuccacuccaaacacaguccuggcgaccccuuuuagaucauccagaagugauggcagcgcuaccccaagcaguacuguuggguucaugacucccagaagcggcgcaguugugccaguaggugcucagggugcuuauguaccaucugucagagauaaauugaauauaaacccggaagacggaacaguugacgugaccacuacuccagcaacccagaaaauguaucaaaauucugugaggagucacguaaaaguaggucucaguaguuuaccgcagccaaaaaaugacuaugaaauuguuguucccgagcaugaagaccaggagaugccagaacaagcccaagagcaguugguugaagaucaggcagacaucgacaaaaaaauccaagaggaacugaaagcuaaagcagcacgggagcuugcaagucgaucgcaaguaauccaaagaggcuuccccagaccucaagaaguuaacaugucuguguuacguccuccccaugagagcuauucuuugacagaucuccagaaauccgaggaacugauaaaaugugaaauggugacaaugcugcuacacgacaaucugaaaaacccgguaccaaacucgaauaagaggucuaauuuaucacaagcugaacaacuggcuuuccuggaacaacauccguaugaaaacuuccgagacgaagacauagccaucgcaaaaaauauguugaaacgcgagauggauauuguaaaagucggcaugagccacggagaacuucccuuagauguguacacucaagucugggaggaaugccucggucaaguucuuuuucucccuaaucaaaacagauacaccagagcgaacuuggcaaguaagaaagau

SEQ ID NO: 7214 - RNA, 474 nt, Leptinotarsa decemlineata
augaugcaguucauguuacuauucagccgucaaggcaaauuaagguuacagaagugguauguggcucauccugauaaacucaagaaaaaaauaacuagagaauuaaucaccacgaucuuggcgaggaaacccaaaauguguaguuucuuagaguggagagauuugaaaguuguauauaagagauaugccagcuuauacuucuguugugcgauugaacaaagcgacaaugaacugcuaacuuuggagaucauucaccguuacguggaacuucucgacaaguauuuuggcaguguaugugaacuggauaucauuuucaauuucgagaaagcauacuucauccuggacgaacuuuuguuggguggggagguccaggagaccagcaagaaaaauguucucaaagccauugcugcucaggaucuuuuacaagaggacgaagcuguugaaggagcuuugagggauaucggguugcuguaa

SEQ ID NO: 7215 - RNA, 1251 nt, Leptinotarsa decemlineata
auguaccggauacacuguguaaugcguaaauaugccuucacuaauggguuacgacucuauucucgagagccucagaagcgcaguucuuuuuuaucgagauuguaugauaacuuuagagaagaaauggcaaaaaacaaagaaaugaaagagucuuugaaaaaguuucgggaagaagcagaaaaauuagaacaaagugaugcucuaaaggcugcucgacaaaaauuugaaacuguagagaaagaggccagcaagggcagugaagucuucaaagauaguuugggaaccauuaaagacaggguuaaggguguuauagaugaagccaguaaaucagauauagcgaaaaaagcuggcaaauucacugaagaaguaggaaaacagacucauagaauaagugaaaaggcccaagaaauaaguaaaacuggugcuuuucaaaguauuucucaggcuacacaagcuguuaaaaaggaaauugacaccacaagcauggaagguagaguuuaccagagucccacaaaauuacgaaagcgaaccgaaacuggugcaguagugcaccaaaaauauuaugagccaaacguagaugcuacuggaguugaacuucacaaggauucaaaguucuacgagucguggcaaaacuucaaagauaacaaccccuauguccacaaagugauggacuggaaauugaaguucgaugaaagugagaaucccgucauucgugcaucaagagcccucacugaaaaagugggugauaucauggguggucuguuccagaaaacagaacuuucagaaacucucacggaaaucuguaagauugauacgacuuucgaaacgaaacgcuuuuuaaaacagugcgagaccgacauuauuccuaauguacuugaagcaaugacgcgaggcgauuuagaaauucucaaagacuggugucaugaaggccccuucaaccuguucgcuguucccaucaaagaggcuuacaagaaggguuauacaaucgaaucuaaaauuuuggauguggacaacgucgaucuaguuauggguaaaguaauggaacaagguccaguauugauaauuucuuuuacuucucagcaagugauggcuguacgugaugcuaccggcgccgucguagaaggagauccaaauaaaauaaugcggguuaauuacguguggguucuguguagggaccccucagaaccugacccuagagcugcguggagguuacuugauauaucagcaagcaguaacgaacaacuaguguaa

SEQ ID NO: 7216 - RNA, 618 nt, Leptinotarsa decemlineata
gcaccaagugaagauccaguguugaaugauuuuaaaagggaaaugcuuuucuaccguagagcacaagcugcaguaucagaagcuauucccaaauugaaaggcuugggauuguugacaaaaaggccugaugauuacuuugcagagauggcgaagacagacgaacacaugcaaaaaauucgggaacauuugaugaagaagcaggaacagcaaaagagaagugaaagggucaaacaacuucggcaacagaggaaagaggggaaaaugguucaaauucaaacgaaacuacaaagacaggaagaaaagaaagaaauguugaaucagguuaagaaaguucgaaaggggaugucuaaagaucuugauuuucuugaugguaaaaaaaauaaaucuauuggaagaaaaucuauggaaaagaggaaaaugaaagauaaaaaguuuggcuuugguggaaaaaaaagcggcaugaaaaguaauacaaaggauagugcugcugauauuagugaauucagaaauccuggaaaaucugguaaaaaauuccccaaaagaaacagcaaacauggaaauaaaaacagacccggaaagaauaggcgggggaaaauuaaagccagaggaaaaaaauga

SEQ ID NO: 7217 - RNA, 828 nt, Leptinotarsa decemlineata
augaaugaaacuaaaaaauuagagcacgucucccuuguuucgaaaauauguacacaacuggagaaucauauaggguuaaacgacaaggacguagcugaauucauaauacauuuaucugaagaaaacaauacucuugagaguuuuacaaaaguaaucaaagauaaugacauugaauugucggauucuuucauugcugaucugcuucauauuauucaagacaauaaugguagaaucgcuaaaaugagugagaaagcuccuacuacugaaaagaugaaugaaguagaaaaauuggaauaccugucucuuguaucgaaaguguguacagaauuagaaaaucaucuuggacucaaugauaaagacguagcugaauucaucauacauuuaucugaaaaaaacaauacgcuugaaacauucaccaaagcacucguggacugugggucuggauuuucugauucuuuuauugcuaaucuacuacgaauuauucaacacaugaaacccccaaaaaaucagucgaaggaagaggcugccauuacucaaaaggaaguauuagccaagaaauuuccaggauuauccauuccuaaugagccucagaaaccacuugaucuugaagggaaugaaaaugacagcauugauacagauauuguagcagauaugaugaaacaguuugaagcagaugcaccuucaaaaaaagauaacauugaaaaggauucaagccgaaguaaagaugguaaaaauagaaacgauagaaaaaggucaacuucccgacacagaaguagcagaagaucaagaaguagaucaccuaagagacgaagauuaaguccuagaucu

SEQ ID NO: 7218 - RNA, 1884 nt, Leptinotarsa decemlineata
augaauccugcugccccgaauuaucccauggcgucuuuguacgucggggauuuacauucugauauuacugaagcuaugcuuuuugaaaaauuuuccaccacuggaccugugcucucaauucgcgucugcagagauuugauuacacggcgaucauuggguuaugccuaugugaauuuucaacaaccugcugaugcugagcgugccuuggacaccaugaauuuugauuugauuaagggccgaccaauucgaauuauguggucccagagagaucccucuuugaggaagucugguguuggcaauguauucauuaaaaacuuagaucguucuauugacaacaaagcuauguacgauacuuucucagcuuuugguaauauucucagcuguaaaguagcucaagaugaaacuggcaccaguaaagguuaugguuuuguccauuuugaaaccgaagaagcugccaacaaguccauagaaaaggucaaugguauguugcugaacgguaaaaaagucuacguuggccgcuucauuccgcgcaaagaaagggaaaaggaauugggagaaaaagcaaaacuguucacuaacgucuauguuaaaaauuuuggggaagauuugucugaagaucagcuucgauccauguuugaacaauauggcaagauaacaaguuacaagauuaugagcaaagaugauggaaaguccaaaggauuuggauuuguugcauuugaaaauccugaagcugcggaaaaugcaguagaagcauugaauggaaaggaaauuauagagggcaaaucgcuauauguuggccgugcccaaaagaaagcugagcgucaacaggaguugaaacgucgcuucgaagcauugaaaauggaaagauugaaccguuaucaaggugucaauuuguauguuaaaaacuuggaugauaccauugacgaugaacguuugcgaaaggaauuuucaccauucggaacaaucacaucugccaaagucaugauggaagagggccgaagcaagggauucgguuuugucugcuucucuucaccagaagaagccaccaaggccgucaccgaaaugaacggcagaauuguaggguccaagccuuuauauguagccuuagcgcagcguaaagaagaccgaaaagcucaucugacuucccaguauaugcaacgcauggcaaauaugcguaugcaccagaugggacaauuuauccagccgggagcuucaagcgguuacuucguacccaccauucccaccucccagcgcuucuacgguccagcucaaauggcacagauccguacaaguccaagauggccugcccagacaccggugagacccgcuggucaaggaggcacugccgcuuacacaggcaugcccaacacauacagagcagcagcuaggccuccaaaucaauccacugccaugcgcggaaauauuagcgugccaagacccauuacaggccaacaaccacaaaccaugcagggacguccauuagcuggacaagguguuguaccugcuacgggaagucgaacaaacuucaaauacaccucuaacaugagaaauccaccacaagccuuaacuuugcaaggagcugcugcuccuguucaacaagcuguccauauccaaggccaggaaccacugaccucaacuauguuggccucagcuccuccacaagagcaaaagcagauguugggcgaaagauuguucccucucauccaacgcauguaugcugauauggcuggaaagauuacuggaauguugcuggaaauugacaacaccgagcuguugcauauguuggaacacaaugaaucccucaagaacaagguugaggaagcuguugcuguucuucaggcucaucaggccaagcaggcugccacucaaaucaagaaagaguga

SEQ ID NO: 7219 - RNA, 2751 nt, Leptinotarsa decemlineata
augaccgacucuaaauauuuuacaaccacaaagaagggggaaaucuucgaauugaaaucagaauuaaacaaugacaaaaaagagaagaaaaaggaagcuguuaagaaggugauagccucuaugacgguugguaaagaugucucagcucuauuuccugauguaguaaacuguaugcaaaccgauaaucuagaguugaagaaguuaguuuaucuauauuuaaugaacuaugccaagucccaaccagauauggcaauaauggcuguuaacacuuuuguuaaagauugcgaagauccuaacccacuuaucagagcacuggcaguaagaacuaugggauguauaagaguggacaagaucacagaauauuuaugugaaccuuuaagaaagugucugaaagaugaagauccuuacguacgaaaaacugcagcuguuuguguugcuaaacuuuaugauauuuccucaggauuaguugaagaucaaggauuucuggaacaguugaaagaauuauugagugauucuaauccaauggugguugcuaaugcaguugcagcacugucugaaauuaaugaaagcagcccaacuggucaaccucuuguugaacucagcaccaacacaauaaacaaacugcugacagcucucaacgaauguacugaauggggucaaguuuucauuuuggauucccuuuccaacuauacuccaagagacgaccgugaggcccaaaguauuugcgaacguauaacaccacguuuggcacaugcgaaugcugcaguuguacugucagcugucaaaguucugaucaaaaugauggagauucuagcaggggauacugaauucugcaccacuaugagcaagaagcuugcaccaccucugguuacgcuacuuaguucugaaccugaaguccaguauguugcauugagaaauauaaauuugauugugcaaaaaaaaccggauauucugaaacaugaaaugaagguuuucuuugucaaguauaaugacccuaucuaugucaaacuagagaagcuugauaucaugauucgucuagccucucaaguuaacauugcacaaguucugagcgaacugaaagaauacgcaacugaaguggauguggacuuugugagaaaagccgugagagccauuggaagaugugccauuaagguagaaccuuccgcagaaagauguguugcuacacuccuugacuugauacaaaccaaagugaauuaugucguucaagaagcuauaguggucaucaaggauaucuucagaaaauauccuaacaaauacgagaguaucaucaguacucugugugaaaaucucgacacauuggaugaaccggaagcaagagcuaguaugguauggauuauuggagaauaugcggaaagaauugacaaugccgaugaacuucuggacaguuuucuggaagguuuugcugacgagaaugcucagguacaacugcaacugcucacagcuguggugaaacuuuuuuugaaacguccucagcauacucaagguuuaguucaacauguucucagcuuagcuacucaagauucugauaaucccgacuugagagaucgugguuucaucuauuggagauuauuaaguaccgacccagcugccgcuaaagagguuguacuagccgacaaaccuuugauaucugaagaaacugauuuguuggaaccuacauuacuugaugaacugauuugucacauaucaucauuggcuagcguguaucauaaaccacccacugcuuuuguugaaggaagaagugcaggagucagaaaaucucuuccagcaagacaagguucaaaugaagaaguaucuagugcaccugaagcuacagucauuccgaaucaggagagucugauuggcgauuuacucucuauggaucugggugcgccugcuccaccaguuucugcaccugcuccagucccaacaagcaauguagauuugcuuggugggggauuggacguuuuguuaggcggaccugaucucagugcaggugcugcuccaucaacuacaggauuauugggugacauauuugguuuaaccucugccccuaccauguacaccccgccgaagaucugcugguugccagcagauaaaggaaaaggucuugagauuuuuggaacauucucaaggagaaccaaucaaauuucuauggauaugaccuugacuaauaaagcuaugcaggcgaugacaggguuugccauccaguucaacaaaaacaguuucgguauaacuccaagugccccacucaauguaccugccuugcaaccuggucagaguuuggaguacagucuucccuugagcaccacugguccaguucaaagaauggagccgcuaacuaccuugcaaguugccaucaagaacaguguugauguguuuuauuaugcuugucaaguaccaauucagguucuguucaccgaggaugguacuuuggacaagagaguauuuuugacuacuuggagagacauuccuucugcaaaugagguucaguacaccauaaaugauaucaagggaacaacugauggaguuuccaacaaaaugacccucaacaauauuuucacuauugcuaagcgcaacguagaaggacaagacauguuauaucaaucucugaaacuaacuaacaauauuuggguacuuuuggaacugaaguugcaaccagguauaacaacagccacgcugaguuugaaaucaagaucuguggaaguugcaccuuauguuuuccaagcauaugauucaauuuugaagaacuaa

SEQ ID NO: 7220 - RNA, 489 nt, Leptinotarsa decemlineata
augccaccaaaguucgaucccacugaaguuaaguauguuuacuuaaaguguguugggggcgaagugggagcuacaucuuccuuggcuccuaaaaucgguccucuaggauuguccccaaaaaaaauuggagaugauauagccaagaauacagccgacuggaaaggucugaaaaucacuguccagcugaagauccaaaacagacaggccaccauuuccguuguaccuucugcugccucucucaucaucaaggccuugaaagagccuccaagagauaggaagaagcaaaagaauauuaaacacagugggaauaucaguuuugaugaaauuauuuccauugccaagcagaugagaccucgaucgauggcaaagcaacugucuggaacagugaaggaaguuuuaggaacugcccagucagugggcugcaccauugacggaaaaccuccacaugauguuauugacgaaguuaaugaugguacuauagaaguaccc

SEQ ID NO: 7221 - RNA, 1095 nt, Leptinotarsa decemlineata
augggggaagaaggaaaacgagcccugauuuugguuggaggauaugguacaagacugagacccuugacauuaagucgaccuaaaccucuuguagaauuugcuaacaaaccaauccuucuucaccagauugaagcauugguagaagcugguguaaccgaaguaauucuugcuguguccuacagggccgaacagauggaacaggagcugacggcagaggcagcuaaacuuggaauaacuguaguguucucccaugagacugaaccauugggaacagcaggacccauagcuuuagcuagagaacaccucucaaaaagcacaaagccauuuuuugugcucaauucugaugucauuugugauuuuccuuuuagagauuuggcucguuuccacgaggcacauggaaaagaggguacaauuguugugacaaagguagaagagccuucaaaauauggagugguuguauacgguaaggacaacuguauacaaaguuucguagaaaaaccacaagaguucauuucuaauaaaaucaaugcuggccuuuacguucucaaucccagcguaauagaucggaucgagcugcgaccuacuucuauagaaaaagagguuuuuccuggcauggcagcugauaagcaguuguuugcuuuugaccuacagggcuuuuggauggaugugggacagcccaaggauuuucucacuggaaugugcuuguauuugaagcauuugagauccaccaauggaagcaaauuauauaaagggccagguguuguuggaaauguucuaguggauccaucugccaaaauuggaaaugacugucagauagguccaaauguaacuauugggccuggaguuguuguagaagaugguguguguauaaagagaagcacaauacuccgagacgcaacaauucgaucaaauuccuggcuagagaguugcauuguaggauggaacuguucgguaggucgcuggguucgaauggaaggcacuaccguucuuggagaagaugucaucgucaaagaugagacuuacauaaauggagggcaaguauugccucauaaaaauauuacuacaucuguuccugagccacaaaucauaauguag

SEQ ID NO: 7222 - RNA, 873 nt, Leptinotarsa decemlineata
cuaaacauggcguccgacggugaagauguuaucacagaccaagaaaaaguuaaaauaguaucggauuucauucuccauucgccgccuggcgaauuuaaugaagucuuuaacgacguacgaaaacuccucaauaaugacgaccuacuaaaggagggcgccagcggggcauucgcccaguacaacaaagaccaacugaccccagugaaaauagaaaacuccgauaacuuagugcucaucaccgaauacaacgaucagggaaacaacagauuuuucgacccgcgaagcaggcagagcuuuaaguaugaccaccugcgaaaagaggccuccgacuaccagacguacaccccggauccagcggcggagcccuggcgcuccgcucucgacgcugaguucauccaguacaccaggaaucauuaccgggacggggugugcaguguggugggcaggaaccaagggggcaacguggucuugacagcuugcaucgaagaccaccaguuccagccaaagaacuucuggaacggcagguggaggucgcaguggucgaucucucugaauggaggauccguggcagaaguuagagguguguugaaggugcagguacacuacuacgaggaaggcaauguccagcugguuagcacgaaggaaaucaaagagucaguggugguaacgaacgaggcucaaacggcgaaggaaauaguccaggucaucgaaacggcggagaaccucuaucagacggcgauuucggagaacuaccagacgaugucugacaccacuuuuaaagcucugaggagauugcuaccugucaccagaacgaaaaucgacuggaacaagaucguguccuacagcaucggcaaagaacucaaaacgcaguga

SEQ ID NO: 7223 - RNA, 3663 nt, Leptinotarsa decemlineata
aacacugggccuucagauacuacaaacccaaauuaugcuguagugcccccuguaguuucugauagcaaaccugcaauaacaaauagugaaacaaaugacacuaacaaugauguuguaauguugaguccuacgaaauuucucaugaaaaagggacgaucuggacguuuauuggaauauccgacugauuacgauccuaugacuucccauauugcuccaccggauagugaucagagaggauauucaggaguaccauaugucuugacggaaaccagacugcaacagauccgccaaaauuucauguaucccuacuacaacagaggcgguaaugcagaugacgaaggagacuaccagaaagaaauucagucaucuauuccgcaaguguacaagaaccucaacuuccaacucccuuucuucggauuucgauucaauuacacgagggucuccuugaacgguuauuuggaauucagcgauccuccuccaaauuacgacuauccuuuggucuuuccaguaaaggaauggccuaaaaagaacgacccuucuuucaucgguaucuuuuucaguaaauguagaaucgguaaccugagggacggagauauugaucaaagagacccuggaguguacuuuaggauggaaagggaucucagaaauaggcaggacaggaugggaguggagaucagagaacgacugaaaugggauauaagggaaggggugauagggucagaaacauucaaucccaaacacgccauuaucgucacauggaaaaauaucucuuucaauggagguuuuggcaaugcucucuaccagacuaacacuuuccaaaugauccucgccacugaugaaguuuucaccuacgccauguucaacuacuugaaucuugacuggaccacccacacugaagcgggaggcgacacaagaaaaggagaaggaggaguucccgcuuuugugggauucaacgcuggaaacgguacuagaaguuuugaauacaaaccauacagucaagaaucuguuauucgagaucucacacaaacugguuucgcuaaugguuucaaaggaaggcacauuuuccgaaucgacgaaaauauccuaacuggaacaugcaauaaagauauagauggugcuaaucuaccgcuaaugauaucuccagaaaguggaaauaugcuggguggaacaauagugaauauaacaggaccuuguuucggccuagacgaccaaguuaaaugcaaauuugauguagccgaugaaauaaauggcgucguuauagauaaaaacagggcuauaugcauccaaccuagacuguaugccgaaggaugggugaauuuacaaauagccauaggggcugggguauacaaauggaagggaaaauauuaugucgaaucccccgcagcggcuucucaaaaaaucuacuucaaggacaugaagguucaugaaaaaucgccuagugaaauaagaauaacuugggaaaaauacaacuugaccacuaacgaaaacgcuaacauucgcaucuccuuaugggguuacagagaaacaacaauaaggccaacguucguuuacaucacugauaucgcagacagucuccaaaauacuggagaguauaccaucguaccgucccaauauagaacaaaaguuaaugaguuucucacggauaucaaauuugguuucuugcaaauuaacuugacugaaucuaucaaagugaacacuuauacaucuguacaaagaucgguggaaauaguuccuguuguauggagucgacccauuccccuaggaugguacuuucaguuccaaugggaaaauauguauggacgaagcuggcccaaagcacucugcgaugacuggcuaagaacagacagauaccugaaaaacuuugcucaugaguuaccucaaugcccuugcacuguagaacaggcuuuggcagacaaagggagguauaugcccgacuuugauugcgacaaggacucaaaucccguaugcuacuacaauaaccaagcucugcacugugugaaaacaggaucaccaacguuggagggaucagaacagcagugcugcuaugacaaaaacggguaucucauguuaucauacgaucagcagugggguucaaguccacggcguugccacaaucugggaaaaaugcccuacaacgaagcaacaaaaguuccaaccuuaucgcaaugguucaacgauaugguaccgaaguaucuuugcuguuuguggcaggaagaacaggcgguggguugcgaaacgcugagauucgaaagaagaccaacucaggacugugucgcguaccaagcuccagggauugcugggauuuacggagauccccacgucaucacuuucgaugacgucgaguacaccuucaacgggaaaggagaguuugcucuugugaaaucugugacacaaacugacaacuuggaggugcaaggcagauuugagcaaauggacccuaacgccuauggagaaguacgugcaacucaacugacuucaauuguggcaagaggaaacaacacuauagcaguggaggucagaaggaggccauuggaugcuagguggagguauaggcuggaugucauagcugauaacaggaaguuguucuucgacaggccgucuuugaaauuccaacauuuccaaggagugacuauuuauacaccuacuuauauccucaaucagucugaagucaucauuauguuugauaacggagcaggaguucaaguaauggauaaccagggauucaugaccgcgaggguguaucuuccuuggucauucaucaacaaaacuguuggucucuuuggcaacuggaguuucaauaaggaagaugacuucacucuuccugaugagucgaaggcugccgucguggguaauaucaaugauauggaaagggucuacaaugacuuugguuccaaauggaugguggacgacguacuagauccgaaaagagguagaucccuauuuuucagagaauucggcagaucaucggcaacguacaacaacaaaacuuucaaaccgcaguuccuuauguuaccugaggacauaauacccgcaaacaggucgauacagauacagagaacuuacgacauuuguagcacaaaaauguacgaaugcuucuacgauuaugccaugacgcucaacagagaucuugcccauuuuacucagaauuauaaagcaaccauauaucaacucaaagaaacgacgaggcagaagguuguuucuugcggaguucuggaaacaccgcgauucgguaggaagaguacuuuucuuuuuauaccuggaaccaaagucacuuacgagugcaaucaagacuucguauuggugggagaucccagaagagaauguuuggcagauggcacauggaaugcuccugaauauggcuacaccgaauguuuacgucaacaagaauauucucagcgccaaucagccauugccucuggagccguucucgcaauaauuauuccacuaguucuauuauuuguauaucuggcuuauauguuccucaagaagaaacagaaagaacgagacgaagaaaauuuacaaacgcaagcguacgagcaacagaaaagacaagcucaggaagcugcugcuagaaaauuaacugcugccgaagaguacaacucagaugaagacgauaauaacagcaacguuacgagcacagcaaaagaaacaacaguguauuag

SEQ ID NO: 7224 - RNA, 300 nt, Leptinotarsa decemlineata
augucgucaucuucugauucugauuccucuuuuuucucuucuuucuuggauucuuucuuuucuucggcggcugcuggugcugcagaagcugcugcagcagcaggagcagcuccuccagcuggcauggagcucaauuucucacguccuugggcgaugaguucaucaauagauuuuccaccuaguucagcaaugaccuuuuucagccguucuccuucagcuucaauuccuacagauccuaaaauuuuuucaagaucagcagcagauggggaaguuuuuccgcccaaaacggccaaaagauaa

SEQ ID NO: 7225 - RNA, 2121 nt, Leptinotarsa decemlineata
augacugaucguuucggauuaaaaugggaccccaaaaauuuagagauuagaacaaugucuguagaaaagacacuggaaccucuaguguugcaaguuacaacacuugugaauacuaaggggcccaguaaaaagaagaaagguaaaucuaaacgugccaaugcucuugugaguacuguggaaaaagcuacugaaaacuuuauugaaaagggagagcaaauugccuaugaaaauccagauauuacugaugaaaugcuagcagcaguagaagaagugaagaaaacaggcacugcuaugaguguagcagcaagggaauuuucugaagauccuuguucuucgcugaaaagaggcaauaugguccgagcugccagaaauuuacuaucagcaguaacacgguuacuuauucuggcugauaugguugacguucaccuuuuacugaaauccuuacauguaguagaagaugauuuagagaaauugaaaaaugcaucaagucauggugaacuucuugauaauaucaaagcuuucgggcaaaaugccaaugaguugaugaaucaggcagcuaaacggcaacaggaacucaaagauccacaacuucgagaugaucuugccgcagcuagagcuguauugaagaagcauucuaccaugcuguugacagcuuccaaaguuuacguucgucauccugaauuggcagcugcuaaggcaaauagggacuacguauugaaacaaguuugugaggcuguccauacuaucaaugauguugcacagggucguacuccgcaaccagcuuguggaccuuacgauggcccaggugaauuggcugcagcacuagacgauuucgaugaucacauggugauggaaccauuagcuuauaaugaaguucauacuagaccaucucuugaggaaagauuggaaagcauaauaagcggagcagcccucauggcugauuccaguugcaccagagacgagagaagagaaagaauuguugcugaauguaaugcuguuaggcaggcauuacaagaccucuugucagaauauaugacuaacaugggaaauaaggauaagagugaaagccucaauagagcuauugauaauaugggaaggaaaaccagggauuugagaagacaguugagaaaagccguuguugaucauguuucugacaguuucuuggagaccaauguaccauuguugguucucauuaaggcugcucaaaauggaaaugaaaaagaaguggaggaauaugcaguugucuucacugaacauuccaauaaauugguugaagucgccaaccucguuugcagcaugucuaauaaugaggauggcgugaaaaugguccguuacgcagcagcucaaauagaaaaucucugcccugaaguaauaaacgcugcucguaucuuggcagccagaccucguagcaaaguugcucaagaaaauauggcugcuuucaaacagucuugggagaaucaugucagaauucucacggaagcugucgaugauauaacgacuauugaugacuuuuuggcugucucggagaaucauauuuuagaggaugucaauaaauguguuuuggcauuacaagaaggggaugcugacacauuggaccguacagccagugguauucguggaagaucgaacaggguuugcaauguuguuucugcugagauggacaauuaugagccguguauauacacgaagcgcguacuggaagcugucaaagugcucaacgaucaaguaaugccaaaauucacucaaagaguucagguugcggugcaagcauuaggaaacaauccaccaaaagaaguugaugaaaaugacuucauagaugcgucucgcuugguuuaugauggagugagggaaauacguagagccguguugaugaauagagcugacgaagauuuggacccagaggauguugaacuggaugaaaacuauacauuggagaacagaagcaaaucgagugcuccuacugaagaagauccaguugaugaguauccagauauuagcggaaucaccacagcacgagaagcaaugggagaaaugcuggaagaagauaaacagaagauucugcaacaaguggagcucuuaagaagcgaaaaacuuaaauuugacugugaaguugccaaauga

SEQ ID NO: 7226 - RNA, 1101 nt, Leptinotarsa decemlineata
augucuuucaauuuuggaaacacacccgucuccaaaccaggugcuacgguuuucgcauugccaacuaauccuacuacaacuucagcgacaggauuucaguuuuccgcugcuucaggagauacaaaaaaucagaagccuacuagcucugccuucacuucuuuaacgcaagucaaaccuacugggacuuuaggaggacaagguaccacugcugcuuuuccuacaggugguuuuaguuucggaaauacuaaaucagcaacuacaaccacugccuuugucccuauuucuggaucaacuccaguuaccaaaccuaccacuacuacaggacuuucuuugggcgucccuucugucaccaguacggcugcugguauuacaacuacuucugcaaccaaauugaguuucggacuaucaucaggaucaucuacuacuacagcuguugugacaacaucaggaacaucuucaaccauuguuccagcugcaaccacgguaacaucgucaacuucgauaauuccagcaacuggguuacuaacuuuuagccaacuagaagacucuauaaauaaauggacaauagauuuagaagaacaaggaaaauuuuucauaaaucaggcaaaacaguuaaaugcuugggauucuuuauugauuucaaauggugaacaaauauugaauuugaauggcaguguagagcgugucaaacagcaacaacaacaacuagaucaagaacuggacuuuguacuugcucagcaaaaagaauuggaagagcuuauagcucccuuagagaaggaauuaugggacauaccuguuacugauauugauagaaaucaaauguaccaguuuucagaaaugauugauucucagcuaaaacaaaugucggaagacuugaaggaaaucaucgaacacauaaaugagucuaauagaaaugaagcggcaucuaauccaauugcccaaaucagccgcauccugaaugcucauaugaacucccuacaguggauagauagaaacacuucgcaaauaaguucucauuuggagcaaaucaccaaaaugcaagauucgaauaggagaaauuuggcccuuagcaacucuuucaaucacucuaugaauauguag

SEQ ID NO: 7227 - RNA, 582 nt, Leptinotarsa decemlineata
auguucaucugggauugguuuaccgguguacuugguuacuugggauuauggaagaaaucaggcaagcugcuuuuccuaggccuggacaaugcuggaaaaacaacuuuacugcauaugcucaaagaugauaggcuggcacagcaucuucccacuuuacauccuacaucagaagaauugucaaucggcagcaugagguucacgacuuuugauuugggaggccauucacaagcaaggcgaguguggaaggacuacuucccugcuguugacgccauugucuuuuuaguagaugccaaugauaggaacagauucaaagagaguaaacaagaauuggauucgcuacucacagacgagacucuuucgaauuguccgguucuuauauuagguaacaaaauugauuugccucaagcagcuucggaagacgaacuaagaaauuacuaugccuuguauggccaaacaacuggaaagggaaagguggcaagguccgauuugccaggacguccccucgagcucuucaugugcuccauucugaagaggcagggauacggagaagguuuccguuggcuggcccaguacaucgacuga

SEQ ID NO: 7228 - RNA, 642 nt, Leptinotarsa decemlineata
acugucaggugguacaggugucacucuggugagucugguggaaaagaaguggaaauuuuauuuuguauuuguguuacuuuauugcguguaauuuuucugauggauccaauaaacuuguuagagagccguauugaaaaucuggaaauucagauuuucggagauaaauuaccaacuacaaauacuaaaaauguuacuaguuuacuuuuggaaacucaugcaaugauuacuucagcuuuaaguugcagagaaguaauuaguuccaugcuucaccauuugucuauuauaaaugaauaucuagauccaaaccuuggaguagaugagcuagaagcugaagcuaagagguaucacuuacuccaauuauacucggaauugaaagauacuguacagaagauuggaacuuuagagucacuguuacccuucauugauucugagaacauagcgaaaguaacugaacuaucaggaaauauagagcagcuggcaguugguaauaugaauacauauucugaaugccaagaaguuacucagaauguauugaaaucuuugcgaaauuacaaugagaucauuucgacuauaaagauauuauuugcugaucuggauacugaaguuucucuucuggaaaauucuuuaauuacagaagaauag

SEQ ID NO: 7229 - RNA, 1740 nt, Leptinotarsa decemlineata
augaccacuucggacguuuauaaugacuugagucuauauguuacacccgagaaauucuaccuugaacccagaaacagcgacgaacucuugauuaucgaccgaccuucggagcaaaucacgauacagagaaaugucggccagauuccugccucgagcagcagaagggacuucuguggacugcuggguacgauccaucuacuggcaggacccuaccuagucguggcccuccagagagaccuggugggguacaucgccggccacgcugucuggagacuagccaaagccgagcuagugccuuacaauagaacauuguugcauuuagaugcugagcagcagaacgacaacaacgucuaccuuuccaugguggaacagaugcuuuccacacccuuccauuacuucagcuacgacuaugacaucacgcauuccauccagcgccugcaugacaucagccccgacuucuggcagcaaucucuguacgagcgagcugaucaacgauucguuuggaacaaucauuugcugcaacccuucaagagcgcgggcgucaagcguuucugcuugccgcuacuccacggauucguuucgauuaaccaaugugucaucaauggccacaaucucagcuggacuaucaucucacgccgaagcguguuacgcgcagggacaaggcuguuccgaaggggcaucgacagggaugggaacguugcuaauuuuguagaaacagagcagauaguggaguuccuaggcgaccgcgcuagcuucguacagauaagaggauccauaccccuguucuggcaucagaacccggauuuacgguacaaaccaccgccuacacuucuggauguggacccccaggagcagcaggcugcgugucuacgucacuuggaggaaaugacugcuauauacggcaagcaaguucuggugaaucucaucgaucagacugguagagaagguggaauugagaaggccuucagggauaccaucaguauuuuaggguuugcuucugcaagauacgagccuuucgauuuccaccacgaguguagaaagaugcgcugggauaggcucucaauccucaucgacagaauugcucuggaccaggaugaaaugggcuucuuccugauucuucgggacggcucuuugagcucucuucaggacggaguguucagaacgaacugcaucgacugccuggauaggacgaacgugguacaaaguaugcucgcccacagaaauuuggaugugguguugaagaaacugaauauucugcauccgaaucagagguuggacgagcagucaucguucgagaugcuauacaagaacgugugggccgacaacgcggauuucaucagcauucaguacuccggaacuggagcucugaaaacggacuucacuaggacaggaaagcgcacacagcugggauugauucgggacgggaucaacucucucgugagguacuauaagaauaaccugacagacggcuaccggcaagacuccauagacuuguuucuggguuacgggaagauuaucucgccucugacaguggagaagggcuggcgauacaugacguucccuucgguucuucugauggccaucgcgauguuuguggccuccgccgucuucccuucggaguacucuacggaaaaucuauuguacuugcuguucuggggcuccaugguuuacguuucugcgcacaccauccucaaguaugguguggaguuuguugauaagccgaggcucacgcagucguag

SEQ ID NO: 7230 - RNA, 1650 nt, Leptinotarsa decemlineata
augccuccaacgauccagcaaaguggucaaaguacugccaaugguguagagaaaagaccuguaaaacccguggaaaaaaggucagauuuaauauguaaaguuaaauauuguaauacguuaccagauauuccguucgauuugaaguucauauccuacccuuuugaaucgauaagauucauacaguacaaucccacuucuuuagaacgcaauuaucgguaugaagugcuaacggaacaugauuuaggaguaagcaucgaucuaaucaauaaagauauauaugcaauugagccaggugcauauuuagauccagccgaugagaagcuguuagaagaagacauuuugacgccucaggacucuaaaagaucucgacaccaugcuaaaucaguaucauggcuccgccguacagaauauauuucaacagaacaaacccgcuuucagccccagaccauggacaagguugaagccaaaguugguuacagcaucaagaagucucuuaacaaugagacauuguauauggaucgugauucacaaaucaaagccauugagaagacguuugaagauucuaaaauaccuaucgagaaacauuauaguaagccgaaugugguaccuguugauauucuucccguguauccugacuucaaucuguggaaguauccuugugcucaagucaucuuugauucagauccagcuccagugggaaagcaggugccugcccaaauugaagaaaugucacaggcuaugauucggggugucauggaugagaguggugaacaguuuguugccuacuuucuuccuacggaggaaaccuugcagaagcgaagggaagauuuugcaaaugaaauacccuaucaagaugaugaggaguaugaauauaaaauggcuagagaauacaauuggaaugucaagaguaaagcaagcaaaggauacgaagagaauuacuucuuuguuguuagacaagacgguauuuauuauaacgaauuggaaacuaggguaagacugaguaagaggagacagaagauuggccaggcacccagcaauacgaggcucauuguuaagcacagaccaauggaugccaaugaguuuaggaugcaacgcuacagagagaaacaacuugaaccuccgggugaagaagacgaagaaauggagguagaggaaacccaggaggagacucaggaagagacucaggaagggcaaggcaaugacagucaagcagaaucugaucaggaaaaccgagaaaaagcaggaagcggaaaggaagaagguucacgagccucuucgagaucuuccaggaaaucaaaaucccguucaagaucccgauccaauucaucagcaaagucacguucaagaucuagaucgaaaucagcuuccaaaucgaggucccaaucuagaucaagguccaggucaaaaucuaagucaaggucacguucuguaucuaggucucgaucaagaucaaagucuggcucaaaaucuccgucgaggucuagauccagaucuggcucaaaaucuccuucuagaucuagaucuucaucuaaagcaucgucaagaucuagaucaaagucuaggaguagaucugguucucguucgagaucuaauuccaaaucuccuucaagaucuagaucggguucuagaucuggaucugacagugaguga

SEQ ID NO: 7231 - RNA, 1170 nt, Leptinotarsa decemlineata
augccuauugaaaauuuggaggaccaaggucuggaaaagaacccagacuuggaauuagcgcauuauaaauuucuacuaaccuuaccagaguaucagaaugauacauugguacauacaaaaaucacagaagcaaucaaaaaagaugauauggcuccuugguaugaauuaauuuguaaggacucuggcuggaaaguggaucagaacuuauugaaagccaugaaaaugaaaaaugaugaacaaauaaaacuuuuggaugaggccauugaagaugcugaaaaaaacuuaggagaaauggaaguuagggaagcauauuugagaaaggcagaguacuucagucgaauuggugauaaagauaaugccgugagcacauuuaggcaaacuuaugauaagacaguuucgcuugggcacagacuggauauuauuuuccauuuaauaagaauaggcuuauucuucauggaucaugaucucaucacuagaaauauugaaaaagcaaaaacuuuaauagaggaagguggugauugggauaggagaaaucgcuugaaaguauaucagggugcuuacuguauggcaguaagagauuuuaagacugcagcaaacuuguuuauagacacagucaguacuuucacaucuuaugaguugauggauuauaaagcauuuguccgcuacacaguuuauacaucuaucauuagucuuccaaggaaccaacuucgagauaagguuguuaaagggucagaaauucuggagguucuucauucugaaccauucguuaaggauuauuuauuuucacuguacaauugccaguaugcagaauucuucucaaauuuagcggaaguagaaaccacucucagaaaagacuacuucaugaauccucauuaucgcuauuauguucgagaaaugaagauuuuggccuacacacaguuacuagaaucauauagaucucucacccuacaguacauggcugaagcuuuugguguuucuauggaauacauugaucaagaguugucaacauucauugcugcgggucgacuacauugcaaaauugauagaguuggaggaauuguggaaaccaaccguccagaucuaaaaaaugcacaauucaauucuguuguuaaacagggagauuugcuuuugaaucgagugcaaaagcugucucgugucauuaauauuuag

SEQ ID NO: 7232 - RNA, 450 nt, Leptinotarsa decemlineata
gcuuucuccgaaccaccaaguccuuggguaagugcgagugauccacccgaaauugacagcaccaaugucgguguaccuucaaccuacaaucagcguucuucugaaaaaaugaaagccgacgaaggguugggaaaaggagcuaccauuucugcaguccuguaugcuaauguuaaucauccugaguggaaaaaagaguucccuaguuggucagauagguacaaacagauaaucaaaaaauggaggacuuugagucaggaucagaaggcuccauuuuugcagcucgcgagggauaauaggagccaauugaggaugaagaagucccaacaagaucaggacaagauggcccuacagcaaaaaucugcucgagaggcggaacaagagaggcaguggaaacaguugcaggcuuugagacaacaacaagcucaacaacagcaacacguuauccaugaa

SEQ ID NO: 7233 - RNA, 4305 nt, Leptinotarsa decemlineata
auggaagauucaucugaagaacguagaccaaaaagaucgaaacgggaaacuucauauaaagcuaaagcauuugaaaaauucaaacagcucaaaagugguauuagaaacaaguaugaagucgaagaacuggauaguguuuaugagguaguugaggaaaaagaguauguuaagaaaguucuuucucgucaagaugaugacuggauuguugacgaugaugguaguggguacuuggaagaugguagagauauauuugaugaugauuuggacuccgaaucuauugcucaagcaagugcaagaggaaaaggugucaaaagaaagaaaaaaaaugucucggaaaaugccggaagaggaaauuugcaacaaaugcuuucaaguaugccaaccaaaaagaaagaggaaaccaaacuugaugacgaugaaaugcugucugaaaucuuaggugaaauugaugaaacuucugcuaguaucccaaaaccaaaaauuaaagaauacucgguuaugucucgaaaacuugcugcuaagaauuauaugaagaacuuaaguguuccaaacaaaaauauuucuauuacucgacccauaagugacauauugaaaaaagaagcuacugguaacauauugaaagagguacaaaacaaaguaauagaaaauggcgacuugaaugaaauugcugaauuuccacaaguugauauuguagaagaaaacucuuuacgaauuacugaggaggaagaacagccuguugaauuaagugaaaacuugacuaucgaggaugauuuuacccaagaguguuuugaagaugacaucgacaugacacaaauagaagaauuugagucucagcaacuuccugauauuucagucgaugaagaaaaaauuucagaugaguuacaagcagaauuuaugagugaaugggaaaauuucacaaacgaaucagaugauauugauauggacaaguuaguggauagaucugacauaccucuuguugaaguugauaauaaaaagguauuccgguuuuauuggugggacgcuuaugaagauccugaaaaacaaaggggggugguauuucuguuuggaaaaacauacugugauaagacuaaaaguuuugugagcugcuguguggcuguuagaaacauuaguagaagaguuuuucuuuuaccaaggccauuugaacuuggagaagaugggacaccuacagaagaaccaguuaccuuuaagaaaauguacaaugaauugaaugaaaaaauaauaaagccauugcauaucaguuuuuucaaaacaagaucuaucaagaaaaaauaugccuucaauccugaaauaccaaccgaaucugaauacauggaacuccgauacccggccacugacgcaagaauagauuuaggagaucugaagaagaaaccucaaacuauuucgaaaauauuuggaacaaacuccagcuuucuugaaauacuccuuuuggaaagaaaagucaaggguccauguugguuagauaucaguaauccaucgccuguuucaaauccuuugagcuggugcaaguuugaaguuaacugcauaaaagucacagaucucaacauaauggaaucagauaaaccauuaccaccuccaccguuagugguggcagcuauuaauaugagaaguuuugugaaucccaagacguaugccaaugagauucucaugauguccugccuuacacaaacuaaauaugcuguugacaaaaaaccuccaaauccuccauuccagcaacauuuuuguguuuuuucauguccugcacagcaaguucuaccucuuaacauucaugaggcucugggaaauuauaggguaacgaaaguacaaaaaauggacucugaacgagcgcuccucaacuauuucauuacacaguuuuccaaaaucgauccagaccuuauaguagggcaugaucugcaaggauaucaaaucaauauuuuagcugaucgucuuacaaaacaggacaacaaaacuuucaguaaauugggaagaauaaaaagauccgaaaagaaaagacuggaaaagcauuuauuugcugguagacucguaugugauaucaaaauaucagccaaagaacuaauaaaaucgcgaucauacgaccuagaugcucuuugucaagucauucuuaaacucaaagaaaaucaaagaauugaacuagaaccugaagacauucccaaaauguaucagucaaccaaggaucuacugaaacugauaucauuuacagugcaagauacaucguacauucucaaaaugauguacgacuugaauguuauuccucuugccuuacaaaucacaaacauagcugguaauauaaugucgaggacuuugaugggugguagaucagaacgaaacgaguuuuuacuauuacaugcauuuucagaaaagaauuauauaguuccugauaaggaauauaagagaaaagauaccacacugucgaguucagcaagaaagaagccaacuuauucaggaggauuaguuuuggaacccaagauaggcuucuaugauaagcucauuuugcuuauggauuuuaauucuuuguauccaaguauaauccaggaguacaauauuugcuucaccacucugccaguaacuaauagcgaggauaaucuaguuuuaccugaucgaggguuaccaccugguauauuaccuacugaaauuagaaaacuuguagaaagucggaggcaagucaagaaauugaugaauagugcugacauaucacuugauuugaaaaugcaguacaauauucgucaaauagcgcucaaauuaacggccaacaguauguaugguugucuugguuuuucgaauucacgguuuuaugccaagaaucuagcagcacuggucacccauaagggacgagagauucucacaaauacucgagauaugguugagaagauguguuaugagguaguuuauggugauacugauaguauaaugauaaacacaaacaucuuggaauacgaucagguauucaaaauuggaacaaaaauuaaacaagaagucaauaaauuguacaaacaaguggaacuugauauugauggaguauucaaguaccuucuguuguugaagaaaaaaaaguaugcugcuguuacuuugacaaaaauaaacgacaauaaauugaaggaggugaaggaauauaagggauuagacaucguaagaagggacuggucacagcuagccuguggagcuggugaauauauauuggaccacauuuugagugaucagucaccagaugauagaauaaauaauauccacgaguacuugagaaaaauaaggaaacauauggaggaaggucaaguuccuaucucucuacuaguuauaacaaagcaauugaccaaagacccaaaaauguauacugacaagaauucacugccucauguucaaguagcacuacgauacaaccaacaaaguggcggucauuucagggcuggggauacaguuccuuauguuauaugugaggauggcacuucuaauucugcuucucaacgugcuuaccauauugaggaacugaauaagucugaaacguuaaaaauagauguuaaauauuauuuaggacaacaaauacacccaguggugacuagaauuugugaaccgauagaagguacagauucuuuccaaauagcagaaugucuuggucucgauacuaacucuuucaaaaaacccaaacaacacucuauggaagucauugggcaaaacauuucuaagccugaagucaaguuuagaaauguggauaaauuuaaguucaaauguuacaucuguaagcaagagaaugucguugauaaucuguuggauggcaauauacguuuuuuggaaaaaugcaagaauucugaaugcggagucaggccuguagaguaccuaccuuauauccaaaaccagcuagcauuggcuauucaguuguacauuacuaaauauuaugauaaugaacuuacuugugaggauccagcuuguacgaacgaaacaaaucgacugccauugaaguuuuuuaagaaauauccugucuguacccuuugccagaaaggaguuauguaucgaacauauacugaacaacaacuuuacacgcaacucaccuacuuucagcacauauuugauuugggaaaacuaaauaaaggacuggacccugaccuggaaucuggauaucauucacuucgagaaacaguugaaaaauauuuaaaccacucagguuauucaguuauuaaccuuacggagcuguuuuccggauuucugguuagaaauaaacauccaaauacaauugaaaggauagacguaccauaugaagaacuugaaaauuucgaugaagaagaugaagaguuuuaa

SEQ ID NO: 7234 - RNA, 1398 nt, Leptinotarsa decemlineata
auggccgcugcagcugcugcgaaaaucguagaaguucgagagucaacuaaaguugaacgaauaggagcucacucccauauaagagguuuagguuuagaugacagucuugaggcuagacauguuucacaaggaaugguuggacaaguuucggcacgacgugccauuggugucguacuccaaaugguacgagaagguagaauagcugguagagcaguuuuguuggcuggacaaccaggaacuggcaaaacagccauugcuacagcuuuagcagcagcuuuagguguugacacucccuucacuagcauggcuggaucugaaauauauucucuagagaugaguaagacugaagcuauaacgcaggccauuagaaagaguauuggcguuagaauaaaggaagagagcgagaucaucgagggugaaguaguugagguacagauugaacgaccagcuacuggggucgguacgaaaguagggaaacucauuuugaaaaccaccgauauggaaaccgucuaugaucuuggugggaagaugaucgacaguauuuugaaggagaaaguucagucuggagauguaaucacuauagauaaagcuacaggaaaaaucacuagguuaggcagguccuuugcaagagcuagagauuacgaugcuacugggcaacaaacgagguucguacaaugcccugaaggugaacuccagaagagaaaagaagugguccauacuguuacauugcacgaaaucgaugucauaaacagcagaacgcaugguuucuuagcuuuguuuucaggugauaccggagaaaucaaagcugagguccgcgagcaaaucaacggcaaaguagcggaauggcgagaggaggguaaagccgaaauuauuccagggguuuuguucaucgacgaaguccacaugcucgacaucgaguguuucucguuccugaacagggcucuggaaaacgaaauguccccgaucguuaugauggcaacgaacaggggcaucaccaagaucagagggacgaccuacaagucaccucacggcaucccauuagaucugcuggacaggacgauaauagugccuacucagccauacgaggagaaggaguugaaggagauuuugagcauccguugcgaggaagaagacugucagaugucagacacugcccuggcuguucucacucgcauuugcaaagagaccucuuugcguuacggcaugcaacuuaucaugacuucgagucucauagcgaggaaacgcaaagcucacgagguagacguucaagacauuaaaagggcuuacgagcuguucuuugaugaaggcagaucugugcaguuuuugagggaguaccaacaggaguucauguucaaugauuuggaugacaaagaugauauggaaaucgaaacaaauuag

SEQ ID NO: 7235 - RNA, 1116 nt, Leptinotarsa decemlineata
auggcauugaggacauauggagacaagcccauaagcuuucaacuagaagaaaauggagaauauuauugugugggaucagagguuggaaacuauguccgacucuuccgagggucucuuuauaaaaaauauccuggaauguucagaagaucuauaaccaaugaagaaagaagacgauugauagaucuuggcuugagccaacauguuuuagcuaguagcguuucuuuguugaaagcaacagaaguugaagauaucauagaaggcaaugacgagaaguacaaagcuguaucaguucacacgucugaaccuccugcucccagagagagcaagucaaagaagaacaugcaauggguaccuuccuuaccaaauuccagucacuuagaugcaguuccccaagcuacaccuauuaauagaaauagaguugcaucuaagaagguuagaacuuuuccauuauguuuugacgauacagauccacaaauuaauguugaaaaugcuugccaaggagaaguauugguaccuauaagacucgacauggaaauugaaggacaaaaauugagagauaccuucacauggaauaaaaaugaaaguuugauuaccccagagcaguuugcugagguucuuugugaugaccuugauuugaauccucugacguuuguaccagcuauugcacaagcaaucagacaacaacuggaggcuuuuccagcugaaccuucaagcauuauugaggaaacuugugaucagagaguuauuaucaaacucaauauccaugucggaaauacuucuuuaguugaccagauugaaugggauaugagugaaaaacaaaauaaugcugaggaauuugcacugaaacuuugcgcagaacuuggccuagguggcgaauucguaacggcuauugcuuauuccauucguggucaauuaucuuggcaucaaagaacauaugcuuucagcgaggcaccuuugccaacuguggagguaccuuucaggacuccgagugagucugaucagugggccccauucuuggaaacuuugacugaugcugaaauggagaagaaaaucagagaucaagacaggaacacacguagaauccgacgauuagcaaauacuacuccugggugguag

SEQ ID NO: 7236 - RNA, 624 nt, Leptinotarsa decemlineata
auguuuuguuguuguucugaccaagaggacuacggaaaagguccgauggcugcaauacggaaaaaauugguuauugucggugauggagccuguggaaaaacaugucuguuaauuguauucaguaaggaucaguuuccagagguguacguaccaaccguguuugaaaauuauguagcagacauugaagucgauggaaagcaaguugaacucgccuuaugggauaccgcugggcaagaggauuaugaucgucuacggcccuuaucguauccagacaccgaugugauuuuaaugugcuucucgguagauucgcccgauuccuuggagaauauaccugaaaaauggacuccagaggugaaacauuucugcccaaaugugccaauuauucuggugggcaacaaaaaggaccugagaaacgauccuaguaccauuaaugaacuaaagaaaaugaaacaagaaccagucaaaccucaggauggucgaucuauggcagaaaaaaucaaugcuuuugcuuauuuagaauguucugcuaaaaguaaggaagguguuagagaaguauucgagaaugcuacuagagcugcucugcagguuaaaaagaagaagaagcaucguugcguaauauuuuga

SEQ ID NO: 7237 - RNA, 4014 nt, Leptinotarsa decemlineata
augaauacaucuacuuuccacaaucagagagccgauaccucacaaaaucccuugaauagaauggaacacgcgucuagaaacguugagaagucauugcaacuggacuguaacgcuccgaaacucguugaucucauggguaucgggccccaaacuggguccacagcuagcggucucauagaucaugacuauccuacauugucugcuuugccacucgucaacaacaauaugacucagaucaaaugcguaaacagcgugccucugccaucggaaauaguagaucauuuuacacauguucaaugucacuguaugauggguuuauuuucugaaaucaauagagcuuggcugacugucgauagcgauauuuaugucuggacauaugaagaaaacacugacuuggcuuacuuugaugggaucaacgagacuauccugugugugggauuggugacaccgaaaaauagaguuuuucaugcuuucaucaagcaccugcucaucuuagcaacuucggucgauauaguuguguuaggugucacauucacagaaaaacccggggaaaguacggaugaaauacagcuuauaccugauccgguauuuacuauucccacugacggaucgacuguuucaauuauaacaggaacugaggauggcagaauauuuuuuggaaccaaggaggggugcuuauucgaaauuucuuaucaggccgaaagcggcugguuuggcaaacgauguaagaaagucaauuuauccacuaguucuuucuccuucuuaguuccuuccuucuugaacgccgcccucagcgaagaugauggcaucacccaaauuucuauagacaacagcagacauauucuguacacucucaccgaaaaaggaaccaucgaaguaugcgaucugggagaaaaaggaaauucauuuucgaggauagcgaaaaugacucaaaacacucuggucaaccaggccaugaacacaguuaagacuuuggacagucaaaacuuccgucccaucaucagcaucuccgccauagaaucguucgagucugcaaaucugaaccuugucgcaguaucccaaacgggaaucagauucuacaugucgguggugagccuuuccaacuuucugccgaaucagagaccauacacuuugacucucguucacgugaggaugccuccuggauauucugccaacguaacggugagacccagggcgguccacgugucucaauacagggauaggaauucauuguugaucucaacuguuaaugagaaagacguuuugugguguauaaguucggauuuauuuccuuucagucaaacgcugauggaagccuauacuacggugaauuuggauggaccugcucuggcuguggcugagguucaucaauccguaccuuuauuguccacgcaaaacgaagaagcaccuccacugguuauccgccagcaugccgaaccaccgaaaaaguuuaucguucucacaucucacggcguucagauauucguuaaacucagaccuguggauuuguugcggcaaaucuugaaggacagucgcgggcaagagacggaagcgcugaagacuuucuucgccauccaaaaggaugaucaggcgugugccacuuguuugauucuggcaucgcuggaaaccaguaacacuagugagauuguggaguaugcgacaagggcguucuuccuuuucggaggggaaccaaaacuggcgccggucaguucaggaaauauguuuucaggagccucgauauucucuccaaacaucauaucuacuccugcuccgcaucaguuucagcagcagcagcaacaguuucagcagaauuugucucuuaccaugucgccagccaaccaaacucuugacaugauauguccguucauauuuucggccaagcauaauggacucuaucuguauuugaguaggauuuugagaccuaucugguaucgaagguguaucgaaagaacaacuguggauggaaaaacuauaacgaaccucaguacgauuucgagugaagacugcaucucgaucuugaccaaccugaccgccuugcauaauuuucugaugcacaacacucagcuuucggcuguuagcaccggaagcugcaacuugcagaacucugugucgcugaacaacacgucgaugaacaugacccgaaugaaucaaaccauacaggaugcccagcaagaggaaaagcagucucucaagucguugaagguguucgugugucacugcugccagauauuaggccuguggcagaucuugugcgaacaucaauuccauucguugaucggagcucucccggaaaaugagcagcagcuccugcagaauauggcguucaaagaucuguuccuguacaggcaggauaucuguucgcugcugaucaccaaucuagucgacaguuaccuuggcgauaaugcuuccgucgacucgaucaguaauaagcugagggaggucuguccucaucuguauaagacugaagacgcugcuuucucaaaggccaucgaaauucuuaaagcagcucgaacgauacaaaacgcagaugagaaggaagaaauguuauuguccgcucuacaaauuuguaagugcauaucgccgaauauaaauaugggugaaguuugcagggaguuuacaucucucaaagcguacagagcaguaauagaguuauguaugcauuacgguagaaugauggauccggaaaaaguugcggagaacuauuacaacacggacgauaauucggcggaucaggaggguuucaauuuuuaucaaagaaggauggaaaucuacaagcauauccugcaaaugcuggaauauguauauaaugaacagcagcagguucccaauaauagaugugaaccugacuauacuacuaaucaaucgauuuuguugaaugauaccagagaaucacagauuggauguacguugaaacaggucaucgaagaaauuuuggaaacccccgacgaaauaaugcaaguugcucuauaugaauggcuaguuucgaaaaauauguccggagaucucauaaaaauucacaacuccucuuuggaagucuacuugaaaaaaaccucugcucaaaauccgaauaauaucagugucauggaucucuuguggaaauauuacgaaaguaauaauaaucaugcagcagcugccaaaguacuaaauaacaucgcuuguaaaacaggaaauuaugugccauugaaagaaagacuguccuaccuugccaaagcuauaaugugcaugaggagugacaaaguggguuacgcaccuuaucugggagucuuuuugagagauuuggaggacagaauggaaguggccaaggugcaagaacagauacaagaggccauuucgaauuugcaagggcagguaccgaacgugcaagaagcugucgccgcucuaaauucuggcuuguacgaaauuucacaacuguaugaaaacuuugcggaaccguucaaacuacuggaaugccaacuggcgaucauugacuguuccgguuacagugauaaaguucuaguagaaucgauuuggcagcaaauuuuagccgacgaacugagaaaggcgucuggauccgucaacgacaaacucagccaaguuuuagcuaaaguuaaacacuuggccaagcaguacucaaaaucaguuuauacuuuuccguuagauucaguuaucuucgaauuggaaucggucaacuccaaauugaaaggugacaagagacuuguuccagaagcuuuggaaucugugaauauuccauucgaaguuuuaauuaaugcguauaacaauuugaaccaaaugucgcacaaugaccguuucuggcagcuggaagagcacgaguuccaucuggcugaagcuacugcugcuuuaauugauuguuuccucaauaaaagugacuguuacaacagcauagaaaagagaaaacuugcuucuaugugucaggauacugugguaggcuuacuuucgcauuuauauagcaaaccgaacacugaccauuugguuaauaggauaagagguauucaagcaagacuuucgaggauuuga

SEQ ID NO: 7238 - RNA, 3843 nt, Leptinotarsa decemlineata
augaccgaauuuacauuaaauuaccgugaaaucacaccagaucaaacuguuuccgauaacuggaaagaaauuacgcuuacaacaggugggacucaaaguacucuccaagacauaaaggucgcugaaagagcaaauggcuucuguuacgaagauucuacaaaacaccauaccaggaacagauuuauuuauuggagaaucaacuaugacauucuggaauuaguagaacacagucuugaugugaaucuaacagcaaaucgagugagguacagauucacagacacuccuauuuuagacggagugucaauauaugaaacauaugaaaaugugauagucuuaguuccuacagugugcaguguacaucguuugauauuuccacauccugaaagauuucacagacaagacgagcuuuuaggagcuuacacagaucuuucuguuccaucaauuuuuucuaaagcuucagcaauugaugcaagaaauccaucuaccuuuuauguguucaguaaucccaguacugccagugaccaacuuccaaauuuggcuaguucuuauuuguuuccugaaacugaggaagccuucuuuguacuagcuuauccgucuacagaacucuuacuuaucaaacagaacccugaugauggacaaguugucgccacagaauugaaaggcgaaucucugaugcccagauuuuugucgggacuugcagagaaauuucgacagaaaaauucagauggaagcaauauagucagucucuuauucuacgugguggauuaugaaacauauguguuaacucuaagcagggacggacauuugaaauucuggucuugugcuaaaggacaguguguggcaguaguugauauucucgaaaaaucaggggaggucucaagaaccaggauccaaucagcaaguuuaaggaaagcugucgacggaaacagcagcgaaagucuguuggcuguguuuuugaguuuugcuaauggaugucaguuucaaauuuugagccccguuauaagaggacaggaaauuacaguggaucguuuggauacgagacauucuccagagagugaccucaucgauuuugcucuccaaacaaaucguuuguggacagcauggagaugugaagauggcgaaugugugguauacacuacuucucuucaaccaggaaugagccaaucuucucgccacucggguuuguuacaaucuaguaacugggcccccguugucuuggaaacaauaccagacgcaaaucaagcaccugucaaugauggcgagagcgauccgagacagauauauuugcaacacauuuuccacccuggacgguuuccuaugcauaucauuaccaaagcucuaucuauuuauaaaagaucgacucuuguagcagaaacacauauuucugcuucuauacugaaacaaaggauaugucuggcugucgauaaugaaauccagaacacucuaaacggaacaaauguaacugaugaugaauaucuagaaugugcagagugguguuggcagaaauuuuauucuugcuguguucaguaccaaauagcaagucugaaaccuuuggguuugaugcucuugccuucugugucaggagcaguauuucucaaaaaguccuccuuuucuuucuugaggccuuuggacccauuggaacacaugacucucuguaacgauagcacauacagcgaccaguuugucaacuuuucaauguuagcugaagauguagaaaccaccgacgauguuaugagacuuuuugaaguguugguuuauuuggaacaacaaaugagugaaauguucauucaagcauucgaaaaggaguuguuuaccuugcaaguaccggauauuguaauggagaauauuuuagaaaaaauucaaucggaaauggauugucaauucacaucucauaucuugaacaugcucaacaacaucguugauuuauacagagccaugcacaaaguuuuggaacuuuuaagauacgaaaacacacuagccaauccagauaacgaaauaaacccaucagcgauguuccauuucaguucccaguugggcacaucuguuguagcggguuguuugaagcaacaagccgagaucagguuucagaucugccggaaucuccuucucgucuguaacauuuugcugagugguaaagcuuuugacaguggcguuuuggaagcuauaaggucuguguguaugccggaaauagugguuuugacacaagcuaguuaugugaugcucugguugaguggacugucagcguuggguaauuuaccacaagacuccggcaugcagaaacugacaccccucaaauuggcaccaguuuuuaauuugagaccugccggcauauucauaucucuacuggaacuuuucaucucuucaacuggaggacaggaagcuaggaaaucauuugccagggugaacuguagaggugaagauuuggcacauuggcaucuuucguuauuaccuuuccugaaccauuuaaggcauauuauauggccaauaagugguggcacgguucuagccgagugguuguugaguaguggccaacauuuaugguugcagcaauauguuagauuacuaggcaauuggugugaauggaacagcuguacacgaaacuuuuuacucgcugcuucuuuucugacuacgggcgaaaacuacaaagcucaggaacuguucgaaagagcagccaaaggaauuuuuacugauaccuuccugcaagagagagucuuaaaaggugcugaagacaauccgacaaaggcauauaucaauuauuauuugaaggucauucaacuguucgaguuacauaaggccagagauugugcaauaaguauugcaaauacugcacugaguguugucgaaccaacugacccucuuacggccacccuguacucgaucaaauucaaacaucagcuugcccugaaacacuacgagcucgcuuucgacucccuuuauucgaauccggaugcugagcguaaaaaggauaacuugagagaccugguaaaaacauuacuggacgaaaaaaaguuggacaaguuacugaacuucaccuauggaaauuuggaugaauuuuucacgaauauucuguugagcagagcuagagcaucagauggaaucaauaauaucuucuaugauuuucuuuacucguaccaaauuaagaggggagcacuuucucauagauuagcugcuucuguaauguacgagcaagcauucagauuaaaucacaucaauacugcagaaucuuuggaaaagcaagugaaaugcuaucuagcggcuaaaaacguguuacaacucuguaaaccggaacaugcuuggguagugagaccaucugacccagaugaagaagaggaggaaauuaucauucaaccguuggcaggauccaaacaggaacugaaaguagugaagcuacaaaaacagguugaaguagucaacaucgaaguuauaaagacugaacugauuuucgcaagcgcuaaacucaaacuagcuagauucaauagugcugcaccggugacuauuacaagcgcaguggaguugguaacucuucucaacaacgcaggucuuuucaagaccucauuggaaauuuguaagacuuucaaccuaccauacagcagcguuuuugaaacucuuaccaaacacugugucaaucucacugaacaggaccagccaacugcuuggaacuggcuuguagagaacgacuuacaagaucuuccugucaauagagacagugccucugauguuguauggcaauuauuacaggacuacuuagaaaaguacgagcagccauauaugacaacuuuacauuacguagucuguaagaaaaucaucaauaugaggauguacauaccucacuggcucuuggcu

SEQ ID NO: 7239 - RNA, 2115 nt, Leptinotarsa decemlineata
auggaaauaucugaggaaaaccuaaaaacauuggcaaaauauuuacaggaaacucucaauccugauauuaacgucaggaggccggcugagaaguuuuuagaaggagucgaggucaaucaaaauuaucccgugauucucuuaaauguaguuaauaaaucagauguugauaugacuauucgcauugcuggagcuguagcauucaaaaauuauauuaagcgaaacugggaauuagaagaaaaccaagcggaucguauccacgagucagaucgagcagaaauuaaaaauucaauuguaacucuaauguugaguucaccagaaaugauacagaaacaauugagugaagcaauaaguauuauugggaagauugauuuucgcauggaauggccaaacuugauuccacaaaugguugaaauguuugccacaggcaacuucaaugugauuaauggugugcuucgaacagcacauucucuuuucaaaaaguauagauacgaguucaaaucucaaaaacuguggauggaaauaaaauauguacuugagaaaauagcgcaaccucuuaccgaucuuuucauugcaacaauaaaccuuucccaaacucaugccaaugauguaaaugcauugaaaguaaucuauaguucuuuaguucucauaugcaaaguguuuuauucuuuaaauuuccaagacuuaccagaauucuuugaagauaauauucaaguuuggaugucaaauuuucacacuuugcuuacuguggagguaaaaagucuucaaaauaauaacagugaagaagcuggaguuauugaacaacugaaaucucaaguaugugauaacauugcucuguaugcucaaaaauaugaugaagaauuucaaccuuuucugcaacaguuugugacugauacuuggagccuucuaguuggaaccggucucgaaccuaaauacgaucugauaguuucaaaugcccuacaauuuuugucgucaguagcagaacgggcaaaauauagaaguuuauuugaagacgauacuguuuugaguaguaucugugaaaaaguaaucauaccuaauauggaguuuaggguaucugacgaagaauuguuugaagacaauccugaggaauauacucguagagauauugaagggucagauguugacacaagaagaagagcugucugugaccuaguaaauacucucagucagaauuuugaaaagagaauuauugagauuuuuggucaauauuuacacgugauguugacaaaauaugcagaaaauccgaaacaauuuuggcgaaguaaagauuccgcucuguauuuaguuacuucucucgcaagcagaggaucaacacaaaagcauggaguaacucaaacuagucaacuuguuaauauaacucaguuuugccagcaacaaguuuuaccggaauuagaaaggccagauguaaacgaacuaccaguucucaaagcagacgcaauaaaauaugucaugacauucagaacaauuuuacccaaugaaauuguggucaguacuuuaccucaauuaauaagacacaugucuagugagagugcuguuguacauaccuaugcagcaugugcuuuggaaaaaauucuuaucaugaagaauaacaauaaucaaccaaucguaucuggaaugcagcuagaaacuaucucgaacgauuuguuuucaaacuuguuugccauauuggaaaggccaguuucagaacaaaaugaguauguaaugaaagcuauaaugcgaacguuugcaacccugcaagaaagaguuauaccauuuuuaaauaugucucuuccaaaacugacagaaaaauuacaaaugguggcuaaaaauccuucaaaaccccauuucaaccauuaucuauucgaaaccuucucacuugcaaucaggaucguuugcaaagcaaaccaaucagcuguaacauccuuugaagauauccuuuuccccaucuuccagggaauucugcagcaagauauucaagaauucaucccuuacguuuuccaaauucuuucccuacugauggagaauacgccuacugguucaauaccugaaccauauaugcaacuauugccaugucuguuagcaccuauucuuugggagaggccugcuaauaucaauccu

SEQ ID NO: 7240 - RNA, 609 nt, Leptinotarsa decemlineata
auggcaaaaguucaauuguguaauauuacaguaauggacaauccuagucaauuuuugaacccuuuucaguuugaaauuacuuucgaaugcauagaagaacugaaagaagaucuagaguggaaaaugauauauguaggcucugcugaaagugaagaguaugaucaaguauuggauucaguauuuguuggccccauuccagaaggaaaacauauguuuguauuucaggcggauccuccaaauguaucucgaauucccgagaaugaugccauaggagucacugucgugcuauuaacauguucauacagaagucaagaauuuauuagaguaggauauuuuauuaauaaugaauacagugacccagaauugagagaaaaucuucccagcccaccacaguuugauaagguuguaagaaauauuuuagcaucggaaccaaggguaacuagauuuaaaauaaacugggaagagacaaacccacaagaaaaugugacacauacggaacaaacugcgacagggucgucaguuaauguagaaaauaacagcaguacuccagcugauguaccaucuuucaacgaaaauucaaacuccugggcaacaauggaauguucguaa

SEQ ID NO: 7241 - RNA, 927 nt, Leptinotarsa decemlineata
auggaucaaaugcuaccuaguccaggguuuaguauacccagcauagggacgccucuucaucaaccggaggaagaucagaugauccucccuaaugcccuucagcagcagcagcaaccuagcacuucucaaguuccacccuuggcaccaauggguggucuaacgccaacuuugggucucggcaugggccaugccaugucuaugaccccaacuaaguauguuacuggauucgcucuuccaaugaguaccauuacccagcaaacuccacaacauacuaugaugaguccucugguuaacuuggggggaucaguaguuaccggaucaacacccaccauggcuccagcaaccccuucuccauugacuccaaugacuccacauucugcugauccaggaauaauuccucaacuacaaaauaucguaucaacaguuaaucugaacuguaaauuggacuugaaaaaaaucgcccuccacgcaagaaaugcugaauacaauccaaaacguuuugcugccgucauaaugaggauacgagaaccccguaccacugcauuaaucuucuccuccgguaaaaugguguguacaggcgcuaaaagcgaggaagacuccagguuggcugcaagaaaauaugccaggaucauacaaaaacuugguuucaaugcgaaauuccuugauuucaaaauccaaaacauggucggcagcugcgacguuaaauuucccauuagauuagaggggcucgugcucacucacaguucuuucaguaguuacgaaccugaauuguuccccggauugaucuaccgaauggugaaaccuaggauaguucuguugauuuucguuuccggaaagguuguguuaacgggugccaaaguuaggcaagaaauuuaugaagcuuuugauaauauuuauccuauauugaaaaguuucaaaaaacaguga

SEQ ID NO: 7242 - RNA, 474 nt, Leptinotarsa decemlineata
auggcagcaguacgaucaguuucccgacuuuuuucuuugagaucccucacuacaacugcgaagagaaguuaugcugauaugagcuucacuuuugcugcuggaaaucaggucuauuacgaugcuaaaucaguuaaacaaguugaugucccaucauuuucuggcaguuuugguauuuuaccagcucacguacccacacuagcaguccuuaaaccgggaguagugacagucuaugaagaaggaggcaaugucaacaaaauuuuugugucuaguggaacuguuaccaucaaugaggauucuucaguacaaauucuagcagaagaagcacacccuguuggaaaccuagaugcuucagcagccagagaaguucuuagcaaagcacaaagugaauuaucgucagccacaacugaugaggcacgagcagaagcggcaauugcuguagaagucggugaagcuuuagugaaagcaguugaauaa

SEQ ID NO: 7243 - RNA, 972 nt, Leptinotarsa decemlineata
augaguggcaguggugacaaaacugaacauuucgauucuauguuccucucgauugcucagcaucauccagaaggagcuucucagcuucucgauacauucgucaguuuucucggaaggaaaacagauuucuucacuggaggaaaagagggggaaugggagaagcuaguuaugaauacauucagaaagcaugaaaaacaaaguagagaaaagcaagaagcugagcugaaagagaaacgugagagggaagcucgagcaaaagcagcugcagcaaaaaaagcugaagcugaaagaguugagccugccaaaauaacagaacuaacugaugcugaagccgaacagcuucaggccgaaauaaacgcaaagaaaaauccgucaucguccaguucacaaccugcugccccuaucggagauaaaaucaaggaagacgaagaugaaucagaaaaggggaagauuuugccgaacaaaggaaauggcugugauuuggacaaguacaaguggacucagacuuugggcgauauugagcuucgagugccacuaaacgucaacuucagagucaagcagaaagaucuugugguuaaccuuacgaagaaacauuugacaugcggaaucaaaggucaaccgccuaucauaaacgacgauuuuccuuaugaaaucaagcuagaagaauccacuugggucauagaagauggaaaaucacuguuguucaauuuagaaaaggugaauaaaaugaacugguggaacaaacuaguuaacucagauccggaaaucagcacaaagaaaauaaacccagagccgucuaaguugagcgaucuagauggugaaaccagggggcuagucgagaaaaugauguaugaccaaagacagaaggaaaugggacuucccacuagugacgagcaaaaaaaacaggacgucauuaaaaaguucauggagcagcacccagaaauggacuucucaaaaugcaaauucaauuga

SEQ ID NO: 7244 - RNA, 474 nt, Leptinotarsa decemlineata
augcagucucauaguggugcacauuuaggucauguaccuguuuuacaguggagccccgauaagaaacauagugauagagaaagguggauauguauuuacccagcuuauaucaauaauaagaaaacguuagcucaaggaagaaagauaaauaaggauaaaugcguugaaaacccaacacaccaagaaauuagagauguauuaguggcagcaaaucuuaaaauaggaguugaaaauaaauuauauagcagagaaaaaagcaaggaaccucuuuaucgaggcagaauuagaguucaauugaggaaugaugacggaaguuuguucaauagcgcuuucccaaccagagagagcauaauguaucaucuuggugaaaugauuccuaaauuaaaaucuagacaaaauaaaggugcaggggaagcaccacaacaagcaucaaccagcaauaaggggaaaggaaagggcaaaggaaggcgauga

SEQ ID NO: 7245 - RNA, 1068 nt, Leptinotarsa decemlineata
gaggaaucucagaaagacauacaacgugcaagaucaguuugggagagagcuuuagacguggaucaucagagagucccaauaugguuaaaauauacagaaauggaaaugagaaaucggcagguaaaccaugcaagaaauuugugggaucgagcuguuacgauauuaccuaggauugauacuuuuugguacaaauacacuuauauggaggaaauguuggaaaauguaccuggagcccgugcugucuuugaacgauggauggaguggcagccugaugagcaggcauggcaaacuuacaucaauuuugaacuucgguauaaagaaauugauagagcuagacaaauauaugaaagguuuguuaugacucacccagaaguuaaacacuggauuaaguaugcaaaauuugaggaaaaacaugguuucauucauucugcucgcaaaaucuuugaacgugcuguuaauuuuuuuggugacgaucauuuggacgaaaauuuguacauugcuuuugcuaaauucgaagaaaaucagaaagagcaugaaagagcaaggguaaucuacaaauaugcgcuugaucacauacccaaagaccagacuaaagaacucuauaagucauacacaauacaugaaaaaaaauauggagacaaaagugacauagaugaggugauugaaucgaagcgaaaauuucaguacgaacaggaaauuuugcaaaauccaacuaauuacgaugcuugguuugauuauauuagguuaguagaaggugaaggagacuuagaauuuaucagagagacguaugaaagagccauugccaacauaccuccuucaaaucaaaagcaauuuuggagaagauauauauaucuuuggauaaacuaugccuuguuugaagaauuagaagccaaggacuaugaccguaccaggcaaguguauaaggcguguuuagaguuacugccccacaagguuuucacuuucucaaaaauaugguugcuuuuugcaaaguuugaaauuagacaaaaaaaauuuaacuccugccagaaaaauucuuggaauggcuuugggaauguguccgagggauaa

SEQ ID NO: 7246 - RNA, 930 nt, Leptinotarsa decemlineata
augggaauuaaauuucuggaggugaucaagccguuuugcaguauucugccugaaauagcgaagccagaaagaaaaauucaauucagggagaagguacuauggaccgcaauaacucuauucaucuucuuaguuugcugccagaucccucuauuugguauaaugaguucagauucugcagaucccuucuacuggauucgaguaauucuagcaucgaauagagguacucuuauggaauugggcauaucuccaaucgugacaucuggauuaauaaugcaacuuuuggcuggagccaaaauuauagaaguaggcgacacuccuaaagacagggcucuguuuaauggugcacaaaaauuguuugguaugguuaucacugucggucaagcgaucguuuauguaaugaccggcauguauggagacccugcagaaaucggagcgggagucugucuucugaucaucauccagcucuuuguggccggucucauagugcugcugcuagacgaacuucuucaaaaaggcuacgggcucgguucgggaauuucccucuuuaucgccacuaacaucugcgagaccaucauuuggaaggcuuucucuccagcaacugucaacacuggacgcggaaccgaguucgagggagcagucaucgcucuuuuccacuugcuuaccacccgacaggacaaaaucagaggacucagggaggcguuuuaccgucaaaaucuacccaaucugaugaaucuucuagcuacagucuuuguauuugcuauagugauauacuuccagggauucagaguagauuuacccaucaagagugcuagguaccguggccaguacucgagcuaccccaucaaacuguucuacaccucaaacauccccaucauccugcaaucugcgcuugucucuaaccuguacgugaucucgcagauguuggccguc

SEQ ID NO: 7247 - RNA, 486 nt, Leptinotarsa decemlineata
auggccaugaucacuacuccuucgguggaucucaguucuuaucgugaccaacauuucaaagguacuagagcugagcaagacaaacuauugagaguuacuucuacuuuguauguaggaaaucuuucuuuuuauacaacugaggaacaaauuuaugaacuauucucgaaauguggggauauaagacggauagugauggguuuggauaaguacaaaaaaacuccaugugguuuuugcuuuguagaguauuauacucgaauugaugcagagaacugcuuaagguauauuaauggcacccgucuggacgauagaauaguacgaacugacugggaugcugguuucauagagggacgacaauaugguagaggaaaaacgggugggcagguaagagaugaauauaggacagacuuugacucuggaagaggugguuauggcaagauuauccagcagaagauuggggguauugaaaccccugcguuuuuaagauaa

SEQ ID NO: 7248 - RNA, 432 nt, Leptinotarsa decemlineata
gaagcugcccgugcugccaacaauggugccuaucccccggaucuuagcuacauuaccucugccagacauggaggugaggacuacaucuucgcccuacuaacaggcuacugcgauccucccgcgggcguggugcugcgagaaggccaguacuucaaccccuacuucccaggaggggcuauuucaauggcgcaagcccuguacaacgaagccaucgaguauuccgaugggacgccugcaacggccagccaguuggccaaagauauauccacuuuccugaaauggaccgcggaacccgagcacgacgacaggaagaaaaugcucaucaaauguauaggcauauucgcgaugcuggcaggucuuugcuacuacaugaagagacucaaguuuucuucgcugaagacgcguaagaucgaguucaggcccaagaaguag

SEQ ID NO: 7249 - RNA, 1710 nt, Leptinotarsa decemlineata
auguuggcuuuacaacaguauucaggaaguagugaugaagauuguggagaggauacucauucuucaaauguggaaguguuuccaacuauuccuaaaaauucacaguuauuacaaaaacagcuugcgauauguucggcucccgacguaauuccaacggguuuaaaugaagaaaacauuuauauccauccugaaacaacagaacuaaccuucaaucccaaguaugaagaguuguuugcuccauugguuggaccaaaaaauccuuucaaaacacaacaacaaaguaucgauagaaacauuuuaucaggccauguagaaccugcucaugucagugauuuucaguuugaaaaccaaagacgaacuuucacaagcuaugguuaugcccucgauccaucuguuaguacugauggucagguuaaagugguagguuccacagaugacggcaaaaauccugaugauaucaaaacuguuuuugaaucaucaaaggacagaccuuuggacaaaaggaaacguaaaagaaaugcugacccuagcgacauugaugguuuuuugggaccguggggugguuuugucgaugaacaaaaaauugcuaagccuagugaagaagaacaagcagaauuagaugaacuaauaucuaaaaagaacaaaagagguaaaccuacagaagauaaaccuguugaagagaaaucuguucuucacaucaaggacgcuguugauuaucaaggucggucauucuugcaugcuccacaagauguagguguuaaucuuaaaucagacacaccaccagaaaaaugcuuuuugccaaaaucucauauucacaccuggucaggucauuccaaaggaauugcagccauacgaugguuuccaagaacagcacauuuauuuuuaucagcuaguauggauugucguauuaaacuuugggaaguguauaaugaaagaagauguguaaggacauauuauggucaucgacaagccguaagggauaucaauuucaauaacuccggaaaacacuuccucucugcugguuaugacagauauaucaaauuaugggauacagaaacagggcagguucucucaagauucaccagcaggaaaauuccuuacugugucaaguucaauccugauaagaauaagcagcacuuauuuguugcgggaacuucagauaaaaaaauaauaugcugggauacuagaucaggugauauuguucaagaauaugauaggcauuuaggagcagucaauucaauuacauuuguggacgaaaacaggagauuugugaccacgucugaugauaagucacugagggugugggaaugggauauuccaguggauaugaaguauaucgcugacccaacuaugcacagcaugccugcagucacuccagcaccgaauggaaaguggcuugcuugucagagcauggacaauaaaauagucaucuuuucggcuaugaaucgcuucaaaauaaaccgcaagaaaacuuuuacuggucauaugguagcagguuaugccugcaguuuagauuuuucaccggauaugaguuacuugguuucuggagaugccgauggaaaguguuauauuugggacuggaagacaaccaaacuuuauaaaaaauggaaagcacaugacaauguaugcauaagugcuuuguggcauccucaugaaucuagcaaacugauaacggcagguugggauggacucauuaaguauugggauuaa

SEQ ID NO: 7250 - RNA, 807 nt, Leptinotarsa decemlineata
augguccagaaaaagcccaagaagaaggucggaaagaaaguugcagcugcuccuuuggcagucaagaaaguagaguccaagaaggagguuaacccucuuuucgaaaagaggguaaggaacuuuggaaucggucaggauauucaaccuccacgugauuuaucgagguucgucaaauggcccaaauacauucgaauucaaaggcagaaggccguuuugcagaagagauugaagguuccuccgccaaucaaucaguuuacucaaaccguugacaaacaaacagccacccaguuguucaaacuccuagagaaauacagaccagagacggcucuccaaaaaaggaauaggcugaaggcuaaagccgaagcuaaaguggccaagaaagaggaagccccuaccaagaggccaaacacccucagggcuggaacuaacacuguuacuaaacucauugaacagaagaaagcucagcugguagugauugcccacgacguggacccuauugaguugguguuauucuuacccgcccucugcaggaaaauggguguaccauauugcauagugaaaggaaaagcuagacugggacuuuuggugaggcgcaaaacuugcacugcaguagcucuuacccagguugauucuggugacagguccaacuucaacaagguuguggaggucaucaaaaccaacuucaaugaccgcucagacgaaaucaggagacacugggguggugguuuguuggguuccaaauccgcagcucguaucgccaagaucgaaagggccagggcuaaggaacucgcccagaaacaggguuga

SEQ ID NO: 7251 - RNA, 1002 nt, Leptinotarsa decemlineata
augacgaccuuaaccaaagauauuacgcuucaagaaaacauuccaucaaacauucuuauggaaaaacauauugaauucaucagagacuaugggcaaaaagaaaauagcuaugaauauggaaugacggauuaucuucgaguaucugguauguacuggggucugacagcuuuggaacugaugaacacuucaccaccucagaguaaagaugagauugcgaaguacaucaaaagcugccaagacccggaaaguggaggaauuagugcuugucagaaacaugauccucauauccuccacaccuugagugcugugcagauucuuugcauuuaugacaacuuggaugcuguagacauugaagccgucguuucuuauguagccagucuucagcuaccugaugguaguuucaugggcgauaaauggggagaaguugauacgagauuuuccuuuugugcaguugcgauucuguccuuguugaauaagauggauguaauugaugugaacaaagcaguggauuucauugcuucgugcaggaauuucgacggugguuucgguucaagacccuuaucagaaagucaugcuggucuuauuuauugcuguguuggauuuuuaucuaucaccaauagguuagauaucguuaaccgugauacuuuagccugguggcuuugcgagcgucaacuuccuuccgguggguugaauggucgcccugagaaacucccagacguuugcuauucauggugggucuuaucaacccucacuauacuuggaagacuacauuggaucgaugcaagugcacuaaagaacuucauuuuggcaugccaagacucugaaacaggaggauuugcugauaggccuggcgauauugcugauccguuccauacuuuguuugguuuagcagcaaugucgcucuuaggacaugagucuguacagaaagucaauccuacuuacugcaugccacagaaugucaucgauagacugcagcucaagccucagagacuaacagauuga

SEQ ID NO: 7252 - RNA, 2346 nt, Leptinotarsa decemlineata
augcaucaagaaacucuucaacucauucagauucuggaaaaaacaguuucucccgauaaaacugagcuagaacaagcuucaucuuuucuggaacaagccgcggcuaccaacuuguuagaguucauaaaaacuuuaucugauaucuugagacauggagguaauagcccuguggcucgcauggcagcugguuugcaacucaaaaaucaauuaacuuccaaggauccaucuguuaaaacaaccuaucagcaucgcugguuagccuuuccugaagaaaucaggaauuauauuaaaaaaaauguuguuggagccuuagguacagaaacuaauagacccucuucugcagcacaaugcguagccuauauugcgguaacagaauugccucagaggcaauggccagauuuaauagcaaaucuggucagcaauguaugccaaggaaacucuacagaaaugcagaaagaagcuacccuggaggccaucggcuacauuugccaggagauugauucugauguacucguaacccagucgaaugauauauuaacugccaucguucacggaaugagagccaccgaaccaagcaaucacguacguuuggccgcaacgcaagcucugcucaacucucuggaauucaccaaagccaacuuugaccaaccuaccgagaggaauuauauaauggaaguugugugugaggcaacucagucucccgagucucaaauaaaagucgccgcccuccaaugcuugguuaagauaaugucguuguacuaucagcacauggaaccauacauggcuccggcgcucuuuccgaucacgcuggaagcgaugaaauccgaaaacgaugccguggccuuacagggcauugaauucuggucgaacgugagugacgaggaaguagaucucgcgauugaagauuccgaggcuacugaagcgggaaggccuccagcuagaguuuccagacauuaugcaaagggagcccuacaguacaucguucccauccugcuucagaaacucaccaaacaagaagaacucgaugaugaagacgauuggaauccgaguaaagcagcaggaguuuguuugaugcuucucgccacauguugcgaagaugagaucguuccccacguucugccuuucaucaaagacaacaucaaauccgauaauuggagauucagagaugcuucgcugauggccuucggguccauccucggcggauuggaaagcacgacuuugaagccguuagucgagcaagccaugccgacuuugauagagcucauguacgacaauagcguuauugugagagacacagccgcguggacuuucgguagaauaugcgaaauaauaccagaagcagccauaaacgaaacguauuugaaaccucuucuggaaaguuugauaaccggucucaaggccgaaccccgagucgccgcuaacguaugcugggccuucucugguuuggucgaggcggcguacgauaacgccgauguuagcgacgaaaugggaacgccagacacauacauucucucucaguacuuugaguucaucauucagagacuucuugagacuacggaccggccggacggcgcucaggccaaucucagaccagcugccuacgaggcgcugauggaaauggugaagaauucuccgaaagacugcuacgucaccguacagaaaacuacgauggugauucuggagcggcugcagcaagugcuccagauggaaacgcauauaaguagucacaaugacaggucgcaguucaacgaucuccagucucuuuugugcggaacucugcagucgguucucaggaaggucacuccugaagaugcaccacaaauaucugaugcgaucaugacagcaauguugaccauguucaauucaaauucuuguaaaaauggaggaguucaagaagaugcuuuaauggcugucuccacuuuaguugaaguacugggugaaggauucauaaaguacauggaugcuuucaaaccauuccucuaucuuggauugaagaaccaccaggaauaucaaguguguggcacagccgugggcuuaacuggcgauauuuucagagcccucaaacucaaaguucugccauacugugaugaaauaaugacacugcuucuagaaaauuuaggcgaccaaucuguccaucgcagcgucaaaccccagauacuguccguauucggagauaugguucucagcauuggaccggaauucaagaaguaucuggacgucguucuaucaacucuugcucaggcuucucaggcgcacgucgauagaaacgauuucgauaugauugauuaccucaaugauuugagggagggaguauuggacgcuuacacgggaauaauacaaggacuc

SEQ ID NO: 7253 - RNA, 1503 nt, Leptinotarsa decemlineata
auggaaaccauuuuggaacagcaacgaagauaucaugaagaaaaagaacguuugauagaugcuauggugaaagaaaugcugacuaaaaaaacaauguaccgcgaagcgauaaauucagaccaucgucaaaaguuucuauuggacagauauaugacugcuacagaccgcuuaauugagcuuuaugaagauaaagauggucagcguaaagcugaaguugcaucuuuaacuggcccaaaugaauuucaagaauuuuacaauaggcucaaacaaaucaaagacuuuuauagaagacauccaaaugaaauaagcgugcccaugucuguagaguuugaugaauuugcuaaggcaagggaaaauccaaacgaugauauggccaauuuuguggaauucacagaugaggagggauacggaaaguauuuggaucugcacgaguguuaugaaaaauacauaaaucuaaaaggaauugagaaaguagauuacaucacguaccuuggaauguuugaucaacuuuaugacauucccaaagaaagaaaaaguggugaauaccgaaaauauuuauuaugucuuauagaguauuugaugugguuuguccaaaggaucaagccauuaauggauuuagaaagugguuuacaggaagaaguugauagaguuauugcuacaugggaaaguggcacaguaccuggauggccuaaagaaacggguucugcuuuagccaauguuggugcacauuuggaucuuucugcauuuuccagcugggaagaauuggcuucuuuaggucuggaucgucuuaaaucugcucuuauggcauuagggcugaaaugcggagggacuuuggaagaacgagcucaaagauuguuuucaaccaaaggaaaagguucuuuggauccuucucuuaugacuaaaaccaauaaaggaaaagcuagcaaagaaaaggaacaacuucgucaaagggagcuagcuacauuggaggcacagguuuacagauuggcagaauuaguugcuguucagagaacagcaacaaaagagaauguacaaagaaaacaagcacgcacagauggugaacgugaugauagcgaaaaugaagaaagugaugaugacaguccugaugagggugacgacgauguuccauauaacccuaaaaaucuuccucucggaugggauggaaagccuauuccauauuggcuguauaagcuucaugguuugaauauaaguuacaauugcgaaauaugcggaaacuauguuuauaaaggaccaaaagcuuuccagagacauuucgcugaguggagacacgcccauggaaugagauguuuaggaauuccaaauacugcacauuuugcgaauguuacacagauugaagaugcuuuagccuuaugggaaaaacugaaaguucaaaaacaaagugaacguuggcaaccugaaacugaagaagaauaugaggauucucaaggaaauguaguuaaccgaaaaacuuaugaggaucuuaagagacaaggucuuuuauag

SEQ ID NO: 7254 - RNA, 642 nt, Leptinotarsa decemlineata
augacuaucggcaagaauaauaagaugauggcucaccucaacuacaggguacgaguaacuuuacaggacucccgaacauuuauuggaacuuucaaagcuuucgauaaacauaugaacaugauccuaggugauugugaagaauuucguaaaaucaaacccaagaauucaaaaguggaaagggaagagaaacgaguuuuaggguuuguuuuggugagaggggagaguauugucucauuaacuguggaaggcccgccaccuccugaagagggcuugcccagaguuccuauuccaggagcagcaccuggaccaggaauagguagagcuuccggaagaggcaugcccccaggaaugggaggaguacccguugguuugcagggaccgguaagaggggucgguggaccaucgcagcaagucaugacaccagguggaagaggacaggugucugccccaccccaaaugaaucaaggucccccaaggaugggugguccaccaccagguguaauggggcccccuccaggaaugaugggaaugccuccucaaaugggcaugggacgaggaggcccuccaccuccgaugggaaugagaggaccuccaccugguaugaugagaggaggaccuccugggccaccaaggccauacuag

SEQ ID NO: 7255 - RNA, 1059 nt, Leptinotarsa decemlineata
augaugagugaugcugauuuuaccaauuacuuccgcaugaaucgcaaccaguuuuuugauguucaugggaugauucaacaagacauugacucaaauggauguaaugcucaaaagccgauaucaacagaggaaaaacuugcaguuuucuugagauauuuggcuucuggagacagcuacaaaaguauugcuuauaacuaccuguugggagaucgaacagugucuaauauuguccaagaaguagcuaccgcuauauggaauaauaugcaaccagucuauuuagccgaacccaaaacagaaacauggaaaucuauagcuuuacgguuugaggauagauggcaauuuccacacugcgucggugcugucgacggaaaacauauuguuauuaaaaaaccaggcaaaaguggaucaucauacuuuaacuauaaacauacauucucuauuauuuuaauggcaacaguggacgcggauuauaaauuuaucacaauagauauuggagcgaugggaagauuuagcgauggaaauguauuugcaaguaguggauugggcaagaaaaugaucaaacacacuauacuacuucccaauccugaacaaauaccuacgauugccgagccucugccguauguuuuuguuggagacgaggcuuuuccuuuaucggaaaaucuaaugagaccauauccaagaaggcaaauaacuggaaauuaucaacaccaaguuuucaaugcacgacuuucucgagcucggcaaacaguggaaugugccuucgguauacugucuucgcgguuucgcguauuccgaagaccauuugaaaguaaaguggacacugugagagauguaguaaaagccgcuuguguuuugcacaacuacuuacgacccucagcccugguagaagauguaaaugauaucgaacagcugccacaaacucaacuguuacauguucaaggaaacagggcgagaacuucauuagcugcauuuagagucagggauaguuuuacggaauauuuuaacaauuguggggcacuuccuuggcaacaucaauccguuaugcuuggaaaguauuga

SEQ ID NO: 7256 - RNA, 1221 nt, Leptinotarsa decemlineata
accagcgacgaugaguucauaaugcaaggaaaaaccaaaaaguauaaccuaguuccccauacuggcgaacuauugaacaugcacggcgcgccggaaucgccggaucaagaagagaugacugcagaaccaucuccugaagcaaucgaugaagaaggcuugaauaauuaugacgguucugaguugcugauuauugaucaaaauaacaagucucccgaagauucgauuucgacaaaagaagauuucgaggaacuuauugacgaaggauccagaaaaaauaacuugucuaaaagagaaauuaccacuaaacacuugaacgacuuucacaaguaugcuaauauuuucaauuauaccaaaaacguucaaaccauacaaacuccaccgcaaaauacugguagaguuaccaauguaccacagaaaaugacuccaaaaauuucucucaucggcaauucuguaguacauagcgccaagacgguugcagacaaacuuauccuaacaccuucagcgacaacgguuauaaacacaacgcaagcaucaaaaguuacaagcaucauuuuaacucacaacucugcuguuaggggaaauguuaucaaugucacaaagguugugagcaccguaucaccagcuauaacuauaguuacugcuagcacuucacaaauagccucaauuuugccuuccaaauucacggugcccgucauaagugcuagcgcugugcgacaccuaucgaacguuaaaguaauagauaagccaucguccucucuaucgcucacuucccacgacagugccuugcccaacaagauauuugaagaugacuccguuucuccagauaguuccaauuucgaagacgacaaguccaaagacucuuucgaagagaaguccaagucugaaucgcccacucaagacgcgaaaccuccaguauucuccaagaauguugaagucacuaucaauaacugcguuccgccaaaagcugugaucgacuauaaacccaaggaacaggaacagacaaaaaagaucgaacaucuccaaguaaccaaucuaguaucuaaagaacauguucagaaacauaggguuccuagcccuauaauaucgaaaacuucuucgccuaugauuauucacaauacucccgaacucaaaaugacggcacaggucauucaggagacgcaaacgcacaugcagaugaguucaacuaccaacacgguugaugcauaugguggcuccauagac

SEQ ID NO: 7257 - DNA, 20 bp, Artificial Sequence
  Synthetic polynucleotide
cacgaaccgtacacatatct

SEQ ID NO: 7258 - DNA, 20 bp, Artificial Sequence
  Synthetic polynucleotide
gtctgtttgtgtcatcctct

SEQ ID NO: 7259 - DNA, 20 bp, Artificial Sequence
  Synthetic polynucleotide
tatgaagccaccgaagaaaa

SEQ ID NO: 7260 - DNA, 20 bp, Artificial Sequence
  Synthetic polynucleotide
gtaccacgaggatctagaga

SEQ ID NO: 7261 - DNA, 20 bp, Artificial Sequence
  Synthetic polynucleotide
cagctcacagaagagaagtt

SEQ ID NO: 7262 - DNA, 20 bp, Artificial Sequence
  Synthetic polynucleotide
gtgaatcaaaaccgtccatc

SEQ ID NO: 7263 - DNA, 20 bp, Artificial Sequence
  Synthetic polynucleotide
gccatttctttagcaggaac

SEQ ID NO: 7264 - DNA, 20 bp, Artificial Sequence
  Synthetic polynucleotide
tgtgagatcaactcttccac

SEQ ID NO: 7265 - DNA, 20 bp, Artificial Sequence
  Synthetic polynucleotide
tgttgatggagattgaacgt

SEQ ID NO: 7266 - DNA, 20 bp, Artificial Sequence
  Synthetic polynucleotide
cactcattcctaacaccaca

SEQ ID NO: 7267 - DNA, 20 bp, Artificial Sequence
  Synthetic polynucleotide
ccgggaaacaatatggaaga

SEQ ID NO: 7268 - DNA, 20 bp, Artificial Sequence
  Synthetic polynucleotide
tcattctttgttggtgcatg

SEQ ID NO: 7269 - DNA, 20 bp, Artificial Sequence
  Synthetic polynucleotide
tcggcagaaaatctctcaaa

SEQ ID NO: 7270 - DNA, 20 bp, Artificial Sequence
  Synthetic polynucleotide
agttcggtatcagaggtgta

SEQ ID NO: 7271 - DNA, 20 bp, Artificial Sequence
  Synthetic polynucleotide
agaagatttggtatccaggc

SEQ ID NO: 7272 - DNA, 20 bp, Artificial Sequence
  Synthetic polynucleotide
caaccagacatagcatctct

SEQ ID NO: 7273 - DNA, 20 bp, Artificial Sequence
  Synthetic polynucleotide
agcgcacctaataatatgca

SEQ ID NO: 7274 - DNA, 20 bp, Artificial Sequence
  Synthetic polynucleotide
gaaagtgtcaatttggtgca

SEQ ID NO: 7275 - DNA, 20 bp, Artificial Sequence
  Synthetic polynucleotide
atgccaagaatgatcccaat

SEQ ID NO: 7276 - DNA, 20 bp, Artificial Sequence
  Synthetic polynucleotide
ggcaaagctcaggaaaaatt

SEQ ID NO: 7277 - DNA, 20 bp, Artificial Sequence
  Synthetic polynucleotide
gaaccaaccttagatgagct

SEQ ID NO: 7278 - DNA, 20 bp, Artificial Sequence
  Synthetic polynucleotide
cgacaaatgcaattagtccc

SEQ ID NO: 7279 - DNA, 20 bp, Artificial Sequence
  Synthetic polynucleotide
gcactatcagacagatcgtt

SEQ ID NO: 7280 - DNA, 20 bp, Artificial Sequence
  Synthetic polynucleotide
ccatacaggtgaccagaaaa

SEQ ID NO: 7281 - DNA, 20 bp, Artificial Sequence
  Synthetic polynucleotide
gaagatgtggacgttatcga

SEQ ID NO: 7282 - DNA, 20 bp, Artificial Sequence
  Synthetic polynucleotide
ataaccgcctgtgttattgt

SEQ ID NO: 7283 - DNA, 20 bp, Artificial Sequence
  Synthetic polynucleotide
gactatgccgctatggatag

SEQ ID NO: 7284 - DNA, 20 bp, Artificial Sequence
  Synthetic polynucleotide
tacgttgattcctgcagaaa

SEQ ID NO: 7285 - DNA, 20 bp, Artificial Sequence
  Synthetic polynucleotide
cagcaatgccttagttgatg

SEQ ID NO: 7286 - DNA, 20 bp, Artificial Sequence
  Synthetic polynucleotide
tttgtcttctgtcaggtagc

SEQ ID NO: 7287 - DNA, 20 bp, Artificial Sequence
  Synthetic polynucleotide
cggttaccatcaaaaccatg

SEQ ID NO: 7288 - DNA, 20 bp, Artificial Sequence
  Synthetic polynucleotide
ttgaacgttttgcgaatttc

SEQ ID NO: 7289 - DNA, 20 bp, Artificial Sequence
  Synthetic polynucleotide
aggggcttattaatatggcg

SEQ ID NO: 7290 - DNA, 20 bp, Artificial Sequence
  Synthetic polynucleotide
gccctcgaaactaaggttaa

SEQ ID NO: 7291 - DNA, 20 bp, Artificial Sequence
  Synthetic polynucleotide
gttaaggggaggtatgcaaa

SEQ ID NO: 7292 - DNA, 20 bp, Artificial Sequence
  Synthetic polynucleotide
ggcttctacttccaaagtga

SEQ ID NO: 7293 - DNA, 20 bp, Artificial Sequence
  Synthetic polynucleotide
tctggcaaggctacaatatc

SEQ ID NO: 7294 - DNA, 20 bp, Artificial Sequence
  Synthetic polynucleotide
atcccgttcagcctttaatt

SEQ ID NO: 7295 - DNA, 20 bp, Artificial Sequence
  Synthetic polynucleotide
aaacttcctgtcaacctgtt

SEQ ID NO: 7296 - DNA, 20 bp, Artificial Sequence
  Synthetic polynucleotide
atatgcaagctcatcatcgt

SEQ ID NO: 7297 - DNA, 20 bp, Artificial Sequence
  Synthetic polynucleotide
gctcaggaaatgggagttaa

SEQ ID NO: 7298 - DNA, 20 bp, Artificial Sequence
  Synthetic polynucleotide
ttgcttagcaaatccaggat

SEQ ID NO: 7299 - DNA, 20 bp, Artificial Sequence
  Synthetic polynucleotide
cgaactcacacctgtagaaa

SEQ ID NO: 7300 - DNA, 20 bp, Artificial Sequence
  Synthetic polynucleotide
gcttcttcgtcaatttccag

SEQ ID NO: 7301 - DNA, 20 bp, Artificial Sequence
  Synthetic polynucleotide
agtagtgctgacttggaaag

SEQ ID NO: 7302 - DNA, 20 bp, Artificial Sequence
  Synthetic polynucleotide
tgggacaggattttcatcag

SEQ ID NO: 7303 - DNA, 20 bp, Artificial Sequence
  Synthetic polynucleotide
agaaatggacgagcttttct

SEQ ID NO: 7304 - DNA, 20 bp, Artificial Sequence
  Synthetic polynucleotide
ggaattttctccccagtgat

SEQ ID NO: 7305 - DNA, 20 bp, Artificial Sequence
  Synthetic polynucleotide
attggcaatcaaaaacgtgt

SEQ ID NO: 7306 - DNA, 20 bp, Artificial Sequence
  Synthetic polynucleotide
tcggcatctctgtttgttaa

SEQ ID NO: 7307 - DNA, 20 bp, Artificial Sequence
  Synthetic polynucleotide
tacaaaaagggcgaatctca

SEQ ID NO: 7308 - DNA, 20 bp, Artificial Sequence
  Synthetic polynucleotide
ctttcaccatcaatacccca

SEQ ID NO: 7309 - DNA, 20 bp, Artificial Sequence
  Synthetic polynucleotide
cttatgccgataatggaggg

SEQ ID NO: 7310 - DNA, 20 bp, Artificial Sequence
  Synthetic polynucleotide
tatctctttcagcagcagag

SEQ ID NO: 7311 - DNA, 20 bp, Artificial Sequence
  Synthetic polynucleotide
ttaacatgttcccggacatt

SEQ ID NO: 7312 - DNA, 20 bp, Artificial Sequence
  Synthetic polynucleotide
gttgttacagaatccttgcg

SEQ ID NO: 7313 - DNA, 20 bp, Artificial Sequence
  Synthetic polynucleotide
cctgtttcagacaaaaaccc

SEQ ID NO: 7314 - DNA, 20 bp, Artificial Sequence
  Synthetic polynucleotide
atcctaacttttcagggctg

SEQ ID NO: 7315 - DNA, 19 bp, Artificial Sequence
  Synthetic polynucleotide
ctctaaaggcgaccgaaaa

SEQ ID NO: 7316 - DNA, 20 bp, Artificial Sequence
  Synthetic polynucleotide
tgcaatgaaaatggaaagca

SEQ ID NO: 7317 - DNA, 20 bp, Artificial Sequence
  Synthetic polynucleotide
gggtagggttgaaaatgcta

SEQ ID NO: 7318 - DNA, 20 bp, Artificial Sequence
  Synthetic polynucleotide
tagtatgggctgctctaagt

SEQ ID NO: 7319 - DNA, 20 bp, Artificial Sequence
  Synthetic polynucleotide
gctgtaaatttgggatctgc

SEQ ID NO: 7320 - DNA, 20 bp, Artificial Sequence
  Synthetic polynucleotide
accaacataaccgattgaca

SEQ ID NO: 7321 - DNA, 20 bp, Artificial Sequence
  Synthetic polynucleotide
tatggctgtgtatgaacgag

SEQ ID NO: 7322 - DNA, 20 bp, Artificial Sequence
  Synthetic polynucleotide
cttcagaaggtacagcttgt

SEQ ID NO: 7323 - DNA, 20 bp, Artificial Sequence
  Synthetic polynucleotide
agataatgagagacccggaa

SEQ ID NO: 7324 - DNA, 20 bp, Artificial Sequence
  Synthetic polynucleotide
gttcgggaaattgctgttag

SEQ ID NO: 7325 - DNA, 20 bp, Artificial Sequence
  Synthetic polynucleotide
gccccaaaactgagatatct

SEQ ID NO: 7326 - DNA, 20 bp, Artificial Sequence
  Synthetic polynucleotide
caataagaccaactttccgc

SEQ ID NO: 7327 - DNA, 20 bp, Artificial Sequence
  Synthetic polynucleotide
gaaaacagttggccactaag

SEQ ID NO: 7328 - DNA, 20 bp, Artificial Sequence
  Synthetic polynucleotide
caaaaagcccgaccaaataa

SEQ ID NO: 7329 - DNA, 20 bp, Artificial Sequence
  Synthetic polynucleotide
taacagatgtttgccgtaca

SEQ ID NO: 7330 - DNA, 20 bp, Artificial Sequence
  Synthetic polynucleotide
gttcttgcagtcctctacaa

SEQ ID NO: 7331 - DNA, 20 bp, Artificial Sequence
  Synthetic polynucleotide
agcagctttggttgatgata

SEQ ID NO: 7332 - DNA, 20 bp, Artificial Sequence
  Synthetic polynucleotide
cacttgtttccgcagtattc

SEQ ID NO: 7333 - DNA, 20 bp, Artificial Sequence
  Synthetic polynucleotide
ttcttacgcctcaattcaca

SEQ ID NO: 7334 - DNA, 20 bp, Artificial Sequence
  Synthetic polynucleotide
tgctgttgaagaccatgtaa

SEQ ID NO: 7335 - DNA, 20 bp, Artificial Sequence
  Synthetic polynucleotide
cagctacaaagagtccagtt

SEQ ID NO: 7336 - DNA, 20 bp, Artificial Sequence
  Synthetic polynucleotide
tccaaaacttcaccgaatct

SEQ ID NO: 7337 - DNA, 20 bp, Artificial Sequence
  Synthetic polynucleotide
cgagcctacaaaattggaac

SEQ ID NO: 7338 - DNA, 20 bp, Artificial Sequence
  Synthetic polynucleotide
tcggtttctttgcttcaaac

SEQ ID NO: 7339 - DNA, 20 bp, Artificial Sequence
  Synthetic polynucleotide
tctccgtaagaagaggaagt

SEQ ID NO: 7340 - DNA, 20 bp, Artificial Sequence
  Synthetic polynucleotide
cctggtctcgatgaaataca

SEQ ID NO: 7341 - DNA, 20 bp, Artificial Sequence
  Synthetic polynucleotide
tactggagtgagtgtagagg

SEQ ID NO: 7342 - DNA, 20 bp, Artificial Sequence
  Synthetic polynucleotide
tcttaatggcgagttgttca

SEQ ID NO: 7343 - DNA, 20 bp, Artificial Sequence
  Synthetic polynucleotide
ctccctcatgatggttgaaa

SEQ ID NO: 7344 - DNA, 20 bp, Artificial Sequence
  Synthetic polynucleotide
gagtaacgtgaacccttctt

SEQ ID NO: 7345 - DNA, 20 bp, Artificial Sequence
  Synthetic polynucleotide
tacttggctaaaatccgcat

SEQ ID NO: 7346 - DNA, 20 bp, Artificial Sequence
  Synthetic polynucleotide
tacttagcacctccgatttg

SEQ ID NO: 7347 - DNA, 20 bp, Artificial Sequence
  Synthetic polynucleotide
ggtcgtctttttcaagttga

SEQ ID NO: 7348 - DNA, 20 bp, Artificial Sequence
  Synthetic polynucleotide
atttgttaaggcctcttcca

SEQ ID NO: 7349 - DNA, 20 bp, Artificial Sequence
  Synthetic polynucleotide
tgggaaacgatgaacaatct

SEQ ID NO: 7350 - DNA, 20 bp, Artificial Sequence
  Synthetic polynucleotide
gtcaacttagtgatctcgct

SEQ ID NO: 7351 - DNA, 20 bp, Artificial Sequence
  Synthetic polynucleotide
atgccctaaattgcactgta

SEQ ID NO: 7352 - DNA, 20 bp, Artificial Sequence
  Synthetic polynucleotide
aattgttccctgctactcag

SEQ ID NO: 7353 - DNA, 20 bp, Artificial Sequence
  Synthetic polynucleotide
gctccaggaagtttctacaa

SEQ ID NO: 7354 - DNA, 20 bp, Artificial Sequence
  Synthetic polynucleotide
ggtccttcaatagacactcc

SEQ ID NO: 7355 - DNA, 20 bp, Artificial Sequence
  Synthetic polynucleotide
tcctgattcagttgactgtg

SEQ ID NO: 7356 - DNA, 20 bp, Artificial Sequence
  Synthetic polynucleotide
ccagaatactcgttccagag

SEQ ID NO: 7357 - DNA, 20 bp, Artificial Sequence
  Synthetic polynucleotide
gacaaagatcgtaatccgga

SEQ ID NO: 7358 - DNA, 20 bp, Artificial Sequence
  Synthetic polynucleotide
ttatcagtaaccgccttacg

SEQ ID NO: 7359 - DNA, 20 bp, Artificial Sequence
  Synthetic polynucleotide
taccgtccaaatgcttacaa

SEQ ID NO: 7360 - DNA, 20 bp, Artificial Sequence
  Synthetic polynucleotide
tagatatttcgaaccctgcg

SEQ ID NO: 7361 - DNA, 20 bp, Artificial Sequence
  Synthetic polynucleotide
aagaaggtaaggccaaagag

SEQ ID NO: 7362 - DNA, 20 bp, Artificial Sequence
  Synthetic polynucleotide
cttgttgaaagtccgctaac

SEQ ID NO: 7363 - DNA, 20 bp, Artificial Sequence
  Synthetic polynucleotide
cgggaaattcaaacaacaca

SEQ ID NO: 7364 - DNA, 20 bp, Artificial Sequence
  Synthetic polynucleotide
gtttgactgtctatttgcgg

SEQ ID NO: 7365 - DNA, 20 bp, Artificial Sequence
  Synthetic polynucleotide
ttcaaagtggtggaaactga

SEQ ID NO: 7366 - DNA, 20 bp, Artificial Sequence
  Synthetic polynucleotide
tcatgttcttcgtgtggatt

SEQ ID NO: 7367 - DNA, 20 bp, Artificial Sequence
  Synthetic polynucleotide
atttagttcccagcttgtgt

SEQ ID NO: 7368 - DNA, 20 bp, Artificial Sequence
  Synthetic polynucleotide
cagttaagggctgaactgat

SEQ ID NO: 7369 - DNA, 20 bp, Artificial Sequence
  Synthetic polynucleotide
agtagagacacaagccaaag

SEQ ID NO: 7370 - DNA, 20 bp, Artificial Sequence
  Synthetic polynucleotide
tattcgcgattgtccatctt

SEQ ID NO: 7371 - DNA, 20 bp, Artificial Sequence
  Synthetic polynucleotide
ttggcacagacgtgtaaata

SEQ ID NO: 7372 - DNA, 20 bp, Artificial Sequence
  Synthetic polynucleotide
aacttctcttcttgtcgtcc

SEQ ID NO: 7373 - DNA, 20 bp, Artificial Sequence
  Synthetic polynucleotide
gacgcctgaaagattgaaag

SEQ ID NO: 7374 - DNA, 20 bp, Artificial Sequence
  Synthetic polynucleotide
tgtctttcttcttctctgcc

SEQ ID NO: 7375 - DNA, 20 bp, Artificial Sequence
  Synthetic polynucleotide
aaggagtgtggacaaaaact

SEQ ID NO: 7376 - DNA, 20 bp, Artificial Sequence
  Synthetic polynucleotide
atttgttgaaacggttccac

SEQ ID NO: 7377 - DNA, 20 bp, Artificial Sequence
  Synthetic polynucleotide
accctttgtgctactttagg

SEQ ID NO: 7378 - DNA, 20 bp, Artificial Sequence
  Synthetic polynucleotide
caaattggcaatggtctgtt

SEQ ID NO: 7379 - DNA, 20 bp, Artificial Sequence
  Synthetic polynucleotide
gggaagtcacggatacttac

SEQ ID NO: 7380 - DNA, 20 bp, Artificial Sequence
  Synthetic polynucleotide
tggatgcaatcattgtggta

SEQ ID NO: 7381 - DNA, 20 bp, Artificial Sequence
  Synthetic polynucleotide
ggcaattggctttagaaaca

SEQ ID NO: 7382 - DNA, 20 bp, Artificial Sequence
  Synthetic polynucleotide
gggattgaacataggaggtc

SEQ ID NO: 7383 - DNA, 20 bp, Artificial Sequence
  Synthetic polynucleotide
ccggtgaagtttatagaggg

SEQ ID NO: 7384 - DNA, 19 bp, Artificial Sequence
  Synthetic polynucleotide
ctctagtaggaggtccacc

SEQ ID NO: 7385 - DNA, 20 bp, Artificial Sequence
  Synthetic polynucleotide
ctcaagtggctccagttaat

SEQ ID NO: 7386 - DNA, 20 bp, Artificial Sequence
  Synthetic polynucleotide
ggattggagacaccttcatt

SEQ ID NO: 7387 - DNA, 20 bp, Artificial Sequence
  Synthetic polynucleotide
agaaaatgaacgtatggcac

SEQ ID NO: 7388 - DNA, 21 bp, Artificial Sequence
  Synthetic polynucleotide
ttgtgaacctctagacagttt

SEQ ID NO: 7389 - DNA, 20 bp, Artificial Sequence
  Synthetic polynucleotide
ttcaagtattcgaaggcaca

SEQ ID NO: 7390 - DNA, 20 bp, Artificial Sequence
  Synthetic polynucleotide
taggcatagtcaagatggga

SEQ ID NO: 7391 - DNA, 20 bp, Artificial Sequence
  Synthetic polynucleotide
agcaatattcaaggaccagg

SEQ ID NO: 7392 - DNA, 20 bp, Artificial Sequence
  Synthetic polynucleotide
ctttgaccacctccagttaa

SEQ ID NO: 7393 - DNA, 20 bp, Artificial Sequence
  Synthetic polynucleotide
agaggaacaacaccaagttt

SEQ ID NO: 7394 - DNA, 20 bp, Artificial Sequence
  Synthetic polynucleotide
cgaagaggcaagaaattgtc

SEQ ID NO: 7395 - DNA, 20 bp, Artificial Sequence
  Synthetic polynucleotide
ccaactgggagagaatgaaa

SEQ ID NO: 7396 - DNA, 20 bp, Artificial Sequence
  Synthetic polynucleotide
gacatgtgcaacgaatcttt

SEQ ID NO: 7397 - DNA, 20 bp, Artificial Sequence
  Synthetic polynucleotide
cttgactggtgaattcgaga

SEQ ID NO: 7398 - DNA, 20 bp, Artificial Sequence
  Synthetic polynucleotide
atccttctcgatttgttgct

SEQ ID NO: 7399 - DNA, 20 bp, Artificial Sequence
  Synthetic polynucleotide
gattccaaggcgattttctg

SEQ ID NO: 7400 - DNA, 24 bp, Artificial Sequence
  Synthetic polynucleotide
tgaaggatgatgatctacttaaca

SEQ ID NO: 7401 - DNA, 20 bp, Artificial Sequence
  Synthetic polynucleotide
gataaaatgcgaaatggcca

SEQ ID NO: 7402 - DNA, 20 bp, Artificial Sequence
  Synthetic polynucleotide
cagtttcatctgtcacaacg

SEQ ID NO: 7403 - DNA, 20 bp, Artificial Sequence
  Synthetic polynucleotide
agaaaatcacgagagagctg

SEQ ID NO: 7404 - DNA, 20 bp, Artificial Sequence
  Synthetic polynucleotide
gtgtctcctcctcttgtaag

SEQ ID NO: 7405 - DNA, 20 bp, Artificial Sequence
  Synthetic polynucleotide
aggaaattgggaaaactggt

SEQ ID NO: 7406 - DNA, 20 bp, Artificial Sequence
  Synthetic polynucleotide
ttccttccaagtcctttacg

SEQ ID NO: 7407 - DNA, 20 bp, Artificial Sequence
  Synthetic polynucleotide
aacttggctagaaagactgg

SEQ ID NO: 7408 - DNA, 20 bp, Artificial Sequence
  Synthetic polynucleotide
ccctttgaaggtttcctgta

SEQ ID NO: 7409 - DNA, 22 bp, Artificial Sequence
  Synthetic polynucleotide
agaactagagaatcatttgggt

SEQ ID NO: 7410 - DNA, 20 bp, Artificial Sequence
  Synthetic polynucleotide
tcccttgatctggatcttga

SEQ ID NO: 7411 - DNA, 20 bp, Artificial Sequence
  Synthetic polynucleotide
tggcgtgggaaatgtattta

SEQ ID NO: 7412 - DNA, 20 bp, Artificial Sequence
  Synthetic polynucleotide
aagtgatcgttccaaatgga

SEQ ID NO: 7413 - DNA, 20 bp, Artificial Sequence
  Synthetic polynucleotide
tttgaaacgtcctcagcata

SEQ ID NO: 7414 - DNA, 20 bp, Artificial Sequence
  Synthetic polynucleotide
ttccatgtgtacttgtccag

SEQ ID NO: 7415 - DNA, 20 bp, Artificial Sequence
  Synthetic polynucleotide
aaatcggtcctttaggtctg

SEQ ID NO: 7416 - DNA, 20 bp, Artificial Sequence
  Synthetic polynucleotide
gcgcttttccatcaattgta

SEQ ID NO: 7417 - DNA, 20 bp, Artificial Sequence
  Synthetic polynucleotide
cagcagagcatttgacaaaa

SEQ ID NO: 7418 - DNA, 20 bp, Artificial Sequence
  Synthetic polynucleotide
ccattctaacccattgtcca

SEQ ID NO: 7419 - DNA, 20 bp, Artificial Sequence
  Synthetic polynucleotide
ggcgagtttaatgaagtgtt

SEQ ID NO: 7420 - DNA, 20 bp, Artificial Sequence
  Synthetic polynucleotide
tcaccgaaatagcagtttga

SEQ ID NO: 7421 - DNA, 20 bp, Artificial Sequence
  Synthetic polynucleotide
atccccacattgtaaccttc

SEQ ID NO: 7422 - DNA, 20 bp, Artificial Sequence
  Synthetic polynucleotide
gtcaagccattttctcgaag

SEQ ID NO: 7423 - DNA, 20 bp, Artificial Sequence
  Synthetic polynucleotide
ggatcattgcgacattgaaa

SEQ ID NO: 7424 - DNA, 20 bp, Artificial Sequence
  Synthetic polynucleotide
cttcctctttcttggcatct

SEQ ID NO: 7425 - DNA, 20 bp, Artificial Sequence
  Synthetic polynucleotide
gaatgaagcagacacattgg

SEQ ID NO: 7426 - DNA, 20 bp, Artificial Sequence
  Synthetic polynucleotide
ctatacgttgcaaatacgcc

SEQ ID NO: 7427 - DNA, 20 bp, Artificial Sequence
  Synthetic polynucleotide
caccatcgcctattacttca

SEQ ID NO: 7428 - DNA, 20 bp, Artificial Sequence
  Synthetic polynucleotide
ctcttgatctagctgcgatt

SEQ ID NO: 7429 - DNA, 20 bp, Artificial Sequence
  Synthetic polynucleotide
aggcaaaaccactttattgc

SEQ ID NO: 7430 - DNA, 19 bp, Artificial Sequence
  Synthetic polynucleotide
gaggatggagcacatgaac

SEQ ID NO: 7431 - DNA, 20 bp, Artificial Sequence
  Synthetic polynucleotide
aattcagatatggatgccgt

SEQ ID NO: 7432 - DNA, 22 bp, Artificial Sequence
  Synthetic polynucleotide
attattgtactcctgtaaggct

SEQ ID NO: 7433 - DNA, 20 bp, Artificial Sequence
  Synthetic polynucleotide
ggagaaggcatttaaggaca

SEQ ID NO: 7434 - DNA, 20 bp, Artificial Sequence
  Synthetic polynucleotide
tatgacagaagcgacaaaca

SEQ ID NO: 7435 - DNA, 20 bp, Artificial Sequence
  Synthetic polynucleotide
tttcctacccttttgagtcg

SEQ ID NO: 7436 - DNA, 20 bp, Artificial Sequence
  Synthetic polynucleotide
agctttgcttttgacattcc

SEQ ID NO: 7437 - DNA, 20 bp, Artificial Sequence
  Synthetic polynucleotide
gacaaaacagtccatgcaaa

SEQ ID NO: 7438 - DNA, 20 bp, Artificial Sequence
  Synthetic polynucleotide
accgatagtggggatttaga

SEQ ID NO: 7439 - DNA, 20 bp, Artificial Sequence
  Synthetic polynucleotide
aaaaacacggagttggaaac

SEQ ID NO: 7440 - DNA, 20 bp, Artificial Sequence
  Synthetic polynucleotide
attctcaactggcttcgatt

SEQ ID NO: 7441 - DNA, 20 bp, Artificial Sequence
  Synthetic polynucleotide
gagttggtgcaagtttgaag

SEQ ID NO: 7442 - DNA, 20 bp, Artificial Sequence
  Synthetic polynucleotide
gctttttcggagtccatttt

SEQ ID NO: 7443 - DNA, 20 bp, Artificial Sequence
  Synthetic polynucleotide
attgaaagaccagctacagg

SEQ ID NO: 7444 - DNA, 20 bp, Artificial Sequence
  Synthetic polynucleotide
atctgacatttggcaatcct

SEQ ID NO: 7445 - DNA, 20 bp, Artificial Sequence
  Synthetic polynucleotide
cagcattgtcttgcaagtag

SEQ ID NO: 7446 - DNA, 20 bp, Artificial Sequence
  Synthetic polynucleotide
gtaagttctttgatgccagc

SEQ ID NO: 7447 - DNA, 20 bp, Artificial Sequence
  Synthetic polynucleotide
cgaaagaaattggtgatcgt

SEQ ID NO: 7448 - DNA, 20 bp, Artificial Sequence
  Synthetic polynucleotide
tttcaaacacttccctcaca

SEQ ID NO: 7449 - DNA, 20 bp, Artificial Sequence
  Synthetic polynucleotide
ggtttggaaaacgctgtaaa

SEQ ID NO: 7450 - DNA, 20 bp, Artificial Sequence
  Synthetic polynucleotide
cacctctgctaaagctagag

SEQ ID NO: 7451 - DNA, 20 bp, Artificial Sequence
  Synthetic polynucleotide
ataacattacacacaggggg

SEQ ID NO: 7452 - DNA, 21 bp, Artificial Sequence
  Synthetic polynucleotide
acgttttcttcagtttcttgt

SEQ ID NO: 7453 - DNA, 20 bp, Artificial Sequence
  Synthetic polynucleotide
agacagcaacaatcaagcta

SEQ ID NO: 7454 - DNA, 20 bp, Artificial Sequence
  Synthetic polynucleotide
ccaaaaagccaggcaattta

SEQ ID NO: 7455 - DNA, 21 bp, Artificial Sequence
  Synthetic polynucleotide
acatttgaatgcattgaggaa

SEQ ID NO: 7456 - DNA, 20 bp, Artificial Sequence
  Synthetic polynucleotide
gaatttgggattgagttgca

SEQ ID NO: 7457 - DNA, 20 bp, Artificial Sequence
  Synthetic polynucleotide
accaaatgcattacaacagc

SEQ ID NO: 7458 - DNA, 20 bp, Artificial Sequence
  Synthetic polynucleotide
caataccaagccctctagac

SEQ ID NO: 7459 - DNA, 20 bp, Artificial Sequence
  Synthetic polynucleotide
acttttgcctcaggaaatca

SEQ ID NO: 7460 - DNA, 19 bp, Artificial Sequence
  Synthetic polynucleotide
cttcagccttagcctgatc

SEQ ID NO: 7461 - DNA, 20 bp, Artificial Sequence
  Synthetic polynucleotide
ggatttctcggtcgaaaaac

SEQ ID NO: 7462 - DNA, 20 bp, Artificial Sequence
  Synthetic polynucleotide
atctctttctgtcgctgatc

SEQ ID NO: 7463 - DNA, 20 bp, Artificial Sequence
  Synthetic polynucleotide
tggatttgtatctatcccgc

SEQ ID NO: 7464 - DNA, 20 bp, Artificial Sequence
  Synthetic polynucleotide
tactaagtcgggtcttcagt

SEQ ID NO: 7465 - DNA, 20 bp, Artificial Sequence
  Synthetic polynucleotide
agtgtataaggcctgtttgg

SEQ ID NO: 7466 - DNA, 20 bp, Artificial Sequence
  Synthetic polynucleotide
atctcttcccaaccttgttc

SEQ ID NO: 7467 - DNA, 20 bp, Artificial Sequence
  Synthetic polynucleotide
caggacaaaattagggctct

SEQ ID NO: 7468 - DNA, 20 bp, Artificial Sequence
  Synthetic polynucleotide
ccctatagcacccaaaaagt

SEQ ID NO: 7469 - DNA, 20 bp, Artificial Sequence
  Synthetic polynucleotide
atttcaaaggtacacgagct

SEQ ID NO: 7470 - DNA, 20 bp, Artificial Sequence
  Synthetic polynucleotide
cctcttcctgcatcatagtc

SEQ ID NO: 7471 - DNA, 20 bp, Artificial Sequence
  Synthetic polynucleotide
ggccttgtttgagtcagata

SEQ ID NO: 7472 - DNA, 20 bp, Artificial Sequence
  Synthetic polynucleotide
atataccaatggcccgaatc

SEQ ID NO: 7473 - DNA, 20 bp, Artificial Sequence
  Synthetic polynucleotide
ctctgggaagtttacaacga

SEQ ID NO: 7474 - DNA, 20 bp, Artificial Sequence
  Synthetic polynucleotide
agagaaccaatacacacacc

SEQ ID NO: 7475 - DNA, 20 bp, Artificial Sequence
  Synthetic polynucleotide
ccctggttgttaagaaggtt

SEQ ID NO: 7476 - DNA, 18 bp, Artificial Sequence
  Synthetic polynucleotide
gtgccttctgatctcgtc

SEQ ID NO: 7477 - DNA, 20 bp, Artificial Sequence
  Synthetic polynucleotide
cagtgaaccagtacaaggaa

SEQ ID NO: 7478 - DNA, 20 bp, Artificial Sequence
  Synthetic polynucleotide
cctcctgtttctgtatcctg

SEQ ID NO: 7479 - DNA, 20 bp, Artificial Sequence
  Synthetic polynucleotide
tggaggtgttcaagaagatg

SEQ ID NO: 7480 - DNA, 20 bp, Artificial Sequence
  Synthetic polynucleotide
tcctcagttctttagttgcc

SEQ ID NO: 7481 - DNA, 20 bp, Artificial Sequence
  Synthetic polynucleotide
agttagcttctctgggtttg

SEQ ID NO: 7482 - DNA, 20 bp, Artificial Sequence
  Synthetic polynucleotide
ctcttcttcagtttcaggct

SEQ ID NO: 7483 - DNA, 20 bp, Artificial Sequence
  Synthetic polynucleotide
aattacgcttcaggactctc

SEQ ID NO: 7484 - DNA, 20 bp, Artificial Sequence
  Synthetic polynucleotide
catacccatagcgttaggtg

SEQ ID NO: 7485 - DNA, 20 bp, Artificial Sequence
  Synthetic polynucleotide
tcagactaattgttcggcaa

SEQ ID NO: 7486 - DNA, 20 bp, Artificial Sequence
  Synthetic polynucleotide
ctcgattcgtcgtttgattc

SEQ ID NO: 7487 - DNA, 20 bp, Artificial Sequence
  Synthetic polynucleotide
atcaagatgcaactaccgaa

SEQ ID NO: 7488 - DNA, 20 bp, Artificial Sequence
  Synthetic polynucleotide
gctgctgtggtgtttatttt

SEQ ID NO: 7489 - DNA, 20 bp, Artificial Sequence
  Synthetic polynucleotide
gcagaggagaagagaatgag

SEQ ID NO: 7490 - DNA, 20 bp, Artificial Sequence
  Synthetic polynucleotide
tccagctactgactgatgta

SEQ ID NO: 7491 - DNA, 20 bp, Artificial Sequence
  Synthetic polynucleotide
gtgaaactggaaaacccaag

SEQ ID NO: 7492 - DNA, 20 bp, Artificial Sequence
  Synthetic polynucleotide
ctccgatagttggtggtaag

SEQ ID NO: 7493 - DNA, 20 bp, Artificial Sequence
  Synthetic polynucleotide
gaagatcccggagatgttac

SEQ ID NO: 7494 - DNA, 20 bp, Artificial Sequence
  Synthetic polynucleotide
atcagctccattgaatgtgt

SEQ ID NO: 7495 - DNA, 20 bp, Artificial Sequence
  Synthetic polynucleotide
ggctatttctcatgcaggta

SEQ ID NO: 7496 - DNA, 20 bp, Artificial Sequence
  Synthetic polynucleotide
agttcttctacttccttgcc

SEQ ID NO: 7497 - DNA, 20 bp, Artificial Sequence
  Synthetic polynucleotide
ctggtaactcacatgtgaca

SEQ ID NO: 7498 - DNA, 20 bp, Artificial Sequence
  Synthetic polynucleotide
tacagctactggactcatca

SEQ ID NO: 7499 - DNA, 20 bp, Artificial Sequence
  Synthetic polynucleotide
ttcaactccacaggaacaaa

SEQ ID NO: 7500 - DNA, 20 bp, Artificial Sequence
  Synthetic polynucleotide
ggtctgtgaaccccattaat

SEQ ID NO: 7501 - DNA, 20 bp, Artificial Sequence
  Synthetic polynucleotide
ataatcatgctcaacgtcga

SEQ ID NO: 7502 - DNA, 20 bp, Artificial Sequence
  Synthetic polynucleotide
ctcagtaaaccggtatcctg

SEQ ID NO: 7503 - DNA, 20 bp, Artificial Sequence
  Synthetic polynucleotide
tgtagcaattgcagcagata

SEQ ID NO: 7504 - DNA, 20 bp, Artificial Sequence
  Synthetic polynucleotide
aaaggcattgatgagagctt

SEQ ID NO: 7505 - DNA, 20 bp, Artificial Sequence
  Synthetic polynucleotide
ggatccagtaatgtggctag

SEQ ID NO: 7506 - DNA, 20 bp, Artificial Sequence
  Synthetic polynucleotide
gcatgtaggaatggaggtag

SEQ ID NO: 7507 - DNA, 20 bp, Artificial Sequence
  Synthetic polynucleotide
caatcctccaccaccaaata

SEQ ID NO: 7508 - DNA, 20 bp, Artificial Sequence
  Synthetic polynucleotide
tgaactcccaaaagtctagc

SEQ ID NO: 7509 - DNA, 20 bp, Artificial Sequence
  Synthetic polynucleotide
gaacccacattagacgagtt

SEQ ID NO: 7510 - DNA, 20 bp, Artificial Sequence
  Synthetic polynucleotide
aaagttggtgtctctcgttt

SEQ ID NO: 7511 - DNA, 20 bp, Artificial Sequence
  Synthetic polynucleotide
ggaggatgaattcagaacca

SEQ ID NO: 7512 - DNA, 20 bp, Artificial Sequence
  Synthetic polynucleotide
gagtcgtctatggtgtcttc

SEQ ID NO: 7513 - DNA, 20 bp, Artificial Sequence
  Synthetic polynucleotide
tctggtactggtaaaacagc

SEQ ID NO: 7514 - DNA, 20 bp, Artificial Sequence
  Synthetic polynucleotide
cctactctgtcctgacctaa

SEQ ID NO: 7515 - DNA, 20 bp, Artificial Sequence
  Synthetic polynucleotide
ctggtagagaacaagcttgt

SEQ ID NO: 7516 - DNA, 20 bp, Artificial Sequence
  Synthetic polynucleotide
atagccgctagtttaagagc

SEQ ID NO: 7517 - DNA, 20 bp, Artificial Sequence
  Synthetic polynucleotide
aacacagcaatgccttagta

SEQ ID NO: 7518 - DNA, 20 bp, Artificial Sequence
  Synthetic polynucleotide
gctcctgatattctgtctgg

SEQ ID NO: 7519 - DNA, 20 bp, Artificial Sequence
  Synthetic polynucleotide
atgctccgtcactatcaaaa

SEQ ID NO: 7520 - DNA, 20 bp, Artificial Sequence
  Synthetic polynucleotide
ccgtgaagtcattcttgatg

SEQ ID NO: 7521 - DNA, 20 bp, Artificial Sequence
  Synthetic polynucleotide
gaatgcaagcaattaacgga

SEQ ID NO: 7522 - DNA, 20 bp, Artificial Sequence
  Synthetic polynucleotide
ccaattgtaaccctccatga

SEQ ID NO: 7523 - DNA, 20 bp, Artificial Sequence
  Synthetic polynucleotide
tgatcttcgctggtaaacaa

SEQ ID NO: 7524 - DNA, 20 bp, Artificial Sequence
  Synthetic polynucleotide
aagatctgcatacctcctct

SEQ ID NO: 7525 - DNA, 20 bp, Artificial Sequence
  Synthetic polynucleotide
ggatttgaaatgcaacccaa

SEQ ID NO: 7526 - DNA, 20 bp, Artificial Sequence
  Synthetic polynucleotide
tatcgcataattgtctgggg

SEQ ID NO: 7527 - DNA, 20 bp, Artificial Sequence
  Synthetic polynucleotide
tgggtctcactagaacgtat

SEQ ID NO: 7528 - DNA, 20 bp, Artificial Sequence
  Synthetic polynucleotide
ccagaaactccgatcagtag

SEQ ID NO: 7529 - DNA, 20 bp, Artificial Sequence
  Synthetic polynucleotide
atagaaacgtgccaagaact

SEQ ID NO: 7530 - DNA, 20 bp, Artificial Sequence
  Synthetic polynucleotide
gatctcctgctaagtgactg

SEQ ID NO: 7531 - DNA, 20 bp, Artificial Sequence
  Synthetic polynucleotide
ggtaaaacagcaattgcact

SEQ ID NO: 7532 - DNA, 20 bp, Artificial Sequence
  Synthetic polynucleotide
tacaccaggaaccaattctg

SEQ ID NO: 7533 - DNA, 20 bp, Artificial Sequence
  Synthetic polynucleotide
ttaaatggttgtgagctcga

SEQ ID NO: 7534 - DNA, 20 bp, Artificial Sequence
  Synthetic polynucleotide
tgtcatgtctacctttggtg

SEQ ID NO: 7535 - DNA, 20 bp, Artificial Sequence
  Synthetic polynucleotide
aacagccctttatacccaag

SEQ ID NO: 7536 - DNA, 20 bp, Artificial Sequence
  Synthetic polynucleotide
gttgaatagatggtggtggt

SEQ ID NO: 7537 - DNA, 20 bp, Artificial Sequence
  Synthetic polynucleotide
ttaatcgcatgggcaaaatc

SEQ ID NO: 7538 - DNA, 20 bp, Artificial Sequence
  Synthetic polynucleotide
tccgcgtctctatttgttag

SEQ ID NO: 7539 - DNA, 20 bp, Artificial Sequence
  Synthetic polynucleotide
cgacaatcataattcgccag

SEQ ID NO: 7540 - DNA, 20 bp, Artificial Sequence
  Synthetic polynucleotide
tcgaccacaaagcagaaata

SEQ ID NO: 7541 - DNA, 20 bp, Artificial Sequence
  Synthetic polynucleotide
atgcaacgtcaaattaaccc

SEQ ID NO: 7542 - DNA, 20 bp, Artificial Sequence
  Synthetic polynucleotide
tctctttcagcagcagaaat

SEQ ID NO: 7543 - DNA, 20 bp, Artificial Sequence
  Synthetic polynucleotide
gctactcagtggctatgttt

SEQ ID NO: 7544 - DNA, 20 bp, Artificial Sequence
  Synthetic polynucleotide
ctgacataagttggtttggc

SEQ ID NO: 7545 - DNA, 20 bp, Artificial Sequence
  Synthetic polynucleotide
accacaggtgttgtagtttt

SEQ ID NO: 7546 - DNA, 20 bp, Artificial Sequence
  Synthetic polynucleotide
ctcttcaaaacggggaacta

SEQ ID NO: 7547 - DNA, 22 bp, Artificial Sequence
  Synthetic polynucleotide
aggagaaaagaaacgttttgaa

SEQ ID NO: 7548 - DNA, 20 bp, Artificial Sequence
  Synthetic polynucleotide
tggaagtgaaaggcatgatt

SEQ ID NO: 7549 - DNA, 20 bp, Artificial Sequence
  Synthetic polynucleotide
gatagccaacactcctatgg

SEQ ID NO: 7550 - DNA, 20 bp, Artificial Sequence
  Synthetic polynucleotide
gattctgtgattcccaaggt

SEQ ID NO: 7551 - DNA, 20 bp, Artificial Sequence
  Synthetic polynucleotide
gcatcaggtagaatatgcca

SEQ ID NO: 7552 - DNA, 20 bp, Artificial Sequence
  Synthetic polynucleotide
catctctcaatggatctgca

SEQ ID NO: 7553 - DNA, 20 bp, Artificial Sequence
  Synthetic polynucleotide
tcaaagtagacgatttggca

SEQ ID NO: 7554 - DNA, 20 bp, Artificial Sequence
  Synthetic polynucleotide
tagccttttcgtagatctgc

SEQ ID NO: 7555 - DNA, 20 bp, Artificial Sequence
  Synthetic polynucleotide
ccttattgtgggagctcttt

SEQ ID NO: 7556 - DNA, 20 bp, Artificial Sequence
  Synthetic polynucleotide
ggcaagtttgatagtgttgg

SEQ ID NO: 7557 - DNA, 20 bp, Artificial Sequence
  Synthetic polynucleotide
agcacccaaactacgttatt

SEQ ID NO: 7558 - DNA, 20 bp, Artificial Sequence
  Synthetic polynucleotide
agcgataagaccgactttac

SEQ ID NO: 7559 - DNA, 20 bp, Artificial Sequence
  Synthetic polynucleotide
aaacagttggcaactaaagc

SEQ ID NO: 7560 - DNA, 20 bp, Artificial Sequence
  Synthetic polynucleotide
tcttagcatgaatagcgcat

SEQ ID NO: 7561 - DNA, 20 bp, Artificial Sequence
  Synthetic polynucleotide
cgttggaagtactggagaaa

SEQ ID NO: 7562 - DNA, 20 bp, Artificial Sequence
  Synthetic polynucleotide
gttcatatacatgtccggct

SEQ ID NO: 7563 - DNA, 20 bp, Artificial Sequence
  Synthetic polynucleotide
agcccaagaagtaatgaagg

SEQ ID NO: 7564 - DNA, 20 bp, Artificial Sequence
  Synthetic polynucleotide
tatgttcgatagcattgggg

SEQ ID NO: 7565 - DNA, 20 bp, Artificial Sequence
  Synthetic polynucleotide
aggtacagaaaaagggtgtc

SEQ ID NO: 7566 - DNA, 21 bp, Artificial Sequence
  Synthetic polynucleotide
aaatttcttgcaaactggtct

SEQ ID NO: 7567 - DNA, 20 bp, Artificial Sequence
  Synthetic polynucleotide
gttgctgaattgaccaacaa

SEQ ID NO: 7568 - DNA, 20 bp, Artificial Sequence
  Synthetic polynucleotide
ttctgcatcttcagctgaat

SEQ ID NO: 7569 - DNA, 20 bp, Artificial Sequence
  Synthetic polynucleotide
gagtactcaaacatcgacga

SEQ ID NO: 7570 - DNA, 20 bp, Artificial Sequence
  Synthetic polynucleotide
gttggttcggctaaaagatg

SEQ ID NO: 7571 - DNA, 20 bp, Artificial Sequence
  Synthetic polynucleotide
tctccgtaagaagaggaagt

SEQ ID NO: 7572 - DNA, 20 bp, Artificial Sequence
  Synthetic polynucleotide
atcagctctaccacattgtc

SEQ ID NO: 7573 - DNA, 20 bp, Artificial Sequence
  Synthetic polynucleotide
ggatactgccgaacaagtat

SEQ ID NO: 7574 - DNA, 20 bp, Artificial Sequence
  Synthetic polynucleotide
agctgttctggagtcatttt

SEQ ID NO: 7575 - DNA, 20 bp, Artificial Sequence
  Synthetic polynucleotide
gcaagctcagagaaatgaac

SEQ ID NO: 7576 - DNA, 20 bp, Artificial Sequence
  Synthetic polynucleotide
agtaaagcgggatccaaaat

SEQ ID NO: 7577 - DNA, 20 bp, Artificial Sequence
  Synthetic polynucleotide
ccttcgaacttcaaagcttc

SEQ ID NO: 7578 - DNA, 20 bp, Artificial Sequence
  Synthetic polynucleotide
atgcttaaaccttccgactt

SEQ ID NO: 7579 - DNA, 20 bp, Artificial Sequence
  Synthetic polynucleotide
aggatctaccgctattggaa

SEQ ID NO: 7580 - DNA, 24 bp, Artificial Sequence
  Synthetic polynucleotide
ggaacatatcttttggagtcatag

SEQ ID NO: 7581 - DNA, 20 bp, Artificial Sequence
  Synthetic polynucleotide
aatgacggagctaccatttt

SEQ ID NO: 7582 - DNA, 20 bp, Artificial Sequence
  Synthetic polynucleotide
aggcaaagatcatcgatacc

SEQ ID NO: 7583 - DNA, 20 bp, Artificial Sequence
  Synthetic polynucleotide
ttttacaattttcccggcaa

SEQ ID NO: 7584 - DNA, 20 bp, Artificial Sequence
  Synthetic polynucleotide
aggaaaacttctggcatctc

SEQ ID NO: 7585 - DNA, 20 bp, Artificial Sequence
  Synthetic polynucleotide
atccctttcggaagagacta

SEQ ID NO: 7586 - DNA, 20 bp, Artificial Sequence
  Synthetic polynucleotide
cacatcaagttcctctggaa

SEQ ID NO: 7587 - DNA, 20 bp, Artificial Sequence
  Synthetic polynucleotide
agatcgagagacaggagaaa

SEQ ID NO: 7588 - DNA, 20 bp, Artificial Sequence
  Synthetic polynucleotide
catccttgggtaacaatcca

SEQ ID NO: 7589 - DNA, 20 bp, Artificial Sequence
  Synthetic polynucleotide
ttctcttttggtagctggac

SEQ ID NO: 7590 - DNA, 20 bp, Artificial Sequence
  Synthetic polynucleotide
taccaaccgcaacaaatcta

SEQ ID NO: 7591 - DNA, 20 bp, Artificial Sequence
  Synthetic polynucleotide
tcgaagtacaactctgcaaa

SEQ ID NO: 7592 - DNA, 20 bp, Artificial Sequence
  Synthetic polynucleotide
aacgttcctaaatgtgctct

SEQ ID NO: 7593 - DNA, 20 bp, Artificial Sequence
  Synthetic polynucleotide
tggcagaaaaatatgaggct

SEQ ID NO: 7594 - DNA, 20 bp, Artificial Sequence
  Synthetic polynucleotide
ccttcaagctttagtgacct

SEQ ID NO: 7595 - DNA, 20 bp, Artificial Sequence
  Synthetic polynucleotide
aagaagaagctcttaacgca

SEQ ID NO: 7596 - DNA, 20 bp, Artificial Sequence
  Synthetic polynucleotide
ggtaactgccagtgagttta

SEQ ID NO: 7597 - DNA, 20 bp, Artificial Sequence
  Synthetic polynucleotide
agttcccagtctatgtgaag

SEQ ID NO: 7598 - DNA, 19 bp, Artificial Sequence
  Synthetic polynucleotide
gttgaactgatcgcagact

SEQ ID NO: 7599 - DNA, 20 bp, Artificial Sequence
  Synthetic polynucleotide
tgccaaatcagaaacgagta

SEQ ID NO: 7600 - DNA, 20 bp, Artificial Sequence
  Synthetic polynucleotide
tcagaatcgaactgcatagg

SEQ ID NO: 7601 - DNA, 20 bp, Artificial Sequence
  Synthetic polynucleotide
atgagcaaaggacatgtcat

SEQ ID NO: 7602 - DNA, 20 bp, Artificial Sequence
  Synthetic polynucleotide
ctggatctaatcacgacgtt

SEQ ID NO: 7603 - DNA, 20 bp, Artificial Sequence
  Synthetic polynucleotide
ggcgttccataacatatcct

SEQ ID NO: 7604 - DNA, 20 bp, Artificial Sequence
  Synthetic polynucleotide
tggggataatgtggagtttg

SEQ ID NO: 7605 - DNA, 20 bp, Artificial Sequence
  Synthetic polynucleotide
ggtggccatttcatttttga

SEQ ID NO: 7606 - DNA, 20 bp, Artificial Sequence
  Synthetic polynucleotide
tccgtaaaaagtaaatgcgc

SEQ ID NO: 7607 - DNA, 20 bp, Artificial Sequence
  Synthetic polynucleotide
cacgaacttactttccaagc

SEQ ID NO: 7608 - DNA, 20 bp, Artificial Sequence
  Synthetic polynucleotide
tttctgatccagtttgtcgt

SEQ ID NO: 7609 - DNA, 20 bp, Artificial Sequence
  Synthetic polynucleotide
taacccagaacaagtgatgg

SEQ ID NO: 7610 - DNA, 20 bp, Artificial Sequence
  Synthetic polynucleotide
aaaatatagcgctggaggag

SEQ ID NO: 7611 - DNA, 20 bp, Artificial Sequence
  Synthetic polynucleotide
tcttggtcggaaactaacag

SEQ ID NO: 7612 - DNA, 20 bp, Artificial Sequence
  Synthetic polynucleotide
ataggattgaacatcggtgg

SEQ ID NO: 7613 - DNA, 20 bp, Artificial Sequence
  Synthetic polynucleotide
aacaattaccggcgaagtat

SEQ ID NO: 7614 - DNA, 18 bp, Artificial Sequence
  Synthetic polynucleotide
gttgttgttgccccctac

SEQ ID NO: 7615 - DNA, 20 bp, Artificial Sequence
  Synthetic polynucleotide
tcaacaagttggtgcaaatc

SEQ ID NO: 7616 - DNA, 20 bp, Artificial Sequence
  Synthetic polynucleotide
taacagctgattgaactgct

SEQ ID NO: 7617 - DNA, 20 bp, Artificial Sequence
  Synthetic polynucleotide
agcctacaagatgaggagag

SEQ ID NO: 7618 - DNA, 23 bp, Artificial Sequence
  Synthetic polynucleotide
cacaaataaatacaggatgaggt

SEQ ID NO: 7619 - DNA, 20 bp, Artificial Sequence
  Synthetic polynucleotide
gttccaaggctgtagtacaa

SEQ ID NO: 7620 - DNA, 20 bp, Artificial Sequence
  Synthetic polynucleotide
gtcaagatggggatttgagt

SEQ ID NO: 7621 - DNA, 20 bp, Artificial Sequence
  Synthetic polynucleotide
acttacgatccagaagagga

SEQ ID NO: 7622 - DNA, 20 bp, Artificial Sequence
  Synthetic polynucleotide
gacccaacaaacgttcaaat

SEQ ID NO: 7623 - DNA, 20 bp, Artificial Sequence
  Synthetic polynucleotide
ttatcacaccacagacaagg

SEQ ID NO: 7624 - DNA, 20 bp, Artificial Sequence
  Synthetic polynucleotide
gccatttctgattccacatg

SEQ ID NO: 7625 - DNA, 20 bp, Artificial Sequence
  Synthetic polynucleotide
aaaaacgaaggccctatctt

SEQ ID NO: 7626 - DNA, 20 bp, Artificial Sequence
  Synthetic polynucleotide
gcctgttcgatatcttgttg

SEQ ID NO: 7627 - DNA, 20 bp, Artificial Sequence
  Synthetic polynucleotide
acatgactggtgaattcgaa

SEQ ID NO: 7628 - DNA, 20 bp, Artificial Sequence
  Synthetic polynucleotide
tccttttcgatttgttgctg

SEQ ID NO: 7629 - DNA, 20 bp, Artificial Sequence
  Synthetic polynucleotide
aacgatccaagttagtgctt

SEQ ID NO: 7630 - DNA, 20 bp, Artificial Sequence
  Synthetic polynucleotide
aatcacgttggatgacttga

SEQ ID NO: 7631 - DNA, 20 bp, Artificial Sequence
  Synthetic polynucleotide
aaatggtatgtggctcatcc

SEQ ID NO: 7632 - DNA, 20 bp, Artificial Sequence
  Synthetic polynucleotide
acttgtctcctgaacttcac

SEQ ID NO: 7633 - DNA, 20 bp, Artificial Sequence
  Synthetic polynucleotide
gatgaagctagcaagtcaga

SEQ ID NO: 7634 - DNA, 20 bp, Artificial Sequence
  Synthetic polynucleotide
ccatcactttgcctaagact

SEQ ID NO: 7635 - DNA, 20 bp, Artificial Sequence
  Synthetic polynucleotide
acctggcttaaatactgtgg

SEQ ID NO: 7636 - DNA, 20 bp, Artificial Sequence
  Synthetic polynucleotide
atctgcagcactatctcttg

SEQ ID NO: 7637 - DNA, 20 bp, Artificial Sequence
  Synthetic polynucleotide
tgcagacaagaatcttcgaa

SEQ ID NO: 7638 - DNA, 20 bp, Artificial Sequence
  Synthetic polynucleotide
ttcctagcagttgtttcctc

SEQ ID NO: 7639 - DNA, 20 bp, Artificial Sequence
  Synthetic polynucleotide
agatcgttccattgacaaca

SEQ ID NO: 7640 - DNA, 20 bp, Artificial Sequence
  Synthetic polynucleotide
gcttctaccttcttccaaca

SEQ ID NO: 7641 - DNA, 20 bp, Artificial Sequence
  Synthetic polynucleotide
tcctactggtcaacctctag

SEQ ID NO: 7642 - DNA, 20 bp, Artificial Sequence
  Synthetic polynucleotide
taccatactggctctagctt

SEQ ID NO: 7643 - DNA, 20 bp, Artificial Sequence
  Synthetic polynucleotide
gaagttggagctacctcttc

SEQ ID NO: 7644 - DNA, 20 bp, Artificial Sequence
  Synthetic polynucleotide
tgattgggctgttcctaaaa

SEQ ID NO: 7645 - DNA, 20 bp, Artificial Sequence
  Synthetic polynucleotide
gagtagacccaaacctcttg

SEQ ID NO: 7646 - DNA, 20 bp, Artificial Sequence
  Synthetic polynucleotide
attaggcccgatttgacaat

SEQ ID NO: 7647 - DNA, 20 bp, Artificial Sequence
  Synthetic polynucleotide
acctcttaaaagaaggtgcc

SEQ ID NO: 7648 - DNA, 20 bp, Artificial Sequence
  Synthetic polynucleotide
atccatttttgtcctggtga

SEQ ID NO: 7649 - DNA, 20 bp, Artificial Sequence
  Synthetic polynucleotide
aacaaccaagcacttcattg

SEQ ID NO: 7650 - DNA, 20 bp, Artificial Sequence
  Synthetic polynucleotide
cgaccaaggcaaaaatactc

SEQ ID NO: 7651 - DNA, 20 bp, Artificial Sequence
  Synthetic polynucleotide
gcggctttagttccttttta

SEQ ID NO: 7652 - DNA, 20 bp, Artificial Sequence
  Synthetic polynucleotide
gcctctttcttttcttcagc

SEQ ID NO: 7653 - DNA, 20 bp, Artificial Sequence
  Synthetic polynucleotide
aagggaaaggatagttgcag

SEQ ID NO: 7654 - DNA, 20 bp, Artificial Sequence
  Synthetic polynucleotide
agctgttactacattgcaca

SEQ ID NO: 7655 - DNA, 20 bp, Artificial Sequence
  Synthetic polynucleotide
aactacaaaggccactacag

SEQ ID NO: 7656 - DNA, 20 bp, Artificial Sequence
  Synthetic polynucleotide
acaggtatccccaacaattc

SEQ ID NO: 7657 - DNA, 20 bp, Artificial Sequence
  Synthetic polynucleotide
cttaggactggataacgcag

SEQ ID NO: 7658 - DNA, 20 bp, Artificial Sequence
  Synthetic polynucleotide
atagttctagaggcctaccg

SEQ ID NO: 7659 - DNA, 20 bp, Artificial Sequence
  Synthetic polynucleotide
tgccgacaaaaatcaaacaa

SEQ ID NO: 7660 - DNA, 23 bp, Artificial Sequence
  Synthetic polynucleotide
tgagagaacaataccttaatcga

SEQ ID NO: 7661 - DNA, 20 bp, Artificial Sequence
  Synthetic polynucleotide
agtggcaactttatatggca

SEQ ID NO: 7662 - DNA, 20 bp, Artificial Sequence
  Synthetic polynucleotide
gattcggttgagtattccga

SEQ ID NO: 7663 - DNA, 20 bp, Artificial Sequence
  Synthetic polynucleotide
agattccagcctcagactat

SEQ ID NO: 7664 - DNA, 20 bp, Artificial Sequence
  Synthetic polynucleotide
caacctccatttcctcatca

SEQ ID NO: 7665 - DNA, 20 bp, Artificial Sequence
  Synthetic polynucleotide
aaagctaagaacgctgagaa

SEQ ID NO: 7666 - DNA, 20 bp, Artificial Sequence
  Synthetic polynucleotide
agtaactccaaaggcttctg

SEQ ID NO: 7667 - DNA, 20 bp, Artificial Sequence
  Synthetic polynucleotide
cagcagaggaataaagggtt

SEQ ID NO: 7668 - DNA, 20 bp, Artificial Sequence
  Synthetic polynucleotide
acatccttcttggtccattc

SEQ ID NO: 7669 - DNA, 20 bp, Artificial Sequence
  Synthetic polynucleotide
tgtcaaggaggttttgtcaa

SEQ ID NO: 7670 - DNA, 20 bp, Artificial Sequence
  Synthetic polynucleotide
catgggatcatcatcgaagt

SEQ ID NO: 7671 - DNA, 20 bp, Artificial Sequence
  Synthetic polynucleotide
ccatacttcagaaccaccaa

SEQ ID NO: 7672 - DNA, 20 bp, Artificial Sequence
  Synthetic polynucleotide
cggcatctgttaaagtttcc

SEQ ID NO: 7673 - DNA, 20 bp, Artificial Sequence
  Synthetic polynucleotide
atcagttcccaaagtggatc

SEQ ID NO: 7674 - DNA, 20 bp, Artificial Sequence
  Synthetic polynucleotide
atcttcttcgctaagagcag

SEQ ID NO: 7675 - DNA, 20 bp, Artificial Sequence
  Synthetic polynucleotide
agaagccatacgttcagttt

SEQ ID NO: 7676 - DNA, 20 bp, Artificial Sequence
  Synthetic polynucleotide
ataacggaatctttggcctt

SEQ ID NO: 7677 - DNA, 20 bp, Artificial Sequence
  Synthetic polynucleotide
gagaagctacaaatggttgc

SEQ ID NO: 7678 - DNA, 20 bp, Artificial Sequence
  Synthetic polynucleotide
ttttctatcgacggctacag

SEQ ID NO: 7679 - DNA, 20 bp, Artificial Sequence
  Synthetic polynucleotide
cttgaacccatttcagttcg

SEQ ID NO: 7680 - DNA, 19 bp, Artificial Sequence
  Synthetic polynucleotide
tacttcgacaggagcagag

SEQ ID NO: 7681 - DNA, 20 bp, Artificial Sequence
  Synthetic polynucleotide
ctcttcatcaacctgaggag

SEQ ID NO: 7682 - DNA, 20 bp, Artificial Sequence
  Synthetic polynucleotide
cccttcgagtcttataggga

SEQ ID NO: 7683 - DNA, 20 bp, Artificial Sequence
  Synthetic polynucleotide
atgaacttcacatttgcagc

SEQ ID NO: 7684 - DNA, 20 bp, Artificial Sequence
  Synthetic polynucleotide
ctttcgcctcatctgtactt

SEQ ID NO: 7685 - DNA, 20 bp, Artificial Sequence
  Synthetic polynucleotide
caaggaaggagaatgggaaa

SEQ ID NO: 7686 - DNA, 20 bp, Artificial Sequence
  Synthetic polynucleotide
atcgctaagtttggatggtt

SEQ ID NO: 7687 - DNA, 20 bp, Artificial Sequence
  Synthetic polynucleotide
gataaaaagcatagcgaccg

SEQ ID NO: 7688 - DNA, 20 bp, Artificial Sequence
  Synthetic polynucleotide
gagcttttattttgcctgct

SEQ ID NO: 7689 - DNA, 20 bp, Artificial Sequence
  Synthetic polynucleotide
atcttcgactagtggaagga

SEQ ID NO: 7690 - DNA, 20 bp, Artificial Sequence
  Synthetic polynucleotide
actcttgcttctttctctgg

SEQ ID NO: 7691 - DNA, 20 bp, Artificial Sequence
  Synthetic polynucleotide
gccaagccagaaagaaaaat

SEQ ID NO: 7692 - DNA, 20 bp, Artificial Sequence
  Synthetic polynucleotide
tagctggaatattgtccacg

SEQ ID NO: 7693 - DNA, 21 bp, Artificial Sequence
  Synthetic polynucleotide
acatttcaagggtactagagc

SEQ ID NO: 7694 - DNA, 20 bp, Artificial Sequence
  Synthetic polynucleotide
gtacctgtcctcctgttttt

SEQ ID NO: 7695 - DNA, 20 bp, Artificial Sequence
  Synthetic polynucleotide
cgtggaagaaaagcactttt

SEQ ID NO: 7696 - DNA, 20 bp, Artificial Sequence
  Synthetic polynucleotide
cattttaggaacacagcgac

SEQ ID NO: 7697 - DNA, 20 bp, Artificial Sequence
  Synthetic polynucleotide
agagaaacatactctcggga

SEQ ID NO: 7698 - DNA, 20 bp, Artificial Sequence
  Synthetic polynucleotide
agtttctgtgtcccaaagtt

SEQ ID NO: 7699 - DNA, 20 bp, Artificial Sequence
  Synthetic polynucleotide
ccactttttgaaaagaggcc

SEQ ID NO: 7700 - DNA, 20 bp, Artificial Sequence
  Synthetic polynucleotide
caatacgagcagcagatttg

SEQ ID NO: 7701 - DNA, 20 bp, Artificial Sequence
  Synthetic polynucleotide
gatccagaaagtggtggaat

SEQ ID NO: 7702 - DNA, 20 bp, Artificial Sequence
  Synthetic polynucleotide
gacaatgctgctaaaccaaa

SEQ ID NO: 7703 - DNA, 20 bp, Artificial Sequence
  Synthetic polynucleotide
ggaaccttatatggctcctg

SEQ ID NO: 7704 - DNA, 20 bp, Artificial Sequence
  Synthetic polynucleotide
gtatctggagtaccggtttc

SEQ ID NO: 7705 - DNA, 20 bp, Artificial Sequence
  Synthetic polynucleotide
atttgacttggtttgtgcag

SEQ ID NO: 7706 - DNA, 20 bp, Artificial Sequence
  Synthetic polynucleotide
gtgttaggaataccaaggca

SEQ ID NO: 7707 - DNA, 20 bp, Artificial Sequence
  Synthetic polynucleotide
ttggaactttcaaagcgttc

SEQ ID NO: 7708 - DNA, 19 bp, Artificial Sequence
  Synthetic polynucleotide
gtcctctcattcccattgg

SEQ ID NO: 7709 - DNA, 20 bp, Artificial Sequence
  Synthetic polynucleotide
aagtcacaaggggcttttaa

SEQ ID NO: 7710 - DNA, 20 bp, Artificial Sequence
  Synthetic polynucleotide
cgcttatctcgaggaagaaa

SEQ ID NO: 7711 - DNA, 20 bp, Artificial Sequence
  Synthetic polynucleotide
tacatgcagtttgccctaat

SEQ ID NO: 7712 - DNA, 20 bp, Artificial Sequence
  Synthetic polynucleotide
ccttttcgttcttagggaca

SEQ ID NO: 7713 - DNA, 20 bp, Artificial Sequence
  Synthetic polynucleotide
tgaaagtcattccagtggag

SEQ ID NO: 7714 - DNA, 20 bp, Artificial Sequence
  Synthetic polynucleotide
tgtacgaatactcccactct

SEQ ID NO: 7715 - DNA, 20 bp, Artificial Sequence
  Synthetic polynucleotide
tatgaagcaaccgaggaaaa

SEQ ID NO: 7716 - DNA, 20 bp, Artificial Sequence
  Synthetic polynucleotide
ggccttaatctcagatctgg

SEQ ID NO: 7717 - DNA, 20 bp, Artificial Sequence
  Synthetic polynucleotide
cgagagcagctaaaagatct

SEQ ID NO: 7718 - DNA, 20 bp, Artificial Sequence
  Synthetic polynucleotide
caggatctagagtatcgggt

SEQ ID NO: 7719 - DNA, 20 bp, Artificial Sequence
  Synthetic polynucleotide
ggctatttctcatgcaggta

SEQ ID NO: 7720 - DNA, 20 bp, Artificial Sequence
  Synthetic polynucleotide
tctacagcagcttcactttt

SEQ ID NO: 7721 - DNA, 20 bp, Artificial Sequence
  Synthetic polynucleotide
cgaagaagacaaacagcttc

SEQ ID NO: 7722 - DNA, 20 bp, Artificial Sequence
  Synthetic polynucleotide
actgcatagctaatctcagc

SEQ ID NO: 7723 - DNA, 20 bp, Artificial Sequence
  Synthetic polynucleotide
ggaggtccttacgtgaatac

SEQ ID NO: 7724 - DNA, 20 bp, Artificial Sequence
  Synthetic polynucleotide
cttgctgtgaggtagaagtt

SEQ ID NO: 7725 - DNA, 20 bp, Artificial Sequence
  Synthetic polynucleotide
ccatttgcagatgtggattc

SEQ ID NO: 7726 - DNA, 20 bp, Artificial Sequence
  Synthetic polynucleotide
ctcagtaaaccggtatcctg

SEQ ID NO: 7727 - DNA, 20 bp, Artificial Sequence
  Synthetic polynucleotide
gcagataggcgatttggtat

SEQ ID NO: 7728 - DNA, 20 bp, Artificial Sequence
  Synthetic polynucleotide
tgtatactgtagctccccaa

SEQ ID NO: 7729 - DNA, 20 bp, Artificial Sequence
  Synthetic polynucleotide
caaaacatctgtgctagctg

SEQ ID NO: 7730 - DNA, 20 bp, Artificial Sequence
  Synthetic polynucleotide
cactgtaagatgtggaccaa

SEQ ID NO: 7731 - DNA, 20 bp, Artificial Sequence
  Synthetic polynucleotide
caatcctccaccaccaaata

SEQ ID NO: 7732 - DNA, 20 bp, Artificial Sequence
  Synthetic polynucleotide
tgaactcccaaaagtctagc

SEQ ID NO: 7733 - DNA, 21 bp, Artificial Sequence
  Synthetic polynucleotide
agaacccacattagatgagtt

SEQ ID NO: 7734 - DNA, 20 bp, Artificial Sequence
  Synthetic polynucleotide
aggtacacgacaaatacagt

SEQ ID NO: 7735 - DNA, 20 bp, Artificial Sequence
  Synthetic polynucleotide
ggaggatgaattcagaacca

SEQ ID NO: 7736 - DNA, 20 bp, Artificial Sequence
  Synthetic polynucleotide
gagtcgtctatggtgtcttc

SEQ ID NO: 7737 - DNA, 20 bp, Artificial Sequence
  Synthetic polynucleotide
tctggtactggtaaaacagc

SEQ ID NO: 7738 - DNA, 20 bp, Artificial Sequence
  Synthetic polynucleotide
tctgtcccgatctaaactct

SEQ ID NO: 7739 - DNA, 20 bp, Artificial Sequence
  Synthetic polynucleotide
ggtagggaacaagcttgtaa

SEQ ID NO: 7740 - DNA, 20 bp, Artificial Sequence
  Synthetic polynucleotide
tgcccttgtacaaatagcat

SEQ ID NO: 7741 - DNA, 20 bp, Artificial Sequence
  Synthetic polynucleotide
aacacagcaatgccttagta

SEQ ID NO: 7742 - DNA, 20 bp, Artificial Sequence
  Synthetic polynucleotide
agctacatagtcctccaagt

SEQ ID NO: 7743 - DNA, 20 bp, Artificial Sequence
  Synthetic polynucleotide
gacttgggaatggatgaaga

SEQ ID NO: 7744 - DNA, 21 bp, Artificial Sequence
  Synthetic polynucleotide
acgctgtaaagtcattcttga

SEQ ID NO: 7745 - DNA, 20 bp, Artificial Sequence
  Synthetic polynucleotide
gattgcaagcaattaaccga

SEQ ID NO: 7746 - DNA, 20 bp, Artificial Sequence
  Synthetic polynucleotide
ccaattgtaaccctccatga

SEQ ID NO: 7747 - DNA, 20 bp, Artificial Sequence
  Synthetic polynucleotide
ttgcaattcaagcagacaat

SEQ ID NO: 7748 - DNA, 20 bp, Artificial Sequence
  Synthetic polynucleotide
cggccatcttctaactcatt

SEQ ID NO: 7749 - DNA, 20 bp, Artificial Sequence
  Synthetic polynucleotide
ggatttgaaatgcaacccaa

SEQ ID NO: 7750 - DNA, 20 bp, Artificial Sequence
  Synthetic polynucleotide
tatcgcataattgtctgggg

SEQ ID NO: 7751 - DNA, 20 bp, Artificial Sequence
  Synthetic polynucleotide
tgggtctcactagaacgtat

SEQ ID NO: 7752 - DNA, 20 bp, Artificial Sequence
  Synthetic polynucleotide
aacatcaagctcttcttcgt
